United States Patent 7,618,814 (MICRORNA-RELATED NUCLEIC ACIDS AND USES THEREOF) - sequence listing, part 7

SEQ ID NO: 237775 - RNA, 32 nt, Human
ucggcucacugcaaccuccaccucccggguuc

SEQ ID NO: 237776 - RNA, 32 nt, Human
ucggcucacugcaaccuccaccuccuagguuc

SEQ ID NO: 237777 - RNA, 32 nt, Human
ucggcucacugcaaccuccaccuccuggauuc

SEQ ID NO: 237778 - RNA, 32 nt, Human
ucggcucacugcaaccuccaccuccuggcuuc

SEQ ID NO: 237779 - RNA, 32 nt, Human
ucggcucacugcaaccuccaccuccugggcuc

SEQ ID NO: 237780 - RNA, 32 nt, Human
ucggcucacugcaaccuccaccuccuggguuc

SEQ ID NO: 237781 - RNA, 32 nt, Human
ucggcucacugcaaccuccaccuccuggguuu

SEQ ID NO: 237782 - RNA, 32 nt, Human
ucggcucacugcaaccuccaccuccugguuca

SEQ ID NO: 237783 - RNA, 32 nt, Human
ucggcucacugcaaccuccaccucucggcuuc

SEQ ID NO: 237784 - RNA, 32 nt, Human
ucggcucacugcaaccuccaccuucagggugu

SEQ ID NO: 237785 - RNA, 32 nt, Human
ucggcucacugcaaccuccacuucuuggguuc

SEQ ID NO: 237786 - RNA, 32 nt, Human
ucggcucacugcaaccuccagcucccagguug

SEQ ID NO: 237787 - RNA, 32 nt, Human
ucggcucacugcaaccucccugccugauucuc

SEQ ID NO: 237788 - RNA, 32 nt, Human
ucggcucacugcaaccuccgcaucccggguuc

SEQ ID NO: 237789 - RNA, 32 nt, Human
ucggcucacugcaaccuccgcccccuggguuu

SEQ ID NO: 237790 - RNA, 32 nt, Human
ucggcucacugcaaccuccgccuaccggguuc

SEQ ID NO: 237791 - RNA, 32 nt, Human
ucggcucacugcaaccuccgccucccaaguuc

SEQ ID NO: 237792 - RNA, 32 nt, Human
ucggcucacugcaaccuccgccucccagguuc

SEQ ID NO: 237793 - RNA, 32 nt, Human
ucggcucacugcaaccuccgccucccagguug

SEQ ID NO: 237794 - RNA, 32 nt, Human
ucggcucacugcaaccuccgccucccagguuu

SEQ ID NO: 237795 - RNA, 32 nt, Human
ucggcucacugcaaccuccgccucccaguuuc

SEQ ID NO: 237796 - RNA, 32 nt, Human
ucggcucacugcaaccuccgccucccggcuuc

SEQ ID NO: 237797 - RNA, 32 nt, Human
ucggcucacugcaaccuccgccucccgggcug

SEQ ID NO: 237798 - RNA, 32 nt, Human
ucggcucacugcaaccuccgccucccggguua

SEQ ID NO: 237799 - RNA, 32 nt, Human
ucggcucacugcaaccuccgccucccggguuc

SEQ ID NO: 237800 - RNA, 32 nt, Human
ucggcucacugcaaccuccgccucccgguuca

SEQ ID NO: 237801 - RNA, 32 nt, Human
ucggcucacugcaaccuccgccuccugaguuc

SEQ ID NO: 237802 - RNA, 32 nt, Human
ucggcucacugcaaccuccgccuccugggcuc

SEQ ID NO: 237803 - RNA, 32 nt, Human
ucggcucacugcaaccuccgccuccuggguuc

SEQ ID NO: 237804 - RNA, 32 nt, Human
ucggcucacugcaaccuccgccuccuugguuc

SEQ ID NO: 237805 - RNA, 32 nt, Human
ucggcucacugcaaccuccgccuuccugaguu

SEQ ID NO: 237806 - RNA, 32 nt, Human
ucggcucacugcaaccuccgccuugcugguug

SEQ ID NO: 237807 - RNA, 32 nt, Human
ucggcucacugcaaccuccgccuuuccaccuu

SEQ ID NO: 237808 - RNA, 32 nt, Human
ucggcucacugcaaccuccgcucccuggguuc

SEQ ID NO: 237809 - RNA, 32 nt, Human
ucggcucacugcaaccuccgucucccagguuc

SEQ ID NO: 237810 - RNA, 32 nt, Human
ucggcucacugcaaccuccuccucccagaggu

SEQ ID NO: 237811 - RNA, 32 nt, Human
ucggcucacugcaaccuccuccucccggguuc

SEQ ID NO: 237812 - RNA, 32 nt, Human
ucggcucacugcaaccucuaccucccagguuc

SEQ ID NO: 237813 - RNA, 32 nt, Human
ucggcucacugcaaccucuaccuccuggauuc

SEQ ID NO: 237814 - RNA, 32 nt, Human
ucggcucacugcaaccucuaccuccuggguuc

SEQ ID NO: 237815 - RNA, 32 nt, Human
ucggcucacugcaaccucugccaucaggauua

SEQ ID NO: 237816 - RNA, 32 nt, Human
ucggcucacugcaaccucugccucccaaguuc

SEQ ID NO: 237817 - RNA, 32 nt, Human
ucggcucacugcaaccucugccucccagguuc

SEQ ID NO: 237818 - RNA, 32 nt, Human
ucggcucacugcaaccucugccucccgaguuc

SEQ ID NO: 237819 - RNA, 32 nt, Human
ucggcucacugcaaccucugccucccgcauuc

SEQ ID NO: 237820 - RNA, 32 nt, Human
ucggcucacugcaaccucugccucccggauuc

SEQ ID NO: 237821 - RNA, 32 nt, Human
ucggcucacugcaaccucugccucccggguuc

SEQ ID NO: 237822 - RNA, 32 nt, Human
ucggcucacugcaaccucugccucccguguuc

SEQ ID NO: 237823 - RNA, 32 nt, Human
ucggcucacugcaaccucugccucuuggguuc

SEQ ID NO: 237824 - RNA, 32 nt, Human
ucggcucacugcaaccucugcuucccggguuc

SEQ ID NO: 237825 - RNA, 32 nt, Human
ucggcucacugcaaccucuugccucccagguu

SEQ ID NO: 237826 - RNA, 32 nt, Human
ucggcucacugcaaccugucucucagguugaa

SEQ ID NO: 237827 - RNA, 32 nt, Human
ucggcucacugcaaccuucgccucuggguuca

SEQ ID NO: 237828 - RNA, 32 nt, Human
ucggcucacugcaacguccgccucccggguug

SEQ ID NO: 237829 - RNA, 32 nt, Human
ucggcucacugcaacuccaccucccggguuca

SEQ ID NO: 237830 - RNA, 32 nt, Human
ucggcucacugcaacucugccucccggguuca

SEQ ID NO: 237831 - RNA, 32 nt, Human
ucggcucacugcaacuuccaccucccggguuc

SEQ ID NO: 237832 - RNA, 32 nt, Human
ucggcucacugcaacuuccgccucccgguuuc

SEQ ID NO: 237833 - RNA, 32 nt, Human
ucggcucacugcaacuuccgccuccugggauc

SEQ ID NO: 237834 - RNA, 32 nt, Human
ucggcucacugcaacuucugccucccggguuc

SEQ ID NO: 237835 - RNA, 32 nt, Human
ucggcucacugcaagauccgccucccggguuc

SEQ ID NO: 237836 - RNA, 32 nt, Human
ucggcucacugcaagccccaccucccaaguuc

SEQ ID NO: 237837 - RNA, 32 nt, Human
ucggcucacugcaagccccaccuucugaguuc

SEQ ID NO: 237838 - RNA, 32 nt, Human
ucggcucacugcaagcccugccuccuggguuc

SEQ ID NO: 237839 - RNA, 32 nt, Human
ucggcucacugcaagcuccaccucccagguuc

SEQ ID NO: 237840 - RNA, 32 nt, Human
ucggcucacugcaagcuccaccucccggguuc

SEQ ID NO: 237841 - RNA, 32 nt, Human
ucggcucacugcaagcuccaccuccuggguuc

SEQ ID NO: 237842 - RNA, 32 nt, Human
ucggcucacugcaagcuccaucucccagguuc

SEQ ID NO: 237843 - RNA, 32 nt, Human
ucggcucacugcaagcuccgccucccagauuc

SEQ ID NO: 237844 - RNA, 32 nt, Human
ucggcucacugcaagcuccgccucccaggauc

SEQ ID NO: 237845 - RNA, 32 nt, Human
ucggcucacugcaagcuccgccucccagguuc

SEQ ID NO: 237846 - RNA, 32 nt, Human
ucggcucacugcaagcuccgccucccggauuc

SEQ ID NO: 237847 - RNA, 32 nt, Human
ucggcucacugcaagcuccgccucccggguuc

SEQ ID NO: 237848 - RNA, 32 nt, Human
ucggcucacugcaagcuccgccucucggguuc

SEQ ID NO: 237849 - RNA, 32 nt, Human
ucggcucacugcaagcuccggcucccagguuc

SEQ ID NO: 237850 - RNA, 32 nt, Human
ucggcucacugcaagcucugccucccagguuc

SEQ ID NO: 237851 - RNA, 32 nt, Human
ucggcucacugcaagcucugccucccgggcuc

SEQ ID NO: 237852 - RNA, 32 nt, Human
ucggcucacugcaagcucugccucccggguuc

SEQ ID NO: 237853 - RNA, 32 nt, Human
ucggcucacugcaagcucugccucccgguugc

SEQ ID NO: 237854 - RNA, 32 nt, Human
ucggcucacugcaagcucugccucucggguuc

SEQ ID NO: 237855 - RNA, 32 nt, Human
ucggcucacugcaagcucugcuucccagguuc

SEQ ID NO: 237856 - RNA, 32 nt, Human
ucggcucacugcaagcuucgccucccggguuc

SEQ ID NO: 237857 - RNA, 32 nt, Human
ucggcucacugcaaguuccgccucccggguuc

SEQ ID NO: 237858 - RNA, 32 nt, Human
ucggcucacugcaaucuccgccucccagguuc

SEQ ID NO: 237859 - RNA, 32 nt, Human
ucggcucacugcaaucucugccucccaagcaa

SEQ ID NO: 237860 - RNA, 32 nt, Human
ucggcucacugcaaucucugccucccagguuc

SEQ ID NO: 237861 - RNA, 32 nt, Human
ucggcucacugcaaucucugccucccggauuc

SEQ ID NO: 237862 - RNA, 32 nt, Human
ucggcucacugcaaucucugccucccggguuc

SEQ ID NO: 237863 - RNA, 32 nt, Human
ucggcucacugcaauuugcgucucccaaguuc

SEQ ID NO: 237864 - RNA, 32 nt, Human
ucggcucacugcacccucugccucuuggguuc

SEQ ID NO: 237865 - RNA, 32 nt, Human
ucggcucacugcaccuccgccucccagguuca

SEQ ID NO: 237866 - RNA, 32 nt, Human
ucggcucacugcaccucugccuccuggauuca

SEQ ID NO: 237867 - RNA, 32 nt, Human
ucggcucacugcaccuucugccuaccgaguuc

SEQ ID NO: 237868 - RNA, 32 nt, Human
ucggcucacugcagccccugccucccaggcuc

SEQ ID NO: 237869 - RNA, 32 nt, Human
ucggcucacugcagccuccgccucccagguuc

SEQ ID NO: 237870 - RNA, 32 nt, Human
ucggcucacugcagccuccgccucccguauuc

SEQ ID NO: 237871 - RNA, 32 nt, Human
ucggcucacugcagccuccgccucccugguuc

SEQ ID NO: 237872 - RNA, 32 nt, Human
ucggcucacugcagccucugccucccggguuc

SEQ ID NO: 237873 - RNA, 32 nt, Human
ucggcucacugcagccuucaccucccggguuc

SEQ ID NO: 237874 - RNA, 32 nt, Human
ucggcucacugcagccuugacuucccaggcuc

SEQ ID NO: 237875 - RNA, 32 nt, Human
ucggcucacugcagccuuugccucccggguuc

SEQ ID NO: 237876 - RNA, 32 nt, Human
ucggcucacugcagcgucgacauuucggguca

SEQ ID NO: 237877 - RNA, 32 nt, Human
ucggcucacugcagucaccuccucucagguuc

SEQ ID NO: 237878 - RNA, 32 nt, Human
ucggcucacugcauccuccaccuccuggguuc

SEQ ID NO: 237879 - RNA, 32 nt, Human
ucggcucacugcauccuccgccucccggguuc

SEQ ID NO: 237880 - RNA, 32 nt, Human
ucggcucacugcauccucugccucccggguuc

SEQ ID NO: 237881 - RNA, 32 nt, Human
ucggcucacugcaucuuccgccucccggguuc

SEQ ID NO: 237882 - RNA, 32 nt, Human
ucggcucacugcgagcuccaccucucggguuc

SEQ ID NO: 237883 - RNA, 32 nt, Human
ucggcucacuguaaccuccaccuccuggguuc

SEQ ID NO: 237884 - RNA, 32 nt, Human
ucggcucacuguagccuccaccucccccaauc

SEQ ID NO: 237885 - RNA, 32 nt, Human
ucggcucagugcaaccucugccucccagguug

SEQ ID NO: 237886 - RNA, 32 nt, Human
ucggcucauuacaaccuccaccucccggguuc

SEQ ID NO: 237887 - RNA, 32 nt, Human
ucggcucauugcaaccuccaccuuccagauuc

SEQ ID NO: 237888 - RNA, 32 nt, Human
ucggcucauugcaaccuccgccucccggguuc

SEQ ID NO: 237889 - RNA, 32 nt, Human
ucggcucauugcaaccuccgccuccuggguuc

SEQ ID NO: 237890 - RNA, 32 nt, Human
ucggcucauugcaaccuccgccuuccggguuc

SEQ ID NO: 237891 - RNA, 32 nt, Human
ucggcuccagacuccggcauuuccuccccgcu

SEQ ID NO: 237892 - RNA, 31 nt, Human
ucggcuccaggaggucacacagcagguuucu

SEQ ID NO: 237893 - RNA, 32 nt, Human
ucggcuccaggaggucacacagcagguuucug

SEQ ID NO: 237894 - RNA, 32 nt, Human
ucggcuccaucuucauugcguucaucauccug

SEQ ID NO: 237895 - RNA, 32 nt, Human
ucggcucccccaggaggagcaggcugggccca

SEQ ID NO: 237896 - RNA, 32 nt, Human
ucggcucccucuuccccuucuaaaccaaggua

SEQ ID NO: 237897 - RNA, 32 nt, Human
ucggcucccugcaaccuccaccucccggguuc

SEQ ID NO: 237898 - RNA, 32 nt, Human
ucggcucccugcaaccuucgccucccggguuc

SEQ ID NO: 237899 - RNA, 32 nt, Human
ucggcucccugcaaucuccaccucccagguuc

SEQ ID NO: 237900 - RNA, 32 nt, Human
ucggcuccucaagguggugguugaggagacag

SEQ ID NO: 237901 - RNA, 32 nt, Human
ucggcuccucaccacuuucuaugccagucucc

SEQ ID NO: 237902 - RNA, 32 nt, Human
ucggcuccuccuccuccucccggcggugggug

SEQ ID NO: 237903 - RNA, 32 nt, Human
ucggcuccuggaaaccucaccccaaauuggag

SEQ ID NO: 237904 - RNA, 32 nt, Human
ucggcucgcuacaaccuccaccucccagcaac

SEQ ID NO: 237905 - RNA, 32 nt, Human
ucggcucgcugcaaccuccgccucccggguuc

SEQ ID NO: 237906 - RNA, 32 nt, Human
ucggcucggcccgcgggggagccccgggagcc

SEQ ID NO: 237907 - RNA, 32 nt, Human
ucggcucuaccaaucagcagguuguggauggg

SEQ ID NO: 237908 - RNA, 32 nt, Human
ucggcucucaccgcaaccuccgucuccugggu

SEQ ID NO: 237909 - RNA, 32 nt, Human
ucggcucucugcaaccuccgccucccagguuc

SEQ ID NO: 237910 - RNA, 32 nt, Human
ucggcucucugcaaccucugccucccggguuc

SEQ ID NO: 237911 - RNA, 32 nt, Human
ucggcucucugcaaccucugucucccggguuc

SEQ ID NO: 237912 - RNA, 21 nt, Human
ucggcucugaagcggacgccu

SEQ ID NO: 237913 - RNA, 32 nt, Human
ucggcucuucacugcuccuccuggccugccua

SEQ ID NO: 237914 - RNA, 32 nt, Human
ucggcucuugggucccccuccgccgccccgcc

SEQ ID NO: 237915 - RNA, 32 nt, Human
ucggcugaaccaggacuccucacugucuaccu

SEQ ID NO: 237916 - RNA, 32 nt, Human
ucggcugaagaaagaaggugggagcggagagc

SEQ ID NO: 237917 - RNA, 32 nt, Human
ucggcugacaggcuccacagagcuccacucac

SEQ ID NO: 237918 - RNA, 32 nt, Human
ucggcugacugcaaccacugccuccaggguuc

SEQ ID NO: 237919 - RNA, 32 nt, Human
ucggcugacugcaaccuccaccucccgggugc

SEQ ID NO: 237920 - RNA, 32 nt, Human
ucggcugagauuugagcuucauggugaacaca

SEQ ID NO: 237921 - RNA, 32 nt, Human
ucggcugcagcgcugggcuggugugcaguggu

SEQ ID NO: 237922 - RNA, 31 nt, Human
ucggcugccagcuagaauaaaccaggcagga

SEQ ID NO: 237923 - RNA, 32 nt, Human
ucggcugccuggggacauugccaccacgucgc

SEQ ID NO: 237924 - RNA, 32 nt, Human
ucggcugccuggggacauugucaccacgucgc

SEQ ID NO: 237925 - RNA, 23 nt, Human
ucggcugcggcgggugugggagg

SEQ ID NO: 237926 - RNA, 32 nt, Human
ucggcugcuggaauuggaaucaggcuguacuc

SEQ ID NO: 237927 - RNA, 32 nt, Human
ucggcuggcccauaacuccugagcuacacaga

SEQ ID NO: 237928 - RNA, 32 nt, Human
ucggcugucuaggacuaguuuaucucugcuuc

SEQ ID NO: 237929 - RNA, 32 nt, Human
ucggcuuacacauaaucauucuuucugaacuu

SEQ ID NO: 237930 - RNA, 32 nt, Human
ucggcuuacugcaaccuccaccucccaggugc

SEQ ID NO: 237931 - RNA, 32 nt, Human
ucggcuuacugcaaccuccaccucccggguuc

SEQ ID NO: 237932 - RNA, 32 nt, Human
ucggcuuacugcaaccuccgccuacuggguuc

SEQ ID NO: 237933 - RNA, 32 nt, Human
ucggcuuacugcaaccuccgccuucccagauu

SEQ ID NO: 237934 - RNA, 32 nt, Human
ucggcuuacugcaaccuuugccucccagguuu

SEQ ID NO: 237935 - RNA, 32 nt, Human
ucggcuuauggcaaccuccgccucccggguuc

SEQ ID NO: 237936 - RNA, 32 nt, Human
ucggcuucaagcaauucuccugccucagccuc

SEQ ID NO: 237937 - RNA, 32 nt, Human
ucggcuucccaaagugcugggauuacaggaau

SEQ ID NO: 237938 - RNA, 32 nt, Human
ucggcuucccaaagugcugggauuacaggcgu

SEQ ID NO: 237939 - RNA, 32 nt, Human
ucggcuucccaaagugcugggauuacaggcuu

SEQ ID NO: 237940 - RNA, 32 nt, Human
ucggcuucccaaagugcugggauuacgggcgu

SEQ ID NO: 237941 - RNA, 32 nt, Human
ucggcuucccaaagugcugggauugcaggcgu

SEQ ID NO: 237942 - RNA, 32 nt, Human
ucggcuucccaaaguucugggauuacaggcau

SEQ ID NO: 237943 - RNA, 32 nt, Human
ucggcuucccaaguagcugggauuacaggcac

SEQ ID NO: 237944 - RNA, 32 nt, Human
ucggcuucccgaagugcugggauuauaggcgu

SEQ ID NO: 237945 - RNA, 32 nt, Human
ucggcuuccuaaagugcugggauugcaggcgu

SEQ ID NO: 237946 - RNA, 32 nt, Human
ucggcuuccuaaaguguugggauuacaggcuu

SEQ ID NO: 237947 - RNA, 32 nt, Human
ucggcuucgucacugagaccucaggccucugc

SEQ ID NO: 237948 - RNA, 32 nt, Human
ucggcuucugcaggaggccauuagcucugcac

SEQ ID NO: 237949 - RNA, 32 nt, Human
ucggcuuuccaaagugcugggauuacagaugu

SEQ ID NO: 237950 - RNA, 32 nt, Human
ucggcuuucugacuucauagauguccagaggc

SEQ ID NO: 237951 - RNA, 32 nt, Human
ucgggaaaacagugggcagugaaguuagagaa

SEQ ID NO: 237952 - RNA, 32 nt, Human
ucgggaaaauaaccaguuaaaccagcuacuca

SEQ ID NO: 237953 - RNA, 32 nt, Human
ucgggaaaccucccccgacgcucucucucgga

SEQ ID NO: 237954 - RNA, 24 nt, Human
ucgggaaagcagagguugcaguga

SEQ ID NO: 237955 - RNA, 24 nt, Human
ucgggaaaguggcaguugcaguga

SEQ ID NO: 237956 - RNA, 32 nt, Human
ucgggaaccugaggcaggagaauggcuugaac

SEQ ID NO: 237957 - RNA, 32 nt, Human
ucgggaagcugaggcaagagaaucacuugaac

SEQ ID NO: 237958 - RNA, 32 nt, Human
ucgggaagcugaggcaggagaaucacuugaac

SEQ ID NO: 237959 - RNA, 32 nt, Human
ucgggaagcugaggcaggagaauugcuugaac

SEQ ID NO: 237960 - RNA, 32 nt, Human
ucgggaagcugaggcaggugaauuguuugaac

SEQ ID NO: 237961 - RNA, 32 nt, Human
ucgggaagcugagguaggagaaucucucuuuu

SEQ ID NO: 237962 - RNA, 32 nt, Human
ucgggaaggcaucuccacagccccggguccuc

SEQ ID NO: 237963 - RNA, 32 nt, Human
ucgggaagggcaagacugcggcgacgagaugc

SEQ ID NO: 237964 - RNA, 32 nt, Human
ucgggaaguuccaugaacacacaaggcaacau

SEQ ID NO: 237965 - RNA, 32 nt, Human
ucgggaaugaaugaucccuuuacagguguaau

SEQ ID NO: 237966 - RNA, 31 nt, Human
ucgggacaguucaaggaggaggagaccccua

SEQ ID NO: 237967 - RNA, 32 nt, Human
ucgggaccaaucuggccaacauggcgaaaccc

SEQ ID NO: 237968 - RNA, 32 nt, Human
ucgggaccagccuagccuacauggugaaaccc

SEQ ID NO: 237969 - RNA, 32 nt, Human
ucgggaccagccuggccaacaugaugaaaccc

SEQ ID NO: 237970 - RNA, 32 nt, Human
ucgggaccagccugggaaauauagugaaacuc

SEQ ID NO: 237971 - RNA, 32 nt, Human
ucgggaccagccugggcaacauggugaaaccc

SEQ ID NO: 237972 - RNA, 32 nt, Human
ucgggaccauccuggccaacauggugaaaccc

SEQ ID NO: 237973 - RNA, 32 nt, Human
ucgggacccaggagguaugggucagaaggaaa

SEQ ID NO: 237974 - RNA, 32 nt, Human
ucgggacccucuucauucucugaucucauccu

SEQ ID NO: 237975 - RNA, 32 nt, Human
ucgggacuaugaccuuuuucuccaguaugcua

SEQ ID NO: 237976 - RNA, 32 nt, Human
ucgggacucccagcacugcagagggugugagg

SEQ ID NO: 237977 - RNA, 32 nt, Human
ucgggacuccgaccucagccucccggugaagg

SEQ ID NO: 237978 - RNA, 32 nt, Human
ucgggacugugagcuuccuggcuccugggcag

SEQ ID NO: 237979 - RNA, 28 nt, Human
ucgggagacgucucccaagccugcuagg

SEQ ID NO: 237980 - RNA, 32 nt, Human
ucgggagacugaggcaggagaauggggagaac

SEQ ID NO: 237981 - RNA, 32 nt, Human
ucgggagccccuggccauguuaguugcacauu

SEQ ID NO: 237982 - RNA, 27 nt, Human
ucgggagcccuagcccugcuccaacuc

SEQ ID NO: 237983 - RNA, 32 nt, Human
ucgggagccguggggcagaggcugcagagccc

SEQ ID NO: 237984 - RNA, 32 nt, Human
ucgggagccguggggcagaggcugcggagccc

SEQ ID NO: 237985 - RNA, 29 nt, Human
ucgggagccugaggcaggagaaucacuug

SEQ ID NO: 237986 - RNA, 32 nt, Human
ucgggagcugugcacggcuucucaagugauuc

SEQ ID NO: 237987 - RNA, 32 nt, Human
ucgggaggaggcggagggcgcaaagcgagccg

SEQ ID NO: 237988 - RNA, 32 nt, Human
ucgggaggaugaggcaggagaauugcuugaaa

SEQ ID NO: 237989 - RNA, 32 nt, Human
ucgggaggaugagucaggagaauugcuugaac

SEQ ID NO: 237990 - RNA, 32 nt, Human
ucgggaggccaaggcaggagaauugcucgaac

SEQ ID NO: 237991 - RNA, 32 nt, Human
ucgggaggccccugccuucuguccuccauggu

SEQ ID NO: 237992 - RNA, 32 nt, Human
ucgggaggccgaggcaggaaaauuuauugaac

SEQ ID NO: 237993 - RNA, 32 nt, Human
ucgggaggccgaggcaggagaauugcuugaac

SEQ ID NO: 237994 - RNA, 32 nt, Human
ucgggaggccgaggcagguggaacacuugaga

SEQ ID NO: 237995 - RNA, 32 nt, Human
ucgggaggccgaggcggguggaucacgagguc

SEQ ID NO: 237996 - RNA, 32 nt, Human
ucgggaggccgagguaggcggaucaccugagg

SEQ ID NO: 237997 - RNA, 32 nt, Human
ucgggaggcggaggcaggagaaucacuugaac

SEQ ID NO: 237998 - RNA, 32 nt, Human
ucgggaggcuaaagcaggagaauugcuugaac

SEQ ID NO: 237999 - RNA, 32 nt, Human
ucgggaggcuaaggcaggagaaucacuugaac

SEQ ID NO: 238000 - RNA, 32 nt, Human
ucgggaggcuaaggcaggagaaucgcuugaac

SEQ ID NO: 238001 - RNA, 32 nt, Human
ucgggaggcuaaggcaggagaaucgcuugacg

SEQ ID NO: 238002 - RNA, 32 nt, Human
ucgggaggcuaaggcaggagaauugcuugagc

SEQ ID NO: 238003 - RNA, 32 nt, Human
ucgggaggcucaggcaggagaaucacuugaac

SEQ ID NO: 238004 - RNA, 32 nt, Human
ucgggaggcugaaacaggagaaucacuugaac

SEQ ID NO: 238005 - RNA, 32 nt, Human
ucgggaggcugaaccaggagaauugcuugaac

SEQ ID NO: 238006 - RNA, 32 nt, Human
ucgggaggcugaagcaagcagaucacuugagg

SEQ ID NO: 238007 - RNA, 32 nt, Human
ucgggaggcugaagcagaagaaucgcuugaac

SEQ ID NO: 238008 - RNA, 32 nt, Human
ucgggaggcugaagcaggagaaucacuugaac

SEQ ID NO: 238009 - RNA, 32 nt, Human
ucgggaggcugaagcaggagaaucgcuugagc

SEQ ID NO: 238010 - RNA, 32 nt, Human
ucgggaggcugaagcaggagaauggcgugaac

SEQ ID NO: 238011 - RNA, 32 nt, Human
ucgggaggcugaagcaggagaauugcuugaac

SEQ ID NO: 238012 - RNA, 32 nt, Human
ucgggaggcugaagcaggagauuugcuugaac

SEQ ID NO: 238013 - RNA, 32 nt, Human
ucgggaggcugaagcaggaggacugcuugagc

SEQ ID NO: 238014 - RNA, 32 nt, Human
ucgggaggcugacgcaggagaaucacuugaac

SEQ ID NO: 238015 - RNA, 32 nt, Human
ucgggaggcugagacaggagaaucacuugaac

SEQ ID NO: 238016 - RNA, 32 nt, Human
ucgggaggcugagacaggagaaucacuugagc

SEQ ID NO: 238017 - RNA, 32 nt, Human
ucgggaggcugagacaggagaaucgcuuaaac

SEQ ID NO: 238018 - RNA, 32 nt, Human
ucgggaggcugagacaggagaaucgcuugaac

SEQ ID NO: 238019 - RNA, 32 nt, Human
ucgggaggcugagacaggagaaucgcuugaau

SEQ ID NO: 238020 - RNA, 32 nt, Human
ucgggaggcugagacaggagaaucucuugaau

SEQ ID NO: 238021 - RNA, 32 nt, Human
ucgggaggcugagacaggagaauugcuugaac

SEQ ID NO: 238022 - RNA, 32 nt, Human
ucgggaggcugaggaaggagaaucgcuugaac

SEQ ID NO: 238023 - RNA, 32 nt, Human
ucgggaggcugaggcaagagaaucacuugaac

SEQ ID NO: 238024 - RNA, 32 nt, Human
ucgggaggcugaggcacaagaaucacuugaac

SEQ ID NO: 238025 - RNA, 32 nt, Human
ucgggaggcugaggcacgagaaucacuugaac

SEQ ID NO: 238026 - RNA, 32 nt, Human
ucgggaggcugaggcacgagaaucacuugaag

SEQ ID NO: 238027 - RNA, 32 nt, Human
ucgggaggcugaggcagcagaaucacuugaaa

SEQ ID NO: 238028 - RNA, 32 nt, Human
ucgggaggcugaggcaggagaaaggcaugaau

SEQ ID NO: 238029 - RNA, 32 nt, Human
ucgggaggcugaggcaggagaaccgcuugaac

SEQ ID NO: 238030 - RNA, 32 nt, Human
ucgggaggcugaggcaggagaacggcgugaac

SEQ ID NO: 238031 - RNA, 32 nt, Human
ucgggaggcugaggcaggagaauagcauggac

SEQ ID NO: 238032 - RNA, 32 nt, Human
ucgggaggcugaggcaggagaauagccugaac

SEQ ID NO: 238033 - RNA, 32 nt, Human
ucgggaggcugaggcaggagaauagcgugaac

SEQ ID NO: 238034 - RNA, 32 nt, Human
ucgggaggcugaggcaggagaaucaaucacuu

SEQ ID NO: 238035 - RNA, 32 nt, Human
ucgggaggcugaggcaggagaaucacaugaau

SEQ ID NO: 238036 - RNA, 32 nt, Human
ucgggaggcugaggcaggagaaucaccugaac

SEQ ID NO: 238037 - RNA, 32 nt, Human
ucgggaggcugaggcaggagaaucacuagaag

SEQ ID NO: 238038 - RNA, 32 nt, Human
ucgggaggcugaggcaggagaaucacuuaaac

SEQ ID NO: 238039 - RNA, 32 nt, Human
ucgggaggcugaggcaggagaaucacuucagc

SEQ ID NO: 238040 - RNA, 32 nt, Human
ucgggaggcugaggcaggagaaucacuugaaa

SEQ ID NO: 238041 - RNA, 32 nt, Human
ucgggaggcugaggcaggagaaucacuugaac

SEQ ID NO: 238042 - RNA, 32 nt, Human
ucgggaggcugaggcaggagaaucacuugaau

SEQ ID NO: 238043 - RNA, 32 nt, Human
ucgggaggcugaggcaggagaaucacuugagc

SEQ ID NO: 238044 - RNA, 32 nt, Human
ucgggaggcugaggcaggagaaucauuucaac

SEQ ID NO: 238045 - RNA, 32 nt, Human
ucgggaggcugaggcaggagaaucccuugaac

SEQ ID NO: 238046 - RNA, 32 nt, Human
ucgggaggcugaggcaggagaaucgccugaac

SEQ ID NO: 238047 - RNA, 32 nt, Human
ucgggaggcugaggcaggagaaucgcgugaac

SEQ ID NO: 238048 - RNA, 32 nt, Human
ucgggaggcugaggcaggagaaucgcuggaac

SEQ ID NO: 238049 - RNA, 32 nt, Human
ucgggaggcugaggcaggagaaucgcuuaaac

SEQ ID NO: 238050 - RNA, 32 nt, Human
ucgggaggcugaggcaggagaaucgcuugaac

SEQ ID NO: 238051 - RNA, 32 nt, Human
ucgggaggcugaggcaggagaaucgcuugaau

SEQ ID NO: 238052 - RNA, 32 nt, Human
ucgggaggcugaggcaggagaaucgcuugagc

SEQ ID NO: 238053 - RNA, 32 nt, Human
ucgggaggcugaggcaggagaaucgucuaagc

SEQ ID NO: 238054 - RNA, 32 nt, Human
ucgggaggcugaggcaggagaaucguuugaac

SEQ ID NO: 238055 - RNA, 32 nt, Human
ucgggaggcugaggcaggagaaucucuugaac

SEQ ID NO: 238056 - RNA, 32 nt, Human
ucgggaggcugaggcaggagaaucucuuucuu

SEQ ID NO: 238057 - RNA, 32 nt, Human
ucgggaggcugaggcaggagaaugaugugaac

SEQ ID NO: 238058 - RNA, 32 nt, Human
ucgggaggcugaggcaggagaauggcaugaac

SEQ ID NO: 238059 - RNA, 32 nt, Human
ucgggaggcugaggcaggagaauggccugaac

SEQ ID NO: 238060 - RNA, 32 nt, Human
ucgggaggcugaggcaggagaauggcgugaac

SEQ ID NO: 238061 - RNA, 32 nt, Human
  misc_feature (27)..(27): n is a, c, g or u
ucgggaggcugaggcaggagaauggcnugaac

SEQ ID NO: 238062 - RNA, 32 nt, Human
ucgggaggcugaggcaggagaauggcuggaac

SEQ ID NO: 238063 - RNA, 32 nt, Human
ucgggaggcugaggcaggagaauggcuugaac

SEQ ID NO: 238064 - RNA, 32 nt, Human
ucgggaggcugaggcaggagaauggcuugaau

SEQ ID NO: 238065 - RNA, 32 nt, Human
ucgggaggcugaggcaggagaauugcuugaac

SEQ ID NO: 238066 - RNA, 32 nt, Human
ucgggaggcugaggcaggagaauugcuugaau

SEQ ID NO: 238067 - RNA, 32 nt, Human
ucgggaggcugaggcaggagaauugcuugagc

SEQ ID NO: 238068 - RNA, 32 nt, Human
ucgggaggcugaggcaggagaauuguugaacc

SEQ ID NO: 238069 - RNA, 32 nt, Human
ucgggaggcugaggcaggagaauuguuugaac

SEQ ID NO: 238070 - RNA, 32 nt, Human
ucgggaggcugaggcaggagacucgcuugaac

SEQ ID NO: 238071 - RNA, 32 nt, Human
ucgggaggcugaggcaggagacuggcgugaac

SEQ ID NO: 238072 - RNA, 32 nt, Human
ucgggaggcugaggcaggagagaaucgcuuga

SEQ ID NO: 238073 - RNA, 32 nt, Human
ucgggaggcugaggcaggagagugacgugaac

SEQ ID NO: 238074 - RNA, 32 nt, Human
ucgggaggcugaggcaggagaucgcuggaacu

SEQ ID NO: 238075 - RNA, 32 nt, Human
ucgggaggcugaggcaggagauucgccugaac

SEQ ID NO: 238076 - RNA, 32 nt, Human
ucgggaggcugaggcaggaggaucacuugaac

SEQ ID NO: 238077 - RNA, 32 nt, Human
ucgggaggcugaggcaggaggaucacuugagc

SEQ ID NO: 238078 - RNA, 32 nt, Human
ucgggaggcugaggcaggaggaucauuugagg

SEQ ID NO: 238079 - RNA, 32 nt, Human
ucgggaggcugaggcaggaggaucgcuugaac

SEQ ID NO: 238080 - RNA, 32 nt, Human
ucgggaggcugaggcaggauugccugagcccu

SEQ ID NO: 238081 - RNA, 32 nt, Human
ucgggaggcugaggcaggggaaucacuugaac

SEQ ID NO: 238082 - RNA, 32 nt, Human
ucgggaggcugaggcaggggaaucgcuugaac

SEQ ID NO: 238083 - RNA, 32 nt, Human
ucgggaggcugaggcagguggaucacuugagg

SEQ ID NO: 238084 - RNA, 32 nt, Human
ucgggaggcugaggcauaagaaucacuugaac

SEQ ID NO: 238085 - RNA, 32 nt, Human
ucgggaggcugaggcggaagaaucacuugaac

SEQ ID NO: 238086 - RNA, 32 nt, Human
ucgggaggcugaggcgggagaaucacuugaac

SEQ ID NO: 238087 - RNA, 32 nt, Human
ucgggaggcugagggaggagaaucucuugaag

SEQ ID NO: 238088 - RNA, 32 nt, Human
ucgggaggcugagguaggagaaucacuugaac

SEQ ID NO: 238089 - RNA, 32 nt, Human
ucgggaggcugagguaggagaaucguuugaac

SEQ ID NO: 238090 - RNA, 32 nt, Human
ucgggaggcugagguagguggaucaccucugc

SEQ ID NO: 238091 - RNA, 32 nt, Human
ucgggaggcugaggugggagaaucacuugaac

SEQ ID NO: 238092 - RNA, 32 nt, Human
ucgggaggcugaggugggagaaucccuugaac

SEQ ID NO: 238093 - RNA, 32 nt, Human
ucgggaggcugagucaggagaaucacuugaac

SEQ ID NO: 238094 - RNA, 32 nt, Human
ucgggaggcugcagcaggagaauggcaugaac

SEQ ID NO: 238095 - RNA, 32 nt, Human
ucgggaggcugcggcgggagaaucgcuugaac

SEQ ID NO: 238096 - RNA, 32 nt, Human
ucgggaggcuggggcaggagaaucacuugagc

SEQ ID NO: 238097 - RNA, 32 nt, Human
ucgggaggcuguggcaggagaaucgcuugaac

SEQ ID NO: 238098 - RNA, 32 nt, Human
ucgggaggcuguggcaggagaauugcuugaac

SEQ ID NO: 238099 - RNA, 32 nt, Human
ucgggaggcuuagacaugagaaucacuugaac

SEQ ID NO: 238100 - RNA, 32 nt, Human
ucgggaggcuuagacaugagaaucacuugggc

SEQ ID NO: 238101 - RNA, 32 nt, Human
ucgggagggcagcagaggcagagaacgaggac

SEQ ID NO: 238102 - RNA, 32 nt, Human
ucgggagggucugagcagcccugguggcugcc

SEQ ID NO: 238103 - RNA, 32 nt, Human
ucgggagggugaaaggagggaggagaagggcg

SEQ ID NO: 238104 - RNA, 32 nt, Human
ucgggagggugaggcaggagaaucacuucaac

SEQ ID NO: 238105 - RNA, 32 nt, Human
ucgggaggucgaggcaggaggaucacuugagu

SEQ ID NO: 238106 - RNA, 32 nt, Human
ucgggagguggagccaaucagguccaaccaag

SEQ ID NO: 238107 - RNA, 19 nt, Human
ucgggaggugguggaguga

SEQ ID NO: 238108 - RNA, 32 nt, Human
ucgggagguugaggcaggagaaucacuugaac

SEQ ID NO: 238109 - RNA, 32 nt, Human
ucgggagguugaggcaggagaaucgcuuaaac

SEQ ID NO: 238110 - RNA, 32 nt, Human
ucgggagguugaggcaggagaaucgcuugaac

SEQ ID NO: 238111 - RNA, 32 nt, Human
ucgggagguugaggcaggagaauugcaugaac

SEQ ID NO: 238112 - RNA, 32 nt, Human
ucgggagguugaggcaggagaauugcuuaaac

SEQ ID NO: 238113 - RNA, 32 nt, Human
ucgggagguugaggcaggagaauugcuugaac

SEQ ID NO: 238114 - RNA, 32 nt, Human
ucgggagguugagggagaagaaucacuuaaac

SEQ ID NO: 238115 - RNA, 32 nt, Human
ucgggagguugagggaggagaaucacuugacc

SEQ ID NO: 238116 - RNA, 32 nt, Human
ucgggagguugaugcaggagaaucacuugaaa

SEQ ID NO: 238117 - RNA, 32 nt, Human
ucgggagguuuaggcaggagaaucgcuugaac

SEQ ID NO: 238118 - RNA, 32 nt, Human
ucgggagucucaggcaggagaauugcuugaau

SEQ ID NO: 238119 - RNA, 32 nt, Human
ucgggagucugaaacaggagaauagcuugaac

SEQ ID NO: 238120 - RNA, 32 nt, Human
ucgggagugaggaccaggcugagaacucgggg

SEQ ID NO: 238121 - RNA, 32 nt, Human
ucgggaucucagaggaaauugcagugauucca

SEQ ID NO: 238122 - RNA, 32 nt, Human
ucgggaucugucauccuggaccaggauacuug

SEQ ID NO: 238123 - RNA, 32 nt, Human
ucgggauucugcugcuuuagauuggcacagcu

SEQ ID NO: 238124 - RNA, 32 nt, Human
ucgggcaaagggcagaggucaccguccagguu

SEQ ID NO: 238125 - RNA, 32 nt, Human
ucgggcaacacccuucucgcagccugggccuc

SEQ ID NO: 238126 - RNA, 32 nt, Human
ucgggcaagaaagucugggcagcuggagaagg

SEQ ID NO: 238127 - RNA, 32 nt, Human
ucgggcaccacccauauagcagucccagaggg

SEQ ID NO: 238128 - RNA, 32 nt, Human
ucgggcaccagccugcauauguguucacuuuu

SEQ ID NO: 238129 - RNA, 32 nt, Human
ucgggcagaguccuugggacaccagccucucu

SEQ ID NO: 238130 - RNA, 32 nt, Human
ucgggcagcaggugggaagugggagccggagc

SEQ ID NO: 238131 - RNA, 32 nt, Human
ucgggcagccauagaggagagcuuucuuaacg

SEQ ID NO: 238132 - RNA, 32 nt, Human
ucgggcagccuauugauacugucaggggaaaa

SEQ ID NO: 238133 - RNA, 32 nt, Human
ucgggcagcugagacaggagaaucacuugggc

SEQ ID NO: 238134 - RNA, 21 nt, Human
ucgggcagcuggaauuacagg

SEQ ID NO: 238135 - RNA, 24 nt, Human
ucgggcagcuggaauuacaggcau

SEQ ID NO: 238136 - RNA, 32 nt, Human
ucgggcaggcccagagagccagaguggaagga

SEQ ID NO: 238137 - RNA, 32 nt, Human
ucgggcaguagugugccacaccccagagccuu

SEQ ID NO: 238138 - RNA, 32 nt, Human
ucgggcaugaugacaggcaccuguaaucccag

SEQ ID NO: 238139 - RNA, 32 nt, Human
ucgggcaugguggcacaagccuguaaucucug

SEQ ID NO: 238140 - RNA, 32 nt, Human
ucgggcaugguggcacaugccuguaaucccag

SEQ ID NO: 238141 - RNA, 32 nt, Human
ucgggcaugguggcucaugccuguaaucucag

SEQ ID NO: 238142 - RNA, 32 nt, Human
ucgggccacggcacuccagccugggugacaga

SEQ ID NO: 238143 - RNA, 32 nt, Human
ucgggccacugcacuccagcuugggugacaga

SEQ ID NO: 238144 - RNA, 32 nt, Human
ucgggccacuuacacaccacugccugauaacc

SEQ ID NO: 238145 - RNA, 32 nt, Human
ucgggccagaagcagagaacaggaaguugaug

SEQ ID NO: 238146 - RNA, 32 nt, Human
ucgggccagccugucuguugugcagacgccuc

SEQ ID NO: 238147 - RNA, 24 nt, Human
ucgggccagcugguccuuuuccca

SEQ ID NO: 238148 - RNA, 32 nt, Human
ucgggccagggagguugaggcugcagugagcu

SEQ ID NO: 238149 - RNA, 23 nt, Human
ucgggcccagcccuuccacccca

SEQ ID NO: 238150 - RNA, 19 nt, Human
ucgggcccaucuuccuccc

SEQ ID NO: 238151 - RNA, 32 nt, Human
ucgggccccauccucaucccugacuggccaaa

SEQ ID NO: 238152 - RNA, 22 nt, Human
ucgggcccccacuuucuuccca

SEQ ID NO: 238153 - RNA, 21 nt, Human
ucgggccccgcgcccaggccc

SEQ ID NO: 238154 - RNA, 24 nt, Human
ucgggccccugcuccuguccccca

SEQ ID NO: 238155 - RNA, 22 nt, Human
ucgggcccgagcgggggccuga

SEQ ID NO: 238156 - RNA, 32 nt, Human
ucgggcccuccaaacccaaccuugccagcugg

SEQ ID NO: 238157 - RNA, 32 nt, Human
ucgggcccugcuccuccugcagccccuccuca

SEQ ID NO: 238158 - RNA, 32 nt, Human
ucgggcccuuuuuagucccuuuccaaagcugc

SEQ ID NO: 238159 - RNA, 32 nt, Human
ucgggccgcugcacuccagccugggggacaga

SEQ ID NO: 238160 - RNA, 32 nt, Human
ucgggccguucuguuccaagagauaaccauug

SEQ ID NO: 238161 - RNA, 23 nt, Human
ucgggccuccuccccaccuccca

SEQ ID NO: 238162 - RNA, 23 nt, Human
ucgggccuccugccuuccuccca

SEQ ID NO: 238163 - RNA, 32 nt, Human
ucgggccucuuccccaggcagcuugugagccc

SEQ ID NO: 238164 - RNA, 32 nt, Human
ucgggccugacccguccacacagggccguguc

SEQ ID NO: 238165 - RNA, 32 nt, Human
ucgggccugcagccaccaugcuccacucccug

SEQ ID NO: 238166 - RNA, 24 nt, Human
ucgggccuguaaucccagcacuuu

SEQ ID NO: 238167 - RNA, 32 nt, Human
ucgggccuguaaucccagcacuuucggaggcc

SEQ ID NO: 238168 - RNA, 32 nt, Human
ucgggcgagaggaggcgagaggcgcaaaggag

SEQ ID NO: 238169 - RNA, 32 nt, Human
ucgggcgaggagaagaggugacccgcgccaga

SEQ ID NO: 238170 - RNA, 32 nt, Human
ucgggcgagucacugccucucccuggcccuca

SEQ ID NO: 238171 - RNA, 32 nt, Human
ucgggcgauucuccugccccagccucuugagu

SEQ ID NO: 238172 - RNA, 32 nt, Human
ucgggcgauuggguucucccugccuuuucaau

SEQ ID NO: 238173 - RNA, 32 nt, Human
ucgggcgcaguggcucacaccuguaauccugc

SEQ ID NO: 238174 - RNA, 32 nt, Human
ucgggcgcaguggcucaugccuguaaucccag

SEQ ID NO: 238175 - RNA, 32 nt, Human
ucgggcgcaguggcuuaugccuguaaucccag

SEQ ID NO: 238176 - RNA, 32 nt, Human
ucgggcgccaggcaugacuaagagauaucgug

SEQ ID NO: 238177 - RNA, 32 nt, Human
ucgggcgcgguggcucacgccuguaaucccag

SEQ ID NO: 238178 - RNA, 32 nt, Human
ucgggcgcgguggcucaugcuuguaaucccag

SEQ ID NO: 238179 - RNA, 32 nt, Human
ucgggcggcgccgagcugagguggugagggac

SEQ ID NO: 238180 - RNA, 32 nt, Human
ucgggcgggaggcgggaggcgggaggccgggc

SEQ ID NO: 238181 - RNA, 32 nt, Human
ucgggcgggcggacgaggcgggcgauggcccu

SEQ ID NO: 238182 - RNA, 32 nt, Human
ucgggcguaguggugcaugccuguaaucccag

SEQ ID NO: 238183 - RNA, 32 nt, Human
ucgggcgugcuggugcaugccuguaauccuag

SEQ ID NO: 238184 - RNA, 32 nt, Human
ucgggcgugguggcucaugccuguaaucccag

SEQ ID NO: 238185 - RNA, 32 nt, Human
ucgggcuacuccacccuguccaccauggaccg

SEQ ID NO: 238186 - RNA, 32 nt, Human
ucgggcucccaaaguacugggauuacaggcau

SEQ ID NO: 238187 - RNA, 32 nt, Human
ucgggcucccaaagugcugggauuacagacgu

SEQ ID NO: 238188 - RNA, 32 nt, Human
ucgggcucccaaagugcugggauuacaggcgu

SEQ ID NO: 238189 - RNA, 32 nt, Human
ucgggcucccaaaguguugggauuacaggcau

SEQ ID NO: 238190 - RNA, 32 nt, Human
ucgggcuccuaaagugcugggauuacaggcgu

SEQ ID NO: 238191 - RNA, 18 nt, Human
ucgggcuccugcaggccg

SEQ ID NO: 238192 - RNA, 32 nt, Human
ucgggcucucccggcccugccucccagcaagu

SEQ ID NO: 238193 - RNA, 20 nt, Human
ucgggcucugcagagugaga

SEQ ID NO: 238194 - RNA, 32 nt, Human
ucgggcugcggacucugccuccugggucugag

SEQ ID NO: 238195 - RNA, 32 nt, Human
ucgggcugcugcagcucaggaggccgaaugau

SEQ ID NO: 238196 - RNA, 32 nt, Human
ucgggcuggagacgcaggaugggguaggccuu

SEQ ID NO: 238197 - RNA, 32 nt, Human
ucgggcugggcugagaggggagggggcggcgg

SEQ ID NO: 238198 - RNA, 32 nt, Human
ucgggcugggcuuccaaagccggccgcagccc

SEQ ID NO: 238199 - RNA, 32 nt, Human
ucgggcuuccggggaaagcaaucauuggugug

SEQ ID NO: 238200 - RNA, 23 nt, Human
ucgggcuuguguucucccucuca

SEQ ID NO: 238201 - RNA, 32 nt, Human
ucgggcuuuuggugagacagacuuucccaacc

SEQ ID NO: 238202 - RNA, 32 nt, Human
ucggggaaagaauggagcucagagugggaggu

SEQ ID NO: 238203 - RNA, 32 nt, Human
ucggggaacacauuccgggagagaugccuggc

SEQ ID NO: 238204 - RNA, 32 nt, Human
ucggggaagaugacacaucugaaccgagguac

SEQ ID NO: 238205 - RNA, 32 nt, Human
ucggggaccguucucugaucaucaggauuuuc

SEQ ID NO: 238206 - RNA, 32 nt, Human
ucggggaccguucugugaucaucaggauuuuc

SEQ ID NO: 238207 - RNA, 32 nt, Human
ucggggacgccagagcuccugagaagauguca

SEQ ID NO: 238208 - RNA, 32 nt, Human
ucggggagagaaggggccuguguucucagccu

SEQ ID NO: 238209 - RNA, 32 nt, Human
ucggggaggaagagauggcugcugagcaaggg

SEQ ID NO: 238210 - RNA, 32 nt, Human
ucggggaggcagagcuugcagucagccgagau

SEQ ID NO: 238211 - RNA, 32 nt, Human
ucggggaggggagggaaaagcagcacccacag

SEQ ID NO: 238212 - RNA, 32 nt, Human
ucggggaggggcuggcagagaugguuggucca

SEQ ID NO: 238213 - RNA, 32 nt, Human
ucggggaugggugccauuugagcccagcuugg

SEQ ID NO: 238214 - RNA, 23 nt, Human
ucggggcacugcaggggccgagc

SEQ ID NO: 238215 - RNA, 32 nt, Human
ucggggcagcggaacccagagaagcugagggg

SEQ ID NO: 238216 - RNA, 32 nt, Human
ucggggcaggaggcuggggaugggggugggau

SEQ ID NO: 238217 - RNA, 32 nt, Human
ucggggcagggugggcgcgagagagccuagaa

SEQ ID NO: 238218 - RNA, 32 nt, Human
ucggggcaucgcacgacauccaccuccugaag

SEQ ID NO: 238219 - RNA, 32 nt, Human
ucggggcauuuucacugucaaagaaaguucua

SEQ ID NO: 238220 - RNA, 32 nt, Human
ucggggcccaggccugggccagaagcuguuga

SEQ ID NO: 238221 - RNA, 32 nt, Human
ucggggcccgggaggcgggccgcgcagcgccg

SEQ ID NO: 238222 - RNA, 32 nt, Human
ucggggcccuuucugcagaucuaccucuggcu

SEQ ID NO: 238223 - RNA, 32 nt, Human
ucggggccgcagccuggugagcucagcccccu

SEQ ID NO: 238224 - RNA, 32 nt, Human
ucggggccggccucugccuugccgcuccccuc

SEQ ID NO: 238225 - RNA, 32 nt, Human
ucggggccucagaagcaggcuuuuaucuggcc

SEQ ID NO: 238226 - RNA, 32 nt, Human
ucggggccugcugggagcccuuaacuccccca

SEQ ID NO: 238227 - RNA, 32 nt, Human
ucggggccugggacacuucccugggccucaac

SEQ ID NO: 238228 - RNA, 24 nt, Human
ucggggccuugccucuugcagcua

SEQ ID NO: 238229 - RNA, 32 nt, Human
ucggggccuugccucuugcagcuacucugugg

SEQ ID NO: 238230 - RNA, 32 nt, Human
ucggggcgagggcagaggugaucaccugcgug

SEQ ID NO: 238231 - RNA, 32 nt, Human
ucggggcgcugaggcaggagaaucgcucgaac

SEQ ID NO: 238232 - RNA, 32 nt, Human
ucggggcucacugccuccugcccuucucuccu

SEQ ID NO: 238233 - RNA, 32 nt, Human
ucggggcucguccacucuccucccucucuccu

SEQ ID NO: 238234 - RNA, 32 nt, Human
ucggggcucucucccucugucucccuccuggc

SEQ ID NO: 238235 - RNA, 32 nt, Human
ucggggcugaccaggcuggggguccagugaaa

SEQ ID NO: 238236 - RNA, 32 nt, Human
ucggggcugcagauggcccaggcgcugaccca

SEQ ID NO: 238237 - RNA, 32 nt, Human
ucggggcugcaggcuggagugcagugggacag

SEQ ID NO: 238238 - RNA, 21 nt, Human
ucggggcugccccugcacccu

SEQ ID NO: 238239 - RNA, 32 nt, Human
ucggggcugcgggguggggaccccaaggcuuu

SEQ ID NO: 238240 - RNA, 28 nt, Human
ucggggcugggcgcugccucucggucga

SEQ ID NO: 238241 - RNA, 24 nt, Human
ucggggcugggggacggggcgggg

SEQ ID NO: 238242 - RNA, 19 nt, Human
ucggggcuugcccugagcc

SEQ ID NO: 238243 - RNA, 32 nt, Human
ucgggggagagggcgccggagaggaggcggcg

SEQ ID NO: 238244 - RNA, 24 nt, Human
ucgggggagcgugaguugcaguua

SEQ ID NO: 238245 - RNA, 32 nt, Human
ucgggggcagcggcagauuugaggcuuaagca

SEQ ID NO: 238246 - RNA, 32 nt, Human
ucgggggccucccacagcacagcacugccucu

SEQ ID NO: 238247 - RNA, 32 nt, Human
ucgggggccucuggguggagggggauucagac

SEQ ID NO: 238248 - RNA, 30 nt, Human
ucgggggcgcugugguuccagaacauuuca

SEQ ID NO: 238249 - RNA, 32 nt, Human
ucgggggcggagugcggggcagaggggugggg

SEQ ID NO: 238250 - RNA, 32 nt, Human
ucgggggcggggcgaucgggucucagccccug

SEQ ID NO: 238251 - RNA, 32 nt, Human
ucgggggcgggggagauucugacucuuaaucu

SEQ ID NO: 238252 - RNA, 32 nt, Human
ucgggggcggugccugccuugcagccuccccu

SEQ ID NO: 238253 - RNA, 32 nt, Human
ucgggggcuugacuccagccccggggaucgag

SEQ ID NO: 238254 - RNA, 24 nt, Human
ucggggggcuuucugucuggcuca

SEQ ID NO: 238255 - RNA, 32 nt, Human
ucggggguagcgccucucauuccugaugucuc

SEQ ID NO: 238256 - RNA, 32 nt, Human
ucgggggugccugggagccuggagucccgggg

SEQ ID NO: 238257 - RNA, 23 nt, Human
ucggggguuucagcucacugcuc

SEQ ID NO: 238258 - RNA, 32 nt, Human
ucggggguuugcgaccagccuggucaacauag

SEQ ID NO: 238259 - RNA, 32 nt, Human
ucgggguacagauggggcaggggcacuuguga

SEQ ID NO: 238260 - RNA, 32 nt, Human
ucggggucgggaggcguccccacgccgcccgg

SEQ ID NO: 238261 - RNA, 32 nt, Human
ucggggucuaaggugaucagaugcagaagcau

SEQ ID NO: 238262 - RNA, 23 nt, Human
ucggggucuggugucggcacagc

SEQ ID NO: 238263 - RNA, 32 nt, Human
ucggggugugagcuggcaugaggaccuguugg

SEQ ID NO: 238264 - RNA, 32 nt, Human
ucgggguuagaugaccacaggauaaagaggaa

SEQ ID NO: 238265 - RNA, 24 nt, Human
ucgggguuugggauugacacugga

SEQ ID NO: 238266 - RNA, 32 nt, Human
ucggguacccacccgcuguucuccaugcaaac

SEQ ID NO: 238267 - RNA, 32 nt, Human
ucggguaugguggcacaugccuguaauuccag

SEQ ID NO: 238268 - RNA, 32 nt, Human
ucgggucaaggcagaggcaggaaacuaacugg

SEQ ID NO: 238269 - RNA, 32 nt, Human
ucgggucaccacaaccuccgccucccggauuc

SEQ ID NO: 238270 - RNA, 32 nt, Human
ucgggucacugcaaccuccgccucccggguuc

SEQ ID NO: 238271 - RNA, 32 nt, Human
ucgggucacugcaaccucuaccuccaggguuc

SEQ ID NO: 238272 - RNA, 32 nt, Human
ucgggucacugcaagcucugccucccaaguuc

SEQ ID NO: 238273 - RNA, 32 nt, Human
ucgggucacugcagccucugucccuggguuca

SEQ ID NO: 238274 - RNA, 32 nt, Human
ucgggucagcccuaguggcugccugcacacug

SEQ ID NO: 238275 - RNA, 32 nt, Human
ucgggucaguuccagccuuccucuccaacucu

SEQ ID NO: 238276 - RNA, 32 nt, Human
ucggguccacagcugagguugccucugacaag

SEQ ID NO: 238277 - RNA, 32 nt, Human
ucggguccggcucugggcgugguucccuuccc

SEQ ID NO: 238278 - RNA, 32 nt, Human
ucgggucgcgggugcacuccggcccggcuccc

SEQ ID NO: 238279 - RNA, 32 nt, Human
ucgggugacugcaaccacugccucccagguuc

SEQ ID NO: 238280 - RNA, 32 nt, Human
ucgggugagcccagaagugagagcaguuggcu

SEQ ID NO: 238281 - RNA, 21 nt, Human
ucgggugauccacccaccuca

SEQ ID NO: 238282 - RNA, 32 nt, Human
ucgggugcaguggcucacaccuguaauuccag

SEQ ID NO: 238283 - RNA, 32 nt, Human
ucgggugcccucagagccaccucugccuguga

SEQ ID NO: 238284 - RNA, 32 nt, Human
ucgggugcgguggcucacaccuguaauccuag

SEQ ID NO: 238285 - RNA, 32 nt, Human
ucgggugcgguggcucaugccuauaauccuag

SEQ ID NO: 238286 - RNA, 32 nt, Human
ucggguggcugaggcaggagaaucacuugaac

SEQ ID NO: 238287 - RNA, 32 nt, Human
ucgggugggaaggaagcagggaagagaaagca

SEQ ID NO: 238288 - RNA, 32 nt, Human
ucgggugggagacuucagaugggcucaguacc

SEQ ID NO: 238289 - RNA, 32 nt, Human
ucgggugguggucucgguuggccaaggcugag

SEQ ID NO: 238290 - RNA, 32 nt, Human
ucggguguaguggcucaugcuuguaaucccag

SEQ ID NO: 238291 - RNA, 32 nt, Human
ucggguguccgcccucagccuccuggggacuc

SEQ ID NO: 238292 - RNA, 32 nt, Human
ucgggugugauggcucacgccuguaauccuag

SEQ ID NO: 238293 - RNA, 32 nt, Human
ucggguucaagcaauucuccugcaucagccuc

SEQ ID NO: 238294 - RNA, 32 nt, Human
ucggguucaagcaauugucugccucagccucc

SEQ ID NO: 238295 - RNA, 32 nt, Human
ucggguucacaccauucuccugccucagccuc

SEQ ID NO: 238296 - RNA, 32 nt, Human
ucggguucacgcuauccucccgccucagccuc

SEQ ID NO: 238297 - RNA, 32 nt, Human
ucggguuccagcaauucuccugccucagccuc

SEQ ID NO: 238298 - RNA, 19 nt, Human
ucggguuccgccugagcca

SEQ ID NO: 238299 - RNA, 32 nt, Human
ucggguuggggucuucccgaagccagguccaa

SEQ ID NO: 238300 - RNA, 32 nt, Human
ucggguuugcaccauucuccugccucagccuc

SEQ ID NO: 238301 - RNA, 20 nt, Human
ucgguaaacaguaguaacca

SEQ ID NO: 238302 - RNA, 32 nt, Human
ucgguaaagagagagagggcugggaggaaaag

SEQ ID NO: 238303 - RNA, 31 nt, Human
ucgguaaagcagugccuccucacuuaaguga

SEQ ID NO: 238304 - RNA, 32 nt, Human
ucgguaagaucucuccacagcugccaccaacc

SEQ ID NO: 238305 - RNA, 32 nt, Human
ucgguacagaagagguuucuuucugcaccagg

SEQ ID NO: 238306 - RNA, 32 nt, Human
ucgguaccugaaaacaacgauggcauggaaaa

SEQ ID NO: 238307 - RNA, 32 nt, Human
ucgguacuaagucauuuucaggggauugaaag

SEQ ID NO: 238308 - RNA, 17 nt, Human
ucgguagacaccaguca

SEQ ID NO: 238309 - RNA, 32 nt, Human
ucgguagcugaagucagccacggugggagugu

SEQ ID NO: 238310 - RNA, 32 nt, Human
ucgguaggcugaggcaggagaaucacuugaau

SEQ ID NO: 238311 - RNA, 32 nt, Human
ucgguauauggaaacacauugcucuacccugc

SEQ ID NO: 238312 - RNA, 18 nt, Human
ucgguaucccuacucuca

SEQ ID NO: 238313 - RNA, 32 nt, Human
ucggucaccauacuugaguuagcucuagggaa

SEQ ID NO: 238314 - RNA, 32 nt, Human
ucggucacccaccaacgccgcucccucgaucc

SEQ ID NO: 238315 - RNA, 32 nt, Human
ucggucaccuaggcuggaguguaguggcgcaa

SEQ ID NO: 238316 - RNA, 32 nt, Human
ucggucauucuccccauuuccauccauuaccc

SEQ ID NO: 238317 - RNA, 32 nt, Human
ucggucauugucuccccuccagcucuacucac

SEQ ID NO: 238318 - RNA, 22 nt, Human
ucggucccccagggugcgcuca

SEQ ID NO: 238319 - RNA, 22 nt, Human
ucgguccccuuccuuuagcuca

SEQ ID NO: 238320 - RNA, 20 nt, Human
ucggucccucacuggcacuu

SEQ ID NO: 238321 - RNA, 32 nt, Human
ucggucccucacuggcacuucucccuccggcc

SEQ ID NO: 238322 - RNA, 32 nt, Human
ucggucccuccaggcagccaaggcuuggcagc

SEQ ID NO: 238323 - RNA, 32 nt, Human
ucggucccuuagugaagccaugcuuacuccag

SEQ ID NO: 238324 - RNA, 21 nt, Human
ucgguccgguugagguuguca

SEQ ID NO: 238325 - RNA, 32 nt, Human
ucgguccugcuguagugccuucugcgccaggc

SEQ ID NO: 238326 - RNA, 32 nt, Human
ucggucuagggaggggagggucagcguggcaa

SEQ ID NO: 238327 - RNA, 32 nt, Human
ucggucuauacuacucggccauggcccacauc

SEQ ID NO: 238328 - RNA, 32 nt, Human
ucggucucaaaaacaaaacaaaacaaaacaaa

SEQ ID NO: 238329 - RNA, 21 nt, Human
ucggucuccaccccaggguca

SEQ ID NO: 238330 - RNA, 32 nt, Human
ucggucuccagugcggcaucccuuccuugccu

SEQ ID NO: 238331 - RNA, 32 nt, Human
ucggucucccaaaaugcugggauuacaggggu

SEQ ID NO: 238332 - RNA, 32 nt, Human
ucggucucccaaagcgcugggauuacaggcgu

SEQ ID NO: 238333 - RNA, 32 nt, Human
ucggucucccaaagugcugggauuacagaugu

SEQ ID NO: 238334 - RNA, 32 nt, Human
ucggucucccaaagugcugggauuacaggagu

SEQ ID NO: 238335 - RNA, 32 nt, Human
ucggucucccaaagugcugggauuacaggcau

SEQ ID NO: 238336 - RNA, 32 nt, Human
ucggucucccaaagugcugggauuacaggcgu

SEQ ID NO: 238337 - RNA, 32 nt, Human
ucggucucccaaagugcugggauuacaggcuu

SEQ ID NO: 238338 - RNA, 32 nt, Human
ucggucucccaaagugcugggauuacagggau

SEQ ID NO: 238339 - RNA, 32 nt, Human
ucggucucccaaagugcugggauuacaggugu

SEQ ID NO: 238340 - RNA, 32 nt, Human
ucggucucccaaaguguugggauuacaggcau

SEQ ID NO: 238341 - RNA, 32 nt, Human
ucggucucccgaagugcugggauuacaggugu

SEQ ID NO: 238342 - RNA, 22 nt, Human
ucggucuccguccgucgguccg

SEQ ID NO: 238343 - RNA, 32 nt, Human
ucggucucuggaaagucaggcugagaaauccu

SEQ ID NO: 238344 - RNA, 32 nt, Human
ucggugaacucugcaacccucucccgaacacu

SEQ ID NO: 238345 - RNA, 31 nt, Human
ucggugaacugccccuggccuguguccccca

SEQ ID NO: 238346 - RNA, 32 nt, Human
ucggugacagugagccacuugacuccagggac

SEQ ID NO: 238347 - RNA, 32 nt, Human
ucggugagaggcagugggcaagugaucuugga

SEQ ID NO: 238348 - RNA, 32 nt, Human
ucggugaggaucuccuuuagaagaggagaagc

SEQ ID NO: 238349 - RNA, 32 nt, Human
ucggugagggccagcuacauaccuggcuaagc

SEQ ID NO: 238350 - RNA, 32 nt, Human
ucggugaggggcugggcuggacaccagggccc

SEQ ID NO: 238351 - RNA, 32 nt, Human
ucggugagugcccagcugauuggggguauggc

SEQ ID NO: 238352 - RNA, 32 nt, Human
ucggugcagagugacgagagccucgaccucag

SEQ ID NO: 238353 - RNA, 32 nt, Human
ucggugcagcagcccugcaaaggaguggagcc

SEQ ID NO: 238354 - RNA, 32 nt, Human
ucggugcaggagcugaaggugaguggagugcu

SEQ ID NO: 238355 - RNA, 32 nt, Human
ucggugcccagaagucagcccagaccuuccug

SEQ ID NO: 238356 - RNA, 32 nt, Human
ucggugcggagcugccgggcugagggacgccu

SEQ ID NO: 238357 - RNA, 32 nt, Human
ucggugcuauuuugguuuugcauuuccauggu

SEQ ID NO: 238358 - RNA, 32 nt, Human
ucggugcucccagaucccgcagccucuggaga

SEQ ID NO: 238359 - RNA, 32 nt, Human
ucggugcugccugguccuggccuggggcagag

SEQ ID NO: 238360 - RNA, 32 nt, Human
ucggugcugcugcugcugcuccuggggcugcu

SEQ ID NO: 238361 - RNA, 32 nt, Human
ucggugcuggaugccagccuacagcagggucc

SEQ ID NO: 238362 - RNA, 32 nt, Human
ucgguggacccagggaugacaugucccuacac

SEQ ID NO: 238363 - RNA, 32 nt, Human
ucgguggagguggaggagcaaacugaggggca

SEQ ID NO: 238364 - RNA, 32 nt, Human
ucgguggagguuugugaccauugcucuucaaa

SEQ ID NO: 238365 - RNA, 32 nt, Human
ucgguggggaccccgacaucccagcgcugugc

SEQ ID NO: 238366 - RNA, 32 nt, Human
ucgguggggaggcaagagggcggcgaggaggu

SEQ ID NO: 238367 - RNA, 32 nt, Human
ucgguggggcugcagaaggucggggcugcacu

SEQ ID NO: 238368 - RNA, 32 nt, Human
ucggugggugaauggggagaccagaaagaaag

SEQ ID NO: 238369 - RNA, 32 nt, Human
ucgguggguuccccgcaaaaucaggcuugagu

SEQ ID NO: 238370 - RNA, 32 nt, Human
ucgguggucuccaccugucauucuagaaacag

SEQ ID NO: 238371 - RNA, 32 nt, Human
ucgguggugaugacagacccccuuuuggacuc

SEQ ID NO: 238372 - RNA, 32 nt, Human
ucggugguucucaucuucuguuucuugaacac

SEQ ID NO: 238373 - RNA, 32 nt, Human
ucggugucccuuucauccugggccugugugaa

SEQ ID NO: 238374 - RNA, 32 nt, Human
ucggugucugcagcacccuccgcuuccucucc

SEQ ID NO: 238375 - RNA, 29 nt, Human
ucggugugucugugugauggggaugaggc

SEQ ID NO: 238376 - RNA, 32 nt, Human
ucgguuaacuauauacugugcgcaguauggau

SEQ ID NO: 238377 - RNA, 32 nt, Human
ucgguuacauaaaacacagcugggcugggaag

SEQ ID NO: 238378 - RNA, 32 nt, Human
ucgguucaccgcaaccuccacaucccagguuc

SEQ ID NO: 238379 - RNA, 32 nt, Human
ucgguucacugcaacauucaccucccagguuc

SEQ ID NO: 238380 - RNA, 32 nt, Human
ucgguucacugcaaccuccaccucccgaguuc

SEQ ID NO: 238381 - RNA, 32 nt, Human
ucgguucacugcaaccuccaccucucagauuc

SEQ ID NO: 238382 - RNA, 32 nt, Human
ucgguucacugcaaccuccgccuccagguuca

SEQ ID NO: 238383 - RNA, 32 nt, Human
ucgguucacugcaaccuccgccucccgguuca

SEQ ID NO: 238384 - RNA, 32 nt, Human
ucgguucacugcaaccucugccucccaggauc

SEQ ID NO: 238385 - RNA, 32 nt, Human
ucgguucacugcaaccucugccucccagguuc

SEQ ID NO: 238386 - RNA, 32 nt, Human
ucgguucacugcaaccucugccucucagguuc

SEQ ID NO: 238387 - RNA, 32 nt, Human
ucgguucacugcagccuccaccucccgagcac

SEQ ID NO: 238388 - RNA, 32 nt, Human
ucgguucacugcagccucugccuucugggcuc

SEQ ID NO: 238389 - RNA, 32 nt, Human
ucgguucauugcaaccuccgccucccgaguuc

SEQ ID NO: 238390 - RNA, 32 nt, Human
ucgguucauugcaaccuccgccuccugcguuc

SEQ ID NO: 238391 - RNA, 32 nt, Human
ucgguuccaguucuacuuccagcagaaggggc

SEQ ID NO: 238392 - RNA, 32 nt, Human
ucgguucucagccucagauauccgcaccggcg

SEQ ID NO: 238393 - RNA, 32 nt, Human
ucgguucuccuccaccuggacaggaugagcca

SEQ ID NO: 238394 - RNA, 32 nt, Human
ucgguucucuuuugucugaccucucuccuccc

SEQ ID NO: 238395 - RNA, 32 nt, Human
ucgguucuguuucuccccuuggcugccuguac

SEQ ID NO: 238396 - RNA, 32 nt, Human
ucgguucuuccagacaagcugcaagacgcuga

SEQ ID NO: 238397 - RNA, 32 nt, Human
ucgguugaauccaggagguaaagaugcuguga

SEQ ID NO: 238398 - RNA, 32 nt, Human
ucgguugagcccaggagguuguggcugcagug

SEQ ID NO: 238399 - RNA, 32 nt, Human
ucgguugauggggaggucaggucugggaaacu

SEQ ID NO: 238400 - RNA, 32 nt, Human
ucgguugcaccugacauucucuccccaguaag

SEQ ID NO: 238401 - RNA, 32 nt, Human
ucgguuggugagugcagggaaggaggauguaa

SEQ ID NO: 238402 - RNA, 32 nt, Human
ucgguugucaucugugccaucuguccaugguu

SEQ ID NO: 238403 - RNA, 32 nt, Human
ucgguuguucucuggagccccaggacccaggc

SEQ ID NO: 238404 - RNA, 32 nt, Human
ucgguuuaaaacaugcuauauguacuguaugu

SEQ ID NO: 238405 - RNA, 32 nt, Human
ucgguuuccccaagugcugggauuacaggugu

SEQ ID NO: 238406 - RNA, 27 nt, Human
ucgguuuccccgcccccgccgggcuua

SEQ ID NO: 238407 - RNA, 32 nt, Human
ucgguuucucucuuaaagacacucacuguaca

SEQ ID NO: 238408 - RNA, 32 nt, Human
ucgguuucugcaucuucuggaucaauucacgg

SEQ ID NO: 238409 - RNA, 32 nt, Human
ucgguuugaaggcuuauugaggcccuacauug

SEQ ID NO: 238410 - RNA, 32 nt, Human
ucgguuugugguggcuucgcugaggcaguggu

SEQ ID NO: 238411 - RNA, 32 nt, Human
ucgguuuuccaaagagcugggauuacaggcau

SEQ ID NO: 238412 - RNA, 32 nt, Human
ucgguuuuuauguuuaacuuccacccagagcu

SEQ ID NO: 238413 - RNA, 32 nt, Human
ucgguuuuucuaguucuugcaaaggaacggug

SEQ ID NO: 238414 - RNA, 32 nt, Human
ucguaaaugucaucauaagaugccauucaaaa

SEQ ID NO: 238415 - RNA, 32 nt, Human
ucguaacauggcccuggcugggcuuggugguu

SEQ ID NO: 238416 - RNA, 32 nt, Human
ucguaacuuugacauucugccuuacagucuau

SEQ ID NO: 238417 - RNA, 22 nt, Human
ucguaagaacagccacuucuga

SEQ ID NO: 238418 - RNA, 32 nt, Human
ucguaauaggcagagaugacuugcaucccagc

SEQ ID NO: 238419 - RNA, 32 nt, Human
ucguacagcagcagaaaaugaccauguuacag

SEQ ID NO: 238420 - RNA, 32 nt, Human
ucguacaguccccuagaagcagaaggacaagg

SEQ ID NO: 238421 - RNA, 32 nt, Human
ucguaccacuacacuccagccugggcaacgga

SEQ ID NO: 238422 - RNA, 32 nt, Human
ucguaccacugcacuccagccuaggugacagg

SEQ ID NO: 238423 - RNA, 32 nt, Human
ucguaccacugcacuccagccuggaugacaga

SEQ ID NO: 238424 - RNA, 32 nt, Human
ucguaccacugcacuccagccugggcgacaga

SEQ ID NO: 238425 - RNA, 32 nt, Human
ucguaccacugcacuccagccugggcuacaga

SEQ ID NO: 238426 - RNA, 32 nt, Human
ucguaccacugcacuccagccugggugacaga

SEQ ID NO: 238427 - RNA, 32 nt, Human
ucguaccacugcacuccagucugggcgacaga

SEQ ID NO: 238428 - RNA, 32 nt, Human
ucguaccacugcacucuggccugggcaacaag

SEQ ID NO: 238429 - RNA, 32 nt, Human
ucguaccauugcacuccagccugggcaacaag

SEQ ID NO: 238430 - RNA, 32 nt, Human
ucguacccucuuuauaacuuccuccccaccgg

SEQ ID NO: 238431 - RNA, 32 nt, Human
ucguaccgcugcacuccagccugggugauaga

SEQ ID NO: 238432 - RNA, 32 nt, Human
ucguaccuauugcacuccauccuggaugaaag

SEQ ID NO: 238433 - RNA, 32 nt, Human
ucguacgcuaguguccucccuuuucaguccgc

SEQ ID NO: 238434 - RNA, 32 nt, Human
ucguacuacugcacuccagcauggaagacagc

SEQ ID NO: 238435 - RNA, 32 nt, Human
ucguacucaaagcucgugcauccagggagggg

SEQ ID NO: 238436 - RNA, 32 nt, Human
ucguacucuuucucccgucuucuucuucccca

SEQ ID NO: 238437 - RNA, 32 nt, Human
ucguacuggggaggcagcuggagcagcaagau

SEQ ID NO: 238438 - RNA, 32 nt, Human
ucguacuuugcucuccuugcgggugguugccg

SEQ ID NO: 238439 - RNA, 32 nt, Human
ucguagaacuagggcugcaggaauugcgccgc

SEQ ID NO: 238440 - RNA, 32 nt, Human
ucguagagaugggguuucaccauguuggcugg

SEQ ID NO: 238441 - RNA, 32 nt, Human
ucguagaggagagaaaacaagaguggacuggg

SEQ ID NO: 238442 - RNA, 32 nt, Human
ucguagaggcaucggaagaagauuagcaguuu

SEQ ID NO: 238443 - RNA, 32 nt, Human
ucguagaucauccucagaaaagccuugcccug

SEQ ID NO: 238444 - RNA, 32 nt, Human
ucguagcaaagucacuuuuauaacaguuuacc

SEQ ID NO: 238445 - RNA, 21 nt, Human
ucguagcaagcugccgaugga

SEQ ID NO: 238446 - RNA, 32 nt, Human
ucguagcaccaggguuuggaggcugcgaccgc

SEQ ID NO: 238447 - RNA, 32 nt, Human
ucguagcacugcaguccagccugggcgacaga

SEQ ID NO: 238448 - RNA, 32 nt, Human
ucguagcagccaucuuuuccuggcuuugguga

SEQ ID NO: 238449 - RNA, 32 nt, Human
ucguagcagggaaaggauaugacaauggggag

SEQ ID NO: 238450 - RNA, 32 nt, Human
ucguagcaucuaaaucaucuuaggguggcuca

SEQ ID NO: 238451 - RNA, 32 nt, Human
ucguagccauaccucgagucccugcauuggac

SEQ ID NO: 238452 - RNA, 32 nt, Human
ucguagcccuggagggucgugaucuccuacaa

SEQ ID NO: 238453 - RNA, 32 nt, Human
ucguagccugccacuccgugcauugcuugaug

SEQ ID NO: 238454 - RNA, 32 nt, Human
ucguagcuccccauugaacacaggugucauca

SEQ ID NO: 238455 - RNA, 19 nt, Human
ucguagcugccgccgagcc

SEQ ID NO: 238456 - RNA, 32 nt, Human
ucguaggggauggagugacagccucagccccc

SEQ ID NO: 238457 - RNA, 32 nt, Human
ucguagguagcccuguccucacuugagaagcc

SEQ ID NO: 238458 - RNA, 32 nt, Human
ucguaguagaagcagggagcggaagaagucuc

SEQ ID NO: 238459 - RNA, 32 nt, Human
ucguagucuccucuagauauuuugccauaaua

SEQ ID NO: 238460 - RNA, 32 nt, Human
ucguauacccauggaguguuguaggggccccu

SEQ ID NO: 238461 - RNA, 32 nt, Human
ucguauaugaaauguuccuuggcagcuggacu

SEQ ID NO: 238462 - RNA, 32 nt, Human
ucguaucaauggaaucaaacaguaaguggucc

SEQ ID NO: 238463 - RNA, 32 nt, Human
ucguauccaaguuagucccccuuauuccacug

SEQ ID NO: 238464 - RNA, 32 nt, Human
ucguaucucagguuuuucucuguuuuugagaa

SEQ ID NO: 238465 - RNA, 32 nt, Human
ucguaucuguaaucccagcacuuugagaggcc

SEQ ID NO: 238466 - RNA, 32 nt, Human
ucguaucuuuccaaagugcagacucuugugaa

SEQ ID NO: 238467 - RNA, 24 nt, Human
ucguaugaucaguacugacuuucu

SEQ ID NO: 238468 - RNA, 32 nt, Human
ucguaugcuugggaugggggccgugccacccg

SEQ ID NO: 238469 - RNA, 32 nt, Human
ucguauggggacucgggugaggguggcgagua

SEQ ID NO: 238470 - RNA, 32 nt, Human
ucguauuaguccauuuucacgcugcugauaaa

SEQ ID NO: 238471 - RNA, 32 nt, Human
ucguauucucuucaucccagucugauugcaua

SEQ ID NO: 238472 - RNA, 32 nt, Human
ucguauugugcacucaggcuuggccuguaaca

SEQ ID NO: 238473 - RNA, 32 nt, Human
ucguauuugcugcaucguaaugacaugaguac

SEQ ID NO: 238474 - RNA, 32 nt, Human
ucgucaagccuguaaucccaacacuuugggag

SEQ ID NO: 238475 - RNA, 32 nt, Human
ucgucaaggcgccaucgggggugcaggugcug

SEQ ID NO: 238476 - RNA, 32 nt, Human
ucgucaaggcucagagguaacaagacagaaaa

SEQ ID NO: 238477 - RNA, 32 nt, Human
ucgucacagcuggcaugggcuggacaguugcu

SEQ ID NO: 238478 - RNA, 32 nt, Human
ucgucaccaugauagcaccaucagccuuugac

SEQ ID NO: 238479 - RNA, 32 nt, Human
ucgucacccacauuggagugcagugguacgau

SEQ ID NO: 238480 - RNA, 32 nt, Human
ucgucacccagccugugaggguccugacugga

SEQ ID NO: 238481 - RNA, 32 nt, Human
ucgucacccaggcuggagugcaauugugcaau

SEQ ID NO: 238482 - RNA, 32 nt, Human
ucgucaccccagcuggagugcaguggugcgau

SEQ ID NO: 238483 - RNA, 32 nt, Human
ucgucacccugagcuuguuggcugcuaucuaa

SEQ ID NO: 238484 - RNA, 32 nt, Human
ucgucaccucgcguagaugaucagccccugau

SEQ ID NO: 238485 - RNA, 21 nt, Human
ucgucaccugacugcaaugag

SEQ ID NO: 238486 - RNA, 32 nt, Human
ucgucacgccuguaaucccagcacuuuagauc

SEQ ID NO: 238487 - RNA, 32 nt, Human
ucgucacgccuguaaucccagcacuuuggcag

SEQ ID NO: 238488 - RNA, 32 nt, Human
ucgucacgccuguaaucccagcacuuugggag

SEQ ID NO: 238489 - RNA, 32 nt, Human
ucgucacugagaccucaggccucugccagcca

SEQ ID NO: 238490 - RNA, 32 nt, Human
ucgucacuggguucaucagagcagugugugaa

SEQ ID NO: 238491 - RNA, 32 nt, Human
ucgucacuguggcuggggcucccuggacccgc

SEQ ID NO: 238492 - RNA, 32 nt, Human
ucgucacuuccagcuaccuguagggcagggcu

SEQ ID NO: 238493 - RNA, 32 nt, Human
ucgucagacuccugugcucuuccaggggcugc

SEQ ID NO: 238494 - RNA, 32 nt, Human
ucgucagccuaggccaucaugaugaagcccug

SEQ ID NO: 238495 - RNA, 32 nt, Human
ucgucagccuggguggcugggcccggcuuagg

SEQ ID NO: 238496 - RNA, 18 nt, Human
ucgucagcugcccugggc

SEQ ID NO: 238497 - RNA, 32 nt, Human
ucgucaggagguggagguugcagugagccaag

SEQ ID NO: 238498 - RNA, 32 nt, Human
ucgucaggaucuccggaggcugugucaugggc

SEQ ID NO: 238499 - RNA, 32 nt, Human
ucgucagugcuguggucucugcucuggcugug

SEQ ID NO: 238500 - RNA, 32 nt, Human
ucgucagugugaaaaugcccuugcugauaauu

SEQ ID NO: 238501 - RNA, 32 nt, Human
ucgucaguguugugcaggagaauccacuuaga

SEQ ID NO: 238502 - RNA, 32 nt, Human
ucgucauggaaaucccagcuaugcagcacuag

SEQ ID NO: 238503 - RNA, 32 nt, Human
ucgucauggauggcgggguccuggaggagcug

SEQ ID NO: 238504 - RNA, 32 nt, Human
ucgucauugcagcucucagcaaacugggucau

SEQ ID NO: 238505 - RNA, 32 nt, Human
ucguccaccucuccaaccucacauccuacuag

SEQ ID NO: 238506 - RNA, 32 nt, Human
ucguccagccacucuucagcacauuccuuuac

SEQ ID NO: 238507 - RNA, 32 nt, Human
ucguccagccagacugccucuugaaagauggc

SEQ ID NO: 238508 - RNA, 19 nt, Human
ucguccagccgccgggcca

SEQ ID NO: 238509 - RNA, 31 nt, Human
ucguccagccucucucugaacugugaucuuu

SEQ ID NO: 238510 - RNA, 20 nt, Human
ucguccaggcuggagugcag

SEQ ID NO: 238511 - RNA, 21 nt, Human
ucguccaggcuggagugcagu

SEQ ID NO: 238512 - RNA, 32 nt, Human
ucguccaggcuggagugcaguacgcaaucuug

SEQ ID NO: 238513 - RNA, 32 nt, Human
ucguccaggcuggagugcaguagcgcaaucuu

SEQ ID NO: 238514 - RNA, 22 nt, Human
ucguccaggcuggagugcagug

SEQ ID NO: 238515 - RNA, 32 nt, Human
ucguccaggcuggagugcagugcugcaaucuu

SEQ ID NO: 238516 - RNA, 32 nt, Human
ucguccaggcuggagugcaguggcgcaaucuc

SEQ ID NO: 238517 - RNA, 32 nt, Human
ucguccaggcuggagugcaguggcgccaucuc

SEQ ID NO: 238518 - RNA, 32 nt, Human
ucguccaggcuggagugcaguggcgcgaucuc

SEQ ID NO: 238519 - RNA, 32 nt, Human
ucguccaggcuggagugcagugguguggucuc

SEQ ID NO: 238520 - RNA, 32 nt, Human
ucguccaggcuggagugccguggcguaaucuc

SEQ ID NO: 238521 - RNA, 32 nt, Human
ucguccaggcuggagugcgguggcgugaucuc

SEQ ID NO: 238522 - RNA, 22 nt, Human
ucguccagguuagagugcaaug

SEQ ID NO: 238523 - RNA, 32 nt, Human
ucguccagguuagagugcaauggcuugaucuc

SEQ ID NO: 238524 - RNA, 32 nt, Human
ucguccaguagaaaugcaucuaugaggucagc

SEQ ID NO: 238525 - RNA, 32 nt, Human
ucguccagugccugaacccuuaccggaaaccu

SEQ ID NO: 238526 - RNA, 32 nt, Human
ucgucccaccuugcugucugucucauugucuu

SEQ ID NO: 238527 - RNA, 32 nt, Human
ucgucccacugcaccgccuggcugagggcguu

SEQ ID NO: 238528 - RNA, 32 nt, Human
ucgucccacugcacuccagcccgggcaacaga

SEQ ID NO: 238529 - RNA, 32 nt, Human
ucgucccacugcacuccagccugggcaacaga

SEQ ID NO: 238530 - RNA, 32 nt, Human
ucgucccacuggccucuguacauuucccugug

SEQ ID NO: 238531 - RNA, 32 nt, Human
ucgucccagcaacccaggaggcugagguagga

SEQ ID NO: 238532 - RNA, 32 nt, Human
ucgucccagcuacuagggaggcugaggcagga

SEQ ID NO: 238533 - RNA, 32 nt, Human
ucgucccagcuacucaggaggcugaggcagga

SEQ ID NO: 238534 - RNA, 32 nt, Human
ucgucccagguaaggagaguccuggucuuugu

SEQ ID NO: 238535 - RNA, 32 nt, Human
ucguccccaaguguuuccugacacgcaucuuu

SEQ ID NO: 238536 - RNA, 22 nt, Human
ucgucccggagcgccccgagcu

SEQ ID NO: 238537 - RNA, 21 nt, Human
ucgucccggcugaagugcagu

SEQ ID NO: 238538 - RNA, 32 nt, Human
ucgucccucguucuccccugaagugagucaua

SEQ ID NO: 238539 - RNA, 32 nt, Human
ucgucccuggcuagggaggugagacucuccgg

SEQ ID NO: 238540 - RNA, 32 nt, Human
ucgucccugggaggggagggaggcgcgccugg

SEQ ID NO: 238541 - RNA, 21 nt, Human
ucguccgcggggcccugggcu

SEQ ID NO: 238542 - RNA, 16 nt, Human
ucguccggccccggcc

SEQ ID NO: 238543 - RNA, 32 nt, Human
ucguccgugaggaaaaagaggcgaggcuuuuc

SEQ ID NO: 238544 - RNA, 32 nt, Human
ucguccguuuuccuccucagcucucgcugguu

SEQ ID NO: 238545 - RNA, 32 nt, Human
ucguccucaguucugcggagacagagucccca

SEQ ID NO: 238546 - RNA, 32 nt, Human
ucguccuccaaaagagcugggauuacaagugu

SEQ ID NO: 238547 - RNA, 32 nt, Human
ucguccucccaaaguacugggauuacaggcgu

SEQ ID NO: 238548 - RNA, 32 nt, Human
ucguccucccaaagugcugggauuacaggugu

SEQ ID NO: 238549 - RNA, 32 nt, Human
ucguccucccaaagugcugggauugaaggcgu

SEQ ID NO: 238550 - RNA, 32 nt, Human
ucguccuccccaugugcugggauuacaggcgu

SEQ ID NO: 238551 - RNA, 21 nt, Human
ucguccucugccccugagcca

SEQ ID NO: 238552 - RNA, 19 nt, Human
ucguccucuuccugggcua

SEQ ID NO: 238553 - RNA, 32 nt, Human
ucgucgaggcuggaguguaguggugcgauuuc

SEQ ID NO: 238554 - RNA, 32 nt, Human
ucgucgauuuacagaaaacagaaucaaaggcc

SEQ ID NO: 238555 - RNA, 32 nt, Human
ucgucgcccaggcuggaaugcaguggugcgau

SEQ ID NO: 238556 - RNA, 32 nt, Human
ucgucgcccccuucaccuuggaucauguucaa

SEQ ID NO: 238557 - RNA, 32 nt, Human
ucgucgccgcacgggcugguuggggcuguguc

SEQ ID NO: 238558 - RNA, 32 nt, Human
ucgucgccgccgccgccgcccagauccccgca

SEQ ID NO: 238559 - RNA, 21 nt, Human
ucgucgcgaccggcccgggcc

SEQ ID NO: 238560 - RNA, 32 nt, Human
ucgucgcugcuggcacuucaggcucugccucu

SEQ ID NO: 238561 - RNA, 32 nt, Human
ucgucgggaaucaggauuauugagaggugaag

SEQ ID NO: 238562 - RNA, 32 nt, Human
ucgucgguggcagaggugggcgugggugcugg

SEQ ID NO: 238563 - RNA, 20 nt, Human
ucgucguuggcucugagaca

SEQ ID NO: 238564 - RNA, 32 nt, Human
ucgucuaaaaauacaaaaauuagccgggcgug

SEQ ID NO: 238565 - RNA, 32 nt, Human
ucgucuaugaugacgucuucuuggucugggag

SEQ ID NO: 238566 - RNA, 32 nt, Human
ucgucucacccacucccagccuggggaagaag

SEQ ID NO: 238567 - RNA, 32 nt, Human
ucgucucacugcaaccuccgccucccagauuc

SEQ ID NO: 238568 - RNA, 23 nt, Human
ucgucucagaagccccuuuccca

SEQ ID NO: 238569 - RNA, 32 nt, Human
ucgucucagaucugguugugcucgagcuaugc

SEQ ID NO: 238570 - RNA, 32 nt, Human
ucgucucagccuguugguuucuccucauugcc

SEQ ID NO: 238571 - RNA, 32 nt, Human
ucgucuccccgcucugccccaccagggauacu

SEQ ID NO: 238572 - RNA, 32 nt, Human
ucgucuccccguuccaccuuguacugguuucc

SEQ ID NO: 238573 - RNA, 32 nt, Human
ucgucuccccuccugagaacaucaccgucaac

SEQ ID NO: 238574 - RNA, 32 nt, Human
ucgucucccuccccuucucuugcuguacagca

SEQ ID NO: 238575 - RNA, 32 nt, Human
ucgucucccuuucugggcagcuuccuugagga

SEQ ID NO: 238576 - RNA, 32 nt, Human
ucgucuccuccccuccuucuugucacuggcuu

SEQ ID NO: 238577 - RNA, 32 nt, Human
ucgucuccuccuccuucccacaggccggcuuc

SEQ ID NO: 238578 - RNA, 32 nt, Human
ucgucuccugucucucuggcugaugucaccug

SEQ ID NO: 238579 - RNA, 32 nt, Human
ucgucucuacuaaaaauacaaaauuagccggg

SEQ ID NO: 238580 - RNA, 32 nt, Human
ucgucucuacuaaaaaugcaaaauuagccggg

SEQ ID NO: 238581 - RNA, 32 nt, Human
ucgucucuacugaaaauucaaaauuagccugg

SEQ ID NO: 238582 - RNA, 28 nt, Human
ucgucucucaucccugccucaucuuccg

SEQ ID NO: 238583 - RNA, 32 nt, Human
ucgucucucccacccccuccccaaagccacug

SEQ ID NO: 238584 - RNA, 32 nt, Human
ucgucucuccugugcuguccucaggccuccgc

SEQ ID NO: 238585 - RNA, 32 nt, Human
ucgucucucugugugugucuguguccucaucu

SEQ ID NO: 238586 - RNA, 32 nt, Human
ucgucucugcaagcaugguuguccugggaugg

SEQ ID NO: 238587 - RNA, 32 nt, Human
ucgucucugcaagcuuggucgcccugggaugg

SEQ ID NO: 238588 - RNA, 32 nt, Human
ucgucucugcagcugccuaccccugccccaug

SEQ ID NO: 238589 - RNA, 32 nt, Human
ucgucugcccucaagcuggaaaacaaggggcu

SEQ ID NO: 238590 - RNA, 32 nt, Human
ucgucugcuacccuuauuaacucccauacugu

SEQ ID NO: 238591 - RNA, 32 nt, Human
ucgucuggcccaucuucugccucacaguggcc

SEQ ID NO: 238592 - RNA, 32 nt, Human
ucgucugggacucggcuggagcuggccuaggg

SEQ ID NO: 238593 - RNA, 32 nt, Human
ucgucugguagugcuggggugugucaggaccg

SEQ ID NO: 238594 - RNA, 32 nt, Human
ucgucuuagcuacuugggaggcugagguggga

SEQ ID NO: 238595 - RNA, 32 nt, Human
ucgucuucccuccagucuucugagggauaggg

SEQ ID NO: 238596 - RNA, 32 nt, Human
ucgucuugaugcucucugggcuuuguugaggc

SEQ ID NO: 238597 - RNA, 32 nt, Human
ucgucuuggugcuucuggccuccgugcucugc

SEQ ID NO: 238598 - RNA, 19 nt, Human
ucgucuuucgucgccccgu

SEQ ID NO: 238599 - RNA, 32 nt, Human
ucgugaaagacgccaucguaguagaagcaggg

SEQ ID NO: 238600 - RNA, 32 nt, Human
ucgugaaaggcagagggugacugugugugaug

SEQ ID NO: 238601 - RNA, 32 nt, Human
ucgugaacuucaaagggcagaggggaaacugu

SEQ ID NO: 238602 - RNA, 32 nt, Human
ucgugaagaaaaucuguucuuaauauauuuca

SEQ ID NO: 238603 - RNA, 32 nt, Human
ucgugaagaaaucuugagucuuccugcuccau

SEQ ID NO: 238604 - RNA, 32 nt, Human
ucgugaaggacuacaugaucaccaucacccgg

SEQ ID NO: 238605 - RNA, 32 nt, Human
ucgugaaggcauuacauugccucacauucacu

SEQ ID NO: 238606 - RNA, 32 nt, Human
ucgugaaguaauacagugaacuugcaggugca

SEQ ID NO: 238607 - RNA, 32 nt, Human
ucgugaaucuggagaagagcuggagaauggau

SEQ ID NO: 238608 - RNA, 32 nt, Human
ucgugaaucuggagccuguuuuccugaaaagu

SEQ ID NO: 238609 - RNA, 32 nt, Human
ucgugacacugcacuccagccugggcgacaga

SEQ ID NO: 238610 - RNA, 32 nt, Human
ucgugacacugcacuucagccuggcugacaga

SEQ ID NO: 238611 - RNA, 32 nt, Human
ucgugacaucuccggcgcggagggacucgaug

SEQ ID NO: 238612 - RNA, 32 nt, Human
ucgugacauggccuccagccugggugaccgag

SEQ ID NO: 238613 - RNA, 32 nt, Human
ucgugaccagccuggccaauauggugaaaccc

SEQ ID NO: 238614 - RNA, 32 nt, Human
ucgugaccagccuggucaacauggugaaaccu

SEQ ID NO: 238615 - RNA, 32 nt, Human
ucgugacuucaugauccugggccugagaacac

SEQ ID NO: 238616 - RNA, 32 nt, Human
ucgugacuucuggucuaagaugugagagcacc

SEQ ID NO: 238617 - RNA, 32 nt, Human
ucgugagagaucuggucguuuaaguguguagc

SEQ ID NO: 238618 - RNA, 32 nt, Human
ucgugaggccaaggcaggagaauugcuugagc

SEQ ID NO: 238619 - RNA, 22 nt, Human
ucgugaggugagcgugauccua

SEQ ID NO: 238620 - RNA, 23 nt, Human
ucgugaguagcugagauuacagg

SEQ ID NO: 238621 - RNA, 32 nt, Human
ucgugagugcagcccauguuccugcgugcagc

SEQ ID NO: 238622 - RNA, 32 nt, Human
ucgugaguggucagggaguggaagagaagacg

SEQ ID NO: 238623 - RNA, 21 nt, Human
ucgugauaaugcagacuuccu

SEQ ID NO: 238624 - RNA, 32 nt, Human
ucgugaucagccuggccaacguggagaaaccc

SEQ ID NO: 238625 - RNA, 32 nt, Human
ucgugauccacccuccuccaccucccaaagua

SEQ ID NO: 238626 - RNA, 32 nt, Human
ucgugaucucuccuucuccaucaucucaucuc

SEQ ID NO: 238627 - RNA, 32 nt, Human
ucgugaugaaggacggaagcagcagcgggccg

SEQ ID NO: 238628 - RNA, 32 nt, Human
ucgugaugaaggcagagagcagagacaucccg

SEQ ID NO: 238629 - RNA, 32 nt, Human
ucgugaugaucaggacacaagcucuuccccgc

SEQ ID NO: 238630 - RNA, 32 nt, Human
ucgugaugcuuugccaaacccgcacacugcca

SEQ ID NO: 238631 - RNA, 32 nt, Human
ucgugauggcgccacuucacugcagccugggu

SEQ ID NO: 238632 - RNA, 32 nt, Human
ucgugauguccugcccgccgggagucuuuccc

SEQ ID NO: 238633 - RNA, 32 nt, Human
ucgugauucaggagacugaagggaccuggugg

SEQ ID NO: 238634 - RNA, 32 nt, Human
ucgugauuucggccuauuuccuugccaggccu

SEQ ID NO: 238635 - RNA, 32 nt, Human
ucgugcaacugcacuccaaccugggcaacaga

SEQ ID NO: 238636 - RNA, 32 nt, Human
ucgugcaacugcacuccagccugggcaaaaga

SEQ ID NO: 238637 - RNA, 32 nt, Human
ucgugcagguagggaaaaaguuggucuaauug

SEQ ID NO: 238638 - RNA, 32 nt, Human
ucgugcaguaggccagugggcccagcggggag

SEQ ID NO: 238639 - RNA, 19 nt, Human
ucgugcaugcccugagcca

SEQ ID NO: 238640 - RNA, 32 nt, Human
ucgugcaugccugugauauucaucaucaaaau

SEQ ID NO: 238641 - RNA, 32 nt, Human
ucgugcauguaauccuagcacuuugggaggcu

SEQ ID NO: 238642 - RNA, 32 nt, Human
ucgugccaaugcacuccauccugggcaaaaag

SEQ ID NO: 238643 - RNA, 32 nt, Human
ucgugccaccgcagcgagacccugucuccaaa

SEQ ID NO: 238644 - RNA, 32 nt, Human
ucgugccaccuacacuccagccugggugacag

SEQ ID NO: 238645 - RNA, 32 nt, Human
ucgugccacgcacugcaaccugggugacagag

SEQ ID NO: 238646 - RNA, 32 nt, Human
ucgugccacuacacuccagccugggcaaaaga

SEQ ID NO: 238647 - RNA, 32 nt, Human
ucgugccacuacacuccagccugggggacaga

SEQ ID NO: 238648 - RNA, 32 nt, Human
ucgugccacuacacuccagccugggugacaga

SEQ ID NO: 238649 - RNA, 32 nt, Human
ucgugccacuccacuccagccugggcaacagu

SEQ ID NO: 238650 - RNA, 32 nt, Human
ucgugccacugaccuccagccugggggacaga

SEQ ID NO: 238651 - RNA, 32 nt, Human
ucgugccacugcacaccauccuggaugacaga

SEQ ID NO: 238652 - RNA, 32 nt, Human
ucgugccacugcaccacuccagccugggcaac

SEQ ID NO: 238653 - RNA, 32 nt, Human
ucgugccacugcaccccagccugggcaacaga

SEQ ID NO: 238654 - RNA, 32 nt, Human
ucgugccacugcaccguagccugggugauaag

SEQ ID NO: 238655 - RNA, 32 nt, Human
ucgugccacugcacgccagccugggcaacaga

SEQ ID NO: 238656 - RNA, 32 nt, Human
ucgugccacugcacuacaaccugggugauaga

SEQ ID NO: 238657 - RNA, 32 nt, Human
ucgugccacugcacucaagccugggugacaga

SEQ ID NO: 238658 - RNA, 32 nt, Human
ucgugccacugcacucaagccuggugacagag

SEQ ID NO: 238659 - RNA, 32 nt, Human
ucgugccacugcacuccaaccugagugacagc

SEQ ID NO: 238660 - RNA, 32 nt, Human
ucgugccacugcacuccaaccugggugagaga

SEQ ID NO: 238661 - RNA, 32 nt, Human
ucgugccacugcacuccagacugggggagaga

SEQ ID NO: 238662 - RNA, 32 nt, Human
ucgugccacugcacuccagacuuggugacaga

SEQ ID NO: 238663 - RNA, 32 nt, Human
ucgugccacugcacuccagagccugggcgaca

SEQ ID NO: 238664 - RNA, 32 nt, Human
ucgugccacugcacuccagcccaggcaacaga

SEQ ID NO: 238665 - RNA, 32 nt, Human
ucgugccacugcacuccagccugaagacagag

SEQ ID NO: 238666 - RNA, 32 nt, Human
ucgugccacugcacuccagccugagcaacaga

SEQ ID NO: 238667 - RNA, 32 nt, Human
ucgugccacugcacuccagccugcgggacaga

SEQ ID NO: 238668 - RNA, 32 nt, Human
ucgugccacugcacuccagccuggacaacgga

SEQ ID NO: 238669 - RNA, 32 nt, Human
ucgugccacugcacuccagccuggaggacaga

SEQ ID NO: 238670 - RNA, 32 nt, Human
ucgugccacugcacuccagccuggauuacaga

SEQ ID NO: 238671 - RNA, 32 nt, Human
ucgugccacugcacuccagccuggcgacacag

SEQ ID NO: 238672 - RNA, 32 nt, Human
ucgugccacugcacuccagccugggagacaga

SEQ ID NO: 238673 - RNA, 32 nt, Human
ucgugccacugcacuccagccugggcaacaag

SEQ ID NO: 238674 - RNA, 32 nt, Human
ucgugccacugcacuccagccugggcaacaga

SEQ ID NO: 238675 - RNA, 32 nt, Human
ucgugccacugcacuccagccugggcaccaca

SEQ ID NO: 238676 - RNA, 32 nt, Human
ucgugccacugcacuccagccugggcaccaga

SEQ ID NO: 238677 - RNA, 32 nt, Human
ucgugccacugcacuccagccugggcagcaga

SEQ ID NO: 238678 - RNA, 32 nt, Human
ucgugccacugcacuccagccugggccacaga

SEQ ID NO: 238679 - RNA, 32 nt, Human
ucgugccacugcacuccagccugggcgacaag

SEQ ID NO: 238680 - RNA, 32 nt, Human
ucgugccacugcacuccagccugggcgacaga

SEQ ID NO: 238681 - RNA, 32 nt, Human
ucgugccacugcacuccagccugggcgacgag

SEQ ID NO: 238682 - RNA, 32 nt, Human
ucgugccacugcacuccagccugggcuacaag

SEQ ID NO: 238683 - RNA, 32 nt, Human
ucgugccacugcacuccagccuggggaacaga

SEQ ID NO: 238684 - RNA, 32 nt, Human
ucgugccacugcacuccagccugggggacaga

SEQ ID NO: 238685 - RNA, 32 nt, Human
ucgugccacugcacuccagccugggugacaaa

SEQ ID NO: 238686 - RNA, 32 nt, Human
ucgugccacugcacuccagccugggugacaca

SEQ ID NO: 238687 - RNA, 32 nt, Human
ucgugccacugcacuccagccugggugacaga

SEQ ID NO: 238688 - RNA, 32 nt, Human
ucgugccacugcacuccagccugggugauaga

SEQ ID NO: 238689 - RNA, 32 nt, Human
ucgugccacugcacuccagccuggguggacag

SEQ ID NO: 238690 - RNA, 32 nt, Human
ucgugccacugcacuccagccuggucaacaga

SEQ ID NO: 238691 - RNA, 32 nt, Human
ucgugccacugcacuccagccuggugacagag

SEQ ID NO: 238692 - RNA, 32 nt, Human
ucgugccacugcacuccagccuggugagagca

SEQ ID NO: 238693 - RNA, 32 nt, Human
ucgugccacugcacuccagccugguugacaga

SEQ ID NO: 238694 - RNA, 32 nt, Human
ucgugccacugcacuccagccuugagacagag

SEQ ID NO: 238695 - RNA, 32 nt, Human
ucgugccacugcacuccagccuuggugacaga

SEQ ID NO: 238696 - RNA, 32 nt, Human
ucgugccacugcacuccagcuugggcaacaaa

SEQ ID NO: 238697 - RNA, 32 nt, Human
ucgugccacugcacuccaggcugggcgacaga

SEQ ID NO: 238698 - RNA, 32 nt, Human
ucgugccacugcacuccaggcugggugacaga

SEQ ID NO: 238699 - RNA, 32 nt, Human
ucgugccacugcacuccagucugggcaacaga

SEQ ID NO: 238700 - RNA, 32 nt, Human
ucgugccacugcacuccagucugggugacaga

SEQ ID NO: 238701 - RNA, 32 nt, Human
ucgugccacugcacuccauccuggacgacaga

SEQ ID NO: 238702 - RNA, 32 nt, Human
ucgugccacugcacucccagccugggcaacgg

SEQ ID NO: 238703 - RNA, 32 nt, Human
ucgugccacugcacuccggccugggugaugga

SEQ ID NO: 238704 - RNA, 32 nt, Human
ucgugccacugcacucuagccggggcgacaga

SEQ ID NO: 238705 - RNA, 32 nt, Human
ucgugccacugcacucuagccugggcgacaga

SEQ ID NO: 238706 - RNA, 32 nt, Human
ucgugccacugcacucuagccugggugacaga

SEQ ID NO: 238707 - RNA, 32 nt, Human
ucgugccacugcacucuauccuggguaacagc

SEQ ID NO: 238708 - RNA, 32 nt, Human
ucgugccacugcacuucagccugggugacaga

SEQ ID NO: 238709 - RNA, 32 nt, Human
ucgugccacugcaguccagccuaggcaacaga

SEQ ID NO: 238710 - RNA, 32 nt, Human
ucgugccacugcaugccagccugggcaacaag

SEQ ID NO: 238711 - RNA, 32 nt, Human
ucgugccacugcauuccagccugagcgacaga

SEQ ID NO: 238712 - RNA, 32 nt, Human
ucgugccacugcauuccagccugggagagaga

SEQ ID NO: 238713 - RNA, 32 nt, Human
ucgugccacugcauuccagccugggcgacaga

SEQ ID NO: 238714 - RNA, 32 nt, Human
ucgugccacugcauuccagccugggugacaga

SEQ ID NO: 238715 - RNA, 32 nt, Human
ucgugccacugcauuccagccugguugacaga

SEQ ID NO: 238716 - RNA, 32 nt, Human
ucgugccacugcgcuccagccugggugacaga

SEQ ID NO: 238717 - RNA, 32 nt, Human
ucgugccacugcgcuccagccuggguggcaga

SEQ ID NO: 238718 - RNA, 32 nt, Human
ucgugccacugcucuccagccugggugacaga

SEQ ID NO: 238719 - RNA, 32 nt, Human
ucgugccacuguacaucaccagccugggcgac

SEQ ID NO: 238720 - RNA, 32 nt, Human
ucgugccacuucacuccagccugggcaaaaga

SEQ ID NO: 238721 - RNA, 32 nt, Human
ucgugccagagcgguggccacagggcugaaug

SEQ ID NO: 238722 - RNA, 32 nt, Human
ucgugccagcaaggagccuacugucuggugug

SEQ ID NO: 238723 - RNA, 32 nt, Human
ucgugccagugcacuccagccugggugacagc

SEQ ID NO: 238724 - RNA, 32 nt, Human
ucgugccaucggacuccagccugggugaagga

SEQ ID NO: 238725 - RNA, 32 nt, Human
ucgugccauuacacuccagccugggcgaaagg

SEQ ID NO: 238726 - RNA, 32 nt, Human
ucgugccauuacacuccagccugggugacaga

SEQ ID NO: 238727 - RNA, 32 nt, Human
ucgugccauuccacuccagccugagcaacaca

SEQ ID NO: 238728 - RNA, 32 nt, Human
ucgugccauuccacuccagccugggcaacgag

SEQ ID NO: 238729 - RNA, 32 nt, Human
ucgugccauugcacuacagccugggcaacaag

SEQ ID NO: 238730 - RNA, 32 nt, Human
ucgugccauugcacuccagcccaggcgacaga

SEQ ID NO: 238731 - RNA, 32 nt, Human
ucgugccauugcacuccagcccggaugacaga

SEQ ID NO: 238732 - RNA, 32 nt, Human
ucgugccauugcacuccagccuaggcaacaag

SEQ ID NO: 238733 - RNA, 32 nt, Human
ucgugccauugcacuccagccuaggcaagaag

SEQ ID NO: 238734 - RNA, 32 nt, Human
ucgugccauugcacuccagccuaggcaauaag

SEQ ID NO: 238735 - RNA, 32 nt, Human
ucgugccauugcacuccagccuggaugacaag

SEQ ID NO: 238736 - RNA, 32 nt, Human
ucgugccauugcacuccagccuggccacagag

SEQ ID NO: 238737 - RNA, 32 nt, Human
ucgugccauugcacuccagccuggcgacaaga

SEQ ID NO: 238738 - RNA, 32 nt, Human
ucgugccauugcacuccagccuggcgacagag

SEQ ID NO: 238739 - RNA, 32 nt, Human
ucgugccauugcacuccagccugggcaacaag

SEQ ID NO: 238740 - RNA, 32 nt, Human
ucgugccauugcacuccagccugggcaacagg

SEQ ID NO: 238741 - RNA, 32 nt, Human
ucgugccauugcacuccagccugggcaauaga

SEQ ID NO: 238742 - RNA, 32 nt, Human
ucgugccauugcacuccagccugggcgacaag

SEQ ID NO: 238743 - RNA, 32 nt, Human
ucgugccauugcacuccagccugggugacaga

SEQ ID NO: 238744 - RNA, 32 nt, Human
ucgugccauugcacuccagccugggugacagu

SEQ ID NO: 238745 - RNA, 32 nt, Human
ucgugccauugcacuccagucugggagacaag

SEQ ID NO: 238746 - RNA, 32 nt, Human
ucgugccauugcacuccagucuggguaagaag

SEQ ID NO: 238747 - RNA, 32 nt, Human
ucgugccauugcacuccggccugggcaacaac

SEQ ID NO: 238748 - RNA, 32 nt, Human
ucgugccauugcacucuagccugggcaacaag

SEQ ID NO: 238749 - RNA, 32 nt, Human
ucgugccauugcauuccagccugggagacgga

SEQ ID NO: 238750 - RNA, 32 nt, Human
ucgugccauugcgcuccagccuaggugacaga

SEQ ID NO: 238751 - RNA, 32 nt, Human
ucgugccauugcgcuccagccugggcaacaag

SEQ ID NO: 238752 - RNA, 32 nt, Human
ucgugccauuguauuccagccucggcaacaca

SEQ ID NO: 238753 - RNA, 32 nt, Human
ucgugccauugugcuccagccugggcaacaag

SEQ ID NO: 238754 - RNA, 32 nt, Human
ucgugccauugugcuccagccugggcaacaga

SEQ ID NO: 238755 - RNA, 32 nt, Human
ucgugcccagccuguacccacaguggcagccc

SEQ ID NO: 238756 - RNA, 32 nt, Human
ucgugccccucagacuggggaagaguccaagg

SEQ ID NO: 238757 - RNA, 32 nt, Human
ucgugcccuccugguacaugggguuuuaagac

SEQ ID NO: 238758 - RNA, 32 nt, Human
ucgugcccucggucucuugccucggcaccugg

SEQ ID NO: 238759 - RNA, 32 nt, Human
ucgugcccugcaggccuggcccagccuggccc

SEQ ID NO: 238760 - RNA, 32 nt, Human
ucgugcccugcagggcuccagggcuauuugga

SEQ ID NO: 238761 - RNA, 32 nt, Human
ucgugccgcuaaauucuagccugggcaacaga

SEQ ID NO: 238762 - RNA, 32 nt, Human
ucgugccgcugcauccagccugagcaacagag

SEQ ID NO: 238763 - RNA, 32 nt, Human
ucgugccguuacucuccaaccuggacaacaag

SEQ ID NO: 238764 - RNA, 32 nt, Human
ucgugccguugcacuccagccugggcaacaag

SEQ ID NO: 238765 - RNA, 32 nt, Human
ucgugccguugcacuccagccugggcgacaag

SEQ ID NO: 238766 - RNA, 32 nt, Human
ucgugccuacaaucccagcacuuugggaggcc

SEQ ID NO: 238767 - RNA, 32 nt, Human
ucgugccucugcacuccaaccugggugaugga

SEQ ID NO: 238768 - RNA, 32 nt, Human
ucgugccugaaccccucucacagucuggcggg

SEQ ID NO: 238769 - RNA, 32 nt, Human
ucgugccugggguuccuuccucugugggcauc

SEQ ID NO: 238770 - RNA, 24 nt, Human
ucgugccuguaaucccagcacuuu

SEQ ID NO: 238771 - RNA, 32 nt, Human
ucgugccuguaaucccagcacuuugggaggcu

SEQ ID NO: 238772 - RNA, 32 nt, Human
ucgugccuguaaucccagcacuuugggagguc

SEQ ID NO: 238773 - RNA, 32 nt, Human
ucgugccuguaaucccagcucuuugggaggcc

SEQ ID NO: 238774 - RNA, 32 nt, Human
ucgugccuguacuguacuccagccugggaaac

SEQ ID NO: 238775 - RNA, 32 nt, Human
ucgugccugucaucccagcacuuugggaggcc

SEQ ID NO: 238776 - RNA, 32 nt, Human
ucgugccugucucucagucaaguuuucuuucc

SEQ ID NO: 238777 - RNA, 32 nt, Human
ucgugccugugaucccagcacuuugggaggcc

SEQ ID NO: 238778 - RNA, 32 nt, Human
ucgugccuuugcacuccagcguggaagacagu

SEQ ID NO: 238779 - RNA, 32 nt, Human
ucgugcgggcugacugucgcucugccuuugac

SEQ ID NO: 238780 - RNA, 32 nt, Human
ucgugcgggcugcgcuccuccugggugcuauu

SEQ ID NO: 238781 - RNA, 32 nt, Human
ucgugcuacugcacuccagccccagcugggug

SEQ ID NO: 238782 - RNA, 32 nt, Human
ucgugcuacugcacuccagccugggcaacaca

SEQ ID NO: 238783 - RNA, 32 nt, Human
ucgugcuacugcacuccagccugggggacaga

SEQ ID NO: 238784 - RNA, 32 nt, Human
ucgugcuacugcacuccagucugggugacaga

SEQ ID NO: 238785 - RNA, 32 nt, Human
ucgugcuacugcacucccgccugggugacaga

SEQ ID NO: 238786 - RNA, 32 nt, Human
ucgugcuacugcaguccagccugggcuacaga

SEQ ID NO: 238787 - RNA, 32 nt, Human
ucgugcuauugcacuccagccugggcgacaga

SEQ ID NO: 238788 - RNA, 32 nt, Human
ucgugcucagccguaucucagcaggaggacag

SEQ ID NO: 238789 - RNA, 32 nt, Human
ucgugcuccacuccagcauccaugaagcuggc

SEQ ID NO: 238790 - RNA, 32 nt, Human
ucgugcucuccaggaguccggagcaugguccu

SEQ ID NO: 238791 - RNA, 32 nt, Human
ucgugcucugcaacuucuucaauuccagaguu

SEQ ID NO: 238792 - RNA, 32 nt, Human
ucgugcugcugcaccccagccuagcgacagag

SEQ ID NO: 238793 - RNA, 32 nt, Human
ucgugcugcugcacuccagccugggcaauaga

SEQ ID NO: 238794 - RNA, 32 nt, Human
ucgugcuuguaaucccagcacuuugggaggcg

SEQ ID NO: 238795 - RNA, 32 nt, Human
ucgugcuuguugcccaggcuggagugcagugg

SEQ ID NO: 238796 - RNA, 32 nt, Human
ucguggaaauacugugguuggaggagauuucu

SEQ ID NO: 238797 - RNA, 32 nt, Human
ucguggaagucaccccauuuccccagccagac

SEQ ID NO: 238798 - RNA, 32 nt, Human
ucguggacagaagccagaguucagagaggauc

SEQ ID NO: 238799 - RNA, 32 nt, Human
ucguggacugugguugggggaggugggagcug

SEQ ID NO: 238800 - RNA, 32 nt, Human
ucguggacuucuaagaaagcgccauggccugu

SEQ ID NO: 238801 - RNA, 32 nt, Human
ucguggagaauuccgccugcaggaugacacga

SEQ ID NO: 238802 - RNA, 32 nt, Human
ucguggagacuggcuggaugcccugugcucua

SEQ ID NO: 238803 - RNA, 32 nt, Human
ucguggagagugaggcugugagaaggcagcuc

SEQ ID NO: 238804 - RNA, 32 nt, Human
ucguggagcugcggcggcugcacccaggccac

SEQ ID NO: 238805 - RNA, 32 nt, Human
ucguggaggagaaaguaccaacaccucugcag

SEQ ID NO: 238806 - RNA, 32 nt, Human
ucguggaggaggacaaggcaagaagauggguc

SEQ ID NO: 238807 - RNA, 32 nt, Human
ucguggaggccacguggucacugaccucauuu

SEQ ID NO: 238808 - RNA, 32 nt, Human
ucguggaguacaagccggacugugcugagguu

SEQ ID NO: 238809 - RNA, 32 nt, Human
ucguggauuccuuuccccuccaaagggcaaga

SEQ ID NO: 238810 - RNA, 32 nt, Human
ucguggcagcagcugcagcuguuucacaggcu

SEQ ID NO: 238811 - RNA, 32 nt, Human
ucguggcagcuuugacuguuggcauagccauu

SEQ ID NO: 238812 - RNA, 32 nt, Human
ucguggcauugcacucuagccugggcaaccaa

SEQ ID NO: 238813 - RNA, 32 nt, Human
ucguggcauuuccagaaccauggauucugccu

SEQ ID NO: 238814 - RNA, 24 nt, Human
ucguggccacaccucugccugccu

SEQ ID NO: 238815 - RNA, 32 nt, Human
ucguggccacugcaauccagccugggcgauag

SEQ ID NO: 238816 - RNA, 32 nt, Human
ucguggccagaacuugcugaggugaaggcaca

SEQ ID NO: 238817 - RNA, 32 nt, Human
ucguggccauccaccucugcucucccagaccc

SEQ ID NO: 238818 - RNA, 32 nt, Human
ucguggccccuccacggggcaggacgacccug

SEQ ID NO: 238819 - RNA, 32 nt, Human
ucguggccgucuggggccagagcuguggaccg

SEQ ID NO: 238820 - RNA, 32 nt, Human
ucguggccuccugguucacucugcugucugau

SEQ ID NO: 238821 - RNA, 32 nt, Human
ucguggccugcucucaggaagugggucaagcc

SEQ ID NO: 238822 - RNA, 32 nt, Human
ucguggcucacugaagccuccgcuuccugggu

SEQ ID NO: 238823 - RNA, 32 nt, Human
ucguggcucacugcagccuccaccuccugggc

SEQ ID NO: 238824 - RNA, 32 nt, Human
ucguggcucacugcagccuccaucucccgggg

SEQ ID NO: 238825 - RNA, 32 nt, Human
ucguggcugaggcuccacagggcugcaagugc

SEQ ID NO: 238826 - RNA, 32 nt, Human
ucguggcugccuggggugcucucugcgugaac

SEQ ID NO: 238827 - RNA, 32 nt, Human
ucguggcugggaacugcagggaggcucugaca

SEQ ID NO: 238828 - RNA, 32 nt, Human
ucgugggaccugagccucacggaggccaugcu

SEQ ID NO: 238829 - RNA, 32 nt, Human
ucgugggacgugucaaguugacuuuaaagccu

SEQ ID NO: 238830 - RNA, 32 nt, Human
ucgugggagaugaggucccaggguaaacagcg

SEQ ID NO: 238831 - RNA, 21 nt, Human
ucgugggccgcgcauggcccu

SEQ ID NO: 238832 - RNA, 24 nt, Human
ucguggggagagggaugcuauuua

SEQ ID NO: 238833 - RNA, 32 nt, Human
ucgugggggccgagccaagaccagucugcaaa

SEQ ID NO: 238834 - RNA, 32 nt, Human
ucgugggucucugagacccaaaaauggagagc

SEQ ID NO: 238835 - RNA, 23 nt, Human
ucgugggugcacccuggacccca

SEQ ID NO: 238836 - RNA, 32 nt, Human
ucgugguagcugggcuugcagggaacggagca

SEQ ID NO: 238837 - RNA, 32 nt, Human
ucguggucacugcacuccagccuggcuacaga

SEQ ID NO: 238838 - RNA, 32 nt, Human
ucguggucacugcuccagccucagccagggca

SEQ ID NO: 238839 - RNA, 32 nt, Human
ucguggucagcuccgaggaauguggcguccag

SEQ ID NO: 238840 - RNA, 32 nt, Human
ucguggucauuuccacagccucaaccacuguc

SEQ ID NO: 238841 - RNA, 32 nt, Human
ucgugguccucugcccacaccuccacgcacac

SEQ ID NO: 238842 - RNA, 32 nt, Human
ucguggugaauauuucagaccuaaagauccag

SEQ ID NO: 238843 - RNA, 32 nt, Human
ucgugguggcccauccucucucuccccuugga

SEQ ID NO: 238844 - RNA, 32 nt, Human
ucgugguggcccugucuugccugcuguccauc

SEQ ID NO: 238845 - RNA, 32 nt, Human
ucguggugggugcucaagacuggcauggacau

SEQ ID NO: 238846 - RNA, 32 nt, Human
ucguggugugccagagccugugugguccccug

SEQ ID NO: 238847 - RNA, 32 nt, Human
ucgugguuccugccuuucucauagauccccug

SEQ ID NO: 238848 - RNA, 32 nt, Human
ucguguacacagcagucuucagcccccuggaa

SEQ ID NO: 238849 - RNA, 32 nt, Human
ucguguagauugauucauucuucuucuagcau

SEQ ID NO: 238850 - RNA, 32 nt, Human
ucguguaugugguggagggacagccugccagc

SEQ ID NO: 238851 - RNA, 32 nt, Human
ucgugucacuacacuccaggcugggugacaga

SEQ ID NO: 238852 - RNA, 32 nt, Human
ucgugucacugcacuccagccggggcaacaga

SEQ ID NO: 238853 - RNA, 32 nt, Human
ucgugucacugcacuccagccuggcgacagag

SEQ ID NO: 238854 - RNA, 32 nt, Human
ucgugucacugcacuccagccugggcgacaga

SEQ ID NO: 238855 - RNA, 32 nt, Human
ucgugucacugcacuccagccugggugacaag

SEQ ID NO: 238856 - RNA, 32 nt, Human
ucgugucacugcacuccagccuggugacagag

SEQ ID NO: 238857 - RNA, 32 nt, Human
ucguguccagcgacagcuaggugguggaaucg

SEQ ID NO: 238858 - RNA, 32 nt, Human
ucguguccucauaugaaucaggaaaaggcagu

SEQ ID NO: 238859 - RNA, 32 nt, Human
ucguguccuggaucgccuucuucaccacggcc

SEQ ID NO: 238860 - RNA, 32 nt, Human
ucgugucucauuuugaacccagaucugaacag

SEQ ID NO: 238861 - RNA, 32 nt, Human
ucgugucucccaggagccauggaggcugugga

SEQ ID NO: 238862 - RNA, 32 nt, Human
ucgugucuggcccaaucucugugucaucauug

SEQ ID NO: 238863 - RNA, 32 nt, Human
ucgugugagccaaccccacccgcuccacccuu

SEQ ID NO: 238864 - RNA, 32 nt, Human
ucgugugaucccccugcuucagccucucaaac

SEQ ID NO: 238865 - RNA, 32 nt, Human
ucgugugccauggaucugaucuguaccaugac

SEQ ID NO: 238866 - RNA, 21 nt, Human
ucguguggcccuccccuccca

SEQ ID NO: 238867 - RNA, 24 nt, Human
ucguguggccgccaccuccgggaa

SEQ ID NO: 238868 - RNA, 32 nt, Human
ucgugugugguggcgcgugccuguaauccuag

SEQ ID NO: 238869 - RNA, 32 nt, Human
ucguguguguuuuaaacugguaggaaacuagg

SEQ ID NO: 238870 - RNA, 32 nt, Human
ucguguuaacaguuugaaauccuggccucccu

SEQ ID NO: 238871 - RNA, 32 nt, Human
ucguguuagucacucaaccucuuuggccuugu

SEQ ID NO: 238872 - RNA, 32 nt, Human
ucguguuaguccauuuucacgcugcugauaaa

SEQ ID NO: 238873 - RNA, 32 nt, Human
ucguguucaagcagcucccaugacaacuucca

SEQ ID NO: 238874 - RNA, 32 nt, Human
ucguguucugggaaggccugggugugugcaca

SEQ ID NO: 238875 - RNA, 32 nt, Human
ucguguucuugcugcaggaccugggcaagaaa

SEQ ID NO: 238876 - RNA, 32 nt, Human
ucguguugccccggcuggagugcaguggcgcu

SEQ ID NO: 238877 - RNA, 32 nt, Human
ucguguuguuacugucucaaguggaagcgccc

SEQ ID NO: 238878 - RNA, 32 nt, Human
ucguguuuccuaaaacaaagacuccaucauaa

SEQ ID NO: 238879 - RNA, 32 nt, Human
ucguguuugcuaugccaacuaguagaaccuuc

SEQ ID NO: 238880 - RNA, 32 nt, Human
ucguguuuugucaucagcaucuuuucuauuaa

SEQ ID NO: 238881 - RNA, 32 nt, Human
ucguuaacuuccaagaggagaagggcucgggg

SEQ ID NO: 238882 - RNA, 32 nt, Human
ucguuaagcccauggggagacuggggcugugg

SEQ ID NO: 238883 - RNA, 32 nt, Human
ucguuaauuuuccuuugucauuuccuuuguug

SEQ ID NO: 238884 - RNA, 32 nt, Human
ucguuacauguuuaguucauagaaucauuuaa

SEQ ID NO: 238885 - RNA, 32 nt, Human
ucguuacccaggguggagugcagugguagcga

SEQ ID NO: 238886 - RNA, 32 nt, Human
ucguuaccuugggaucugccaggcuggggugu

SEQ ID NO: 238887 - RNA, 32 nt, Human
ucguuacuaagcuuccugggagaaucaaauaa

SEQ ID NO: 238888 - RNA, 32 nt, Human
ucguuagagacagggauucaccauguuggccu

SEQ ID NO: 238889 - RNA, 32 nt, Human
ucguuagccugggaaaaucauucuuuuaaaca

SEQ ID NO: 238890 - RNA, 32 nt, Human
ucguuagggagagaggcccaggguggggacug

SEQ ID NO: 238891 - RNA, 32 nt, Human
ucguuaucucucaaguggccuccaauacccca

SEQ ID NO: 238892 - RNA, 32 nt, Human
ucguuauuaauagcacagcagaugugugcugc

SEQ ID NO: 238893 - RNA, 32 nt, Human
ucguucacauuccaggaguccaaaaagaagau

SEQ ID NO: 238894 - RNA, 32 nt, Human
ucguucaccuuggcucauggucuuccaggguu

SEQ ID NO: 238895 - RNA, 32 nt, Human
ucguucacugacugaguagcccccagggagug

SEQ ID NO: 238896 - RNA, 32 nt, Human
ucguucagagaccauuucugugccucaagaaa

SEQ ID NO: 238897 - RNA, 32 nt, Human
ucguucagccacacuuugaggauucucuucag

SEQ ID NO: 238898 - RNA, 32 nt, Human
ucguucaggugcaauucuucuuggucucagcu

SEQ ID NO: 238899 - RNA, 32 nt, Human
ucguuccaaggaggcucuucagucucacagau

SEQ ID NO: 238900 - RNA, 32 nt, Human
ucguuccaucacuuuauuccagcacuucucug

SEQ ID NO: 238901 - RNA, 32 nt, Human
ucguucccacagccuucaagcugcaguguuuu

SEQ ID NO: 238902 - RNA, 32 nt, Human
ucguuccccuccaucugauccccacacaggcu

SEQ ID NO: 238903 - RNA, 31 nt, Human
ucguucccuccccuggugccugugucugcag

SEQ ID NO: 238904 - RNA, 32 nt, Human
ucguucccugcucucugcuccccaaagacacu

SEQ ID NO: 238905 - RNA, 32 nt, Human
ucguuccuccaggauucccgcaguguugagga

SEQ ID NO: 238906 - RNA, 32 nt, Human
ucguucucaggaacaaaaccugaggcagcccu

SEQ ID NO: 238907 - RNA, 32 nt, Human
ucguucucccaaagugcugggauuacaggugu

SEQ ID NO: 238908 - RNA, 32 nt, Human
ucguucucccuuucccccucucuccagccccu

SEQ ID NO: 238909 - RNA, 32 nt, Human
ucguucugucgcuuagcuggagugcgguggcg

SEQ ID NO: 238910 - RNA, 32 nt, Human
ucguucuguggcccuggcuggaguucaguggu

SEQ ID NO: 238911 - RNA, 32 nt, Human
ucguucuugucccccaggcuugagugcaauga

SEQ ID NO: 238912 - RNA, 32 nt, Human
ucguugaggaaacccuugcauaggacuuccua

SEQ ID NO: 238913 - RNA, 32 nt, Human
ucguugaggagaaggaguaguaagcagaacua

SEQ ID NO: 238914 - RNA, 32 nt, Human
ucguugaugagaaaguucguaggagggaggaa

SEQ ID NO: 238915 - RNA, 32 nt, Human
ucguugccaaggcuggagugcaauggcacgau

SEQ ID NO: 238916 - RNA, 32 nt, Human
ucguugcccaggcuggagugcaauggcgcgau

SEQ ID NO: 238917 - RNA, 32 nt, Human
ucguugcccaggcuggagugcaguggcgcaau

SEQ ID NO: 238918 - RNA, 32 nt, Human
ucguugcccaggcuggaguguagaggcgagau

SEQ ID NO: 238919 - RNA, 32 nt, Human
ucguugccgaggcuggaguguaguagugugau

SEQ ID NO: 238920 - RNA, 18 nt, Human
ucguugcucagucaguca

SEQ ID NO: 238921 - RNA, 19 nt, Human
ucguugcucgucaccucca

SEQ ID NO: 238922 - RNA, 32 nt, Human
ucguugcuguuagagccucacguggaggaguc

SEQ ID NO: 238923 - RNA, 32 nt, Human
ucguuggcaacagcagaugugguuaagcuaau

SEQ ID NO: 238924 - RNA, 32 nt, Human
ucguuggucuggcccaaguuccugcccaugug

SEQ ID NO: 238925 - RNA, 32 nt, Human
ucguuggugagaagaacaguaucgcugacuuc

SEQ ID NO: 238926 - RNA, 32 nt, Human
ucguuguaaucagcaacauauucccaacagga

SEQ ID NO: 238927 - RNA, 18 nt, Human
ucguuguucucacggcca

SEQ ID NO: 238928 - RNA, 32 nt, Human
ucguuuauaaaaagcagaaggccagcaggaaa

SEQ ID NO: 238929 - RNA, 32 nt, Human
ucguuuccucauuuagcaccuaccuccuagag

SEQ ID NO: 238930 - RNA, 32 nt, Human
ucguuucuaaaccuaggggagaugcuaucuuu

SEQ ID NO: 238931 - RNA, 32 nt, Human
ucguuucuacuaaaaauacaaaauuagcuggg

SEQ ID NO: 238932 - RNA, 32 nt, Human
ucguuucugugccucugcacucacagguuccu

SEQ ID NO: 238933 - RNA, 32 nt, Human
ucguuugaacccaggaggcggagguugcagug

SEQ ID NO: 238934 - RNA, 32 nt, Human
ucguuugaacccaggaggcugagguugcagug

SEQ ID NO: 238935 - RNA, 32 nt, Human
ucguuugaauggaggagguguugagugagcaa

SEQ ID NO: 238936 - RNA, 32 nt, Human
ucguuugacuccaauaccugaaauucugacuu

SEQ ID NO: 238937 - RNA, 32 nt, Human
ucguuugagcccaggaggucaaggcugcagug

SEQ ID NO: 238938 - RNA, 32 nt, Human
ucguuugagcccaggaguugaagaccagccug

SEQ ID NO: 238939 - RNA, 32 nt, Human
ucguuugagcucaggagguugggucugcagug

SEQ ID NO: 238940 - RNA, 32 nt, Human
ucguuugcagccugucacuguaaggcacaaac

SEQ ID NO: 238941 - RNA, 32 nt, Human
ucguuuggcaggacacagagagguaggugaac

SEQ ID NO: 238942 - RNA, 32 nt, Human
ucguuuggcaggcacacacaguggcauaaauu

SEQ ID NO: 238943 - RNA, 32 nt, Human
ucguuugggaggaggaccugaagcuagacagg

SEQ ID NO: 238944 - RNA, 32 nt, Human
ucguuuuaaauggaaucggaagccgggcauag

SEQ ID NO: 238945 - RNA, 32 nt, Human
ucguuuugacccuuccaauaaggaaaggggag

SEQ ID NO: 238946 - RNA, 32 nt, Human
ucguuuuggaggaaacaaucucugccaccacc

SEQ ID NO: 238947 - RNA, 32 nt, Human
ucguuuuucuuagugugacaagaguucgaugu

SEQ ID NO: 238948 - RNA, 24 nt, Human
ucuaaaaaccaaaaccucuuugaa

SEQ ID NO: 238949 - RNA, 32 nt, Human
ucuaaaaagagcaaacccucccuaguccuggg

SEQ ID NO: 238950 - RNA, 32 nt, Human
ucuaaaacaaagucuaugcaaaccacuuaaaa

SEQ ID NO: 238951 - RNA, 32 nt, Human
ucuaaaacacaggcgcccuccuggugacagug

SEQ ID NO: 238952 - RNA, 32 nt, Human
ucuaaaacagcuucuacugggagauuaauuau

SEQ ID NO: 238953 - RNA, 32 nt, Human
ucuaaaacaugcuucucuauaggugcaaaguu

SEQ ID NO: 238954 - RNA, 32 nt, Human
ucuaaaacccacaggccaucagcagcuagagg

SEQ ID NO: 238955 - RNA, 32 nt, Human
ucuaaaacccuucauccaauggugcuaacccc

SEQ ID NO: 238956 - RNA, 32 nt, Human
ucuaaaacccuuggucuguguucucaacacac

SEQ ID NO: 238957 - RNA, 32 nt, Human
ucuaaaacuucuguugcuuuugccauuccaaa

SEQ ID NO: 238958 - RNA, 32 nt, Human
ucuaaaagagacaaaugaagccacagggaaag

SEQ ID NO: 238959 - RNA, 21 nt, Human
ucuaaaagagcaugaacaagu

SEQ ID NO: 238960 - RNA, 32 nt, Human
ucuaaaagcugagaaguccaagaugguggggc

SEQ ID NO: 238961 - RNA, 32 nt, Human
ucuaaaaggaggacagggagggaacagaccuc

SEQ ID NO: 238962 - RNA, 32 nt, Human
ucuaaaaggccucugugcccugacugauccuc

SEQ ID NO: 238963 - RNA, 32 nt, Human
ucuaaaagguaucgaaaguuaccaccuugcaa

SEQ ID NO: 238964 - RNA, 32 nt, Human
ucuaaaauagggggaggaaggaaggggaguaa

SEQ ID NO: 238965 - RNA, 32 nt, Human
ucuaaaauagugcuugcuuuaugauaggugcu

SEQ ID NO: 238966 - RNA, 32 nt, Human
ucuaaaauguauugugaauuucucagacaaac

SEQ ID NO: 238967 - RNA, 32 nt, Human
ucuaaacaacccagaauggucauuucaggcac

SEQ ID NO: 238968 - RNA, 32 nt, Human
ucuaaacagaaugagucuaaagucaguauaaa

SEQ ID NO: 238969 - RNA, 32 nt, Human
ucuaaacagauuccuccucuucucagagaccu

SEQ ID NO: 238970 - RNA, 32 nt, Human
ucuaaacagcaacaguguaacuagucuuuugu

SEQ ID NO: 238971 - RNA, 32 nt, Human
ucuaaacauagacacacacauauacagcucuc

SEQ ID NO: 238972 - RNA, 32 nt, Human
ucuaaacccgaagaugccucagaaggaagaaa

SEQ ID NO: 238973 - RNA, 32 nt, Human
ucuaaaccuaguuugaaaucaacagucuugag

SEQ ID NO: 238974 - RNA, 32 nt, Human
ucuaaaccucaaccuccuccuaccuggcaguc

SEQ ID NO: 238975 - RNA, 32 nt, Human
ucuaaaccucaguuuucacauuuguccaaugg

SEQ ID NO: 238976 - RNA, 32 nt, Human
ucuaaaccugcacuugucccucuccagcaaga

SEQ ID NO: 238977 - RNA, 32 nt, Human
ucuaaaccugcccagggaccuuaccagauucg

SEQ ID NO: 238978 - RNA, 32 nt, Human
ucuaaacugcccccucugcccugcgggucaca

SEQ ID NO: 238979 - RNA, 32 nt, Human
ucuaaacuuuaaaaucaguacauuuaauuuga

SEQ ID NO: 238980 - RNA, 32 nt, Human
ucuaaagaaaugcaguucuuggaguugaugag

SEQ ID NO: 238981 - RNA, 32 nt, Human
ucuaaagaaauguaagauguuacuagcacuag

SEQ ID NO: 238982 - RNA, 32 nt, Human
ucuaaagaagaaaaagaaaaacugaagagaga

SEQ ID NO: 238983 - RNA, 32 nt, Human
ucuaaagaaguuaaggauacauaguagggaau

SEQ ID NO: 238984 - RNA, 32 nt, Human
ucuaaagagaauugguuauggggaaaauaaca

SEQ ID NO: 238985 - RNA, 32 nt, Human
ucuaaagagagaagaauccagggaacagguag

SEQ ID NO: 238986 - RNA, 32 nt, Human
ucuaaagagagcaaucacuacacuuauggcug

SEQ ID NO: 238987 - RNA, 31 nt, Human
ucuaaagagcccucugggccuguguugcugu

SEQ ID NO: 238988 - RNA, 32 nt, Human
ucuaaagauagaguaaaaagaaaacaaaacca

SEQ ID NO: 238989 - RNA, 20 nt, Human
ucuaaagaugccucugggau

SEQ ID NO: 238990 - RNA, 32 nt, Human
ucuaaagauguagcucuggcccagugggaaaa

SEQ ID NO: 238991 - RNA, 32 nt, Human
ucuaaagaugucuuuauguuuccuucauuccc

SEQ ID NO: 238992 - RNA, 32 nt, Human
ucuaaagauucugccaaucugauucugcugcc

SEQ ID NO: 238993 - RNA, 32 nt, Human
ucuaaagauugaauccacauuuugucacuaau

SEQ ID NO: 238994 - RNA, 32 nt, Human
ucuaaagcacaagccaaaaacugugugaacgg

SEQ ID NO: 238995 - RNA, 31 nt, Human
ucuaaagcacuuuucauugaacauguuagcc

SEQ ID NO: 238996 - RNA, 32 nt, Human
ucuaaagcagcagcaauaguguucuuuuagau

SEQ ID NO: 238997 - RNA, 32 nt, Human
ucuaaagcagugguccagacuugccacauacu

SEQ ID NO: 238998 - RNA, 32 nt, Human
ucuaaagccccaggcuggguuagguggucuag

SEQ ID NO: 238999 - RNA, 32 nt, Human
ucuaaagccccuuccuccccagccccugcuuu

SEQ ID NO: 239000 - RNA, 32 nt, Human
ucuaaagccuggcuaauuguucuagguuuaug

SEQ ID NO: 239001 - RNA, 32 nt, Human
ucuaaagccuuuucgcauuuuaaucaguuuac

SEQ ID NO: 239002 - RNA, 32 nt, Human
ucuaaagcuacaacaaauacuacaggcccuua

SEQ ID NO: 239003 - RNA, 32 nt, Human
ucuaaagcuucuucacgucucucuccauccug

SEQ ID NO: 239004 - RNA, 32 nt, Human
ucuaaaggaauaaaccugauuuacagauuuug

SEQ ID NO: 239005 - RNA, 32 nt, Human
ucuaaaggcccagcuacagccaaucagccgau

SEQ ID NO: 239006 - RNA, 32 nt, Human
ucuaaaggggaggcauuaaaauucacugugcc

SEQ ID NO: 239007 - RNA, 32 nt, Human
ucuaaagguagaaugugaauauugccacagag

SEQ ID NO: 239008 - RNA, 32 nt, Human
ucuaaaggugccugucaucucagagagugacg

SEQ ID NO: 239009 - RNA, 32 nt, Human
ucuaaagucuuagaauuuucagugugcuuuac

SEQ ID NO: 239010 - RNA, 32 nt, Human
ucuaaaguucucuccuuccugccuccccuaaa

SEQ ID NO: 239011 - RNA, 24 nt, Human
ucuaaauaaguaccuuuuauugga

SEQ ID NO: 239012 - RNA, 32 nt, Human
ucuaaauagaugcagaaaaauggaauuuucuc

SEQ ID NO: 239013 - RNA, 32 nt, Human
ucuaaauggaaaggaaaguaacaugaagagcu

SEQ ID NO: 239014 - RNA, 32 nt, Human
ucuaaauggcuucccagccacugugaccaaau

SEQ ID NO: 239015 - RNA, 32 nt, Human
ucuaaaugucacugcugacauaacucccuugg

SEQ ID NO: 239016 - RNA, 32 nt, Human
ucuaaaugugaguucguguccucugccagacc

SEQ ID NO: 239017 - RNA, 22 nt, Human
ucuaaauguuacauucuugcca

SEQ ID NO: 239018 - RNA, 32 nt, Human
ucuaaauuaaugguuuaaauauacaaauugaa

SEQ ID NO: 239019 - RNA, 32 nt, Human
ucuaaauuuggcuaguaaagugcaauaaaggc

SEQ ID NO: 239020 - RNA, 32 nt, Human
ucuaaauuuguuuuagcucuaaccucaucaaa

SEQ ID NO: 239021 - RNA, 19 nt, Human
ucuaacaaaaagcacaaga

SEQ ID NO: 239022 - RNA, 18 nt, Human
ucuaacaaagccacauga

SEQ ID NO: 239023 - RNA, 18 nt, Human
ucuaacaaaucuguagua

SEQ ID NO: 239024 - RNA, 32 nt, Human
ucuaacaaaugaugugaaaggaaaguaguuuu

SEQ ID NO: 239025 - RNA, 18 nt, Human
ucuaacaaauggcauuga

SEQ ID NO: 239026 - RNA, 18 nt, Human
ucuaacaaauucagcaug

SEQ ID NO: 239027 - RNA, 32 nt, Human
ucuaacaaccuagacuggaauaaggcccuguc

SEQ ID NO: 239028 - RNA, 18 nt, Human
ucuaacaacugagcaaga

SEQ ID NO: 239029 - RNA, 32 nt, Human
ucuaacaacuguggagauuugagggaaugugu

SEQ ID NO: 239030 - RNA, 19 nt, Human
ucuaacaagaaagacaugg

SEQ ID NO: 239031 - RNA, 19 nt, Human
ucuaacaagagaaagcaga

SEQ ID NO: 239032 - RNA, 17 nt, Human
ucuaacaagccacauga

SEQ ID NO: 239033 - RNA, 32 nt, Human
ucuaacaaguugagcacagccuucuuccccuu

SEQ ID NO: 239034 - RNA, 32 nt, Human
ucuaacacauacgagucuucuggcucccccau

SEQ ID NO: 239035 - RNA, 32 nt, Human
ucuaacaccacacuccagcuacuguguagugg

SEQ ID NO: 239036 - RNA, 32 nt, Human
ucuaacaccaucacaaauagguucauggucag

SEQ ID NO: 239037 - RNA, 32 nt, Human
ucuaacaccucuuuucccuugugugagggcaa

SEQ ID NO: 239038 - RNA, 32 nt, Human
ucuaacacuccugggagcucaggaggcuucug

SEQ ID NO: 239039 - RNA, 32 nt, Human
ucuaacacugcaaagagugagccaugccuguu

SEQ ID NO: 239040 - RNA, 32 nt, Human
ucuaacacugccuuauacuguguuucucuuuu

SEQ ID NO: 239041 - RNA, 32 nt, Human
ucuaacacuggcauguucaaagccacauuauu

SEQ ID NO: 239042 - RNA, 17 nt, Human
ucuaacagaaagcauga

SEQ ID NO: 239043 - RNA, 32 nt, Human
ucuaacagagagagacauagucuugcucuguu

SEQ ID NO: 239044 - RNA, 32 nt, Human
ucuaacagaggacccuggcugucuacgggguu

SEQ ID NO: 239045 - RNA, 20 nt, Human
ucuaacagaucagaacauga

SEQ ID NO: 239046 - RNA, 19 nt, Human
ucuaacagaugccagcuga

SEQ ID NO: 239047 - RNA, 32 nt, Human
ucuaacaggagauaggagagagucacucauaa

SEQ ID NO: 239048 - RNA, 18 nt, Human
ucuaacagggccagcuga

SEQ ID NO: 239049 - RNA, 32 nt, Human
ucuaacauauguauuaagccaaacaugaguga

SEQ ID NO: 239050 - RNA, 32 nt, Human
ucuaacauccuggagaaaaauggcaguuugac

SEQ ID NO: 239051 - RNA, 32 nt, Human
ucuaacaugaaucacagcuucugccucauugg

SEQ ID NO: 239052 - RNA, 32 nt, Human
ucuaacaugcugaagaaaucaucugaggggga

SEQ ID NO: 239053 - RNA, 32 nt, Human
ucuaacauuuccugcucuaugccugcaucuuu

SEQ ID NO: 239054 - RNA, 32 nt, Human
ucuaaccaaagacaugccccacccuccuggag

SEQ ID NO: 239055 - RNA, 32 nt, Human
ucuaaccaaaguugacagacugugcgucuguc

SEQ ID NO: 239056 - RNA, 32 nt, Human
ucuaaccaagauaugcaaaagaugcauucagu

SEQ ID NO: 239057 - RNA, 32 nt, Human
ucuaaccaauugccuuuucuuguuaucugagc

SEQ ID NO: 239058 - RNA, 32 nt, Human
ucuaaccaauuugagccucugaagggagugcc

SEQ ID NO: 239059 - RNA, 32 nt, Human
ucuaaccaggcuggagccgaccccagacagac

SEQ ID NO: 239060 - RNA, 32 nt, Human
ucuaaccagugaucaggguaaagaggaugcgu

SEQ ID NO: 239061 - RNA, 32 nt, Human
ucuaaccauuuugcuuguuccuugauuuuuau

SEQ ID NO: 239062 - RNA, 32 nt, Human
ucuaacccggcucucccgaugugaaccgagcc

SEQ ID NO: 239063 - RNA, 32 nt, Human
ucuaacccucauugcugucuugccccaguuug

SEQ ID NO: 239064 - RNA, 32 nt, Human
ucuaacccuccccucccccuucccuucugguc

SEQ ID NO: 239065 - RNA, 32 nt, Human
ucuaacccuccuccagcccugcagccuccccu

SEQ ID NO: 239066 - RNA, 32 nt, Human
ucuaaccguaacacaaacacagcaaguuuuaa

SEQ ID NO: 239067 - RNA, 32 nt, Human
ucuaaccuaaccuuucccucugggguagagaa

SEQ ID NO: 239068 - RNA, 32 nt, Human
ucuaaccucagccaaacacagagcgggaguga

SEQ ID NO: 239069 - RNA, 32 nt, Human
ucuaaccugaaccagccuggcuuuucaaacac

SEQ ID NO: 239070 - RNA, 32 nt, Human
ucuaaccugacuggcacaucucagccuaacca

SEQ ID NO: 239071 - RNA, 24 nt, Human
ucuaaccugggcgacagagugaga

SEQ ID NO: 239072 - RNA, 32 nt, Human
ucuaaccuuccagaaucgcaaucccuucuccc

SEQ ID NO: 239073 - RNA, 32 nt, Human
ucuaaccuugauagaagaaccuuggguuacau

SEQ ID NO: 239074 - RNA, 32 nt, Human
ucuaacgaccagaguauugcccugccaccacu

SEQ ID NO: 239075 - RNA, 32 nt, Human
ucuaacgagccaagccaaaaagacugcaaugg

SEQ ID NO: 239076 - RNA, 32 nt, Human
ucuaacuaaccugguggggauguggagaaccu

SEQ ID NO: 239077 - RNA, 32 nt, Human
ucuaacuaguuuaaaaguacaggaaggaugau

SEQ ID NO: 239078 - RNA, 17 nt, Human
ucuaacuaugggacaag

SEQ ID NO: 239079 - RNA, 32 nt, Human
ucuaacucauauaauuuuucucagccaaucca

SEQ ID NO: 239080 - RNA, 19 nt, Human
ucuaacucaugccugucca

SEQ ID NO: 239081 - RNA, 32 nt, Human
ucuaacuccaugucugugguuucuuugaaccc

SEQ ID NO: 239082 - RNA, 23 nt, Human
ucuaacuccuggccucaagugau

SEQ ID NO: 239083 - RNA, 19 nt, Human
ucuaacuccugggcucaag

SEQ ID NO: 239084 - RNA, 32 nt, Human
ucuaacucugucucuucucucuuucccccaga

SEQ ID NO: 239085 - RNA, 31 nt, Human
ucuaacugacuucugcuuuccacggcgugug

SEQ ID NO: 239086 - RNA, 32 nt, Human
ucuaacugcucaacaggaaaugaaccuagaaa

SEQ ID NO: 239087 - RNA, 32 nt, Human
ucuaacugcucuggacugaaagugaugcauca

SEQ ID NO: 239088 - RNA, 32 nt, Human
ucuaacugcuuccccggacacccuccaccucu

SEQ ID NO: 239089 - RNA, 32 nt, Human
ucuaacuggacugcacguuggugacagcgucc

SEQ ID NO: 239090 - RNA, 32 nt, Human
ucuaacuggcagcugcuccaggggcugccagg

SEQ ID NO: 239091 - RNA, 32 nt, Human
ucuaacuguucuagugggaaugugggaaugga

SEQ ID NO: 239092 - RNA, 32 nt, Human
ucuaacuuaacauguugagucucugagagugc

SEQ ID NO: 239093 - RNA, 32 nt, Human
ucuaacuucucugaaaucaucuccuauuaagg

SEQ ID NO: 239094 - RNA, 32 nt, Human
ucuaacuugcugucugacucucucucagcucc

SEQ ID NO: 239095 - RNA, 32 nt, Human
ucuaacuuugcacaaauaaaccuguguagaaa

SEQ ID NO: 239096 - RNA, 32 nt, Human
ucuaagaaaugcugaaguaucggcauuacaug

SEQ ID NO: 239097 - RNA, 32 nt, Human
ucuaagaacaucugccaacagcuggguucaga

SEQ ID NO: 239098 - RNA, 32 nt, Human
ucuaagaagagaagacagggacacacaggaga

SEQ ID NO: 239099 - RNA, 22 nt, Human
ucuaagaagaggcugggugcag

SEQ ID NO: 239100 - RNA, 32 nt, Human
ucuaagacaaaucucucgggccuuuuauuuuu

SEQ ID NO: 239101 - RNA, 32 nt, Human
ucuaagacaggcuggaggaacagugcagacac

SEQ ID NO: 239102 - RNA, 32 nt, Human
ucuaagacccuccaccagcgucagagagacag

SEQ ID NO: 239103 - RNA, 32 nt, Human
ucuaagacccucccccaacagucugaccuugg

SEQ ID NO: 239104 - RNA, 32 nt, Human
ucuaagacucagcgagaggagcccgggaggag

SEQ ID NO: 239105 - RNA, 31 nt, Human
ucuaagaucauaaauacuaguggaaacucca

SEQ ID NO: 239106 - RNA, 32 nt, Human
ucuaagaucuuagauucucugugucuaagauu

SEQ ID NO: 239107 - RNA, 32 nt, Human
ucuaagauucaaggagcuuuucaguguuccac

SEQ ID NO: 239108 - RNA, 32 nt, Human
ucuaagcaaacaguccaaucagugagucauaa

SEQ ID NO: 239109 - RNA, 32 nt, Human
ucuaagcaagugaacucaucccuuguuuauaa

SEQ ID NO: 239110 - RNA, 32 nt, Human
ucuaagcaauccagcucaucagucuacuaguu

SEQ ID NO: 239111 - RNA, 32 nt, Human
ucuaagcaccaaucucccucugccaucagauu

SEQ ID NO: 239112 - RNA, 32 nt, Human
ucuaagcagcagcugagagagagcggagccua

SEQ ID NO: 239113 - RNA, 32 nt, Human
ucuaagcagucuggucaggaaccuugguuucu

SEQ ID NO: 239114 - RNA, 31 nt, Human
ucuaagcaguuucaucagcauuacuugggaa

SEQ ID NO: 239115 - RNA, 32 nt, Human
ucuaagcaucugcugguacaagucaauguggc

SEQ ID NO: 239116 - RNA, 32 nt, Human
ucuaagcauguggguucccccuuucugccagc

SEQ ID NO: 239117 - RNA, 32 nt, Human
ucuaagccaaggaaggcagagaauugcuggca

SEQ ID NO: 239118 - RNA, 32 nt, Human
ucuaagccacaaccccugucucaggucguuug

SEQ ID NO: 239119 - RNA, 32 nt, Human
ucuaagcccagccuaggaucugacacugaguc

SEQ ID NO: 239120 - RNA, 23 nt, Human
ucuaagccccuuucuccagggca

SEQ ID NO: 239121 - RNA, 32 nt, Human
ucuaagcccgggagguggagguugcagugagc

SEQ ID NO: 239122 - RNA, 32 nt, Human
ucuaagccuuucuaaucagcauuuaccuccca

SEQ ID NO: 239123 - RNA, 32 nt, Human
ucuaagcuacagccccucagccaaccacagac

SEQ ID NO: 239124 - RNA, 32 nt, Human
ucuaagcucuaugccagcauaucuucccugag

SEQ ID NO: 239125 - RNA, 32 nt, Human
ucuaagcucuucuucuuccuucauuggccucu

SEQ ID NO: 239126 - RNA, 32 nt, Human
ucuaagcuggacuuaccucuguggauucugaa

SEQ ID NO: 239127 - RNA, 32 nt, Human
ucuaagcuuucucuuccucccuuagggaauau

SEQ ID NO: 239128 - RNA, 32 nt, Human
ucuaaggacuccugagaauuccuguuacagua

SEQ ID NO: 239129 - RNA, 32 nt, Human
ucuaaggagauaauuuugccuuaaacagaaag

SEQ ID NO: 239130 - RNA, 32 nt, Human
ucuaaggagggcgcuggagcugauggaggugc

SEQ ID NO: 239131 - RNA, 32 nt, Human
ucuaaggaguagcaagucagugggaggacuuu

SEQ ID NO: 239132 - RNA, 18 nt, Human
ucuaaggagucucaggga

SEQ ID NO: 239133 - RNA, 23 nt, Human
ucuaaggauuuaaacagcuccac

SEQ ID NO: 239134 - RNA, 21 nt, Human
ucuaagggagcccucugcacu

SEQ ID NO: 239135 - RNA, 32 nt, Human
ucuaagggcugccuccccgccacuccuugucc

SEQ ID NO: 239136 - RNA, 32 nt, Human
ucuaaggguacaccucccuccaaacuacugca

SEQ ID NO: 239137 - RNA, 32 nt, Human
ucuaaggguagccauuauaagacuucaaaaga

SEQ ID NO: 239138 - RNA, 32 nt, Human
ucuaagguaauggcaagagcaaagguguggaa

SEQ ID NO: 239139 - RNA, 32 nt, Human
ucuaagguauuuuuagcccuugauccccuuug

SEQ ID NO: 239140 - RNA, 20 nt, Human
ucuaaggugacagagugaga

SEQ ID NO: 239141 - RNA, 32 nt, Human
ucuaaggugucauuucucccuccuggggugac

SEQ ID NO: 239142 - RNA, 32 nt, Human
ucuaaggugugucucuuuuccaaugagaaguc

SEQ ID NO: 239143 - RNA, 32 nt, Human
ucuaagguucuccuguuuucaccaucuauaau

SEQ ID NO: 239144 - RNA, 32 nt, Human
ucuaaguaagcaacagcaaggcuggucacagg

SEQ ID NO: 239145 - RNA, 22 nt, Human
ucuaaguacgucuguagcauga

SEQ ID NO: 239146 - RNA, 32 nt, Human
ucuaaguaucucagccuucauccauuaacucu

SEQ ID NO: 239147 - RNA, 32 nt, Human
ucuaaguccaggcagccugcaggcuggggacc

SEQ ID NO: 239148 - RNA, 32 nt, Human
ucuaagucuuugucccaccagggguugcagug

SEQ ID NO: 239149 - RNA, 32 nt, Human
ucuaaguggaaguucuuauagagaugcauuuc

SEQ ID NO: 239150 - RNA, 32 nt, Human
ucuaaguggacaaccaggcuccaggcugaugu

SEQ ID NO: 239151 - RNA, 32 nt, Human
ucuaaguguguauucuaugucugguuaaaugu

SEQ ID NO: 239152 - RNA, 32 nt, Human
ucuaaguuccucaagagaguccuuggcuuaaa

SEQ ID NO: 239153 - RNA, 32 nt, Human
ucuaaguuucaucacaaacuguguccaguuuc

SEQ ID NO: 239154 - RNA, 32 nt, Human
ucuaauaaaaauacaaaaauuagccaggcaug

SEQ ID NO: 239155 - RNA, 32 nt, Human
ucuaauaaaaauacaaaaauuagccaggcgug

SEQ ID NO: 239156 - RNA, 32 nt, Human
ucuaauaaaaauacaaaaauuagccgggcgug

SEQ ID NO: 239157 - RNA, 32 nt, Human
ucuaauaaaaauacgaaaaauuagcugggcau

SEQ ID NO: 239158 - RNA, 32 nt, Human
ucuaauaaguugaaauggucuuucucccuucc

SEQ ID NO: 239159 - RNA, 32 nt, Human
ucuaauaaucggguugggacuuaacuuuaagg

SEQ ID NO: 239160 - RNA, 32 nt, Human
ucuaauacaaauucacuugcggugucauucug

SEQ ID NO: 239161 - RNA, 32 nt, Human
ucuaauacaguauuuguugcauuuaaacaaac

SEQ ID NO: 239162 - RNA, 32 nt, Human
ucuaauaccaaagaggagguuuggcuuucugu

SEQ ID NO: 239163 - RNA, 32 nt, Human
ucuaauacuggcaucugggcucaaauugccau

SEQ ID NO: 239164 - RNA, 32 nt, Human
ucuaauagaguaagaauugaagaaaaguuaag

SEQ ID NO: 239165 - RNA, 32 nt, Human
ucuaauauuuugugaauuuaugacuuugccuu

SEQ ID NO: 239166 - RNA, 32 nt, Human
ucuaaucacaccacugcacuccagccugggca

SEQ ID NO: 239167 - RNA, 32 nt, Human
ucuaaucacaugcacuccuuuaccacagaggc

SEQ ID NO: 239168 - RNA, 32 nt, Human
ucuaaucagugagggugucaucagggaggacc

SEQ ID NO: 239169 - RNA, 32 nt, Human
ucuaauccaauacaaugcuaauaaaaugaaac

SEQ ID NO: 239170 - RNA, 32 nt, Human
ucuaaucccuuucugaguacucuggggcccug

SEQ ID NO: 239171 - RNA, 32 nt, Human
ucuaauccugcuucuacucucagcuuuaggac

SEQ ID NO: 239172 - RNA, 32 nt, Human
ucuaaucucaagucauuaggcugcaguagcau

SEQ ID NO: 239173 - RNA, 32 nt, Human
ucuaaucuccucuccaauucccacuccucaug

SEQ ID NO: 239174 - RNA, 32 nt, Human
ucuaaucucuucuguguuuuccuugccuuaac

SEQ ID NO: 239175 - RNA, 32 nt, Human
ucuaaucugcuucaguucauccuucuugcuac

SEQ ID NO: 239176 - RNA, 32 nt, Human
ucuaaucuuaaaggaauaaagcacugaauugg

SEQ ID NO: 239177 - RNA, 31 nt, Human
ucuaaugacaaaggaaguggugaucagucug

SEQ ID NO: 239178 - RNA, 32 nt, Human
ucuaaugaccagcucagccauuuaaaauauuu

SEQ ID NO: 239179 - RNA, 32 nt, Human
ucuaaugcacagaaauaauguuaaauagaaua

SEQ ID NO: 239180 - RNA, 32 nt, Human
ucuaaugccugaugaucugucacugucuccca

SEQ ID NO: 239181 - RNA, 32 nt, Human
ucuaaugcgagcagacagacccuguuaaccaa

SEQ ID NO: 239182 - RNA, 32 nt, Human
ucuaaugcucuucuucccacccuugaggcagc

SEQ ID NO: 239183 - RNA, 32 nt, Human
ucuaaugcugaagugacuuuugccagugccau

SEQ ID NO: 239184 - RNA, 32 nt, Human
ucuaauggaaaugaguagaauugcugaaaguc

SEQ ID NO: 239185 - RNA, 32 nt, Human
ucuaauggaauaugcguaguucccuggggccu

SEQ ID NO: 239186 - RNA, 32 nt, Human
ucuaauggccugguuaggcucaucucaucccu

SEQ ID NO: 239187 - RNA, 32 nt, Human
ucuaauggcucuuaauauauccuugaaaucgg

SEQ ID NO: 239188 - RNA, 32 nt, Human
ucuaaugggaccuuaaagaccaucugguauca

SEQ ID NO: 239189 - RNA, 32 nt, Human
ucuaaugggaguuggcuucugauucucauuca

SEQ ID NO: 239190 - RNA, 18 nt, Human
ucuaauguagcagcaugg

SEQ ID NO: 239191 - RNA, 32 nt, Human
ucuaauguuagcugugguuggaauugaccaag

SEQ ID NO: 239192 - RNA, 21 nt, Human
ucuaauguuauugcagcaugg

SEQ ID NO: 239193 - RNA, 32 nt, Human
ucuaauuaaaggcaccuucuuuacagcagggc

SEQ ID NO: 239194 - RNA, 32 nt, Human
ucuaauucaaagcucucucccaauauauuuac

SEQ ID NO: 239195 - RNA, 32 nt, Human
ucuaauucucagaacaacccugagagaaagau

SEQ ID NO: 239196 - RNA, 32 nt, Human
ucuaauucuuaauaaaacaaaugaguaucaua

SEQ ID NO: 239197 - RNA, 32 nt, Human
ucuaauugacauccuucucuucccaacuuuug

SEQ ID NO: 239198 - RNA, 32 nt, Human
ucuaauugcgccacugcacuccagccugagcg

SEQ ID NO: 239199 - RNA, 32 nt, Human
ucuaauuggcauguguaggcugcucugugacu

SEQ ID NO: 239200 - RNA, 32 nt, Human
ucuaauuguaacucaacacacauugagguaug

SEQ ID NO: 239201 - RNA, 32 nt, Human
ucuaauuuauacaaucauucuauacuuaaagg

SEQ ID NO: 239202 - RNA, 32 nt, Human
ucuaauuuauuuuucauuucagggggcaaaua

SEQ ID NO: 239203 - RNA, 32 nt, Human
ucuacaaaaacuacaaaaauuagccgggugug

SEQ ID NO: 239204 - RNA, 32 nt, Human
ucuacaaaaaguacaaaaauuagccgggcaug

SEQ ID NO: 239205 - RNA, 32 nt, Human
ucuacaaaaauaagaaaauuagccagguguag

SEQ ID NO: 239206 - RNA, 32 nt, Human
ucuacaaaaauacaaaaaucagccaggcgugg

SEQ ID NO: 239207 - RNA, 32 nt, Human
ucuacaaaaauacaaaaauuagccaggcguga

SEQ ID NO: 239208 - RNA, 32 nt, Human
ucuacaaaaauacaaaaauuagccaggcgugg

SEQ ID NO: 239209 - RNA, 32 nt, Human
ucuacaaaaauacaaaaauuagccaggugugg

SEQ ID NO: 239210 - RNA, 32 nt, Human
ucuacaaaaauacaaaaauuagccagguuugg

SEQ ID NO: 239211 - RNA, 32 nt, Human
ucuacaaaaauacaaaaauuagcugggcgugg

SEQ ID NO: 239212 - RNA, 32 nt, Human
ucuacaaaaauacaaaaauuaggccgggugcc

SEQ ID NO: 239213 - RNA, 32 nt, Human
ucuacaaaaauacaaaaauuaggugggugugg

SEQ ID NO: 239214 - RNA, 32 nt, Human
ucuacaaaaauacaaaacuuagcugggugugg

SEQ ID NO: 239215 - RNA, 32 nt, Human
ucuacaaaaauacaaaauuagccagguauggu

SEQ ID NO: 239216 - RNA, 32 nt, Human
ucuacaaaagagauuucuuucccuuuuauauu

SEQ ID NO: 239217 - RNA, 32 nt, Human
ucuacaaaaguacaaaaauuagccaggcgugg

SEQ ID NO: 239218 - RNA, 32 nt, Human
ucuacaaaauauacaaaaauuagccaggcaug

SEQ ID NO: 239219 - RNA, 32 nt, Human
ucuacaaacaauacaaaaauuagccaggcaug

SEQ ID NO: 239220 - RNA, 32 nt, Human
ucuacaaacauggucuagcuucugucucuccg

SEQ ID NO: 239221 - RNA, 32 nt, Human
ucuacaaauaaauaaaaauuagcugggcaauu

SEQ ID NO: 239222 - RNA, 32 nt, Human
ucuacaaaucuauaaaguuucuagggcauuga

SEQ ID NO: 239223 - RNA, 32 nt, Human
ucuacaacaacaaaaacguuccccuaagccac

SEQ ID NO: 239224 - RNA, 32 nt, Human
ucuacaacacagaguacugacucugccugguu

SEQ ID NO: 239225 - RNA, 32 nt, Human
ucuacaacugauugcaacagacuguugaguua

SEQ ID NO: 239226 - RNA, 32 nt, Human
ucuacaagaguaugcaccuggacucuccagug

SEQ ID NO: 239227 - RNA, 32 nt, Human
ucuacaagaguugugguuuuccaucugauccu

SEQ ID NO: 239228 - RNA, 32 nt, Human
ucuacaagccaagaagagaggccucaccagac

SEQ ID NO: 239229 - RNA, 32 nt, Human
ucuacaagccaaggacagagaccuggaacaga

SEQ ID NO: 239230 - RNA, 32 nt, Human
ucuacaagggcauguggcagcugcaguaugug

SEQ ID NO: 239231 - RNA, 32 nt, Human
ucuacaagggugcucagagaguuuggagcgaa

SEQ ID NO: 239232 - RNA, 27 nt, Human
ucuacaagugcccaggcucaggugcag

SEQ ID NO: 239233 - RNA, 32 nt, Human
ucuacaaugagcugugcugcagugcacggccg

SEQ ID NO: 239234 - RNA, 17 nt, Human
ucuacaauguuauuuua

SEQ ID NO: 239235 - RNA, 32 nt, Human
ucuacacacacagaggaugcuggauacuguau

SEQ ID NO: 239236 - RNA, 20 nt, Human
ucuacacauuaaucuacuua

SEQ ID NO: 239237 - RNA, 32 nt, Human
ucuacaccaucaucccuuuuucuuuuuauccu

SEQ ID NO: 239238 - RNA, 32 nt, Human
ucuacaccccaggauacuccagccuccagcug

SEQ ID NO: 239239 - RNA, 32 nt, Human
ucuacacccgagacacagggccccaggagaca

SEQ ID NO: 239240 - RNA, 21 nt, Human
ucuacaccuggaaauuuacuc

SEQ ID NO: 239241 - RNA, 32 nt, Human
ucuacacgggacugaagacagcucagaaguuu

SEQ ID NO: 239242 - RNA, 32 nt, Human
ucuacacuccaucacaggacauugagucccuc

SEQ ID NO: 239243 - RNA, 31 nt, Human
ucuacacugcaugucugacauugcagaguga

SEQ ID NO: 239244 - RNA, 32 nt, Human
ucuacacugccuccucucaccaaccaaauugu

SEQ ID NO: 239245 - RNA, 32 nt, Human
ucuacacugcuggugacuuucugcagugaaug

SEQ ID NO: 239246 - RNA, 32 nt, Human
ucuacagaaaaauuuuaaaauuagcugggcgu

SEQ ID NO: 239247 - RNA, 32 nt, Human
ucuacagaaacuaccaaaauuagccaggugug

SEQ ID NO: 239248 - RNA, 32 nt, Human
ucuacagaaaguuuuaaaauuagccaggugua

SEQ ID NO: 239249 - RNA, 32 nt, Human
ucuacagaacaaagaacggcaugugaauucug

SEQ ID NO: 239250 - RNA, 32 nt, Human
ucuacagaccacacucuaguuguuuuccauga

SEQ ID NO: 239251 - RNA, 32 nt, Human
ucuacagacucaggaagccccagcugacauuc

SEQ ID NO: 239252 - RNA, 32 nt, Human
ucuacagacucugcugucgcuggcuuccuaga

SEQ ID NO: 239253 - RNA, 32 nt, Human
ucuacagauaaaucuacagagacaauuccuca

SEQ ID NO: 239254 - RNA, 32 nt, Human
ucuacagaugcaugaggguuggaagagucugg

SEQ ID NO: 239255 - RNA, 32 nt, Human
ucuacagauucuaggaauucucuccccugaaa

SEQ ID NO: 239256 - RNA, 32 nt, Human
ucuacagcacagauucacuggcugggucucca

SEQ ID NO: 239257 - RNA, 32 nt, Human
ucuacagcauucucucccaccuacguccugcu

SEQ ID NO: 239258 - RNA, 32 nt, Human
ucuacagcauuuucuuacacccccuccccagc

SEQ ID NO: 239259 - RNA, 32 nt, Human
ucuacagccaggaaguggggauucugccagug

SEQ ID NO: 239260 - RNA, 32 nt, Human
ucuacagcccuuccucugcauguggccacagg

SEQ ID NO: 239261 - RNA, 32 nt, Human
ucuacagcgacaaggccggccugugcguggug

SEQ ID NO: 239262 - RNA, 32 nt, Human
ucuacagcgaccuguaccugaccguaugcgag

SEQ ID NO: 239263 - RNA, 32 nt, Human
ucuacagcgugugugccuucuguaccaucccc

SEQ ID NO: 239264 - RNA, 19 nt, Human
ucuacagcucccagcauga

SEQ ID NO: 239265 - RNA, 32 nt, Human
ucuacagcugcggaggauggcagguggcaucu

SEQ ID NO: 239266 - RNA, 32 nt, Human
ucuacagcuuuucauguaaauuagucuugguu

SEQ ID NO: 239267 - RNA, 32 nt, Human
ucuacaggagaggaggaaaacaccugggaugc

SEQ ID NO: 239268 - RNA, 32 nt, Human
ucuacaggcccaaccucugccucaugggggcu

SEQ ID NO: 239269 - RNA, 32 nt, Human
ucuacaggguucccuaggccagguggagauga

SEQ ID NO: 239270 - RNA, 32 nt, Human
ucuacagucaacugaagacuacccaaaggagc

SEQ ID NO: 239271 - RNA, 32 nt, Human
ucuacagucccaacgucugccucacagcagau

SEQ ID NO: 239272 - RNA, 32 nt, Human
ucuacaguccucccgggcugccagcccugacu

SEQ ID NO: 239273 - RNA, 32 nt, Human
ucuacaguuauucaaaugagagucacgcuuuu

SEQ ID NO: 239274 - RNA, 21 nt, Human
ucuacauaaaauaaaucuacu

SEQ ID NO: 239275 - RNA, 32 nt, Human
ucuacauagaaaacaugcaguaccuucuuauu

SEQ ID NO: 239276 - RNA, 32 nt, Human
ucuacauagccccagcuugggguccaauccau

SEQ ID NO: 239277 - RNA, 17 nt, Human
ucuacauaguuauucua

SEQ ID NO: 239278 - RNA, 32 nt, Human
ucuacaucagccuuagucauuauggauaguaa

SEQ ID NO: 239279 - RNA, 32 nt, Human
ucuacauccaucaagagagacagagcgcacaa

SEQ ID NO: 239280 - RNA, 32 nt, Human
ucuacaucccaggaggaugcaccaaguugcuc

SEQ ID NO: 239281 - RNA, 22 nt, Human
ucuacauccccuucccccuccu

SEQ ID NO: 239282 - RNA, 32 nt, Human
ucuacaucugcaaccucgcgcccaaggacagc

SEQ ID NO: 239283 - RNA, 32 nt, Human
ucuacaucugcagaaccaggugauugauccuc

SEQ ID NO: 239284 - RNA, 32 nt, Human
ucuacaucugcagcuugagguuagccucauau

SEQ ID NO: 239285 - RNA, 32 nt, Human
ucuacaucuggcaaaagccaaagguuuggaag

SEQ ID NO: 239286 - RNA, 32 nt, Human
ucuacaugaaguuuacagauugguaaauauca

SEQ ID NO: 239287 - RNA, 32 nt, Human
ucuacaugccaugaccuuccuccuccucuuca

SEQ ID NO: 239288 - RNA, 32 nt, Human
ucuacauggaaagaaguuauagaaucuucaua

SEQ ID NO: 239289 - RNA, 32 nt, Human
ucuacauggggcugcugaucuaugccaugugg

SEQ ID NO: 239290 - RNA, 32 nt, Human
ucuacauguaguagagguguaugaagaucaua

SEQ ID NO: 239291 - RNA, 32 nt, Human
ucuacaugugcuuaaaaacaaaaagaaaccua

SEQ ID NO: 239292 - RNA, 32 nt, Human
ucuacauugggcggaagucugugugcacagag

SEQ ID NO: 239293 - RNA, 32 nt, Human
ucuaccaaaaauaaaaauaaaaauuauccagg

SEQ ID NO: 239294 - RNA, 32 nt, Human
ucuaccaaaaauacaaaaauuagccagacgug

SEQ ID NO: 239295 - RNA, 32 nt, Human
ucuaccaaaaauacaaaaauuagccaggcaua

SEQ ID NO: 239296 - RNA, 32 nt, Human
ucuaccaaaaauacaaaaauuagccaggcgug

SEQ ID NO: 239297 - RNA, 32 nt, Human
ucuaccaaaaauacaaaaauuagccgggcgug

SEQ ID NO: 239298 - RNA, 32 nt, Human
ucuaccaaaaauacaaaaauuagccgggugug

SEQ ID NO: 239299 - RNA, 32 nt, Human
ucuaccaaaaauacaaaaauuagcuagacaua

SEQ ID NO: 239300 - RNA, 32 nt, Human
ucuaccaaaaauacaggaaauuaucugggcau

SEQ ID NO: 239301 - RNA, 32 nt, Human
ucuaccaaaacuacaaaaauuagccgggcuca

SEQ ID NO: 239302 - RNA, 32 nt, Human
ucuaccaaaauacaaaaauuagccgggcauga

SEQ ID NO: 239303 - RNA, 32 nt, Human
ucuaccaagccacuccaagagccagccccuuu

SEQ ID NO: 239304 - RNA, 32 nt, Human
ucuaccaaggcccuguuagugcacugauuaua

SEQ ID NO: 239305 - RNA, 32 nt, Human
ucuaccaaguccuggagaugaagggaauucac

SEQ ID NO: 239306 - RNA, 32 nt, Human
ucuaccaauauacaaaaauuagccgggcauga

SEQ ID NO: 239307 - RNA, 32 nt, Human
ucuaccaaugggcaauagagguugagagagau

SEQ ID NO: 239308 - RNA, 32 nt, Human
ucuaccaauucuucaaccagaaaaaccuauug

SEQ ID NO: 239309 - RNA, 32 nt, Human
ucuaccacaauccuccuccuccucuccagggg

SEQ ID NO: 239310 - RNA, 32 nt, Human
ucuaccaccaccacagcaccccagacagcuag

SEQ ID NO: 239311 - RNA, 32 nt, Human
ucuaccacccaggcuggagugcagugguguga

SEQ ID NO: 239312 - RNA, 32 nt, Human
ucuaccacuuuugcaaaaagagaggacccgug

SEQ ID NO: 239313 - RNA, 32 nt, Human
ucuaccagaagccagaaucacagaacagucuc

SEQ ID NO: 239314 - RNA, 32 nt, Human
ucuaccagaucacuccuucacccuccauaaag

SEQ ID NO: 239315 - RNA, 32 nt, Human
ucuaccagcagagaagagaguggcccauucgg

SEQ ID NO: 239316 - RNA, 32 nt, Human
ucuaccaggcagccgagaacagggagauaaac

SEQ ID NO: 239317 - RNA, 32 nt, Human
ucuaccaugagcaauucuccugccucagccuc

SEQ ID NO: 239318 - RNA, 32 nt, Human
ucuaccauggagaagagcaggaagggauacac

SEQ ID NO: 239319 - RNA, 32 nt, Human
ucuaccauguauuguacauaugacuuuaugua

SEQ ID NO: 239320 - RNA, 32 nt, Human
ucuaccauguccaguggaguucagagaucguu

SEQ ID NO: 239321 - RNA, 32 nt, Human
ucuaccaugugauuuccagacuauuggaagug

SEQ ID NO: 239322 - RNA, 32 nt, Human
ucuaccauuucugccacugguguucagcuccu

SEQ ID NO: 239323 - RNA, 32 nt, Human
ucuacccaaagcucugucccccugcucccacu

SEQ ID NO: 239324 - RNA, 32 nt, Human
ucuacccaaagucacuguaacaguuaagugug

SEQ ID NO: 239325 - RNA, 32 nt, Human
ucuacccagauccuuuuucauuuccuuaaguu

SEQ ID NO: 239326 - RNA, 32 nt, Human
ucuacccagcaacuuuccgugcuuuguucccc

SEQ ID NO: 239327 - RNA, 32 nt, Human
ucuacccagcgaggaggaggcggggagagaaa

SEQ ID NO: 239328 - RNA, 32 nt, Human
ucuacccauaccucagccucaggcgaguggcu

SEQ ID NO: 239329 - RNA, 32 nt, Human
ucuacccaucucccaguugcauaguacagugu

SEQ ID NO: 239330 - RNA, 32 nt, Human
ucuacccaucucugcugcuccagcucauaaag

SEQ ID NO: 239331 - RNA, 32 nt, Human
ucuaccccacugcuuccuucugcuccaggccu

SEQ ID NO: 239332 - RNA, 32 nt, Human
ucuaccccagggagaacucgccagagacugag

SEQ ID NO: 239333 - RNA, 24 nt, Human
ucuaccccccaggcugaagugcag

SEQ ID NO: 239334 - RNA, 31 nt, Human
ucuacccccuaaaaauagaaagauuagcaag

SEQ ID NO: 239335 - RNA, 32 nt, Human
ucuaccccucauuucacgcucaaggagucaua

SEQ ID NO: 239336 - RNA, 32 nt, Human
ucuaccccucccggcccugccugcuggugggc

SEQ ID NO: 239337 - RNA, 32 nt, Human
ucuaccccucuggaugccccagucuccucucc

SEQ ID NO: 239338 - RNA, 32 nt, Human
ucuacccgccacugcauuccacagccuguaga

SEQ ID NO: 239339 - RNA, 32 nt, Human
ucuacccggaggagaaagaggcuuccgggcug

SEQ ID NO: 239340 - RNA, 32 nt, Human
ucuacccucagugcaagaccagugccagaugu

SEQ ID NO: 239341 - RNA, 18 nt, Human
ucuacccuccccaagaaa

SEQ ID NO: 239342 - RNA, 32 nt, Human
ucuacccucugccucucaccaggagacacucu

SEQ ID NO: 239343 - RNA, 32 nt, Human
ucuacccugcagcagcagcagccgugauacac

SEQ ID NO: 239344 - RNA, 32 nt, Human
ucuacccugccuggccacuugcuguuucuuca

SEQ ID NO: 239345 - RNA, 32 nt, Human
ucuacccugcucugcaccugugcucgacugcc

SEQ ID NO: 239346 - RNA, 32 nt, Human
ucuacccuguggaggcugaggggucgggggaa

SEQ ID NO: 239347 - RNA, 32 nt, Human
ucuacccuuaccuuucccagcagcaaguucag

SEQ ID NO: 239348 - RNA, 32 nt, Human
ucuaccgacccuguuggcaagucuguaccugu

SEQ ID NO: 239349 - RNA, 32 nt, Human
ucuaccggcauuaagaggcauuccgucuugga

SEQ ID NO: 239350 - RNA, 32 nt, Human
ucuaccgucccucugucugucuuuggaaguau

SEQ ID NO: 239351 - RNA, 32 nt, Human
ucuaccguuggcucuggcagggccaggagaca

SEQ ID NO: 239352 - RNA, 32 nt, Human
ucuaccuagcgcugcaggcuccugggcgauug

SEQ ID NO: 239353 - RNA, 32 nt, Human
ucuaccuaucaucugucuauuuuucugucuau

SEQ ID NO: 239354 - RNA, 32 nt, Human
ucuaccucacugccaccacuccugcuuuuagg

SEQ ID NO: 239355 - RNA, 32 nt, Human
ucuaccuccacccugcauuuuccucuuguccu

SEQ ID NO: 239356 - RNA, 32 nt, Human
ucuaccucccaaagugcugggauuacagacau

SEQ ID NO: 239357 - RNA, 32 nt, Human
ucuaccucccaaagugcugggauuacaggcau

SEQ ID NO: 239358 - RNA, 32 nt, Human
ucuaccucccaaagugcugggauuacagucgu

SEQ ID NO: 239359 - RNA, 32 nt, Human
ucuaccuccuccuaucuggaaucuaggccuaa

SEQ ID NO: 239360 - RNA, 32 nt, Human
ucuaccuccucuuccuccaucuuuggcucuuu

SEQ ID NO: 239361 - RNA, 32 nt, Human
ucuaccucgcacugaacucacagucuauuucc

SEQ ID NO: 239362 - RNA, 32 nt, Human
ucuaccucugaagcgcccuccugggcccugcu

SEQ ID NO: 239363 - RNA, 32 nt, Human
ucuaccucuggcugaaggaguggugcagucaa

SEQ ID NO: 239364 - RNA, 32 nt, Human
ucuaccucugggagaaaaaugacaaauagcaa

SEQ ID NO: 239365 - RNA, 32 nt, Human
ucuaccugacccccucuccucacuggccuggg

SEQ ID NO: 239366 - RNA, 32 nt, Human
ucuaccugccucaagaaggggcucagagcaga

SEQ ID NO: 239367 - RNA, 32 nt, Human
ucuaccugcucacucagaaucauuucugcacc

SEQ ID NO: 239368 - RNA, 32 nt, Human
ucuaccugcuccacccucaauccaccagaacc

SEQ ID NO: 239369 - RNA, 32 nt, Human
ucuaccugcucuguccucuuccuugccagaug

SEQ ID NO: 239370 - RNA, 32 nt, Human
ucuaccuggaaccucggaaugugcuuuauuug

SEQ ID NO: 239371 - RNA, 32 nt, Human
ucuaccuggcaaagcuuuuggauuucaaagcu

SEQ ID NO: 239372 - RNA, 32 nt, Human
ucuaccuggcagcagacugugcaggagcccca

SEQ ID NO: 239373 - RNA, 32 nt, Human
ucuaccugguauauccuauugucucuucugaa

SEQ ID NO: 239374 - RNA, 32 nt, Human
ucuaccuguaggaucagggucuaagcaccuug

SEQ ID NO: 239375 - RNA, 32 nt, Human
ucuaccugucaggaugacuccaggaagacagc

SEQ ID NO: 239376 - RNA, 32 nt, Human
ucuaccuugggacuggggucuccugggaacau

SEQ ID NO: 239377 - RNA, 32 nt, Human
ucuaccuugggugacagagagacggugucuca

SEQ ID NO: 239378 - RNA, 32 nt, Human
ucuaccuuuauugcaguuccccaaaucgccua

SEQ ID NO: 239379 - RNA, 32 nt, Human
ucuaccuuucaucuauuucucucccucccucc

SEQ ID NO: 239380 - RNA, 32 nt, Human
ucuaccuuugacacuccagcaugcuagugaau

SEQ ID NO: 239381 - RNA, 32 nt, Human
ucuacgaaaaacacagaaagauuagccaggca

SEQ ID NO: 239382 - RNA, 32 nt, Human
ucuacgaaaaauacaaaauuagccagauguga

SEQ ID NO: 239383 - RNA, 32 nt, Human
ucuacgaaaaauagaaaaauuagccagacgug

SEQ ID NO: 239384 - RNA, 32 nt, Human
ucuacgauggaagugauuuccuguacuucagc

SEQ ID NO: 239385 - RNA, 32 nt, Human
ucuacgccaauguuaugccagcuccauguucu

SEQ ID NO: 239386 - RNA, 32 nt, Human
ucuacgccacaucacuuaggugcuaagagaug

SEQ ID NO: 239387 - RNA, 32 nt, Human
ucuacgcuccagguggagaacagccccucucc

SEQ ID NO: 239388 - RNA, 32 nt, Human
ucuacggaggggaaccgcagagccagaagagc

SEQ ID NO: 239389 - RNA, 32 nt, Human
ucuacggauauccugcauguccaagccacccg

SEQ ID NO: 239390 - RNA, 32 nt, Human
ucuacggccaugagacugaucccuggccacug

SEQ ID NO: 239391 - RNA, 32 nt, Human
ucuacggggccgcggccacuagcgcggcgccg

SEQ ID NO: 239392 - RNA, 32 nt, Human
ucuacguagccacucuccuucccccauuucug

SEQ ID NO: 239393 - RNA, 32 nt, Human
ucuacgucucuccuggauuuuggguucuuuuu

SEQ ID NO: 239394 - RNA, 32 nt, Human
ucuacgucuuucuccaguuucugagcccuaug

SEQ ID NO: 239395 - RNA, 32 nt, Human
ucuacgugaccuuuaguccucuaccucagagc

SEQ ID NO: 239396 - RNA, 32 nt, Human
ucuacguggugcaccccaccagcuucaucaag

SEQ ID NO: 239397 - RNA, 32 nt, Human
ucuacgugguucaaucagucuucucccaucug

SEQ ID NO: 239398 - RNA, 32 nt, Human
ucuacuaaaaacacaaaaauuagccaggcaug

SEQ ID NO: 239399 - RNA, 32 nt, Human
ucuacuaaaaacacaaaaauuagccaggcgug

SEQ ID NO: 239400 - RNA, 32 nt, Human
ucuacuaaaaacacaaaaauuagccggacgug

SEQ ID NO: 239401 - RNA, 32 nt, Human
ucuacuaaaaacacaaaaauuagccgggcggg

SEQ ID NO: 239402 - RNA, 32 nt, Human
ucuacuaaaaacacaaaaauuagccgggugua

SEQ ID NO: 239403 - RNA, 32 nt, Human
ucuacuaaaaacacaaaaauuagcuaggcaug

SEQ ID NO: 239404 - RNA, 32 nt, Human
ucuacuaaaaacacaaaaauuagcugggcaug

SEQ ID NO: 239405 - RNA, 32 nt, Human
ucuacuaaaaacacaaaaauuagcugggcgug

SEQ ID NO: 239406 - RNA, 32 nt, Human
ucuacuaaaaacacaaaaauuagcugggugug

SEQ ID NO: 239407 - RNA, 32 nt, Human
ucuacuaaaaacacaaauuagccaggcguggu

SEQ ID NO: 239408 - RNA, 32 nt, Human
ucuacuaaaaacgcaaaauuagccgggcgugg

SEQ ID NO: 239409 - RNA, 32 nt, Human
ucuacuaaaaacgcacagaaaaauuagccagg

SEQ ID NO: 239410 - RNA, 32 nt, Human
ucuacuaaaaaguacaaaaauuagcugggugu

SEQ ID NO: 239411 - RNA, 32 nt, Human
ucuacuaaaaauaacaaaaauuagccaggcau

SEQ ID NO: 239412 - RNA, 32 nt, Human
ucuacuaaaaauaacaaaaauuagcugggcgu

SEQ ID NO: 239413 - RNA, 32 nt, Human
ucuacuaaaaauaacaacaauuagcuaggcgu

SEQ ID NO: 239414 - RNA, 32 nt, Human
ucuacuaaaaauaagaaaaauuagcugggcgu

SEQ ID NO: 239415 - RNA, 32 nt, Human
ucuacuaaaaauacaaaaauagccaggcaugg

SEQ ID NO: 239416 - RNA, 32 nt, Human
ucuacuaaaaauacaaaaauuagccagacgug

SEQ ID NO: 239417 - RNA, 32 nt, Human
ucuacuaaaaauacaaaaauuagccaggacug

SEQ ID NO: 239418 - RNA, 32 nt, Human
ucuacuaaaaauacaaaaauuagccaggcacg

SEQ ID NO: 239419 - RNA, 32 nt, Human
ucuacuaaaaauacaaaaauuagccaggcauc

SEQ ID NO: 239420 - RNA, 32 nt, Human
ucuacuaaaaauacaaaaauuagccaggcaug

SEQ ID NO: 239421 - RNA, 32 nt, Human
ucuacuaaaaauacaaaaauuagccaggcgug

SEQ ID NO: 239422 - RNA, 32 nt, Human
ucuacuaaaaauacaaaaauuagccaggcuua

SEQ ID NO: 239423 - RNA, 32 nt, Human
ucuacuaaaaauacaaaaauuagccaggggug

SEQ ID NO: 239424 - RNA, 32 nt, Human
ucuacuaaaaauacaaaaauuagccagguaug

SEQ ID NO: 239425 - RNA, 32 nt, Human
ucuacuaaaaauacaaaaauuagccagguggu

SEQ ID NO: 239426 - RNA, 32 nt, Human
ucuacuaaaaauacaaaaauuagccaggugug

SEQ ID NO: 239427 - RNA, 32 nt, Human
ucuacuaaaaauacaaaaauuagccagguguu

SEQ ID NO: 239428 - RNA, 32 nt, Human
ucuacuaaaaauacaaaaauuagccagucacg

SEQ ID NO: 239429 - RNA, 32 nt, Human
ucuacuaaaaauacaaaaauuagcccggcaug

SEQ ID NO: 239430 - RNA, 32 nt, Human
ucuacuaaaaauacaaaaauuagcccggcgug

SEQ ID NO: 239431 - RNA, 32 nt, Human
ucuacuaaaaauacaaaaauuagcccggugug

SEQ ID NO: 239432 - RNA, 32 nt, Human
ucuacuaaaaauacaaaaauuagccggacgca

SEQ ID NO: 239433 - RNA, 32 nt, Human
ucuacuaaaaauacaaaaauuagccggacgug

SEQ ID NO: 239434 - RNA, 32 nt, Human
ucuacuaaaaauacaaaaauuagccggcaggg

SEQ ID NO: 239435 - RNA, 32 nt, Human
ucuacuaaaaauacaaaaauuagccgggcaug

SEQ ID NO: 239436 - RNA, 32 nt, Human
ucuacuaaaaauacaaaaauuagccgggccug

SEQ ID NO: 239437 - RNA, 32 nt, Human
ucuacuaaaaauacaaaaauuagccgggcgua

SEQ ID NO: 239438 - RNA, 32 nt, Human
ucuacuaaaaauacaaaaauuagccgggcgug

SEQ ID NO: 239439 - RNA, 32 nt, Human
ucuacuaaaaauacaaaaauuagccggguagu

SEQ ID NO: 239440 - RNA, 32 nt, Human
ucuacuaaaaauacaaaaauuagccgggugug

SEQ ID NO: 239441 - RNA, 32 nt, Human
ucuacuaaaaauacaaaaauuagccgguggug

SEQ ID NO: 239442 - RNA, 32 nt, Human
ucuacuaaaaauacaaaaauuagcuaggcaug

SEQ ID NO: 239443 - RNA, 32 nt, Human
ucuacuaaaaauacaaaaauuagcuaggccug

SEQ ID NO: 239444 - RNA, 32 nt, Human
ucuacuaaaaauacaaaaauuagcuaggcggg

SEQ ID NO: 239445 - RNA, 32 nt, Human
ucuacuaaaaauacaaaaauuagcuaggcgug

SEQ ID NO: 239446 - RNA, 32 nt, Human
ucuacuaaaaauacaaaaauuagcuagguaug

SEQ ID NO: 239447 - RNA, 32 nt, Human
ucuacuaaaaauacaaaaauuaggccaggugc

SEQ ID NO: 239448 - RNA, 32 nt, Human
ucuacuaaaaauacaaaaauuaggccgggcgc

SEQ ID NO: 239449 - RNA, 32 nt, Human
ucuacuaaaaauacaaaaauuaggccggguac

SEQ ID NO: 239450 - RNA, 32 nt, Human
ucuacuaaaaauacaaaaauuagucaggcaug

SEQ ID NO: 239451 - RNA, 32 nt, Human
ucuacuaaaaauacaaaaauuagucaggcgcg

SEQ ID NO: 239452 - RNA, 32 nt, Human
ucuacuaaaaauacaaaaauuagucaggcgug

SEQ ID NO: 239453 - RNA, 32 nt, Human
ucuacuaaaaauacaaaaauuagucaggugug

SEQ ID NO: 239454 - RNA, 32 nt, Human
ucuacuaaaaauacaaaaauuagucgggcgug

SEQ ID NO: 239455 - RNA, 32 nt, Human
ucuacuaaaaauacaaaacuagccaggaaugg

SEQ ID NO: 239456 - RNA, 32 nt, Human
ucuacuaaaaauacaaaacuagccaggcgcgg

SEQ ID NO: 239457 - RNA, 32 nt, Human
ucuacuaaaaauacaaaacuuagccaggcaug

SEQ ID NO: 239458 - RNA, 32 nt, Human
ucuacuaaaaauacaaaacuuagccaggugug

SEQ ID NO: 239459 - RNA, 32 nt, Human
ucuacuaaaaauacaaaagaaaauuagccggg

SEQ ID NO: 239460 - RNA, 19 nt, Human
ucuacuaaaaauacaaaau

SEQ ID NO: 239461 - RNA, 32 nt, Human
ucuacuaaaaauacaaaauauuagcugggcgu

SEQ ID NO: 239462 - RNA, 32 nt, Human
ucuacuaaaaauacaaaauuagcagggcaugg

SEQ ID NO: 239463 - RNA, 32 nt, Human
ucuacuaaaaauacaaaauuagccagacgugg

SEQ ID NO: 239464 - RNA, 32 nt, Human
ucuacuaaaaauacaaaauuagccagaugugg

SEQ ID NO: 239465 - RNA, 32 nt, Human
ucuacuaaaaauacaaaauuagccaggcauga

SEQ ID NO: 239466 - RNA, 32 nt, Human
ucuacuaaaaauacaaaauuagccaggcaugg

SEQ ID NO: 239467 - RNA, 32 nt, Human
ucuacuaaaaauacaaaauuagccaggcguag

SEQ ID NO: 239468 - RNA, 32 nt, Human
ucuacuaaaaauacaaaauuagccaggcguga

SEQ ID NO: 239469 - RNA, 32 nt, Human
ucuacuaaaaauacaaaauuagccaggcgugg

SEQ ID NO: 239470 - RNA, 32 nt, Human
ucuacuaaaaauacaaaauuagccaggugugg

SEQ ID NO: 239471 - RNA, 32 nt, Human
ucuacuaaaaauacaaaauuagccgggcauga

SEQ ID NO: 239472 - RNA, 32 nt, Human
ucuacuaaaaauacaaaauuagccgggcaugg

SEQ ID NO: 239473 - RNA, 32 nt, Human
ucuacuaaaaauacaaaauuagccgggcgugg

SEQ ID NO: 239474 - RNA, 32 nt, Human
ucuacuaaaaauacaaaauuagccggguggug

SEQ ID NO: 239475 - RNA, 32 nt, Human
ucuacuaaaaauacaaaauuagccgggugugg

SEQ ID NO: 239476 - RNA, 32 nt, Human
ucuacuaaaaauacaaaauuagcugggcaugg

SEQ ID NO: 239477 - RNA, 32 nt, Human
ucuacuaaaaauacaaaauuagcugggcgugg

SEQ ID NO: 239478 - RNA, 32 nt, Human
ucuacuaaaaauacaaaauuagcugggugggg

SEQ ID NO: 239479 - RNA, 32 nt, Human
ucuacuaaaaauacaaaauuagcugggugugc

SEQ ID NO: 239480 - RNA, 32 nt, Human
ucuacuaaaaauacaaaauuagcugggugugg

SEQ ID NO: 239481 - RNA, 32 nt, Human
ucuacuaaaaauacaaaauuagucaggcauug

SEQ ID NO: 239482 - RNA, 32 nt, Human
ucuacuaaaaauacaaaauuagucgggcguag

SEQ ID NO: 239483 - RNA, 32 nt, Human
ucuacuaaaaauacaaaauuagucggguaugg

SEQ ID NO: 239484 - RNA, 32 nt, Human
ucuacuaaaaauacaaacauuagccaggugug

SEQ ID NO: 239485 - RNA, 32 nt, Human
ucuacuaaaaauacaagaaacuagccagaugc

SEQ ID NO: 239486 - RNA, 32 nt, Human
ucuacuaaaaauacaagaauuagccaggugug

SEQ ID NO: 239487 - RNA, 32 nt, Human
ucuacuaaaaauacaauaaauuagcugggcau

SEQ ID NO: 239488 - RNA, 32 nt, Human
ucuacuaaaaauacaauaauuagccaggcaug

SEQ ID NO: 239489 - RNA, 32 nt, Human
ucuacuaaaaauacacaaaauuagcugggcgu

SEQ ID NO: 239490 - RNA, 32 nt, Human
ucuacuaaaaauacacaaauuagcuaggcaug

SEQ ID NO: 239491 - RNA, 32 nt, Human
ucuacuaaaaauacagaaaauuagcugggcgc

SEQ ID NO: 239492 - RNA, 32 nt, Human
ucuacuaaaaauacagaaauuagccgggcaug

SEQ ID NO: 239493 - RNA, 32 nt, Human
ucuacuaaaaauacagaaauuagccgggcgug

SEQ ID NO: 239494 - RNA, 32 nt, Human
ucuacuaaaaauacagaaauuagccggucaug

SEQ ID NO: 239495 - RNA, 32 nt, Human
ucuacuaaaaauacagaauuagccaggcaugg

SEQ ID NO: 239496 - RNA, 32 nt, Human
ucuacuaaaaauacagcaaauuagcugggcgu

SEQ ID NO: 239497 - RNA, 32 nt, Human
ucuacuaaaaauaccaaaaauuagccgagcgu

SEQ ID NO: 239498 - RNA, 32 nt, Human
ucuacuaaaaauaccaaaaauuagccgggcgu

SEQ ID NO: 239499 - RNA, 32 nt, Human
ucuacuaaaaauaccaaauuagccaggcgugg

SEQ ID NO: 239500 - RNA, 32 nt, Human
ucuacuaaaaauacgaaauuagccaggugugg

SEQ ID NO: 239501 - RNA, 32 nt, Human
ucuacuaaaaauauaaaauuagccaggcaugg

SEQ ID NO: 239502 - RNA, 32 nt, Human
ucuacuaaaaaugcaaaaauuagccaggcgua

SEQ ID NO: 239503 - RNA, 32 nt, Human
ucuacuaaaaaugcaaaaauuagccgggcgug

SEQ ID NO: 239504 - RNA, 32 nt, Human
ucuacuaaaaaugcaaaaauuaguccggcgug

SEQ ID NO: 239505 - RNA, 32 nt, Human
ucuacuaaaaaugcaaaauuagccgggcgugg

SEQ ID NO: 239506 - RNA, 32 nt, Human
ucuacuaaaaaugcaaaauuagucaggcaugg

SEQ ID NO: 239507 - RNA, 32 nt, Human
ucuacuaaaaauuuaaaaauuagcugggcaug

SEQ ID NO: 239508 - RNA, 32 nt, Human
ucuacuaaaaauuugaaauuagccaggcaugg

SEQ ID NO: 239509 - RNA, 32 nt, Human
ucuacuaaaacauacaaaaauuagccgggcau

SEQ ID NO: 239510 - RNA, 32 nt, Human
ucuacuaaaacuacaaaaauuagccgggugug

SEQ ID NO: 239511 - RNA, 32 nt, Human
ucuacuaaaaguacaaaaauuagccaggcggu

SEQ ID NO: 239512 - RNA, 32 nt, Human
ucuacuaaaaguacaaaaauuagccaggcgug

SEQ ID NO: 239513 - RNA, 32 nt, Human
ucuacuaaaaguacaaaaauuagccagguggu

SEQ ID NO: 239514 - RNA, 32 nt, Human
ucuacuaaaaguacagaauuagccgggcgugg

SEQ ID NO: 239515 - RNA, 32 nt, Human
ucuacuaaaauacaaaaaguuagcugggcuug

SEQ ID NO: 239516 - RNA, 32 nt, Human
ucuacuaaaauacaaaaauuagccagacaugg

SEQ ID NO: 239517 - RNA, 27 nt, Human
ucuacuaaaauacaaaaauuagccggg

SEQ ID NO: 239518 - RNA, 32 nt, Human
ucuacuaaaauacaaaaauuagccgggcguag

SEQ ID NO: 239519 - RNA, 32 nt, Human
ucuacuaaaauacaaaaauuagcugggcauga

SEQ ID NO: 239520 - RNA, 32 nt, Human
ucuacuaaaauacaaaaauuagcugggcaugg

SEQ ID NO: 239521 - RNA, 32 nt, Human
ucuacuaaaauacaaaaauuagcugggugugg

SEQ ID NO: 239522 - RNA, 32 nt, Human
ucuacuaaaauacaaaaauuaggugugguggc

SEQ ID NO: 239523 - RNA, 32 nt, Human
ucuacuaaaauacaaaaauuauccgggcaugg

SEQ ID NO: 239524 - RNA, 32 nt, Human
ucuacuaaaauacaaaaauuuagccgggcgua

SEQ ID NO: 239525 - RNA, 32 nt, Human
ucuacuaaaauacaaaauuagccaggcguggu

SEQ ID NO: 239526 - RNA, 32 nt, Human
ucuacuaaaauacaaguaaauaagccaggcau

SEQ ID NO: 239527 - RNA, 32 nt, Human
ucuacuaaaauacacaaauuagcuaggcauug

SEQ ID NO: 239528 - RNA, 32 nt, Human
ucuacuaaaauacauaaauuagccgggugugg

SEQ ID NO: 239529 - RNA, 32 nt, Human
ucuacuaaaauauaaaaauuagccagaugugg

SEQ ID NO: 239530 - RNA, 32 nt, Human
ucuacuaaaauauaaaaauuagccgggugugg

SEQ ID NO: 239531 - RNA, 32 nt, Human
ucuacuaaaauauacaaaaauuagccaggugu

SEQ ID NO: 239532 - RNA, 32 nt, Human
ucuacuaaaauauacaaaaauuagccuggcgu

SEQ ID NO: 239533 - RNA, 32 nt, Human
ucuacuaaaauuacaaaaauuagccggccaug

SEQ ID NO: 239534 - RNA, 32 nt, Human
ucuacuaaaauuacaaaaauuagccgggcaug

SEQ ID NO: 239535 - RNA, 32 nt, Human
ucuacuaaaauuacaaaaauuagccggguguc

SEQ ID NO: 239536 - RNA, 32 nt, Human
ucuacuaaacauacaaaaauuagcuaggcgug

SEQ ID NO: 239537 - RNA, 32 nt, Human
ucuacuaaauacagaaaauuagccaggcaugg

SEQ ID NO: 239538 - RNA, 32 nt, Human
ucuacuaaauauacaaaauuagccgggcgugg

SEQ ID NO: 239539 - RNA, 32 nt, Human
ucuacuaagaauacaaaauuagcugggcaugg

SEQ ID NO: 239540 - RNA, 32 nt, Human
ucuacuaaggauacaaaauuagccgggcaugg

SEQ ID NO: 239541 - RNA, 32 nt, Human
ucuacuaaguuuccuuuuaauucuaccaaccc

SEQ ID NO: 239542 - RNA, 32 nt, Human
ucuacuaauacaucugcuucaaaaugaacaua

SEQ ID NO: 239543 - RNA, 32 nt, Human
ucuacuacaaauacaaaaauuagccaggcgug

SEQ ID NO: 239544 - RNA, 32 nt, Human
ucuacuacaaauacaaaaauuagccgggugug

SEQ ID NO: 239545 - RNA, 32 nt, Human
ucuacuaccauguagugugauggagagaacuu

SEQ ID NO: 239546 - RNA, 32 nt, Human
ucuacuacugcaggaugaccucaccuucccaa

SEQ ID NO: 239547 - RNA, 32 nt, Human
ucuacuagaaauacaaaaauuagccaggugug

SEQ ID NO: 239548 - RNA, 32 nt, Human
ucuacuagaacucagcuagagaggacaaaaca

SEQ ID NO: 239549 - RNA, 32 nt, Human
ucuacuagucgcuggccccagugcaguacccc

SEQ ID NO: 239550 - RNA, 32 nt, Human
ucuacuauaaauacaaaaauuagccaggcucg

SEQ ID NO: 239551 - RNA, 32 nt, Human
ucuacucaaaaauacaaaaauuagccuggugu

SEQ ID NO: 239552 - RNA, 32 nt, Human
ucuacucacugcaaccuccaccucccggguuc

SEQ ID NO: 239553 - RNA, 32 nt, Human
ucuacucagcacaacugacugcuucagugcug

SEQ ID NO: 239554 - RNA, 23 nt, Human
ucuacucaggaggcugaggcagu

SEQ ID NO: 239555 - RNA, 32 nt, Human
ucuacuccacugcugucuaucuugccugccgg

SEQ ID NO: 239556 - RNA, 32 nt, Human
ucuacuccagccugggcaacacagcaagaccc

SEQ ID NO: 239557 - RNA, 32 nt, Human
ucuacuccagccugggcaauaggguaagaucc

SEQ ID NO: 239558 - RNA, 32 nt, Human
ucuacuccaugauccagucggccaacagccau

SEQ ID NO: 239559 - RNA, 32 nt, Human
ucuacucccgaggcucuguacauugcugccac

SEQ ID NO: 239560 - RNA, 32 nt, Human
ucuacucccucuugacugucucagccucuggg

SEQ ID NO: 239561 - RNA, 32 nt, Human
ucuacucccugcagccccucgcacuacccagc

SEQ ID NO: 239562 - RNA, 32 nt, Human
ucuacuccgguuggcagagaacacucacacac

SEQ ID NO: 239563 - RNA, 32 nt, Human
ucuacuccucacccgucuacauugccuucuuc

SEQ ID NO: 239564 - RNA, 32 nt, Human
ucuacucuacccagcuugcgcuccccagccgc

SEQ ID NO: 239565 - RNA, 32 nt, Human
ucuacucuagaagaaagacuuuggaagcagcu

SEQ ID NO: 239566 - RNA, 32 nt, Human
ucuacucuagagaaguggacuggaggagcugg

SEQ ID NO: 239567 - RNA, 32 nt, Human
ucuacucucauuuugauuacuuccuuaugguu

SEQ ID NO: 239568 - RNA, 32 nt, Human
ucuacucuccaacauaccagauuguacacugu

SEQ ID NO: 239569 - RNA, 32 nt, Human
ucuacucuccuucucugguucucagcuguggc

SEQ ID NO: 239570 - RNA, 32 nt, Human
ucuacucugagaguuuuuauacacuuggaaaa

SEQ ID NO: 239571 - RNA, 32 nt, Human
ucuacucugccccuggggaauguguccccugc

SEQ ID NO: 239572 - RNA, 32 nt, Human
ucuacucugggugacagaaugagaccccaucu

SEQ ID NO: 239573 - RNA, 32 nt, Human
ucuacucuuagcacugagaguuuuucacgucc

SEQ ID NO: 239574 - RNA, 32 nt, Human
ucuacucuuccucuauuccuucauaagaaucu

SEQ ID NO: 239575 - RNA, 32 nt, Human
ucuacugaaaaauacaacaaaaauuagacagg

SEQ ID NO: 239576 - RNA, 32 nt, Human
ucuacugaaaacacaaacaacaaagcagaaga

SEQ ID NO: 239577 - RNA, 32 nt, Human
ucuacugaaaauacaaaaauuagccagacgug

SEQ ID NO: 239578 - RNA, 32 nt, Human
ucuacugaaaauacaaaaauuagccaggcgug

SEQ ID NO: 239579 - RNA, 32 nt, Human
ucuacugaaaauacaaaaauuagccaggcuug

SEQ ID NO: 239580 - RNA, 32 nt, Human
ucuacugaaaauacaaaaauuagccagguaug

SEQ ID NO: 239581 - RNA, 32 nt, Human
ucuacugaaaauacaaaaauuagccaggugug

SEQ ID NO: 239582 - RNA, 32 nt, Human
ucuacugaaaauacaaaaauuagccgggcaug

SEQ ID NO: 239583 - RNA, 32 nt, Human
ucuacugaaaauacaaaaauuagccgggcgug

SEQ ID NO: 239584 - RNA, 32 nt, Human
ucuacugaaaauacaaaaauuagucaggugca

SEQ ID NO: 239585 - RNA, 32 nt, Human
ucuacugaaaauacaaaauuagccgggcauug

SEQ ID NO: 239586 - RNA, 32 nt, Human
ucuacugaaaauacaagaaauuagcugggacu

SEQ ID NO: 239587 - RNA, 32 nt, Human
ucuacugaaaauacagaauuagccaggcaugg

SEQ ID NO: 239588 - RNA, 32 nt, Human
ucuacugaaaauauaaaaauuagccaggcaug

SEQ ID NO: 239589 - RNA, 32 nt, Human
ucuacugaaaauauaaaaauuagccaggcgug

SEQ ID NO: 239590 - RNA, 32 nt, Human
ucuacugaaaaugcaaaaauuagccagguaua

SEQ ID NO: 239591 - RNA, 32 nt, Human
ucuacugaaaaugcaaaaauuagccaggugug

SEQ ID NO: 239592 - RNA, 23 nt, Human
ucuacugaaaauucaaaauuagc

SEQ ID NO: 239593 - RNA, 32 nt, Human
ucuacugaaauacaaaagaaauuagccaggug

SEQ ID NO: 239594 - RNA, 32 nt, Human
ucuacugaaaugcacagucaugcagagcccag

SEQ ID NO: 239595 - RNA, 32 nt, Human
ucuacugaauucuucuaauuccuucacaacag

SEQ ID NO: 239596 - RNA, 19 nt, Human
ucuacugacauugacuagc

SEQ ID NO: 239597 - RNA, 32 nt, Human
ucuacugcauccaugcucucagucucuuccuc

SEQ ID NO: 239598 - RNA, 32 nt, Human
ucuacugcguagcugggauuacaggugcccac

SEQ ID NO: 239599 - RNA, 32 nt, Human
ucuacugcucaagaacagauuugaggccaggu

SEQ ID NO: 239600 - RNA, 32 nt, Human
ucuacugcucccuccaggucugggggcuuuua

SEQ ID NO: 239601 - RNA, 19 nt, Human
ucuacugcucguggugcuc

SEQ ID NO: 239602 - RNA, 32 nt, Human
ucuacugcucuucuuuagccugugaugagggg

SEQ ID NO: 239603 - RNA, 32 nt, Human
ucuacugcuucagagcauacaacugaugugcc

SEQ ID NO: 239604 - RNA, 32 nt, Human
ucuacuggaaaagauugugagauugaacuuau

SEQ ID NO: 239605 - RNA, 32 nt, Human
ucuacuggacuuuucucccaaacaggacaagc

SEQ ID NO: 239606 - RNA, 22 nt, Human
ucuacuggcuggagugcagugg

SEQ ID NO: 239607 - RNA, 32 nt, Human
ucuacugguccucuuaacugugguguugaggc

SEQ ID NO: 239608 - RNA, 32 nt, Human
ucuacuggugaggaaacaugaggaucagaggc

SEQ ID NO: 239609 - RNA, 32 nt, Human
ucuacuguaaucucucaauauucauagaagau

SEQ ID NO: 239610 - RNA, 32 nt, Human
ucuacuguaguuggagaucauuagaauugaau

SEQ ID NO: 239611 - RNA, 32 nt, Human
ucuacugucccuuccuagcugugugaucuuga

SEQ ID NO: 239612 - RNA, 32 nt, Human
ucuacugucuucaugccucagcacagcagaga

SEQ ID NO: 239613 - RNA, 32 nt, Human
ucuacugugcaaggaagauguaaggaaaaacu

SEQ ID NO: 239614 - RNA, 32 nt, Human
ucuacuguucauaaaccaugcuaacauuuucc

SEQ ID NO: 239615 - RNA, 32 nt, Human
ucuacuuaagaaaguccucuuugcccugugug

SEQ ID NO: 239616 - RNA, 32 nt, Human
ucuacuuaguucagaaaaaugauguugaauug

SEQ ID NO: 239617 - RNA, 32 nt, Human
ucuacuucaccugaaaccacagauccauggca

SEQ ID NO: 239618 - RNA, 32 nt, Human
ucuacuucaguuccugucuggcccagaucucu

SEQ ID NO: 239619 - RNA, 32 nt, Human
ucuacuugagccugugugcccacugaagagau

SEQ ID NO: 239620 - RNA, 32 nt, Human
ucuacuugcaggacccuuccuccuucccuagg

SEQ ID NO: 239621 - RNA, 32 nt, Human
ucuacuugggaucucaggaggcugcaaucaaa

SEQ ID NO: 239622 - RNA, 32 nt, Human
ucuacuuguuuuucccaucucuuccuuuccaa

SEQ ID NO: 239623 - RNA, 32 nt, Human
ucuacuuuacaccuuucucugccuuguaucug

SEQ ID NO: 239624 - RNA, 32 nt, Human
ucuacuuuaucccuuccuuuuaauaguuccuu

SEQ ID NO: 239625 - RNA, 32 nt, Human
ucuacuuuauuuauuguucccuugaaaugacu

SEQ ID NO: 239626 - RNA, 32 nt, Human
ucuacuuucccucugggauuugcccacguacc

SEQ ID NO: 239627 - RNA, 32 nt, Human
ucuacuuucccugaggcuuuggggucagagua

SEQ ID NO: 239628 - RNA, 32 nt, Human
ucuacuuuccuacugcagccuucagauucuca

SEQ ID NO: 239629 - RNA, 32 nt, Human
ucuacuuuccuauacugccaaagaaugugagg

SEQ ID NO: 239630 - RNA, 32 nt, Human
ucuacuuucuuucucacauucauuucuuaggu

SEQ ID NO: 239631 - RNA, 32 nt, Human
ucuacuuugugucccuggcagggccuggagaa

SEQ ID NO: 239632 - RNA, 32 nt, Human
ucuacuuuuacauccccaaaccaccuuuguca

SEQ ID NO: 239633 - RNA, 32 nt, Human
ucuacuuuucuuaaaucucuguucaucagugg

SEQ ID NO: 239634 - RNA, 32 nt, Human
ucuagaaaaauguagagacuccaccaaaaacu

SEQ ID NO: 239635 - RNA, 32 nt, Human
ucuagaaaacaaaaugaaagaaaacaaauaug

SEQ ID NO: 239636 - RNA, 32 nt, Human
ucuagaaaacauagcuucuuacugaacuugaa

SEQ ID NO: 239637 - RNA, 32 nt, Human
ucuagaaaaccagcuuguggcuaacagucccu

SEQ ID NO: 239638 - RNA, 32 nt, Human
ucuagaaaagagauuucuaggccucauguaua

SEQ ID NO: 239639 - RNA, 32 nt, Human
ucuagaaaaggggagacucacuucccugggag

SEQ ID NO: 239640 - RNA, 32 nt, Human
ucuagaaaguaaauauauugcugagagggaaa

SEQ ID NO: 239641 - RNA, 32 nt, Human
ucuagaaauaggugaaagugagagguggggga

SEQ ID NO: 239642 - RNA, 32 nt, Human
ucuagaaauguucacaagguaccccaaaacuc

SEQ ID NO: 239643 - RNA, 32 nt, Human
ucuagaaauuacaagcauauaacuuuagccua

SEQ ID NO: 239644 - RNA, 32 nt, Human
ucuagaaauuacguauauuuugugcuacuguc

SEQ ID NO: 239645 - RNA, 32 nt, Human
ucuagaacagccuggucaacauggugaaaccc

SEQ ID NO: 239646 - RNA, 32 nt, Human
ucuagaaccccacgcguccggaaguccuuaua

SEQ ID NO: 239647 - RNA, 32 nt, Human
ucuagaaccucaggaagcugcagcuggagggc

SEQ ID NO: 239648 - RNA, 32 nt, Human
ucuagaacgguucugaaauccugcugaagguu

SEQ ID NO: 239649 - RNA, 32 nt, Human
ucuagaacuaugagcccgaggccuuccccucu

SEQ ID NO: 239650 - RNA, 32 nt, Human
ucuagaacuucaucgcccucugaucgccgauc

SEQ ID NO: 239651 - RNA, 32 nt, Human
ucuagaagccaagggaaaggggugcuuuuaua

SEQ ID NO: 239652 - RNA, 32 nt, Human
ucuagaagccgcuguuaccucuuguuuacagu

SEQ ID NO: 239653 - RNA, 32 nt, Human
ucuagaaggaagccaagcagcugccuuccuuu

SEQ ID NO: 239654 - RNA, 32 nt, Human
ucuagaaggagcuuccugacuggaaccagaga

SEQ ID NO: 239655 - RNA, 20 nt, Human
ucuagaaggcugcagcguga

SEQ ID NO: 239656 - RNA, 32 nt, Human
ucuagaauccacccucuugugcccuuaagcau

SEQ ID NO: 239657 - RNA, 32 nt, Human
ucuagaaucuggaacugucaccaugaugaaug

SEQ ID NO: 239658 - RNA, 32 nt, Human
ucuagacaaaggacuaggacaggggcagccua

SEQ ID NO: 239659 - RNA, 32 nt, Human
ucuagacaucaguuuccacaucugaaaaauaa

SEQ ID NO: 239660 - RNA, 32 nt, Human
ucuagacauuuacuaucacugcaccugaagaa

SEQ ID NO: 239661 - RNA, 32 nt, Human
ucuagaccagaagaggaugacaauggcaacaa

SEQ ID NO: 239662 - RNA, 32 nt, Human
ucuagaccagaucuagccccacccucacucca

SEQ ID NO: 239663 - RNA, 32 nt, Human
ucuagaccagccugaccaacauggagaaaccc

SEQ ID NO: 239664 - RNA, 32 nt, Human
ucuagaccagccugaccaacauggugaaaccc

SEQ ID NO: 239665 - RNA, 32 nt, Human
ucuagaccagccuggccaacauauagugaaac

SEQ ID NO: 239666 - RNA, 32 nt, Human
ucuagaccagccuggccagcauggugaaaacc

SEQ ID NO: 239667 - RNA, 32 nt, Human
ucuagaccagccuggccagcauggugaaaccc

SEQ ID NO: 239668 - RNA, 32 nt, Human
ucuagaccagccugggcaacauagugagaccc

SEQ ID NO: 239669 - RNA, 32 nt, Human
ucuagaccagccugggcaacguggugaaaccc

SEQ ID NO: 239670 - RNA, 32 nt, Human
ucuagaccagccuggucaacauggcgaaaccc

SEQ ID NO: 239671 - RNA, 32 nt, Human
ucuagaccaucccugaugcguagaugugagag

SEQ ID NO: 239672 - RNA, 23 nt, Human
ucuagacccucccuuuccuguca

SEQ ID NO: 239673 - RNA, 32 nt, Human
ucuagaccucugacaucaugguguuuucuuaa

SEQ ID NO: 239674 - RNA, 32 nt, Human
ucuagaccuggcucuuucucucccgucucagu

SEQ ID NO: 239675 - RNA, 32 nt, Human
ucuagaccuucaucgcccucugaucgccgauc

SEQ ID NO: 239676 - RNA, 32 nt, Human
ucuagacucacugcaaccuccaccuccugugu

SEQ ID NO: 239677 - RNA, 32 nt, Human
ucuagacuccagcggcuggaauuggguggggg

SEQ ID NO: 239678 - RNA, 32 nt, Human
ucuagacugggaaacauacacauacaagcaga

SEQ ID NO: 239679 - RNA, 32 nt, Human
ucuagacugggacaauggcucacaucuguaau

SEQ ID NO: 239680 - RNA, 32 nt, Human
ucuagagaaacagaacaaauauacaaagagau

SEQ ID NO: 239681 - RNA, 32 nt, Human
ucuagagacaucuuaggcccucccuucaucuu

SEQ ID NO: 239682 - RNA, 23 nt, Human
ucuagagaccccaccucugugaa

SEQ ID NO: 239683 - RNA, 32 nt, Human
ucuagagagaaaagccucauggaacagauaac

SEQ ID NO: 239684 - RNA, 32 nt, Human
ucuagagagaaggaaauuaauguuucuuaaua

SEQ ID NO: 239685 - RNA, 32 nt, Human
ucuagagagucaaauggucuugcucaauucuu

SEQ ID NO: 239686 - RNA, 32 nt, Human
ucuagagcaguuggguuggaggcucauugagg

SEQ ID NO: 239687 - RNA, 32 nt, Human
ucuagagcccaggaauucaaguuuaacaugag

SEQ ID NO: 239688 - RNA, 32 nt, Human
ucuagagccccagcugcuggcggcugcuggaa

SEQ ID NO: 239689 - RNA, 32 nt, Human
ucuagagcuacacuacugccaaugccuucaua

SEQ ID NO: 239690 - RNA, 32 nt, Human
ucuagagcugguugcaauuauuggacaagcag

SEQ ID NO: 239691 - RNA, 32 nt, Human
ucuagagcuugcugcuguucaaagcacuccuu

SEQ ID NO: 239692 - RNA, 32 nt, Human
ucuagaggaagaggaggacgacaggccauacg

SEQ ID NO: 239693 - RNA, 32 nt, Human
ucuagaggaaguaucuauucacugugaaaauc

SEQ ID NO: 239694 - RNA, 20 nt, Human
ucuagagggauccaccgcca

SEQ ID NO: 239695 - RNA, 32 nt, Human
ucuagaguagcucccauauauggagaugggug

SEQ ID NO: 239696 - RNA, 26 nt, Human
ucuagagucacucuaaccuugcuaag

SEQ ID NO: 239697 - RNA, 31 nt, Human
ucuagaguuaucuucuuuauuauuccuaguc

SEQ ID NO: 239698 - RNA, 32 nt, Human
ucuagaguuccuaccauggagugggucuggag

SEQ ID NO: 239699 - RNA, 23 nt, Human
ucuagaguugcccauuccuguua

SEQ ID NO: 239700 - RNA, 32 nt, Human
ucuagauaaaacuuucuuuucugaucaugaau

SEQ ID NO: 239701 - RNA, 32 nt, Human
ucuagauagauaaccucaccccaaucacaggc

SEQ ID NO: 239702 - RNA, 32 nt, Human
ucuagauaucuucuccacccuccuugcaccag

SEQ ID NO: 239703 - RNA, 32 nt, Human
ucuagauauuuuuaguuuguugccaagguagc

SEQ ID NO: 239704 - RNA, 32 nt, Human
ucuagaucccccuccccugccugcucugcagu

SEQ ID NO: 239705 - RNA, 32 nt, Human
ucuagauccucaacuugaccucccaggcccag

SEQ ID NO: 239706 - RNA, 32 nt, Human
ucuagaugaacuguccaaugcugacaguagga

SEQ ID NO: 239707 - RNA, 32 nt, Human
ucuagaugaaguuuuacauuguugagcuauug

SEQ ID NO: 239708 - RNA, 32 nt, Human
ucuagaugaauugggaguaucucuccaguuau

SEQ ID NO: 239709 - RNA, 32 nt, Human
ucuagaugacagagcaagacccugcuccugga

SEQ ID NO: 239710 - RNA, 30 nt, Human
ucuagaugacucugacccccgccccagguc

SEQ ID NO: 239711 - RNA, 32 nt, Human
ucuagaugcaaauaacuccuucaccaggcagu

SEQ ID NO: 239712 - RNA, 32 nt, Human
ucuagaugccuaguuugguagccaauucugcu

SEQ ID NO: 239713 - RNA, 32 nt, Human
ucuagauggcacaaaccaccucucagggaaua

SEQ ID NO: 239714 - RNA, 32 nt, Human
ucuagauggcccugucuugacccugaaaugaa

SEQ ID NO: 239715 - RNA, 32 nt, Human
ucuagauuuuccuauguugaaugcuuaaagca

SEQ ID NO: 239716 - RNA, 32 nt, Human
ucuagauuuuuccuugcuuucuguguuuauug

SEQ ID NO: 239717 - RNA, 32 nt, Human
ucuagcaaaaauacaaaaauuagucaggagug

SEQ ID NO: 239718 - RNA, 32 nt, Human
ucuagcaacaugggaaagcauuugcuguggau

SEQ ID NO: 239719 - RNA, 32 nt, Human
ucuagcacaauguugaaaaguauggcccagac

SEQ ID NO: 239720 - RNA, 32 nt, Human
ucuagcaccuccugacagcagugagaagaucu

SEQ ID NO: 239721 - RNA, 32 nt, Human
ucuagcacucagcucagccuccuguccccaug

SEQ ID NO: 239722 - RNA, 32 nt, Human
ucuagcagagagagacuaacauugucguuagu

SEQ ID NO: 239723 - RNA, 32 nt, Human
ucuagcagagagaugguauauuacucccuucu

SEQ ID NO: 239724 - RNA, 32 nt, Human
ucuagcagcauuauggggacuuuuccauaagu

SEQ ID NO: 239725 - RNA, 32 nt, Human
ucuagcagggcucuuccaguccugcagcacgg

SEQ ID NO: 239726 - RNA, 32 nt, Human
ucuagcaggggacaggauuggcucagaugacc

SEQ ID NO: 239727 - RNA, 32 nt, Human
ucuagcagguaucagggcaaccagaugaagca

SEQ ID NO: 239728 - RNA, 32 nt, Human
ucuagcaguaaacucucucggucuccauuaaa

SEQ ID NO: 239729 - RNA, 32 nt, Human
ucuagcaguuugagcccagccuaggcaacaua

SEQ ID NO: 239730 - RNA, 23 nt, Human
ucuagcauggacagccaguucca

SEQ ID NO: 239731 - RNA, 32 nt, Human
ucuagcauggcuuggguaaucugugauuguac

SEQ ID NO: 239732 - RNA, 32 nt, Human
ucuagcauuucuguucugugcugugcuaagcu

SEQ ID NO: 239733 - RNA, 21 nt, Human
ucuagccaaaggaagaccagu

SEQ ID NO: 239734 - RNA, 32 nt, Human
ucuagccaccucuuccuuuuccuucuuuauuc

SEQ ID NO: 239735 - RNA, 32 nt, Human
ucuagccacucccugcacuucccguucucagc

SEQ ID NO: 239736 - RNA, 32 nt, Human
ucuagccacuccucccagcucuucugugcugu

SEQ ID NO: 239737 - RNA, 32 nt, Human
ucuagccagauggggguggaguggaggacaca

SEQ ID NO: 239738 - RNA, 32 nt, Human
ucuagcccaaccuacauuccacccuguuacuu

SEQ ID NO: 239739 - RNA, 32 nt, Human
ucuagccccaccauugcucucucugucuucag

SEQ ID NO: 239740 - RNA, 23 nt, Human
ucuagccccgcucucuuccccuc

SEQ ID NO: 239741 - RNA, 23 nt, Human
ucuagccccuccaacaguucuuc

SEQ ID NO: 239742 - RNA, 32 nt, Human
ucuagccccugccucugcgcccccaucacugg

SEQ ID NO: 239743 - RNA, 26 nt, Human
ucuagcccugcccggauggagcgggg

SEQ ID NO: 239744 - RNA, 24 nt, Human
ucuagccggagugacagaguaaga

SEQ ID NO: 239745 - RNA, 32 nt, Human
ucuagccggagugacagaguaagacucugucu

SEQ ID NO: 239746 - RNA, 25 nt, Human
ucuagccgggccaugcuuuccuuuu

SEQ ID NO: 239747 - RNA, 32 nt, Human
ucuagccggggcagacacccagcuggcugggu

SEQ ID NO: 239748 - RNA, 32 nt, Human
ucuagccggggcgacagagcgagacucugucu

SEQ ID NO: 239749 - RNA, 24 nt, Human
ucuagccuaggugacagagugaga

SEQ ID NO: 239750 - RNA, 32 nt, Human
ucuagccuaggugacagagugagacuccaucu

SEQ ID NO: 239751 - RNA, 32 nt, Human
ucuagccucagucuugucaucuguaaaauggg

SEQ ID NO: 239752 - RNA, 32 nt, Human
ucuagccuccacugcccuagccccagacugcu

SEQ ID NO: 239753 - RNA, 32 nt, Human
ucuagccuccagcccaccugcccaugugauga

SEQ ID NO: 239754 - RNA, 32 nt, Human
ucuagccuccgcuucucuaucuccuacaggcg

SEQ ID NO: 239755 - RNA, 32 nt, Human
ucuagccucggugacagaguaagauuccaucu

SEQ ID NO: 239756 - RNA, 24 nt, Human
ucuagccugagcgacagagugaga

SEQ ID NO: 239757 - RNA, 24 nt, Human
ucuagccugagggacagagugaga

SEQ ID NO: 239758 - RNA, 32 nt, Human
ucuagccugaguaccgggcuacuucuuaaaug

SEQ ID NO: 239759 - RNA, 22 nt, Human
ucuagccugagugacagagcag

SEQ ID NO: 239760 - RNA, 23 nt, Human
ucuagccugagugacagagcaga

SEQ ID NO: 239761 - RNA, 32 nt, Human
ucuagccugagugacagagcagacuccugucu

SEQ ID NO: 239762 - RNA, 32 nt, Human
ucuagccugagugacagagcaugauuccaucu

SEQ ID NO: 239763 - RNA, 32 nt, Human
ucuagccugcuacugccuggggacacggacuu

SEQ ID NO: 239764 - RNA, 22 nt, Human
ucuagccugcuggaggaugaga

SEQ ID NO: 239765 - RNA, 32 nt, Human
ucuagccugcuggccugccuucacuguccugg

SEQ ID NO: 239766 - RNA, 32 nt, Human
ucuagccuggaagacagagugagaccccaucu

SEQ ID NO: 239767 - RNA, 32 nt, Human
ucuagccuggacaacaagagugaaacucuguc

SEQ ID NO: 239768 - RNA, 32 nt, Human
ucuagccuggacaacacagcaggacuccaucu

SEQ ID NO: 239769 - RNA, 32 nt, Human
ucuagccuggacagcagagcaagacuccaucu

SEQ ID NO: 239770 - RNA, 32 nt, Human
ucuagccuggaugacagagcaagacucugucu

SEQ ID NO: 239771 - RNA, 23 nt, Human
ucuagccuggcaacagagcaaga

SEQ ID NO: 239772 - RNA, 23 nt, Human
ucuagccuggcaacagagcgaga

SEQ ID NO: 239773 - RNA, 23 nt, Human
ucuagccugggcaacaagaguga

SEQ ID NO: 239774 - RNA, 24 nt, Human
ucuagccugggcaacagagcaagg

SEQ ID NO: 239775 - RNA, 31 nt, Human
ucuagccugggcaacagagcaaggcucuguc

SEQ ID NO: 239776 - RNA, 24 nt, Human
ucuagccugggcaacagagcgaga

SEQ ID NO: 239777 - RNA, 24 nt, Human
ucuagccugggcaacagaguaaga

SEQ ID NO: 239778 - RNA, 24 nt, Human
ucuagccugggcaacagagugaga

SEQ ID NO: 239779 - RNA, 23 nt, Human
ucuagccugggcaacgagagcga

SEQ ID NO: 239780 - RNA, 24 nt, Human
ucuagccugggcagcagagugaga

SEQ ID NO: 239781 - RNA, 32 nt, Human
ucuagccugggcagcagagugagacccugucu

SEQ ID NO: 239782 - RNA, 24 nt, Human
ucuagccugggccacagggcgaga

SEQ ID NO: 239783 - RNA, 24 nt, Human
ucuagccugggcgacagagcaaga

SEQ ID NO: 239784 - RNA, 32 nt, Human
ucuagccugggcgacagagcaagacuccaucu

SEQ ID NO: 239785 - RNA, 32 nt, Human
ucuagccugggcgacagagcaagacugucuca

SEQ ID NO: 239786 - RNA, 24 nt, Human
ucuagccugggcgacagagcgaga

SEQ ID NO: 239787 - RNA, 32 nt, Human
ucuagccugggcgacagagcgagacuccaucu

SEQ ID NO: 239788 - RNA, 24 nt, Human
ucuagccugggcgacagagugaga

SEQ ID NO: 239789 - RNA, 24 nt, Human
ucuagccuggggaauagagugaga

SEQ ID NO: 239790 - RNA, 32 nt, Human
ucuagccugggugaaagagcgaaacuccaucu

SEQ ID NO: 239791 - RNA, 24 nt, Human
ucuagccugggugacaaagcaaga

SEQ ID NO: 239792 - RNA, 32 nt, Human
ucuagccugggugacaaagcaagacuccaucu

SEQ ID NO: 239793 - RNA, 24 nt, Human
ucuagccugggugacaaagugaga

SEQ ID NO: 239794 - RNA, 31 nt, Human
ucuagccugggugacaaagugagacccuguc

SEQ ID NO: 239795 - RNA, 21 nt, Human
ucuagccugggugacaagagc

SEQ ID NO: 239796 - RNA, 25 nt, Human
ucuagccugggugacaagagcaaga

SEQ ID NO: 239797 - RNA, 24 nt, Human
ucuagccugggugacagaacgaga

SEQ ID NO: 239798 - RNA, 24 nt, Human
ucuagccugggugacagaaugaga

SEQ ID NO: 239799 - RNA, 24 nt, Human
ucuagccugggugacagagagaga

SEQ ID NO: 239800 - RNA, 32 nt, Human
ucuagccugggugacagagagagacuccgucu

SEQ ID NO: 239801 - RNA, 20 nt, Human
ucuagccugggugacagagc

SEQ ID NO: 239802 - RNA, 22 nt, Human
ucuagccugggugacagagcaa

SEQ ID NO: 239803 - RNA, 32 nt, Human
ucuagccugggugacagagcaaaacugugucu

SEQ ID NO: 239804 - RNA, 24 nt, Human
ucuagccugggugacagagcaaga

SEQ ID NO: 239805 - RNA, 32 nt, Human
ucuagccugggugacagagcaagacucugucu

SEQ ID NO: 239806 - RNA, 32 nt, Human
ucuagccugggugacagagcaagacuuugucu

SEQ ID NO: 239807 - RNA, 32 nt, Human
ucuagccugggugacagagcgagaccuugucu

SEQ ID NO: 239808 - RNA, 32 nt, Human
ucuagccugggugacagagcgagacuccaucu

SEQ ID NO: 239809 - RNA, 32 nt, Human
ucuagccugggugacagagcgagacucugucu

SEQ ID NO: 239810 - RNA, 24 nt, Human
ucuagccugggugacagagucaga

SEQ ID NO: 239811 - RNA, 32 nt, Human
ucuagccugggugacagagucagacuccgucc

SEQ ID NO: 239812 - RNA, 24 nt, Human
ucuagccugggugacagagugaga

SEQ ID NO: 239813 - RNA, 32 nt, Human
ucuagccugggugacagagugagacuccauca

SEQ ID NO: 239814 - RNA, 32 nt, Human
ucuagccugggugacagugagacugucucaaa

SEQ ID NO: 239815 - RNA, 24 nt, Human
ucuagccugggugacagugugaga

SEQ ID NO: 239816 - RNA, 32 nt, Human
ucuagccugggugacagugugagacucugucu

SEQ ID NO: 239817 - RNA, 32 nt, Human
ucucggcucacugcaagcuccgccuccugggu

SEQ ID NO: 239818 - RNA, 32 nt, Human
ucucggcucacugcaagcuccgccucucgggu

SEQ ID NO: 239819 - RNA, 32 nt, Human
ucucggcucacugcaagcuccggcucccaggu

SEQ ID NO: 239820 - RNA, 32 nt, Human
ucucggcucacugcaagcucggccuccugggu

SEQ ID NO: 239821 - RNA, 23 nt, Human
ucucggcucacugcaagcucugc

SEQ ID NO: 239822 - RNA, 32 nt, Human
ucucggcucacugcaagcucugccucccaggu

SEQ ID NO: 239823 - RNA, 32 nt, Human
ucucggcucacugcaagcucugccucccgggc

SEQ ID NO: 239824 - RNA, 32 nt, Human
ucucggcucacugcaagcucugccucccgggu

SEQ ID NO: 239825 - RNA, 32 nt, Human
ucucggcucacugcaagcucugccucccgguu

SEQ ID NO: 239826 - RNA, 32 nt, Human
ucucggcucacugcaagcucugccucccgugu

SEQ ID NO: 239827 - RNA, 32 nt, Human
ucucggcucacugcaagcucugccuccugggu

SEQ ID NO: 239828 - RNA, 32 nt, Human
ucucggcucacugcaagcucugccucucgggu

SEQ ID NO: 239829 - RNA, 32 nt, Human
ucucggcucacugcaagcucugcguccugggu

SEQ ID NO: 239830 - RNA, 32 nt, Human
ucucggcucacugcaagcucugcuucccaggu

SEQ ID NO: 239831 - RNA, 32 nt, Human
ucucggcucacugcaagcuucgccucccgggu

SEQ ID NO: 239832 - RNA, 32 nt, Human
ucucggcucacugcaaguuccgccucccgggu

SEQ ID NO: 239833 - RNA, 32 nt, Human
ucucggcucacugcaaucuccgccucccaggu

SEQ ID NO: 239834 - RNA, 32 nt, Human
ucucggcucacugcaaucucugccucccaagc

SEQ ID NO: 239835 - RNA, 32 nt, Human
ucucggcucacugcaaucucugccucccaggu

SEQ ID NO: 239836 - RNA, 32 nt, Human
ucucggcucacugcaaucucugccucccggau

SEQ ID NO: 239837 - RNA, 32 nt, Human
ucucggcucacugcaaucucugccucccgggu

SEQ ID NO: 239838 - RNA, 32 nt, Human
ucucggcucacugcaaucucugccuccugggu

SEQ ID NO: 239839 - RNA, 32 nt, Human
ucucggcucacugcaauuugcgucucccaagu

SEQ ID NO: 239840 - RNA, 32 nt, Human
ucucggcucacugcacccucugccucuugggu

SEQ ID NO: 239841 - RNA, 32 nt, Human
ucucggcucacugcaccuccgccucccagguu

SEQ ID NO: 239842 - RNA, 32 nt, Human
ucucggcucacugcaccucugccuccuggauu

SEQ ID NO: 239843 - RNA, 32 nt, Human
ucucggcucacugcaccuucugccuaccgagu

SEQ ID NO: 239844 - RNA, 32 nt, Human
ucucggcucacugcagccccugccucccaggc

SEQ ID NO: 239845 - RNA, 32 nt, Human
ucucggcucacugcagccucaaccuccugggc

SEQ ID NO: 239846 - RNA, 32 nt, Human
ucucggcucacugcagccuccgccucccaggu

SEQ ID NO: 239847 - RNA, 32 nt, Human
ucucggcucacugcagccuccgccucccguau

SEQ ID NO: 239848 - RNA, 32 nt, Human
ucucggcucacugcagccuccgccucccuggu

SEQ ID NO: 239849 - RNA, 32 nt, Human
ucucggcucacugcagccuccgccugccgggu

SEQ ID NO: 239850 - RNA, 32 nt, Human
ucucggcucacugcagccucugccucccgggu

SEQ ID NO: 239851 - RNA, 32 nt, Human
ucucggcucacugcagccuucaccucccgggu

SEQ ID NO: 239852 - RNA, 32 nt, Human
ucucggcucacugcagccuugacuucccaggc

SEQ ID NO: 239853 - RNA, 32 nt, Human
ucucggcucacugcagccuugacuuccugggc

SEQ ID NO: 239854 - RNA, 32 nt, Human
ucucggcucacugcagccuuugccucccgggu

SEQ ID NO: 239855 - RNA, 32 nt, Human
ucucggcucacugcagcgucgacauuucgggu

SEQ ID NO: 239856 - RNA, 32 nt, Human
ucucggcucacugcaggcucugccuccugggu

SEQ ID NO: 239857 - RNA, 32 nt, Human
ucucggcucacugcagucaccuccucucaggu

SEQ ID NO: 239858 - RNA, 32 nt, Human
ucucggcucacugcauccuccaccuccugggu

SEQ ID NO: 239859 - RNA, 32 nt, Human
ucucggcucacugcauccuccgccucccgggu

SEQ ID NO: 239860 - RNA, 32 nt, Human
ucucggcucacugcauccucugccucccgggu

SEQ ID NO: 239861 - RNA, 32 nt, Human
ucucggcucacugcauccucugccuccugggu

SEQ ID NO: 239862 - RNA, 32 nt, Human
ucucggcucacugcaucuuccgccucccgggu

SEQ ID NO: 239863 - RNA, 32 nt, Human
ucucggcucacugccaccucucccucaugguu

SEQ ID NO: 239864 - RNA, 32 nt, Human
ucucggcucacugccaccucugccucccaggu

SEQ ID NO: 239865 - RNA, 32 nt, Human
ucucggcucacugcgaccuccgucucccgggc

SEQ ID NO: 239866 - RNA, 32 nt, Human
ucucggcucacugcgaccucggccuccuggau

SEQ ID NO: 239867 - RNA, 32 nt, Human
ucucggcucacugcgaccucugccucccaggu

SEQ ID NO: 239868 - RNA, 32 nt, Human
ucucggcucacugcgaccucugcuuccugggu

SEQ ID NO: 239869 - RNA, 32 nt, Human
ucucggcucacugcgagcuccaccucucgggu

SEQ ID NO: 239870 - RNA, 32 nt, Human
ucucggcucacugcgagcucugccuccugggu

SEQ ID NO: 239871 - RNA, 32 nt, Human
ucucggcucacuguaaccuccaccuccugggu

SEQ ID NO: 239872 - RNA, 32 nt, Human
ucucggcucacuguaaccuccgccuccugaau

SEQ ID NO: 239873 - RNA, 32 nt, Human
ucucggcucacuguaaccuccgccuccugggu

SEQ ID NO: 239874 - RNA, 32 nt, Human
ucucggcucacuguaaccucugccuccugccu

SEQ ID NO: 239875 - RNA, 32 nt, Human
ucucggcucacuguaaccuucaccuacugggu

SEQ ID NO: 239876 - RNA, 32 nt, Human
ucucggcucacuguaagcuccgccucccgggu

SEQ ID NO: 239877 - RNA, 32 nt, Human
ucucggcucacuguaaucuccgccuccugggu

SEQ ID NO: 239878 - RNA, 32 nt, Human
ucucggcucacuguaccucugucucccugguu

SEQ ID NO: 239879 - RNA, 32 nt, Human
ucucggcucacuguagccucaaccugccaggu

SEQ ID NO: 239880 - RNA, 32 nt, Human
ucucggcucacuguagccuccaccucccccaa

SEQ ID NO: 239881 - RNA, 32 nt, Human
ucucggcucacugugaccucugccuccugggu

SEQ ID NO: 239882 - RNA, 32 nt, Human
ucucggcucagugcaaccucugccucccaggu

SEQ ID NO: 239883 - RNA, 32 nt, Human
ucucggcucauuacaaccuccaccucccgggu

SEQ ID NO: 239884 - RNA, 32 nt, Human
ucucggcucauugcaaccuccaccuuccagau

SEQ ID NO: 239885 - RNA, 32 nt, Human
ucucggcucauugcaaccuccgccucccgggu

SEQ ID NO: 239886 - RNA, 32 nt, Human
ucucggcucauugcaaccuccgccuccugggu

SEQ ID NO: 239887 - RNA, 32 nt, Human
ucucggcucauugcaaccuccgccuuccgggu

SEQ ID NO: 239888 - RNA, 32 nt, Human
ucucggcucauugcaaccucugcuuccugggc

SEQ ID NO: 239889 - RNA, 32 nt, Human
ucucggcucccugcaaccuccaccucccgggu

SEQ ID NO: 239890 - RNA, 32 nt, Human
ucucggcucccugcaaccuccaccuccugggu

SEQ ID NO: 239891 - RNA, 32 nt, Human
ucucggcucccugcaaccuucgccucccgggu

SEQ ID NO: 239892 - RNA, 32 nt, Human
ucucggcucccugcaaucuccaccucccaggu

SEQ ID NO: 239893 - RNA, 32 nt, Human
ucucggcucgccuuccagccucgccugagccc

SEQ ID NO: 239894 - RNA, 32 nt, Human
ucucggcucgcuacaaccuccaccucccagca

SEQ ID NO: 239895 - RNA, 32 nt, Human
ucucggcucgcugcaaccuccgccucccgggu

SEQ ID NO: 239896 - RNA, 32 nt, Human
ucucggcucgcugcaaccuccuccuccugggu

SEQ ID NO: 239897 - RNA, 32 nt, Human
ucucggcucgcugcaaccucugacucccuggu

SEQ ID NO: 239898 - RNA, 32 nt, Human
ucucggcucuaugcaaccuccaccuccugggu

SEQ ID NO: 239899 - RNA, 32 nt, Human
ucucggcucucaccgcaaccuccgucuccugg

SEQ ID NO: 239900 - RNA, 32 nt, Human
ucucggcucucugcaaccuccgccucccaggu

SEQ ID NO: 239901 - RNA, 32 nt, Human
ucucggcucucugcaaccucugccucccgggu

SEQ ID NO: 239902 - RNA, 32 nt, Human
ucucggcucucugcaaccucugucucccgggu

SEQ ID NO: 239903 - RNA, 32 nt, Human
ucucggcugacugcaaccacugccuccagggu

SEQ ID NO: 239904 - RNA, 32 nt, Human
ucucggcugacugcaaccuccaccucccgggu

SEQ ID NO: 239905 - RNA, 32 nt, Human
ucucggcugacugcaaccuccaccuccugggu

SEQ ID NO: 239906 - RNA, 32 nt, Human
ucucggcugccacccccucccccgguccuccg

SEQ ID NO: 239907 - RNA, 32 nt, Human
ucucggcuuacugcaaccuccaccucccaggu

SEQ ID NO: 239908 - RNA, 32 nt, Human
ucucggcuuacugcaaccuccgccuacugggu

SEQ ID NO: 239909 - RNA, 32 nt, Human
ucucggcuuacugcaaccuuugccucccaggu

SEQ ID NO: 239910 - RNA, 32 nt, Human
ucucggcuuacugcaacuuccagcuccugggu

SEQ ID NO: 239911 - RNA, 23 nt, Human
ucucggcuuacugcaagcuccgc

SEQ ID NO: 239912 - RNA, 32 nt, Human
ucucggcuuauggcaaccuccgccucccgggu

SEQ ID NO: 239913 - RNA, 32 nt, Human
ucucggcuuauugcaaccuccgcuuccugggu

SEQ ID NO: 239914 - RNA, 32 nt, Human
ucucgggacaggcuaaccaggaggacaggagc

SEQ ID NO: 239915 - RNA, 32 nt, Human
ucucgggagacgccgcgaaucucuccagggaa

SEQ ID NO: 239916 - RNA, 32 nt, Human
ucucgggaggcagagguugcagugagccgaga

SEQ ID NO: 239917 - RNA, 32 nt, Human
ucucgggaggcugaggcaggagaaucacuuga

SEQ ID NO: 239918 - RNA, 19 nt, Human
ucucgggauccuucuguca

SEQ ID NO: 239919 - RNA, 32 nt, Human
ucucgggcaagaaacauucaugcaugaguaua

SEQ ID NO: 239920 - RNA, 32 nt, Human
ucucgggcagcaauggccgagaagcgcgacac

SEQ ID NO: 239921 - RNA, 22 nt, Human
ucucgggcaguggguuuccugg

SEQ ID NO: 239922 - RNA, 32 nt, Human
ucucgggccagggagguugaggcugcagugag

SEQ ID NO: 239923 - RNA, 21 nt, Human
ucucgggcccauuggggccug

SEQ ID NO: 239924 - RNA, 32 nt, Human
ucucgggccuaguucaaaccuuugccucaaag

SEQ ID NO: 239925 - RNA, 32 nt, Human
ucucgggcucaagcaguccuccugccucaguc

SEQ ID NO: 239926 - RNA, 32 nt, Human
ucucgggcucaagccauuuuucugccucagcu

SEQ ID NO: 239927 - RNA, 32 nt, Human
ucucggggaagaagcuuccucuggccuggcgc

SEQ ID NO: 239928 - RNA, 32 nt, Human
ucucggggaagagaaagauagguuuaauuuau

SEQ ID NO: 239929 - RNA, 32 nt, Human
ucucggggaagagauggcggcggagcggggag

SEQ ID NO: 239930 - RNA, 32 nt, Human
ucucggggcaccuggcaggaggcgggugugug

SEQ ID NO: 239931 - RNA, 32 nt, Human
ucucggggcucuggagagaguggggcgggagg

SEQ ID NO: 239932 - RNA, 32 nt, Human
ucucgggggacgggggacagagccagggcuca

SEQ ID NO: 239933 - RNA, 32 nt, Human
ucucgggggccugugcaccucagucccuccug

SEQ ID NO: 239934 - RNA, 32 nt, Human
ucucgggucaccacaaccuccgccucccggau

SEQ ID NO: 239935 - RNA, 32 nt, Human
ucucgggucacugcaaccuccgccucccgggu

SEQ ID NO: 239936 - RNA, 32 nt, Human
ucucgggucacugcaaccucuaccuccagggu

SEQ ID NO: 239937 - RNA, 32 nt, Human
ucucgggucacugcaagcucugccucccaagu

SEQ ID NO: 239938 - RNA, 32 nt, Human
ucucgggucacugcagccucugucccuggguu

SEQ ID NO: 239939 - RNA, 32 nt, Human
ucucggguucaagcgauucuccugccucagcu

SEQ ID NO: 239940 - RNA, 32 nt, Human
ucucggguucaagugacucuucugccucagcc

SEQ ID NO: 239941 - RNA, 32 nt, Human
ucucggguucacaccauucuccugccucagcc

SEQ ID NO: 239942 - RNA, 32 nt, Human
ucucggguucacgccauucuccugccucagcc

SEQ ID NO: 239943 - RNA, 18 nt, Human
ucucggguuccacaugcc

SEQ ID NO: 239944 - RNA, 32 nt, Human
ucucggguuugcaccauucuccugccucagcc

SEQ ID NO: 239945 - RNA, 32 nt, Human
ucucgguauuucacaugcagcucucuuucugc

SEQ ID NO: 239946 - RNA, 32 nt, Human
ucucggucacagggaggaaggcagcuagaaau

SEQ ID NO: 239947 - RNA, 31 nt, Human
ucucggucacucaggaggcaguuggcagagu

SEQ ID NO: 239948 - RNA, 32 nt, Human
ucucggucuuccuucuugcuuuagggaccgga

SEQ ID NO: 239949 - RNA, 32 nt, Human
ucucgguggccgcugcuccagcgcggccugcg

SEQ ID NO: 239950 - RNA, 32 nt, Human
ucucggugggccugugcaggucugggaaggcc

SEQ ID NO: 239951 - RNA, 32 nt, Human
ucucgguguguucuguuaauguaagacgauga

SEQ ID NO: 239952 - RNA, 32 nt, Human
ucucgguucaagaaagcacguugcuauaugaa

SEQ ID NO: 239953 - RNA, 32 nt, Human
ucucgguucaccgcaaccuccacaucccaggu

SEQ ID NO: 239954 - RNA, 32 nt, Human
ucucgguucacugcaacauucaccucccaggu

SEQ ID NO: 239955 - RNA, 32 nt, Human
ucucgguucacugcaaccuccaccucccgagu

SEQ ID NO: 239956 - RNA, 32 nt, Human
ucucgguucacugcaaccuccaccucucagau

SEQ ID NO: 239957 - RNA, 32 nt, Human
ucucgguucacugcaaccuccgccuccagguu

SEQ ID NO: 239958 - RNA, 32 nt, Human
ucucgguucacugcaaccuccgccucccgguu

SEQ ID NO: 239959 - RNA, 32 nt, Human
ucucgguucacugcaaccucugccacccaugu

SEQ ID NO: 239960 - RNA, 32 nt, Human
ucucgguucacugcaaccucugccucccagga

SEQ ID NO: 239961 - RNA, 32 nt, Human
ucucgguucacugcaaccucugccucccaggu

SEQ ID NO: 239962 - RNA, 32 nt, Human
ucucgguucacugcaaccucugccuccugggu

SEQ ID NO: 239963 - RNA, 32 nt, Human
ucucgguucacugcaaccucugccucucaggu

SEQ ID NO: 239964 - RNA, 32 nt, Human
ucucgguucacugcaaccuuggccuccuaggu

SEQ ID NO: 239965 - RNA, 32 nt, Human
ucucgguucacugcagccuccaccucccgagc

SEQ ID NO: 239966 - RNA, 32 nt, Human
ucucgguucacugcagccucugccuucugggc

SEQ ID NO: 239967 - RNA, 32 nt, Human
ucucgguucauugcaaccuccgccucccgagu

SEQ ID NO: 239968 - RNA, 32 nt, Human
ucucgguucauugcaaccuccgccuccugcgu

SEQ ID NO: 239969 - RNA, 32 nt, Human
ucucgguucucuagucccacccgcucccacua

SEQ ID NO: 239970 - RNA, 32 nt, Human
ucucgguuugccagccuuugcagccacuuuug

SEQ ID NO: 239971 - RNA, 32 nt, Human
ucucguaccacagaggacaggucuccuccagc

SEQ ID NO: 239972 - RNA, 32 nt, Human
ucucguacuguaucuuacuauguccauacaga

SEQ ID NO: 239973 - RNA, 32 nt, Human
ucucguagauaacuucacagucauccaguccc

SEQ ID NO: 239974 - RNA, 32 nt, Human
ucucguagcuucaaauaccaucuaguuuauag

SEQ ID NO: 239975 - RNA, 32 nt, Human
ucucgucaaguacagcucugcaccguuguggc

SEQ ID NO: 239976 - RNA, 32 nt, Human
ucucgucaugcugcugugccugcucugccaac

SEQ ID NO: 239977 - RNA, 32 nt, Human
ucucgucccuuucuuacagccauuuuccugcu

SEQ ID NO: 239978 - RNA, 32 nt, Human
ucucguccgccucuccauaucuccccauuucc

SEQ ID NO: 239979 - RNA, 32 nt, Human
ucucguccuccuuugugcaggcgaggaagggg

SEQ ID NO: 239980 - RNA, 32 nt, Human
ucucguccugcccccaggcccugccggucccc

SEQ ID NO: 239981 - RNA, 32 nt, Human
ucucgucgcccaggcuggaaugcaguggugcg

SEQ ID NO: 239982 - RNA, 32 nt, Human
ucucgucgugcugcugugccugcucugccaac

SEQ ID NO: 239983 - RNA, 32 nt, Human
ucucgucucacauuugcacucucuccuuccca

SEQ ID NO: 239984 - RNA, 32 nt, Human
ucucgucucacccacucccagccuggggaaga

SEQ ID NO: 239985 - RNA, 32 nt, Human
ucucgucucacugcaaccuccgccucccagau

SEQ ID NO: 239986 - RNA, 32 nt, Human
ucucgucucacugcaaccucugccuccugggu

SEQ ID NO: 239987 - RNA, 32 nt, Human
ucucgucuccuccccuccuucuugucacuggc

SEQ ID NO: 239988 - RNA, 22 nt, Human
ucucgucuccuuccccucgcca

SEQ ID NO: 239989 - RNA, 32 nt, Human
ucucgucugacuccaaaugcaccaagaggaug

SEQ ID NO: 239990 - RNA, 32 nt, Human
ucucgugagaucugguuguuuaaaagugugca

SEQ ID NO: 239991 - RNA, 32 nt, Human
ucucgugauucuguuuguuacccauguucacu

SEQ ID NO: 239992 - RNA, 32 nt, Human
ucucgugcaauuacagaaugaacacccaucag

SEQ ID NO: 239993 - RNA, 32 nt, Human
ucucgugcccgccuccugccagucuccgggcc

SEQ ID NO: 239994 - RNA, 32 nt, Human
ucucgugcucagccacucugcccagcuggguu

SEQ ID NO: 239995 - RNA, 32 nt, Human
ucucgugcuucauguagaacccuuagguuugc

SEQ ID NO: 239996 - RNA, 32 nt, Human
ucucguggaacccagaggggcugaggacugug

SEQ ID NO: 239997 - RNA, 32 nt, Human
ucucguggguaaggcccggugccuggaagacc

SEQ ID NO: 239998 - RNA, 20 nt, Human
ucucguucucucuccuuccc

SEQ ID NO: 239999 - RNA, 32 nt, Human
ucucguugccaaggcuggagugcaauggcacg

SEQ ID NO: 240000 - RNA, 24 nt, Human
ucucguugcccaggcuggagugca

SEQ ID NO: 240001 - RNA, 32 nt, Human
ucucguugcccaggcuggagugcaauggcgcg

SEQ ID NO: 240002 - RNA, 32 nt, Human
ucucguugccgaggcuggaguguaguagugug

SEQ ID NO: 240003 - RNA, 32 nt, Human
ucucguuuugggccagaggcagccucugcacu

SEQ ID NO: 240004 - RNA, 32 nt, Human
ucucuaaaaauacaaaaauuagcugggcgugg

SEQ ID NO: 240005 - RNA, 26 nt, Human
ucucuaaaacugccaagaucacauca

SEQ ID NO: 240006 - RNA, 32 nt, Human
ucucuaaaauaugaaaucagaguuuggaacau

SEQ ID NO: 240007 - RNA, 32 nt, Human
ucucuaaaccucagugcugagaccuaugcagu

SEQ ID NO: 240008 - RNA, 32 nt, Human
ucucuaaagcagugguccagacuugccacaua

SEQ ID NO: 240009 - RNA, 32 nt, Human
ucucuaaagcaucuuaccccugugcuggaggu

SEQ ID NO: 240010 - RNA, 25 nt, Human
ucucuaaauauguagaccucacuaa

SEQ ID NO: 240011 - RNA, 32 nt, Human
ucucuaaauuccagcuuuacugugaaguucua

SEQ ID NO: 240012 - RNA, 32 nt, Human
ucucuaacauuuccuuacagaacuacuucuua

SEQ ID NO: 240013 - RNA, 32 nt, Human
ucucuaacccgagcuagagugcagugacgcga

SEQ ID NO: 240014 - RNA, 32 nt, Human
ucucuaacucuuaucuuccacaggguccaaga

SEQ ID NO: 240015 - RNA, 32 nt, Human
ucucuaaggaagggagaggagcccuagagaga

SEQ ID NO: 240016 - RNA, 24 nt, Human
ucucuacaaaaaacacaaaaauua

SEQ ID NO: 240017 - RNA, 24 nt, Human
ucucuacaaaaaacauaaaaguua

SEQ ID NO: 240018 - RNA, 22 nt, Human
ucucuacaaaaaauaaaaaaua

SEQ ID NO: 240019 - RNA, 23 nt, Human
ucucuacaaaaaauaaaaaauua

SEQ ID NO: 240020 - RNA, 20 nt, Human
ucucuacaaaaaauacaaaa

SEQ ID NO: 240021 - RNA, 24 nt, Human
ucucuacaaaaaauacaaaaauua

SEQ ID NO: 240022 - RNA, 21 nt, Human
ucucuacaaaaaauacaaaau

SEQ ID NO: 240023 - RNA, 23 nt, Human
ucucuacaaaaaauacaaaauua

SEQ ID NO: 240024 - RNA, 24 nt, Human
ucucuacaaaaaauacagaaauua

SEQ ID NO: 240025 - RNA, 24 nt, Human
ucucuacaaaaaaugcaaaaauua

SEQ ID NO: 240026 - RNA, 24 nt, Human
ucucuacaaaaaaugcuaaaauua

SEQ ID NO: 240027 - RNA, 22 nt, Human
ucucuacaaaaaauuaaaaauu

SEQ ID NO: 240028 - RNA, 24 nt, Human
ucucuacaaaaaauuaaaacauua

SEQ ID NO: 240029 - RNA, 23 nt, Human
ucucuacaaaaaauuaaagauua

SEQ ID NO: 240030 - RNA, 25 nt, Human
ucucuacaaaaaauuuaaaaaauua

SEQ ID NO: 240031 - RNA, 24 nt, Human
ucucuacaaaaaauuuaaaaauua

SEQ ID NO: 240032 - RNA, 24 nt, Human
ucucuacaaaaaauuuaagaauua

SEQ ID NO: 240033 - RNA, 23 nt, Human
ucucuacaaaaaauuuuaaaaau

SEQ ID NO: 240034 - RNA, 23 nt, Human
ucucuacaaaaaccaaaaaguua

SEQ ID NO: 240035 - RNA, 24 nt, Human
ucucuacaaaaacuacaaaaauua

SEQ ID NO: 240036 - RNA, 25 nt, Human
ucucuacaaaaagacacaaaaauua

SEQ ID NO: 240037 - RNA, 24 nt, Human
ucucuacaaaaagcauaaaaauua

SEQ ID NO: 240038 - RNA, 22 nt, Human
ucucuacaaaaaguaaaaauua

SEQ ID NO: 240039 - RNA, 30 nt, Human
ucucuacaaaaaguaaacaaaaaucagccg

SEQ ID NO: 240040 - RNA, 24 nt, Human
ucucuacaaaaaguacaaaaauua

SEQ ID NO: 240041 - RNA, 24 nt, Human
ucucuacaaaaaguuaaaaaauua

SEQ ID NO: 240042 - RNA, 19 nt, Human
ucucuacaaaaauacaaaa

SEQ ID NO: 240043 - RNA, 23 nt, Human
ucucuacaaaaauacaaaaauua

SEQ ID NO: 240044 - RNA, 32 nt, Human
ucucuacaaaaauacaaaaauuaauugggcgu

SEQ ID NO: 240045 - RNA, 32 nt, Human
ucucuacaaaaauacaaaaauuagccaggcgu

SEQ ID NO: 240046 - RNA, 32 nt, Human
ucucuacaaaaauacaaaaauuagccaggugu

SEQ ID NO: 240047 - RNA, 32 nt, Human
ucucuacaaaaauacaaaaauuagcugggcgu

SEQ ID NO: 240048 - RNA, 32 nt, Human
ucucuacaaaaauacaaaaauuaggugggugu

SEQ ID NO: 240049 - RNA, 32 nt, Human
ucucuacaaaaauacaaaauuagccagguaug

SEQ ID NO: 240050 - RNA, 32 nt, Human
ucucuacaaaaauauggaaauuagcugggcau

SEQ ID NO: 240051 - RNA, 24 nt, Human
ucucuacaaaaauuuaaaaaauua

SEQ ID NO: 240052 - RNA, 23 nt, Human
ucucuacaaaaauuuaaaaauua

SEQ ID NO: 240053 - RNA, 27 nt, Human
ucucuacaaaaauuuuuuaaaaaauua

SEQ ID NO: 240054 - RNA, 22 nt, Human
ucucuacaaaacuuaaaaguua

SEQ ID NO: 240055 - RNA, 32 nt, Human
ucucuacaaaacuuaaaaguuagccaggccug

SEQ ID NO: 240056 - RNA, 23 nt, Human
ucucuacaaaagauuaaaaauua

SEQ ID NO: 240057 - RNA, 32 nt, Human
ucucuacaaaagauuaaaaauuagcugcgugu

SEQ ID NO: 240058 - RNA, 26 nt, Human
ucucuacaaaagauuuuuaaaaauua

SEQ ID NO: 240059 - RNA, 32 nt, Human
ucucuacaaaagauuuuuaaaaauuagccagg

SEQ ID NO: 240060 - RNA, 23 nt, Human
ucucuacaaaaguacaaaaauua

SEQ ID NO: 240061 - RNA, 32 nt, Human
ucucuacaaaaguacaaaaauuagccaggcgu

SEQ ID NO: 240062 - RNA, 27 nt, Human
ucucuacaaaauaauuuuuaaaaauua

SEQ ID NO: 240063 - RNA, 24 nt, Human
ucucuacaaaauauacaaaaauua

SEQ ID NO: 240064 - RNA, 22 nt, Human
ucucuacaaaauauacaaaaua

SEQ ID NO: 240065 - RNA, 24 nt, Human
ucucuacaaaauauuaaaacauua

SEQ ID NO: 240066 - RNA, 24 nt, Human
ucucuacaaacaauacaaaaauua

SEQ ID NO: 240067 - RNA, 24 nt, Human
ucucuacaaacauuuuaaaaauua

SEQ ID NO: 240068 - RNA, 24 nt, Human
ucucuacaaauaaauaaaaaauua

SEQ ID NO: 240069 - RNA, 23 nt, Human
ucucuacaaauaaauaaaaauua

SEQ ID NO: 240070 - RNA, 32 nt, Human
ucucuacaaauaaauaaaaauuagcugggcaa

SEQ ID NO: 240071 - RNA, 19 nt, Human
ucucuacaaauaauaaaaa

SEQ ID NO: 240072 - RNA, 32 nt, Human
ucucuacaacaaaaauacaaaaauuagccaag

SEQ ID NO: 240073 - RNA, 32 nt, Human
ucucuacacccacccaaaagucacccagggac

SEQ ID NO: 240074 - RNA, 24 nt, Human
ucucuacagacgaucaaaaaauua

SEQ ID NO: 240075 - RNA, 32 nt, Human
ucucuacagagcugugacgggggcacugagcc

SEQ ID NO: 240076 - RNA, 32 nt, Human
ucucuacagcauccaccucucuuggcucuugu

SEQ ID NO: 240077 - RNA, 32 nt, Human
ucucuacauccuggaagaggcagcagucucuu

SEQ ID NO: 240078 - RNA, 32 nt, Human
ucucuacaucuucucuuggagugagggaggcu

SEQ ID NO: 240079 - RNA, 32 nt, Human
ucucuacaugaacugcucauuuggaggacagc

SEQ ID NO: 240080 - RNA, 32 nt, Human
ucucuacaugguggucuagauaagcuaauuuu

SEQ ID NO: 240081 - RNA, 26 nt, Human
ucucuaccaaaaaacuuuaaaaauua

SEQ ID NO: 240082 - RNA, 20 nt, Human
ucucuaccaaaaauacaaaa

SEQ ID NO: 240083 - RNA, 32 nt, Human
ucucuaccaaaacagaagcaguauagaccgac

SEQ ID NO: 240084 - RNA, 32 nt, Human
ucucuaccaaaauaaaaauuagcugggcaugg

SEQ ID NO: 240085 - RNA, 32 nt, Human
ucucuaccaaaauacaaaaauuagccgggcau

SEQ ID NO: 240086 - RNA, 32 nt, Human
ucucuaccaaccacugucccagagucaccaaa

SEQ ID NO: 240087 - RNA, 32 nt, Human
ucucuaccacaagccaccagcacuauaaccag

SEQ ID NO: 240088 - RNA, 32 nt, Human
ucucuaccacagcaaacacauucuccaccaug

SEQ ID NO: 240089 - RNA, 32 nt, Human
ucucuaccauggagaagagcaggaagggauac

SEQ ID NO: 240090 - RNA, 22 nt, Human
ucucuaccaugucccccagaca

SEQ ID NO: 240091 - RNA, 32 nt, Human
ucucuaccauuugaaguugauuucucaaugcu

SEQ ID NO: 240092 - RNA, 32 nt, Human
ucucuacccuauucccccucugagccuuugcu

SEQ ID NO: 240093 - RNA, 32 nt, Human
ucucuacccuugccguaucuaaggagcugagg

SEQ ID NO: 240094 - RNA, 32 nt, Human
ucucuaccuccauccuugaaucauccacuuuu

SEQ ID NO: 240095 - RNA, 32 nt, Human
ucucuaccuccccuccccaccucuucucuccc

SEQ ID NO: 240096 - RNA, 20 nt, Human
ucucuacgaaaaauacaaaa

SEQ ID NO: 240097 - RNA, 21 nt, Human
ucucuacgaaaaauacaaaau

SEQ ID NO: 240098 - RNA, 32 nt, Human
ucucuacgcuggaaauuugcugccucaauguu

SEQ ID NO: 240099 - RNA, 21 nt, Human
ucucuacuaaaaaauacaaaa

SEQ ID NO: 240100 - RNA, 20 nt, Human
ucucuacuaaaaacacaaaa

SEQ ID NO: 240101 - RNA, 32 nt, Human
ucucuacuaaaaacacaaauuagccaggcgug

SEQ ID NO: 240102 - RNA, 21 nt, Human
ucucuacuaaaaacgcaaaau

SEQ ID NO: 240103 - RNA, 20 nt, Human
ucucuacuaaaaagacaaaa

SEQ ID NO: 240104 - RNA, 21 nt, Human
ucucuacuaaaaaguacaaaa

SEQ ID NO: 240105 - RNA, 21 nt, Human
ucucuacuaaaaauaaaaaau

SEQ ID NO: 240106 - RNA, 19 nt, Human
ucucuacuaaaaauacaaa

SEQ ID NO: 240107 - RNA, 20 nt, Human
ucucuacuaaaaauacaaaa

SEQ ID NO: 240108 - RNA, 21 nt, Human
ucucuacuaaaaauacaaaau

SEQ ID NO: 240109 - RNA, 32 nt, Human
ucucuacuaaaaauacaaaauuagcugggcau

SEQ ID NO: 240110 - RNA, 32 nt, Human
ucucuacuaaaaauacaaaauuagcugggcgu

SEQ ID NO: 240111 - RNA, 32 nt, Human
ucucuacuaaaaauacaaaauuagcugggugg

SEQ ID NO: 240112 - RNA, 32 nt, Human
ucucuacuaaaaauacaaaauuagcugggugu

SEQ ID NO: 240113 - RNA, 32 nt, Human
ucucuacuaaaaauacaaaauuagucgggcgu

SEQ ID NO: 240114 - RNA, 32 nt, Human
ucucuacuaaaaauacaaaauuagucggguau

SEQ ID NO: 240115 - RNA, 32 nt, Human
ucucuacuaaaaauacaauuagccaggugugg

SEQ ID NO: 240116 - RNA, 20 nt, Human
ucucuacuaaaaauacagaa

SEQ ID NO: 240117 - RNA, 32 nt, Human
ucucuacuaaaaauacagaaaaauuagccagg

SEQ ID NO: 240118 - RNA, 32 nt, Human
ucucuacuaaaaauacagaauuagcugagugu

SEQ ID NO: 240119 - RNA, 22 nt, Human
ucucuacuaaaaauaccaaaau

SEQ ID NO: 240120 - RNA, 20 nt, Human
ucucuacuaaaaauacgaaa

SEQ ID NO: 240121 - RNA, 20 nt, Human
ucucuacuaaaaauauaaaa

SEQ ID NO: 240122 - RNA, 21 nt, Human
ucucuacuaaaaauauaaaau

SEQ ID NO: 240123 - RNA, 19 nt, Human
ucucuacuaaaaaugcaaa

SEQ ID NO: 240124 - RNA, 20 nt, Human
ucucuacuaaaaaugcaaaa

SEQ ID NO: 240125 - RNA, 32 nt, Human
ucucuacuaaaaaugcaaaauuagucaggcau

SEQ ID NO: 240126 - RNA, 32 nt, Human
ucucuacuaaaaauuaaaaauuagcuggacau

SEQ ID NO: 240127 - RNA, 21 nt, Human
ucucuacuaaaaauucaaaau

SEQ ID NO: 240128 - RNA, 24 nt, Human
ucucuacuaaaaauuuaaaaauua

SEQ ID NO: 240129 - RNA, 21 nt, Human
ucucuacuaaaacauacaaaa

SEQ ID NO: 240130 - RNA, 20 nt, Human
ucucuacuaaaacuacaaaa

SEQ ID NO: 240131 - RNA, 19 nt, Human
ucucuacuaaaaguacaaa

SEQ ID NO: 240132 - RNA, 20 nt, Human
ucucuacuaaaaguacaaaa

SEQ ID NO: 240133 - RNA, 19 nt, Human
ucucuacuaaaauacaaaa

SEQ ID NO: 240134 - RNA, 32 nt, Human
ucucuacuaaaauacaaaaaguuagcugggcu

SEQ ID NO: 240135 - RNA, 32 nt, Human
ucucuacuaaaauacaaaaauuagcugggcau

SEQ ID NO: 240136 - RNA, 32 nt, Human
ucucuacuaaaauacaaaaauuagcugggugu

SEQ ID NO: 240137 - RNA, 32 nt, Human
ucucuacuaaaauacaaaaauuagguguggug

SEQ ID NO: 240138 - RNA, 20 nt, Human
ucucuacuaaaauacaaaau

SEQ ID NO: 240139 - RNA, 32 nt, Human
ucucuacuaaaauaguacaaaaauuagccggg

SEQ ID NO: 240140 - RNA, 20 nt, Human
ucucuacuaaaauuacaaaa

SEQ ID NO: 240141 - RNA, 24 nt, Human
ucucuacuaaaauuauaaaaauua

SEQ ID NO: 240142 - RNA, 32 nt, Human
ucucuacuaaacauacaaaauuagcugggcau

SEQ ID NO: 240143 - RNA, 21 nt, Human
ucucuacuaaacuacaaaaua

SEQ ID NO: 240144 - RNA, 20 nt, Human
ucucuacuaaagauacaaaa

SEQ ID NO: 240145 - RNA, 32 nt, Human
ucucuacuaacauacaaaauuagcugggcaca

SEQ ID NO: 240146 - RNA, 20 nt, Human
ucucuacuaagaauacaaaa

SEQ ID NO: 240147 - RNA, 32 nt, Human
ucucuacuaagaauacaaaauuagcugggcau

SEQ ID NO: 240148 - RNA, 20 nt, Human
ucucuacuaauaauacaaaa

SEQ ID NO: 240149 - RNA, 20 nt, Human
ucucuacuagaaauacaaaa

SEQ ID NO: 240150 - RNA, 21 nt, Human
ucucuacuagaaauacaaaau

SEQ ID NO: 240151 - RNA, 32 nt, Human
ucucuacuagaaauacagaaaaauuagcuggg

SEQ ID NO: 240152 - RNA, 20 nt, Human
ucucuacuauaaauacaaaa

SEQ ID NO: 240153 - RNA, 32 nt, Human
ucucuacucacugcaaccuccaccucccgggu

SEQ ID NO: 240154 - RNA, 32 nt, Human
ucucuacucacugcagccucaaucuccugguc

SEQ ID NO: 240155 - RNA, 19 nt, Human
ucucuacucagcccaguca

SEQ ID NO: 240156 - RNA, 32 nt, Human
ucucuacucauaguuucaagcuuuucaguuua

SEQ ID NO: 240157 - RNA, 20 nt, Human
ucucuacugaaaauacaaaa

SEQ ID NO: 240158 - RNA, 32 nt, Human
ucucuacugaaaauucaaaauuagccuggugu

SEQ ID NO: 240159 - RNA, 32 nt, Human
ucucuacugcaaaaacucaaaaauuagccagg

SEQ ID NO: 240160 - RNA, 32 nt, Human
ucucuacuucugguuucagaaaacacgagaga

SEQ ID NO: 240161 - RNA, 32 nt, Human
ucucuagaaagacauccugagaggacuuggca

SEQ ID NO: 240162 - RNA, 32 nt, Human
ucucuagaagcugcauccccagcccuuucacc

SEQ ID NO: 240163 - RNA, 31 nt, Human
ucucuagagagguacaguuguaagucagagu

SEQ ID NO: 240164 - RNA, 32 nt, Human
ucucuagauguccaugcccugccuucucagga

SEQ ID NO: 240165 - RNA, 32 nt, Human
ucucuagcaaguggucaggacgcugauuguuc

SEQ ID NO: 240166 - RNA, 32 nt, Human
ucucuagcagagggaggggacccaccccagug

SEQ ID NO: 240167 - RNA, 32 nt, Human
ucucuagcagcaccuccugucccuugaccuua

SEQ ID NO: 240168 - RNA, 32 nt, Human
ucucuagccagccugaccucuccauucccuuc

SEQ ID NO: 240169 - RNA, 32 nt, Human
ucucuagccugugcucuccauaugcucaucca

SEQ ID NO: 240170 - RNA, 32 nt, Human
ucucuagcuagugccucuugcccucuccucac

SEQ ID NO: 240171 - RNA, 32 nt, Human
ucucuaggacgcagcagccucuccccagcacu

SEQ ID NO: 240172 - RNA, 26 nt, Human
ucucuaggacggggcugcagcauagg

SEQ ID NO: 240173 - RNA, 32 nt, Human
ucucuaggcaagaaucccggaggcagaggcca

SEQ ID NO: 240174 - RNA, 32 nt, Human
ucucuaggcucuggaguauggaagugacagcu

SEQ ID NO: 240175 - RNA, 32 nt, Human
ucucuagggcugacaugagaacuccaugucac

SEQ ID NO: 240176 - RNA, 32 nt, Human
ucucuagggcugggacgcccauuucuucuugc

SEQ ID NO: 240177 - RNA, 32 nt, Human
ucucuagggugcuucuuccagagucugucuuc

SEQ ID NO: 240178 - RNA, 32 nt, Human
ucucuaggugagggucuugaugaggacagaag

SEQ ID NO: 240179 - RNA, 20 nt, Human
ucucuaguaaaaauacaaaa

SEQ ID NO: 240180 - RNA, 32 nt, Human
ucucuaguagguggaaagguagguggagcagg

SEQ ID NO: 240181 - RNA, 32 nt, Human
ucucuagucccaauuacucaggaggcugaggc

SEQ ID NO: 240182 - RNA, 32 nt, Human
ucucuagucccagcuacucgggaggcugaggc

SEQ ID NO: 240183 - RNA, 32 nt, Human
ucucuagucucagcuacucaggaggcuguggc

SEQ ID NO: 240184 - RNA, 32 nt, Human
ucucuagugcugccucacauugggccucagca

SEQ ID NO: 240185 - RNA, 32 nt, Human
ucucuaguuacucccucccuguccucacuccu

SEQ ID NO: 240186 - RNA, 32 nt, Human
ucucuaguucacaaggacagaggagauggaga

SEQ ID NO: 240187 - RNA, 32 nt, Human
ucucuaguucgucauccucccuucccauaucc

SEQ ID NO: 240188 - RNA, 24 nt, Human
ucucuauaaaaauuuuaaaaauua

SEQ ID NO: 240189 - RNA, 21 nt, Human
ucucuauaaccugccccguca

SEQ ID NO: 240190 - RNA, 26 nt, Human
ucucuauauacacauuuuaaacauua

SEQ ID NO: 240191 - RNA, 32 nt, Human
ucucuauccaggacaucaggagugagggaugg

SEQ ID NO: 240192 - RNA, 32 nt, Human
ucucuaucuguagcuacuuucucugggcugca

SEQ ID NO: 240193 - RNA, 32 nt, Human
ucucuaucuuucuauucucaccaauaaucucu

SEQ ID NO: 240194 - RNA, 32 nt, Human
ucucuaugaaaaauauuuaaaaauuagcuggg

SEQ ID NO: 240195 - RNA, 25 nt, Human
ucucuaugaugaaguuuaaaaauua

SEQ ID NO: 240196 - RNA, 20 nt, Human
ucucuauuaaaaauacaaaa

SEQ ID NO: 240197 - RNA, 32 nt, Human
ucucuauucccuccuucucauaacugccaccc

SEQ ID NO: 240198 - RNA, 32 nt, Human
ucucuauuccugacccucccuaccugaggccu

SEQ ID NO: 240199 - RNA, 32 nt, Human
ucucuauucuauccugguucugccucaaccau

SEQ ID NO: 240200 - RNA, 32 nt, Human
ucucuauucucccagccccgcacugccugggg

SEQ ID NO: 240201 - RNA, 32 nt, Human
ucucuauucucccagcccugcacugccugggg

SEQ ID NO: 240202 - RNA, 21 nt, Human
ucucuauucuuucaacagguu

SEQ ID NO: 240203 - RNA, 32 nt, Human
ucucuauuggagugucuguuucuuuaagcugu

SEQ ID NO: 240204 - RNA, 32 nt, Human
ucucuauuucacuugaccccugcccaccucuc

SEQ ID NO: 240205 - RNA, 32 nt, Human
ucucuauuuugucccugaauaauauuuuucuu

SEQ ID NO: 240206 - RNA, 32 nt, Human
ucucucaaaauugccauuuucucuaccauguc

SEQ ID NO: 240207 - RNA, 32 nt, Human
ucucucaaagugcugggauuacaggcauaagc

SEQ ID NO: 240208 - RNA, 32 nt, Human
ucucucaaagugcugggauuacaggcaugagc

SEQ ID NO: 240209 - RNA, 32 nt, Human
ucucucaaagugcugggauuacaggugugagc

SEQ ID NO: 240210 - RNA, 32 nt, Human
ucucucaagaagcaagagaacaccugcaggaa

SEQ ID NO: 240211 - RNA, 32 nt, Human
ucucucaagaugaccugaguuccuuccugcca

SEQ ID NO: 240212 - RNA, 32 nt, Human
ucucucaagccugauguguccucucucucuuu

SEQ ID NO: 240213 - RNA, 32 nt, Human
ucucucaaggggcacugucauguaggagucug

SEQ ID NO: 240214 - RNA, 32 nt, Human
ucucucaauccuccuccuccuccucuuucuug

SEQ ID NO: 240215 - RNA, 32 nt, Human
ucucucacccaggccugaagugcaguggcaug

SEQ ID NO: 240216 - RNA, 32 nt, Human
ucucucaccucagccuccugaguaggugggau

SEQ ID NO: 240217 - RNA, 32 nt, Human
ucucucaccuucuugacccucucuccaucauu

SEQ ID NO: 240218 - RNA, 32 nt, Human
ucucucacucacugcaauugcuucuacucugg

SEQ ID NO: 240219 - RNA, 32 nt, Human
ucucucacugauccauuuggcuguaguuuuca

SEQ ID NO: 240220 - RNA, 32 nt, Human
ucucucacuuccccaucuugucuuccuagacc

SEQ ID NO: 240221 - RNA, 32 nt, Human
ucucucagaccagcucacugaggcagaggagu

SEQ ID NO: 240222 - RNA, 32 nt, Human
ucucucagaguguugggauuacagccaugagc

SEQ ID NO: 240223 - RNA, 32 nt, Human
ucucucagaguugcugucuucucugagacaca

SEQ ID NO: 240224 - RNA, 21 nt, Human
ucucucagcaaaccugcuggg

SEQ ID NO: 240225 - RNA, 32 nt, Human
ucucucagcagagaucuuccagagugucagcc

SEQ ID NO: 240226 - RNA, 32 nt, Human
ucucucagcauccccucuagcuccuuacaccc

SEQ ID NO: 240227 - RNA, 32 nt, Human
ucucucagccuccacucccugucugaaaccag

SEQ ID NO: 240228 - RNA, 32 nt, Human
ucucucagcuggagagacucgggaugggguaa

SEQ ID NO: 240229 - RNA, 32 nt, Human
ucucucagcuucccucccaggaucaguuucua

SEQ ID NO: 240230 - RNA, 32 nt, Human
ucucucaggaggugggcugaccaccagaauga

SEQ ID NO: 240231 - RNA, 32 nt, Human
ucucucaggcuggguugcaauggcacaaucuc

SEQ ID NO: 240232 - RNA, 32 nt, Human
ucucucagggcugcuaugggcugaauugcuuu

SEQ ID NO: 240233 - RNA, 32 nt, Human
ucucucaucuugcaccccaaccucuguaaaua

SEQ ID NO: 240234 - RNA, 32 nt, Human
ucucucaucuuucucauccuguucucucacua

SEQ ID NO: 240235 - RNA, 32 nt, Human
ucucucaugaaaggagaugaacugcuucagau

SEQ ID NO: 240236 - RNA, 32 nt, Human
ucucucaugcauucccuggccuggaggcguca

SEQ ID NO: 240237 - RNA, 32 nt, Human
ucucucauggucugaaauugacuggggucucc

SEQ ID NO: 240238 - RNA, 32 nt, Human
ucucucauuuucuucccucucucccuccaucu

SEQ ID NO: 240239 - RNA, 32 nt, Human
ucucuccaaaccuguuucugcuggauugcgca

SEQ ID NO: 240240 - RNA, 32 nt, Human
ucucuccaaaugaagacaucacagccucauuc

SEQ ID NO: 240241 - RNA, 32 nt, Human
ucucuccaagccuucuuauuucacugcaguua

SEQ ID NO: 240242 - RNA, 32 nt, Human
ucucuccacacggagcuccuggcagcgagaac

SEQ ID NO: 240243 - RNA, 21 nt, Human
ucucuccaccaaagcucaucc

SEQ ID NO: 240244 - RNA, 32 nt, Human
ucucuccacuacccgcuggagauuucugcagc

SEQ ID NO: 240245 - RNA, 21 nt, Human
ucucuccacucaacuccaccc

SEQ ID NO: 240246 - RNA, 32 nt, Human
ucucuccacucucagccaucagugccagucca

SEQ ID NO: 240247 - RNA, 32 nt, Human
ucucuccacugcauuguuucacugggcucacc

SEQ ID NO: 240248 - RNA, 32 nt, Human
ucucuccacuggccgccagccucccuagcaca

SEQ ID NO: 240249 - RNA, 32 nt, Human
ucucuccagacuccaccacugacuguuucaga

SEQ ID NO: 240250 - RNA, 32 nt, Human
ucucuccagcauggacaggcggcugagaaggg

SEQ ID NO: 240251 - RNA, 32 nt, Human
ucucuccagccagccacugccuucuuuguaau

SEQ ID NO: 240252 - RNA, 19 nt, Human
ucucuccagcccacucuuc

SEQ ID NO: 240253 - RNA, 32 nt, Human
ucucuccagggcuguugguucuuucuccugac

SEQ ID NO: 240254 - RNA, 32 nt, Human
ucucuccaguugguuuucagcuggggcuugaa

SEQ ID NO: 240255 - RNA, 32 nt, Human
ucucuccauccagcgugaccagggcccgagag

SEQ ID NO: 240256 - RNA, 32 nt, Human
ucucuccauugccugcaccccaccccagccac

SEQ ID NO: 240257 - RNA, 28 nt, Human
ucucucccaagugccuugaucuuuguaa

SEQ ID NO: 240258 - RNA, 32 nt, Human
ucucucccacacccugcccuccuuguuucagc

SEQ ID NO: 240259 - RNA, 32 nt, Human
ucucucccacccacacuuaucucccccagggc

SEQ ID NO: 240260 - RNA, 19 nt, Human
ucucucccaccuccuuccc

SEQ ID NO: 240261 - RNA, 32 nt, Human
ucucucccacugcaacuccacuuucuuugcau

SEQ ID NO: 240262 - RNA, 32 nt, Human
ucucucccagaacccacagugggaaagcgguc

SEQ ID NO: 240263 - RNA, 32 nt, Human
ucucucccagagaacuacuggauuuccucaua

SEQ ID NO: 240264 - RNA, 32 nt, Human
ucucucccagcuuagccucuggcuguaagcuu

SEQ ID NO: 240265 - RNA, 32 nt, Human
ucucucccauuuucucucugcuuucucuccaa

SEQ ID NO: 240266 - RNA, 24 nt, Human
ucucuccccacagccucaaggcca

SEQ ID NO: 240267 - RNA, 32 nt, Human
ucucuccccagcugccuccuccucuucucucc

SEQ ID NO: 240268 - RNA, 32 nt, Human
ucucuccccgccccucuccucggcccuuucuc

SEQ ID NO: 240269 - RNA, 32 nt, Human
ucucuccccgccucgccuucccucucuucugu

SEQ ID NO: 240270 - RNA, 32 nt, Human
ucucuccccucacauccuccugcccagcuccu

SEQ ID NO: 240271 - RNA, 32 nt, Human
ucucuccccuccucugaauuuaauucuuucaa

SEQ ID NO: 240272 - RNA, 32 nt, Human
ucucuccccuucuuccucgguuucuuccgucc

SEQ ID NO: 240273 - RNA, 32 nt, Human
ucucucccgaaaauacaaaauuagccaggcgu

SEQ ID NO: 240274 - RNA, 32 nt, Human
ucucucccgcagcugccucagucggcuacucu

SEQ ID NO: 240275 - RNA, 32 nt, Human
ucucucccguuuucucuuugcuuucucuccaa

SEQ ID NO: 240276 - RNA, 32 nt, Human
ucucucccuagugucccuucagccugggcuga

SEQ ID NO: 240277 - RNA, 32 nt, Human
ucucucccucaugaacacccacccaccucguu

SEQ ID NO: 240278 - RNA, 32 nt, Human
ucucucccuccaccccuugcagccugggcugu

SEQ ID NO: 240279 - RNA, 32 nt, Human
ucucucccuccagggccacugcuugaagaaga

SEQ ID NO: 240280 - RNA, 32 nt, Human
ucucucccuccccacuuucuccuuuuccuucc

SEQ ID NO: 240281 - RNA, 32 nt, Human
ucucucccucccccuucaggggcucccugccu

SEQ ID NO: 240282 - RNA, 32 nt, Human
ucucucccuccccuaauuucugagguugguuc

SEQ ID NO: 240283 - RNA, 32 nt, Human
ucucucccuccccucccccuucuacuuuagcc

SEQ ID NO: 240284 - RNA, 32 nt, Human
ucucucccuccuacagugcucucccucccugg

SEQ ID NO: 240285 - RNA, 32 nt, Human
ucucucccuccuccuccccucucccucccccu

SEQ ID NO: 240286 - RNA, 32 nt, Human
ucucucccucucccucucccacucucccucuc

SEQ ID NO: 240287 - RNA, 32 nt, Human
ucucucccucucccucucccucucugucucgg

SEQ ID NO: 240288 - RNA, 20 nt, Human
ucucucccucucuccuuccc

SEQ ID NO: 240289 - RNA, 32 nt, Human
ucucucccucugggcuggagcucagugaggga

SEQ ID NO: 240290 - RNA, 32 nt, Human
ucucucccucugucucccuccuggccauucug

SEQ ID NO: 240291 - RNA, 19 nt, Human
ucucucccucuucuuuccc

SEQ ID NO: 240292 - RNA, 32 nt, Human
ucucucccugaaccugauccucagccuucagu

SEQ ID NO: 240293 - RNA, 32 nt, Human
ucucucccugcccuuuuccugccugaagagca

SEQ ID NO: 240294 - RNA, 32 nt, Human
ucucucccugccuuuaaaugaaacaagucuag

SEQ ID NO: 240295 - RNA, 32 nt, Human
ucucucccugcucucugccugagcucugggcc

SEQ ID NO: 240296 - RNA, 21 nt, Human
ucucucccugcuguauauuaa

SEQ ID NO: 240297 - RNA, 32 nt, Human
ucucucccuguggcuggucugguucucaugua

SEQ ID NO: 240298 - RNA, 32 nt, Human
ucucucccuucggcuucucucuuucggccggc

SEQ ID NO: 240299 - RNA, 32 nt, Human
ucucucccuucuuuaccuucauuucauccugu

SEQ ID NO: 240300 - RNA, 32 nt, Human
ucucucccuuggcaaauguaaguuuucuaagu

SEQ ID NO: 240301 - RNA, 32 nt, Human
ucucucccuuucuagguauuugcauaggaauc

SEQ ID NO: 240302 - RNA, 32 nt, Human
ucucucccuuucucccccucucucucugccuu

SEQ ID NO: 240303 - RNA, 32 nt, Human
ucucucccuuucucccuccauccuuccacuuc

SEQ ID NO: 240304 - RNA, 32 nt, Human
ucucucccuuucucccucgcuccccaccaacu

SEQ ID NO: 240305 - RNA, 32 nt, Human
ucucucccuuucucucuccuucucuguuucuc

SEQ ID NO: 240306 - RNA, 20 nt, Human
ucucuccgcugccccgguca

SEQ ID NO: 240307 - RNA, 32 nt, Human
ucucuccggcugggaugaucacacccucugcu

SEQ ID NO: 240308 - RNA, 23 nt, Human
ucucuccguugccccagcuucac

SEQ ID NO: 240309 - RNA, 32 nt, Human
ucucuccuauuuccuuucuaccuuccguguuu

SEQ ID NO: 240310 - RNA, 32 nt, Human
ucucuccucauuucccugucaugaacaccucg

SEQ ID NO: 240311 - RNA, 32 nt, Human
ucucuccuccccaucagugaggaccagacacc

SEQ ID NO: 240312 - RNA, 32 nt, Human
ucucuccuccccuccucucucuuccucuccuc

SEQ ID NO: 240313 - RNA, 32 nt, Human
ucucuccuccucccccucucuccuuccuuccu

SEQ ID NO: 240314 - RNA, 32 nt, Human
ucucuccuccucuuccucucucuggacgcccg

SEQ ID NO: 240315 - RNA, 32 nt, Human
ucucuccuccugcuggagugccagucccugag

SEQ ID NO: 240316 - RNA, 32 nt, Human
ucucuccuccuuccaccuccccucccuccauc

SEQ ID NO: 240317 - RNA, 32 nt, Human
ucucuccucucccccuccuucaucucuccucc

SEQ ID NO: 240318 - RNA, 32 nt, Human
ucucuccucuccgcuucucucccccucugucu

SEQ ID NO: 240319 - RNA, 32 nt, Human
ucucuccugaacccuacucucuccuuuuugcu

SEQ ID NO: 240320 - RNA, 32 nt, Human
ucucuccugaugcuagguuggggcccacccug

SEQ ID NO: 240321 - RNA, 32 nt, Human
ucucuccugcaacccccacugcucagccucua

SEQ ID NO: 240322 - RNA, 24 nt, Human
ucucuccugcauccuguagacuca

SEQ ID NO: 240323 - RNA, 32 nt, Human
ucucuccugccagucucuuguacucugugucc

SEQ ID NO: 240324 - RNA, 32 nt, Human
ucucuccugccugcccugccucagccaggccc

SEQ ID NO: 240325 - RNA, 32 nt, Human
ucucuccugccugccuuauccuugggccauca

SEQ ID NO: 240326 - RNA, 32 nt, Human
ucucuccugcucacccgccucuugccccuucu

SEQ ID NO: 240327 - RNA, 32 nt, Human
ucucuccuggcagaaagcaggcgaagggcagg

SEQ ID NO: 240328 - RNA, 32 nt, Human
ucucuccugggcagccacaccacagagcgggg

SEQ ID NO: 240329 - RNA, 32 nt, Human
ucucuccuggggacacagaggucggcaggcag

SEQ ID NO: 240330 - RNA, 32 nt, Human
ucucuccuggucaaagaggcuuggggacugga

SEQ ID NO: 240331 - RNA, 32 nt, Human
ucucuccuguauaaccccaccuugccaagcuu

SEQ ID NO: 240332 - RNA, 32 nt, Human
ucucuccugucaaagugaaugauauauucuug

SEQ ID NO: 240333 - RNA, 32 nt, Human
ucucuccugugcaaaauggcaacucuuaagga

SEQ ID NO: 240334 - RNA, 32 nt, Human
ucucuccuucccaggcuacugauguccugggu

SEQ ID NO: 240335 - RNA, 32 nt, Human
ucucuccuuccucccuuccuuuacaguuuaaa

SEQ ID NO: 240336 - RNA, 32 nt, Human
ucucuccuucuccuccuccuccuccucuuccc

SEQ ID NO: 240337 - RNA, 32 nt, Human
ucucuccuucucucuucucuucuucuugccug

SEQ ID NO: 240338 - RNA, 32 nt, Human
ucucuccuucuggccucucauuuccuuacacu

SEQ ID NO: 240339 - RNA, 32 nt, Human
ucucuccuuucaccaucucuccucucccccuc

SEQ ID NO: 240340 - RNA, 32 nt, Human
ucucuccuuuccagucggagaccucugccgca

SEQ ID NO: 240341 - RNA, 32 nt, Human
ucucucgcaguuuccccgucccucucugucuc

SEQ ID NO: 240342 - RNA, 32 nt, Human
ucucucgcccacccuucccccuucuuccccca

SEQ ID NO: 240343 - RNA, 32 nt, Human
ucucucgcccaggcuggagugcaguggcguga

SEQ ID NO: 240344 - RNA, 32 nt, Human
ucucucgcccaggcuggagugcaguggugcga

SEQ ID NO: 240345 - RNA, 32 nt, Human
ucucucgcccaggcuggagugcagugguguga

SEQ ID NO: 240346 - RNA, 32 nt, Human
ucucucgccuguucugugucucacaugcuuuu

SEQ ID NO: 240347 - RNA, 32 nt, Human
ucucucggcggagcugcugugcaguggaacgc

SEQ ID NO: 240348 - RNA, 32 nt, Human
ucucucgggagcccuagcccugcuccaacucc

SEQ ID NO: 240349 - RNA, 32 nt, Human
ucucucgggccagggagguugaggcugcagug

SEQ ID NO: 240350 - RNA, 32 nt, Human
ucucucggguucaagcaauugucugccucagc

SEQ ID NO: 240351 - RNA, 32 nt, Human
ucucucgugggucgccuuugcccacacuggcg

SEQ ID NO: 240352 - RNA, 19 nt, Human
ucucucuaaaaauacaaaa

SEQ ID NO: 240353 - RNA, 32 nt, Human
ucucucuaaaaauacaaaaauuagcugggcgu

SEQ ID NO: 240354 - RNA, 32 nt, Human
ucucucuaccacccucuccugcgccccugaga

SEQ ID NO: 240355 - RNA, 32 nt, Human
ucucucuaccauggagaagagcaggaagggau

SEQ ID NO: 240356 - RNA, 32 nt, Human
ucucucuacccuggggaggaacaguggcuucu

SEQ ID NO: 240357 - RNA, 32 nt, Human
ucucucuagccgugugaaacugugaguccauu

SEQ ID NO: 240358 - RNA, 32 nt, Human
ucucucuagggcagcagagagcuuuuugcacu

SEQ ID NO: 240359 - RNA, 32 nt, Human
ucucucuaggguacauggugcugggagaggca

SEQ ID NO: 240360 - RNA, 32 nt, Human
ucucucuaguagcuggaauuauaggcacacgc

SEQ ID NO: 240361 - RNA, 32 nt, Human
ucucucuauuucccccuuucuuccucauuccc

SEQ ID NO: 240362 - RNA, 32 nt, Human
ucucucucaagaaagcagcuguuggccauuca

SEQ ID NO: 240363 - RNA, 32 nt, Human
ucucucucacccaggcuggaguggaguggcgc

SEQ ID NO: 240364 - RNA, 23 nt, Human
ucucucucagccauggagagcug

SEQ ID NO: 240365 - RNA, 32 nt, Human
ucucucucaucauccuccucaugccagauagc

SEQ ID NO: 240366 - RNA, 32 nt, Human
ucucucucauuucagaaacggacuuucucauc

SEQ ID NO: 240367 - RNA, 32 nt, Human
ucucucucauuuccuacucccugauuauccua

SEQ ID NO: 240368 - RNA, 32 nt, Human
ucucucuccaauaaaccuuuugcuucagggua

SEQ ID NO: 240369 - RNA, 20 nt, Human
ucucucuccacugagugcug

SEQ ID NO: 240370 - RNA, 32 nt, Human
ucucucuccagcugccaccacagccuggaggc

SEQ ID NO: 240371 - RNA, 32 nt, Human
ucucucuccaucccucuccucugcccucugcu

SEQ ID NO: 240372 - RNA, 32 nt, Human
ucucucucccagacccuucccccaccacaucg

SEQ ID NO: 240373 - RNA, 32 nt, Human
ucucucuccccacugucucucuucuuucuguc

SEQ ID NO: 240374 - RNA, 32 nt, Human
ucucucucccccucauuucucuuccuccucac

SEQ ID NO: 240375 - RNA, 32 nt, Human
ucucucucccucacucccaaaaccuggcauca

SEQ ID NO: 240376 - RNA, 32 nt, Human
ucucucucccucccucuccuucccuacccucu

SEQ ID NO: 240377 - RNA, 32 nt, Human
ucucucucccuucacccuuucuccauaccagg

SEQ ID NO: 240378 - RNA, 32 nt, Human
ucucucuccgucucuccuccccucucucucuu

SEQ ID NO: 240379 - RNA, 32 nt, Human
ucucucuccucauuucggugcauguccuuucu

SEQ ID NO: 240380 - RNA, 32 nt, Human
ucucucuccugccuccuccuccacacugaagg

SEQ ID NO: 240381 - RNA, 32 nt, Human
ucucucuccuucagggagauucuuuuucucua

SEQ ID NO: 240382 - RNA, 32 nt, Human
ucucucucgccaugguuggagugcaguggugc

SEQ ID NO: 240383 - RNA, 32 nt, Human
ucucucucgcccacccuucccccuucuucccc

SEQ ID NO: 240384 - RNA, 22 nt, Human
ucucucucugccuuaggcucug

SEQ ID NO: 240385 - RNA, 21 nt, Human
ucucucucugcgccugggucg

SEQ ID NO: 240386 - RNA, 20 nt, Human
ucucucucugucucucagcc

SEQ ID NO: 240387 - RNA, 32 nt, Human
ucucucucugugcccuuagccugcugugccca

SEQ ID NO: 240388 - RNA, 32 nt, Human
ucucucucuucccugacuaucucucucaauga

SEQ ID NO: 240389 - RNA, 32 nt, Human
ucucucucuuugcucucuuucucccuccccua

SEQ ID NO: 240390 - RNA, 32 nt, Human
ucucucugacuuaagucucugccauucuaaaa

SEQ ID NO: 240391 - RNA, 32 nt, Human
ucucucugagccuggaugggcuuggggccaga

SEQ ID NO: 240392 - RNA, 32 nt, Human
ucucucugagggcagaugaggcgcaggaaaau

SEQ ID NO: 240393 - RNA, 32 nt, Human
ucucucugagggggugggggugcugcucucuc

SEQ ID NO: 240394 - RNA, 32 nt, Human
ucucucugcaccucucuggucaggccuaguca

SEQ ID NO: 240395 - RNA, 32 nt, Human
ucucucugcacuccagccugggugacagagca

SEQ ID NO: 240396 - RNA, 32 nt, Human
ucucucugcccaacccuucccucaccuuggca

SEQ ID NO: 240397 - RNA, 20 nt, Human
ucucucugcccccaaaagug

SEQ ID NO: 240398 - RNA, 32 nt, Human
ucucucugccccucagguccuggcccuugggu

SEQ ID NO: 240399 - RNA, 32 nt, Human
ucucucugcucacccuugaaugcagcuaccau

SEQ ID NO: 240400 - RNA, 32 nt, Human
ucucucugcuccagcgugccuccgggaaucac

SEQ ID NO: 240401 - RNA, 32 nt, Human
ucucucugcuucucucuugcauagauacaauc

SEQ ID NO: 240402 - RNA, 32 nt, Human
ucucucuggaaacugucauuaggguuagggaa

SEQ ID NO: 240403 - RNA, 32 nt, Human
ucucucuggaggaauggcaaugccuggauugu

SEQ ID NO: 240404 - RNA, 32 nt, Human
ucucucuggaggaguggcaaugccuggacacc

SEQ ID NO: 240405 - RNA, 32 nt, Human
ucucucuggaggaguggcaaugccuggacacu

SEQ ID NO: 240406 - RNA, 32 nt, Human
ucucucuggaggaguggcaaugccuggauacu

SEQ ID NO: 240407 - RNA, 32 nt, Human
ucucucugggaggggucuggugcggguggaau

SEQ ID NO: 240408 - RNA, 32 nt, Human
ucucucugggaugagucaggaggccuggaggc

SEQ ID NO: 240409 - RNA, 32 nt, Human
ucucucuggggucccacacuggggucaugaga

SEQ ID NO: 240410 - RNA, 32 nt, Human
ucucucuggucaggcccacugcagagauggug

SEQ ID NO: 240411 - RNA, 32 nt, Human
ucucucuguaccacgugcacaugagguccauu

SEQ ID NO: 240412 - RNA, 32 nt, Human
ucucucuguaccaugagcuccuccaggagauu

SEQ ID NO: 240413 - RNA, 32 nt, Human
ucucucuguagccaggcuggagggcaauugua

SEQ ID NO: 240414 - RNA, 32 nt, Human
ucucucugucaucugggcugcagugcaguggu

SEQ ID NO: 240415 - RNA, 22 nt, Human
ucucucuguccucuucuccccu

SEQ ID NO: 240416 - RNA, 32 nt, Human
ucucucuguccucuucuccccucucucagauu

SEQ ID NO: 240417 - RNA, 32 nt, Human
ucucucugucgccaggcuggaaugcagugcag

SEQ ID NO: 240418 - RNA, 29 nt, Human
ucucucugucuguguggaugccugaugcu

SEQ ID NO: 240419 - RNA, 32 nt, Human
ucucucugugcccuccugcaauggcagccuug

SEQ ID NO: 240420 - RNA, 32 nt, Human
ucucucugugcuggugggggccucuuuaccau

SEQ ID NO: 240421 - RNA, 32 nt, Human
ucucucuguguccuagacuuccauugcauuua

SEQ ID NO: 240422 - RNA, 19 nt, Human
ucucucuguuccugaagug

SEQ ID NO: 240423 - RNA, 32 nt, Human
ucucucuguugucccccugccugguccucugg

SEQ ID NO: 240424 - RNA, 32 nt, Human
ucucucuuagguaccaccucauggagaccccc

SEQ ID NO: 240425 - RNA, 32 nt, Human
ucucucuuauaagcuauuccugccucacaccu

SEQ ID NO: 240426 - RNA, 32 nt, Human
ucucucuucccaaccauaacucugcccucagc

SEQ ID NO: 240427 - RNA, 32 nt, Human
ucucucuucccugacuaucucucucaaugauc

SEQ ID NO: 240428 - RNA, 18 nt, Human
ucucucuucuccagggca

SEQ ID NO: 240429 - RNA, 32 nt, Human
ucucucuucucccaguucuaccuccccagaag

SEQ ID NO: 240430 - RNA, 32 nt, Human
ucucucuucucccugccgucaugucuaaguca

SEQ ID NO: 240431 - RNA, 32 nt, Human
ucucucuucuccucucuuucucuccucugucu

SEQ ID NO: 240432 - RNA, 32 nt, Human
ucucucuucucucuccucuccucucucuucuc

SEQ ID NO: 240433 - RNA, 24 nt, Human
ucucucuucugaaccuggagccug

SEQ ID NO: 240434 - RNA, 32 nt, Human
ucucucuucuugccccugccuccuagagggag

SEQ ID NO: 240435 - RNA, 32 nt, Human
ucucucuugcuccccgcuucguucuguuuugg

SEQ ID NO: 240436 - RNA, 32 nt, Human
ucucucuugguauuucuucucucccaacuuua

SEQ ID NO: 240437 - RNA, 32 nt, Human
ucucucuuggucauuuaggcagucuccuauac

SEQ ID NO: 240438 - RNA, 32 nt, Human
ucucucuugucgcccaggcuggagugcaaugg

SEQ ID NO: 240439 - RNA, 32 nt, Human
ucucucuugucucccaggcuggagugcaaucg

SEQ ID NO: 240440 - RNA, 32 nt, Human
ucucucuuguuacccaggcuggagugcaaugg

SEQ ID NO: 240441 - RNA, 32 nt, Human
ucucucuuguugcccaggcugaagugcaaugu

SEQ ID NO: 240442 - RNA, 32 nt, Human
ucucucuuguugcccaggcugaagugcagugu

SEQ ID NO: 240443 - RNA, 32 nt, Human
ucucucuuguugcccaggcuggagugcauugg

SEQ ID NO: 240444 - RNA, 22 nt, Human
ucucucuuuaaaaugcaaaaua

SEQ ID NO: 240445 - RNA, 32 nt, Human
ucucucuuuccacggcaguagcuccugcaaga

SEQ ID NO: 240446 - RNA, 32 nt, Human
ucucucuuuccucugcuguucuucccauuguu

SEQ ID NO: 240447 - RNA, 32 nt, Human
ucucucuuucuucacuccuuuuucuuuccaaa

SEQ ID NO: 240448 - RNA, 32 nt, Human
ucucucuuucuuucccuuucucuuucuaucuc

SEQ ID NO: 240449 - RNA, 32 nt, Human
ucucucuuucuuucuuucuuucuuucuuucug

SEQ ID NO: 240450 - RNA, 32 nt, Human
ucucucuuucuuucuuuucuuucuuucucuuu

SEQ ID NO: 240451 - RNA, 32 nt, Human
ucucucuuucuuuugugcauauggcaacguuc

SEQ ID NO: 240452 - RNA, 21 nt, Human
ucucucuuugcaggagcaccg

SEQ ID NO: 240453 - RNA, 19 nt, Human
ucucucuuugccucgcucc

SEQ ID NO: 240454 - RNA, 23 nt, Human
ucucucuuugccuuuaguuugcc

SEQ ID NO: 240455 - RNA, 22 nt, Human
ucucucuuugcuuuggcugcug

SEQ ID NO: 240456 - RNA, 32 nt, Human
ucucucuuuggccauccuuccuuucccccacc

SEQ ID NO: 240457 - RNA, 24 nt, Human
ucucucuuuguuuuuauggcucug

SEQ ID NO: 240458 - RNA, 32 nt, Human
ucucucuuuuccuaggucugcagccaccccag

SEQ ID NO: 240459 - RNA, 32 nt, Human
ucucucuuuuuccccgauuuuccagagcuagg

SEQ ID NO: 240460 - RNA, 22 nt, Human
ucucugaaacgagcaacagguu

SEQ ID NO: 240461 - RNA, 21 nt, Human
ucucugaaaucccagcacuca

SEQ ID NO: 240462 - RNA, 21 nt, Human
ucucugaagacccggcacagg

SEQ ID NO: 240463 - RNA, 22 nt, Human
ucucugaagaucuggacugagg

SEQ ID NO: 240464 - RNA, 22 nt, Human
ucucugaagaucuuugugaggu

SEQ ID NO: 240465 - RNA, 32 nt, Human
ucucugaagauguuuugugaccagguuugugu

SEQ ID NO: 240466 - RNA, 22 nt, Human
ucucugaagcacacaacaaguu

SEQ ID NO: 240467 - RNA, 32 nt, Human
ucucugaagcugugcaggcugccuguaugguu

SEQ ID NO: 240468 - RNA, 31 nt, Human
ucucugaaucaauaugaccucacuuaaaaca

SEQ ID NO: 240469 - RNA, 21 nt, Human
ucucugaaucucaaacaaguu

SEQ ID NO: 240470 - RNA, 32 nt, Human
ucucugacacaaaccaagaaaagguggugauu

SEQ ID NO: 240471 - RNA, 32 nt, Human
ucucugacagagcgggacagaauggauauuug

SEQ ID NO: 240472 - RNA, 32 nt, Human
ucucugacagccacagcacuacaucaaucccu

SEQ ID NO: 240473 - RNA, 32 nt, Human
ucucugacauaaggagugccugaauagcuugg

SEQ ID NO: 240474 - RNA, 23 nt, Human
ucucugaccagcuuggggcacug

SEQ ID NO: 240475 - RNA, 32 nt, Human
ucucugaccaugcccuuuccugccucagauuu

SEQ ID NO: 240476 - RNA, 32 nt, Human
ucucugacccuugaguucuguuggcccacuga

SEQ ID NO: 240477 - RNA, 32 nt, Human
ucucugacucuugaacccuugugcagauuucc

SEQ ID NO: 240478 - RNA, 32 nt, Human
ucucugacugccaccccugccugccugcccgg

SEQ ID NO: 240479 - RNA, 32 nt, Human
ucucugacugccuuucccacagacacagcaca

SEQ ID NO: 240480 - RNA, 25 nt, Human
ucucugacuucugccuggagacuua

SEQ ID NO: 240481 - RNA, 32 nt, Human
ucucugacuucugcuugauuccacagucucca

SEQ ID NO: 240482 - RNA, 32 nt, Human
ucucugacuugguuuuucugucccugucuccc

SEQ ID NO: 240483 - RNA, 24 nt, Human
ucucugacuuuaccuugagaucug

SEQ ID NO: 240484 - RNA, 32 nt, Human
ucucugagaaccauucucccaccccaaguucc

SEQ ID NO: 240485 - RNA, 32 nt, Human
ucucugagaacuggcuuggugacuuugcuuca

SEQ ID NO: 240486 - RNA, 24 nt, Human
ucucugagauaacagcagaaguca

SEQ ID NO: 240487 - RNA, 26 nt, Human
ucucugagauauaccucaaucacaca

SEQ ID NO: 240488 - RNA, 32 nt, Human
ucucugagcagggaccugcuccugcagcaacc

SEQ ID NO: 240489 - RNA, 32 nt, Human
ucucugagcauuuuaaacaucuucccauuuaa

SEQ ID NO: 240490 - RNA, 32 nt, Human
ucucugagccaguuuucauuucuuccuggugg

SEQ ID NO: 240491 - RNA, 32 nt, Human
ucucugagccucuccuggaaaguaugaugcua

SEQ ID NO: 240492 - RNA, 32 nt, Human
ucucugagcuaaagcaguaaacucccaaauug

SEQ ID NO: 240493 - RNA, 32 nt, Human
ucucugagcuccagagguggccucuuggacag

SEQ ID NO: 240494 - RNA, 32 nt, Human
ucucugagcugugcagguggggagacugggcu

SEQ ID NO: 240495 - RNA, 32 nt, Human
ucucugaggaagcugggguucaugacaauggc

SEQ ID NO: 240496 - RNA, 32 nt, Human
ucucugaggaccaccagcuggccagggucuga

SEQ ID NO: 240497 - RNA, 32 nt, Human
ucucugaggcagggugggagccugggcugggc

SEQ ID NO: 240498 - RNA, 32 nt, Human
ucucugaggcggaggaugcgggagcgcaucug

SEQ ID NO: 240499 - RNA, 23 nt, Human
ucucugagggccugcaaggaggc

SEQ ID NO: 240500 - RNA, 32 nt, Human
ucucugaggguaugggggccagauggcucuug

SEQ ID NO: 240501 - RNA, 32 nt, Human
ucucugaggugcaaagaaugcacuuuucccua

SEQ ID NO: 240502 - RNA, 32 nt, Human
ucucugagucccccuuccuuuuuaaucuucuu

SEQ ID NO: 240503 - RNA, 32 nt, Human
ucucugagugugaaacagagcacuugcagagc

SEQ ID NO: 240504 - RNA, 32 nt, Human
ucucugaguuccuguggcuccugggcccaugc

SEQ ID NO: 240505 - RNA, 32 nt, Human
ucucugaucagugucuuuucagcacuuugagc

SEQ ID NO: 240506 - RNA, 32 nt, Human
ucucugauccucagcagggaaggcgaggguua

SEQ ID NO: 240507 - RNA, 32 nt, Human
ucucugaucgcacagaaaucacugccuaucac

SEQ ID NO: 240508 - RNA, 32 nt, Human
ucucugaucuccucucucucugugucugcucc

SEQ ID NO: 240509 - RNA, 32 nt, Human
ucucugaugacaacuccaaagccccggcucuu

SEQ ID NO: 240510 - RNA, 32 nt, Human
ucucugaugccaccaccugaacccugcucccu

SEQ ID NO: 240511 - RNA, 32 nt, Human
ucucugaugggaauauugccaguccugcuuuu

SEQ ID NO: 240512 - RNA, 32 nt, Human
ucucugaugggacuggaguugagggaaggagc

SEQ ID NO: 240513 - RNA, 32 nt, Human
ucucugcaacaagccacccaucugccaucaac

SEQ ID NO: 240514 - RNA, 32 nt, Human
ucucugcaacuccuuccucccugggccucccu

SEQ ID NO: 240515 - RNA, 31 nt, Human
ucucugcaagugucuguuauuagagaaacga

SEQ ID NO: 240516 - RNA, 32 nt, Human
ucucugcaauccaaauguauccauucuggcug

SEQ ID NO: 240517 - RNA, 32 nt, Human
ucucugcaauccaguaugcauuccaaaugaaa

SEQ ID NO: 240518 - RNA, 32 nt, Human
ucucugcaccccaccauccacauguauuuuuc

SEQ ID NO: 240519 - RNA, 32 nt, Human
ucucugcaccugcuuagaacaugggguuuuga

SEQ ID NO: 240520 - RNA, 32 nt, Human
ucucugcacucagacaguuuacagaaauaaau

SEQ ID NO: 240521 - RNA, 32 nt, Human
ucucugcacuccugauuuugcuccauacuuuu

SEQ ID NO: 240522 - RNA, 31 nt, Human
ucucugcacuugucucccauuaaggucccau

SEQ ID NO: 240523 - RNA, 32 nt, Human
ucucugcacuuugaggaugcagacagugaagu

SEQ ID NO: 240524 - RNA, 32 nt, Human
ucucugcagcagcaaccggauuucagccuggg

SEQ ID NO: 240525 - RNA, 32 nt, Human
ucucugcagccuguucuggggcugggccucgg

SEQ ID NO: 240526 - RNA, 32 nt, Human
ucucugcaggccucacaugccgugacaccaga

SEQ ID NO: 240527 - RNA, 32 nt, Human
ucucugcaggcgccgggagaagugaccagagc

SEQ ID NO: 240528 - RNA, 32 nt, Human
ucucugcagggguuuccucuccauccauuucc

SEQ ID NO: 240529 - RNA, 32 nt, Human
ucucugcaggucgagcccagcccagcuggugg

SEQ ID NO: 240530 - RNA, 32 nt, Human
ucucugcaggugucguggaggaaccuagcacc

SEQ ID NO: 240531 - RNA, 32 nt, Human
ucucugcaguuucucuaccugcccccagagcu

SEQ ID NO: 240532 - RNA, 32 nt, Human
ucucugcauccuaacuugcugccuuaucgucu

SEQ ID NO: 240533 - RNA, 32 nt, Human
ucucugcaucuauucuggacaccagaauggcg

SEQ ID NO: 240534 - RNA, 32 nt, Human
ucucugcaucugacucucuuuugaggucccug

SEQ ID NO: 240535 - RNA, 32 nt, Human
ucucugcauuuggagauucguggagaaccuau

SEQ ID NO: 240536 - RNA, 32 nt, Human
ucucugccaacaugaggacagaaggacuggug

SEQ ID NO: 240537 - RNA, 23 nt, Human
ucucugccaagucacucagguca

SEQ ID NO: 240538 - RNA, 32 nt, Human
ucucugccaagugcucuugauaauuucuucag

SEQ ID NO: 240539 - RNA, 32 nt, Human
ucucugccaaugugaggacagaaggacuggug

SEQ ID NO: 240540 - RNA, 20 nt, Human
ucucugccacugggcugcaa

SEQ ID NO: 240541 - RNA, 32 nt, Human
ucucugccagccaggcuggagugcaguggcau

SEQ ID NO: 240542 - RNA, 32 nt, Human
ucucugccaggccucagggugccugagacacu

SEQ ID NO: 240543 - RNA, 32 nt, Human
ucucugccauguccugagucugcuucagucug

SEQ ID NO: 240544 - RNA, 32 nt, Human
ucucugccauuuucucuaucagaaaacauuaa

SEQ ID NO: 240545 - RNA, 32 nt, Human
ucucugcccacuacaaccuccaccuccugggu

SEQ ID NO: 240546 - RNA, 32 nt, Human
ucucugcccaggagucagaggugccuccagga

SEQ ID NO: 240547 - RNA, 32 nt, Human
ucucugcccaguuugaaaaucucauggcagag

SEQ ID NO: 240548 - RNA, 32 nt, Human
ucucugcccauuucuucugucucccacagaca

SEQ ID NO: 240549 - RNA, 32 nt, Human
ucucugccccgugggagccggcggggcggcgg

SEQ ID NO: 240550 - RNA, 32 nt, Human
ucucugccccuauuuccuuguaaagagggagc

SEQ ID NO: 240551 - RNA, 32 nt, Human
ucucugccccuuccuuccuuccuuccuucguu

SEQ ID NO: 240552 - RNA, 32 nt, Human
ucucugcccuauuuuucuggauauuucugugu

SEQ ID NO: 240553 - RNA, 32 nt, Human
ucucugcccugccucccucugcuguguuccca

SEQ ID NO: 240554 - RNA, 32 nt, Human
ucucugcccuuccucuagccucuugucacaug

SEQ ID NO: 240555 - RNA, 32 nt, Human
ucucugccgcggcuuccucggcugccagcucu

SEQ ID NO: 240556 - RNA, 22 nt, Human
ucucugccuaugcaaaaauuca

SEQ ID NO: 240557 - RNA, 32 nt, Human
ucucugccuccagagagguggaugccuggguu

SEQ ID NO: 240558 - RNA, 32 nt, Human
ucucugccuccagccccaccuuccccgggaga

SEQ ID NO: 240559 - RNA, 32 nt, Human
ucucugccuccuccucccuuucucccuugugg

SEQ ID NO: 240560 - RNA, 32 nt, Human
ucucugccuccuuccuccuccuucccagucua

SEQ ID NO: 240561 - RNA, 32 nt, Human
ucucugccucugccugccuccugguccccacu

SEQ ID NO: 240562 - RNA, 32 nt, Human
ucucugccugacaaggccagcacccaaagggu

SEQ ID NO: 240563 - RNA, 32 nt, Human
ucucugccugggaaacaggcuucauucagcac

SEQ ID NO: 240564 - RNA, 32 nt, Human
ucucugccugggagauggcuuccccgagcccc

SEQ ID NO: 240565 - RNA, 32 nt, Human
ucucugccugggcucaaccucugugauuucug

SEQ ID NO: 240566 - RNA, 32 nt, Human
ucucugccuucaguuccacauuucccuuuggc

SEQ ID NO: 240567 - RNA, 32 nt, Human
ucucugccuucugccaccucugccucaggagc

SEQ ID NO: 240568 - RNA, 32 nt, Human
ucucugccuuucgagcucugcagcacucuuau

SEQ ID NO: 240569 - RNA, 32 nt, Human
ucucugcggcacucuucugccuggugacugac

SEQ ID NO: 240570 - RNA, 31 nt, Human
ucucugcguuucagugaccuaccuuaaaaca

SEQ ID NO: 240571 - RNA, 20 nt, Human
ucucugcuaaaaauacaaaa

SEQ ID NO: 240572 - RNA, 21 nt, Human
ucucugcuaaaaauacaaaau

SEQ ID NO: 240573 - RNA, 32 nt, Human
ucucugcuaaaaauacaaaauuagcugggcgu

SEQ ID NO: 240574 - RNA, 32 nt, Human
ucucugcuauucaugaaucuugcuauugcaca

SEQ ID NO: 240575 - RNA, 31 nt, Human
ucucugcucaauaaaauaccuguaacuggaa

SEQ ID NO: 240576 - RNA, 32 nt, Human
ucucugcucaccaggacguacuucucucuaca

SEQ ID NO: 240577 - RNA, 32 nt, Human
ucucugcucacgaggcaggagcaguaugugcu

SEQ ID NO: 240578 - RNA, 32 nt, Human
ucucugcucacuacagcacccgcuucccaggu

SEQ ID NO: 240579 - RNA, 32 nt, Human
ucucugcucacugaaagcuccgccucccgggu

SEQ ID NO: 240580 - RNA, 32 nt, Human
ucucugcucacugcaaccuccgccucccgggu

SEQ ID NO: 240581 - RNA, 32 nt, Human
ucucugcucacugcaaccucugccuccugggu

SEQ ID NO: 240582 - RNA, 32 nt, Human
ucucugcucacugcaagcucagccucucgggu

SEQ ID NO: 240583 - RNA, 32 nt, Human
ucucugcucacugcaagcuccgccaucugggu

SEQ ID NO: 240584 - RNA, 32 nt, Human
ucucugcucacugcaagcuccgccucccgggu

SEQ ID NO: 240585 - RNA, 32 nt, Human
ucucugcucacugcaagcuccgccuccugggu

SEQ ID NO: 240586 - RNA, 32 nt, Human
ucucugcucacuguaaccucugccuccugggu

SEQ ID NO: 240587 - RNA, 32 nt, Human
ucucugcucauuuagucccgucuuccucaccg

SEQ ID NO: 240588 - RNA, 32 nt, Human
ucucugcucccacccuugccugccucuaaccc

SEQ ID NO: 240589 - RNA, 32 nt, Human
ucucugcucccaggagccagugacaugaggug

SEQ ID NO: 240590 - RNA, 32 nt, Human
ucucugcucccugcaaccuccaccucccgggu

SEQ ID NO: 240591 - RNA, 32 nt, Human
ucucugcucccuucuucaguaagcaaggagcc

SEQ ID NO: 240592 - RNA, 20 nt, Human
ucucugcuccuguuugaauu

SEQ ID NO: 240593 - RNA, 22 nt, Human
ucucugcuccuucuugcugugu

SEQ ID NO: 240594 - RNA, 32 nt, Human
ucucugcucugacccuucucaggcccgccuga

SEQ ID NO: 240595 - RNA, 32 nt, Human
ucucugcugacuucagccuggucaugcuugcu

SEQ ID NO: 240596 - RNA, 32 nt, Human
ucucugcugagcuguggcugcgguccuggugc

SEQ ID NO: 240597 - RNA, 32 nt, Human
ucucugcugaggaaguggcagguguguggccc

SEQ ID NO: 240598 - RNA, 32 nt, Human
ucucugcugaggcugccugccugccgggccca

SEQ ID NO: 240599 - RNA, 32 nt, Human
ucucugcugccagacacccccugcugcccacu

SEQ ID NO: 240600 - RNA, 32 nt, Human
ucucugcugccuccuccuuucuugagaagcuc

SEQ ID NO: 240601 - RNA, 32 nt, Human
ucucugcugccuccuuccuuuccugagaggcu

SEQ ID NO: 240602 - RNA, 24 nt, Human
ucucugcugcguguucgcgggcca

SEQ ID NO: 240603 - RNA, 32 nt, Human
ucucugcugcuuguuugagcuuaauaagccuc

SEQ ID NO: 240604 - RNA, 32 nt, Human
ucucugcugggcaggcaaccugggguccagcu

SEQ ID NO: 240605 - RNA, 32 nt, Human
ucucugcuguccuuuauuuaugggagaaacau

SEQ ID NO: 240606 - RNA, 20 nt, Human
ucucugcuguggcaguaggu

SEQ ID NO: 240607 - RNA, 32 nt, Human
ucucugcuguggcguucucucuugagagaccc

SEQ ID NO: 240608 - RNA, 32 nt, Human
ucucugcugugggaagacugugcaauggcaca

SEQ ID NO: 240609 - RNA, 32 nt, Human
ucucugcuguguagucuccuucaggcuuauug

SEQ ID NO: 240610 - RNA, 32 nt, Human
ucucugcuguguauuaaauucauuuaucuaaa

SEQ ID NO: 240611 - RNA, 32 nt, Human
ucucugcuguguugcgcagugcaguggggugc

SEQ ID NO: 240612 - RNA, 32 nt, Human
ucucugcuguucccugcguggaggaagcccac

SEQ ID NO: 240613 - RNA, 22 nt, Human
ucucugcuuaggucgcagcuca

SEQ ID NO: 240614 - RNA, 32 nt, Human
ucucugcuuauggcuggaccucagcuggcagg

SEQ ID NO: 240615 - RNA, 32 nt, Human
ucucugcuuccagaaugagaagcuuugcugug

SEQ ID NO: 240616 - RNA, 32 nt, Human
ucucugcuuccuguaccuugacaugcaaaagg

SEQ ID NO: 240617 - RNA, 32 nt, Human
ucucugcuucucuccagcucucaaucugcugc

SEQ ID NO: 240618 - RNA, 23 nt, Human
ucucugcuugcaauuuuuguuca

SEQ ID NO: 240619 - RNA, 32 nt, Human
ucucugcuugccacccuuggggccuccuucag

SEQ ID NO: 240620 - RNA, 18 nt, Human
ucucugcuugcugagcua

SEQ ID NO: 240621 - RNA, 32 nt, Human
ucucugcuuguccugggcugagguguccauga

SEQ ID NO: 240622 - RNA, 32 nt, Human
ucucugcuuuauucucuccauguggcaacauu

SEQ ID NO: 240623 - RNA, 32 nt, Human
ucucugcuuuccuccggagaaauaacagcguc

SEQ ID NO: 240624 - RNA, 32 nt, Human
ucucugcuuuuccauucuggguguuuucagaa

SEQ ID NO: 240625 - RNA, 20 nt, Human
ucucugcuuuuguugcuuca

SEQ ID NO: 240626 - RNA, 22 nt, Human
ucucuggacaaggcagcgcuga

SEQ ID NO: 240627 - RNA, 22 nt, Human
ucucuggacacuccaggguaga

SEQ ID NO: 240628 - RNA, 23 nt, Human
ucucuggacagcuacggcgccga

SEQ ID NO: 240629 - RNA, 23 nt, Human
ucucuggacaucuucagcccaga

SEQ ID NO: 240630 - RNA, 32 nt, Human
ucucuggaccuauucuaaccacuuaaaauuau

SEQ ID NO: 240631 - RNA, 21 nt, Human
ucucuggacgugcagaccaga

SEQ ID NO: 240632 - RNA, 32 nt, Human
ucucuggacguguagaccagauccagaagaaa

SEQ ID NO: 240633 - RNA, 32 nt, Human
ucucuggacugcacuguagggccuggagaccu

SEQ ID NO: 240634 - RNA, 32 nt, Human
ucucuggacuguugcauguacagugccuccau

SEQ ID NO: 240635 - RNA, 32 nt, Human
ucucuggagaacuuccucacacaccgcagcaa

SEQ ID NO: 240636 - RNA, 32 nt, Human
ucucuggagaaggcuucacugacuaaacuaug

SEQ ID NO: 240637 - RNA, 32 nt, Human
ucucuggagcagaauuuaucacacacaaaagu

SEQ ID NO: 240638 - RNA, 32 nt, Human
ucucuggagccugcaagccucuucccaugugu

SEQ ID NO: 240639 - RNA, 32 nt, Human
ucucuggagcugaaggggccagagagugggca

SEQ ID NO: 240640 - RNA, 32 nt, Human
ucucuggaggcagaaugagggagugagcagca

SEQ ID NO: 240641 - RNA, 32 nt, Human
ucucuggagggugcccuccuucugcuggcauc

SEQ ID NO: 240642 - RNA, 32 nt, Human
ucucuggaguuucccaguaggagagaaaugac

SEQ ID NO: 240643 - RNA, 22 nt, Human
ucucuggaugcucugaggcaga

SEQ ID NO: 240644 - RNA, 21 nt, Human
ucucuggauuaggcaggcaga

SEQ ID NO: 240645 - RNA, 32 nt, Human
ucucuggcacacacacuuggacauacaguucu

SEQ ID NO: 240646 - RNA, 32 nt, Human
ucucuggcagacucagcccacugccuugccag

SEQ ID NO: 240647 - RNA, 32 nt, Human
ucucuggcagagaaggauguccguuccaggag

SEQ ID NO: 240648 - RNA, 32 nt, Human
ucucuggcaggagaaccaggagguaagagucu

SEQ ID NO: 240649 - RNA, 32 nt, Human
ucucuggcaucugggguuccugacugauacca

SEQ ID NO: 240650 - RNA, 32 nt, Human
ucucuggcauucaugcagagcaaagcacuuua

SEQ ID NO: 240651 - RNA, 32 nt, Human
ucucuggcauugcuuccucuccuuccuuccug

SEQ ID NO: 240652 - RNA, 32 nt, Human
ucucuggccaccauggcaaaugcugagaucug

SEQ ID NO: 240653 - RNA, 32 nt, Human
ucucuggcccaagcuggagugcaguggcacga

SEQ ID NO: 240654 - RNA, 23 nt, Human
ucucuggccccuagcagcacgga

SEQ ID NO: 240655 - RNA, 17 nt, Human
ucucuggccucaucuug

SEQ ID NO: 240656 - RNA, 32 nt, Human
ucucuggccugggagcucucacacccugcacg

SEQ ID NO: 240657 - RNA, 32 nt, Human
ucucuggcgggcuguccuccuuggugggagcu

SEQ ID NO: 240658 - RNA, 32 nt, Human
ucucuggcgugcugugggagaggaccuuugcu

SEQ ID NO: 240659 - RNA, 32 nt, Human
ucucuggcucaagcaauccucucacuucagcc

SEQ ID NO: 240660 - RNA, 32 nt, Human
ucucuggcucaccgcaaccuccgccucccagg

SEQ ID NO: 240661 - RNA, 32 nt, Human
ucucuggcucacugcaaccucccugccugauu

SEQ ID NO: 240662 - RNA, 32 nt, Human
ucucuggcugagaggaugggggcagaugggga

SEQ ID NO: 240663 - RNA, 22 nt, Human
ucucuggcuggugggcugcaag

SEQ ID NO: 240664 - RNA, 32 nt, Human
ucucuggcuguaaugaucacuuuggaagauuu

SEQ ID NO: 240665 - RNA, 32 nt, Human
ucucuggcuuuacccaaguucugaaugcauug

SEQ ID NO: 240666 - RNA, 32 nt, Human
ucucugggaaaacacaagauuuacagacugca

SEQ ID NO: 240667 - RNA, 19 nt, Human
ucucugggaaaaggaaugc

SEQ ID NO: 240668 - RNA, 32 nt, Human
ucucugggacaugcucaccugccagaccagcc

SEQ ID NO: 240669 - RNA, 32 nt, Human
ucucugggacuguggaccuggccucgcacagg

SEQ ID NO: 240670 - RNA, 21 nt, Human
ucucugggagcugagcacaga

SEQ ID NO: 240671 - RNA, 32 nt, Human
ucucugggauuccggacuggcuucgcccaacu

SEQ ID NO: 240672 - RNA, 25 nt, Human
ucucugggcacccgcugugcaugga

SEQ ID NO: 240673 - RNA, 24 nt, Human
ucucugggcaucugcauggccagg

SEQ ID NO: 240674 - RNA, 32 nt, Human
ucucugggccucgucuuuccucccucuaaaau

SEQ ID NO: 240675 - RNA, 21 nt, Human
ucucugggccuucagcgcggg

SEQ ID NO: 240676 - RNA, 32 nt, Human
ucucugggcucgaaccaauacaagcaccuuuc

SEQ ID NO: 240677 - RNA, 32 nt, Human
ucucugggcuggaggugggggugggggcagcc

SEQ ID NO: 240678 - RNA, 32 nt, Human
ucucugggcuuccuuuuuaaaaacuuuuucua

SEQ ID NO: 240679 - RNA, 17 nt, Human
ucucuggggaaaggaag

SEQ ID NO: 240680 - RNA, 32 nt, Human
ucucuggggaaaggaagguggcacagaccaug

SEQ ID NO: 240681 - RNA, 32 nt, Human
ucucuggggaggcaguaaggggccguggagcu

SEQ ID NO: 240682 - RNA, 32 nt, Human
ucucuggggcugggcucuacucccugcagccc

SEQ ID NO: 240683 - RNA, 32 nt, Human
ucucugggggcugagggacccaccuggccccu

SEQ ID NO: 240684 - RNA, 32 nt, Human
ucucuggggucaggaaccucagaggagggggc

SEQ ID NO: 240685 - RNA, 17 nt, Human
ucucuggggucaggaag

SEQ ID NO: 240686 - RNA, 32 nt, Human
ucucugggguccucuuucaaggauguccacgg

SEQ ID NO: 240687 - RNA, 19 nt, Human
ucucuggggugcucuuccc

SEQ ID NO: 240688 - RNA, 32 nt, Human
ucucuggguaccccagccugggcugggggaga

SEQ ID NO: 240689 - RNA, 32 nt, Human
ucucugggucauaaauccugcaggcaguccaa

SEQ ID NO: 240690 - RNA, 32 nt, Human
ucucugggucccucuaacaucucccauggcuc

SEQ ID NO: 240691 - RNA, 19 nt, Human
ucucugggugccccaguua

SEQ ID NO: 240692 - RNA, 32 nt, Human
ucucugguacucaggcuggagugcgguggugu

SEQ ID NO: 240693 - RNA, 32 nt, Human
ucucuggucugugucugugugugccuguaagu

SEQ ID NO: 240694 - RNA, 22 nt, Human
ucucuggucuucuccagacugg

SEQ ID NO: 240695 - RNA, 32 nt, Human
ucucuggugaacaaacuuccucucuggccucu

SEQ ID NO: 240696 - RNA, 32 nt, Human
ucucuggugauuuuugcaccagaagagggaaa

SEQ ID NO: 240697 - RNA, 32 nt, Human
ucucuggugcugcuucuguauauuuccacagc

SEQ ID NO: 240698 - RNA, 24 nt, Human
ucucugguguucccaccacccuag

SEQ ID NO: 240699 - RNA, 23 nt, Human
ucucugguuauagcuggucccag

SEQ ID NO: 240700 - RNA, 32 nt, Human
ucucugguucaagcgauucuccugccucagcc

SEQ ID NO: 240701 - RNA, 32 nt, Human
ucucugguucauuuuucuguuuacagaaguaa

SEQ ID NO: 240702 - RNA, 32 nt, Human
ucucugguucccaguuucucuggucauuuugg

SEQ ID NO: 240703 - RNA, 32 nt, Human
ucucugguucucagcuguggcuuuuguucugg

SEQ ID NO: 240704 - RNA, 21 nt, Human
ucucugguuuccaucauucug

SEQ ID NO: 240705 - RNA, 20 nt, Human
ucucugguuuccuacucuua

SEQ ID NO: 240706 - RNA, 22 nt, Human
ucucugguuuucuccacaucua

SEQ ID NO: 240707 - RNA, 25 nt, Human
ucucugguuuucuguguaauuccag

SEQ ID NO: 240708 - RNA, 32 nt, Human
ucucuguaacuucaguucugguguuuuccuug

SEQ ID NO: 240709 - RNA, 32 nt, Human
ucucuguacccagcugacagccugucucuaug

SEQ ID NO: 240710 - RNA, 32 nt, Human
ucucuguacucaguugguucucaguuagcugg

SEQ ID NO: 240711 - RNA, 32 nt, Human
ucucuguacucuagucuccugccuccucaguu

SEQ ID NO: 240712 - RNA, 32 nt, Human
ucucuguacuuuccccaugcugccucaaaagu

SEQ ID NO: 240713 - RNA, 32 nt, Human
ucucuguagagaaacaaauugucauucuucuc

SEQ ID NO: 240714 - RNA, 32 nt, Human
ucucuguagccaggcuggagggcaauuguaca

SEQ ID NO: 240715 - RNA, 32 nt, Human
ucucuguauucaugcucuuggcaauuucuuug

SEQ ID NO: 240716 - RNA, 32 nt, Human
ucucuguauuuugauacuugaaugacuuuccc

SEQ ID NO: 240717 - RNA, 32 nt, Human
ucucugucaaccuaagaauguuggccuuacug

SEQ ID NO: 240718 - RNA, 32 nt, Human
ucucugucaacuucaguuucucucucaguuua

SEQ ID NO: 240719 - RNA, 32 nt, Human
ucucugucacaagcaucauacauugcugauug

SEQ ID NO: 240720 - RNA, 32 nt, Human
ucucugucaccaggcuguauuacaguggugca

SEQ ID NO: 240721 - RNA, 32 nt, Human
ucucugucacccaagcuggaauacaauggcac

SEQ ID NO: 240722 - RNA, 32 nt, Human
ucucugucacccaagcuggaaugcaauggcac

SEQ ID NO: 240723 - RNA, 32 nt, Human
ucucugucacccaaggguguuucuugaggagg

SEQ ID NO: 240724 - RNA, 32 nt, Human
ucucugucacccaaguuggagugcaguggccc

SEQ ID NO: 240725 - RNA, 32 nt, Human
ucucugucacccaggauggagugcaguguugu

SEQ ID NO: 240726 - RNA, 32 nt, Human
ucucugucacccaggcuagagugcaguggagc

SEQ ID NO: 240727 - RNA, 32 nt, Human
ucucugucacccaggcuggaaugcaguggcgu

SEQ ID NO: 240728 - RNA, 32 nt, Human
ucucugucacccaggcuggagugcaauggcac

SEQ ID NO: 240729 - RNA, 32 nt, Human
ucucugucacccaggcuggagugcaauggcgc

SEQ ID NO: 240730 - RNA, 32 nt, Human
ucucugucacccaggcuggagugcagugcaca

SEQ ID NO: 240731 - RNA, 32 nt, Human
ucucugucacccaggcuggagugcaguggcgu

SEQ ID NO: 240732 - RNA, 32 nt, Human
ucucugucacccaggcuggagugcaguggugc

SEQ ID NO: 240733 - RNA, 32 nt, Human
ucucugucacccaggcuggagugcaguggugu

SEQ ID NO: 240734 - RNA, 32 nt, Human
ucucugucacccaggcuggcgugcaauggcgc

SEQ ID NO: 240735 - RNA, 32 nt, Human
ucucugucacccagguuggagugcaguggugu

SEQ ID NO: 240736 - RNA, 32 nt, Human
ucucugucaccuaagcaggacauguggugagu

SEQ ID NO: 240737 - RNA, 32 nt, Human
ucucugucaccuagccaggagggguagcaaaa

SEQ ID NO: 240738 - RNA, 32 nt, Human
ucucugucaccuaggcuggagggcaggguuga

SEQ ID NO: 240739 - RNA, 32 nt, Human
ucucugucaccuaggcuggagugcaguggcac

SEQ ID NO: 240740 - RNA, 32 nt, Human
ucucugucagccaggcuggagugugguggcac

SEQ ID NO: 240741 - RNA, 32 nt, Human
ucucugucauccaggcuagagugcaguggcac

SEQ ID NO: 240742 - RNA, 25 nt, Human
ucucugucauccucgucucucuucu

SEQ ID NO: 240743 - RNA, 32 nt, Human
ucucugucauccucgucucucuucugaaauga

SEQ ID NO: 240744 - RNA, 32 nt, Human
ucucugucaucugggcugcagugcaguggugu

SEQ ID NO: 240745 - RNA, 32 nt, Human
ucucuguccacugcaaccuccacauccugggu

SEQ ID NO: 240746 - RNA, 20 nt, Human
ucucuguccaguucauuuuc

SEQ ID NO: 240747 - RNA, 32 nt, Human
ucucuguccccaaggcuggagugcaguggugc

SEQ ID NO: 240748 - RNA, 32 nt, Human
ucucugucccccaggcugaagugcagcggcau

SEQ ID NO: 240749 - RNA, 32 nt, Human
ucucuguccccuaggcugcagugcaguggcgc

SEQ ID NO: 240750 - RNA, 32 nt, Human
ucucuguccccuuugcccauccuuccuuuucu

SEQ ID NO: 240751 - RNA, 31 nt, Human
ucucugucccucucugggccucugcacgaug

SEQ ID NO: 240752 - RNA, 32 nt, Human
ucucuguccuacuucugacuuuacuuguggug

SEQ ID NO: 240753 - RNA, 32 nt, Human
ucucuguccugacuucauaggugccaccuugu

SEQ ID NO: 240754 - RNA, 32 nt, Human
ucucuguccugcuucauaggugccaccuugug

SEQ ID NO: 240755 - RNA, 32 nt, Human
ucucugucgccaggcuggaaugcagugcagug

SEQ ID NO: 240756 - RNA, 32 nt, Human
ucucugucgcccaggcuggagcccaguggcga

SEQ ID NO: 240757 - RNA, 32 nt, Human
ucucugucgcccaggcuggaguacaguggugc

SEQ ID NO: 240758 - RNA, 32 nt, Human
ucucugucgcccaggcuggagugcaguggcuc

SEQ ID NO: 240759 - RNA, 32 nt, Human
ucucugucgcccaggcuggcgugaaguggcgc

SEQ ID NO: 240760 - RNA, 32 nt, Human
ucucugucgcccaggcuggggugcaguggcgc

SEQ ID NO: 240761 - RNA, 32 nt, Human
ucucugucgcccagguuggagugccauggcac

SEQ ID NO: 240762 - RNA, 32 nt, Human
ucucugucgccuaggcuggagugcaguggugc

SEQ ID NO: 240763 - RNA, 32 nt, Human
ucucugucguggacacgcgugauugacccuuu

SEQ ID NO: 240764 - RNA, 32 nt, Human
ucucugucucaaggagagcaggguaggugaaa

SEQ ID NO: 240765 - RNA, 32 nt, Human
ucucugucuccgaggcuggagugcaauguugc

SEQ ID NO: 240766 - RNA, 32 nt, Human
ucucugucucuuggaccugccaccaucacuuu

SEQ ID NO: 240767 - RNA, 32 nt, Human
ucucugucugccagggucuccgacugucccag

SEQ ID NO: 240768 - RNA, 32 nt, Human
ucucugucugcuccugccuccuccaggcaaug

SEQ ID NO: 240769 - RNA, 32 nt, Human
ucucugucuuuuccugucuucugauuuaucug

SEQ ID NO: 240770 - RNA, 21 nt, Human
ucucugugaacauguaacuca

SEQ ID NO: 240771 - RNA, 32 nt, Human
ucucugugaagagucugggagggacgguuuag

SEQ ID NO: 240772 - RNA, 21 nt, Human
ucucugugacugaggaaguca

SEQ ID NO: 240773 - RNA, 22 nt, Human
ucucugugcauuuugaaaauua

SEQ ID NO: 240774 - RNA, 32 nt, Human
ucucugugcccugucuuuguguguuucuuucu

SEQ ID NO: 240775 - RNA, 32 nt, Human
ucucugugccguuccccaugcauucccugcac

SEQ ID NO: 240776 - RNA, 32 nt, Human
ucucugugcuuacgcaguugugaagguuguga

SEQ ID NO: 240777 - RNA, 32 nt, Human
ucucuguggaaaggaaaucagccuugcagagc

SEQ ID NO: 240778 - RNA, 32 nt, Human
ucucuguggcaaagcagcaacuauucacaaaa

SEQ ID NO: 240779 - RNA, 32 nt, Human
ucucuguggccaaccucugcuccuuccccauc

SEQ ID NO: 240780 - RNA, 32 nt, Human
ucucuguggcccaggcugaagugcaguggugu

SEQ ID NO: 240781 - RNA, 32 nt, Human
ucucugugggcaaggccagcuugcuucaggcu

SEQ ID NO: 240782 - RNA, 32 nt, Human
ucucugugggggagacagggacuauaacaggg

SEQ ID NO: 240783 - RNA, 32 nt, Human
ucucugugguaaacgaggaaacugacaggauu

SEQ ID NO: 240784 - RNA, 32 nt, Human
ucucuguguaguuccagcaaaucaagcugagc

SEQ ID NO: 240785 - RNA, 32 nt, Human
ucucugugugcuuucuggacugugauaaguga

SEQ ID NO: 240786 - RNA, 32 nt, Human
ucucugugugggccaggugggcuaagguuagc

SEQ ID NO: 240787 - RNA, 32 nt, Human
ucucugugugugugcacauaugcagauguaug

SEQ ID NO: 240788 - RNA, 32 nt, Human
ucucuguguugauuacuaaucaucuuagauau

SEQ ID NO: 240789 - RNA, 32 nt, Human
ucucuguguuuccagaaggccccacacaccca

SEQ ID NO: 240790 - RNA, 32 nt, Human
ucucuguuaaccuugugccugucuccuguaug

SEQ ID NO: 240791 - RNA, 32 nt, Human
ucucuguuacccaggcuagagugcaauggcgu

SEQ ID NO: 240792 - RNA, 32 nt, Human
ucucuguuaguccccaaauccuuacuuauuuu

SEQ ID NO: 240793 - RNA, 25 nt, Human
ucucuguuauacgccggggcauaga

SEQ ID NO: 240794 - RNA, 32 nt, Human
ucucuguucacugcaaccgccucccgugcuca

SEQ ID NO: 240795 - RNA, 32 nt, Human
ucucuguucauggccuguuugcugcuaugagg

SEQ ID NO: 240796 - RNA, 32 nt, Human
ucucuguucauuuuguuuuuauuucauugaca

SEQ ID NO: 240797 - RNA, 32 nt, Human
ucucuguuccagcugcugucagggauuaacaa

SEQ ID NO: 240798 - RNA, 32 nt, Human
ucucuguuccgcaggaugggguuuguuaaagu

SEQ ID NO: 240799 - RNA, 32 nt, Human
ucucuguuccucacacucagcuucagcauaag

SEQ ID NO: 240800 - RNA, 32 nt, Human
ucucuguuccugagagaccagaauuuauucuu

SEQ ID NO: 240801 - RNA, 32 nt, Human
ucucuguuccugcagacaguuuugccagcuuu

SEQ ID NO: 240802 - RNA, 32 nt, Human
ucucuguucugagaucucuuuauuccugaaua

SEQ ID NO: 240803 - RNA, 32 nt, Human
ucucuguugcccaagcuugagggcaguggugc

SEQ ID NO: 240804 - RNA, 32 nt, Human
ucucuguugcccaggcuagagugcacuggugg

SEQ ID NO: 240805 - RNA, 32 nt, Human
ucucuguugcccaggcugcagugcaguggugc

SEQ ID NO: 240806 - RNA, 32 nt, Human
ucucuguugcccaggcuggaguacaauggcgu

SEQ ID NO: 240807 - RNA, 32 nt, Human
ucucuguugcccaggcuggagugcaauggcac

SEQ ID NO: 240808 - RNA, 32 nt, Human
ucucuguugcccaggcuggagugcaauggcau

SEQ ID NO: 240809 - RNA, 32 nt, Human
ucucuguugcccaggcuggagugcaguggcac

SEQ ID NO: 240810 - RNA, 32 nt, Human
ucucuguugcccaggcuggagugcaguggcgc

SEQ ID NO: 240811 - RNA, 32 nt, Human
ucucuguugcccaggcuggaguguaguggugc

SEQ ID NO: 240812 - RNA, 32 nt, Human
ucucuguugccugggcuggagugcaguggccc

SEQ ID NO: 240813 - RNA, 24 nt, Human
ucucuguugugggcagcagggcca

SEQ ID NO: 240814 - RNA, 32 nt, Human
ucucuguuucaaaucaacauccuggauacccu

SEQ ID NO: 240815 - RNA, 32 nt, Human
ucucuguuuccuuuuuguguuuuguugcuuuu

SEQ ID NO: 240816 - RNA, 23 nt, Human
ucucuguuucuccucucuucucu

SEQ ID NO: 240817 - RNA, 32 nt, Human
ucucuguuucuggggccucccccaccauagcu

SEQ ID NO: 240818 - RNA, 32 nt, Human
ucucuuaaaggaacagggugacccugcuggcu

SEQ ID NO: 240819 - RNA, 32 nt, Human
ucucuuaagggugggagcuggggcagggacua

SEQ ID NO: 240820 - RNA, 32 nt, Human
ucucuuacaagggaagucuauauggcaaucug

SEQ ID NO: 240821 - RNA, 32 nt, Human
ucucuuacauugaauguagagaauguagccau

SEQ ID NO: 240822 - RNA, 32 nt, Human
ucucuuacccaagcuggagugcagugacauga

SEQ ID NO: 240823 - RNA, 32 nt, Human
ucucuuacccuugcccccuccacccggucuug

SEQ ID NO: 240824 - RNA, 32 nt, Human
ucucuuaccuacagcuggacaguaccugucug

SEQ ID NO: 240825 - RNA, 32 nt, Human
ucucuuagagccucuagaaagaacuagcccua

SEQ ID NO: 240826 - RNA, 32 nt, Human
ucucuuagccaagaacuugaacaguacaaaau

SEQ ID NO: 240827 - RNA, 32 nt, Human
ucucuuagcccaagccugucccucgcacagcc

SEQ ID NO: 240828 - RNA, 32 nt, Human
ucucuuaggcuucucucagguccccuuucccu

SEQ ID NO: 240829 - RNA, 32 nt, Human
ucucuuaggucaccaagauauuaguugcugcu

SEQ ID NO: 240830 - RNA, 32 nt, Human
ucucuuagucuucuuauuuaauuaacuucauu

SEQ ID NO: 240831 - RNA, 32 nt, Human
ucucuuaguucuucucuaacauaguacuuucu

SEQ ID NO: 240832 - RNA, 32 nt, Human
ucucuuauaaauucuguuagcugcucacuuaa

SEQ ID NO: 240833 - RNA, 32 nt, Human
ucucuuauacuucuccuaccuuccucaauauu

SEQ ID NO: 240834 - RNA, 32 nt, Human
ucucuuaucccaguaacuccucuucccauuuu

SEQ ID NO: 240835 - RNA, 32 nt, Human
ucucuuaucuaugaauuaaagacuucauguac

SEQ ID NO: 240836 - RNA, 32 nt, Human
ucucuucacaaaaggcucugaagacaucauga

SEQ ID NO: 240837 - RNA, 32 nt, Human
ucucuucaccucuccuccucuugguccacuug

SEQ ID NO: 240838 - RNA, 32 nt, Human
ucucuucacugcucuguguccucugcuccuag

SEQ ID NO: 240839 - RNA, 32 nt, Human
ucucuucagcuccugugguaugugggaaucga

SEQ ID NO: 240840 - RNA, 23 nt, Human
ucucuucaggaagucagaccuuc

SEQ ID NO: 240841 - RNA, 32 nt, Human
ucucuucagguuuaacagagaagaacuccugg

SEQ ID NO: 240842 - RNA, 32 nt, Human
ucucuucaugcucuccccaucccaguuuuuag

SEQ ID NO: 240843 - RNA, 32 nt, Human
ucucuuccacagcauagccacucagaagaaaa

SEQ ID NO: 240844 - RNA, 32 nt, Human
ucucuuccacuccauuccccugcccaccucca

SEQ ID NO: 240845 - RNA, 32 nt, Human
ucucuuccagaagccaagaggagaacaaaggu

SEQ ID NO: 240846 - RNA, 32 nt, Human
ucucuuccagagcugugacacccuucucaugc

SEQ ID NO: 240847 - RNA, 17 nt, Human
ucucuuccauuugauca

SEQ ID NO: 240848 - RNA, 20 nt, Human
ucucuucccaaccauaacuc

SEQ ID NO: 240849 - RNA, 24 nt, Human
ucucuucccacagccuguaacuca

SEQ ID NO: 240850 - RNA, 32 nt, Human
ucucuucccacugugggccgguuccagccugg

SEQ ID NO: 240851 - RNA, 32 nt, Human
ucucuucccacuugcagagccugcugcccacg

SEQ ID NO: 240852 - RNA, 32 nt, Human
ucucuuccccacccuucucucuucccugcaaa

SEQ ID NO: 240853 - RNA, 32 nt, Human
ucucuucccccuuuuuggcauccuggcuugcc

SEQ ID NO: 240854 - RNA, 32 nt, Human
ucucuuccccuccucuaucucuuccucuccuc

SEQ ID NO: 240855 - RNA, 32 nt, Human
ucucuuccccucucagagcuacuugggccaua

SEQ ID NO: 240856 - RNA, 32 nt, Human
ucucuuccccucuccccuucucuuccccgagg

SEQ ID NO: 240857 - RNA, 32 nt, Human
ucucuucccggcuuggcaaucucagcugugcc

SEQ ID NO: 240858 - RNA, 32 nt, Human
ucucuucccuagggcauauccccaaauucuua

SEQ ID NO: 240859 - RNA, 21 nt, Human
ucucuucccucccugcaacuc

SEQ ID NO: 240860 - RNA, 32 nt, Human
ucucuucccugaccuggagagaaggaagcauu

SEQ ID NO: 240861 - RNA, 32 nt, Human
ucucuucccugacuaucucucucaaugaucau

SEQ ID NO: 240862 - RNA, 32 nt, Human
ucucuucccuucaucagggaagggaagccaag

SEQ ID NO: 240863 - RNA, 32 nt, Human
ucucuucccuuccccucucucauugcugcacc

SEQ ID NO: 240864 - RNA, 32 nt, Human
ucucuucccuucuaacuugacagggucuugcu

SEQ ID NO: 240865 - RNA, 32 nt, Human
ucucuucccuuuccucucucccccucggugaa

SEQ ID NO: 240866 - RNA, 32 nt, Human
ucucuuccuccagggacucuggggcccuuugg

SEQ ID NO: 240867 - RNA, 32 nt, Human
ucucuuccuccuccuccgucuucuucccuggc

SEQ ID NO: 240868 - RNA, 22 nt, Human
ucucuuccuccucuggacgcug

SEQ ID NO: 240869 - RNA, 32 nt, Human
ucucuuccucuccucucucucuuccucuccuc

SEQ ID NO: 240870 - RNA, 32 nt, Human
ucucuuccucuccucucucucuuccucuucuc

SEQ ID NO: 240871 - RNA, 32 nt, Human
ucucuuccucuuccuauaaaggcacuaacccu

SEQ ID NO: 240872 - RNA, 32 nt, Human
ucucuuccugacacaaauaccggauucucaga

SEQ ID NO: 240873 - RNA, 32 nt, Human
ucucuuccugcccucacuucuuucaccuugaa

SEQ ID NO: 240874 - RNA, 32 nt, Human
ucucuuccugcucuccaucauggcgcaggauc

SEQ ID NO: 240875 - RNA, 32 nt, Human
ucucuuccuggcuggggcuggggugaacugga

SEQ ID NO: 240876 - RNA, 32 nt, Human
ucucuuccugguaauccucuggcccagccuua

SEQ ID NO: 240877 - RNA, 32 nt, Human
ucucuuccuguccucuaucucuuccccuccuc

SEQ ID NO: 240878 - RNA, 32 nt, Human
ucucuuccugucuuuguugucucccucuuucu

SEQ ID NO: 240879 - RNA, 32 nt, Human
ucucuuccuguuacauuucaugcaucagaagc

SEQ ID NO: 240880 - RNA, 32 nt, Human
ucucuuccuugcuuuguuguguguucuaauuc

SEQ ID NO: 240881 - RNA, 18 nt, Human
ucucuuccuuuccuuucc

SEQ ID NO: 240882 - RNA, 32 nt, Human
ucucuuccuuucucucugccugucccucuccu

SEQ ID NO: 240883 - RNA, 32 nt, Human
ucucuuccuuugucauuucaagcaauuuucau

SEQ ID NO: 240884 - RNA, 18 nt, Human
ucucuuccuuuuccuccu

SEQ ID NO: 240885 - RNA, 32 nt, Human
ucucuucgucuucuccucuuccuuguccccuc

SEQ ID NO: 240886 - RNA, 32 nt, Human
ucucuucuccaaugcccugguuguuauuuuuc

SEQ ID NO: 240887 - RNA, 32 nt, Human
ucucuucuccaccucccacaaaggagagcuag

SEQ ID NO: 240888 - RNA, 32 nt, Human
ucucuucuccaccuucucuccacagaauguuu

SEQ ID NO: 240889 - RNA, 32 nt, Human
ucucuucuccuacucugggucuucuauccugg

SEQ ID NO: 240890 - RNA, 32 nt, Human
ucucuucuccuccuccucuuucuucacuccuc

SEQ ID NO: 240891 - RNA, 32 nt, Human
ucucuucuccuuuguaccugucaacaccagag

SEQ ID NO: 240892 - RNA, 32 nt, Human
ucucuucucuacugcccugggcuucagccuuu

SEQ ID NO: 240893 - RNA, 32 nt, Human
ucucuucucucuucucaauuuugagguccuca

SEQ ID NO: 240894 - RNA, 32 nt, Human
ucucuucucugaggagcucgacggcauaaauc

SEQ ID NO: 240895 - RNA, 32 nt, Human
ucucuucucugcacuccagggcuuugauaaua

SEQ ID NO: 240896 - RNA, 32 nt, Human
ucucuucucugcacuccugccgaccuucccac

SEQ ID NO: 240897 - RNA, 32 nt, Human
ucucuucucugccucucaccaggacagccgcc

SEQ ID NO: 240898 - RNA, 32 nt, Human
ucucuucucugccucuggcccuccuggcucuu

SEQ ID NO: 240899 - RNA, 32 nt, Human
ucucuucucuuaucuucugucuguucucuuuu

SEQ ID NO: 240900 - RNA, 32 nt, Human
ucucuucucuuccccuucuccccaucgccacu

SEQ ID NO: 240901 - RNA, 32 nt, Human
ucucuucucuucuauguugcaaugaauguaaa

SEQ ID NO: 240902 - RNA, 32 nt, Human
ucucuucucuuucuccccucuucgccacccua

SEQ ID NO: 240903 - RNA, 32 nt, Human
ucucuucugauucuucucuucucccaagcccg

SEQ ID NO: 240904 - RNA, 32 nt, Human
ucucuucugcuccacccuuggccugucucauc

SEQ ID NO: 240905 - RNA, 32 nt, Human
ucucuucugcugucucuccuaccugucuucug

SEQ ID NO: 240906 - RNA, 32 nt, Human
ucucuucuguccccaccuccucuugggaauuc

SEQ ID NO: 240907 - RNA, 32 nt, Human
ucucuucugugcaccuaaguugcccagcccug

SEQ ID NO: 240908 - RNA, 32 nt, Human
ucucuucuguggcccccaccugcuccgggacg

SEQ ID NO: 240909 - RNA, 32 nt, Human
ucucuucuuccucuugcgucuucccggccccu

SEQ ID NO: 240910 - RNA, 32 nt, Human
ucucuucuucuuuacaccccugaugacucugg

SEQ ID NO: 240911 - RNA, 18 nt, Human
ucucuucuucuuuggaga

SEQ ID NO: 240912 - RNA, 32 nt, Human
ucucuucuugcguguggggcagguguggagaa

SEQ ID NO: 240913 - RNA, 32 nt, Human
ucucuucuuuaugauguucacuuuaaaaacaa

SEQ ID NO: 240914 - RNA, 32 nt, Human
ucucuugaacccaggaggcagagguugcagug

SEQ ID NO: 240915 - RNA, 32 nt, Human
ucucuugaacccaggaggccgagguugcagug

SEQ ID NO: 240916 - RNA, 32 nt, Human
ucucuugaacccaggaggcggagguugcagug

SEQ ID NO: 240917 - RNA, 32 nt, Human
ucucuugaacccaggaggcggagguugcggug

SEQ ID NO: 240918 - RNA, 32 nt, Human
ucucuugaacccaggagguggaggaugcagug

SEQ ID NO: 240919 - RNA, 32 nt, Human
ucucuugaacccaggagguggagguugcagug

SEQ ID NO: 240920 - RNA, 32 nt, Human
ucucuugaacccaggggguggagguugcacug

SEQ ID NO: 240921 - RNA, 32 nt, Human
ucucuugaacugaggagguggagguugcagug

SEQ ID NO: 240922 - RNA, 32 nt, Human
ucucuugaauccaggaggcagaggcuguggug

SEQ ID NO: 240923 - RNA, 32 nt, Human
ucucuugagcccagagacaaggcagcuugguc

SEQ ID NO: 240924 - RNA, 32 nt, Human
ucucuugagcccaggagaugcaggcuugcagu

SEQ ID NO: 240925 - RNA, 32 nt, Human
ucucuugagcccaggaguuggaguccagucca

SEQ ID NO: 240926 - RNA, 32 nt, Human
ucucuugagccccucacccuguuucuuucugu

SEQ ID NO: 240927 - RNA, 32 nt, Human
ucucuugagcuucgacucuucugugcucuauu

SEQ ID NO: 240928 - RNA, 32 nt, Human
ucucuugaggcggugagcagaagcuuguccuc

SEQ ID NO: 240929 - RNA, 32 nt, Human
ucucuugaggcugccuuggcauucacccacgc

SEQ ID NO: 240930 - RNA, 32 nt, Human
ucucuugaguagcugagauuacagguacgcac

SEQ ID NO: 240931 - RNA, 32 nt, Human
ucucuugauugcauaugcaugccaucauacag

SEQ ID NO: 240932 - RNA, 32 nt, Human
ucucuugcagugguggggucagaugcugugga

SEQ ID NO: 240933 - RNA, 32 nt, Human
ucucuugccaucaccuagcugccugcaccugc

SEQ ID NO: 240934 - RNA, 32 nt, Human
ucucuugcccaggcuggagugcaguggcacgg

SEQ ID NO: 240935 - RNA, 32 nt, Human
ucucuugcccaggcuggagugcagugguauga

SEQ ID NO: 240936 - RNA, 32 nt, Human
ucucuugcccagguaagcuggggaagagccug

SEQ ID NO: 240937 - RNA, 32 nt, Human
ucucuugcccuucuucuagcagucugugccuc

SEQ ID NO: 240938 - RNA, 32 nt, Human
ucucuugccuugaaagccuccucuuuggaccu

SEQ ID NO: 240939 - RNA, 32 nt, Human
ucucuugcgugugaaucucuuacccugaaaaa

SEQ ID NO: 240940 - RNA, 32 nt, Human
ucucuugcucuuccuguacccacauuuggggg

SEQ ID NO: 240941 - RNA, 32 nt, Human
ucucuugcugucagacccauucuauauucuaa

SEQ ID NO: 240942 - RNA, 32 nt, Human
ucucuugcuuccucuucucuucucccuuaucg

SEQ ID NO: 240943 - RNA, 32 nt, Human
ucucuugcuuucccaacucggcuacgcuggcc

SEQ ID NO: 240944 - RNA, 32 nt, Human
ucucuuggaaaguccagucucuccucggcuug

SEQ ID NO: 240945 - RNA, 32 nt, Human
ucucuuggaccugccaccaucacuuucugggu

SEQ ID NO: 240946 - RNA, 32 nt, Human
ucucuuggagcagcagccgcccaggccuuuag

SEQ ID NO: 240947 - RNA, 32 nt, Human
ucucuuggcagagugagggccuggagauaacc

SEQ ID NO: 240948 - RNA, 32 nt, Human
ucucuuggcauaccacugccucccagggaaca

SEQ ID NO: 240949 - RNA, 32 nt, Human
ucucuuggccuggaggaauugcuccuaacuag

SEQ ID NO: 240950 - RNA, 32 nt, Human
ucucuuggcugggccaagagggccuuccugga

SEQ ID NO: 240951 - RNA, 32 nt, Human
ucucuugggacccuccugguuuuaacugggag

SEQ ID NO: 240952 - RNA, 32 nt, Human
ucucuuggggcugagggagcaccaugcagcuu

SEQ ID NO: 240953 - RNA, 32 nt, Human
ucucuugguaugucuuguuuggaaaaguggau

SEQ ID NO: 240954 - RNA, 32 nt, Human
ucucuuguaaccaucacugaagucaagaaaua

SEQ ID NO: 240955 - RNA, 32 nt, Human
ucucuugucaaccgggcuggagugcaguggug

SEQ ID NO: 240956 - RNA, 32 nt, Human
ucucuuguccaaggcuggaguguaguagugcu

SEQ ID NO: 240957 - RNA, 32 nt, Human
ucucuugucccucggcccucccugguuuuguc

SEQ ID NO: 240958 - RNA, 32 nt, Human
ucucuugucgcccaggcuggagugcaauggcg

SEQ ID NO: 240959 - RNA, 32 nt, Human
ucucuugucucccaggcuggagugcaaucgcg

SEQ ID NO: 240960 - RNA, 32 nt, Human
ucucuugucuucagacagcccugacagcacgc

SEQ ID NO: 240961 - RNA, 32 nt, Human
ucucuugugcuagcuggagcagcuccuucccc

SEQ ID NO: 240962 - RNA, 32 nt, Human
ucucuuguuacccaggcuggagugcaauggca

SEQ ID NO: 240963 - RNA, 32 nt, Human
ucucuuguugcccaggcugaagugcaauguug

SEQ ID NO: 240964 - RNA, 32 nt, Human
ucucuuguugcccaggcugaagugcaguguug

SEQ ID NO: 240965 - RNA, 32 nt, Human
ucucuuguugcccaggcuggagugcauuggcg

SEQ ID NO: 240966 - RNA, 31 nt, Human
ucucuuuaccagucccaccuaccucacuaug

SEQ ID NO: 240967 - RNA, 32 nt, Human
ucucuuuagcucaaccacucuguccauccagc

SEQ ID NO: 240968 - RNA, 32 nt, Human
ucucuuuauuuucccugguagagacaucuuca

SEQ ID NO: 240969 - RNA, 32 nt, Human
ucucuuucaagugccauuacagcugaacauua

SEQ ID NO: 240970 - RNA, 32 nt, Human
ucucuuucaagugccuuaauccgagccagcag

SEQ ID NO: 240971 - RNA, 32 nt, Human
ucucuuucacugggcugcuuuucaaucuuauu

SEQ ID NO: 240972 - RNA, 32 nt, Human
ucucuuuccccuccaaccaguucaaucucauc

SEQ ID NO: 240973 - RNA, 32 nt, Human
ucucuuucccucucccugucccucucuuucuu

SEQ ID NO: 240974 - RNA, 32 nt, Human
ucucuuuccucuuccuccuccacuucccacuu

SEQ ID NO: 240975 - RNA, 32 nt, Human
ucucuuuccucuuuguccaagcauccuauccc

SEQ ID NO: 240976 - RNA, 32 nt, Human
ucucuuuccuuuucucugucugcuacugacuu

SEQ ID NO: 240977 - RNA, 32 nt, Human
ucucuuucgccuccucuucucuuaguucucuc

SEQ ID NO: 240978 - RNA, 32 nt, Human
ucucuuucuccuccacauacugcagccucccu

SEQ ID NO: 240979 - RNA, 32 nt, Human
ucucuuucuccuccuggccuggccugaauauu

SEQ ID NO: 240980 - RNA, 32 nt, Human
ucucuuucucucuuucuuucucuguccccaag

SEQ ID NO: 240981 - RNA, 32 nt, Human
ucucuuucucuuccucccuucugccaucacug

SEQ ID NO: 240982 - RNA, 32 nt, Human
ucucuuucugccuccccuccccugggggccgg

SEQ ID NO: 240983 - RNA, 22 nt, Human
ucucuuucugcuucaguugcug

SEQ ID NO: 240984 - RNA, 32 nt, Human
ucucuuucuggcccauccucugcuucacacca

SEQ ID NO: 240985 - RNA, 32 nt, Human
ucucuuucuguccuuuuucuugcugauuuaug

SEQ ID NO: 240986 - RNA, 32 nt, Human
ucucuuucuuauccuaacaagugucuuauuug

SEQ ID NO: 240987 - RNA, 32 nt, Human
ucucuuucuucucugcugccccauggcuaagc

SEQ ID NO: 240988 - RNA, 32 nt, Human
ucucuuucuucucuuggcacugggggcgucag

SEQ ID NO: 240989 - RNA, 32 nt, Human
ucucuuucuuuccacccaguugcccuugcggc

SEQ ID NO: 240990 - RNA, 32 nt, Human
ucucuuucuuucucuuucuguuuccuggccuc

SEQ ID NO: 240991 - RNA, 32 nt, Human
ucucuuucuuucucuuuucccuuccuuccuuc

SEQ ID NO: 240992 - RNA, 32 nt, Human
ucucuuugaacccugaggguggccaggaucug

SEQ ID NO: 240993 - RNA, 32 nt, Human
ucucuuugaacucuggaucuuugcuuuugcuc

SEQ ID NO: 240994 - RNA, 22 nt, Human
ucucuuugaagcaauugugaau

SEQ ID NO: 240995 - RNA, 23 nt, Human
ucucuuugacagcaguuuggaau

SEQ ID NO: 240996 - RNA, 32 nt, Human
ucucuuugauuauguugugacuaguuuuguua

SEQ ID NO: 240997 - RNA, 21 nt, Human
ucucuuugcaucagaucugaa

SEQ ID NO: 240998 - RNA, 32 nt, Human
ucucuuugcccuuccagaugucugacugggac

SEQ ID NO: 240999 - RNA, 31 nt, Human
ucucuuugccucucugggucucuaucuccuc

SEQ ID NO: 241000 - RNA, 32 nt, Human
ucucuuuggaauugggagcacgaugacucuga

SEQ ID NO: 241001 - RNA, 32 nt, Human
ucucuuuggacucuccccucuuauguaccucu

SEQ ID NO: 241002 - RNA, 32 nt, Human
ucucuuuggaggaguggcaaugccuggacacu

SEQ ID NO: 241003 - RNA, 32 nt, Human
ucucuuuggcugcugccucagcacagagagcc

SEQ ID NO: 241004 - RNA, 32 nt, Human
ucucuuugggucucaauuuugccuucccuaau

SEQ ID NO: 241005 - RNA, 32 nt, Human
ucucuuugggugaccggaaaacuccaccucaa

SEQ ID NO: 241006 - RNA, 32 nt, Human
ucucuuuggguugucuuucuccucuccuacau

SEQ ID NO: 241007 - RNA, 32 nt, Human
ucucuuuggucucaaagcaaauugcucugauc

SEQ ID NO: 241008 - RNA, 32 nt, Human
ucucuuuggucuugcagucggcuucucuaugg

SEQ ID NO: 241009 - RNA, 32 nt, Human
ucucuuuggucuuguugauuuaccucugggca

SEQ ID NO: 241010 - RNA, 32 nt, Human
ucucuuuguagaaguuuuguuuuugaaaugug

SEQ ID NO: 241011 - RNA, 32 nt, Human
ucucuuuguggggcucaaaaccuccaaggacc

SEQ ID NO: 241012 - RNA, 31 nt, Human
ucucuuuuauacuagaauauuaaaaagccag

SEQ ID NO: 241013 - RNA, 24 nt, Human
ucucuuuucagaggggaaaaagga

SEQ ID NO: 241014 - RNA, 32 nt, Human
ucucuuuuccucccucuccuuccccuugcugu

SEQ ID NO: 241015 - RNA, 32 nt, Human
ucucuuuucuaccggacuuuuccucuucugcc

SEQ ID NO: 241016 - RNA, 32 nt, Human
ucucuuuucucuaccccuguguccugcuucuc

SEQ ID NO: 241017 - RNA, 32 nt, Human
ucucuuuucuuccuucuuuuccuuccuuuuug

SEQ ID NO: 241018 - RNA, 32 nt, Human
ucucuuuucuuuccuucucccuuucuucuuug

SEQ ID NO: 241019 - RNA, 32 nt, Human
ucucuuuucuuuuagcuccucuguggugaauu

SEQ ID NO: 241020 - RNA, 32 nt, Human
ucucuuuugccucccacugacugcccuuuucc

SEQ ID NO: 241021 - RNA, 32 nt, Human
ucucuuuuggaaaacaaaaaucagaaggcugc

SEQ ID NO: 241022 - RNA, 32 nt, Human
ucucuuuugucugaccucucuccuccccuccu

SEQ ID NO: 241023 - RNA, 32 nt, Human
ucucuuuuuaccacugaauuuuuccaaaagga

SEQ ID NO: 241024 - RNA, 32 nt, Human
ucucuuuuuacugcaacuuaauauuucuauuu

SEQ ID NO: 241025 - RNA, 32 nt, Human
ucucuuuuuauccuuauuccucccccgaccua

SEQ ID NO: 241026 - RNA, 32 nt, Human
ucucuuuuuccuuacaccuuguggaucaugug

SEQ ID NO: 241027 - RNA, 32 nt, Human
ucucuuuuugagacagucucgcucuguuaccc

SEQ ID NO: 241028 - RNA, 20 nt, Human
ucucuuuuuugucuugaauc

SEQ ID NO: 241029 - RNA, 32 nt, Human
ucugaaaacauguagagaagaugaguugagga

SEQ ID NO: 241030 - RNA, 32 nt, Human
ucugaaaaccuaccagccagaggguagggcac

SEQ ID NO: 241031 - RNA, 32 nt, Human
ucugaaaacugaggaguguccucuguucuucc

SEQ ID NO: 241032 - RNA, 32 nt, Human
ucugaaaagaauacauacucuuuccaugcaua

SEQ ID NO: 241033 - RNA, 32 nt, Human
ucugaaaagaggagccagagaaggugguaccc

SEQ ID NO: 241034 - RNA, 21 nt, Human
ucugaaaagccagcucuugaa

SEQ ID NO: 241035 - RNA, 31 nt, Human
ucugaaaagugugaggaaaaagaacuguaac

SEQ ID NO: 241036 - RNA, 32 nt, Human
ucugaaaauaaguggucucaagagaagcauuc

SEQ ID NO: 241037 - RNA, 32 nt, Human
ucugaaaauccccaguagcaucugccaagaag

SEQ ID NO: 241038 - RNA, 32 nt, Human
ucugaaaauucacuuuuaccuugaaguucaau

SEQ ID NO: 241039 - RNA, 32 nt, Human
ucugaaaauuuugccauuuaucuacagaaauu

SEQ ID NO: 241040 - RNA, 21 nt, Human
ucugaaacaaacagaggcugg

SEQ ID NO: 241041 - RNA, 32 nt, Human
ucugaaacaagguaucuuccaucagcauaaca

SEQ ID NO: 241042 - RNA, 21 nt, Human
ucugaaacagacagaggcugg

SEQ ID NO: 241043 - RNA, 32 nt, Human
ucugaaaccgagcaggcucuacuccagaacag

SEQ ID NO: 241044 - RNA, 32 nt, Human
ucugaaaccucggccugaucugaucucauguu

SEQ ID NO: 241045 - RNA, 32 nt, Human
ucugaaaccucugggucaucucucacacauuc

SEQ ID NO: 241046 - RNA, 32 nt, Human
ucugaaacucacaaccuaaagcccaaucuuga

SEQ ID NO: 241047 - RNA, 31 nt, Human
ucugaaacucacacaacuaggaaguggcuga

SEQ ID NO: 241048 - RNA, 32 nt, Human
ucugaaagagggcugugccuuccguuucagaa

SEQ ID NO: 241049 - RNA, 32 nt, Human
ucugaaagauggacagagagacaggagauggu

SEQ ID NO: 241050 - RNA, 32 nt, Human
ucugaaagcacaggucacccagccucagaauc

SEQ ID NO: 241051 - RNA, 20 nt, Human
ucugaaagcugguugaagga

SEQ ID NO: 241052 - RNA, 32 nt, Human
ucugaaaggagaaaggacuauuucucaguuag

SEQ ID NO: 241053 - RNA, 32 nt, Human
ucugaaaggccaucaggacaacuguuagagaa

SEQ ID NO: 241054 - RNA, 32 nt, Human
ucugaaagggaaaugcuuuucugcagaggccc

SEQ ID NO: 241055 - RNA, 32 nt, Human
ucugaaaguaagaucagugaacugcuuuucag

SEQ ID NO: 241056 - RNA, 32 nt, Human
ucugaaagugacuggaugagauccucaaaaau

SEQ ID NO: 241057 - RNA, 32 nt, Human
ucugaaaguuccuuuguggaccccagaaaccc

SEQ ID NO: 241058 - RNA, 32 nt, Human
ucugaaaguugucuaguucuuccuucaucaca

SEQ ID NO: 241059 - RNA, 32 nt, Human
ucugaaauagucaccucacagcucuucaaaga

SEQ ID NO: 241060 - RNA, 21 nt, Human
ucugaaauccccaaucaauca

SEQ ID NO: 241061 - RNA, 32 nt, Human
ucugaaaucuagguggagguucccaaacuuca

SEQ ID NO: 241062 - RNA, 32 nt, Human
ucugaaaucugacaccugcucucccggcaagg

SEQ ID NO: 241063 - RNA, 32 nt, Human
ucugaaaucuggcaaaugcagccucaacagaa

SEQ ID NO: 241064 - RNA, 32 nt, Human
ucugaaaucuuucucccuagcccccucuggaa

SEQ ID NO: 241065 - RNA, 31 nt, Human
ucugaaaugaagauggaggaggcagugggaa

SEQ ID NO: 241066 - RNA, 32 nt, Human
ucugaaaugucagcaaguaaguucugaaacac

SEQ ID NO: 241067 - RNA, 32 nt, Human
ucugaacaaaggaugcugauggauucaagcca

SEQ ID NO: 241068 - RNA, 32 nt, Human
ucugaacacaaccagagguggcaggagaauuu

SEQ ID NO: 241069 - RNA, 32 nt, Human
ucugaacacaguuaucaggauuacaaaaugug

SEQ ID NO: 241070 - RNA, 32 nt, Human
ucugaacaccaccaccaccaauaauacuuauc

SEQ ID NO: 241071 - RNA, 32 nt, Human
ucugaacaccuacauuuccuuugcagacaaau

SEQ ID NO: 241072 - RNA, 32 nt, Human
ucugaacaccucagcugcuguaagcuucuccu

SEQ ID NO: 241073 - RNA, 32 nt, Human
ucugaacaggcagguaggauucagugugcuca

SEQ ID NO: 241074 - RNA, 32 nt, Human
ucugaaccacccuuuauucuacauaugauagg

SEQ ID NO: 241075 - RNA, 32 nt, Human
ucugaaccagcuguguccagacugaggcccca

SEQ ID NO: 241076 - RNA, 32 nt, Human
ucugaacccagcaccaucaguaccaaagucuu

SEQ ID NO: 241077 - RNA, 32 nt, Human
ucugaacccaggagacagguugcagugagccg

SEQ ID NO: 241078 - RNA, 32 nt, Human
ucugaaccugccucuugcugggccuuuguucc

SEQ ID NO: 241079 - RNA, 32 nt, Human
ucugaacugaacauuugcuuugucagaaaaua

SEQ ID NO: 241080 - RNA, 32 nt, Human
ucugaacugcacccaggaggugacugggaagg

SEQ ID NO: 241081 - RNA, 32 nt, Human
ucugaacuguuacaacuuguauuuccaaaccu

SEQ ID NO: 241082 - RNA, 32 nt, Human
ucugaacuguucugagaccuguucccagucac

SEQ ID NO: 241083 - RNA, 32 nt, Human
ucugaacuuaacagggcacauucugucucuaa

SEQ ID NO: 241084 - RNA, 19 nt, Human
ucugaagaacugccaaugc

SEQ ID NO: 241085 - RNA, 32 nt, Human
ucugaagaagagcaagaagaagagugacuccu

SEQ ID NO: 241086 - RNA, 32 nt, Human
ucugaagaagaggcaaaacuguugaaugcaag

SEQ ID NO: 241087 - RNA, 32 nt, Human
ucugaagaaguccaggugaauucagcuuugga

SEQ ID NO: 241088 - RNA, 32 nt, Human
ucugaagaaugagacauugagaaaacuaugua

SEQ ID NO: 241089 - RNA, 32 nt, Human
ucugaagacauuaaacaggcaguuuguaggaa

SEQ ID NO: 241090 - RNA, 32 nt, Human
ucugaagaccccaaucucagaaauucaaauuu

SEQ ID NO: 241091 - RNA, 32 nt, Human
ucugaagacucaggcagagcagcuccacaacc

SEQ ID NO: 241092 - RNA, 32 nt, Human
ucugaagacucaugacaucugccccagccgca

SEQ ID NO: 241093 - RNA, 23 nt, Human
ucugaagagagcugcucuguguu

SEQ ID NO: 241094 - RNA, 32 nt, Human
ucugaagagcuuccgcgccuucccccuggucu

SEQ ID NO: 241095 - RNA, 32 nt, Human
ucugaagaggggaaucccuccaaccccaaacu

SEQ ID NO: 241096 - RNA, 32 nt, Human
ucugaagaugacugagucacacugccugcucc

SEQ ID NO: 241097 - RNA, 32 nt, Human
ucugaagcaaacaucuggugccaagaucuaca

SEQ ID NO: 241098 - RNA, 32 nt, Human
ucugaagcacagaguccaucucagaugggaaa

SEQ ID NO: 241099 - RNA, 32 nt, Human
ucugaagcacagcgcgguuaggaaaagucaca

SEQ ID NO: 241100 - RNA, 32 nt, Human
ucugaagcagagccaaaaggccagaauggguc

SEQ ID NO: 241101 - RNA, 32 nt, Human
ucugaagcagagcccugggacggaccccaugc

SEQ ID NO: 241102 - RNA, 32 nt, Human
ucugaagcagaggcaagacaaacacaggcgcu

SEQ ID NO: 241103 - RNA, 32 nt, Human
ucugaagcagcaacaccaagggcaaugugagu

SEQ ID NO: 241104 - RNA, 32 nt, Human
ucugaagcagcugcacugauacauuugggagu

SEQ ID NO: 241105 - RNA, 32 nt, Human
ucugaagcagggaccagagggagccaggcagc

SEQ ID NO: 241106 - RNA, 32 nt, Human
ucugaagcagggccaggggaggcucacucaca

SEQ ID NO: 241107 - RNA, 32 nt, Human
ucugaagccacucugaaaucacucugaagcca

SEQ ID NO: 241108 - RNA, 32 nt, Human
ucugaagccagguguugagaccagccugcugu

SEQ ID NO: 241109 - RNA, 32 nt, Human
ucugaagcccugaaaagccucaugucugcauc

SEQ ID NO: 241110 - RNA, 32 nt, Human
ucugaagccucuuccugaucuggagccacagu

SEQ ID NO: 241111 - RNA, 32 nt, Human
ucugaagcuacguggccaccagaagacacagc

SEQ ID NO: 241112 - RNA, 32 nt, Human
ucugaagcugaacccagggccuggcugugguc

SEQ ID NO: 241113 - RNA, 32 nt, Human
ucugaagcugcucaccuggccgagggaggucc

SEQ ID NO: 241114 - RNA, 32 nt, Human
ucugaagcuuagaaugagaagccaguagcuau

SEQ ID NO: 241115 - RNA, 32 nt, Human
ucugaagcuucugaguucugcagccucaccuc

SEQ ID NO: 241116 - RNA, 32 nt, Human
ucugaagcuuugcccaggauccauugcugcag

SEQ ID NO: 241117 - RNA, 32 nt, Human
ucugaaggaacaccugaugaggcugcacccuu

SEQ ID NO: 241118 - RNA, 32 nt, Human
ucugaaggaauccaaaugugacuuugaaaauu

SEQ ID NO: 241119 - RNA, 24 nt, Human
ucugaaggaucaccugccccaccu

SEQ ID NO: 241120 - RNA, 32 nt, Human
ucugaaggcucgagagagaacucccccagggc

SEQ ID NO: 241121 - RNA, 32 nt, Human
ucugaaggcuuaauuuugcaaaggaggaugca

SEQ ID NO: 241122 - RNA, 32 nt, Human
ucugaaggggcccccaacacaccaccugccuu

SEQ ID NO: 241123 - RNA, 32 nt, Human
ucugaagggguugugagaagagagacgggaaa

SEQ ID NO: 241124 - RNA, 32 nt, Human
ucugaaggugaucuccacaagagggugugugu

SEQ ID NO: 241125 - RNA, 32 nt, Human
ucugaaguaaauacagaagaggcuccaaaaua

SEQ ID NO: 241126 - RNA, 32 nt, Human
ucugaagucugaggaacaaugccuuaagaaaa

SEQ ID NO: 241127 - RNA, 31 nt, Human
ucugaagucugugucuuuaugccaagaacug

SEQ ID NO: 241128 - RNA, 23 nt, Human
ucugaagugcccaguuccugcca

SEQ ID NO: 241129 - RNA, 32 nt, Human
ucugaagugccuugagaacauguggguccgag

SEQ ID NO: 241130 - RNA, 32 nt, Human
ucugaaguggacauauucagccuuggcgagaa

SEQ ID NO: 241131 - RNA, 32 nt, Human
ucugaaguuauauuuccuauaccauuuccgua

SEQ ID NO: 241132 - RNA, 31 nt, Human
ucugaaguuggccuccuuucacuggggauug

SEQ ID NO: 241133 - RNA, 32 nt, Human
ucugaaguugucucccugacccuucuuuagug

SEQ ID NO: 241134 - RNA, 22 nt, Human
ucugaaguuuguaggaagggaa

SEQ ID NO: 241135 - RNA, 32 nt, Human
ucugaaguuuucucuuuucucucccauuuaag

SEQ ID NO: 241136 - RNA, 32 nt, Human
ucugaaguuuugcuccuuauugcacaucuuau

SEQ ID NO: 241137 - RNA, 22 nt, Human
ucugaauaaaccugccugcuca

SEQ ID NO: 241138 - RNA, 22 nt, Human
ucugaauagaugaucuuacuca

SEQ ID NO: 241139 - RNA, 32 nt, Human
ucugaauauuuacacacauagcacacuauagc

SEQ ID NO: 241140 - RNA, 32 nt, Human
ucugaaucaagugcugcuaguaccaagcugcu

SEQ ID NO: 241141 - RNA, 32 nt, Human
ucugaaucaccagcauucaaacaaauauuucg

SEQ ID NO: 241142 - RNA, 32 nt, Human
ucugaauccuaccugguuucuucaggcuucug

SEQ ID NO: 241143 - RNA, 32 nt, Human
ucugaaucuagagaacaguauugggcaggagg

SEQ ID NO: 241144 - RNA, 32 nt, Human
ucugaaugacacggaacgcucccacugcaggc

SEQ ID NO: 241145 - RNA, 32 nt, Human
ucugaaugagcgagaaaaauguggauguacug

SEQ ID NO: 241146 - RNA, 32 nt, Human
ucugaaugcaucuagcuuauuucuuggccauc

SEQ ID NO: 241147 - RNA, 32 nt, Human
ucugaaugccuccucccugccugcgcuuugcc

SEQ ID NO: 241148 - RNA, 21 nt, Human
ucugaaugccuccuuucucca

SEQ ID NO: 241149 - RNA, 32 nt, Human
ucugaaugcugauccccugugugagagaaaag

SEQ ID NO: 241150 - RNA, 32 nt, Human
ucugaauggcagcacgaagcaggccuguuacu

SEQ ID NO: 241151 - RNA, 32 nt, Human
ucugaauggggagcagguaagagcagagcacc

SEQ ID NO: 241152 - RNA, 32 nt, Human
ucugaaugucuccagugccuaugaggucagcu

SEQ ID NO: 241153 - RNA, 32 nt, Human
ucugaaugugcacagaacacguggcucaaaug

SEQ ID NO: 241154 - RNA, 32 nt, Human
ucugaaugugccagacccgggacucgaaccuu

SEQ ID NO: 241155 - RNA, 32 nt, Human
ucugaauguuugucccccaucuaggauuccag

SEQ ID NO: 241156 - RNA, 23 nt, Human
ucugaauuauuuucuuguugcuu

SEQ ID NO: 241157 - RNA, 32 nt, Human
ucugaauucauguuaugagugucaucuuuauc

SEQ ID NO: 241158 - RNA, 32 nt, Human
ucugaauuccagccaagaaguuccaggacccu

SEQ ID NO: 241159 - RNA, 32 nt, Human
ucugaauugagugaggagagaaaggggaaaga

SEQ ID NO: 241160 - RNA, 32 nt, Human
ucugaauuggcuuagagugugcaguccaaccc

SEQ ID NO: 241161 - RNA, 32 nt, Human
ucugaauuuccuuuucuuggcuuguuucuacu

SEQ ID NO: 241162 - RNA, 32 nt, Human
ucugacaacgcugaggccacgagcuccugggu

SEQ ID NO: 241163 - RNA, 32 nt, Human
ucugacacacguauuuauauuuggaaagagac

SEQ ID NO: 241164 - RNA, 23 nt, Human
ucugacacagaguccuugucugg

SEQ ID NO: 241165 - RNA, 32 nt, Human
ucugacaccacugacagucaugcgacaucuac

SEQ ID NO: 241166 - RNA, 32 nt, Human
ucugacaccaguuuuugcuauuguaauauguu

SEQ ID NO: 241167 - RNA, 32 nt, Human
ucugacaccugggcuggagugcaguggugcaa

SEQ ID NO: 241168 - RNA, 25 nt, Human
ucugacacgggcuccaaccccaccu

SEQ ID NO: 241169 - RNA, 32 nt, Human
ucugacacugaauuuggaugcaccuuguuuua

SEQ ID NO: 241170 - RNA, 32 nt, Human
ucugacacugguguccaaaagucaacaauaaa

SEQ ID NO: 241171 - RNA, 32 nt, Human
ucugacacuuagaaaacagauaacagccccuc

SEQ ID NO: 241172 - RNA, 32 nt, Human
ucugacagaacagagaccuccucaccagggcu

SEQ ID NO: 241173 - RNA, 32 nt, Human
ucugacagaagaggagcaggagaaacaaaucg

SEQ ID NO: 241174 - RNA, 32 nt, Human
ucugacagaagcagaggcaguucugaggcagc

SEQ ID NO: 241175 - RNA, 32 nt, Human
ucugacagagagggugaaggggaaccagagcg

SEQ ID NO: 241176 - RNA, 32 nt, Human
ucugacagauuuuaaaaauugauaugauaaaa

SEQ ID NO: 241177 - RNA, 20 nt, Human
ucugacagcagccugugagg

SEQ ID NO: 241178 - RNA, 32 nt, Human
ucugacagccaagacauggagcaucucugcua

SEQ ID NO: 241179 - RNA, 32 nt, Human
ucugacagccagccuggugugcuuauucaggc

SEQ ID NO: 241180 - RNA, 22 nt, Human
ucugacagccuagaaguccaau

SEQ ID NO: 241181 - RNA, 30 nt, Human
ucugacagccucucccccauucugugugug

SEQ ID NO: 241182 - RNA, 32 nt, Human
ucugacagcucccagaggguucugggggugac

SEQ ID NO: 241183 - RNA, 32 nt, Human
ucugacaggaagcuucugcuccccaguucucc

SEQ ID NO: 241184 - RNA, 23 nt, Human
ucugacaggcuguuucuggggua

SEQ ID NO: 241185 - RNA, 26 nt, Human
ucugacaggugugccugcccccaucu

SEQ ID NO: 241186 - RNA, 32 nt, Human
ucugacaguacagugcagccaccaccauccca

SEQ ID NO: 241187 - RNA, 32 nt, Human
ucugacauacauugcaguuacaugcauuauuu

SEQ ID NO: 241188 - RNA, 32 nt, Human
ucugacaucgugaacaguuugcagugggcuau

SEQ ID NO: 241189 - RNA, 32 nt, Human
ucugacaucuguguccucacucuuaaccacug

SEQ ID NO: 241190 - RNA, 19 nt, Human
ucugacauucacagcauga

SEQ ID NO: 241191 - RNA, 32 nt, Human
ucugaccaaaggacgaaugagggagacguucc

SEQ ID NO: 241192 - RNA, 32 nt, Human
ucugaccaaguuggagcagaugguuuguuacu

SEQ ID NO: 241193 - RNA, 32 nt, Human
ucugaccacaaacaaguuggcuguuacuguau

SEQ ID NO: 241194 - RNA, 32 nt, Human
ucugaccacacuugaggagcccuucagcccag

SEQ ID NO: 241195 - RNA, 32 nt, Human
ucugaccacugcagaccagucucggagguguc

SEQ ID NO: 241196 - RNA, 21 nt, Human
ucugaccagaugcauucacuu

SEQ ID NO: 241197 - RNA, 32 nt, Human
ucugaccaguaggaagaaaccaggacagcagu

SEQ ID NO: 241198 - RNA, 32 nt, Human
ucugaccaucccucucaaucuucccugcccag

SEQ ID NO: 241199 - RNA, 32 nt, Human
ucugaccaucuuucucuuacuguccucuuugu

SEQ ID NO: 241200 - RNA, 32 nt, Human
ucugaccaugagacacggcuugcagugggggu

SEQ ID NO: 241201 - RNA, 32 nt, Human
ucugaccauucuauuguguggaugaccacaua

SEQ ID NO: 241202 - RNA, 32 nt, Human
ucugaccauucuguucucucuggcaggucaug

SEQ ID NO: 241203 - RNA, 32 nt, Human
ucugacccaagugccaaaggcagacgugcuuu

SEQ ID NO: 241204 - RNA, 32 nt, Human
ucugaccccacccugcacucccauccuuuccu

SEQ ID NO: 241205 - RNA, 32 nt, Human
ucugaccccaucucccccuagcuccuccuggg

SEQ ID NO: 241206 - RNA, 25 nt, Human
ucugacccccaagaggccugugagg

SEQ ID NO: 241207 - RNA, 23 nt, Human
ucugaccccucagcuccuuggaa

SEQ ID NO: 241208 - RNA, 32 nt, Human
ucugaccccuggaggagccacuguggaagcag

SEQ ID NO: 241209 - RNA, 32 nt, Human
ucugacccucaagaacgggacagagcagcugc

SEQ ID NO: 241210 - RNA, 32 nt, Human
ucugacccucccccugccuuccucuugccuug

SEQ ID NO: 241211 - RNA, 32 nt, Human
ucugacccuccccugcucgccucccucacccc

SEQ ID NO: 241212 - RNA, 32 nt, Human
ucugacccucuccugggcauugguuccugcug

SEQ ID NO: 241213 - RNA, 32 nt, Human
ucugacccuugggccugggccucugccccucc

SEQ ID NO: 241214 - RNA, 21 nt, Human
ucugaccgaagcugguuccag

SEQ ID NO: 241215 - RNA, 32 nt, Human
ucugaccguucccaccaccaucugcauguccc

SEQ ID NO: 241216 - RNA, 23 nt, Human
ucugaccucaggugauccacccg

SEQ ID NO: 241217 - RNA, 21 nt, Human
ucugaccucccccaggaugag

SEQ ID NO: 241218 - RNA, 21 nt, Human
ucugaccuccccuggaggcga

SEQ ID NO: 241219 - RNA, 18 nt, Human
ucugaccucccugggacc

SEQ ID NO: 241220 - RNA, 32 nt, Human
ucugaccuccuuccuguucaccuuugccuuug

SEQ ID NO: 241221 - RNA, 32 nt, Human
ucugaccuccuuggcacuggagcaucuggggc

SEQ ID NO: 241222 - RNA, 25 nt, Human
ucugaccucgugauccgccgaccuc

SEQ ID NO: 241223 - RNA, 25 nt, Human
ucugaccucgugaucugcccgccuc

SEQ ID NO: 241224 - RNA, 32 nt, Human
ucugaccucucuccuccccuccuuccucucuc

SEQ ID NO: 241225 - RNA, 19 nt, Human
ucugaccugccuguaccac

SEQ ID NO: 241226 - RNA, 32 nt, Human
ucugaccuugucaugugugugccaccaaacac

SEQ ID NO: 241227 - RNA, 23 nt, Human
ucugaccuuuugucuuauagcua

SEQ ID NO: 241228 - RNA, 23 nt, Human
ucugacgcaccacugccaaugcu

SEQ ID NO: 241229 - RNA, 32 nt, Human
ucugacgcauacaauggaaaaggcuuugucag

SEQ ID NO: 241230 - RNA, 32 nt, Human
ucugacgcuggagugcucacaguguggcuggg

SEQ ID NO: 241231 - RNA, 32 nt, Human
ucugacgcuggggccugcugcagccaccaaca

SEQ ID NO: 241232 - RNA, 32 nt, Human
ucugacgggaagagacagccagcacaguguuu

SEQ ID NO: 241233 - RNA, 32 nt, Human
ucugacgggagugacugagggagcuccuggug

SEQ ID NO: 241234 - RNA, 32 nt, Human
ucugacgggauuuguugauucucuccauuuug

SEQ ID NO: 241235 - RNA, 32 nt, Human
ucugacgguauuccugcgccacugggcugguc

SEQ ID NO: 241236 - RNA, 25 nt, Human
ucugacgguuacccuccccccaccu

SEQ ID NO: 241237 - RNA, 32 nt, Human
ucugacgguugggagugguggaaauuggaagg

SEQ ID NO: 241238 - RNA, 32 nt, Human
ucugacgucuugacuuuagacuucuggucccc

SEQ ID NO: 241239 - RNA, 32 nt, Human
ucugacuagcagcugccucccacucccaaaca

SEQ ID NO: 241240 - RNA, 32 nt, Human
ucugacuauaugcacacaccuuugauaccauc

SEQ ID NO: 241241 - RNA, 32 nt, Human
ucugacuaugugaagauacggugggaagauga

SEQ ID NO: 241242 - RNA, 32 nt, Human
ucugacucaaaggacauauacauucauucuuu

SEQ ID NO: 241243 - RNA, 32 nt, Human
ucugacucccagacucaagugauccucuugcc

SEQ ID NO: 241244 - RNA, 32 nt, Human
ucugacucccagguccaugcuccagagucaga

SEQ ID NO: 241245 - RNA, 22 nt, Human
ucugacucccccaacagcgagg

SEQ ID NO: 241246 - RNA, 19 nt, Human
ucugacucccuccaccuca

SEQ ID NO: 241247 - RNA, 32 nt, Human
ucugacucggguccagcuguucuuccugccag

SEQ ID NO: 241248 - RNA, 32 nt, Human
ucugacucguggggcucccugcugcagagagc

SEQ ID NO: 241249 - RNA, 32 nt, Human
ucugacucuaccccacugcuuccuucugcucc

SEQ ID NO: 241250 - RNA, 32 nt, Human
ucugacucucaucugcacuguccucucccuuu

SEQ ID NO: 241251 - RNA, 32 nt, Human
ucugacucuggcuucugcuuuuguuuuaaggg

SEQ ID NO: 241252 - RNA, 24 nt, Human
ucugacugaaccaugcccccaccu

SEQ ID NO: 241253 - RNA, 32 nt, Human
ucugacugccaagccagauucucuugaauaaa

SEQ ID NO: 241254 - RNA, 32 nt, Human
ucugacuggcagcagggucaguggccauccuu

SEQ ID NO: 241255 - RNA, 32 nt, Human
ucugacuggcuguucagccuaggcugcacaca

SEQ ID NO: 241256 - RNA, 20 nt, Human
ucugacuguacacccccacc

SEQ ID NO: 241257 - RNA, 31 nt, Human
ucugacugucaggcugggccugccuccuugu

SEQ ID NO: 241258 - RNA, 23 nt, Human
ucugacugucccugccaaugcuc

SEQ ID NO: 241259 - RNA, 32 nt, Human
ucugacuguggaccccaacccucucauuugac

SEQ ID NO: 241260 - RNA, 32 nt, Human
ucugacuuagguuggagaucaagccuuuuucc

SEQ ID NO: 241261 - RNA, 32 nt, Human
ucugacuuccgaugaugguguugaagcagguc

SEQ ID NO: 241262 - RNA, 32 nt, Human
ucugacuucuaggagcacaagagaggagccug

SEQ ID NO: 241263 - RNA, 32 nt, Human
ucugacuugagucccugcugcugcagugcacg

SEQ ID NO: 241264 - RNA, 32 nt, Human
ucugacuugucaccugccaaugccuggaacag

SEQ ID NO: 241265 - RNA, 32 nt, Human
ucugacuuucugccccuccacugacauggccc

SEQ ID NO: 241266 - RNA, 32 nt, Human
ucugacuuugccucuguccugccuggugugga

SEQ ID NO: 241267 - RNA, 32 nt, Human
ucugacuuuuagaaaccuagucuucuaaggca

SEQ ID NO: 241268 - RNA, 32 nt, Human
ucugacuuuuuccaucucuugcuucaaaguaa

SEQ ID NO: 241269 - RNA, 24 nt, Human
ucugacuuuuuguuucuuuguguu

SEQ ID NO: 241270 - RNA, 32 nt, Human
ucugagaaaccuuuguccucacuugaggcauu

SEQ ID NO: 241271 - RNA, 32 nt, Human
ucugagaaagccucugcaccauugucucagag

SEQ ID NO: 241272 - RNA, 32 nt, Human
ucugagaacagaagcccccuccccuacucaga

SEQ ID NO: 241273 - RNA, 32 nt, Human
ucugagaaccuccagcuucaccuccuuuucug

SEQ ID NO: 241274 - RNA, 32 nt, Human
ucugagaacuucaggaugcagaugucuccagc

SEQ ID NO: 241275 - RNA, 32 nt, Human
ucugagaagcauccuucuaagacauucuguug

SEQ ID NO: 241276 - RNA, 32 nt, Human
ucugagaagccauuucaaaguugcugauaacu

SEQ ID NO: 241277 - RNA, 32 nt, Human
ucugagaagcccugagcuaccuuggggucugg

SEQ ID NO: 241278 - RNA, 22 nt, Human
ucugagaagcugggacuacagg

SEQ ID NO: 241279 - RNA, 28 nt, Human
ucugagaauucacuucaguuuugccaga

SEQ ID NO: 241280 - RNA, 32 nt, Human
ucugagacagagucucacucugucucccaggc

SEQ ID NO: 241281 - RNA, 32 nt, Human
ucugagacaggcuggcuuggaguuaguguaug

SEQ ID NO: 241282 - RNA, 32 nt, Human
ucugagaccagccucggcaacaugccaagacc

SEQ ID NO: 241283 - RNA, 32 nt, Human
ucugagaccagccugagcaacaugaugagacc

SEQ ID NO: 241284 - RNA, 32 nt, Human
ucugagaccagccuggccaacauagcaaaacc

SEQ ID NO: 241285 - RNA, 32 nt, Human
ucugagaccagccuggccaacauggcaaaacc

SEQ ID NO: 241286 - RNA, 32 nt, Human
ucugagaccagccuggcuaacauggugaaacc

SEQ ID NO: 241287 - RNA, 32 nt, Human
ucugagaccagccuggcuuacauggugaaacc

SEQ ID NO: 241288 - RNA, 24 nt, Human
ucugagaccagccugggcaacaua

SEQ ID NO: 241289 - RNA, 32 nt, Human
ucugagaccagccugggcaacauagcaagacc

SEQ ID NO: 241290 - RNA, 32 nt, Human
ucugagaccagccugggcaacauggugaaacc

SEQ ID NO: 241291 - RNA, 32 nt, Human
ucugagacucuaaggaggugaaaugaauccca

SEQ ID NO: 241292 - RNA, 32 nt, Human
ucugagacugccuguuccucccucucugugac

SEQ ID NO: 241293 - RNA, 32 nt, Human
ucugagacuguugcugaacuggcaacuuacuu

SEQ ID NO: 241294 - RNA, 32 nt, Human
ucugagagaccugaaccccuacccauccccug

SEQ ID NO: 241295 - RNA, 32 nt, Human
ucugagagagaaggcaugggauuuucagcaua

SEQ ID NO: 241296 - RNA, 32 nt, Human
ucugagagcaagaauauauuggaugaacugaa

SEQ ID NO: 241297 - RNA, 32 nt, Human
ucugagagcagaggagggaaggcgggauggcc

SEQ ID NO: 241298 - RNA, 32 nt, Human
ucugagagcagcagguugagggccggugggca

SEQ ID NO: 241299 - RNA, 32 nt, Human
ucugagagcaucaggaaauacaacccuuuugc

SEQ ID NO: 241300 - RNA, 32 nt, Human
ucugagagcccagccacgccuuggagggaggg

SEQ ID NO: 241301 - RNA, 32 nt, Human
ucugagagccucaugaggguuucuaggauuua

SEQ ID NO: 241302 - RNA, 22 nt, Human
ucugagagcuccuuuuuugcca

SEQ ID NO: 241303 - RNA, 24 nt, Human
ucugagagcuccuuuuuugccaag

SEQ ID NO: 241304 - RNA, 32 nt, Human
ucugagagcuuaugaagcacauggacaaggaa

SEQ ID NO: 241305 - RNA, 31 nt, Human
ucugagaggcacuucacucacaggccugugg

SEQ ID NO: 241306 - RNA, 31 nt, Human
ucugagaggcacuucugucuucuccuuacuu

SEQ ID NO: 241307 - RNA, 32 nt, Human
ucugagaguggacugucuucucucccuucaca

SEQ ID NO: 241308 - RNA, 21 nt, Human
ucugagaguuggcucaggcag

SEQ ID NO: 241309 - RNA, 32 nt, Human
ucugagaucaugcaucucccacccaucugccc

SEQ ID NO: 241310 - RNA, 32 nt, Human
ucugagaucccgggagaaggaggacaguucuu

SEQ ID NO: 241311 - RNA, 32 nt, Human
ucugagaucccuugguuucucucuuguugauc

SEQ ID NO: 241312 - RNA, 32 nt, Human
ucugagaucugcaagaggaagcaguggaggaa

SEQ ID NO: 241313 - RNA, 32 nt, Human
ucugagaucuuucagaugguuuugccacauug

SEQ ID NO: 241314 - RNA, 32 nt, Human
ucugagaugaggccucguccuccuggaagcug

SEQ ID NO: 241315 - RNA, 32 nt, Human
ucugagaugccaccguaccccuacugcaugca

SEQ ID NO: 241316 - RNA, 32 nt, Human
ucugagauggccccagugaaccagcuucuaga

SEQ ID NO: 241317 - RNA, 32 nt, Human
ucugagaugggcguguguccugacuggccagu

SEQ ID NO: 241318 - RNA, 21 nt, Human
ucugagauuccauuuuugcca

SEQ ID NO: 241319 - RNA, 32 nt, Human
ucugagauuguggaagaauuuuugcaaccagc

SEQ ID NO: 241320 - RNA, 32 nt, Human
ucugagcaacagaucgagacccugccugaaaa

SEQ ID NO: 241321 - RNA, 32 nt, Human
ucugagcaaccagaacaugcugcugcggggcu

SEQ ID NO: 241322 - RNA, 32 nt, Human
ucugagcaaccagggacuuuaagaucuaaucc

SEQ ID NO: 241323 - RNA, 32 nt, Human
ucugagcaagcuggcgaacagcccuggcugcu

SEQ ID NO: 241324 - RNA, 32 nt, Human
ucugagcaaggcucuuccuccacccacagauc

SEQ ID NO: 241325 - RNA, 32 nt, Human
ucugagcacaugcugggugaagucacagcuca

SEQ ID NO: 241326 - RNA, 32 nt, Human
ucugagcaccuccacaccccacugccucuguc

SEQ ID NO: 241327 - RNA, 32 nt, Human
ucugagcacuauauuuugcugggcuauaaaag

SEQ ID NO: 241328 - RNA, 32 nt, Human
ucugagcacucacgaggacccucagcugcugg

SEQ ID NO: 241329 - RNA, 32 nt, Human
ucugagcacuuccguggacugaaggaaccgua

SEQ ID NO: 241330 - RNA, 32 nt, Human
ucugagcagagacauugauuugguuucauuau

SEQ ID NO: 241331 - RNA, 23 nt, Human
ucugagcagagggcggggugcag

SEQ ID NO: 241332 - RNA, 32 nt, Human
ucugagcagcccugguggcugccugugcucag

SEQ ID NO: 241333 - RNA, 22 nt, Human
ucugagcaggacaaggccccug

SEQ ID NO: 241334 - RNA, 32 nt, Human
ucugagcaggaugcccauagaaacccccaugg

SEQ ID NO: 241335 - RNA, 32 nt, Human
ucugagcaggcagaccagaagaccaggcacug

SEQ ID NO: 241336 - RNA, 32 nt, Human
ucugagcaggcucauuuuaaagggacuugcaa

SEQ ID NO: 241337 - RNA, 32 nt, Human
ucugagcagucugggagccuggagcagcccca

SEQ ID NO: 241338 - RNA, 32 nt, Human
ucugagcagugaaugauucaguguuaaaugug

SEQ ID NO: 241339 - RNA, 19 nt, Human
ucugagcaucuuggugcua

SEQ ID NO: 241340 - RNA, 32 nt, Human
ucugagcauggauccaaccaccccggccuggg

SEQ ID NO: 241341 - RNA, 32 nt, Human
ucugagccaacaucuauccagcagcccugacc

SEQ ID NO: 241342 - RNA, 32 nt, Human
ucugagccacggagacagggaggaaggagcgc

SEQ ID NO: 241343 - RNA, 32 nt, Human
ucugagccacuuuaaagaugaauccaugguau

SEQ ID NO: 241344 - RNA, 28 nt, Human
ucugagccagaugcugccugggucgguu

SEQ ID NO: 241345 - RNA, 32 nt, Human
ucugagccauggugucgagugaagaguaguuc

SEQ ID NO: 241346 - RNA, 32 nt, Human
ucugagcccaggaugcgaggauggccagacca

SEQ ID NO: 241347 - RNA, 32 nt, Human
ucugagcccagggcagcuucuggggccacugc

SEQ ID NO: 241348 - RNA, 32 nt, Human
ucugagccccaccucagcaggucuccaggauc

SEQ ID NO: 241349 - RNA, 32 nt, Human
ucugagccccagcaagccugauuucccagccu

SEQ ID NO: 241350 - RNA, 32 nt, Human
ucugagccccggagguggcagagcggcagacu

SEQ ID NO: 241351 - RNA, 19 nt, Human
ucugagcccgaaccugcca

SEQ ID NO: 241352 - RNA, 32 nt, Human
ucugagcccuccuucuugcccugagcuuuccg

SEQ ID NO: 241353 - RNA, 32 nt, Human
ucugagcccugaggcagagaucucucaccugg

SEQ ID NO: 241354 - RNA, 32 nt, Human
ucugagcccuggcugcuuguccuccucgcaac

SEQ ID NO: 241355 - RNA, 32 nt, Human
ucugagccgggcagggacagagcugucgggga

SEQ ID NO: 241356 - RNA, 32 nt, Human
ucugagccggggcuccuuccaggagcugaaau

SEQ ID NO: 241357 - RNA, 18 nt, Human
ucugagccgggggcgcgg

SEQ ID NO: 241358 - RNA, 32 nt, Human
ucugagccuauggauucugucucagugauggg

SEQ ID NO: 241359 - RNA, 32 nt, Human
ucugagccucaaggagccucugcgacucggug

SEQ ID NO: 241360 - RNA, 32 nt, Human
ucugagccucaggagguugaggcugcagugag

SEQ ID NO: 241361 - RNA, 32 nt, Human
ucugagccuccugcaaccaccauuuuugaaau

SEQ ID NO: 241362 - RNA, 32 nt, Human
ucugagccugaccuccccuuggggaccuagcc

SEQ ID NO: 241363 - RNA, 32 nt, Human
ucugagccugcccugccuccuccaucagaucc

SEQ ID NO: 241364 - RNA, 32 nt, Human
ucugagccugggagggugaggaugcaugagcc

SEQ ID NO: 241365 - RNA, 32 nt, Human
ucugagccuguucccuccucuuagaccaucuc

SEQ ID NO: 241366 - RNA, 23 nt, Human
ucugagccuucauccgugcuaag

SEQ ID NO: 241367 - RNA, 32 nt, Human
ucugagccuucucuuacaacagggagucuuuc

SEQ ID NO: 241368 - RNA, 32 nt, Human
ucugagccuugugaugucaggcuguuaagauu

SEQ ID NO: 241369 - RNA, 32 nt, Human
ucugagccuuugucuauuguguuccugucacc

SEQ ID NO: 241370 - RNA, 32 nt, Human
ucugagcgauagggucucaccauguugcccag

SEQ ID NO: 241371 - RNA, 18 nt, Human
ucugagcggcgggcgcag

SEQ ID NO: 241372 - RNA, 32 nt, Human
ucugagcggcgggcgcagggaggucgcagguc

SEQ ID NO: 241373 - RNA, 32 nt, Human
ucugagcucacugcaaccucugacucccagac

SEQ ID NO: 241374 - RNA, 32 nt, Human
ucugagcucacugcaaccucugccucccaagu

SEQ ID NO: 241375 - RNA, 32 nt, Human
ucugagcucagucacugaagugagagugugcu

SEQ ID NO: 241376 - RNA, 22 nt, Human
ucugagcucauccuuugccaga

SEQ ID NO: 241377 - RNA, 32 nt, Human
ucugagcuccaaguggcuagguuguaaaaguu

SEQ ID NO: 241378 - RNA, 32 nt, Human
ucugagcuccuggcuggcucucaggcccucua

SEQ ID NO: 241379 - RNA, 32 nt, Human
ucugagcucugggcguggaggucugucugcag

SEQ ID NO: 241380 - RNA, 32 nt, Human
ucugagcucuuauccagcauccaggaagaauc

SEQ ID NO: 241381 - RNA, 32 nt, Human
ucugagcugcugggcccagcugccuggugcau

SEQ ID NO: 241382 - RNA, 32 nt, Human
ucugagcuggauugauggggccagucuccccc

SEQ ID NO: 241383 - RNA, 32 nt, Human
ucugagcuucugugaccugcuccugggacuuu

SEQ ID NO: 241384 - RNA, 32 nt, Human
ucugagcuuuucucccucauccuccccaaucc

SEQ ID NO: 241385 - RNA, 32 nt, Human
ucugaggaacacgccgcagggccaggcaugug

SEQ ID NO: 241386 - RNA, 32 nt, Human
ucugaggaacgcaggcccuggccacuaccagg

SEQ ID NO: 241387 - RNA, 32 nt, Human
ucugaggaacucaaguuugguugccagaaaaa

SEQ ID NO: 241388 - RNA, 32 nt, Human
ucugaggaacuggaauaaagaugaggggccuu

SEQ ID NO: 241389 - RNA, 32 nt, Human
ucugaggaagaaaaggaguuaggagaaagaag

SEQ ID NO: 241390 - RNA, 32 nt, Human
ucugaggaagaacugucugggugcaaaagucc

SEQ ID NO: 241391 - RNA, 32 nt, Human
ucugaggaagaagaggaggaggaggaagagga

SEQ ID NO: 241392 - RNA, 32 nt, Human
ucugaggaagauuuugcugcuuuugccugaag

SEQ ID NO: 241393 - RNA, 32 nt, Human
ucugaggaagcacaacagggacagacuugaag

SEQ ID NO: 241394 - RNA, 32 nt, Human
ucugaggaagccaagacgccaggagaggcuca

SEQ ID NO: 241395 - RNA, 32 nt, Human
ucugaggaaggugcgaggcggauggagcgggu

SEQ ID NO: 241396 - RNA, 32 nt, Human
ucugaggaauugccacacugucuuccacaaug

SEQ ID NO: 241397 - RNA, 32 nt, Human
ucugaggacagaaacagcugcaagaguaccau

SEQ ID NO: 241398 - RNA, 32 nt, Human
ucugaggaccguggcugagggugcaugggcgc

SEQ ID NO: 241399 - RNA, 20 nt, Human
ucugaggacggggggugggg

SEQ ID NO: 241400 - RNA, 32 nt, Human
ucugaggagcagucuagguuacaggcuuuuug

SEQ ID NO: 241401 - RNA, 32 nt, Human
ucugaggagcaguuuucaagaaagcugaaaau

SEQ ID NO: 241402 - RNA, 32 nt, Human
ucugaggagccccagucaugcucagcacgcua

SEQ ID NO: 241403 - RNA, 32 nt, Human
ucugaggagcuggggaaggaacaaagcgaggc

SEQ ID NO: 241404 - RNA, 32 nt, Human
ucugaggagguggcauuugagcacucaagugc

SEQ ID NO: 241405 - RNA, 32 nt, Human
ucugaggaugcucaagucccuuguauaaaaug

SEQ ID NO: 241406 - RNA, 32 nt, Human
ucugaggauggggaggggccagugagcucugg

SEQ ID NO: 241407 - RNA, 32 nt, Human
ucugaggcaaacacagcaaggcuggcccaggc

SEQ ID NO: 241408 - RNA, 32 nt, Human
ucugaggcaagcuggacaggagagguggauau

SEQ ID NO: 241409 - RNA, 32 nt, Human
ucugaggcagagaagacucgaguccagccccc

SEQ ID NO: 241410 - RNA, 32 nt, Human
ucugaggcagcuccgcaggacugugugugaau

SEQ ID NO: 241411 - RNA, 32 nt, Human
ucugaggcaguggacaggaagacuucucaucc

SEQ ID NO: 241412 - RNA, 32 nt, Human
ucugaggcauaagccucucuucccagggcucc

SEQ ID NO: 241413 - RNA, 32 nt, Human
ucugaggccagccuggccuccugccucuacug

SEQ ID NO: 241414 - RNA, 32 nt, Human
ucugaggccaggaguucaagaccagccuggcu

SEQ ID NO: 241415 - RNA, 32 nt, Human
ucugaggccaggaguucgagaccagccuggcc

SEQ ID NO: 241416 - RNA, 32 nt, Human
ucugaggccaggaguucgagaccugccuggcc

SEQ ID NO: 241417 - RNA, 32 nt, Human
ucugaggcccagggguggagguuaggggugga

SEQ ID NO: 241418 - RNA, 32 nt, Human
ucugaggcccauucucaggcugggcagagguc

SEQ ID NO: 241419 - RNA, 32 nt, Human
ucugaggccccaggcccuaggauuccuccccc

SEQ ID NO: 241420 - RNA, 32 nt, Human
ucugaggcccucaaccuggcaucuuaggguau

SEQ ID NO: 241421 - RNA, 32 nt, Human
ucugaggcccuugaguaacugaccacauuugg

SEQ ID NO: 241422 - RNA, 32 nt, Human
ucugaggccgaggcaccucuaagauacugaug

SEQ ID NO: 241423 - RNA, 22 nt, Human
ucugaggccugaauccaaaaga

SEQ ID NO: 241424 - RNA, 32 nt, Human
ucugaggccugccugauuugggccacauagau

SEQ ID NO: 241425 - RNA, 32 nt, Human
ucugaggccugggagagucucuacugucuauu

SEQ ID NO: 241426 - RNA, 32 nt, Human
ucugaggccuuaggguccuucggugucuuuga

SEQ ID NO: 241427 - RNA, 18 nt, Human
ucugaggcgagacggcuc

SEQ ID NO: 241428 - RNA, 32 nt, Human
ucugaggcucgcuggugacucaugcccuaauu

SEQ ID NO: 241429 - RNA, 32 nt, Human
ucugaggcugagcaagggcugagaggagaggc

SEQ ID NO: 241430 - RNA, 18 nt, Human
ucugaggcugcagcaugg

SEQ ID NO: 241431 - RNA, 32 nt, Human
ucugaggcugccauacugccacuguccaggug

SEQ ID NO: 241432 - RNA, 32 nt, Human
ucugaggcugggccaagccugagggaaauggg

SEQ ID NO: 241433 - RNA, 32 nt, Human
ucugaggcugggccucugccuuugugaaguug

SEQ ID NO: 241434 - RNA, 23 nt, Human
ucugaggcuggggcggggugggg

SEQ ID NO: 241435 - RNA, 32 nt, Human
ucugaggcuuugccccacacaugguccucacu

SEQ ID NO: 241436 - RNA, 32 nt, Human
ucugagggaagaagcuuugcagcaaccucugu

SEQ ID NO: 241437 - RNA, 32 nt, Human
ucugagggcaauugcguugcucaaaucacuag

SEQ ID NO: 241438 - RNA, 32 nt, Human
ucugagggcagagaugcugucagugccgcagg

SEQ ID NO: 241439 - RNA, 32 nt, Human
ucugagggcagcaagcccuguagauccuuccu

SEQ ID NO: 241440 - RNA, 32 nt, Human
ucugagggcaggcgggcagcugcagggaggag

SEQ ID NO: 241441 - RNA, 32 nt, Human
ucugagggcaguaaucacaggcugcaggcuag

SEQ ID NO: 241442 - RNA, 32 nt, Human
ucugagggcuccguguggcugccuguguuccu

SEQ ID NO: 241443 - RNA, 32 nt, Human
ucugaggggaaagcacaggcugugcugucgag

SEQ ID NO: 241444 - RNA, 32 nt, Human
ucugaggggaaggaacagcaaaagaggcccuu

SEQ ID NO: 241445 - RNA, 32 nt, Human
ucugaggggaauggggagagagaggaagcgac

SEQ ID NO: 241446 - RNA, 32 nt, Human
ucugaggggacugacagcauggucagggugua

SEQ ID NO: 241447 - RNA, 32 nt, Human
ucugaggggcccuugguggggagcucaaacag

SEQ ID NO: 241448 - RNA, 32 nt, Human
ucugagggugagcggcucauucugcuaguuua

SEQ ID NO: 241449 - RNA, 32 nt, Human
ucugagggugauuugugaucaaguuuaaucac

SEQ ID NO: 241450 - RNA, 32 nt, Human
ucugaggguuccaugaggcaggcuugcaggag

SEQ ID NO: 241451 - RNA, 32 nt, Human
ucugaggucacugcaaccuccaccucccgggu

SEQ ID NO: 241452 - RNA, 32 nt, Human
ucugaggugaccacugcaacuccaagccaucc

SEQ ID NO: 241453 - RNA, 32 nt, Human
ucugaggugacggacugagacgcaucuggucc

SEQ ID NO: 241454 - RNA, 19 nt, Human
ucugaggugccugcuggca

SEQ ID NO: 241455 - RNA, 32 nt, Human
ucugaggugcuugagaaaguguacacugcaga

SEQ ID NO: 241456 - RNA, 32 nt, Human
ucugagguguuucaacacaauuuuggaucagc

SEQ ID NO: 241457 - RNA, 32 nt, Human
ucugagguuagaauuaauucaaauucagaauc

SEQ ID NO: 241458 - RNA, 32 nt, Human
ucugagguuaguggucucucugcugugccaca

SEQ ID NO: 241459 - RNA, 32 nt, Human
ucugagguuggagagaaagaacagaccagcgc

SEQ ID NO: 241460 - RNA, 32 nt, Human
ucugagguuuuucugccagugucuugucugaa

SEQ ID NO: 241461 - RNA, 24 nt, Human
ucugaguaacugggacuacaggug

SEQ ID NO: 241462 - RNA, 21 nt, Human
ucugaguagcuaggauuacag

SEQ ID NO: 241463 - RNA, 22 nt, Human
ucugaguagcuggaauuacagg

SEQ ID NO: 241464 - RNA, 22 nt, Human
ucugaguagcugggaccacagg

SEQ ID NO: 241465 - RNA, 24 nt, Human
ucugaguagcugggacuacaagug

SEQ ID NO: 241466 - RNA, 22 nt, Human
ucugaguagcugggacuacagg

SEQ ID NO: 241467 - RNA, 24 nt, Human
ucugaguagcugggacuacaggug

SEQ ID NO: 241468 - RNA, 24 nt, Human
ucugaguagcugggacuacaguug

SEQ ID NO: 241469 - RNA, 22 nt, Human
ucugaguagcugggaguacagg

SEQ ID NO: 241470 - RNA, 21 nt, Human
ucugaguagcugggauuacag

SEQ ID NO: 241471 - RNA, 22 nt, Human
ucugaguagcugggauuacagg

SEQ ID NO: 241472 - RNA, 22 nt, Human
ucugaguagcugggauugcagg

SEQ ID NO: 241473 - RNA, 32 nt, Human
ucugaguagggagacgccagaggagccucacg

SEQ ID NO: 241474 - RNA, 32 nt, Human
ucugaguauuagacacuaguuaacauauuugu

SEQ ID NO: 241475 - RNA, 32 nt, Human
ucugagucaacauagcuagaaaaugcuaaacu

SEQ ID NO: 241476 - RNA, 32 nt, Human
ucugagucaccuaggccgccuggggcugagaa

SEQ ID NO: 241477 - RNA, 32 nt, Human
ucugagucacugguuucucaccugcaaaagaa

SEQ ID NO: 241478 - RNA, 32 nt, Human
ucugagucaggugcccuagggccaaagacuag

SEQ ID NO: 241479 - RNA, 32 nt, Human
ucugagucauggacaaaccagaauucuugccc

SEQ ID NO: 241480 - RNA, 32 nt, Human
ucugaguccagauuucuucucuccuuacuucc

SEQ ID NO: 241481 - RNA, 32 nt, Human
ucugaguccagccucgggagccccugcggugg

SEQ ID NO: 241482 - RNA, 32 nt, Human
ucugaguccccuaguacaugguagaggcugua

SEQ ID NO: 241483 - RNA, 32 nt, Human
ucugaguccccucccucaucccuuagggucca

SEQ ID NO: 241484 - RNA, 22 nt, Human
ucugaguccuagucucccuccu

SEQ ID NO: 241485 - RNA, 32 nt, Human
ucugagucuggcccagcagaggcugcaacugg

SEQ ID NO: 241486 - RNA, 22 nt, Human
ucugagugacccugguuucuga

SEQ ID NO: 241487 - RNA, 32 nt, Human
ucugagugcaaguucauguguggaaaugggac

SEQ ID NO: 241488 - RNA, 32 nt, Human
ucugagugccuugccagcacuaacauucuaga

SEQ ID NO: 241489 - RNA, 32 nt, Human
ucugagugcuuuccucuucuucaacacucaac

SEQ ID NO: 241490 - RNA, 32 nt, Human
ucugagugggaaagacaugugcugagacacgg

SEQ ID NO: 241491 - RNA, 32 nt, Human
ucugaguggggagagguugggcagugagugag

SEQ ID NO: 241492 - RNA, 23 nt, Human
ucugagugguggucuuugggaua

SEQ ID NO: 241493 - RNA, 32 nt, Human
ucugaguguuaacugugugccaggccuugucc

SEQ ID NO: 241494 - RNA, 32 nt, Human
ucugaguguuuuucagauguuuugccaugugg

SEQ ID NO: 241495 - RNA, 32 nt, Human
ucugaguuaauuggacuggagcgcagucggac

SEQ ID NO: 241496 - RNA, 32 nt, Human
ucugaguuagaccugcagauguguacagauag

SEQ ID NO: 241497 - RNA, 32 nt, Human
ucugaguuauucucucaguguaucgaagauau

SEQ ID NO: 241498 - RNA, 32 nt, Human
ucugaguuccaguuuccucugggcuccaaucu

SEQ ID NO: 241499 - RNA, 32 nt, Human
ucugaguucccuccccucucuuugacauuccu

SEQ ID NO: 241500 - RNA, 32 nt, Human
ucugaguucugcuggcagcuuccagaggauug

SEQ ID NO: 241501 - RNA, 32 nt, Human
ucugaguugcaggggccauggcuuccaaaugc

SEQ ID NO: 241502 - RNA, 32 nt, Human
ucugauaacucauauaaaaauaucaucauaaa

SEQ ID NO: 241503 - RNA, 32 nt, Human
ucugauaagugaauguuuaucuaucuuugugg

SEQ ID NO: 241504 - RNA, 32 nt, Human
ucugauaaucuuccuuuccucaaugcuuccua

SEQ ID NO: 241505 - RNA, 32 nt, Human
ucugauacaauccagcugucuucucuaccuua

SEQ ID NO: 241506 - RNA, 32 nt, Human
ucugauacucagccgggaaccucauucucagu

SEQ ID NO: 241507 - RNA, 32 nt, Human
ucugauaguccuaggagguucuggaagaaagu

SEQ ID NO: 241508 - RNA, 32 nt, Human
ucugauagugcccuugcucuucugucugucau

SEQ ID NO: 241509 - RNA, 32 nt, Human
ucugauaguucuucauuauuucacaaaggugg

SEQ ID NO: 241510 - RNA, 32 nt, Human
ucugauaucccauccgcaucacgggagugggg

SEQ ID NO: 241511 - RNA, 32 nt, Human
ucugauaucucaaacaccagcaucagggccag

SEQ ID NO: 241512 - RNA, 23 nt, Human
ucugauaucuucacauucuccca

SEQ ID NO: 241513 - RNA, 32 nt, Human
ucugauauucaacccacccucuugucaauaac

SEQ ID NO: 241514 - RNA, 32 nt, Human
ucugauauuuaggucuucagaagccuguaggu

SEQ ID NO: 241515 - RNA, 32 nt, Human
ucugauauuuauacugaaugaguuacuguaag

SEQ ID NO: 241516 - RNA, 31 nt, Human
ucugaucaaauaaauaaugcuggaauacuca

SEQ ID NO: 241517 - RNA, 32 nt, Human
ucugaucaauuggcaagaaagggagauuucaa

SEQ ID NO: 241518 - RNA, 32 nt, Human
ucugaucacaugcagggcaaagccagcauuca

SEQ ID NO: 241519 - RNA, 32 nt, Human
ucugaucaccucaagccucccacucugaacau

SEQ ID NO: 241520 - RNA, 32 nt, Human
ucugaucacuccacugcacuccagccugggug

SEQ ID NO: 241521 - RNA, 32 nt, Human
ucugaucagcaugguccagggacaguugagag

SEQ ID NO: 241522 - RNA, 32 nt, Human
ucugaucaucugaaucuuaaucauguccaacu

SEQ ID NO: 241523 - RNA, 32 nt, Human
ucugaucaugccagguuugcaccagccucgag

SEQ ID NO: 241524 - RNA, 32 nt, Human
ucugauccaagagcugagacacggccacccag

SEQ ID NO: 241525 - RNA, 32 nt, Human
ucugauccacccuccgcucugccugccaugga

SEQ ID NO: 241526 - RNA, 32 nt, Human
ucugauccacgagauaucucaggcugggaaga

SEQ ID NO: 241527 - RNA, 32 nt, Human
ucugauccaucagauugucaaaaauccaaaag

SEQ ID NO: 241528 - RNA, 32 nt, Human
ucugaucccaggcuggauggaguggcuggaag

SEQ ID NO: 241529 - RNA, 32 nt, Human
ucugaucccugaucaagcuucagaccucccuc

SEQ ID NO: 241530 - RNA, 22 nt, Human
ucugauccuggcuaaaacuagc

SEQ ID NO: 241531 - RNA, 32 nt, Human
ucugauccuugcaaaaacccugccaagaaagc

SEQ ID NO: 241532 - RNA, 32 nt, Human
ucugaucggagcugauguuucccuccaggaaa

SEQ ID NO: 241533 - RNA, 32 nt, Human
ucugaucgggucuuccuucaucaggaacgaau

SEQ ID NO: 241534 - RNA, 32 nt, Human
ucugaucuacaaaggcgguggcaucgacaaaa

SEQ ID NO: 241535 - RNA, 32 nt, Human
ucugaucuacucggggccucaggcuucucagc

SEQ ID NO: 241536 - RNA, 32 nt, Human
ucugaucuccaccuucuucuaauucaaaaggu

SEQ ID NO: 241537 - RNA, 32 nt, Human
ucugaucugcauuucaacauagagucacauaa

SEQ ID NO: 241538 - RNA, 32 nt, Human
ucugaucugcccaccuccucuuccuucuucuc

SEQ ID NO: 241539 - RNA, 32 nt, Human
ucugaucugcgcccccagcccccagccccagc

SEQ ID NO: 241540 - RNA, 32 nt, Human
ucugaucuggggaggcagaggugacagugagc

SEQ ID NO: 241541 - RNA, 32 nt, Human
ucugaucuguucuacauauuaaaguucaugcu

SEQ ID NO: 241542 - RNA, 32 nt, Human
ucugaucuugaaaaucugaguagguggacaaa

SEQ ID NO: 241543 - RNA, 32 nt, Human
ucugaucuugggcucucagcagccucuucugc

SEQ ID NO: 241544 - RNA, 22 nt, Human
ucugaucuuucauuuccugcca

SEQ ID NO: 241545 - RNA, 32 nt, Human
ucugaugaaaguacaauagccauguugauuca

SEQ ID NO: 241546 - RNA, 27 nt, Human
ucugaugaacaagguuguuuuaccuua

SEQ ID NO: 241547 - RNA, 32 nt, Human
ucugaugaaccagcuuugcaccuacauacgua

SEQ ID NO: 241548 - RNA, 32 nt, Human
ucugaugaacuuagaaaagaaggccugaaugc

SEQ ID NO: 241549 - RNA, 24 nt, Human
ucugaugacugaaugucuguuuca

SEQ ID NO: 241550 - RNA, 32 nt, Human
ucugaugaggaagaaaauggccagggggaagg

SEQ ID NO: 241551 - RNA, 32 nt, Human
ucugaugaggagcuuccuccugauuggagugg

SEQ ID NO: 241552 - RNA, 32 nt, Human
ucugaugaggucugggcaggaaccaaagagag

SEQ ID NO: 241553 - RNA, 32 nt, Human
ucugaugaucuccagccuccacugcuucugcc

SEQ ID NO: 241554 - RNA, 32 nt, Human
ucugaugcagaacguaucagugaaacucccuc

SEQ ID NO: 241555 - RNA, 32 nt, Human
ucugaugcagaacuuucucuuuugaauguuaa

SEQ ID NO: 241556 - RNA, 32 nt, Human
ucugaugccuucaggugugacacugcccugga

SEQ ID NO: 241557 - RNA, 32 nt, Human
ucugaugcucuaggcugcugugaggugguggu

SEQ ID NO: 241558 - RNA, 32 nt, Human
ucugaugcugcccaucgcuugcacuggggucu

SEQ ID NO: 241559 - RNA, 32 nt, Human
ucugaugcugggacaggugagaagaaacugug

SEQ ID NO: 241560 - RNA, 32 nt, Human
ucugaugcuucuuuugucaggugcagaagcac

SEQ ID NO: 241561 - RNA, 32 nt, Human
ucugauggaaggaagagaguagggccagugaa

SEQ ID NO: 241562 - RNA, 32 nt, Human
ucugauggcaacuguaugauagaagcuauaua

SEQ ID NO: 241563 - RNA, 20 nt, Human
ucugauggccaggcauggug

SEQ ID NO: 241564 - RNA, 32 nt, Human
ucugauggcgcacaccuguaaucaggaggcua

SEQ ID NO: 241565 - RNA, 32 nt, Human
ucugaugggaggagucgugggagcccagcucc

SEQ ID NO: 241566 - RNA, 32 nt, Human
ucugaugguaccacugcacuccagccugggug

SEQ ID NO: 241567 - RNA, 32 nt, Human
ucugauggucagcaucuuccccaacacuuagg

SEQ ID NO: 241568 - RNA, 32 nt, Human
ucugauguaccugcuucuagcauacaagaaaa

SEQ ID NO: 241569 - RNA, 32 nt, Human
ucugauguccauaguuccuucccccuagauug

SEQ ID NO: 241570 - RNA, 32 nt, Human
ucugauguccccucaccuucugaugucaccuc

SEQ ID NO: 241571 - RNA, 32 nt, Human
ucugaugugaggagggacuugaguugagugac

SEQ ID NO: 241572 - RNA, 32 nt, Human
ucugauguggaggaggcgguggcagaugccuu

SEQ ID NO: 241573 - RNA, 32 nt, Human
ucugauguuucggaacagucauuucaccuacu

SEQ ID NO: 241574 - RNA, 32 nt, Human
ucugauguuuugggaagauuuggacagagaaa

SEQ ID NO: 241575 - RNA, 32 nt, Human
ucugauuaaagaaaacaaaaagugccgugcca

SEQ ID NO: 241576 - RNA, 32 nt, Human
ucugauuaaagaaaauaaaaagugccgugcca

SEQ ID NO: 241577 - RNA, 32 nt, Human
ucugauuaaauacugugccuuaggagacugga

SEQ ID NO: 241578 - RNA, 32 nt, Human
ucugauuauuggagacagaaguccugucacuu

SEQ ID NO: 241579 - RNA, 32 nt, Human
ucugauucaccugccauuugcugagccucugc

SEQ ID NO: 241580 - RNA, 32 nt, Human
ucugauucagaaacacacuucuaccucuuuac

SEQ ID NO: 241581 - RNA, 32 nt, Human
ucugauucagaaucagugugggcuccugcagu

SEQ ID NO: 241582 - RNA, 32 nt, Human
ucugauucagccagggggaggacaggaaucug

SEQ ID NO: 241583 - RNA, 32 nt, Human
ucugauucccagagauagcagauucugucaac

SEQ ID NO: 241584 - RNA, 32 nt, Human
ucugauucccuuucccugucuucccgcuuauc

SEQ ID NO: 241585 - RNA, 32 nt, Human
ucugauuccuggaagaaaggguugguccccuc

SEQ ID NO: 241586 - RNA, 32 nt, Human
ucugauucugccugaauagcugagagguucca

SEQ ID NO: 241587 - RNA, 32 nt, Human
ucugauucugguggauccucccuccccuaauu

SEQ ID NO: 241588 - RNA, 32 nt, Human
ucugauugcaccacugcacuccaggcugggua

SEQ ID NO: 241589 - RNA, 32 nt, Human
ucugauugcuaucagcaaugccccaaacuuuc

SEQ ID NO: 241590 - RNA, 32 nt, Human
ucugauuggaaaugugugcaugugagucggcc

SEQ ID NO: 241591 - RNA, 32 nt, Human
ucugauuggagcaaaccacuucuuuagucauc

SEQ ID NO: 241592 - RNA, 32 nt, Human
ucugauuggaggagggacaguuucugguaccc

SEQ ID NO: 241593 - RNA, 32 nt, Human
ucugauugggacaacauucagacccauuucca

SEQ ID NO: 241594 - RNA, 32 nt, Human
ucugauuggggcucgcaccgcagcacgcugga

SEQ ID NO: 241595 - RNA, 32 nt, Human
ucugauuucccuuuugauuucuucuuuuaccc

SEQ ID NO: 241596 - RNA, 32 nt, Human
ucugauuuccuacccuguuacuuucauccaua

SEQ ID NO: 241597 - RNA, 32 nt, Human
ucugauuugccacccaugccucuucaggcugg

SEQ ID NO: 241598 - RNA, 32 nt, Human
ucugauuuguaacccacugagaggacagagag

SEQ ID NO: 241599 - RNA, 32 nt, Human
ucugauuuuagaacuguaggucaguggugagu

SEQ ID NO: 241600 - RNA, 32 nt, Human
ucugcaaaaauggauauuauuagaaauuagaa

SEQ ID NO: 241601 - RNA, 20 nt, Human
ucugcaaaacagccaaugcu

SEQ ID NO: 241602 - RNA, 32 nt, Human
ucugcaaaacagucaagagacucggacguuga

SEQ ID NO: 241603 - RNA, 32 nt, Human
ucugcaaacagaaucuuggauauuucuucuga

SEQ ID NO: 241604 - RNA, 32 nt, Human
ucugcaaaccagccauagauacaucuugcucu

SEQ ID NO: 241605 - RNA, 32 nt, Human
ucugcaaacccagcuacucgggaggcugaagc

SEQ ID NO: 241606 - RNA, 32 nt, Human
ucugcaaagauaaaagcuucgaugaugaagaa

SEQ ID NO: 241607 - RNA, 32 nt, Human
ucugcaaagcagggaugguccagauaauuucu

SEQ ID NO: 241608 - RNA, 32 nt, Human
ucugcaaagcuuuucugcuccuggguuaaggc

SEQ ID NO: 241609 - RNA, 32 nt, Human
ucugcaaaggaucagcugggagauaguuucaa

SEQ ID NO: 241610 - RNA, 32 nt, Human
ucugcaaaggcagagggucauugugacagcuu

SEQ ID NO: 241611 - RNA, 32 nt, Human
ucugcaaauauugccagcauuuuagccauauu

SEQ ID NO: 241612 - RNA, 32 nt, Human
ucugcaaauuggcaaugggauccagaggcuug

SEQ ID NO: 241613 - RNA, 25 nt, Human
ucugcaacaaaaauccagucuuuca

SEQ ID NO: 241614 - RNA, 23 nt, Human
ucugcaacaaaagccuccaccca

SEQ ID NO: 241615 - RNA, 32 nt, Human
ucugcaacaacagcaggcucuccaggcagcaa

SEQ ID NO: 241616 - RNA, 32 nt, Human
ucugcaacccacccacucccccagcaaacaua

SEQ ID NO: 241617 - RNA, 21 nt, Human
ucugcaacccacccaucccuc

SEQ ID NO: 241618 - RNA, 32 nt, Human
ucugcaacccacccaucccucccugcagcacc

SEQ ID NO: 241619 - RNA, 32 nt, Human
ucugcaacccuaauuaaaugaguacaggucua

SEQ ID NO: 241620 - RNA, 23 nt, Human
ucugcaacccugcucuaugcuga

SEQ ID NO: 241621 - RNA, 32 nt, Human
ucugcaacggugcuuccagccuucguaauuag

SEQ ID NO: 241622 - RNA, 32 nt, Human
ucugcaacucggcuucugagccaggccaccgg

SEQ ID NO: 241623 - RNA, 32 nt, Human
ucugcaagaggaagcaguggaggaacaggagg

SEQ ID NO: 241624 - RNA, 24 nt, Human
ucugcaagaucauguuguucuuuc

SEQ ID NO: 241625 - RNA, 32 nt, Human
ucugcaagccaaggagagaggcugcaggagaa

SEQ ID NO: 241626 - RNA, 31 nt, Human
ucugcaagccacuuuuccaugccaagcaucc

SEQ ID NO: 241627 - RNA, 32 nt, Human
ucugcaaggacaguuguuugguguuuugcuuc

SEQ ID NO: 241628 - RNA, 32 nt, Human
ucugcaaggcggccuguugcucacgucucucc

SEQ ID NO: 241629 - RNA, 32 nt, Human
ucugcaaggcuugacaaccacagaucagggac

SEQ ID NO: 241630 - RNA, 29 nt, Human
ucugcaagucugugugggccuugaaaaua

SEQ ID NO: 241631 - RNA, 32 nt, Human
ucugcaagugcuucccagcccagaacaggggu

SEQ ID NO: 241632 - RNA, 32 nt, Human
ucugcaaguguccugaaaaagacugaacgaaa

SEQ ID NO: 241633 - RNA, 32 nt, Human
ucugcaaguuugcaaggauuuuguagguccug

SEQ ID NO: 241634 - RNA, 22 nt, Human
ucugcaauagaaugcacucuua

SEQ ID NO: 241635 - RNA, 32 nt, Human
ucugcaauaguugugggcaugggugagaaaua

SEQ ID NO: 241636 - RNA, 32 nt, Human
ucugcaaucuacgugaagaccccacaccccuc

SEQ ID NO: 241637 - RNA, 24 nt, Human
ucugcaaucuauuguuccauucca

SEQ ID NO: 241638 - RNA, 32 nt, Human
ucugcaaucucagcuacucaggaggcugaggc

SEQ ID NO: 241639 - RNA, 32 nt, Human
ucugcaaucugcacuguccagccuagcaggcc

SEQ ID NO: 241640 - RNA, 32 nt, Human
ucugcaaucuuuaaaucagccuccaguuuuug

SEQ ID NO: 241641 - RNA, 19 nt, Human
ucugcaaugauuauuguuu

SEQ ID NO: 241642 - RNA, 32 nt, Human
ucugcaaugcagcccugccaacuggggaccug

SEQ ID NO: 241643 - RNA, 32 nt, Human
ucugcacaagcuagugaggaccugccagaauu

SEQ ID NO: 241644 - RNA, 32 nt, Human
ucugcacaaucagagacugucucgaucucucc

SEQ ID NO: 241645 - RNA, 32 nt, Human
ucugcacacagcaucugcucccaucccccaag

SEQ ID NO: 241646 - RNA, 32 nt, Human
ucugcacacagccccagucgggcagcaggaaa

SEQ ID NO: 241647 - RNA, 32 nt, Human
ucugcacagaugggagagggagugucccugaa

SEQ ID NO: 241648 - RNA, 22 nt, Human
ucugcacagccucuuucacuca

SEQ ID NO: 241649 - RNA, 32 nt, Human
ucugcacaggggagauuucuuauaccagcagu

SEQ ID NO: 241650 - RNA, 32 nt, Human
ucugcacaguggaacagaacagcuccagggua

SEQ ID NO: 241651 - RNA, 32 nt, Human
ucugcacauaauaucacacauugcgcuccacg

SEQ ID NO: 241652 - RNA, 32 nt, Human
ucugcacaugaggccaguauaggcaacgucac

SEQ ID NO: 241653 - RNA, 19 nt, Human
ucugcacaugccugucaaa

SEQ ID NO: 241654 - RNA, 32 nt, Human
ucugcaccaaagcucauugcaggcaauguugg

SEQ ID NO: 241655 - RNA, 32 nt, Human
ucugcaccaaagcugcuucuaaagcagaaagc

SEQ ID NO: 241656 - RNA, 32 nt, Human
ucugcaccacaccagcgcaugaggggauggag

SEQ ID NO: 241657 - RNA, 32 nt, Human
ucugcaccacaccagugcaugaggggaugcag

SEQ ID NO: 241658 - RNA, 32 nt, Human
ucugcaccacaccagugcaugaggggauggag

SEQ ID NO: 241659 - RNA, 32 nt, Human
ucugcaccauauucagcaccagaguugccuca

SEQ ID NO: 241660 - RNA, 32 nt, Human
ucugcaccaugccacacacuugcuguaaggcu

SEQ ID NO: 241661 - RNA, 32 nt, Human
ucugcacccaccccugcccugacuuguguugc

SEQ ID NO: 241662 - RNA, 32 nt, Human
ucugcacccagccugcccgcccacaccauccu

SEQ ID NO: 241663 - RNA, 32 nt, Human
ucugcaccccaagcccuugccccagcccaguc

SEQ ID NO: 241664 - RNA, 26 nt, Human
ucugcaccccaaguuguuucuucuca

SEQ ID NO: 241665 - RNA, 32 nt, Human
ucugcaccccacuucagaccucggugggcauu

SEQ ID NO: 241666 - RNA, 32 nt, Human
ucugcaccccucccuugggagggagacuucau

SEQ ID NO: 241667 - RNA, 23 nt, Human
ucugcacccuugccccaucccuc

SEQ ID NO: 241668 - RNA, 32 nt, Human
ucugcaccucaguuggcaaaggagacuggaug

SEQ ID NO: 241669 - RNA, 32 nt, Human
ucugcaccucugugguuccugcccucagcccu

SEQ ID NO: 241670 - RNA, 32 nt, Human
ucugcacggcucugcuagagagaggaucacaa

SEQ ID NO: 241671 - RNA, 32 nt, Human
ucugcacgggggaacugugugugcaaagguga

SEQ ID NO: 241672 - RNA, 32 nt, Human
ucugcacggugggagaccugcugccggaaguc

SEQ ID NO: 241673 - RNA, 32 nt, Human
ucugcacgucaccaaguaaccaggccccagcc

SEQ ID NO: 241674 - RNA, 32 nt, Human
ucugcacgugccugugccucacccagagccag

SEQ ID NO: 241675 - RNA, 32 nt, Human
ucugcacuccacggcccuucucagccacacuu

SEQ ID NO: 241676 - RNA, 32 nt, Human
ucugcacuccagccuaggugacagagugagac

SEQ ID NO: 241677 - RNA, 32 nt, Human
ucugcacuccagccuggcgacugagugagacu

SEQ ID NO: 241678 - RNA, 32 nt, Human
ucugcacuccagccugggugacagagugagag

SEQ ID NO: 241679 - RNA, 24 nt, Human
ucugcacucccacgccuguccucc

SEQ ID NO: 241680 - RNA, 32 nt, Human
ucugcacugcaaccuccaccaggaccaggauc

SEQ ID NO: 241681 - RNA, 32 nt, Human
ucugcacuggagucucacaucuguuagcuuug

SEQ ID NO: 241682 - RNA, 32 nt, Human
ucugcacugggagccucaggagggcucugcuc

SEQ ID NO: 241683 - RNA, 32 nt, Human
ucugcacugguccccucuuuucccuucagucu

SEQ ID NO: 241684 - RNA, 32 nt, Human
ucugcacuguucuuacuuccucuugucccuuu

SEQ ID NO: 241685 - RNA, 32 nt, Human
ucugcacuucugggccagccagcuccaacugc

SEQ ID NO: 241686 - RNA, 32 nt, Human
ucugcacuugccucaccagcucuggcuuuucu

SEQ ID NO: 241687 - RNA, 32 nt, Human
ucugcacuugggaacaaucauucucccccagc

SEQ ID NO: 241688 - RNA, 32 nt, Human
ucugcacuuuagccagccugggucggcaacca

SEQ ID NO: 241689 - RNA, 32 nt, Human
ucugcacuuugggagacugagguggguggauc

SEQ ID NO: 241690 - RNA, 32 nt, Human
ucugcacuuuuccuuaccuccuggccucagau

SEQ ID NO: 241691 - RNA, 32 nt, Human
ucugcacuuuuuccugcaucuuaugcauuaca

SEQ ID NO: 241692 - RNA, 32 nt, Human
ucugcagaaaagcuccagcaggcgcugccuuc

SEQ ID NO: 241693 - RNA, 32 nt, Human
ucugcagaaguauuaucagaguagagcugacu

SEQ ID NO: 241694 - RNA, 32 nt, Human
ucugcagaauccagccccucacuuccuugcuu

SEQ ID NO: 241695 - RNA, 22 nt, Human
ucugcagaauggggcugccugg

SEQ ID NO: 241696 - RNA, 32 nt, Human
ucugcagacacaccugggaggcaucagcacgu

SEQ ID NO: 241697 - RNA, 32 nt, Human
ucugcagaccacacaggaacuugcuucauggc

SEQ ID NO: 241698 - RNA, 32 nt, Human
ucugcagaccagcugaggggaggacuccuggg

SEQ ID NO: 241699 - RNA, 32 nt, Human
ucugcagaccguggcccugucggcagcccacg

SEQ ID NO: 241700 - RNA, 21 nt, Human
ucugcagacuaagucuagcca

SEQ ID NO: 241701 - RNA, 32 nt, Human
ucugcagacuccaaggaggucccaggaagagg

SEQ ID NO: 241702 - RNA, 32 nt, Human
ucugcagacuggcagucgcacacacauuugga

SEQ ID NO: 241703 - RNA, 32 nt, Human
ucugcagagacacaauaaaagccagcagaccc

SEQ ID NO: 241704 - RNA, 32 nt, Human
ucugcagagacacccguuucagccacaucuaa

SEQ ID NO: 241705 - RNA, 32 nt, Human
ucugcagagagagagcgcgagagauggagaug

SEQ ID NO: 241706 - RNA, 32 nt, Human
ucugcagagagggaauugcauguuuguguugu

SEQ ID NO: 241707 - RNA, 32 nt, Human
ucugcagagcacguagagucaccccgcaaagc

SEQ ID NO: 241708 - RNA, 32 nt, Human
ucugcagaggagcuggagaaucaguacugucc

SEQ ID NO: 241709 - RNA, 32 nt, Human
ucugcagaguccaugcugugagcuuccuaccu

SEQ ID NO: 241710 - RNA, 32 nt, Human
ucugcagaguccugugcaccagcucagaggac

SEQ ID NO: 241711 - RNA, 32 nt, Human
ucugcagaucaagauuuucucauuagaacaau

SEQ ID NO: 241712 - RNA, 32 nt, Human
ucugcagaucucggaugcuagcacuugacacu

SEQ ID NO: 241713 - RNA, 32 nt, Human
ucugcagauggaccucucuccgcuagagaugc

SEQ ID NO: 241714 - RNA, 32 nt, Human
ucugcagauggcacugccugggcaccaggaga

SEQ ID NO: 241715 - RNA, 32 nt, Human
ucugcagauuccaaacuggaauaagcucuauc

SEQ ID NO: 241716 - RNA, 32 nt, Human
ucugcagauuccugccuccccacuuugguuca

SEQ ID NO: 241717 - RNA, 32 nt, Human
ucugcagauuucugcauuuucuccucauuaau

SEQ ID NO: 241718 - RNA, 32 nt, Human
ucugcagauuuugguggggaggcgguaauagg

SEQ ID NO: 241719 - RNA, 21 nt, Human
ucugcagcaacucguccugcc

SEQ ID NO: 241720 - RNA, 32 nt, Human
ucugcagcaagcuucuuccuggacauccagac

SEQ ID NO: 241721 - RNA, 32 nt, Human
ucugcagcacuggguuggagagagggcacggg

SEQ ID NO: 241722 - RNA, 32 nt, Human
ucugcagcagaggcagccuaucccauugcaag

SEQ ID NO: 241723 - RNA, 32 nt, Human
ucugcagcagcccccagcgauggucuucagca

SEQ ID NO: 241724 - RNA, 22 nt, Human
ucugcagcagggcucagccuca

SEQ ID NO: 241725 - RNA, 32 nt, Human
ucugcagcauugaaguaugguguguucacgua

SEQ ID NO: 241726 - RNA, 32 nt, Human
ucugcagcauuuuacacuuacugggaaccuua

SEQ ID NO: 241727 - RNA, 32 nt, Human
ucugcagccauccuggacaggccgggguggcg

SEQ ID NO: 241728 - RNA, 21 nt, Human
ucugcagccaugcuucagggu

SEQ ID NO: 241729 - RNA, 32 nt, Human
ucugcagccccagcuacucgggaggcugagau

SEQ ID NO: 241730 - RNA, 18 nt, Human
ucugcagccccgcaggcc

SEQ ID NO: 241731 - RNA, 18 nt, Human
ucugcagccugccagugc

SEQ ID NO: 241732 - RNA, 23 nt, Human
ucugcagccugcccucccuuccc

SEQ ID NO: 241733 - RNA, 21 nt, Human
ucugcagcgugguccaccccg

SEQ ID NO: 241734 - RNA, 32 nt, Human
ucugcagcuguagauucucacugugaaucccu

SEQ ID NO: 241735 - RNA, 32 nt, Human
ucugcagcuguggggacaggagacugagaccc

SEQ ID NO: 241736 - RNA, 32 nt, Human
ucugcaggaaguggcugacuugaugcaaauga

SEQ ID NO: 241737 - RNA, 32 nt, Human
ucugcaggagcaagugaguacugugaacaccu

SEQ ID NO: 241738 - RNA, 32 nt, Human
ucugcaggagccaaagacauagcaauggagaa

SEQ ID NO: 241739 - RNA, 32 nt, Human
ucugcaggauggcaccggaccccugguucucc

SEQ ID NO: 241740 - RNA, 20 nt, Human
ucugcaggcaccgggcuggc

SEQ ID NO: 241741 - RNA, 32 nt, Human
ucugcaggcagccuugcccauucucuaagccu

SEQ ID NO: 241742 - RNA, 23 nt, Human
ucugcaggcaugcccuuccuucc

SEQ ID NO: 241743 - RNA, 21 nt, Human
ucugcaggccacuuaccuucc

SEQ ID NO: 241744 - RNA, 32 nt, Human
ucugcaggcccacucccuggggccgcacccuu

SEQ ID NO: 241745 - RNA, 32 nt, Human
ucugcaggcccagacuguugucaagucggccu

SEQ ID NO: 241746 - RNA, 32 nt, Human
ucugcaggcccaguguagaggcucacaccugu

SEQ ID NO: 241747 - RNA, 32 nt, Human
ucugcaggccccgcccuugccucccaggggcc

SEQ ID NO: 241748 - RNA, 32 nt, Human
ucugcaggcccggaagagagcccucaccagga

SEQ ID NO: 241749 - RNA, 32 nt, Human
ucugcaggcccugcucuugccucccaggggcu

SEQ ID NO: 241750 - RNA, 32 nt, Human
ucugcaggccgagcucuuccucccugcugugu

SEQ ID NO: 241751 - RNA, 22 nt, Human
ucugcaggcuuccuguccuuuu

SEQ ID NO: 241752 - RNA, 24 nt, Human
ucugcaggcuugcagaguucuucu

SEQ ID NO: 241753 - RNA, 32 nt, Human
ucugcagggaaagacuggcaaggaggcucagg

SEQ ID NO: 241754 - RNA, 32 nt, Human
ucugcagggaacaggugcugggggugcagauc

SEQ ID NO: 241755 - RNA, 32 nt, Human
ucugcagggaagucugugacugccuggccaga

SEQ ID NO: 241756 - RNA, 32 nt, Human
ucugcagggagaaggauuccauuuuucuucuc

SEQ ID NO: 241757 - RNA, 32 nt, Human
ucugcagggauccugggcuggaagaaaguuca

SEQ ID NO: 241758 - RNA, 22 nt, Human
ucugcagggcaaggcugucugg

SEQ ID NO: 241759 - RNA, 32 nt, Human
ucugcagggcaggccagaagccugggcacccc

SEQ ID NO: 241760 - RNA, 32 nt, Human
ucugcagggccugcucuugccucccaggggcu

SEQ ID NO: 241761 - RNA, 32 nt, Human
ucugcagggcuggacguggcggcucuugccug

SEQ ID NO: 241762 - RNA, 32 nt, Human
ucugcagggugguccagccuaggugacagggu

SEQ ID NO: 241763 - RNA, 32 nt, Human
ucugcagguggaccagccagcccugaccucca

SEQ ID NO: 241764 - RNA, 21 nt, Human
ucugcagguggcaaaauggca

SEQ ID NO: 241765 - RNA, 32 nt, Human
ucugcaguaccacagaacaggccccaugcuga

SEQ ID NO: 241766 - RNA, 32 nt, Human
ucugcagucagaagaucccuacccaggcuucu

SEQ ID NO: 241767 - RNA, 32 nt, Human
ucugcagucaucaaggcaguucuggcucauua

SEQ ID NO: 241768 - RNA, 32 nt, Human
ucugcagucccaacgucugccucacagcagau

SEQ ID NO: 241769 - RNA, 32 nt, Human
ucugcagucccagcuacucuugaaggcugagc

SEQ ID NO: 241770 - RNA, 32 nt, Human
ucugcaguccuccucagggcccaacaggaccc

SEQ ID NO: 241771 - RNA, 32 nt, Human
ucugcaguccuccucugcucaccccucccuca

SEQ ID NO: 241772 - RNA, 32 nt, Human
ucugcagucgcugcaaccuacccucucucugc

SEQ ID NO: 241773 - RNA, 32 nt, Human
ucugcagugaaaagcuggagcccugauuccua

SEQ ID NO: 241774 - RNA, 32 nt, Human
ucugcagugagcuaugauugcaccacugcacu

SEQ ID NO: 241775 - RNA, 32 nt, Human
ucugcagugcacugcaaccauuguuuccccua

SEQ ID NO: 241776 - RNA, 21 nt, Human
ucugcagugcuccccuggcca

SEQ ID NO: 241777 - RNA, 32 nt, Human
ucugcaguuccuugcuaaucugagcuacuuag

SEQ ID NO: 241778 - RNA, 32 nt, Human
ucugcaguucugaagcucacacauagucuccc

SEQ ID NO: 241779 - RNA, 32 nt, Human
ucugcaguugggggcguggcggggcaggagau

SEQ ID NO: 241780 - RNA, 32 nt, Human
ucugcaguuugcuccagcuaccaguuucuuua

SEQ ID NO: 241781 - RNA, 32 nt, Human
ucugcaguuuuugacuucauagauuaugcuuu

SEQ ID NO: 241782 - RNA, 32 nt, Human
ucugcauaaaugguaaccaguagcucuacuuu

SEQ ID NO: 241783 - RNA, 26 nt, Human
ucugcauaauguucacugccaaacuc

SEQ ID NO: 241784 - RNA, 32 nt, Human
ucugcauacgccaucucugagagccauggagg

SEQ ID NO: 241785 - RNA, 32 nt, Human
ucugcauagacagggucuagauuuuguuaacc

SEQ ID NO: 241786 - RNA, 32 nt, Human
ucugcauaguuucuuucucuuccuucauagau

SEQ ID NO: 241787 - RNA, 32 nt, Human
ucugcauauaugcacauacauacguaaggauc

SEQ ID NO: 241788 - RNA, 32 nt, Human
ucugcauaugcugcuuucucacucagcaucau

SEQ ID NO: 241789 - RNA, 32 nt, Human
ucugcauauucucuggcaaccuugccccauac

SEQ ID NO: 241790 - RNA, 32 nt, Human
ucugcaucaagaguacuguagccugggaaacc

SEQ ID NO: 241791 - RNA, 32 nt, Human
ucugcaucauuucuuaaggcugccuuccucuc

SEQ ID NO: 241792 - RNA, 32 nt, Human
ucugcaucuccggcucaagucacugcagaguc

SEQ ID NO: 241793 - RNA, 32 nt, Human
ucugcaucucucucugaucuagcuagcagugg

SEQ ID NO: 241794 - RNA, 32 nt, Human
ucugcaucuggaaagcugaagacugaagaaag

SEQ ID NO: 241795 - RNA, 32 nt, Human
ucugcaugaacugcucucaaaccaacaaacag

SEQ ID NO: 241796 - RNA, 32 nt, Human
ucugcaugaacugcucucaaaccaacaaauag

SEQ ID NO: 241797 - RNA, 32 nt, Human
ucugcaugcaugcucacccuggcaacaguuga

SEQ ID NO: 241798 - RNA, 32 nt, Human
ucugcauggagccacuccagggacuuuucuuc

SEQ ID NO: 241799 - RNA, 32 nt, Human
ucugcauggaggaaaaaugacuaaggacugag

SEQ ID NO: 241800 - RNA, 32 nt, Human
ucugcauggccaaaucuuucccuuauuucaag

SEQ ID NO: 241801 - RNA, 32 nt, Human
ucugcauggcgaucguggaagcagccaguugu

SEQ ID NO: 241802 - RNA, 32 nt, Human
ucugcauggugcauggccugugcugccuucug

SEQ ID NO: 241803 - RNA, 32 nt, Human
ucugcauggugcauggucugugcugccuucug

SEQ ID NO: 241804 - RNA, 32 nt, Human
ucugcauguaagauagaugacauccuagaaca

SEQ ID NO: 241805 - RNA, 32 nt, Human
ucugcaugugagcccugagagcugcagauguu

SEQ ID NO: 241806 - RNA, 32 nt, Human
ucugcaugugguacuucucuuuucccucaguu

SEQ ID NO: 241807 - RNA, 32 nt, Human
ucugcaugugugugagugugcacaggugagug

SEQ ID NO: 241808 - RNA, 32 nt, Human
ucugcauguuugucugugugucugcguugugu

SEQ ID NO: 241809 - RNA, 32 nt, Human
ucugcauuaagcugcuucucaucacauuauaa

SEQ ID NO: 241810 - RNA, 32 nt, Human
ucugcauuaguauuuuaaggagcacugugaga

SEQ ID NO: 241811 - RNA, 32 nt, Human
ucugcauuaguggggcugagagaugugggggc

SEQ ID NO: 241812 - RNA, 32 nt, Human
ucugcauucccaggagacccagggugauuaaa

SEQ ID NO: 241813 - RNA, 18 nt, Human
ucugcauucccuccuucc

SEQ ID NO: 241814 - RNA, 32 nt, Human
ucugcauucuacauuuucuuuguacuuuucuu

SEQ ID NO: 241815 - RNA, 32 nt, Human
ucugcauucugggaacauguggcuuccugacc

SEQ ID NO: 241816 - RNA, 22 nt, Human
ucugcauuguccccgucuuucc

SEQ ID NO: 241817 - RNA, 23 nt, Human
ucugcauuugcaaggcccggugg

SEQ ID NO: 241818 - RNA, 32 nt, Human
ucugcauuuggucugcugaucauguugccaua

SEQ ID NO: 241819 - RNA, 32 nt, Human
ucugcauuugucucagaacauuuccuuggcug

SEQ ID NO: 241820 - RNA, 32 nt, Human
ucugcauuuguuacaucaucucuucaucuuaa

SEQ ID NO: 241821 - RNA, 32 nt, Human
ucugcauuuuuggauuccacgugcuuagcacc

SEQ ID NO: 241822 - RNA, 32 nt, Human
ucugccaaaagacaauuucuacaguaguuuug

SEQ ID NO: 241823 - RNA, 32 nt, Human
ucugccaaacugggaaccagcagugcuaguaa

SEQ ID NO: 241824 - RNA, 32 nt, Human
ucugccaacgugguguuggaggcuccaccuug

SEQ ID NO: 241825 - RNA, 32 nt, Human
ucugccaagaaucuuccaguuauuagcaaacu

SEQ ID NO: 241826 - RNA, 32 nt, Human
ucugccaaggaucagaacucaugugaaacaaa

SEQ ID NO: 241827 - RNA, 32 nt, Human
ucugccaaggccagggccagcaggacggcagg

SEQ ID NO: 241828 - RNA, 32 nt, Human
ucugccaagggugggggcccacgcggaggcga

SEQ ID NO: 241829 - RNA, 32 nt, Human
ucugccacauagaaggcucucaacaucaugua

SEQ ID NO: 241830 - RNA, 32 nt, Human
ucugccacauccucaaucucuaccggaggaac

SEQ ID NO: 241831 - RNA, 32 nt, Human
ucugccaccaauauguaucuucauacacguuu

SEQ ID NO: 241832 - RNA, 32 nt, Human
ucugccaccacagcccuaccgggagccggaac

SEQ ID NO: 241833 - RNA, 32 nt, Human
ucugccaccagcugacggaaagcagccuucug

SEQ ID NO: 241834 - RNA, 32 nt, Human
ucugccaccagcugcucgcagcccaugccugg

SEQ ID NO: 241835 - RNA, 32 nt, Human
ucugccaccaucaccagcucugucuaagcaau

SEQ ID NO: 241836 - RNA, 32 nt, Human
ucugccaccauggccauugugcagacucugcc

SEQ ID NO: 241837 - RNA, 32 nt, Human
ucugccacccaccugugaacuucacuuugcca

SEQ ID NO: 241838 - RNA, 21 nt, Human
ucugccaccggaaauaccaug

SEQ ID NO: 241839 - RNA, 32 nt, Human
ucugccaccucagacugacacacagccagcug

SEQ ID NO: 241840 - RNA, 32 nt, Human
ucugccaccugacaacauuuuuccucaauuac

SEQ ID NO: 241841 - RNA, 32 nt, Human
ucugccaccugccccguguauccuggcucuca

SEQ ID NO: 241842 - RNA, 21 nt, Human
ucugccacgagcaguuucuca

SEQ ID NO: 241843 - RNA, 32 nt, Human
ucugccacucacacacugcugaguguucagcu

SEQ ID NO: 241844 - RNA, 32 nt, Human
ucugccacucauuuccccaguugguguuucca

SEQ ID NO: 241845 - RNA, 32 nt, Human
ucugccacugacccagugacugugcuggugau

SEQ ID NO: 241846 - RNA, 32 nt, Human
ucugccacugcacuccagccuggcgacagagc

SEQ ID NO: 241847 - RNA, 32 nt, Human
ucugccacuggcaauguccuguccugaacauu

SEQ ID NO: 241848 - RNA, 32 nt, Human
ucugccacugugcccaagccuggguaucacag

SEQ ID NO: 241849 - RNA, 32 nt, Human
ucugccacuucucuuagacuccuugucugcaa

SEQ ID NO: 241850 - RNA, 32 nt, Human
ucugccagagguggagggaggguuggggucgc

SEQ ID NO: 241851 - RNA, 21 nt, Human
ucugccagauaaguaccgcca

SEQ ID NO: 241852 - RNA, 32 nt, Human
ucugccagaucuucccaucuuguggcaugugg

SEQ ID NO: 241853 - RNA, 21 nt, Human
ucugccagcccccaccugcca

SEQ ID NO: 241854 - RNA, 32 nt, Human
ucugccagccccgggaacagcagaggcggcgg

SEQ ID NO: 241855 - RNA, 32 nt, Human
ucugccagccuccuccuccccugccagccucu

SEQ ID NO: 241856 - RNA, 32 nt, Human
ucugccagccuccuccuucucccgcccuccuc

SEQ ID NO: 241857 - RNA, 32 nt, Human
ucugccagccugggcaacauagugagacuuca

SEQ ID NO: 241858 - RNA, 32 nt, Human
ucugccagccugggguccuaagcgaugagcag

SEQ ID NO: 241859 - RNA, 32 nt, Human
ucugccagcguggcagagcaugucuuggaacc

SEQ ID NO: 241860 - RNA, 22 nt, Human
ucugccagcguuucucaccaca

SEQ ID NO: 241861 - RNA, 32 nt, Human
ucugccagcucacaaggggaggcugcaguggg

SEQ ID NO: 241862 - RNA, 32 nt, Human
ucugccaggacugggaagggaggcaggaggcu

SEQ ID NO: 241863 - RNA, 32 nt, Human
ucugccaggacuugcugcagagcugcugagag

SEQ ID NO: 241864 - RNA, 19 nt, Human
ucugccaggaucaacugcc

SEQ ID NO: 241865 - RNA, 23 nt, Human
ucugccaggauccuccgagguca

SEQ ID NO: 241866 - RNA, 32 nt, Human
ucugccaggcucugcccugcccagugaccaac

SEQ ID NO: 241867 - RNA, 32 nt, Human
ucugccaggcugucccgugcccugcucggugg

SEQ ID NO: 241868 - RNA, 32 nt, Human
ucugccagggcagcaggcaugccacaacuccu

SEQ ID NO: 241869 - RNA, 22 nt, Human
ucugccaggucucaaaaauuca

SEQ ID NO: 241870 - RNA, 32 nt, Human
ucugccagguggggcgggaggcuucugaugcu

SEQ ID NO: 241871 - RNA, 32 nt, Human
ucugccaguuauugacacagcucucuuuguaa

SEQ ID NO: 241872 - RNA, 32 nt, Human
ucugccauccacccucauuuucccuuuagcaa

SEQ ID NO: 241873 - RNA, 32 nt, Human
ucugccauccacuugaggguauugagagccag

SEQ ID NO: 241874 - RNA, 32 nt, Human
ucugccauccauaagguaaauguaauacaucu

SEQ ID NO: 241875 - RNA, 32 nt, Human
ucugccaucccccucccucccugggcccggcc

SEQ ID NO: 241876 - RNA, 18 nt, Human
ucugccauccuugcuaag

SEQ ID NO: 241877 - RNA, 32 nt, Human
ucugccaucucucuccuccuuuuucuucagcc

SEQ ID NO: 241878 - RNA, 32 nt, Human
ucugccaucuucccucccacaauuagaguugu

SEQ ID NO: 241879 - RNA, 23 nt, Human
ucugccaugaacuggaggccagg

SEQ ID NO: 241880 - RNA, 32 nt, Human
ucugccaugagacuagagguugcuugagaaca

SEQ ID NO: 241881 - RNA, 32 nt, Human
ucugccaugaggccauuuucagacaaguuaaa

SEQ ID NO: 241882 - RNA, 22 nt, Human
ucugccauucauucuuguuaaa

SEQ ID NO: 241883 - RNA, 32 nt, Human
ucugccauugauguccagccucugacaugcuc

SEQ ID NO: 241884 - RNA, 32 nt, Human
ucugccauuucagaccuuuugcugcuaccugc

SEQ ID NO: 241885 - RNA, 21 nt, Human
ucugcccaaaagaugcugcuu

SEQ ID NO: 241886 - RNA, 32 nt, Human
ucugcccaacagcaacaacaacuccagcagcu

SEQ ID NO: 241887 - RNA, 32 nt, Human
ucugcccaaccagguugcaguagcaguggaug

SEQ ID NO: 241888 - RNA, 32 nt, Human
ucugcccaagcccugucuuaaggcccaggggg

SEQ ID NO: 241889 - RNA, 32 nt, Human
ucugcccaagcuccucucagaguccagucccc

SEQ ID NO: 241890 - RNA, 32 nt, Human
ucugcccacacccucacucacacucagucucc

SEQ ID NO: 241891 - RNA, 32 nt, Human
ucugcccacagccucagcauuucuuggagcag

SEQ ID NO: 241892 - RNA, 32 nt, Human
ucugcccaccucuucucuucugcuuccauauu

SEQ ID NO: 241893 - RNA, 32 nt, Human
ucugcccaccuggggucucucucccuaccucc

SEQ ID NO: 241894 - RNA, 32 nt, Human
ucugcccaccuugcccugugcaucucuuccug

SEQ ID NO: 241895 - RNA, 32 nt, Human
ucugcccacuccacaaccucaggucguggaga

SEQ ID NO: 241896 - RNA, 32 nt, Human
ucugcccacugcagccauacugugaccuccag

SEQ ID NO: 241897 - RNA, 32 nt, Human
ucugcccacugcagcucucugcagucuccggc

SEQ ID NO: 241898 - RNA, 32 nt, Human
ucugcccacuucggacccccaaagugcuggga

SEQ ID NO: 241899 - RNA, 32 nt, Human
ucugcccagaguggccaugagcaccagaacag

SEQ ID NO: 241900 - RNA, 32 nt, Human
ucugcccagauccccucucuuuucucggaaaa

SEQ ID NO: 241901 - RNA, 32 nt, Human
ucugcccagcaaacccaggaagguguggcguc

SEQ ID NO: 241902 - RNA, 32 nt, Human
ucugcccagccacccagcugugugagaugagc

SEQ ID NO: 241903 - RNA, 24 nt, Human
ucugcccagccagcuacuccagca

SEQ ID NO: 241904 - RNA, 32 nt, Human
ucugcccagccaucugcugguggcaccucucc

SEQ ID NO: 241905 - RNA, 32 nt, Human
ucugcccaggaacucgcaccugugcuggagcc

SEQ ID NO: 241906 - RNA, 32 nt, Human
ucugcccaggcccggcuccacccugcaccuca

SEQ ID NO: 241907 - RNA, 32 nt, Human
ucugcccaggcugccagccucacacagaucuu

SEQ ID NO: 241908 - RNA, 32 nt, Human
ucugcccagggagccucaggagcaggaugagu

SEQ ID NO: 241909 - RNA, 32 nt, Human
ucugcccagggagggagaaggaagagggggag

SEQ ID NO: 241910 - RNA, 32 nt, Human
ucugcccagggugggugggacugagcaggaug

SEQ ID NO: 241911 - RNA, 32 nt, Human
ucugcccaggguugacuccaccaggagcggcu

SEQ ID NO: 241912 - RNA, 22 nt, Human
ucugcccaguuguucaaccuca

SEQ ID NO: 241913 - RNA, 32 nt, Human
ucugcccaucccucuucauucacacacaguuc

SEQ ID NO: 241914 - RNA, 32 nt, Human
ucugcccaugccaggagccagcugugugacca

SEQ ID NO: 241915 - RNA, 32 nt, Human
ucugcccauggccacagggugcagagaggcag

SEQ ID NO: 241916 - RNA, 32 nt, Human
ucugccccaagagccaagagggguggaaagga

SEQ ID NO: 241917 - RNA, 32 nt, Human
ucugccccacagucuccggccucuccagccuc

SEQ ID NO: 241918 - RNA, 32 nt, Human
ucugccccacaucugggcaagcuaagaaagcc

SEQ ID NO: 241919 - RNA, 32 nt, Human
ucugccccacccacuuccuccccaccaccugu

SEQ ID NO: 241920 - RNA, 32 nt, Human
ucugccccacucuugccauuuccccaggcccc

SEQ ID NO: 241921 - RNA, 32 nt, Human
ucugccccagaggaaggagcuguaguguccug

SEQ ID NO: 241922 - RNA, 32 nt, Human
ucugccccagcccuggggauucauccugccca

SEQ ID NO: 241923 - RNA, 32 nt, Human
ucugccccaggaggccagaguaaaaagugcug

SEQ ID NO: 241924 - RNA, 32 nt, Human
ucugccccaguaauuuaccaaagguagcaaaa

SEQ ID NO: 241925 - RNA, 25 nt, Human
ucugccccagugccuuuguccuucc

SEQ ID NO: 241926 - RNA, 32 nt, Human
ucugccccaugugcccuugaagcugccccaca

SEQ ID NO: 241927 - RNA, 22 nt, Human
ucugcccccacgccuguccuuc

SEQ ID NO: 241928 - RNA, 32 nt, Human
ucugcccccaggacaggagcuugacggaugaa

SEQ ID NO: 241929 - RNA, 32 nt, Human
ucugcccccuaccuucccuccuggaaccacac

SEQ ID NO: 241930 - RNA, 32 nt, Human
ucugcccccugccccucccugccccagguucc

SEQ ID NO: 241931 - RNA, 32 nt, Human
ucugccccguccaucucuuucccuucaucuua

SEQ ID NO: 241932 - RNA, 18 nt, Human
ucugccccucacuuccuu

SEQ ID NO: 241933 - RNA, 32 nt, Human
ucugccccuccagacccagggcaugguccugc

SEQ ID NO: 241934 - RNA, 32 nt, Human
ucugccccuccaggcccagggcaugguccugc

SEQ ID NO: 241935 - RNA, 32 nt, Human
ucugccccucccccuggcuucuuucucuuggg

SEQ ID NO: 241936 - RNA, 32 nt, Human
ucugccccuccuccuuuucuguccuuggccau

SEQ ID NO: 241937 - RNA, 32 nt, Human
ucugccccugaucacucccagcacuccccuug

SEQ ID NO: 241938 - RNA, 22 nt, Human
ucugccccugcccaggcugcca

SEQ ID NO: 241939 - RNA, 32 nt, Human
ucugccccugcucugcccucccuggcuccugg

SEQ ID NO: 241940 - RNA, 32 nt, Human
ucugccccugggcccagucucuccucggaggc

SEQ ID NO: 241941 - RNA, 32 nt, Human
ucugccccugugaacacccaucugcaguaucc

SEQ ID NO: 241942 - RNA, 21 nt, Human
ucugccccugugauugggcca

SEQ ID NO: 241943 - RNA, 32 nt, Human
ucugccccuguguuccccuuggguuucuguga

SEQ ID NO: 241944 - RNA, 32 nt, Human
ucugccccuuccucucugccccaaacucuucc

SEQ ID NO: 241945 - RNA, 24 nt, Human
ucugccccuucgaaaugaggcagu

SEQ ID NO: 241946 - RNA, 32 nt, Human
ucugccccuucggaccucgucucccaucuaca

SEQ ID NO: 241947 - RNA, 32 nt, Human
ucugccccuucuuuacccuucuuccaauuuuu

SEQ ID NO: 241948 - RNA, 24 nt, Human
ucugcccgccuuucccauccugcu

SEQ ID NO: 241949 - RNA, 32 nt, Human
ucugcccgcucgacuccuccgcccgggccgcu

SEQ ID NO: 241950 - RNA, 32 nt, Human
ucugcccgcugccucuugucuagcugcuguca

SEQ ID NO: 241951 - RNA, 32 nt, Human
ucugcccggcccagcaccaugcacacgcuugu

SEQ ID NO: 241952 - RNA, 32 nt, Human
ucugcccggcucccagugucugcccagcccuc

SEQ ID NO: 241953 - RNA, 17 nt, Human
ucugcccgggcgccggu

SEQ ID NO: 241954 - RNA, 32 nt, Human
ucugcccucaccaugagccucuggcagccccu

SEQ ID NO: 241955 - RNA, 32 nt, Human
ucugcccucaccucugugcccagccuggaaac

SEQ ID NO: 241956 - RNA, 32 nt, Human
ucugcccucccuucauuguacuuuaucauuaa

SEQ ID NO: 241957 - RNA, 32 nt, Human
ucugcccuccucacccucagggacaccacucg

SEQ ID NO: 241958 - RNA, 21 nt, Human
ucugcccucggauguccgacc

SEQ ID NO: 241959 - RNA, 32 nt, Human
ucugcccucuacucgugccaggcccacuugcc

SEQ ID NO: 241960 - RNA, 32 nt, Human
ucugcccucuacugaugagacuuccugcugcc

SEQ ID NO: 241961 - RNA, 32 nt, Human
ucugcccucuccccaccccuuccaaugagcuc

SEQ ID NO: 241962 - RNA, 32 nt, Human
ucugcccucucuccuaccuccaccuucucaga

SEQ ID NO: 241963 - RNA, 32 nt, Human
ucugcccucugcuccguucccugggggcuggg

SEQ ID NO: 241964 - RNA, 32 nt, Human
ucugcccugaaccaaaccuaauuguccugguc

SEQ ID NO: 241965 - RNA, 32 nt, Human
ucugcccugagaucugggcauaaaguggauga

SEQ ID NO: 241966 - RNA, 32 nt, Human
ucugcccugaguauugaggugcaggcuucuuc

SEQ ID NO: 241967 - RNA, 32 nt, Human
ucugcccugcagcugaaacuuggccaucacau

SEQ ID NO: 241968 - RNA, 32 nt, Human
ucugcccugcccacccagagccccucuuugug

SEQ ID NO: 241969 - RNA, 19 nt, Human
ucugcccugccccaccccc

SEQ ID NO: 241970 - RNA, 20 nt, Human
ucugcccugccccccacccc

SEQ ID NO: 241971 - RNA, 32 nt, Human
ucugcccugcccuccagccugggacaauaaaa

SEQ ID NO: 241972 - RNA, 22 nt, Human
ucugcccugcccugcacccccc

SEQ ID NO: 241973 - RNA, 32 nt, Human
ucugcccugccuccuccuuucguuguaggagg

SEQ ID NO: 241974 - RNA, 32 nt, Human
ucugcccugccugcccacaucccugccuccug

SEQ ID NO: 241975 - RNA, 32 nt, Human
ucugcccugccugccucccugcaccugcggcc

SEQ ID NO: 241976 - RNA, 21 nt, Human
ucugcccugcgcguucuuccc

SEQ ID NO: 241977 - RNA, 22 nt, Human
ucugcccugcgcuccuucuccc

SEQ ID NO: 241978 - RNA, 32 nt, Human
ucugcccuggaaaacccaaagcaaguagugau

SEQ ID NO: 241979 - RNA, 32 nt, Human
ucugcccuggacaaggugcugaggugcauugu

SEQ ID NO: 241980 - RNA, 32 nt, Human
ucugcccuggaccugugacacucuggacuauu

SEQ ID NO: 241981 - RNA, 32 nt, Human
ucugcccuggaccugugacauucuggacuauu

SEQ ID NO: 241982 - RNA, 18 nt, Human
ucugcccuggacuuuccc

SEQ ID NO: 241983 - RNA, 32 nt, Human
ucugcccuggccucuccugcuccagggcagcc

SEQ ID NO: 241984 - RNA, 19 nt, Human
ucugcccugggcagacagg

SEQ ID NO: 241985 - RNA, 32 nt, Human
ucugcccugggccuucccagggagacaauagu

SEQ ID NO: 241986 - RNA, 32 nt, Human
ucugcccuguaaaaaucagacucggaaccgau

SEQ ID NO: 241987 - RNA, 32 nt, Human
ucugcccugucugggagguugaggccacagug

SEQ ID NO: 241988 - RNA, 19 nt, Human
ucugcccuguguacuuccc

SEQ ID NO: 241989 - RNA, 32 nt, Human
ucugcccuuaacuggcuggaacugguucauuc

SEQ ID NO: 241990 - RNA, 32 nt, Human
ucugcccuuacacccaugacugaggaccaaug

SEQ ID NO: 241991 - RNA, 20 nt, Human
ucugcccuucacacucuccu

SEQ ID NO: 241992 - RNA, 32 nt, Human
ucugcccuucacuuagcaccugccucagcccc

SEQ ID NO: 241993 - RNA, 32 nt, Human
ucugcccuucagccuccuccagcugggcccug

SEQ ID NO: 241994 - RNA, 27 nt, Human
ucugcccuucuaagucauagacuaggu

SEQ ID NO: 241995 - RNA, 32 nt, Human
ucugcccuugggaggcggguggaggagcagca

SEQ ID NO: 241996 - RNA, 32 nt, Human
ucugcccuuggguucaagaaccagacugugga

SEQ ID NO: 241997 - RNA, 19 nt, Human
ucugcccuuuccccagcca

SEQ ID NO: 241998 - RNA, 32 nt, Human
ucugccgagacugccgugcccauugcucgccu

SEQ ID NO: 241999 - RNA, 32 nt, Human
ucugccgagagcagcuggaggacagcugagcu

SEQ ID NO: 242000 - RNA, 32 nt, Human
ucugccgaguagcugggauuacaggcaugcgc

SEQ ID NO: 242001 - RNA, 32 nt, Human
ucugccgcagacauggagaaacucagcgcgcu

SEQ ID NO: 242002 - RNA, 32 nt, Human
ucugccgcagcccugcagagggcacagaaaau

SEQ ID NO: 242003 - RNA, 20 nt, Human
ucugccgccguggcugcaag

SEQ ID NO: 242004 - RNA, 23 nt, Human
ucugccgccucuugggacugggg

SEQ ID NO: 242005 - RNA, 18 nt, Human
ucugccgcgggggcgcgg

SEQ ID NO: 242006 - RNA, 32 nt, Human
ucugccgcucugucuucucucuucaguuuucu

SEQ ID NO: 242007 - RNA, 32 nt, Human
ucugccgcugccgccucagcugcuuuggccca

SEQ ID NO: 242008 - RNA, 32 nt, Human
ucugccggacgcguguuccugccaccaggugc

SEQ ID NO: 242009 - RNA, 32 nt, Human
ucugccggaugucuuucuuuaccuaccccuca

SEQ ID NO: 242010 - RNA, 32 nt, Human
ucugccggcauccucgaaagcagcggguuugg

SEQ ID NO: 242011 - RNA, 32 nt, Human
ucugccggccggugguuggaggccgcggcggc

SEQ ID NO: 242012 - RNA, 32 nt, Human
ucugccggcucccgcccagccuguguggaaag

SEQ ID NO: 242013 - RNA, 32 nt, Human
ucugccggggaggaggaggaggaggaagagga

SEQ ID NO: 242014 - RNA, 32 nt, Human
ucugccggggccugcugacugaaggaauuugu

SEQ ID NO: 242015 - RNA, 32 nt, Human
ucugccggguccucccagcccuugccacacag

SEQ ID NO: 242016 - RNA, 32 nt, Human
ucugccggugagugggaagugggugccuugcg

SEQ ID NO: 242017 - RNA, 32 nt, Human
ucugccgguuucuugucccagcagguuggggg

SEQ ID NO: 242018 - RNA, 32 nt, Human
ucugccguccgggcccugccaggcuugccagg

SEQ ID NO: 242019 - RNA, 32 nt, Human
ucugccguggccugggcugccugcgcccaccc

SEQ ID NO: 242020 - RNA, 32 nt, Human
ucugccguucuucuccacuuggcuccagcugc

SEQ ID NO: 242021 - RNA, 18 nt, Human
ucugccguuuuccuuucc

SEQ ID NO: 242022 - RNA, 32 nt, Human
ucugccuaccugccagguucaguucuuuuaag

SEQ ID NO: 242023 - RNA, 32 nt, Human
ucugccuacuauuuuggucugacauuuuugua

SEQ ID NO: 242024 - RNA, 32 nt, Human
ucugccuagcuggugagggcauggggaaagag

SEQ ID NO: 242025 - RNA, 32 nt, Human
ucugccuagucucugugcccugucuuugugug

SEQ ID NO: 242026 - RNA, 32 nt, Human
ucugccucaaaaccagcccuaacuggacuacu

SEQ ID NO: 242027 - RNA, 32 nt, Human
ucugccucaagcgauccucccaucucagccuc

SEQ ID NO: 242028 - RNA, 32 nt, Human
ucugccucacauagcuuacaagccagcuggag

SEQ ID NO: 242029 - RNA, 23 nt, Human
ucugccucaccaaacacaugcua

SEQ ID NO: 242030 - RNA, 32 nt, Human
ucugccucagacuggagggggcucagcuccug

SEQ ID NO: 242031 - RNA, 32 nt, Human
ucugccucagccaguagcgcagucucggccuc

SEQ ID NO: 242032 - RNA, 32 nt, Human
ucugccucauccuccuccucauucagaccaau

SEQ ID NO: 242033 - RNA, 32 nt, Human
ucugccuccaaagugcuggauuacaggcugag

SEQ ID NO: 242034 - RNA, 32 nt, Human
ucugccuccaucucagucacacaugucuagcc

SEQ ID NO: 242035 - RNA, 32 nt, Human
ucugccuccaugucaccaccuuugaaggacug

SEQ ID NO: 242036 - RNA, 32 nt, Human
ucugccucccaaaaugcugggauuacaggcgu

SEQ ID NO: 242037 - RNA, 32 nt, Human
ucugccucccaaagggcugggacugcaggugc

SEQ ID NO: 242038 - RNA, 32 nt, Human
ucugccucccaaagugcuaggauuacaggcgu

SEQ ID NO: 242039 - RNA, 32 nt, Human
ucugccucccaaagugcugggaucacaggcau

SEQ ID NO: 242040 - RNA, 32 nt, Human
ucugccucccaaagugcugggauuacaggcau

SEQ ID NO: 242041 - RNA, 32 nt, Human
ucugccucccaaagugcugggauuacaggcgu

SEQ ID NO: 242042 - RNA, 32 nt, Human
ucugccucccaaagugcugggauuacaggugu

SEQ ID NO: 242043 - RNA, 32 nt, Human
ucugccucccaaagugcugugauuacaggccu

SEQ ID NO: 242044 - RNA, 32 nt, Human
ucugccucccaaggugcugggauugcagacgu

SEQ ID NO: 242045 - RNA, 32 nt, Human
ucugccucccaaguagcugggauuaaggcgcc

SEQ ID NO: 242046 - RNA, 32 nt, Human
ucugccucccaaguagcugggauuacaggcac

SEQ ID NO: 242047 - RNA, 32 nt, Human
ucugccucccauucugaccacccuucucauuc

SEQ ID NO: 242048 - RNA, 20 nt, Human
ucugccucccccaccccuua

SEQ ID NO: 242049 - RNA, 32 nt, Human
ucugccucccgaguagcugggauuacaggcau

SEQ ID NO: 242050 - RNA, 24 nt, Human
ucugccucccuuuuuguuuuccca

SEQ ID NO: 242051 - RNA, 32 nt, Human
ucugccuccguccccgcccuccaggcuucucg

SEQ ID NO: 242052 - RNA, 32 nt, Human
ucugccuccuaaagugcugggauucugggccu

SEQ ID NO: 242053 - RNA, 20 nt, Human
ucugccuccucccccuuccc

SEQ ID NO: 242054 - RNA, 32 nt, Human
ucugccuccuccucccaugagguggggagagg

SEQ ID NO: 242055 - RNA, 32 nt, Human
ucugccuccuccugccugucugcacuauuccu

SEQ ID NO: 242056 - RNA, 32 nt, Human
ucugccuccucuuccacacauccugggucagc

SEQ ID NO: 242057 - RNA, 32 nt, Human
ucugccuccugaggcagguuuucagagagaaa

SEQ ID NO: 242058 - RNA, 32 nt, Human
ucugccuccugaguagcugggauuacuggcac

SEQ ID NO: 242059 - RNA, 19 nt, Human
ucugccuccugguuuccuu

SEQ ID NO: 242060 - RNA, 32 nt, Human
ucugccuccuuggccccacauuucugcaaaca

SEQ ID NO: 242061 - RNA, 21 nt, Human
ucugccucuagccaaaugcua

SEQ ID NO: 242062 - RNA, 32 nt, Human
ucugccucucccucccuuccucaggcaucaga

SEQ ID NO: 242063 - RNA, 32 nt, Human
ucugccucuccucaaaugcugugugcugcaau

SEQ ID NO: 242064 - RNA, 32 nt, Human
ucugccucuccugucaccccugcccaccaccc

SEQ ID NO: 242065 - RNA, 32 nt, Human
ucugccucucugcuucuucaucuucuuauaau

SEQ ID NO: 242066 - RNA, 26 nt, Human
ucugccucugccucauauucuuguua

SEQ ID NO: 242067 - RNA, 32 nt, Human
ucugccucugcugcacacacaggcaccagcag

SEQ ID NO: 242068 - RNA, 32 nt, Human
ucugccucugcugccaggcagggaagggcccc

SEQ ID NO: 242069 - RNA, 32 nt, Human
ucugccucuguaccugcagcucugcucucggg

SEQ ID NO: 242070 - RNA, 32 nt, Human
ucugccucuguucgcauaguaagaaggaguga

SEQ ID NO: 242071 - RNA, 32 nt, Human
ucugccucuuggcugcuuccaguucccgccau

SEQ ID NO: 242072 - RNA, 32 nt, Human
ucugccucuugggucuuccucccaggccuugu

SEQ ID NO: 242073 - RNA, 28 nt, Human
ucugccucuuuuaggucagaguaugcua

SEQ ID NO: 242074 - RNA, 32 nt, Human
ucugccucuuuucucuccccagccugcccugu

SEQ ID NO: 242075 - RNA, 32 nt, Human
ucugccugaacagccccuucucucccuccacc

SEQ ID NO: 242076 - RNA, 32 nt, Human
ucugccugcagcugggccucugccucauccug

SEQ ID NO: 242077 - RNA, 32 nt, Human
ucugccugccaagaagacacagugagaggggu

SEQ ID NO: 242078 - RNA, 32 nt, Human
ucugccugcccagcaucaugaagggccuugca

SEQ ID NO: 242079 - RNA, 18 nt, Human
ucugccugcccugaaagu

SEQ ID NO: 242080 - RNA, 32 nt, Human
ucugccugcccuuuguccuccugcugccagua

SEQ ID NO: 242081 - RNA, 32 nt, Human
ucugccugccgccugccugccugccacugagg

SEQ ID NO: 242082 - RNA, 32 nt, Human
ucugccugccuaaccagccuuucauaaaauuu

SEQ ID NO: 242083 - RNA, 31 nt, Human
ucugccugccucucagcuugcuucagaaaau

SEQ ID NO: 242084 - RNA, 32 nt, Human
ucugccugccuuccugccguccuuccuucuuc

SEQ ID NO: 242085 - RNA, 18 nt, Human
ucugccugcucagcucca

SEQ ID NO: 242086 - RNA, 32 nt, Human
ucugccugcuccucucccuccuaaggaaaagg

SEQ ID NO: 242087 - RNA, 32 nt, Human
ucugccuggaaacuuugacaugguucauguuu

SEQ ID NO: 242088 - RNA, 32 nt, Human
ucugccuggaaccuggcucgugcugugaccag

SEQ ID NO: 242089 - RNA, 32 nt, Human
ucugccuggagugucggauccugugaguaggc

SEQ ID NO: 242090 - RNA, 20 nt, Human
ucugccuggaucccccgggc

SEQ ID NO: 242091 - RNA, 32 nt, Human
ucugccuggcccucggaccccucugccugccc

SEQ ID NO: 242092 - RNA, 19 nt, Human
ucugccuggcgcggcuaca

SEQ ID NO: 242093 - RNA, 32 nt, Human
ucugccuggcucuucuccacuggaccagggag

SEQ ID NO: 242094 - RNA, 29 nt, Human
ucugccugggccucacugacagccugcag

SEQ ID NO: 242095 - RNA, 32 nt, Human
ucugccuggucugagggugcagccagggcaca

SEQ ID NO: 242096 - RNA, 32 nt, Human
ucugccuguagucccagcuacucgggaggcug

SEQ ID NO: 242097 - RNA, 20 nt, Human
ucugccuguccggggcacca

SEQ ID NO: 242098 - RNA, 32 nt, Human
ucugccugugcacggccagcugcaucuacuca

SEQ ID NO: 242099 - RNA, 32 nt, Human
ucugccugugcagccccaccucaagggccaug

SEQ ID NO: 242100 - RNA, 32 nt, Human
ucugccuguggguggucacgggagggugugag

SEQ ID NO: 242101 - RNA, 32 nt, Human
ucugccuguggucccagcuacucgggaggcug

SEQ ID NO: 242102 - RNA, 21 nt, Human
ucugccuguguccccaccacu

SEQ ID NO: 242103 - RNA, 32 nt, Human
ucugccugugugugugcacucgugucgcgccu

SEQ ID NO: 242104 - RNA, 32 nt, Human
ucugccuguuacugcugcucccucccuggucc

SEQ ID NO: 242105 - RNA, 32 nt, Human
ucugccuguugguugugaucugugggcaccag

SEQ ID NO: 242106 - RNA, 32 nt, Human
ucugccuguuucccuccucccuuccuuuccac

SEQ ID NO: 242107 - RNA, 32 nt, Human
ucugccuuaauuaacuuaaagacugauuuuaa

SEQ ID NO: 242108 - RNA, 32 nt, Human
ucugccuuaguguguguuauugccauuucaau

SEQ ID NO: 242109 - RNA, 32 nt, Human
ucugccuucaaccuuaagauuuaggaaguucu

SEQ ID NO: 242110 - RNA, 32 nt, Human
ucugccuucaaggagcuugcaguauagugaga

SEQ ID NO: 242111 - RNA, 25 nt, Human
ucugccuucaugcaccuguccuuuc

SEQ ID NO: 242112 - RNA, 32 nt, Human
ucugccuuccaaggaagaaggggaagaaaagg

SEQ ID NO: 242113 - RNA, 32 nt, Human
ucugccuuccagaaucucucucuggcuucuca

SEQ ID NO: 242114 - RNA, 22 nt, Human
ucugccuuccccagagcaggug

SEQ ID NO: 242115 - RNA, 32 nt, Human
ucugccuuccucccaagaaacagcagcucaaa

SEQ ID NO: 242116 - RNA, 32 nt, Human
ucugccuuccugagucccuuccagucaugugu

SEQ ID NO: 242117 - RNA, 23 nt, Human
ucugccuucucccacaccccuua

SEQ ID NO: 242118 - RNA, 32 nt, Human
ucugccuucuccccuuacccucccgccuccca

SEQ ID NO: 242119 - RNA, 32 nt, Human
ucugccuucucccucuucucuugccugaucau

SEQ ID NO: 242120 - RNA, 32 nt, Human
ucugccuucucccuuuacccucccgccuccca

SEQ ID NO: 242121 - RNA, 20 nt, Human
ucugccuugaccacuuuccc

SEQ ID NO: 242122 - RNA, 32 nt, Human
ucugccuugaguagcugggacuucaggugcac

SEQ ID NO: 242123 - RNA, 32 nt, Human
ucugccuugcacucuuugcugauggcuguggg

SEQ ID NO: 242124 - RNA, 32 nt, Human
ucugccuugccucaagaaccauccccugcaga

SEQ ID NO: 242125 - RNA, 32 nt, Human
ucugccuugccuggaggcagaaggagggggcu

SEQ ID NO: 242126 - RNA, 32 nt, Human
ucugccuuuaaaauccuuccucuuucuuccuc

SEQ ID NO: 242127 - RNA, 32 nt, Human
ucugccuuucaguucugaacagcuuccagcau

SEQ ID NO: 242128 - RNA, 32 nt, Human
ucugccuuuccuauuuguuccaguuuuugcuu

SEQ ID NO: 242129 - RNA, 23 nt, Human
ucugccuuucuaccgaccaugug

SEQ ID NO: 242130 - RNA, 19 nt, Human
ucugccuuugcauuuccuu

SEQ ID NO: 242131 - RNA, 22 nt, Human
ucugccuuugcugccacugcca

SEQ ID NO: 242132 - RNA, 32 nt, Human
ucugccuuuguagagcucugagcgcccacucu

SEQ ID NO: 242133 - RNA, 32 nt, Human
ucugccuuuguauaaagaaacagccucugaaa

SEQ ID NO: 242134 - RNA, 32 nt, Human
ucugccuuuucuguaaaaugcauggacugagg

SEQ ID NO: 242135 - RNA, 32 nt, Human
ucugccuuuuugggaaagagacaggaaagauu

SEQ ID NO: 242136 - RNA, 32 nt, Human
ucugcgagccccugcacuccauccugcugacc

SEQ ID NO: 242137 - RNA, 32 nt, Human
ucugcgaugccggccuuccguuccucugggag

SEQ ID NO: 242138 - RNA, 22 nt, Human
ucugcgccacuuguccgcuuca

SEQ ID NO: 242139 - RNA, 32 nt, Human
ucugcgcccaggauggagugcaguggcaugau

SEQ ID NO: 242140 - RNA, 32 nt, Human
ucugcgccccggauugccuggccagcaccacg

SEQ ID NO: 242141 - RNA, 32 nt, Human
ucugcgcccugccuaccuguccaggggugggg

SEQ ID NO: 242142 - RNA, 32 nt, Human
ucugcgccgaagguggaggccgaagugagccu

SEQ ID NO: 242143 - RNA, 32 nt, Human
ucugcgccgcagcugccgcccccgccucuuug

SEQ ID NO: 242144 - RNA, 32 nt, Human
ucugcgcgauaucaauacuggcuauuuucucu

SEQ ID NO: 242145 - RNA, 24 nt, Human
ucugcgcgggaguggggggcgcgg

SEQ ID NO: 242146 - RNA, 32 nt, Human
ucugcgcucauuucauccucuggcuuccucac

SEQ ID NO: 242147 - RNA, 32 nt, Human
ucugcgcucccaggccggcaucgagugucauc

SEQ ID NO: 242148 - RNA, 22 nt, Human
ucugcgcugagcagaaccagcu

SEQ ID NO: 242149 - RNA, 32 nt, Human
ucugcgcugccuggcagccguguguggcugug

SEQ ID NO: 242150 - RNA, 32 nt, Human
ucugcggaaggugggaggaggcagacacccug

SEQ ID NO: 242151 - RNA, 21 nt, Human
ucugcggaccccagcugugag

SEQ ID NO: 242152 - RNA, 32 nt, Human
ucugcggaggaggucaccugagcucacaggac

SEQ ID NO: 242153 - RNA, 32 nt, Human
ucugcggagggugagacugagguggcugcagu

SEQ ID NO: 242154 - RNA, 32 nt, Human
ucugcggagguggaaguuggggagcuuugagg

SEQ ID NO: 242155 - RNA, 32 nt, Human
ucugcggaucuucugguugaaccacguggcca

SEQ ID NO: 242156 - RNA, 22 nt, Human
ucugcggcaagggcuucaccca

SEQ ID NO: 242157 - RNA, 32 nt, Human
ucugcggccaggaagugcuggucauggagcaa

SEQ ID NO: 242158 - RNA, 32 nt, Human
ucugcggcccggggcuggagcgcagcgggaag

SEQ ID NO: 242159 - RNA, 32 nt, Human
ucugcggccgcagcagcacuuuuugcacaguc

SEQ ID NO: 242160 - RNA, 18 nt, Human
ucugcggccugcagagca

SEQ ID NO: 242161 - RNA, 32 nt, Human
ucugcggcgggccgcguccccgcugagccucg

SEQ ID NO: 242162 - RNA, 32 nt, Human
ucugcggcucucuccaccugccgaccugccgg

SEQ ID NO: 242163 - RNA, 32 nt, Human
ucugcgggcccagcuccugccucccaguggcc

SEQ ID NO: 242164 - RNA, 32 nt, Human
ucugcgggcucccuccucuggcaggcuucccc

SEQ ID NO: 242165 - RNA, 32 nt, Human
ucugcgggcugcaucugugcagccuggcagcg

SEQ ID NO: 242166 - RNA, 32 nt, Human
ucugcggggacugaggcauggcagggaaacug

SEQ ID NO: 242167 - RNA, 32 nt, Human
ucugcgggguggggugggggagggacgggagc

SEQ ID NO: 242168 - RNA, 32 nt, Human
ucugcggucacaguggccccugggcaggggca

SEQ ID NO: 242169 - RNA, 32 nt, Human
ucugcggugaagccaagccgcaagguuacaag

SEQ ID NO: 242170 - RNA, 32 nt, Human
ucugcgguguagucgcucuguccucagggugg

SEQ ID NO: 242171 - RNA, 32 nt, Human
ucugcguaaucaggacuugcaacacccugauu

SEQ ID NO: 242172 - RNA, 24 nt, Human
ucugcguaucccccagccuugagg

SEQ ID NO: 242173 - RNA, 24 nt, Human
ucugcguccucuuaucuucugcca

SEQ ID NO: 242174 - RNA, 32 nt, Human
ucugcgucggaucccugagaacuucgaagcca

SEQ ID NO: 242175 - RNA, 32 nt, Human
ucugcgucucccucucugcagccuguguaagc

SEQ ID NO: 242176 - RNA, 32 nt, Human
ucugcgugagggccuuaaugucacccaccaga

SEQ ID NO: 242177 - RNA, 32 nt, Human
ucugcgugcaaaccccagccucccucuucuuc

SEQ ID NO: 242178 - RNA, 32 nt, Human
ucugcgugcaugggcacgugugcauugcucag

SEQ ID NO: 242179 - RNA, 16 nt, Human
ucugcgugcuuucaaa

SEQ ID NO: 242180 - RNA, 32 nt, Human
ucugcgugugucucagcaccgcuaucucagcc

SEQ ID NO: 242181 - RNA, 32 nt, Human
ucugcguugugugaaauguccaucuuaguuuu

SEQ ID NO: 242182 - RNA, 32 nt, Human
ucugcguuuaagacaggaagcugccggguuac

SEQ ID NO: 242183 - RNA, 32 nt, Human
ucugcuaaaaauacaaaaauuagccagaugug

SEQ ID NO: 242184 - RNA, 32 nt, Human
ucugcuaaaaauacaaaaauuagccaggcaug

SEQ ID NO: 242185 - RNA, 32 nt, Human
ucugcuaaaaauacaaaaauuagccgggcgug

SEQ ID NO: 242186 - RNA, 32 nt, Human
ucugcuaaaaauacaaaaauuagccgggugug

SEQ ID NO: 242187 - RNA, 32 nt, Human
ucugcuaaaaauacaaaauuagcugggcgugg

SEQ ID NO: 242188 - RNA, 32 nt, Human
ucugcuaagguagcucucacacaccucggcuc

SEQ ID NO: 242189 - RNA, 32 nt, Human
ucugcuacaccagggcugccucaggccaggcc

SEQ ID NO: 242190 - RNA, 32 nt, Human
ucugcuacacucgucccccuccugccucaucu

SEQ ID NO: 242191 - RNA, 32 nt, Human
ucugcuacauauauaaauagacuugcaguuau

SEQ ID NO: 242192 - RNA, 32 nt, Human
ucugcuaccaagcaggcgucucagcuuuccuc

SEQ ID NO: 242193 - RNA, 32 nt, Human
ucugcuaccacaguaaccagcagaccuccagg

SEQ ID NO: 242194 - RNA, 18 nt, Human
ucugcuaccauuuccuua

SEQ ID NO: 242195 - RNA, 32 nt, Human
ucugcuaccccgugaccucccucucuccuucc

SEQ ID NO: 242196 - RNA, 32 nt, Human
ucugcuaccuagucuauacacagcgugaaccu

SEQ ID NO: 242197 - RNA, 21 nt, Human
ucugcuaccugcuccugaagc

SEQ ID NO: 242198 - RNA, 32 nt, Human
ucugcuacuuugcugcuaugguuuucuccaag

SEQ ID NO: 242199 - RNA, 32 nt, Human
ucugcuagaggcagaggaagaagggugaggac

SEQ ID NO: 242200 - RNA, 32 nt, Human
ucugcuagcugucacccugccuugugccccag

SEQ ID NO: 242201 - RNA, 32 nt, Human
ucugcuaggagagguuuuauaugccaggcgug

SEQ ID NO: 242202 - RNA, 32 nt, Human
ucugcuauauagaacuagcucaaaagacugua

SEQ ID NO: 242203 - RNA, 32 nt, Human
ucugcuaucuuugagcaaucugggcacuuuua

SEQ ID NO: 242204 - RNA, 32 nt, Human
ucugcuauggcuggagccacugcugagggacu

SEQ ID NO: 242205 - RNA, 31 nt, Human
ucugcuauugugcucuuucauuuaaaaugua

SEQ ID NO: 242206 - RNA, 32 nt, Human
ucugcucaacuugcuguuguccauagagcaug

SEQ ID NO: 242207 - RNA, 31 nt, Human
ucugcucaauaaaauaccuguaacuggaaaa

SEQ ID NO: 242208 - RNA, 32 nt, Human
ucugcucaauccaaaucacagcucucccguuu

SEQ ID NO: 242209 - RNA, 32 nt, Human
ucugcucaauccugcaugugcaggaggucaug

SEQ ID NO: 242210 - RNA, 32 nt, Human
ucugcucaauuuccuuuccucaucucaaauaa

SEQ ID NO: 242211 - RNA, 32 nt, Human
ucugcucacaccagccuugggcuccagcccuc

SEQ ID NO: 242212 - RNA, 32 nt, Human
ucugcucacaugcacugcguguggcgcaucuc

SEQ ID NO: 242213 - RNA, 32 nt, Human
ucugcucacccacauccucccuccacagcccc

SEQ ID NO: 242214 - RNA, 32 nt, Human
ucugcucaccgcaaccuccgccucccagguuc

SEQ ID NO: 242215 - RNA, 32 nt, Human
ucugcucacugaacagccacgucugggggcgu

SEQ ID NO: 242216 - RNA, 32 nt, Human
ucugcucacugcaaccuccgccucccagguuc

SEQ ID NO: 242217 - RNA, 32 nt, Human
ucugcucacugcaaccuccgccucccggguuc

SEQ ID NO: 242218 - RNA, 32 nt, Human
ucugcucacugcaagcucagccucucggguuc

SEQ ID NO: 242219 - RNA, 32 nt, Human
ucugcucacugcaagcuccgccaucuggguuc

SEQ ID NO: 242220 - RNA, 32 nt, Human
ucugcucacugcaagcuccgccucccggguuc

SEQ ID NO: 242221 - RNA, 32 nt, Human
ucugcucagaagcagaacaagugaugaccuaa

SEQ ID NO: 242222 - RNA, 32 nt, Human
ucugcucagaccugcacccagucacagcagca

SEQ ID NO: 242223 - RNA, 23 nt, Human
ucugcucagaggaggcuuucuua

SEQ ID NO: 242224 - RNA, 32 nt, Human
ucugcucagcuauucuugggccagauggggcc

SEQ ID NO: 242225 - RNA, 32 nt, Human
ucugcucagcuccccucugcccccucuuucca

SEQ ID NO: 242226 - RNA, 32 nt, Human
ucugcucaguguuugguaccuagaaagaacug

SEQ ID NO: 242227 - RNA, 32 nt, Human
ucugcucaguucucugugccugucucccucca

SEQ ID NO: 242228 - RNA, 21 nt, Human
ucugcucaguuuuucuguguu

SEQ ID NO: 242229 - RNA, 32 nt, Human
ucugcucaucccuccucauucagacauccucc

SEQ ID NO: 242230 - RNA, 32 nt, Human
ucugcucauggagggcagcccugugugucccu

SEQ ID NO: 242231 - RNA, 32 nt, Human
ucugcucaugggagaauggcagagggaucccc

SEQ ID NO: 242232 - RNA, 32 nt, Human
ucugcucauuuagucccgucuuccucaccgcc

SEQ ID NO: 242233 - RNA, 32 nt, Human
ucugcuccaagaggcagaggugggccccaccg

SEQ ID NO: 242234 - RNA, 32 nt, Human
ucugcuccaccacauccuccguccagccgcca

SEQ ID NO: 242235 - RNA, 32 nt, Human
ucugcuccaccccugugccaccccagagcccu

SEQ ID NO: 242236 - RNA, 32 nt, Human
ucugcuccagaacucuauccacuguauuucca

SEQ ID NO: 242237 - RNA, 32 nt, Human
ucugcuccagccuguccucucgucagccuucc

SEQ ID NO: 242238 - RNA, 32 nt, Human
ucugcuccagucaaggaguuacagggggaauc

SEQ ID NO: 242239 - RNA, 21 nt, Human
ucugcucccaggcaacugugu

SEQ ID NO: 242240 - RNA, 32 nt, Human
ucugcucccaggggcccugggacgcugggcug

SEQ ID NO: 242241 - RNA, 18 nt, Human
ucugcuccccaggcuauu

SEQ ID NO: 242242 - RNA, 22 nt, Human
ucugcuccccgcccgucuucuc

SEQ ID NO: 242243 - RNA, 32 nt, Human
ucugcucccgauucuccuccucuccuuucucu

SEQ ID NO: 242244 - RNA, 21 nt, Human
ucugcucccuauguuauuuca

SEQ ID NO: 242245 - RNA, 32 nt, Human
ucugcucccucauucucuccccaccacucucu

SEQ ID NO: 242246 - RNA, 32 nt, Human
ucugcucccugaccacacaucggaagggcugg

SEQ ID NO: 242247 - RNA, 32 nt, Human
ucugcucccugcaaccuccaccucccggguuc

SEQ ID NO: 242248 - RNA, 32 nt, Human
ucugcucccugccuuugccucacuuuacgcaa

SEQ ID NO: 242249 - RNA, 32 nt, Human
ucugcucccuggggcugcuucuagcucaggac

SEQ ID NO: 242250 - RNA, 27 nt, Human
ucugcucccugucuccucuuucugcca

SEQ ID NO: 242251 - RNA, 32 nt, Human
ucugcuccgcagaaccccauguccucagauaa

SEQ ID NO: 242252 - RNA, 32 nt, Human
ucugcuccucuccugggccccugcucuuccca

SEQ ID NO: 242253 - RNA, 32 nt, Human
ucugcuccucuccugggccccugcucuucccg

SEQ ID NO: 242254 - RNA, 32 nt, Human
ucugcuccugacacugcuuuucccucugacuc

SEQ ID NO: 242255 - RNA, 32 nt, Human
ucugcuccugagacugagcccagauccccaaa

SEQ ID NO: 242256 - RNA, 32 nt, Human
ucugcuccugggaauggggugggagccacagg

SEQ ID NO: 242257 - RNA, 23 nt, Human
ucugcuccuuuguggaaggcagu

SEQ ID NO: 242258 - RNA, 32 nt, Human
ucugcucggaaaucguccuggcccaacucggc

SEQ ID NO: 242259 - RNA, 23 nt, Human
ucugcucggcgggacuccggcca

SEQ ID NO: 242260 - RNA, 32 nt, Human
ucugcucuaucccgcugaccucauuguugagg

SEQ ID NO: 242261 - RNA, 32 nt, Human
ucugcucuccaaacgcugggggagacugauuu

SEQ ID NO: 242262 - RNA, 32 nt, Human
ucugcucuccccaggauggggucagaggagac

SEQ ID NO: 242263 - RNA, 32 nt, Human
ucugcucuccuccucugugagcucugggcuuc

SEQ ID NO: 242264 - RNA, 32 nt, Human
ucugcucucuggccuccagccucccagcagca

SEQ ID NO: 242265 - RNA, 28 nt, Human
ucugcucucugugaggccucaucuugaa

SEQ ID NO: 242266 - RNA, 32 nt, Human
ucugcucucuucugaaucucaugccuuuggca

SEQ ID NO: 242267 - RNA, 32 nt, Human
ucugcucugacccuucucaggcccgccugaug

SEQ ID NO: 242268 - RNA, 32 nt, Human
ucugcucugagaaacucuggcaaguggacgcc

SEQ ID NO: 242269 - RNA, 32 nt, Human
ucugcucugagaugcauuguuccuaugacuuc

SEQ ID NO: 242270 - RNA, 32 nt, Human
ucugcucugaguaaacaguaauuacuguuuaa

SEQ ID NO: 242271 - RNA, 32 nt, Human
ucugcucugauuacugcucugccuuccauucu

SEQ ID NO: 242272 - RNA, 32 nt, Human
ucugcucugcagggucccucaggcucccuauc

SEQ ID NO: 242273 - RNA, 32 nt, Human
ucugcucugccauccagccccaucuggaugug

SEQ ID NO: 242274 - RNA, 32 nt, Human
ucugcucugcuucuaguucuccaccuccaggu

SEQ ID NO: 242275 - RNA, 32 nt, Human
ucugcucugggaacagcaaaaaucaggauggu

SEQ ID NO: 242276 - RNA, 24 nt, Human
ucugcucugggucaggcgaggcag

SEQ ID NO: 242277 - RNA, 32 nt, Human
ucugcucuggugucuugggaguugugcaggga

SEQ ID NO: 242278 - RNA, 19 nt, Human
ucugcucuguggcucccag

SEQ ID NO: 242279 - RNA, 32 nt, Human
ucugcucuuaaaggagccgcgucccucaggca

SEQ ID NO: 242280 - RNA, 32 nt, Human
ucugcucuuucccuccccauccucuggcagaa

SEQ ID NO: 242281 - RNA, 32 nt, Human
ucugcugaagaaagaagaauagaagaaaauca

SEQ ID NO: 242282 - RNA, 32 nt, Human
ucugcugaagucagaaguuugagaccagccuu

SEQ ID NO: 242283 - RNA, 32 nt, Human
ucugcugaccuggguguggcggagggagaggc

SEQ ID NO: 242284 - RNA, 21 nt, Human
ucugcugacuugcccccagcu

SEQ ID NO: 242285 - RNA, 32 nt, Human
ucugcugacuugcuagucuuagcaggagguug

SEQ ID NO: 242286 - RNA, 32 nt, Human
ucugcugagcacgugucccagccacagaggcc

SEQ ID NO: 242287 - RNA, 32 nt, Human
ucugcugagcuucccccuggaagaacccucuu

SEQ ID NO: 242288 - RNA, 32 nt, Human
ucugcugagcuucugcgcaccccucccuggaa

SEQ ID NO: 242289 - RNA, 32 nt, Human
ucugcugaggcugccaacagaggaugaagagg

SEQ ID NO: 242290 - RNA, 32 nt, Human
ucugcugaucugagucugccugcagcauggac

SEQ ID NO: 242291 - RNA, 32 nt, Human
ucugcugauggucuccacagcuuccccagcga

SEQ ID NO: 242292 - RNA, 32 nt, Human
ucugcugauguguccccaucucuggcagagcc

SEQ ID NO: 242293 - RNA, 32 nt, Human
ucugcugcacacacaggcaccagcagggaugc

SEQ ID NO: 242294 - RNA, 32 nt, Human
ucugcugcacguggcaucugauuaccuguggu

SEQ ID NO: 242295 - RNA, 32 nt, Human
ucugcugcagccgcugguugcaggcagaguuu

SEQ ID NO: 242296 - RNA, 19 nt, Human
ucugcugcaggaggcgugg

SEQ ID NO: 242297 - RNA, 32 nt, Human
ucugcugcagggguaagcucucagggagaacc

SEQ ID NO: 242298 - RNA, 32 nt, Human
ucugcugccaggauggagcagaggagcgccac

SEQ ID NO: 242299 - RNA, 32 nt, Human
ucugcugccaucaucuuccaugggcuuuccag

SEQ ID NO: 242300 - RNA, 32 nt, Human
ucugcugcccaggaguggccaguguucggcgu

SEQ ID NO: 242301 - RNA, 32 nt, Human
ucugcugcccagguuggagugcaguggcacga

SEQ ID NO: 242302 - RNA, 32 nt, Human
ucugcugcccauggggaaacaggcugggagac

SEQ ID NO: 242303 - RNA, 32 nt, Human
ucugcugcccgggcuagagugcagugguggga

SEQ ID NO: 242304 - RNA, 31 nt, Human
ucugcugccggcucugggccugaggguccac

SEQ ID NO: 242305 - RNA, 32 nt, Human
ucugcugccuuggcccccuccagaguuugggu

SEQ ID NO: 242306 - RNA, 32 nt, Human
ucugcugcuacugcugcugccgcugcuuuuga

SEQ ID NO: 242307 - RNA, 32 nt, Human
ucugcugcuaucucuagagcuugcugcuguuc

SEQ ID NO: 242308 - RNA, 32 nt, Human
ucugcugcucaggcuggagugcaguggugcaa

SEQ ID NO: 242309 - RNA, 19 nt, Human
ucugcugcucuggacuggg

SEQ ID NO: 242310 - RNA, 32 nt, Human
ucugcugcuguuuagagaaauugugaaacaag

SEQ ID NO: 242311 - RNA, 32 nt, Human
ucugcugcuuuccccagcuccaaccucucugg

SEQ ID NO: 242312 - RNA, 32 nt, Human
ucugcuggaaggggcagcaggaggaguggaag

SEQ ID NO: 242313 - RNA, 32 nt, Human
ucugcuggacccaagcggcucuccagcccuuc

SEQ ID NO: 242314 - RNA, 32 nt, Human
ucugcuggagaaagcccugcagaggaggucau

SEQ ID NO: 242315 - RNA, 32 nt, Human
ucugcuggagaacuuagcccagagcuagugaa

SEQ ID NO: 242316 - RNA, 32 nt, Human
ucugcuggagagcccaggugggcacagagaag

SEQ ID NO: 242317 - RNA, 32 nt, Human
ucugcuggaggcaccauaucagccugcgggac

SEQ ID NO: 242318 - RNA, 32 nt, Human
ucugcuggagugaaacaggaugcuugauuucu

SEQ ID NO: 242319 - RNA, 32 nt, Human
ucugcuggaguguugcuguugcaccauacuuu

SEQ ID NO: 242320 - RNA, 32 nt, Human
ucugcuggcaucuucaagaggagggagggucc

SEQ ID NO: 242321 - RNA, 32 nt, Human
ucugcuggccucuguguggggagagaucagga

SEQ ID NO: 242322 - RNA, 32 nt, Human
ucuuccguucuggcuccagccagaccuucagu

SEQ ID NO: 242323 - RNA, 32 nt, Human
ucuuccuaaaugaaguuuauuuggaggaacac

SEQ ID NO: 242324 - RNA, 32 nt, Human
ucuuccuacaucuucuucccaguaaguuuccc

SEQ ID NO: 242325 - RNA, 32 nt, Human
ucuuccuacccaucugcuccccagagggcugc

SEQ ID NO: 242326 - RNA, 32 nt, Human
ucuuccuaccucucagccuucucccuccccag

SEQ ID NO: 242327 - RNA, 32 nt, Human
ucuuccuacuuccuccucuccuggaugcucau

SEQ ID NO: 242328 - RNA, 32 nt, Human
ucuuccuaggaacgucugguccuaaccaguga

SEQ ID NO: 242329 - RNA, 32 nt, Human
ucuuccuaguuuucuccucccaggaacugggc

SEQ ID NO: 242330 - RNA, 32 nt, Human
ucuuccuaugugucagaaacaacugugucuug

SEQ ID NO: 242331 - RNA, 32 nt, Human
ucuuccucaacacacauacaugcacaacacau

SEQ ID NO: 242332 - RNA, 17 nt, Human
ucuuccucacaccacaa

SEQ ID NO: 242333 - RNA, 32 nt, Human
ucuuccucaccaaugacauucuuuucuuuucu

SEQ ID NO: 242334 - RNA, 32 nt, Human
ucuuccucagcagccuggcaggcaggaaacag

SEQ ID NO: 242335 - RNA, 23 nt, Human
ucuuccucaucccuaggguguug

SEQ ID NO: 242336 - RNA, 32 nt, Human
ucuuccucaucuuccuccucuuccuucuuuuu

SEQ ID NO: 242337 - RNA, 32 nt, Human
ucuuccucauuuccucugccccuuaaaagauu

SEQ ID NO: 242338 - RNA, 32 nt, Human
ucuuccucauuuccuucuuuuauuccucccca

SEQ ID NO: 242339 - RNA, 32 nt, Human
ucuuccuccaaggcuggagugcagugacgcga

SEQ ID NO: 242340 - RNA, 32 nt, Human
ucuuccuccaauaaugggcacuucagaaggcc

SEQ ID NO: 242341 - RNA, 32 nt, Human
ucuuccuccagcugcaccagagcaaccucuca

SEQ ID NO: 242342 - RNA, 32 nt, Human
ucuuccuccccuuccuccuccagagccugcuc

SEQ ID NO: 242343 - RNA, 32 nt, Human
ucuuccucccucauuccaccuucccaugcccu

SEQ ID NO: 242344 - RNA, 32 nt, Human
ucuuccucccucccucccuuccucuuacucuc

SEQ ID NO: 242345 - RNA, 32 nt, Human
ucuuccucccuuccucccuuucuuaccacaga

SEQ ID NO: 242346 - RNA, 32 nt, Human
ucuuccuccucagagcugucauggacaauugg

SEQ ID NO: 242347 - RNA, 32 nt, Human
ucuuccuccucccaaggcauucucccagcucu

SEQ ID NO: 242348 - RNA, 32 nt, Human
ucuuccuccuccuccuccucucuaggcacccc

SEQ ID NO: 242349 - RNA, 32 nt, Human
ucuuccuccucuacagaaagagcugcugucca

SEQ ID NO: 242350 - RNA, 32 nt, Human
ucuuccuccucuuccuccuccuccucuuccuc

SEQ ID NO: 242351 - RNA, 32 nt, Human
ucuuccuccucuuccuccuccucuuguuccuc

SEQ ID NO: 242352 - RNA, 32 nt, Human
ucuuccuccucuuccuccuccuggugggugcc

SEQ ID NO: 242353 - RNA, 32 nt, Human
ucuuccuccucuuccuucuccuccuccauccc

SEQ ID NO: 242354 - RNA, 32 nt, Human
ucuuccuccucuuccuucuuuuucuugcuuuu

SEQ ID NO: 242355 - RNA, 32 nt, Human
ucuuccuccugcugcuaucauauuguccauag

SEQ ID NO: 242356 - RNA, 32 nt, Human
ucuuccucuacagaaggugcuucugacggcga

SEQ ID NO: 242357 - RNA, 32 nt, Human
ucuuccucuagucgccagcucaucagaaaaac

SEQ ID NO: 242358 - RNA, 32 nt, Human
ucuuccucucccuccuccuuuuccccucuccc

SEQ ID NO: 242359 - RNA, 32 nt, Human
ucuuccucuccucucuuuaagcuucacccucu

SEQ ID NO: 242360 - RNA, 32 nt, Human
ucuuccucuccugggccguccucugagcagca

SEQ ID NO: 242361 - RNA, 32 nt, Human
ucuuccucucuaguguauaacuuuaaauauuu

SEQ ID NO: 242362 - RNA, 32 nt, Human
ucuuccucucuccuuccuuuccuuccuuuuuc

SEQ ID NO: 242363 - RNA, 32 nt, Human
ucuuccucugacuuuguaucccuuaauaccua

SEQ ID NO: 242364 - RNA, 32 nt, Human
ucuuccucugcaggacacagaucuggaggacg

SEQ ID NO: 242365 - RNA, 21 nt, Human
ucuuccucugccccugcucug

SEQ ID NO: 242366 - RNA, 32 nt, Human
ucuuccucugccgggaggguguuuucaacucc

SEQ ID NO: 242367 - RNA, 32 nt, Human
ucuuccucuucucacccuccucccuccccuua

SEQ ID NO: 242368 - RNA, 32 nt, Human
ucuuccucuucuucuucuuccuccuccuccuc

SEQ ID NO: 242369 - RNA, 32 nt, Human
ucuuccucuugggaacaucccuccacuccgca

SEQ ID NO: 242370 - RNA, 32 nt, Human
ucuuccucuuucaagaccccuacccauuuugc

SEQ ID NO: 242371 - RNA, 32 nt, Human
ucuuccucuuucuccggccauguaagauaugc

SEQ ID NO: 242372 - RNA, 32 nt, Human
ucuuccucuuuugcuuccucccccucccccgc

SEQ ID NO: 242373 - RNA, 32 nt, Human
ucuuccugaacaagacuuucaauaggggccag

SEQ ID NO: 242374 - RNA, 32 nt, Human
ucuuccugacagcagaaugacugugugaccuu

SEQ ID NO: 242375 - RNA, 32 nt, Human
ucuuccugagauauccucagguuuucucagcc

SEQ ID NO: 242376 - RNA, 32 nt, Human
ucuuccugaggcagaaaauuggauuacuaagg

SEQ ID NO: 242377 - RNA, 32 nt, Human
ucuuccugagggcagagcucuuaccgcccacu

SEQ ID NO: 242378 - RNA, 32 nt, Human
ucuuccugauccugggaaggccuggaugacca

SEQ ID NO: 242379 - RNA, 32 nt, Human
ucuuccugcaagaccugcagaguguaugacac

SEQ ID NO: 242380 - RNA, 32 nt, Human
ucuuccugcacagcuuugccuucccagggauc

SEQ ID NO: 242381 - RNA, 32 nt, Human
ucuuccugcagaggccucuuucugccuccaug

SEQ ID NO: 242382 - RNA, 32 nt, Human
ucuuccugcagaggcuccuuucugccuccaug

SEQ ID NO: 242383 - RNA, 32 nt, Human
ucuuccugcagguauuuuccaucugcugugcc

SEQ ID NO: 242384 - RNA, 16 nt, Human
ucuuccugccagcugg

SEQ ID NO: 242385 - RNA, 32 nt, Human
ucuuccugccaucaaauauuuuuaguagaaaa

SEQ ID NO: 242386 - RNA, 32 nt, Human
ucuuccugccaucauuccuccuuuucccacag

SEQ ID NO: 242387 - RNA, 32 nt, Human
ucuuccugcccaggccucucccaccaccaccu

SEQ ID NO: 242388 - RNA, 32 nt, Human
ucuuccugccccgcuuuccucucccauccuca

SEQ ID NO: 242389 - RNA, 32 nt, Human
ucuuccugcccugcucuccuccagaggaugaa

SEQ ID NO: 242390 - RNA, 18 nt, Human
ucuuccugccucucccca

SEQ ID NO: 242391 - RNA, 32 nt, Human
ucuuccugccuuuaccccaccugggcccaguu

SEQ ID NO: 242392 - RNA, 21 nt, Human
ucuuccugcugcagggugcug

SEQ ID NO: 242393 - RNA, 20 nt, Human
ucuuccugcugggcucccag

SEQ ID NO: 242394 - RNA, 30 nt, Human
ucuuccugcuucuccaugcucuugauuugg

SEQ ID NO: 242395 - RNA, 32 nt, Human
ucuuccugcuuuguccagaacacauugaccaa

SEQ ID NO: 242396 - RNA, 32 nt, Human
ucuuccuggaagcagagcuggggagggagagc

SEQ ID NO: 242397 - RNA, 23 nt, Human
ucuuccuggaccugggcauucag

SEQ ID NO: 242398 - RNA, 32 nt, Human
ucuuccuggagaaggcacccuucauggaagac

SEQ ID NO: 242399 - RNA, 32 nt, Human
ucuuccuggagacaccgccauggccgggcuau

SEQ ID NO: 242400 - RNA, 32 nt, Human
ucuuccuggaucaucucuccccaucacuugcc

SEQ ID NO: 242401 - RNA, 32 nt, Human
ucuuccuggcagaucuguggccuucccugcuc

SEQ ID NO: 242402 - RNA, 32 nt, Human
ucuuccuggccucuggaaccagccugugugcc

SEQ ID NO: 242403 - RNA, 32 nt, Human
ucuuccugggcccucauugcugcuuaucguac

SEQ ID NO: 242404 - RNA, 32 nt, Human
ucuuccugguugggcccugcccugagcugcca

SEQ ID NO: 242405 - RNA, 32 nt, Human
ucuuccuguaaacccagauggcgucauacaga

SEQ ID NO: 242406 - RNA, 32 nt, Human
ucuuccuguaggugugggacgugcgugcggcg

SEQ ID NO: 242407 - RNA, 32 nt, Human
ucuuccuguccaucucuccaucugucugucca

SEQ ID NO: 242408 - RNA, 32 nt, Human
ucuuccugugugagccaccacacccagccugg

SEQ ID NO: 242409 - RNA, 32 nt, Human
ucuuccuguuacauuucaugcaucagaagcau

SEQ ID NO: 242410 - RNA, 29 nt, Human
ucuuccuguuuaugugugccaagggagua

SEQ ID NO: 242411 - RNA, 32 nt, Human
ucuuccuuacccuuucuguugccagucagcaa

SEQ ID NO: 242412 - RNA, 32 nt, Human
ucuuccuucacucacugcccgggcgggagcgg

SEQ ID NO: 242413 - RNA, 32 nt, Human
ucuuccuuccacacccuucacucaccaucuuu

SEQ ID NO: 242414 - RNA, 32 nt, Human
ucuuccuuccacccuguggccugcacuugagc

SEQ ID NO: 242415 - RNA, 32 nt, Human
ucuuccuuccccucucauucucccucuaaugu

SEQ ID NO: 242416 - RNA, 32 nt, Human
ucuuccuuccuuucuuucuuccuuccuuucuu

SEQ ID NO: 242417 - RNA, 32 nt, Human
ucuuccuucucccgaggccuuauucccccuuc

SEQ ID NO: 242418 - RNA, 32 nt, Human
ucuuccuucucccucgcuucccuccuccucuu

SEQ ID NO: 242419 - RNA, 32 nt, Human
ucuuccuugaucagccuuuacaguaaaaugac

SEQ ID NO: 242420 - RNA, 32 nt, Human
ucuuccuugcagaguaguguuagaauagaugg

SEQ ID NO: 242421 - RNA, 32 nt, Human
ucuuccuugccuggacugccuuugacaaggca

SEQ ID NO: 242422 - RNA, 32 nt, Human
ucuuccuugcugucucuggauauugucacaug

SEQ ID NO: 242423 - RNA, 32 nt, Human
ucuuccuugguuuuguucucuuggcuugaugu

SEQ ID NO: 242424 - RNA, 32 nt, Human
ucuuccuuguucaccacuauauuaccagaaca

SEQ ID NO: 242425 - RNA, 32 nt, Human
ucuuccuuuauccccuccuuuaccccacauau

SEQ ID NO: 242426 - RNA, 32 nt, Human
ucuuccuuuccuccuccaccugccuauugcag

SEQ ID NO: 242427 - RNA, 23 nt, Human
ucuuccuuugcuucaggcagcug

SEQ ID NO: 242428 - RNA, 32 nt, Human
ucuuccuuugucuuauugaauucaaguaccuu

SEQ ID NO: 242429 - RNA, 32 nt, Human
ucuuccuuugugcuggggccaggcgaguggag

SEQ ID NO: 242430 - RNA, 32 nt, Human
ucuuccuuuguucuaaaacuuagacugacauc

SEQ ID NO: 242431 - RNA, 32 nt, Human
ucuuccuuuuacccucucuugucuugccuuuu

SEQ ID NO: 242432 - RNA, 32 nt, Human
ucuuccuuuuguugggaggugagcacauuuac

SEQ ID NO: 242433 - RNA, 32 nt, Human
ucuucgaacuccugagauucuuacuguaaauu

SEQ ID NO: 242434 - RNA, 32 nt, Human
ucuucgaaugugucagaucaguauuuaacacg

SEQ ID NO: 242435 - RNA, 32 nt, Human
ucuucgagaguauagaaccguucauucuugcu

SEQ ID NO: 242436 - RNA, 32 nt, Human
ucuucgccuccuuuauuuaauucauguuauuu

SEQ ID NO: 242437 - RNA, 32 nt, Human
ucuucgccugcacuuuuucuuccccaggagau

SEQ ID NO: 242438 - RNA, 32 nt, Human
ucuucgccuuaaauucgggugucuuuuaugaa

SEQ ID NO: 242439 - RNA, 32 nt, Human
ucuucgccuuucccacccuccugccccacacu

SEQ ID NO: 242440 - RNA, 32 nt, Human
ucuucgccuuucuucuccgcuucuaccccguc

SEQ ID NO: 242441 - RNA, 32 nt, Human
ucuucgcggcuguggaggcgcaggccgggcgu

SEQ ID NO: 242442 - RNA, 32 nt, Human
ucuucgcucacuucaaccucugccuucugggu

SEQ ID NO: 242443 - RNA, 32 nt, Human
ucuucgcugaaaucuaaaauauacuauaacaa

SEQ ID NO: 242444 - RNA, 21 nt, Human
ucuucgcugcagcgucagcca

SEQ ID NO: 242445 - RNA, 26 nt, Human
ucuucggaaaacauuuuaucaaacca

SEQ ID NO: 242446 - RNA, 32 nt, Human
ucuucggacugugagcccugaugccuuuuugc

SEQ ID NO: 242447 - RNA, 32 nt, Human
ucuucggagagggcgcgggggccggggccaaa

SEQ ID NO: 242448 - RNA, 32 nt, Human
ucuucggaggagaagaggggcggagucacggc

SEQ ID NO: 242449 - RNA, 32 nt, Human
ucuucggccagcaccucugcccuccagaaccu

SEQ ID NO: 242450 - RNA, 32 nt, Human
ucuucggcccucuccugucgccgccaugagca

SEQ ID NO: 242451 - RNA, 32 nt, Human
ucuucgggaccuggcuucauuuggaguucagc

SEQ ID NO: 242452 - RNA, 32 nt, Human
ucuucgggaggcagaauugaagugaacaugaa

SEQ ID NO: 242453 - RNA, 32 nt, Human
ucuucggugaaauauuuauaugcauaaauggc

SEQ ID NO: 242454 - RNA, 32 nt, Human
ucuucgguggccagguaugucccuuaccuggg

SEQ ID NO: 242455 - RNA, 32 nt, Human
ucuucgguuuugugcuugugcugguaugauuu

SEQ ID NO: 242456 - RNA, 32 nt, Human
ucuucguauggauacuccuguucugcauccca

SEQ ID NO: 242457 - RNA, 32 nt, Human
ucuucgucccacgucagcaggaaguaguuaca

SEQ ID NO: 242458 - RNA, 32 nt, Human
ucuucguccugaucccuccacccccauguggc

SEQ ID NO: 242459 - RNA, 32 nt, Human
ucuucgucgguggcagaggugggcgugggugc

SEQ ID NO: 242460 - RNA, 32 nt, Human
ucuucgucucucaggauggcgaguagcagcgg

SEQ ID NO: 242461 - RNA, 32 nt, Human
ucuucgucugcaucagggugaccucuggaagg

SEQ ID NO: 242462 - RNA, 32 nt, Human
ucuucgucugcccugcuuuucucccuccccuu

SEQ ID NO: 242463 - RNA, 32 nt, Human
ucuucgucuucacucuuaggcacuuugggggu

SEQ ID NO: 242464 - RNA, 32 nt, Human
ucuucgucuuccuccucuuccuccuccuccuc

SEQ ID NO: 242465 - RNA, 24 nt, Human
ucuucguggcgcucucggggccug

SEQ ID NO: 242466 - RNA, 31 nt, Human
ucuucguucgucuccuugccugugucugcua

SEQ ID NO: 242467 - RNA, 32 nt, Human
ucuucguuucaggucagaacagccuggggucu

SEQ ID NO: 242468 - RNA, 32 nt, Human
ucuucguuuucuuccuccguauugauuuucuc

SEQ ID NO: 242469 - RNA, 32 nt, Human
ucuucuaaaauacuucacucacauuguaauuc

SEQ ID NO: 242470 - RNA, 32 nt, Human
ucuucuaacuccaagccgaguguacucuccag

SEQ ID NO: 242471 - RNA, 32 nt, Human
ucuucuaacugaucuaggauggggacgcaccc

SEQ ID NO: 242472 - RNA, 32 nt, Human
ucuucuaaucuccucccugccugcugagagag

SEQ ID NO: 242473 - RNA, 21 nt, Human
ucuucuaccccuucagugucu

SEQ ID NO: 242474 - RNA, 32 nt, Human
ucuucuacccuuuagcagguaaugacucaguu

SEQ ID NO: 242475 - RNA, 19 nt, Human
ucuucuaccugugaugcuu

SEQ ID NO: 242476 - RNA, 32 nt, Human
ucuucuagaagagagaaggaggaaaagaagca

SEQ ID NO: 242477 - RNA, 32 nt, Human
ucuucuagcuacuuacuucauucuccaugggu

SEQ ID NO: 242478 - RNA, 32 nt, Human
ucuucuagcuauuuauccauuguuggauacuu

SEQ ID NO: 242479 - RNA, 32 nt, Human
ucuucuagcugaagccaaccucccaggaaaag

SEQ ID NO: 242480 - RNA, 32 nt, Human
ucuucuagcugcuuccucaaccccuguccccu

SEQ ID NO: 242481 - RNA, 32 nt, Human
ucuucuagcuuuguuguccucccaggaaccaa

SEQ ID NO: 242482 - RNA, 32 nt, Human
ucuucuagguaaagcugagaucacaggaacag

SEQ ID NO: 242483 - RNA, 32 nt, Human
ucuucuagguauuccccacacauuauuugugg

SEQ ID NO: 242484 - RNA, 32 nt, Human
ucuucuaucugugguugcuguuuuuggaguaa

SEQ ID NO: 242485 - RNA, 32 nt, Human
ucuucuaugccacccuacagauucuauuuuaa

SEQ ID NO: 242486 - RNA, 32 nt, Human
ucuucuauggcagaagguuuuggggaauaaau

SEQ ID NO: 242487 - RNA, 32 nt, Human
ucuucuauugcucuccucuguccaccguucca

SEQ ID NO: 242488 - RNA, 32 nt, Human
ucuucuauuguguggcuuucugaguauuugaa

SEQ ID NO: 242489 - RNA, 23 nt, Human
ucuucuauuuauuaauuugcaga

SEQ ID NO: 242490 - RNA, 32 nt, Human
ucuucucaaacccugagcgggcugccggccuc

SEQ ID NO: 242491 - RNA, 32 nt, Human
ucuucucaagcagagugugguuaucuccugua

SEQ ID NO: 242492 - RNA, 32 nt, Human
ucuucucacagucaaaaggaacugggugguuu

SEQ ID NO: 242493 - RNA, 32 nt, Human
ucuucucacauggugcccagucaccaauauuu

SEQ ID NO: 242494 - RNA, 32 nt, Human
ucuucucacccaggcuggaaugcaguggcaca

SEQ ID NO: 242495 - RNA, 32 nt, Human
ucuucucaccccuuggcuucugagcaaggcuc

SEQ ID NO: 242496 - RNA, 23 nt, Human
ucuucucaccucuuuccuaguca

SEQ ID NO: 242497 - RNA, 32 nt, Human
ucuucucacuacugcacuugacuagucuuaaa

SEQ ID NO: 242498 - RNA, 32 nt, Human
ucuucucagaaacacuccuucaauauuauauu

SEQ ID NO: 242499 - RNA, 32 nt, Human
ucuucucagagcagcacugggguuugggggcu

SEQ ID NO: 242500 - RNA, 32 nt, Human
ucuucucaggcaccccucuuccccagcugucc

SEQ ID NO: 242501 - RNA, 32 nt, Human
ucuucucagggcacugcacuggaacacugggu

SEQ ID NO: 242502 - RNA, 31 nt, Human
ucuucucaguuucagcacuuugugaucauau

SEQ ID NO: 242503 - RNA, 31 nt, Human
ucuucucaguuucagggccuuugcagccucu

SEQ ID NO: 242504 - RNA, 22 nt, Human
ucuucucaguuuucucauuuua

SEQ ID NO: 242505 - RNA, 32 nt, Human
ucuucucaucaggagccaggagagagggggac

SEQ ID NO: 242506 - RNA, 32 nt, Human
ucuucucaucccuaggacaagcauagugccug

SEQ ID NO: 242507 - RNA, 32 nt, Human
ucuucucaucuggccccaccucuaaggagucc

SEQ ID NO: 242508 - RNA, 30 nt, Human
ucuucucauucagcuaaauucacauuugcc

SEQ ID NO: 242509 - RNA, 32 nt, Human
ucuucuccaagaaacucaaccacuagugacaa

SEQ ID NO: 242510 - RNA, 32 nt, Human
ucuucuccaagguguugaggugagcugggguu

SEQ ID NO: 242511 - RNA, 32 nt, Human
ucuucuccacauaccaccucccaucagaaauc

SEQ ID NO: 242512 - RNA, 32 nt, Human
ucuucuccacaucugcucguucuugccgaggg

SEQ ID NO: 242513 - RNA, 32 nt, Human
ucuucuccagaaggcaauaccaaccugaaagu

SEQ ID NO: 242514 - RNA, 32 nt, Human
ucuucuccagggccucauucagucucagacca

SEQ ID NO: 242515 - RNA, 32 nt, Human
ucuucuccauuuucaauuuuucccuucuuucc

SEQ ID NO: 242516 - RNA, 32 nt, Human
ucuucucccagaggauccuggagcugcaggac

SEQ ID NO: 242517 - RNA, 32 nt, Human
ucuucuccccguguaggggagccccagcaugg

SEQ ID NO: 242518 - RNA, 32 nt, Human
ucuucucccuacuuucagauguuuucagccca

SEQ ID NO: 242519 - RNA, 32 nt, Human
ucuucucccuuagggaggcucuugaaggagca

SEQ ID NO: 242520 - RNA, 32 nt, Human
ucuucuccucaacaucugaaucaugccaugug

SEQ ID NO: 242521 - RNA, 32 nt, Human
ucuucuccucacccaguuuggccaacagcauc

SEQ ID NO: 242522 - RNA, 32 nt, Human
ucuucuccuccacugcucacaggaggcccgug

SEQ ID NO: 242523 - RNA, 32 nt, Human
ucuucuccuccaugccaagaccugccagacac

SEQ ID NO: 242524 - RNA, 32 nt, Human
ucuucuccuccuccuccuuccuuccuccuccu

SEQ ID NO: 242525 - RNA, 32 nt, Human
ucuucuccucuguggccugggagaccucugcc

SEQ ID NO: 242526 - RNA, 32 nt, Human
ucuucuccuuccccaucucacuccaccccacu

SEQ ID NO: 242527 - RNA, 32 nt, Human
ucuucuccuuuucucuuccugagaaguucucc

SEQ ID NO: 242528 - RNA, 32 nt, Human
ucuucucgaggcgguggugggaagggagacau

SEQ ID NO: 242529 - RNA, 32 nt, Human
ucuucucgcccuucucacccucccuacccagc

SEQ ID NO: 242530 - RNA, 32 nt, Human
ucuucucuaccgaacuucccaggauuucaucu

SEQ ID NO: 242531 - RNA, 21 nt, Human
ucuucucucaaagggaagcug

SEQ ID NO: 242532 - RNA, 32 nt, Human
ucuucucucaaggagcacaguccugggaaagg

SEQ ID NO: 242533 - RNA, 32 nt, Human
ucuucucucacuauccguuucugacaaaugaa

SEQ ID NO: 242534 - RNA, 22 nt, Human
ucuucucucagaaguucagcug

SEQ ID NO: 242535 - RNA, 24 nt, Human
ucuucucucaggcaagaaaggcug

SEQ ID NO: 242536 - RNA, 32 nt, Human
ucuucucucaggcaagaaaggcugcaggcugc

SEQ ID NO: 242537 - RNA, 32 nt, Human
ucuucucuccaaugauacuaccaagucuuagu

SEQ ID NO: 242538 - RNA, 32 nt, Human
ucuucucucccaggaaggacuugcugggcucu

SEQ ID NO: 242539 - RNA, 32 nt, Human
ucuucucucccaggcucuggcucaugcacaug

SEQ ID NO: 242540 - RNA, 32 nt, Human
ucuucucuccccuaaagcaucucaguuuccag

SEQ ID NO: 242541 - RNA, 32 nt, Human
ucuucucuccuuggccucacucugcagugggg

SEQ ID NO: 242542 - RNA, 32 nt, Human
ucuucucucugccucgucccaccuugcugucu

SEQ ID NO: 242543 - RNA, 32 nt, Human
ucuucucugcuccccuugcccacugggacucc

SEQ ID NO: 242544 - RNA, 32 nt, Human
ucuucucugcugguucccaggcugcugcuccg

SEQ ID NO: 242545 - RNA, 32 nt, Human
ucuucucuggaggucaaugguggagggagaug

SEQ ID NO: 242546 - RNA, 32 nt, Human
ucuucucugugguucuagccuugggcagaauu

SEQ ID NO: 242547 - RNA, 32 nt, Human
ucuucucuuauccucucucucuucuaggccca

SEQ ID NO: 242548 - RNA, 32 nt, Human
ucuucucuuccuccuccacuucugugcccgcg

SEQ ID NO: 242549 - RNA, 32 nt, Human
ucuucucuuccucucaggcuaggcuuucuuac

SEQ ID NO: 242550 - RNA, 32 nt, Human
ucuucucuucggggaagcacaaggcagauguu

SEQ ID NO: 242551 - RNA, 32 nt, Human
ucuucucuucuccuccuccucuuucuucacuc

SEQ ID NO: 242552 - RNA, 32 nt, Human
ucuucucuucuguccccaccuccucuugggaa

SEQ ID NO: 242553 - RNA, 21 nt, Human
ucuucucuuguaaagaagcug

SEQ ID NO: 242554 - RNA, 32 nt, Human
ucuucucuuguccuaucucauuccagcccaca

SEQ ID NO: 242555 - RNA, 32 nt, Human
ucuucucuuucucuuggucaacucaggagccu

SEQ ID NO: 242556 - RNA, 32 nt, Human
ucuucugaacaacuuaggagaaacuuuugauc

SEQ ID NO: 242557 - RNA, 32 nt, Human
ucuucugaccggcaguggcucuggaagcaguc

SEQ ID NO: 242558 - RNA, 32 nt, Human
ucuucugacuccaagcucugggguuuugccau

SEQ ID NO: 242559 - RNA, 32 nt, Human
ucuucugagauguccucugccuuccagguauu

SEQ ID NO: 242560 - RNA, 32 nt, Human
ucuucugagcauuccaaaauaucugcuuagaa

SEQ ID NO: 242561 - RNA, 32 nt, Human
ucuucugaggagcuuaauguguuuuugcaacu

SEQ ID NO: 242562 - RNA, 32 nt, Human
ucuucugaggcagaggcuggagcaguucuuuu

SEQ ID NO: 242563 - RNA, 32 nt, Human
ucuucugaguagcugggacuacaggcaugcau

SEQ ID NO: 242564 - RNA, 32 nt, Human
ucuucugauggaagacauuaagaguggaugca

SEQ ID NO: 242565 - RNA, 32 nt, Human
ucuucugcaacucccauucaugcccaccaggc

SEQ ID NO: 242566 - RNA, 31 nt, Human
ucuucugcaauuuucugauuggagauugcau

SEQ ID NO: 242567 - RNA, 32 nt, Human
ucuucugcacacauaucacacaucaguacugu

SEQ ID NO: 242568 - RNA, 32 nt, Human
ucuucugcacuuccaagcucuuucacacucag

SEQ ID NO: 242569 - RNA, 29 nt, Human
ucuucugcagacaccuagcugcccucaga

SEQ ID NO: 242570 - RNA, 32 nt, Human
ucuucugcagccaccugcuuuccagagagaug

SEQ ID NO: 242571 - RNA, 32 nt, Human
ucuucugcagccugcugaccucguggcccccu

SEQ ID NO: 242572 - RNA, 24 nt, Human
ucuucugcagcuccuggugcugcu

SEQ ID NO: 242573 - RNA, 32 nt, Human
ucuucugcagucuuaaaagaccuagucccuaa

SEQ ID NO: 242574 - RNA, 32 nt, Human
ucuucugcagugaguauggcccgaugcuuucu

SEQ ID NO: 242575 - RNA, 32 nt, Human
ucuucugcauguuuuuaugcacugccaauuag

SEQ ID NO: 242576 - RNA, 32 nt, Human
ucuucugcauucugggaacaugcggcuuccug

SEQ ID NO: 242577 - RNA, 32 nt, Human
ucuucugccaaggucaccagcaccccagaugg

SEQ ID NO: 242578 - RNA, 32 nt, Human
ucuucugccacuccucccugcuugcaucucgu

SEQ ID NO: 242579 - RNA, 32 nt, Human
ucuucugccagccauggauuccaggcuauaua

SEQ ID NO: 242580 - RNA, 20 nt, Human
ucuucugcccccagugcccu

SEQ ID NO: 242581 - RNA, 32 nt, Human
ucuucugccccuccuccuuuucuguccuuggc

SEQ ID NO: 242582 - RNA, 32 nt, Human
ucuucugccccuucaacugcaggcuggaaaau

SEQ ID NO: 242583 - RNA, 24 nt, Human
ucuucugccgcuccuggugcugcu

SEQ ID NO: 242584 - RNA, 20 nt, Human
ucuucugccucagccuucca

SEQ ID NO: 242585 - RNA, 23 nt, Human
ucuucugcggcucucggugcccu

SEQ ID NO: 242586 - RNA, 32 nt, Human
ucuucugcgggcccacucacacaucugccugc

SEQ ID NO: 242587 - RNA, 32 nt, Human
ucuucugcuacuuuagaagagucacagagaaa

SEQ ID NO: 242588 - RNA, 32 nt, Human
ucuucugcuagugcccugccccugucucugcc

SEQ ID NO: 242589 - RNA, 32 nt, Human
ucuucugcucuuccucaacuaccaaagaaaaa

SEQ ID NO: 242590 - RNA, 32 nt, Human
ucuucugcucuuucuucuuccacacaugcaag

SEQ ID NO: 242591 - RNA, 32 nt, Human
ucuucugcugugcgcucagcuuccgacgggag

SEQ ID NO: 242592 - RNA, 32 nt, Human
ucuucugcuugaggaacugacugugaagcgac

SEQ ID NO: 242593 - RNA, 32 nt, Human
ucuucuggaaaaucauggauuuucauauuucu

SEQ ID NO: 242594 - RNA, 32 nt, Human
ucuucuggacucuucucucaggcaagaaaggc

SEQ ID NO: 242595 - RNA, 32 nt, Human
ucuucuggagaaaaaggugccaucucaggaga

SEQ ID NO: 242596 - RNA, 32 nt, Human
ucuucuggagcaggaagcaaauguccuggaau

SEQ ID NO: 242597 - RNA, 32 nt, Human
ucuucuggaggaagacuggacaaaggggguca

SEQ ID NO: 242598 - RNA, 32 nt, Human
ucuucuggagugacucaaaugcagaggaagcc

SEQ ID NO: 242599 - RNA, 32 nt, Human
ucuucuggaucugccuauguuuuccuuucuca

SEQ ID NO: 242600 - RNA, 32 nt, Human
ucuucuggcaaaaacugccagaauaaaacagc

SEQ ID NO: 242601 - RNA, 32 nt, Human
ucuucuggccagggccugugcugcagucgggg

SEQ ID NO: 242602 - RNA, 32 nt, Human
ucuucuggccuaaaugaauauuuaugugcaaa

SEQ ID NO: 242603 - RNA, 32 nt, Human
ucuucuggcuccucgaggguagacccugaccc

SEQ ID NO: 242604 - RNA, 21 nt, Human
ucuucuggcugggcgcagugg

SEQ ID NO: 242605 - RNA, 32 nt, Human
ucuucuggcuuuucagcuguucuuuguagucc

SEQ ID NO: 242606 - RNA, 32 nt, Human
ucuucuggggaccccagaggugucugugcuga

SEQ ID NO: 242607 - RNA, 32 nt, Human
ucuucuggggccacccuccagccuggggcauc

SEQ ID NO: 242608 - RNA, 32 nt, Human
ucuucuggguuaggccuugccuaggcauagcc

SEQ ID NO: 242609 - RNA, 32 nt, Human
ucuucuggugcaaacaguugcuuguggacuua

SEQ ID NO: 242610 - RNA, 32 nt, Human
ucuucugguugcaggugcaaagugacuuuguu

SEQ ID NO: 242611 - RNA, 32 nt, Human
ucuucuguaaagaugucuaggacgaaauauuu

SEQ ID NO: 242612 - RNA, 32 nt, Human
ucuucuguaggugagagaaaauaaguaagucu

SEQ ID NO: 242613 - RNA, 32 nt, Human
ucuucuguaguggaugugaaauuuccuuuagu

SEQ ID NO: 242614 - RNA, 32 nt, Human
ucuucugucaccuaggcuggaguguagugaca

SEQ ID NO: 242615 - RNA, 32 nt, Human
ucuucuguccaaggaacaucaucugaggaucg

SEQ ID NO: 242616 - RNA, 32 nt, Human
ucuucugucuucauuuuggccccagcauucuu

SEQ ID NO: 242617 - RNA, 32 nt, Human
ucuucuguuagugccaugcgaguccugaacac

SEQ ID NO: 242618 - RNA, 32 nt, Human
ucuucuguuaucuuugacauguaacauccuuu

SEQ ID NO: 242619 - RNA, 32 nt, Human
ucuucuuacuggcacaguuggcaccagucagu

SEQ ID NO: 242620 - RNA, 32 nt, Human
ucuucuuagcagcucaucagcuuauaaacuac

SEQ ID NO: 242621 - RNA, 32 nt, Human
ucuucuuagcgccuacccucauaccuaucucc

SEQ ID NO: 242622 - RNA, 32 nt, Human
ucuucuuauucccauucccauucuggaauccu

SEQ ID NO: 242623 - RNA, 32 nt, Human
ucuucuucaccuuugcauccucauagcuuagc

SEQ ID NO: 242624 - RNA, 32 nt, Human
ucuucuucagagaggcaggagggcgguccgaa

SEQ ID NO: 242625 - RNA, 32 nt, Human
ucuucuucagccacugcucuuuggccucuuac

SEQ ID NO: 242626 - RNA, 32 nt, Human
ucuucuucauauucuaaaaccauuccauuucc

SEQ ID NO: 242627 - RNA, 32 nt, Human
ucuucuucauuaauucuccaucuagucuugug

SEQ ID NO: 242628 - RNA, 32 nt, Human
ucuucuuccacacuaggcugggcccagcaaua

SEQ ID NO: 242629 - RNA, 32 nt, Human
ucuucuuccauucagugacauccacagauuau

SEQ ID NO: 242630 - RNA, 32 nt, Human
ucuucuuccccaauaccuggcucuaacccagc

SEQ ID NO: 242631 - RNA, 32 nt, Human
ucuucuucccgcaccuucuucucccccgcagu

SEQ ID NO: 242632 - RNA, 32 nt, Human
ucuucuucccuaucuccauccaaggcagauuu

SEQ ID NO: 242633 - RNA, 32 nt, Human
ucuucuucccuugaguaacucgccuucuguau

SEQ ID NO: 242634 - RNA, 22 nt, Human
ucuucuuccguaccacuugaca

SEQ ID NO: 242635 - RNA, 32 nt, Human
ucuucuuccuucugucccuccugccuuccuuc

SEQ ID NO: 242636 - RNA, 32 nt, Human
ucuucuucuccucuccggcuucgcgcggcccu

SEQ ID NO: 242637 - RNA, 32 nt, Human
ucuucuucuccucuucuucucucucuugccuc

SEQ ID NO: 242638 - RNA, 32 nt, Human
ucuucuucuggcccuugaggcaggucuggaga

SEQ ID NO: 242639 - RNA, 32 nt, Human
ucuucuucuuccucaccuccuucuaccccacc

SEQ ID NO: 242640 - RNA, 32 nt, Human
ucuucuucuucuuccuccuccuccuccucuuu

SEQ ID NO: 242641 - RNA, 32 nt, Human
ucuucuugaacccuuggugcacagauccauau

SEQ ID NO: 242642 - RNA, 32 nt, Human
ucuucuugaauccauugcagauugacuuccac

SEQ ID NO: 242643 - RNA, 32 nt, Human
ucuucuugacccuucucuuuaaaggguaaaau

SEQ ID NO: 242644 - RNA, 32 nt, Human
ucuucuugaggugggguggagguggggagcaa

SEQ ID NO: 242645 - RNA, 32 nt, Human
ucuucuugcuaucuccuauaccaauaaauacg

SEQ ID NO: 242646 - RNA, 32 nt, Human
ucuucuugcuccucauccuauuuccuuugucu

SEQ ID NO: 242647 - RNA, 32 nt, Human
ucuucuugcugcagccugccccuagacaugga

SEQ ID NO: 242648 - RNA, 32 nt, Human
ucuucuuggagcuguaggucuugaagcagcaa

SEQ ID NO: 242649 - RNA, 32 nt, Human
ucuucuuggaggacaggaggagaggcgaaggc

SEQ ID NO: 242650 - RNA, 32 nt, Human
ucuucuuggcauccuucuuaugcuacuucucc

SEQ ID NO: 242651 - RNA, 32 nt, Human
ucuucuuggcugcagccucuuccccacuuccu

SEQ ID NO: 242652 - RNA, 32 nt, Human
ucuucuuggcugcugcuguuuucuucauuuua

SEQ ID NO: 242653 - RNA, 32 nt, Human
ucuucuugugaacagcguggggagaggaaaau

SEQ ID NO: 242654 - RNA, 22 nt, Human
ucuucuuuacagauuacucagu

SEQ ID NO: 242655 - RNA, 32 nt, Human
ucuucuuuauuauuuuggaugaugucauauga

SEQ ID NO: 242656 - RNA, 32 nt, Human
ucuucuuucaacguucacgucuugcagggcac

SEQ ID NO: 242657 - RNA, 32 nt, Human
ucuucuuuccacccugucccuaucucuaccac

SEQ ID NO: 242658 - RNA, 32 nt, Human
ucuucuuuccagccucacccuaaucucuguga

SEQ ID NO: 242659 - RNA, 32 nt, Human
ucuucuuuccauccccuagaaauccugggagg

SEQ ID NO: 242660 - RNA, 21 nt, Human
ucuucuuuccauuuauuucgu

SEQ ID NO: 242661 - RNA, 21 nt, Human
ucuucuuuccugggacauggu

SEQ ID NO: 242662 - RNA, 32 nt, Human
ucuucuuucucaauaccugcccugucucaaau

SEQ ID NO: 242663 - RNA, 32 nt, Human
ucuucuuucucccaugcuuuuguucauucagu

SEQ ID NO: 242664 - RNA, 24 nt, Human
ucuucuuucuugguuuccuuuagu

SEQ ID NO: 242665 - RNA, 32 nt, Human
ucuucuuucuuuccuuuuuccuuucuucuucc

SEQ ID NO: 242666 - RNA, 32 nt, Human
ucuucuuucuuucuuuugcaggaguuuguggu

SEQ ID NO: 242667 - RNA, 32 nt, Human
ucuucuuugagcccucuccuccacugcccccg

SEQ ID NO: 242668 - RNA, 32 nt, Human
ucuucuuugcaagcuccauucuaccuggauga

SEQ ID NO: 242669 - RNA, 32 nt, Human
ucuucuuugccauuugcaucuacagcauuuau

SEQ ID NO: 242670 - RNA, 32 nt, Human
ucuucuuugccucugcuggaguccggggagug

SEQ ID NO: 242671 - RNA, 32 nt, Human
ucuucuuugcuuauuauacagcaacaagaauc

SEQ ID NO: 242672 - RNA, 32 nt, Human
ucuucuuuggguaaacgugugacgggggaaag

SEQ ID NO: 242673 - RNA, 32 nt, Human
ucuucuuugugccuggcuucuuucacuuaaca

SEQ ID NO: 242674 - RNA, 32 nt, Human
ucuucuuuuaccuuuuugucuaccucauaguc

SEQ ID NO: 242675 - RNA, 32 nt, Human
ucuucuuuucccuuuuugucccagagcucagc

SEQ ID NO: 242676 - RNA, 24 nt, Human
ucuucuuuucuucuucccucauca

SEQ ID NO: 242677 - RNA, 32 nt, Human
ucuucuuuugagauggagucuugcucugucac

SEQ ID NO: 242678 - RNA, 32 nt, Human
ucuugaaaaccucacugcaaggcugaagcuga

SEQ ID NO: 242679 - RNA, 32 nt, Human
ucuugaaaagcuggagcuucaccagaaugcac

SEQ ID NO: 242680 - RNA, 32 nt, Human
ucuugaaaaugauugggguuuaauaccacugc

SEQ ID NO: 242681 - RNA, 32 nt, Human
ucuugaaacagcccuguuguucugucauggcc

SEQ ID NO: 242682 - RNA, 32 nt, Human
ucuugaaacccccauucuguuuccagcccaga

SEQ ID NO: 242683 - RNA, 32 nt, Human
ucuugaaacuugaggaaacaagauacauacua

SEQ ID NO: 242684 - RNA, 32 nt, Human
ucuugaaagccuuacugcaaaugaguauuaua

SEQ ID NO: 242685 - RNA, 22 nt, Human
ucuugaaauguucuguaguguu

SEQ ID NO: 242686 - RNA, 32 nt, Human
ucuugaaauuuccuaauagcaagaccagcgaa

SEQ ID NO: 242687 - RNA, 32 nt, Human
ucuugaaccaggagguggacguugcagugauc

SEQ ID NO: 242688 - RNA, 32 nt, Human
ucuugaacccaggagacggaaguugcagugag

SEQ ID NO: 242689 - RNA, 32 nt, Human
ucuugaacccaggaggcagagguugcagugag

SEQ ID NO: 242690 - RNA, 32 nt, Human
ucuugaacccaggaggccgagguugcagugag

SEQ ID NO: 242691 - RNA, 32 nt, Human
ucuugaacccaggaggcggagguugcagugag

SEQ ID NO: 242692 - RNA, 32 nt, Human
ucuugaacccaggaggcggagguugcggugag

SEQ ID NO: 242693 - RNA, 32 nt, Human
ucuugaacccaggagguggaggaugcagugaa

SEQ ID NO: 242694 - RNA, 32 nt, Human
ucuugaacccaggagguggagguugcagugag

SEQ ID NO: 242695 - RNA, 32 nt, Human
ucuugaacccgggaguuggagguugcagugag

SEQ ID NO: 242696 - RNA, 32 nt, Human
ucuugaaccuaggagguggagguugcagugag

SEQ ID NO: 242697 - RNA, 32 nt, Human
ucuugaaccugggaggugaagguugcuguggg

SEQ ID NO: 242698 - RNA, 32 nt, Human
ucuugaacuaugaguacugcaaucuuuuuaau

SEQ ID NO: 242699 - RNA, 22 nt, Human
ucuugaacuccugaccucguga

SEQ ID NO: 242700 - RNA, 24 nt, Human
ucuugaacuccuggccuccuugaa

SEQ ID NO: 242701 - RNA, 32 nt, Human
ucuugaacugaggagguggagguugcagugag

SEQ ID NO: 242702 - RNA, 32 nt, Human
ucuugaacugauuaagaauggaucauaaaaua

SEQ ID NO: 242703 - RNA, 22 nt, Human
ucuugaacuucugaccuuguga

SEQ ID NO: 242704 - RNA, 32 nt, Human
ucuugaagacuaauuaguuacacuggauaugc

SEQ ID NO: 242705 - RNA, 32 nt, Human
ucuugaagcagggcuucccaaugcccuuuucc

SEQ ID NO: 242706 - RNA, 32 nt, Human
ucuugaagccagggauaccauaucaggaacua

SEQ ID NO: 242707 - RNA, 32 nt, Human
ucuugaaggaagcagaaagagggacuccucuc

SEQ ID NO: 242708 - RNA, 32 nt, Human
ucuugaagucagagucuaucuccucugucacu

SEQ ID NO: 242709 - RNA, 32 nt, Human
ucuugaaguuuuggguuccugcccugaugguc

SEQ ID NO: 242710 - RNA, 32 nt, Human
ucuugaauaaaucauguguucuuugcaauggg

SEQ ID NO: 242711 - RNA, 32 nt, Human
ucuugaauacauguugggaagaaucggugucu

SEQ ID NO: 242712 - RNA, 23 nt, Human
ucuugaauagaaugauccacuca

SEQ ID NO: 242713 - RNA, 32 nt, Human
ucuugaauagagagcugcaaaccaccaggggg

SEQ ID NO: 242714 - RNA, 32 nt, Human
ucuugaaugcagacuucauuuguauuuuucgu

SEQ ID NO: 242715 - RNA, 32 nt, Human
ucuugaauucaaauacucccaaugagcuugua

SEQ ID NO: 242716 - RNA, 32 nt, Human
ucuugacaaauugagauuugcugauggaagaa

SEQ ID NO: 242717 - RNA, 32 nt, Human
ucuugacaaauugagauuugcugauggaagca

SEQ ID NO: 242718 - RNA, 32 nt, Human
ucuugacaaccaagggccuccgucuggauuuc

SEQ ID NO: 242719 - RNA, 32 nt, Human
ucuugacacagcugugucuuaguaugagaaac

SEQ ID NO: 242720 - RNA, 32 nt, Human
ucuugaccacaccugugccuggcacugugcac

SEQ ID NO: 242721 - RNA, 32 nt, Human
ucuugaccagcacucccucccaaccagagaau

SEQ ID NO: 242722 - RNA, 32 nt, Human
ucuugacccagggaaagggaagcaggguagga

SEQ ID NO: 242723 - RNA, 32 nt, Human
ucuugacccaucucccccucacugaaugccuc

SEQ ID NO: 242724 - RNA, 24 nt, Human
ucuugaccucaaaugauccaccca

SEQ ID NO: 242725 - RNA, 32 nt, Human
ucuugaccucaagugauccaccugucucagcc

SEQ ID NO: 242726 - RNA, 32 nt, Human
ucuugaccucaagugauccaccugucucggcc

SEQ ID NO: 242727 - RNA, 32 nt, Human
ucuugaccucaagugauccgcccaccuuggcc

SEQ ID NO: 242728 - RNA, 32 nt, Human
ucuugaccucaagugaucuguccaccuuggcc

SEQ ID NO: 242729 - RNA, 23 nt, Human
ucuugaccucaggcugccucacu

SEQ ID NO: 242730 - RNA, 21 nt, Human
ucuugaccucaggugauccac

SEQ ID NO: 242731 - RNA, 24 nt, Human
ucuugaccucaggugauccaccca

SEQ ID NO: 242732 - RNA, 21 nt, Human
ucuugaccucaggugauccau

SEQ ID NO: 242733 - RNA, 32 nt, Human
ucuugaccucaggugauccugagccucagccu

SEQ ID NO: 242734 - RNA, 24 nt, Human
ucuugaccucaggugaucugcccg

SEQ ID NO: 242735 - RNA, 32 nt, Human
ucuugaccucaugauccacccaccucggucuc

SEQ ID NO: 242736 - RNA, 32 nt, Human
ucuugaccucaugaucugcccaccucggccuc

SEQ ID NO: 242737 - RNA, 22 nt, Human
ucuugaccucauguuccacccg

SEQ ID NO: 242738 - RNA, 32 nt, Human
ucuugaccuccaccgcccuccucacagccaug

SEQ ID NO: 242739 - RNA, 21 nt, Human
ucuugaccuccuccuccuuca

SEQ ID NO: 242740 - RNA, 22 nt, Human
ucuugaccuccugauccaccca

SEQ ID NO: 242741 - RNA, 24 nt, Human
ucuugaccucgggugauccaccca

SEQ ID NO: 242742 - RNA, 32 nt, Human
ucuugaccucgugauccacccaccucggccuc

SEQ ID NO: 242743 - RNA, 32 nt, Human
ucuugaccucgugauccgcccaccucagccuc

SEQ ID NO: 242744 - RNA, 22 nt, Human
ucuugaccucgugaucugcccg

SEQ ID NO: 242745 - RNA, 22 nt, Human
ucuugaccucuugauccacccg

SEQ ID NO: 242746 - RNA, 32 nt, Human
ucuugaccuguccccucuggcugccucugagu

SEQ ID NO: 242747 - RNA, 32 nt, Human
ucuugaccuuuggccacugccuucccagcugc

SEQ ID NO: 242748 - RNA, 32 nt, Human
ucuugaccuuuuugcauggcuuuuugcugaaa

SEQ ID NO: 242749 - RNA, 32 nt, Human
ucuugacucaaccuuccagcagucuccacugc

SEQ ID NO: 242750 - RNA, 32 nt, Human
ucuugacucacuacaaccuccgccucccaggu

SEQ ID NO: 242751 - RNA, 32 nt, Human
ucuugacucacugcaacaucugccucccgggu

SEQ ID NO: 242752 - RNA, 32 nt, Human
ucuugacucacugcaaccuccaccucccaggu

SEQ ID NO: 242753 - RNA, 32 nt, Human
ucuugacucacugcaaccuccgccucacagcu

SEQ ID NO: 242754 - RNA, 32 nt, Human
ucuugacucacugcaaccuccgccucccaggu

SEQ ID NO: 242755 - RNA, 32 nt, Human
ucuugacucacugcaaccucugccucccaggu

SEQ ID NO: 242756 - RNA, 32 nt, Human
ucuugacucacugcaaccucugccucucgggu

SEQ ID NO: 242757 - RNA, 32 nt, Human
ucuugacucacugcaacuucugccacccaggu

SEQ ID NO: 242758 - RNA, 32 nt, Human
ucuugacucacugcaaucuccaccucccacag

SEQ ID NO: 242759 - RNA, 32 nt, Human
ucuugacucacugcaauucugccuccuggguu

SEQ ID NO: 242760 - RNA, 32 nt, Human
ucuugacucacugcagccucaaccucccaggc

SEQ ID NO: 242761 - RNA, 32 nt, Human
ucuugacucacugcauuuuccaccuugggagu

SEQ ID NO: 242762 - RNA, 32 nt, Human
ucuugacuccacccucaccaugucuucucaca

SEQ ID NO: 242763 - RNA, 32 nt, Human
ucuugacucgcagcaaccuccgccuccugggu

SEQ ID NO: 242764 - RNA, 32 nt, Human
ucuugacucgcugcagucuccaccuccaggau

SEQ ID NO: 242765 - RNA, 32 nt, Human
ucuugacucuagggcagaacagaucuaaccau

SEQ ID NO: 242766 - RNA, 32 nt, Human
ucuugacucugggaacagcugcuacccccaag

SEQ ID NO: 242767 - RNA, 32 nt, Human
ucuugacugcaccccaaagaggcuccaggauc

SEQ ID NO: 242768 - RNA, 32 nt, Human
ucuugacuguuuucccuacuugcugacuuaac

SEQ ID NO: 242769 - RNA, 32 nt, Human
ucuugacuuagagugucacuucacuuuauaga

SEQ ID NO: 242770 - RNA, 24 nt, Human
ucuugacuucaagugauccacccg

SEQ ID NO: 242771 - RNA, 32 nt, Human
ucuugacuucaagugauccacccgccucagcc

SEQ ID NO: 242772 - RNA, 21 nt, Human
ucuugacuucagaugauccau

SEQ ID NO: 242773 - RNA, 23 nt, Human
ucuugacuuuaccuuggcacuug

SEQ ID NO: 242774 - RNA, 22 nt, Human
ucuugacuuuaucuccgcugca

SEQ ID NO: 242775 - RNA, 32 nt, Human
ucuugagaaguagaacaaggcacuucaguccu

SEQ ID NO: 242776 - RNA, 32 nt, Human
ucuugagaccaaaucuggaacaugguguaucu

SEQ ID NO: 242777 - RNA, 32 nt, Human
ucuugagaccagccugggcaacaggcuauuuu

SEQ ID NO: 242778 - RNA, 32 nt, Human
ucuugagacucaacuccugggaggagaggguc

SEQ ID NO: 242779 - RNA, 32 nt, Human
ucuugagaggcugaucaucagggguucacuuu

SEQ ID NO: 242780 - RNA, 32 nt, Human
ucuugagauccccuuccucaccugccaaucaa

SEQ ID NO: 242781 - RNA, 32 nt, Human
ucuugagauggcucuggccaggaucugccccc

SEQ ID NO: 242782 - RNA, 32 nt, Human
ucuugagcaaacugaguuagggaggguaugcu

SEQ ID NO: 242783 - RNA, 21 nt, Human
ucuugagcaagcuaaagaaac

SEQ ID NO: 242784 - RNA, 32 nt, Human
ucuugagcaguggcugguccagggcuagugac

SEQ ID NO: 242785 - RNA, 32 nt, Human
ucuugagccaucauucaucccuuaacaggcac

SEQ ID NO: 242786 - RNA, 32 nt, Human
ucuugagcccaggagaugcaggcuugcaguga

SEQ ID NO: 242787 - RNA, 32 nt, Human
ucuugagcccaggaguuugagacuagccuggc

SEQ ID NO: 242788 - RNA, 32 nt, Human
ucuugagcccaggaguuugagacuagccuggg

SEQ ID NO: 242789 - RNA, 32 nt, Human
ucuugagcccaggaguuugaggccagacugca

SEQ ID NO: 242790 - RNA, 32 nt, Human
ucuugagcccagggguuugaggcugcagugag

SEQ ID NO: 242791 - RNA, 32 nt, Human
ucuugagccugggaggucaaggcugcagugaa

SEQ ID NO: 242792 - RNA, 32 nt, Human
ucuugagccugggaggucaaggcugcagugag

SEQ ID NO: 242793 - RNA, 32 nt, Human
ucuugagcguguccaccuucucccucuccacu

SEQ ID NO: 242794 - RNA, 32 nt, Human
ucuugagcugggggugugagggggagggccug

SEQ ID NO: 242795 - RNA, 32 nt, Human
ucuugaggaaacugaggcaaagaggagggcag

SEQ ID NO: 242796 - RNA, 32 nt, Human
ucuugaggccaagauuaagagauguucuuaca

SEQ ID NO: 242797 - RNA, 32 nt, Human
ucuugaggcguuuccagggcgcugagucugag

SEQ ID NO: 242798 - RNA, 32 nt, Human
ucuugaggcuguagccugugucaagcuguuuc

SEQ ID NO: 242799 - RNA, 32 nt, Human
ucuugagggucugcugccccagccuggcagca

SEQ ID NO: 242800 - RNA, 32 nt, Human
ucuugaguauguauauugaggccaucugagcu

SEQ ID NO: 242801 - RNA, 32 nt, Human
ucuugaguauguauguugaggccaucugagcu

SEQ ID NO: 242802 - RNA, 32 nt, Human
ucuugaguauguauguugaggccaucugcacu

SEQ ID NO: 242803 - RNA, 20 nt, Human
ucuugagucaagaguggcag

SEQ ID NO: 242804 - RNA, 32 nt, Human
ucuugagucuguacugaggaccagccuguaca

SEQ ID NO: 242805 - RNA, 32 nt, Human
ucuugagucuuucuguccaucccauucuauuc

SEQ ID NO: 242806 - RNA, 24 nt, Human
ucuugaguuaauuuucugccucca

SEQ ID NO: 242807 - RNA, 32 nt, Human
ucuugaguuacuguacuauagcauuuuauugu

SEQ ID NO: 242808 - RNA, 32 nt, Human
ucuugaguucaagcgauucuccugccucagcu

SEQ ID NO: 242809 - RNA, 32 nt, Human
ucuugauaguuucaaguagcuaugauggucuc

SEQ ID NO: 242810 - RNA, 32 nt, Human
ucuugaucaucagccaggauuuugccacagca

SEQ ID NO: 242811 - RNA, 32 nt, Human
ucuugauccacaugcauggaagugagaauccu

SEQ ID NO: 242812 - RNA, 23 nt, Human
ucuugaucucuuggaucuccuca

SEQ ID NO: 242813 - RNA, 32 nt, Human
ucuugaucugcagcuucucugaaguuuggaaa

SEQ ID NO: 242814 - RNA, 32 nt, Human
ucuugaugaucccacuuccuguuuccaucugc

SEQ ID NO: 242815 - RNA, 32 nt, Human
ucuugaugauggcgguggagguggugguugua

SEQ ID NO: 242816 - RNA, 32 nt, Human
ucuugaugccuagagagcuggcccagccaaca

SEQ ID NO: 242817 - RNA, 32 nt, Human
ucuugauuaaagucuucaguugaaauuccacu

SEQ ID NO: 242818 - RNA, 32 nt, Human
ucuugauuccaaauccuaaaccaggaagaguu

SEQ ID NO: 242819 - RNA, 32 nt, Human
ucuugauuccaggacacccuccccugugucua

SEQ ID NO: 242820 - RNA, 32 nt, Human
ucuugauugaaggaggauagggcauuaaagug

SEQ ID NO: 242821 - RNA, 32 nt, Human
ucuugauuuuugaauguauuuguuucaggaag

SEQ ID NO: 242822 - RNA, 32 nt, Human
ucuugcaagacauuucuccuuucacagaacug

SEQ ID NO: 242823 - RNA, 32 nt, Human
ucuugcacaccccucccuguaaccaaggaaca

SEQ ID NO: 242824 - RNA, 32 nt, Human
ucuugcacacugcaacaacucugugacacugg

SEQ ID NO: 242825 - RNA, 32 nt, Human
ucuugcacaugaacugucacauguuuaaaaau

SEQ ID NO: 242826 - RNA, 32 nt, Human
ucuugcacauuaggaagcagaauauccuccag

SEQ ID NO: 242827 - RNA, 19 nt, Human
ucuugcaccagcagcauga

SEQ ID NO: 242828 - RNA, 32 nt, Human
ucuugcaccucagcagcugaaggucucagaga

SEQ ID NO: 242829 - RNA, 20 nt, Human
ucuugcaccuucuccugccu

SEQ ID NO: 242830 - RNA, 32 nt, Human
ucuugcacgcgcucccugccugggcacaccaa

SEQ ID NO: 242831 - RNA, 22 nt, Human
ucuugcacgcucucucuucucu

SEQ ID NO: 242832 - RNA, 26 nt, Human
ucuugcacugaucuuucuccucuccu

SEQ ID NO: 242833 - RNA, 32 nt, Human
ucuugcagacuggcccacccugccuacuuccc

SEQ ID NO: 242834 - RNA, 32 nt, Human
ucuugcagagcuagggcucugaaggggaggga

SEQ ID NO: 242835 - RNA, 32 nt, Human
ucuugcagcaucagagaguucacacuagagaa

SEQ ID NO: 242836 - RNA, 32 nt, Human
ucuugcagccuccccgccccucccgcaacgcu

SEQ ID NO: 242837 - RNA, 32 nt, Human
ucuugcagcuacucuguggucaggccgggucc

SEQ ID NO: 242838 - RNA, 32 nt, Human
ucuugcagcuggugccauccaugucucacagc

SEQ ID NO: 242839 - RNA, 32 nt, Human
ucuugcaggcugggccggcuucaugccagugc

SEQ ID NO: 242840 - RNA, 32 nt, Human
ucuugcagggcuggcccugccugcuccugcgg

SEQ ID NO: 242841 - RNA, 32 nt, Human
ucuugcaguccggggaaagugugcagauggau

SEQ ID NO: 242842 - RNA, 32 nt, Human
ucuugcagugacggaaaguugcagccccuggu

SEQ ID NO: 242843 - RNA, 32 nt, Human
ucuugcauaaggcaguuccuggagacccagca

SEQ ID NO: 242844 - RNA, 32 nt, Human
ucuugcaucagccuguggauguaugccuacca

SEQ ID NO: 242845 - RNA, 32 nt, Human
ucuugcaucccucucucuuccuuuuccugccg

SEQ ID NO: 242846 - RNA, 32 nt, Human
ucuugcaucuucuuccacugggcucuggauua

SEQ ID NO: 242847 - RNA, 32 nt, Human
ucuugcaugagacuccuggggccugggcacag

SEQ ID NO: 242848 - RNA, 32 nt, Human
ucuugcauuuggaaaguacuuuauccagaaaa

SEQ ID NO: 242849 - RNA, 32 nt, Human
ucuugccacaaaaaucugcaaauuugauaauu

SEQ ID NO: 242850 - RNA, 32 nt, Human
ucuugccacagauugaggccacuuuugagcaa

SEQ ID NO: 242851 - RNA, 32 nt, Human
ucuugccacccaccauccugcccaggcccuga

SEQ ID NO: 242852 - RNA, 32 nt, Human
ucuugccaccccagguaucccugguauugucc

SEQ ID NO: 242853 - RNA, 32 nt, Human
ucuugccacugcacaccagccugggcaacaca

SEQ ID NO: 242854 - RNA, 32 nt, Human
ucuugccacugcacuccagccugggcaacaga

SEQ ID NO: 242855 - RNA, 32 nt, Human
ucuugccacugcucuccagccugagcgacaga

SEQ ID NO: 242856 - RNA, 32 nt, Human
ucuugccacuguacuccagccugaagagcgag

SEQ ID NO: 242857 - RNA, 32 nt, Human
ucuugccagcccagcccugccuccccggucuc

SEQ ID NO: 242858 - RNA, 32 nt, Human
ucuugccaggaggaggaaugagagugauguug

SEQ ID NO: 242859 - RNA, 32 nt, Human
ucuugccagggugggaaguagaauuucaugua

SEQ ID NO: 242860 - RNA, 32 nt, Human
ucuugccauaaugguaaaggacugauugauau

SEQ ID NO: 242861 - RNA, 32 nt, Human
ucuugccauagagaggaggagaagaaacuaac

SEQ ID NO: 242862 - RNA, 32 nt, Human
ucuugccaugaucagacaugcagcugccuacc

SEQ ID NO: 242863 - RNA, 32 nt, Human
ucuugccaugccugugugccccacagaccuaa

SEQ ID NO: 242864 - RNA, 32 nt, Human
ucuugccauugcacuccagcugagagugugac

SEQ ID NO: 242865 - RNA, 23 nt, Human
ucuugccauuuguauuaucuuua

SEQ ID NO: 242866 - RNA, 32 nt, Human
ucuugcccaauacuuugcugcuugccuauacc

SEQ ID NO: 242867 - RNA, 32 nt, Human
ucuugcccagagcugugcagugcaguggcuga

SEQ ID NO: 242868 - RNA, 32 nt, Human
ucuugcccagcugcccagcagagaguggacga

SEQ ID NO: 242869 - RNA, 32 nt, Human
ucuugcccaggcccuccugggagggggacagg

SEQ ID NO: 242870 - RNA, 32 nt, Human
ucuugcccauuuucugcucgacucgccccuga

SEQ ID NO: 242871 - RNA, 32 nt, Human
ucuugccccucagaccuugcauccacagaagc

SEQ ID NO: 242872 - RNA, 32 nt, Human
ucuugcccuagauuguaaauuaaguuuggcau

SEQ ID NO: 242873 - RNA, 32 nt, Human
ucuugcccugcuccuucauugucuauagggca

SEQ ID NO: 242874 - RNA, 32 nt, Human
ucuugcccugcucuccgcuccacccccugcca

SEQ ID NO: 242875 - RNA, 32 nt, Human
ucuugcccuuaacccagcuucuuccaaagaua

SEQ ID NO: 242876 - RNA, 32 nt, Human
ucuugcccuuuggccaacagauuucuuguccu

SEQ ID NO: 242877 - RNA, 32 nt, Human
ucuugcccuuuucagcagcuugcccagcucuu

SEQ ID NO: 242878 - RNA, 32 nt, Human
ucuugccguccaccccgggccaugccagugug

SEQ ID NO: 242879 - RNA, 32 nt, Human
ucuugccguccaggcuggagugcaauggcgug

SEQ ID NO: 242880 - RNA, 21 nt, Human
ucuugccguucuguaaguguu

SEQ ID NO: 242881 - RNA, 31 nt, Human
ucuugccuaguguccagagcagcagagauuu

SEQ ID NO: 242882 - RNA, 32 nt, Human
ucuugccucacugcaacgccugccucucaggc

SEQ ID NO: 242883 - RNA, 28 nt, Human
ucuugccucagagcagccucaucccagg

SEQ ID NO: 242884 - RNA, 32 nt, Human
ucuugccucauuuugcuucccaucugaagagu

SEQ ID NO: 242885 - RNA, 32 nt, Human
ucuugccuccacuucauaaugucauaaaagcc

SEQ ID NO: 242886 - RNA, 32 nt, Human
ucuugccuccuucuggcugccugcccccuccc

SEQ ID NO: 242887 - RNA, 32 nt, Human
ucuugccucuacuuugauuucagagucuuucc

SEQ ID NO: 242888 - RNA, 32 nt, Human
ucuugccugccuguuuuugaccucugcaugag

SEQ ID NO: 242889 - RNA, 32 nt, Human
ucuugccugcuguuccaguucuggucaagggc

SEQ ID NO: 242890 - RNA, 32 nt, Human
ucuugccuggagccugagaaagggaggagaga

SEQ ID NO: 242891 - RNA, 21 nt, Human
ucuugccuggcucccagggcu

SEQ ID NO: 242892 - RNA, 22 nt, Human
ucuugccugggcccaccccuca

SEQ ID NO: 242893 - RNA, 32 nt, Human
ucuugccuguaacccuagcacuuugggaggcc

SEQ ID NO: 242894 - RNA, 24 nt, Human
ucuugccuguaaucccagcacuuu

SEQ ID NO: 242895 - RNA, 32 nt, Human
ucuugccuguaaucccagcacuuugauaggcu

SEQ ID NO: 242896 - RNA, 32 nt, Human
ucuugccuguaaucccagcacuuugggaggcc

SEQ ID NO: 242897 - RNA, 32 nt, Human
ucuugccuguaaucccagcacuuugggaggcu

SEQ ID NO: 242898 - RNA, 32 nt, Human
ucuugccuguaaucccagcacuuuggggagga

SEQ ID NO: 242899 - RNA, 22 nt, Human
ucuugccuguaaucccagcauu

SEQ ID NO: 242900 - RNA, 32 nt, Human
ucuugccuguaaucccagcauucugggaggcc

SEQ ID NO: 242901 - RNA, 32 nt, Human
ucuugccuguaaucuuagcacuuugggaggcc

SEQ ID NO: 242902 - RNA, 32 nt, Human
ucuugccuguaauuccagcuacuugggaggcu

SEQ ID NO: 242903 - RNA, 32 nt, Human
ucuugccuguuucucuugaggcugccuuggca

SEQ ID NO: 242904 - RNA, 22 nt, Human
ucuugccuuaaccagucucuca

SEQ ID NO: 242905 - RNA, 32 nt, Human
ucuugccuuccuggcaucauuuccuccuacca

SEQ ID NO: 242906 - RNA, 24 nt, Human
ucuugccuugggacccagucccuc

SEQ ID NO: 242907 - RNA, 32 nt, Human
ucuugcgccuguacucccagcacuuugggagg

SEQ ID NO: 242908 - RNA, 32 nt, Human
ucuugcgcuugcagauaccuggcaaagaacuc

SEQ ID NO: 242909 - RNA, 32 nt, Human
ucuugcgggaggcgugggcugggauugcggug

SEQ ID NO: 242910 - RNA, 32 nt, Human
ucuugcgguggaguccuguugcugugagggag

SEQ ID NO: 242911 - RNA, 32 nt, Human
ucuugcgguggcguaaucucucagccuuucug

SEQ ID NO: 242912 - RNA, 32 nt, Human
ucuugcgucccugccagcauccuggaguccua

SEQ ID NO: 242913 - RNA, 32 nt, Human
ucuugcgugccuuuuaaaugcugacauuccuu

SEQ ID NO: 242914 - RNA, 32 nt, Human
ucuugcuaauuuccaaccauauugaauaaaug

SEQ ID NO: 242915 - RNA, 32 nt, Human
ucuugcuaccuccaccuccaccgccaccucca

SEQ ID NO: 242916 - RNA, 32 nt, Human
ucuugcuaccugugagcauccuucccagcaga

SEQ ID NO: 242917 - RNA, 23 nt, Human
ucuugcuaggagcccuucugucc

SEQ ID NO: 242918 - RNA, 32 nt, Human
ucuugcuauguugcccaagcuaguuucaaacu

SEQ ID NO: 242919 - RNA, 32 nt, Human
ucuugcuauuggaaacucagcacauuugaacu

SEQ ID NO: 242920 - RNA, 32 nt, Human
ucuugcucaaguucuggucaacuaguagccug

SEQ ID NO: 242921 - RNA, 32 nt, Human
ucuugcucaccgcccugauucuguuccucggc

SEQ ID NO: 242922 - RNA, 32 nt, Human
ucuugcucauccuugucccuuugacaauaagg

SEQ ID NO: 242923 - RNA, 32 nt, Human
ucuugcuccagcccaggcuggagugcaguggc

SEQ ID NO: 242924 - RNA, 32 nt, Human
ucuugcucccaugcugcugucccuucaggcuc

SEQ ID NO: 242925 - RNA, 32 nt, Human
ucuugcucccccacccuuccugaaacucuuga

SEQ ID NO: 242926 - RNA, 32 nt, Human
ucuugcuccuuacuccuccaucaucucuaaug

SEQ ID NO: 242927 - RNA, 32 nt, Human
ucuugcucgcccaggguggagugcaguggugu

SEQ ID NO: 242928 - RNA, 32 nt, Human
ucuugcucucccaggcuggagugcaguggugu

SEQ ID NO: 242929 - RNA, 32 nt, Human
ucuugcucuccccuccccuggcuuuccucucu

SEQ ID NO: 242930 - RNA, 21 nt, Human
ucuugcucucccuccccuccc

SEQ ID NO: 242931 - RNA, 31 nt, Human
ucuugcucugaugcucccaugcucaguacag

SEQ ID NO: 242932 - RNA, 32 nt, Human
ucuugcucugcuccuuucauccucgucucccc

SEQ ID NO: 242933 - RNA, 32 nt, Human
ucuugcucugcucucguucuccagaaggcugu

SEQ ID NO: 242934 - RNA, 32 nt, Human
ucuugcucugucgcccacccaggcuggaguac

SEQ ID NO: 242935 - RNA, 32 nt, Human
ucuugcucugucuacagccuaggccaacuagu

SEQ ID NO: 242936 - RNA, 32 nt, Human
ucuugcucugugacccagguugcagugagcca

SEQ ID NO: 242937 - RNA, 32 nt, Human
ucuugcucuucucuccccuuugccucccucug

SEQ ID NO: 242938 - RNA, 32 nt, Human
ucuugcucuuuuagcuagaguguaugugaaaa

SEQ ID NO: 242939 - RNA, 32 nt, Human
ucuugcugagauuauggaucugugccacaggg

SEQ ID NO: 242940 - RNA, 32 nt, Human
ucuugcugcccaggcuagagugcaauggugcg

SEQ ID NO: 242941 - RNA, 32 nt, Human
ucuugcugcccaggcuggagugcaauggugca

SEQ ID NO: 242942 - RNA, 32 nt, Human
ucuugcugcccaggcuggagugcaguggcuca

SEQ ID NO: 242943 - RNA, 21 nt, Human
ucuugcugcccccugugaccc

SEQ ID NO: 242944 - RNA, 24 nt, Human
ucuugcugccuuuucuccuguccu

SEQ ID NO: 242945 - RNA, 32 nt, Human
ucuugcugcuccguggccucugaggccccagg

SEQ ID NO: 242946 - RNA, 19 nt, Human
ucuugcugcuguccugucc

SEQ ID NO: 242947 - RNA, 32 nt, Human
ucuugcugcuugccucugcugcucuggucugg

SEQ ID NO: 242948 - RNA, 32 nt, Human
ucuugcuggaggaccugcaccuagccacuucu

SEQ ID NO: 242949 - RNA, 26 nt, Human
ucuugcuggcuacgccucuucugucc

SEQ ID NO: 242950 - RNA, 20 nt, Human
ucuugcuggcucaccugucc

SEQ ID NO: 242951 - RNA, 32 nt, Human
ucuugcugggagggucugcaggagaaccgcag

SEQ ID NO: 242952 - RNA, 32 nt, Human
ucuugcuggguccucagggagcugcaggagcg

SEQ ID NO: 242953 - RNA, 32 nt, Human
ucuugcugguuuggaauaggcugccauguguu

SEQ ID NO: 242954 - RNA, 32 nt, Human
ucuugcuguccacucccugccugccugcccgc

SEQ ID NO: 242955 - RNA, 32 nt, Human
ucuugcuguggacgaaauaucuggggguuagg

SEQ ID NO: 242956 - RNA, 29 nt, Human
ucuugcugugugccugugccuggggccuu

SEQ ID NO: 242957 - RNA, 25 nt, Human
ucuugcuuaaauuuuguccuauccu

SEQ ID NO: 242958 - RNA, 32 nt, Human
ucuugcuuacuacccaaagagcucugcagaag

SEQ ID NO: 242959 - RNA, 32 nt, Human
ucuugcuucaaaauugucccacaguggcauuc

SEQ ID NO: 242960 - RNA, 32 nt, Human
ucuugcuucacccuccucuguuguggaaugau

SEQ ID NO: 242961 - RNA, 32 nt, Human
ucuugcuucaggaaggugaagugcuucccauu

SEQ ID NO: 242962 - RNA, 32 nt, Human
ucuugcuucgcguccggcucucaggcccugga

SEQ ID NO: 242963 - RNA, 32 nt, Human
ucuugcuugagugcuggaacucaggccagaag

SEQ ID NO: 242964 - RNA, 32 nt, Human
ucuugcuuguggcgccuuccucaucucuauau

SEQ ID NO: 242965 - RNA, 32 nt, Human
ucuugcuuuaaagaguccuccuucccagcucu

SEQ ID NO: 242966 - RNA, 32 nt, Human
ucuugcuuuauucauccuccaucucaaaauga

SEQ ID NO: 242967 - RNA, 32 nt, Human
ucuugcuuuccaggguaucuaugugugugcau

SEQ ID NO: 242968 - RNA, 32 nt, Human
ucuugcuuucuuucuugcuuucuuucuugcuu

SEQ ID NO: 242969 - RNA, 32 nt, Human
ucuugcuuucuuucuuucuugcuuucuuucuu

SEQ ID NO: 242970 - RNA, 32 nt, Human
ucuugcuuuguugcccaggcuggucuugaacu

SEQ ID NO: 242971 - RNA, 32 nt, Human
ucuugcuuuguugcccagguuagucuuauucu

SEQ ID NO: 242972 - RNA, 32 nt, Human
ucuuggaaagguucuauuccugaucuccagcu

SEQ ID NO: 242973 - RNA, 32 nt, Human
ucuuggaacaaaugugagcuauuugaaaacaa

SEQ ID NO: 242974 - RNA, 32 nt, Human
ucuuggaacagcuacaguuucacaguaggaag

SEQ ID NO: 242975 - RNA, 32 nt, Human
ucuuggaacagcuucucuauguguggauucgu

SEQ ID NO: 242976 - RNA, 32 nt, Human
ucuuggaaccaccacaccuguuuaaagaaccu

SEQ ID NO: 242977 - RNA, 32 nt, Human
ucuuggaagaaaguauaaaauugaccggcauc

SEQ ID NO: 242978 - RNA, 21 nt, Human
ucuuggaagaagaaagaaaca

SEQ ID NO: 242979 - RNA, 32 nt, Human
ucuuggaagugaggcccggccccggacagggu

SEQ ID NO: 242980 - RNA, 32 nt, Human
ucuuggaauccuuggccugccugcaggccucu

SEQ ID NO: 242981 - RNA, 32 nt, Human
ucuuggaaucuguagaccagaucgguggaggu

SEQ ID NO: 242982 - RNA, 32 nt, Human
ucuuggacacugaaggaaaaggccaacuaggg

SEQ ID NO: 242983 - RNA, 32 nt, Human
ucuuggacauuaaccccugaggcuccaccacc

SEQ ID NO: 242984 - RNA, 32 nt, Human
ucuuggaccagcccgcccugaccaccagcucu

SEQ ID NO: 242985 - RNA, 24 nt, Human
ucuuggacccaccuguggggccug

SEQ ID NO: 242986 - RNA, 32 nt, Human
ucuuggaccugaggcugcuuucuugaagaaaa

SEQ ID NO: 242987 - RNA, 32 nt, Human
ucuuggacucaggccucagagccuggccuggu

SEQ ID NO: 242988 - RNA, 32 nt, Human
ucuuggacuucuagccuauggaacuguaagau

SEQ ID NO: 242989 - RNA, 32 nt, Human
ucuuggacuuugccccgaaagcacauccauaa

SEQ ID NO: 242990 - RNA, 32 nt, Human
ucuuggagaagagggaggaauaggagcaaauc

SEQ ID NO: 242991 - RNA, 32 nt, Human
ucuuggagccugaaaagaaggagcagcgacug

SEQ ID NO: 242992 - RNA, 32 nt, Human
ucuuggagcuucccccugucgaacucgucuag

SEQ ID NO: 242993 - RNA, 32 nt, Human
ucuuggaggaaggcauccuucuauucuacuga

SEQ ID NO: 242994 - RNA, 21 nt, Human
ucuuggaggagucguaagaaa

SEQ ID NO: 242995 - RNA, 32 nt, Human
ucuuggaggauucugagguagagaguagcaua

SEQ ID NO: 242996 - RNA, 21 nt, Human
ucuuggaggccccuccugcuu

SEQ ID NO: 242997 - RNA, 32 nt, Human
ucuuggaggccccuccugcuucguuggguucu

SEQ ID NO: 242998 - RNA, 32 nt, Human
ucuuggagggggcaggaggagagaggaaaagg

SEQ ID NO: 242999 - RNA, 32 nt, Human
ucuuggagucugaaagcucaaugaagucacga

SEQ ID NO: 243000 - RNA, 32 nt, Human
ucuuggaucaccacaaccuccgucucccaggu

SEQ ID NO: 243001 - RNA, 32 nt, Human
ucuuggaucacuacaaccuccaccucccgggu

SEQ ID NO: 243002 - RNA, 32 nt, Human
ucuuggauccuucagagccucagccacuagcu

SEQ ID NO: 243003 - RNA, 32 nt, Human
ucuuggaugagacuguagagcggucuugugcg

SEQ ID NO: 243004 - RNA, 32 nt, Human
ucuuggauuacaucaaguuuauaauuuuggca

SEQ ID NO: 243005 - RNA, 32 nt, Human
ucuuggcaagcauggagggaggggcuaacugu

SEQ ID NO: 243006 - RNA, 32 nt, Human
ucuuggcacuguacuccaaccuggguaacagg

SEQ ID NO: 243007 - RNA, 32 nt, Human
ucuuggcagagugagggccuggagauaaccag

SEQ ID NO: 243008 - RNA, 32 nt, Human
ucuuggcagaguuccagccacgcucuuuauuc

SEQ ID NO: 243009 - RNA, 32 nt, Human
ucuuggcagaugcugcagauaacguggagagc

SEQ ID NO: 243010 - RNA, 32 nt, Human
ucuuggcagcgggcgaggaggcugcgagcgag

SEQ ID NO: 243011 - RNA, 32 nt, Human
ucuuggcagggugggcaugaggcaucacuguu

SEQ ID NO: 243012 - RNA, 32 nt, Human
ucuuggcauugcaaccuccauuucuagcuccu

SEQ ID NO: 243013 - RNA, 32 nt, Human
ucuuggccagagaagacagaaggacccggcuu

SEQ ID NO: 243014 - RNA, 32 nt, Human
ucuuggccaucuuuucaaccgcugucuuuccu

SEQ ID NO: 243015 - RNA, 32 nt, Human
ucuuggcccacagucucccagaaaugauguuu

SEQ ID NO: 243016 - RNA, 32 nt, Human
ucuuggcccacugcaaccucugccucccgggu

SEQ ID NO: 243017 - RNA, 32 nt, Human
ucuuggcccacugcaaccucugcuuccuaggu

SEQ ID NO: 243018 - RNA, 32 nt, Human
ucuuggcccaggaugggagagccgccugcccu

SEQ ID NO: 243019 - RNA, 32 nt, Human
ucuuggcccccugcaaccuccgccucccgggu

SEQ ID NO: 243020 - RNA, 32 nt, Human
ucuuggcccccuugguuauucauucuagauga

SEQ ID NO: 243021 - RNA, 32 nt, Human
ucuuggcccugugcccugcacuuucuucacug

SEQ ID NO: 243022 - RNA, 24 nt, Human
ucuuggccuagccuggcccacuca

SEQ ID NO: 243023 - RNA, 32 nt, Human
ucuuggccuagggaguggaggguaaggaaaau

SEQ ID NO: 243024 - RNA, 32 nt, Human
ucuuggccucaagugauccuccugccuuagcu

SEQ ID NO: 243025 - RNA, 23 nt, Human
ucuuggccucaggugauccucuu

SEQ ID NO: 243026 - RNA, 32 nt, Human
ucuuggccucaggugauccucuucccucagcu

SEQ ID NO: 243027 - RNA, 24 nt, Human
ucuuggccucaugugucuccguca

SEQ ID NO: 243028 - RNA, 22 nt, Human
ucuuggccuccacucucccuca

SEQ ID NO: 243029 - RNA, 21 nt, Human
ucuuggccuccagagucccuu

SEQ ID NO: 243030 - RNA, 19 nt, Human
ucuuggccucugcagccuu

SEQ ID NO: 243031 - RNA, 32 nt, Human
ucuuggccucuuccucucucaagauaaagaug

SEQ ID NO: 243032 - RNA, 32 nt, Human
ucuuggccuggcugaauaucuucuacaaagau

SEQ ID NO: 243033 - RNA, 32 nt, Human
ucuuggccuuacuguauaaaggugugcugugu

SEQ ID NO: 243034 - RNA, 32 nt, Human
ucuuggccuuccaaaugcagcgcuggaaagag

SEQ ID NO: 243035 - RNA, 22 nt, Human
ucuuggccuuugcauuuauuua

SEQ ID NO: 243036 - RNA, 32 nt, Human
ucuuggcgccggagaagaggcagggucacccu

SEQ ID NO: 243037 - RNA, 32 nt, Human
ucuuggcggguuuggagccaggggauggcaug

SEQ ID NO: 243038 - RNA, 32 nt, Human
ucuuggcggucccugagaguccugcugaaauc

SEQ ID NO: 243039 - RNA, 32 nt, Human
ucuuggcuaacugcaaccuccagcuccugggu

SEQ ID NO: 243040 - RNA, 32 nt, Human
ucuuggcuaacugcaaccuccgccucccaggu

SEQ ID NO: 243041 - RNA, 32 nt, Human
ucuuggcuaacugcaacuuccaccuccugggu

SEQ ID NO: 243042 - RNA, 32 nt, Human
ucuuggcucacagcaaccucuaccuccugggu

SEQ ID NO: 243043 - RNA, 32 nt, Human
ucuuggcucacagcagccucugccucccgggu

SEQ ID NO: 243044 - RNA, 32 nt, Human
ucuuggcucaccacaaccuccaccucccaggu

SEQ ID NO: 243045 - RNA, 32 nt, Human
ucuuggcucaccacaaccuccgccucccggau

SEQ ID NO: 243046 - RNA, 32 nt, Human
ucuuggcucaccgcaaccuccaccuccugagu

SEQ ID NO: 243047 - RNA, 32 nt, Human
ucuuggcucaccgcaaccuccgccucccaggu

SEQ ID NO: 243048 - RNA, 32 nt, Human
ucuuggcucaccgcaaccuccgccuccuaggu

SEQ ID NO: 243049 - RNA, 32 nt, Human
ucuuggcucaccgcaaccucugccuaccgggu

SEQ ID NO: 243050 - RNA, 32 nt, Human
ucuuggcucaccgcaaccucugccucccuggu

SEQ ID NO: 243051 - RNA, 32 nt, Human
ucuuggcucaccgcaaccucugccuccugggu

SEQ ID NO: 243052 - RNA, 32 nt, Human
ucuuggcucacuacaaccuccaccucccaggu

SEQ ID NO: 243053 - RNA, 32 nt, Human
ucuuggcucacuacaaccuccaccucccgggu

SEQ ID NO: 243054 - RNA, 32 nt, Human
ucuuggcucacuacaaccuccaccuuccaggc

SEQ ID NO: 243055 - RNA, 32 nt, Human
ucuuggcucacuacaaccuccgccucccaggu

SEQ ID NO: 243056 - RNA, 32 nt, Human
ucuuggcucacuacaaccuccgccuccugggu

SEQ ID NO: 243057 - RNA, 32 nt, Human
ucuuggcucacuccaaccuccaccuuccaggu

SEQ ID NO: 243058 - RNA, 32 nt, Human
ucuuggcucacuccaaccuccgccuccugggu

SEQ ID NO: 243059 - RNA, 32 nt, Human
ucuuggcucacugaaaccucugccucccgguu

SEQ ID NO: 243060 - RNA, 32 nt, Human
ucuuggcucacugcaaacccgccucccagguu

SEQ ID NO: 243061 - RNA, 32 nt, Human
ucuuggcucacugcaaacuccgccuuccaggu

SEQ ID NO: 243062 - RNA, 32 nt, Human
ucuuggcucacugcaaacucugccuaccaggu

SEQ ID NO: 243063 - RNA, 32 nt, Human
ucuuggcucacugcaaacucugccuuuugggu

SEQ ID NO: 243064 - RNA, 32 nt, Human
ucuuggcucacugcaacauccgccucccgggu

SEQ ID NO: 243065 - RNA, 32 nt, Human
ucuuggcucacugcaacaucugacuccugggu

SEQ ID NO: 243066 - RNA, 32 nt, Human
ucuuggcucacugcaaccacugcuuccugggu

SEQ ID NO: 243067 - RNA, 32 nt, Human
ucuuggcucacugcaaccacugucucccgggu

SEQ ID NO: 243068 - RNA, 32 nt, Human
ucuuggcucacugcaacccccaccucccgggu

SEQ ID NO: 243069 - RNA, 32 nt, Human
ucuuggcucacugcaacccccgccaccuaggu

SEQ ID NO: 243070 - RNA, 32 nt, Human
ucuuggcucacugcaacccccgccuccagggu

SEQ ID NO: 243071 - RNA, 32 nt, Human
ucuuggcucacugcaaccccgccucccagguu

SEQ ID NO: 243072 - RNA, 32 nt, Human
ucuuggcucacugcaacccucccucccggguu

SEQ ID NO: 243073 - RNA, 32 nt, Human
ucuuggcucacugcaaccucaaccagcccagg

SEQ ID NO: 243074 - RNA, 32 nt, Human
ucuuggcucacugcaaccucagccucccaggu

SEQ ID NO: 243075 - RNA, 32 nt, Human
ucuuggcucacugcaaccuccacccgccgggu

SEQ ID NO: 243076 - RNA, 32 nt, Human
ucuuggcucacugcaaccuccaccuccagguu

SEQ ID NO: 243077 - RNA, 32 nt, Human
ucuuggcucacugcaaccuccaccucccaggu

SEQ ID NO: 243078 - RNA, 32 nt, Human
ucuuggcucacugcaaccuccaccucccaguu

SEQ ID NO: 243079 - RNA, 32 nt, Human
ucuuggcucacugcaaccuccaccucccgggu

SEQ ID NO: 243080 - RNA, 32 nt, Human
ucuuggcucacugcaaccuccaccuccugggc

SEQ ID NO: 243081 - RNA, 32 nt, Human
ucuuggcucacugcaaccuccaccuccugggu

SEQ ID NO: 243082 - RNA, 32 nt, Human
ucuuggcucacugcaaccuccaccucugggau

SEQ ID NO: 243083 - RNA, 32 nt, Human
ucuuggcucacugcaaccuccaccuuccuggu

SEQ ID NO: 243084 - RNA, 32 nt, Human
ucuuggcucacugcaaccuccacuucccaggu

SEQ ID NO: 243085 - RNA, 32 nt, Human
ucuuggcucacugcaaccuccacuucccgggu

SEQ ID NO: 243086 - RNA, 32 nt, Human
ucuuggcucacugcaaccuccacuuccugggu

SEQ ID NO: 243087 - RNA, 32 nt, Human
ucuuggcucacugcaaccuccacuucucaggu

SEQ ID NO: 243088 - RNA, 32 nt, Human
ucuuggcucacugcaaccuccgacucccaggu

SEQ ID NO: 243089 - RNA, 32 nt, Human
ucuuggcucacugcaaccuccgacucccuggu

SEQ ID NO: 243090 - RNA, 32 nt, Human
ucuuggcucacugcaaccuccgccuccagggc

SEQ ID NO: 243091 - RNA, 32 nt, Human
ucuuggcucacugcaaccuccgccuccagggu

SEQ ID NO: 243092 - RNA, 32 nt, Human
ucuuggcucacugcaaccuccgccucccaggu

SEQ ID NO: 243093 - RNA, 32 nt, Human
ucuuggcucacugcaaccuccgccucccgagu

SEQ ID NO: 243094 - RNA, 32 nt, Human
ucuuggcucacugcaaccuccgccucccgggu

SEQ ID NO: 243095 - RNA, 32 nt, Human
ucuuggcucacugcaaccuccgccucccuggu

SEQ ID NO: 243096 - RNA, 32 nt, Human
ucuuggcucacugcaaccuccgccuccugggu

SEQ ID NO: 243097 - RNA, 32 nt, Human
ucuuggcucacugcaaccuccgccucucaggu

SEQ ID NO: 243098 - RNA, 32 nt, Human
ucuuggcucacugcaaccuccgccucucgggu

SEQ ID NO: 243099 - RNA, 32 nt, Human
ucuuggcucacugcaaccuccgccucuugggu

SEQ ID NO: 243100 - RNA, 32 nt, Human
ucuuggcucacugcaaccuccgccuuccuggu

SEQ ID NO: 243101 - RNA, 32 nt, Human
ucuuggcucacugcaaccuccgucucccaggu

SEQ ID NO: 243102 - RNA, 32 nt, Human
ucuuggcucacugcaaccuccgucuccugggu

SEQ ID NO: 243103 - RNA, 32 nt, Human
ucuuggcucacugcaaccuccgucuuccgggu

SEQ ID NO: 243104 - RNA, 32 nt, Human
ucuuggcucacugcaaccuccuccucccgggu

SEQ ID NO: 243105 - RNA, 32 nt, Human
ucuuggcucacugcaaccuccugcuuccuggg

SEQ ID NO: 243106 - RNA, 32 nt, Human
ucuuggcucacugcaaccucuaccuccugggu

SEQ ID NO: 243107 - RNA, 32 nt, Human
ucuuggcucacugcaaccucugccaccugggu

SEQ ID NO: 243108 - RNA, 32 nt, Human
ucuuggcucacugcaaccucugccccaccaaa

SEQ ID NO: 243109 - RNA, 32 nt, Human
ucuuggcucacugcaaccucugccuaccggau

SEQ ID NO: 243110 - RNA, 32 nt, Human
ucuuggcucacugcaaccucugccucacaggc

SEQ ID NO: 243111 - RNA, 32 nt, Human
ucuuggcucacugcaaccucugccucacaggu

SEQ ID NO: 243112 - RNA, 32 nt, Human
ucuuggcucacugcaaccucugccucccaggu

SEQ ID NO: 243113 - RNA, 32 nt, Human
ucuuggcucacugcaaccucugccucccgggc

SEQ ID NO: 243114 - RNA, 32 nt, Human
ucuuggcucacugcaaccucugccucccgggu

SEQ ID NO: 243115 - RNA, 29 nt, Human
ucuuggcucacugcaaccucugccuccug

SEQ ID NO: 243116 - RNA, 32 nt, Human
ucuuggcucacugcaaccucugccuccugaau

SEQ ID NO: 243117 - RNA, 32 nt, Human
ucuuggcucacugcaaccucugccuccugggc

SEQ ID NO: 243118 - RNA, 32 nt, Human
ucuuggcucacugcaaccucugccuccugggu

SEQ ID NO: 243119 - RNA, 32 nt, Human
ucuuggcucacugcaaccucugccuccuucgu

SEQ ID NO: 243120 - RNA, 32 nt, Human
ucuuggcucacugcaaccucugccuccuuggu

SEQ ID NO: 243121 - RNA, 32 nt, Human
ucuuggcucacugcaaccucugccugccgggu

SEQ ID NO: 243122 - RNA, 32 nt, Human
ucuuggcucacugcaaccucugccuucugggu

SEQ ID NO: 243123 - RNA, 32 nt, Human
ucuuggcucacugcaaccucugcgggcucacg

SEQ ID NO: 243124 - RNA, 32 nt, Human
ucuuggcucacugcaaccucugcuucccaggu

SEQ ID NO: 243125 - RNA, 32 nt, Human
ucuuggcucacugcaaccucugcuucccgagu

SEQ ID NO: 243126 - RNA, 32 nt, Human
ucuuggcucacugcaaccucugcuucccgggu

SEQ ID NO: 243127 - RNA, 32 nt, Human
ucuuggcucacugcaaccucugucucccaggu

SEQ ID NO: 243128 - RNA, 32 nt, Human
ucuuggcucacugcaaccucugucuccugggc

SEQ ID NO: 243129 - RNA, 32 nt, Human
ucuuggcucacugcaaccucugucuuccaggu

SEQ ID NO: 243130 - RNA, 32 nt, Human
ucuuggcucacugcaaccucuguguccugggc

SEQ ID NO: 243131 - RNA, 32 nt, Human
ucuuggcucacugcaaccucuuccuccugguu

SEQ ID NO: 243132 - RNA, 32 nt, Human
ucuuggcucacugcaaccugcgccuccugggu

SEQ ID NO: 243133 - RNA, 32 nt, Human
ucuuggcucacugcaacguccgccucccaggu

SEQ ID NO: 243134 - RNA, 32 nt, Human
ucuuggcucacugcaacgucugccuccugggu

SEQ ID NO: 243135 - RNA, 32 nt, Human
ucuuggcucacugcaacucugcuucccagguu

SEQ ID NO: 243136 - RNA, 32 nt, Human
ucuuggcucacugcaacuuccaccucugggau

SEQ ID NO: 243137 - RNA, 32 nt, Human
ucuuggcucacugcaacuuccacuucccgggu

SEQ ID NO: 243138 - RNA, 32 nt, Human
ucuuggcucacugcaacuuccgccuccugugu

SEQ ID NO: 243139 - RNA, 32 nt, Human
ucuuggcucacugcaacuuccgucucccgggu

SEQ ID NO: 243140 - RNA, 32 nt, Human
ucuuggcucacugcaacuucuaccuccgaggu

SEQ ID NO: 243141 - RNA, 32 nt, Human
ucuuggcucacugcaacuucugccaccugggu

SEQ ID NO: 243142 - RNA, 32 nt, Human
ucuuggcucacugcaacuucugccucuugggu

SEQ ID NO: 243143 - RNA, 32 nt, Human
ucuuggcucacugcaacuucugccuuccaggu

SEQ ID NO: 243144 - RNA, 32 nt, Human
ucuuggcucacugcaacuugggccucccaggu

SEQ ID NO: 243145 - RNA, 32 nt, Human
ucuuggcucacugcaagcuccaccuccugggu

SEQ ID NO: 243146 - RNA, 32 nt, Human
ucuuggcucacugcaagcuccgccucccaggu

SEQ ID NO: 243147 - RNA, 32 nt, Human
ucuuggcucacugcaagcuccgccucccgagu

SEQ ID NO: 243148 - RNA, 32 nt, Human
ucuuggcucacugcaagcuccgccucccggcu

SEQ ID NO: 243149 - RNA, 32 nt, Human
ucuuggcucacugcaagcuccgccucccgggu

SEQ ID NO: 243150 - RNA, 32 nt, Human
ucuuggcucacugcaagcuccgccuccugggu

SEQ ID NO: 243151 - RNA, 32 nt, Human
ucuuggcucacugcaagcuccgccucucgggu

SEQ ID NO: 243152 - RNA, 32 nt, Human
ucuuggcucacugcaagcuccgucugccgggu

SEQ ID NO: 243153 - RNA, 32 nt, Human
ucuuggcucacugcaagcucugcccuccccgg

SEQ ID NO: 243154 - RNA, 32 nt, Human
ucuuggcucacugcaagcuuccccuuccgggu

SEQ ID NO: 243155 - RNA, 32 nt, Human
ucuuggcucacugcaaucucuauccccugggu

SEQ ID NO: 243156 - RNA, 32 nt, Human
ucuuggcucacugcaaucucugccucucgggu

SEQ ID NO: 243157 - RNA, 32 nt, Human
ucuuggcucacugcaaucucugccuuccgggu

SEQ ID NO: 243158 - RNA, 32 nt, Human
ucuuggcucacugcacccuccgccuccugggc

SEQ ID NO: 243159 - RNA, 32 nt, Human
ucuuggcucacugcaccuccaccuuccgggcu

SEQ ID NO: 243160 - RNA, 32 nt, Human
ucuuggcucacugcaccucugucucccaaguu

SEQ ID NO: 243161 - RNA, 32 nt, Human
ucuuggcucacugcagacuucaccuccugagu

SEQ ID NO: 243162 - RNA, 32 nt, Human
ucuuggcucacugcagccucaaccuguugggg

SEQ ID NO: 243163 - RNA, 32 nt, Human
ucuuggcucacugcagccucaacuuccagcgc

SEQ ID NO: 243164 - RNA, 32 nt, Human
ucuuggcucacugcagccuccaccuccccggu

SEQ ID NO: 243165 - RNA, 32 nt, Human
ucuuggcucacugcagccuccaccucccgggu

SEQ ID NO: 243166 - RNA, 32 nt, Human
ucuuggcucacugcagccuccaccuccugggc

SEQ ID NO: 243167 - RNA, 32 nt, Human
ucuuggcucacugcagccuccgccucccgggu

SEQ ID NO: 243168 - RNA, 32 nt, Human
ucuuggcucacugcagccucgacuuccugggc

SEQ ID NO: 243169 - RNA, 32 nt, Human
ucuuggcucacugcagccucugccucccaggu

SEQ ID NO: 243170 - RNA, 32 nt, Human
ucuuggcucacugcagccucugccucccgggu

SEQ ID NO: 243171 - RNA, 32 nt, Human
ucuuggcucacugcagccucugccuccugagu

SEQ ID NO: 243172 - RNA, 32 nt, Human
ucuuggcucacugcagccucugccuccugggu

SEQ ID NO: 243173 - RNA, 32 nt, Human
ucuuggcucacugcagccuucgccucccgggu

SEQ ID NO: 243174 - RNA, 32 nt, Human
ucuuggcucacugcaggcucugccucccgguu

SEQ ID NO: 243175 - RNA, 32 nt, Human
ucuuggcucacugcauccuccgccuuccaggu

SEQ ID NO: 243176 - RNA, 32 nt, Human
ucuuggcucacugcggccucugccucccggcu

SEQ ID NO: 243177 - RNA, 32 nt, Human
ucuuggcucacugcugcaaccucccccuccug

SEQ ID NO: 243178 - RNA, 32 nt, Human
ucuuggcucacuguaaacucaagcuccugaac

SEQ ID NO: 243179 - RNA, 32 nt, Human
ucuuggcucacuguaaccuccaccucccaggc

SEQ ID NO: 243180 - RNA, 32 nt, Human
ucuuggcucacuguaaccuccgccucccaggu

SEQ ID NO: 243181 - RNA, 32 nt, Human
ucuuggcucacuguaaccuccgccucccgggu

SEQ ID NO: 243182 - RNA, 32 nt, Human
ucuuggcucacuguaaccucugccuccaggau

SEQ ID NO: 243183 - RNA, 32 nt, Human
ucuuggcucacuguaaccucugccucccaguu

SEQ ID NO: 243184 - RNA, 32 nt, Human
ucuuggcucacuguaacuuccacuugccaggc

SEQ ID NO: 243185 - RNA, 32 nt, Human
ucuuggcucacuguagccuugacauccugggc

SEQ ID NO: 243186 - RNA, 32 nt, Human
ucuuggcucacuucaaccuccgcccccaaggu

SEQ ID NO: 243187 - RNA, 32 nt, Human
ucuuggcucacuuuaaccuccacuucccuggu

SEQ ID NO: 243188 - RNA, 32 nt, Human
ucuuggcucagugcaaccuccgccuccugggu

SEQ ID NO: 243189 - RNA, 32 nt, Human
ucuuggcucaucguaaccuccaccucccgggu

SEQ ID NO: 243190 - RNA, 32 nt, Human
ucuuggcucauugcaaccuccgccucccuccc

SEQ ID NO: 243191 - RNA, 32 nt, Human
ucuuggcucauugcaaccucugccucccaggu

SEQ ID NO: 243192 - RNA, 32 nt, Human
ucuuggcuccaagugauacuucugccuuggcc

SEQ ID NO: 243193 - RNA, 32 nt, Human
ucuuggcucccuacaacuuccaccucccaggu

SEQ ID NO: 243194 - RNA, 32 nt, Human
ucuuggcucccugcaaccucugcuuccugggu

SEQ ID NO: 243195 - RNA, 32 nt, Human
ucuuggcuccugggagcgacucuugcuaccca

SEQ ID NO: 243196 - RNA, 32 nt, Human
ucuuggcuccuugccaguuccaaugcucccag

SEQ ID NO: 243197 - RNA, 32 nt, Human
ucuuggcucgcugcaaccucagcuuccagagu

SEQ ID NO: 243198 - RNA, 32 nt, Human
ucuuggcucgcugcaaccuccgccucccaggu

SEQ ID NO: 243199 - RNA, 30 nt, Human
ucuuggcucgcugcaaccucugccuccugg

SEQ ID NO: 243200 - RNA, 32 nt, Human
ucuuggcucgcugcaaccuucacccuucaccu

SEQ ID NO: 243201 - RNA, 32 nt, Human
ucuuggcucgcugcagccuccaccucccaggu

SEQ ID NO: 243202 - RNA, 32 nt, Human
ucuuggcucucugcaaccucugccucccaggu

SEQ ID NO: 243203 - RNA, 32 nt, Human
ucuuggcucugcaaccuccacuucccagguuc

SEQ ID NO: 243204 - RNA, 32 nt, Human
ucuuggcucugcaaccuccgccucccgguuua

SEQ ID NO: 243205 - RNA, 31 nt, Human
ucuuggcucugcucagccaugccaggcagga

SEQ ID NO: 243206 - RNA, 32 nt, Human
ucuuggcucuuugcaaccucugccuccugggc

SEQ ID NO: 243207 - RNA, 32 nt, Human
ucuuggcugacugcaacuucugccuccugggu

SEQ ID NO: 243208 - RNA, 32 nt, Human
ucuuggcugcacacuucugcucuaagagucuc

SEQ ID NO: 243209 - RNA, 19 nt, Human
ucuuggcuggagugagugg

SEQ ID NO: 243210 - RNA, 32 nt, Human
ucuuggcuuacuacaaccuccgccuccugggu

SEQ ID NO: 243211 - RNA, 32 nt, Human
ucuuggcuuacugcaaccuccaccucccaggu

SEQ ID NO: 243212 - RNA, 32 nt, Human
ucuuggcuuacugcaaccuccaccuccugggu

SEQ ID NO: 243213 - RNA, 32 nt, Human
ucuuggcuuacugcaaccuccgccucccaggu

SEQ ID NO: 243214 - RNA, 32 nt, Human
ucuuggcuuacugcaaccuccgccuccugggu

SEQ ID NO: 243215 - RNA, 32 nt, Human
ucuuggcuuacugcaaccucugccucccaggu

SEQ ID NO: 243216 - RNA, 32 nt, Human
ucuuggcuuacugcaacuuccgacucccaggu

SEQ ID NO: 243217 - RNA, 23 nt, Human
ucuuggcuuauugaagccucugc

SEQ ID NO: 243218 - RNA, 32 nt, Human
ucuuggcuuccucuuauucuuccacaaaccau

SEQ ID NO: 243219 - RNA, 32 nt, Human
ucuuggcuucggguugagaugagggacaggga

SEQ ID NO: 243220 - RNA, 32 nt, Human
ucuuggcuucuccaaaaggguuuauacggacu

SEQ ID NO: 243221 - RNA, 32 nt, Human
ucuuggcuucuuguccccuccuggggucaucc

SEQ ID NO: 243222 - RNA, 32 nt, Human
ucuuggcuuucugcaaccucugccucccaggu

SEQ ID NO: 243223 - RNA, 32 nt, Human
ucuugggaaacccagcccugguggcuccugca

SEQ ID NO: 243224 - RNA, 32 nt, Human
ucuugggaaaggggugaauucacugggucaug

SEQ ID NO: 243225 - RNA, 32 nt, Human
ucuugggaaggaguuuuauguuguuuaaaaga

SEQ ID NO: 243226 - RNA, 32 nt, Human
ucuugggagaugacuccucuucagagcaccug

SEQ ID NO: 243227 - RNA, 32 nt, Human
ucuugggagccagcgguauggcgucgggcugc

SEQ ID NO: 243228 - RNA, 32 nt, Human
ucuugggagcuggggaggaggcugcggaggcu

SEQ ID NO: 243229 - RNA, 32 nt, Human
ucuugggaggccauaaaccuauguugcuggga

SEQ ID NO: 243230 - RNA, 32 nt, Human
ucuugggaggcugagaugggaaucacuugaac

SEQ ID NO: 243231 - RNA, 32 nt, Human
ucuugggaggcugaggcaggauugcuugagcc

SEQ ID NO: 243232 - RNA, 32 nt, Human
ucuugggaggcugaggcgggaguaucauuuga

SEQ ID NO: 243233 - RNA, 32 nt, Human
ucuugggaggcugaggugggaggauccacuga

SEQ ID NO: 243234 - RNA, 32 nt, Human
ucuugggaggcugaggugggaggauugcuuga

SEQ ID NO: 243235 - RNA, 32 nt, Human
ucuugggagugaggacuuggggcaggugggua

SEQ ID NO: 243236 - RNA, 27 nt, Human
ucuugggauaguguucugcuccugcuu

SEQ ID NO: 243237 - RNA, 32 nt, Human
ucuugggcauuuuccccugcccugaaagcgua

SEQ ID NO: 243238 - RNA, 32 nt, Human
ucuugggccaucugagggcuccugggucacuc

SEQ ID NO: 243239 - RNA, 32 nt, Human
ucuugggcccaagugauacucccaccucugcc

SEQ ID NO: 243240 - RNA, 22 nt, Human
ucuugggcccagccagcugggc

SEQ ID NO: 243241 - RNA, 32 nt, Human
ucuugggcucaagcaauccuccugccucagcc

SEQ ID NO: 243242 - RNA, 32 nt, Human
ucuugggcucaagcacuccucccuccucagcc

SEQ ID NO: 243243 - RNA, 32 nt, Human
ucuugggcucaagcagugcuccaaccucagcc

SEQ ID NO: 243244 - RNA, 27 nt, Human
ucuugggcucaagccauccuucugccu

SEQ ID NO: 243245 - RNA, 32 nt, Human
ucuugggcucaagccauccuucugccucacug

SEQ ID NO: 243246 - RNA, 32 nt, Human
ucuugggcucaagcgauccucccaccugggac

SEQ ID NO: 243247 - RNA, 32 nt, Human
ucuugggcucaagugauccucccgccucagcc

SEQ ID NO: 243248 - RNA, 32 nt, Human
ucuugggcucaagugauccucucgccuuggcc

SEQ ID NO: 243249 - RNA, 32 nt, Human
ucuugggcucacugcagccucaaccucccagg

SEQ ID NO: 243250 - RNA, 32 nt, Human
ucuugggcucaggugauccucccaccuuggcc

SEQ ID NO: 243251 - RNA, 32 nt, Human
ucuugggcugagagcaggaacaacgcgguagg

SEQ ID NO: 243252 - RNA, 32 nt, Human
ucuugggcuggggcaucucaggaacagugagg

SEQ ID NO: 243253 - RNA, 20 nt, Human
ucuugggcugggugcagugg

SEQ ID NO: 243254 - RNA, 32 nt, Human
ucuugggcugugagcuguguucuguccuuccu

SEQ ID NO: 243255 - RNA, 24 nt, Human
ucuuggggaaggggcaccucucuu

SEQ ID NO: 243256 - RNA, 32 nt, Human
ucuuggggaccugaguuugggugggguggcag

SEQ ID NO: 243257 - RNA, 23 nt, Human
ucuuggggagaagagcauccugc

SEQ ID NO: 243258 - RNA, 22 nt, Human
ucuuggggagaagaguaugcuu

SEQ ID NO: 243259 - RNA, 20 nt, Human
ucuuggggagagaccgugcu

SEQ ID NO: 243260 - RNA, 32 nt, Human
ucuuggggagagaggaggaggugacugcuuag

SEQ ID NO: 243261 - RNA, 22 nt, Human
ucuuggggagaggagauuucgc

SEQ ID NO: 243262 - RNA, 21 nt, Human
ucuuggggagagggaacccug

SEQ ID NO: 243263 - RNA, 32 nt, Human
ucuuggggaggcagaggcaggaggaucgcuug

SEQ ID NO: 243264 - RNA, 32 nt, Human
ucuuggggagguggccgggugcaguggcucgc

SEQ ID NO: 243265 - RNA, 32 nt, Human
ucuuggggauaugagcucuaaauaugagaagc

SEQ ID NO: 243266 - RNA, 20 nt, Human
ucuuggggauuaaccucugc

SEQ ID NO: 243267 - RNA, 32 nt, Human
ucuuggggcaggacagcagaggaugugcuggg

SEQ ID NO: 243268 - RNA, 32 nt, Human
ucuuggggcccagcugcagccugcugccugcc

SEQ ID NO: 243269 - RNA, 32 nt, Human
ucuugggggccaggauccaccugcuggaacca

SEQ ID NO: 243270 - RNA, 26 nt, Human
ucuugggggcuugcuacuuuuugucu

SEQ ID NO: 243271 - RNA, 32 nt, Human
ucuugggggugagaggagaaggagggagggaa

SEQ ID NO: 243272 - RNA, 32 nt, Human
ucuuggggugugcggggagggagccagggagu

SEQ ID NO: 243273 - RNA, 32 nt, Human
ucuugggguucauuugugcaggccgguuggcc

SEQ ID NO: 243274 - RNA, 24 nt, Human
ucuugggguugcccccucuuguuu

SEQ ID NO: 243275 - RNA, 25 nt, Human
ucuuggguacucgcaccucuuggcu

SEQ ID NO: 243276 - RNA, 32 nt, Human
ucuuggguacugccuucugcccccaaaucucu

SEQ ID NO: 243277 - RNA, 32 nt, Human
ucuugggucacugcaaacuccgccucccaggu

SEQ ID NO: 243278 - RNA, 32 nt, Human
ucuugggucacugcaaccucugccuccugggu

SEQ ID NO: 243279 - RNA, 32 nt, Human
ucuugggucacugcagccuccaacuccuuggc

SEQ ID NO: 243280 - RNA, 32 nt, Human
ucuugggucucccauuccagcuucccugucuc

SEQ ID NO: 243281 - RNA, 24 nt, Human
ucuugggucuccuacuuccugucu

SEQ ID NO: 243282 - RNA, 32 nt, Human
ucuugggugaagccuagacaaagccgccaggu

SEQ ID NO: 243283 - RNA, 32 nt, Human
ucuugggugaagguauugcugucucuaagcca

SEQ ID NO: 243284 - RNA, 32 nt, Human
ucuugggugaagguauugcugucucuaaggca

SEQ ID NO: 243285 - RNA, 32 nt, Human
ucuugggugagcugaugacugcuucaaccaau

SEQ ID NO: 243286 - RNA, 32 nt, Human
ucuugggugccagcagagccauucaguacaac

SEQ ID NO: 243287 - RNA, 32 nt, Human
ucuugggugggaacuuggaggcauuggauauu

SEQ ID NO: 243288 - RNA, 32 nt, Human
ucuugggugggagggaguuggggaagggaggu

SEQ ID NO: 243289 - RNA, 22 nt, Human
ucuugggugugugccuucugcc

SEQ ID NO: 243290 - RNA, 32 nt, Human
ucuuggguuacugcaaccucugccccucggga

SEQ ID NO: 243291 - RNA, 32 nt, Human
ucuuggguucaagcgauucuccugccucagcc

SEQ ID NO: 243292 - RNA, 32 nt, Human
ucuuggguucaagcgauucuccugccucaguc

SEQ ID NO: 243293 - RNA, 32 nt, Human
ucuuggguucaagugauucuccugccucagcc

SEQ ID NO: 243294 - RNA, 32 nt, Human
ucuuggguucaagugauucuccugucucagcc

SEQ ID NO: 243295 - RNA, 32 nt, Human
ucuuggguucaagugauucuuccaccucagcc

SEQ ID NO: 243296 - RNA, 32 nt, Human
ucuuggguucaagugauucuugugccucagcc

SEQ ID NO: 243297 - RNA, 32 nt, Human
ucuuggguucaugccauucuccugccucagcc

SEQ ID NO: 243298 - RNA, 32 nt, Human
ucuuggguuggcagagugugaaggggcaagag

SEQ ID NO: 243299 - RNA, 32 nt, Human
ucuuggguuucagugauuuuucugccucggcc

SEQ ID NO: 243300 - RNA, 32 nt, Human
ucuugguagcugguguggagggccgguguccu

SEQ ID NO: 243301 - RNA, 32 nt, Human
ucuugguaugaacaguugacuucaugguggag

SEQ ID NO: 243302 - RNA, 23 nt, Human
ucuuggucaagacaccaggcagg

SEQ ID NO: 243303 - RNA, 32 nt, Human
ucuuggucccugucuacuaagagucaugaagg

SEQ ID NO: 243304 - RNA, 32 nt, Human
ucuugguccuguuaacccuccaccuccucucu

SEQ ID NO: 243305 - RNA, 28 nt, Human
ucuuggucucaaguugccucauugcggc

SEQ ID NO: 243306 - RNA, 32 nt, Human
ucuuggucuccacagaaccacagugccuuaag

SEQ ID NO: 243307 - RNA, 32 nt, Human
ucuuggucugaguaggcaucaugugggggcca

SEQ ID NO: 243308 - RNA, 32 nt, Human
ucuuggucuuuccuuaaaaagacuugguaaau

SEQ ID NO: 243309 - RNA, 32 nt, Human
ucuuggugcacuucucacucuuccugccuguu

SEQ ID NO: 243310 - RNA, 32 nt, Human
ucuuggugccacccucuccacuccuacugcca

SEQ ID NO: 243311 - RNA, 24 nt, Human
ucuuggugcccaggcuagagugca

SEQ ID NO: 243312 - RNA, 32 nt, Human
ucuuggugcccaggcuagagugcaauggcgcg

SEQ ID NO: 243313 - RNA, 32 nt, Human
ucuuggugcuaccugauggaauuccugcacuu

SEQ ID NO: 243314 - RNA, 24 nt, Human
ucuuggugcuauuucauuccugcu

SEQ ID NO: 243315 - RNA, 32 nt, Human
ucuuggugcucaaggguauaaguggccgggaa

SEQ ID NO: 243316 - RNA, 32 nt, Human
ucuuggugcucuggguagugagggaugaccag

SEQ ID NO: 243317 - RNA, 32 nt, Human
ucuugguggcagugguagcagcaacagcagca

SEQ ID NO: 243318 - RNA, 32 nt, Human
ucuugguggccgcugcuggagcgcggccugcg

SEQ ID NO: 243319 - RNA, 32 nt, Human
ucuugguggcucugcugucucagcccagccuu

SEQ ID NO: 243320 - RNA, 32 nt, Human
ucuugguggggaggggauguuaucagcuucug

SEQ ID NO: 243321 - RNA, 32 nt, Human
ucuugguguuaacuauguuaguagauucuuca

SEQ ID NO: 243322 - RNA, 32 nt, Human
ucuugguguugcaugcucacaacucugcugac

SEQ ID NO: 243323 - RNA, 32 nt, Human
ucuugguuagcccacuuucccucuccaugugg

SEQ ID NO: 243324 - RNA, 32 nt, Human
ucuugguucacugcaaccuccaccuccagggu

SEQ ID NO: 243325 - RNA, 32 nt, Human
ucuugguucacugcaaccuccaccucccaggu

SEQ ID NO: 243326 - RNA, 32 nt, Human
ucuugguucacugcaaccuccaccucuugggu

SEQ ID NO: 243327 - RNA, 32 nt, Human
ucuugguucacugcaaccuccgcauccggggu

SEQ ID NO: 243328 - RNA, 32 nt, Human
ucuugguucacugcaaccuccgccuccuggau

SEQ ID NO: 243329 - RNA, 32 nt, Human
ucuugguucacugcaaccucugccucccaggu

SEQ ID NO: 243330 - RNA, 32 nt, Human
ucuugguucacugcaaccucugccucccgggu

SEQ ID NO: 243331 - RNA, 32 nt, Human
ucuugguucacugcaagcuccaccucccgggu

SEQ ID NO: 243332 - RNA, 32 nt, Human
ucuugguucaucuccagcccgugagcuggucc

SEQ ID NO: 243333 - RNA, 32 nt, Human
ucuugguucugcaugguacauuuugccaaccc

SEQ ID NO: 243334 - RNA, 32 nt, Human
ucuugguuggcaagacuuggguguagauauga

SEQ ID NO: 243335 - RNA, 32 nt, Human
ucuugguugucccagagacaccuguguguguc

SEQ ID NO: 243336 - RNA, 32 nt, Human
ucuugguuuacugcaaccuccaccuccuaggc

SEQ ID NO: 243337 - RNA, 32 nt, Human
ucuugguuucccguugugcccaugaaggcgcc

SEQ ID NO: 243338 - RNA, 32 nt, Human
ucuugguuucuuuucuugccuuccccuacuuu

SEQ ID NO: 243339 - RNA, 32 nt, Human
ucuugguuuggucccuagaaauggcagccugc

SEQ ID NO: 243340 - RNA, 32 nt, Human
ucuugguuugguucuaacaaacucucauguuc

SEQ ID NO: 243341 - RNA, 32 nt, Human
ucuugguuuuccaugaauacagcauguauaau

SEQ ID NO: 243342 - RNA, 32 nt, Human
ucuuguaaacucugcugcuucccaacacaacu

SEQ ID NO: 243343 - RNA, 32 nt, Human
ucuuguaaccacugagcacugaaggagagagg

SEQ ID NO: 243344 - RNA, 32 nt, Human
ucuuguaagauggauuucacccccaggccaau

SEQ ID NO: 243345 - RNA, 32 nt, Human
ucuuguaaucugcauucuccaggaguuuuaug

SEQ ID NO: 243346 - RNA, 32 nt, Human
ucuuguaauuaauuugguggguucuacuuguu

SEQ ID NO: 243347 - RNA, 32 nt, Human
ucuuguacaauacaguauuacaucccagaaac

SEQ ID NO: 243348 - RNA, 24 nt, Human
ucuuguacauuugugucucccuuc

SEQ ID NO: 243349 - RNA, 32 nt, Human
ucuuguaccaccagcaccacacuguuuuaauu

SEQ ID NO: 243350 - RNA, 32 nt, Human
ucuuguaccccaggcuggagugcaauggcgug

SEQ ID NO: 243351 - RNA, 24 nt, Human
ucuuguaccucugucccuuacucu

SEQ ID NO: 243352 - RNA, 32 nt, Human
ucuuguacgucucaucacagcugguagagacc

SEQ ID NO: 243353 - RNA, 32 nt, Human
ucuuguacuaggaucuagcauauuucacuauu

SEQ ID NO: 243354 - RNA, 32 nt, Human
ucuuguacuaugaauagcuucuugcuuuauga

SEQ ID NO: 243355 - RNA, 32 nt, Human
ucuuguagaauuugaugagacccucccuaguc

SEQ ID NO: 243356 - RNA, 32 nt, Human
ucuuguagcccaggcuggagugcaauggcagg

SEQ ID NO: 243357 - RNA, 32 nt, Human
ucuuguagcccaggcugggaugcaauggcaug

SEQ ID NO: 243358 - RNA, 32 nt, Human
ucuuguagcuuaacuacugccuccucauuuuu

SEQ ID NO: 243359 - RNA, 32 nt, Human
ucuuguauagccacugcauauuacauagccag

SEQ ID NO: 243360 - RNA, 32 nt, Human
ucuuguaucagcaacagaagccucagauuauc

SEQ ID NO: 243361 - RNA, 32 nt, Human
ucuuguauguaaguugcuuucuauuccaguau

SEQ ID NO: 243362 - RNA, 32 nt, Human
ucuuguauuauaauuaauuuucuacccccaga

SEQ ID NO: 243363 - RNA, 24 nt, Human
ucuuguauuuauugguuuugcaga

SEQ ID NO: 243364 - RNA, 32 nt, Human
ucuugucaaaccugagcacuccuccugcugaa

SEQ ID NO: 243365 - RNA, 32 nt, Human
ucuugucaaccagauuggagugcaguggugca

SEQ ID NO: 243366 - RNA, 32 nt, Human
ucuugucaaccgggcuggagugcaguggugca

SEQ ID NO: 243367 - RNA, 32 nt, Human
ucuugucacccacgcuggagugcaauggugug

SEQ ID NO: 243368 - RNA, 32 nt, Human
ucuugucacccagacuggagugcgauggcacg

SEQ ID NO: 243369 - RNA, 32 nt, Human
ucuugucacccaggcaggagugcaguggcguu

SEQ ID NO: 243370 - RNA, 32 nt, Human
ucuugucacccaggcuggaguacaaugaugcg

SEQ ID NO: 243371 - RNA, 32 nt, Human
ucuugucacccaggcuggaguacaguggcacg

SEQ ID NO: 243372 - RNA, 32 nt, Human
ucuugucacccaggcuggagugcaauggcacg

SEQ ID NO: 243373 - RNA, 32 nt, Human
ucuugucacccaggcuggagugcaauggcgcg

SEQ ID NO: 243374 - RNA, 32 nt, Human
ucuugucacccaggcuggagugcaguagugcg

SEQ ID NO: 243375 - RNA, 32 nt, Human
ucuugucacccaggcuggagugcaguggcaca

SEQ ID NO: 243376 - RNA, 32 nt, Human
ucuugucacccaggcuggagugcaguggcgca

SEQ ID NO: 243377 - RNA, 32 nt, Human
ucuugucacccaggcuggagugcaguggcgcc

SEQ ID NO: 243378 - RNA, 32 nt, Human
ucuugucacccaggcuggagugcaguggcgcg

SEQ ID NO: 243379 - RNA, 32 nt, Human
ucuugucacccaggcuggagugcaguggugca

SEQ ID NO: 243380 - RNA, 32 nt, Human
ucuugucacccaggcuggaguguaguggugug

SEQ ID NO: 243381 - RNA, 32 nt, Human
ucuugucaccccagcuggagugcaguagcacg

SEQ ID NO: 243382 - RNA, 32 nt, Human
ucuugucaccgaggcuggagugcaaugacaug

SEQ ID NO: 243383 - RNA, 32 nt, Human
ucuugucaccuagacuggagugcaauggcgug

SEQ ID NO: 243384 - RNA, 32 nt, Human
ucuugucaccuaggcaagagugcaauggcaca

SEQ ID NO: 243385 - RNA, 32 nt, Human
ucuugucaccuaggccagagugcagugucaug

SEQ ID NO: 243386 - RNA, 32 nt, Human
ucuugucaccucuucaagcuuucaagccuuua

SEQ ID NO: 243387 - RNA, 32 nt, Human
ucuugucacucaggcuggagugcaguggugug

SEQ ID NO: 243388 - RNA, 32 nt, Human
ucuugucacucauguccagaucugcagugcca

SEQ ID NO: 243389 - RNA, 32 nt, Human
ucuugucacugcacaacaguggccuggucccc

SEQ ID NO: 243390 - RNA, 32 nt, Human
ucuugucagacaauggcuauaaacugaauuag

SEQ ID NO: 243391 - RNA, 32 nt, Human
ucuugucagccugugaacuaggcccugccucu

SEQ ID NO: 243392 - RNA, 32 nt, Human
ucuugucauccuggcuggagugugauggugcg

SEQ ID NO: 243393 - RNA, 32 nt, Human
ucuugucaucuucucauccucugcgccaagaa

SEQ ID NO: 243394 - RNA, 32 nt, Human
ucuugucaugggguggaggggaaaguaggagg

SEQ ID NO: 243395 - RNA, 32 nt, Human
ucuuguccaaggcuggaguguaguagugcuau

SEQ ID NO: 243396 - RNA, 24 nt, Human
ucuuguccacaccccuuaucccca

SEQ ID NO: 243397 - RNA, 21 nt, Human
ucuuguccacauucuacuuca

SEQ ID NO: 243398 - RNA, 23 nt, Human
ucuuguccacauugugauguuca

SEQ ID NO: 243399 - RNA, 32 nt, Human
ucuuguccaggcuggaggagugcagucguaca

SEQ ID NO: 243400 - RNA, 32 nt, Human
ucuugucccagcagguugggggcgccugcccc

SEQ ID NO: 243401 - RNA, 32 nt, Human
ucuugucccccagacuggagugcaauggcacg

SEQ ID NO: 243402 - RNA, 32 nt, Human
ucuugucccccaggcuggaguggugcaguggc

SEQ ID NO: 243403 - RNA, 32 nt, Human
ucuugucccccaggcuugagugcaaugacuca

SEQ ID NO: 243404 - RNA, 32 nt, Human
ucuuguccucaagugauccucccaccuuagcc

SEQ ID NO: 243405 - RNA, 32 nt, Human
ucuuguccucaccaucacagcuguuaaagaug

SEQ ID NO: 243406 - RNA, 32 nt, Human
ucuuguccucaguuucgguauguuauccaaag

SEQ ID NO: 243407 - RNA, 32 nt, Human
ucuuguccuccacuacccucaggaaaccaaga

SEQ ID NO: 243408 - RNA, 24 nt, Human
ucuuguccugcugaaguaucucca

SEQ ID NO: 243409 - RNA, 32 nt, Human
ucuuguccugcuuccucacuguggaccccugu

SEQ ID NO: 243410 - RNA, 32 nt, Human
ucuuguccugggcccucaggucagccuggcug

SEQ ID NO: 243411 - RNA, 32 nt, Human
ucuuguccuguuucccuuccugcccuugcagu

SEQ ID NO: 243412 - RNA, 32 nt, Human
ucuugucgcccaggcuggagguuaauggcaug

SEQ ID NO: 243413 - RNA, 32 nt, Human
ucuugucgcccaggcuggagugcaacgguaug

SEQ ID NO: 243414 - RNA, 32 nt, Human
ucuugucgcccaggcuggagugcaauggcgca

SEQ ID NO: 243415 - RNA, 32 nt, Human
ucuugucgcccaggcuggagugcaauggcgug

SEQ ID NO: 243416 - RNA, 32 nt, Human
ucuugucgcccaggcuggagugcaguggcacg

SEQ ID NO: 243417 - RNA, 32 nt, Human
ucuugucgcccaggcuggagugcaguggcgca

SEQ ID NO: 243418 - RNA, 32 nt, Human
ucuugucgcccaggcuggagugcaguggcgug

SEQ ID NO: 243419 - RNA, 32 nt, Human
ucuugucgcccaggcuguagugcagugguaca

SEQ ID NO: 243420 - RNA, 32 nt, Human
ucuugucgcucagccuggagugcagugagcug

SEQ ID NO: 243421 - RNA, 32 nt, Human
ucuugucgcucaggcuggagugccauggcgcg

SEQ ID NO: 243422 - RNA, 32 nt, Human
ucuugucggccagcccacuccccagccagaga

SEQ ID NO: 243423 - RNA, 32 nt, Human
ucuugucggccaggcuagagugcaguggcgcu

SEQ ID NO: 243424 - RNA, 32 nt, Human
ucuugucuacaaaauuuggcagcugcaacaua

SEQ ID NO: 243425 - RNA, 32 nt, Human
ucuugucuacccacccucccucccccauccuc

SEQ ID NO: 243426 - RNA, 32 nt, Human
ucuugucuacugaacaaauaagugagagagug

SEQ ID NO: 243427 - RNA, 32 nt, Human
ucuugucuauacagauccucucuuucuuuccc

SEQ ID NO: 243428 - RNA, 32 nt, Human
ucuugucucacugcaaccucugccucccgggu

SEQ ID NO: 243429 - RNA, 32 nt, Human
ucuugucucagucuccuugauagccacuucac

SEQ ID NO: 243430 - RNA, 32 nt, Human
ucuugucuccauaauccucccuuucaaggaug

SEQ ID NO: 243431 - RNA, 32 nt, Human
ucuugucucccagacuggagugcaauggcaug

SEQ ID NO: 243432 - RNA, 32 nt, Human
ucuugucucccaggcuggagugcaaucgcgca

SEQ ID NO: 243433 - RNA, 32 nt, Human
ucuugucucccaggcuggagugcagugacaca

SEQ ID NO: 243434 - RNA, 32 nt, Human
ucuugucucccaucccagcacauugaggaugu

SEQ ID NO: 243435 - RNA, 32 nt, Human
ucuugucuccccggcuggagugcaguggcaug

SEQ ID NO: 243436 - RNA, 32 nt, Human
ucuugucuccugggaagagcuugcucccgccc

SEQ ID NO: 243437 - RNA, 32 nt, Human
ucuugucucucaggcuggguugcaauggcaca

SEQ ID NO: 243438 - RNA, 32 nt, Human
ucuugucucuccccugcguccugccaggaagc

SEQ ID NO: 243439 - RNA, 32 nt, Human
ucuugucugggugacagagugagaccccuagc

SEQ ID NO: 243440 - RNA, 32 nt, Human
ucuugucugguugaggacuuggggcaggaaag

SEQ ID NO: 243441 - RNA, 32 nt, Human
ucuugucuguaaucccagcgcucugggaggcu

SEQ ID NO: 243442 - RNA, 32 nt, Human
ucuugucuguucugccgcugugugggccuggg

SEQ ID NO: 243443 - RNA, 32 nt, Human
ucuugucuucccacgcaagaugugacaauguu

SEQ ID NO: 243444 - RNA, 23 nt, Human
ucuugucuuccccgcccuguccu

SEQ ID NO: 243445 - RNA, 32 nt, Human
ucuugucuucuuuuuaauuuauggacuagucu

SEQ ID NO: 243446 - RNA, 23 nt, Human
ucuugucuuucucccuccugcuu

SEQ ID NO: 243447 - RNA, 32 nt, Human
ucuugucuuuuucuuuucuuuuuaacuaagaa

SEQ ID NO: 243448 - RNA, 32 nt, Human
ucuugugaaaccagaaagaaaguucaagaaau

SEQ ID NO: 243449 - RNA, 32 nt, Human
ucuugugaccaccacaugucuagugauuauuu

SEQ ID NO: 243450 - RNA, 32 nt, Human
ucuugugagaucugguuguuuaaaaauaugug

SEQ ID NO: 243451 - RNA, 32 nt, Human
ucuugugagcagcaauaccucacuuuuuauca

SEQ ID NO: 243452 - RNA, 32 nt, Human
ucuugugagggcugggggcauccaggcacuca

SEQ ID NO: 243453 - RNA, 21 nt, Human
ucuugugcagagccucugcuu

SEQ ID NO: 243454 - RNA, 32 nt, Human
ucuugugccacagagcucagaaagcuaaagca

SEQ ID NO: 243455 - RNA, 32 nt, Human
ucuugugccaggaccagggaugacugggccau

SEQ ID NO: 243456 - RNA, 32 nt, Human
ucuugugccaugaugaauaaaaaguuaagcaa

SEQ ID NO: 243457 - RNA, 23 nt, Human
ucuugugcccaggcuggagugca

SEQ ID NO: 243458 - RNA, 32 nt, Human
ucuugugccuaggaguucgaggcugcaguggg

SEQ ID NO: 243459 - RNA, 32 nt, Human
ucuugugccuggcagcuacacgcccggggugg

SEQ ID NO: 243460 - RNA, 28 nt, Human
ucuugugcuagccacuggauuuugcaga

SEQ ID NO: 243461 - RNA, 25 nt, Human
ucuugugcugacuuucuccuguccu

SEQ ID NO: 243462 - RNA, 32 nt, Human
ucuugugcuguuccacucuuggcuccagcaga

SEQ ID NO: 243463 - RNA, 32 nt, Human
ucuugugcuuuaauacuuuauggcaggauugu

SEQ ID NO: 243464 - RNA, 32 nt, Human
ucuuguggaaggacagcaaggcugaggagaau

SEQ ID NO: 243465 - RNA, 32 nt, Human
ucuuguggagcuuagagguugguggggaagaa

SEQ ID NO: 243466 - RNA, 32 nt, Human
ucuuguggauaugagggaagagccaaauagac

SEQ ID NO: 243467 - RNA, 32 nt, Human
ucuuguggauccuguugggaccagccacucac

SEQ ID NO: 243468 - RNA, 32 nt, Human
ucuuguggcaaacacaagacccucuaugcguc

SEQ ID NO: 243469 - RNA, 32 nt, Human
ucuuguggccacucugggcucaccgggaacau

SEQ ID NO: 243470 - RNA, 32 nt, Human
ucuuguggcccuggcagaaucaagaugaggcc

SEQ ID NO: 243471 - RNA, 32 nt, Human
ucuugugggagccuaguggagagcagacgugg

SEQ ID NO: 243472 - RNA, 32 nt, Human
ucuugugggaggacacugcugggcacaguuaa

SEQ ID NO: 243473 - RNA, 32 nt, Human
ucuugugggaggcggugggcagcgacacuccu

SEQ ID NO: 243474 - RNA, 32 nt, Human
ucuuguggggagcaaggaggggaugagcggua

SEQ ID NO: 243475 - RNA, 32 nt, Human
ucuugugggggaaaaauucuaguauuuugauu

SEQ ID NO: 243476 - RNA, 32 nt, Human
ucuugugggugaccuggaugugagaccuggag

SEQ ID NO: 243477 - RNA, 21 nt, Human
ucuuguggguuuucuguuuga

SEQ ID NO: 243478 - RNA, 32 nt, Human
ucuuguguauuuuacuuuccauguaacacugu

SEQ ID NO: 243479 - RNA, 32 nt, Human
ucuuguguauuuuuguccauauccaauguuau

SEQ ID NO: 243480 - RNA, 32 nt, Human
ucuugugucacccaggcuggagugcaauggcg

SEQ ID NO: 243481 - RNA, 32 nt, Human
ucuugugucacccaggcuggcgugcagggccc

SEQ ID NO: 243482 - RNA, 21 nt, Human
ucuugugucacgucuccuccu

SEQ ID NO: 243483 - RNA, 24 nt, Human
ucuuguguccaggcuggagugcag

SEQ ID NO: 243484 - RNA, 32 nt, Human
ucuuguguccaggcuggagugcaguggcacua

SEQ ID NO: 243485 - RNA, 32 nt, Human
ucuugugucuuauguucucuguauuuaugcag

SEQ ID NO: 243486 - RNA, 32 nt, Human
ucuugugucuuucugccaggcaaaauccuggg

SEQ ID NO: 243487 - RNA, 32 nt, Human
ucuugugugacuggcccugccgucacagcugg

SEQ ID NO: 243488 - RNA, 32 nt, Human
ucuugugugguuuggcccuucuccuuuugaaa

SEQ ID NO: 243489 - RNA, 32 nt, Human
ucuuguguugaaaugugaugcccagccaggca

SEQ ID NO: 243490 - RNA, 32 nt, Human
ucuuguguugagauacacauaucuguacuuuu

SEQ ID NO: 243491 - RNA, 32 nt, Human
ucuuguguuggcuuaauuucuggaugggggcc

SEQ ID NO: 243492 - RNA, 32 nt, Human
ucuuguguuuaaccuaaugcucagccuuggua

SEQ ID NO: 243493 - RNA, 32 nt, Human
ucuuguuacccaggcaggagugcaguggcgug

SEQ ID NO: 243494 - RNA, 32 nt, Human
ucuuguuacccaggcuggagugcaauggcacg

SEQ ID NO: 243495 - RNA, 32 nt, Human
ucuuguuacccaggcuggagugcaguggcgcg

SEQ ID NO: 243496 - RNA, 32 nt, Human
ucuuguuacccaggcuggagugcaguggcgug

SEQ ID NO: 243497 - RNA, 32 nt, Human
ucuuguuagagagcuuuucacugugaggaagu

SEQ ID NO: 243498 - RNA, 32 nt, Human
ucuuguuauccaggcuggggugcaauggugcg

SEQ ID NO: 243499 - RNA, 32 nt, Human
ucuuguucaccuuccacuugucugcauaccuc

SEQ ID NO: 243500 - RNA, 32 nt, Human
ucuuguucaccuuccacuugucugcauauauc

SEQ ID NO: 243501 - RNA, 32 nt, Human
ucuuguucagguagucgcccuucugguuuguu

SEQ ID NO: 243502 - RNA, 32 nt, Human
ucuuguuccccaggcuggagugcaauggcacg

SEQ ID NO: 243503 - RNA, 32 nt, Human
ucuuguuccucugccauuccccaugaagccgu

SEQ ID NO: 243504 - RNA, 32 nt, Human
ucuuguucuccacuugugcuguuagaacucac

SEQ ID NO: 243505 - RNA, 32 nt, Human
ucuuguucuuucucaucgcucuccuugccagc

SEQ ID NO: 243506 - RNA, 32 nt, Human
ucuuguugaugaggcuggagugcaguggcgcg

SEQ ID NO: 243507 - RNA, 32 nt, Human
ucuuguugcaucuuuucuacuucaguacacuu

SEQ ID NO: 243508 - RNA, 32 nt, Human
ucuuguugcccaaccuggagugcaguggugcg

SEQ ID NO: 243509 - RNA, 32 nt, Human
ucuuguugcccaagcuggagugcaauggcacg

SEQ ID NO: 243510 - RNA, 32 nt, Human
ucuuguugcccaagcuggagugcaauggcgcg

SEQ ID NO: 243511 - RNA, 32 nt, Human
ucuuguugcccaagcuggagugcaguggcgcg

SEQ ID NO: 243512 - RNA, 32 nt, Human
ucuuguugcccaagcuggagugcaguggugca

SEQ ID NO: 243513 - RNA, 32 nt, Human
ucuuguugcccacgcuggagugcaauggugca

SEQ ID NO: 243514 - RNA, 32 nt, Human
ucuuguugcccagacuggagugcaauggcaca

SEQ ID NO: 243515 - RNA, 32 nt, Human
ucuuguugcccagccuggagugcaauagcgug

SEQ ID NO: 243516 - RNA, 32 nt, Human
ucuuguugcccaggcaggaguacaauggcagg

SEQ ID NO: 243517 - RNA, 32 nt, Human
ucuuguugcccaggccagagugcaauggcgug

SEQ ID NO: 243518 - RNA, 32 nt, Human
ucuuguugcccaggcccgagugcaguggugcg

SEQ ID NO: 243519 - RNA, 32 nt, Human
ucuuguugcccaggcggaguacaaugguggga

SEQ ID NO: 243520 - RNA, 32 nt, Human
ucuuguugcccaggcggagugcaguggaacaa

SEQ ID NO: 243521 - RNA, 32 nt, Human
ucuuguugcccaggcuagagggcaauggugca

SEQ ID NO: 243522 - RNA, 32 nt, Human
ucuuguugcccaggcuagagugcaauggcaca

SEQ ID NO: 243523 - RNA, 32 nt, Human
ucuuguugcccaggcuagagugcaauggcaug

SEQ ID NO: 243524 - RNA, 32 nt, Human
ucuuguugcccaggcuagagugcaauggcgcc

SEQ ID NO: 243525 - RNA, 32 nt, Human
ucuuguugcccaggcuagcaugcaauggugug

SEQ ID NO: 243526 - RNA, 32 nt, Human
ucuuguugcccaggcuaugggaagaaaugaaa

SEQ ID NO: 243527 - RNA, 32 nt, Human
ucuuguugcccaggcugaagugcaauguugug

SEQ ID NO: 243528 - RNA, 32 nt, Human
ucuuguugcccaggcugaagugcaguguugug

SEQ ID NO: 243529 - RNA, 32 nt, Human
ucuuguugcccaggcugcagugcaauggcaca

SEQ ID NO: 243530 - RNA, 32 nt, Human
ucuuguugcccaggcuggaaauggcgcgaucu

SEQ ID NO: 243531 - RNA, 32 nt, Human
ucuuguugcccaggcuggaaugcaauggcgcg

SEQ ID NO: 243532 - RNA, 32 nt, Human
ucuuguugcccaggcuggaaugcaguggcacg

SEQ ID NO: 243533 - RNA, 32 nt, Human
ucuuguugcccaggcuggagggcaauggugca

SEQ ID NO: 243534 - RNA, 32 nt, Human
ucuuguugcccaggcuggaguacaauggcaug

SEQ ID NO: 243535 - RNA, 32 nt, Human
ucuuguugcccaggcuggaguacaauggcgcg

SEQ ID NO: 243536 - RNA, 32 nt, Human
ucuuguugcccaggcuggaguacaauggcgug

SEQ ID NO: 243537 - RNA, 32 nt, Human
ucuuguugcccaggcuggaguacaauggugcg

SEQ ID NO: 243538 - RNA, 32 nt, Human
ucuuguugcccaggcuggaguacagugguaug

SEQ ID NO: 243539 - RNA, 32 nt, Human
ucuuguugcccaggcuggagugaaauggugcg

SEQ ID NO: 243540 - RNA, 32 nt, Human
ucuuguugcccaggcuggagugaaguggcgug

SEQ ID NO: 243541 - RNA, 32 nt, Human
ucuuguugcccaggcuggagugcaacggcacg

SEQ ID NO: 243542 - RNA, 32 nt, Human
ucuuguugcccaggcuggagugcaacggcaug

SEQ ID NO: 243543 - RNA, 32 nt, Human
ucuuguugcccaggcuggagugcaacggugca

SEQ ID NO: 243544 - RNA, 32 nt, Human
ucuuguugcccaggcuggagugcaauagcaug

SEQ ID NO: 243545 - RNA, 32 nt, Human
ucuuguugcccaggcuggagugcaauagcgca

SEQ ID NO: 243546 - RNA, 32 nt, Human
ucuuguugcccaggcuggagugcaauagcgcg

SEQ ID NO: 243547 - RNA, 32 nt, Human
ucuuguugcccaggcuggagugcaaugacacg

SEQ ID NO: 243548 - RNA, 32 nt, Human
ucuuguugcccaggcuggagugcaaugcgcga

SEQ ID NO: 243549 - RNA, 32 nt, Human
ucuuguugcccaggcuggagugcaauggagcg

SEQ ID NO: 243550 - RNA, 32 nt, Human
ucuuguugcccaggcuggagugcaauggcaca

SEQ ID NO: 243551 - RNA, 32 nt, Human
ucuuguugcccaggcuggagugcaauggcacc

SEQ ID NO: 243552 - RNA, 32 nt, Human
ucuuguugcccaggcuggagugcaauggcacg

SEQ ID NO: 243553 - RNA, 32 nt, Human
ucuuguugcccaggcuggagugcaauggcaua

SEQ ID NO: 243554 - RNA, 32 nt, Human
ucuuguugcccaggcuggagugcaauggcaug

SEQ ID NO: 243555 - RNA, 32 nt, Human
ucuuguugcccaggcuggagugcaauggcgca

SEQ ID NO: 243556 - RNA, 32 nt, Human
ucuuguugcccaggcuggagugcaauggcgcg

SEQ ID NO: 243557 - RNA, 32 nt, Human
ucuuguugcccaggcuggagugcaauggcgug

SEQ ID NO: 243558 - RNA, 32 nt, Human
ucuuguugcccaggcuggagugcaaugguaug

SEQ ID NO: 243559 - RNA, 32 nt, Human
ucuuguugcccaggcuggagugcaauggugca

SEQ ID NO: 243560 - RNA, 32 nt, Human
ucuuguugcccaggcuggagugcaauggugcg

SEQ ID NO: 243561 - RNA, 32 nt, Human
ucuuguugcccaggcuggagugcaguagcacu

SEQ ID NO: 243562 - RNA, 32 nt, Human
ucuuguugcccaggcuggagugcagugacaca

SEQ ID NO: 243563 - RNA, 32 nt, Human
ucuuguugcccaggcuggagugcaguggugcg

SEQ ID NO: 243564 - RNA, 32 nt, Human
ucuuguugcccaggcuggagugcaguggugug

SEQ ID NO: 243565 - RNA, 32 nt, Human
ucuuguugcccaggcuggagugcauuggcgcg

SEQ ID NO: 243566 - RNA, 32 nt, Human
ucuuguugcccaggcuggagugcggugguaca

SEQ ID NO: 243567 - RNA, 32 nt, Human
ucuuguugcccaggcuggagugcguuggcgug

SEQ ID NO: 243568 - RNA, 32 nt, Human
ucuuguugcccaggcuggagugugaugggcuc

SEQ ID NO: 243569 - RNA, 32 nt, Human
ucuuguugcccaggcugggagggcaauggcac

SEQ ID NO: 243570 - RNA, 32 nt, Human
ucuuguugcccaggcuggugugcaauggcgug

SEQ ID NO: 243571 - RNA, 32 nt, Human
ucuuguugcccaggcuugagugcagugaugca

SEQ ID NO: 243572 - RNA, 32 nt, Human
ucuuguugcccagggcuggagugcaguggcau

SEQ ID NO: 243573 - RNA, 32 nt, Human
ucuuguugcccagguuagagugcaguggcacg

SEQ ID NO: 243574 - RNA, 32 nt, Human
ucuuguugcccagguuggaguguaauagcacg

SEQ ID NO: 243575 - RNA, 32 nt, Human
ucuuguugcccgggcuggagugcaauggcgcg

SEQ ID NO: 243576 - RNA, 32 nt, Human
ucuuguugcccgggcuggagugcaauggugag

SEQ ID NO: 243577 - RNA, 32 nt, Human
ucuuguugccgaggcuggagugcaauggcgca

SEQ ID NO: 243578 - RNA, 32 nt, Human
ucuuguugccuagcuggagugcaauggcgcaa

SEQ ID NO: 243579 - RNA, 32 nt, Human
ucuuguugccuaggcuggagugcaauggcgag

SEQ ID NO: 243580 - RNA, 32 nt, Human
ucuuguugccuaggcuggagugcaauggugcg

SEQ ID NO: 243581 - RNA, 32 nt, Human
ucuuguugccuaggcuggagugcaguggcgca

SEQ ID NO: 243582 - RNA, 32 nt, Human
ucuuguugccugcacucauuucccagggaccc

SEQ ID NO: 243583 - RNA, 32 nt, Human
ucuuguugcugaggcaggagaauugcucaaac

SEQ ID NO: 243584 - RNA, 32 nt, Human
ucuuguugcugaggcuggagugcaguggcacc

SEQ ID NO: 243585 - RNA, 32 nt, Human
ucuuguuggacauaggcaaaauaacuuggcaa

SEQ ID NO: 243586 - RNA, 32 nt, Human
ucuuguuggcccuaugaaauucugcacuuuuc

SEQ ID NO: 243587 - RNA, 32 nt, Human
ucuuguuggccugggaacuucuuggaacuuua

SEQ ID NO: 243588 - RNA, 32 nt, Human
ucuuguuggcuaggcuggaguaaaauggugcg

SEQ ID NO: 243589 - RNA, 32 nt, Human
ucuuguuguccaggcuagagugcaauggcaug

SEQ ID NO: 243590 - RNA, 32 nt, Human
ucuuguuguccaggcuggagugcaauggcacg

SEQ ID NO: 243591 - RNA, 32 nt, Human
ucuuguuguccaggcuggagugcaauggcgca

SEQ ID NO: 243592 - RNA, 32 nt, Human
ucuuguuguccaggcuggagugcaguggcgcg

SEQ ID NO: 243593 - RNA, 32 nt, Human
ucuuguuguccagucuggagugcaauggcaca

SEQ ID NO: 243594 - RNA, 32 nt, Human
ucuuguugucuaggcuggagugccguggugcg

SEQ ID NO: 243595 - RNA, 32 nt, Human
ucuuguuguuuauaugaaaacacucaaaauga

SEQ ID NO: 243596 - RNA, 32 nt, Human
ucuuguuuaccauucauguaacaaaacccagc

SEQ ID NO: 243597 - RNA, 32 nt, Human
ucuuguuucaauuacaaacuccugggcuuucu

SEQ ID NO: 243598 - RNA, 32 nt, Human
ucuuguuucccaggcuggagugcaauggcaca

SEQ ID NO: 243599 - RNA, 32 nt, Human
ucuuguuucccaggcuggagugcaauggguga

SEQ ID NO: 243600 - RNA, 32 nt, Human
ucuuguuucccagucuucucuucacccuuccu

SEQ ID NO: 243601 - RNA, 32 nt, Human
ucuuguuucucaaaucauaggagaugacauuu

SEQ ID NO: 243602 - RNA, 32 nt, Human
ucuuguuucuuuccucccugucuuagacuuug

SEQ ID NO: 243603 - RNA, 32 nt, Human
ucuuguuugggauaggcaagagccaaagguuc

SEQ ID NO: 243604 - RNA, 23 nt, Human
ucuuguuuuacccuauacaucca

SEQ ID NO: 243605 - RNA, 32 nt, Human
ucuuguuuuccaacucuucauuuuguugcaau

SEQ ID NO: 243606 - RNA, 32 nt, Human
ucuuguuuucuugggguugcccccucuuguuu

SEQ ID NO: 243607 - RNA, 32 nt, Human
ucuuguuuugacuuccacugacucauucugaa

SEQ ID NO: 243608 - RNA, 32 nt, Human
ucuuguuuuuccacuacugcuaccacaacuau

SEQ ID NO: 243609 - RNA, 32 nt, Human
ucuuuaaaaaccauuuaaacugcuagauagua

SEQ ID NO: 243610 - RNA, 32 nt, Human
ucuuuaaaaauggauuuaucuggggguugcag

SEQ ID NO: 243611 - RNA, 32 nt, Human
ucuuuaaaauaacauguaaacuucaauguucu

SEQ ID NO: 243612 - RNA, 32 nt, Human
ucuuuaaagaggaaggggaguggagggaaccc

SEQ ID NO: 243613 - RNA, 32 nt, Human
ucuuuaaagcaucuuuaggaagcgguugccac

SEQ ID NO: 243614 - RNA, 32 nt, Human
ucuuuaaaugauuuguauuacuuuauuaaaac

SEQ ID NO: 243615 - RNA, 32 nt, Human
ucuuuaacacccuuaggaccucaggccaucuu

SEQ ID NO: 243616 - RNA, 32 nt, Human
ucuuuaacaucccacugugaacauuaggcaga

SEQ ID NO: 243617 - RNA, 32 nt, Human
ucuuuaaccauggcgucccucuucaagaagag

SEQ ID NO: 243618 - RNA, 32 nt, Human
ucuuuaacugauuuugcuaaaaaucucccugu

SEQ ID NO: 243619 - RNA, 32 nt, Human
ucuuuaacugggcugcucagcacugcuugggg

SEQ ID NO: 243620 - RNA, 32 nt, Human
ucuuuaacuuauuucaaaaucaucucaugacc

SEQ ID NO: 243621 - RNA, 32 nt, Human
ucuuuaacuucuaacaaaggccuaguaaacaa

SEQ ID NO: 243622 - RNA, 32 nt, Human
ucuuuaagcaguggagguccaggagcagagcc

SEQ ID NO: 243623 - RNA, 32 nt, Human
ucuuuaagcugccuggauugcaccuuugaaau

SEQ ID NO: 243624 - RNA, 24 nt, Human
ucuuuaaguguggucaucagguca

SEQ ID NO: 243625 - RNA, 32 nt, Human
ucuuuaauacaguguuucuaccucucauuugu

SEQ ID NO: 243626 - RNA, 32 nt, Human
ucuuuaaucucucaucuucagauuauacaagg

SEQ ID NO: 243627 - RNA, 32 nt, Human
ucuuuaaucuuucuugguccacauccugaaag

SEQ ID NO: 243628 - RNA, 32 nt, Human
ucuuuaauuauuucaagagucaagaccaaaag

SEQ ID NO: 243629 - RNA, 32 nt, Human
ucuuuaauucccaagaauaaguuuacauuuca

SEQ ID NO: 243630 - RNA, 32 nt, Human
ucuuuaauuugugaaaaauuaccauggugagu

SEQ ID NO: 243631 - RNA, 32 nt, Human
ucuuuacaaaaauacaaaaauuagcuggacgu

SEQ ID NO: 243632 - RNA, 32 nt, Human
ucuuuacaacagcaaccaaagaaaacauaccu

SEQ ID NO: 243633 - RNA, 32 nt, Human
ucuuuacacagauugcucugauucucacaacu

SEQ ID NO: 243634 - RNA, 32 nt, Human
ucuuuacaggagaaagaggugauuauggaggg

SEQ ID NO: 243635 - RNA, 32 nt, Human
ucuuuacagggugggagcgggcugagcaagca

SEQ ID NO: 243636 - RNA, 32 nt, Human
ucuuuacaucacuuaucuuucucacugagguu

SEQ ID NO: 243637 - RNA, 32 nt, Human
ucuuuaccagaggcuggguguggugggaagga

SEQ ID NO: 243638 - RNA, 32 nt, Human
ucuuuaccaguauccuggcaaugguuguuuaa

SEQ ID NO: 243639 - RNA, 32 nt, Human
ucuuuaccaucccuccuucucuccuuccacag

SEQ ID NO: 243640 - RNA, 32 nt, Human
ucuuuaccauuaugcucgaugguuuguuuguu

SEQ ID NO: 243641 - RNA, 32 nt, Human
ucuuuaccgggaccuucucucaauuuucaugg

SEQ ID NO: 243642 - RNA, 32 nt, Human
ucuuuaccuaggcuguguuuccuaagcucuga

SEQ ID NO: 243643 - RNA, 32 nt, Human
ucuuuaccucuucugcugauuaucaguugaca

SEQ ID NO: 243644 - RNA, 20 nt, Human
ucuuuacuaaaaauacaaaa

SEQ ID NO: 243645 - RNA, 32 nt, Human
ucuuuacuccacugagaugucugggugcagag

SEQ ID NO: 243646 - RNA, 22 nt, Human
ucuuuacugaaaauacaaaaua

SEQ ID NO: 243647 - RNA, 32 nt, Human
ucuuuacugcucaaaaaccaaaaucuuuggaa

SEQ ID NO: 243648 - RNA, 32 nt, Human
ucuuuacugcucagaaccucuacuucucaucu

SEQ ID NO: 243649 - RNA, 32 nt, Human
ucuuuacugcuuuuucaucaagugaauauuua

SEQ ID NO: 243650 - RNA, 32 nt, Human
ucuuuacuggcccugacugcuguuaauaauug

SEQ ID NO: 243651 - RNA, 32 nt, Human
ucuuuacuguguccacaaaacuacccaucaua

SEQ ID NO: 243652 - RNA, 32 nt, Human
ucuuuacuuacagugugacuguaacuuucaga

SEQ ID NO: 243653 - RNA, 32 nt, Human
ucuuuacuuuuuccuuuuccuucuuaaguuag

SEQ ID NO: 243654 - RNA, 32 nt, Human
ucuuuagaacagugguucucaaacuuuaguac

SEQ ID NO: 243655 - RNA, 32 nt, Human
ucuuuagacccagcuccugccucccagccuuc

SEQ ID NO: 243656 - RNA, 32 nt, Human
ucuuuagacuauagucugucuccucugaccug

SEQ ID NO: 243657 - RNA, 32 nt, Human
ucuuuagaggauccuguacacaguuccacuau

SEQ ID NO: 243658 - RNA, 32 nt, Human
ucuuuagagguucccuguauaaaucauucaua

SEQ ID NO: 243659 - RNA, 32 nt, Human
ucuuuagaugacgaauuaacccuugcuucuuc

SEQ ID NO: 243660 - RNA, 32 nt, Human
ucuuuagauggucccuucccucuuucucuccc

SEQ ID NO: 243661 - RNA, 32 nt, Human
ucuuuagaugguggcacauuccuuuggguaug

SEQ ID NO: 243662 - RNA, 32 nt, Human
ucuuuaggaaaucacaacacagagaagcaaaa

SEQ ID NO: 243663 - RNA, 32 nt, Human
ucuuuaggacaaagcagagaguccaauuuauu

SEQ ID NO: 243664 - RNA, 32 nt, Human
ucuuuaggagcagaaaaggggagugcuaacug

SEQ ID NO: 243665 - RNA, 32 nt, Human
ucuuuaggauuugcagcuccaggaagcgagau

SEQ ID NO: 243666 - RNA, 32 nt, Human
ucuuuaggcaaaacaggaaacuucuuaaguga

SEQ ID NO: 243667 - RNA, 32 nt, Human
ucuuuaggccuuucacaacuaggacugagaau

SEQ ID NO: 243668 - RNA, 32 nt, Human
ucuuuagggcuggaaggcagcaucccucugac

SEQ ID NO: 243669 - RNA, 32 nt, Human
ucuuuagggugacugugguaagaaggauauuu

SEQ ID NO: 243670 - RNA, 32 nt, Human
ucuuuagguggcuaggagggcuggggaggccc

SEQ ID NO: 243671 - RNA, 32 nt, Human
ucuuuaguaauaauucacaccuugcacagcau

SEQ ID NO: 243672 - RNA, 32 nt, Human
ucuuuaguaauuugggcccagugccuugguga

SEQ ID NO: 243673 - RNA, 32 nt, Human
ucuuuaguuccauugagcucccccucuggauu

SEQ ID NO: 243674 - RNA, 22 nt, Human
ucuuuaguuccuaaaguuucuu

SEQ ID NO: 243675 - RNA, 32 nt, Human
ucuuuaguucucagagguagggacaaaaccac

SEQ ID NO: 243676 - RNA, 32 nt, Human
ucuuuauacuauauaauaugguaacuugggua

SEQ ID NO: 243677 - RNA, 32 nt, Human
ucuuuauaucucuuccuuuuccuccucaucuu

SEQ ID NO: 243678 - RNA, 32 nt, Human
ucuuuaucacuuccgagcaaauacucagauuu

SEQ ID NO: 243679 - RNA, 32 nt, Human
ucuuuauccagccuaucauucaugggcauucg

SEQ ID NO: 243680 - RNA, 32 nt, Human
ucuuuaucccuacugauaguuccucuuucuca

SEQ ID NO: 243681 - RNA, 32 nt, Human
ucuuuaucuuugaccuccuucuaucuguaaau

SEQ ID NO: 243682 - RNA, 32 nt, Human
ucuuuaugaaaguacccugggucuuucauccg

SEQ ID NO: 243683 - RNA, 32 nt, Human
ucuuuaugccaagaacuguauuuacugugguu

SEQ ID NO: 243684 - RNA, 32 nt, Human
ucuuuaugcugauguugaguuuugggauuguu

SEQ ID NO: 243685 - RNA, 32 nt, Human
ucuuuaugucuuuuuaaauuuucauuguacag

SEQ ID NO: 243686 - RNA, 31 nt, Human
ucuuuauguuuucucccuuugcucuaaaagg

SEQ ID NO: 243687 - RNA, 21 nt, Human
ucuuuauuaaaaaucaaaaua

SEQ ID NO: 243688 - RNA, 32 nt, Human
ucuuuauucccuucuuuccucuuccagcugag

SEQ ID NO: 243689 - RNA, 32 nt, Human
ucuuuauuccugguuaggaaggugggccgcua

SEQ ID NO: 243690 - RNA, 32 nt, Human
ucuuuauuuagacaugguugccugcagguauu

SEQ ID NO: 243691 - RNA, 32 nt, Human
ucuuuauuuucccugguagagacaucuucaag

SEQ ID NO: 243692 - RNA, 32 nt, Human
ucuuuauuuugaaaaauacagaacuuuggaau

SEQ ID NO: 243693 - RNA, 32 nt, Human
ucuuucaaaagacaguuuuaaugaguaauuaa

SEQ ID NO: 243694 - RNA, 32 nt, Human
ucuuucaaaauauggcugggugcaguggcuca

SEQ ID NO: 243695 - RNA, 32 nt, Human
ucuuucaaacacagcaguggauucuuucucuc

SEQ ID NO: 243696 - RNA, 32 nt, Human
ucuuucaaaccagcuaaauauuugucacaaaa

SEQ ID NO: 243697 - RNA, 32 nt, Human
ucuuucaacgccuugggagacugggugaaagg

SEQ ID NO: 243698 - RNA, 32 nt, Human
ucuuucaagaagcaggcauuguaggacagcug

SEQ ID NO: 243699 - RNA, 32 nt, Human
ucuuucaagauucauucucccugaaucuuacc

SEQ ID NO: 243700 - RNA, 32 nt, Human
ucuuucacacagaauuguacaagcaaaguuug

SEQ ID NO: 243701 - RNA, 32 nt, Human
ucuuucaccagucugucucuuuaauuaaauaa

SEQ ID NO: 243702 - RNA, 32 nt, Human
ucuuucacccaccuucuuaccccugucagcgc

SEQ ID NO: 243703 - RNA, 32 nt, Human
ucuuucacccagccagggagaagguucuucgc

SEQ ID NO: 243704 - RNA, 32 nt, Human
ucuuucacccaggcuggagugcaguggcacga

SEQ ID NO: 243705 - RNA, 32 nt, Human
ucuuucaccccuuccccucucccuugggcucu

SEQ ID NO: 243706 - RNA, 32 nt, Human
ucuuucaccuguaaucccagcacuuugggagg

SEQ ID NO: 243707 - RNA, 32 nt, Human
ucuuucacguguuugaggccaucugugucuau

SEQ ID NO: 243708 - RNA, 32 nt, Human
ucuuucacugauuucugaaucauguucuacuu

SEQ ID NO: 243709 - RNA, 32 nt, Human
ucuuucacugauuucugaaucauguucuaguu

SEQ ID NO: 243710 - RNA, 32 nt, Human
ucuuucacuuuauuaccuucuuucuaauacaa

SEQ ID NO: 243711 - RNA, 32 nt, Human
ucuuucagacacauaucuccccaguacccuac

SEQ ID NO: 243712 - RNA, 32 nt, Human
ucuuucagaguuguuaguuuacuccauucuuu

SEQ ID NO: 243713 - RNA, 32 nt, Human
ucuuucagauuuggaacuguaucuguauggaa

SEQ ID NO: 243714 - RNA, 32 nt, Human
ucuuucaggaauaauaaagagcaugauuccac

SEQ ID NO: 243715 - RNA, 32 nt, Human
ucuuucaggcuuuccauggaguacaauauaug

SEQ ID NO: 243716 - RNA, 32 nt, Human
ucuuucagugaaagaggaaggaaaggaguagg

SEQ ID NO: 243717 - RNA, 32 nt, Human
ucuuucaguuauguauauuuguuuuccuuguu

SEQ ID NO: 243718 - RNA, 32 nt, Human
ucuuucauaggugaaaagcaccagagaauaca

SEQ ID NO: 243719 - RNA, 32 nt, Human
ucuuucaucucaccacagcugccuccuuugaa

SEQ ID NO: 243720 - RNA, 32 nt, Human
ucuuucaugaguguuucccaugguguuuuugc

SEQ ID NO: 243721 - RNA, 32 nt, Human
ucuuucauggggagagaaggagacugaauuac

SEQ ID NO: 243722 - RNA, 32 nt, Human
ucuuucauguacacuguuucuuuuucaauacu

SEQ ID NO: 243723 - RNA, 32 nt, Human
ucuuucauuacauuuaaucucuggacccugga

SEQ ID NO: 243724 - RNA, 32 nt, Human
ucuuucauuauggaaugugaaauaucaguguu

SEQ ID NO: 243725 - RNA, 32 nt, Human
ucuuucauuccuuccuuccucuguuucuuucu

SEQ ID NO: 243726 - RNA, 32 nt, Human
ucuuucauugcacuucacucugccuguuuuca

SEQ ID NO: 243727 - RNA, 32 nt, Human
ucuuucauuuauuugcuuuccugggccucuau

SEQ ID NO: 243728 - RNA, 32 nt, Human
ucuuuccaaaaggcagcuugaaauguuggucc

SEQ ID NO: 243729 - RNA, 32 nt, Human
ucuuuccaaagaagcuuccuggacacuguuau

SEQ ID NO: 243730 - RNA, 32 nt, Human
ucuuuccaagucacaaaauucuccccuccccu

SEQ ID NO: 243731 - RNA, 32 nt, Human
ucuuuccaaucacuuguucauacaacagccau

SEQ ID NO: 243732 - RNA, 32 nt, Human
ucuuuccacagcuguugcuucugguuggaugg

SEQ ID NO: 243733 - RNA, 32 nt, Human
ucuuuccacauucuagagagggcucggaggcc

SEQ ID NO: 243734 - RNA, 32 nt, Human
ucuuuccaccacugccuucaucuuuggggugg

SEQ ID NO: 243735 - RNA, 32 nt, Human
ucuuuccacgcuuuccagccugugggagcggc

SEQ ID NO: 243736 - RNA, 32 nt, Human
ucuuuccagcucuaggucggcugugcuggagu

SEQ ID NO: 243737 - RNA, 31 nt, Human
ucuuuccaguuucauaaguuacccaguccaa

SEQ ID NO: 243738 - RNA, 32 nt, Human
ucuuuccaugaggagcaggugagggucugaga

SEQ ID NO: 243739 - RNA, 32 nt, Human
ucuuuccauucaaaucacauggcuuuccacca

SEQ ID NO: 243740 - RNA, 32 nt, Human
ucuuuccauuucucuaucaagcauuaaauaau

SEQ ID NO: 243741 - RNA, 32 nt, Human
ucuuucccaccauucucacccccaccaccccc

SEQ ID NO: 243742 - RNA, 32 nt, Human
ucuuucccaccccaacaccacugccaccaccc

SEQ ID NO: 243743 - RNA, 32 nt, Human
ucuuucccaucuccacucaguauuccaauggc

SEQ ID NO: 243744 - RNA, 32 nt, Human
ucuuuccccaaaagugaugaucucaaguccuu

SEQ ID NO: 243745 - RNA, 32 nt, Human
ucuuuccccagucuccccucagggaccugcag

SEQ ID NO: 243746 - RNA, 32 nt, Human
ucuuucccccacccuacucccuccaauucccc

SEQ ID NO: 243747 - RNA, 32 nt, Human
ucuuucccccuuccuuucugugucuccugccu

SEQ ID NO: 243748 - RNA, 32 nt, Human
ucuuuccccugccccuaguugcugucucggcu

SEQ ID NO: 243749 - RNA, 32 nt, Human
ucuuuccccuuucaaagaggagcaucucuaag

SEQ ID NO: 243750 - RNA, 32 nt, Human
ucuuuccccuuuccugcccuuucugcucaucu

SEQ ID NO: 243751 - RNA, 32 nt, Human
ucuuuccccuuuccuuuccuucuucccuaccu

SEQ ID NO: 243752 - RNA, 32 nt, Human
ucuuucccuccagccggcccuuaggacggcug

SEQ ID NO: 243753 - RNA, 32 nt, Human
ucuuucccuccccucuggucuccauucucuuc

SEQ ID NO: 243754 - RNA, 32 nt, Human
ucuuucccucugucugugcuuguguuguugac

SEQ ID NO: 243755 - RNA, 32 nt, Human
ucuuucccuucuuccuccucuccuucacaaau

SEQ ID NO: 243756 - RNA, 32 nt, Human
ucuuucccuuucucuucuucaugaaugcuuau

SEQ ID NO: 243757 - RNA, 32 nt, Human
ucuuucccuuuucucaaagaccuguguggggc

SEQ ID NO: 243758 - RNA, 32 nt, Human
ucuuuccgcggcccuuuccaccucuuuucacu

SEQ ID NO: 243759 - RNA, 32 nt, Human
ucuuuccguguaagcuaucccaccucagcggc

SEQ ID NO: 243760 - RNA, 32 nt, Human
ucuuuccuaaauggaaggaauuggaacugaaa

SEQ ID NO: 243761 - RNA, 22 nt, Human
ucuuuccuacuccagucccucu

SEQ ID NO: 243762 - RNA, 32 nt, Human
ucuuuccuacuuccucaagguucuuucugucc

SEQ ID NO: 243763 - RNA, 32 nt, Human
ucuuuccuagcucugggcugccuucucagccu

SEQ ID NO: 243764 - RNA, 32 nt, Human
ucuuuccucaaaaggguuaagaugucuaaaau

SEQ ID NO: 243765 - RNA, 32 nt, Human
ucuuuccucaguucucacuaacaagaaagcac

SEQ ID NO: 243766 - RNA, 32 nt, Human
ucuuuccuccaccccuccaucccccaaugcuu

SEQ ID NO: 243767 - RNA, 32 nt, Human
ucuuuccucccgcugccaugcacccugcagcc

SEQ ID NO: 243768 - RNA, 32 nt, Human
ucuuuccuccuugccacuuaccuuugcaaagu

SEQ ID NO: 243769 - RNA, 32 nt, Human
ucuuuccuccuuggcauuacugccccagccgc

SEQ ID NO: 243770 - RNA, 32 nt, Human
ucuuuccucuccaaagccucagucuagccugc

SEQ ID NO: 243771 - RNA, 32 nt, Human
ucuuuccucucugugccucucuguaaaauggg

SEQ ID NO: 243772 - RNA, 32 nt, Human
ucuuuccucuuucugcucugccaucuucagga

SEQ ID NO: 243773 - RNA, 32 nt, Human
ucuuuccugaagccaccaccacuguggccacu

SEQ ID NO: 243774 - RNA, 32 nt, Human
ucuuuccugccaccagaauugcagugguucac

SEQ ID NO: 243775 - RNA, 32 nt, Human
ucuuuccuguagaguaauagcuacuucaugau

SEQ ID NO: 243776 - RNA, 32 nt, Human
ucuuuccugucugcacaagugaaguguuuugu

SEQ ID NO: 243777 - RNA, 32 nt, Human
ucuuuccuguuacuuucaccucaggucguaac

SEQ ID NO: 243778 - RNA, 32 nt, Human
ucuuuccuguuuugccuggaccacuuaaagcc

SEQ ID NO: 243779 - RNA, 32 nt, Human
ucuuuccuuccuuccuccuggucuguuccaaa

SEQ ID NO: 243780 - RNA, 32 nt, Human
ucuuuccuuccuuccuccuuuccuaucuuccu

SEQ ID NO: 243781 - RNA, 32 nt, Human
ucuuuccuucucccuuucuucuuugccuucua

SEQ ID NO: 243782 - RNA, 32 nt, Human
ucuuuccuucuuuccuuccuuuugcucuuucc

SEQ ID NO: 243783 - RNA, 32 nt, Human
ucuuuccuucuuucuuucuuucuuucuucuuu

SEQ ID NO: 243784 - RNA, 32 nt, Human
ucuuuccuugcuuuguuuguguguuuguccag

SEQ ID NO: 243785 - RNA, 32 nt, Human
ucuuuccuuuauaaauugcucagucugaggua

SEQ ID NO: 243786 - RNA, 32 nt, Human
ucuuuccuuuuucccggcuuccuuccucgcgu

SEQ ID NO: 243787 - RNA, 32 nt, Human
ucuuuccuuuuuccuuucuucuuccuuuccuu

SEQ ID NO: 243788 - RNA, 32 nt, Human
ucuuucgacaacagcuguauggcaucaaaacc

SEQ ID NO: 243789 - RNA, 32 nt, Human
ucuuucgccaaggcuggagugcaguggcacga

SEQ ID NO: 243790 - RNA, 32 nt, Human
ucuuucgcccaggauggagugcaguggugcga

SEQ ID NO: 243791 - RNA, 32 nt, Human
ucuuucgcccaggcuggagugcaguggcgcaa

SEQ ID NO: 243792 - RNA, 32 nt, Human
ucuuucgcccaggcuggagugcagugguauga

SEQ ID NO: 243793 - RNA, 32 nt, Human
ucuuucgcugcagccuccaccgugcugagguc

SEQ ID NO: 243794 - RNA, 32 nt, Human
ucuuucguucuuucuuucuuucuuucuuucuc

SEQ ID NO: 243795 - RNA, 32 nt, Human
ucuuucguugcuucugguccaggcuaauaaag

SEQ ID NO: 243796 - RNA, 32 nt, Human
ucuuucuaauccagccaacgucugcucaggaa

SEQ ID NO: 243797 - RNA, 32 nt, Human
ucuuucuaaucucaauccuguucuuuguuuaa

SEQ ID NO: 243798 - RNA, 32 nt, Human
ucuuucuacagauggugcuacucuuggucucc

SEQ ID NO: 243799 - RNA, 32 nt, Human
ucuuucuacagggcugacauuguggcacauuc

SEQ ID NO: 243800 - RNA, 32 nt, Human
ucuuucuacuaccacacauaaaauugcuuugc

SEQ ID NO: 243801 - RNA, 32 nt, Human
ucuuucuacugaugcuuuguuuuguuguaugu

SEQ ID NO: 243802 - RNA, 32 nt, Human
ucuuucuagaggugcuacauaguugguaaugc

SEQ ID NO: 243803 - RNA, 32 nt, Human
ucuuucuagaguagcucccauauauggagaug

SEQ ID NO: 243804 - RNA, 32 nt, Human
ucuuucuaucacccucuucagucaccucuaua

SEQ ID NO: 243805 - RNA, 32 nt, Human
ucuuucuauccaugcagugauagugaguguaa

SEQ ID NO: 243806 - RNA, 32 nt, Human
ucuuucuccaucccucuccucuucccgccgcg

SEQ ID NO: 243807 - RNA, 32 nt, Human
ucuuucuccauccugugcuccaaaaacauacu

SEQ ID NO: 243808 - RNA, 32 nt, Human
ucuuucucccccaaagaaaccccaucgccauc

SEQ ID NO: 243809 - RNA, 32 nt, Human
ucuuucucccuaccaaccuccuccucuccugu

SEQ ID NO: 243810 - RNA, 32 nt, Human
ucuuucucccucagauccuccccacagcucag

SEQ ID NO: 243811 - RNA, 32 nt, Human
ucuuucucccugccaaccuccuccucuccugc

SEQ ID NO: 243812 - RNA, 32 nt, Human
ucuuucuccucccacagggucccccuugcccc

SEQ ID NO: 243813 - RNA, 21 nt, Human
ucuuucuccugcauaccaccu

SEQ ID NO: 243814 - RNA, 32 nt, Human
ucuuucuccugccucagcagcacggacggguu

SEQ ID NO: 243815 - RNA, 32 nt, Human
ucuuucucguuuguggacaaagcagcacguau

SEQ ID NO: 243816 - RNA, 32 nt, Human
ucuuucucucacucuucugucauuugcugcua

SEQ ID NO: 243817 - RNA, 32 nt, Human
ucuuucucucauuuuccuugcuuuuacauaga

SEQ ID NO: 243818 - RNA, 32 nt, Human
ucuuucucucccagaagccucacucugcacag

SEQ ID NO: 243819 - RNA, 32 nt, Human
ucuuucucuccccucacuuccaccccuucacc

SEQ ID NO: 243820 - RNA, 32 nt, Human
ucuuucucucccuuucccuccugaaucgauuc

SEQ ID NO: 243821 - RNA, 32 nt, Human
ucuuucucuccucugucucucuuccucuccuc

SEQ ID NO: 243822 - RNA, 32 nt, Human
ucuuucucuccucuuugccugucuucugucuu

SEQ ID NO: 243823 - RNA, 32 nt, Human
ucuuucucucucccucucccacaccucacaca

SEQ ID NO: 243824 - RNA, 32 nt, Human
ucuuucucucugccuuugcauuuccuuugaca

SEQ ID NO: 243825 - RNA, 32 nt, Human
ucuuucucucuuuccaucucccuugguuguuc

SEQ ID NO: 243826 - RNA, 32 nt, Human
ucuuucucucuuucuuucuuuucuuucuuucu

SEQ ID NO: 243827 - RNA, 32 nt, Human
ucuuucucugcacuccagccuaggcaacagag

SEQ ID NO: 243828 - RNA, 32 nt, Human
ucuuucucugcauacucuccagccuccuucua

SEQ ID NO: 243829 - RNA, 32 nt, Human
ucuuucucuggcccccuguccucucucucugu

SEQ ID NO: 243830 - RNA, 32 nt, Human
ucuuucucuggugucauuuccaaaggacucaa

SEQ ID NO: 243831 - RNA, 32 nt, Human
ucuuucucuuagucccacuuuaucucuucuuu

SEQ ID NO: 243832 - RNA, 32 nt, Human
ucuuucucuuccucccuucugccaucacuggc

SEQ ID NO: 243833 - RNA, 32 nt, Human
ucuuucucuuccuccuuccucuuccuuacuuu

SEQ ID NO: 243834 - RNA, 32 nt, Human
ucuuucucuuccucucccuccuccuuuucccc

SEQ ID NO: 243835 - RNA, 32 nt, Human
ucuuucucuuccugccuuuccucuaucagaga

SEQ ID NO: 243836 - RNA, 32 nt, Human
ucuuucucuucucuuguaagaaguuccuuuug

SEQ ID NO: 243837 - RNA, 32 nt, Human
ucuuucucuuggucaacucaggagccuuuuag

SEQ ID NO: 243838 - RNA, 32 nt, Human
ucuuucucuuucucccccucaggccaccuccu

SEQ ID NO: 243839 - RNA, 32 nt, Human
ucuuucucuuucuuucucuuuucccuuccuuc

SEQ ID NO: 243840 - RNA, 32 nt, Human
ucuuucucuuuucccuuccuuccuuccuuccu

SEQ ID NO: 243841 - RNA, 32 nt, Human
ucuuucugaacuucuaacaguuccaaaguuau

SEQ ID NO: 243842 - RNA, 32 nt, Human
ucuuucugagccugcuggacaugaagagcaga

SEQ ID NO: 243843 - RNA, 32 nt, Human
ucuuucugcaccuuagaucaucucuacaacua

SEQ ID NO: 243844 - RNA, 32 nt, Human
ucuuucugccacccuccuuuccuuccucccuc

SEQ ID NO: 243845 - RNA, 32 nt, Human
ucuuucugccuuuuguugcugccugucaugcu

SEQ ID NO: 243846 - RNA, 32 nt, Human
ucuuucugcuccaucguccccaaggaauaagu

SEQ ID NO: 243847 - RNA, 32 nt, Human
ucuuucuggaaaagggaaagaaaauagucuuc

SEQ ID NO: 243848 - RNA, 32 nt, Human
ucuuucuggacucuuuggcagaugguuuuggu

SEQ ID NO: 243849 - RNA, 32 nt, Human
ucuuucuggagaccccaaagcuggagggagau

SEQ ID NO: 243850 - RNA, 32 nt, Human
ucuuucuggaguuuaaguacagugaugguugg

SEQ ID NO: 243851 - RNA, 32 nt, Human
ucuuucuggaguuuuuccagcauacaauacau

SEQ ID NO: 243852 - RNA, 32 nt, Human
ucuuucuggcccacagaugagggcuccugauu

SEQ ID NO: 243853 - RNA, 22 nt, Human
ucuuucuggcucccaacugaag

SEQ ID NO: 243854 - RNA, 32 nt, Human
ucuuucugggccuggagaccacggucacuugu

SEQ ID NO: 243855 - RNA, 32 nt, Human
ucuuucugggccuuacugugcugguauaauua

SEQ ID NO: 243856 - RNA, 32 nt, Human
ucuuucugggucucugccugggucauguggcc

SEQ ID NO: 243857 - RNA, 20 nt, Human
ucuuucuguccccucuuccu

SEQ ID NO: 243858 - RNA, 32 nt, Human
ucuuucuguccuuuuaaguguaccuggaauuc

SEQ ID NO: 243859 - RNA, 32 nt, Human
ucuuucuguuauugcacuaugaaaaucaguua

SEQ ID NO: 243860 - RNA, 32 nt, Human
ucuuucuuaaaauguuuagagcaaguauagcu

SEQ ID NO: 243861 - RNA, 32 nt, Human
ucuuucuuaaagccacuuuagugagaagcagg

SEQ ID NO: 243862 - RNA, 32 nt, Human
ucuuucuuaccuucucuccucuugucauucag

SEQ ID NO: 243863 - RNA, 32 nt, Human
ucuuucuuagauucucuaccucccucuuccau

SEQ ID NO: 243864 - RNA, 32 nt, Human
ucuuucuucauagcuucucugcuuggcaaaga

SEQ ID NO: 243865 - RNA, 32 nt, Human
ucuuucuuccagcugcucacugggucaaaggg

SEQ ID NO: 243866 - RNA, 32 nt, Human
ucuuucuucccagccagucaguggcuuugagc

SEQ ID NO: 243867 - RNA, 32 nt, Human
ucuuucuuccucccucucccugccuuuccauu

SEQ ID NO: 243868 - RNA, 32 nt, Human
ucuuucuuccuuccuuucuuucuuccuuccuu

SEQ ID NO: 243869 - RNA, 32 nt, Human
ucuuucuucuucuucuacaacuggaaccagcc

SEQ ID NO: 243870 - RNA, 32 nt, Human
ucuuucuucuuucuuuccuuuuuccuuucuuc

SEQ ID NO: 243871 - RNA, 32 nt, Human
ucuuucuugcuuucuuucuuucuugcuuucuu

SEQ ID NO: 243872 - RNA, 32 nt, Human
ucuuucuugucucucaggaucaagcugaagug

SEQ ID NO: 243873 - RNA, 32 nt, Human
ucuuucuuuaaugucagaaauagaagaaaucu

SEQ ID NO: 243874 - RNA, 32 nt, Human
ucuuucuuuccuuucuuuccucccuuuuuccc

SEQ ID NO: 243875 - RNA, 32 nt, Human
ucuuucuuucugacggauucucgcucuguugg

SEQ ID NO: 243876 - RNA, 32 nt, Human
ucuuucuuucuugcuuucuuucuucucucucu

SEQ ID NO: 243877 - RNA, 32 nt, Human
ucuuucuuucuugcuuucuuucuugcuuucuu

SEQ ID NO: 243878 - RNA, 32 nt, Human
ucuuucuuucuuucuugcuuucuuucuugcuu

SEQ ID NO: 243879 - RNA, 32 nt, Human
ucuuucuuucuuucuuuccuucuuucuuucuu

SEQ ID NO: 243880 - RNA, 32 nt, Human
ucuuucuuucuuucuuucugacggauucucgc

SEQ ID NO: 243881 - RNA, 32 nt, Human
ucuuucuuucuuucuuucuugcuuucuuucuu

SEQ ID NO: 243882 - RNA, 32 nt, Human
ucuuucuuucuuucuuucuuuccuucuuucuu

SEQ ID NO: 243883 - RNA, 32 nt, Human
ucuuucuuucuuucuuucuuucugacggauuc

SEQ ID NO: 243884 - RNA, 32 nt, Human
ucuuucuuucuuucuuucuuucuugcuuucuu

SEQ ID NO: 243885 - RNA, 32 nt, Human
ucuuucuuucuuucuuucuuucuuucugacgg

SEQ ID NO: 243886 - RNA, 32 nt, Human
ucuuucuuucuuucuuucuuucuuucuugcuu

SEQ ID NO: 243887 - RNA, 32 nt, Human
ucuuucuuucuuucuuucuuucuuucuuucuu

SEQ ID NO: 243888 - RNA, 32 nt, Human
ucuuucuuucuuucuuucuuuuuaagcucagu

SEQ ID NO: 243889 - RNA, 32 nt, Human
ucuuucuuucuuucuuuuuaagcucaguggca

SEQ ID NO: 243890 - RNA, 32 nt, Human
ucuuucuuugcaccaaagacaucagucuccaa

SEQ ID NO: 243891 - RNA, 32 nt, Human
ucuuucuuuuaaggcuguuccugggccuggcg

SEQ ID NO: 243892 - RNA, 32 nt, Human
ucuuucuuuucagaaucuagguggugaauuuu

SEQ ID NO: 243893 - RNA, 32 nt, Human
ucuuucuuuucauugacaacaccuacacccac

SEQ ID NO: 243894 - RNA, 32 nt, Human
ucuuucuuuuugagguggugggauuauuccac

SEQ ID NO: 243895 - RNA, 32 nt, Human
ucuuugaaaauacuucauuuucuuagcauuuc

SEQ ID NO: 243896 - RNA, 32 nt, Human
ucuuugaagccagcauccuagcaucuucaaau

SEQ ID NO: 243897 - RNA, 32 nt, Human
ucuuugaaggcagaaucaguugaguugugagg

SEQ ID NO: 243898 - RNA, 32 nt, Human
ucuuugaaugugcuauuuuuauaacugaacuu

SEQ ID NO: 243899 - RNA, 32 nt, Human
ucuuugacaggcaauucugguuggcuguggcu

SEQ ID NO: 243900 - RNA, 32 nt, Human
ucuuugaccagauggcaguaacauuugaagau

SEQ ID NO: 243901 - RNA, 32 nt, Human
ucuuugacuccuggcauuugccuuaaggaccu

SEQ ID NO: 243902 - RNA, 32 nt, Human
ucuuugacugacugaccucauuccacugggau

SEQ ID NO: 243903 - RNA, 32 nt, Human
ucuuugacuguugccaccacacaguucccuag

SEQ ID NO: 243904 - RNA, 32 nt, Human
ucuuugacuuccaauggcaaaccugggugauc

SEQ ID NO: 243905 - RNA, 32 nt, Human
ucuuugagacuauccugaacuugaaaucccac

SEQ ID NO: 243906 - RNA, 32 nt, Human
ucuuugagacuauuuaaaaacugguacaacag

SEQ ID NO: 243907 - RNA, 32 nt, Human
ucuuugagagcagcaguuugaggucugacucc

SEQ ID NO: 243908 - RNA, 32 nt, Human
ucuuugaggagccugggcuuggaucuauccug

SEQ ID NO: 243909 - RNA, 32 nt, Human
ucuuugaggccaagaagcugguguaugcccuc

SEQ ID NO: 243910 - RNA, 32 nt, Human
ucuuugaggccuuacagcucuucacaguacaa

SEQ ID NO: 243911 - RNA, 32 nt, Human
ucuuugauagagaaagagucucaaauggacaa

SEQ ID NO: 243912 - RNA, 32 nt, Human
ucuuugauccuucugagcuccaccucuggugg

SEQ ID NO: 243913 - RNA, 32 nt, Human
ucuuugaucucaaauuuuuauauguaaaacaa

SEQ ID NO: 243914 - RNA, 32 nt, Human
ucuuugaucugguuuuauuccuguaauucagc

SEQ ID NO: 243915 - RNA, 32 nt, Human
ucuuugcaauaccugucccugccggucuccaa

SEQ ID NO: 243916 - RNA, 32 nt, Human
ucuuugcaauaggcagcuugacugcagcguug

SEQ ID NO: 243917 - RNA, 32 nt, Human
ucuuugcacaacaacaacaacaacaaauucac

SEQ ID NO: 243918 - RNA, 32 nt, Human
ucuuugcacaauugaaggccugugcaucugau

SEQ ID NO: 243919 - RNA, 32 nt, Human
ucuuugcacauccugcucuuucugccugaaaa

SEQ ID NO: 243920 - RNA, 32 nt, Human
ucuuugcacugaggcacccgccgggcagggac

SEQ ID NO: 243921 - RNA, 32 nt, Human
ucuuugcacugaggccuugcugcuguggauac

SEQ ID NO: 243922 - RNA, 32 nt, Human
ucuuugcagaacugcugguggacugauguggu

SEQ ID NO: 243923 - RNA, 32 nt, Human
ucuuugcagaccugcauuuuucagugaacaau

SEQ ID NO: 243924 - RNA, 32 nt, Human
ucuuugcagagaaccucagaucaggugcaccu

SEQ ID NO: 243925 - RNA, 32 nt, Human
ucuuugcagagacaguauuuugcugaauacuu

SEQ ID NO: 243926 - RNA, 32 nt, Human
ucuuugcagcuggagaugaacuuuuaaaaauc

SEQ ID NO: 243927 - RNA, 32 nt, Human
ucuuugcaguaggggagagagcagagaaguac

SEQ ID NO: 243928 - RNA, 32 nt, Human
ucuuugcaugauaccaugauagacacuccauu

SEQ ID NO: 243929 - RNA, 32 nt, Human
ucuuugcauucacuugauuugucagaauauua

SEQ ID NO: 243930 - RNA, 32 nt, Human
ucuuugccaccgaggcauaguguagaacaguc

SEQ ID NO: 243931 - RNA, 32 nt, Human
ucuuugccauuuuagaagguuccagugagcug

SEQ ID NO: 243932 - RNA, 32 nt, Human
ucuuugcccugaccuugaucaacaggggugaa

SEQ ID NO: 243933 - RNA, 32 nt, Human
ucuuugccuccucccuucccuuccacucuuua

SEQ ID NO: 243934 - RNA, 32 nt, Human
ucuuugccucugcuuugucaugccauuaagcc

SEQ ID NO: 243935 - RNA, 32 nt, Human
ucuuugccucugcuuugucaugccauuaagcu

SEQ ID NO: 243936 - RNA, 32 nt, Human
ucuuugccugguccucaguuugcccaucaaua

SEQ ID NO: 243937 - RNA, 32 nt, Human
ucuuugccuuccuauuuccuuucaaagaaauc

SEQ ID NO: 243938 - RNA, 32 nt, Human
ucuuugccuuucuggguagggagcugucuaau

SEQ ID NO: 243939 - RNA, 32 nt, Human
ucuuugcuaaagcagugaaggaagagaacaga

SEQ ID NO: 243940 - RNA, 32 nt, Human
ucuuugcuaccaggcugaagucugucaugaaa

SEQ ID NO: 243941 - RNA, 32 nt, Human
ucuuugcuaccugaacgcaccacccucuggcc

SEQ ID NO: 243942 - RNA, 32 nt, Human
ucuuugcucacacccucacagcugcucucugg

SEQ ID NO: 243943 - RNA, 32 nt, Human
ucuuugcucacugcaacauccaccucaugggc

SEQ ID NO: 243944 - RNA, 32 nt, Human
ucuuugcucacugcaaccucugccacccgggu

SEQ ID NO: 243945 - RNA, 32 nt, Human
ucuuugcucacugccccaugucccucggucag

SEQ ID NO: 243946 - RNA, 32 nt, Human
ucuuugcucagauugagaacugcagcauuuau

SEQ ID NO: 243947 - RNA, 32 nt, Human
ucuuugcucccccgcccugcccugcccucacc

SEQ ID NO: 243948 - RNA, 32 nt, Human
ucuuugcugcuuuguuuuccuccugauucucu

SEQ ID NO: 243949 - RNA, 24 nt, Human
ucuuugcugugccaaagcagguca

SEQ ID NO: 243950 - RNA, 22 nt, Human
ucuuugcuguuggaucagacca

SEQ ID NO: 243951 - RNA, 32 nt, Human
ucuuugcuguuucacaggcuucacugaugaua

SEQ ID NO: 243952 - RNA, 32 nt, Human
ucuuugcuguuucucugggcuccugagcauac

SEQ ID NO: 243953 - RNA, 32 nt, Human
ucuuugcuuaaguaugagauacuugauggggg

SEQ ID NO: 243954 - RNA, 32 nt, Human
ucuuugcuuacagugcaucacaacugaagaau

SEQ ID NO: 243955 - RNA, 32 nt, Human
ucuuugcuucugccgguccucagucuggcgug

SEQ ID NO: 243956 - RNA, 32 nt, Human
ucuuugcuuguuuauuucugaaaaagaacugu

SEQ ID NO: 243957 - RNA, 32 nt, Human
ucuuugcuuuaaguguaacuggcaguuuucca

SEQ ID NO: 243958 - RNA, 32 nt, Human
ucuuugcuuucuuaguaguauuucaagguguu

SEQ ID NO: 243959 - RNA, 32 nt, Human
ucuuugcuuuucucccaaacccgccuccccgc

SEQ ID NO: 243960 - RNA, 32 nt, Human
ucuuuggaaaguacacucugcuguuugacacc

SEQ ID NO: 243961 - RNA, 32 nt, Human
ucuuuggacacacaagccuagcccaugggcug

SEQ ID NO: 243962 - RNA, 32 nt, Human
ucuuuggacguggcagaaccuuacauauucug

SEQ ID NO: 243963 - RNA, 23 nt, Human
ucuuuggacuucugaagagacca

SEQ ID NO: 243964 - RNA, 32 nt, Human
ucuuuggagaagcucaucagaaacucaaaaga

SEQ ID NO: 243965 - RNA, 32 nt, Human
ucuuuggagaaggagaaagaaaggaaagaacu

SEQ ID NO: 243966 - RNA, 32 nt, Human
ucuuuggagacagggucucacugugucaugca

SEQ ID NO: 243967 - RNA, 22 nt, Human
ucuuuggagagcucaguacagg

SEQ ID NO: 243968 - RNA, 32 nt, Human
ucuuuggagaggaggauggaagggaggggucc

SEQ ID NO: 243969 - RNA, 32 nt, Human
ucuuuggagagggggaggagugauaaacuagc

SEQ ID NO: 243970 - RNA, 32 nt, Human
ucuuuggaggcuggggauaguagcaucaacau

SEQ ID NO: 243971 - RNA, 25 nt, Human
ucuuuggaugcggcugcggcaugga

SEQ ID NO: 243972 - RNA, 24 nt, Human
ucuuuggaugugguucaccaacca

SEQ ID NO: 243973 - RNA, 32 nt, Human
ucuuuggcaaagucauuuaccugggcuggaau

SEQ ID NO: 243974 - RNA, 23 nt, Human
ucuuuggcaagauugcagcaaga

SEQ ID NO: 243975 - RNA, 32 nt, Human
ucuuuggccauagcugaagcuguggggccagu

SEQ ID NO: 243976 - RNA, 32 nt, Human
ucuuuggcccagucucugacccuucccaagua

SEQ ID NO: 243977 - RNA, 32 nt, Human
ucuuuggccccuugcuggagucaugugccucu

SEQ ID NO: 243978 - RNA, 32 nt, Human
ucuuuggcccucaucgagaagcuggaacuugu

SEQ ID NO: 243979 - RNA, 32 nt, Human
ucuuuggccucaaccccuccccugcacugaga

SEQ ID NO: 243980 - RNA, 32 nt, Human
ucuuuggccuccaggauaaguggaaccgucug

SEQ ID NO: 243981 - RNA, 32 nt, Human
ucuuuggccugacaacagucuucugcccaugu

SEQ ID NO: 243982 - RNA, 32 nt, Human
ucuuuggcucaagccauccauccuccuaccuc

SEQ ID NO: 243983 - RNA, 32 nt, Human
ucuuuggcucaagugaucuuccugccucagcc

SEQ ID NO: 243984 - RNA, 32 nt, Human
ucuuuggcucaugugauccucccaucucagcc

SEQ ID NO: 243985 - RNA, 25 nt, Human
ucuuuggcugcugccucagcacaga

SEQ ID NO: 243986 - RNA, 24 nt, Human
ucuuuggcuucgccgcgcggaccu

SEQ ID NO: 243987 - RNA, 32 nt, Human
ucuuuggcuuugcuaccaguuccauaugauga

SEQ ID NO: 243988 - RNA, 32 nt, Human
ucuuugggcagccauugagauuauacggaacc

SEQ ID NO: 243989 - RNA, 24 nt, Human
ucuuugggcaugccagcccaugga

SEQ ID NO: 243990 - RNA, 23 nt, Human
ucuuugggcccagcggcugcggg

SEQ ID NO: 243991 - RNA, 32 nt, Human
ucuuugggcuguggcuugcagaacaaacuaca

SEQ ID NO: 243992 - RNA, 32 nt, Human
ucuuuggggaaugggcauuuugguagguaaag

SEQ ID NO: 243993 - RNA, 32 nt, Human
ucuuuggggaauggggugggggugggagagga

SEQ ID NO: 243994 - RNA, 32 nt, Human
ucuuuggggaaugggugggaaaggauuguuug

SEQ ID NO: 243995 - RNA, 22 nt, Human
ucuuuggggacuugagcauggg

SEQ ID NO: 243996 - RNA, 32 nt, Human
ucuuuggggaggcaacuaggaugguguggccg

SEQ ID NO: 243997 - RNA, 32 nt, Human
ucuuuggggaugacauuuucaccgugacauuu

SEQ ID NO: 243998 - RNA, 18 nt, Human
ucuuuggggauguuuuca

SEQ ID NO: 243999 - RNA, 32 nt, Human
ucuuugggggauuccaccacacccaaugcucu

SEQ ID NO: 244000 - RNA, 32 nt, Human
ucuuuggggucacaaugaccacugcaggcagg

SEQ ID NO: 244001 - RNA, 32 nt, Human
ucuuugggguugguuccuagaggcagagguug

SEQ ID NO: 244002 - RNA, 32 nt, Human
ucuuugguaaagucacauguuaaggaugacug

SEQ ID NO: 244003 - RNA, 32 nt, Human
ucuuuggucccgcaggaggguggguggagcag

SEQ ID NO: 244004 - RNA, 32 nt, Human
ucuuuggugaguggccuuugcccacauccccu

SEQ ID NO: 244005 - RNA, 32 nt, Human
ucuuuggugcugggaccaaauucuucacuucu

SEQ ID NO: 244006 - RNA, 32 nt, Human
ucuuugguuuccuguaucuuuuuaaucaaguc

SEQ ID NO: 244007 - RNA, 31 nt, Human
ucuuugguuuuguaaaggugggugaagguug

SEQ ID NO: 244008 - RNA, 32 nt, Human
ucuuugguuuuuguaaacggagaggacaguuc

SEQ ID NO: 244009 - RNA, 32 nt, Human
ucuuuguaaccugugugaagcagcagccagcc

SEQ ID NO: 244010 - RNA, 32 nt, Human
ucuuuguaaggacuugugccucuugggagacg

SEQ ID NO: 244011 - RNA, 32 nt, Human
ucuuuguacagaagaguacuguauuuuugaau

SEQ ID NO: 244012 - RNA, 32 nt, Human
ucuuuguaccucccuccucucccucacucaug

SEQ ID NO: 244013 - RNA, 32 nt, Human
ucuuuguauuuuuaguagagaugggguuugac

SEQ ID NO: 244014 - RNA, 32 nt, Human
ucuuuguauuuuuaguggagaugggguuucac

SEQ ID NO: 244015 - RNA, 32 nt, Human
ucuuugucaacauuaguaacugauacauagaa

SEQ ID NO: 244016 - RNA, 32 nt, Human
ucuuugucaccaccacccagugugugggucug

SEQ ID NO: 244017 - RNA, 32 nt, Human
ucuuuguccagauuuccaaagcuggauaaguu

SEQ ID NO: 244018 - RNA, 19 nt, Human
ucuuuguccaggucaaaaa

SEQ ID NO: 244019 - RNA, 32 nt, Human
ucuuugucccaccagggguugcaguggcuugg

SEQ ID NO: 244020 - RNA, 32 nt, Human
ucuuugucccuaaugugugacaccucaucaug

SEQ ID NO: 244021 - RNA, 32 nt, Human
ucuuuguccuggcggugagcacccagggcuaa

SEQ ID NO: 244022 - RNA, 32 nt, Human
ucuuugucucuuccuuucaccucauucuggua

SEQ ID NO: 244023 - RNA, 31 nt, Human
ucuuugucucuuuucuggguugcagagggau

SEQ ID NO: 244024 - RNA, 32 nt, Human
ucuuugucuuucuuucuuuuccuuccucccuu

SEQ ID NO: 244025 - RNA, 32 nt, Human
ucuuugugaacaaaugagacaaggcugcaaau

SEQ ID NO: 244026 - RNA, 32 nt, Human
ucuuugugaccagccagaccucaggucuucac

SEQ ID NO: 244027 - RNA, 32 nt, Human
ucuuugugagaagguacagagauggaaaccuu

SEQ ID NO: 244028 - RNA, 32 nt, Human
ucuuugugcaagugccuuccugagcagaagaa

SEQ ID NO: 244029 - RNA, 23 nt, Human
ucuuugugccuccuuccaaacca

SEQ ID NO: 244030 - RNA, 32 nt, Human
ucuuugugccuguacuuaugcagcuuucuaca

SEQ ID NO: 244031 - RNA, 32 nt, Human
ucuuuguggacucuacccuucccuucaaggag

SEQ ID NO: 244032 - RNA, 32 nt, Human
ucuuuguggagccucucagugugggcagcccu

SEQ ID NO: 244033 - RNA, 32 nt, Human
ucuuuguggauaauacauucagguggugcugg

SEQ ID NO: 244034 - RNA, 32 nt, Human
ucuuuguguauacuucugugucuguuauguuc

SEQ ID NO: 244035 - RNA, 32 nt, Human
ucuuugugucaggcugacaucaaauggcaggg

SEQ ID NO: 244036 - RNA, 32 nt, Human
ucuuugugucuccuggcacaggcccuggcccc

SEQ ID NO: 244037 - RNA, 32 nt, Human
ucuuuguguuccccauggaugaagacucugcu

SEQ ID NO: 244038 - RNA, 32 nt, Human
ucuuuguuacccaggcuggaguacaguggugu

SEQ ID NO: 244039 - RNA, 32 nt, Human
ucuuuguucagcaucccaggagacaggccucu

SEQ ID NO: 244040 - RNA, 32 nt, Human
ucuuuguucccauccagccgaugaaggagcaa

SEQ ID NO: 244041 - RNA, 32 nt, Human
ucuuuguucuuguuugcugcuauuuucugucc

SEQ ID NO: 244042 - RNA, 32 nt, Human
ucuuuguugaggucuuugcagauggcuguuuc

SEQ ID NO: 244043 - RNA, 32 nt, Human
ucuuuguugauacugcuuauuuagagaagggu

SEQ ID NO: 244044 - RNA, 32 nt, Human
ucuuuguugcccaggcuggagugcaauggcgc

SEQ ID NO: 244045 - RNA, 32 nt, Human
ucuuuguugcccaggcuggagugcaguggcac

SEQ ID NO: 244046 - RNA, 32 nt, Human
ucuuuguugcucaggcuggaguacaguggcau

SEQ ID NO: 244047 - RNA, 32 nt, Human
ucuuuguugcucugggagaggggacuccugga

SEQ ID NO: 244048 - RNA, 32 nt, Human
ucuuuguuggaauaugcaaaggucauucuuua

SEQ ID NO: 244049 - RNA, 32 nt, Human
ucuuuguugguggaaguaucuacugaaguauu

SEQ ID NO: 244050 - RNA, 32 nt, Human
ucuuuguuugagauggagucuugcucugucac

SEQ ID NO: 244051 - RNA, 32 nt, Human
ucuuuguuugcuccuguguuugcccagcuuua

SEQ ID NO: 244052 - RNA, 21 nt, Human
ucuuuguuuuuccccaaacca

SEQ ID NO: 244053 - RNA, 32 nt, Human
ucuuuuaaaacacaaaccaccaccaaaaauuu

SEQ ID NO: 244054 - RNA, 23 nt, Human
ucuuuuaaaaguuucucacuuua

SEQ ID NO: 244055 - RNA, 32 nt, Human
ucuuuuaaaaucaagaagaaccauggugucca

SEQ ID NO: 244056 - RNA, 32 nt, Human
ucuuuuaaaauuggaaugcaacuguagguuuu

SEQ ID NO: 244057 - RNA, 32 nt, Human
ucuuuuaaaguaaaugcaaguaccaaagcuca

SEQ ID NO: 244058 - RNA, 32 nt, Human
ucuuuuaaauguugaauauucccuuguaugga

SEQ ID NO: 244059 - RNA, 32 nt, Human
ucuuuuaacauacucuuucuguucuauuguau

SEQ ID NO: 244060 - RNA, 32 nt, Human
ucuuuuaacauaggugguucugugauaacauc

SEQ ID NO: 244061 - RNA, 32 nt, Human
ucuuuuaauccuucauuguuucauguaugaag

SEQ ID NO: 244062 - RNA, 32 nt, Human
ucuuuuaaugucagauaugauacacugcacau

SEQ ID NO: 244063 - RNA, 32 nt, Human
ucuuuuaaugugcaaugauggcuggaucauuu

SEQ ID NO: 244064 - RNA, 32 nt, Human
ucuuuuaauuagcaucucagaaaugcaugggu

SEQ ID NO: 244065 - RNA, 32 nt, Human
ucuuuuacauuuuuccuauucacugcacuuuu

SEQ ID NO: 244066 - RNA, 32 nt, Human
ucuuuuaccaaaagugucuguacagcagccau

SEQ ID NO: 244067 - RNA, 32 nt, Human
ucuuuuacccuggccccucucccuugggcucu

SEQ ID NO: 244068 - RNA, 21 nt, Human
ucuuuuaccuuucuccucccu

SEQ ID NO: 244069 - RNA, 32 nt, Human
ucuuuuacuaguaggcaagccugggcauuucu

SEQ ID NO: 244070 - RNA, 32 nt, Human
ucuuuuacucacugcccacuucucaucucugu

SEQ ID NO: 244071 - RNA, 32 nt, Human
ucuuuuacugacuguuuauaacacucaauuga

SEQ ID NO: 244072 - RNA, 32 nt, Human
ucuuuuagacuucucauuuaacucaauucccu

SEQ ID NO: 244073 - RNA, 32 nt, Human
ucuuuuagagccuaggacucaggcuggaggca

SEQ ID NO: 244074 - RNA, 32 nt, Human
ucuuuuagagugguucugauagguacagauuc

SEQ ID NO: 244075 - RNA, 32 nt, Human
ucuuuuagugcauuuccuccugccuuugcuug

SEQ ID NO: 244076 - RNA, 31 nt, Human
ucuuuuauaaaacuauuacauuuaaaauaug

SEQ ID NO: 244077 - RNA, 23 nt, Human
ucuuuuaucacgauauuauuagu

SEQ ID NO: 244078 - RNA, 32 nt, Human
ucuuuuaucucaaauuuuuauauguaaaacaa

SEQ ID NO: 244079 - RNA, 32 nt, Human
ucuuuuaucugcaaugugugaagggacucuuu

SEQ ID NO: 244080 - RNA, 32 nt, Human
ucuuuuauuaacacccugcucucauguccaua

SEQ ID NO: 244081 - RNA, 32 nt, Human
ucuuuuauuguuucuuuucuuuuccgcgacag

SEQ ID NO: 244082 - RNA, 32 nt, Human
ucuuuuauuuucuugcauuugugaauuaguuc

SEQ ID NO: 244083 - RNA, 31 nt, Human
ucuuuucaaagcuagaaauaagcacugucua

SEQ ID NO: 244084 - RNA, 32 nt, Human
ucuuuucaaguuggucaggcuuuggacaggug

SEQ ID NO: 244085 - RNA, 32 nt, Human
ucuuuucacagcaagaacaguccauguuguau

SEQ ID NO: 244086 - RNA, 32 nt, Human
ucuuuucacaguuaaagguuuaagcagagggc

SEQ ID NO: 244087 - RNA, 21 nt, Human
ucuuuucaccccccaccuccu

SEQ ID NO: 244088 - RNA, 32 nt, Human
ucuuuucaccucuuuaaccacuccucaggaac

SEQ ID NO: 244089 - RNA, 32 nt, Human
ucuuuucagaagcaagccagaccuagcaggcu

SEQ ID NO: 244090 - RNA, 32 nt, Human
ucuuuucagaggggaaaaaggagcagcucuua

SEQ ID NO: 244091 - RNA, 32 nt, Human
ucuuuucagcaacccgguccaguacugggaga

SEQ ID NO: 244092 - RNA, 32 nt, Human
ucuuuucagccuguuacuguccugugccauuu

SEQ ID NO: 244093 - RNA, 32 nt, Human
ucuuuucaggagaaaucacuguugcacagaga

SEQ ID NO: 244094 - RNA, 20 nt, Human
ucuuuucaguaucugcuuua

SEQ ID NO: 244095 - RNA, 32 nt, Human
ucuuuucaguauuuacuguguaauacuuaagu

SEQ ID NO: 244096 - RNA, 32 nt, Human
ucuuuucaguucagagaacugcagaauaagua

SEQ ID NO: 244097 - RNA, 32 nt, Human
ucuuuucaucaaaaauuccacacccucaggua

SEQ ID NO: 244098 - RNA, 32 nt, Human
ucuuuucaugccagcgccaacaggaggcuguc

SEQ ID NO: 244099 - RNA, 32 nt, Human
ucuuuucaugccagcgucaacaggaggcuguc

SEQ ID NO: 244100 - RNA, 32 nt, Human
ucuuuuccaagaagcuuuugaauaagcauauu

SEQ ID NO: 244101 - RNA, 32 nt, Human
ucuuuuccacaguuggcugagugccuucguga

SEQ ID NO: 244102 - RNA, 32 nt, Human
ucuuuuccagaaggugaaagagaaagggccug

SEQ ID NO: 244103 - RNA, 32 nt, Human
ucuuuuccagcuuuuaguuacucucaucaaau

SEQ ID NO: 244104 - RNA, 32 nt, Human
ucuuuuccaguucuccuuccucuaggagccau

SEQ ID NO: 244105 - RNA, 32 nt, Human
ucuuuuccauugucuuuggcucucacaggagc

SEQ ID NO: 244106 - RNA, 32 nt, Human
ucuuuuccauuucucccuccaucaccaccugc

SEQ ID NO: 244107 - RNA, 32 nt, Human
ucuuuucccagagaccuucugaucuccaaaaa

SEQ ID NO: 244108 - RNA, 32 nt, Human
ucuuuucccuccagagccgggguuuguaaacc

SEQ ID NO: 244109 - RNA, 32 nt, Human
ucuuuucccugcuagagaaagcagagagcggg

SEQ ID NO: 244110 - RNA, 20 nt, Human
ucuuuuccgggaacucaccc

SEQ ID NO: 244111 - RNA, 32 nt, Human
ucuuuuccgugcuaccugcagagggguccaua

SEQ ID NO: 244112 - RNA, 24 nt, Human
ucuuuuccucaggugguauacuua

SEQ ID NO: 244113 - RNA, 32 nt, Human
ucuuuuccucuacagcuccaucuuguuucacc

SEQ ID NO: 244114 - RNA, 32 nt, Human
ucuuuuccugaacucacagucuugggguguuu

SEQ ID NO: 244115 - RNA, 22 nt, Human
ucuuuuccugaccaaucuuguu

SEQ ID NO: 244116 - RNA, 32 nt, Human
ucuuuuccugcucuuuggcccuggaucgagaa

SEQ ID NO: 244117 - RNA, 32 nt, Human
ucuuuuccuuugaugagccucuccccaggugu

SEQ ID NO: 244118 - RNA, 32 nt, Human
ucuuuuccuuuuccucuuugacugagcaccga

SEQ ID NO: 244119 - RNA, 32 nt, Human
ucuuuucgccccucacgcuuuuguaauaaugg

SEQ ID NO: 244120 - RNA, 28 nt, Human
ucuuuucuaagugcugugggaucuggga

SEQ ID NO: 244121 - RNA, 32 nt, Human
ucuuuucuaauugugaaggacauggcagauug

SEQ ID NO: 244122 - RNA, 32 nt, Human
ucuuuucuacuaauaaagauggaucaagucuc

SEQ ID NO: 244123 - RNA, 32 nt, Human
ucuuuucucaucuccuggacagucugugguca

SEQ ID NO: 244124 - RNA, 32 nt, Human
ucuuuucucgggacgggagaggccguguagcg

SEQ ID NO: 244125 - RNA, 32 nt, Human
ucuuuucucuaaucagagauacagagguugag

SEQ ID NO: 244126 - RNA, 32 nt, Human
ucuuuucucuagacggaaagcugcaaaggaaa

SEQ ID NO: 244127 - RNA, 32 nt, Human
ucuuuucucucaucaucauguucuuuuacccc

SEQ ID NO: 244128 - RNA, 32 nt, Human
ucuuuucucucccuuccauuucuaagucaaua

SEQ ID NO: 244129 - RNA, 32 nt, Human
ucuuuucugacuggcccugaaguugucagugg

SEQ ID NO: 244130 - RNA, 32 nt, Human
ucuuuucugcccuuucuuugcagcuacuggug

SEQ ID NO: 244131 - RNA, 32 nt, Human
ucuuuucugccucugaaucccuaccuuuaaag

SEQ ID NO: 244132 - RNA, 32 nt, Human
ucuuuucugccucugucaggcgaacugugaug

SEQ ID NO: 244133 - RNA, 32 nt, Human
ucuuuucugggagcggggaggugguuuggagu

SEQ ID NO: 244134 - RNA, 32 nt, Human
ucuuuucuguuuuucucagagcaaguuaucua

SEQ ID NO: 244135 - RNA, 32 nt, Human
ucuuuucuuacugcaaccuucgccucccgagu

SEQ ID NO: 244136 - RNA, 32 nt, Human
ucuuuucuucuuuccggcugcucucuggcccu

SEQ ID NO: 244137 - RNA, 32 nt, Human
ucuuuucuucuuuuuccuauauguccuggaug

SEQ ID NO: 244138 - RNA, 32 nt, Human
ucuuuucuugccucugugccccuucucucauc

SEQ ID NO: 244139 - RNA, 32 nt, Human
ucuuuucuuucuuucuccuuccuuccuuccuc

SEQ ID NO: 244140 - RNA, 32 nt, Human
ucuuuugaaagccauaugauaaaaugauuuua

SEQ ID NO: 244141 - RNA, 32 nt, Human
ucuuuugaauaguuuuacuucucuccaucuug

SEQ ID NO: 244142 - RNA, 32 nt, Human
ucuuuugaauuuccucaucccuccaucucaau

SEQ ID NO: 244143 - RNA, 23 nt, Human
ucuuuugacaaaguagccaaaga

SEQ ID NO: 244144 - RNA, 32 nt, Human
ucuuuugacaauagcgucauugccaagugcac

SEQ ID NO: 244145 - RNA, 32 nt, Human
ucuuuugacucuggcuuccgucaagagcuguc

SEQ ID NO: 244146 - RNA, 32 nt, Human
ucuuuugagauggagucuugcucugucaccca

SEQ ID NO: 244147 - RNA, 32 nt, Human
ucuuuugagauggaguuuugcucugucaccca

SEQ ID NO: 244148 - RNA, 32 nt, Human
ucuuuugauaccuuuaaaagaaccacugucaa

SEQ ID NO: 244149 - RNA, 32 nt, Human
ucuuuugcaaaacugugugaucuuugugaaag

SEQ ID NO: 244150 - RNA, 32 nt, Human
ucuuuugcaaaagggucugcuuggagaggcca

SEQ ID NO: 244151 - RNA, 32 nt, Human
ucuuuugcagaacucugauaagaaaaguguuc

SEQ ID NO: 244152 - RNA, 32 nt, Human
ucuuuugcagauaucagcugguuggauuucuc

SEQ ID NO: 244153 - RNA, 32 nt, Human
ucuuuugcaguggaaaggagcagugcugcagc

SEQ ID NO: 244154 - RNA, 32 nt, Human
ucuuuugcauuaagggaucauuccaagagcag

SEQ ID NO: 244155 - RNA, 32 nt, Human
ucuuuugccacccugaauugcuggagacccuc

SEQ ID NO: 244156 - RNA, 32 nt, Human
ucuuuugccacugucugggccccaucugggau

SEQ ID NO: 244157 - RNA, 24 nt, Human
ucuuuugcccaggcuggagugcag

SEQ ID NO: 244158 - RNA, 32 nt, Human
ucuuuugcccaggcuggagugcaguggcacaa

SEQ ID NO: 244159 - RNA, 32 nt, Human
ucuuuugccugguacaaggcuugaugagaaga

SEQ ID NO: 244160 - RNA, 32 nt, Human
ucuuuugccugucauggugaccugaaagcaag

SEQ ID NO: 244161 - RNA, 32 nt, Human
ucuuuugcuuccucccccucccccgccccugc

SEQ ID NO: 244162 - RNA, 32 nt, Human
ucuuuugcuuuauuccagaaugcuguacaucu

SEQ ID NO: 244163 - RNA, 32 nt, Human
ucuuuuggaaaaucauuuuucagcucaauuac

SEQ ID NO: 244164 - RNA, 30 nt, Human
ucuuuuggaggccacagggaauagaggugg

SEQ ID NO: 244165 - RNA, 32 nt, Human
ucuuuuggauaccugcuuuucaucccacaggg

SEQ ID NO: 244166 - RNA, 31 nt, Human
ucuuuuggcagcuagauccauacuaggcaca

SEQ ID NO: 244167 - RNA, 32 nt, Human
ucuuuuggcccagcuccuaccucccagcagcc

SEQ ID NO: 244168 - RNA, 32 nt, Human
ucuuuuggcccucuucuuucugaggcccacuu

SEQ ID NO: 244169 - RNA, 32 nt, Human
ucuuuuggccggaaauggaugggcagggaucu

SEQ ID NO: 244170 - RNA, 32 nt, Human
ucuuuugggauucaucuucuggcuuugugauu

SEQ ID NO: 244171 - RNA, 32 nt, Human
ucuuuuggggccccuagaaaucaaagagaccc

SEQ ID NO: 244172 - RNA, 32 nt, Human
ucuuuuggggguugggaggaguaggacugguc

SEQ ID NO: 244173 - RNA, 32 nt, Human
ucuuuuggucucaagugauucccuucaaguug

SEQ ID NO: 244174 - RNA, 32 nt, Human
ucuuuuggucucaagugauucucuucauguug

SEQ ID NO: 244175 - RNA, 32 nt, Human
ucuuuugguggagucaggaaagacaggcugag

SEQ ID NO: 244176 - RNA, 32 nt, Human
ucuuuugguuggcagagauucaggaucaugga

SEQ ID NO: 244177 - RNA, 20 nt, Human
ucuuuugguuguuguucuua

SEQ ID NO: 244178 - RNA, 32 nt, Human
ucuuuugguuuguguuucuguuuuuccagaaa

SEQ ID NO: 244179 - RNA, 32 nt, Human
ucuuuuguauauguaucugucuuagauauuug

SEQ ID NO: 244180 - RNA, 32 nt, Human
ucuuuugugccauguggagugcuccucaguaa

SEQ ID NO: 244181 - RNA, 32 nt, Human
ucuuuuguguaaaacaucccauuuuucacauu

SEQ ID NO: 244182 - RNA, 32 nt, Human
ucuuuuguguuauguggagcaaugccaucucu

SEQ ID NO: 244183 - RNA, 32 nt, Human
ucuuuuguguuguacugaacacaauauuugug

SEQ ID NO: 244184 - RNA, 32 nt, Human
ucuuuuguuggggaggggaaugggaggggaaa

SEQ ID NO: 244185 - RNA, 32 nt, Human
ucuuuuguuuuuaaaauguacaaaccuauaag

SEQ ID NO: 244186 - RNA, 32 nt, Human
ucuuuuguuuuuaauaaguuucuuacuauaaa

SEQ ID NO: 244187 - RNA, 32 nt, Human
ucuuuuuaaaaaguaagagauuuugaaaagca

SEQ ID NO: 244188 - RNA, 32 nt, Human
ucuuuuuaaaacacuggaagacucauguuaaa

SEQ ID NO: 244189 - RNA, 32 nt, Human
ucuuuuuaaacaucagaggcucuggcuacaca

SEQ ID NO: 244190 - RNA, 32 nt, Human
ucuuuuuaaagcuucugccaaaaugauguuuc

SEQ ID NO: 244191 - RNA, 32 nt, Human
ucuuuuuaacacuaaaaauacaauucaaauuu

SEQ ID NO: 244192 - RNA, 32 nt, Human
ucuuuuuaaugggguugcuuguuuuucgcuug

SEQ ID NO: 244193 - RNA, 32 nt, Human
ucuuuuuacccaggcuggagugcaaugaugcg

SEQ ID NO: 244194 - RNA, 32 nt, Human
ucuuuuuaccccuguuuccauucuuuuagauc

SEQ ID NO: 244195 - RNA, 32 nt, Human
ucuuuuuagaauggaucucugaugccugccca

SEQ ID NO: 244196 - RNA, 32 nt, Human
ucuuuuuauaacuaaguuuaagaaauacuuuu

SEQ ID NO: 244197 - RNA, 32 nt, Human
ucuuuuuauuuuuaaugaaagguguaccacgg

SEQ ID NO: 244198 - RNA, 32 nt, Human
ucuuuuucaaguuuggguuguggccuggcaug

SEQ ID NO: 244199 - RNA, 32 nt, Human
ucuuuuucaccaugcuuugggcaguuucugua

SEQ ID NO: 244200 - RNA, 32 nt, Human
ucuuuuucaccauggaugaaacuauaacuuaa

SEQ ID NO: 244201 - RNA, 32 nt, Human
ucuuuuucagccccggagaggguccugaccug

SEQ ID NO: 244202 - RNA, 32 nt, Human
ucuuuuucaugucuucugagggcuggauauaa

SEQ ID NO: 244203 - RNA, 32 nt, Human
ucuuuuuccaauaaaagaacuugcccagcgug

SEQ ID NO: 244204 - RNA, 32 nt, Human
ucuuuuuccagccuucaguucuagugcacucu

SEQ ID NO: 244205 - RNA, 32 nt, Human
ucuuuuuccccuuugccucucuccuuacauca

SEQ ID NO: 244206 - RNA, 32 nt, Human
ucuuuuuccgagauggagucuugcucugucgc

SEQ ID NO: 244207 - RNA, 32 nt, Human
ucuuuuuccgccccucuccuucucuccucccc

SEQ ID NO: 244208 - RNA, 32 nt, Human
ucuuuuuccucuuauuauacuuuggccaaggu

SEQ ID NO: 244209 - RNA, 32 nt, Human
ucuuuuucuagggucccugaacgcccugguaa

SEQ ID NO: 244210 - RNA, 32 nt, Human
ucuuuuucuauucauucccccuucaacauauu

SEQ ID NO: 244211 - RNA, 24 nt, Human
ucuuuuucucauuuucaaugcaca

SEQ ID NO: 244212 - RNA, 32 nt, Human
ucuuuuucuccucaucggccagccccuccucc

SEQ ID NO: 244213 - RNA, 32 nt, Human
ucuuuuucuccucucugagccuuugucuauug

SEQ ID NO: 244214 - RNA, 32 nt, Human
ucuuuuucucucuaccauucucaaccuguauu

SEQ ID NO: 244215 - RNA, 32 nt, Human
ucuuuuucucugcagugcauuucacagaauaa

SEQ ID NO: 244216 - RNA, 32 nt, Human
ucuuuuucucugccucccucugccucacucuc

SEQ ID NO: 244217 - RNA, 32 nt, Human
ucuuuuucucuuuucuccuuuuucuucuuuuu

SEQ ID NO: 244218 - RNA, 32 nt, Human
ucuuuuucuguugaggcuucccccucucugag

SEQ ID NO: 244219 - RNA, 32 nt, Human
ucuuuuucuucugugcuugccucccagugaac

SEQ ID NO: 244220 - RNA, 32 nt, Human
ucuuuuucuucuuuugagauggagucuugcuc

SEQ ID NO: 244221 - RNA, 32 nt, Human
ucuuuuugagagcacagcuucucagaugugcu

SEQ ID NO: 244222 - RNA, 32 nt, Human
ucuuuuugcccaggccggagugcaauggcacg

SEQ ID NO: 244223 - RNA, 32 nt, Human
ucuuuuugcccaggcuggagugcaguggcgcc

SEQ ID NO: 244224 - RNA, 32 nt, Human
ucuuuuugccuaggcuggagugcagugguaca

SEQ ID NO: 244225 - RNA, 32 nt, Human
ucuuuuugccugcuggaggacacggaccauug

SEQ ID NO: 244226 - RNA, 32 nt, Human
ucuuuuuggacucagccugccugcacccaggu

SEQ ID NO: 244227 - RNA, 32 nt, Human
ucuuuuuggcccucccucccucccucuucugc

SEQ ID NO: 244228 - RNA, 32 nt, Human
ucuuuuuguccaccucuccuuuaucucuguuu

SEQ ID NO: 244229 - RNA, 32 nt, Human
ucuuuuuguggugugaauaaaucuuuuaucuu

SEQ ID NO: 244230 - RNA, 32 nt, Human
ucuuuuuguucgugaggucacuguccaggccu

SEQ ID NO: 244231 - RNA, 32 nt, Human
ucuuuuuguucgugaggucacuguccgggccu

SEQ ID NO: 244232 - RNA, 32 nt, Human
ucuuuuuguugacagauuacauugaggcaacu

SEQ ID NO: 244233 - RNA, 32 nt, Human
ucuuuuuguuuggccaaaauguaauacauucc

SEQ ID NO: 244234 - RNA, 23 nt, Human
ucuuuuuucaaauguugcauagu

SEQ ID NO: 244235 - RNA, 22 nt, Human
ucuuuuuucaggugugcuuggu

SEQ ID NO: 244236 - RNA, 23 nt, Human
ucuuuuuuccguaauuacuaggu

SEQ ID NO: 244237 - RNA, 21 nt, Human
ucuuuuuuccuaugcacuggu

SEQ ID NO: 244238 - RNA, 21 nt, Human
ucuuuuuuccucuccugucuu

SEQ ID NO: 244239 - RNA, 24 nt, Human
ucuuuuuuccugggaauauuuugu

SEQ ID NO: 244240 - RNA, 23 nt, Human
ucuuuuuucuugucauugcuggu

SEQ ID NO: 244241 - RNA, 22 nt, Human
ucuuuuuucuuuuauauuuagu

SEQ ID NO: 244242 - RNA, 23 nt, Human
ucuuuuuuguuguaaugcuuagu

SEQ ID NO: 244243 - RNA, 32 nt, Human
ugaaaaacaaaacaaaaccacaugugaagugu

SEQ ID NO: 244244 - RNA, 32 nt, Human
ugaaaaacacugacauaguaaagcucaacaaa

SEQ ID NO: 244245 - RNA, 32 nt, Human
ugaaaaacagcuuuguugaggaaugguuggga

SEQ ID NO: 244246 - RNA, 26 nt, Human
ugaaaaacaugcuauguuuuguuuua

SEQ ID NO: 244247 - RNA, 32 nt, Human
ugaaaaacccagcaugagaacgcagugucagg

SEQ ID NO: 244248 - RNA, 32 nt, Human
ugaaaaacuaagaacaugaaaugucaagagug

SEQ ID NO: 244249 - RNA, 32 nt, Human
ugaaaaacuaaugacucugcugccuucuccuu

SEQ ID NO: 244250 - RNA, 32 nt, Human
ugaaaaacucaggccuguggagucagaacccg

SEQ ID NO: 244251 - RNA, 32 nt, Human
ugaaaaagaaacauaguuguaguacuuagccu

SEQ ID NO: 244252 - RNA, 25 nt, Human
ugaaaaagaacuuauaaugaagcua

SEQ ID NO: 244253 - RNA, 32 nt, Human
ugaaaaagaccagccucuauuagaucaguguc

SEQ ID NO: 244254 - RNA, 32 nt, Human
ugaaaaagagaaaaagaaugaaguacuuccug

SEQ ID NO: 244255 - RNA, 32 nt, Human
ugaaaaagaggcaccguguaaagaaaauggca

SEQ ID NO: 244256 - RNA, 32 nt, Human
ugaaaaagagguguuugguuacgugugagcca

SEQ ID NO: 244257 - RNA, 32 nt, Human
ugaaaaagcaggcuggacacaguggcucaugc

SEQ ID NO: 244258 - RNA, 32 nt, Human
ugaaaaaggaaacaccaaagggaagagugaua

SEQ ID NO: 244259 - RNA, 32 nt, Human
ugaaaaaggacacccugagaaaagguccuagc

SEQ ID NO: 244260 - RNA, 32 nt, Human
ugaaaaaggauauggaaaaccuuacaaaacac

SEQ ID NO: 244261 - RNA, 19 nt, Human
ugaaaaaggauggguccca

SEQ ID NO: 244262 - RNA, 32 nt, Human
ugaaaaagucagcaguggauugcuugagaucu

SEQ ID NO: 244263 - RNA, 32 nt, Human
ugaaaaaguucagcaucccaggaaaggagcaa

SEQ ID NO: 244264 - RNA, 32 nt, Human
ugaaaaaguugcuuaguauuuaugaggaaauu

SEQ ID NO: 244265 - RNA, 32 nt, Human
ugaaaaauacaaaaauuagcuggaugugaugc

SEQ ID NO: 244266 - RNA, 32 nt, Human
ugaaaaauccucuccgucucccuucccugccu

SEQ ID NO: 244267 - RNA, 32 nt, Human
ugaaaaaucugucauccuuaucuuuguuccuc

SEQ ID NO: 244268 - RNA, 32 nt, Human
ugaaaaaugaaaagcccucaauccagagagcu

SEQ ID NO: 244269 - RNA, 18 nt, Human
ugaaaaaugaggguccca

SEQ ID NO: 244270 - RNA, 32 nt, Human
ugaaaaauggacaaauaaugaagaucucuccu

SEQ ID NO: 244271 - RNA, 32 nt, Human
ugaaaaauguacaauuuaucgaucucaucagu

SEQ ID NO: 244272 - RNA, 32 nt, Human
ugaaaaauuccagaaauaaacaauucacacgu

SEQ ID NO: 244273 - RNA, 32 nt, Human
ugaaaaauugcacucccuugguguagacaaau

SEQ ID NO: 244274 - RNA, 32 nt, Human
ugaaaacaaauuuguucccagguucuuggggc

SEQ ID NO: 244275 - RNA, 32 nt, Human
ugaaaacaagcaggacagccuggcacagaggc

SEQ ID NO: 244276 - RNA, 32 nt, Human
ugaaaacaagggcccuucaugggugaacauua

SEQ ID NO: 244277 - RNA, 32 nt, Human
ugaaaacaauccagcacucugguuaaauuuua

SEQ ID NO: 244278 - RNA, 32 nt, Human
ugaaaacacuccuuuaccaacuguuuuagggg

SEQ ID NO: 244279 - RNA, 32 nt, Human
ugaaaacacugcaacagugaacuuuugcaucu

SEQ ID NO: 244280 - RNA, 20 nt, Human
ugaaaacagaucaacucuca

SEQ ID NO: 244281 - RNA, 32 nt, Human
ugaaaacagcacuucagcuuuagcugauguau

SEQ ID NO: 244282 - RNA, 32 nt, Human
ugaaaacagccucuagcuucaggcugggcacg

SEQ ID NO: 244283 - RNA, 32 nt, Human
ugaaaacaggagguggagguugcagugagccg

SEQ ID NO: 244284 - RNA, 32 nt, Human
ugaaaacagucccauguacacuuucuggaagc

SEQ ID NO: 244285 - RNA, 32 nt, Human
ugaaaacaucagugaacuuguaacuauuguuu

SEQ ID NO: 244286 - RNA, 32 nt, Human
ugaaaacaugaccaaacucauacuucaaaaau

SEQ ID NO: 244287 - RNA, 28 nt, Human
ugaaaacaugggaggagaagauaaagag

SEQ ID NO: 244288 - RNA, 32 nt, Human
ugaaaaccaaaaacucuccaaguguauuuauu

SEQ ID NO: 244289 - RNA, 32 nt, Human
ugaaaaccacagguucaucuuugacuucaaau

SEQ ID NO: 244290 - RNA, 32 nt, Human
ugaaaaccacagugagucagcccuucacagaa

SEQ ID NO: 244291 - RNA, 32 nt, Human
ugaaaaccacuuccagagucuaaagcagcuca

SEQ ID NO: 244292 - RNA, 18 nt, Human
ugaaaaccaucugggaga

SEQ ID NO: 244293 - RNA, 32 nt, Human
ugaaaacccacguguuuuacacagaaccaccc

SEQ ID NO: 244294 - RNA, 32 nt, Human
ugaaaacccagaggaauacauuugguggcuga

SEQ ID NO: 244295 - RNA, 31 nt, Human
ugaaaacccucugaugccuguugaggagccu

SEQ ID NO: 244296 - RNA, 32 nt, Human
ugaaaacccuugccaugugcuaguaauuggaa

SEQ ID NO: 244297 - RNA, 32 nt, Human
ugaaaaccugcacuuuuccuugcaugacaggu

SEQ ID NO: 244298 - RNA, 32 nt, Human
ugaaaaccuuucucucuuucugaugccuucag

SEQ ID NO: 244299 - RNA, 32 nt, Human
ugaaaacguacacacaugcagaauaaugcguu

SEQ ID NO: 244300 - RNA, 32 nt, Human
ugaaaacuacagccuuagucuuacaggccccc

SEQ ID NO: 244301 - RNA, 32 nt, Human
ugaaaacuccaucccuccuaagaaucuuaaaa

SEQ ID NO: 244302 - RNA, 32 nt, Human
ugaaaacucuaaaagauaucagcggauuugaa

SEQ ID NO: 244303 - RNA, 32 nt, Human
ugaaaacucuagaguuggagcaagucuuccau

SEQ ID NO: 244304 - RNA, 32 nt, Human
ugaaaacucucaagcuguuuucccucugauuu

SEQ ID NO: 244305 - RNA, 32 nt, Human
ugaaaacugaggcagcagccugguuguggggc

SEQ ID NO: 244306 - RNA, 32 nt, Human
ugaaaacuucauuuuaaaugaucuuaagcaag

SEQ ID NO: 244307 - RNA, 32 nt, Human
ugaaaagaaagaaaggaggaccaagagaugaa

SEQ ID NO: 244308 - RNA, 32 nt, Human
ugaaaagaaagccauccaaccaaaggaaguga

SEQ ID NO: 244309 - RNA, 32 nt, Human
ugaaaagaaagcccggaggagcgaacagaagg

SEQ ID NO: 244310 - RNA, 17 nt, Human
ugaaaagaaaugagucc

SEQ ID NO: 244311 - RNA, 32 nt, Human
ugaaaagaaauguugacaccagugaaugaaac

SEQ ID NO: 244312 - RNA, 32 nt, Human
ugaaaagacccacgugcuccagucccagcucc

SEQ ID NO: 244313 - RNA, 32 nt, Human
ugaaaagacgcagaacaugaagggacucagaa

SEQ ID NO: 244314 - RNA, 22 nt, Human
ugaaaagacugaagggccagga

SEQ ID NO: 244315 - RNA, 32 nt, Human
ugaaaagacuguccuuucucccuugaaugguc

SEQ ID NO: 244316 - RNA, 32 nt, Human
ugaaaagagacacagagacaccucuggcuacc

SEQ ID NO: 244317 - RNA, 32 nt, Human
ugaaaagagacuggccgaagaacugugaauag

SEQ ID NO: 244318 - RNA, 32 nt, Human
ugaaaagaggaaauggauccaggagaaggaga

SEQ ID NO: 244319 - RNA, 32 nt, Human
ugaaaagaggagggaaaggccuuuggugugga

SEQ ID NO: 244320 - RNA, 21 nt, Human
ugaaaagcagaaaucgguugc

SEQ ID NO: 244321 - RNA, 32 nt, Human
ugaaaagcagcaaucgaaagucaguguguucu

SEQ ID NO: 244322 - RNA, 24 nt, Human
ugaaaagcaggaaaauacauugca

SEQ ID NO: 244323 - RNA, 32 nt, Human
ugaaaagcagugucuuugaucugcaacagcaa

SEQ ID NO: 244324 - RNA, 32 nt, Human
ugaaaagccaucaaaaaguugugauaucaaaa

SEQ ID NO: 244325 - RNA, 32 nt, Human
ugaaaagcccauauucuguucuugucaccuga

SEQ ID NO: 244326 - RNA, 32 nt, Human
ugaaaagccuguagguggcaccugccacucug

SEQ ID NO: 244327 - RNA, 32 nt, Human
ugaaaagcgggcuccaguugggugccaggaaa

SEQ ID NO: 244328 - RNA, 32 nt, Human
ugaaaagcuacuuagagaacuuaggaacuugg

SEQ ID NO: 244329 - RNA, 32 nt, Human
ugaaaagcucugaggucccacaauucauggua

SEQ ID NO: 244330 - RNA, 32 nt, Human
ugaaaagcugcugccaucaguaaucucaauag

SEQ ID NO: 244331 - RNA, 32 nt, Human
ugaaaagcuggaaacuuccacuuccccaaccu

SEQ ID NO: 244332 - RNA, 32 nt, Human
ugaaaaggaaaucuagcaugugaggggacuaa

SEQ ID NO: 244333 - RNA, 32 nt, Human
ugaaaaggaaggguaauuaaaauggaaugucu

SEQ ID NO: 244334 - RNA, 32 nt, Human
ugaaaaggaccuuguagaaccucuuugcagac

SEQ ID NO: 244335 - RNA, 32 nt, Human
ugaaaaggagaaaagguucguuuggaaguaua

SEQ ID NO: 244336 - RNA, 32 nt, Human
ugaaaaggaggaucgagcucacuguggaguau

SEQ ID NO: 244337 - RNA, 32 nt, Human
ugaaaaggagggauuucuccauaacucauuuu

SEQ ID NO: 244338 - RNA, 32 nt, Human
ugaaaagggaggagcaagaugggaugaaagca

SEQ ID NO: 244339 - RNA, 32 nt, Human
ugaaaagggaguuucguaagcaaaauagagga

SEQ ID NO: 244340 - RNA, 32 nt, Human
ugaaaaggggaguguaacuaguggauuuggga

SEQ ID NO: 244341 - RNA, 32 nt, Human
ugaaaagggguuugagaaagagcccaguagga

SEQ ID NO: 244342 - RNA, 32 nt, Human
ugaaaagguauuauaguaaggagagaaggaga

SEQ ID NO: 244343 - RNA, 22 nt, Human
ugaaaaggugauguguggggag

SEQ ID NO: 244344 - RNA, 32 nt, Human
ugaaaagguuaaguaugccaguaguuuacaaa

SEQ ID NO: 244345 - RNA, 32 nt, Human
ugaaaaguacuggaaucuggcucugcucugug

SEQ ID NO: 244346 - RNA, 32 nt, Human
ugaaaaguagugcuugcuagguguuugaagau

SEQ ID NO: 244347 - RNA, 32 nt, Human
ugaaaagucccagcauauuuugccgaguaguc

SEQ ID NO: 244348 - RNA, 32 nt, Human
ugaaaagugccucuaagacauccacaggugug

SEQ ID NO: 244349 - RNA, 32 nt, Human
ugaaaagugucacccuccuuggacuuauucag

SEQ ID NO: 244350 - RNA, 32 nt, Human
ugaaaaguguuaaaacauugccaacucaaaau

SEQ ID NO: 244351 - RNA, 32 nt, Human
ugaaaaguuccuguuugcauuacucugcaguu

SEQ ID NO: 244352 - RNA, 32 nt, Human
ugaaaaguuuucugagaggcaauacuuaagac

SEQ ID NO: 244353 - RNA, 23 nt, Human
ugaaaauaaaguauguacuguuu

SEQ ID NO: 244354 - RNA, 32 nt, Human
ugaaaauaaagugagaaaguucaauuaggacu

SEQ ID NO: 244355 - RNA, 32 nt, Human
ugaaaauacaagaaauuagcugggacuacagg

SEQ ID NO: 244356 - RNA, 32 nt, Human
ugaaaauacauacaugcuugucucaacucuuc

SEQ ID NO: 244357 - RNA, 32 nt, Human
ugaaaauacauacuuuuacauuucuacuuuau

SEQ ID NO: 244358 - RNA, 32 nt, Human
ugaaaauagagccagacaggcagaggagaagu

SEQ ID NO: 244359 - RNA, 32 nt, Human
ugaaaauauaaauauauguauacacuacuaaa

SEQ ID NO: 244360 - RNA, 32 nt, Human
ugaaaauauaacuguuuccccucucugcugcu

SEQ ID NO: 244361 - RNA, 32 nt, Human
ugaaaauauaugcacauaugcacccuaauaac

SEQ ID NO: 244362 - RNA, 32 nt, Human
ugaaaauaucuagaaauguggaagagaccuac

SEQ ID NO: 244363 - RNA, 32 nt, Human
ugaaaaucaaaugaugcaaaauauauacaagc

SEQ ID NO: 244364 - RNA, 32 nt, Human
ugaaaaucaucucuuuuucucaagaagaaagc

SEQ ID NO: 244365 - RNA, 32 nt, Human
ugaaaaucauuuccagacaaccucuuacuuuc

SEQ ID NO: 244366 - RNA, 32 nt, Human
ugaaaaucucagaaaccugaacauggaaacca

SEQ ID NO: 244367 - RNA, 32 nt, Human
ugaaaaucuccaaacauaugcacaagcagaga

SEQ ID NO: 244368 - RNA, 32 nt, Human
ugaaaaucuccacucccaaugucugaggguuc

SEQ ID NO: 244369 - RNA, 32 nt, Human
ugaaaaugaccaggccacuucuuccgagggcc

SEQ ID NO: 244370 - RNA, 32 nt, Human
ugaaaaugaucacuucauuugauacuguuuuu

SEQ ID NO: 244371 - RNA, 32 nt, Human
ugaaaaugcaaugacuggcugggugcaguggc

SEQ ID NO: 244372 - RNA, 32 nt, Human
ugaaaaugcagauucacugagccagacuaagg

SEQ ID NO: 244373 - RNA, 32 nt, Human
ugaaaaugccuaaugccuggaucuguguucua

SEQ ID NO: 244374 - RNA, 32 nt, Human
ugaaaaugccuccaaacugagaugcuuucagc

SEQ ID NO: 244375 - RNA, 30 nt, Human
ugaaaauggagcuuccugcaaagagaagcc

SEQ ID NO: 244376 - RNA, 32 nt, Human
ugaaaauggugaggacaggcacaaacgcaaag

SEQ ID NO: 244377 - RNA, 31 nt, Human
ugaaaaugucaugauaccuguugagauaacu

SEQ ID NO: 244378 - RNA, 30 nt, Human
ugaaaaugucuguacagccaaagcuuuccc

SEQ ID NO: 244379 - RNA, 32 nt, Human
ugaaaauguguuugcugccuugcuccuagcag

SEQ ID NO: 244380 - RNA, 32 nt, Human
ugaaaauguucuguucucacuuuuggcuuuau

SEQ ID NO: 244381 - RNA, 32 nt, Human
ugaaaauguuugcugucccuugcugaugcuaa

SEQ ID NO: 244382 - RNA, 32 nt, Human
ugaaaauuacuaauuuguuugacauuccaugu

SEQ ID NO: 244383 - RNA, 32 nt, Human
ugaaaauuagugacugguuaaggugugccacu

SEQ ID NO: 244384 - RNA, 24 nt, Human
ugaaaauucagaccuuguuuuaca

SEQ ID NO: 244385 - RNA, 32 nt, Human
ugaaaauugccuccuccaucucucaccuuuuc

SEQ ID NO: 244386 - RNA, 32 nt, Human
ugaaaauugcuuguaauuccuagccuucaaau

SEQ ID NO: 244387 - RNA, 32 nt, Human
ugaaaauuguacuuuacuacuacagcauuaca

SEQ ID NO: 244388 - RNA, 32 nt, Human
ugaaacaaaagagcauuucuucagguuucuau

SEQ ID NO: 244389 - RNA, 17 nt, Human
ugaaacaaaggucccuc

SEQ ID NO: 244390 - RNA, 20 nt, Human
ugaaacaaaucuugcucugu

SEQ ID NO: 244391 - RNA, 20 nt, Human
ugaaacaaauuaaugaagcu

SEQ ID NO: 244392 - RNA, 32 nt, Human
ugaaacaagagaaaguggccugccuggcaucc

SEQ ID NO: 244393 - RNA, 32 nt, Human
ugaaacaaggggaucacuugaggccaggaguu

SEQ ID NO: 244394 - RNA, 32 nt, Human
ugaaacaauaaggcuuuuuagagcagacuuug

SEQ ID NO: 244395 - RNA, 23 nt, Human
ugaaacaauccuugugaugaagu

SEQ ID NO: 244396 - RNA, 32 nt, Human
ugaaacaccaagaugucugucucugaagcgug

SEQ ID NO: 244397 - RNA, 32 nt, Human
ugaaacaccuuccugguaguccggccuuguca

SEQ ID NO: 244398 - RNA, 32 nt, Human
ugaaacacuccucccgcugccugcuccugagg

SEQ ID NO: 244399 - RNA, 32 nt, Human
ugaaacacuguacuguacuaucuugcucugag

SEQ ID NO: 244400 - RNA, 32 nt, Human
ugaaacagaagcaauggaugagugcuggacga

SEQ ID NO: 244401 - RNA, 32 nt, Human
ugaaacagagugagauagauaggguagaaauu

SEQ ID NO: 244402 - RNA, 32 nt, Human
ugaaacagaguuuggggguuguuugggauuag

SEQ ID NO: 244403 - RNA, 28 nt, Human
ugaaacagcacuguuuuguuuuguuuug

SEQ ID NO: 244404 - RNA, 21 nt, Human
ugaaacaggaucuugcucugu

SEQ ID NO: 244405 - RNA, 32 nt, Human
ugaaacaggaucuugcucugucacccaggcuu

SEQ ID NO: 244406 - RNA, 32 nt, Human
ugaaacaggcagcguaggauggggguccagug

SEQ ID NO: 244407 - RNA, 32 nt, Human
ugaaacagggucucacccuguugcccaggcua

SEQ ID NO: 244408 - RNA, 19 nt, Human
ugaaacagggucucacucu

SEQ ID NO: 244409 - RNA, 32 nt, Human
ugaaacagggucucacucuauugcccaggcug

SEQ ID NO: 244410 - RNA, 32 nt, Human
ugaaacagggucucacucuguugcccaggcug

SEQ ID NO: 244411 - RNA, 19 nt, Human
ugaaacaggugucaggcug

SEQ ID NO: 244412 - RNA, 32 nt, Human
ugaaacaguagggauugcgggaagaagggugu

SEQ ID NO: 244413 - RNA, 19 nt, Human
ugaaacagucucgcucugu

SEQ ID NO: 244414 - RNA, 32 nt, Human
ugaaacagucucuugcuugucguguauuuuuc

SEQ ID NO: 244415 - RNA, 32 nt, Human
ugaaacaucguuucucaggaaguucaccagaa

SEQ ID NO: 244416 - RNA, 32 nt, Human
ugaaacaucugucaauaaaauggcuacacuca

SEQ ID NO: 244417 - RNA, 32 nt, Human
ugaaacaucuucccuccucaaccuggaaaauu

SEQ ID NO: 244418 - RNA, 32 nt, Human
ugaaacauuauucaggcugauaagcuaagugc

SEQ ID NO: 244419 - RNA, 32 nt, Human
ugaaacauucagagcauccucuaccccgagga

SEQ ID NO: 244420 - RNA, 32 nt, Human
ugaaacauuugaucucaugacacuucauccaa

SEQ ID NO: 244421 - RNA, 20 nt, Human
ugaaaccaaaacgggcccug

SEQ ID NO: 244422 - RNA, 32 nt, Human
ugaaaccaaaggacuaggagucaggagaacaa

SEQ ID NO: 244423 - RNA, 32 nt, Human
ugaaaccaacaacaaacauuuuuaaaauuaaa

SEQ ID NO: 244424 - RNA, 32 nt, Human
ugaaaccacauacacagaccacugcagcauuc

SEQ ID NO: 244425 - RNA, 32 nt, Human
ugaaaccacaugcaucauucaggaagccuuca

SEQ ID NO: 244426 - RNA, 32 nt, Human
ugaaaccagccaacugcuuuuugugcggucuc

SEQ ID NO: 244427 - RNA, 32 nt, Human
ugaaaccaggauacaagacagccucgacucug

SEQ ID NO: 244428 - RNA, 31 nt, Human
ugaaaccagguggaaagaaaggggaagaauu

SEQ ID NO: 244429 - RNA, 32 nt, Human
ugaaaccagugugauaaaaaccugccaagcca

SEQ ID NO: 244430 - RNA, 32 nt, Human
ugaaaccaucugauuggcuuucugagguuuag

SEQ ID NO: 244431 - RNA, 32 nt, Human
ugaaacccacaggcggagguugcggugggcug

SEQ ID NO: 244432 - RNA, 18 nt, Human
ugaaacccaucucuacua

SEQ ID NO: 244433 - RNA, 32 nt, Human
ugaaaccccaggaggagguccucugagcccug

SEQ ID NO: 244434 - RNA, 19 nt, Human
ugaaaccccaucgcuacua

SEQ ID NO: 244435 - RNA, 19 nt, Human
ugaaaccccaucucaacua

SEQ ID NO: 244436 - RNA, 19 nt, Human
ugaaaccccaucuccacua

SEQ ID NO: 244437 - RNA, 18 nt, Human
ugaaaccccaucucuacu

SEQ ID NO: 244438 - RNA, 19 nt, Human
ugaaaccccaucucuacua

SEQ ID NO: 244439 - RNA, 19 nt, Human
ugaaaccccaucucuacug

SEQ ID NO: 244440 - RNA, 19 nt, Human
ugaaaccccaucucuagua

SEQ ID NO: 244441 - RNA, 19 nt, Human
ugaaaccccaucucuauua

SEQ ID NO: 244442 - RNA, 19 nt, Human
ugaaaccccaucuguacua

SEQ ID NO: 244443 - RNA, 19 nt, Human
ugaaaccccaugucuacua

SEQ ID NO: 244444 - RNA, 19 nt, Human
ugaaaccccgucucuacua

SEQ ID NO: 244445 - RNA, 24 nt, Human
ugaaaccccucgccagauuuugca

SEQ ID NO: 244446 - RNA, 19 nt, Human
ugaaaccccuucucuacua

SEQ ID NO: 244447 - RNA, 32 nt, Human
ugaaacccgacagaaguaucucagccugcagu

SEQ ID NO: 244448 - RNA, 32 nt, Human
ugaaacccgggagucagaggcugcagagagcc

SEQ ID NO: 244449 - RNA, 19 nt, Human
ugaaacccuaucucuacua

SEQ ID NO: 244450 - RNA, 32 nt, Human
ugaaacccucacccuuccgucccucccagcca

SEQ ID NO: 244451 - RNA, 32 nt, Human
ugaaacccugcagccuuaagagagaggggccc

SEQ ID NO: 244452 - RNA, 32 nt, Human
ugaaaccggaagcagaagcugaguguggugag

SEQ ID NO: 244453 - RNA, 32 nt, Human
ugaaaccggaaggcagagguugcagugagcca

SEQ ID NO: 244454 - RNA, 32 nt, Human
ugaaaccggccuaauuuuucugacugauaugg

SEQ ID NO: 244455 - RNA, 32 nt, Human
ugaaaccgggaggcggagguugaggugagccg

SEQ ID NO: 244456 - RNA, 32 nt, Human
ugaaaccguuuguuuucccucuccauuuuccc

SEQ ID NO: 244457 - RNA, 24 nt, Human
ugaaaccuccaccucccggguuca

SEQ ID NO: 244458 - RNA, 32 nt, Human
ugaaaccuccuugggccgcaauuucaucaucu

SEQ ID NO: 244459 - RNA, 32 nt, Human
ugaaaccucuaauuugauuauugggaggauuu

SEQ ID NO: 244460 - RNA, 32 nt, Human
ugaaaccugagauaaaugaaugugagguaucu

SEQ ID NO: 244461 - RNA, 32 nt, Human
ugaaaccugcagcaguucaggaugacuaauga

SEQ ID NO: 244462 - RNA, 32 nt, Human
ugaaaccuuugucuuaaaaauacucagcuuuc

SEQ ID NO: 244463 - RNA, 32 nt, Human
ugaaacgaauauaagcuuaaaauaagugaauc

SEQ ID NO: 244464 - RNA, 32 nt, Human
ugaaacgagguuucaccauauuggccaggcug

SEQ ID NO: 244465 - RNA, 19 nt, Human
ugaaacgccaucucuacua

SEQ ID NO: 244466 - RNA, 21 nt, Human
ugaaacggagucucacucugu

SEQ ID NO: 244467 - RNA, 32 nt, Human
ugaaacggagucucacucugucaccaggcugg

SEQ ID NO: 244468 - RNA, 21 nt, Human
ugaaacggagucucgcucugu

SEQ ID NO: 244469 - RNA, 32 nt, Human
ugaaacggagucucgcucugucacccaggcug

SEQ ID NO: 244470 - RNA, 32 nt, Human
ugaaacggagucucgcucugucgcccaggcug

SEQ ID NO: 244471 - RNA, 32 nt, Human
ugaaacggagucucgcucuguugcccaggcug

SEQ ID NO: 244472 - RNA, 21 nt, Human
ugaaacggagucuugcucugu

SEQ ID NO: 244473 - RNA, 32 nt, Human
ugaaacggagucuugcucugucccccaggcug

SEQ ID NO: 244474 - RNA, 32 nt, Human
ugaaacgggagccagacgaauuaagaagauuc

SEQ ID NO: 244475 - RNA, 32 nt, Human
ugaaacgggaggcggagguugcagugagccga

SEQ ID NO: 244476 - RNA, 22 nt, Human
ugaaacgggagucucacucuuc

SEQ ID NO: 244477 - RNA, 32 nt, Human
ugaaacuaaaaaggcaauuuuggaaaaagaga

SEQ ID NO: 244478 - RNA, 32 nt, Human
ugaaacuaauaauaauacaaaaauuagcuggg

SEQ ID NO: 244479 - RNA, 32 nt, Human
ugaaacuagacagggucuugccauguucugga

SEQ ID NO: 244480 - RNA, 32 nt, Human
ugaaacuagcugguuuguggauucagauacuc

SEQ ID NO: 244481 - RNA, 32 nt, Human
ugaaacuaggaguucaagaccagccaaggcaa

SEQ ID NO: 244482 - RNA, 32 nt, Human
ugaaacuaggucuggggcacucccaaugcagc

SEQ ID NO: 244483 - RNA, 32 nt, Human
ugaaacucaaaaccaucucucuuccagcugcu

SEQ ID NO: 244484 - RNA, 32 nt, Human
ugaaacucaccagcaaaugcugaccugggaau

SEQ ID NO: 244485 - RNA, 32 nt, Human
ugaaacuccaucucaaaaagaaagagagagag

SEQ ID NO: 244486 - RNA, 19 nt, Human
ugaaacuccaucucuacua

SEQ ID NO: 244487 - RNA, 32 nt, Human
ugaaacuccaucucuacuaaaaguacaaaaau

SEQ ID NO: 244488 - RNA, 32 nt, Human
ugaaacuccgucucaaaacaaaacaaaacaaa

SEQ ID NO: 244489 - RNA, 32 nt, Human
ugaaacuccuagcucaucugucaccgagcuuc

SEQ ID NO: 244490 - RNA, 32 nt, Human
ugaaacucugcaggccuuccgccugauuauua

SEQ ID NO: 244491 - RNA, 32 nt, Human
ugaaacucugggccagcagcccccaggagcau

SEQ ID NO: 244492 - RNA, 32 nt, Human
ugaaacucuguggaauauaaacuuuuuaaaaa

SEQ ID NO: 244493 - RNA, 32 nt, Human
ugaaacucuguuuucuugccccagucaggcuc

SEQ ID NO: 244494 - RNA, 32 nt, Human
ugaaacucuugaaauccaguugccauugagua

SEQ ID NO: 244495 - RNA, 32 nt, Human
ugaaacugaaagcucaucugcagcucagaaaa

SEQ ID NO: 244496 - RNA, 32 nt, Human
ugaaacugagccacacgcaccucugcuaguag

SEQ ID NO: 244497 - RNA, 32 nt, Human
ugaaacugagguucaggagaccggccuguucc

SEQ ID NO: 244498 - RNA, 32 nt, Human
ugaaacugagucuguggacacuguggaaagcu

SEQ ID NO: 244499 - RNA, 32 nt, Human
ugaaacuggaaggcagagguugcagugagcca

SEQ ID NO: 244500 - RNA, 32 nt, Human
ugaaacuggaaggcagagguugcagugagccg

SEQ ID NO: 244501 - RNA, 32 nt, Human
ugaaacuggcaguugacggcuccugggacuag

SEQ ID NO: 244502 - RNA, 32 nt, Human
ugaaacugggaggcagggguuggagugagcca

SEQ ID NO: 244503 - RNA, 32 nt, Human
ugaaacugggaggcggagcuugcagugagccg

SEQ ID NO: 244504 - RNA, 32 nt, Human
ugaaacugggagguggagguugcagugagcca

SEQ ID NO: 244505 - RNA, 32 nt, Human
ugaaacuggguuggggacagggauaguuucca

SEQ ID NO: 244506 - RNA, 32 nt, Human
ugaaacugucuccuccugccuccacuugaccu

SEQ ID NO: 244507 - RNA, 32 nt, Human
ugaaacuucuccucacggggugaggaucgagg

SEQ ID NO: 244508 - RNA, 32 nt, Human
ugaaacuugagaagccaccuaaagcuauauca

SEQ ID NO: 244509 - RNA, 32 nt, Human
ugaaacuugcaacuuugagaacaaaacagucc

SEQ ID NO: 244510 - RNA, 32 nt, Human
ugaaacuugcagggcgaagagcaggcggcgag

SEQ ID NO: 244511 - RNA, 32 nt, Human
ugaaacuuggugguaagauagagaucguaucu

SEQ ID NO: 244512 - RNA, 32 nt, Human
ugaaacuuguacaguaagagaagccugcuaag

SEQ ID NO: 244513 - RNA, 32 nt, Human
ugaaacuugugccacagagcuauauguaauau

SEQ ID NO: 244514 - RNA, 23 nt, Human
ugaaagaaaaagaacacuugcuc

SEQ ID NO: 244515 - RNA, 32 nt, Human
ugaaagaaaagcuucucagggaacugcaagcu

SEQ ID NO: 244516 - RNA, 32 nt, Human
ugaaagaaaaggaagcaaagaaaauagcugcc

SEQ ID NO: 244517 - RNA, 32 nt, Human
ugaaagaaacacggcggaaucucuccaggaga

SEQ ID NO: 244518 - RNA, 17 nt, Human
ugaaagaaagggaccca

SEQ ID NO: 244519 - RNA, 17 nt, Human
ugaaagaaagggguccc

SEQ ID NO: 244520 - RNA, 22 nt, Human
ugaaagaaaguaugguaugucu

SEQ ID NO: 244521 - RNA, 32 nt, Human
ugaaagaaauaauauuugaucuucucaguguu

SEQ ID NO: 244522 - RNA, 18 nt, Human
ugaaagaaauggauucca

SEQ ID NO: 244523 - RNA, 18 nt, Human
ugaaagaacggagucuca

SEQ ID NO: 244524 - RNA, 32 nt, Human
ugaaagaacuccugccaagagcccagaccucu

SEQ ID NO: 244525 - RNA, 32 nt, Human
ugaaagaagaauuuguggaaguuaauuuguaa

SEQ ID NO: 244526 - RNA, 21 nt, Human
ugaaagaauaguacuuuggug

SEQ ID NO: 244527 - RNA, 32 nt, Human
ugaaagacaaacacaucugcccaaugauccag

SEQ ID NO: 244528 - RNA, 32 nt, Human
ugaaagacaaggauaaagucccagggaaacaa

SEQ ID NO: 244529 - RNA, 32 nt, Human
ugaaagacacacacccaggcaaccccugaggc

SEQ ID NO: 244530 - RNA, 32 nt, Human
ugaaagacacugcuccuuccucucauggaguu

SEQ ID NO: 244531 - RNA, 32 nt, Human
ugaaagacacuguuucuccuguuggcucacag

SEQ ID NO: 244532 - RNA, 32 nt, Human
ugaaagacagcagugcccuucucuggaagaag

SEQ ID NO: 244533 - RNA, 32 nt, Human
ugaaagaccuaugagcaaauggugcugaauac

SEQ ID NO: 244534 - RNA, 32 nt, Human
ugaaagacucacugucuacaccaucccucuuc

SEQ ID NO: 244535 - RNA, 32 nt, Human
ugaaagacucggcuucugcugcuagcgccgga

SEQ ID NO: 244536 - RNA, 32 nt, Human
ugaaagacugggugcuagacaagaaggaagca

SEQ ID NO: 244537 - RNA, 32 nt, Human
ugaaagacuuguuuguucugcuucucuucaua

SEQ ID NO: 244538 - RNA, 32 nt, Human
ugaaagagaaggcauuaaaaagaagugcgauu

SEQ ID NO: 244539 - RNA, 32 nt, Human
ugaaagagacaugcucuagcugcagaggcaaa

SEQ ID NO: 244540 - RNA, 32 nt, Human
ugaaagagaggcggaggggagagagggauuuu

SEQ ID NO: 244541 - RNA, 32 nt, Human
ugaaagagagugaaaaugcagacaagacaguu

SEQ ID NO: 244542 - RNA, 31 nt, Human
ugaaagagaugaggaagaaaagacugacgca

SEQ ID NO: 244543 - RNA, 32 nt, Human
ugaaagagauggaagggcuacugugcagcuuu

SEQ ID NO: 244544 - RNA, 32 nt, Human
ugaaagagcaagagaaagccagcugggcggcu

SEQ ID NO: 244545 - RNA, 32 nt, Human
ugaaagagcaagauggagcaauggagagaaga

SEQ ID NO: 244546 - RNA, 32 nt, Human
ugaaagagccaguagagacagcuguagauaac

SEQ ID NO: 244547 - RNA, 32 nt, Human
ugaaagagcuaaaucccucucuucaucucgug

SEQ ID NO: 244548 - RNA, 32 nt, Human
ugaaagaggaagaggcugcaauggagcagcac

SEQ ID NO: 244549 - RNA, 32 nt, Human
ugaaagaggcagaguuuaucccaaugacuucu

SEQ ID NO: 244550 - RNA, 32 nt, Human
ugaaagagggaacugaggugcagagaagccag

SEQ ID NO: 244551 - RNA, 32 nt, Human
ugaaagagucaaugaaaagaaagcuuuaaacu

SEQ ID NO: 244552 - RNA, 32 nt, Human
ugaaagagucagcaccagcagaggcuacucga

SEQ ID NO: 244553 - RNA, 32 nt, Human
ugaaagagugagagaagauggaagggaagggc

SEQ ID NO: 244554 - RNA, 32 nt, Human
ugaaagaguuacuacaaccccaaagaguugug

SEQ ID NO: 244555 - RNA, 23 nt, Human
ugaaagaguuucuuuuacugaga

SEQ ID NO: 244556 - RNA, 32 nt, Human
ugaaagauauggaagacagagcccaggccaua

SEQ ID NO: 244557 - RNA, 32 nt, Human
ugaaagaugcauucacuucuccuuugagaguu

SEQ ID NO: 244558 - RNA, 32 nt, Human
ugaaagaugccagagccggagaugucugcugg

SEQ ID NO: 244559 - RNA, 32 nt, Human
ugaaagcaaacagugcugcucuuuauuccaga

SEQ ID NO: 244560 - RNA, 32 nt, Human
ugaaagcaaauacauuuggauuucaaauuuca

SEQ ID NO: 244561 - RNA, 32 nt, Human
ugaaagcaaaugggagaugaugucagaggcau

SEQ ID NO: 244562 - RNA, 19 nt, Human
ugaaagcaauaguuccuca

SEQ ID NO: 244563 - RNA, 32 nt, Human
ugaaagcaaucugagagauuugaauagaaaaa

SEQ ID NO: 244564 - RNA, 32 nt, Human
ugaaagcacagccgugccuggccagacuccau

SEQ ID NO: 244565 - RNA, 32 nt, Human
ugaaagcaccuccggccacuccugggagacag

SEQ ID NO: 244566 - RNA, 32 nt, Human
ugaaagcagaauaccuguuucaaagagucaac

SEQ ID NO: 244567 - RNA, 32 nt, Human
ugaaagcaguagccaccauguucaaccaucug

SEQ ID NO: 244568 - RNA, 32 nt, Human
ugaaagcagucaucuucagcguuuuccagccc

SEQ ID NO: 244569 - RNA, 22 nt, Human
ugaaagccaagcacacuuuccu

SEQ ID NO: 244570 - RNA, 32 nt, Human
ugaaagccaaggagucacugagaccaaggcuu

SEQ ID NO: 244571 - RNA, 32 nt, Human
ugaaagccaccuggagccaccuugccgggauu

SEQ ID NO: 244572 - RNA, 32 nt, Human
ugaaagccagaacaagagagcgcuccucuccc

SEQ ID NO: 244573 - RNA, 22 nt, Human
ugaaagccauggguucugaaga

SEQ ID NO: 244574 - RNA, 21 nt, Human
ugaaagccgguauugcugaga

SEQ ID NO: 244575 - RNA, 23 nt, Human
ugaaagccucaguuucugaguga

SEQ ID NO: 244576 - RNA, 17 nt, Human
ugaaagccugaguccca

SEQ ID NO: 244577 - RNA, 22 nt, Human
ugaaagccuggugagcagaaag

SEQ ID NO: 244578 - RNA, 32 nt, Human
ugaaagccuuccccggcuccgggcauuauuug

SEQ ID NO: 244579 - RNA, 22 nt, Human
ugaaagccuugcacacucaccu

SEQ ID NO: 244580 - RNA, 32 nt, Human
ugaaagccuuguucuggcauugcagcccagug

SEQ ID NO: 244581 - RNA, 32 nt, Human
ugaaagccuuucugccuuccuuccuguagcug

SEQ ID NO: 244582 - RNA, 32 nt, Human
ugaaagcuaauucucaugaauucaaguagcug

SEQ ID NO: 244583 - RNA, 32 nt, Human
ugaaagcucacucuggauuccacacugcacug

SEQ ID NO: 244584 - RNA, 32 nt, Human
ugaaagcucuuggcagaccucuugucugauaa

SEQ ID NO: 244585 - RNA, 32 nt, Human
ugaaagcugagaagggaaggcagaugggagaa

SEQ ID NO: 244586 - RNA, 32 nt, Human
ugaaagcugauucucaugaauucaaguagcug

SEQ ID NO: 244587 - RNA, 31 nt, Human
ugaaagcugauuuucugagcagcagauacgg

SEQ ID NO: 244588 - RNA, 32 nt, Human
ugaaagcugcacuuaacccuuugugauaauga

SEQ ID NO: 244589 - RNA, 32 nt, Human
ugaaagcuggaaaaggagaagugaaggaugac

SEQ ID NO: 244590 - RNA, 20 nt, Human
ugaaagcuggugugagccca

SEQ ID NO: 244591 - RNA, 32 nt, Human
ugaaagcuguagguaggugaaguggcucacgc

SEQ ID NO: 244592 - RNA, 32 nt, Human
ugaaagcuucaccucuucccucguuuauaucu

SEQ ID NO: 244593 - RNA, 19 nt, Human
ugaaagcuuggggguccca

SEQ ID NO: 244594 - RNA, 32 nt, Human
ugaaaggaaagggagagcuguaagcuucacuc

SEQ ID NO: 244595 - RNA, 17 nt, Human
ugaaaggaaaguagucc

SEQ ID NO: 244596 - RNA, 20 nt, Human
ugaaaggaaagugcuuucca

SEQ ID NO: 244597 - RNA, 17 nt, Human
ugaaaggaaaugcacca

SEQ ID NO: 244598 - RNA, 32 nt, Human
ugaaaggaaaugggugugacucugaggaagcc

SEQ ID NO: 244599 - RNA, 32 nt, Human
ugaaaggaaauuaucaguauuaggcaaagaug

SEQ ID NO: 244600 - RNA, 20 nt, Human
ugaaaggaagacauuuucua

SEQ ID NO: 244601 - RNA, 32 nt, Human
ugaaaggaagacuucuggcuucuccuaaaucu

SEQ ID NO: 244602 - RNA, 19 nt, Human
ugaaaggaagauaugacua

SEQ ID NO: 244603 - RNA, 18 nt, Human
ugaaaggaagaugccccg

SEQ ID NO: 244604 - RNA, 19 nt, Human
ugaaaggaagaugcuuuca

SEQ ID NO: 244605 - RNA, 20 nt, Human
ugaaaggaagauuucagucc

SEQ ID NO: 244606 - RNA, 20 nt, Human
ugaaaggaaggaaugugccc

SEQ ID NO: 244607 - RNA, 19 nt, Human
ugaaaggaaugaagcacca

SEQ ID NO: 244608 - RNA, 32 nt, Human
ugaaaggaaugagaaaagacaguuugagagag

SEQ ID NO: 244609 - RNA, 20 nt, Human
ugaaaggaccgugcagccca

SEQ ID NO: 244610 - RNA, 32 nt, Human
ugaaaggagaaaaaggaggugugggaaguaaa

SEQ ID NO: 244611 - RNA, 18 nt, Human
ugaaaggagaaaauucca

SEQ ID NO: 244612 - RNA, 18 nt, Human
ugaaaggagacagccuca

SEQ ID NO: 244613 - RNA, 32 nt, Human
ugaaaggaggagaggggaaaaggggaggggaa

SEQ ID NO: 244614 - RNA, 32 nt, Human
ugaaaggaggcugggaccaggggaccagguag

SEQ ID NO: 244615 - RNA, 32 nt, Human
ugaaaggaggggcaaaggagucaccagagguc

SEQ ID NO: 244616 - RNA, 32 nt, Human
ugaaaggaggucaagcagagaggaauggcugc

SEQ ID NO: 244617 - RNA, 32 nt, Human
ugaaaggcaaaaacuuccaucacaacaagaaa

SEQ ID NO: 244618 - RNA, 32 nt, Human
ugaaaggcaaauacauuuccauuuuucugucu

SEQ ID NO: 244619 - RNA, 32 nt, Human
ugaaaggcacugacauuagcagaauaagugau

SEQ ID NO: 244620 - RNA, 32 nt, Human
ugaaaggcaguagucauuuucaagacugaauu

SEQ ID NO: 244621 - RNA, 32 nt, Human
ugaaaggcauugaaggaaaccagauacauuaa

SEQ ID NO: 244622 - RNA, 32 nt, Human
ugaaaggcauuuuagugugguuuauguguaau

SEQ ID NO: 244623 - RNA, 32 nt, Human
ugaaaggccacugcacuccagccugagugaca

SEQ ID NO: 244624 - RNA, 32 nt, Human
ugaaaggccacuuuggaaaggguuuggaugag

SEQ ID NO: 244625 - RNA, 32 nt, Human
ugaaaggcuguggcuucaguccuggguuucug

SEQ ID NO: 244626 - RNA, 32 nt, Human
ugaaaggcuguggucuggaagagcccaggucc

SEQ ID NO: 244627 - RNA, 32 nt, Human
ugaaagggaaauuuucuuucaguuuacagaug

SEQ ID NO: 244628 - RNA, 19 nt, Human
ugaaagggacaggguccca

SEQ ID NO: 244629 - RNA, 32 nt, Human
ugaaagggagagaagauuggcgcugggugccg

SEQ ID NO: 244630 - RNA, 18 nt, Human
ugaaagggagcgagcccc

SEQ ID NO: 244631 - RNA, 32 nt, Human
ugaaagggaggaacuuguccuuuacccaguuu

SEQ ID NO: 244632 - RNA, 32 nt, Human
ugaaagggaugagagacagaaaaccuagagga

SEQ ID NO: 244633 - RNA, 32 nt, Human
ugaaagggcagugagacaagaccucauccuac

SEQ ID NO: 244634 - RNA, 18 nt, Human
ugaaagggccagguccca

SEQ ID NO: 244635 - RNA, 32 nt, Human
ugaaagggcuacuauucuuacucccaucccca

SEQ ID NO: 244636 - RNA, 32 nt, Human
ugaaagggcuagauuauaaaauuaagccuuag

SEQ ID NO: 244637 - RNA, 32 nt, Human
ugaaaggggaaagauuggagguaagagagaaa

SEQ ID NO: 244638 - RNA, 32 nt, Human
ugaaagggggauguaggauaugucaucuggcu

SEQ ID NO: 244639 - RNA, 32 nt, Human
ugaaaggguaggucaaggcagcgguggaagga

SEQ ID NO: 244640 - RNA, 32 nt, Human
ugaaagggucaacggcccuguuuauauuggua

SEQ ID NO: 244641 - RNA, 32 nt, Human
ugaaagggugagugcuugaugucuuuaguuua

SEQ ID NO: 244642 - RNA, 32 nt, Human
ugaaagggugaugcucuuaugccugagucuug

SEQ ID NO: 244643 - RNA, 32 nt, Human
ugaaaggguuugaagccaggaggagagaugca

SEQ ID NO: 244644 - RNA, 32 nt, Human
ugaaagguaaccuuagcccugccuuguguucc

SEQ ID NO: 244645 - RNA, 32 nt, Human
ugaaagguaaugaagauggagcagaaugagca

SEQ ID NO: 244646 - RNA, 19 nt, Human
ugaaagguaauuugagaga

SEQ ID NO: 244647 - RNA, 32 nt, Human
ugaaaggucccugguaucuggccagaguguua

SEQ ID NO: 244648 - RNA, 32 nt, Human
ugaaaggugacuucgacgcucuucugaggccu

SEQ ID NO: 244649 - RNA, 23 nt, Human
ugaaagguggggggugaguccca

SEQ ID NO: 244650 - RNA, 32 nt, Human
ugaaaggugugaacagcuuuguauguuuauga

SEQ ID NO: 244651 - RNA, 32 nt, Human
ugaaagguguuauuugugaagcugauaaccga

SEQ ID NO: 244652 - RNA, 32 nt, Human
ugaaagguugcacucuagggugaaccaagcua

SEQ ID NO: 244653 - RNA, 32 nt, Human
ugaaagguugggggaggcugggagaggggaac

SEQ ID NO: 244654 - RNA, 32 nt, Human
ugaaagguugggucugaaaagucaucaccuac

SEQ ID NO: 244655 - RNA, 20 nt, Human
ugaaagguuuucgaguccua

SEQ ID NO: 244656 - RNA, 32 nt, Human
ugaaaguaaggguuuccgagcagccuuaucau

SEQ ID NO: 244657 - RNA, 32 nt, Human
ugaaaguacagaaucucaaccuuacagucuuu

SEQ ID NO: 244658 - RNA, 23 nt, Human
ugaaaguacgaggcuggaagaaa

SEQ ID NO: 244659 - RNA, 32 nt, Human
ugaaaguacugaggaagaguugcugagaagac

SEQ ID NO: 244660 - RNA, 32 nt, Human
ugaaaguacugaggaagaguugcugagacgac

SEQ ID NO: 244661 - RNA, 32 nt, Human
ugaaaguagaagcaagaaucaguugguuugcu

SEQ ID NO: 244662 - RNA, 32 nt, Human
ugaaaguaggaggugggggaagaggcaagccu

SEQ ID NO: 244663 - RNA, 32 nt, Human
ugaaaguagggagggacuaagucagucaucau

SEQ ID NO: 244664 - RNA, 32 nt, Human
ugaaaguaucugccuggcagugcaguaaauga

SEQ ID NO: 244665 - RNA, 32 nt, Human
ugaaaguaugauuucauuucccagaaaaugua

SEQ ID NO: 244666 - RNA, 32 nt, Human
ugaaaguauugcaguauugaugccauuguaga

SEQ ID NO: 244667 - RNA, 32 nt, Human
ugaaagucaaagauuccauuuuaaagccauug

SEQ ID NO: 244668 - RNA, 32 nt, Human
ugaaagucacauccuucuccugccucuguccc

SEQ ID NO: 244669 - RNA, 32 nt, Human
ugaaagucagggucggcuucuaaaaauuuguu

SEQ ID NO: 244670 - RNA, 32 nt, Human
ugaaaguccacuccuuucaugguuuuuccugc

SEQ ID NO: 244671 - RNA, 32 nt, Human
ugaaagucuauugcuguucugagagcuccuuu

SEQ ID NO: 244672 - RNA, 32 nt, Human
ugaaagucuuacugggcccuggggaagguauc

SEQ ID NO: 244673 - RNA, 32 nt, Human
ugaaagugacccugggcuggggcgccggggcg

SEQ ID NO: 244674 - RNA, 32 nt, Human
ugaaagugacucugcuuuuauucaucaaauug

SEQ ID NO: 244675 - RNA, 32 nt, Human
ugaaagugagaccagcugucccaguuggaagc

SEQ ID NO: 244676 - RNA, 32 nt, Human
ugaaagugaugcagagagccaaaaccagcauc

SEQ ID NO: 244677 - RNA, 32 nt, Human
ugaaagugccuucgcagacuuuugccagcaaa

SEQ ID NO: 244678 - RNA, 20 nt, Human
ugaaaguggaguccugagag

SEQ ID NO: 244679 - RNA, 32 nt, Human
ugaaaguggcucuucuaaccucagccaaacac

SEQ ID NO: 244680 - RNA, 32 nt, Human
ugaaaguggcugguugggagcagagcuaagug

SEQ ID NO: 244681 - RNA, 32 nt, Human
ugaaagugggaaagcuuucauuagaaauuugc

SEQ ID NO: 244682 - RNA, 32 nt, Human
ugaaaguguaggaggaaggaagagauacaaac

SEQ ID NO: 244683 - RNA, 32 nt, Human
ugaaagugucaucuucacugccaaucaggcaa

SEQ ID NO: 244684 - RNA, 20 nt, Human
ugaaaguuaaacuuuacuga

SEQ ID NO: 244685 - RNA, 32 nt, Human
ugaaaguuaguauuuuggcucucacaaagccu

SEQ ID NO: 244686 - RNA, 32 nt, Human
ugaaaguuauauucuuuugaaccacguucuaa

SEQ ID NO: 244687 - RNA, 31 nt, Human
ugaaaguugaaaucauaccuaccucauaagg

SEQ ID NO: 244688 - RNA, 21 nt, Human
ugaaaguuuagcccacugaga

SEQ ID NO: 244689 - RNA, 32 nt, Human
ugaaaguuuuuggaaaagaugcagggucugag

SEQ ID NO: 244690 - RNA, 23 nt, Human
ugaaaguuuuuuguuuuguuuug

SEQ ID NO: 244691 - RNA, 32 nt, Human
ugaaauaaaccuggaagcagaauuccugaaug

SEQ ID NO: 244692 - RNA, 32 nt, Human
ugaaauaaaugcugugacucagacauuaagag

SEQ ID NO: 244693 - RNA, 32 nt, Human
ugaaauaaccuagugacccauuucucaagcuc

SEQ ID NO: 244694 - RNA, 32 nt, Human
ugaaauaagagaauuagaccccagggagugac

SEQ ID NO: 244695 - RNA, 32 nt, Human
ugaaauaagauagugacccugaagcccuuagc

SEQ ID NO: 244696 - RNA, 20 nt, Human
ugaaauaagccauuuucuug

SEQ ID NO: 244697 - RNA, 32 nt, Human
ugaaauaaggagggacaugauggggaaggagu

SEQ ID NO: 244698 - RNA, 32 nt, Human
ugaaauacuacugcaauugcuucccuucuuaa

SEQ ID NO: 244699 - RNA, 32 nt, Human
ugaaauacuccucccaccacacacacaugcuc

SEQ ID NO: 244700 - RNA, 32 nt, Human
ugaaauacugaguuguucuguugacuuuugca

SEQ ID NO: 244701 - RNA, 32 nt, Human
ugaaauacugcaacaucugcugcaaucaguaa

SEQ ID NO: 244702 - RNA, 32 nt, Human
ugaaauagaaggccugcccuuccuuucucugu

SEQ ID NO: 244703 - RNA, 32 nt, Human
ugaaauagaauuugcaugucugccuuaauuaa

SEQ ID NO: 244704 - RNA, 32 nt, Human
ugaaauagauuucauuucuugugcacacagcc

SEQ ID NO: 244705 - RNA, 32 nt, Human
ugaaauauaaaccaaaugaaauauuuuaacug

SEQ ID NO: 244706 - RNA, 32 nt, Human
ugaaauauaaggcaccucccacuuuuauguau

SEQ ID NO: 244707 - RNA, 32 nt, Human
ugaaauauacaguacauugcaggaacugccuc

SEQ ID NO: 244708 - RNA, 32 nt, Human
ugaaauauauuuucucuuuuugaucuugugcu

SEQ ID NO: 244709 - RNA, 32 nt, Human
ugaaauaugcugcaaucauuucugcauccuua

SEQ ID NO: 244710 - RNA, 32 nt, Human
ugaaauaugucauugaauuguauuccagacac

SEQ ID NO: 244711 - RNA, 32 nt, Human
ugaaauauuuaucuugauuacugagcuuuuug

SEQ ID NO: 244712 - RNA, 32 nt, Human
ugaaaucaacagaggcaggagugaaguugugu

SEQ ID NO: 244713 - RNA, 32 nt, Human
ugaaaucacaccacuacacuccagccaaagca

SEQ ID NO: 244714 - RNA, 32 nt, Human
ugaaaucaccgcgccucacucgccucgacagu

SEQ ID NO: 244715 - RNA, 32 nt, Human
ugaaaucaggaguucaagaucagccuggcuaa

SEQ ID NO: 244716 - RNA, 32 nt, Human
ugaaaucagggaaaagcuaauaguaucagaca

SEQ ID NO: 244717 - RNA, 32 nt, Human
ugaaaucaggggauauucauuuguaaauuuua

SEQ ID NO: 244718 - RNA, 32 nt, Human
ugaaaucaggguggggccugacagccguagug

SEQ ID NO: 244719 - RNA, 32 nt, Human
ugaaaucauauuuaaagagaagaauccuggag

SEQ ID NO: 244720 - RNA, 32 nt, Human
ugaaaucauauuuggaauaaaaauuccagaau

SEQ ID NO: 244721 - RNA, 32 nt, Human
ugaaaucaugagggagguuguguaggaaagaa

SEQ ID NO: 244722 - RNA, 32 nt, Human
ugaaaucaugccacugcacccuagcuugggug

SEQ ID NO: 244723 - RNA, 32 nt, Human
ugaaaucccagaacauuguuugccaguaucuc

SEQ ID NO: 244724 - RNA, 32 nt, Human
ugaaaucccugccucuggcuuccuaaacccau

SEQ ID NO: 244725 - RNA, 32 nt, Human
ugaaauccuacagaccaaaauccacuugucag

SEQ ID NO: 244726 - RNA, 32 nt, Human
ugaaauccuaggccucuuccagaggccagaug

SEQ ID NO: 244727 - RNA, 32 nt, Human
ugaaauccuuucucgcaaucuuccugcauugu

SEQ ID NO: 244728 - RNA, 32 nt, Human
ugaaaucgacuugccuuugugaaauugaccag

SEQ ID NO: 244729 - RNA, 32 nt, Human
ugaaaucgcguaccacacuccagccuggguga

SEQ ID NO: 244730 - RNA, 32 nt, Human
ugaaaucgggcuucacgcgucuugccuugucc

SEQ ID NO: 244731 - RNA, 32 nt, Human
ugaaaucggugguucucaucuucuguuucuug

SEQ ID NO: 244732 - RNA, 32 nt, Human
ugaaaucuaauauguagcuaaaucugugacuu

SEQ ID NO: 244733 - RNA, 31 nt, Human
ugaaaucucaauaaauuauuuuugaguuuau

SEQ ID NO: 244734 - RNA, 32 nt, Human
ugaaaucuccaccucugcucucugacccuuga

SEQ ID NO: 244735 - RNA, 32 nt, Human
ugaaaucugaacacuacuuagggcuaugaaac

SEQ ID NO: 244736 - RNA, 32 nt, Human
ugaaaucugcuuguaaaacucucaucucauuu

SEQ ID NO: 244737 - RNA, 32 nt, Human
ugaaaucugggcccuggugccugcugaagauu

SEQ ID NO: 244738 - RNA, 20 nt, Human
ugaaaucuguguagguuuua

SEQ ID NO: 244739 - RNA, 21 nt, Human
ugaaaucuuuuaaaaauucaa

SEQ ID NO: 244740 - RNA, 19 nt, Human
ugaaaucuuuucaaaaauc

SEQ ID NO: 244741 - RNA, 29 nt, Human
ugaaaugaagugagaagagaaguuuagag

SEQ ID NO: 244742 - RNA, 32 nt, Human
ugaaaugaagugagacuaucagcuaguugugg

SEQ ID NO: 244743 - RNA, 21 nt, Human
ugaaaugaaugaauuaggaag

SEQ ID NO: 244744 - RNA, 31 nt, Human
ugaaaugacaucaucuugcauuuaaagugag

SEQ ID NO: 244745 - RNA, 32 nt, Human
ugaaaugacgccauugcacuccagccuaggca

SEQ ID NO: 244746 - RNA, 32 nt, Human
ugaaaugacgguauaacacaucuacugaaaaa

SEQ ID NO: 244747 - RNA, 32 nt, Human
ugaaaugacucaauuucuauugugguaagcuc

SEQ ID NO: 244748 - RNA, 20 nt, Human
ugaaaugacugaccaggaaa

SEQ ID NO: 244749 - RNA, 32 nt, Human
ugaaaugagaugggaaugauccagcucuuuca

SEQ ID NO: 244750 - RNA, 19 nt, Human
ugaaaugagauggguccca

SEQ ID NO: 244751 - RNA, 32 nt, Human
ugaaaugagccaauccacauuccauuauuuca

SEQ ID NO: 244752 - RNA, 24 nt, Human
ugaaaugagcuuuugcuuuauuuu

SEQ ID NO: 244753 - RNA, 22 nt, Human
ugaaaugagggaaggcaagaaa

SEQ ID NO: 244754 - RNA, 32 nt, Human
ugaaaugaggggacccugacuggagagguggg

SEQ ID NO: 244755 - RNA, 32 nt, Human
ugaaaugaggugugugggcuugucaacacaga

SEQ ID NO: 244756 - RNA, 32 nt, Human
ugaaaugagugauccugccucuggucccagca

SEQ ID NO: 244757 - RNA, 32 nt, Human
ugaaaugauccaauccaacuugaagucaauug

SEQ ID NO: 244758 - RNA, 32 nt, Human
ugaaaugaugcaggcugcuccuauguuggaaa

SEQ ID NO: 244759 - RNA, 32 nt, Human
ugaaaugcaagaaauaacaaugauggcagcaa

SEQ ID NO: 244760 - RNA, 32 nt, Human
ugaaaugcagccaagaagaggagaccgucggc

SEQ ID NO: 244761 - RNA, 32 nt, Human
ugaaaugcagcucccuguccaagugccuugga

SEQ ID NO: 244762 - RNA, 29 nt, Human
ugaaaugcaguggcauaaucucagcucac

SEQ ID NO: 244763 - RNA, 29 nt, Human
ugaaaugccaacaacgucgaggccugcac

SEQ ID NO: 244764 - RNA, 32 nt, Human
ugaaaugccuaugaaugucucaguuagugugu

SEQ ID NO: 244765 - RNA, 32 nt, Human
ugaaaugcuacuuaacuuacuauuucaaaggg

SEQ ID NO: 244766 - RNA, 23 nt, Human
ugaaaugcuagggggccagggaa

SEQ ID NO: 244767 - RNA, 32 nt, Human
ugaaauggaaacauuauuuugaaacguuguca

SEQ ID NO: 244768 - RNA, 32 nt, Human
ugaaauggaaucaagaggaaaauuguaauuga

SEQ ID NO: 244769 - RNA, 21 nt, Human
ugaaauggaaucuugcucugu

SEQ ID NO: 244770 - RNA, 32 nt, Human
ugaaauggagaaagggcuucaggcuggugacu

SEQ ID NO: 244771 - RNA, 32 nt, Human
ugaaauggaggcagaggugugggaggcagaag

SEQ ID NO: 244772 - RNA, 21 nt, Human
ugaaauggagucucgcucugu

SEQ ID NO: 244773 - RNA, 32 nt, Human
ugaaauggagucucgcucugucauucaggcug

SEQ ID NO: 244774 - RNA, 32 nt, Human
ugaaauggagucucgcucugucgcccaggcug

SEQ ID NO: 244775 - RNA, 21 nt, Human
ugaaauggagucuugcucugu

SEQ ID NO: 244776 - RNA, 32 nt, Human
ugaaauggagucuugcucugucacccaggcug

SEQ ID NO: 244777 - RNA, 32 nt, Human
ugaaauggagugaacccaggagagcucaacca

SEQ ID NO: 244778 - RNA, 32 nt, Human
ugaaauggagugagcccaggagagcucagcca

SEQ ID NO: 244779 - RNA, 32 nt, Human
ugaaauggcgccacugcacuccagccugggua

SEQ ID NO: 244780 - RNA, 32 nt, Human
ugaaauggcuguaaggacuccugagauaugug

SEQ ID NO: 244781 - RNA, 32 nt, Human
ugaaaugggacagcagaguaggccagccucug

SEQ ID NO: 244782 - RNA, 32 nt, Human
ugaaaugggaggacucaggaaggaggaucguc

SEQ ID NO: 244783 - RNA, 32 nt, Human
ugaaaugggaggaucacuugagcccaggaguu

SEQ ID NO: 244784 - RNA, 32 nt, Human
ugaaaugggaggaucucuugagcccaggaguu

SEQ ID NO: 244785 - RNA, 32 nt, Human
ugaaaugggauggaguagaacaacagcaggcu

SEQ ID NO: 244786 - RNA, 32 nt, Human
ugaaaugggauuucuggacuguucauugauac

SEQ ID NO: 244787 - RNA, 22 nt, Human
ugaaaugggcugaggcaggaaa

SEQ ID NO: 244788 - RNA, 32 nt, Human
ugaaauggggugcccggguuccucucguuuuu

SEQ ID NO: 244789 - RNA, 32 nt, Human
ugaaaugggguuguggggcagagcaggguuag

SEQ ID NO: 244790 - RNA, 32 nt, Human
ugaaauggugccacugcacuccagucugggca

SEQ ID NO: 244791 - RNA, 32 nt, Human
ugaaauguaauccccaaugcuggaggugggac

SEQ ID NO: 244792 - RNA, 32 nt, Human
ugaaauguaucuccugcaccagccugggccuc

SEQ ID NO: 244793 - RNA, 23 nt, Human
ugaaauguaugcauucacauuua

SEQ ID NO: 244794 - RNA, 32 nt, Human
ugaaauguauuaucugaaaggcuaccugaagc

SEQ ID NO: 244795 - RNA, 32 nt, Human
ugaaaugucagguuguuuagucacugaauaga

SEQ ID NO: 244796 - RNA, 32 nt, Human
ugaaaugucagucuuuucaguaaugaggauac

SEQ ID NO: 244797 - RNA, 32 nt, Human
ugaaaugucucucuucucaucuccuaucuccg

SEQ ID NO: 244798 - RNA, 32 nt, Human
ugaaaugucucuguguugcagauauguagaug

SEQ ID NO: 244799 - RNA, 32 nt, Human
ugaaauguuaccacccucugcuccagguccuc

SEQ ID NO: 244800 - RNA, 32 nt, Human
ugaaauguuuguaaucucauaagcacuuuaua

SEQ ID NO: 244801 - RNA, 23 nt, Human
ugacacgaucuuggcucacugca

SEQ ID NO: 244802 - RNA, 23 nt, Human
ugacacgaucuugucucacugca

SEQ ID NO: 244803 - RNA, 32 nt, Human
ugacacgauuagacacuccuccccacaaaggc

SEQ ID NO: 244804 - RNA, 32 nt, Human
ugacacgccggccaggaggucuguagcugggg

SEQ ID NO: 244805 - RNA, 32 nt, Human
ugacacggagucucgcucuguugcccaggcug

SEQ ID NO: 244806 - RNA, 32 nt, Human
ugacacgggaccccuuuucuacagaccucauc

SEQ ID NO: 244807 - RNA, 21 nt, Human
ugacacgugccuguaauccua

SEQ ID NO: 244808 - RNA, 21 nt, Human
ugacacgugccuguaguccca

SEQ ID NO: 244809 - RNA, 32 nt, Human
ugacacgugccuguagucccagcuacucggga

SEQ ID NO: 244810 - RNA, 32 nt, Human
ugacacgugccuguagucccagcuacucugga

SEQ ID NO: 244811 - RNA, 20 nt, Human
ugacacuaaagcugcuccuu

SEQ ID NO: 244812 - RNA, 32 nt, Human
ugacacuacaugugaucugccuggugaaggcu

SEQ ID NO: 244813 - RNA, 32 nt, Human
ugacacuacuugaacaagaaaaggagggggaa

SEQ ID NO: 244814 - RNA, 22 nt, Human
ugacacuagccugggcaacaca

SEQ ID NO: 244815 - RNA, 32 nt, Human
ugacacucagagagaucaggccaguuucccag

SEQ ID NO: 244816 - RNA, 32 nt, Human
ugacacucaguucugucacugucaaggaugca

SEQ ID NO: 244817 - RNA, 32 nt, Human
ugacacucaugcacagcagccauugcacgugc

SEQ ID NO: 244818 - RNA, 32 nt, Human
ugacacucuagugacuuccuggugaggcccag

SEQ ID NO: 244819 - RNA, 32 nt, Human
ugacacucucagagauuccugaugggcuuucu

SEQ ID NO: 244820 - RNA, 32 nt, Human
ugacacucucuccaaaaauccauuccauuguc

SEQ ID NO: 244821 - RNA, 32 nt, Human
ugacacucugcagacugcuaguguucugucua

SEQ ID NO: 244822 - RNA, 22 nt, Human
ugacacucuuuagagcuuuaau

SEQ ID NO: 244823 - RNA, 32 nt, Human
ugacacugagccugaggacgagaagguuguuu

SEQ ID NO: 244824 - RNA, 23 nt, Human
ugacacugcacccgacucccagu

SEQ ID NO: 244825 - RNA, 32 nt, Human
ugacacugcacuccagccugggcaacagagug

SEQ ID NO: 244826 - RNA, 32 nt, Human
ugacacugcacuccagccugggcgacagagug

SEQ ID NO: 244827 - RNA, 32 nt, Human
ugacacugcacuccagccugggugauagagug

SEQ ID NO: 244828 - RNA, 32 nt, Human
ugacacugcacuccagccuuggcaacaaagca

SEQ ID NO: 244829 - RNA, 32 nt, Human
ugacacugcacuucagccuggcugacagagca

SEQ ID NO: 244830 - RNA, 32 nt, Human
ugacacugcccuccagccugggugacagagug

SEQ ID NO: 244831 - RNA, 32 nt, Human
ugacacugccuaggcauccagcucagugucau

SEQ ID NO: 244832 - RNA, 32 nt, Human
ugacacugcugggcugggugaauggccugguc

SEQ ID NO: 244833 - RNA, 32 nt, Human
ugacacugcuuuggcaaggucauagggggugc

SEQ ID NO: 244834 - RNA, 32 nt, Human
ugacacuggccugucugaacucaccuggccug

SEQ ID NO: 244835 - RNA, 32 nt, Human
ugacacugggaggugggagggccaggccaacu

SEQ ID NO: 244836 - RNA, 32 nt, Human
ugacacuggugacuugacccuuccuagacacc

SEQ ID NO: 244837 - RNA, 32 nt, Human
ugacacugugccagagaguggcugguuuuaaa

SEQ ID NO: 244838 - RNA, 32 nt, Human
ugacacuguuacuuccucaggcuguuaccugc

SEQ ID NO: 244839 - RNA, 32 nt, Human
ugacacuuaccuccacccccauccagcacccu

SEQ ID NO: 244840 - RNA, 32 nt, Human
ugacacuucccugcaacccauccaccccuggu

SEQ ID NO: 244841 - RNA, 17 nt, Human
ugacacuucuuguguua

SEQ ID NO: 244842 - RNA, 23 nt, Human
ugacacuuggauuuacuucuuua

SEQ ID NO: 244843 - RNA, 32 nt, Human
ugacacuuggucauucuuccagccuccauguc

SEQ ID NO: 244844 - RNA, 32 nt, Human
ugacacuuucuccuugcugcuuuuucuucugu

SEQ ID NO: 244845 - RNA, 17 nt, Human
ugacacuuuuuguguug

SEQ ID NO: 244846 - RNA, 32 nt, Human
ugacagaaaaggcagaagcuggggcuuucugg

SEQ ID NO: 244847 - RNA, 32 nt, Human
ugacagaaaggacuuuugaguucuaauuaauc

SEQ ID NO: 244848 - RNA, 32 nt, Human
ugacagaaauugacuggacugucauuguguga

SEQ ID NO: 244849 - RNA, 32 nt, Human
ugacagaagguucauaugcaucacacaccacu

SEQ ID NO: 244850 - RNA, 32 nt, Human
ugacagaagugugagaccagcccagccaacau

SEQ ID NO: 244851 - RNA, 32 nt, Human
ugacagacacaaaauucuacugcauuugggcu

SEQ ID NO: 244852 - RNA, 32 nt, Human
ugacagacgccuguaaucccagcuacuuggga

SEQ ID NO: 244853 - RNA, 32 nt, Human
ugacagacuccucaucuucaggagacucagga

SEQ ID NO: 244854 - RNA, 32 nt, Human
ugacagacucuuccccuccucucccucugccu

SEQ ID NO: 244855 - RNA, 32 nt, Human
ugacagacugauagaaaguauuggcagaccag

SEQ ID NO: 244856 - RNA, 32 nt, Human
ugacagacuguuaucuccucugggugaccuca

SEQ ID NO: 244857 - RNA, 32 nt, Human
ugacagagaacucacaggaaguuacuucaagc

SEQ ID NO: 244858 - RNA, 32 nt, Human
ugacagagaaggcagaggggaguguggagugg

SEQ ID NO: 244859 - RNA, 32 nt, Human
ugacagagacacacgcccuugcccaccuuccu

SEQ ID NO: 244860 - RNA, 18 nt, Human
ugacagagaccuaagcca

SEQ ID NO: 244861 - RNA, 32 nt, Human
ugacagagaggaaggaggaggaaugagagggg

SEQ ID NO: 244862 - RNA, 32 nt, Human
ugacagagaugauccagacagagauguucagg

SEQ ID NO: 244863 - RNA, 32 nt, Human
ugacagagauggggaggggcagaggaauuuaa

SEQ ID NO: 244864 - RNA, 32 nt, Human
ugacagagccugggaaggagagacgaggaggc

SEQ ID NO: 244865 - RNA, 32 nt, Human
ugacagagcugcagaccccugccuugagucuc

SEQ ID NO: 244866 - RNA, 32 nt, Human
ugacagagcugcaucuugauuuagacuaaaag

SEQ ID NO: 244867 - RNA, 32 nt, Human
ugacagagcuguccaggauugcaguggauagg

SEQ ID NO: 244868 - RNA, 19 nt, Human
ugacagaguggaugggguc

SEQ ID NO: 244869 - RNA, 31 nt, Human
ugacagaguggggaaagauggggacugaggg

SEQ ID NO: 244870 - RNA, 32 nt, Human
ugacagaucacugaggggaggacuuguuuuuc

SEQ ID NO: 244871 - RNA, 32 nt, Human
ugacagaucacugcagccuccaacuccugggc

SEQ ID NO: 244872 - RNA, 32 nt, Human
ugacagaucagugcauuucccuucccuguagg

SEQ ID NO: 244873 - RNA, 32 nt, Human
ugacagaucucaauuuuauaguagugggaaag

SEQ ID NO: 244874 - RNA, 32 nt, Human
ugacagaugaggaaacggcgaggcagacaggu

SEQ ID NO: 244875 - RNA, 32 nt, Human
ugacagauuggcagagugcagggaggugagag

SEQ ID NO: 244876 - RNA, 32 nt, Human
ugacagcaaagaagguggugaagguuucacag

SEQ ID NO: 244877 - RNA, 32 nt, Human
ugacagcacacaaaucuuuaauuuuccuuuuu

SEQ ID NO: 244878 - RNA, 32 nt, Human
ugacagcacaucugcaggaagcaugagggucu

SEQ ID NO: 244879 - RNA, 32 nt, Human
ugacagcaccacaagcucaggcaucguugaag

SEQ ID NO: 244880 - RNA, 32 nt, Human
ugacagcaccacugcacagagcuuugggaggc

SEQ ID NO: 244881 - RNA, 32 nt, Human
ugacagcaccacugcacuccagccaggaauga

SEQ ID NO: 244882 - RNA, 32 nt, Human
ugacagcaccugccuggugaugcucuuggagg

SEQ ID NO: 244883 - RNA, 32 nt, Human
ugacagcacuuagacgaggcuugggggcaggg

SEQ ID NO: 244884 - RNA, 15 nt, Human
ugacagcacuuccuc

SEQ ID NO: 244885 - RNA, 32 nt, Human
ugacagcagccagcucaggaggcagaggacga

SEQ ID NO: 244886 - RNA, 32 nt, Human
ugacagcagcccuggugccccagccugcuagg

SEQ ID NO: 244887 - RNA, 32 nt, Human
ugacagcagggucugcccucuugagugugggg

SEQ ID NO: 244888 - RNA, 32 nt, Human
ugacagcaguaaggauaagaagaagaaaacua

SEQ ID NO: 244889 - RNA, 16 nt, Human
ugacagcaguggccca

SEQ ID NO: 244890 - RNA, 32 nt, Human
ugacagcauccuggcgacuccacaguggagcu

SEQ ID NO: 244891 - RNA, 32 nt, Human
ugacagcaucugauaaucuguugguuuauuuc

SEQ ID NO: 244892 - RNA, 32 nt, Human
ugacagcaugaagauaaugccugugguuaugc

SEQ ID NO: 244893 - RNA, 32 nt, Human
ugacagcauuuuagaagacagaacaggaauuc

SEQ ID NO: 244894 - RNA, 20 nt, Human
ugacagccaaggacuggaag

SEQ ID NO: 244895 - RNA, 32 nt, Human
ugacagccagcucacaguuucuugccugaagc

SEQ ID NO: 244896 - RNA, 32 nt, Human
ugacagccaggaccccaggcagcagcgaguga

SEQ ID NO: 244897 - RNA, 23 nt, Human
ugacagccauguuuucccggaga

SEQ ID NO: 244898 - RNA, 32 nt, Human
ugacagcccaagauagaaucagucccagagca

SEQ ID NO: 244899 - RNA, 32 nt, Human
ugacagcccccaccccuccccacugccagauc

SEQ ID NO: 244900 - RNA, 32 nt, Human
ugacagcccccaggccugggggcacagauccc

SEQ ID NO: 244901 - RNA, 32 nt, Human
ugacagcccugccuucugcccucugcccugca

SEQ ID NO: 244902 - RNA, 32 nt, Human
ugacagcccuugaaggugguagcccagcuccu

SEQ ID NO: 244903 - RNA, 32 nt, Human
ugacagccgagacucauuuccaaggcacagca

SEQ ID NO: 244904 - RNA, 32 nt, Human
ugacagccgcagccgggcucucagccagcggc

SEQ ID NO: 244905 - RNA, 32 nt, Human
ugacagccggcgcuacagccuggcagaucuga

SEQ ID NO: 244906 - RNA, 32 nt, Human
ugacagccgguguccuggaaagccccaagcag

SEQ ID NO: 244907 - RNA, 32 nt, Human
ugacagccuuucuugcccucugaccucaaagg

SEQ ID NO: 244908 - RNA, 32 nt, Human
ugacagcggcgccgcugugcucgcgaccccgg

SEQ ID NO: 244909 - RNA, 32 nt, Human
ugacagcgugagccaccacaccuggccaagaa

SEQ ID NO: 244910 - RNA, 32 nt, Human
ugacagcgugggcaucuucaggcacagccuug

SEQ ID NO: 244911 - RNA, 32 nt, Human
ugacagcuaagauccugaucaaauuggaggag

SEQ ID NO: 244912 - RNA, 32 nt, Human
ugacagcucacuggaacuuuucaucugcuugg

SEQ ID NO: 244913 - RNA, 32 nt, Human
ugacagcucccagguacuucaagguuggcccu

SEQ ID NO: 244914 - RNA, 32 nt, Human
ugacagcugcagaggcagggcccagugcuggc

SEQ ID NO: 244915 - RNA, 32 nt, Human
ugacagcugcagcugccuugccuugccgccgc

SEQ ID NO: 244916 - RNA, 32 nt, Human
ugacagcugcuugccaugacugaugcagacua

SEQ ID NO: 244917 - RNA, 32 nt, Human
ugacagcuggaaagagcgcggagccagcgccu

SEQ ID NO: 244918 - RNA, 32 nt, Human
ugacagcuuggucaggguguauuguagcuuau

SEQ ID NO: 244919 - RNA, 32 nt, Human
ugacagcuuuaucuccccaggagcagcaucuc

SEQ ID NO: 244920 - RNA, 32 nt, Human
ugacaggaauguuaccuucaauuguauguuac

SEQ ID NO: 244921 - RNA, 24 nt, Human
ugacaggaccaaggucucagcaca

SEQ ID NO: 244922 - RNA, 32 nt, Human
ugacaggagaagguuuaaauguucuugaaaag

SEQ ID NO: 244923 - RNA, 32 nt, Human
ugacaggagauggagaagcaccagcugaucug

SEQ ID NO: 244924 - RNA, 32 nt, Human
ugacaggagcuugggagcucgggagcuuggga

SEQ ID NO: 244925 - RNA, 32 nt, Human
ugacaggaggcagcagaaguugcagagaagag

SEQ ID NO: 244926 - RNA, 32 nt, Human
ugacaggauaaauauccaaaccauaucacuua

SEQ ID NO: 244927 - RNA, 23 nt, Human
ugacaggaucucggcucacugca

SEQ ID NO: 244928 - RNA, 32 nt, Human
ugacaggauggaccacguggccaucugaggaa

SEQ ID NO: 244929 - RNA, 18 nt, Human
ugacaggauggcuuucuc

SEQ ID NO: 244930 - RNA, 32 nt, Human
ugacaggaugggggaggguggggaggggaaga

SEQ ID NO: 244931 - RNA, 32 nt, Human
ugacaggauguggcacugcuugaggaggggca

SEQ ID NO: 244932 - RNA, 32 nt, Human
ugacaggcacauacaugagaacaggccaucuc

SEQ ID NO: 244933 - RNA, 32 nt, Human
ugacaggcacccaccaccacacccagcuaauu

SEQ ID NO: 244934 - RNA, 25 nt, Human
ugacaggcacccccuucugugggaa

SEQ ID NO: 244935 - RNA, 21 nt, Human
ugacaggcaccuguaauccca

SEQ ID NO: 244936 - RNA, 32 nt, Human
ugacaggcagaggguguuccugacagagggaa

SEQ ID NO: 244937 - RNA, 32 nt, Human
ugacaggcaguggcgugaucuuggcucacugc

SEQ ID NO: 244938 - RNA, 32 nt, Human
ugacaggcauggccggggucagcucuuucagc

SEQ ID NO: 244939 - RNA, 32 nt, Human
ugacaggccaugacuguagaguggucagaacu

SEQ ID NO: 244940 - RNA, 28 nt, Human
ugacaggcccaaugugccucauugagaa

SEQ ID NO: 244941 - RNA, 15 nt, Human
ugacaggcccgaggu

SEQ ID NO: 244942 - RNA, 32 nt, Human
ugacaggccgcggcugucuguguguccuucug

SEQ ID NO: 244943 - RNA, 19 nt, Human
ugacaggccuguggcggua

SEQ ID NO: 244944 - RNA, 32 nt, Human
ugacaggccuuuucacaaaggccccaaggaca

SEQ ID NO: 244945 - RNA, 32 nt, Human
ugacaggcgcagcgaaaggcagcccucugcua

SEQ ID NO: 244946 - RNA, 32 nt, Human
ugacaggcgcuguuccccacagccagcgccgc

SEQ ID NO: 244947 - RNA, 32 nt, Human
ugacagggaauggauuccaaacaccagugugu

SEQ ID NO: 244948 - RNA, 32 nt, Human
ugacagggacaaaugccucccuucccugcagc

SEQ ID NO: 244949 - RNA, 32 nt, Human
ugacagggacaggggagcaggaagccaaccca

SEQ ID NO: 244950 - RNA, 32 nt, Human
ugacagggaugcaauccagggugggauuucuu

SEQ ID NO: 244951 - RNA, 32 nt, Human
ugacagggcaggaagagaagaaaacggaggag

SEQ ID NO: 244952 - RNA, 32 nt, Human
ugacaggggcccugcuccucucugugguugga

SEQ ID NO: 244953 - RNA, 32 nt, Human
ugacagggggaggagcccgccgggagggccgg

SEQ ID NO: 244954 - RNA, 32 nt, Human
ugacaggguccccagggagaccgugucaguag

SEQ ID NO: 244955 - RNA, 21 nt, Human
ugacagggucucacucuguca

SEQ ID NO: 244956 - RNA, 25 nt, Human
ugacagggucuugcucugucauuca

SEQ ID NO: 244957 - RNA, 32 nt, Human
ugacaggguucaggaagacugacugggccacu

SEQ ID NO: 244958 - RNA, 32 nt, Human
ugacaggguugcagaagccaaggaguucggca

SEQ ID NO: 244959 - RNA, 32 nt, Human
ugacaggugcagcaaaccaccauggcacaugu

SEQ ID NO: 244960 - RNA, 21 nt, Human
ugacaggugccuguaauccca

SEQ ID NO: 244961 - RNA, 32 nt, Human
ugacaggugccuguaaucccagcuacucggua

SEQ ID NO: 244962 - RNA, 32 nt, Human
ugacaggugccuguaaucccagcuacuuggga

SEQ ID NO: 244963 - RNA, 32 nt, Human
ugacaggugccuguagucccagcuacucggga

SEQ ID NO: 244964 - RNA, 32 nt, Human
ugacaggugcugcugccucugagcccucccug

SEQ ID NO: 244965 - RNA, 21 nt, Human
ugacagguuccgguauucuga

SEQ ID NO: 244966 - RNA, 32 nt, Human
ugacagguuugcuacacacagccccggacugu

SEQ ID NO: 244967 - RNA, 32 nt, Human
ugacagguuuugcccaaggcuuugauaccugu

SEQ ID NO: 244968 - RNA, 32 nt, Human
ugacaguaacagcaucuuuaacacaacucuuu

SEQ ID NO: 244969 - RNA, 32 nt, Human
ugacaguaaccccuaccucacaggguuguugu

SEQ ID NO: 244970 - RNA, 32 nt, Human
ugacaguaacccuuccccggaaagaaauagaa

SEQ ID NO: 244971 - RNA, 32 nt, Human
ugacaguacaaggacuagauccacaggaaaca

SEQ ID NO: 244972 - RNA, 32 nt, Human
ugacaguaccaggagacaaaugacuuacagau

SEQ ID NO: 244973 - RNA, 32 nt, Human
ugacaguagcaccagcaacugcagugauacca

SEQ ID NO: 244974 - RNA, 32 nt, Human
ugacaguaguuauuucucagcuuuucagugau

SEQ ID NO: 244975 - RNA, 32 nt, Human
ugacaguaucagaagacacagcuucuuuaaug

SEQ ID NO: 244976 - RNA, 32 nt, Human
ugacagucaccaggaaggacaagggugcucug

SEQ ID NO: 244977 - RNA, 32 nt, Human
ugacagucaccuccucaccucugcuccuugcc

SEQ ID NO: 244978 - RNA, 32 nt, Human
ugacagucacugcauuugccugcuucuuucca

SEQ ID NO: 244979 - RNA, 32 nt, Human
ugacagucacugccacgguuuccccaggcagg

SEQ ID NO: 244980 - RNA, 32 nt, Human
ugacagucucaccaauuucagaaaaucauuaa

SEQ ID NO: 244981 - RNA, 32 nt, Human
ugacagugaacccacagugggagagaguuuuu

SEQ ID NO: 244982 - RNA, 32 nt, Human
ugacagugacuguccccaccuccuguguuagu

SEQ ID NO: 244983 - RNA, 32 nt, Human
ugacagugagcagauccagacaccagauccag

SEQ ID NO: 244984 - RNA, 32 nt, Human
ugacagugagggugaugccaucuacccugccc

SEQ ID NO: 244985 - RNA, 32 nt, Human
ugacagugagggugcguccagguucagauaga

SEQ ID NO: 244986 - RNA, 32 nt, Human
ugacagugaucugacauccacuaagcaaauuu

SEQ ID NO: 244987 - RNA, 32 nt, Human
ugacagugaugagcuaggugcagagagaguua

SEQ ID NO: 244988 - RNA, 32 nt, Human
ugacagugauucaccacuggugaugauaaaaa

SEQ ID NO: 244989 - RNA, 32 nt, Human
ugacagugcccagagugacagcuguauauugc

SEQ ID NO: 244990 - RNA, 32 nt, Human
ugacagugcuucuguucaaggauauaaggccc

SEQ ID NO: 244991 - RNA, 32 nt, Human
ugacaguggaugaauggauggacguacagagg

SEQ ID NO: 244992 - RNA, 21 nt, Human
ugacaguggcugcaguauuga

SEQ ID NO: 244993 - RNA, 32 nt, Human
ugacagugggguccucugcagggucagguccc

SEQ ID NO: 244994 - RNA, 32 nt, Human
ugacaguguggaccauggaaucaccagcuaga

SEQ ID NO: 244995 - RNA, 32 nt, Human
ugacaguguggcauuacugauaaguuauggaa

SEQ ID NO: 244996 - RNA, 32 nt, Human
ugacaguguguguagagcaugugccacccagc

SEQ ID NO: 244997 - RNA, 32 nt, Human
ugacaguguugaagcagggugaauaacuaggg

SEQ ID NO: 244998 - RNA, 20 nt, Human
ugacaguguuggucauccca

SEQ ID NO: 244999 - RNA, 32 nt, Human
ugacaguuaguaaacugcuccagggaaauaag

SEQ ID NO: 245000 - RNA, 32 nt, Human
ugacaguuccaugagcugggaacccgcucagu

SEQ ID NO: 245001 - RNA, 32 nt, Human
ugacaguucuccacacugugcaugcacccuug

SEQ ID NO: 245002 - RNA, 32 nt, Human
ugacaguuggagggaaagccagccugggggcu

SEQ ID NO: 245003 - RNA, 32 nt, Human
ugacaguuuccugaguggcucugccaauccau

SEQ ID NO: 245004 - RNA, 32 nt, Human
ugacaguuucugaggcagaagccguaucaugu

SEQ ID NO: 245005 - RNA, 31 nt, Human
ugacaguuuguggcaucuugccaaggguccc

SEQ ID NO: 245006 - RNA, 32 nt, Human
ugacauaaaugcugaagagacaggcauuguuu

SEQ ID NO: 245007 - RNA, 26 nt, Human
ugacauaagguaauccacccgccuca

SEQ ID NO: 245008 - RNA, 32 nt, Human
ugacauaaucccuuccuccugggaaacaccag

SEQ ID NO: 245009 - RNA, 32 nt, Human
ugacauaaucuugaucuuuuaauuuguaaaua

SEQ ID NO: 245010 - RNA, 32 nt, Human
ugacauaauuuaguuucauguaaugaaacuuu

SEQ ID NO: 245011 - RNA, 32 nt, Human
ugacauacacauccaccauggaaagggaagca

SEQ ID NO: 245012 - RNA, 32 nt, Human
ugacauaccuaaaacacguggcucugaccugu

SEQ ID NO: 245013 - RNA, 32 nt, Human
ugacauaccucagacgccucuggauccaagaa

SEQ ID NO: 245014 - RNA, 32 nt, Human
ugacauacuaguuguauugacagugccucacu

SEQ ID NO: 245015 - RNA, 32 nt, Human
ugacauacugaagcuccagccagggggauggg

SEQ ID NO: 245016 - RNA, 24 nt, Human
ugacauacuucuccuuuguauucu

SEQ ID NO: 245017 - RNA, 24 nt, Human
ugacauagacacuagguuuuuaca

SEQ ID NO: 245018 - RNA, 32 nt, Human
ugacauaguaccauugggguuaagucauuuuc

SEQ ID NO: 245019 - RNA, 32 nt, Human
ugacauauauagaaacauaaaucaggcuagag

SEQ ID NO: 245020 - RNA, 32 nt, Human
ugacauaucacaugucagccacugugauagag

SEQ ID NO: 245021 - RNA, 32 nt, Human
ugacauaugaugggacugcuuccccuacauua

SEQ ID NO: 245022 - RNA, 32 nt, Human
ugacauauguaaucccagcacuuugggaggcu

SEQ ID NO: 245023 - RNA, 21 nt, Human
ugacaucaacagugacucagu

SEQ ID NO: 245024 - RNA, 20 nt, Human
ugacaucaagcugcuucgau

SEQ ID NO: 245025 - RNA, 32 nt, Human
ugacaucaauuccaaagacagaagcagcugcu

SEQ ID NO: 245026 - RNA, 20 nt, Human
ugacaucacagggccucagu

SEQ ID NO: 245027 - RNA, 32 nt, Human
ugacaucacccaggaugcaaugauccaaaaga

SEQ ID NO: 245028 - RNA, 32 nt, Human
ugacaucacuggcauugcaccugggugugccc

SEQ ID NO: 245029 - RNA, 32 nt, Human
ugacaucagcgucgacuugccuuucccggggu

SEQ ID NO: 245030 - RNA, 32 nt, Human
ugacaucaggaguuugagaccaaccuggccaa

SEQ ID NO: 245031 - RNA, 32 nt, Human
ugacaucaggcagaggagagugcagccucaca

SEQ ID NO: 245032 - RNA, 25 nt, Human
ugacaucaggugauccaccugccuc

SEQ ID NO: 245033 - RNA, 32 nt, Human
ugacaucaguaguucaagaccagccuggccaa

SEQ ID NO: 245034 - RNA, 32 nt, Human
ugacaucauccagggagacacacaagguccca

SEQ ID NO: 245035 - RNA, 32 nt, Human
ugacaucauccagguaaauggcacccagguga

SEQ ID NO: 245036 - RNA, 20 nt, Human
ugacaucauccauuuagucu

SEQ ID NO: 245037 - RNA, 17 nt, Human
ugacaucaugaccucaa

SEQ ID NO: 245038 - RNA, 22 nt, Human
ugacaucauuaggcauucuuga

SEQ ID NO: 245039 - RNA, 32 nt, Human
ugacaucauucaaccagcucucguccuagcaa

SEQ ID NO: 245040 - RNA, 32 nt, Human
ugacauccaauacagaguucugguaaagauaa

SEQ ID NO: 245041 - RNA, 32 nt, Human
ugacauccaccaggagaucggcaggggugcuu

SEQ ID NO: 245042 - RNA, 32 nt, Human
ugacauccaccgacuucugcuccuuccagcag

SEQ ID NO: 245043 - RNA, 32 nt, Human
ugacaucccacacagcugucuguucugccagu

SEQ ID NO: 245044 - RNA, 32 nt, Human
ugacaucccaucuccuccucugcauuaaagau

SEQ ID NO: 245045 - RNA, 31 nt, Human
ugacaucccgcagaugagaccaaagccacau

SEQ ID NO: 245046 - RNA, 32 nt, Human
ugacauccuccagagauggccccuccucaccu

SEQ ID NO: 245047 - RNA, 32 nt, Human
ugacaucgcccccugaggacuuggcugcaacc

SEQ ID NO: 245048 - RNA, 32 nt, Human
ugacaucgcgccacugcacuucagccuggaca

SEQ ID NO: 245049 - RNA, 32 nt, Human
ugacaucggcaacuucgagcuccuguggaggc

SEQ ID NO: 245050 - RNA, 19 nt, Human
ugacaucguucccugggga

SEQ ID NO: 245051 - RNA, 32 nt, Human
ugacaucuaauucaagauuacaacaucuguua

SEQ ID NO: 245052 - RNA, 31 nt, Human
ugacaucuacuuuucuuagagacaugaagaa

SEQ ID NO: 245053 - RNA, 32 nt, Human
ugacaucuagaaucaccugccaccuggagccu

SEQ ID NO: 245054 - RNA, 32 nt, Human
ugacaucuagcuuugacaaucauaguauguuu

SEQ ID NO: 245055 - RNA, 32 nt, Human
ugacaucuccauccccaggcucucaaccgucu

SEQ ID NO: 245056 - RNA, 32 nt, Human
ugacaucugccuggagucccgccccugcccag

SEQ ID NO: 245057 - RNA, 32 nt, Human
ugacaucugccugggcuugagugcuacggacu

SEQ ID NO: 245058 - RNA, 32 nt, Human
ugacaucuguaauccccgcacuuugugaggcu

SEQ ID NO: 245059 - RNA, 32 nt, Human
ugacaucuucauuucugggcuacuacuaugac

SEQ ID NO: 245060 - RNA, 32 nt, Human
ugacaucuuccagaugcuggaugugcugcagg

SEQ ID NO: 245061 - RNA, 32 nt, Human
ugacaugaaaagaucuggcucauggggcagag

SEQ ID NO: 245062 - RNA, 32 nt, Human
ugacaugaaaccugggugcuacaguaaaagaa

SEQ ID NO: 245063 - RNA, 18 nt, Human
ugacaugaaaucuuuguu

SEQ ID NO: 245064 - RNA, 32 nt, Human
ugacaugaacccaggaggcggagcuugcagug

SEQ ID NO: 245065 - RNA, 19 nt, Human
ugacaugaauuuuauguua

SEQ ID NO: 245066 - RNA, 32 nt, Human
ugacaugagaaaagaggagcuguuuugguauu

SEQ ID NO: 245067 - RNA, 19 nt, Human
ugacaugagaacuugguua

SEQ ID NO: 245068 - RNA, 18 nt, Human
ugacaugagccuauguug

SEQ ID NO: 245069 - RNA, 32 nt, Human
ugacaugaggugcagaggcccacccagccccc

SEQ ID NO: 245070 - RNA, 32 nt, Human
ugacaugagguggccugaacaccugagggacu

SEQ ID NO: 245071 - RNA, 20 nt, Human
ugacaugauaagugguguug

SEQ ID NO: 245072 - RNA, 32 nt, Human
ugacaugaucauagcucacuccagccugaagc

SEQ ID NO: 245073 - RNA, 24 nt, Human
ugacaugaucauagcucacugcag

SEQ ID NO: 245074 - RNA, 32 nt, Human
ugacaugaucauagcucacugcagccuggaac

SEQ ID NO: 245075 - RNA, 17 nt, Human
ugacaugaucgcugugu

SEQ ID NO: 245076 - RNA, 23 nt, Human
ugacaugaucucagcucacugca

SEQ ID NO: 245077 - RNA, 32 nt, Human
ugacaugaucuccgcucacugcagccuccgcc

SEQ ID NO: 245078 - RNA, 23 nt, Human
ugacaugaucuuggcugacugca

SEQ ID NO: 245079 - RNA, 17 nt, Human
ugacaugauggguguua

SEQ ID NO: 245080 - RNA, 20 nt, Human
ugacaugauuuccucagugu

SEQ ID NO: 245081 - RNA, 32 nt, Human
ugacaugcacaccuccccugccccaccagccc

SEQ ID NO: 245082 - RNA, 21 nt, Human
ugacaugcaccuguaauccca

SEQ ID NO: 245083 - RNA, 32 nt, Human
ugacaugccaaacacccugcucagggcuggaa

SEQ ID NO: 245084 - RNA, 32 nt, Human
ugacaugcccugucacagggcguauguguucu

SEQ ID NO: 245085 - RNA, 32 nt, Human
ugacaugcccuucaccucccaccaucauuuua

SEQ ID NO: 245086 - RNA, 32 nt, Human
ugacaugccugcucccccuccaccuuccacca

SEQ ID NO: 245087 - RNA, 18 nt, Human
ugacaugcgucuguaaca

SEQ ID NO: 245088 - RNA, 21 nt, Human
ugacauggaaagaaaggucug

SEQ ID NO: 245089 - RNA, 29 nt, Human
ugacauggagaguaaccugucuggccugg

SEQ ID NO: 245090 - RNA, 32 nt, Human
ugacauggccauaacagaaggaggugccucug

SEQ ID NO: 245091 - RNA, 32 nt, Human
ugacauggcucuggacucuaaagaccaaacuu

SEQ ID NO: 245092 - RNA, 17 nt, Human
ugacauggcuuauguua

SEQ ID NO: 245093 - RNA, 32 nt, Human
ugacaugggacccaucugcuccuccagccaac

SEQ ID NO: 245094 - RNA, 32 nt, Human
ugacaugggaucuugcuauguuauccaggcug

SEQ ID NO: 245095 - RNA, 32 nt, Human
ugacaugggcagaguuucucuugcccuuaaag

SEQ ID NO: 245096 - RNA, 32 nt, Human
ugacauggggcuguggcagugggagacaccgc

SEQ ID NO: 245097 - RNA, 32 nt, Human
ugacauggucaugcgucacugcagccuccacc

SEQ ID NO: 245098 - RNA, 32 nt, Human
ugacaugucaugccuggagaaggaacaaggcu

SEQ ID NO: 245099 - RNA, 21 nt, Human
ugacaugugccuguaauccca

SEQ ID NO: 245100 - RNA, 32 nt, Human
ugacaugugccuguaaucccagcuacucagga

SEQ ID NO: 245101 - RNA, 32 nt, Human
ugacauguggggagaggaccagcugggugcuu

SEQ ID NO: 245102 - RNA, 32 nt, Human
ugacauuacuguauuuaagaaaacaccaugga

SEQ ID NO: 245103 - RNA, 32 nt, Human
ugacauuagagugaaaacuccuuccuuugggu

SEQ ID NO: 245104 - RNA, 32 nt, Human
ugacauuagcagcaucuuuaacacagccgugu

SEQ ID NO: 245105 - RNA, 32 nt, Human
ugacauuauacacagucuccucccaucacuug

SEQ ID NO: 245106 - RNA, 32 nt, Human
ugacauuauucuuccuagagaagauuauccug

SEQ ID NO: 245107 - RNA, 32 nt, Human
ugacauucaaagaugugucuguggacuucacc

SEQ ID NO: 245108 - RNA, 32 nt, Human
ugacauucagggauguggccauagacuucucu

SEQ ID NO: 245109 - RNA, 32 nt, Human
ugacauucagggauguggccauugacuucucu

SEQ ID NO: 245110 - RNA, 32 nt, Human
ugacauuccaccauugugauuuguuccugccc

SEQ ID NO: 245111 - RNA, 32 nt, Human
ugacauuccaugacgacauacaugcuacuuuu

SEQ ID NO: 245112 - RNA, 32 nt, Human
ugacauucccucccucccucccgcagggcuga

SEQ ID NO: 245113 - RNA, 32 nt, Human
ugacauuccugccucccuauuugccaggcuuu

SEQ ID NO: 245114 - RNA, 32 nt, Human
ugacauucugcuccccuccuccagaaaggacu

SEQ ID NO: 245115 - RNA, 32 nt, Human
ugacauucuggguggaggggagcccaagugag

SEQ ID NO: 245116 - RNA, 19 nt, Human
ugacauugaauuuguguug

SEQ ID NO: 245117 - RNA, 32 nt, Human
ugacauugccaaugagaucacugacauuccac

SEQ ID NO: 245118 - RNA, 32 nt, Human
ugacauugccuacuaccagagacagagauucu

SEQ ID NO: 245119 - RNA, 32 nt, Human
ugacauugcgccacugcacuccagcgcggaag

SEQ ID NO: 245120 - RNA, 32 nt, Human
ugacauugcuggaccccugaaaaccauuccau

SEQ ID NO: 245121 - RNA, 32 nt, Human
ugacauuggagaauuggagugcagucauaauc

SEQ ID NO: 245122 - RNA, 32 nt, Human
ugacauuggguaguguagaagcaacaagcaug

SEQ ID NO: 245123 - RNA, 32 nt, Human
ugacauugguggcaaggaauagccaagugacc

SEQ ID NO: 245124 - RNA, 32 nt, Human
ugacauugguuauucuggguugcccagaugcu

SEQ ID NO: 245125 - RNA, 32 nt, Human
ugacauuguagcagaaacagaaaaugagauua

SEQ ID NO: 245126 - RNA, 32 nt, Human
ugacauugucauuccgccugguuguuucccuu

SEQ ID NO: 245127 - RNA, 23 nt, Human
ugacauugugauccaccugccuc

SEQ ID NO: 245128 - RNA, 32 nt, Human
ugacauugugguuccucacgaaggagauauaa

SEQ ID NO: 245129 - RNA, 19 nt, Human
ugacauuucauccaugucc

SEQ ID NO: 245130 - RNA, 32 nt, Human
ugacauuucccuuucuucuuuccuuuuuguuu

SEQ ID NO: 245131 - RNA, 19 nt, Human
ugacauuucuguaguccca

SEQ ID NO: 245132 - RNA, 32 nt, Human
ugacauuugagcagacaccugaaggaggugag

SEQ ID NO: 245133 - RNA, 32 nt, Human
ugacauuugaggauguagcugugaacuucacu

SEQ ID NO: 245134 - RNA, 32 nt, Human
ugacauuuguuugguuauagugcaauauauuu

SEQ ID NO: 245135 - RNA, 32 nt, Human
ugacauuuuauuaauccucugugaauuuucug

SEQ ID NO: 245136 - RNA, 32 nt, Human
ugacauuuucaccgugacauuuuuagccauuu

SEQ ID NO: 245137 - RNA, 32 nt, Human
ugacauuuucuccccuuccucacuuacaguca

SEQ ID NO: 245138 - RNA, 32 nt, Human
ugacauuuuguuaguaaagaaaaccggauggu

SEQ ID NO: 245139 - RNA, 32 nt, Human
ugaccaaaaauuaaggaaggaaaacacaguuu

SEQ ID NO: 245140 - RNA, 32 nt, Human
ugaccaaaagagaccuuguuuucuuugagaag

SEQ ID NO: 245141 - RNA, 32 nt, Human
ugaccaaaauggagaaaccccaucucuacuaa

SEQ ID NO: 245142 - RNA, 32 nt, Human
ugaccaaaccagccuugggagcguucuguccu

SEQ ID NO: 245143 - RNA, 32 nt, Human
ugaccaaaccucaguggaggggccucugcuuc

SEQ ID NO: 245144 - RNA, 32 nt, Human
ugaccaaagaugaccugugguaagcaaccugg

SEQ ID NO: 245145 - RNA, 32 nt, Human
ugaccaaauaucuacaggaggcagccauuugg

SEQ ID NO: 245146 - RNA, 32 nt, Human
ugaccaaaucacccaaucccaguucuuccugc

SEQ ID NO: 245147 - RNA, 32 nt, Human
ugaccaaaugcguagauuugggaucuugaauc

SEQ ID NO: 245148 - RNA, 32 nt, Human
ugaccaacacggagaaaccccaucucuacuaa

SEQ ID NO: 245149 - RNA, 32 nt, Human
ugaccaacacggagaaaccccgucucuacuaa

SEQ ID NO: 245150 - RNA, 32 nt, Human
ugaccaacacggugaaaccccaucucuacuaa

SEQ ID NO: 245151 - RNA, 32 nt, Human
ugaccaacacggugaaaccccgucucuacuaa

SEQ ID NO: 245152 - RNA, 32 nt, Human
ugaccaacacugagaaaccccaucucuauuaa

SEQ ID NO: 245153 - RNA, 21 nt, Human
ugaccaacauagugaaacccc

SEQ ID NO: 245154 - RNA, 32 nt, Human
ugaccaacauagugaaaccccaucucuacuaa

SEQ ID NO: 245155 - RNA, 32 nt, Human
ugaccaacauagugaaaccccaucucuacuga

SEQ ID NO: 245156 - RNA, 30 nt, Human
ugaccaacauaguuucaccccaucucuacu

SEQ ID NO: 245157 - RNA, 32 nt, Human
ugaccaacaugaagaaaccccaucucuacuaa

SEQ ID NO: 245158 - RNA, 32 nt, Human
ugaccaacaugacaaaaccccgucucuacuaa

SEQ ID NO: 245159 - RNA, 32 nt, Human
ugaccaacaugacgaaaccccgucucuacuaa

SEQ ID NO: 245160 - RNA, 32 nt, Human
ugaccaacaugcugaaaccccaucucuauuag

SEQ ID NO: 245161 - RNA, 32 nt, Human
ugaccaacauggaaaaaccccgucucuacuaa

SEQ ID NO: 245162 - RNA, 32 nt, Human
ugaccaacauggacaaaccccgucucuacuaa

SEQ ID NO: 245163 - RNA, 32 nt, Human
ugaccaacauggagaaaccccaucuccacuaa

SEQ ID NO: 245164 - RNA, 32 nt, Human
ugaccaacauggagaaaccccaucucuacuaa

SEQ ID NO: 245165 - RNA, 32 nt, Human
ugaccaacauggagaaaccccaucucucccga

SEQ ID NO: 245166 - RNA, 32 nt, Human
ugaccaacauggagaaaccccgucucuacuaa

SEQ ID NO: 245167 - RNA, 32 nt, Human
ugaccaacauggagaaaccccgucucuauugg

SEQ ID NO: 245168 - RNA, 32 nt, Human
ugaccaacauggagaaaccccgucucugcuaa

SEQ ID NO: 245169 - RNA, 32 nt, Human
ugaccaacauggagaaacgccaucucuacuaa

SEQ ID NO: 245170 - RNA, 32 nt, Human
ugaccaacauggagaaacuccaucucuacuaa

SEQ ID NO: 245171 - RNA, 32 nt, Human
ugaccaacauggagaaacuccgucucuacuaa

SEQ ID NO: 245172 - RNA, 32 nt, Human
ugaccaacauggagaaaucccgucucuacuaa

SEQ ID NO: 245173 - RNA, 32 nt, Human
ugaccaacauggagaaaugccaucucuacuaa

SEQ ID NO: 245174 - RNA, 32 nt, Human
ugaccaacauggagaaccccaucucuacuaaa

SEQ ID NO: 245175 - RNA, 32 nt, Human
ugaccaacauggagaagccccgucucuacuaa

SEQ ID NO: 245176 - RNA, 32 nt, Human
ugaccaacauggauaaaucccaucucuacuaa

SEQ ID NO: 245177 - RNA, 32 nt, Human
ugaccaacauggcaaaaccccgucucuacuaa

SEQ ID NO: 245178 - RNA, 32 nt, Human
ugaccaacauggcaaaaccccgucuguacuaa

SEQ ID NO: 245179 - RNA, 27 nt, Human
ugaccaacauggcaaaacccugucucu

SEQ ID NO: 245180 - RNA, 32 nt, Human
ugaccaacauggcaaaacccugucucuacuaa

SEQ ID NO: 245181 - RNA, 32 nt, Human
ugaccaacauggccaaaaacugucucuacuaa

SEQ ID NO: 245182 - RNA, 21 nt, Human
ugaccaacauggcgaaacccc

SEQ ID NO: 245183 - RNA, 32 nt, Human
ugaccaacauggcgaaaccccaucucuacuaa

SEQ ID NO: 245184 - RNA, 32 nt, Human
ugaccaacauggcgaaaccccauuucuacuaa

SEQ ID NO: 245185 - RNA, 32 nt, Human
ugaccaacauggcgaaaccccgucucuacuaa

SEQ ID NO: 245186 - RNA, 32 nt, Human
ugaccaacauggcgaaaccccgucucuagcaa

SEQ ID NO: 245187 - RNA, 32 nt, Human
ugaccaacauggggauaccccgucucuacuaa

SEQ ID NO: 245188 - RNA, 32 nt, Human
ugaccaacauggugaaacaccaucucuacuaa

SEQ ID NO: 245189 - RNA, 32 nt, Human
ugaccaacauggugaaaccccaucucuacaaa

SEQ ID NO: 245190 - RNA, 32 nt, Human
ugaccaacauggugaaaccccaucucuacgaa

SEQ ID NO: 245191 - RNA, 32 nt, Human
ugaccaacauggugaaaccccaucucuacuaa

SEQ ID NO: 245192 - RNA, 32 nt, Human
ugaccaacauggugaaaccccaucucuacuua

SEQ ID NO: 245193 - RNA, 32 nt, Human
ugaccaacauggugaaaccccgucucuacaaa

SEQ ID NO: 245194 - RNA, 32 nt, Human
ugaccaacauggugaaaccccgucucuacuaa

SEQ ID NO: 245195 - RNA, 32 nt, Human
ugaccaacauggugaaaccccgucuuuauuaa

SEQ ID NO: 245196 - RNA, 23 nt, Human
ugaccaacauggugaaacccugu

SEQ ID NO: 245197 - RNA, 32 nt, Human
ugaccaacauggugaaacgccaucucuacuaa

SEQ ID NO: 245198 - RNA, 32 nt, Human
ugaccaacauggugaaacuccaucucuacuaa

SEQ ID NO: 245199 - RNA, 32 nt, Human
ugaccaacauggugaaaucccgucucuauuaa

SEQ ID NO: 245200 - RNA, 32 nt, Human
ugaccaacauggugaaaugaaaccccaucuca

SEQ ID NO: 245201 - RNA, 32 nt, Human
ugaccaacaugucgaaaucccgucucuacuga

SEQ ID NO: 245202 - RNA, 32 nt, Human
ugaccaaccuggagaaaccccgucucuacuaa

SEQ ID NO: 245203 - RNA, 32 nt, Human
ugaccaacguggagaaaccccaucucuacuaa

SEQ ID NO: 245204 - RNA, 32 nt, Human
ugaccaacguggagaaaccccgucucuauuaa

SEQ ID NO: 245205 - RNA, 32 nt, Human
ugaccaacguggagaaaccccgucuuuacuaa

SEQ ID NO: 245206 - RNA, 32 nt, Human
ugaccaacguggagaaaugccaucucuacuaa

SEQ ID NO: 245207 - RNA, 32 nt, Human
ugaccaacguggugaaaccccaucucuacuaa

SEQ ID NO: 245208 - RNA, 32 nt, Human
ugaccaacguggugaaaccccgucucuacuaa

SEQ ID NO: 245209 - RNA, 32 nt, Human
ugaccaacguggugaaacuccgucucuacuaa

SEQ ID NO: 245210 - RNA, 32 nt, Human
ugaccaagaggaccaggaggaaccugacucag

SEQ ID NO: 245211 - RNA, 22 nt, Human
ugaccaagauucgccaaucuca

SEQ ID NO: 245212 - RNA, 32 nt, Human
ugaccaagcuggucucuaacuccugggcuuaa

SEQ ID NO: 245213 - RNA, 32 nt, Human
ugaccaaggucaaggggcaggugcagaggugg

SEQ ID NO: 245214 - RNA, 32 nt, Human
ugaccaagguggugaaaccccaucucuaguua

SEQ ID NO: 245215 - RNA, 32 nt, Human
ugaccaagguggugaaaccccgucucuacuaa

SEQ ID NO: 245216 - RNA, 32 nt, Human
ugaccaaguagggccugucacaccaggguggc

SEQ ID NO: 245217 - RNA, 23 nt, Human
ugaccaagugauccaccugcuuc

SEQ ID NO: 245218 - RNA, 32 nt, Human
ugaccaauaugaugaaaccccgucucuacuaa

SEQ ID NO: 245219 - RNA, 32 nt, Human
ugaccaauauggugaaaccccaucucuacuaa

SEQ ID NO: 245220 - RNA, 32 nt, Human
ugaccaauauggugaaaccccgucucuacuaa

SEQ ID NO: 245221 - RNA, 32 nt, Human
ugaccaauccccauggcagacagcgggcuggu

SEQ ID NO: 245222 - RNA, 32 nt, Human
ugaccaaucucugugacucgcuuagcugaaac

SEQ ID NO: 245223 - RNA, 32 nt, Human
ugaccaaugcccacuuccccuccugggucacc

SEQ ID NO: 245224 - RNA, 32 nt, Human
ugaccaauguggucaaaccccgucucuacuaa

SEQ ID NO: 245225 - RNA, 32 nt, Human
ugaccacaaagaaaaucaacuugcuacuacau

SEQ ID NO: 245226 - RNA, 20 nt, Human
ugaccacaaaugauauuguc

SEQ ID NO: 245227 - RNA, 20 nt, Human
ugaccacaaauguguccggg

SEQ ID NO: 245228 - RNA, 32 nt, Human
ugaccacacacagcaagaccugggacauggca

SEQ ID NO: 245229 - RNA, 20 nt, Human
ugaccacacagccuacaccc

SEQ ID NO: 245230 - RNA, 31 nt, Human
ugaccacacagcuagagcaccagagcccuuu

SEQ ID NO: 245231 - RNA, 21 nt, Human
ugaccacacaggcaccugccu

SEQ ID NO: 245232 - RNA, 32 nt, Human
ugaccacacugcuucccuuucucaguuccuga

SEQ ID NO: 245233 - RNA, 32 nt, Human
ugaccacagauucccagagggccaggugugga

SEQ ID NO: 245234 - RNA, 32 nt, Human
ugaccacagcaaaguaaccacugccagaugcu

SEQ ID NO: 245235 - RNA, 18 nt, Human
ugaccacagcuggcaguc

SEQ ID NO: 245236 - RNA, 32 nt, Human
ugaccacagggaggggacagcucagugacugg

SEQ ID NO: 245237 - RNA, 21 nt, Human
ugaccacaggggcuguggguc

SEQ ID NO: 245238 - RNA, 32 nt, Human
ugaccacagucuguaauuccccacuucaauac

SEQ ID NO: 245239 - RNA, 31 nt, Human
ugaccacaguuucagcgaugccucaggucuc

SEQ ID NO: 245240 - RNA, 25 nt, Human
ugaccacaugugguccacccaccuu

SEQ ID NO: 245241 - RNA, 22 nt, Human
ugaccacauuguacccauuuca

SEQ ID NO: 245242 - RNA, 24 nt, Human
ugaccaccaagguugcggcaggug

SEQ ID NO: 245243 - RNA, 32 nt, Human
ugaccaccauggagaaaccccgucucuacuga

SEQ ID NO: 245244 - RNA, 32 nt, Human
ugaccaccccugcaggcauccaaaggagcaca

SEQ ID NO: 245245 - RNA, 32 nt, Human
ugaccacccggcgaagugcacacacccagaag

SEQ ID NO: 245246 - RNA, 32 nt, Human
ugaccaccugauggacgugcugggcagcaugg

SEQ ID NO: 245247 - RNA, 32 nt, Human
ugaccacgcaccuccacgccacugccuccccc

SEQ ID NO: 245248 - RNA, 23 nt, Human
ugaccacgugauccgcccaccuc

SEQ ID NO: 245249 - RNA, 23 nt, Human
ugaccacgugcuacccccaugcu

SEQ ID NO: 245250 - RNA, 32 nt, Human
ugaccacgugggaacagccugcagugagcggu

SEQ ID NO: 245251 - RNA, 32 nt, Human
ugaccacguucccagggccuucacugaucaga

SEQ ID NO: 245252 - RNA, 32 nt, Human
ugaccacucuugggagugcugcagucuuuaau

SEQ ID NO: 245253 - RNA, 24 nt, Human
ugaccacugaauucacuccaguca

SEQ ID NO: 245254 - RNA, 32 nt, Human
ugaccacugcaaucccagcgcccaaggaaggc

SEQ ID NO: 245255 - RNA, 32 nt, Human
ugaccacugcagccuccaccuccuaggcucaa

SEQ ID NO: 245256 - RNA, 32 nt, Human
ugaccacugccaugcugaccugacaggcuccg

SEQ ID NO: 245257 - RNA, 32 nt, Human
ugaccacugcuuccugucuacccucagagggu

SEQ ID NO: 245258 - RNA, 32 nt, Human
ugaccacuucuuuguagccaccaauuguagug

SEQ ID NO: 245259 - RNA, 32 nt, Human
ugaccagacggcgggucuccaucuucuuucac

SEQ ID NO: 245260 - RNA, 32 nt, Human
ugaccagagacagaacugguccaucauguuug

SEQ ID NO: 245261 - RNA, 32 nt, Human
ugaccagagaggcugggcagaggcagagguca

SEQ ID NO: 245262 - RNA, 32 nt, Human
ugaccagaggagagcaugagggguggggcuuu

SEQ ID NO: 245263 - RNA, 22 nt, Human
ugaccagaucuagcccaucuua

SEQ ID NO: 245264 - RNA, 22 nt, Human
ugaccagcaaggucagaggccc

SEQ ID NO: 245265 - RNA, 32 nt, Human
ugaccagcaccaugcuucuccuggugacaagc

SEQ ID NO: 245266 - RNA, 32 nt, Human
ugaccagcauucucuucuugguaacaucuacu

SEQ ID NO: 245267 - RNA, 32 nt, Human
ugaccagccauggucuggacugugaguuuacu

SEQ ID NO: 245268 - RNA, 32 nt, Human
ugaccagcccaaggccacacagcuggucugag

SEQ ID NO: 245269 - RNA, 32 nt, Human
ugaccagcccaggcguuggguguuagucugca

SEQ ID NO: 245270 - RNA, 20 nt, Human
ugaccagccgugagcauguu

SEQ ID NO: 245271 - RNA, 32 nt, Human
ugaccagccugaccaacauagugaaaccccau

SEQ ID NO: 245272 - RNA, 20 nt, Human
ugaccagccugggcaacaua

SEQ ID NO: 245273 - RNA, 32 nt, Human
ugaccagcgaagagagagagcuguaggccagc

SEQ ID NO: 245274 - RNA, 32 nt, Human
ugaccagcuagugccuugucuucuccugccuc

SEQ ID NO: 245275 - RNA, 32 nt, Human
ugaccagcucacuugcagacacccugccggaa

SEQ ID NO: 245276 - RNA, 32 nt, Human
ugaccagcuguggucaggagagccucagcagg

SEQ ID NO: 245277 - RNA, 32 nt, Human
ugaccaggaaccugggcgagcagcggcggggg

SEQ ID NO: 245278 - RNA, 32 nt, Human
ugaccaggagugugugaaugccuuccaggagg

SEQ ID NO: 245279 - RNA, 32 nt, Human
ugaccaggaguucgaggcugcagugagccgag

SEQ ID NO: 245280 - RNA, 32 nt, Human
ugaccaggcaagcugugaucugaaaggagcaa

SEQ ID NO: 245281 - RNA, 32 nt, Human
ugaccaggccauccuucgcuggggugaacgga

SEQ ID NO: 245282 - RNA, 32 nt, Human
ugaccaggccugggcccaugugcccugggcaa

SEQ ID NO: 245283 - RNA, 21 nt, Human
ugaccaggcuggaguauagug

SEQ ID NO: 245284 - RNA, 32 nt, Human
ugaccaggcuggucuugaaccccugaccucag

SEQ ID NO: 245285 - RNA, 32 nt, Human
ugaccaggcuuaguugcuucccaccccagccu

SEQ ID NO: 245286 - RNA, 32 nt, Human
ugaccaggggcaaaauaggcuuuuaccgcugc

SEQ ID NO: 245287 - RNA, 32 nt, Human
ugaccagucaccuucaaagaugccauuaaggg

SEQ ID NO: 245288 - RNA, 32 nt, Human
ugaccagucgugguuacucccugcugccaggu

SEQ ID NO: 245289 - RNA, 32 nt, Human
ugaccagugguccccaguaccaggccagcgaa

SEQ ID NO: 245290 - RNA, 32 nt, Human
ugaccaguucccaaucucguccucugucccca

SEQ ID NO: 245291 - RNA, 32 nt, Human
ugaccauaaagaaacuaaagaaaaagugcucc

SEQ ID NO: 245292 - RNA, 32 nt, Human
ugaccauaccagugcauuccagccuggguaca

SEQ ID NO: 245293 - RNA, 32 nt, Human
ugaccauagaggcagagauuggagugaagugg

SEQ ID NO: 245294 - RNA, 32 nt, Human
ugaccaucugucuccagccaggccaccccuuu

SEQ ID NO: 245295 - RNA, 18 nt, Human
ugaccaugagaugggguc

SEQ ID NO: 245296 - RNA, 30 nt, Human
ugaccaugagccaccagguaaagggccuga

SEQ ID NO: 245297 - RNA, 32 nt, Human
ugaccaugaggaggaggaggggaaagcgccag

SEQ ID NO: 245298 - RNA, 32 nt, Human
ugaccaugaugcugggguuaccucacaguccc

SEQ ID NO: 245299 - RNA, 32 nt, Human
ugaccaugcaccccugcaucuuccugcugggc

SEQ ID NO: 245300 - RNA, 32 nt, Human
ugaccauggcagacaucaccaaucaagugcag

SEQ ID NO: 245301 - RNA, 25 nt, Human
ugaccaugucauuccaccugcuuua

SEQ ID NO: 245302 - RNA, 22 nt, Human
ugaccaugucugugagcuccua

SEQ ID NO: 245303 - RNA, 32 nt, Human
ugaccauguuggccaggauggucucgauaucc

SEQ ID NO: 245304 - RNA, 20 nt, Human
ugaccauuaaaaacacagca

SEQ ID NO: 245305 - RNA, 32 nt, Human
ugaccauuauagaacaacaaacugucaaaggg

SEQ ID NO: 245306 - RNA, 22 nt, Human
ugaccauuucccuuguauuuuu

SEQ ID NO: 245307 - RNA, 32 nt, Human
ugacccaaagugaaggacauugccgggagagg

SEQ ID NO: 245308 - RNA, 32 nt, Human
ugacccaaauaaauugggaaaggaggggguca

SEQ ID NO: 245309 - RNA, 32 nt, Human
ugacccaacugauccugcuccagcagcacacc

SEQ ID NO: 245310 - RNA, 32 nt, Human
ugacccaagcccacacagagacuugcacagcu

SEQ ID NO: 245311 - RNA, 32 nt, Human
ugacccaaggccuccugucucccuucaaaggg

SEQ ID NO: 245312 - RNA, 32 nt, Human
ugacccacaagcuuuuguucucucaguacuug

SEQ ID NO: 245313 - RNA, 32 nt, Human
ugacccacacagcgaaaccccgucucuacuaa

SEQ ID NO: 245314 - RNA, 21 nt, Human
ugacccacaccuguaauccca

SEQ ID NO: 245315 - RNA, 32 nt, Human
ugacccacaccuguaaucccagcacuuuggga

SEQ ID NO: 245316 - RNA, 32 nt, Human
ugacccacauggagaaacgccaucucuacuaa

SEQ ID NO: 245317 - RNA, 32 nt, Human
ugacccacauggucaagaccaggcagaagcuc

SEQ ID NO: 245318 - RNA, 32 nt, Human
ugacccaccacugucaggucucagagccaccc

SEQ ID NO: 245319 - RNA, 32 nt, Human
ugacccaccauggggcucagcaucuuuuugcu

SEQ ID NO: 245320 - RNA, 32 nt, Human
ugacccacccaccuaccuuugcaucaccuacc

SEQ ID NO: 245321 - RNA, 32 nt, Human
ugacccaccgcgucaagccucugacaacuauu

SEQ ID NO: 245322 - RNA, 32 nt, Human
ugacccacugcauuccagccuggcgacagagc

SEQ ID NO: 245323 - RNA, 32 nt, Human
ugacccacugcuuuuggucugugugaugauga

SEQ ID NO: 245324 - RNA, 32 nt, Human
ugacccagaaggcaguuggcagugggcuaccc

SEQ ID NO: 245325 - RNA, 20 nt, Human
ugacccagacaugccugucc

SEQ ID NO: 245326 - RNA, 16 nt, Human
ugacccagaccugaca

SEQ ID NO: 245327 - RNA, 32 nt, Human
ugacccagagccucugccugugcacugcaagc

SEQ ID NO: 245328 - RNA, 32 nt, Human
ugacccagagccugcacgcuuggucaugaagc

SEQ ID NO: 245329 - RNA, 18 nt, Human
ugacccagcacaguuggc

SEQ ID NO: 245330 - RNA, 21 nt, Human
ugacccagcccgagauggagu

SEQ ID NO: 245331 - RNA, 32 nt, Human
ugacccagccucagaacccacaugucaucccc

SEQ ID NO: 245332 - RNA, 32 nt, Human
ugacccagccuccaacucaucuccuuccuguc

SEQ ID NO: 245333 - RNA, 32 nt, Human
ugacccagccugggucuuccaggagaugcugu

SEQ ID NO: 245334 - RNA, 32 nt, Human
ugacccaggaagcggagguugcagugagccaa

SEQ ID NO: 245335 - RNA, 32 nt, Human
ugacccaggaaguucugggaguugccguuuuu

SEQ ID NO: 245336 - RNA, 32 nt, Human
ugacccaggaggcagagguugcagugagccaa

SEQ ID NO: 245337 - RNA, 32 nt, Human
ugacccaggaggcggagguugcggugacccuc

SEQ ID NO: 245338 - RNA, 32 nt, Human
ugacccaggaggucugguguagggggugcucc

SEQ ID NO: 245339 - RNA, 32 nt, Human
ugacccaggagguggaggucgcagugagccga

SEQ ID NO: 245340 - RNA, 32 nt, Human
ugacccaggaguucaagaccagccuggccaac

SEQ ID NO: 245341 - RNA, 32 nt, Human
ugacccaggauggcucuacuccccagccuuca

SEQ ID NO: 245342 - RNA, 32 nt, Human
ugacccaggcaucuugauuugcaaaaucacaa

SEQ ID NO: 245343 - RNA, 32 nt, Human
ugacccaggcggccguggaaacccaccugcag

SEQ ID NO: 245344 - RNA, 22 nt, Human
ugacccaggcuggaaugcaaug

SEQ ID NO: 245345 - RNA, 23 nt, Human
ugacccaggcuggaaugcaaugg

SEQ ID NO: 245346 - RNA, 32 nt, Human
ugacccaggcuggaaugcaauggcucacugca

SEQ ID NO: 245347 - RNA, 21 nt, Human
ugacccaggcuggaguguagu

SEQ ID NO: 245348 - RNA, 32 nt, Human
ugacccaggcuggaguguaguagcuauucaca

SEQ ID NO: 245349 - RNA, 32 nt, Human
ugacccaggcuugggagccagaaacaagugug

SEQ ID NO: 245350 - RNA, 32 nt, Human
ugacccaggggaaggaaguggggaaggggcgg

SEQ ID NO: 245351 - RNA, 32 nt, Human
ugacccaguggccaccacucccaccgggugac

SEQ ID NO: 245352 - RNA, 32 nt, Human
ugacccaucuagcuucagcuguauccauuuuc

SEQ ID NO: 245353 - RNA, 32 nt, Human
ugacccaucugucagcuuuuucccagggagcc

SEQ ID NO: 245354 - RNA, 32 nt, Human
ugacccaucuucuaccaggcagaucuuuauua

SEQ ID NO: 245355 - RNA, 16 nt, Human
ugacccaugccugccc

SEQ ID NO: 245356 - RNA, 32 nt, Human
ugacccauggggacccaugguaggacccucgg

SEQ ID NO: 245357 - RNA, 25 nt, Human
ugacccauguacugcuauaguccca

SEQ ID NO: 245358 - RNA, 18 nt, Human
ugacccauguucacguug

SEQ ID NO: 245359 - RNA, 32 nt, Human
ugacccauuuuucugcccucuucuuaccccaa

SEQ ID NO: 245360 - RNA, 32 nt, Human
ugaccccaaacaucucaccaaacugugaaaca

SEQ ID NO: 245361 - RNA, 32 nt, Human
ugaccccaacagcacagagaacagccaacggg

SEQ ID NO: 245362 - RNA, 32 nt, Human
ugaccccaagcauggucccccuuggucgccug

SEQ ID NO: 245363 - RNA, 32 nt, Human
ugaccccacuggccacugccauccugcugccu

SEQ ID NO: 245364 - RNA, 32 nt, Human
ugaccccagacagggcccugaggaccccaggg

SEQ ID NO: 245365 - RNA, 32 nt, Human
ugaccccagaugccucucccacccuuaccucc

SEQ ID NO: 245366 - RNA, 32 nt, Human
ugaccccaggaagugggagaaguggccccucg

SEQ ID NO: 245367 - RNA, 32 nt, Human
ugaccccaggagacguagguuguggugagcug

SEQ ID NO: 245368 - RNA, 32 nt, Human
ugaccccaggaggcagagguugaagugagcca

SEQ ID NO: 245369 - RNA, 32 nt, Human
ugaccccaggaggcgaagauugcagugagcug

SEQ ID NO: 245370 - RNA, 32 nt, Human
ugaccccaggagguggacauugcagugagccg

SEQ ID NO: 245371 - RNA, 32 nt, Human
ugaccccaggaguucaagaccagccugggcaa

SEQ ID NO: 245372 - RNA, 32 nt, Human
ugaccccagggagccaguccaagauugaagga

SEQ ID NO: 245373 - RNA, 32 nt, Human
ugaccccagggccugaggacagguccccaagu

SEQ ID NO: 245374 - RNA, 25 nt, Human
ugaccccaggugaucugcccaccuu

SEQ ID NO: 245375 - RNA, 32 nt, Human
ugaccccaggugggaggcuguguguggaggcc

SEQ ID NO: 245376 - RNA, 32 nt, Human
ugaccccaggugguggagguugcagugagcca

SEQ ID NO: 245377 - RNA, 25 nt, Human
ugaccccagucugccuccacauccc

SEQ ID NO: 245378 - RNA, 32 nt, Human
ugaccccagugcagugucuguagggaagagga

SEQ ID NO: 245379 - RNA, 24 nt, Human
ugaccccaugauccacccgccuca

SEQ ID NO: 245380 - RNA, 32 nt, Human
ugaccccauggacaccuccucaaacucucugc

SEQ ID NO: 245381 - RNA, 32 nt, Human
ugacccccacacaggcacugggaaugcagggg

SEQ ID NO: 245382 - RNA, 23 nt, Human
ugacccccagcagacccccagca

SEQ ID NO: 245383 - RNA, 32 nt, Human
ugacccccaggaggaggauuccuggggcuggu

SEQ ID NO: 245384 - RNA, 20 nt, Human
ugacccccaugcugcuuccu

SEQ ID NO: 245385 - RNA, 32 nt, Human
ugacccccuacuuggcucuuuccagggagcau

SEQ ID NO: 245386 - RNA, 32 nt, Human
ugacccccuccccucccauccuucaccuccua

SEQ ID NO: 245387 - RNA, 18 nt, Human
ugaccccgagcugucccu

SEQ ID NO: 245388 - RNA, 32 nt, Human
ugaccccgcggcggccugagggacgcucccug

SEQ ID NO: 245389 - RNA, 32 nt, Human
ugaccccgggagguggaggcugcagugaguug

SEQ ID NO: 245390 - RNA, 32 nt, Human
ugaccccgggcacaauuucuccuuccucugga

SEQ ID NO: 245391 - RNA, 32 nt, Human
ugaccccguagccaccaccacacugcuuccag

SEQ ID NO: 245392 - RNA, 24 nt, Human
ugaccccgucggcaucacaggggu

SEQ ID NO: 245393 - RNA, 32 nt, Human
ugaccccgugugggcagaaggcugcaaggccu

SEQ ID NO: 245394 - RNA, 32 nt, Human
ugaccccucagccugcauacugguauccuggu

SEQ ID NO: 245395 - RNA, 32 nt, Human
ugaccccucccaggacucgugaugccaaggcc

SEQ ID NO: 245396 - RNA, 32 nt, Human
ugaccccugacacgugugugcagcagccugca

SEQ ID NO: 245397 - RNA, 32 nt, Human
ugaccccugcagccauugcagcugccacaacc

SEQ ID NO: 245398 - RNA, 32 nt, Human
ugaccccugccucugcaguagccuuuugugag

SEQ ID NO: 245399 - RNA, 32 nt, Human
ugaccccugccugaccaagccaugucugaaca

SEQ ID NO: 245400 - RNA, 32 nt, Human
ugaccccuggaggagccacuguggaagcagag

SEQ ID NO: 245401 - RNA, 32 nt, Human
ugaccccuucaccucucccccucccuuuuccu

SEQ ID NO: 245402 - RNA, 22 nt, Human
ugacccgaaagaugauacagca

SEQ ID NO: 245403 - RNA, 32 nt, Human
ugacccgagugaccuccaggauacauccaaca

SEQ ID NO: 245404 - RNA, 32 nt, Human
ugacccgcagacccuggcugagcgacggauga

SEQ ID NO: 245405 - RNA, 32 nt, Human
ugacccgccagccugcaccgcgggcacguccu

SEQ ID NO: 245406 - RNA, 32 nt, Human
ugacccgccgcuuccccuucagccugggacca

SEQ ID NO: 245407 - RNA, 32 nt, Human
ugacccgccggcccaggcgaggcugcagccag

SEQ ID NO: 245408 - RNA, 32 nt, Human
ugacccgcucccuuucugaccugggccaguuc

SEQ ID NO: 245409 - RNA, 32 nt, Human
ugacccggcauccugacgccucaaaucccuuu

SEQ ID NO: 245410 - RNA, 32 nt, Human
ugacccggcgaggcccagagacaggggagggg

SEQ ID NO: 245411 - RNA, 32 nt, Human
ugacccgggacuagaaggaaaauaaaugaucu

SEQ ID NO: 245412 - RNA, 32 nt, Human
ugacccgggcccugaccuucucccucuucccu

SEQ ID NO: 245413 - RNA, 23 nt, Human
ugacccggguucccccacuccca

SEQ ID NO: 245414 - RNA, 21 nt, Human
ugacccggugugcgugggguc

SEQ ID NO: 245415 - RNA, 22 nt, Human
ugacccguuuuccaaccaguuc

SEQ ID NO: 245416 - RNA, 32 nt, Human
ugacccuagaauggggacagggaaagugaagg

SEQ ID NO: 245417 - RNA, 32 nt, Human
ugacccuagucucugcuguaugcugggcccug

SEQ ID NO: 245418 - RNA, 26 nt, Human
ugacccucaagugaucugcccaccuu

SEQ ID NO: 245419 - RNA, 32 nt, Human
ugacccucagaaccuccuuccugggccugcgg

SEQ ID NO: 245420 - RNA, 32 nt, Human
ugacccucagcagccucuccuggccuuggcag

SEQ ID NO: 245421 - RNA, 32 nt, Human
ugacccucccccagggccuuggcucugagcuu

SEQ ID NO: 245422 - RNA, 32 nt, Human
ugacccucccccugccuuccucuugccuuggg

SEQ ID NO: 245423 - RNA, 32 nt, Human
ugacccuccuacuugaggccgcccuuuucucc

SEQ ID NO: 245424 - RNA, 28 nt, Human
ugacccucuaacuccaugucuaacuugc

SEQ ID NO: 245425 - RNA, 32 nt, Human
ugacccugaagaagaugacaagcccugcucca

SEQ ID NO: 245426 - RNA, 32 nt, Human
ugacccugacagugcuuaaugaccucagauga

SEQ ID NO: 245427 - RNA, 32 nt, Human
ugacccugagccagugccaggucuccaagugc

SEQ ID NO: 245428 - RNA, 32 nt, Human
ugacccugcaaguaccuugauuuuggacuucu

SEQ ID NO: 245429 - RNA, 32 nt, Human
ugacccugcuccuuaccccaugggagcagcag

SEQ ID NO: 245430 - RNA, 31 nt, Human
ugacccuggcucgucucagccgagacccaga

SEQ ID NO: 245431 - RNA, 32 nt, Human
ugacccugggagguggagguggcagugagccg

SEQ ID NO: 245432 - RNA, 32 nt, Human
ugacccugggcaaguuacuuaaccucgcuaag

SEQ ID NO: 245433 - RNA, 32 nt, Human
ugacccugggcugcuggaggccagacugggcu

SEQ ID NO: 245434 - RNA, 19 nt, Human
ugacccugggcugcuuccu

SEQ ID NO: 245435 - RNA, 32 nt, Human
ugacccuggguggaggggacuugcugugaagu

SEQ ID NO: 245436 - RNA, 32 nt, Human
ugacccugguauaagaaguacucugaaauucu

SEQ ID NO: 245437 - RNA, 22 nt, Human
ugacccugucuuacccauuuca

SEQ ID NO: 245438 - RNA, 23 nt, Human
ugacccugugauccaccugccuu

SEQ ID NO: 245439 - RNA, 23 nt, Human
ugacccugugauccgcccgccuc

SEQ ID NO: 245440 - RNA, 16 nt, Human
ugacccuguggccuca

SEQ ID NO: 245441 - RNA, 32 nt, Human
ugacccuucaaggaguucagaccugggggcuc

SEQ ID NO: 245442 - RNA, 21 nt, Human
ugacccuuccaccccgccuca

SEQ ID NO: 245443 - RNA, 32 nt, Human
ugacccuucccaaaucugcuccagcaggacua

SEQ ID NO: 245444 - RNA, 32 nt, Human
ugacccuucccagcccccuccagggccaaugc

SEQ ID NO: 245445 - RNA, 19 nt, Human
ugacccuuccucgcucccu

SEQ ID NO: 245446 - RNA, 32 nt, Human
ugacccuugaguucuagaaaugggguucuccc

SEQ ID NO: 245447 - RNA, 32 nt, Human
ugacccuugcagcucaggcaggacauucugga

SEQ ID NO: 245448 - RNA, 31 nt, Human
ugacccuugcagucucccacauccagggccu

SEQ ID NO: 245449 - RNA, 32 nt, Human
ugacccuugggaacagugaacguagagaauug

SEQ ID NO: 245450 - RNA, 18 nt, Human
ugaccgaagcugcucucu

SEQ ID NO: 245451 - RNA, 32 nt, Human
ugaccgacauggagaaaccccaucucuacuaa

SEQ ID NO: 245452 - RNA, 32 nt, Human
ugaccgaccauugccauuucuggccucgcuag

SEQ ID NO: 245453 - RNA, 32 nt, Human
ugaccgacuccaccaucacccaaucuguugau

SEQ ID NO: 245454 - RNA, 32 nt, Human
ugaccgacuccacuuaacccccaaacccagcc

SEQ ID NO: 245455 - RNA, 32 nt, Human
ugaccgagaggcugcuggagcucguguuugga

SEQ ID NO: 245456 - RNA, 32 nt, Human
ugaccgagauaggucaucagcccagggcuuca

SEQ ID NO: 245457 - RNA, 26 nt, Human
ugaccgcaagcgauucacccaccuca

SEQ ID NO: 245458 - RNA, 25 nt, Human
ugaccgcaagugauccacccgccuc

SEQ ID NO: 245459 - RNA, 32 nt, Human
ugaccgcaggagacccuguaaggccugugagc

SEQ ID NO: 245460 - RNA, 32 nt, Human
ugaccgcaggguggcccagguggaucggcuuc

SEQ ID NO: 245461 - RNA, 32 nt, Human
ugaccgcaggguguucucagagaacccuggcu

SEQ ID NO: 245462 - RNA, 25 nt, Human
ugaccgcaggugauccaccugccuc

SEQ ID NO: 245463 - RNA, 24 nt, Human
ugaccgcagugauccucccgccuc

SEQ ID NO: 245464 - RNA, 32 nt, Human
ugaccgccaaccucacguuuucuuagucugag

SEQ ID NO: 245465 - RNA, 26 nt, Human
ugaccgcccagcucucccacauccca

SEQ ID NO: 245466 - RNA, 22 nt, Human
ugaccgccgcagaggcagcagg

SEQ ID NO: 245467 - RNA, 32 nt, Human
ugaccgccuuguacuccagguggaaccagccc

SEQ ID NO: 245468 - RNA, 32 nt, Human
ugaccgcgaggcugcgggaggaaggggacagg

SEQ ID NO: 245469 - RNA, 19 nt, Human
ugaccgcgccuguaauccc

SEQ ID NO: 245470 - RNA, 18 nt, Human
ugaccgcuuccccgggga

SEQ ID NO: 245471 - RNA, 32 nt, Human
ugaccggcaucccagauguggggaagaggcca

SEQ ID NO: 245472 - RNA, 32 nt, Human
ugaccggcuagugccggguauggccaccagcc

SEQ ID NO: 245473 - RNA, 32 nt, Human
ugaccgggacuggagccagggucuggggagag

SEQ ID NO: 245474 - RNA, 32 nt, Human
ugaccgggagacagagguugcagugagcugag

SEQ ID NO: 245475 - RNA, 32 nt, Human
ugaccgggccaucuugguuuucuucuggauga

SEQ ID NO: 245476 - RNA, 32 nt, Human
ugaccgggcccucuggcccacagccauuggua

SEQ ID NO: 245477 - RNA, 32 nt, Human
ugaccgggggccagcccaggagggcggguggu

SEQ ID NO: 245478 - RNA, 32 nt, Human
ugaccguagggagggaucuugagggcccuccg

SEQ ID NO: 245479 - RNA, 32 nt, Human
ugaccgucgagacugcagcagcgccuuuccug

SEQ ID NO: 245480 - RNA, 32 nt, Human
ugaccgugacauccucccucucgucaaaagac

SEQ ID NO: 245481 - RNA, 32 nt, Human
ugaccgugaccccucaaagcagagccaguagu

SEQ ID NO: 245482 - RNA, 32 nt, Human
ugaccgugccagcauuuacacagggaacacuu

SEQ ID NO: 245483 - RNA, 32 nt, Human
ugaccguggggagcucccuggagcucaacgug

SEQ ID NO: 245484 - RNA, 32 nt, Human
ugaccguggguguggcuggcucucggcccugc

SEQ ID NO: 245485 - RNA, 32 nt, Human
ugaccgugguggugcuggaggcucgaggccug

SEQ ID NO: 245486 - RNA, 32 nt, Human
ugaccgugucugcaggcagcacccagaacuga

SEQ ID NO: 245487 - RNA, 32 nt, Human
ugaccguguuagccaggauggucucgaucucc

SEQ ID NO: 245488 - RNA, 32 nt, Human
ugaccguguuagccaggauggucuugaucucc

SEQ ID NO: 245489 - RNA, 32 nt, Human
ugaccguuccauccuucccacugcuccacggg

SEQ ID NO: 245490 - RNA, 32 nt, Human
ugaccguugcccaccuggaggugugcaugcca

SEQ ID NO: 245491 - RNA, 25 nt, Human
ugaccuaaagugaucugcccgccuu

SEQ ID NO: 245492 - RNA, 32 nt, Human
ugaccuaaccuuccugucuccucuucgggaag

SEQ ID NO: 245493 - RNA, 32 nt, Human
ugaccuaagagccuaacaaccugcucuuuggg

SEQ ID NO: 245494 - RNA, 21 nt, Human
ugaccuaaggaaucaggggga

SEQ ID NO: 245495 - RNA, 32 nt, Human
ugaccuaagggacucccacaacaacaaaagcu

SEQ ID NO: 245496 - RNA, 32 nt, Human
ugaccuacaaagcaaugcuucacuggaaauuc

SEQ ID NO: 245497 - RNA, 32 nt, Human
ugaccuacuggccaucuuccucacagcccuca

SEQ ID NO: 245498 - RNA, 32 nt, Human
ugaccuacuucacugaccugugaggauuccuu

SEQ ID NO: 245499 - RNA, 32 nt, Human
ugaccuagcuagugccuggugcccagugaccu

SEQ ID NO: 245500 - RNA, 32 nt, Human
ugaccuaggaacuuggccaacauaugcaacau

SEQ ID NO: 245501 - RNA, 32 nt, Human
ugaccuaggugggaggugauaaaauuuguucc

SEQ ID NO: 245502 - RNA, 26 nt, Human
ugaccuagucugccauauuugccuuc

SEQ ID NO: 245503 - RNA, 23 nt, Human
ugaccuagugauccacccuccuc

SEQ ID NO: 245504 - RNA, 23 nt, Human
ugaccuagugaucugccugccuc

SEQ ID NO: 245505 - RNA, 23 nt, Human
ugaccuagugaugcacccaccuu

SEQ ID NO: 245506 - RNA, 32 nt, Human
ugaccuauaaugagccguugugcuccagccug

SEQ ID NO: 245507 - RNA, 32 nt, Human
ugaccuaugccugcaauccagcacuuugggaa

SEQ ID NO: 245508 - RNA, 26 nt, Human
ugaccucaaacgaucugcccacccca

SEQ ID NO: 245509 - RNA, 25 nt, Human
ugaccucaaaugauccacccaccuu

SEQ ID NO: 245510 - RNA, 25 nt, Human
ugaccucaaaugauccaccugccuc

SEQ ID NO: 245511 - RNA, 25 nt, Human
ugaccucaaaugauccgcccaccuc

SEQ ID NO: 245512 - RNA, 25 nt, Human
ugaccucaacugguccacccgccuc

SEQ ID NO: 245513 - RNA, 24 nt, Human
ugaccucaagcgauccacccaccu

SEQ ID NO: 245514 - RNA, 25 nt, Human
ugaccucaagcgauccacccaccuc

SEQ ID NO: 245515 - RNA, 25 nt, Human
ugaccucaagcgaucugcccgccuc

SEQ ID NO: 245516 - RNA, 32 nt, Human
ugaccucaagcuggcugcagagcgaggucagc

SEQ ID NO: 245517 - RNA, 25 nt, Human
ugaccucaaguaauccaccugccuc

SEQ ID NO: 245518 - RNA, 26 nt, Human
ugaccucaaguaauccaccugccuca

SEQ ID NO: 245519 - RNA, 26 nt, Human
ugaccucaaguaauccgccugccuca

SEQ ID NO: 245520 - RNA, 21 nt, Human
ugaccucaagugacccaccuu

SEQ ID NO: 245521 - RNA, 26 nt, Human
ugaccucaagugauaugccugccuca

SEQ ID NO: 245522 - RNA, 25 nt, Human
ugaccucaagugauccacccaccuc

SEQ ID NO: 245523 - RNA, 26 nt, Human
ugaccucaagugauccacccaccuca

SEQ ID NO: 245524 - RNA, 25 nt, Human
ugaccucaagugauccacccaccuu

SEQ ID NO: 245525 - RNA, 26 nt, Human
ugaccucaagugauccacccacuuca

SEQ ID NO: 245526 - RNA, 25 nt, Human
ugaccucaagugauccacccgccuc

SEQ ID NO: 245527 - RNA, 26 nt, Human
ugaccucaagugauccacccgccuca

SEQ ID NO: 245528 - RNA, 25 nt, Human
ugaccucaagugauccacccgccuu

SEQ ID NO: 245529 - RNA, 25 nt, Human
ugaccucaagugauccacccgucuu

SEQ ID NO: 245530 - RNA, 25 nt, Human
ugaccucaagugauccaccuaccuc

SEQ ID NO: 245531 - RNA, 25 nt, Human
ugaccucaagugauccaccugccuc

SEQ ID NO: 245532 - RNA, 25 nt, Human
ugaccucaagugauccaccugccuu

SEQ ID NO: 245533 - RNA, 25 nt, Human
ugaccucaagugauccaccugcuuc

SEQ ID NO: 245534 - RNA, 25 nt, Human
ugaccucaagugauccaccuuccuu

SEQ ID NO: 245535 - RNA, 25 nt, Human
ugaccucaagugauccacugccuca

SEQ ID NO: 245536 - RNA, 25 nt, Human
ugaccucaagugauccacuggccuu

SEQ ID NO: 245537 - RNA, 24 nt, Human
ugaccucaagugaucccccaccuc

SEQ ID NO: 245538 - RNA, 25 nt, Human
ugaccucaagugauccgcccacuuc

SEQ ID NO: 245539 - RNA, 24 nt, Human
ugaccucaagugauccgcccgcuu

SEQ ID NO: 245540 - RNA, 26 nt, Human
ugaccucaagugauccgccugccuca

SEQ ID NO: 245541 - RNA, 25 nt, Human
ugaccucaagugauccgccugccuu

SEQ ID NO: 245542 - RNA, 26 nt, Human
ugaccucaagugauccguccgccucg

SEQ ID NO: 245543 - RNA, 26 nt, Human
ugaccucaagugauccucccaccuca

SEQ ID NO: 245544 - RNA, 25 nt, Human
ugaccucaagugaucuacccaccuc

SEQ ID NO: 245545 - RNA, 25 nt, Human
ugaccucaagugaucuaccugccuc

SEQ ID NO: 245546 - RNA, 26 nt, Human
ugaccucaagugaucugcccaccuca

SEQ ID NO: 245547 - RNA, 25 nt, Human
ugaccucaagugaucugcccaccuu

SEQ ID NO: 245548 - RNA, 25 nt, Human
ugaccucaagugaucugcccacuuc

SEQ ID NO: 245549 - RNA, 26 nt, Human
ugaccucaagugaucugcccaucuca

SEQ ID NO: 245550 - RNA, 25 nt, Human
ugaccucaagugaucugcccgccuc

SEQ ID NO: 245551 - RNA, 26 nt, Human
ugaccucaagugaucugcccgccuca

SEQ ID NO: 245552 - RNA, 25 nt, Human
ugaccucaagugaucugcccgccuu

SEQ ID NO: 245553 - RNA, 26 nt, Human
ugaccucaagugaucugcccuccuca

SEQ ID NO: 245554 - RNA, 26 nt, Human
ugaccucaagugaucugcccuccuua

SEQ ID NO: 245555 - RNA, 25 nt, Human
ugaccucaagugaucugccuaccuu

SEQ ID NO: 245556 - RNA, 26 nt, Human
ugaccucaagugaucugccugccuca

SEQ ID NO: 245557 - RNA, 25 nt, Human
ugaccucaagugaucugcucaccuu

SEQ ID NO: 245558 - RNA, 25 nt, Human
ugaccucaagugaucuucccaccuu

SEQ ID NO: 245559 - RNA, 25 nt, Human
ugaccucaagugauuugcccaccuu

SEQ ID NO: 245560 - RNA, 25 nt, Human
ugaccucaagugguccaccugccuu

SEQ ID NO: 245561 - RNA, 32 nt, Human
ugaccucaauccaggcuggaguugguuuaucc

SEQ ID NO: 245562 - RNA, 31 nt, Human
ugaccucacagcuggaggcuuuccaggccaa

SEQ ID NO: 245563 - RNA, 20 nt, Human
ugaccucacauccucugcca

SEQ ID NO: 245564 - RNA, 32 nt, Human
ugaccucacuucagagccccucuagcagagug

SEQ ID NO: 245565 - RNA, 32 nt, Human
ugaccucagacgauccaccugccuuggccucc

SEQ ID NO: 245566 - RNA, 25 nt, Human
ugaccucagaugauccacccaccuu

SEQ ID NO: 245567 - RNA, 25 nt, Human
ugaccucagaugauccaccugccuu

SEQ ID NO: 245568 - RNA, 25 nt, Human
ugaccucagaugaucuaccagccuc

SEQ ID NO: 245569 - RNA, 25 nt, Human
ugaccucagaugaucuacccgccuu

SEQ ID NO: 245570 - RNA, 26 nt, Human
ugaccucagaugaucugcccacuuua

SEQ ID NO: 245571 - RNA, 26 nt, Human
ugaccucagaugaucugcccgccuca

SEQ ID NO: 245572 - RNA, 26 nt, Human
ugaccucagaugauucacccgccuca

SEQ ID NO: 245573 - RNA, 25 nt, Human
ugaccucagaugguccacccaccuc

SEQ ID NO: 245574 - RNA, 32 nt, Human
ugaccucagcaucugcucacaucccacccucu

SEQ ID NO: 245575 - RNA, 32 nt, Human
ugaccucaggaggcggagguugcagugagccg

SEQ ID NO: 245576 - RNA, 32 nt, Human
ugaccucaggaggucaccuuuucuugauucca

SEQ ID NO: 245577 - RNA, 19 nt, Human
ugaccucaggaguucgaga

SEQ ID NO: 245578 - RNA, 26 nt, Human
ugaccucaggcaaucugcccaccuca

SEQ ID NO: 245579 - RNA, 26 nt, Human
ugaccucaggcgauccgcccgccuca

SEQ ID NO: 245580 - RNA, 25 nt, Human
ugaccucaggcgaucuacccgccuc

SEQ ID NO: 245581 - RNA, 26 nt, Human
ugaccucaggcgaucugcccaccuca

SEQ ID NO: 245582 - RNA, 25 nt, Human
ugaccucaggggauccacccgccuc

SEQ ID NO: 245583 - RNA, 26 nt, Human
ugaccucagggugaucagcccaccuc

SEQ ID NO: 245584 - RNA, 32 nt, Human
ugaccucagggugugcucuguucuccacccua

SEQ ID NO: 245585 - RNA, 26 nt, Human
ugaccucagguaauccaccugcuuca

SEQ ID NO: 245586 - RNA, 25 nt, Human
ugaccucagguaauccgcccaucuc

SEQ ID NO: 245587 - RNA, 26 nt, Human
ugaccucagguaauccucccaccuca

SEQ ID NO: 245588 - RNA, 32 nt, Human
ugaccucagguaauccucccaccucagccucc

SEQ ID NO: 245589 - RNA, 25 nt, Human
ugaccucaggugagccacccgccuc

SEQ ID NO: 245590 - RNA, 25 nt, Human
ugaccucaggugauccaacugccuc

SEQ ID NO: 245591 - RNA, 24 nt, Human
ugaccucaggugauccaccaccuc

SEQ ID NO: 245592 - RNA, 25 nt, Human
ugaccucaggugauccaccagccuc

SEQ ID NO: 245593 - RNA, 25 nt, Human
ugaccucaggugauccacccaccuc

SEQ ID NO: 245594 - RNA, 26 nt, Human
ugaccucaggugauccacccaccuca

SEQ ID NO: 245595 - RNA, 25 nt, Human
ugaccucaggugauccacccaccuu

SEQ ID NO: 245596 - RNA, 26 nt, Human
ugaccucaggugauccacccacguca

SEQ ID NO: 245597 - RNA, 23 nt, Human
ugaccucaggugauccacccgcc

SEQ ID NO: 245598 - RNA, 24 nt, Human
ugaccucaggugauccacccgccu

SEQ ID NO: 245599 - RNA, 25 nt, Human
ugaccucaggugauccacccgccuc

SEQ ID NO: 245600 - RNA, 26 nt, Human
ugaccucaggugauccacccgccuca

SEQ ID NO: 245601 - RNA, 25 nt, Human
ugaccucaggugauccacccgccuu

SEQ ID NO: 245602 - RNA, 26 nt, Human
ugaccucaggugauccacccgccuua

SEQ ID NO: 245603 - RNA, 25 nt, Human
ugaccucaggugauccacccgcguu

SEQ ID NO: 245604 - RNA, 26 nt, Human
ugaccucaggugauccacccgcuuca

SEQ ID NO: 245605 - RNA, 25 nt, Human
ugaccucaggugauccacccuccuu

SEQ ID NO: 245606 - RNA, 25 nt, Human
ugaccucaggugauccaccuaccuc

SEQ ID NO: 245607 - RNA, 24 nt, Human
ugaccucaggugauccaccugccu

SEQ ID NO: 245608 - RNA, 25 nt, Human
ugaccucaggugauccaccugccuc

SEQ ID NO: 245609 - RNA, 26 nt, Human
ugaccucaggugauccaccugccuca

SEQ ID NO: 245610 - RNA, 25 nt, Human
ugaccucaggugauccaccugccuu

SEQ ID NO: 245611 - RNA, 25 nt, Human
ugaccucaggugauccacucgccuc

SEQ ID NO: 245612 - RNA, 26 nt, Human
ugaccucaggugauccauccaccucg

SEQ ID NO: 245613 - RNA, 26 nt, Human
ugaccucaggugauccaucugccucg

SEQ ID NO: 245614 - RNA, 25 nt, Human
ugaccucaggugauccgaccgccuc

SEQ ID NO: 245615 - RNA, 25 nt, Human
ugaccucaggugauccgcccaccuc

SEQ ID NO: 245616 - RNA, 26 nt, Human
ugaccucaggugauccgcccaccuca

SEQ ID NO: 245617 - RNA, 25 nt, Human
ugaccucaggugauccgcccgccuc

SEQ ID NO: 245618 - RNA, 26 nt, Human
ugaccucaggugauccgcccgccuca

SEQ ID NO: 245619 - RNA, 26 nt, Human
ugaccucaggugauccgccuaccuca

SEQ ID NO: 245620 - RNA, 25 nt, Human
ugaccucaggugauccgccugccuc

SEQ ID NO: 245621 - RNA, 26 nt, Human
ugaccucaggugauccgccugccuca

SEQ ID NO: 245622 - RNA, 25 nt, Human
ugaccucaggugauccgccugccuu

SEQ ID NO: 245623 - RNA, 26 nt, Human
ugaccucaggugauccguccaccuca

SEQ ID NO: 245624 - RNA, 25 nt, Human
ugaccucaggugauccucccaccuc

SEQ ID NO: 245625 - RNA, 32 nt, Human
ugaccucaggugauccucccaccucggccucc

SEQ ID NO: 245626 - RNA, 25 nt, Human
ugaccucaggugauccucccgccuc

SEQ ID NO: 245627 - RNA, 25 nt, Human
ugaccucaggugauccuccugccuc

SEQ ID NO: 245628 - RNA, 25 nt, Human
ugaccucaggugaucuacccaccuc

SEQ ID NO: 245629 - RNA, 26 nt, Human
ugaccucaggugaucuaccugccuca

SEQ ID NO: 245630 - RNA, 25 nt, Human
ugaccucaggugaucugcccaccuc

SEQ ID NO: 245631 - RNA, 26 nt, Human
ugaccucaggugaucugcccaccuca

SEQ ID NO: 245632 - RNA, 25 nt, Human
ugaccucaggugaucugcccaccuu

SEQ ID NO: 245633 - RNA, 25 nt, Human
ugaccucaggugaucugcccacuuu

SEQ ID NO: 245634 - RNA, 25 nt, Human
ugaccucaggugaucugcccaucuc

SEQ ID NO: 245635 - RNA, 26 nt, Human
ugaccucaggugaucugcccgccccg

SEQ ID NO: 245636 - RNA, 25 nt, Human
ugaccucaggugaucugcccgccuc

SEQ ID NO: 245637 - RNA, 26 nt, Human
ugaccucaggugaucugcccgccuca

SEQ ID NO: 245638 - RNA, 25 nt, Human
ugaccucaggugaucugcccgccuu

SEQ ID NO: 245639 - RNA, 32 nt, Human
ugaccucaggugaucugccugccuuggcaucc

SEQ ID NO: 245640 - RNA, 32 nt, Human
ugaccucaggugaucugccugccuuggccucc

SEQ ID NO: 245641 - RNA, 26 nt, Human
ugaccucaggugaugcacccaccuca

SEQ ID NO: 245642 - RNA, 25 nt, Human
ugaccucaggugaugcaccugccuc

SEQ ID NO: 245643 - RNA, 26 nt, Human
ugaccucaggugauucaccagccuca

SEQ ID NO: 245644 - RNA, 26 nt, Human
ugaccucaggugauucgccggccuca

SEQ ID NO: 245645 - RNA, 32 nt, Human
ugaccucagugaaagcagucaucuucagcguu

SEQ ID NO: 245646 - RNA, 24 nt, Human
ugaccucagugauccccccaccuc

SEQ ID NO: 245647 - RNA, 24 nt, Human
ugaccucagugauccccccgccuc

SEQ ID NO: 245648 - RNA, 32 nt, Human
ugaccucagugugugucugcaauuggggagau

SEQ ID NO: 245649 - RNA, 25 nt, Human
ugaccucaguugauccacccaccuu

SEQ ID NO: 245650 - RNA, 26 nt, Human
ugaccucaguugauccacccgccuca

SEQ ID NO: 245651 - RNA, 26 nt, Human
ugaccucaguugauccaccugccuca

SEQ ID NO: 245652 - RNA, 26 nt, Human
ugaccucaguugauccgccugccuca

SEQ ID NO: 245653 - RNA, 23 nt, Human
ugaccucauauuccacccgccuc

SEQ ID NO: 245654 - RNA, 17 nt, Human
ugaccucaucugcuccc

SEQ ID NO: 245655 - RNA, 23 nt, Human
ugaccucaugagccgcccgccuu

SEQ ID NO: 245656 - RNA, 32 nt, Human
ugaccucaugauaugguggcugcugaccaggg

SEQ ID NO: 245657 - RNA, 23 nt, Human
ugaccucaugauccacccaccuc

SEQ ID NO: 245658 - RNA, 24 nt, Human
ugaccucaugauccacccaccuca

SEQ ID NO: 245659 - RNA, 23 nt, Human
ugaccucaugauccacccaccuu

SEQ ID NO: 245660 - RNA, 24 nt, Human
ugaccucaugauccacccaccuua

SEQ ID NO: 245661 - RNA, 23 nt, Human
ugaccucaugauccaccccccuc

SEQ ID NO: 245662 - RNA, 23 nt, Human
ugaccucaugauccacccgccuc

SEQ ID NO: 245663 - RNA, 24 nt, Human
ugaccucaugauccacccgccuca

SEQ ID NO: 245664 - RNA, 24 nt, Human
ugaccucaugauccaccucccuca

SEQ ID NO: 245665 - RNA, 23 nt, Human
ugaccucaugauccaccugccuc

SEQ ID NO: 245666 - RNA, 24 nt, Human
ugaccucaugauccaccugccuca

SEQ ID NO: 245667 - RNA, 32 nt, Human
ugaccucaugauccccuccaccugcacuggug

SEQ ID NO: 245668 - RNA, 24 nt, Human
ugaccucaugauccgcccaccuca

SEQ ID NO: 245669 - RNA, 23 nt, Human
ugaccucaugauccgcccaccuu

SEQ ID NO: 245670 - RNA, 23 nt, Human
ugaccucaugauccgcccaucuu

SEQ ID NO: 245671 - RNA, 23 nt, Human
ugaccucaugauccgcccgccuc

SEQ ID NO: 245672 - RNA, 23 nt, Human
ugaccucaugauccgcccgccuu

SEQ ID NO: 245673 - RNA, 24 nt, Human
ugaccucaugauccgcccuccuca

SEQ ID NO: 245674 - RNA, 23 nt, Human
ugaccucaugauccgccugccuc

SEQ ID NO: 245675 - RNA, 23 nt, Human
ugaccucaugauccgccugccuu

SEQ ID NO: 245676 - RNA, 24 nt, Human
ugaccucaugauccucccgccuca

SEQ ID NO: 245677 - RNA, 23 nt, Human
ugaccucaugaucuacccgccuc

SEQ ID NO: 245678 - RNA, 23 nt, Human
ugaccucaugaucuacccgccuu

SEQ ID NO: 245679 - RNA, 23 nt, Human
ugaccucaugaucugcccaccuc

SEQ ID NO: 245680 - RNA, 24 nt, Human
ugaccucaugaucugcccgccuca

SEQ ID NO: 245681 - RNA, 24 nt, Human
ugaccucaugaucugccugccuca

SEQ ID NO: 245682 - RNA, 23 nt, Human
ugaccucaugaucuguccaccuc

SEQ ID NO: 245683 - RNA, 23 nt, Human
ugaccucaugaugugcccacuuc

SEQ ID NO: 245684 - RNA, 26 nt, Human
ugaccucauguaauccacccaccuca

SEQ ID NO: 245685 - RNA, 32 nt, Human
ugaccuccaagaagaugucaauuacaagaaca

SEQ ID NO: 245686 - RNA, 32 nt, Human
ugaccuccacucgcuagaccucaguagcaccu

SEQ ID NO: 245687 - RNA, 32 nt, Human
ugaccuccacuugcuuccaaggugcuagggaa

SEQ ID NO: 245688 - RNA, 32 nt, Human
ugaccuccaggcagcagucucugcuccagaau

SEQ ID NO: 245689 - RNA, 26 nt, Human
ugaccuccagugauccagcugccuca

SEQ ID NO: 245690 - RNA, 25 nt, Human
ugaccuccagugaucugcccaccuc

SEQ ID NO: 245691 - RNA, 32 nt, Human
ugaccuccaucgccaugcagagcugcucucac

SEQ ID NO: 245692 - RNA, 32 nt, Human
ugaccucccaggcugcggcucagguggccaac

SEQ ID NO: 245693 - RNA, 32 nt, Human
ugaccuccccaucagccugugcugcuaggucu

SEQ ID NO: 245694 - RNA, 32 nt, Human
ugaccuccccucauuguggccccacacccagu

SEQ ID NO: 245695 - RNA, 32 nt, Human
ugaccucccuccuccauuccucucacaggccc

SEQ ID NO: 245696 - RNA, 25 nt, Human
ugaccuccggugaucugcccaccuc

SEQ ID NO: 245697 - RNA, 32 nt, Human
ugaccuccguggggguggagaugaggaggaug

SEQ ID NO: 245698 - RNA, 32 nt, Human
ugaccuccuccugucuguuucccuucacggau

SEQ ID NO: 245699 - RNA, 24 nt, Human
ugaccuccugaccugcccaccuca

SEQ ID NO: 245700 - RNA, 23 nt, Human
ugaccuccugauccacccaccuc

SEQ ID NO: 245701 - RNA, 24 nt, Human
ugaccuccugauccacccaccuca

SEQ ID NO: 245702 - RNA, 23 nt, Human
ugaccuccugauccgcccaccuc

SEQ ID NO: 245703 - RNA, 24 nt, Human
ugaccuccugauccgcccaccuca

SEQ ID NO: 245704 - RNA, 24 nt, Human
ugaccuccugaugcgccugccuca

SEQ ID NO: 245705 - RNA, 32 nt, Human
ugaccuccuucagcagggcagcuccuaagagg

SEQ ID NO: 245706 - RNA, 22 nt, Human
ugaccucgagcugcucacuuca

SEQ ID NO: 245707 - RNA, 27 nt, Human
ugaccucggccaguguccacccaccuc

SEQ ID NO: 245708 - RNA, 17 nt, Human
ugaccucggcugcuccu

SEQ ID NO: 245709 - RNA, 24 nt, Human
ugaccucgggauccacccgccuca

SEQ ID NO: 245710 - RNA, 24 nt, Human
ugaccucgggauccaccggccuca

SEQ ID NO: 245711 - RNA, 26 nt, Human
ugaccucgggugauccacccaccuca

SEQ ID NO: 245712 - RNA, 25 nt, Human
ugaccucgggugauccacccgccuc

SEQ ID NO: 245713 - RNA, 23 nt, Human
ugaccucguauccacccgccuca

SEQ ID NO: 245714 - RNA, 23 nt, Human
ugaccucgugacccacccgccuu

SEQ ID NO: 245715 - RNA, 32 nt, Human
ugaccucgugagccaccacgcccagccucuuu

SEQ ID NO: 245716 - RNA, 23 nt, Human
ugaccucgugauaugcccaccuc

SEQ ID NO: 245717 - RNA, 23 nt, Human
ugaccucgugauccacccaacuc

SEQ ID NO: 245718 - RNA, 23 nt, Human
ugaccucgugauccacccaccuc

SEQ ID NO: 245719 - RNA, 24 nt, Human
ugaccucgugauccacccaccuca

SEQ ID NO: 245720 - RNA, 23 nt, Human
ugaccucgugauccacccaccuu

SEQ ID NO: 245721 - RNA, 23 nt, Human
ugaccucgugauccacccgacuc

SEQ ID NO: 245722 - RNA, 22 nt, Human
ugaccucgugauccacccgccu

SEQ ID NO: 245723 - RNA, 23 nt, Human
ugaccucgugauccacccgccuc

SEQ ID NO: 245724 - RNA, 24 nt, Human
ugaccucgugauccacccgccuca

SEQ ID NO: 245725 - RNA, 23 nt, Human
ugaccucgugauccacccgccuu

SEQ ID NO: 245726 - RNA, 24 nt, Human
ugaccucgugauccacccgccuua

SEQ ID NO: 245727 - RNA, 24 nt, Human
ugaccucgugauccacccgucuca

SEQ ID NO: 245728 - RNA, 21 nt, Human
ugaccucgugauccaccugcc

SEQ ID NO: 245729 - RNA, 23 nt, Human
ugaccucgugauccaccugccuc

SEQ ID NO: 245730 - RNA, 23 nt, Human
ugaccucgugauccaccugccuu

SEQ ID NO: 245731 - RNA, 23 nt, Human
ugaccucgugauccaccugcuuc

SEQ ID NO: 245732 - RNA, 23 nt, Human
ugaccucgugauccaccugucuc

SEQ ID NO: 245733 - RNA, 23 nt, Human
ugaccucgugaucccccugccuc

SEQ ID NO: 245734 - RNA, 23 nt, Human
ugaccucgugauccccugccuca

SEQ ID NO: 245735 - RNA, 23 nt, Human
ugaccucgugauccgcccaccuc

SEQ ID NO: 245736 - RNA, 24 nt, Human
ugaccucgugauccgcccaccuca

SEQ ID NO: 245737 - RNA, 23 nt, Human
ugaccucgugauccgcccaccuu

SEQ ID NO: 245738 - RNA, 23 nt, Human
ugaccucgugauccgcccaucuc

SEQ ID NO: 245739 - RNA, 22 nt, Human
ugaccucgugauccgcccgccu

SEQ ID NO: 245740 - RNA, 23 nt, Human
ugaccucgugauccgcccgccuc

SEQ ID NO: 245741 - RNA, 24 nt, Human
ugaccucgugauccgcccgccuca

SEQ ID NO: 245742 - RNA, 23 nt, Human
ugaccucgugauccgcccgccuu

SEQ ID NO: 245743 - RNA, 23 nt, Human
ugaccucgugauccgcccuccuc

SEQ ID NO: 245744 - RNA, 23 nt, Human
ugaccucgugauccgccuaccuc

SEQ ID NO: 245745 - RNA, 23 nt, Human
ugaccucgugauccgccugccuc

SEQ ID NO: 245746 - RNA, 24 nt, Human
ugaccucgugauccgccugccuca

SEQ ID NO: 245747 - RNA, 23 nt, Human
ugaccucgugauccgccugccuu

SEQ ID NO: 245748 - RNA, 23 nt, Human
ugaccucgugauccguccaccuu

SEQ ID NO: 245749 - RNA, 23 nt, Human
ugaccucgugaucuacccaccuc

SEQ ID NO: 245750 - RNA, 23 nt, Human
ugaccucgugaucuacccgccuc

SEQ ID NO: 245751 - RNA, 24 nt, Human
ugaccucgugaucuaccggccuca

SEQ ID NO: 245752 - RNA, 23 nt, Human
ugaccucgugaucugcccaccuc

SEQ ID NO: 245753 - RNA, 23 nt, Human
ugaccucgugaucugcccgccuc

SEQ ID NO: 245754 - RNA, 24 nt, Human
ugaccucgugaucugcccgccuca

SEQ ID NO: 245755 - RNA, 23 nt, Human
ugaccucgugaucugcccgccuu

SEQ ID NO: 245756 - RNA, 24 nt, Human
ugaccucgugaucugcccuccuca

SEQ ID NO: 245757 - RNA, 23 nt, Human
ugaccucgugaucugccugccuc

SEQ ID NO: 245758 - RNA, 23 nt, Human
ugaccucgugaugcacccaccuc

SEQ ID NO: 245759 - RNA, 23 nt, Human
ugaccucgugaugcaccugccuu

SEQ ID NO: 245760 - RNA, 23 nt, Human
ugaccucgugaugcacucaccuc

SEQ ID NO: 245761 - RNA, 24 nt, Human
ugaccucgugauucacccaccuca

SEQ ID NO: 245762 - RNA, 23 nt, Human
ugaccucgugauucacccaccuu

SEQ ID NO: 245763 - RNA, 23 nt, Human
ugaccucgugauucacccgccuc

SEQ ID NO: 245764 - RNA, 24 nt, Human
ugaccucgugauuggcccaccuca

SEQ ID NO: 245765 - RNA, 23 nt, Human
ugaccucgugauuugcccgccuc

SEQ ID NO: 245766 - RNA, 26 nt, Human
ugaccucgugugauccgcccuccuca

SEQ ID NO: 245767 - RNA, 32 nt, Human
ugaccucguguuccgcccgccuaggccuccca

SEQ ID NO: 245768 - RNA, 32 nt, Human
ugaccucuaaacagauccuccucuucucggag

SEQ ID NO: 245769 - RNA, 32 nt, Human
ugaccucucaauccucaccauccacagagcua

SEQ ID NO: 245770 - RNA, 32 nt, Human
ugaccucuccuuuccucguccugggccgggaa

SEQ ID NO: 245771 - RNA, 32 nt, Human
ugaccucucuaacacagagaagcacuaacuua

SEQ ID NO: 245772 - RNA, 21 nt, Human
ugaccucucucuacugccaca

SEQ ID NO: 245773 - RNA, 32 nt, Human
ugaccucucugacuucucuuccuccaccaagg

SEQ ID NO: 245774 - RNA, 32 nt, Human
ugaccucucugccucagucuuuguuaauguug

SEQ ID NO: 245775 - RNA, 24 nt, Human
ugaccucugaagacuauugugcug

SEQ ID NO: 245776 - RNA, 32 nt, Human
ugaccucugagugccaaggacaccacuggaac

SEQ ID NO: 245777 - RNA, 24 nt, Human
ugaccucugaugaucuacccgccu

SEQ ID NO: 245778 - RNA, 32 nt, Human
ugaccucugccacccacauccuucacaaacuc

SEQ ID NO: 245779 - RNA, 32 nt, Human
ugaccucugccucucccacauuccuccccgcg

SEQ ID NO: 245780 - RNA, 32 nt, Human
ugaccucugccuggcucccccuuggugcaacu

SEQ ID NO: 245781 - RNA, 32 nt, Human
ugaccucugccugguggcugguguaucccaac

SEQ ID NO: 245782 - RNA, 32 nt, Human
ugaccucugggcugaaaacagcagcauuuuca

SEQ ID NO: 245783 - RNA, 25 nt, Human
ugaccucuggugaucugcccacuuc

SEQ ID NO: 245784 - RNA, 21 nt, Human
ugaccucuguccacccacuuu

SEQ ID NO: 245785 - RNA, 32 nt, Human
ugaccucugugaccuugcacuccccuggccug

SEQ ID NO: 245786 - RNA, 32 nt, Human
ugaccucuuagcagaaccgcuuccauucugga

SEQ ID NO: 245787 - RNA, 23 nt, Human
ugaccucuugauccacccgacuu

SEQ ID NO: 245788 - RNA, 23 nt, Human
ugaccucuugauccgccugccuu

SEQ ID NO: 245789 - RNA, 23 nt, Human
ugaccucuugaucugcccaccuu

SEQ ID NO: 245790 - RNA, 22 nt, Human
ugaccucuuuaggccccgcuca

SEQ ID NO: 245791 - RNA, 21 nt, Human
ugaccucuuucacaguuggcu

SEQ ID NO: 245792 - RNA, 32 nt, Human
ugaccucuuucuuccucuuucaccaugugagg

SEQ ID NO: 245793 - RNA, 26 nt, Human
ugaccugaagugauccaccugccuua

SEQ ID NO: 245794 - RNA, 32 nt, Human
ugaccugacaaguacuaugugugugcaugucu

SEQ ID NO: 245795 - RNA, 32 nt, Human
ugaccugacaguuguaucccgauaauuugcca

SEQ ID NO: 245796 - RNA, 32 nt, Human
ugaccugaccuaggcuaggcagugggggccag

SEQ ID NO: 245797 - RNA, 32 nt, Human
ugaccugaccucaagugcucuugccacagaac

SEQ ID NO: 245798 - RNA, 32 nt, Human
ugaccugagagggacagugagauggggcuggc

SEQ ID NO: 245799 - RNA, 32 nt, Human
ugaccugagaugcacuucccuccucugugagc

SEQ ID NO: 245800 - RNA, 32 nt, Human
ugaccugagcccggggaggaacguggggcagg

SEQ ID NO: 245801 - RNA, 25 nt, Human
ugaccugaggcgaucugcccaccuc

SEQ ID NO: 245802 - RNA, 32 nt, Human
ugaccugaggcuguggucacagcggaggugug

SEQ ID NO: 245803 - RNA, 32 nt, Human
ugaccugaguauccaccaugugccaggcacag

SEQ ID NO: 245804 - RNA, 32 nt, Human
ugaccugaguguccuaggcauucacucggagc

SEQ ID NO: 245805 - RNA, 32 nt, Human
ugaccugaugcucuuccuggcaccacauggcc

SEQ ID NO: 245806 - RNA, 23 nt, Human
ugaccugauguccauucauccca

SEQ ID NO: 245807 - RNA, 32 nt, Human
ugaccugcacaggaucacagagcauggggcag

SEQ ID NO: 245808 - RNA, 32 nt, Human
ugaccugcacaucugcagugagggcagaauuc

SEQ ID NO: 245809 - RNA, 32 nt, Human
ugaccugcacccagguugugggggcuguaugg

SEQ ID NO: 245810 - RNA, 22 nt, Human
ugaccugcaccgaaguuugucc

SEQ ID NO: 245811 - RNA, 32 nt, Human
ugaccugcaccgaaguuugucccauuuguugc

SEQ ID NO: 245812 - RNA, 23 nt, Human
ugaccugcacuuucauuguacug

SEQ ID NO: 245813 - RNA, 21 nt, Human
ugaccugcagcaggccugcug

SEQ ID NO: 245814 - RNA, 32 nt, Human
ugaccugcaguggcuuaauuccgcuagcuaug

SEQ ID NO: 245815 - RNA, 32 nt, Human
ugaccugcaucaagucuucugaucucagauaa

SEQ ID NO: 245816 - RNA, 32 nt, Human
ugaccugcauuaacgucaaagcagagaucuua

SEQ ID NO: 245817 - RNA, 20 nt, Human
ugaccugcauugauuggcug

SEQ ID NO: 245818 - RNA, 18 nt, Human
ugaccugcccccugcaca

SEQ ID NO: 245819 - RNA, 32 nt, Human
ugaccugcccucugugagccucccucugacac

SEQ ID NO: 245820 - RNA, 32 nt, Human
ugaccugcccugggugacacggauagcgugga

SEQ ID NO: 245821 - RNA, 23 nt, Human
ugaccugccucccccuccccgcc

SEQ ID NO: 245822 - RNA, 32 nt, Human
ugaccugccucccuucaugcauggaaauuccc

SEQ ID NO: 245823 - RNA, 32 nt, Human
ugaccugccucuggcccugguccugggcgggg

SEQ ID NO: 245824 - RNA, 19 nt, Human
ugaccugccuguagcccca

SEQ ID NO: 245825 - RNA, 32 nt, Human
ugaccugccuuccaccauuaagaugaagagcu

SEQ ID NO: 245826 - RNA, 32 nt, Human
ugaccugcgauggugacacccugacucucagu

SEQ ID NO: 245827 - RNA, 32 nt, Human
ugaccugcucacugugucagcuguuuucccug

SEQ ID NO: 245828 - RNA, 21 nt, Human
ugaccugcuccgcugcuccuu

SEQ ID NO: 245829 - RNA, 32 nt, Human
ugaccugcugacugcacucugccaggcuuccc

SEQ ID NO: 245830 - RNA, 32 nt, Human
ugaccugcugcccggcuggaacugggggugcu

SEQ ID NO: 245831 - RNA, 32 nt, Human
ugaccugcugggaaggcaggcugauggggcac

SEQ ID NO: 245832 - RNA, 32 nt, Human
ugaccugcuguugguguacauguggguacagg

SEQ ID NO: 245833 - RNA, 32 nt, Human
ugaccuggaaccucugggagggcugcagagua

SEQ ID NO: 245834 - RNA, 32 nt, Human
ugaccuggacaaggcugaccucagugccagag

SEQ ID NO: 245835 - RNA, 32 nt, Human
ugaccuggcaggcggagguugcagugagccga

SEQ ID NO: 245836 - RNA, 20 nt, Human
ugaccuggcccgcccgccuu

SEQ ID NO: 245837 - RNA, 30 nt, Human
ugaccuggccucuccaaugucuccucgaac

SEQ ID NO: 245838 - RNA, 32 nt, Human
ugaccuggcgccagccucaucgucguguccuu

SEQ ID NO: 245839 - RNA, 32 nt, Human
ugaccuggcuccugcccauuggugucccaaga

SEQ ID NO: 245840 - RNA, 32 nt, Human
ugaccugggaggacagcggagccaggagcucc

SEQ ID NO: 245841 - RNA, 32 nt, Human
ugaccugggaggcggagauugcggugagccua

SEQ ID NO: 245842 - RNA, 32 nt, Human
ugaccugggcauacgcagcugcaggaucccuu

SEQ ID NO: 245843 - RNA, 32 nt, Human
ugaccugggggcuucuggaggagaggaugaga

SEQ ID NO: 245844 - RNA, 32 nt, Human
ugaccugggguccugggcugggauagcucaac

SEQ ID NO: 245845 - RNA, 32 nt, Human
ugaccugggucaucaccaugugcuuauugaag

SEQ ID NO: 245846 - RNA, 23 nt, Human
ugaccuggugauccacccaccuc

SEQ ID NO: 245847 - RNA, 23 nt, Human
ugaccuggugauccaccugccuc

SEQ ID NO: 245848 - RNA, 24 nt, Human
ugaccuggugauccuccugccuca

SEQ ID NO: 245849 - RNA, 23 nt, Human
ugaccuggugaucugcccaccca

SEQ ID NO: 245850 - RNA, 23 nt, Human
ugaccuggugaucugcccaccuc

SEQ ID NO: 245851 - RNA, 32 nt, Human
ugaccuggugaucugcccaccugggccuccca

SEQ ID NO: 245852 - RNA, 23 nt, Human
ugaccuggugauuugcccgccuu

SEQ ID NO: 245853 - RNA, 18 nt, Human
ugaccugguggacagggg

SEQ ID NO: 245854 - RNA, 18 nt, Human
ugaccugguggagggcga

SEQ ID NO: 245855 - RNA, 32 nt, Human
ugaccugguggagggcgacgagggcaggaugu

SEQ ID NO: 245856 - RNA, 23 nt, Human
ugaccuguauuccacuuacucca

SEQ ID NO: 245857 - RNA, 22 nt, Human
ugaccugucccauggauccuga

SEQ ID NO: 245858 - RNA, 19 nt, Human
ugaccugucuagggccaca

SEQ ID NO: 245859 - RNA, 32 nt, Human
ugaccugugacuguuuuaucuccagggccaac

SEQ ID NO: 245860 - RNA, 24 nt, Human
ugaccugugcacgccuucugcaac

SEQ ID NO: 245861 - RNA, 32 nt, Human
ugaccuguggaggaugggaggggugagcagca

SEQ ID NO: 245862 - RNA, 32 nt, Human
ugaccuguuacugaggcuggauggaggauggc

SEQ ID NO: 245863 - RNA, 32 nt, Human
ugaccuguuaggcugagcucaggaauugucca

SEQ ID NO: 245864 - RNA, 32 nt, Human
ugaccuguucacugcugaguccucagcacuga

SEQ ID NO: 245865 - RNA, 32 nt, Human
ugaccuuaaaacaccccagggccggcuccggc

SEQ ID NO: 245866 - RNA, 25 nt, Human
ugaccuuaagugauccacccaccuu

SEQ ID NO: 245867 - RNA, 24 nt, Human
ugaccuuaagugauccaccugccu

SEQ ID NO: 245868 - RNA, 32 nt, Human
ugaccuuacuugcauuuauccggcauuauuuc

SEQ ID NO: 245869 - RNA, 32 nt, Human
ugaccuuagccaugguuugcaagugaacagaa

SEQ ID NO: 245870 - RNA, 25 nt, Human
ugaccuuaggugauccacucgccuu

SEQ ID NO: 245871 - RNA, 26 nt, Human
ugaccuuaggugauccgcccgccuca

SEQ ID NO: 245872 - RNA, 25 nt, Human
ugaccuuaggugaucugcccacuuc

SEQ ID NO: 245873 - RNA, 25 nt, Human
ugaccuuagguggucagcccgccuc

SEQ ID NO: 245874 - RNA, 25 nt, Human
ugaccuuaguugaucugcccaccuc

SEQ ID NO: 245875 - RNA, 21 nt, Human
ugaccuuauaacccucugcac

SEQ ID NO: 245876 - RNA, 23 nt, Human
ugaccuuauaauccgcccaccuc

SEQ ID NO: 245877 - RNA, 22 nt, Human
ugaccuuaugccauuccauaua

SEQ ID NO: 245878 - RNA, 32 nt, Human
ugaccuucacccgggauggagggguccagugg

SEQ ID NO: 245879 - RNA, 26 nt, Human
ugaccuucaggugauccaccugccuc

SEQ ID NO: 245880 - RNA, 32 nt, Human
ugaccuucauuucuagguucuucaagaauggu

SEQ ID NO: 245881 - RNA, 32 nt, Human
ugaccuuccauccuuaccuguauucccaucuc

SEQ ID NO: 245882 - RNA, 23 nt, Human
ugaccuuccaucuggugaaccaa

SEQ ID NO: 245883 - RNA, 32 nt, Human
ugaccuuccgcacaucucuaaguuuuaucuuu

SEQ ID NO: 245884 - RNA, 18 nt, Human
ugaccuuccucagccuca

SEQ ID NO: 245885 - RNA, 32 nt, Human
ugaccuuccucuucuuuaacccuuuagcccua

SEQ ID NO: 245886 - RNA, 32 nt, Human
ugaccuuccuuccuuccuuccuucccucccuu

SEQ ID NO: 245887 - RNA, 32 nt, Human
ugaccuuccuucugcuggugaagggccaacag

SEQ ID NO: 245888 - RNA, 32 nt, Human
ugaccuucgcuugguguccuccuggccucagc

SEQ ID NO: 245889 - RNA, 23 nt, Human
ugaccuucuccugccccauuuca

SEQ ID NO: 245890 - RNA, 23 nt, Human
ugaccuucugaucugccugccuc

SEQ ID NO: 245891 - RNA, 24 nt, Human
ugaccuucugucccggccgccuua

SEQ ID NO: 245892 - RNA, 32 nt, Human
ugaccuucugugaagaacugggguagugacuu

SEQ ID NO: 245893 - RNA, 22 nt, Human
ugaccuucuuugcccaccugca

SEQ ID NO: 245894 - RNA, 32 nt, Human
ugaccuucuuuguccuuuuuacagcuuuugac

SEQ ID NO: 245895 - RNA, 19 nt, Human
ugaccuugacucucugagg

SEQ ID NO: 245896 - RNA, 26 nt, Human
ugaccuugagccuucuauuugccuca

SEQ ID NO: 245897 - RNA, 18 nt, Human
ugaccuugcacugcuccu

SEQ ID NO: 245898 - RNA, 32 nt, Human
ugaccuugcagaaccaccgcauuccacccugc

SEQ ID NO: 245899 - RNA, 32 nt, Human
ugaccuugcaucuccagacuguuccagagaag

SEQ ID NO: 245900 - RNA, 32 nt, Human
ugaccuugccacuugaauccuccagggccugu

SEQ ID NO: 245901 - RNA, 32 nt, Human
ugaccuugcccauagccuuggccacaccagua

SEQ ID NO: 245902 - RNA, 19 nt, Human
ugaccuugcccucugccca

SEQ ID NO: 245903 - RNA, 32 nt, Human
ugaccuugccuccuucuccuugccaacuuuga

SEQ ID NO: 245904 - RNA, 21 nt, Human
ugaccuugcuggccucucuca

SEQ ID NO: 245905 - RNA, 22 nt, Human
ugaccuuggacaagucacuuca

SEQ ID NO: 245906 - RNA, 32 nt, Human
ugaccuuggacaccagccuccagcacgcugag

SEQ ID NO: 245907 - RNA, 32 nt, Human
ugaccuuggagguggaggagaaugaugggcgu

SEQ ID NO: 245908 - RNA, 23 nt, Human
ugaccuuggcccaucugccugca

SEQ ID NO: 245909 - RNA, 32 nt, Human
ugaccuuggcucacugcaaccuccaggccagc

SEQ ID NO: 245910 - RNA, 32 nt, Human
ugaccuuggcuggauuucuucugccauuguuu

SEQ ID NO: 245911 - RNA, 32 nt, Human
ugaccuugggggcaaggaauccagaaagguag

SEQ ID NO: 245912 - RNA, 25 nt, Human
ugaccuuggguaauccaccugccuu

SEQ ID NO: 245913 - RNA, 24 nt, Human
ugaccuuggugauccacccgccuu

SEQ ID NO: 245914 - RNA, 32 nt, Human
ugaccuuguagauggccuuuuccuucaucccc

SEQ ID NO: 245915 - RNA, 23 nt, Human
ugaccuugucauccaccugucuu

SEQ ID NO: 245916 - RNA, 23 nt, Human
ugaccuugugaaccacccgucuc

SEQ ID NO: 245917 - RNA, 23 nt, Human
ugaccuugugaaccacucauuuu

SEQ ID NO: 245918 - RNA, 24 nt, Human
ugaccuugugauacaccugccuca

SEQ ID NO: 245919 - RNA, 24 nt, Human
ugaccuugugauccaccagccuca

SEQ ID NO: 245920 - RNA, 23 nt, Human
ugaccuugugauccacccaccuc

SEQ ID NO: 245921 - RNA, 24 nt, Human
ugaccuugugauccacccaccuca

SEQ ID NO: 245922 - RNA, 23 nt, Human
ugaccuugugauccacccaccuu

SEQ ID NO: 245923 - RNA, 24 nt, Human
ugaccuugugauccaccccgccuu

SEQ ID NO: 245924 - RNA, 23 nt, Human
ugaccuugugauccaccuccucg

SEQ ID NO: 245925 - RNA, 24 nt, Human
ugaccuugugauccaccugccuca

SEQ ID NO: 245926 - RNA, 23 nt, Human
ugaccuugugauccaccugccuu

SEQ ID NO: 245927 - RNA, 24 nt, Human
ugaccuugugauccaccuggccuu

SEQ ID NO: 245928 - RNA, 21 nt, Human
ugaccuugugauccaucgauc

SEQ ID NO: 245929 - RNA, 23 nt, Human
ugaccuugugaucccccugccuc

SEQ ID NO: 245930 - RNA, 24 nt, Human
ugaccuugugauccgcaugccuca

SEQ ID NO: 245931 - RNA, 23 nt, Human
ugaccuugugauccgccaaccuu

SEQ ID NO: 245932 - RNA, 23 nt, Human
ugaccuugugauccgcccaccuc

SEQ ID NO: 245933 - RNA, 23 nt, Human
ugaccuugugauccgcccgccuc

SEQ ID NO: 245934 - RNA, 24 nt, Human
ugaccuugugauccgcccgccuca

SEQ ID NO: 245935 - RNA, 23 nt, Human
ugaccuugugauccgccugccuc

SEQ ID NO: 245936 - RNA, 24 nt, Human
ugaccuugugauccgccugccuca

SEQ ID NO: 245937 - RNA, 24 nt, Human
ugaccuugugauccgcgcgccuca

SEQ ID NO: 245938 - RNA, 24 nt, Human
ugaccuugugauccgcucgccuca

SEQ ID NO: 245939 - RNA, 23 nt, Human
ugaccuugugauccguccgccuu

SEQ ID NO: 245940 - RNA, 24 nt, Human
ugaccuugugauccucccgccuca

SEQ ID NO: 245941 - RNA, 21 nt, Human
ugaccuugugaucuaccugcc

SEQ ID NO: 245942 - RNA, 23 nt, Human
ugaccuugugaucugcccaccuc

SEQ ID NO: 245943 - RNA, 23 nt, Human
ugaccuugugaucugcccaccuu

SEQ ID NO: 245944 - RNA, 23 nt, Human
ugaccuugugaucugcccgccuc

SEQ ID NO: 245945 - RNA, 23 nt, Human
ugaccuugugaucugcccgccuu

SEQ ID NO: 245946 - RNA, 24 nt, Human
ugaccuugugaucugccugccuca

SEQ ID NO: 245947 - RNA, 23 nt, Human
ugaccuugugaugcucccaccuc

SEQ ID NO: 245948 - RNA, 23 nt, Human
ugaccuugugcccgauucuuuca

SEQ ID NO: 245949 - RNA, 32 nt, Human
ugaccuugugcccgauucuuucagauugcuuu

SEQ ID NO: 245950 - RNA, 23 nt, Human
ugaccuugugguccacccgccuc

SEQ ID NO: 245951 - RNA, 24 nt, Human
ugaccuugugguccacccgccuca

SEQ ID NO: 245952 - RNA, 23 nt, Human
ugaccuugugguccaccugccuu

SEQ ID NO: 245953 - RNA, 23 nt, Human
ugaccuuguguucucccgccucg

SEQ ID NO: 245954 - RNA, 32 nt, Human
ugaccuuucaccugaugcuaagccccuacaag

SEQ ID NO: 245955 - RNA, 32 nt, Human
ugaccuuucaucuguugcuaagccccuacaag

SEQ ID NO: 245956 - RNA, 32 nt, Human
ugaccuuucugguaguuucucaaaucccugug

SEQ ID NO: 245957 - RNA, 32 nt, Human
ugaccuuucuucucucaacaggaaccugccug

SEQ ID NO: 245958 - RNA, 32 nt, Human
ugaccuuugaagcacagauaaucaaucaacgu

SEQ ID NO: 245959 - RNA, 18 nt, Human
ugaccuuugacccugcca

SEQ ID NO: 245960 - RNA, 32 nt, Human
ugaccuuugauacucucuaccuccuccagaaa

SEQ ID NO: 245961 - RNA, 23 nt, Human
ugaccuuugcaucugccugucca

SEQ ID NO: 245962 - RNA, 25 nt, Human
ugaccuuuggugauccaccugccuu

SEQ ID NO: 245963 - RNA, 23 nt, Human
ugaccuuuguaucuacucuuuua

SEQ ID NO: 245964 - RNA, 32 nt, Human
ugaccuuugucuggaaugucugaaaaguaguu

SEQ ID NO: 245965 - RNA, 32 nt, Human
ugaccuuuuucacuguggccaucaggacuuuc

SEQ ID NO: 245966 - RNA, 25 nt, Human
ugaccuuuuuucccacccuacuuca

SEQ ID NO: 245967 - RNA, 32 nt, Human
ugacgaagaaaagcccaagaucaaagaugugg

SEQ ID NO: 245968 - RNA, 32 nt, Human
ugacgaagaucuugagccacccuaccucccug

SEQ ID NO: 245969 - RNA, 32 nt, Human
ugacgacaagaccaccaacguguccuuguacc

SEQ ID NO: 245970 - RNA, 32 nt, Human
ugacgacaccugucuguuccugcccuguugcu

SEQ ID NO: 245971 - RNA, 32 nt, Human
ugacgacacgaucauaaccacucuggagaacc

SEQ ID NO: 245972 - RNA, 32 nt, Human
ugacgacacucagguccagccuugccagucuc

SEQ ID NO: 245973 - RNA, 32 nt, Human
ugacgacagaagcagggguuggagugauguga

SEQ ID NO: 245974 - RNA, 32 nt, Human
ugacgacaucacagcucacugcagccucaacc

SEQ ID NO: 245975 - RNA, 32 nt, Human
ugacgacucacugcagccucaaccuccugggg

SEQ ID NO: 245976 - RNA, 32 nt, Human
ugacgacuccgagagcccugacucccgccuug

SEQ ID NO: 245977 - RNA, 32 nt, Human
ugacgacucuugcgcgcacacacacauacaag

SEQ ID NO: 245978 - RNA, 32 nt, Human
ugacgagacagauaguuagagcagagucaaau

SEQ ID NO: 245979 - RNA, 32 nt, Human
ugacgagacaucguucauaaggcacagcacau

SEQ ID NO: 245980 - RNA, 32 nt, Human
ugacgagauaaagaagagucuuaaacaucuug

SEQ ID NO: 245981 - RNA, 32 nt, Human
ugacgagauaagcaguuaugugaccucacgug

SEQ ID NO: 245982 - RNA, 23 nt, Human
ugacgagaucuuggcucacugca

SEQ ID NO: 245983 - RNA, 32 nt, Human
ugacgagcagcagcgaaagcaccuugaggccu

SEQ ID NO: 245984 - RNA, 32 nt, Human
ugacgagccuuacuuuuccuuuguggaaauau

SEQ ID NO: 245985 - RNA, 32 nt, Human
ugacgagggaagaucacuugagcccaggaguu

SEQ ID NO: 245986 - RNA, 32 nt, Human
ugacgagggugaggagugacggccagacuggg

SEQ ID NO: 245987 - RNA, 32 nt, Human
ugacgaguguggcagagagugugcaugugaga

SEQ ID NO: 245988 - RNA, 32 nt, Human
ugacgaucggcuuuguagcaagauccacaggu

SEQ ID NO: 245989 - RNA, 32 nt, Human
ugacgaugcaggcuggagucuggcugaggagc

SEQ ID NO: 245990 - RNA, 23 nt, Human
ugacgcaaucucggcucacugca

SEQ ID NO: 245991 - RNA, 23 nt, Human
ugacgcacaggcuggagugcagu

SEQ ID NO: 245992 - RNA, 24 nt, Human
ugacgcacaggcuggagugcagug

SEQ ID NO: 245993 - RNA, 32 nt, Human
ugacgcacuuuuccagcucgagcccucacgag

SEQ ID NO: 245994 - RNA, 32 nt, Human
ugacgcagcgaguuucagucgugacuuuucug

SEQ ID NO: 245995 - RNA, 32 nt, Human
ugacgcagcugaugccugccuugguuccuacc

SEQ ID NO: 245996 - RNA, 32 nt, Human
ugacgcaguggugccaucguagccuaaaagca

SEQ ID NO: 245997 - RNA, 32 nt, Human
ugacgcauagcccugcaccugcagccagcugg

SEQ ID NO: 245998 - RNA, 32 nt, Human
ugacgcaucuucuuuuucugccuguagagaug

SEQ ID NO: 245999 - RNA, 32 nt, Human
ugacgcaugaaggagauuauguugugcucuuu

SEQ ID NO: 246000 - RNA, 32 nt, Human
ugacgcaugccugcgcgcacagcugggccggg

SEQ ID NO: 246001 - RNA, 32 nt, Human
ugacgcaugccuguaaucccagcuacucggga

SEQ ID NO: 246002 - RNA, 32 nt, Human
ugacgcaugccuguaguccuagcuacucagga

SEQ ID NO: 246003 - RNA, 32 nt, Human
ugacgccaagaguucgagaccagccugggcau

SEQ ID NO: 246004 - RNA, 32 nt, Human
ugacgccagagcuguaagugucgugacgagcu

SEQ ID NO: 246005 - RNA, 32 nt, Human
ugacgccaggagccgggagagccgagugggag

SEQ ID NO: 246006 - RNA, 32 nt, Human
ugacgccauugcacuccagccuaggcaauaag

SEQ ID NO: 246007 - RNA, 32 nt, Human
ugacgccauugcacuccagccugggugagaag

SEQ ID NO: 246008 - RNA, 32 nt, Human
ugacgccccagaaaugcugcuuccauaucagc

SEQ ID NO: 246009 - RNA, 32 nt, Human
ugacgccccaggagcugagcaccaggcuuugc

SEQ ID NO: 246010 - RNA, 32 nt, Human
ugacgcccggagcuggaguuauggcggcuacg

SEQ ID NO: 246011 - RNA, 32 nt, Human
ugacgcccucauucuccuuucguucaauaacu

SEQ ID NO: 246012 - RNA, 32 nt, Human
ugacgcccucugcccaccucccccgcugugug

SEQ ID NO: 246013 - RNA, 32 nt, Human
ugacgccucaggugaaaaucugguuuuaaaau

SEQ ID NO: 246014 - RNA, 21 nt, Human
ugacgccugccuguaguccca

SEQ ID NO: 246015 - RNA, 15 nt, Human
ugacgccuggccuca

SEQ ID NO: 246016 - RNA, 32 nt, Human
ugacgccuguaaucccagcacuuugggaggcc

SEQ ID NO: 246017 - RNA, 32 nt, Human
ugacgccuucugggccccaucuguccuuccuc

SEQ ID NO: 246018 - RNA, 32 nt, Human
ugacgcgaucuuggcugacugcagucugugcc

SEQ ID NO: 246019 - RNA, 23 nt, Human
ugacgcgaucuugguucacugca

SEQ ID NO: 246020 - RNA, 32 nt, Human
ugacgcggcacugcgucuccagccuaccuccu

SEQ ID NO: 246021 - RNA, 32 nt, Human
ugacgcggguguuuccccaguuuguggccccu

SEQ ID NO: 246022 - RNA, 22 nt, Human
ugacgcggugcggauccagauc

SEQ ID NO: 246023 - RNA, 21 nt, Human
ugacgcguaccugugauccca

SEQ ID NO: 246024 - RNA, 32 nt, Human
ugacgcuccuugggugcugcugcuacucagac

SEQ ID NO: 246025 - RNA, 32 nt, Human
ugacgcucguccgcaaccucugcuguccuccg

SEQ ID NO: 246026 - RNA, 32 nt, Human
ugacgcucugggccgccaccuccgcggacccu

SEQ ID NO: 246027 - RNA, 32 nt, Human
ugacgcugcccaggaaaggaguucugagugcu

SEQ ID NO: 246028 - RNA, 32 nt, Human
ugacgcuggagugcucacaguguggcugggac

SEQ ID NO: 246029 - RNA, 32 nt, Human
ugacgcuggccgcggcgagaucaacgaguuga

SEQ ID NO: 246030 - RNA, 32 nt, Human
ugacgcugggaacccaggguugugguccauuc

SEQ ID NO: 246031 - RNA, 32 nt, Human
ugacgcuuccagaaagcuguggagagggacag

SEQ ID NO: 246032 - RNA, 32 nt, Human
ugacgcuuccuuggggccacuuccuucuuuuu

SEQ ID NO: 246033 - RNA, 20 nt, Human
ugacgcuugccuguauccca

SEQ ID NO: 246034 - RNA, 32 nt, Human
ugacgcuugccuguaucccagcuacucaggaa

SEQ ID NO: 246035 - RNA, 32 nt, Human
ugacggacacuggguucaggcuggcaucauca

SEQ ID NO: 246036 - RNA, 32 nt, Human
ugacggacuucaccggggcucuccaggcaucu

SEQ ID NO: 246037 - RNA, 32 nt, Human
ugacggagaaggagagaaagagacgggagaga

SEQ ID NO: 246038 - RNA, 32 nt, Human
ugacggaggaggaucacuugagcccaggaauu

SEQ ID NO: 246039 - RNA, 32 nt, Human
ugacggagggaggaggaggaggaagagguaug

SEQ ID NO: 246040 - RNA, 32 nt, Human
ugacggcaccaugccauccucugccuucugug

SEQ ID NO: 246041 - RNA, 32 nt, Human
ugacggccacugcgaggcucagggagaauuua

SEQ ID NO: 246042 - RNA, 32 nt, Human
ugacggcccugcaauguaucccuucucacagc

SEQ ID NO: 246043 - RNA, 32 nt, Human
ugacggccucucacucucaucuccugugcuca

SEQ ID NO: 246044 - RNA, 32 nt, Human
ugacggcguuggcggggcugggcacaggggca

SEQ ID NO: 246045 - RNA, 32 nt, Human
ugacggcuacuguggagaugcaguggaggacc

SEQ ID NO: 246046 - RNA, 32 nt, Human
ugacggcucacauuugccccagggaaggucac

SEQ ID NO: 246047 - RNA, 32 nt, Human
ugacggcucacugcagccugcgccucccagcg

SEQ ID NO: 246048 - RNA, 32 nt, Human
ugacggcucauuucugcuucaucauacauucc

SEQ ID NO: 246049 - RNA, 32 nt, Human
ugacggcuggggaccuggcggccgugggcucc

SEQ ID NO: 246050 - RNA, 32 nt, Human
ugacggcuguggaggccaggguggaacugggg

SEQ ID NO: 246051 - RNA, 20 nt, Human
ugacggcuuuuucccggggg

SEQ ID NO: 246052 - RNA, 32 nt, Human
ugacgggaagcggagguugcagugagccgaga

SEQ ID NO: 246053 - RNA, 32 nt, Human
ugacgggaccccagaggugccgggugacagcc

SEQ ID NO: 246054 - RNA, 32 nt, Human
ugacgggacucgccuccugguguuugguggga

SEQ ID NO: 246055 - RNA, 23 nt, Human
ugacgggagccucugcgaagagg

SEQ ID NO: 246056 - RNA, 21 nt, Human
ugacgggcaccuguaguccca

SEQ ID NO: 246057 - RNA, 32 nt, Human
ugacgggcagcuucgcagagugcaguacagca

SEQ ID NO: 246058 - RNA, 32 nt, Human
ugacgggcagcuucgcggagugcaguacagca

SEQ ID NO: 246059 - RNA, 32 nt, Human
ugacgggccgccuucugcuccagcugcaucac

SEQ ID NO: 246060 - RNA, 21 nt, Human
ugacgggcgccuguaauccca

SEQ ID NO: 246061 - RNA, 32 nt, Human
ugacggggccagcuggacacacggugagauuu

SEQ ID NO: 246062 - RNA, 32 nt, Human
ugacggggcugcaggagcaggugcagugggcg

SEQ ID NO: 246063 - RNA, 21 nt, Human
ugacgggugcccguaauccca

SEQ ID NO: 246064 - RNA, 21 nt, Human
ugacgggugccuguaauccca

SEQ ID NO: 246065 - RNA, 32 nt, Human
ugacgggugccuguaaucccagcuacucagga

SEQ ID NO: 246066 - RNA, 32 nt, Human
ugacggucauuuucuccuucuuucucccucuu

SEQ ID NO: 246067 - RNA, 32 nt, Human
ugacggugccacugcacuccagcuugggugac

SEQ ID NO: 246068 - RNA, 32 nt, Human
ugacggugcccaggauagauguaauauuucuu

SEQ ID NO: 246069 - RNA, 24 nt, Human
ugacgguggcaacggcagcgucgg

SEQ ID NO: 246070 - RNA, 18 nt, Human
ugacgguguccucgggga

SEQ ID NO: 246071 - RNA, 32 nt, Human
ugacguacaccuguaauuccagcuacuuggga

SEQ ID NO: 246072 - RNA, 32 nt, Human
ugacguacugcagccucaaccuccugggcuca

SEQ ID NO: 246073 - RNA, 32 nt, Human
ugacguauuuugcuucuaguaugugccuacug

SEQ ID NO: 246074 - RNA, 25 nt, Human
ugacgucaagugauccacccgacuc

SEQ ID NO: 246075 - RNA, 32 nt, Human
ugacgucagccaacccagcuggacuggccuua

SEQ ID NO: 246076 - RNA, 32 nt, Human
ugacgucagcuuccauucuuccuuucuuauag

SEQ ID NO: 246077 - RNA, 25 nt, Human
ugacgucaggugauccacccgccuc

SEQ ID NO: 246078 - RNA, 25 nt, Human
ugacgucaggugauccgcccaccuu

SEQ ID NO: 246079 - RNA, 23 nt, Human
ugacgucgugauccacccgccuc

SEQ ID NO: 246080 - RNA, 23 nt, Human
ugacgucgugauccacccgccuu

SEQ ID NO: 246081 - RNA, 23 nt, Human
ugacgucgugauccagccaccuc

SEQ ID NO: 246082 - RNA, 24 nt, Human
ugacgucgugauccgcccaccuca

SEQ ID NO: 246083 - RNA, 24 nt, Human
ugacgucgugauucgcccgccuca

SEQ ID NO: 246084 - RNA, 32 nt, Human
ugacgucucggaaaauucccccuugcccaggc

SEQ ID NO: 246085 - RNA, 32 nt, Human
ugacgucuucuggggcuccuggcaucccuagg

SEQ ID NO: 246086 - RNA, 22 nt, Human
ugacgugagucugcccuccuua

SEQ ID NO: 246087 - RNA, 32 nt, Human
ugacgugaucagagcucacugcagcuucaaca

SEQ ID NO: 246088 - RNA, 32 nt, Human
ugacgugaucauggcucacugcagccucaacc

SEQ ID NO: 246089 - RNA, 23 nt, Human
ugacgugaucucagcucacugca

SEQ ID NO: 246090 - RNA, 23 nt, Human
ugacgugaucuccgcucacugca

SEQ ID NO: 246091 - RNA, 24 nt, Human
ugacgugaucucggcucacugcag

SEQ ID NO: 246092 - RNA, 32 nt, Human
ugacgugaucucggcucacugcagccuugacu

SEQ ID NO: 246093 - RNA, 32 nt, Human
ugacguggaagacgccgaagaggugagggagg

SEQ ID NO: 246094 - RNA, 32 nt, Human
ugacguggcgucaccgcccucuacccucgcuu

SEQ ID NO: 246095 - RNA, 32 nt, Human
ugacgugggaggauugcuugugcccagggguu

SEQ ID NO: 246096 - RNA, 32 nt, Human
ugacguggguggcucacuugagcacaggaguu

SEQ ID NO: 246097 - RNA, 32 nt, Human
ugacguggucaccaaggcagugagccccgcug

SEQ ID NO: 246098 - RNA, 24 nt, Human
ugacguggucauagcucacugcag

SEQ ID NO: 246099 - RNA, 23 nt, Human
ugacguggugauccaccugccuc

SEQ ID NO: 246100 - RNA, 32 nt, Human
ugacguguaccaggcgucugugggguuugugu

SEQ ID NO: 246101 - RNA, 26 nt, Human
ugacguucaauaaaacuguugaaucu

SEQ ID NO: 246102 - RNA, 32 nt, Human
ugacguuggguugcuuccuaggccuggcugag

SEQ ID NO: 246103 - RNA, 32 nt, Human
ugacguuucacuccucaccuucccaacaccuc

SEQ ID NO: 246104 - RNA, 32 nt, Human
ugacguuucucuuccuugccuggacugccuuu

SEQ ID NO: 246105 - RNA, 32 nt, Human
ugacguuugcuagcuuuuaaauauauuuauuu

SEQ ID NO: 246106 - RNA, 32 nt, Human
ugacuaaaaauggaauuucuucaggaaucaua

SEQ ID NO: 246107 - RNA, 32 nt, Human
ugacuaaacucugccaggaugucuugccagca

SEQ ID NO: 246108 - RNA, 32 nt, Human
ugacuaaacugaccucuuccuccuggcuaaau

SEQ ID NO: 246109 - RNA, 32 nt, Human
ugacuaaagaagcagaccugggaaucaccuaa

SEQ ID NO: 246110 - RNA, 32 nt, Human
ugacuaaagcuaaacaccaguuucucaggagg

SEQ ID NO: 246111 - RNA, 32 nt, Human
ugacuaaauuauucuugaucuuuuggcauuua

SEQ ID NO: 246112 - RNA, 32 nt, Human
ugacuaacacagugaaaccccgucucuaauaa

SEQ ID NO: 246113 - RNA, 32 nt, Human
ugacuaacacggugaaaccccaucucuacuaa

SEQ ID NO: 246114 - RNA, 32 nt, Human
ugacuaacagcaacuccaucacuugagaagua

SEQ ID NO: 246115 - RNA, 32 nt, Human
ugacuaacauggugaaaccccaucucuacuaa

SEQ ID NO: 246116 - RNA, 32 nt, Human
ugacuaaccuggugcugggauucuacgaagau

SEQ ID NO: 246117 - RNA, 32 nt, Human
ugacuaaggaaggacuacagaggcuuugccaa

SEQ ID NO: 246118 - RNA, 32 nt, Human
ugacuaaggaugacacuaauuguuagcuguuu

SEQ ID NO: 246119 - RNA, 32 nt, Human
ugacuaaggcucucaugaaauucaaagugcca

SEQ ID NO: 246120 - RNA, 32 nt, Human
ugacuaagggucaggucauguuugaaaccaug

SEQ ID NO: 246121 - RNA, 32 nt, Human
ugacuaaggguggucagccagagcucauggga

SEQ ID NO: 246122 - RNA, 22 nt, Human
ugacuaagucaagcuacuuccu

SEQ ID NO: 246123 - RNA, 32 nt, Human
ugacuaauccuguggcaaaaccacgacaccac

SEQ ID NO: 246124 - RNA, 32 nt, Human
ugacuacaccugaaaaguaucaagagacaucu

SEQ ID NO: 246125 - RNA, 32 nt, Human
ugacuacagggccaccggcaauaaaagcccag

SEQ ID NO: 246126 - RNA, 32 nt, Human
ugacuacaguagccauaaagaaaaugaaauac

SEQ ID NO: 246127 - RNA, 32 nt, Human
ugacuacaucacagccaggcggcauucccugc

SEQ ID NO: 246128 - RNA, 32 nt, Human
ugacuaccccagacucugccugccucagaucu

SEQ ID NO: 246129 - RNA, 32 nt, Human
ugacuaccucaaaggccaggcacccccaaauc

SEQ ID NO: 246130 - RNA, 32 nt, Human
ugacuaccuucccagccaugucucugcaguca

SEQ ID NO: 246131 - RNA, 19 nt, Human
ugacuacgaugacauagca

SEQ ID NO: 246132 - RNA, 32 nt, Human
ugacuacuagaggcuugacuugcagugaaacc

SEQ ID NO: 246133 - RNA, 32 nt, Human
ugacuagaaacugccuuuuucuccacuucauu

SEQ ID NO: 246134 - RNA, 32 nt, Human
ugacuagaagugaaacugcaacacuaacuucc

SEQ ID NO: 246135 - RNA, 32 nt, Human
ugacuagacuaugagcuauugcagugaaaggg

SEQ ID NO: 246136 - RNA, 32 nt, Human
ugacuagagaggaggugggaacagaagagaga

SEQ ID NO: 246137 - RNA, 32 nt, Human
ugacuagaucacguuucucagcagccugacag

SEQ ID NO: 246138 - RNA, 32 nt, Human
ugacuagcaaggagucugcuucugcuacuugg

SEQ ID NO: 246139 - RNA, 32 nt, Human
ugacuagcacagagcugaucucuguuucuguu

SEQ ID NO: 246140 - RNA, 32 nt, Human
ugacuagccagcccucuacuccuccaaccuuu

SEQ ID NO: 246141 - RNA, 32 nt, Human
ugacuagccuaggucaucagagcccagacucc

SEQ ID NO: 246142 - RNA, 32 nt, Human
ugacuagcuacugcacuccaaccugggcaaca

SEQ ID NO: 246143 - RNA, 32 nt, Human
ugacuagcugaaaugugaauucuguuaguguu

SEQ ID NO: 246144 - RNA, 32 nt, Human
ugacuaggacacauuugggaguauuuaaucag

SEQ ID NO: 246145 - RNA, 32 nt, Human
ugacuaggcccucucauuuccucccuccuugg

SEQ ID NO: 246146 - RNA, 32 nt, Human
ugacuaggccggcucccccagacucagagggc

SEQ ID NO: 246147 - RNA, 32 nt, Human
ugacuaggggcuggggugucuccucaccaggg

SEQ ID NO: 246148 - RNA, 18 nt, Human
ugacuaggguuucagaca

SEQ ID NO: 246149 - RNA, 32 nt, Human
ugacuaggugugugugcacauguguagggugc

SEQ ID NO: 246150 - RNA, 32 nt, Human
ugacuagucacagucagagucagaaucacagg

SEQ ID NO: 246151 - RNA, 32 nt, Human
ugacuagucccauccuguacauggagaaaacg

SEQ ID NO: 246152 - RNA, 32 nt, Human
ugacuagugaucucaggagauggcacuguccu

SEQ ID NO: 246153 - RNA, 32 nt, Human
ugacuauagugugagccaggaaucacuggcug

SEQ ID NO: 246154 - RNA, 32 nt, Human
ugacuaucacacacuuucucuucaaugaaaaa

SEQ ID NO: 246155 - RNA, 32 nt, Human
ugacuaucaucggccaugccacugccuugcuc

SEQ ID NO: 246156 - RNA, 32 nt, Human
ugacuaucuuuuaggaauucaggaagcaaauc

SEQ ID NO: 246157 - RNA, 32 nt, Human
ugacuaugaagaggaagaggaggacagugaug

SEQ ID NO: 246158 - RNA, 32 nt, Human
ugacuaugccacuguacuccagccuggguaac

SEQ ID NO: 246159 - RNA, 32 nt, Human
ugacuauggcugcuuuagacaacugugacaga

SEQ ID NO: 246160 - RNA, 22 nt, Human
ugacuauguuucacccgcuuca

SEQ ID NO: 246161 - RNA, 32 nt, Human
ugacuauucucaucucuguuuugcagguuuac

SEQ ID NO: 246162 - RNA, 32 nt, Human
ugacuauuuaauccuuucuacuugucgcuaaa

SEQ ID NO: 246163 - RNA, 32 nt, Human
ugacuauuuuuagaaucauaaaauuaguuacu

SEQ ID NO: 246164 - RNA, 32 nt, Human
ugacucaaaguagaucguuauuuugaucaaac

SEQ ID NO: 246165 - RNA, 32 nt, Human
ugacucaaauguauuauugccaaccaagucgu

SEQ ID NO: 246166 - RNA, 32 nt, Human
ugacucaacaccugggcucucacagggaggag

SEQ ID NO: 246167 - RNA, 32 nt, Human
ugacucaagauugcucuacagacucagaagau

SEQ ID NO: 246168 - RNA, 21 nt, Human
ugacucaagccuauaauccca

SEQ ID NO: 246169 - RNA, 32 nt, Human
ugacucaagccuguaucccagcacuuugggag

SEQ ID NO: 246170 - RNA, 32 nt, Human
ugacucaagucucggcccugaggacucagaac

SEQ ID NO: 246171 - RNA, 23 nt, Human
ugacucacaaccuucuaauccca

SEQ ID NO: 246172 - RNA, 32 nt, Human
ugacucacaauuguccucagaaccuagugcca

SEQ ID NO: 246173 - RNA, 21 nt, Human
ugacucacaccuauaauccca

SEQ ID NO: 246174 - RNA, 19 nt, Human
ugacucacaccuguaaucc

SEQ ID NO: 246175 - RNA, 21 nt, Human
ugacucacaccuguaauccca

SEQ ID NO: 246176 - RNA, 23 nt, Human
ugacucacaccuguaaucccagc

SEQ ID NO: 246177 - RNA, 32 nt, Human
ugacucacaccuguaaucccagcacuuucgga

SEQ ID NO: 246178 - RNA, 32 nt, Human
ugacucacaccuguaaucccagcacuuuggga

SEQ ID NO: 246179 - RNA, 21 nt, Human
ugacucacaccuguaauccua

SEQ ID NO: 246180 - RNA, 21 nt, Human
ugacucacaccuguaaucuca

SEQ ID NO: 246181 - RNA, 32 nt, Human
ugacucacaccuguaauuccagcacuucagga

SEQ ID NO: 246182 - RNA, 32 nt, Human
ugacucacaccuguaauuccagcacuuuggga

SEQ ID NO: 246183 - RNA, 21 nt, Human
ugacucacaccuguacuccca

SEQ ID NO: 246184 - RNA, 18 nt, Human
ugacucacacugauccca

SEQ ID NO: 246185 - RNA, 21 nt, Human
ugacucacacuuguaauccca

SEQ ID NO: 246186 - RNA, 32 nt, Human
ugacucacagcccuauucaggcaggagcugcu

SEQ ID NO: 246187 - RNA, 21 nt, Human
ugacucacagccguaauccca

SEQ ID NO: 246188 - RNA, 19 nt, Human
ugacucacaucuguaaucc

SEQ ID NO: 246189 - RNA, 21 nt, Human
ugacucacaucuguaauccca

SEQ ID NO: 246190 - RNA, 32 nt, Human
ugacucaccaacaaauguacagcaauaacacc

SEQ ID NO: 246191 - RNA, 19 nt, Human
ugacucaccagaugggguc

SEQ ID NO: 246192 - RNA, 21 nt, Human
ugacucacgccuauaauccca

SEQ ID NO: 246193 - RNA, 32 nt, Human
ugacucacgccuauaaucccagcacuuuggga

SEQ ID NO: 246194 - RNA, 21 nt, Human
ugacucacgccuauaaucuca

SEQ ID NO: 246195 - RNA, 21 nt, Human
ugacucacgccuguaacccca

SEQ ID NO: 246196 - RNA, 23 nt, Human
ugacucacgccuguaaccccagc

SEQ ID NO: 246197 - RNA, 32 nt, Human
ugacucacgccuguaaccccagcacuuuggga

SEQ ID NO: 246198 - RNA, 21 nt, Human
ugacucacgccuguaauccca

SEQ ID NO: 246199 - RNA, 23 nt, Human
ugacucacgccuguaaucccagc

SEQ ID NO: 246200 - RNA, 32 nt, Human
ugacucacgccuguaaucccagcacuuuagga

SEQ ID NO: 246201 - RNA, 32 nt, Human
ugacucacgccuguaaucccagcacuuuggga

SEQ ID NO: 246202 - RNA, 32 nt, Human
ugacucacguacuguaguuugcacuggacgcc

SEQ ID NO: 246203 - RNA, 21 nt, Human
ugacucacgucuguaauccca

SEQ ID NO: 246204 - RNA, 23 nt, Human
ugacucacgucuguaaucccagc

SEQ ID NO: 246205 - RNA, 32 nt, Human
ugacucacgucuguaaucccagcacuuuggga

SEQ ID NO: 246206 - RNA, 32 nt, Human
ugacucacuacaaccuccgccucccagguuca

SEQ ID NO: 246207 - RNA, 32 nt, Human
ugacucacuacagccucugccucccagguuca

SEQ ID NO: 246208 - RNA, 32 nt, Human
ugacucacugagacuggcucaauaucgacuuc

SEQ ID NO: 246209 - RNA, 32 nt, Human
ugacucacugaugaaggcccuggugaggagaa

SEQ ID NO: 246210 - RNA, 32 nt, Human
ugacucacugcaacaucugccucccggguuca

SEQ ID NO: 246211 - RNA, 32 nt, Human
ugacucacugcaaccuccaccucccagguuca

SEQ ID NO: 246212 - RNA, 32 nt, Human
ugacucacugcaaccuccgccucacagcuuca

SEQ ID NO: 246213 - RNA, 32 nt, Human
ugacucacugcaaccuccgccucccagguuca

SEQ ID NO: 246214 - RNA, 32 nt, Human
ugacucacugcaaccuccgccuccuggguuca

SEQ ID NO: 246215 - RNA, 32 nt, Human
ugacucacugcaaccucugccucccagguuua

SEQ ID NO: 246216 - RNA, 32 nt, Human
ugacucacugcaaccucugccucucggguucc

SEQ ID NO: 246217 - RNA, 32 nt, Human
ugacucacugcaacuucugccacccagguuca

SEQ ID NO: 246218 - RNA, 32 nt, Human
ugacucacugcaaucuccaccucccacagguu

SEQ ID NO: 246219 - RNA, 32 nt, Human
ugacucacugcaauucugccuccuggguucaa

SEQ ID NO: 246220 - RNA, 32 nt, Human
ugacucacugcagccucaaccucccaggcuca

SEQ ID NO: 246221 - RNA, 32 nt, Human
ugacucagaaucagagaggcagucauaucagu

SEQ ID NO: 246222 - RNA, 32 nt, Human
ugacucagaauggauuaacaugaaaguuaucc

SEQ ID NO: 246223 - RNA, 32 nt, Human
ugacucagcaagaauagauggauggggcugga

SEQ ID NO: 246224 - RNA, 32 nt, Human
ugacucagcagacucagcagggaugacucagc

SEQ ID NO: 246225 - RNA, 20 nt, Human
ugacucagcaguccuucccu

SEQ ID NO: 246226 - RNA, 32 nt, Human
ugacucagccucucaaguagcugggauuacaa

SEQ ID NO: 246227 - RNA, 32 nt, Human
ugacucaggaccccgccucuguccucacugug

SEQ ID NO: 246228 - RNA, 24 nt, Human
ugacucaggagccuccuagggcuu

SEQ ID NO: 246229 - RNA, 21 nt, Human
ugacucaggcagguaauccca

SEQ ID NO: 246230 - RNA, 20 nt, Human
ugacucaggccugagggcua

SEQ ID NO: 246231 - RNA, 32 nt, Human
ugacucaggccuggggcaucugggcauuguag

SEQ ID NO: 246232 - RNA, 21 nt, Human
ugacucaggccuguaauccca

SEQ ID NO: 246233 - RNA, 23 nt, Human
ugacucaggccuguaaucccagc

SEQ ID NO: 246234 - RNA, 32 nt, Human
ugacucaggccuguaaucccagcacuuuggga

SEQ ID NO: 246235 - RNA, 32 nt, Human
ugacucagggguggaggagccuaggaaugccu

SEQ ID NO: 246236 - RNA, 32 nt, Human
ugacucagucacagcaacccccuguuaucugc

SEQ ID NO: 246237 - RNA, 32 nt, Human
ugacucagucccaguaacccccuguuaucugc

SEQ ID NO: 246238 - RNA, 32 nt, Human
ugacucagugaugcagaaccuuucagaguuag

SEQ ID NO: 246239 - RNA, 32 nt, Human
ugacucagugcucccuuccucuccucuccuuc

SEQ ID NO: 246240 - RNA, 21 nt, Human
ugacucauaccuguaauccca

SEQ ID NO: 246241 - RNA, 18 nt, Human
ugacucauaccuguuucc

SEQ ID NO: 246242 - RNA, 22 nt, Human
ugacucauaccuguuuccggcu

SEQ ID NO: 246243 - RNA, 18 nt, Human
ugacucaucaaaauccca

SEQ ID NO: 246244 - RNA, 32 nt, Human
ugacucaucagaguguggggguugugaaagcu

SEQ ID NO: 246245 - RNA, 32 nt, Human
ugacucaucagggcacuuugugaagagugagg

SEQ ID NO: 246246 - RNA, 24 nt, Human
ugacucaucccuacccauauucuu

SEQ ID NO: 246247 - RNA, 32 nt, Human
ugacucaucgccaagauuugcuguaaugcagg

SEQ ID NO: 246248 - RNA, 32 nt, Human
ugacucaucuuucagaccuaaguccuccuguc

SEQ ID NO: 246249 - RNA, 20 nt, Human
ugacucaugacucaccccca

SEQ ID NO: 246250 - RNA, 19 nt, Human
ugacucaugccaucuuccc

SEQ ID NO: 246251 - RNA, 21 nt, Human
ugacucaugccuacaauccca

SEQ ID NO: 246252 - RNA, 23 nt, Human
ugacucaugccuacaaucccagc

SEQ ID NO: 246253 - RNA, 32 nt, Human
ugacucaugccuauaaucccagcacuuuggga

SEQ ID NO: 246254 - RNA, 32 nt, Human
ugacucaugccuguaaccccagcgcuuuggga

SEQ ID NO: 246255 - RNA, 21 nt, Human
ugacucaugccuguaauccca

SEQ ID NO: 246256 - RNA, 23 nt, Human
ugacucaugccuguaaucccagc

SEQ ID NO: 246257 - RNA, 32 nt, Human
ugacucaugccuguaaucccagcacguuggga

SEQ ID NO: 246258 - RNA, 32 nt, Human
ugacucaugccuguaaucccagcacuguggga

SEQ ID NO: 246259 - RNA, 32 nt, Human
ugacucaugccuguaaucccagcacuuuggga

SEQ ID NO: 246260 - RNA, 23 nt, Human
ugacucaugccuguaaucccagu

SEQ ID NO: 246261 - RNA, 32 nt, Human
ugacucaugccuguaaucccaguacucuggga

SEQ ID NO: 246262 - RNA, 32 nt, Human
ugacucaugccuguaaucccugcacuuuggga

SEQ ID NO: 246263 - RNA, 20 nt, Human
ugacucaugccuguaauccu

SEQ ID NO: 246264 - RNA, 21 nt, Human
ugacucaugccuguaauccua

SEQ ID NO: 246265 - RNA, 32 nt, Human
ugacucaugccuguaauccuagcacuuuggga

SEQ ID NO: 246266 - RNA, 23 nt, Human
ugacucaugccuguaauccuagu

SEQ ID NO: 246267 - RNA, 32 nt, Human
ugacucaugccuguaauccuaguacuuuggga

SEQ ID NO: 246268 - RNA, 23 nt, Human
ugacucaugccuguaauccuggc

SEQ ID NO: 246269 - RNA, 32 nt, Human
ugacucaugccuguaguaaucccagcacuuuu

SEQ ID NO: 246270 - RNA, 20 nt, Human
ugacucaugccugugauccc

SEQ ID NO: 246271 - RNA, 32 nt, Human
ugacucaugccuguuaucccaacacuuuggga

SEQ ID NO: 246272 - RNA, 17 nt, Human
ugacucaugcuucaccc

SEQ ID NO: 246273 - RNA, 20 nt, Human
ugacucaugcuugacacccc

SEQ ID NO: 246274 - RNA, 21 nt, Human
ugacucaugcuuguaauccca

SEQ ID NO: 246275 - RNA, 23 nt, Human
ugacucaugcuuguaaucccagc

SEQ ID NO: 246276 - RNA, 20 nt, Human
ugacucauggcagaaucgca

SEQ ID NO: 246277 - RNA, 20 nt, Human
ugacucauuacgugauccca

SEQ ID NO: 246278 - RNA, 32 nt, Human
ugacuccaaggagcacauacagggaugcgaca

SEQ ID NO: 246279 - RNA, 20 nt, Human
ugacuccacacccagcaugu

SEQ ID NO: 246280 - RNA, 18 nt, Human
ugacuccacacucagccu

SEQ ID NO: 246281 - RNA, 20 nt, Human
ugacuccacaucucacaucc

SEQ ID NO: 246282 - RNA, 32 nt, Human
ugacuccacuugaaaggugugcuugguuuggc

SEQ ID NO: 246283 - RNA, 32 nt, Human
ugacuccagagccuccagcaagaugcuacuga

SEQ ID NO: 246284 - RNA, 32 nt, Human
ugacuccagcagauucuggcccagggacagga

SEQ ID NO: 246285 - RNA, 32 nt, Human
ugacuccaggacuccacagaauggagcaagaa

SEQ ID NO: 246286 - RNA, 32 nt, Human
ugacuccaggaggcgcaggcugcagugagcuc

SEQ ID NO: 246287 - RNA, 32 nt, Human
ugacuccaugucugcagcucuacaggaugaac

SEQ ID NO: 246288 - RNA, 32 nt, Human
ugacucccaaagugcugaaauuacaggcauga

SEQ ID NO: 246289 - RNA, 32 nt, Human
ugacucccacugcacuccagcucggggaacag

SEQ ID NO: 246290 - RNA, 32 nt, Human
ugacucccagcccuguagguucucccaaacca

SEQ ID NO: 246291 - RNA, 32 nt, Human
ugacuccccugagcccucuucucuccaggcua

SEQ ID NO: 246292 - RNA, 24 nt, Human
ugacucccucagguugacacagca

SEQ ID NO: 246293 - RNA, 32 nt, Human
ugacucccugaacuccaaagcaaggguuggug

SEQ ID NO: 246294 - RNA, 20 nt, Human
ugacucccuggcugcuccuu

SEQ ID NO: 246295 - RNA, 32 nt, Human
ugacucccuuucucccuggacuugaucugcug

SEQ ID NO: 246296 - RNA, 32 nt, Human
ugacuccgccuggguuggggacagagagcaga

SEQ ID NO: 246297 - RNA, 32 nt, Human
ugacuccgcuggagguggggccuggagcaggc

SEQ ID NO: 246298 - RNA, 32 nt, Human
ugacuccucacacucagcgaugaccugugggg

SEQ ID NO: 246299 - RNA, 32 nt, Human
ugacuccuccaggaccagccaugguguggagg

SEQ ID NO: 246300 - RNA, 32 nt, Human
ugacuccugcccacccccagcccuuuacuaag

SEQ ID NO: 246301 - RNA, 31 nt, Human
ugacuccugccuguagcuccuguguccccau

SEQ ID NO: 246302 - RNA, 32 nt, Human
ugacuccugcugguaccugcccucuauuuauu

SEQ ID NO: 246303 - RNA, 32 nt, Human
ugacuccugcugugggggugcccuuucuaccc

SEQ ID NO: 246304 - RNA, 20 nt, Human
ugacuccuggcauuugccuu

SEQ ID NO: 246305 - RNA, 32 nt, Human
ugacuccuggcuuuggggucaggcagacgugg

SEQ ID NO: 246306 - RNA, 24 nt, Human
ugacuccugggcaucugugccuuc

SEQ ID NO: 246307 - RNA, 32 nt, Human
ugacuccuuccagggaaguaucagcuuaagaa

SEQ ID NO: 246308 - RNA, 32 nt, Human
ugacuccuuuaguacacugagaaaaaucuuau

SEQ ID NO: 246309 - RNA, 25 nt, Human
ugacucgaagugauccgcccaccuu

SEQ ID NO: 246310 - RNA, 32 nt, Human
ugacucgaucccuagacauuuguuacagauag

SEQ ID NO: 246311 - RNA, 21 nt, Human
ugacucgcaccuguaauccca

SEQ ID NO: 246312 - RNA, 32 nt, Human
ugacucgcaccuguaaucccagcacuuuggga

SEQ ID NO: 246313 - RNA, 32 nt, Human
ugacucgcagcaaccuccgccuccuggguuca

SEQ ID NO: 246314 - RNA, 32 nt, Human
ugacucgcugcagucuccaccuccaggauuca

SEQ ID NO: 246315 - RNA, 32 nt, Human
ugacucggcagcgggcagccaccccacgcucc

SEQ ID NO: 246316 - RNA, 32 nt, Human
ugacucggggcagaagucgggaaccggguuca

SEQ ID NO: 246317 - RNA, 32 nt, Human
ugacucgguuuauuagagacauaguguggcag

SEQ ID NO: 246318 - RNA, 32 nt, Human
ugacucgugccugcccaucccuguaauagaug

SEQ ID NO: 246319 - RNA, 22 nt, Human
ugacucgugcucuccaaccugu

SEQ ID NO: 246320 - RNA, 32 nt, Human
ugacucguggcgcgggagcugggagccaggcu

SEQ ID NO: 246321 - RNA, 25 nt, Human
ugacucuacugcugggacuuacaga

SEQ ID NO: 246322 - RNA, 32 nt, Human
ugacucuaggagagcaggagagaggcaggucu

SEQ ID NO: 246323 - RNA, 32 nt, Human
ugacucuaucaggagcuuuuuaaggaaaguaa

SEQ ID NO: 246324 - RNA, 32 nt, Human
ugacucucagcagcuaugguaggaacugcugg

SEQ ID NO: 246325 - RNA, 32 nt, Human
ugacucucccggcucugccacuguuuucugag

SEQ ID NO: 246326 - RNA, 32 nt, Human
ugacucucccuccacccugccuccucgggcuc

SEQ ID NO: 246327 - RNA, 32 nt, Human
ugacucuccugccucagccucccuaguagcug

SEQ ID NO: 246328 - RNA, 20 nt, Human
ugacucuccugucuguagca

SEQ ID NO: 246329 - RNA, 32 nt, Human
ugacucucugaccugguuugcugagauagucg

SEQ ID NO: 246330 - RNA, 32 nt, Human
ugacucugaacugucucucagucuccagaaag

SEQ ID NO: 246331 - RNA, 32 nt, Human
ugacucugaccuggaaccacagcccagaugug

SEQ ID NO: 246332 - RNA, 32 nt, Human
ugacucugacuccugaggaagaggccuguuug

SEQ ID NO: 246333 - RNA, 32 nt, Human
ugacucugccagaggcccagccccagaacuca

SEQ ID NO: 246334 - RNA, 32 nt, Human
ugacucugcccuuuauguauuauccacacgau

SEQ ID NO: 246335 - RNA, 32 nt, Human
ugacucugccuccaacuguggcucagagaaca

SEQ ID NO: 246336 - RNA, 32 nt, Human
ugacucugccugaggccagccugcccgaagcu

SEQ ID NO: 246337 - RNA, 21 nt, Human
ugacucugcucccugaccaca

SEQ ID NO: 246338 - RNA, 23 nt, Human
ugacucugcugccccaaccuuuc

SEQ ID NO: 246339 - RNA, 29 nt, Human
ugacucuggcugccaagauaccuucaugg

SEQ ID NO: 246340 - RNA, 32 nt, Human
ugacucugggcaccccucucaccagcuacaag

SEQ ID NO: 246341 - RNA, 24 nt, Human
ugacucugugacauuucuagcaua

SEQ ID NO: 246342 - RNA, 32 nt, Human
ugacucugugccaggcccuaaucagugugcug

SEQ ID NO: 246343 - RNA, 20 nt, Human
ugacucuguucccccggggg

SEQ ID NO: 246344 - RNA, 28 nt, Human
ugacucuuauauacugccucaucuugau

SEQ ID NO: 246345 - RNA, 28 nt, Human
ugacucuuaucuacugccucaucuugau

SEQ ID NO: 246346 - RNA, 32 nt, Human
ugacucuucagccucaaauccccaguuuuuga

SEQ ID NO: 246347 - RNA, 32 nt, Human
ugacucuucauacgugauucauuccacacaau

SEQ ID NO: 246348 - RNA, 17 nt, Human
ugacucuuccugcuccc

SEQ ID NO: 246349 - RNA, 18 nt, Human
ugacucuuccugcuuccu

SEQ ID NO: 246350 - RNA, 32 nt, Human
ugacucuucgauccucccucuuuguguccauu

SEQ ID NO: 246351 - RNA, 23 nt, Human
ugacucuucuaaucuugaaccaa

SEQ ID NO: 246352 - RNA, 32 nt, Human
ugacucuugaaucacaaauaaaagccaauugu

SEQ ID NO: 246353 - RNA, 32 nt, Human
ugacucuugcccaauccuugaccuugacuccu

SEQ ID NO: 246354 - RNA, 32 nt, Human
ugacucuugcccagugccugccugccucucuc

SEQ ID NO: 246355 - RNA, 32 nt, Human
ugacucuuggcucuugggcaugugggugagcu

SEQ ID NO: 246356 - RNA, 32 nt, Human
ugacucuuuaacgggugggcacuggaccaucu

SEQ ID NO: 246357 - RNA, 32 nt, Human
ugacucuuugaaaaucugagguauuuugaaaa

SEQ ID NO: 246358 - RNA, 23 nt, Human
ugacucuuuguaaagagaggcau

SEQ ID NO: 246359 - RNA, 32 nt, Human
ugacugaaaauuccaccccacacccacugagc

SEQ ID NO: 246360 - RNA, 32 nt, Human
ugacugaaagaaucccugucaaagggguguca

SEQ ID NO: 246361 - RNA, 32 nt, Human
ugacugaaagaugaaguucaagagaagggaca

SEQ ID NO: 246362 - RNA, 32 nt, Human
ugacugaagcauuggauauaaauauggugucc

SEQ ID NO: 246363 - RNA, 32 nt, Human
ugacugaagcgguccuaugaggcccuguucaa

SEQ ID NO: 246364 - RNA, 32 nt, Human
ugacugaagcuuaaugaugugaggcuucuagu

SEQ ID NO: 246365 - RNA, 32 nt, Human
ugacugaaugcagaacgguuuuuggaucuggc

SEQ ID NO: 246366 - RNA, 32 nt, Human
ugacugaauguguuucaaaugggugguggggu

SEQ ID NO: 246367 - RNA, 22 nt, Human
ugacugacauagaccugcagcu

SEQ ID NO: 246368 - RNA, 32 nt, Human
ugacugacauagaccugcagcugcaguucucc

SEQ ID NO: 246369 - RNA, 24 nt, Human
ugacugacauuccuuucugcaacu

SEQ ID NO: 246370 - RNA, 32 nt, Human
ugacugacauucucucggucaggaaaagagcu

SEQ ID NO: 246371 - RNA, 32 nt, Human
ugacugacccuuugccuuaucacacaugugcu

SEQ ID NO: 246372 - RNA, 32 nt, Human
ugacugaccgucuggggcucaggcuggugugg

SEQ ID NO: 246373 - RNA, 32 nt, Human
ugacugacguuggcuucaguuuggaauccaaa

SEQ ID NO: 246374 - RNA, 32 nt, Human
ugacugagaaauccucugcugaagaccccugg

SEQ ID NO: 246375 - RNA, 32 nt, Human
ugacugagaaguuaggguagaaaacaaaaagg

SEQ ID NO: 246376 - RNA, 32 nt, Human
ugacugagacacuccugugugguuucaggaga

SEQ ID NO: 246377 - RNA, 32 nt, Human
ugacugagaucuugagacugaaggaaacccaa

SEQ ID NO: 246378 - RNA, 31 nt, Human
ugacugagccacuucuuuaugccucaagaca

SEQ ID NO: 246379 - RNA, 32 nt, Human
ugacugagcuacuacaaaaagaaaaaucacug

SEQ ID NO: 246380 - RNA, 32 nt, Human
ugacugagcuccucuugcacucucacacacaa

SEQ ID NO: 246381 - RNA, 32 nt, Human
ugacugaggcggggcggggagcagggggacac

SEQ ID NO: 246382 - RNA, 32 nt, Human
ugacugagggagcuccuggugaaaugugccaa

SEQ ID NO: 246383 - RNA, 32 nt, Human
ugacugagggggcagaggcaguggcucuuuag

SEQ ID NO: 246384 - RNA, 32 nt, Human
ugacugagguuagggaggacgcccgagacccc

SEQ ID NO: 246385 - RNA, 32 nt, Human
ugacugagucaccacaccccucuccccugauc

SEQ ID NO: 246386 - RNA, 32 nt, Human
ugacugagugcuccauuucuuccuuuaccccc

SEQ ID NO: 246387 - RNA, 32 nt, Human
ugacugaguguuggccagugagaugaagucuc

SEQ ID NO: 246388 - RNA, 32 nt, Human
ugacugaguuccuuccuguggccacagggagg

SEQ ID NO: 246389 - RNA, 32 nt, Human
ugacugaucaaauguuuuggugccagugaaga

SEQ ID NO: 246390 - RNA, 21 nt, Human
ugacugaugccuguaauccca

SEQ ID NO: 246391 - RNA, 32 nt, Human
ugacugaugccuguaaucccaacacuuuguug

SEQ ID NO: 246392 - RNA, 32 nt, Human
ugacugauguuacaucacaguguuugcaaugg

SEQ ID NO: 246393 - RNA, 17 nt, Human
ugacugauguuguguua

SEQ ID NO: 246394 - RNA, 32 nt, Human
ugacugcaaauacaaacacccaggauccuuuc

SEQ ID NO: 246395 - RNA, 32 nt, Human
ugacugcaacuugccuuuuccauuacagaaau

SEQ ID NO: 246396 - RNA, 32 nt, Human
ugacugcaagccccacccuccuugagacugga

SEQ ID NO: 246397 - RNA, 32 nt, Human
ugacugcaaguuggccuggucaggucuugaug

SEQ ID NO: 246398 - RNA, 32 nt, Human
ugacugcaccacugcacagucugggcgacaga

SEQ ID NO: 246399 - RNA, 32 nt, Human
ugacugcaccacugcacuccacccugggcaga

SEQ ID NO: 246400 - RNA, 32 nt, Human
ugacugcaccucaggguugggcucagggcuug

SEQ ID NO: 246401 - RNA, 32 nt, Human
ugacugcagccaugagcagcaaugagugcuuc

SEQ ID NO: 246402 - RNA, 32 nt, Human
ugacugcagccuugaacuccugggcuuaagug

SEQ ID NO: 246403 - RNA, 32 nt, Human
ugacugcagcuccugaggaugggccugcccug

SEQ ID NO: 246404 - RNA, 32 nt, Human
ugacugcagcucucuucauucugccaaccuuu

SEQ ID NO: 246405 - RNA, 32 nt, Human
ugacugcaggggaaggauguacuuuccaaaca

SEQ ID NO: 246406 - RNA, 32 nt, Human
ugacugcauagggcuucauuucccaggcgugg

SEQ ID NO: 246407 - RNA, 32 nt, Human
ugacugcaucacugcacuccagccugggcaac

SEQ ID NO: 246408 - RNA, 32 nt, Human
ugacugcaucucccucuccucugucuucacau

SEQ ID NO: 246409 - RNA, 32 nt, Human
ugacugccaccccugccugccugcccggcccu

SEQ ID NO: 246410 - RNA, 32 nt, Human
ugacugccagcuccagccuggccccggggcag

SEQ ID NO: 246411 - RNA, 32 nt, Human
ugacugccauggggcccuccccugagcacaug

SEQ ID NO: 246412 - RNA, 32 nt, Human
ugacugccggcgucucuccgacugccucucgc

SEQ ID NO: 246413 - RNA, 32 nt, Human
ugacugccggugagcuggacggaacagagcca

SEQ ID NO: 246414 - RNA, 32 nt, Human
ugacugccugcuuucuggaggggagggucugg

SEQ ID NO: 246415 - RNA, 32 nt, Human
ugacugccugucagcuagucucuccaccuugg

SEQ ID NO: 246416 - RNA, 23 nt, Human
ugacugccuuccauccacucuca

SEQ ID NO: 246417 - RNA, 32 nt, Human
ugacugccuuuggaccagccuccaugaucagc

SEQ ID NO: 246418 - RNA, 32 nt, Human
ugacugcgaagcugugccuugccccucuccca

SEQ ID NO: 246419 - RNA, 32 nt, Human
ugacugcgccacugcacuccagucugggacaa

SEQ ID NO: 246420 - RNA, 20 nt, Human
ugacugcggagccugcucca

SEQ ID NO: 246421 - RNA, 31 nt, Human
ugacugcucaauaaauguugguuccugcuga

SEQ ID NO: 246422 - RNA, 32 nt, Human
ugacugcucacugcagccuccaccuccugggc

SEQ ID NO: 246423 - RNA, 32 nt, Human
ugacugcucagucccgcucuccuaccacaccc

SEQ ID NO: 246424 - RNA, 32 nt, Human
ugacugcuccaacuuccugcucucacacacac

SEQ ID NO: 246425 - RNA, 32 nt, Human
ugacugcuccaaugcagcaugugucuucucca

SEQ ID NO: 246426 - RNA, 32 nt, Human
ugacugcucggucaggagggugcaguaucucu

SEQ ID NO: 246427 - RNA, 32 nt, Human
ugacugcucugcccccuagaauguguguauuu

SEQ ID NO: 246428 - RNA, 32 nt, Human
ugacugcucuuuuuccucugucucuuaagugu

SEQ ID NO: 246429 - RNA, 32 nt, Human
ugacugcugcugaacagaggugggccccaggg

SEQ ID NO: 246430 - RNA, 32 nt, Human
ugacugcuucaaccaauggaguacgguggaag

SEQ ID NO: 246431 - RNA, 32 nt, Human
ugacugcuugaaauagucucucucccauggag

SEQ ID NO: 246432 - RNA, 32 nt, Human
ugacugcuuuuaccuuuuucucauguuuauau

SEQ ID NO: 246433 - RNA, 32 nt, Human
ugacuggaaccggggcgguggggugagggugg

SEQ ID NO: 246434 - RNA, 22 nt, Human
ugacuggaaucucuccaccuca

SEQ ID NO: 246435 - RNA, 32 nt, Human
ugacuggaccccaaguggcugcuauguaaauu

SEQ ID NO: 246436 - RNA, 32 nt, Human
ugacuggagccgcggcgacggcggcagcagcu

SEQ ID NO: 246437 - RNA, 32 nt, Human
ugacuggaggaaugugcucugaaggauggcua

SEQ ID NO: 246438 - RNA, 32 nt, Human
ugacuggaggccucgccccaacacuguccuuc

SEQ ID NO: 246439 - RNA, 19 nt, Human
ugacuggaggccuuccaag

SEQ ID NO: 246440 - RNA, 32 nt, Human
ugacuggaggcggagguugcagugagccgaga

SEQ ID NO: 246441 - RNA, 32 nt, Human
ugacuggaggggcaggagaugguccaaguguc

SEQ ID NO: 246442 - RNA, 32 nt, Human
ugacuggcaaauucacuuuuuacucauuuauu

SEQ ID NO: 246443 - RNA, 32 nt, Human
ugacuggcaacauuguacagaggggaaaacug

SEQ ID NO: 246444 - RNA, 32 nt, Human
ugacuggcacaucucagccuaaccaggagagg

SEQ ID NO: 246445 - RNA, 32 nt, Human
ugacuggcaggcaggugaggggcacagcaccc

SEQ ID NO: 246446 - RNA, 32 nt, Human
ugacuggcagggggagaaaguaaacagaguug

SEQ ID NO: 246447 - RNA, 32 nt, Human
ugacuggccugagacucuauaccgggagucuc

SEQ ID NO: 246448 - RNA, 32 nt, Human
ugacugggaaccagagagguugagcagaauuc

SEQ ID NO: 246449 - RNA, 32 nt, Human
ugacugggaagacagacguacccugagaagca

SEQ ID NO: 246450 - RNA, 32 nt, Human
ugacugggaagugccugcaggaaacaagcccu

SEQ ID NO: 246451 - RNA, 32 nt, Human
ugacugggagggcugcugacuccaggcucaga

SEQ ID NO: 246452 - RNA, 32 nt, Human
ugacugggcacugccucugcccccagcaccca

SEQ ID NO: 246453 - RNA, 32 nt, Human
ugacugggcagggcccuggaccccuuuauuug

SEQ ID NO: 246454 - RNA, 32 nt, Human
ugacugggcccacccucuagccacuuucccca

SEQ ID NO: 246455 - RNA, 32 nt, Human
ugacugggccuuucuuucuuuucuucuccucu

SEQ ID NO: 246456 - RNA, 32 nt, Human
ugacuggggaauggggacccuggggagggggc

SEQ ID NO: 246457 - RNA, 32 nt, Human
ugacuggggcagagggacagggaagccagguc

SEQ ID NO: 246458 - RNA, 32 nt, Human
ugacuggggcguccgacuggagcucagccgcg

SEQ ID NO: 246459 - RNA, 17 nt, Human
ugacuggggcugcuccu

SEQ ID NO: 246460 - RNA, 32 nt, Human
ugacugggggccucacgcuuaacugguagugc

SEQ ID NO: 246461 - RNA, 32 nt, Human
ugacuggggugaggcagggucaagugcuacgg

SEQ ID NO: 246462 - RNA, 32 nt, Human
ugacugggugguggcuucacugggcagugcuc

SEQ ID NO: 246463 - RNA, 32 nt, Human
ugacuggguguguguuguguguauguaauaca

SEQ ID NO: 246464 - RNA, 32 nt, Human
ugacuggguuccaaaguugaggccuagguuuu

SEQ ID NO: 246465 - RNA, 32 nt, Human
ugacugguagggcugcucagcauuccgaaaca

SEQ ID NO: 246466 - RNA, 32 nt, Human
ugacuggucaucuggaccaucguacuugcugu

SEQ ID NO: 246467 - RNA, 32 nt, Human
ugacuggucugccuggugccagggugagcgug

SEQ ID NO: 246468 - RNA, 32 nt, Human
ugacugguggaaggaaaaugcacuuagcagua

SEQ ID NO: 246469 - RNA, 32 nt, Human
ugacugguggguuugaaucugcacuuaucccc

SEQ ID NO: 246470 - RNA, 32 nt, Human
ugacugguucauuacccuccccuacucagacu

SEQ ID NO: 246471 - RNA, 32 nt, Human
ugacuguaacugcaccuguggagaguggagag

SEQ ID NO: 246472 - RNA, 32 nt, Human
ugacuguaauuuauaaacuaaaaauuuuuaca

SEQ ID NO: 246473 - RNA, 32 nt, Human
ugacuguagcauucaaggcuugaggcuggagg

SEQ ID NO: 246474 - RNA, 21 nt, Human
ugacuguagcucauaagaccc

SEQ ID NO: 246475 - RNA, 32 nt, Human
ugacuguauauacuauuuuguauccuuucaug

SEQ ID NO: 246476 - RNA, 32 nt, Human
ugacuguauggaggcagguggggagggauccc

SEQ ID NO: 246477 - RNA, 32 nt, Human
ugacuguauuauagcuauauuucugaggcuuu

SEQ ID NO: 246478 - RNA, 31 nt, Human
ugacuguauuucuuugcccuaccucacuaua

SEQ ID NO: 246479 - RNA, 23 nt, Human
ugacuguauuuuccaacuuguuc

SEQ ID NO: 246480 - RNA, 32 nt, Human
ugacugucacccaugagguauggaaggagcgg

SEQ ID NO: 246481 - RNA, 32 nt, Human
ugacugucacucuggcacuaggaggcugaucu

SEQ ID NO: 246482 - RNA, 25 nt, Human
ugacugucagaaccauucugcaacu

SEQ ID NO: 246483 - RNA, 32 nt, Human
ugacugucccauucuccacucacugcauuugg

SEQ ID NO: 246484 - RNA, 32 nt, Human
ugacuguccucucugaggcccagauucccuuu

SEQ ID NO: 246485 - RNA, 32 nt, Human
ugacuguccugaaaaccagaaaagcaaagaaa

SEQ ID NO: 246486 - RNA, 32 nt, Human
ugacugugagauugugugugggaaaauguauu

SEQ ID NO: 246487 - RNA, 32 nt, Human
ugacugugauuguaggggguugcuggguggcc

SEQ ID NO: 246488 - RNA, 32 nt, Human
ugacugugccacugcaccucuagucuggguga

SEQ ID NO: 246489 - RNA, 32 nt, Human
ugacugugccacugcacuccagccuggucaac

SEQ ID NO: 246490 - RNA, 32 nt, Human
ugacugugccaugugguaggacacaggacaca

SEQ ID NO: 246491 - RNA, 32 nt, Human
ugacugugcccuuuagggccuccuggaguuuc

SEQ ID NO: 246492 - RNA, 18 nt, Human
ugacugugcucugugaca

SEQ ID NO: 246493 - RNA, 32 nt, Human
ugacuguggccugcaaccacgagugccaugcu

SEQ ID NO: 246494 - RNA, 23 nt, Human
ugacuguggggaggagcauguca

SEQ ID NO: 246495 - RNA, 31 nt, Human
ugacugugggguccuagaugccaaagggguu

SEQ ID NO: 246496 - RNA, 21 nt, Human
ugacuguguuccucugucaca

SEQ ID NO: 246497 - RNA, 32 nt, Human
ugacuguguuucuccauuuccacagccaaaug

SEQ ID NO: 246498 - RNA, 32 nt, Human
ugacuguguuuuaaaauucucuuucuaaacac

SEQ ID NO: 246499 - RNA, 32 nt, Human
ugacuguuagccagcccugccucuccaggaua

SEQ ID NO: 246500 - RNA, 32 nt, Human
ugacuguuauuucuuuucuuccugcuuuccua

SEQ ID NO: 246501 - RNA, 32 nt, Human
ugacuguucccaaggagaugccacucugcucu

SEQ ID NO: 246502 - RNA, 32 nt, Human
ugacuguuccuuuugccccagcccucucagac

SEQ ID NO: 246503 - RNA, 32 nt, Human
ugacuguugcccaagcuggaaugcaguggcac

SEQ ID NO: 246504 - RNA, 32 nt, Human
ugacuguugcccaggcuggaguguaauggcgc

SEQ ID NO: 246505 - RNA, 32 nt, Human
ugacuguuuccuggcauauaugcaugaauaug

SEQ ID NO: 246506 - RNA, 32 nt, Human
ugacuguuucucuuccucucuuucuuccuuuu

SEQ ID NO: 246507 - RNA, 32 nt, Human
ugacuguuuuggaaggugaagggcuaucagaa

SEQ ID NO: 246508 - RNA, 18 nt, Human
ugacuuaaacuguaaucc

SEQ ID NO: 246509 - RNA, 32 nt, Human
ugacuuaaccaccugacauucacagugucuug

SEQ ID NO: 246510 - RNA, 21 nt, Human
ugacuuacgccuguaaucuca

SEQ ID NO: 246511 - RNA, 32 nt, Human
ugacuuacgccuguaaucucagcacuuuggga

SEQ ID NO: 246512 - RNA, 32 nt, Human
ugacuuacuacuugaaacuuuauuuauugcac

SEQ ID NO: 246513 - RNA, 32 nt, Human
ugacuuacugccucugagccuuggcuuucugu

SEQ ID NO: 246514 - RNA, 32 nt, Human
ugacuuacuguacaugaauuacacaauaauga

SEQ ID NO: 246515 - RNA, 32 nt, Human
ugacuuacuuccacggugacucuggcuguugc

SEQ ID NO: 246516 - RNA, 32 nt, Human
ugacuuaggaacaguuucagucugaccuuguc

SEQ ID NO: 246517 - RNA, 32 nt, Human
ugacuuaggaaucauuuuauguacuuguucua

SEQ ID NO: 246518 - RNA, 32 nt, Human
ugacuuaggcagaggagugcagaggagggucu

SEQ ID NO: 246519 - RNA, 32 nt, Human
ugacuuaguggaauugggucgaaggaguggag

SEQ ID NO: 246520 - RNA, 32 nt, Human
ugacuuauaaauaauugaagcugcaguauauu

SEQ ID NO: 246521 - RNA, 21 nt, Human
ugacuuauaccauaaugccca

SEQ ID NO: 246522 - RNA, 21 nt, Human
ugacuuaucgagcugcucccu

SEQ ID NO: 246523 - RNA, 32 nt, Human
ugacuuauuccagagugccucaguuaggggaa

SEQ ID NO: 246524 - RNA, 18 nt, Human
ugacuuauugcaauccca

SEQ ID NO: 246525 - RNA, 32 nt, Human
ugacuucaaaccugugugucaaugcagaaggu

SEQ ID NO: 246526 - RNA, 19 nt, Human
ugacuucaaacugagagca

SEQ ID NO: 246527 - RNA, 32 nt, Human
ugacuucaaagaaggaaggaaagaaucaggca

SEQ ID NO: 246528 - RNA, 32 nt, Human
ugacuucaaaggcagagaccgacaaaauagag

SEQ ID NO: 246529 - RNA, 19 nt, Human
ugacuucaaaggcagcagc

SEQ ID NO: 246530 - RNA, 32 nt, Human
ugacuucaaaguugccuggugaaggaagauaa

SEQ ID NO: 246531 - RNA, 19 nt, Human
ugacuucaagggucacagc

SEQ ID NO: 246532 - RNA, 26 nt, Human
ugacuucaagugauccacccgccuca

SEQ ID NO: 246533 - RNA, 26 nt, Human
ugacuucaagugauccaccugucuua

SEQ ID NO: 246534 - RNA, 32 nt, Human
ugacuucacagaaucccuaagcuccauaaauc

SEQ ID NO: 246535 - RNA, 32 nt, Human
ugacuucaccucaguuuugugauccguaaaau

SEQ ID NO: 246536 - RNA, 32 nt, Human
ugacuucaccucugcucaucucaguuuccuaa

SEQ ID NO: 246537 - RNA, 19 nt, Human
ugacuucacuggacacagc

SEQ ID NO: 246538 - RNA, 32 nt, Human
ugacuucagacacagaagucuguccauggcuc

SEQ ID NO: 246539 - RNA, 32 nt, Human
ugacuucagcaguggcagguguuuucagcuug

SEQ ID NO: 246540 - RNA, 19 nt, Human
ugacuucagcccaccagca

SEQ ID NO: 246541 - RNA, 32 nt, Human
ugacuucagccuggaaauugcuugccuuuuaa

SEQ ID NO: 246542 - RNA, 19 nt, Human
ugacuucagggacagagca

SEQ ID NO: 246543 - RNA, 25 nt, Human
ugacuucaggugacccacccgccuc

SEQ ID NO: 246544 - RNA, 25 nt, Human
ugacuucaggugauccacccgccuc

SEQ ID NO: 246545 - RNA, 25 nt, Human
ugacuucaggugauccgccuaccuu

SEQ ID NO: 246546 - RNA, 32 nt, Human
ugacuucauccugucauuccagccuggggucu

SEQ ID NO: 246547 - RNA, 23 nt, Human
ugacuucaugauccacccaccuc

SEQ ID NO: 246548 - RNA, 23 nt, Human
ugacuucaugauccacccaccuu

SEQ ID NO: 246549 - RNA, 32 nt, Human
ugacuucaugauuugcacauuuggagggcuua

SEQ ID NO: 246550 - RNA, 32 nt, Human
ugacuucauggaugaggaaccuggagaccaaa

SEQ ID NO: 246551 - RNA, 24 nt, Human
ugacuucaugguccgccugccuca

SEQ ID NO: 246552 - RNA, 25 nt, Human
ugacuucaugugauccgccagccuc

SEQ ID NO: 246553 - RNA, 22 nt, Human
ugacuuccauagacacacagca

SEQ ID NO: 246554 - RNA, 32 nt, Human
ugacuucccagaaugcagugggcugcugggca

SEQ ID NO: 246555 - RNA, 20 nt, Human
ugacuuccccacugcucucu

SEQ ID NO: 246556 - RNA, 32 nt, Human
ugacuuccuacagccaaauccccagaggccaa

SEQ ID NO: 246557 - RNA, 32 nt, Human
ugacuuccuagccuguggauaauuuacuauua

SEQ ID NO: 246558 - RNA, 32 nt, Human
ugacuuccucaccuacaacugccucacgaaug

SEQ ID NO: 246559 - RNA, 32 nt, Human
ugacuuccucgggcucuucaggagacugagac

SEQ ID NO: 246560 - RNA, 32 nt, Human
ugacuuccugaggugugaucuguccaccuuga

SEQ ID NO: 246561 - RNA, 32 nt, Human
ugacuucgaguaagccacccagcuuuucuugg

SEQ ID NO: 246562 - RNA, 23 nt, Human
ugacuucguuauccacccgccuc

SEQ ID NO: 246563 - RNA, 27 nt, Human
ugacuucuaccucccauguuugcucuc

SEQ ID NO: 246564 - RNA, 25 nt, Human
ugacuucucaggacugacaccuaca

SEQ ID NO: 246565 - RNA, 32 nt, Human
ugacuucucauccccgaguucuuucaggccaa

SEQ ID NO: 246566 - RNA, 32 nt, Human
ugacuucucccagcgcagaugagaggucaaaa

SEQ ID NO: 246567 - RNA, 23 nt, Human
ugacuucugaagaugacugccuc

SEQ ID NO: 246568 - RNA, 22 nt, Human
ugacuucugacauuccacuuuc

SEQ ID NO: 246569 - RNA, 19 nt, Human
ugacuucugaucuuugucu

SEQ ID NO: 246570 - RNA, 32 nt, Human
ugacuucugcucccaguaacccaucguuaggg

SEQ ID NO: 246571 - RNA, 32 nt, Human
ugacuucugcucccucacuagcuuuuccacca

SEQ ID NO: 246572 - RNA, 32 nt, Human
ugacuucugcucccucccuagcuuuuccacca

SEQ ID NO: 246573 - RNA, 32 nt, Human
ugacuucuggcuggccagaggcugcgguccgu

SEQ ID NO: 246574 - RNA, 32 nt, Human
ugacuucugggaacugcuuugcauuucuccua

SEQ ID NO: 246575 - RNA, 32 nt, Human
ugacuucugggaagccacccaggucucauucc

SEQ ID NO: 246576 - RNA, 23 nt, Human
ugacuucuguguuagccaucuua

SEQ ID NO: 246577 - RNA, 32 nt, Human
ugacuucuucuagcccugcacucugucacuua

SEQ ID NO: 246578 - RNA, 32 nt, Human
ugacuucuuguggcauuucacacacuguagau

SEQ ID NO: 246579 - RNA, 32 nt, Human
ugacuugaaaguuuucuuugguauaugugcau

SEQ ID NO: 246580 - RNA, 32 nt, Human
ugacuugaaauaguaacaccaaacaugauuau

SEQ ID NO: 246581 - RNA, 32 nt, Human
ugacuugacauguccaauuucauuucagaaua

SEQ ID NO: 246582 - RNA, 32 nt, Human
ugacuugacuccuguggcuucuggaccccucc

SEQ ID NO: 246583 - RNA, 32 nt, Human
ugacuugagcccaggaguuggaggccacagug

SEQ ID NO: 246584 - RNA, 31 nt, Human
ugacuugagguguugggaugggugagggagc

SEQ ID NO: 246585 - RNA, 21 nt, Human
ugacuugcaccuguaauccca

SEQ ID NO: 246586 - RNA, 32 nt, Human
ugacuugccuaagauuacacagcuaguuuaug

SEQ ID NO: 246587 - RNA, 32 nt, Human
ugacuugcucaaguucaccagcaugguagugg

SEQ ID NO: 246588 - RNA, 32 nt, Human
ugacuugcuuuuuccugccuccuuccucuccu

SEQ ID NO: 246589 - RNA, 32 nt, Human
ugacuuggaauugaaccaggaggacuuuucag

SEQ ID NO: 246590 - RNA, 30 nt, Human
ugacuuggacucuccauuccucugccugua

SEQ ID NO: 246591 - RNA, 32 nt, Human
ugacuuggaguuuccagcaggguggugugcac

SEQ ID NO: 246592 - RNA, 32 nt, Human
ugacuuggcagacugguguuguucaucgcagu

SEQ ID NO: 246593 - RNA, 32 nt, Human
ugacuuggcccccacagagagagguccuacag

SEQ ID NO: 246594 - RNA, 32 nt, Human
ugacuuggcgugggacacaggacaagaucacu

SEQ ID NO: 246595 - RNA, 32 nt, Human
ugacuuggcuuccugugaucugcauucaugaa

SEQ ID NO: 246596 - RNA, 32 nt, Human
ugacuugggaggcugaggcaggagaaucgcuu

SEQ ID NO: 246597 - RNA, 32 nt, Human
ugacuugggaugacauauuacaugcuguaguu

SEQ ID NO: 246598 - RNA, 17 nt, Human
ugacuugggcugauccc

SEQ ID NO: 246599 - RNA, 32 nt, Human
ugacuugguccugguggggcgugcugggacua

SEQ ID NO: 246600 - RNA, 32 nt, Human
ugacuugguggccaauaccugccuuccaaaga

SEQ ID NO: 246601 - RNA, 32 nt, Human
ugacuugguuaguaggaacuacccaggaaugu

SEQ ID NO: 246602 - RNA, 21 nt, Human
ugacuuguaacuguaauccca

SEQ ID NO: 246603 - RNA, 32 nt, Human
ugacuuguauuuuuaaaaauugcucacauaaa

SEQ ID NO: 246604 - RNA, 19 nt, Human
ugacuugucagugucugug

SEQ ID NO: 246605 - RNA, 32 nt, Human
ugacuugugagugggguuuauggggaaaggga

SEQ ID NO: 246606 - RNA, 32 nt, Human
ugacuugugugugcugauguguuuccauuugu

SEQ ID NO: 246607 - RNA, 32 nt, Human
ugacuuguuauagaagauuaaaacuagauuug

SEQ ID NO: 246608 - RNA, 32 nt, Human
ugacuuguucaguaaauuccaauaugaauaaa

SEQ ID NO: 246609 - RNA, 32 nt, Human
ugacuuuaaauugucaccaauugaaaaucuug

SEQ ID NO: 246610 - RNA, 32 nt, Human
ugacuuuaaucagcuugaacugccagugcacc

SEQ ID NO: 246611 - RNA, 32 nt, Human
ugacuuuaccauugaccaccagucuugcucuc

SEQ ID NO: 246612 - RNA, 32 nt, Human
ugacuuuaccugcacacaagcuuacaugugcc

SEQ ID NO: 246613 - RNA, 32 nt, Human
ugacuuuacuaaucaguuguucuaagugugaa

SEQ ID NO: 246614 - RNA, 32 nt, Human
ugacuuuagaaaaugcugauuugagaacaaaa

SEQ ID NO: 246615 - RNA, 25 nt, Human
ugacuuuagguaaucugcccgccuc

SEQ ID NO: 246616 - RNA, 26 nt, Human
ugacuuuaggugauccacacgccuca

SEQ ID NO: 246617 - RNA, 21 nt, Human
ugacuuuauauggcugcuccu

SEQ ID NO: 246618 - RNA, 32 nt, Human
ugacuuuaucuaggaguuuguuuuucauuuug

SEQ ID NO: 246619 - RNA, 26 nt, Human
ugacuuuaugcaagucacucaccuca

SEQ ID NO: 246620 - RNA, 32 nt, Human
ugacuuucacccaggaggaguggggccagcug

SEQ ID NO: 246621 - RNA, 20 nt, Human
ugacuuucacguccacagug

SEQ ID NO: 246622 - RNA, 24 nt, Human
ugacuuucagaacuucucaccuca

SEQ ID NO: 246623 - RNA, 21 nt, Human
ugacuuuccagccucuucaac

SEQ ID NO: 246624 - RNA, 32 nt, Human
ugacuuucccuaggcugagggcaguggacccu

SEQ ID NO: 246625 - RNA, 32 nt, Human
ugacuuucccuguccugaggcuugccuccacu

SEQ ID NO: 246626 - RNA, 32 nt, Human
ugacuuuccugagaucuacccggggcuuggcu

SEQ ID NO: 246627 - RNA, 32 nt, Human
ugacuuuccuucccuuucacaugaggaucugc

SEQ ID NO: 246628 - RNA, 32 nt, Human
ugacuuuccuuuuuauuuagucuuccagcucu

SEQ ID NO: 246629 - RNA, 32 nt, Human
ugacuuucucccaccaguaauugaaaugaggu

SEQ ID NO: 246630 - RNA, 32 nt, Human
ugacuuucuccuccaaccuccaucagucccag

SEQ ID NO: 246631 - RNA, 32 nt, Human
ugacuuucucucucgauucuuccauacucaga

SEQ ID NO: 246632 - RNA, 32 nt, Human
ugacuuucugaccaaggaggugaugguggaug

SEQ ID NO: 246633 - RNA, 22 nt, Human
ugacuuucugacccauccaccu

SEQ ID NO: 246634 - RNA, 32 nt, Human
ugacuuucugaggaguugacaaggucacugcc

SEQ ID NO: 246635 - RNA, 32 nt, Human
ugacuuucuuacuacuugcaguagccuguccc

SEQ ID NO: 246636 - RNA, 32 nt, Human
ugacuuugaaaaucaucucuuuuucucaagaa

SEQ ID NO: 246637 - RNA, 21 nt, Human
ugacuuugaggccuuaccuua

SEQ ID NO: 246638 - RNA, 21 nt, Human
ugacuuugcagggcucacaga

SEQ ID NO: 246639 - RNA, 20 nt, Human
ugacuuugcccauagaccaa

SEQ ID NO: 246640 - RNA, 22 nt, Human
ugacuuugcuucuucacuccca

SEQ ID NO: 246641 - RNA, 32 nt, Human
ugacuuuggaagggcaggcucuuguccaguuu

SEQ ID NO: 246642 - RNA, 24 nt, Human
ugacuuuggaguucacuccaauca

SEQ ID NO: 246643 - RNA, 24 nt, Human
ugacuuuggcagacccccauuuca

SEQ ID NO: 246644 - RNA, 32 nt, Human
ugacuuugggcagagggugggacagggaccuu

SEQ ID NO: 246645 - RNA, 32 nt, Human
ugacuuuggugggcaucaucagcuggggccug

SEQ ID NO: 246646 - RNA, 22 nt, Human
ugacuuuguacaugucaccuca

SEQ ID NO: 246647 - RNA, 25 nt, Human
ugacuuuguacugggcccacacuca

SEQ ID NO: 246648 - RNA, 21 nt, Human
ugacuuuguauauucaucuua

SEQ ID NO: 246649 - RNA, 22 nt, Human
ugacuuugucaggucagccuca

SEQ ID NO: 246650 - RNA, 22 nt, Human
ugacuuugugaccccuaguuua

SEQ ID NO: 246651 - RNA, 20 nt, Human
ugacuuugugccauauccca

SEQ ID NO: 246652 - RNA, 21 nt, Human
ugacuuuguuaaccguucccu

SEQ ID NO: 246653 - RNA, 32 nt, Human
ugacuuuuaaggcuccuccuauuaugagacuu

SEQ ID NO: 246654 - RNA, 32 nt, Human
ugacuuuucacucaaaucuauaugugccaguu

SEQ ID NO: 246655 - RNA, 32 nt, Human
ugacuuuucagccacaauuacaugucaucauu

SEQ ID NO: 246656 - RNA, 32 nt, Human
ugacuuuuccuucaaucucuucccaaggcuga

SEQ ID NO: 246657 - RNA, 22 nt, Human
ugacuuuucucucuuauaccaa

SEQ ID NO: 246658 - RNA, 32 nt, Human
ugacuuuucugaguuauuuauguacuuaaaau

SEQ ID NO: 246659 - RNA, 32 nt, Human
ugacuuuucuucauauuuugcaaagagaaauu

SEQ ID NO: 246660 - RNA, 20 nt, Human
ugacuuuucuucugcucucu

SEQ ID NO: 246661 - RNA, 32 nt, Human
ugacuuuugauaggccaugccuugccacuuua

SEQ ID NO: 246662 - RNA, 28 nt, Human
ugacuuuugcauauggucucuuaccuca

SEQ ID NO: 246663 - RNA, 32 nt, Human
ugacuuuuguaauccaggaauuuggaacuacu

SEQ ID NO: 246664 - RNA, 32 nt, Human
ugacuuuugugccuuucugcuccagucucaaa

SEQ ID NO: 246665 - RNA, 32 nt, Human
ugacuuuuucccccucucccuccccaauggcu

SEQ ID NO: 246666 - RNA, 32 nt, Human
ugacuuuuuccugccuacuaucuugauccuag

SEQ ID NO: 246667 - RNA, 32 nt, Human
ugacuuuuuccugguggagugugacggaggca

SEQ ID NO: 246668 - RNA, 32 nt, Human
ugacuuuuugcacuucuguauauagucaaaag

SEQ ID NO: 246669 - RNA, 32 nt, Human
ugagaaaaacauuugaucuuuuuaaagggaaa

SEQ ID NO: 246670 - RNA, 32 nt, Human
ugagaaaaaggagucgucuuaccgguuucugu

SEQ ID NO: 246671 - RNA, 32 nt, Human
ugagaaaaaggcagcccuccagauuuuguaga

SEQ ID NO: 246672 - RNA, 32 nt, Human
ugagaaaaagguccagggggccaaggugacug

SEQ ID NO: 246673 - RNA, 21 nt, Human
ugagaaaaauaaaggcguuca

SEQ ID NO: 246674 - RNA, 32 nt, Human
ugagaaaaaugguuccaccaaaguauucaaaa

SEQ ID NO: 246675 - RNA, 22 nt, Human
ugagaaaaccaagucuccaagg

SEQ ID NO: 246676 - RNA, 32 nt, Human
ugagaaaaccauuucagaagccuggauuaagg

SEQ ID NO: 246677 - RNA, 32 nt, Human
ugagaaaacucuuuggugcuucugccuuuagu

SEQ ID NO: 246678 - RNA, 32 nt, Human
ugagaaaacugagaggugaggugacuugccug

SEQ ID NO: 246679 - RNA, 32 nt, Human
ugagaaaagguuguaggaugugucacaagaga

SEQ ID NO: 246680 - RNA, 22 nt, Human
ugagaaaaucaguccauaaagg

SEQ ID NO: 246681 - RNA, 32 nt, Human
ugagaaaaugcacaaagcccugggagaugaca

SEQ ID NO: 246682 - RNA, 32 nt, Human
ugagaaacacuccaaaucuaaacacaccagga

SEQ ID NO: 246683 - RNA, 32 nt, Human
ugagaaacggaggaggaggaggguuugcuuga

SEQ ID NO: 246684 - RNA, 32 nt, Human
ugagaaacuucuagaaccucaggaagcugcag

SEQ ID NO: 246685 - RNA, 32 nt, Human
ugagaaagaaaaauuuuaaaaagggaggaaau

SEQ ID NO: 246686 - RNA, 32 nt, Human
ugagaaagaagaggaagauaaagaugacgaag

SEQ ID NO: 246687 - RNA, 23 nt, Human
ugagaaagaauggaucccugcag

SEQ ID NO: 246688 - RNA, 18 nt, Human
ugagaaagagucuugcuc

SEQ ID NO: 246689 - RNA, 31 nt, Human
ugagaaagcaagacaucaaggagggaccugu

SEQ ID NO: 246690 - RNA, 32 nt, Human
ugagaaagccuaggaucuuucuccccagagag

SEQ ID NO: 246691 - RNA, 32 nt, Human
ugagaaagccuucugccuucugucauuggaua

SEQ ID NO: 246692 - RNA, 32 nt, Human
ugagaaaggaacccgugggaagaaggagcacg

SEQ ID NO: 246693 - RNA, 32 nt, Human
ugagaaaggcaaagcauuugucugaaagcgaa

SEQ ID NO: 246694 - RNA, 21 nt, Human
ugagaaagggaggauggggag

SEQ ID NO: 246695 - RNA, 32 nt, Human
ugagaaaggugaaaugaaaacaagcucaaaac

SEQ ID NO: 246696 - RNA, 24 nt, Human
ugagaaagguuguuuuccaguaaa

SEQ ID NO: 246697 - RNA, 32 nt, Human
ugagaaagucacagauauauuucuccaagaaa

SEQ ID NO: 246698 - RNA, 21 nt, Human
ugagaaauaaucuugcucugu

SEQ ID NO: 246699 - RNA, 32 nt, Human
ugagaaauacaaaaauacucagauaagguaaa

SEQ ID NO: 246700 - RNA, 32 nt, Human
ugagaaauacgaccccacagacugcgagacug

SEQ ID NO: 246701 - RNA, 32 nt, Human
ugagaaaugaaagaaguagagagagaauuaaa

SEQ ID NO: 246702 - RNA, 32 nt, Human
ugagaaaugccuguucagcuacuuugcccaug

SEQ ID NO: 246703 - RNA, 21 nt, Human
ugagaaauguauuccuggagg

SEQ ID NO: 246704 - RNA, 32 nt, Human
ugagaaaugucuuuaguucagugagaagaaac

SEQ ID NO: 246705 - RNA, 32 nt, Human
ugagaaauuagacuguaccuguguacacuucu

SEQ ID NO: 246706 - RNA, 32 nt, Human
ugagaaauugcacccccagcuggcagagaaga

SEQ ID NO: 246707 - RNA, 32 nt, Human
ugagaaauuucugugcuuccaauccacaauga

SEQ ID NO: 246708 - RNA, 32 nt, Human
ugagaacaaaggagggaccugagguggagaga

SEQ ID NO: 246709 - RNA, 32 nt, Human
ugagaacaaauacccacccauuuccaccaugg

SEQ ID NO: 246710 - RNA, 32 nt, Human
ugagaacaaccaaagaaggccugcucuuugcu

SEQ ID NO: 246711 - RNA, 32 nt, Human
ugagaacaaccacaccaccaaaugucacaccu

SEQ ID NO: 246712 - RNA, 32 nt, Human
ugagaacacaagugagccaguccugguucuuc

SEQ ID NO: 246713 - RNA, 32 nt, Human
ugagaacacgccauugcacucaagccugggca

SEQ ID NO: 246714 - RNA, 32 nt, Human
ugagaacacuuaaaauugucucuuuuagaaau

SEQ ID NO: 246715 - RNA, 32 nt, Human
ugagaacagaaagagaggguggaggggcugua

SEQ ID NO: 246716 - RNA, 32 nt, Human
ugagaacagcaugggggacacugcccccauga

SEQ ID NO: 246717 - RNA, 32 nt, Human
ugagaacaggaaaaaggaagaggacacuggaa

SEQ ID NO: 246718 - RNA, 32 nt, Human
ugagaacaggcuuuugauaaacucacgaauuc

SEQ ID NO: 246719 - RNA, 32 nt, Human
ugagaacaggucauugcacucaagccugggca

SEQ ID NO: 246720 - RNA, 32 nt, Human
ugagaacaguaauggaaaaugguguugaagga

SEQ ID NO: 246721 - RNA, 32 nt, Human
ugagaacaucucugccuaauuuaccaaagcca

SEQ ID NO: 246722 - RNA, 31 nt, Human
ugagaacaugguucuuuacauauaaaucugc

SEQ ID NO: 246723 - RNA, 32 nt, Human
ugagaaccaaugaguuuuagggauguuugugc

SEQ ID NO: 246724 - RNA, 32 nt, Human
ugagaaccagaugcugucugguggguuagggc

SEQ ID NO: 246725 - RNA, 32 nt, Human
ugagaaccagccagaagcaugcagugacauug

SEQ ID NO: 246726 - RNA, 32 nt, Human
ugagaaccagggccgugacaccagaggggccu

SEQ ID NO: 246727 - RNA, 32 nt, Human
ugagaacccagccagucaggaagucgcuacuu

SEQ ID NO: 246728 - RNA, 32 nt, Human
ugagaacccauguauggguugcagugagccga

SEQ ID NO: 246729 - RNA, 32 nt, Human
ugagaacccauugggaccgagccuggggagca

SEQ ID NO: 246730 - RNA, 32 nt, Human
ugagaacccuccugcuguuacggaggcagcac

SEQ ID NO: 246731 - RNA, 32 nt, Human
ugagaacccucucucugcucacgaggcaggag

SEQ ID NO: 246732 - RNA, 32 nt, Human
ugagaaccucaaggaggaccuggucuaccuga

SEQ ID NO: 246733 - RNA, 32 nt, Human
ugagaaccucaaggaggagcuggccuaccuga

SEQ ID NO: 246734 - RNA, 32 nt, Human
ugagaaccugcagccauuucuuguuacaugaa

SEQ ID NO: 246735 - RNA, 32 nt, Human
ugagaacgggccaugugacaauggcgguuuug

SEQ ID NO: 246736 - RNA, 21 nt, Human
ugagaacgguuugucccugga

SEQ ID NO: 246737 - RNA, 32 nt, Human
ugagaacuagaguccucauccccaggcuugaa

SEQ ID NO: 246738 - RNA, 32 nt, Human
ugagaacuagcaccucugaaaaguaaaaugau

SEQ ID NO: 246739 - RNA, 32 nt, Human
ugagaacuagcccuagaccucugcgugagggu

SEQ ID NO: 246740 - RNA, 32 nt, Human
ugagaacuauguggagagaggcugcgagcccu

SEQ ID NO: 246741 - RNA, 32 nt, Human
ugagaacuauuuaaagacgcaaucccagguuc

SEQ ID NO: 246742 - RNA, 32 nt, Human
ugagaacucaaaggguuacaaguugcugccac

SEQ ID NO: 246743 - RNA, 32 nt, Human
ugagaacucaccauugcacuccagccuggaug

SEQ ID NO: 246744 - RNA, 32 nt, Human
ugagaacucaggcuggcacagggauucccagg

SEQ ID NO: 246745 - RNA, 32 nt, Human
ugagaacucauuuucuacccugccucgucuua

SEQ ID NO: 246746 - RNA, 32 nt, Human
ugagaacuccacugucagucuaauugucguua

SEQ ID NO: 246747 - RNA, 32 nt, Human
ugagaacuccuuccucccuuugaagaucuguc

SEQ ID NO: 246748 - RNA, 32 nt, Human
ugagaacucuccccuucuucccucucucaucc

SEQ ID NO: 246749 - RNA, 32 nt, Human
ugagaacugggcagacaccccuggagcucagc

SEQ ID NO: 246750 - RNA, 32 nt, Human
ugagaacuggggccuccugcucccagggagcu

SEQ ID NO: 246751 - RNA, 32 nt, Human
ugagaacugucuuuuaaaauugaucacaacga

SEQ ID NO: 246752 - RNA, 32 nt, Human
ugagaacuucuugggaauagagucuaggcccc

SEQ ID NO: 246753 - RNA, 32 nt, Human
ugagaacuugccaaccagggauuaaagcuauu

SEQ ID NO: 246754 - RNA, 32 nt, Human
ugagaacuuguuucuuuucuaaucucugggcc

SEQ ID NO: 246755 - RNA, 32 nt, Human
ugagaagaaagccagacuuaagggauguuggc

SEQ ID NO: 246756 - RNA, 32 nt, Human
ugagaagaaauccaaucucaguccuggauuga

SEQ ID NO: 246757 - RNA, 32 nt, Human
ugagaagaaauccuuggaucucuuuucuuaaa

SEQ ID NO: 246758 - RNA, 32 nt, Human
ugagaagaacacggugcugggcuuucggguuc

SEQ ID NO: 246759 - RNA, 32 nt, Human
ugagaagacaugaacguuuucucuucaccgcc

SEQ ID NO: 246760 - RNA, 32 nt, Human
ugagaagaccuaaacuccuggccaucaucucu

SEQ ID NO: 246761 - RNA, 32 nt, Human
ugagaagacuccugggcuucagccucucccac

SEQ ID NO: 246762 - RNA, 32 nt, Human
ugagaagagaugaccucaucugucucaugcuc

SEQ ID NO: 246763 - RNA, 32 nt, Human
ugagaagagcagagaugaagggugggaccuga

SEQ ID NO: 246764 - RNA, 32 nt, Human
ugagaagaggcagaggaagggcgaaacauggc

SEQ ID NO: 246765 - RNA, 32 nt, Human
ugagaagaucagugagcugggggcuggcaaug

SEQ ID NO: 246766 - RNA, 32 nt, Human
ugagaagaugcgguggcugccuauguucucag

SEQ ID NO: 246767 - RNA, 32 nt, Human
ugagaagauggacaagcucugcucagaacaaa

SEQ ID NO: 246768 - RNA, 32 nt, Human
ugagaagauggagaacacagaggcagagaaag

SEQ ID NO: 246769 - RNA, 32 nt, Human
ugagaagcaaucagcugccauccugcccucca

SEQ ID NO: 246770 - RNA, 32 nt, Human
ugagaagcaccugccagcaacagcuuccuucu

SEQ ID NO: 246771 - RNA, 22 nt, Human
ugagaagcacugcuccuggagg

SEQ ID NO: 246772 - RNA, 32 nt, Human
ugagaagcagagccagcaaagcccgggaccug

SEQ ID NO: 246773 - RNA, 32 nt, Human
ugagaagcaguuaacccagaggccaggagccu

SEQ ID NO: 246774 - RNA, 32 nt, Human
ugagaagccaaggacaccgagucagucauggc

SEQ ID NO: 246775 - RNA, 32 nt, Human
ugagaagccagcccguagugccucccgaagga

SEQ ID NO: 246776 - RNA, 32 nt, Human
ugagaagccagccucagaccuuagcuugaagc

SEQ ID NO: 246777 - RNA, 32 nt, Human
ugagaagcccugguuuccccaaagaagugacu

SEQ ID NO: 246778 - RNA, 32 nt, Human
ugagaagccguuucauuuuauuucucacugua

SEQ ID NO: 246779 - RNA, 32 nt, Human
ugagaagcuacugcuaucugcugcucugggaa

SEQ ID NO: 246780 - RNA, 32 nt, Human
ugagaagcucacuucacccucuccccaugcca

SEQ ID NO: 246781 - RNA, 32 nt, Human
ugagaagcucuucgaaacauuuuaugguaagg

SEQ ID NO: 246782 - RNA, 32 nt, Human
ugagaagcuggaggaggagggggaagaggagu

SEQ ID NO: 246783 - RNA, 32 nt, Human
ugagaagcugugcagcugccgcugggugcacc

SEQ ID NO: 246784 - RNA, 32 nt, Human
ugagaagcuucucuagacuuggcuccaaacau

SEQ ID NO: 246785 - RNA, 32 nt, Human
ugagaagcuuugaccuugaagggcuucuggga

SEQ ID NO: 246786 - RNA, 17 nt, Human
ugagaaggaacugugau

SEQ ID NO: 246787 - RNA, 32 nt, Human
ugagaaggaacuuccagguguuacuguaauuc

SEQ ID NO: 246788 - RNA, 32 nt, Human
ugagaaggagccaccagcuggaggaaaggggc

SEQ ID NO: 246789 - RNA, 32 nt, Human
ugagaaggagcugugguucugaccuucagggg

SEQ ID NO: 246790 - RNA, 32 nt, Human
ugagaaggagguuuaaggcaaguagacaacau

SEQ ID NO: 246791 - RNA, 21 nt, Human
ugagaaggagucucgcgcugu

SEQ ID NO: 246792 - RNA, 21 nt, Human
ugagaaggagucuugcucugu

SEQ ID NO: 246793 - RNA, 32 nt, Human
ugagaaggagucuugcucuguugcccacauug

SEQ ID NO: 246794 - RNA, 32 nt, Human
ugagaaggcagagagaagaaagcagacaggaa

SEQ ID NO: 246795 - RNA, 32 nt, Human
ugagaagggaaaaaggaaagaaaaauugaggg

SEQ ID NO: 246796 - RNA, 32 nt, Human
ugagaagggaaggcagaugggagaagccaaug

SEQ ID NO: 246797 - RNA, 32 nt, Human
ugagaagggagaagacagaggagaaugccaga

SEQ ID NO: 246798 - RNA, 32 nt, Human
ugagaagggagagagagcuagagggacaaaga

SEQ ID NO: 246799 - RNA, 32 nt, Human
ugagaagggcggcagaggcaguggggcuggcu

SEQ ID NO: 246800 - RNA, 32 nt, Human
ugagaaggggcagcacgauuggcgcuccagcu

SEQ ID NO: 246801 - RNA, 32 nt, Human
ugagaagguuugcaugcucagagcagagaagg

SEQ ID NO: 246802 - RNA, 32 nt, Human
ugagaagucaacacacugaggauggagagaaa

SEQ ID NO: 246803 - RNA, 32 nt, Human
ugagaagucacugcuuuggggagaccugaucu

SEQ ID NO: 246804 - RNA, 32 nt, Human
ugagaagucaguccaaggagguauguucuucc

SEQ ID NO: 246805 - RNA, 32 nt, Human
ugagaaguccaaggaaugagccuuggaccacu

SEQ ID NO: 246806 - RNA, 32 nt, Human
ugagaagucuaagagaagcucuaagacguuua

SEQ ID NO: 246807 - RNA, 32 nt, Human
ugagaagucugccaagucuaaggagauguccc

SEQ ID NO: 246808 - RNA, 32 nt, Human
ugagaagucuucgugcuucagauuuguuuacc

SEQ ID NO: 246809 - RNA, 32 nt, Human
ugagaauacuccuugguuuucucugaagccca

SEQ ID NO: 246810 - RNA, 32 nt, Human
ugagaauagaaggaaacuagcuuacaugagaa

SEQ ID NO: 246811 - RNA, 32 nt, Human
ugagaauaggaguucaagaccagccugggcaa

SEQ ID NO: 246812 - RNA, 32 nt, Human
ugagaauauuguugcugcucuuuuggagacaa

SEQ ID NO: 246813 - RNA, 20 nt, Human
ugagaaucagagagcauaau

SEQ ID NO: 246814 - RNA, 32 nt, Human
ugagaaucauacaagccccgcuacagacaaca

SEQ ID NO: 246815 - RNA, 32 nt, Human
ugagaauccaauuagucuucugaaccaccuuu

SEQ ID NO: 246816 - RNA, 24 nt, Human
ugagaaugaaagcuuaggcugcuu

SEQ ID NO: 246817 - RNA, 32 nt, Human
ugagaaugaaguauuaagauccaauuucuaua

SEQ ID NO: 246818 - RNA, 32 nt, Human
ugagaaugagcagcugcaggagcacugcgcca

SEQ ID NO: 246819 - RNA, 32 nt, Human
ugagaaugagcccagaggcuuguuuggggacu

SEQ ID NO: 246820 - RNA, 32 nt, Human
ugagaaugaguguggauguguacaguacacgc

SEQ ID NO: 246821 - RNA, 32 nt, Human
ugagaaugagugugugugagugaggcgguauc

SEQ ID NO: 246822 - RNA, 32 nt, Human
ugagaaugaugauacagucugagcuacuggca

SEQ ID NO: 246823 - RNA, 32 nt, Human
ugagaaugccagaucuguggcugucuucauuc

SEQ ID NO: 246824 - RNA, 32 nt, Human
ugagaaugccuagcaaaguccucaacuuacuu

SEQ ID NO: 246825 - RNA, 32 nt, Human
ugagaauggggucccagauggcucaggcugug

SEQ ID NO: 246826 - RNA, 32 nt, Human
ugagaauguuucucagccucccccuuuacaga

SEQ ID NO: 246827 - RNA, 32 nt, Human
ugagaauuaucaccaugacaccugccauaccg

SEQ ID NO: 246828 - RNA, 32 nt, Human
ugagaauucauuuugaucuguaucuacaccac

SEQ ID NO: 246829 - RNA, 32 nt, Human
ugagaauucuuuuguuuauaagcuaccagucu

SEQ ID NO: 246830 - RNA, 32 nt, Human
ugagaauugguaccuacaacagucuauuugcu

SEQ ID NO: 246831 - RNA, 32 nt, Human
ugagacaaaccugccuuugcagggaaaguguc

SEQ ID NO: 246832 - RNA, 32 nt, Human
ugagacaaaccugggagccuccugacacggag

SEQ ID NO: 246833 - RNA, 21 nt, Human
ugagacaaagucucgcacugu

SEQ ID NO: 246834 - RNA, 21 nt, Human
ugagacaaagucucgcucugu

SEQ ID NO: 246835 - RNA, 19 nt, Human
ugagacaaaguuucgcucu

SEQ ID NO: 246836 - RNA, 19 nt, Human
ugagacaaaguuuugcucu

SEQ ID NO: 246837 - RNA, 32 nt, Human
ugagacaacugcacuccagugugggcgugccu

SEQ ID NO: 246838 - RNA, 32 nt, Human
ugagacaagaggaucaauugagcccaggaguu

SEQ ID NO: 246839 - RNA, 22 nt, Human
ugagacaagagucucgcucugu

SEQ ID NO: 246840 - RNA, 32 nt, Human
ugagacaagauuucgccauguugcccaggcug

SEQ ID NO: 246841 - RNA, 32 nt, Human
ugagacaaggucucacuauguugcccaggcug

SEQ ID NO: 246842 - RNA, 21 nt, Human
ugagacaaggucuugcucugu

SEQ ID NO: 246843 - RNA, 32 nt, Human
ugagacaauaaugaguuaaauauuuuauugga

SEQ ID NO: 246844 - RNA, 32 nt, Human
ugagacacacaccuacccuccccagcuuucca

SEQ ID NO: 246845 - RNA, 32 nt, Human
ugagacacagccuugcucugucgcccaggcug

SEQ ID NO: 246846 - RNA, 21 nt, Human
ugagacacagucucgcucugu

SEQ ID NO: 246847 - RNA, 20 nt, Human
ugagacacaguuugcucugu

SEQ ID NO: 246848 - RNA, 32 nt, Human
ugagacacggcauggcauugaaugacaccaag

SEQ ID NO: 246849 - RNA, 32 nt, Human
ugagacacggcuugcagugggggugaacgcac

SEQ ID NO: 246850 - RNA, 32 nt, Human
ugagacacggucugacucugucacccaggcug

SEQ ID NO: 246851 - RNA, 21 nt, Human
ugagacacggucuugcucugu

SEQ ID NO: 246852 - RNA, 32 nt, Human
ugagacacucaccucucugccucgcaguuggg

SEQ ID NO: 246853 - RNA, 32 nt, Human
ugagacacuggguggcuguggagggagcucag

SEQ ID NO: 246854 - RNA, 32 nt, Human
ugagacacuguggcugucuaauguaauccuuu

SEQ ID NO: 246855 - RNA, 19 nt, Human
ugagacagaaucucacucu

SEQ ID NO: 246856 - RNA, 21 nt, Human
ugagacagaaucucacuuugu

SEQ ID NO: 246857 - RNA, 21 nt, Human
ugagacagaaucucagucugu

SEQ ID NO: 246858 - RNA, 21 nt, Human
ugagacagaaucucccucugu

SEQ ID NO: 246859 - RNA, 21 nt, Human
ugagacagaaucucgcucugu

SEQ ID NO: 246860 - RNA, 19 nt, Human
ugagacagaaucucucugu

SEQ ID NO: 246861 - RNA, 21 nt, Human
ugagacagaaucuugaucugu

SEQ ID NO: 246862 - RNA, 21 nt, Human
ugagacagaaucuugcucugu

SEQ ID NO: 246863 - RNA, 21 nt, Human
ugagacagaauuucacucuuc

SEQ ID NO: 246864 - RNA, 19 nt, Human
ugagacagaauuuugcucu

SEQ ID NO: 246865 - RNA, 32 nt, Human
ugagacagacacacagccucacgcccccagga

SEQ ID NO: 246866 - RNA, 32 nt, Human
ugagacagacagggaucaggagccggacuggg

SEQ ID NO: 246867 - RNA, 21 nt, Human
ugagacagacauggguucugu

SEQ ID NO: 246868 - RNA, 32 nt, Human
ugagacagagaagggaaguaggcccuuacuuc

SEQ ID NO: 246869 - RNA, 32 nt, Human
ugagacagagacucgcucugucacccaggcug

SEQ ID NO: 246870 - RNA, 21 nt, Human
ugagacagagacuugcuuugu

SEQ ID NO: 246871 - RNA, 32 nt, Human
ugagacagagauggaagccaggacaagggagc

SEQ ID NO: 246872 - RNA, 18 nt, Human
ugagacagagccucgcuc

SEQ ID NO: 246873 - RNA, 25 nt, Human
ugagacagagccucgcuugcucugu

SEQ ID NO: 246874 - RNA, 18 nt, Human
ugagacagagcucgccuc

SEQ ID NO: 246875 - RNA, 20 nt, Human
ugagacagagcugcccgugu

SEQ ID NO: 246876 - RNA, 20 nt, Human
ugagacagaggcugccccug

SEQ ID NO: 246877 - RNA, 20 nt, Human
ugagacagaguagcucucug

SEQ ID NO: 246878 - RNA, 17 nt, Human
ugagacagagucacugu

SEQ ID NO: 246879 - RNA, 21 nt, Human
ugagacagagucaugcucugu

SEQ ID NO: 246880 - RNA, 32 nt, Human
ugagacagagucaugcucugucacccgggcug

SEQ ID NO: 246881 - RNA, 21 nt, Human
ugagacagagucccacucugu

SEQ ID NO: 246882 - RNA, 32 nt, Human
ugagacagagucccacucugucacccaggcug

SEQ ID NO: 246883 - RNA, 32 nt, Human
ugagacagagucgcacucugucauccaggcug

SEQ ID NO: 246884 - RNA, 21 nt, Human
ugagacagagucucacacugu

SEQ ID NO: 246885 - RNA, 21 nt, Human
ugagacagagucucacccugu

SEQ ID NO: 246886 - RNA, 21 nt, Human
ugagacagagucucaccuugu

SEQ ID NO: 246887 - RNA, 19 nt, Human
ugagacagagucucacucu

SEQ ID NO: 246888 - RNA, 21 nt, Human
ugagacagagucucacucugu

SEQ ID NO: 246889 - RNA, 32 nt, Human
ugagacagagucucacucugucacccagacug

SEQ ID NO: 246890 - RNA, 32 nt, Human
ugagacagagucucacucugucacccaggcug

SEQ ID NO: 246891 - RNA, 32 nt, Human
ugagacagagucucacucugucacucaggcug

SEQ ID NO: 246892 - RNA, 21 nt, Human
ugagacagagucucacucuug

SEQ ID NO: 246893 - RNA, 19 nt, Human
ugagacagagucucacugu

SEQ ID NO: 246894 - RNA, 20 nt, Human
ugagacagagucucacuuug

SEQ ID NO: 246895 - RNA, 21 nt, Human
ugagacagagucucacuuugu

SEQ ID NO: 246896 - RNA, 21 nt, Human
ugagacagagucucaugcugu

SEQ ID NO: 246897 - RNA, 18 nt, Human
ugagacagagucucauuc

SEQ ID NO: 246898 - RNA, 21 nt, Human
ugagacagagucucauucugu

SEQ ID NO: 246899 - RNA, 32 nt, Human
ugagacagagucucauucugucacccaggcug

SEQ ID NO: 246900 - RNA, 21 nt, Human
ugagacagagucucccucugu

SEQ ID NO: 246901 - RNA, 32 nt, Human
ugagacagagucucccucugucaccaggcugg

SEQ ID NO: 246902 - RNA, 32 nt, Human
ugagacagagucucccucugucacccaggcua

SEQ ID NO: 246903 - RNA, 21 nt, Human
ugagacagagucucgcacugu

SEQ ID NO: 246904 - RNA, 21 nt, Human
ugagacagagucucgccuugu

SEQ ID NO: 246905 - RNA, 21 nt, Human
ugagacagagucucgcgcugu

SEQ ID NO: 246906 - RNA, 18 nt, Human
ugagacagagucucgcuc

SEQ ID NO: 246907 - RNA, 21 nt, Human
ugagacagagucucgcucugu

SEQ ID NO: 246908 - RNA, 32 nt, Human
ugagacagagucucgcucugucaccaggcugu

SEQ ID NO: 246909 - RNA, 32 nt, Human
ugagacagagucucgcucugucacccaggcug

SEQ ID NO: 246910 - RNA, 32 nt, Human
ugagacagagucucgcucugucgccaggcuag

SEQ ID NO: 246911 - RNA, 32 nt, Human
ugagacagagucucgcucugucgccaggcuga

SEQ ID NO: 246912 - RNA, 32 nt, Human
ugagacagagucucgcucugucgccagguugg

SEQ ID NO: 246913 - RNA, 32 nt, Human
ugagacagagucucgcucugucgcccagacua

SEQ ID NO: 246914 - RNA, 32 nt, Human
ugagacagagucucgcucugucgcccaggcug

SEQ ID NO: 246915 - RNA, 32 nt, Human
ugagacagagucucgcucugucgcucaggcug

SEQ ID NO: 246916 - RNA, 32 nt, Human
ugagacagagucucgcucugucguccaggcug

SEQ ID NO: 246917 - RNA, 21 nt, Human
ugagacagagucucgcuuugu

SEQ ID NO: 246918 - RNA, 21 nt, Human
ugagacagagucucguucugu

SEQ ID NO: 246919 - RNA, 19 nt, Human
ugagacagagucucucucu

SEQ ID NO: 246920 - RNA, 21 nt, Human
ugagacagagucucucucugu

SEQ ID NO: 246921 - RNA, 18 nt, Human
ugagacagagucucuguu

SEQ ID NO: 246922 - RNA, 21 nt, Human
ugagacagagucucuuucugu

SEQ ID NO: 246923 - RNA, 21 nt, Human
ugagacagagucuggcucugu

SEQ ID NO: 246924 - RNA, 32 nt, Human
ugagacagagucuggcucugucacccaggcug

SEQ ID NO: 246925 - RNA, 32 nt, Human
ugagacagagucuggcucugucauccaggcug

SEQ ID NO: 246926 - RNA, 32 nt, Human
ugagacagagucuggcucugucgcccaggcug

SEQ ID NO: 246927 - RNA, 21 nt, Human
ugagacagagucugguucugu

SEQ ID NO: 246928 - RNA, 21 nt, Human
ugagacagagucuuacucugu

SEQ ID NO: 246929 - RNA, 32 nt, Human
ugagacagagucuuacucugucacccaggcug

SEQ ID NO: 246930 - RNA, 21 nt, Human
ugagacagagucuuauucugu

SEQ ID NO: 246931 - RNA, 21 nt, Human
ugagacagagucuuccucugu

SEQ ID NO: 246932 - RNA, 19 nt, Human
ugagacagagucuugaucu

SEQ ID NO: 246933 - RNA, 21 nt, Human
ugagacagagucuugcccugu

SEQ ID NO: 246934 - RNA, 18 nt, Human
ugagacagagucuugcuc

SEQ ID NO: 246935 - RNA, 19 nt, Human
ugagacagagucuugcucu

SEQ ID NO: 246936 - RNA, 21 nt, Human
ugagacagagucuugcucugu

SEQ ID NO: 246937 - RNA, 32 nt, Human
ugagacagagucuugcucugucaccaggcugg

SEQ ID NO: 246938 - RNA, 32 nt, Human
ugagacagagucuugcucugucacccaggcug

SEQ ID NO: 246939 - RNA, 32 nt, Human
ugagacagagucuugcucugucacccagguug

SEQ ID NO: 246940 - RNA, 32 nt, Human
ugagacagagucuugcucugucacccgggcug

SEQ ID NO: 246941 - RNA, 32 nt, Human
ugagacagagucuugcucugucauccaaacug

SEQ ID NO: 246942 - RNA, 32 nt, Human
ugagacagagucuugcucugucgccaaggcug

SEQ ID NO: 246943 - RNA, 32 nt, Human
ugagacagagucuugcucugucgccaaguugg

SEQ ID NO: 246944 - RNA, 32 nt, Human
ugagacagagucuugcucugucgcccgggcug

SEQ ID NO: 246945 - RNA, 32 nt, Human
ugagacagagucuugcucugucgccgaggcug

SEQ ID NO: 246946 - RNA, 32 nt, Human
ugagacagagucuugcucugucggccaggcug

SEQ ID NO: 246947 - RNA, 32 nt, Human
ugagacagagucuugcucugucgucgaggcug

SEQ ID NO: 246948 - RNA, 32 nt, Human
ugagacagagucuugcucugugacccagguug

SEQ ID NO: 246949 - RNA, 32 nt, Human
ugagacagagucuugcucuguggcccaggcug

SEQ ID NO: 246950 - RNA, 32 nt, Human
ugagacagagucuugcucuguuacccaggcug

SEQ ID NO: 246951 - RNA, 32 nt, Human
ugagacagagucuugcucuguugcccaggcag

SEQ ID NO: 246952 - RNA, 32 nt, Human
ugagacagagucuugcucuguugcccaggcua

SEQ ID NO: 246953 - RNA, 32 nt, Human
ugagacagagucuugcucuguugcccaggcug

SEQ ID NO: 246954 - RNA, 21 nt, Human
ugagacagagucuugcuuugu

SEQ ID NO: 246955 - RNA, 32 nt, Human
ugagacagagucuugcuuuguugcccaggcug

SEQ ID NO: 246956 - RNA, 21 nt, Human
ugagacagagucuuggucugu

SEQ ID NO: 246957 - RNA, 20 nt, Human
ugagacagagucuuguuuug

SEQ ID NO: 246958 - RNA, 21 nt, Human
ugagacagagucuuucucugu

SEQ ID NO: 246959 - RNA, 32 nt, Human
ugagacagagucuuucucugucacccaggcug

SEQ ID NO: 246960 - RNA, 32 nt, Human
ugagacagagugccuaagagaaacccuugcac

SEQ ID NO: 246961 - RNA, 16 nt, Human
ugagacagaguggccu

SEQ ID NO: 246962 - RNA, 32 nt, Human
ugagacagagugucacuuugucacccaggcug

SEQ ID NO: 246963 - RNA, 19 nt, Human
ugagacagaguuucacucu

SEQ ID NO: 246964 - RNA, 21 nt, Human
ugagacagaguuucacucugu

SEQ ID NO: 246965 - RNA, 32 nt, Human
ugagacagaguuucacucugucacccaggcug

SEQ ID NO: 246966 - RNA, 19 nt, Human
ugagacagaguuucauucu

SEQ ID NO: 246967 - RNA, 19 nt, Human
ugagacagaguuucgaucu

SEQ ID NO: 246968 - RNA, 19 nt, Human
ugagacagaguuucgcucu

SEQ ID NO: 246969 - RNA, 19 nt, Human
ugagacagaguuucgcuuu

SEQ ID NO: 246970 - RNA, 21 nt, Human
ugagacagaguuucgcuuugu

SEQ ID NO: 246971 - RNA, 19 nt, Human
ugagacagaguuuggcucu

SEQ ID NO: 246972 - RNA, 20 nt, Human
ugagacagaguuuguuuucc

SEQ ID NO: 246973 - RNA, 20 nt, Human
ugagacagaguuuucacucu

SEQ ID NO: 246974 - RNA, 19 nt, Human
ugagacagaguuuugcccu

SEQ ID NO: 246975 - RNA, 19 nt, Human
ugagacagaguuuugcucu

SEQ ID NO: 246976 - RNA, 32 nt, Human
ugagacagaguuuugcucuguugcccaggcug

SEQ ID NO: 246977 - RNA, 19 nt, Human
ugagacagaguuuuugcuc

SEQ ID NO: 246978 - RNA, 18 nt, Human
ugagacagaucugggcuc

SEQ ID NO: 246979 - RNA, 20 nt, Human
ugagacagauuaucuucugu

SEQ ID NO: 246980 - RNA, 21 nt, Human
ugagacagauucuugcucugu

SEQ ID NO: 246981 - RNA, 32 nt, Human
ugagacagauucuugcucugucacccaggcug

SEQ ID NO: 246982 - RNA, 32 nt, Human
ugagacagcaacacaaacacucgagcuuccau

SEQ ID NO: 246983 - RNA, 21 nt, Human
ugagacagcaucuugcucugu

SEQ ID NO: 246984 - RNA, 19 nt, Human
ugagacagccucgcucugu

SEQ ID NO: 246985 - RNA, 19 nt, Human
ugagacagccuugcucugu

SEQ ID NO: 246986 - RNA, 19 nt, Human
ugagacagcucuuggucca

SEQ ID NO: 246987 - RNA, 21 nt, Human
ugagacagcuuccugcucugu

SEQ ID NO: 246988 - RNA, 32 nt, Human
ugagacaggagaaucacuugagcccaggaggc

SEQ ID NO: 246989 - RNA, 32 nt, Human
ugagacaggagaauggugugaacccccaaggc

SEQ ID NO: 246990 - RNA, 31 nt, Human
ugagacaggagaccuggcacuggaugcagaa

SEQ ID NO: 246991 - RNA, 32 nt, Human
ugagacaggaggaaguuucuguuuuucuccau

SEQ ID NO: 246992 - RNA, 32 nt, Human
ugagacaggaggaucacuugaggccaggaguu

SEQ ID NO: 246993 - RNA, 32 nt, Human
ugagacaggaggaucacuuuagcccaggaauu

SEQ ID NO: 246994 - RNA, 32 nt, Human
ugagacaggaggaucgcuugaacccaggaggc

SEQ ID NO: 246995 - RNA, 32 nt, Human
ugagacaggaggaucgguugagcccaggaggu

SEQ ID NO: 246996 - RNA, 32 nt, Human
ugagacaggaggucagcacaagauacacguca

SEQ ID NO: 246997 - RNA, 32 nt, Human
ugagacaggagguccguacaagauacagguca

SEQ ID NO: 246998 - RNA, 22 nt, Human
ugagacaggagucucgcucugu

SEQ ID NO: 246999 - RNA, 21 nt, Human
ugagacaggaucucauucugu

SEQ ID NO: 247000 - RNA, 21 nt, Human
ugagacaggaucuugcucugu

SEQ ID NO: 247001 - RNA, 32 nt, Human
ugagacaggaucuugcucugucgcccaauagc

SEQ ID NO: 247002 - RNA, 32 nt, Human
ugagacaggcagaucacuugaggucaggaguu

SEQ ID NO: 247003 - RNA, 21 nt, Human
ugagacaggcucucacucugu

SEQ ID NO: 247004 - RNA, 32 nt, Human
ugagacaggcuggcuuggaguuaguguaugag

SEQ ID NO: 247005 - RNA, 21 nt, Human
ugagacagggccucacucugu

SEQ ID NO: 247006 - RNA, 32 nt, Human
ugagacagggccucacucuguugcccagguug

SEQ ID NO: 247007 - RNA, 32 nt, Human
ugagacaggguccugcucugucgcccaggcug

SEQ ID NO: 247008 - RNA, 21 nt, Human
ugagacagggucucacacugu

SEQ ID NO: 247009 - RNA, 21 nt, Human
ugagacagggucucacuaugu

SEQ ID NO: 247010 - RNA, 32 nt, Human
ugagacagggucucacuauguugcccaggcug

SEQ ID NO: 247011 - RNA, 19 nt, Human
ugagacagggucucacucu

SEQ ID NO: 247012 - RNA, 21 nt, Human
ugagacagggucucacucugu

SEQ ID NO: 247013 - RNA, 32 nt, Human
ugagacagggucucacucugucacccaggcug

SEQ ID NO: 247014 - RNA, 32 nt, Human
ugagacagggucucacucugucacucaaucug

SEQ ID NO: 247015 - RNA, 32 nt, Human
ugagacagggucucacucuguugcccaggcug

SEQ ID NO: 247016 - RNA, 21 nt, Human
ugagacagggucucacugugu

SEQ ID NO: 247017 - RNA, 21 nt, Human
ugagacagggucuccgucugu

SEQ ID NO: 247018 - RNA, 21 nt, Human
ugagacagggucucgcucugu

SEQ ID NO: 247019 - RNA, 21 nt, Human
ugagacagggucucguucugu

SEQ ID NO: 247020 - RNA, 21 nt, Human
ugagacagggucugacucugu

SEQ ID NO: 247021 - RNA, 21 nt, Human
ugagacagggucuggcucugu

SEQ ID NO: 247022 - RNA, 21 nt, Human
ugagacagggucuuacucugu

SEQ ID NO: 247023 - RNA, 32 nt, Human
ugagacagggucuugcccuguugcccaggcug

SEQ ID NO: 247024 - RNA, 21 nt, Human
ugagacagggucuugcucugu

SEQ ID NO: 247025 - RNA, 32 nt, Human
ugagacagggucuugcucugucacccaagcug

SEQ ID NO: 247026 - RNA, 32 nt, Human
ugagacagggucuugcucugucacccagacug

SEQ ID NO: 247027 - RNA, 32 nt, Human
ugagacagggucuugcucugucacccaggcug

SEQ ID NO: 247028 - RNA, 32 nt, Human
ugagacagggucuugcucugucccccaggcug

SEQ ID NO: 247029 - RNA, 32 nt, Human
ugagacagggucuugcucugucgcccaggcug

SEQ ID NO: 247030 - RNA, 32 nt, Human
ugagacagggucuugcucugucgcccagguug

SEQ ID NO: 247031 - RNA, 32 nt, Human
ugagacagggucuugcucuguugcccaggcug

SEQ ID NO: 247032 - RNA, 32 nt, Human
ugagacagggucuugcucuugcccaggcagga

SEQ ID NO: 247033 - RNA, 32 nt, Human
ugagacagggucuugcuguguugcccaggcug

SEQ ID NO: 247034 - RNA, 32 nt, Human
ugagacagggucuugcuuugucacccaggcug

SEQ ID NO: 247035 - RNA, 32 nt, Human
ugagacagggucuugcuuugucacccagggug

SEQ ID NO: 247036 - RNA, 32 nt, Human
ugagacagggucuuucucugucacccaggaug

SEQ ID NO: 247037 - RNA, 21 nt, Human
ugagacagggugucacuuugu

SEQ ID NO: 247038 - RNA, 21 nt, Human
ugagacaggguuucacccugu

SEQ ID NO: 247039 - RNA, 32 nt, Human
ugagacaggguuucacccuguuucccagguug

SEQ ID NO: 247040 - RNA, 21 nt, Human
ugagacaggguuucacuacgu

SEQ ID NO: 247041 - RNA, 19 nt, Human
ugagacagguaaauucugu

SEQ ID NO: 247042 - RNA, 32 nt, Human
ugagacagguggaucacuugaggucaggaguu

SEQ ID NO: 247043 - RNA, 32 nt, Human
ugagacagguggaucacuugaggucgggaguu

SEQ ID NO: 247044 - RNA, 32 nt, Human
ugagacaggugggccacaugagcccagguauu

SEQ ID NO: 247045 - RNA, 32 nt, Human
ugagacaguaucuugcuauguugcccaggcug

SEQ ID NO: 247046 - RNA, 19 nt, Human
ugagacagucgugcugugu

SEQ ID NO: 247047 - RNA, 19 nt, Human
ugagacagucucacucugu

SEQ ID NO: 247048 - RNA, 19 nt, Human
ugagacagucucgcucugu

SEQ ID NO: 247049 - RNA, 21 nt, Human
ugagacagucucucgcucugu

SEQ ID NO: 247050 - RNA, 16 nt, Human
ugagacagucuugcuc

SEQ ID NO: 247051 - RNA, 17 nt, Human
ugagacagucuugcucu

SEQ ID NO: 247052 - RNA, 19 nt, Human
ugagacagucuugcucugu

SEQ ID NO: 247053 - RNA, 21 nt, Human
ugagacagugccucacucugu

SEQ ID NO: 247054 - RNA, 21 nt, Human
ugagacagugucucucucugu

SEQ ID NO: 247055 - RNA, 21 nt, Human
ugagacagugucuugcucugu

SEQ ID NO: 247056 - RNA, 19 nt, Human
ugagacaguguugcuacug

SEQ ID NO: 247057 - RNA, 19 nt, Human
ugagacaguuucgcucugu

SEQ ID NO: 247058 - RNA, 32 nt, Human
ugagacauccauccugaccccaccucaucagc

SEQ ID NO: 247059 - RNA, 32 nt, Human
ugagacauggccugagcccccugcugccauag

SEQ ID NO: 247060 - RNA, 32 nt, Human
ugagacauggucuugcucuauugcccaggcug

SEQ ID NO: 247061 - RNA, 32 nt, Human
ugagacauucugauuuggaugaugcuagagca

SEQ ID NO: 247062 - RNA, 32 nt, Human
ugagacauuuuucugugucacugugggaaagc

SEQ ID NO: 247063 - RNA, 32 nt, Human
ugagaccaagaguucaagaccagccuggccaa

SEQ ID NO: 247064 - RNA, 32 nt, Human
ugagaccaaugaaaucaccaaugccaacuccc

SEQ ID NO: 247065 - RNA, 32 nt, Human
ugagaccacaccacugcacuccauccugggca

SEQ ID NO: 247066 - RNA, 32 nt, Human
ugagaccacagcaacugcagaagcugaagaca

SEQ ID NO: 247067 - RNA, 32 nt, Human
ugagaccaccggugugggucacgaggacccug

SEQ ID NO: 247068 - RNA, 32 nt, Human
ugagaccaccuugccaugucaauucaggucuc

SEQ ID NO: 247069 - RNA, 32 nt, Human
ugagaccacggugaaacccugucucuacuaaa

SEQ ID NO: 247070 - RNA, 32 nt, Human
ugagaccagcacucucaaacacuggaacugga

SEQ ID NO: 247071 - RNA, 32 nt, Human
ugagaccagcaugggaaacagagcaagaaucu

SEQ ID NO: 247072 - RNA, 32 nt, Human
ugagaccagccucggcaacauggcaaaaucuu

SEQ ID NO: 247073 - RNA, 32 nt, Human
ugagaccagccuggccaagauggugaaacccc

SEQ ID NO: 247074 - RNA, 32 nt, Human
ugagaccagccuggccagcauggugaaacccc

SEQ ID NO: 247075 - RNA, 22 nt, Human
ugagaccagccugggcaacaua

SEQ ID NO: 247076 - RNA, 32 nt, Human
ugagaccagcuggucacugcugggccugcuag

SEQ ID NO: 247077 - RNA, 32 nt, Human
ugagaccaggaauucaagaccagccugggcaa

SEQ ID NO: 247078 - RNA, 32 nt, Human
ugagaccaggagaucaaggcugcagcgagcuc

SEQ ID NO: 247079 - RNA, 32 nt, Human
ugagaccaggaggucaagaccagccuggccaa

SEQ ID NO: 247080 - RNA, 32 nt, Human
ugagaccaggagguugaggcugcagugagccg

SEQ ID NO: 247081 - RNA, 32 nt, Human
ugagaccaggaguucaagaccagccugagaaa

SEQ ID NO: 247082 - RNA, 32 nt, Human
ugagaccaggaguucaagaccagccugggcaa

SEQ ID NO: 247083 - RNA, 32 nt, Human
ugagaccaggaguuugggaccaaccugagcaa

SEQ ID NO: 247084 - RNA, 32 nt, Human
ugagaccaggcguucaagaccagccuggccaa

SEQ ID NO: 247085 - RNA, 32 nt, Human
ugagaccagguguucaagaccagccucaucaa

SEQ ID NO: 247086 - RNA, 32 nt, Human
ugagaccaguccuggccaggguaguuaccagg

SEQ ID NO: 247087 - RNA, 32 nt, Human
ugagaccagucucaguuuauuuugccaagguu

SEQ ID NO: 247088 - RNA, 32 nt, Human
ugagaccauccauucuccucaguggcuucucc

SEQ ID NO: 247089 - RNA, 32 nt, Human
ugagaccauccuggcuaacacagugaacccug

SEQ ID NO: 247090 - RNA, 32 nt, Human
ugagaccaucuccuggggcaggguccuuuucu

SEQ ID NO: 247091 - RNA, 32 nt, Human
ugagaccaucuuagaagaagcgaaagugacug

SEQ ID NO: 247092 - RNA, 32 nt, Human
ugagaccaugccacugcacuccagccugggca

SEQ ID NO: 247093 - RNA, 32 nt, Human
ugagaccauguucuccacagugucuccagugg

SEQ ID NO: 247094 - RNA, 32 nt, Human
ugagacccacagugcaccagagcacagcugca

SEQ ID NO: 247095 - RNA, 32 nt, Human
ugagacccacugaccugcagaccucauagugg

SEQ ID NO: 247096 - RNA, 32 nt, Human
ugagacccagaaagguggaagcacuugucuaa

SEQ ID NO: 247097 - RNA, 32 nt, Human
ugagaccccaucucaaaaacaaaacaccaaac

SEQ ID NO: 247098 - RNA, 19 nt, Human
ugagaccccaucucuacua

SEQ ID NO: 247099 - RNA, 32 nt, Human
ugagacccccacuccugcccgccagagaacaa

SEQ ID NO: 247100 - RNA, 32 nt, Human
ugagaccccugaggcaacuagcuuugagggac

SEQ ID NO: 247101 - RNA, 32 nt, Human
ugagaccccuggcaguugccuacaccccugcu

SEQ ID NO: 247102 - RNA, 32 nt, Human
ugagacccucauuguucacuggcuccaucgca

SEQ ID NO: 247103 - RNA, 32 nt, Human
ugagacccuccuccucagacugcuggagcaac

SEQ ID NO: 247104 - RNA, 23 nt, Human
ugagacccucuuccauccauugg

SEQ ID NO: 247105 - RNA, 32 nt, Human
ugagacccuggauaugaaggcagaggagcccg

SEQ ID NO: 247106 - RNA, 32 nt, Human
ugagacccuuccccagugucugaggccacagc

SEQ ID NO: 247107 - RNA, 32 nt, Human
ugagaccgagucuugcucugucgcccaggcug

SEQ ID NO: 247108 - RNA, 32 nt, Human
ugagaccgagucuugcucuguuacccaggcug

SEQ ID NO: 247109 - RNA, 32 nt, Human
ugagaccuagagcagagaaacuagccaagauc

SEQ ID NO: 247110 - RNA, 32 nt, Human
ugagaccuagggcuggagugcaguugagcggu

SEQ ID NO: 247111 - RNA, 26 nt, Human
ugagaccucagagggccaccccuuga

SEQ ID NO: 247112 - RNA, 32 nt, Human
ugagaccucagccaugaggaguugcuguuugu

SEQ ID NO: 247113 - RNA, 32 nt, Human
ugagaccuccacuccacaucugcaucacucau

SEQ ID NO: 247114 - RNA, 32 nt, Human
ugagaccucuccccucuuucucgccaugugau

SEQ ID NO: 247115 - RNA, 32 nt, Human
ugagaccucucuggggaucaggaaccacacaa

SEQ ID NO: 247116 - RNA, 32 nt, Human
ugagaccugaaguuccgcuggccgguagugua

SEQ ID NO: 247117 - RNA, 32 nt, Human
ugagaccugcuuaugaucagugcaaugaaguu

SEQ ID NO: 247118 - RNA, 32 nt, Human
ugagaccuguggggaaaacaaccacaacaaac

SEQ ID NO: 247119 - RNA, 32 nt, Human
ugagaccuguucuuguauccuuguguccaucu

SEQ ID NO: 247120 - RNA, 32 nt, Human
ugagaccuugcuaagcacucuagaaaguuuua

SEQ ID NO: 247121 - RNA, 20 nt, Human
ugagacgagucucgcucugu

SEQ ID NO: 247122 - RNA, 32 nt, Human
ugagacgcaaggaucacuugagcccagaagcu

SEQ ID NO: 247123 - RNA, 32 nt, Human
ugagacgcuccauguccagucuggccccagca

SEQ ID NO: 247124 - RNA, 32 nt, Human
ugagacggacaggcagcaggggagcgacggga

SEQ ID NO: 247125 - RNA, 21 nt, Human
ugagacggacucucgcucugu

SEQ ID NO: 247126 - RNA, 21 nt, Human
ugagacggagacucacucugu

SEQ ID NO: 247127 - RNA, 32 nt, Human
ugagacggagacucacucuguugcccagacug

SEQ ID NO: 247128 - RNA, 32 nt, Human
ugagacggagauucgcucugucgccaggcugg

SEQ ID NO: 247129 - RNA, 21 nt, Human
ugagacggagccuugcucugu

SEQ ID NO: 247130 - RNA, 32 nt, Human
ugagacggagccuugcucugucgcccaggcug

SEQ ID NO: 247131 - RNA, 21 nt, Human
ugagacggagcgucgcucugu

SEQ ID NO: 247132 - RNA, 19 nt, Human
ugagacggagucacucugu

SEQ ID NO: 247133 - RNA, 19 nt, Human
ugagacggagucccacucu

SEQ ID NO: 247134 - RNA, 21 nt, Human
ugagacggagucucacucugu

SEQ ID NO: 247135 - RNA, 32 nt, Human
ugagacggagucucacucugucacacaggcug

SEQ ID NO: 247136 - RNA, 32 nt, Human
ugagacggagucucacucugucacccaggcug

SEQ ID NO: 247137 - RNA, 32 nt, Human
ugagacggagucucacucuguugcccaggcug

SEQ ID NO: 247138 - RNA, 32 nt, Human
ugagacggagucucacucuguugcccagggug

SEQ ID NO: 247139 - RNA, 21 nt, Human
ugagacggagucucagucugu

SEQ ID NO: 247140 - RNA, 21 nt, Human
ugagacggagucucgaucugu

SEQ ID NO: 247141 - RNA, 21 nt, Human
ugagacggagucucgcacugu

SEQ ID NO: 247142 - RNA, 32 nt, Human
ugagacggagucucgcacuguugcccaggcug

SEQ ID NO: 247143 - RNA, 32 nt, Human
ugagacggagucucgcaguguugcccgggcaa

SEQ ID NO: 247144 - RNA, 21 nt, Human
ugagacggagucucgcccugu

SEQ ID NO: 247145 - RNA, 32 nt, Human
ugagacggagucucgcccuguugcccaggcug

SEQ ID NO: 247146 - RNA, 19 nt, Human
ugagacggagucucgcucu

SEQ ID NO: 247147 - RNA, 20 nt, Human
ugagacggagucucgcucug

SEQ ID NO: 247148 - RNA, 21 nt, Human
ugagacggagucucgcucugu

SEQ ID NO: 247149 - RNA, 32 nt, Human
ugagacggagucucgcucugucacccaggcug

SEQ ID NO: 247150 - RNA, 32 nt, Human
ugagacggagucucgcucugucauccaggcug

SEQ ID NO: 247151 - RNA, 32 nt, Human
ugagacggagucucgcucugucgccaggcugg

SEQ ID NO: 247152 - RNA, 32 nt, Human
ugagacggagucucgcucugucgcccagccug

SEQ ID NO: 247153 - RNA, 32 nt, Human
ugagacggagucucgcucugucgcccaggcug

SEQ ID NO: 247154 - RNA, 32 nt, Human
ugagacggagucucgcucuguugcccaggcug

SEQ ID NO: 247155 - RNA, 21 nt, Human
ugagacggagucucgcuuugu

SEQ ID NO: 247156 - RNA, 21 nt, Human
ugagacggagucucggucugu

SEQ ID NO: 247157 - RNA, 21 nt, Human
ugagacggagucucguucugu

SEQ ID NO: 247158 - RNA, 21 nt, Human
ugagacggagucucucucugu

SEQ ID NO: 247159 - RNA, 21 nt, Human
ugagacggagucuggcucugu

SEQ ID NO: 247160 - RNA, 32 nt, Human
ugagacggagucuggcucugucacccaggcua

SEQ ID NO: 247161 - RNA, 32 nt, Human
ugagacggagucuggcucugucacccgggcug

SEQ ID NO: 247162 - RNA, 32 nt, Human
ugagacggagucuuacucuguugcccaggcug

SEQ ID NO: 247163 - RNA, 21 nt, Human
ugagacggagucuugcccugu

SEQ ID NO: 247164 - RNA, 32 nt, Human
ugagacggagucuugcccuguugcccaugcug

SEQ ID NO: 247165 - RNA, 32 nt, Human
ugagacggagucuugcuauguugcccaggcug

SEQ ID NO: 247166 - RNA, 32 nt, Human
ugagacggagucuugcucuauuacucaggcug

SEQ ID NO: 247167 - RNA, 20 nt, Human
ugagacggagucuugcucug

SEQ ID NO: 247168 - RNA, 32 nt, Human
ugagacggagucuugcucugccgcccaggcgg

SEQ ID NO: 247169 - RNA, 21 nt, Human
ugagacggagucuugcucugu

SEQ ID NO: 247170 - RNA, 32 nt, Human
ugagacggagucuugcucuguagcccaggcca

SEQ ID NO: 247171 - RNA, 32 nt, Human
ugagacggagucuugcucugucacccagacua

SEQ ID NO: 247172 - RNA, 32 nt, Human
ugagacggagucuugcucugucacccaggcug

SEQ ID NO: 247173 - RNA, 32 nt, Human
ugagacggagucuugcucugucgcccaggcug

SEQ ID NO: 247174 - RNA, 32 nt, Human
ugagacggagucuugcucugucgccuaggcug

SEQ ID NO: 247175 - RNA, 32 nt, Human
ugagacggagucuugcucuguugcccaggcug

SEQ ID NO: 247176 - RNA, 32 nt, Human
ugagacggagucuugcucuguugccuaggcug

SEQ ID NO: 247177 - RNA, 32 nt, Human
ugagacggagucuugcugugucaccaggcugg

SEQ ID NO: 247178 - RNA, 32 nt, Human
ugagacggagucuugcuguguuguccaggcug

SEQ ID NO: 247179 - RNA, 32 nt, Human
ugagacggaguguugcucugucacccaagcug

SEQ ID NO: 247180 - RNA, 32 nt, Human
ugagacggaguguugcucugucacccaggcug

SEQ ID NO: 247181 - RNA, 21 nt, Human
ugagacggaguuucacucugu

SEQ ID NO: 247182 - RNA, 32 nt, Human
ugagacggaguuucccucuguugcccaggcug

SEQ ID NO: 247183 - RNA, 21 nt, Human
ugagacggaguuucgcucugu

SEQ ID NO: 247184 - RNA, 32 nt, Human
ugagacggaguuucgcucugucgcccaggcug

SEQ ID NO: 247185 - RNA, 32 nt, Human
ugagacggaguuuugcucugucgcgcagggug

SEQ ID NO: 247186 - RNA, 32 nt, Human
ugagacgggaggaucacaugaggccaggaauu

SEQ ID NO: 247187 - RNA, 20 nt, Human
ugagacgggagucucgcucu

SEQ ID NO: 247188 - RNA, 32 nt, Human
ugagacgggaguuucucucuugucucccaggc

SEQ ID NO: 247189 - RNA, 23 nt, Human
ugagacgggccaggacgcccagc

SEQ ID NO: 247190 - RNA, 32 nt, Human
ugagacggggcaccuagcccugggcgagcgcc

SEQ ID NO: 247191 - RNA, 21 nt, Human
ugagacggggucucacucugu

SEQ ID NO: 247192 - RNA, 19 nt, Human
ugagacggggucucccugu

SEQ ID NO: 247193 - RNA, 21 nt, Human
ugagacggggucucgcucugu

SEQ ID NO: 247194 - RNA, 32 nt, Human
ugagacggggucucgcucugucacccaggcug

SEQ ID NO: 247195 - RNA, 32 nt, Human
ugagacggggucucgcucugucacucaggcug

SEQ ID NO: 247196 - RNA, 32 nt, Human
ugagacggggucucgcucugucgcccaggcug

SEQ ID NO: 247197 - RNA, 21 nt, Human
ugagacggggucuugcucugu

SEQ ID NO: 247198 - RNA, 32 nt, Human
ugagacggggucuugcucugucgcccaggcug

SEQ ID NO: 247199 - RNA, 32 nt, Human
ugagacggggucuugcucuguuguccaggcug

SEQ ID NO: 247200 - RNA, 32 nt, Human
ugagacggggucuuguugugucacccagguua

SEQ ID NO: 247201 - RNA, 32 nt, Human
ugagacgggguuucaccauguuggucaggcug

SEQ ID NO: 247202 - RNA, 32 nt, Human
ugagacgggguuucgcucuuguuguccaggcu

SEQ ID NO: 247203 - RNA, 19 nt, Human
ugagacggucucauucugu

SEQ ID NO: 247204 - RNA, 32 nt, Human
ugagacggugcucgcuucuccuccagguauuu

SEQ ID NO: 247205 - RNA, 32 nt, Human
ugagacggugucacugcacuccagccugggug

SEQ ID NO: 247206 - RNA, 21 nt, Human
ugagacggugucucgcucugu

SEQ ID NO: 247207 - RNA, 32 nt, Human
ugagacgugguguuuuacauggugacucacau

SEQ ID NO: 247208 - RNA, 32 nt, Human
ugagacuaaagugcuuagcacagaaccuggug

SEQ ID NO: 247209 - RNA, 32 nt, Human
ugagacuaauugcagagguuccaguugaccag

SEQ ID NO: 247210 - RNA, 32 nt, Human
ugagacuacaguagcuaugauggugccacuac

SEQ ID NO: 247211 - RNA, 31 nt, Human
ugagacuacuuaagauauuguugaaauaauu

SEQ ID NO: 247212 - RNA, 32 nt, Human
ugagacuaggaguucaagaucagccugggaaa

SEQ ID NO: 247213 - RNA, 21 nt, Human
ugagacuaggucuugcucugu

SEQ ID NO: 247214 - RNA, 21 nt, Human
ugagacucagucucgcucugu

SEQ ID NO: 247215 - RNA, 32 nt, Human
ugagacuccagccucuccuccuggggccaccc

SEQ ID NO: 247216 - RNA, 32 nt, Human
ugagacuccaucucaaaacaaaacaaaacaaa

SEQ ID NO: 247217 - RNA, 32 nt, Human
ugagacuccaucucaaaacaaaacaaaacaac

SEQ ID NO: 247218 - RNA, 32 nt, Human
ugagacuccaucucaaacaacaacaacaacaa

SEQ ID NO: 247219 - RNA, 32 nt, Human
ugagacuccaucucuauauaaaaacaaaaacc

SEQ ID NO: 247220 - RNA, 22 nt, Human
ugagacuccggagucucgcucu

SEQ ID NO: 247221 - RNA, 32 nt, Human
ugagacuccgucucaaaacaaaacaaaagugg

SEQ ID NO: 247222 - RNA, 32 nt, Human
ugagacuccugauguacacugugauauugacc

SEQ ID NO: 247223 - RNA, 32 nt, Human
ugagacuccuucucaaaacaaacaaacaaaca

SEQ ID NO: 247224 - RNA, 32 nt, Human
ugagacucuccagaaagagcaacaguaaugga

SEQ ID NO: 247225 - RNA, 32 nt, Human
ugagacucugucucaaaaacaaaacaaaacag

SEQ ID NO: 247226 - RNA, 32 nt, Human
ugagacucugucucaaaacaaacaaaacaaaa

SEQ ID NO: 247227 - RNA, 32 nt, Human
ugagacucugucucaaaacaaauaaacaacaa

SEQ ID NO: 247228 - RNA, 32 nt, Human
ugagacucuuaaacccccuccugaccuucaga

SEQ ID NO: 247229 - RNA, 32 nt, Human
ugagacugagguuucugcagccaguaagucac

SEQ ID NO: 247230 - RNA, 21 nt, Human
ugagacugagucucgcucugu

SEQ ID NO: 247231 - RNA, 32 nt, Human
ugagacugagucuugcucugucacucaggcug

SEQ ID NO: 247232 - RNA, 32 nt, Human
ugagacugagucuugcucugucaucaggcugg

SEQ ID NO: 247233 - RNA, 32 nt, Human
ugagacugcaccauugcauuccagccugggca

SEQ ID NO: 247234 - RNA, 32 nt, Human
ugagacugcaggagagagagcagcggagggcc

SEQ ID NO: 247235 - RNA, 32 nt, Human
ugagacugccauucuaacauguucccagggga

SEQ ID NO: 247236 - RNA, 32 nt, Human
ugagacugcgccacggcacuccagccugggcg

SEQ ID NO: 247237 - RNA, 32 nt, Human
ugagacugcgggagagcugagcuccagcuuaa

SEQ ID NO: 247238 - RNA, 32 nt, Human
ugagacugcuccaacaugcuugaagaucuaag

SEQ ID NO: 247239 - RNA, 32 nt, Human
ugagacugcuuugcauaaaacugggaagaaag

SEQ ID NO: 247240 - RNA, 32 nt, Human
ugagacugggagaaccugcugggcaccccugc

SEQ ID NO: 247241 - RNA, 32 nt, Human
ugagacugggaggcagagguugcagugaaccg

SEQ ID NO: 247242 - RNA, 32 nt, Human
ugagacugggccccaccagcaggucaagucag

SEQ ID NO: 247243 - RNA, 32 nt, Human
ugagacuggggcaggaggaucacuugaggcca

SEQ ID NO: 247244 - RNA, 32 nt, Human
ugagacuggggucugggcuguuccagacuuca

SEQ ID NO: 247245 - RNA, 32 nt, Human
ugagacuggggucugggcuguuccggacuuca

SEQ ID NO: 247246 - RNA, 32 nt, Human
ugagacuggguagaauguuacuugaguuguga

SEQ ID NO: 247247 - RNA, 21 nt, Human
ugagacugggucucgcuuugu

SEQ ID NO: 247248 - RNA, 32 nt, Human
ugagacugggucucgcuuuguugcccaggcug

SEQ ID NO: 247249 - RNA, 32 nt, Human
ugagacuguaaguuacaugaaggcagcagaau

SEQ ID NO: 247250 - RNA, 32 nt, Human
ugagacuguccagaucuagucuguaaacccag

SEQ ID NO: 247251 - RNA, 32 nt, Human
ugagacugugccacugcacuccagccugggug

SEQ ID NO: 247252 - RNA, 32 nt, Human
ugagacugugccacugcaguccagccugggug

SEQ ID NO: 247253 - RNA, 32 nt, Human
ugagacuguguugucgguggccgcgcugguuu

SEQ ID NO: 247254 - RNA, 32 nt, Human
ugagacuguguuugggaaggaggcugagugac

SEQ ID NO: 247255 - RNA, 32 nt, Human
ugagacuuaggcccuggcucugcauggggaau

SEQ ID NO: 247256 - RNA, 32 nt, Human
ugagacuuauucacuaccaugagaacagcaug

SEQ ID NO: 247257 - RNA, 32 nt, Human
ugagacuuauucacuaccaugagaacaguauc

SEQ ID NO: 247258 - RNA, 32 nt, Human
ugagacuucauaccuucauuucccugcuuucc

SEQ ID NO: 247259 - RNA, 23 nt, Human
ugagacuucgcaaaucucuggaa

SEQ ID NO: 247260 - RNA, 32 nt, Human
ugagacuucgucucaaaacaaacaaacaaaca

SEQ ID NO: 247261 - RNA, 32 nt, Human
ugagacuucuguaguuuuaaaaugccacaguc

SEQ ID NO: 247262 - RNA, 32 nt, Human
ugagacuucuucucaaacucggccaagaagcu

SEQ ID NO: 247263 - RNA, 32 nt, Human
ugagacuugccugaacccaggaggcagagguu

SEQ ID NO: 247264 - RNA, 32 nt, Human
ugagacuuggcggcgcggcugcuauccugaac

SEQ ID NO: 247265 - RNA, 20 nt, Human
ugagacuuggguggugggaa

SEQ ID NO: 247266 - RNA, 32 nt, Human
ugagacuuuguugaguucuuucugggacuugg

SEQ ID NO: 247267 - RNA, 32 nt, Human
ugagagaaaccagacaacguaagccaaugccc

SEQ ID NO: 247268 - RNA, 32 nt, Human
ugagagaaaccagcuggugauuuaugaagaga

SEQ ID NO: 247269 - RNA, 32 nt, Human
ugagagaaacgcagugggggaggcagggaguc

SEQ ID NO: 247270 - RNA, 18 nt, Human
ugagagaaaggagcccca

SEQ ID NO: 247271 - RNA, 27 nt, Human
ugagagaaauaaaggugagagcauuca

SEQ ID NO: 247272 - RNA, 32 nt, Human
ugagagaacaacugucugcuguggaaaguaac

SEQ ID NO: 247273 - RNA, 32 nt, Human
ugagagaagaaagagugagagaggaauugccu

SEQ ID NO: 247274 - RNA, 32 nt, Human
ugagagaagaagagaaagcagcagaauugcaa

SEQ ID NO: 247275 - RNA, 32 nt, Human
ugagagaagaggaccuauaugaaugguuuuau

SEQ ID NO: 247276 - RNA, 32 nt, Human
ugagagaaggcaaacagacaaaaagggugaua

SEQ ID NO: 247277 - RNA, 32 nt, Human
ugagagaaggggaucagcugcucaguacaacc

SEQ ID NO: 247278 - RNA, 22 nt, Human
ugagagaaguaaagguucauuc

SEQ ID NO: 247279 - RNA, 17 nt, Human
ugagagaauccaguaaa

SEQ ID NO: 247280 - RNA, 32 nt, Human
ugagagaauggaaaacagacucagguuguagu

SEQ ID NO: 247281 - RNA, 32 nt, Human
ugagagaauuccagggcuuccuugagaaaaca

SEQ ID NO: 247282 - RNA, 32 nt, Human
ugagagacaaagcagaccaccuggugaaugaa

SEQ ID NO: 247283 - RNA, 31 nt, Human
ugagagacaaugucuuccccuagccacaggu

SEQ ID NO: 247284 - RNA, 32 nt, Human
ugagagacacaaccgaaggaggcacacagauu

SEQ ID NO: 247285 - RNA, 32 nt, Human
ugagagacagaagccaacgaaggaggucauuc

SEQ ID NO: 247286 - RNA, 32 nt, Human
ugagagacagggaacaggcucuccuccagagc

SEQ ID NO: 247287 - RNA, 32 nt, Human
ugagagacauuaacucauuagacuggaacuug

SEQ ID NO: 247288 - RNA, 32 nt, Human
ugagagacccaggaugaagggaugcagugagg

SEQ ID NO: 247289 - RNA, 32 nt, Human
ugagagacgaguugggggaguccuccacgcau

SEQ ID NO: 247290 - RNA, 32 nt, Human
ugagagacucuggguucuacugcuaggcagac

SEQ ID NO: 247291 - RNA, 22 nt, Human
ugagagagaaggucccagcggg

SEQ ID NO: 247292 - RNA, 21 nt, Human
ugagagagaagguccgaguag

SEQ ID NO: 247293 - RNA, 32 nt, Human
ugagagagaccgucgggggcugaggggcaacg

SEQ ID NO: 247294 - RNA, 32 nt, Human
ugagagagacugagacaggagucuuccggagu

SEQ ID NO: 247295 - RNA, 32 nt, Human
ugagagagagcucucagauguaggggcugcag

SEQ ID NO: 247296 - RNA, 20 nt, Human
ugagagagagucuuacucug

SEQ ID NO: 247297 - RNA, 21 nt, Human
ugagagagagucuugcucugu

SEQ ID NO: 247298 - RNA, 32 nt, Human
ugagagagagugaaaaggagaggguaacagaa

SEQ ID NO: 247299 - RNA, 32 nt, Human
ugagagagagugaucuggcgagggccgaugaa

SEQ ID NO: 247300 - RNA, 32 nt, Human
ugagagagaugauggccucucugggccuuucc

SEQ ID NO: 247301 - RNA, 32 nt, Human
ugagagagcauggcccagacaagcagcugggu

SEQ ID NO: 247302 - RNA, 32 nt, Human
ugagagagccaguuccaggcagggccccucag

SEQ ID NO: 247303 - RNA, 32 nt, Human
ugagagaggaagagaaauuucucuaguaacac

SEQ ID NO: 247304 - RNA, 32 nt, Human
ugagagaggagaauagggaauuaggguaaaca

SEQ ID NO: 247305 - RNA, 32 nt, Human
ugagagaggaggaagagggagucuggcaugag

SEQ ID NO: 247306 - RNA, 31 nt, Human
ugagagaggagggagagggagucuggcauga

SEQ ID NO: 247307 - RNA, 32 nt, Human
ugagagaggagggagagggagucuggcaugag

SEQ ID NO: 247308 - RNA, 32 nt, Human
ugagagaguccuccaggcaggguggcuggugc

SEQ ID NO: 247309 - RNA, 32 nt, Human
ugagagaugguuugccuguccagacuugcucu

SEQ ID NO: 247310 - RNA, 32 nt, Human
ugagagcaagagccuucacuuguucuugcggu

SEQ ID NO: 247311 - RNA, 32 nt, Human
ugagagcaagaugccagcagauucaaugccuu

SEQ ID NO: 247312 - RNA, 32 nt, Human
ugagagcacaguagcccagccugcuggucagc

SEQ ID NO: 247313 - RNA, 32 nt, Human
ugagagcaccgcugcacucgcggccggcgaug

SEQ ID NO: 247314 - RNA, 32 nt, Human
ugagagcaccuuaguguugcucugccucagcc

SEQ ID NO: 247315 - RNA, 32 nt, Human
ugagagcacuuucuuuaaaaggaccaaaaaua

SEQ ID NO: 247316 - RNA, 32 nt, Human
ugagagcagaacuugcagcagagaugagcuuu

SEQ ID NO: 247317 - RNA, 32 nt, Human
ugagagcagcacuaaguccucuguguaacugc

SEQ ID NO: 247318 - RNA, 32 nt, Human
ugagagcagcagaucucagccagaugcugccg

SEQ ID NO: 247319 - RNA, 32 nt, Human
ugagagcagccugggcaacguggugaacccug

SEQ ID NO: 247320 - RNA, 32 nt, Human
ugagagcaggaaaaggaggcugugaggaaggg

SEQ ID NO: 247321 - RNA, 32 nt, Human
ugagagcagugcuucugauccugcugucaccc

SEQ ID NO: 247322 - RNA, 32 nt, Human
ugagagcauccgaacuccuggauuucaggaca

SEQ ID NO: 247323 - RNA, 32 nt, Human
ugagagccaaguagucaguggaagagaguaga

SEQ ID NO: 247324 - RNA, 32 nt, Human
ugagagccacagucaggucuguccucaggggu

SEQ ID NO: 247325 - RNA, 32 nt, Human
ugagagccaguggaauggggucugggcugcug

SEQ ID NO: 247326 - RNA, 32 nt, Human
ugagagccccagccugagccagucccagcugu

SEQ ID NO: 247327 - RNA, 32 nt, Human
ugagagcccccagugccggagcagaaaggacc

SEQ ID NO: 247328 - RNA, 32 nt, Human
ugagagcccuccugcugggacagagaauuggg

SEQ ID NO: 247329 - RNA, 32 nt, Human
ugagagcccucuccaccugcaaggugccagga

SEQ ID NO: 247330 - RNA, 32 nt, Human
ugagagcccugaggccuagacucugucuaccu

SEQ ID NO: 247331 - RNA, 17 nt, Human
ugagagcccuggagaga

SEQ ID NO: 247332 - RNA, 32 nt, Human
ugagagcccugggggugggaggcugugggagg

SEQ ID NO: 247333 - RNA, 32 nt, Human
ugagagcccuuucuuuucaaugggcuugaguc

SEQ ID NO: 247334 - RNA, 32 nt, Human
ugagagccgauggccccagcaucccccaggug

SEQ ID NO: 247335 - RNA, 32 nt, Human
ugagagccuccucuugggucuaucccaagguu

SEQ ID NO: 247336 - RNA, 32 nt, Human
ugagagccugaacccgggcuugagagccucgc

SEQ ID NO: 247337 - RNA, 32 nt, Human
ugagagccugcagccugccagagcagagagcc

SEQ ID NO: 247338 - RNA, 32 nt, Human
ugagagccugcagccugccagagcagagccac

SEQ ID NO: 247339 - RNA, 32 nt, Human
ugagagcgagagguggaucggggcggugugug

SEQ ID NO: 247340 - RNA, 32 nt, Human
ugagagcgccucucuuuugagcaaacaagcau

SEQ ID NO: 247341 - RNA, 21 nt, Human
ugagagcgcuccuugcucugu

SEQ ID NO: 247342 - RNA, 32 nt, Human
ugagagcggcucugcugucaucucaagcagcc

SEQ ID NO: 247343 - RNA, 32 nt, Human
ugagagcgggggagaagagacaagcaggggcg

SEQ ID NO: 247344 - RNA, 32 nt, Human
ugagagcuagauguccuaugggcaauuaggua

SEQ ID NO: 247345 - RNA, 32 nt, Human
ugagagcuauccacucuccugccugcauaucc

SEQ ID NO: 247346 - RNA, 32 nt, Human
ugagagcuccacccccacauaccugccaccca

SEQ ID NO: 247347 - RNA, 32 nt, Human
ugagagcugaaaccuguucccugagcugauca

SEQ ID NO: 247348 - RNA, 32 nt, Human
ugagagcugcacucuggcuggggaaggcauga

SEQ ID NO: 247349 - RNA, 32 nt, Human
ugagagcugccacucauuuaauauuucucauu

SEQ ID NO: 247350 - RNA, 32 nt, Human
ugagagcugccucugccucagugggaggccug

SEQ ID NO: 247351 - RNA, 32 nt, Human
ugagagcugggugggaccuagagcucucaaaa

SEQ ID NO: 247352 - RNA, 32 nt, Human
ugagagcuuuucuucauccagaauugcccucu

SEQ ID NO: 247353 - RNA, 32 nt, Human
ugagaggaaacgaggugagcagaggacuuccu

SEQ ID NO: 247354 - RNA, 32 nt, Human
ugagaggacacacgcagcugaagaugaauuug

SEQ ID NO: 247355 - RNA, 32 nt, Human
ugagaggacagagagaaauaagugcccucucc

SEQ ID NO: 247356 - RNA, 32 nt, Human
ugagaggagaaaggaaauguuggcaugggccu

SEQ ID NO: 247357 - RNA, 32 nt, Human
ugagaggagaacaguaggauugcuguggccua

SEQ ID NO: 247358 - RNA, 32 nt, Human
ugagaggagcagagaggaaggagaaagaggag

SEQ ID NO: 247359 - RNA, 32 nt, Human
ugagaggagcuggggagaaggaaggggagcaa

SEQ ID NO: 247360 - RNA, 32 nt, Human
ugagaggaggagguggagacuaucagugcacg

SEQ ID NO: 247361 - RNA, 32 nt, Human
ugagaggaggcggaggagagagccugcgaggu

SEQ ID NO: 247362 - RNA, 32 nt, Human
ugagaggagggaggcaggcugcagcuucagcc

SEQ ID NO: 247363 - RNA, 32 nt, Human
ugagaggauguuuucuggcacaguguuaugaa

SEQ ID NO: 247364 - RNA, 32 nt, Human
ugagaggcaugauggggagagaccagacugaa

SEQ ID NO: 247365 - RNA, 32 nt, Human
ugagaggccaucuaucccagccugggugaucc

SEQ ID NO: 247366 - RNA, 32 nt, Human
ugagaggcccagaacaaacuggagucuagccu

SEQ ID NO: 247367 - RNA, 32 nt, Human
ugagaggcccugggguucucccccuuucucuc

SEQ ID NO: 247368 - RNA, 32 nt, Human
ugagaggccucaauaaagacaucuggggcagc

SEQ ID NO: 247369 - RNA, 32 nt, Human
ugagaggccuggagcccacaaccuucggcucc

SEQ ID NO: 247370 - RNA, 32 nt, Human
ugagaggcgcagcucugucucacuggaaggca

SEQ ID NO: 247371 - RNA, 32 nt, Human
ugagaggcggugaggccagggcuuccagccuc

SEQ ID NO: 247372 - RNA, 32 nt, Human
ugagaggcucgcacgccuccagcccggccccg

SEQ ID NO: 247373 - RNA, 32 nt, Human
ugagaggcuggaaacucacccgccuccuuucc

SEQ ID NO: 247374 - RNA, 32 nt, Human
ugagaggcuguugccaauuguucuuuaggcau

SEQ ID NO: 247375 - RNA, 32 nt, Human
ugagagggaaauggaacucauuuggaacuccc

SEQ ID NO: 247376 - RNA, 32 nt, Human
ugagagggagacagaaagaaagacugaggugg

SEQ ID NO: 247377 - RNA, 32 nt, Human
ugagagggagacgcuccaagaggcuccucagu

SEQ ID NO: 247378 - RNA, 32 nt, Human
ugagagggagagacgacgugaggcgagaggaa

SEQ ID NO: 247379 - RNA, 32 nt, Human
ugagagggagcgagacaggcgaccaacacaga

SEQ ID NO: 247380 - RNA, 32 nt, Human
ugagagggagucucacucuguugcccaggcug

SEQ ID NO: 247381 - RNA, 21 nt, Human
ugagagggagucucgcacugu

SEQ ID NO: 247382 - RNA, 21 nt, Human
ugagagggagucucgcugugu

SEQ ID NO: 247383 - RNA, 32 nt, Human
ugagagggagucuuguucugucacccaggcug

SEQ ID NO: 247384 - RNA, 32 nt, Human
ugaggucgggcugaagcagggucacuggccag

SEQ ID NO: 247385 - RNA, 32 nt, Human
ugaggucgggguggaagaaacgggugauuccc

SEQ ID NO: 247386 - RNA, 32 nt, Human
ugaggucgugccacugcacuccagccugggca

SEQ ID NO: 247387 - RNA, 32 nt, Human
ugaggucgugccacugcacuucagccugggug

SEQ ID NO: 247388 - RNA, 32 nt, Human
ugaggucgugccacugcgcuccagccugggug

SEQ ID NO: 247389 - RNA, 32 nt, Human
ugaggucgugcuacugcacucccgccugggug

SEQ ID NO: 247390 - RNA, 32 nt, Human
ugaggucuaggcucacaugcagguaauuagaa

SEQ ID NO: 247391 - RNA, 32 nt, Human
ugaggucuccauuuucuugcuggcugucagcc

SEQ ID NO: 247392 - RNA, 32 nt, Human
ugaggucucuggggcucucgugagcuguccac

SEQ ID NO: 247393 - RNA, 32 nt, Human
ugaggucugcagccugucuccuaggcacuccc

SEQ ID NO: 247394 - RNA, 32 nt, Human
ugaggucuggacggcuaccacacccaccuacu

SEQ ID NO: 247395 - RNA, 32 nt, Human
ugaggucuggaguucaagaccagccuggccaa

SEQ ID NO: 247396 - RNA, 32 nt, Human
ugaggucugggaccuuucccucccaggagccc

SEQ ID NO: 247397 - RNA, 32 nt, Human
ugaggucugggcaggaaccaaagagagcuuca

SEQ ID NO: 247398 - RNA, 32 nt, Human
ugaggucugggcaggggcagggcaagcuugac

SEQ ID NO: 247399 - RNA, 32 nt, Human
ugaggucuggggcaauggaagucaagacaccc

SEQ ID NO: 247400 - RNA, 32 nt, Human
ugaggucugucccugaaugucucccucacccc

SEQ ID NO: 247401 - RNA, 32 nt, Human
ugaggucuucccaacagacucucccucuucca

SEQ ID NO: 247402 - RNA, 32 nt, Human
ugaggucuuccccauacccucuggguguugag

SEQ ID NO: 247403 - RNA, 20 nt, Human
ugaggucuuccugggcccuc

SEQ ID NO: 247404 - RNA, 32 nt, Human
ugaggugaaagcuucguccgagaaacgccagg

SEQ ID NO: 247405 - RNA, 32 nt, Human
ugaggugaaaggaucacuugagccugggaggu

SEQ ID NO: 247406 - RNA, 32 nt, Human
ugaggugaacaugggggugagacugaagccug

SEQ ID NO: 247407 - RNA, 32 nt, Human
ugaggugaagaucacugucaucuaaaagcagg

SEQ ID NO: 247408 - RNA, 32 nt, Human
ugaggugaagaucacugucaucuaaaagcugg

SEQ ID NO: 247409 - RNA, 32 nt, Human
ugaggugagaggagcaagugagcccaggaguu

SEQ ID NO: 247410 - RNA, 32 nt, Human
ugaggugagaggaucacuugagcccaagaguc

SEQ ID NO: 247411 - RNA, 32 nt, Human
ugaggugagaggaucacuugagcccagaaggc

SEQ ID NO: 247412 - RNA, 32 nt, Human
ugaggugagaggaucacuugagcccaggaggu

SEQ ID NO: 247413 - RNA, 32 nt, Human
ugaggugagaggaucacuugaggccaagaguu

SEQ ID NO: 247414 - RNA, 32 nt, Human
ugaggugagaggaucgcuugagcucaggaguu

SEQ ID NO: 247415 - RNA, 32 nt, Human
ugaggugagagggucacuugagcccaggaguu

SEQ ID NO: 247416 - RNA, 32 nt, Human
ugaggugagcgugugugcucucagggaagggc

SEQ ID NO: 247417 - RNA, 32 nt, Human
ugaggugaggaguucaagaccagccugcccaa

SEQ ID NO: 247418 - RNA, 32 nt, Human
ugaggugaggaguucaagaccagccuggccaa

SEQ ID NO: 247419 - RNA, 32 nt, Human
ugaggugaggcagggccugcagcggucucuga

SEQ ID NO: 247420 - RNA, 32 nt, Human
ugaggugaggcugagaaagaaaaagcccgcua

SEQ ID NO: 247421 - RNA, 32 nt, Human
ugaggugagguuucaccauguuggccaggcgg

SEQ ID NO: 247422 - RNA, 32 nt, Human
ugaggugaguggaucacuugaagucaggaguu

SEQ ID NO: 247423 - RNA, 32 nt, Human
ugaggugauauaaucauuguaguccaugacaa

SEQ ID NO: 247424 - RNA, 32 nt, Human
ugaggugaucuuucccuccucugaacuauuag

SEQ ID NO: 247425 - RNA, 32 nt, Human
ugaggugcaagacuucaggguggggugggcau

SEQ ID NO: 247426 - RNA, 32 nt, Human
ugaggugcagaggcccacccagcccccuaccu

SEQ ID NO: 247427 - RNA, 32 nt, Human
ugaggugcagcuuuuauuuauguuuucccuuu

SEQ ID NO: 247428 - RNA, 32 nt, Human
ugaggugcaguggcacgaucucagcucacugc

SEQ ID NO: 247429 - RNA, 25 nt, Human
ugaggugcaguggcucacgccugua

SEQ ID NO: 247430 - RNA, 32 nt, Human
ugaggugcaucucaccaaccauccuccugcag

SEQ ID NO: 247431 - RNA, 32 nt, Human
ugaggugccagguuucuuuuucaucuagagau

SEQ ID NO: 247432 - RNA, 32 nt, Human
ugaggugcccagcuagcugcagagccacccug

SEQ ID NO: 247433 - RNA, 32 nt, Human
ugaggugccuccgcugggcugucuccucaccc

SEQ ID NO: 247434 - RNA, 32 nt, Human
ugaggugccugccugcacuauugccccagagg

SEQ ID NO: 247435 - RNA, 32 nt, Human
ugaggugccugcuggcauccucucccccaugc

SEQ ID NO: 247436 - RNA, 32 nt, Human
ugaggugcuguugcugaaacgcugccgcugag

SEQ ID NO: 247437 - RNA, 32 nt, Human
ugagguggaaacagugguccugaaucauugug

SEQ ID NO: 247438 - RNA, 32 nt, Human
ugagguggaaggaucacuugagcacaggaguu

SEQ ID NO: 247439 - RNA, 32 nt, Human
ugagguggaaggaucacuugaggccaggaguu

SEQ ID NO: 247440 - RNA, 21 nt, Human
ugagguggagucucauucugu

SEQ ID NO: 247441 - RNA, 32 nt, Human
ugagguggagucucauucuguugcccaggcug

SEQ ID NO: 247442 - RNA, 21 nt, Human
ugagguggagucucgcucugu

SEQ ID NO: 247443 - RNA, 32 nt, Human
ugagguggagucucgcucuguugcccaggcug

SEQ ID NO: 247444 - RNA, 32 nt, Human
ugagguggagucuuccccuguugcccaggcug

SEQ ID NO: 247445 - RNA, 21 nt, Human
ugagguggagucuugcucugu

SEQ ID NO: 247446 - RNA, 32 nt, Human
ugagguggagucuugcucugucacccaggcug

SEQ ID NO: 247447 - RNA, 32 nt, Human
ugagguggagucuugcucugucgcccaggcug

SEQ ID NO: 247448 - RNA, 32 nt, Human
ugagguggccgguucuuggugggaucugagca

SEQ ID NO: 247449 - RNA, 32 nt, Human
ugagguggccugucugugccucuccuuuguuu

SEQ ID NO: 247450 - RNA, 20 nt, Human
ugagguggcgcagggcucuc

SEQ ID NO: 247451 - RNA, 32 nt, Human
ugagguggcgcgacccccucucccagggagcu

SEQ ID NO: 247452 - RNA, 32 nt, Human
ugagguggcucaccccuguaaucccaguacuu

SEQ ID NO: 247453 - RNA, 32 nt, Human
ugagguggcucacgccuauaaucccagcacuu

SEQ ID NO: 247454 - RNA, 32 nt, Human
ugagguggcucaggccuauaaucccaguacuu

SEQ ID NO: 247455 - RNA, 20 nt, Human
ugagguggcucaugccugua

SEQ ID NO: 247456 - RNA, 23 nt, Human
ugagguggcucaugccuguaauc

SEQ ID NO: 247457 - RNA, 32 nt, Human
ugagguggcucaugccuguaaucccagcacuu

SEQ ID NO: 247458 - RNA, 32 nt, Human
ugaggugggaaaaucacuugagcccaggaggu

SEQ ID NO: 247459 - RNA, 32 nt, Human
ugaggugggaaaaugacuugagcccaggagga

SEQ ID NO: 247460 - RNA, 32 nt, Human
ugaggugggagaaucaccugagcccaggaggu

SEQ ID NO: 247461 - RNA, 32 nt, Human
ugaggugggagaaucacuugaaccugggaggc

SEQ ID NO: 247462 - RNA, 32 nt, Human
ugaggugggagaaucacuugaacuugggaggc

SEQ ID NO: 247463 - RNA, 32 nt, Human
ugaggugggagaaucacuuggacuccagaggu

SEQ ID NO: 247464 - RNA, 32 nt, Human
ugaggugggagaaucgcuugagcucaggaguu

SEQ ID NO: 247465 - RNA, 32 nt, Human
ugaggugggagagagaagcagagcgagagaga

SEQ ID NO: 247466 - RNA, 32 nt, Human
ugaggugggagcaucacuugagaccaggaguu

SEQ ID NO: 247467 - RNA, 32 nt, Human
ugaggugggaggaaucccuugagccaaggagg

SEQ ID NO: 247468 - RNA, 32 nt, Human
ugaggugggaggacugcuuaagcucaggaguu

SEQ ID NO: 247469 - RNA, 32 nt, Human
ugaggugggaggaguacuugagcccaggaguu

SEQ ID NO: 247470 - RNA, 32 nt, Human
ugaggugggaggagugcuugaggccaggaguu

SEQ ID NO: 247471 - RNA, 32 nt, Human
ugaggugggaggauaacuugagcacaggaguu

SEQ ID NO: 247472 - RNA, 32 nt, Human
ugaggugggaggaucaccuaagccuggaaggu

SEQ ID NO: 247473 - RNA, 32 nt, Human
ugaggugggaggaucaccuaaggccaggaggu

SEQ ID NO: 247474 - RNA, 32 nt, Human
ugaggugggaggaucaccugagccuaagagga

SEQ ID NO: 247475 - RNA, 32 nt, Human
ugaggugggaggaucaccugaggucgaaaguu

SEQ ID NO: 247476 - RNA, 32 nt, Human
ugaggugggaggaucaccugaggucgggaguu

SEQ ID NO: 247477 - RNA, 32 nt, Human
ugaggugggaggaucacucaaaccugggaguu

SEQ ID NO: 247478 - RNA, 32 nt, Human
ugaggugggaggaucacuggaacccgggagca

SEQ ID NO: 247479 - RNA, 32 nt, Human
ugaggugggaggaucacuggagcccaggaggu

SEQ ID NO: 247480 - RNA, 32 nt, Human
ugaggugggaggaucacuucagcccaggaggu

SEQ ID NO: 247481 - RNA, 32 nt, Human
ugaggugggaggaucacuugaacccaggaggu

SEQ ID NO: 247482 - RNA, 32 nt, Human
ugaggugggaggaucacuugaaccccagaggu

SEQ ID NO: 247483 - RNA, 32 nt, Human
ugaggugggaggaucacuugaaccugggaggu

SEQ ID NO: 247484 - RNA, 32 nt, Human
ugaggugggaggaucacuugaacucaggaguu

SEQ ID NO: 247485 - RNA, 32 nt, Human
ugaggugggaggaucacuugagcccaauucaa

SEQ ID NO: 247486 - RNA, 32 nt, Human
ugaggugggaggaucacuugagcccagaagcu

SEQ ID NO: 247487 - RNA, 32 nt, Human
ugaggugggaggaucacuugagcccagaaguu

SEQ ID NO: 247488 - RNA, 32 nt, Human
ugaggugggaggaucacuugagcccaggaagu

SEQ ID NO: 247489 - RNA, 32 nt, Human
ugaggugggaggaucacuugagcccaggaggu

SEQ ID NO: 247490 - RNA, 32 nt, Human
ugaggugggaggaucacuugagcccaggaguc

SEQ ID NO: 247491 - RNA, 32 nt, Human
ugaggugggaggaucacuugagcccaggaguu

SEQ ID NO: 247492 - RNA, 32 nt, Human
ugaggugggaggaucacuugagccccagaggu

SEQ ID NO: 247493 - RNA, 32 nt, Human
ugaggugggaggaucacuugagccuggaaguu

SEQ ID NO: 247494 - RNA, 32 nt, Human
ugaggugggaggaucacuugagccugggggac

SEQ ID NO: 247495 - RNA, 32 nt, Human
ugaggugggaggaucacuugaguccaggaggc

SEQ ID NO: 247496 - RNA, 32 nt, Human
ugaggugggaggaucacuuggacuugggaggc

SEQ ID NO: 247497 - RNA, 32 nt, Human
ugaggugggaggaucacuuggguccaggaggu

SEQ ID NO: 247498 - RNA, 32 nt, Human
ugaggugggaggaucaguugagcccaaggagu

SEQ ID NO: 247499 - RNA, 32 nt, Human
ugaggugggaggaucaugaggucaagggaucg

SEQ ID NO: 247500 - RNA, 32 nt, Human
ugaggugggaggaucauuugagcccagaggua

SEQ ID NO: 247501 - RNA, 32 nt, Human
ugaggugggaggaucauuugagcccaggaggu

SEQ ID NO: 247502 - RNA, 32 nt, Human
ugaggugggaggaucauuugagcccaggaguu

SEQ ID NO: 247503 - RNA, 32 nt, Human
ugaggugggaggaucauuugagccuaggaggu

SEQ ID NO: 247504 - RNA, 32 nt, Human
ugaggugggaggaucauuugaggccaggaguu

SEQ ID NO: 247505 - RNA, 32 nt, Human
ugaggugggaggaucauuugagugcaggaguu

SEQ ID NO: 247506 - RNA, 32 nt, Human
ugaggugggaggauccacugagcccaggaguu

SEQ ID NO: 247507 - RNA, 32 nt, Human
ugaggugggaggaucccaggaguucaaauccu

SEQ ID NO: 247508 - RNA, 32 nt, Human
ugaggugggaggaucccgugagccugggaggu

SEQ ID NO: 247509 - RNA, 32 nt, Human
ugaggugggaggaucccuugagcccaggaguu

SEQ ID NO: 247510 - RNA, 32 nt, Human
ugaggugggaggaucccuugagccgaggaguu

SEQ ID NO: 247511 - RNA, 32 nt, Human
ugaggugggaggaucccuugagcuggggagau

SEQ ID NO: 247512 - RNA, 32 nt, Human
ugaggugggaggaucccuugaggccacaaguu

SEQ ID NO: 247513 - RNA, 32 nt, Human
ugaggugggaggaucccuugaucccaggaauu

SEQ ID NO: 247514 - RNA, 32 nt, Human
ugaggugggaggauccucugaucuggggaggc

SEQ ID NO: 247515 - RNA, 32 nt, Human
ugaggugggaggaucgccugaaccucagaggc

SEQ ID NO: 247516 - RNA, 32 nt, Human
ugaggugggaggaucgccugagcccaggaguu

SEQ ID NO: 247517 - RNA, 32 nt, Human
ugaggugggaggaucgccugagcccagggagg

SEQ ID NO: 247518 - RNA, 32 nt, Human
ugaggugggaggaucgccugagccugaggggg

SEQ ID NO: 247519 - RNA, 32 nt, Human
ugaggugggaggaucgcuggagccugggaagu

SEQ ID NO: 247520 - RNA, 32 nt, Human
ugaggugggaggaucgcuuaagcccaggagcu

SEQ ID NO: 247521 - RNA, 32 nt, Human
ugaggugggaggaucgcuugaacccaggaggu

SEQ ID NO: 247522 - RNA, 32 nt, Human
ugaggugggaggaucgcuugagcccaggaggu

SEQ ID NO: 247523 - RNA, 32 nt, Human
ugaggugggaggaucgcuugagcccaggaguu

SEQ ID NO: 247524 - RNA, 32 nt, Human
ugaggugggaggaucgcuugagcccaggcggu

SEQ ID NO: 247525 - RNA, 32 nt, Human
ugaggugggaggaucgcuugagccccggaggu

SEQ ID NO: 247526 - RNA, 32 nt, Human
ugaggugggaggaucgcuugagccucggaggc

SEQ ID NO: 247527 - RNA, 32 nt, Human
ugaggugggaggaucgcuugagccugggaggu

SEQ ID NO: 247528 - RNA, 32 nt, Human
ugaggugggaggaucgcuugaggcaaggaguu

SEQ ID NO: 247529 - RNA, 32 nt, Human
ugaggugggaggaucgcuugugccuuggaggu

SEQ ID NO: 247530 - RNA, 32 nt, Human
ugaggugggaggaucgguugagcccaggaguu

SEQ ID NO: 247531 - RNA, 32 nt, Human
ugaggugggaggaucgguugaggccaggaguu

SEQ ID NO: 247532 - RNA, 32 nt, Human
ugaggugggaggaucucuugagcccagcaguu

SEQ ID NO: 247533 - RNA, 32 nt, Human
ugaggugggaggaucucuugagccugggaggu

SEQ ID NO: 247534 - RNA, 32 nt, Human
ugaggugggaggaucucuugaggccagcaguu

SEQ ID NO: 247535 - RNA, 32 nt, Human
ugaggugggaggaucucuugaggcugggaggc

SEQ ID NO: 247536 - RNA, 32 nt, Human
ugaggugggaggaucuuuugaacccaggaguu

SEQ ID NO: 247537 - RNA, 32 nt, Human
ugaggugggaggaugacuugaacgcaggaggc

SEQ ID NO: 247538 - RNA, 32 nt, Human
ugaggugggaggauggcuugagcccaggaguu

SEQ ID NO: 247539 - RNA, 32 nt, Human
ugaggugggaggauggcuugaggcccggaauu

SEQ ID NO: 247540 - RNA, 32 nt, Human
ugaggugggaggauggcuugaguccagaaguu

SEQ ID NO: 247541 - RNA, 32 nt, Human
ugaggugggaggauggcuugcgcucaggaggc

SEQ ID NO: 247542 - RNA, 32 nt, Human
ugaggugggaggaugguuugagcucaggcauu

SEQ ID NO: 247543 - RNA, 32 nt, Human
ugaggugggaggaugguuugggccccggaggu

SEQ ID NO: 247544 - RNA, 32 nt, Human
ugaggugggaggauugauugagcucaggaggu

SEQ ID NO: 247545 - RNA, 32 nt, Human
ugaggugggaggauugccugagcccaggaguu

SEQ ID NO: 247546 - RNA, 32 nt, Human
ugaggugggaggauugcuagaagccaggaguu

SEQ ID NO: 247547 - RNA, 32 nt, Human
ugaggugggaggauugcuugagaccagccugg

SEQ ID NO: 247548 - RNA, 32 nt, Human
ugaggugggaggauugcuugagccaaggaauu

SEQ ID NO: 247549 - RNA, 32 nt, Human
ugaggugggaggauugcuugagcccagcaggu

SEQ ID NO: 247550 - RNA, 32 nt, Human
ugaggugggaggauugcuugagcccaggaagu

SEQ ID NO: 247551 - RNA, 32 nt, Human
ugaggugggaggauugcuugagcccaggagag

SEQ ID NO: 247552 - RNA, 32 nt, Human
ugaggugggaggauugcuugagcccaggaggc

SEQ ID NO: 247553 - RNA, 32 nt, Human
ugaggugggaggauugcuugagcccaggaguu

SEQ ID NO: 247554 - RNA, 32 nt, Human
ugaggugggaggauugcuugagccuaggaggu

SEQ ID NO: 247555 - RNA, 32 nt, Human
ugaggugggaggauugcuugagccugggaggu

SEQ ID NO: 247556 - RNA, 32 nt, Human
ugaggugggaggauugcuugagcucaggaauu

SEQ ID NO: 247557 - RNA, 32 nt, Human
ugaggugggaggauugcuugaguccaggaguu

SEQ ID NO: 247558 - RNA, 32 nt, Human
ugaggugggaggauugcuugggccugggaggu

SEQ ID NO: 247559 - RNA, 32 nt, Human
ugaggugggaggauuguuugagcccaggaggu

SEQ ID NO: 247560 - RNA, 32 nt, Human
ugaggugggaggauuguuugagcccaggaguu

SEQ ID NO: 247561 - RNA, 32 nt, Human
ugaggugggaggauuguuugagccugggaggu

SEQ ID NO: 247562 - RNA, 32 nt, Human
ugaggugggagggucacuugaagcuaggaguu

SEQ ID NO: 247563 - RNA, 32 nt, Human
ugaggugggagggucgcuugagcccaggaguu

SEQ ID NO: 247564 - RNA, 32 nt, Human
ugaggugggaugaucacuugaggccaggaguu

SEQ ID NO: 247565 - RNA, 32 nt, Human
ugaggugggcagauagcuugagcugaggaguu

SEQ ID NO: 247566 - RNA, 32 nt, Human
ugaggugggcagaucacuugagcugggaguuc

SEQ ID NO: 247567 - RNA, 32 nt, Human
ugaggugggcagaucacuugaggccaggaguu

SEQ ID NO: 247568 - RNA, 32 nt, Human
ugaggugggcagaucacuugaggucaggaguu

SEQ ID NO: 247569 - RNA, 32 nt, Human
ugaggugggcagaucacuugagguuagaaguu

SEQ ID NO: 247570 - RNA, 32 nt, Human
ugaggugggcagaucuccugagcucaggaguu

SEQ ID NO: 247571 - RNA, 32 nt, Human
ugaggugggcaggcgaggagcgggaagaccau

SEQ ID NO: 247572 - RNA, 32 nt, Human
ugaggugggcggaucacuugaggucaggaguu

SEQ ID NO: 247573 - RNA, 32 nt, Human
ugaggugggcggaucacuugaugccaggaguu

SEQ ID NO: 247574 - RNA, 32 nt, Human
ugaggugggcggauuacuugagcccaggaguu

SEQ ID NO: 247575 - RNA, 32 nt, Human
ugaggugggcugacugcuugagcucaggaguu

SEQ ID NO: 247576 - RNA, 32 nt, Human
ugagguggggaccaagugauagagcccugauc

SEQ ID NO: 247577 - RNA, 32 nt, Human
ugagguggggcuaaggguggcucagcacuggc

SEQ ID NO: 247578 - RNA, 32 nt, Human
ugagguggggcugagguacaaagggggauuga

SEQ ID NO: 247579 - RNA, 32 nt, Human
ugaggugggggaaucacuugagccuagggagg

SEQ ID NO: 247580 - RNA, 32 nt, Human
ugagguggggugagacagagugggagagauua

SEQ ID NO: 247581 - RNA, 32 nt, Human
ugagguggguagauuacuugagcccaggaauu

SEQ ID NO: 247582 - RNA, 32 nt, Human
ugagguggguggaccacuugaggccaggaguu

SEQ ID NO: 247583 - RNA, 32 nt, Human
ugagguggguggaucacuggaguuugagacca

SEQ ID NO: 247584 - RNA, 32 nt, Human
ugagguggguggaucacugggucaggaguuug

SEQ ID NO: 247585 - RNA, 32 nt, Human
ugagguggguggaucacuugacaucaguaguu

SEQ ID NO: 247586 - RNA, 32 nt, Human
ugagguggguggaucacuugacgucaggaguu

SEQ ID NO: 247587 - RNA, 32 nt, Human
ugagguggguggaucacuugaggccgggaguu

SEQ ID NO: 247588 - RNA, 32 nt, Human
ugagguggguggaucacuugaggucaggagcu

SEQ ID NO: 247589 - RNA, 32 nt, Human
ugagguggguggaucacuugaggucaggaguu

SEQ ID NO: 247590 - RNA, 32 nt, Human
ugagguggguggaucaugaggucgggaguuca

SEQ ID NO: 247591 - RNA, 32 nt, Human
ugagguggguggauugcuugagcccaggaguu

SEQ ID NO: 247592 - RNA, 32 nt, Human
ugagguggguggauugcuugagcccagggauu

SEQ ID NO: 247593 - RNA, 32 nt, Human
ugaggugggugggagaggaagaaaguuggggu

SEQ ID NO: 247594 - RNA, 32 nt, Human
ugagguggguguaucacuugaggucaggaguu

SEQ ID NO: 247595 - RNA, 31 nt, Human
ugaggugguacaaucucggcucacugcaacc

SEQ ID NO: 247596 - RNA, 32 nt, Human
ugaggugguaggaucaccugaggucaggaguu

SEQ ID NO: 247597 - RNA, 32 nt, Human
ugagguggucaccaggauugagcuuccucagc

SEQ ID NO: 247598 - RNA, 32 nt, Human
ugaggugguggaggcggcggaggcggcggcgg

SEQ ID NO: 247599 - RNA, 32 nt, Human
ugaggugguucaggcucccaggaaaggcaacu

SEQ ID NO: 247600 - RNA, 32 nt, Human
ugaggugguugcaggccuggggcagagccugg

SEQ ID NO: 247601 - RNA, 21 nt, Human
ugagguguaugcagggcccuc

SEQ ID NO: 247602 - RNA, 32 nt, Human
ugaggugucuaaggaacaccuucaaauaaagc

SEQ ID NO: 247603 - RNA, 32 nt, Human
ugaggugucucacaucuuuaaucccagcaauu

SEQ ID NO: 247604 - RNA, 32 nt, Human
ugaggugucucacaucuuuaaucccagcaguu

SEQ ID NO: 247605 - RNA, 32 nt, Human
ugaggugucuccugaaaaacuggaccuguaau

SEQ ID NO: 247606 - RNA, 20 nt, Human
ugaggugugauugggcccuc

SEQ ID NO: 247607 - RNA, 32 nt, Human
ugaggugugguggcucaugccuguaaucccag

SEQ ID NO: 247608 - RNA, 32 nt, Human
ugaggugugugaggacgagcuggaccugcagc

SEQ ID NO: 247609 - RNA, 32 nt, Human
ugaggugugugggcuugucaacacagaauuca

SEQ ID NO: 247610 - RNA, 32 nt, Human
ugagguguucccuuucggauggcuccaagguc

SEQ ID NO: 247611 - RNA, 32 nt, Human
ugagguguuggguuugggggacgcuggcagcu

SEQ ID NO: 247612 - RNA, 32 nt, Human
ugagguguuuauaucccagcucugucaggcau

SEQ ID NO: 247613 - RNA, 32 nt, Human
ugagguguuucccuggcucugaagggguaggu

SEQ ID NO: 247614 - RNA, 32 nt, Human
ugagguuaagaguucaagaccagccuggccaa

SEQ ID NO: 247615 - RNA, 32 nt, Human
ugagguuaggacuucaagaccagccuggccaa

SEQ ID NO: 247616 - RNA, 32 nt, Human
ugagguuaggaguucaagaccagcccagccaa

SEQ ID NO: 247617 - RNA, 32 nt, Human
ugagguuaggaguucaagaccagccugaucaa

SEQ ID NO: 247618 - RNA, 32 nt, Human
ugagguuaggaguucaagaccagccuggccaa

SEQ ID NO: 247619 - RNA, 32 nt, Human
ugagguuaggaguucaagaucagccuggccaa

SEQ ID NO: 247620 - RNA, 32 nt, Human
ugagguucauuuuaggaacuaaccucauuagc

SEQ ID NO: 247621 - RNA, 32 nt, Human
ugagguuccucuuccaccccuugucaccuugg

SEQ ID NO: 247622 - RNA, 32 nt, Human
ugagguucggcucacacugagaucggggcugg

SEQ ID NO: 247623 - RNA, 24 nt, Human
ugagguucucaaggucacaggccc

SEQ ID NO: 247624 - RNA, 32 nt, Human
ugagguucugccucuguggcuguguuugaaaa

SEQ ID NO: 247625 - RNA, 32 nt, Human
ugagguucuggccccugucauccucaugcugc

SEQ ID NO: 247626 - RNA, 32 nt, Human
ugagguucuuugucugcuggcagcuaggggcg

SEQ ID NO: 247627 - RNA, 32 nt, Human
ugagguugacuuagggaacaagcccugggauu

SEQ ID NO: 247628 - RNA, 32 nt, Human
ugagguugagccugguugcuauaaagacuuug

SEQ ID NO: 247629 - RNA, 32 nt, Human
ugagguugcgccacuacacuccagccugggug

SEQ ID NO: 247630 - RNA, 32 nt, Human
ugagguugcuggccucaaaaccaugcuugagu

SEQ ID NO: 247631 - RNA, 23 nt, Human
ugagguuggaaagaguugccaua

SEQ ID NO: 247632 - RNA, 32 nt, Human
ugagguuggaggaggaaagagaaggggagcag

SEQ ID NO: 247633 - RNA, 32 nt, Human
ugagguuggaggaucgcuugagccugggaggu

SEQ ID NO: 247634 - RNA, 32 nt, Human
ugagguugggaggaucaccugagcccaaggag

SEQ ID NO: 247635 - RNA, 32 nt, Human
ugagguugggaguucaagaccagccugaccaa

SEQ ID NO: 247636 - RNA, 32 nt, Human
ugagguugggaguucaagaccagccuggccaa

SEQ ID NO: 247637 - RNA, 32 nt, Human
ugagguugggaguucaagaccagccuggucaa

SEQ ID NO: 247638 - RNA, 32 nt, Human
ugagguugggaguucgagaccaaccugaccaa

SEQ ID NO: 247639 - RNA, 32 nt, Human
ugagguugggcugagacccugcuucucuuccc

SEQ ID NO: 247640 - RNA, 32 nt, Human
ugagguugucaccacucagacuucaccuauuc

SEQ ID NO: 247641 - RNA, 32 nt, Human
ugagguugugccacugcacuccagccugggug

SEQ ID NO: 247642 - RNA, 32 nt, Human
ugagguuguguaguuuagauaggucacagagu

SEQ ID NO: 247643 - RNA, 32 nt, Human
ugagguuguguugugucuucuaagcgugguac

SEQ ID NO: 247644 - RNA, 32 nt, Human
ugagguuguuaaaacagaaaagguucugaaua

SEQ ID NO: 247645 - RNA, 32 nt, Human
ugagguuuaggguucaaaaugauggaaggccg

SEQ ID NO: 247646 - RNA, 32 nt, Human
ugagguuuccuaaagaagauggaauucuccuu

SEQ ID NO: 247647 - RNA, 32 nt, Human
ugagguuugaagaugggucucaagugcuaagu

SEQ ID NO: 247648 - RNA, 32 nt, Human
ugagguuugugaggacuggagaucgaacaugu

SEQ ID NO: 247649 - RNA, 32 nt, Human
ugagguuuucuuuccaggacagccugguuucc

SEQ ID NO: 247650 - RNA, 32 nt, Human
ugaguaaagcgcuuuggucaaacacacaaaaa

SEQ ID NO: 247651 - RNA, 32 nt, Human
ugaguaacaggcaccuuugcagagagcaaaga

SEQ ID NO: 247652 - RNA, 32 nt, Human
ugaguaacauggugaaaccccaucucuacgaa

SEQ ID NO: 247653 - RNA, 32 nt, Human
ugaguaagaaucugaugauugugcacagugac

SEQ ID NO: 247654 - RNA, 32 nt, Human
ugaguaagaugacuuguugacugugaaaguga

SEQ ID NO: 247655 - RNA, 32 nt, Human
ugaguaaggacaccuccagccauacagaaacc

SEQ ID NO: 247656 - RNA, 32 nt, Human
ugaguaaggaugaagcuuugagccuccugccc

SEQ ID NO: 247657 - RNA, 32 nt, Human
ugaguaaggguaagggcgcauggaauggggcu

SEQ ID NO: 247658 - RNA, 32 nt, Human
ugaguaagucuacacucuuaagucgguaugaa

SEQ ID NO: 247659 - RNA, 32 nt, Human
ugaguaauacagccccaggggagggaggagac

SEQ ID NO: 247660 - RNA, 32 nt, Human
ugaguaaugcauucuaaacauccuaccccacu

SEQ ID NO: 247661 - RNA, 32 nt, Human
ugaguaauucacugaauugaugguuagcaaga

SEQ ID NO: 247662 - RNA, 32 nt, Human
ugaguaauuucuuuguucuuccuaccuggagg

SEQ ID NO: 247663 - RNA, 32 nt, Human
ugaguaauuuggaacccaaaagugaagaucuu

SEQ ID NO: 247664 - RNA, 32 nt, Human
ugaguacaacuugcauaugucaucccauauaa

SEQ ID NO: 247665 - RNA, 32 nt, Human
ugaguacaggaagagauucuguuauagcucag

SEQ ID NO: 247666 - RNA, 32 nt, Human
ugaguacaguacccagggguucuuggagaaga

SEQ ID NO: 247667 - RNA, 32 nt, Human
ugaguacauacagccuuggaacaaaaugagag

SEQ ID NO: 247668 - RNA, 32 nt, Human
ugaguacaugugcacacacgugugcacaaaug

SEQ ID NO: 247669 - RNA, 32 nt, Human
ugaguaccacuuuauauuuucucuuccauagu

SEQ ID NO: 247670 - RNA, 32 nt, Human
ugaguaccccuuuagugcuauauuugugccau

SEQ ID NO: 247671 - RNA, 32 nt, Human
ugaguaccugugcaugcaagacacuguccugg

SEQ ID NO: 247672 - RNA, 32 nt, Human
ugaguacggagggucuagccugggugaguacg

SEQ ID NO: 247673 - RNA, 32 nt, Human
ugaguacuguggauauuuaaaauaucacagua

SEQ ID NO: 247674 - RNA, 32 nt, Human
ugaguagaaaaugagaauacuaaaaaugugaa

SEQ ID NO: 247675 - RNA, 32 nt, Human
ugaguagacacaaacuccacuguccauccuga

SEQ ID NO: 247676 - RNA, 32 nt, Human
ugaguagagcaaaccaucaagcauuaauugac

SEQ ID NO: 247677 - RNA, 32 nt, Human
ugaguagagcccaugcaaaggaagggaugggg

SEQ ID NO: 247678 - RNA, 32 nt, Human
ugaguagcaggggcagcaccucucacaggggc

SEQ ID NO: 247679 - RNA, 32 nt, Human
ugaguagccacugcacuccagccugggcaacg

SEQ ID NO: 247680 - RNA, 32 nt, Human
ugaguagcucagacuugguuuugccaaaacuc

SEQ ID NO: 247681 - RNA, 32 nt, Human
ugaguagcugggacuacagauguaggcgaaua

SEQ ID NO: 247682 - RNA, 20 nt, Human
ugaguagcugggacuacagg

SEQ ID NO: 247683 - RNA, 32 nt, Human
ugaguagcugggacuucaggagacugaagcca

SEQ ID NO: 247684 - RNA, 32 nt, Human
ugaguagcugguagcugggacuauaggcacgu

SEQ ID NO: 247685 - RNA, 32 nt, Human
ugaguaggagccugaagagcuaggaguaucuu

SEQ ID NO: 247686 - RNA, 32 nt, Human
ugaguagggcugguuuacuauugcuucuugua

SEQ ID NO: 247687 - RNA, 32 nt, Human
ugaguaggugaggagauuaaaagggagccaua

SEQ ID NO: 247688 - RNA, 32 nt, Human
ugaguaggugcccugcaaaggugcaggggauc

SEQ ID NO: 247689 - RNA, 20 nt, Human
ugaguagguguaggaaggag

SEQ ID NO: 247690 - RNA, 32 nt, Human
ugaguaguuuuuaaacauuuuuccuguccuuu

SEQ ID NO: 247691 - RNA, 32 nt, Human
ugaguauacaaguauaucuccucuuuugcuau

SEQ ID NO: 247692 - RNA, 32 nt, Human
ugaguauagcaaaccaucaagcauuaauugac

SEQ ID NO: 247693 - RNA, 32 nt, Human
ugaguauagcaaaccaucaagcauuaauuggc

SEQ ID NO: 247694 - RNA, 32 nt, Human
ugaguauccaccaugugccaggcacagugcug

SEQ ID NO: 247695 - RNA, 32 nt, Human
ugaguaucccuuagaugagaugcuugggacca

SEQ ID NO: 247696 - RNA, 32 nt, Human
ugaguaugccgcugcacuccagccugggggac

SEQ ID NO: 247697 - RNA, 32 nt, Human
ugaguaugccugucccggacccuggugggcca

SEQ ID NO: 247698 - RNA, 32 nt, Human
ugaguaugugugcacacacgugugcauguucc

SEQ ID NO: 247699 - RNA, 32 nt, Human
ugaguauuccuggcagugagguucccaggccg

SEQ ID NO: 247700 - RNA, 32 nt, Human
ugaguauuucuucccagcuccuggccucacau

SEQ ID NO: 247701 - RNA, 19 nt, Human
ugagucaaaaugacacagc

SEQ ID NO: 247702 - RNA, 32 nt, Human
ugagucaaaccacugcaauccagccugggcaa

SEQ ID NO: 247703 - RNA, 32 nt, Human
ugagucaaaccucacccugaaaaccuuugcgc

SEQ ID NO: 247704 - RNA, 32 nt, Human
ugagucaagccaaguaaagcccagagaagauu

SEQ ID NO: 247705 - RNA, 24 nt, Human
ugagucaagugauccucccaccuu

SEQ ID NO: 247706 - RNA, 32 nt, Human
ugagucacacagaugggugagcaguguuuuau

SEQ ID NO: 247707 - RNA, 32 nt, Human
ugagucacacaggacagaggaggcagagcuuc

SEQ ID NO: 247708 - RNA, 32 nt, Human
ugagucacagcccaggugcccggaagcagccu

SEQ ID NO: 247709 - RNA, 32 nt, Human
ugagucacagcugaaugacugaagagcugaac

SEQ ID NO: 247710 - RNA, 32 nt, Human
ugagucacaggccggguguggaagaggaaagu

SEQ ID NO: 247711 - RNA, 32 nt, Human
ugagucacaucagaagcacauugcuccacccc

SEQ ID NO: 247712 - RNA, 32 nt, Human
ugagucaccacugacuguugcccugggcauag

SEQ ID NO: 247713 - RNA, 32 nt, Human
ugagucaccgcugagagcagcugcaguagcug

SEQ ID NO: 247714 - RNA, 32 nt, Human
ugagucacugaaugucaccaggagaggugggg

SEQ ID NO: 247715 - RNA, 32 nt, Human
ugagucacugaauucgaggaggguggggcagg

SEQ ID NO: 247716 - RNA, 32 nt, Human
ugagucacugguuucucaccugcaaaagaaag

SEQ ID NO: 247717 - RNA, 32 nt, Human
ugagucagacagagcaccagccuuggggaccc

SEQ ID NO: 247718 - RNA, 21 nt, Human
ugagucagagucucgcucugu

SEQ ID NO: 247719 - RNA, 32 nt, Human
ugagucagagucuugcucuguugcccgggcug

SEQ ID NO: 247720 - RNA, 32 nt, Human
ugagucagauacacaaggacccuucagguguu

SEQ ID NO: 247721 - RNA, 32 nt, Human
ugagucagaucgugccacugcacuccagccug

SEQ ID NO: 247722 - RNA, 32 nt, Human
ugagucagcacacaucuucccacucgguagac

SEQ ID NO: 247723 - RNA, 32 nt, Human
ugagucagcacucaccuggccugggggaauua

SEQ ID NO: 247724 - RNA, 32 nt, Human
ugagucagcaggaccuggaaucccagaugaga

SEQ ID NO: 247725 - RNA, 23 nt, Human
ugagucaggagaauugcuugaac

SEQ ID NO: 247726 - RNA, 32 nt, Human
ugagucaggaggaugacuugagcccaggaguu

SEQ ID NO: 247727 - RNA, 32 nt, Human
ugagucaggagguugaggcugcagugagcuau

SEQ ID NO: 247728 - RNA, 18 nt, Human
ugagucaggaguucgaga

SEQ ID NO: 247729 - RNA, 32 nt, Human
ugagucaggauuggaucaacagccuccucucu

SEQ ID NO: 247730 - RNA, 32 nt, Human
ugagucaggccuucugguuauauugugcaguu

SEQ ID NO: 247731 - RNA, 19 nt, Human
ugagucagugaguggugaa

SEQ ID NO: 247732 - RNA, 32 nt, Human
ugagucaguguacuuuauagugugaauccugu

SEQ ID NO: 247733 - RNA, 32 nt, Human
ugagucaguguggaagagaggugagggugugc

SEQ ID NO: 247734 - RNA, 32 nt, Human
ugagucaguuagguagucuggaagagagaauc

SEQ ID NO: 247735 - RNA, 32 nt, Human
ugagucaguucuguguggguggucacaggagg

SEQ ID NO: 247736 - RNA, 32 nt, Human
ugagucauagaucuuggcuuccuuuagaagcc

SEQ ID NO: 247737 - RNA, 32 nt, Human
ugagucauccccagggaucaggagccuccagc

SEQ ID NO: 247738 - RNA, 17 nt, Human
ugagucaucucaagucc

SEQ ID NO: 247739 - RNA, 32 nt, Human
ugagucaucugaaggcuuggaccccaaggaug

SEQ ID NO: 247740 - RNA, 32 nt, Human
ugagucaugggaaucacuugaaccugggaggc

SEQ ID NO: 247741 - RNA, 32 nt, Human
ugagucauucuuuccacccccuggccgcacgu

SEQ ID NO: 247742 - RNA, 32 nt, Human
ugaguccaagaguuugagacaagccugagcaa

SEQ ID NO: 247743 - RNA, 32 nt, Human
ugaguccaagaguuugagaccagccugagcaa

SEQ ID NO: 247744 - RNA, 32 nt, Human
ugaguccagaaaguggcaguugcagugagugg

SEQ ID NO: 247745 - RNA, 32 nt, Human
ugaguccagaagacugccucaguggcucauac

SEQ ID NO: 247746 - RNA, 32 nt, Human
ugaguccagaagcaagaccugugagagugcac

SEQ ID NO: 247747 - RNA, 32 nt, Human
ugaguccagagaaagugcucagugaugcuugu

SEQ ID NO: 247748 - RNA, 32 nt, Human
ugaguccagccucguggucuucuccaagaugc

SEQ ID NO: 247749 - RNA, 32 nt, Human
ugaguccaggaggcggaggcugcagugagcug

SEQ ID NO: 247750 - RNA, 32 nt, Human
ugaguccaggaggucgaggcugcagugagcca

SEQ ID NO: 247751 - RNA, 32 nt, Human
ugaguccaggagguugaggcugcagucagcuc

SEQ ID NO: 247752 - RNA, 32 nt, Human
ugaguccaggagguugaggcugcagugagcug

SEQ ID NO: 247753 - RNA, 32 nt, Human
ugaguccaggaguucaaggccagccugggcaa

SEQ ID NO: 247754 - RNA, 32 nt, Human
ugaguccagggauucaaggccaaccugggcaa

SEQ ID NO: 247755 - RNA, 32 nt, Human
ugaguccauacaggagaagaaagaucuguuuc

SEQ ID NO: 247756 - RNA, 32 nt, Human
ugaguccauccaugcuuuagcagcugcuccuc

SEQ ID NO: 247757 - RNA, 32 nt, Human
ugaguccaugagucuaaguauagccacugaug

SEQ ID NO: 247758 - RNA, 32 nt, Human
ugaguccaugggaacagccccacugcaaacaa

SEQ ID NO: 247759 - RNA, 32 nt, Human
ugagucccaggcugagccucagucucccuccc

SEQ ID NO: 247760 - RNA, 32 nt, Human
ugaguccccaugccaugggcaaggggcccaau

SEQ ID NO: 247761 - RNA, 32 nt, Human
ugagucccccuuccuuuuuaaucuucuucccc

SEQ ID NO: 247762 - RNA, 32 nt, Human
ugaguccccuaagucccuuucucaguuugcaa

SEQ ID NO: 247763 - RNA, 32 nt, Human
ugagucccgagcacagcaccuucccagucucc

SEQ ID NO: 247764 - RNA, 32 nt, Human
ugagucccuccuccucuucucccaugccuucc

SEQ ID NO: 247765 - RNA, 32 nt, Human
ugagucccucucagaaaacagagcuaagacaa

SEQ ID NO: 247766 - RNA, 32 nt, Human
ugagucccugcagcucugggucugguucuuca

SEQ ID NO: 247767 - RNA, 32 nt, Human
ugaguccgaccuggccugucugugaagagcaa

SEQ ID NO: 247768 - RNA, 32 nt, Human
ugaguccuaagacugcagucaaagccagaacu

SEQ ID NO: 247769 - RNA, 32 nt, Human
ugaguccucaaagaugacagagcuaggaaagg

SEQ ID NO: 247770 - RNA, 32 nt, Human
ugaguccuccacucgcaucucccuccccugcc

SEQ ID NO: 247771 - RNA, 32 nt, Human
ugaguccuggaccucagccuagauguaaccuu

SEQ ID NO: 247772 - RNA, 32 nt, Human
ugaguccuggacuggacugaacauccagaaag

SEQ ID NO: 247773 - RNA, 32 nt, Human
ugaguccuggaguuugagaccaacaugggcaa

SEQ ID NO: 247774 - RNA, 20 nt, Human
ugaguccuggccucugugga

SEQ ID NO: 247775 - RNA, 32 nt, Human
ugaguccugugcuguuggcaaagugccaggca

SEQ ID NO: 247776 - RNA, 32 nt, Human
ugaguccuuaagggcgguccaagccucccgau

SEQ ID NO: 247777 - RNA, 32 nt, Human
ugaguccuugcugugggaugugccaguguccc

SEQ ID NO: 247778 - RNA, 32 nt, Human
ugaguccuuguggacaaccacacacacgugcc

SEQ ID NO: 247779 - RNA, 32 nt, Human
ugagucgagaagaaggaaagagagggaugggg

SEQ ID NO: 247780 - RNA, 32 nt, Human
ugagucgagaucauugcacuccagccugggca

SEQ ID NO: 247781 - RNA, 32 nt, Human
ugagucgcugggccagggugaggaccugggcc

SEQ ID NO: 247782 - RNA, 32 nt, Human
ugagucggacuaauccaaacagugggugauuu

SEQ ID NO: 247783 - RNA, 32 nt, Human
ugagucggcugugauuccauucccucugcuuu

SEQ ID NO: 247784 - RNA, 32 nt, Human
ugagucgggaggauagcgugagcccaggaguu

SEQ ID NO: 247785 - RNA, 32 nt, Human
ugagucgggggagaggauggcagagacuuuau

SEQ ID NO: 247786 - RNA, 32 nt, Human
ugagucgugugccucuauuggaggauggcugu

SEQ ID NO: 247787 - RNA, 32 nt, Human
ugagucuagagaaaugaccaggguggugaaga

SEQ ID NO: 247788 - RNA, 32 nt, Human
ugagucuagccugggagccaggauacuggggu

SEQ ID NO: 247789 - RNA, 32 nt, Human
ugagucuaggaguucaagaccagccuggccaa

SEQ ID NO: 247790 - RNA, 32 nt, Human
ugagucuaugaguucaagaccagccugggcaa

SEQ ID NO: 247791 - RNA, 32 nt, Human
ugagucucacuccaucagccaggcuggagugc

SEQ ID NO: 247792 - RNA, 32 nt, Human
ugagucucauuucucuggauucccacggcagc

SEQ ID NO: 247793 - RNA, 32 nt, Human
ugagucuccacaaccuucuuuggaaagcucgg

SEQ ID NO: 247794 - RNA, 32 nt, Human
ugagucuccaggucuccagccagauccgggga

SEQ ID NO: 247795 - RNA, 32 nt, Human
ugagucuccugccucagccuccccaguagcug

SEQ ID NO: 247796 - RNA, 32 nt, Human
ugagucucgauguguaggccuuuccauuccau

SEQ ID NO: 247797 - RNA, 32 nt, Human
ugagucucgcucugcacuccagccuggcgacu

SEQ ID NO: 247798 - RNA, 32 nt, Human
ugagucucucccaccaugcaugcaggucacug

SEQ ID NO: 247799 - RNA, 32 nt, Human
ugagucucucccccuggaaucuucuaucuggg

SEQ ID NO: 247800 - RNA, 32 nt, Human
ugagucucuccucuucuccaucuucacuggcu

SEQ ID NO: 247801 - RNA, 32 nt, Human
ugagucucucucuguugcccaggcuggaguac

SEQ ID NO: 247802 - RNA, 32 nt, Human
ugagucucugaggaggugucaggcugggcuca

SEQ ID NO: 247803 - RNA, 32 nt, Human
ugagucucuguacaauuacuucagugccuuug

SEQ ID NO: 247804 - RNA, 32 nt, Human
ugagucucuuauuuaucugcagaaggaacuuu

SEQ ID NO: 247805 - RNA, 32 nt, Human
ugagucugaggcuuccauccggggacaauguc

SEQ ID NO: 247806 - RNA, 32 nt, Human
ugagucugaguccugucucugccugcggccca

SEQ ID NO: 247807 - RNA, 32 nt, Human
ugagucugcaccuccaggcaggcucugugcag

SEQ ID NO: 247808 - RNA, 31 nt, Human
ugagucugccucuugugcuuggugucuuuug

SEQ ID NO: 247809 - RNA, 32 nt, Human
ugagucugcgggagaagagcggcccuaugcau

SEQ ID NO: 247810 - RNA, 32 nt, Human
ugagucugcuccauccaugugucuguuugggg

SEQ ID NO: 247811 - RNA, 32 nt, Human
ugagucugcuucagucuggagcuguuuguggg

SEQ ID NO: 247812 - RNA, 32 nt, Human
ugagucugcuuccacguccucucccaggaaca

SEQ ID NO: 247813 - RNA, 32 nt, Human
ugagucugcuucuccccuuuggaguuaggaag

SEQ ID NO: 247814 - RNA, 32 nt, Human
ugagucuggcgugccuggcgggcacagccaua

SEQ ID NO: 247815 - RNA, 32 nt, Human
ugagucugggacugcccuggccuaagaugggc

SEQ ID NO: 247816 - RNA, 32 nt, Human
ugagucugggagaaggaggcuacagugagcug

SEQ ID NO: 247817 - RNA, 32 nt, Human
ugagucugggaggcggagguugcagugagcug

SEQ ID NO: 247818 - RNA, 32 nt, Human
ugagucugggagguggaggcugcagugagccg

SEQ ID NO: 247819 - RNA, 32 nt, Human
ugagucuguaggagcaagggcacaaacugcag

SEQ ID NO: 247820 - RNA, 32 nt, Human
ugagucuguggcuggagacaguggggucuaug

SEQ ID NO: 247821 - RNA, 21 nt, Human
ugagucuguuguguggaugug

SEQ ID NO: 247822 - RNA, 32 nt, Human
ugagucuuacccuucaugggcugcagaggccc

SEQ ID NO: 247823 - RNA, 32 nt, Human
ugagucuucaggagacggagacauauggaaug

SEQ ID NO: 247824 - RNA, 32 nt, Human
ugagucuuccaggaccgucccacccugcugac

SEQ ID NO: 247825 - RNA, 32 nt, Human
ugagucuugcagaaugaaaggcaucacaggag

SEQ ID NO: 247826 - RNA, 32 nt, Human
ugagucuugcccaaacauucuuucuuuuugug

SEQ ID NO: 247827 - RNA, 32 nt, Human
ugagucuugguauccagguauugcuucaaacu

SEQ ID NO: 247828 - RNA, 29 nt, Human
ugagucuuggugcuaucaaucaccgucug

SEQ ID NO: 247829 - RNA, 32 nt, Human
ugagucuugguggaaacagagucuugacauga

SEQ ID NO: 247830 - RNA, 32 nt, Human
ugagucuuguugugaauauuucuuugaugauu

SEQ ID NO: 247831 - RNA, 18 nt, Human
ugagucuuuaacaucuug

SEQ ID NO: 247832 - RNA, 32 nt, Human
ugagucuuuaguuuuagucaugggcuuucuuc

SEQ ID NO: 247833 - RNA, 32 nt, Human
ugagucuuugggcgcagaagacccggguuaau

SEQ ID NO: 247834 - RNA, 32 nt, Human
ugagucuuuuagggagggugacugggaggugc

SEQ ID NO: 247835 - RNA, 32 nt, Human
ugagugaaaccagcuagugugucaacagugaa

SEQ ID NO: 247836 - RNA, 24 nt, Human
ugagugaaauggaggcaacaggag

SEQ ID NO: 247837 - RNA, 32 nt, Human
ugagugaacagaaccauagcuuucuagguacu

SEQ ID NO: 247838 - RNA, 32 nt, Human
ugagugaacugcagccuggcaccaccacaccc

SEQ ID NO: 247839 - RNA, 32 nt, Human
ugagugaaguaagaacucugcuagagaggaaa

SEQ ID NO: 247840 - RNA, 32 nt, Human
ugagugaauuaaugugugugaggacacuaaga

SEQ ID NO: 247841 - RNA, 32 nt, Human
ugagugacagagaggaaggaggaggaaugaga

SEQ ID NO: 247842 - RNA, 32 nt, Human
ugagugaccagcucuguggcccugugucguca

SEQ ID NO: 247843 - RNA, 32 nt, Human
ugagugacccugguuucugagcuccagaaacu

SEQ ID NO: 247844 - RNA, 32 nt, Human
ugagugaccugcuuccugauugcgcagacuga

SEQ ID NO: 247845 - RNA, 32 nt, Human
ugagugacuggguugacugggacagggaaagg

SEQ ID NO: 247846 - RNA, 32 nt, Human
ugagugagagugaagaggaaccagcaggcuuc

SEQ ID NO: 247847 - RNA, 32 nt, Human
ugagugagagugcuccuggugccaugaacgga

SEQ ID NO: 247848 - RNA, 32 nt, Human
ugagugagauugcugguccucucccgggaucc

SEQ ID NO: 247849 - RNA, 32 nt, Human
ugagugagcacacccgugugcacacucauaca

SEQ ID NO: 247850 - RNA, 32 nt, Human
ugagugagcacuagcagaggaugggagcuaca

SEQ ID NO: 247851 - RNA, 32 nt, Human
ugagugaggagagaaaggggaaagaaauugaa

SEQ ID NO: 247852 - RNA, 32 nt, Human
ugagugaggagaguuggugggccaggucaggc

SEQ ID NO: 247853 - RNA, 32 nt, Human
ugagugaggaggaggagaggaagugggagaag

SEQ ID NO: 247854 - RNA, 32 nt, Human
ugagugaggaggaggaggaggagaaggaggag

SEQ ID NO: 247855 - RNA, 32 nt, Human
ugagugaggcaaggcaggagaauugcuggaac

SEQ ID NO: 247856 - RNA, 32 nt, Human
ugagugaggccuggugccagagcugugcggac

SEQ ID NO: 247857 - RNA, 32 nt, Human
ugagugaggggugacccaggaagaacguguca

SEQ ID NO: 247858 - RNA, 32 nt, Human
ugagugagggugcagaccccugccugugauca

SEQ ID NO: 247859 - RNA, 32 nt, Human
ugagugagguagauugcugucccguuaacaua

SEQ ID NO: 247860 - RNA, 32 nt, Human
ugagugaguaucuuggugaugacuccuccuga

SEQ ID NO: 247861 - RNA, 32 nt, Human
ugagugagugaauuuucauguggcuggguggg

SEQ ID NO: 247862 - RNA, 32 nt, Human
ugagugagugguaaaggccccguuuuuacucu

SEQ ID NO: 247863 - RNA, 32 nt, Human
ugagugaguuugcagaaagcagguggugagcu

SEQ ID NO: 247864 - RNA, 32 nt, Human
ugagugauccucccgccccagccuccugagua

SEQ ID NO: 247865 - RNA, 32 nt, Human
ugagugcaagaguucaagaucagacuggacaa

SEQ ID NO: 247866 - RNA, 32 nt, Human
ugagugcaccucagagcacaggggcccagagc

SEQ ID NO: 247867 - RNA, 32 nt, Human
ugagugcagagcugugggggcacccaaguccu

SEQ ID NO: 247868 - RNA, 32 nt, Human
ugagugcagcaucuuucccacauucaauauga

SEQ ID NO: 247869 - RNA, 32 nt, Human
ugagugcaggagggcagacacaacacucaguu

SEQ ID NO: 247870 - RNA, 32 nt, Human
ugagugcaggaguucaaggacagccuggguaa

SEQ ID NO: 247871 - RNA, 32 nt, Human
ugagugcaggugggcauaggugcagugagugc

SEQ ID NO: 247872 - RNA, 24 nt, Human
ugagugcaguggcucacgucugua

SEQ ID NO: 247873 - RNA, 32 nt, Human
ugagugcaguuugaacuugagauacagucaac

SEQ ID NO: 247874 - RNA, 32 nt, Human
ugagugcauagaguuggaaaggggagcgaaug

SEQ ID NO: 247875 - RNA, 32 nt, Human
ugagugccaccaaguucuaggaccugguucua

SEQ ID NO: 247876 - RNA, 32 nt, Human
ugagugccagccugagccugcauggugccgcc

SEQ ID NO: 247877 - RNA, 32 nt, Human
ugagugcccacggaggcccccagcacacccaa

SEQ ID NO: 247878 - RNA, 22 nt, Human
ugagugcccagacugauaggag

SEQ ID NO: 247879 - RNA, 32 nt, Human
ugagugccucggugccaccccaguggaugucc

SEQ ID NO: 247880 - RNA, 32 nt, Human
ugagugccugagucauccaaggccaguauugu

SEQ ID NO: 247881 - RNA, 32 nt, Human
ugagugccugcagcuauuguaaauguuaaagu

SEQ ID NO: 247882 - RNA, 32 nt, Human
ugagugccuggugugacgucucucaggaugcc

SEQ ID NO: 247883 - RNA, 32 nt, Human
ugagugccuguaaucccagcuacuugggaggc

SEQ ID NO: 247884 - RNA, 32 nt, Human
ugagugccuuugacccccuccccgucagcccu

SEQ ID NO: 247885 - RNA, 24 nt, Human
ugagugcgguggcuuacaccugua

SEQ ID NO: 247886 - RNA, 32 nt, Human
ugagugcgugggucagugucugcaugaagugg

SEQ ID NO: 247887 - RNA, 32 nt, Human
ugagugcuacacgaacacaaguagaaguauua

SEQ ID NO: 247888 - RNA, 29 nt, Human
ugagugcucaauaaauauaaacuaaugag

SEQ ID NO: 247889 - RNA, 32 nt, Human
ugagugcucaccaacgggugaccucagcaacg

SEQ ID NO: 247890 - RNA, 32 nt, Human
ugagugcuccgggccuugccccgcccuguguc

SEQ ID NO: 247891 - RNA, 25 nt, Human
ugagugcucgcagcucauaccugug

SEQ ID NO: 247892 - RNA, 32 nt, Human
ugagugcugaggguaguuugcauugcagaguu

SEQ ID NO: 247893 - RNA, 32 nt, Human
ugagugcugcugcagagggaagcuggggucca

SEQ ID NO: 247894 - RNA, 32 nt, Human
ugagugcuggccaggcuuuccugggcaucagg

SEQ ID NO: 247895 - RNA, 32 nt, Human
ugagugcuggcuucuagccucuccaguucccu

SEQ ID NO: 247896 - RNA, 24 nt, Human
ugagugcuguggcucacaccugua

SEQ ID NO: 247897 - RNA, 32 nt, Human
ugagugcugugggagcaucucaccguggcagc

SEQ ID NO: 247898 - RNA, 32 nt, Human
ugagugcuuaccaaauggcaagcauugugcug

SEQ ID NO: 247899 - RNA, 32 nt, Human
ugagugcuuagaguguuacaguucccacccau

SEQ ID NO: 247900 - RNA, 32 nt, Human
ugagugcuugcaugaacuccauuuuucuuuuc

SEQ ID NO: 247901 - RNA, 32 nt, Human
ugagugcuuuccucuucuucaacacucaaccc

SEQ ID NO: 247902 - RNA, 23 nt, Human
ugaguggaacagacagaugggug

SEQ ID NO: 247903 - RNA, 31 nt, Human
ugaguggaacaggagccgggcauucagagag

SEQ ID NO: 247904 - RNA, 32 nt, Human
ugaguggacauucuuggugaaauguuguauaa

SEQ ID NO: 247905 - RNA, 32 nt, Human
ugaguggacucugccagugccugguggaacug

SEQ ID NO: 247906 - RNA, 32 nt, Human
ugaguggagaggaggaggaggaugaagaaggu

SEQ ID NO: 247907 - RNA, 23 nt, Human
ugaguggauugcuugagccuagg

SEQ ID NO: 247908 - RNA, 32 nt, Human
ugaguggcagaucuuguuuuacacucccaugg

SEQ ID NO: 247909 - RNA, 32 nt, Human
ugaguggcagccgccucccuuaugcaggacau

SEQ ID NO: 247910 - RNA, 32 nt, Human
ugaguggccucuuguguccugcagagauuuaa

SEQ ID NO: 247911 - RNA, 31 nt, Human
ugaguggcuggacucucagccagccacuggg

SEQ ID NO: 247912 - RNA, 32 nt, Human
ugagugggaaggaagcugagagccuaugauua

SEQ ID NO: 247913 - RNA, 32 nt, Human
ugagugggaagugggugccuugcgggguuggg

SEQ ID NO: 247914 - RNA, 32 nt, Human
ugagugggacugcuccuauguucugccccgca

SEQ ID NO: 247915 - RNA, 32 nt, Human
ugagugggcagguuuggaggagcagccaggga

SEQ ID NO: 247916 - RNA, 32 nt, Human
ugagugggcaucuuccugggaugcaggggagu

SEQ ID NO: 247917 - RNA, 21 nt, Human
ugagugggcccugcccgggga

SEQ ID NO: 247918 - RNA, 32 nt, Human
ugagugggccgauccagcuauaucaagaaccu

SEQ ID NO: 247919 - RNA, 32 nt, Human
ugagugggcugguuguuagcagguuuguuuuu

SEQ ID NO: 247920 - RNA, 32 nt, Human
ugaguggggagagagaaggggaggaguagggu

SEQ ID NO: 247921 - RNA, 32 nt, Human
ugaguggggagagguugggcagugagugaggg

SEQ ID NO: 247922 - RNA, 32 nt, Human
ugaguggggcagagggacagggcagccagacc

SEQ ID NO: 247923 - RNA, 32 nt, Human
ugaguggggcagaucacuugaggucaggaguu

SEQ ID NO: 247924 - RNA, 32 nt, Human
ugagugggugaggugacccuugaccuccuggg

SEQ ID NO: 247925 - RNA, 32 nt, Human
ugaguggguuggggguguauguuugcaaggau

SEQ ID NO: 247926 - RNA, 32 nt, Human
ugaguggucacuggucagggcaguggccaagc

SEQ ID NO: 247927 - RNA, 32 nt, Human
ugaguggucuuugucugccuaaacccagaguu

SEQ ID NO: 247928 - RNA, 32 nt, Human
ugaguggugggcaggccaguggcagggccggc

SEQ ID NO: 247929 - RNA, 32 nt, Human
ugaguggugguggagggugggggugcacugca

SEQ ID NO: 247930 - RNA, 32 nt, Human
ugagugguuccuucaagcugggugucuuucca

SEQ ID NO: 247931 - RNA, 32 nt, Human
ugagugguuggcaaacuacagcccaaaggcca

SEQ ID NO: 247932 - RNA, 32 nt, Human
ugagugguugggugaugggcucugcugacgug

SEQ ID NO: 247933 - RNA, 32 nt, Human
ugagugguuguuuucuguguaaagagccguuu

SEQ ID NO: 247934 - RNA, 32 nt, Human
ugagugguuuacaugucuucucuccuuuaaca

SEQ ID NO: 247935 - RNA, 32 nt, Human
ugagugguuuauccucuccaaucugcuccuca

SEQ ID NO: 247936 - RNA, 32 nt, Human
ugaguguaaguucauguaggagaguguaugcg

SEQ ID NO: 247937 - RNA, 32 nt, Human
ugaguguacauauauacacauauacacaucua

SEQ ID NO: 247938 - RNA, 32 nt, Human
ugaguguagaggaggcugaaaggaggaagaga

SEQ ID NO: 247939 - RNA, 32 nt, Human
ugaguguagggagugugggagcagccuuggca

SEQ ID NO: 247940 - RNA, 32 nt, Human
ugaguguccaggagaugagggcugagaauggg

SEQ ID NO: 247941 - RNA, 32 nt, Human
ugaguguccuucaggucauuucuccucucuca

SEQ ID NO: 247942 - RNA, 32 nt, Human
ugagugucucagaggcccccugaguguucccc

SEQ ID NO: 247943 - RNA, 32 nt, Human
ugagugucucccagccugccucgguucucacc

SEQ ID NO: 247944 - RNA, 32 nt, Human
ugagugucuccucugugccagccacgugugaa

SEQ ID NO: 247945 - RNA, 32 nt, Human
ugagugucuccucuuucuugccuguguggggu

SEQ ID NO: 247946 - RNA, 32 nt, Human
ugagugucucucucuucuguucuuugccaucc

SEQ ID NO: 247947 - RNA, 32 nt, Human
ugagugucuuacucccucguacaugcacaaau

SEQ ID NO: 247948 - RNA, 32 nt, Human
ugagugucuugacauuuucacccaggcccucc

SEQ ID NO: 247949 - RNA, 32 nt, Human
ugagugugacggggguugggguggggcgggag

SEQ ID NO: 247950 - RNA, 32 nt, Human
ugagugugagccacacagcagucacacaacuc

SEQ ID NO: 247951 - RNA, 32 nt, Human
ugagugugagccaccuuggcaagugccugugc

SEQ ID NO: 247952 - RNA, 29 nt, Human
ugagugugagugugugugcauggaaguug

SEQ ID NO: 247953 - RNA, 29 nt, Human
ugagugugcauguguguggguggguguga

SEQ ID NO: 247954 - RNA, 20 nt, Human
ugagugugccuguaaucuca

SEQ ID NO: 247955 - RNA, 32 nt, Human
ugagugugccuguaaucucagcacuuugaggg

SEQ ID NO: 247956 - RNA, 32 nt, Human
ugagugugcuggaagccaccauaggaacaagc

SEQ ID NO: 247957 - RNA, 32 nt, Human
ugaguguggaaggcugcccggggcacuggcag

SEQ ID NO: 247958 - RNA, 32 nt, Human
ugaguguggaccaaguuuugggugacauggcc

SEQ ID NO: 247959 - RNA, 32 nt, Human
ugaguguggagcugagcaacugaaccugaaac

SEQ ID NO: 247960 - RNA, 32 nt, Human
ugaguguggcaaagccuuuggcaagcagucaa

SEQ ID NO: 247961 - RNA, 32 nt, Human
ugaguguggggagagcaagcugugagggcagg

SEQ ID NO: 247962 - RNA, 32 nt, Human
ugaguguggguaugacuuuacccuccugguug

SEQ ID NO: 247963 - RNA, 32 nt, Human
ugagugugguccuguaugaacuccuuucagug

SEQ ID NO: 247964 - RNA, 23 nt, Human
ugaguguggugcucacgccugua

SEQ ID NO: 247965 - RNA, 24 nt, Human
ugagugugguggcacaugccugug

SEQ ID NO: 247966 - RNA, 24 nt, Human
ugagugugguggcaggcgccugua

SEQ ID NO: 247967 - RNA, 24 nt, Human
ugagugugguggcgcaugccugua

SEQ ID NO: 247968 - RNA, 24 nt, Human
ugagugugguggcucacaccugua

SEQ ID NO: 247969 - RNA, 21 nt, Human
ugagugugguggcucacgccu

SEQ ID NO: 247970 - RNA, 24 nt, Human
ugagugugguggcucaugccugua

SEQ ID NO: 247971 - RNA, 31 nt, Human
ugaguguguaccugggccuguguuaucugca

SEQ ID NO: 247972 - RNA, 32 nt, Human
ugaguguguauccagagguaaguaugugguaa

SEQ ID NO: 247973 - RNA, 32 nt, Human
ugaguguguaugaauugcgaaacugucugguc

SEQ ID NO: 247974 - RNA, 29 nt, Human
ugaguguguaugugugugugggaguaugu

SEQ ID NO: 247975 - RNA, 32 nt, Human
ugagugugugaagacagggagagccaggcccc

SEQ ID NO: 247976 - RNA, 32 nt, Human
ugagugugugacugagaaugauugaagauagu

SEQ ID NO: 247977 - RNA, 32 nt, Human
ugaguguguuugugguaaggggagaggagccg

SEQ ID NO: 247978 - RNA, 32 nt, Human
ugaguguucucaggccucuccucaccccacca

SEQ ID NO: 247979 - RNA, 32 nt, Human
ugaguguucucuuccuauuccuuuuugauagu

SEQ ID NO: 247980 - RNA, 32 nt, Human
ugaguguuuccaggacccccucggggcccuga

SEQ ID NO: 247981 - RNA, 32 nt, Human
ugaguguuuucaucuugccugggaagcccagg

SEQ ID NO: 247982 - RNA, 32 nt, Human
ugaguuaaacuuuaggaaaaagguuucccuuu

SEQ ID NO: 247983 - RNA, 32 nt, Human
ugaguuaaaggcaguuccaaugccugaugguu

SEQ ID NO: 247984 - RNA, 32 nt, Human
ugaguuaauggccugcgugacacuagugugag

SEQ ID NO: 247985 - RNA, 32 nt, Human
ugaguuaccauagcaaccagcaacuccagggu

SEQ ID NO: 247986 - RNA, 20 nt, Human
ugaguuacccauaaagggaa

SEQ ID NO: 247987 - RNA, 32 nt, Human
ugaguuaccuacauuuuaaugcaccugaaugu

SEQ ID NO: 247988 - RNA, 32 nt, Human
ugaguuagaaacaaacuuaaaauuugggguau

SEQ ID NO: 247989 - RNA, 32 nt, Human
ugaguuagaagcuuuuuaucccuuccucucaa

SEQ ID NO: 247990 - RNA, 32 nt, Human
ugaguuagacccagaaaguauugaacuggaca

SEQ ID NO: 247991 - RNA, 32 nt, Human
ugaguuagauguggaggucagaguggaagcag

SEQ ID NO: 247992 - RNA, 32 nt, Human
ugaguuagcagucagaagacccucuaaguaca

SEQ ID NO: 247993 - RNA, 32 nt, Human
ugaguuagccacaugucucaccaggaauaauu

SEQ ID NO: 247994 - RNA, 32 nt, Human
ugaguuauggccucugcacuccagccugggug

SEQ ID NO: 247995 - RNA, 22 nt, Human
ugaguuauuaauguggauuuua

SEQ ID NO: 247996 - RNA, 32 nt, Human
ugaguuauugguaugacccuguggaaacacac

SEQ ID NO: 247997 - RNA, 32 nt, Human
ugaguuauuugugagaauaaaugagcuaugug

SEQ ID NO: 247998 - RNA, 32 nt, Human
ugaguucaagaaagcuaccuguggaaaaugga

SEQ ID NO: 247999 - RNA, 32 nt, Human
ugaguucaagccuuuauugacauucaaguguu

SEQ ID NO: 248000 - RNA, 32 nt, Human
ugaguucacagcccagucuggggacagcuggg

SEQ ID NO: 248001 - RNA, 31 nt, Human
ugaguucaccucucugggcaucaguguccuu

SEQ ID NO: 248002 - RNA, 32 nt, Human
ugaguucaccugcccuguguguuuccacguca

SEQ ID NO: 248003 - RNA, 32 nt, Human
ugaguucacugugccagcaugcuuccuccaca

SEQ ID NO: 248004 - RNA, 32 nt, Human
ugaguucagagaacuuccccuaccucccccau

SEQ ID NO: 248005 - RNA, 32 nt, Human
ugaguucagcugugacguuagcuucaguggcu

SEQ ID NO: 248006 - RNA, 32 nt, Human
ugaguucagcuuuuaccagccucaguguggag

SEQ ID NO: 248007 - RNA, 32 nt, Human
ugaguucaggaguucaaaaccagccuggacaa

SEQ ID NO: 248008 - RNA, 32 nt, Human
ugaguucaggaguucaagaccagccuggccaa

SEQ ID NO: 248009 - RNA, 32 nt, Human
ugaguucaggaguucaagaccggccugggcag

SEQ ID NO: 248010 - RNA, 19 nt, Human
ugaguucaggaguucgaga

SEQ ID NO: 248011 - RNA, 32 nt, Human
ugaguucaggaguuuuaagaccagccugacca

SEQ ID NO: 248012 - RNA, 32 nt, Human
ugaguucagggagcaacugugggcagaugaaa

SEQ ID NO: 248013 - RNA, 32 nt, Human
ugaguucagggugggaugacggaccgcuucug

SEQ ID NO: 248014 - RNA, 32 nt, Human
ugaguucauggagccuguauucugggaagucu

SEQ ID NO: 248015 - RNA, 32 nt, Human
ugaguucauuucccagcucugccacucaugau

SEQ ID NO: 248016 - RNA, 32 nt, Human
ugaguuccaguccuguggcugugugacuuuga

SEQ ID NO: 248017 - RNA, 21 nt, Human
ugaguucccagcaucaucuua

SEQ ID NO: 248018 - RNA, 32 nt, Human
ugaguucccuugauucaaauaacccugaauca

SEQ ID NO: 248019 - RNA, 26 nt, Human
ugaguuccuacaaaguguuacugucu

SEQ ID NO: 248020 - RNA, 32 nt, Human
ugaguuccucaaggaagcuucugucaugaaag

SEQ ID NO: 248021 - RNA, 32 nt, Human
ugaguuccuggacgggccggaucugugcuguu

SEQ ID NO: 248022 - RNA, 32 nt, Human
ugaguuccugggagcggaggcuggaaggccac

SEQ ID NO: 248023 - RNA, 32 nt, Human
ugaguucgggaguucaagaccagccugaccaa

SEQ ID NO: 248024 - RNA, 32 nt, Human
ugaguucuauagagccuucugaugucucuaaa

SEQ ID NO: 248025 - RNA, 21 nt, Human
ugaguucuccaguugcugccu

SEQ ID NO: 248026 - RNA, 32 nt, Human
ugaguucugcacauuuccccugguucaggcug

SEQ ID NO: 248027 - RNA, 32 nt, Human
ugaguucuucggccacaaugcgccacccgcug

SEQ ID NO: 248028 - RNA, 32 nt, Human
ugaguucuuugcucuucugaguucuugguggc

SEQ ID NO: 248029 - RNA, 32 nt, Human
ugaguugaaaguaucucugcugggcuuucugg

SEQ ID NO: 248030 - RNA, 32 nt, Human
ugaguugaaggagaaggagcugaugcgggccu

SEQ ID NO: 248031 - RNA, 32 nt, Human
ugaguugaggguggguggagggguuugcagug

SEQ ID NO: 248032 - RNA, 32 nt, Human
ugaguugaucacuaucucugcucugugcuccu

SEQ ID NO: 248033 - RNA, 32 nt, Human
ugaguugcacagcgguauucucaccaggcccu

SEQ ID NO: 248034 - RNA, 31 nt, Human
ugaguugcacuuuucuaauaacauaggaugg

SEQ ID NO: 248035 - RNA, 32 nt, Human
ugaguugcagccagggccagugggagggggac

SEQ ID NO: 248036 - RNA, 32 nt, Human
ugaguugcagccagggcuguggggaaggggca

SEQ ID NO: 248037 - RNA, 32 nt, Human
ugaguugccagccugcucuucgugguuuggug

SEQ ID NO: 248038 - RNA, 32 nt, Human
ugaguugcccuccaccuggcuggagagauggc

SEQ ID NO: 248039 - RNA, 32 nt, Human
ugaguugccuauauuugcuauucaaaauuuug

SEQ ID NO: 248040 - RNA, 32 nt, Human
ugaguugcucuaaaauguuuggaaaagagcug

SEQ ID NO: 248041 - RNA, 32 nt, Human
ugaguuggacuucagucuugccuaggcgauuu

SEQ ID NO: 248042 - RNA, 32 nt, Human
ugaguuggagaugucagagggagccauggccc

SEQ ID NO: 248043 - RNA, 21 nt, Human
ugaguuggagucucgcccugu

SEQ ID NO: 248044 - RNA, 32 nt, Human
ugaguuggagucucgcucugucaccaggcuug

SEQ ID NO: 248045 - RNA, 21 nt, Human
ugaguuggagucucgcugugu

SEQ ID NO: 248046 - RNA, 32 nt, Human
ugaguuggauccucugugcgccaccugaguug

SEQ ID NO: 248047 - RNA, 32 nt, Human
ugaguuggccaugcaaugaaugaauauuauaa

SEQ ID NO: 248048 - RNA, 32 nt, Human
ugaguugggaggauggcuugggcccaggaggu

SEQ ID NO: 248049 - RNA, 32 nt, Human
ugaguugggcggaucacuugaggucaggaauu

SEQ ID NO: 248050 - RNA, 32 nt, Human
ugaguuggguuugugacucuucccucucccug

SEQ ID NO: 248051 - RNA, 32 nt, Human
ugaguuguagcugcagacggggaccaguggcu

SEQ ID NO: 248052 - RNA, 32 nt, Human
ugaguuguagcugcagauggggaccagugacu

SEQ ID NO: 248053 - RNA, 32 nt, Human
ugaguuguagcugcagauggggaccaguggcu

SEQ ID NO: 248054 - RNA, 32 nt, Human
ugaguuguccaucuuaaagaaauaugaguaau

SEQ ID NO: 248055 - RNA, 32 nt, Human
ugaguugucucaggaccccgucacugcgacgu

SEQ ID NO: 248056 - RNA, 32 nt, Human
ugaguugucucucugcccuugugacugcugag

SEQ ID NO: 248057 - RNA, 32 nt, Human
ugaguugugcuuucacaaaaccuugucaaaga

SEQ ID NO: 248058 - RNA, 32 nt, Human
ugaguugugggaggggccacauggaaggccag

SEQ ID NO: 248059 - RNA, 32 nt, Human
ugaguugugucaggagauuugaggaacuucug

SEQ ID NO: 248060 - RNA, 32 nt, Human
ugaguuguuuaugggacucguuuauggaacgc

SEQ ID NO: 248061 - RNA, 21 nt, Human
ugaguuuaaagagaaaggcau

SEQ ID NO: 248062 - RNA, 32 nt, Human
ugaguuuaaaucaagauuaugaugaguaaaug

SEQ ID NO: 248063 - RNA, 32 nt, Human
ugaguuuaagaagcaguucuuccuccagaaag

SEQ ID NO: 248064 - RNA, 32 nt, Human
ugaguuuaggcuugguggagucaguggaacag

SEQ ID NO: 248065 - RNA, 32 nt, Human
ugaguuuaucauccuucuuaaagagcaucucu

SEQ ID NO: 248066 - RNA, 32 nt, Human
ugaguuucaguuugcauugcagcugggauuga

SEQ ID NO: 248067 - RNA, 32 nt, Human
ugaguuucauucuacuuuauaucacaugguga

SEQ ID NO: 248068 - RNA, 32 nt, Human
ugaguuuccacuaaggccagggggccuccaac

SEQ ID NO: 248069 - RNA, 32 nt, Human
ugaguuuccagccugcuagucugcccuaugga

SEQ ID NO: 248070 - RNA, 32 nt, Human
ugaguuuccugaaggaguucuuuguuccugau

SEQ ID NO: 248071 - RNA, 32 nt, Human
ugaguuucgauuguuaacguguuuuuguuugg

SEQ ID NO: 248072 - RNA, 22 nt, Human
ugaguuucguggcuuuaucuua

SEQ ID NO: 248073 - RNA, 23 nt, Human
ugaguuucuaaaaauggauguga

SEQ ID NO: 248074 - RNA, 32 nt, Human
ugaguuucucuuucucucuuuuuaacuuuauu

SEQ ID NO: 248075 - RNA, 32 nt, Human
ugaguuucugcugcagauagugguguuaacug

SEQ ID NO: 248076 - RNA, 32 nt, Human
ugaguuucuggccuaauugagggaaggaggaa

SEQ ID NO: 248077 - RNA, 32 nt, Human
ugaguuugagccugagcaccugggggcugaug

SEQ ID NO: 248078 - RNA, 32 nt, Human
ugaguuugauuugacaagaugccuucccaccc

SEQ ID NO: 248079 - RNA, 32 nt, Human
ugaguuugcaucacugcacuccagccugggca

SEQ ID NO: 248080 - RNA, 32 nt, Human
ugaguuugcgaaggaaacccuuggagguagcu

SEQ ID NO: 248081 - RNA, 32 nt, Human
ugaguuugcucaccggcuacugcagcacuuug

SEQ ID NO: 248082 - RNA, 32 nt, Human
ugaguuuggacaagcuccucuccagcuccucu

SEQ ID NO: 248083 - RNA, 31 nt, Human
ugaguuuggacaauuuuaucuaauuguaauu

SEQ ID NO: 248084 - RNA, 32 nt, Human
ugaguuugggguacccacuauaugagagagga

SEQ ID NO: 248085 - RNA, 24 nt, Human
ugaguuugucucagauggaaauga

SEQ ID NO: 248086 - RNA, 21 nt, Human
ugaguuuguucacuaauguga

SEQ ID NO: 248087 - RNA, 23 nt, Human
ugaguuuguugaagugcacaugu

SEQ ID NO: 248088 - RNA, 32 nt, Human
ugaguuuuacccagacucaaggaguugguaaa

SEQ ID NO: 248089 - RNA, 32 nt, Human
ugaguuuuaucuuaacagcaguagcuuaauaa

SEQ ID NO: 248090 - RNA, 22 nt, Human
ugaguuuuuagacuguaucuug

SEQ ID NO: 248091 - RNA, 32 nt, Human
ugaguuuuuauacagcuuuccucuuuuucauc

SEQ ID NO: 248092 - RNA, 20 nt, Human
ugaguuuuuguagcaucuua

SEQ ID NO: 248093 - RNA, 32 nt, Human
ugauaaaaacccucaacagauuaggcauugaa

SEQ ID NO: 248094 - RNA, 32 nt, Human
ugauaaaaagagagcugcuuucccuuuuaccu

SEQ ID NO: 248095 - RNA, 32 nt, Human
ugauaaaaaugcaaagucaaauaaaagguguc

SEQ ID NO: 248096 - RNA, 32 nt, Human
ugauaaaaccaaaauaucacugacucaucccu

SEQ ID NO: 248097 - RNA, 32 nt, Human
ugauaaacaagugaaacauucuuugguguggu

SEQ ID NO: 248098 - RNA, 32 nt, Human
ugauaaacccagacagcuucagccuugcagga

SEQ ID NO: 248099 - RNA, 32 nt, Human
ugauaaaccuggaagcuguucuugaagacuaa

SEQ ID NO: 248100 - RNA, 24 nt, Human
ugauaaagauggaaauggaagaga

SEQ ID NO: 248101 - RNA, 23 nt, Human
ugauaaagaugugaacugugaaa

SEQ ID NO: 248102 - RNA, 32 nt, Human
ugauaaagcauuugaaugguacaguagaugua

SEQ ID NO: 248103 - RNA, 32 nt, Human
ugauaaagcuaaauuauagucuuuugccagag

SEQ ID NO: 248104 - RNA, 32 nt, Human
ugauaaagcugcagaugggcuaaauaaaagcc

SEQ ID NO: 248105 - RNA, 32 nt, Human
ugauaaagcuguuaagaauugucuuuccuaag

SEQ ID NO: 248106 - RNA, 32 nt, Human
ugauaaaggagagguuaaagcaaaccagccuc

SEQ ID NO: 248107 - RNA, 32 nt, Human
ugauaaaggcauucucaccaccugcuuuguuu

SEQ ID NO: 248108 - RNA, 21 nt, Human
ugauaaaggccagauuacaaa

SEQ ID NO: 248109 - RNA, 32 nt, Human
ugauaaagguagaggcacaaagaggcaaacua

SEQ ID NO: 248110 - RNA, 32 nt, Human
ugauaaaguggggagaaggaaaauggacacuc

SEQ ID NO: 248111 - RNA, 32 nt, Human
ugauaaauaaagcccuugcugaagggaaagca

SEQ ID NO: 248112 - RNA, 32 nt, Human
ugauaaaucacagauauaacgaguuaagaggg

SEQ ID NO: 248113 - RNA, 32 nt, Human
ugauaaaugccuguagucccagccacugaagc

SEQ ID NO: 248114 - RNA, 32 nt, Human
ugauaaauggaacuauuccaucaauaggcaaa

SEQ ID NO: 248115 - RNA, 32 nt, Human
ugauaaauggugagauuugaaugugauaagca

SEQ ID NO: 248116 - RNA, 32 nt, Human
ugauaaauuccucucccuccucuccuuuccuc

SEQ ID NO: 248117 - RNA, 21 nt, Human
ugauaacaaaauagccaggca

SEQ ID NO: 248118 - RNA, 21 nt, Human
ugauaacaaagcagcaaggca

SEQ ID NO: 248119 - RNA, 21 nt, Human
ugauaacaauuuguucacuca

SEQ ID NO: 248120 - RNA, 32 nt, Human
ugauaacacaugcccaucaaggaaaagcugug

SEQ ID NO: 248121 - RNA, 32 nt, Human
ugauaacaccucagcuucugagcaucuauuuu

SEQ ID NO: 248122 - RNA, 19 nt, Human
ugauaaccacauggacaca

SEQ ID NO: 248123 - RNA, 32 nt, Human
ugauaaccaguuccuggaaugcccucuaagau

SEQ ID NO: 248124 - RNA, 32 nt, Human
ugauaacugcauuugguaggaagccugaggca

SEQ ID NO: 248125 - RNA, 32 nt, Human
ugauaacugggguguugagaccagcuuugucc

SEQ ID NO: 248126 - RNA, 32 nt, Human
ugauaacuuggggaggcaagagacugggagcc

SEQ ID NO: 248127 - RNA, 22 nt, Human
ugauaagaaaguaaguauucca

SEQ ID NO: 248128 - RNA, 32 nt, Human
ugauaagagaagguguaagguuuuuaucuuau

SEQ ID NO: 248129 - RNA, 32 nt, Human
ugauaagaugaggaaauaaugggaaagguuga

SEQ ID NO: 248130 - RNA, 32 nt, Human
ugauaagcacacuggcccaggcacucagccuu

SEQ ID NO: 248131 - RNA, 32 nt, Human
ugauaagcccagacagcuucagccuugcagga

SEQ ID NO: 248132 - RNA, 23 nt, Human
ugauaagcugcugcggcccaaga

SEQ ID NO: 248133 - RNA, 32 nt, Human
ugauaaggaauuaggucacaaaugggaaauaa

SEQ ID NO: 248134 - RNA, 32 nt, Human
ugauaaggacuuaacguccuaaccucaauugu

SEQ ID NO: 248135 - RNA, 32 nt, Human
ugauaaggcucacagcccugagcucuuuacgg

SEQ ID NO: 248136 - RNA, 32 nt, Human
ugauaaggcugagagagaaaaauaugugcagu

SEQ ID NO: 248137 - RNA, 32 nt, Human
ugauaagggcuagagagaaaaauaaaucagga

SEQ ID NO: 248138 - RNA, 32 nt, Human
ugauaagguucacaguuucucucacccaggug

SEQ ID NO: 248139 - RNA, 32 nt, Human
ugauaaguaggccuggagccucagcuucugua

SEQ ID NO: 248140 - RNA, 32 nt, Human
ugauaagugaucaugcagccagagccagccuu

SEQ ID NO: 248141 - RNA, 32 nt, Human
ugauaagugaucgugcagccagagccagccuu

SEQ ID NO: 248142 - RNA, 32 nt, Human
ugauaagugauugugcagccagagccagccuu

SEQ ID NO: 248143 - RNA, 32 nt, Human
ugauaaguguaccuucaccugcuccagugaug

SEQ ID NO: 248144 - RNA, 32 nt, Human
ugauaauaaagaugacauugccaguuuuguca

SEQ ID NO: 248145 - RNA, 32 nt, Human
ugauaaucaagaaacagcagcuaugaagccuu

SEQ ID NO: 248146 - RNA, 32 nt, Human
ugauaaucucacucuuguaagguuucaucguu

SEQ ID NO: 248147 - RNA, 32 nt, Human
ugauaaucucuuaagagcacccgagaagaaga

SEQ ID NO: 248148 - RNA, 32 nt, Human
ugauaaugaauucaaugugcaacuaugggcaa

SEQ ID NO: 248149 - RNA, 32 nt, Human
ugauaaugccuaguagaucacaugucaaugaa

SEQ ID NO: 248150 - RNA, 32 nt, Human
ugauaaugcuuccaaacuguagcugucacagg

SEQ ID NO: 248151 - RNA, 32 nt, Human
ugauaauuagccugaccagcaggaugaaugca

SEQ ID NO: 248152 - RNA, 32 nt, Human
ugauacaaaaugugagccaggaaacccaguuu

SEQ ID NO: 248153 - RNA, 32 nt, Human
ugauacaacagguagugaaacagcuuaagaau

SEQ ID NO: 248154 - RNA, 32 nt, Human
ugauacaagcaaguuuguuuacaucccugggg

SEQ ID NO: 248155 - RNA, 32 nt, Human
ugauacaaucaucacaauuggcauuaaauuau

SEQ ID NO: 248156 - RNA, 24 nt, Human
ugauacaaucuuggcucacugcag

SEQ ID NO: 248157 - RNA, 32 nt, Human
ugauacagagcuggaggagaagaggagugagg

SEQ ID NO: 248158 - RNA, 21 nt, Human
ugauacagagucucacucugu

SEQ ID NO: 248159 - RNA, 32 nt, Human
ugauacagcuuccaagguguucuugaguagca

SEQ ID NO: 248160 - RNA, 22 nt, Human
ugauacaucagguuucagcaca

SEQ ID NO: 248161 - RNA, 32 nt, Human
ugauacaucgcuacuucugcuucaccuaauca

SEQ ID NO: 248162 - RNA, 32 nt, Human
ugauacaugccuguaauccuggcuacuuggga

SEQ ID NO: 248163 - RNA, 32 nt, Human
ugauacaugccuguggucucagcuacucggga

SEQ ID NO: 248164 - RNA, 32 nt, Human
ugauacaugccuguggucucagcuacuuggga

SEQ ID NO: 248165 - RNA, 32 nt, Human
ugauacaugggcuggaaaaauguagaacguuu

SEQ ID NO: 248166 - RNA, 32 nt, Human
ugauacauuuuccccaaguaagguuuuuacca

SEQ ID NO: 248167 - RNA, 32 nt, Human
ugauaccaaauggcuaacauucaugaccucag

SEQ ID NO: 248168 - RNA, 32 nt, Human
ugauaccaccaucauguucagaccauuuuaua

SEQ ID NO: 248169 - RNA, 32 nt, Human
ugauaccaccaucuuuguaauauuguggugag

SEQ ID NO: 248170 - RNA, 32 nt, Human
ugauaccaccauugauaggcaagcgacugguu

SEQ ID NO: 248171 - RNA, 32 nt, Human
ugauaccagcuacuugggaggcugaggcagaa

SEQ ID NO: 248172 - RNA, 22 nt, Human
ugauaccagcucucuguggaaa

SEQ ID NO: 248173 - RNA, 32 nt, Human
ugauacccaccccaaaggccugccucaagguu

SEQ ID NO: 248174 - RNA, 32 nt, Human
ugauacccagccgccuccagcuugcagugguc

SEQ ID NO: 248175 - RNA, 32 nt, Human
ugauaccccacccuccuccacccucuacccuc

SEQ ID NO: 248176 - RNA, 32 nt, Human
ugauaccgguggaggagcuccaggaagcaggc

SEQ ID NO: 248177 - RNA, 32 nt, Human
ugauaccugcacuccggcuuccuagacucugg

SEQ ID NO: 248178 - RNA, 32 nt, Human
ugauaccugcagaauggacugcagaaaagucu

SEQ ID NO: 248179 - RNA, 32 nt, Human
ugauaccugcucuuuauuucaggaugagaggg

SEQ ID NO: 248180 - RNA, 32 nt, Human
ugauaccuggacauuaaagugcgauucccacu

SEQ ID NO: 248181 - RNA, 32 nt, Human
ugauaccuuauagagaaaagugugaauucagg

SEQ ID NO: 248182 - RNA, 18 nt, Human
ugauaccuucacagccca

SEQ ID NO: 248183 - RNA, 32 nt, Human
ugauaccuuucuaaaaagguggagucuuccgg

SEQ ID NO: 248184 - RNA, 32 nt, Human
ugauacgaucaugacucacugcagccucaaac

SEQ ID NO: 248185 - RNA, 32 nt, Human
ugauacgcuugucucauucacacucccaaagg

SEQ ID NO: 248186 - RNA, 32 nt, Human
ugauacggaacagcauuucccugcagcuaaug

SEQ ID NO: 248187 - RNA, 32 nt, Human
ugauacggagucucgcucuguugcccaggcug

SEQ ID NO: 248188 - RNA, 32 nt, Human
ugauacgggguccggcucugucgcccaggcug

SEQ ID NO: 248189 - RNA, 32 nt, Human
ugauacguggucuugcucugucacucaggcug

SEQ ID NO: 248190 - RNA, 32 nt, Human
ugauacguucccgucugugcacccauggagau

SEQ ID NO: 248191 - RNA, 32 nt, Human
ugauacuaaggagaggagagauuaugucauau

SEQ ID NO: 248192 - RNA, 32 nt, Human
ugauacuacuggggcuuuuccuauugauuugg

SEQ ID NO: 248193 - RNA, 32 nt, Human
ugauacuauuaccaccaccugcucacugguca

SEQ ID NO: 248194 - RNA, 32 nt, Human
ugauacucaucaugguuuugauuugcaauugc

SEQ ID NO: 248195 - RNA, 32 nt, Human
ugauacucccuuacacugaaucauguuaugau

SEQ ID NO: 248196 - RNA, 32 nt, Human
ugauacuccucucccuguaucaugucagcaca

SEQ ID NO: 248197 - RNA, 32 nt, Human
ugauacuccugccucagccuccugagaagcug

SEQ ID NO: 248198 - RNA, 32 nt, Human
ugauacuccugccucagccuccugaguagcug

SEQ ID NO: 248199 - RNA, 32 nt, Human
ugauacucugugguguucuguucauguucuau

SEQ ID NO: 248200 - RNA, 21 nt, Human
ugauacuguaauaauauuuuu

SEQ ID NO: 248201 - RNA, 32 nt, Human
ugauacuguaccagguacaaggcuuuuguaca

SEQ ID NO: 248202 - RNA, 32 nt, Human
ugauacuguacuccagccugagcaacagagca

SEQ ID NO: 248203 - RNA, 32 nt, Human
ugauacugugccauugcacuccaagccugggc

SEQ ID NO: 248204 - RNA, 32 nt, Human
ugauacuguugacauccuccagaauggccaga

SEQ ID NO: 248205 - RNA, 32 nt, Human
ugauacuucagcuguuuguuccugggagaauu

SEQ ID NO: 248206 - RNA, 32 nt, Human
ugauacuucccugaggucucuuuuccuuucaa

SEQ ID NO: 248207 - RNA, 32 nt, Human
ugauacuuucauuuugcacaucaugcacauca

SEQ ID NO: 248208 - RNA, 32 nt, Human
ugauacuuuuauuauucccuugcucauauaac

SEQ ID NO: 248209 - RNA, 32 nt, Human
ugauagaaaauuuggaaagugcaaauaagcaa

SEQ ID NO: 248210 - RNA, 32 nt, Human
ugauagaaagccagcaccagccucgggagcug

SEQ ID NO: 248211 - RNA, 32 nt, Human
ugauagaaaguuaagccagaaggacaaaggaa

SEQ ID NO: 248212 - RNA, 32 nt, Human
ugauagaacuacuuugaaaacaauucaguggu

SEQ ID NO: 248213 - RNA, 32 nt, Human
ugauagaagaaaacagucugggaggauagcgc

SEQ ID NO: 248214 - RNA, 32 nt, Human
ugauagaauccacccugccucugacagcaucc

SEQ ID NO: 248215 - RNA, 32 nt, Human
ugauagaauuucucugccagugcaguaagagu

SEQ ID NO: 248216 - RNA, 32 nt, Human
ugauagacacaaugaaauccacccucaaagag

SEQ ID NO: 248217 - RNA, 32 nt, Human
ugauagaccuuaaauaaguguccuaagucagu

SEQ ID NO: 248218 - RNA, 32 nt, Human
ugauagagaaauuggcccgcuuuguggcagaa

SEQ ID NO: 248219 - RNA, 32 nt, Human
ugauagagaaggaggucccaucaggccccugg

SEQ ID NO: 248220 - RNA, 32 nt, Human
ugauagagacggaguuucaccauguuggccag

SEQ ID NO: 248221 - RNA, 32 nt, Human
ugauagagcaugaggcugggcgugguggcuca

SEQ ID NO: 248222 - RNA, 32 nt, Human
ugauagaggcgggguuucgccauguuacacug

SEQ ID NO: 248223 - RNA, 30 nt, Human
ugauagagucggucccugcuccugugaggc

SEQ ID NO: 248224 - RNA, 32 nt, Human
ugauagaucucuggcuuccugcucuguuuguu

SEQ ID NO: 248225 - RNA, 32 nt, Human
ugauagauuugucccacauaaauguggcccug

SEQ ID NO: 248226 - RNA, 32 nt, Human
ugauagcaccacugcacuccagccugggcaac

SEQ ID NO: 248227 - RNA, 32 nt, Human
ugauagcaccacugcacuccagccugggugac

SEQ ID NO: 248228 - RNA, 32 nt, Human
ugauagcaccacugcaguccagccugggcgac

SEQ ID NO: 248229 - RNA, 32 nt, Human
ugauagcaccacugcgcuccagccugggugag

SEQ ID NO: 248230 - RNA, 30 nt, Human
ugauagcacuuaaacuaguucauuucaaaa

SEQ ID NO: 248231 - RNA, 28 nt, Human
ugauagccaagugcuuggccuggucgac

SEQ ID NO: 248232 - RNA, 32 nt, Human
ugauagccuucagcuacaaaaagauaggacug

SEQ ID NO: 248233 - RNA, 32 nt, Human
ugauagcgaaggauagcaauguggaaaauuug

SEQ ID NO: 248234 - RNA, 32 nt, Human
ugauagcugcuugcuaauuuggucuuagcuca

SEQ ID NO: 248235 - RNA, 32 nt, Human
ugauaggaacaucaaggaauaagucaucaucg

SEQ ID NO: 248236 - RNA, 32 nt, Human
ugauaggaaggaaacugucaucugcaggggcu

SEQ ID NO: 248237 - RNA, 32 nt, Human
ugauaggcacacgaggaugaguggcuuuguau

SEQ ID NO: 248238 - RNA, 32 nt, Human
ugauaggcugaggccagcugggaugcugggaa

SEQ ID NO: 248239 - RNA, 32 nt, Human
ugauagggagagguggcuguuaacagugggcu

SEQ ID NO: 248240 - RNA, 32 nt, Human
ugauagggcaggaagagaagaaaacggaggag

SEQ ID NO: 248241 - RNA, 32 nt, Human
ugauagggcccuggucuuucugcaccagcgug

SEQ ID NO: 248242 - RNA, 32 nt, Human
ugauagggucugaacccaguuggggagacaga

SEQ ID NO: 248243 - RNA, 32 nt, Human
ugauagguccugauuacuaaagaagcuucuuu

SEQ ID NO: 248244 - RNA, 32 nt, Human
ugauaggucucccaaaauguuugggguagggg

SEQ ID NO: 248245 - RNA, 32 nt, Human
ugauaguaaaaaggcaggugauggaaaucagu

SEQ ID NO: 248246 - RNA, 24 nt, Human
ugauaguaaaucuaguuuuugaca

SEQ ID NO: 248247 - RNA, 32 nt, Human
ugauaguaccacugcacuccagccugggcaac

SEQ ID NO: 248248 - RNA, 32 nt, Human
ugauaguaguuguguguuagugugaaugacug

SEQ ID NO: 248249 - RNA, 32 nt, Human
ugauaguaugaacaugguuuugcuuacgcugg

SEQ ID NO: 248250 - RNA, 32 nt, Human
ugauagucacugggcucccugugacuucugac

SEQ ID NO: 248251 - RNA, 30 nt, Human
ugauagugaauguaaucagaaacacacauc

SEQ ID NO: 248252 - RNA, 23 nt, Human
ugauagugcauccaccuacccca

SEQ ID NO: 248253 - RNA, 32 nt, Human
ugauagugccacugcaauucagccugggugac

SEQ ID NO: 248254 - RNA, 32 nt, Human
ugauagugccgcugcacuccauucugggcaag

SEQ ID NO: 248255 - RNA, 32 nt, Human
ugauaguucucuaggccauuguuuuguaacau

SEQ ID NO: 248256 - RNA, 32 nt, Human
ugauaguuuuggauauuugcuugcugugugaa

SEQ ID NO: 248257 - RNA, 32 nt, Human
ugauauaaaaugggauuuauaaaaauauuaga

SEQ ID NO: 248258 - RNA, 32 nt, Human
ugauauaaagagacacagggagaagauaguca

SEQ ID NO: 248259 - RNA, 32 nt, Human
ugauauaaauauggcucacugcagccucgaca

SEQ ID NO: 248260 - RNA, 32 nt, Human
ugauauaacacuuuccagccuauagcagaagc

SEQ ID NO: 248261 - RNA, 32 nt, Human
ugauauaacuaaauuugugguaauaagacugu

SEQ ID NO: 248262 - RNA, 32 nt, Human
ugauauaaucuuguucugcugauuuguuucuu

SEQ ID NO: 248263 - RNA, 32 nt, Human
ugauauaaugucagaaaugcaggaagcuauau

SEQ ID NO: 248264 - RNA, 32 nt, Human
ugauauaucuuucaguucaggcugcuugccug

SEQ ID NO: 248265 - RNA, 32 nt, Human
ugauauaugccuguagucccaacuacuuggaa

SEQ ID NO: 248266 - RNA, 31 nt, Human
ugauauauguacaauuugcucucauguuuuu

SEQ ID NO: 248267 - RNA, 32 nt, Human
ugauauauuaacaucacaaguccuugucaacu

SEQ ID NO: 248268 - RNA, 24 nt, Human
ugauauauuggggaacaaauacua

SEQ ID NO: 248269 - RNA, 23 nt, Human
ugauauauuuguugccaguucca

SEQ ID NO: 248270 - RNA, 32 nt, Human
ugauaucaagaguuugaggccagccuggccaa

SEQ ID NO: 248271 - RNA, 32 nt, Human
ugauaucacccaggcuggagugcaguggcgcg

SEQ ID NO: 248272 - RNA, 32 nt, Human
ugauaucagcaacuguucuggcuccaauucau

SEQ ID NO: 248273 - RNA, 32 nt, Human
ugauaucagccuucucugggccuugugugugg

SEQ ID NO: 248274 - RNA, 32 nt, Human
ugauaucaguccccuucacugcagagccuugc

SEQ ID NO: 248275 - RNA, 32 nt, Human
ugauaucauccagguaaguggcaccuagguga

SEQ ID NO: 248276 - RNA, 23 nt, Human
ugauauccaugaguacuuuagug

SEQ ID NO: 248277 - RNA, 32 nt, Human
ugauaucccugcccagggcuguuuucaaauac

SEQ ID NO: 248278 - RNA, 32 nt, Human
ugauauccuagggggaaaaggaaggccagggg

SEQ ID NO: 248279 - RNA, 32 nt, Human
ugauaucgcaccauuguacuccagccugugug

SEQ ID NO: 248280 - RNA, 32 nt, Human
ugauaucuauuucucagccgaauuccuuaaca

SEQ ID NO: 248281 - RNA, 32 nt, Human
ugauaucuccaccaaagccuugauguuuucuc

SEQ ID NO: 248282 - RNA, 32 nt, Human
ugauaucugugcuucucauaauuacugaaagc

SEQ ID NO: 248283 - RNA, 32 nt, Human
ugauaugagggagauugaggcugcagugagcu

SEQ ID NO: 248284 - RNA, 31 nt, Human
ugauaugaguuucucccugccaaggcaaaaa

SEQ ID NO: 248285 - RNA, 32 nt, Human
ugauaugauaaaagcacaacugcuauagauuc

SEQ ID NO: 248286 - RNA, 32 nt, Human
ugauaugccuguauguuggacuuugcuuuuga

SEQ ID NO: 248287 - RNA, 32 nt, Human
ugauauggcagaagacaccagagcagaugcag

SEQ ID NO: 248288 - RNA, 32 nt, Human
ugauaugguagcaaccaaagauuccaguguuu

SEQ ID NO: 248289 - RNA, 32 nt, Human
ugauaugguaguauuucacuaccauuuucuga

SEQ ID NO: 248290 - RNA, 32 nt, Human
ugauauguaacccaggcgggugggagccucag

SEQ ID NO: 248291 - RNA, 32 nt, Human
ugauaugugagagagaaaucuggaaccuucuu

SEQ ID NO: 248292 - RNA, 32 nt, Human
ugauauguuucaauacauuguugauggcauug

SEQ ID NO: 248293 - RNA, 32 nt, Human
ugauauuaaacaucaucugcauuuuacuugcc

SEQ ID NO: 248294 - RNA, 32 nt, Human
ugauauuacauagaaacggguauuccagacac

SEQ ID NO: 248295 - RNA, 32 nt, Human
ugauauuaggagguggggucuuugggagguga

SEQ ID NO: 248296 - RNA, 32 nt, Human
ugauauuaucaagcuagaaaauaaccaguuug

SEQ ID NO: 248297 - RNA, 32 nt, Human
ugauauucagcauuagaguagaaaagaaacua

SEQ ID NO: 248298 - RNA, 32 nt, Human
ugauauucaggaagaaggggugaggggugggu

SEQ ID NO: 248299 - RNA, 32 nt, Human
ugauauucauucuuuucugcuuuuccagaggg

SEQ ID NO: 248300 - RNA, 32 nt, Human
ugauauuccaccucccaggaaggaaaggaaac

SEQ ID NO: 248301 - RNA, 32 nt, Human
ugauauuccagcugcccuccagagcgccuagc

SEQ ID NO: 248302 - RNA, 32 nt, Human
ugauauuccucuucucacuuuugcaaucacgu

SEQ ID NO: 248303 - RNA, 32 nt, Human
ugauauuccuuugcucacccucaggccuuguu

SEQ ID NO: 248304 - RNA, 32 nt, Human
ugauauucuauguaauaucagaugguuaauac

SEQ ID NO: 248305 - RNA, 32 nt, Human
ugauauugaacaucuuucuaugugcuuacugc

SEQ ID NO: 248306 - RNA, 32 nt, Human
ugauauugaagaaaaauaaguaacuguauuag

SEQ ID NO: 248307 - RNA, 32 nt, Human
ugauauugaagucacuuuauuaauaacagcug

SEQ ID NO: 248308 - RNA, 32 nt, Human
ugauauugcccaggcugaauuugauguuauuu

SEQ ID NO: 248309 - RNA, 32 nt, Human
ugauauugugccacugcacuccagccugggcg

SEQ ID NO: 248310 - RNA, 32 nt, Human
ugauauuguguaacuauaauagagacucuuua

SEQ ID NO: 248311 - RNA, 32 nt, Human
ugauauuucagucugugaacuucuauuaugua

SEQ ID NO: 248312 - RNA, 32 nt, Human
ugauauuuccuaaauacuaauuagcuggaaau

SEQ ID NO: 248313 - RNA, 32 nt, Human
ugauauuugacagacauccuugcaguuuaaga

SEQ ID NO: 248314 - RNA, 20 nt, Human
ugauauuuuagcacuuuggu

SEQ ID NO: 248315 - RNA, 32 nt, Human
ugauauuuuccucugcuugauccauugugcug

SEQ ID NO: 248316 - RNA, 32 nt, Human
ugaucaaaacagagaaaccccaucucuacuaa

SEQ ID NO: 248317 - RNA, 32 nt, Human
ugaucaaaacauagaaaccccaucucuacuaa

SEQ ID NO: 248318 - RNA, 32 nt, Human
ugaucaaaagaaaagaagauggaugaggacac

SEQ ID NO: 248319 - RNA, 32 nt, Human
ugaucaaaagugguauagagggggcuggggcu

SEQ ID NO: 248320 - RNA, 32 nt, Human
ugaucaaaccacuguaguccagccugagugac

SEQ ID NO: 248321 - RNA, 32 nt, Human
ugaucaaauaucacucuccuacuuacaggacu

SEQ ID NO: 248322 - RNA, 32 nt, Human
ugaucaacauggugaaaccccgucucuacuaa

SEQ ID NO: 248323 - RNA, 32 nt, Human
ugaucaacauggugaaaccccgucuuuacuaa

SEQ ID NO: 248324 - RNA, 32 nt, Human
ugaucaacugguuuguguuuugcugcugcauu

SEQ ID NO: 248325 - RNA, 32 nt, Human
ugaucaagacggaguuucaccauguuggccag

SEQ ID NO: 248326 - RNA, 32 nt, Human
ugaucaagcuccggaagaugguggagggucau

SEQ ID NO: 248327 - RNA, 32 nt, Human
ugaucaagcuucagaccucccucccuccccag

SEQ ID NO: 248328 - RNA, 18 nt, Human
ugaucaaggcucccagca

SEQ ID NO: 248329 - RNA, 32 nt, Human
ugaucaaggugcagguguaugugagcggggag

SEQ ID NO: 248330 - RNA, 32 nt, Human
ugaucaagucacucucuggccuaaaaccuucc

SEQ ID NO: 248331 - RNA, 32 nt, Human
ugaucaaugagccccugucacucucaugacac

SEQ ID NO: 248332 - RNA, 32 nt, Human
ugaucaaugccuccuucucucucuuuagccuu

SEQ ID NO: 248333 - RNA, 32 nt, Human
ugaucaauugaauauggacccaagagucagcg

SEQ ID NO: 248334 - RNA, 32 nt, Human
ugaucacacaacugcacuccagccugggcaac

SEQ ID NO: 248335 - RNA, 31 nt, Human
ugaucacacagcuaauaaaagucagagcuca

SEQ ID NO: 248336 - RNA, 32 nt, Human
ugaucacacaucuguauuccagccugggcaau

SEQ ID NO: 248337 - RNA, 32 nt, Human
ugaucacaccaccacacuccagccugagcagc

SEQ ID NO: 248338 - RNA, 32 nt, Human
ugaucacaccaccucacuccagccugggcaac

SEQ ID NO: 248339 - RNA, 32 nt, Human
ugaucacaccacuacacuccagccuggacaac

SEQ ID NO: 248340 - RNA, 32 nt, Human
ugaucacaccacugcaauccagccucgguaac

SEQ ID NO: 248341 - RNA, 32 nt, Human
ugaucacaccacugcaccccagccugggugac

SEQ ID NO: 248342 - RNA, 32 nt, Human
ugaucacaccacugcacuccagccuggacgac

SEQ ID NO: 248343 - RNA, 32 nt, Human
ugaucacaccacugcacuccagccugggcaac

SEQ ID NO: 248344 - RNA, 32 nt, Human
ugaucacaccacugcacuccagccugggugac

SEQ ID NO: 248345 - RNA, 32 nt, Human
ugaucacaccacugcacuccagccuggguguc

SEQ ID NO: 248346 - RNA, 32 nt, Human
ugaucacaccacugcacuccagccuuggcgac

SEQ ID NO: 248347 - RNA, 32 nt, Human
ugaucacaccacugcacucuagccugggcaac

SEQ ID NO: 248348 - RNA, 32 nt, Human
ugaucacaccacugcauucuggccugggugac

SEQ ID NO: 248349 - RNA, 32 nt, Human
ugaucacaccacuguacuccagccugggcaac

SEQ ID NO: 248350 - RNA, 32 nt, Human
ugaucacaccauugcacuucagccugggcgac

SEQ ID NO: 248351 - RNA, 32 nt, Human
ugaucacaccugacugcacuccagccugggug

SEQ ID NO: 248352 - RNA, 32 nt, Human
ugaucacacugcugcacuccagccugugcaac

SEQ ID NO: 248353 - RNA, 32 nt, Human
ugaucacagcuacucgggaggcugaggcacga

SEQ ID NO: 248354 - RNA, 32 nt, Human
ugaucacauaugcagccucaaauguuacacag

SEQ ID NO: 248355 - RNA, 32 nt, Human
ugaucacaucacugcaguccagccugggugac

SEQ ID NO: 248356 - RNA, 32 nt, Human
ugaucaccaauucuugguggcuuggcugggga

SEQ ID NO: 248357 - RNA, 32 nt, Human
ugaucaccagugcccaaugagcuguucucugc

SEQ ID NO: 248358 - RNA, 32 nt, Human
ugaucacccaggcuagagugcaguggcgugau

SEQ ID NO: 248359 - RNA, 28 nt, Human
ugaucacccauggcugccucuccuauua

SEQ ID NO: 248360 - RNA, 32 nt, Human
ugaucacccuccucagccucccaaaaugcugg

SEQ ID NO: 248361 - RNA, 32 nt, Human
ugaucaccucacugcacgcuagccugggcaac

SEQ ID NO: 248362 - RNA, 32 nt, Human
ugaucaccucccccugcuuccugcugcugugg

SEQ ID NO: 248363 - RNA, 22 nt, Human
ugaucaccuuagugcuucagug

SEQ ID NO: 248364 - RNA, 32 nt, Human
ugaucacgauccugcacuccagccugggcaac

SEQ ID NO: 248365 - RNA, 32 nt, Human
ugaucacgccacugcaccccagccugggugac

SEQ ID NO: 248366 - RNA, 32 nt, Human
ugaucacgccacugcacuccagccugggcgac

SEQ ID NO: 248367 - RNA, 32 nt, Human
ugaucacgccacugcacuccagccuggguaac

SEQ ID NO: 248368 - RNA, 32 nt, Human
ugaucacgccacugcacuccagccugggugac

SEQ ID NO: 248369 - RNA, 32 nt, Human
ugaucacgccacugcgcuacagccugggcgac

SEQ ID NO: 248370 - RNA, 32 nt, Human
ugaucacgccauugcacuccagccugggugac

SEQ ID NO: 248371 - RNA, 32 nt, Human
ugaucacggaacgcacaggagcagagcucgag

SEQ ID NO: 248372 - RNA, 32 nt, Human
ugaucacuaacaaaagacaucuucuguuaacc

SEQ ID NO: 248373 - RNA, 32 nt, Human
ugaucacuccacugcacuccagccugggugac

SEQ ID NO: 248374 - RNA, 32 nt, Human
ugaucacucuggaggcuggucagucuacgcac

SEQ ID NO: 248375 - RNA, 25 nt, Human
ugaucacugcagccuccacuuccca

SEQ ID NO: 248376 - RNA, 32 nt, Human
ugaucacuucauuuuaaaugaaugagauaauu

SEQ ID NO: 248377 - RNA, 32 nt, Human
ugaucagaagaaccugccgaagagcacacccc

SEQ ID NO: 248378 - RNA, 32 nt, Human
ugaucagaaucuacugacaguucuuccugucu

SEQ ID NO: 248379 - RNA, 32 nt, Human
ugaucagacucccaggggcagccaccacaugu

SEQ ID NO: 248380 - RNA, 32 nt, Human
ugaucagagccauaccccucuucaccaauggg

SEQ ID NO: 248381 - RNA, 32 nt, Human
ugaucagaggaaaccauggaaggguucacgcu

SEQ ID NO: 248382 - RNA, 32 nt, Human
ugaucagauaagcuccagcccaaauggaaccu

SEQ ID NO: 248383 - RNA, 32 nt, Human
ugaucagaugccagcaccauguuuucauuuaa

SEQ ID NO: 248384 - RNA, 32 nt, Human
ugaucagcacauccaaaaacaccaagacaaac

SEQ ID NO: 248385 - RNA, 32 nt, Human
ugaucagcauuuucuccuucucuucacacucg

SEQ ID NO: 248386 - RNA, 32 nt, Human
ugaucagcuguggugugaggacuucucagaca

SEQ ID NO: 248387 - RNA, 22 nt, Human
ugaucagcuuagaagcauccua

SEQ ID NO: 248388 - RNA, 32 nt, Human
ugaucagcuuugacuggaccucagcucacacg

SEQ ID NO: 248389 - RNA, 32 nt, Human
ugaucaggcagucugcucagauacauugagug

SEQ ID NO: 248390 - RNA, 32 nt, Human
ugaucaggcuccucagccuccaccauccccca

SEQ ID NO: 248391 - RNA, 32 nt, Human
ugaucagggaggcauagcagugagagccauag

SEQ ID NO: 248392 - RNA, 32 nt, Human
ugaucagucucuacugauuaucuugcugcuua

SEQ ID NO: 248393 - RNA, 32 nt, Human
ugaucaguuguacuucauccuauaucagcaca

SEQ ID NO: 248394 - RNA, 32 nt, Human
ugaucauaccacugcacuccagccugggcgac

SEQ ID NO: 248395 - RNA, 32 nt, Human
ugaucauaccacugcacuccagccugggugac

SEQ ID NO: 248396 - RNA, 32 nt, Human
ugaucauaccacugcacuccagucugggcaac

SEQ ID NO: 248397 - RNA, 32 nt, Human
ugaucauaccacugcacuuaacuuggcaacag

SEQ ID NO: 248398 - RNA, 32 nt, Human
ugaucauagcucacuccagccugaagcaagcc

SEQ ID NO: 248399 - RNA, 32 nt, Human
ugaucauagcucacugcacccucaaccuccug

SEQ ID NO: 248400 - RNA, 32 nt, Human
ugaucaucaacaaagacccacacuacuggaca

SEQ ID NO: 248401 - RNA, 32 nt, Human
ugaucaucagaaacuaaauggcagccaggcau

SEQ ID NO: 248402 - RNA, 32 nt, Human
ugaucaucauaacucuguaucugagcagugau

SEQ ID NO: 248403 - RNA, 32 nt, Human
ugaucaucauuucucucaccucucaucuuugg

SEQ ID NO: 248404 - RNA, 32 nt, Human
ugaucaucccagagggaguacccuuuugcaau

SEQ ID NO: 248405 - RNA, 32 nt, Human
ugaucauccuuuucccuauuacugaacauuca

SEQ ID NO: 248406 - RNA, 32 nt, Human
ugaucaucuaaccuuaccuggguccucagcua

SEQ ID NO: 248407 - RNA, 32 nt, Human
ugaucaucuccucaccccaucucccaccuugu

SEQ ID NO: 248408 - RNA, 32 nt, Human
ugaucaucugguucuccucucauuaagcaucc

SEQ ID NO: 248409 - RNA, 32 nt, Human
ugaucaucuuccucauccccuaccuugugaaa

SEQ ID NO: 248410 - RNA, 32 nt, Human
ugaucaugaauaggagcccaugcuagaaguac

SEQ ID NO: 248411 - RNA, 31 nt, Human
ugaucaugacuucuccuuuccagaguuuugg

SEQ ID NO: 248412 - RNA, 32 nt, Human
ugaucaugccaccgcacuuccagccuggguga

SEQ ID NO: 248413 - RNA, 32 nt, Human
ugaucaugccacugcacuccaaccugggcaac

SEQ ID NO: 248414 - RNA, 32 nt, Human
ugaucaugccacugcacuccagcaugcaugac

SEQ ID NO: 248415 - RNA, 32 nt, Human
ugaucaugccacugcacuccagcaugggugau

SEQ ID NO: 248416 - RNA, 32 nt, Human
ugaucaugccacugcacuccagccuggaugac

SEQ ID NO: 248417 - RNA, 32 nt, Human
ugaucaugccacugcacuccagccugggcaac

SEQ ID NO: 248418 - RNA, 32 nt, Human
ugaucaugccacugcacuccagccugggugac

SEQ ID NO: 248419 - RNA, 32 nt, Human
ugaucaugccacugcacuccagcuugggugag

SEQ ID NO: 248420 - RNA, 32 nt, Human
ugaucaugccacugcacuccagucuggaugac

SEQ ID NO: 248421 - RNA, 32 nt, Human
ugaucaugccacugcacuccagucugggugac

SEQ ID NO: 248422 - RNA, 32 nt, Human
ugaucaugccacugcacuccauccugggugac

SEQ ID NO: 248423 - RNA, 32 nt, Human
ugaucaugccacugcacuccuccgugggugac

SEQ ID NO: 248424 - RNA, 32 nt, Human
ugaucaugccacugcacucuagccuaggcuac

SEQ ID NO: 248425 - RNA, 32 nt, Human
ugaucaugccacugcacucugggcuggguaac

SEQ ID NO: 248426 - RNA, 32 nt, Human
ugaucaugccacugcacuuccagccuggguga

SEQ ID NO: 248427 - RNA, 32 nt, Human
ugaucaugccacugcacuuuagccugggcaac

SEQ ID NO: 248428 - RNA, 32 nt, Human
ugaucaugccacugcauuccagccugggcaac

SEQ ID NO: 248429 - RNA, 32 nt, Human
ugaucaugccacugcauuccagccugggcgac

SEQ ID NO: 248430 - RNA, 32 nt, Human
ugaucaugccacugcauuccagccugugugau

SEQ ID NO: 248431 - RNA, 32 nt, Human
ugaucaugccacuguacuccagccugggcgac

SEQ ID NO: 248432 - RNA, 32 nt, Human
ugaucaugccauugcacuccagccugggugac

SEQ ID NO: 248433 - RNA, 32 nt, Human
ugaucaugccauugucuuccagccugaguguc

SEQ ID NO: 248434 - RNA, 31 nt, Human
ugaucaugccucucggccucuugguuucuuu

SEQ ID NO: 248435 - RNA, 32 nt, Human
ugaucaugccucucuacuccagccugggcaau

SEQ ID NO: 248436 - RNA, 32 nt, Human
ugaucaugccucugcauuccagccuuggugac

SEQ ID NO: 248437 - RNA, 32 nt, Human
ugaucaugcuacugcacuccagccuaggugac

SEQ ID NO: 248438 - RNA, 32 nt, Human
ugaucauggcacugcacuccagccugggcaac

SEQ ID NO: 248439 - RNA, 32 nt, Human
ugaucaugggcacauucuccugccauuuguaa

SEQ ID NO: 248440 - RNA, 32 nt, Human
ugaucaugguaaggucuucaguucagccaacg

SEQ ID NO: 248441 - RNA, 32 nt, Human
ugaucauguccuuacacuccagccuggauaac

SEQ ID NO: 248442 - RNA, 32 nt, Human
ugaucauuacacauugcauacauguaccagaa

SEQ ID NO: 248443 - RNA, 32 nt, Human
ugaucauuacauggagauguuugcucauggcu

SEQ ID NO: 248444 - RNA, 32 nt, Human
ugaucauucaggccagcaaggaagggacucug

SEQ ID NO: 248445 - RNA, 32 nt, Human
ugaucauuccacugcauuucagccugggggau

SEQ ID NO: 248446 - RNA, 32 nt, Human
ugaucauuuugaggcugggugcaguggcucac

SEQ ID NO: 248447 - RNA, 32 nt, Human
ugauccacccaccucagccuccaaaagugcug

SEQ ID NO: 248448 - RNA, 24 nt, Human
ugauccacccaccucagccuucca

SEQ ID NO: 248449 - RNA, 32 nt, Human
ugauccacccaccuuggccuuacaaagugcug

SEQ ID NO: 248450 - RNA, 24 nt, Human
ugauccacccacuucagccuccca

SEQ ID NO: 248451 - RNA, 32 nt, Human
ugauccacccgccucggccucccagagugcug

SEQ ID NO: 248452 - RNA, 24 nt, Human
ugauccacccgccucggccuucca

SEQ ID NO: 248453 - RNA, 32 nt, Human
ugauccacccgccuuggccuccugggugcugg

SEQ ID NO: 248454 - RNA, 24 nt, Human
ugauccacccgcuucagcuuccca

SEQ ID NO: 248455 - RNA, 32 nt, Human
ugauccaccgagcuccccacuaggugaagcau

SEQ ID NO: 248456 - RNA, 32 nt, Human
ugauccaccucaaauucacuccugcuuguggu

SEQ ID NO: 248457 - RNA, 32 nt, Human
ugauccaccucagggcacgggcaaacacauag

SEQ ID NO: 248458 - RNA, 24 nt, Human
ugauccaccugccucagccuucca

SEQ ID NO: 248459 - RNA, 32 nt, Human
ugauccaccugccucggccucccacagugcug

SEQ ID NO: 248460 - RNA, 32 nt, Human
ugauccaccugccucggccucccgaaaugcug

SEQ ID NO: 248461 - RNA, 24 nt, Human
ugauccaccugccucggccuucca

SEQ ID NO: 248462 - RNA, 32 nt, Human
ugauccaccugccucguccucccaagugcugg

SEQ ID NO: 248463 - RNA, 32 nt, Human
ugauccaccugccucugccucccaaagugcug

SEQ ID NO: 248464 - RNA, 24 nt, Human
ugauccaccugcuucggccuccca

SEQ ID NO: 248465 - RNA, 32 nt, Human
ugauccacuugcauuccaggggaguuuucuuu

SEQ ID NO: 248466 - RNA, 32 nt, Human
ugauccagaccagcucugugaucagaaggaaa

SEQ ID NO: 248467 - RNA, 32 nt, Human
ugauccagagcagaguuuacgggucuuaggau

SEQ ID NO: 248468 - RNA, 32 nt, Human
ugauccagaugaucaucugauagaagagguga

SEQ ID NO: 248469 - RNA, 32 nt, Human
ugauccagcucuuucagcaucuugguugaacu

SEQ ID NO: 248470 - RNA, 32 nt, Human
ugauccaggagaaaauuagaacagaaaaauaa

SEQ ID NO: 248471 - RNA, 32 nt, Human
ugauccaggcagcccccucugcagagaaaagg

SEQ ID NO: 248472 - RNA, 32 nt, Human
ugauccaucuuaacugaggcucaggccacaua

SEQ ID NO: 248473 - RNA, 32 nt, Human
ugaucccaaaguggccagagugcaaggugcuu

SEQ ID NO: 248474 - RNA, 32 nt, Human
ugaucccaacacucggggagguugaggcuaca

SEQ ID NO: 248475 - RNA, 32 nt, Human
ugaucccaccacugcuccucaacgugcggccu

SEQ ID NO: 248476 - RNA, 23 nt, Human
ugaucccacuccaccccaccuca

SEQ ID NO: 248477 - RNA, 32 nt, Human
ugaucccacugaccuacucuugccugcuggag

SEQ ID NO: 248478 - RNA, 32 nt, Human
ugaucccagcaaccacugucccugccugaaua

SEQ ID NO: 248479 - RNA, 32 nt, Human
ugaucccagcacuuugggaggccgaggcaggu

SEQ ID NO: 248480 - RNA, 32 nt, Human
ugaucccagcacuuugggaggccgaggcgggc

SEQ ID NO: 248481 - RNA, 32 nt, Human
ugaucccagcacuuugggaggcugaggcaggu

SEQ ID NO: 248482 - RNA, 32 nt, Human
ugaucccagcacuuugggaggcugaggcgggu

SEQ ID NO: 248483 - RNA, 32 nt, Human
ugaucccagcacuuugggaggcugagguagga

SEQ ID NO: 248484 - RNA, 32 nt, Human
ugaucccagcacuuugggaggcugaggugggu

SEQ ID NO: 248485 - RNA, 32 nt, Human
ugaucccagcacuuugggaugcugagguggga

SEQ ID NO: 248486 - RNA, 32 nt, Human
ugaucccagcacuuuggguggcugagguggac

SEQ ID NO: 248487 - RNA, 32 nt, Human
ugaucccagcccacacuagccugggugcaucu

SEQ ID NO: 248488 - RNA, 32 nt, Human
ugaucccagcuaccugggaggcugaggaagga

SEQ ID NO: 248489 - RNA, 32 nt, Human
ugaucccagcuacucaggaggcugagacagga

SEQ ID NO: 248490 - RNA, 32 nt, Human
ugaucccagcuacucaggaggcugaggcagga

SEQ ID NO: 248491 - RNA, 32 nt, Human
ugaucccagcuacucgggaggcugaggcagga

SEQ ID NO: 248492 - RNA, 32 nt, Human
ugaucccagcuacugaggaggcugaggcagga

SEQ ID NO: 248493 - RNA, 32 nt, Human
ugaucccagcuacuggagaggcugaggcagga

SEQ ID NO: 248494 - RNA, 32 nt, Human
ugaucccagcuacuggggaggcugaggcagga

SEQ ID NO: 248495 - RNA, 32 nt, Human
ugaucccagcuacuugagaggcugagguggga

SEQ ID NO: 248496 - RNA, 32 nt, Human
ugaucccagcuacuuggaaggcugaggugaga

SEQ ID NO: 248497 - RNA, 32 nt, Human
ugaucccagcuacuugggaggcugaggcagga

SEQ ID NO: 248498 - RNA, 32 nt, Human
ugaucccagcuacuugggaggcugagguagaa

SEQ ID NO: 248499 - RNA, 32 nt, Human
ugaucccagcuacuugggaggcugagguggga

SEQ ID NO: 248500 - RNA, 32 nt, Human
ugaucccagcugcucaggaggcugaggcagga

SEQ ID NO: 248501 - RNA, 32 nt, Human
ugaucccagcuuccugggaggcugaggcaaga

SEQ ID NO: 248502 - RNA, 32 nt, Human
ugaucccaggaauuugagguugcaguaagcua

SEQ ID NO: 248503 - RNA, 32 nt, Human
ugaucccaggaggcggagguugcagugaguug

SEQ ID NO: 248504 - RNA, 32 nt, Human
ugaucccagggaggaaguguuggggcuucaug

SEQ ID NO: 248505 - RNA, 32 nt, Human
ugaucccaggguggcgaguggcggcgaccgag

SEQ ID NO: 248506 - RNA, 32 nt, Human
ugaucccauccuggaagggaaggugcaucgcc

SEQ ID NO: 248507 - RNA, 32 nt, Human
ugaucccaucucuuuucccuucuuuccuccug

SEQ ID NO: 248508 - RNA, 32 nt, Human
ugaucccaugcucccagccucuguuggcggcu

SEQ ID NO: 248509 - RNA, 32 nt, Human
ugaucccauggggcggagguccccaguggcug

SEQ ID NO: 248510 - RNA, 32 nt, Human
ugaucccauuucuccccacccuggggcucuuc

SEQ ID NO: 248511 - RNA, 28 nt, Human
ugauccccaaguguuucuugagcaucug

SEQ ID NO: 248512 - RNA, 32 nt, Human
ugauccccagccacagcacacaggaccaggcu

SEQ ID NO: 248513 - RNA, 32 nt, Human
ugaucccccguuacuuccuagcauuuucuccu

SEQ ID NO: 248514 - RNA, 32 nt, Human
ugaucccccugccucggccucccaaagugcug

SEQ ID NO: 248515 - RNA, 32 nt, Human
ugaucccccugccucggccucccagagugcug

SEQ ID NO: 248516 - RNA, 32 nt, Human
ugauccccgccuggcccuggagguguacuuug

SEQ ID NO: 248517 - RNA, 32 nt, Human
ugauccccucagacauucucaggauuuuacaa

SEQ ID NO: 248518 - RNA, 32 nt, Human
ugauccccuccagcgcccuuccuggagaaucu

SEQ ID NO: 248519 - RNA, 32 nt, Human
ugauccccuccccuccccaugcucuccucccu

SEQ ID NO: 248520 - RNA, 32 nt, Human
ugaucccgaugacucugaaacaugcuuggccu

SEQ ID NO: 248521 - RNA, 32 nt, Human
ugaucccuaacauacuguacuacuugcuuuua

SEQ ID NO: 248522 - RNA, 32 nt, Human
ugaucccuggagccaccaugcccagcaaauuu

SEQ ID NO: 248523 - RNA, 32 nt, Human
ugaucccuguugcaaagccuacccugacucca

SEQ ID NO: 248524 - RNA, 32 nt, Human
ugaucccuuaauucaggcucaggcugaagaac

SEQ ID NO: 248525 - RNA, 32 nt, Human
ugauccgagcacccaaacccucggcggacagc

SEQ ID NO: 248526 - RNA, 32 nt, Human
ugauccgccagccucggccucccgaggugccg

SEQ ID NO: 248527 - RNA, 32 nt, Human
ugauccgccauuacacuccagccugggugaca

SEQ ID NO: 248528 - RNA, 24 nt, Human
ugauccgcccaauccgcccaccuc

SEQ ID NO: 248529 - RNA, 24 nt, Human
ugauccgcccaccucggccuucca

SEQ ID NO: 248530 - RNA, 24 nt, Human
ugauccgcccgccucagccuucua

SEQ ID NO: 248531 - RNA, 32 nt, Human
ugauccgcccgccuuguccuccaaagugcugg

SEQ ID NO: 248532 - RNA, 32 nt, Human
ugauccgccugccucagccucccacagugcug

SEQ ID NO: 248533 - RNA, 32 nt, Human
ugauccgccugccucuaccucccaaagugcug

SEQ ID NO: 248534 - RNA, 32 nt, Human
ugauccgccugccucugccucccaaagugcug

SEQ ID NO: 248535 - RNA, 32 nt, Human
ugauccgggauugggcaacagugcagaacugc

SEQ ID NO: 248536 - RNA, 32 nt, Human
ugauccgggcugggcuguucuccugcugcucu

SEQ ID NO: 248537 - RNA, 32 nt, Human
ugauccggggagguggaaguugcagugggcca

SEQ ID NO: 248538 - RNA, 24 nt, Human
ugauccguccgccucggccuucca

SEQ ID NO: 248539 - RNA, 24 nt, Human
ugauccgucugccucggccuccca

SEQ ID NO: 248540 - RNA, 32 nt, Human
ugauccuaacauggaaaaccugcucugcugau

SEQ ID NO: 248541 - RNA, 32 nt, Human
ugauccuaaccugcagcacggugguuuuacaa

SEQ ID NO: 248542 - RNA, 32 nt, Human
ugauccuaccacugcacuucagccuaggugac

SEQ ID NO: 248543 - RNA, 32 nt, Human
ugauccuaccuuacauccuuuugagguccugc

SEQ ID NO: 248544 - RNA, 32 nt, Human
ugauccuagcuacuugggaggcugagguggga

SEQ ID NO: 248545 - RNA, 32 nt, Human
ugauccuagcugcuggggaggcugagguagga

SEQ ID NO: 248546 - RNA, 32 nt, Human
ugauccuaggagaggguagaugugagccagcc

SEQ ID NO: 248547 - RNA, 32 nt, Human
ugauccuauuccauucccuccugcugcgguuu

SEQ ID NO: 248548 - RNA, 32 nt, Human
ugauccucaaagcccagccagcuccagcaagc

SEQ ID NO: 248549 - RNA, 32 nt, Human
ugauccuccaucuuaaagaagaucagacagag

SEQ ID NO: 248550 - RNA, 32 nt, Human
ugauccucccagggcccugccagguuguuuug

SEQ ID NO: 248551 - RNA, 19 nt, Human
ugauccucccgccccagcc

SEQ ID NO: 248552 - RNA, 24 nt, Human
ugauccucccgccucagccuucca

SEQ ID NO: 248553 - RNA, 24 nt, Human
ugauccucccgcuucagccucuca

SEQ ID NO: 248554 - RNA, 24 nt, Human
ugauccuccuauuucagccuccca

SEQ ID NO: 248555 - RNA, 32 nt, Human
ugauccuccugccucagccccugaguagcugg

SEQ ID NO: 248556 - RNA, 32 nt, Human
ugauccuccugccucagccucccaaugugcug

SEQ ID NO: 248557 - RNA, 32 nt, Human
ugauccuccugccucagccucccgaguagcua

SEQ ID NO: 248558 - RNA, 32 nt, Human
ugauccuccugccucagccucccgaguggcug

SEQ ID NO: 248559 - RNA, 32 nt, Human
ugauccuccugccucagccuccuaagugcugg

SEQ ID NO: 248560 - RNA, 32 nt, Human
ugauccuccugccucagccuccuuaguagcug

SEQ ID NO: 248561 - RNA, 22 nt, Human
ugauccuccugccucagccuuc

SEQ ID NO: 248562 - RNA, 32 nt, Human
ugauccuccugccucagucuccugaguagcug

SEQ ID NO: 248563 - RNA, 32 nt, Human
ugauccuccugccucagucuuccaagcagcug

SEQ ID NO: 248564 - RNA, 32 nt, Human
ugauccuccugccucggccuccuaaagugcug

SEQ ID NO: 248565 - RNA, 23 nt, Human
ugauccuccugcuucagccuccg

SEQ ID NO: 248566 - RNA, 24 nt, Human
ugauccuccugcuucagccucuca

SEQ ID NO: 248567 - RNA, 32 nt, Human
ugauccucuccucucuugaguuaaccccugau

SEQ ID NO: 248568 - RNA, 32 nt, Human
ugauccugaaacucaggaagcaaauggcaauc

SEQ ID NO: 248569 - RNA, 32 nt, Human
ugauccugagccaaggaggugaggagcagagc

SEQ ID NO: 248570 - RNA, 32 nt, Human
ugauccugauuccaguuugccucucucuuuuu

SEQ ID NO: 248571 - RNA, 32 nt, Human
ugauccugccacugcacuccagccugggcgac

SEQ ID NO: 248572 - RNA, 32 nt, Human
ugauccuggaaagugaacugggugaccuagga

SEQ ID NO: 248573 - RNA, 32 nt, Human
ugauccuggaguguggaggcagcagcggcacc

SEQ ID NO: 248574 - RNA, 32 nt, Human
ugauccuggcuacuucagaggcugagguggaa

SEQ ID NO: 248575 - RNA, 32 nt, Human
ugauccugggaaggccuggaugaccaagcuug

SEQ ID NO: 248576 - RNA, 32 nt, Human
ugauccugggagaggugaagagggccaggaug

SEQ ID NO: 248577 - RNA, 32 nt, Human
ugauccugggaggcagagguuguagugagccg

SEQ ID NO: 248578 - RNA, 32 nt, Human
ugauccugggcaagucacuuaaccucuuuagg

SEQ ID NO: 248579 - RNA, 17 nt, Human
ugauccugggccugaga

SEQ ID NO: 248580 - RNA, 32 nt, Human
ugauccugguuuccaccuccagcccugggaaa

SEQ ID NO: 248581 - RNA, 32 nt, Human
ugauccuguacucagaagguuuugccauuucg

SEQ ID NO: 248582 - RNA, 32 nt, Human
ugauccuguggcugguuucucagaaaucaguu

SEQ ID NO: 248583 - RNA, 32 nt, Human
ugauccuuccagagccaucccaaaaagucagc

SEQ ID NO: 248584 - RNA, 32 nt, Human
ugauccuuccuacuuugcuucucuccacccau

SEQ ID NO: 248585 - RNA, 32 nt, Human
ugauccuucuuagagaaggcucagccuuggaa

SEQ ID NO: 248586 - RNA, 32 nt, Human
ugauccuugcagaacuucugugcacaugacau

SEQ ID NO: 248587 - RNA, 32 nt, Human
ugauccuuuacagaaaaaguuugcuaacccuu

SEQ ID NO: 248588 - RNA, 32 nt, Human
ugauccuuucccuccucucacccuccagugug

SEQ ID NO: 248589 - RNA, 32 nt, Human
ugaucgagccacugcacuccagccugggcaac

SEQ ID NO: 248590 - RNA, 32 nt, Human
ugaucgaguuacugcacuccagccugggugac

SEQ ID NO: 248591 - RNA, 32 nt, Human
ugaucgaguuguugcccacagcuguaugauuc

SEQ ID NO: 248592 - RNA, 32 nt, Human
ugaucgcaccacugcacccaaaccuggggaga

SEQ ID NO: 248593 - RNA, 32 nt, Human
ugaucgcaccacugcacuccagccuaggcgac

SEQ ID NO: 248594 - RNA, 32 nt, Human
ugaucgcaccacugcacuccagccugggugac

SEQ ID NO: 248595 - RNA, 32 nt, Human
ugaucgcaccacugcacuccagcucgggugac

SEQ ID NO: 248596 - RNA, 32 nt, Human
ugaucgcaccacugcacuccagcuugguucau

SEQ ID NO: 248597 - RNA, 32 nt, Human
ugaucgcaccacugcacucuagccugggugac

SEQ ID NO: 248598 - RNA, 32 nt, Human
ugaucgcaccacugcauucagccugagcaaca

SEQ ID NO: 248599 - RNA, 32 nt, Human
ugaucgcaccacugcauuccagaccccaucuc

SEQ ID NO: 248600 - RNA, 32 nt, Human
ugaucgcaccacuguacuccagccugggugac

SEQ ID NO: 248601 - RNA, 32 nt, Human
ugaucgcaccacuguauccagcucgggcaaca

SEQ ID NO: 248602 - RNA, 32 nt, Human
ugaucgcaccacuguauuccagccuggaugac

SEQ ID NO: 248603 - RNA, 32 nt, Human
ugaucgcaccauugcacuccagccugagugac

SEQ ID NO: 248604 - RNA, 32 nt, Human
ugaucgcaucaguccacuccagccugagcaac

SEQ ID NO: 248605 - RNA, 32 nt, Human
ugaucgccuggcccagcaggagcugcuucagc

SEQ ID NO: 248606 - RNA, 32 nt, Human
ugaucgcgacacugcacuccagccugggugac

SEQ ID NO: 248607 - RNA, 32 nt, Human
ugaucgcgccacuacacuccagccugagcaac

SEQ ID NO: 248608 - RNA, 32 nt, Human
ugaucgcgccacugcacuccagcccgggugac

SEQ ID NO: 248609 - RNA, 32 nt, Human
ugaucgcgccacugcacuccaggcugggcaac

SEQ ID NO: 248610 - RNA, 32 nt, Human
ugaucgcgccacugcacuccugccugggcaac

SEQ ID NO: 248611 - RNA, 32 nt, Human
ugaucgcugcugucuaggauuuuguuucuuuu

SEQ ID NO: 248612 - RNA, 32 nt, Human
ugaucggccaacugccagcugccuuaaaaagg

SEQ ID NO: 248613 - RNA, 32 nt, Human
ugaucgguaauuccagcuucauacuggcuaca

SEQ ID NO: 248614 - RNA, 32 nt, Human
ugaucgguuuuuaagaggcagugcuuuucagc

SEQ ID NO: 248615 - RNA, 32 nt, Human
ugaucguaccacugcacuccagccuaggugac

SEQ ID NO: 248616 - RNA, 32 nt, Human
ugaucgucauuucucucaccucucaucuuugg

SEQ ID NO: 248617 - RNA, 32 nt, Human
ugaucgugacauggccuccagccugggugacc

SEQ ID NO: 248618 - RNA, 32 nt, Human
ugaucgugccacuacacuccagccugggugac

SEQ ID NO: 248619 - RNA, 32 nt, Human
ugaucgugccacugaccuccagccugggggac

SEQ ID NO: 248620 - RNA, 32 nt, Human
ugaucgugccacugcacuacaaccugggugau

SEQ ID NO: 248621 - RNA, 32 nt, Human
ugaucgugccacugcacuccaaccugagugac

SEQ ID NO: 248622 - RNA, 32 nt, Human
ugaucgugccacugcacuccagccugggcaac

SEQ ID NO: 248623 - RNA, 32 nt, Human
ugaucgugccacugcacuccagccugggggac

SEQ ID NO: 248624 - RNA, 32 nt, Human
ugaucgugccacugcauuccagccugggagag

SEQ ID NO: 248625 - RNA, 32 nt, Human
ugaucgugcuacugcacuccagccugggcaac

SEQ ID NO: 248626 - RNA, 32 nt, Human
ugaucguguacugcaggaccuggguagacaga

SEQ ID NO: 248627 - RNA, 32 nt, Human
ugaucguuguguuguuuugcugcacuuuuuac

SEQ ID NO: 248628 - RNA, 32 nt, Human
ugaucuaaccaggaggccaucacuggaugguc

SEQ ID NO: 248629 - RNA, 32 nt, Human
ugaucuaaggguaguccagccuccuuccaaga

SEQ ID NO: 248630 - RNA, 32 nt, Human
ugaucuacaauccaguaagguggccuuuugcc

SEQ ID NO: 248631 - RNA, 32 nt, Human
ugaucuaccaacaugccacagagaaucacaau

SEQ ID NO: 248632 - RNA, 24 nt, Human
ugaucuacccaccucagccuccca

SEQ ID NO: 248633 - RNA, 24 nt, Human
ugaucuacccaccucggccuccca

SEQ ID NO: 248634 - RNA, 24 nt, Human
ugaucuacccacuggcagucccca

SEQ ID NO: 248635 - RNA, 24 nt, Human
ugaucuacccgccucagccuccca

SEQ ID NO: 248636 - RNA, 23 nt, Human
ugaucuacccgccucggcaucuc

SEQ ID NO: 248637 - RNA, 24 nt, Human
ugaucuacccgccucggccuccca

SEQ ID NO: 248638 - RNA, 24 nt, Human
ugaucuacccgccuggaccucuca

SEQ ID NO: 248639 - RNA, 23 nt, Human
ugaucuacccgccuuggccuccc

SEQ ID NO: 248640 - RNA, 24 nt, Human
ugaucuacccgccuuggccuccca

SEQ ID NO: 248641 - RNA, 24 nt, Human
ugaucuacccuccucggccuccca

SEQ ID NO: 248642 - RNA, 24 nt, Human
ugaucuaccggccucagccucuca

SEQ ID NO: 248643 - RNA, 24 nt, Human
ugaucuaccugccucagccuccca

SEQ ID NO: 248644 - RNA, 32 nt, Human
ugaucuaccuuuucugaauuacuugaaaaggc

SEQ ID NO: 248645 - RNA, 32 nt, Human
ugaucuacuaaacuggaaacacucugaacccu

SEQ ID NO: 248646 - RNA, 32 nt, Human
ugaucuacuguaccuauuuccuccugguggac

SEQ ID NO: 248647 - RNA, 22 nt, Human
ugaucuagcagauacauggcaa

SEQ ID NO: 248648 - RNA, 32 nt, Human
ugaucuaggaagagacugcggccuuaucaccg

SEQ ID NO: 248649 - RNA, 26 nt, Human
ugaucucaagugaucugcccaccuca

SEQ ID NO: 248650 - RNA, 32 nt, Human
ugaucucaccacuacacuccagccugggugac

SEQ ID NO: 248651 - RNA, 32 nt, Human
ugaucucaccacuguacuccagccugggugac

SEQ ID NO: 248652 - RNA, 32 nt, Human
ugaucucaccaugcacuccagccuagacaaca

SEQ ID NO: 248653 - RNA, 32 nt, Human
ugaucucaccccugcacuccagccugggcaac

SEQ ID NO: 248654 - RNA, 32 nt, Human
ugaucucacugcaaccuccaucuccugucuca

SEQ ID NO: 248655 - RNA, 32 nt, Human
ugaucucacugcacacagccuagggccccacc

SEQ ID NO: 248656 - RNA, 32 nt, Human
ugaucucagaguuuagaaucagcagagcacag

SEQ ID NO: 248657 - RNA, 32 nt, Human
ugaucucagcuacccaggaggcugagguggga

SEQ ID NO: 248658 - RNA, 32 nt, Human
ugaucucaggagguugaggcugcagugaauua

SEQ ID NO: 248659 - RNA, 26 nt, Human
ugaucucaggcaauccacccaccuca

SEQ ID NO: 248660 - RNA, 25 nt, Human
ugaucucaggugaccugcccaccuc

SEQ ID NO: 248661 - RNA, 25 nt, Human
ugaucucaggugauccgcccgucuc

SEQ ID NO: 248662 - RNA, 25 nt, Human
ugaucucaggugaucugcccaccuu

SEQ ID NO: 248663 - RNA, 32 nt, Human
ugaucucaucacagacauagccagcucuucag

SEQ ID NO: 248664 - RNA, 24 nt, Human
ugaucucaugauccgcccaucuca

SEQ ID NO: 248665 - RNA, 22 nt, Human
ugaucuccauguaguccauaua

SEQ ID NO: 248666 - RNA, 22 nt, Human
ugaucucccacuucagccuccc

SEQ ID NO: 248667 - RNA, 32 nt, Human
ugaucuccgcucacugccaccuccgccucucu

SEQ ID NO: 248668 - RNA, 32 nt, Human
ugaucuccuccaccuuucuccaaugacagaag

SEQ ID NO: 248669 - RNA, 32 nt, Human
ugaucuccuccacuuccuucagcgccagcagc

SEQ ID NO: 248670 - RNA, 32 nt, Human
ugaucucggcacaccacaaccuucaccucccc

SEQ ID NO: 248671 - RNA, 32 nt, Human
ugaucucggcucacugcaaccuccagcuccca

SEQ ID NO: 248672 - RNA, 23 nt, Human
ugaucucgugauccgccugccuc

SEQ ID NO: 248673 - RNA, 32 nt, Human
ugaucucuaaaacccuuccugcccuuaauauu

SEQ ID NO: 248674 - RNA, 32 nt, Human
ugaucucuaagggcaccaaaucugguauucua

SEQ ID NO: 248675 - RNA, 32 nt, Human
ugaucucuacuuccagcuguguucuguggagg

SEQ ID NO: 248676 - RNA, 32 nt, Human
ugaucucuagcacagacagagauucuggccuc

SEQ ID NO: 248677 - RNA, 32 nt, Human
ugaucucucugaauccuaagggcuggucucug

SEQ ID NO: 248678 - RNA, 21 nt, Human
ugaucucugaucuccaccuca

SEQ ID NO: 248679 - RNA, 32 nt, Human
ugaucucugcucccugcaaccuccaccucccg

SEQ ID NO: 248680 - RNA, 32 nt, Human
ugaucucugggaaggaggauggguggcaggau

SEQ ID NO: 248681 - RNA, 32 nt, Human
ugaucucuugcuguuucaucaggggaaagcac

SEQ ID NO: 248682 - RNA, 32 nt, Human
ugaucucuugugauggggccaaugagucaauu

SEQ ID NO: 248683 - RNA, 20 nt, Human
ugaucugaagcucugugaca

SEQ ID NO: 248684 - RNA, 32 nt, Human
ugaucugaaugagauggagagaagaaugaaga

SEQ ID NO: 248685 - RNA, 32 nt, Human
ugaucugaaugagauggagagaagaaugaagg

SEQ ID NO: 248686 - RNA, 32 nt, Human
ugaucugacuccugcagacucuuccagauuuu

SEQ ID NO: 248687 - RNA, 32 nt, Human
ugaucugagaaugagcccagaggcuuguuugg

SEQ ID NO: 248688 - RNA, 32 nt, Human
ugaucugaucuuuaccuucccuuccuuggauc

SEQ ID NO: 248689 - RNA, 32 nt, Human
ugaucugcaaaccugggcaguauuccacacug

SEQ ID NO: 248690 - RNA, 32 nt, Human
ugaucugcaauacaaggauccauucguaaucu

SEQ ID NO: 248691 - RNA, 24 nt, Human
ugaucugcccaccucaaccuccca

SEQ ID NO: 248692 - RNA, 24 nt, Human
ugaucugcccaccucagccuccca

SEQ ID NO: 248693 - RNA, 24 nt, Human
ugaucugcccaccucggccuccca

SEQ ID NO: 248694 - RNA, 24 nt, Human
ugaucugcccaccucugccuccca

SEQ ID NO: 248695 - RNA, 24 nt, Human
ugaucugcccacuucggccuccca

SEQ ID NO: 248696 - RNA, 24 nt, Human
ugaucugcccacuuuagccuccca

SEQ ID NO: 248697 - RNA, 24 nt, Human
ugaucugcccaucucagccuccca

SEQ ID NO: 248698 - RNA, 24 nt, Human
ugaucugccccccucagccuccca

SEQ ID NO: 248699 - RNA, 32 nt, Human
ugaucugccccuggcguauuuguuaagcacaa

SEQ ID NO: 248700 - RNA, 24 nt, Human
ugaucugcccgccccggccuccca

SEQ ID NO: 248701 - RNA, 24 nt, Human
ugaucugcccgccucagccuccca

SEQ ID NO: 248702 - RNA, 24 nt, Human
ugaucugcccgccucagucuccca

SEQ ID NO: 248703 - RNA, 24 nt, Human
ugaucugcccgccuccaccuccca

SEQ ID NO: 248704 - RNA, 24 nt, Human
ugaucugcccgccucggccuccca

SEQ ID NO: 248705 - RNA, 24 nt, Human
ugaucugcccgccuuagccuccca

SEQ ID NO: 248706 - RNA, 24 nt, Human
ugaucugcccuccucagccuccca

SEQ ID NO: 248707 - RNA, 32 nt, Human
ugaucugcccugcacugagcacucaguggaua

SEQ ID NO: 248708 - RNA, 24 nt, Human
ugaucugccugccccgaccuccca

SEQ ID NO: 248709 - RNA, 22 nt, Human
ugaucugccugccucagccucc

SEQ ID NO: 248710 - RNA, 24 nt, Human
ugaucugccugccucagccuccca

SEQ ID NO: 248711 - RNA, 24 nt, Human
ugaucugccugccucagccucuca

SEQ ID NO: 248712 - RNA, 24 nt, Human
ugaucugccugccucggccuccca

SEQ ID NO: 248713 - RNA, 24 nt, Human
ugaucugccugccucugccuccca

SEQ ID NO: 248714 - RNA, 24 nt, Human
ugaucugccuggcucagccuccca

SEQ ID NO: 248715 - RNA, 24 nt, Human
ugaucugccugucucagccuccca

SEQ ID NO: 248716 - RNA, 22 nt, Human
ugaucugcgcccccagccccca

SEQ ID NO: 248717 - RNA, 32 nt, Human
ugaucugcgcuagguggcaucuccucucacgg

SEQ ID NO: 248718 - RNA, 24 nt, Human
ugaucugcuccccucagccuccca

SEQ ID NO: 248719 - RNA, 24 nt, Human
ugaucugcucgccucggccuccca

SEQ ID NO: 248720 - RNA, 32 nt, Human
ugaucugcugcuuccaaguugugugaccuugg

SEQ ID NO: 248721 - RNA, 24 nt, Human
ugaucugcuugccucagccucuca

SEQ ID NO: 248722 - RNA, 32 nt, Human
ugaucuggaaacauagaggagguugcuugaaa

SEQ ID NO: 248723 - RNA, 32 nt, Human
ugaucuggaaagaauucuucauuuuucauuug

SEQ ID NO: 248724 - RNA, 32 nt, Human
ugaucuggaaccucuugagcagcagaagcagc

SEQ ID NO: 248725 - RNA, 32 nt, Human
ugaucuggagccaaugcagaaagaaaucuaaa

SEQ ID NO: 248726 - RNA, 32 nt, Human
ugaucugggaccccaggccucacaccagaacu

SEQ ID NO: 248727 - RNA, 32 nt, Human
ugaucugggcucaagugaugcuccugucucag

SEQ ID NO: 248728 - RNA, 32 nt, Human
ugaucuggggaggcagaggugacagugagcug

SEQ ID NO: 248729 - RNA, 32 nt, Human
ugaucugguccagccagggccuggcuugucag

SEQ ID NO: 248730 - RNA, 32 nt, Human
ugaucuggucucacugcaaccucuaccuccca

SEQ ID NO: 248731 - RNA, 19 nt, Human
ugaucuguagacucuuccu

SEQ ID NO: 248732 - RNA, 24 nt, Human
ugaucuguccacuucagccgucca

SEQ ID NO: 248733 - RNA, 24 nt, Human
ugaucuguccgccccggccuccca

SEQ ID NO: 248734 - RNA, 32 nt, Human
ugaucugucgcccaggcuggagugcaguagcg

SEQ ID NO: 248735 - RNA, 24 nt, Human
ugaucugucugccucggccuccca

SEQ ID NO: 248736 - RNA, 32 nt, Human
ugaucugugacaguaagcccuccugggauguc

SEQ ID NO: 248737 - RNA, 32 nt, Human
ugaucugugaucuagcauuuauugagagaggu

SEQ ID NO: 248738 - RNA, 32 nt, Human
ugaucuguggcuacucucacaccacaacagag

SEQ ID NO: 248739 - RNA, 32 nt, Human
ugaucuguggugaggccaaauggcagccuuuc

SEQ ID NO: 248740 - RNA, 32 nt, Human
ugaucugugguuuaacacugugcagggcugug

SEQ ID NO: 248741 - RNA, 24 nt, Human
ugaucugugugccccagccuccca

SEQ ID NO: 248742 - RNA, 32 nt, Human
ugaucuguuacccaggcuggagugcaguggca

SEQ ID NO: 248743 - RNA, 24 nt, Human
ugaucuguucgccucggccuccca

SEQ ID NO: 248744 - RNA, 32 nt, Human
ugaucuguugaauauuugcuaaagaccaguuc

SEQ ID NO: 248745 - RNA, 32 nt, Human
ugaucuguugaaugaacccuagacaguucugu

SEQ ID NO: 248746 - RNA, 32 nt, Human
ugaucuguugaaugaauccuagacacuucugu

SEQ ID NO: 248747 - RNA, 32 nt, Human
ugaucuguuuuaacuggacaugguggcacacg

SEQ ID NO: 248748 - RNA, 22 nt, Human
ugaucuguuuuucaccacuuca

SEQ ID NO: 248749 - RNA, 32 nt, Human
ugaucuuaccaaaauuccacauuuaagaguac

SEQ ID NO: 248750 - RNA, 32 nt, Human
ugaucuucagcuuugcaaacuggaugaacuag

SEQ ID NO: 248751 - RNA, 24 nt, Human
ugaucuucccacuucagccuccca

SEQ ID NO: 248752 - RNA, 32 nt, Human
ugaucuuccucccuuccucccuuucuuaccac

SEQ ID NO: 248753 - RNA, 32 nt, Human
ugaucuuccucuucucccuugccagccagcac

SEQ ID NO: 248754 - RNA, 32 nt, Human
ugaucuuccuggcccugcuccauaugcauccu

SEQ ID NO: 248755 - RNA, 32 nt, Human
ugaucuuccuuugaaagagaaugaaagacccu

SEQ ID NO: 248756 - RNA, 32 nt, Human
ugaucuucuccaagaggaagcccuauccgccc

SEQ ID NO: 248757 - RNA, 32 nt, Human
ugaucuugaaaccuccagacacaagaaaacuu

SEQ ID NO: 248758 - RNA, 32 nt, Human
ugaucuugaacuuuccagccuccaggauugug

SEQ ID NO: 248759 - RNA, 32 nt, Human
ugaucuugaagauguuucugcacagaaaugag

SEQ ID NO: 248760 - RNA, 21 nt, Human
ugaucuugauccuuaugcaaa

SEQ ID NO: 248761 - RNA, 32 nt, Human
ugaucuugcacucccagccucaggugauccac

SEQ ID NO: 248762 - RNA, 32 nt, Human
ugaucuugccacugcucuacagccuggaagac

SEQ ID NO: 248763 - RNA, 21 nt, Human
ugaucuugccauugcacucca

SEQ ID NO: 248764 - RNA, 20 nt, Human
ugaucuugccauugcuccau

SEQ ID NO: 248765 - RNA, 32 nt, Human
ugaucuuggauuauggggugaagaggaguaca

SEQ ID NO: 248766 - RNA, 22 nt, Human
ugaucuuggccaagucacuuca

SEQ ID NO: 248767 - RNA, 32 nt, Human
ugaucuuggcccacugcaaccucugcuuccua

SEQ ID NO: 248768 - RNA, 19 nt, Human
ugaucuuggcucacugcag

SEQ ID NO: 248769 - RNA, 32 nt, Human
ugaucuugguguuguggcuccuggagacacga

SEQ ID NO: 248770 - RNA, 32 nt, Human
ugaucuugugucuuagagaagcccccauaccu

SEQ ID NO: 248771 - RNA, 32 nt, Human
ugaucuugugugaccuccuggagaguggauga

SEQ ID NO: 248772 - RNA, 32 nt, Human
ugaucuuuacugaaauauguugccaaaauuua

SEQ ID NO: 248773 - RNA, 32 nt, Human
ugaucuuuccucuccuccuucccaagucauug

SEQ ID NO: 248774 - RNA, 19 nt, Human
ugaucuuucuuuucagcua

SEQ ID NO: 248775 - RNA, 32 nt, Human
ugaucuuuggacuuagcaaagcagagauuauc

SEQ ID NO: 248776 - RNA, 32 nt, Human
ugaucuuuuucuuugcagaugguacaaacucu

SEQ ID NO: 248777 - RNA, 18 nt, Human
ugaugaaaccccaucucu

SEQ ID NO: 248778 - RNA, 32 nt, Human
ugaugaaagcauguacccuccacccuuuuccu

SEQ ID NO: 248779 - RNA, 32 nt, Human
ugaugaaagggaccuucgugcaacuguaguca

SEQ ID NO: 248780 - RNA, 32 nt, Human
ugaugaaauuuccagacagaaagagcccuuuu

SEQ ID NO: 248781 - RNA, 32 nt, Human
ugaugaacaccuggcauccuuuggacaacuuu

SEQ ID NO: 248782 - RNA, 32 nt, Human
ugaugaacaggcugaaaucaguacuucagguu

SEQ ID NO: 248783 - RNA, 32 nt, Human
ugaugaacauggagaaaccccgucucuacuaa

SEQ ID NO: 248784 - RNA, 32 nt, Human
ugaugaacucacaaacuugaacuggcuucaug

SEQ ID NO: 248785 - RNA, 32 nt, Human
ugaugaacuggcagggauaacaaagaaccuaa

SEQ ID NO: 248786 - RNA, 32 nt, Human
ugaugaagacagugcagcagaacauugaaguc

SEQ ID NO: 248787 - RNA, 32 nt, Human
ugaugaagacuucaaaauucaccaagaaucuu

SEQ ID NO: 248788 - RNA, 32 nt, Human
ugaugaagagaaugaauggaagguauuggaag

SEQ ID NO: 248789 - RNA, 32 nt, Human
ugaugaagaggagcaugcuggggugagacugg

SEQ ID NO: 248790 - RNA, 32 nt, Human
ugaugaagaugcuagugcaaugcugaaagaag

SEQ ID NO: 248791 - RNA, 32 nt, Human
ugaugaagcgagacccaccacccuccaucuag

SEQ ID NO: 248792 - RNA, 32 nt, Human
ugaugaaguagagcagagggccugggugucug

SEQ ID NO: 248793 - RNA, 32 nt, Human
ugaugaaguagaucaugcagugacauacaaag

SEQ ID NO: 248794 - RNA, 32 nt, Human
ugaugaagucacugcacccuccacuaccucua

SEQ ID NO: 248795 - RNA, 32 nt, Human
ugaugaaucucuuccuagggagaagcaggaua

SEQ ID NO: 248796 - RNA, 32 nt, Human
ugaugaaucuuccuuucucugccuucugagca

SEQ ID NO: 248797 - RNA, 32 nt, Human
ugaugaaugauuuuauugguggcagcugggug

SEQ ID NO: 248798 - RNA, 32 nt, Human
ugaugaaugcuggccggcaucccugugaggaa

SEQ ID NO: 248799 - RNA, 32 nt, Human
ugaugaauuuaagaagcuacugaauaaauaug

SEQ ID NO: 248800 - RNA, 32 nt, Human
ugaugacaaaccugucaccaguguagcaacaa

SEQ ID NO: 248801 - RNA, 32 nt, Human
ugaugacaaauacacuacucuccucacagaua

SEQ ID NO: 248802 - RNA, 32 nt, Human
ugaugacaccacugcacuccaaccuagguaac

SEQ ID NO: 248803 - RNA, 32 nt, Human
ugaugacacgguggagcucggccacaccaggc

SEQ ID NO: 248804 - RNA, 32 nt, Human
ugaugacacuauuucuaaaagacagacauaau

SEQ ID NO: 248805 - RNA, 32 nt, Human
ugaugacagcccugucccucccugccuccgcc

SEQ ID NO: 248806 - RNA, 32 nt, Human
ugaugacagguguggugguuggaaagggccgg

SEQ ID NO: 248807 - RNA, 32 nt, Human
ugaugacaucucccugcugaagugggaggccc

SEQ ID NO: 248808 - RNA, 32 nt, Human
ugaugacaugcuguuugccuuauggugugggg

SEQ ID NO: 248809 - RNA, 32 nt, Human
ugaugacauguuugcaaccuuugcccaaaucc

SEQ ID NO: 248810 - RNA, 32 nt, Human
ugaugaccagugccagccuuggaguugccagu

SEQ ID NO: 248811 - RNA, 32 nt, Human
ugaugaccauccucauagcucagaucuccuuu

SEQ ID NO: 248812 - RNA, 32 nt, Human
ugaugacccacuggggaacaccaguguuccag

SEQ ID NO: 248813 - RNA, 21 nt, Human
ugaugaccccaggacccagga

SEQ ID NO: 248814 - RNA, 32 nt, Human
ugaugacgccugucugugugcaucauguuucu

SEQ ID NO: 248815 - RNA, 32 nt, Human
ugaugacugacgcggguuugggugauaccccu

SEQ ID NO: 248816 - RNA, 32 nt, Human
ugaugacugcacugccaucgugggcagaugca

SEQ ID NO: 248817 - RNA, 32 nt, Human
ugaugacuggccuggguauucauaugugcacu

SEQ ID NO: 248818 - RNA, 32 nt, Human
ugaugacuuccucuucccagugcaauuuuucc

SEQ ID NO: 248819 - RNA, 32 nt, Human
ugaugacuuugauguaaccucauucucauuaa

SEQ ID NO: 248820 - RNA, 32 nt, Human
ugaugagaaaccuuucuauguaaagaaugugg

SEQ ID NO: 248821 - RNA, 23 nt, Human
ugaugagaaaucuacuuuuucca

SEQ ID NO: 248822 - RNA, 32 nt, Human
ugaugagaaaugaacugagagcauuaagcaga

SEQ ID NO: 248823 - RNA, 32 nt, Human
ugaugagaaauggauguguuauucuugcccuc

SEQ ID NO: 248824 - RNA, 32 nt, Human
ugaugagaagaaaaggcucaggggugaggugg

SEQ ID NO: 248825 - RNA, 32 nt, Human
ugaugagaagcagaacauggugaccuuucacg

SEQ ID NO: 248826 - RNA, 32 nt, Human
ugaugagaagcagaacguggugaccuuucacg

SEQ ID NO: 248827 - RNA, 32 nt, Human
ugaugagaagcagaauguggugaccuuucacg

SEQ ID NO: 248828 - RNA, 23 nt, Human
ugaugagaccuuaguguucucca

SEQ ID NO: 248829 - RNA, 32 nt, Human
ugaugagacgcugggcaucucuccucuguggc

SEQ ID NO: 248830 - RNA, 32 nt, Human
ugaugagagcaaugaacaggagaaggagggag

SEQ ID NO: 248831 - RNA, 32 nt, Human
ugaugagagccaggugcugcagccugaggggc

SEQ ID NO: 248832 - RNA, 32 nt, Human
ugaugagaggaagggaaaccuuacaguaugcu

SEQ ID NO: 248833 - RNA, 32 nt, Human
ugaugagaggaucuugagguucuuggaauugg

SEQ ID NO: 248834 - RNA, 32 nt, Human
ugaugagagggaaaagauugacuggggagggc

SEQ ID NO: 248835 - RNA, 32 nt, Human
ugaugagagucaaacacccugccuacaaggag

SEQ ID NO: 248836 - RNA, 32 nt, Human
ugaugagauauacaucuucuuccuuuugguuu

SEQ ID NO: 248837 - RNA, 32 nt, Human
ugaugagauggaaaaucaacccuuacaggaag

SEQ ID NO: 248838 - RNA, 32 nt, Human
ugaugagauuuuagccuuucuccagaacuaag

SEQ ID NO: 248839 - RNA, 32 nt, Human
ugaugagcauugaggcaccugggaaaugaggc

SEQ ID NO: 248840 - RNA, 32 nt, Human
ugaugagccagccugaugccgacaggucuugu

SEQ ID NO: 248841 - RNA, 32 nt, Human
ugaugagccgaugggcccuggaggcagcccau

SEQ ID NO: 248842 - RNA, 32 nt, Human
ugaugagcgagcucuguaccagcccuugucau

SEQ ID NO: 248843 - RNA, 23 nt, Human
ugaugagcucauggaacuugaga

SEQ ID NO: 248844 - RNA, 32 nt, Human
ugaugagcucugacaaagcuauucccuggugu

SEQ ID NO: 248845 - RNA, 24 nt, Human
ugaugagcugguggcaugcauuga

SEQ ID NO: 248846 - RNA, 32 nt, Human
ugaugaggaaacugaggcuacacagaguuaag

SEQ ID NO: 248847 - RNA, 32 nt, Human
ugaugaggaagaggauaaaauggaagaucaaa

SEQ ID NO: 248848 - RNA, 32 nt, Human
ugaugaggaagugggagcucagggaggacccc

SEQ ID NO: 248849 - RNA, 25 nt, Human
ugaugaggaaucugagaacuggaga

SEQ ID NO: 248850 - RNA, 32 nt, Human
ugaugaggacaugggaaacccacgcucuggca

SEQ ID NO: 248851 - RNA, 32 nt, Human
ugaugaggacuuaagguugcaagaaugaagau

SEQ ID NO: 248852 - RNA, 32 nt, Human
ugaugaggacuuguggaauucagucuacugga

SEQ ID NO: 248853 - RNA, 32 nt, Human
ugaugaggaggaagaagagggcuguggucaua

SEQ ID NO: 248854 - RNA, 32 nt, Human
ugaugaggagguggacagcgagcugggcaccu

SEQ ID NO: 248855 - RNA, 32 nt, Human
ugaugaggcugcacccuugguggagggaacag

SEQ ID NO: 248856 - RNA, 32 nt, Human
ugaugagggaacauuugaaagaacugcaaauu

SEQ ID NO: 248857 - RNA, 22 nt, Human
ugaugagggccauguaguucuu

SEQ ID NO: 248858 - RNA, 32 nt, Human
ugaugagggcugcucccacuucauccgcagga

SEQ ID NO: 248859 - RNA, 32 nt, Human
ugaugaggucaugguaucauauaugggauuuu

SEQ ID NO: 248860 - RNA, 32 nt, Human
ugaugaguagcacugcacugucaccugaugau

SEQ ID NO: 248861 - RNA, 22 nt, Human
ugaugaguaugccuuaaacaaa

SEQ ID NO: 248862 - RNA, 32 nt, Human
ugaugagucuguggcuggagacaguggggucu

SEQ ID NO: 248863 - RNA, 28 nt, Human
ugaugagugacuccugccucauccauug

SEQ ID NO: 248864 - RNA, 32 nt, Human
ugaugagugagacucaggaggcacgacaugag

SEQ ID NO: 248865 - RNA, 32 nt, Human
ugaugagugccuguaguccaagcuacucaaga

SEQ ID NO: 248866 - RNA, 32 nt, Human
ugaugaguucugcggcccagcauauagaaaug

SEQ ID NO: 248867 - RNA, 32 nt, Human
ugaugaguuuccagcagcagagcuuuagguau

SEQ ID NO: 248868 - RNA, 22 nt, Human
ugaugaguuucugaaacuggag

SEQ ID NO: 248869 - RNA, 32 nt, Human
ugaugauaaaaaccacgacccaaccaggcaca

SEQ ID NO: 248870 - RNA, 32 nt, Human
ugaugauaccaccaccaccugccuacccaugg

SEQ ID NO: 248871 - RNA, 32 nt, Human
ugaugauauugaauuuaaaaacugcacaacug

SEQ ID NO: 248872 - RNA, 32 nt, Human
ugaugaucccugguggguaaauugcagacauc

SEQ ID NO: 248873 - RNA, 32 nt, Human
ugaugauccucaaggaaauacaaccuagggug

SEQ ID NO: 248874 - RNA, 32 nt, Human
ugaugauccuggggcucuuggcuuccauacgu

SEQ ID NO: 248875 - RNA, 32 nt, Human
ugaugaugaagaggaggaaggauuagaagaua

SEQ ID NO: 248876 - RNA, 32 nt, Human
ugaugaugacaaccuccagagagaugccauca

SEQ ID NO: 248877 - RNA, 32 nt, Human
ugaugaugauaccucuuucuucccugagugua

SEQ ID NO: 248878 - RNA, 32 nt, Human
ugaugaugaugauaacuagaacuccagguuuu

SEQ ID NO: 248879 - RNA, 32 nt, Human
ugaugaugaugauaucuagaacuccagguuuu

SEQ ID NO: 248880 - RNA, 32 nt, Human
ugaugaugccucagugggaaaaggauuuagca

SEQ ID NO: 248881 - RNA, 32 nt, Human
ugaugauggcgguggagguggugguuguagug

SEQ ID NO: 248882 - RNA, 32 nt, Human
ugaugaugggaaggaaggaaugaagagaaucu

SEQ ID NO: 248883 - RNA, 32 nt, Human
ugaugauggucauuggggugguugucauguga

SEQ ID NO: 248884 - RNA, 32 nt, Human
ugaugaugucacuucucucaagccugaugugu

SEQ ID NO: 248885 - RNA, 32 nt, Human
ugaugaugugccuggguggacauggccccugu

SEQ ID NO: 248886 - RNA, 32 nt, Human
ugaugaugugguugcuauggaaacagaaaagg

SEQ ID NO: 248887 - RNA, 32 nt, Human
ugaugauuacagucuagaguuacuugaaaugg

SEQ ID NO: 248888 - RNA, 32 nt, Human
ugaugauugugaggccucugcagccacgugga

SEQ ID NO: 248889 - RNA, 32 nt, Human
ugaugcaaaacaauuccugccuccuguucccu

SEQ ID NO: 248890 - RNA, 32 nt, Human
ugaugcaaucacggcucacugcagccucgacc

SEQ ID NO: 248891 - RNA, 32 nt, Human
ugaugcaaucauggcucacugcagccuccacc

SEQ ID NO: 248892 - RNA, 23 nt, Human
ugaugcaaucucggcucacugca

SEQ ID NO: 248893 - RNA, 24 nt, Human
ugaugcaaucuuggcucaccgcag

SEQ ID NO: 248894 - RNA, 23 nt, Human
ugaugcaaucuuggcucacugca

SEQ ID NO: 248895 - RNA, 21 nt, Human
ugaugcacaccuguaauccca

SEQ ID NO: 248896 - RNA, 32 nt, Human
ugaugcacagucucccugcucaugcccuucag

SEQ ID NO: 248897 - RNA, 18 nt, Human
ugaugcacaucgcucugu

SEQ ID NO: 248898 - RNA, 32 nt, Human
ugaugcaccacguguuuagacacagcacaguc

SEQ ID NO: 248899 - RNA, 32 nt, Human
ugaugcacgccgucaaggagguguucaaggcu

SEQ ID NO: 248900 - RNA, 32 nt, Human
ugaugcacuggguguggagcugagcagagagg

SEQ ID NO: 248901 - RNA, 32 nt, Human
ugaugcacugugcccagccauuccaggauuuu

SEQ ID NO: 248902 - RNA, 32 nt, Human
ugaugcagacaaaaucucaccuggcaggccca

SEQ ID NO: 248903 - RNA, 32 nt, Human
ugaugcagacccugccuuuuagauccacgguc

SEQ ID NO: 248904 - RNA, 32 nt, Human
ugaugcagauauuugcacaaugguuuggcaaa

SEQ ID NO: 248905 - RNA, 32 nt, Human
ugaugcagaucuuauaaauuugggaauuauaa

SEQ ID NO: 248906 - RNA, 32 nt, Human
ugaugcaggaaaccuucaggaaccuggcuucu

SEQ ID NO: 248907 - RNA, 32 nt, Human
ugaugcaggauggacucagcaccccgccgaag

SEQ ID NO: 248908 - RNA, 23 nt, Human
ugaugcaggcugcagacccaaga

SEQ ID NO: 248909 - RNA, 32 nt, Human
ugaugcaggggagcaggaaagccauccuaaac

SEQ ID NO: 248910 - RNA, 32 nt, Human
ugaugcagguacagugcgcccauuccaacugg

SEQ ID NO: 248911 - RNA, 32 nt, Human
ugaugcaggugccaccuccacccugcacuugc

SEQ ID NO: 248912 - RNA, 32 nt, Human
ugaugcagugccuaggcucacucugggaccag

SEQ ID NO: 248913 - RNA, 32 nt, Human
ugaugcaguguggaugugaagauaugguaccu

SEQ ID NO: 248914 - RNA, 21 nt, Human
ugaugcauaccuauaauccca

SEQ ID NO: 248915 - RNA, 32 nt, Human
ugaugcauaccuauaaucccagcacuugggga

SEQ ID NO: 248916 - RNA, 32 nt, Human
ugaugcauagcaccucuuuucauggaguagag

SEQ ID NO: 248917 - RNA, 21 nt, Human
ugaugcaugccuguaauccca

SEQ ID NO: 248918 - RNA, 32 nt, Human
ugaugcaugccuguaaucccagcuacucggga

SEQ ID NO: 248919 - RNA, 32 nt, Human
ugaugcaugccuguggucccaguuacuuggga

SEQ ID NO: 248920 - RNA, 32 nt, Human
ugaugcauggccaaguucaguguuuacagaua

SEQ ID NO: 248921 - RNA, 32 nt, Human
ugaugcaugggaccccaaauucucccuagacc

SEQ ID NO: 248922 - RNA, 32 nt, Human
ugaugcauguacaguggacuuuguuauuucaa

SEQ ID NO: 248923 - RNA, 32 nt, Human
ugaugcaugugagcccugcccuugggaagcuu

SEQ ID NO: 248924 - RNA, 23 nt, Human
ugaugcauuuaauuucuaaagua

SEQ ID NO: 248925 - RNA, 32 nt, Human
ugaugccaaaagcugccacugugugguauucg

SEQ ID NO: 248926 - RNA, 32 nt, Human
ugaugccaaggggcagagguuagaagugcuaa

SEQ ID NO: 248927 - RNA, 32 nt, Human
ugaugccacugcacuccagccugggcuacaga

SEQ ID NO: 248928 - RNA, 32 nt, Human
ugaugccacuggagcuggaguggcuggaugug

SEQ ID NO: 248929 - RNA, 32 nt, Human
ugaugccacuggccacuguaucugcuuuugua

SEQ ID NO: 248930 - RNA, 32 nt, Human
ugaugccacuguacugcaaccugggacagagu

SEQ ID NO: 248931 - RNA, 32 nt, Human
ugaugccagcagaaagcuauuuugauuuguga

SEQ ID NO: 248932 - RNA, 32 nt, Human
ugaugccagcugcuugggaggcugagguggga

SEQ ID NO: 248933 - RNA, 32 nt, Human
ugaugccaggaccagucccagagcaggaaugg

SEQ ID NO: 248934 - RNA, 32 nt, Human
ugaugccaggaguggagccagggugugcagga

SEQ ID NO: 248935 - RNA, 32 nt, Human
ugaugccaggaguucaagaccagccugggcaa

SEQ ID NO: 248936 - RNA, 32 nt, Human
ugaugccaucuucucccccauccccuucucug

SEQ ID NO: 248937 - RNA, 32 nt, Human
ugaugccaugaagacaguccaguagacuuggu

SEQ ID NO: 248938 - RNA, 32 nt, Human
ugaugccauugcacuccagccugggcaacaag

SEQ ID NO: 248939 - RNA, 32 nt, Human
ugaugcccacaggggagccaggcuggcugccg

SEQ ID NO: 248940 - RNA, 32 nt, Human
ugaugcccagcaggcuagagugcgauggcgcg

SEQ ID NO: 248941 - RNA, 32 nt, Human
ugaugcccaggcugaagagcccucagcauucc

SEQ ID NO: 248942 - RNA, 32 nt, Human
ugaugcccaugcuaaugguagccacccugguu

SEQ ID NO: 248943 - RNA, 32 nt, Human
ugaugccccacucaccuccugacugucccagu

SEQ ID NO: 248944 - RNA, 32 nt, Human
ugaugccccaggagaguccuaaucuagggaau

SEQ ID NO: 248945 - RNA, 32 nt, Human
ugaugccccugccucagccucccgaguagcug

SEQ ID NO: 248946 - RNA, 27 nt, Human
ugaugccccuucugccuuucucucacu

SEQ ID NO: 248947 - RNA, 32 nt, Human
ugaugcccgugccugugaagcuggcaucagcg

SEQ ID NO: 248948 - RNA, 27 nt, Human
ugaugcccuauguauucuccuucaaaa

SEQ ID NO: 248949 - RNA, 32 nt, Human
ugaugcccucggauuaucagcacuccaguucu

SEQ ID NO: 248950 - RNA, 32 nt, Human
ugaugcccugcuccacucucuggucugcccgu

SEQ ID NO: 248951 - RNA, 32 nt, Human
ugaugcccugguuucccuaucuguaaaauggg

SEQ ID NO: 248952 - RNA, 32 nt, Human
ugaugcccuuugucccauuauuuggagcagaa

SEQ ID NO: 248953 - RNA, 32 nt, Human
ugaugccguaucuuuccccugcccucagggca

SEQ ID NO: 248954 - RNA, 32 nt, Human
ugaugccuccacugcugugugccccauguugu

SEQ ID NO: 248955 - RNA, 25 nt, Human
ugaugccucuaugaaagagaggcau

SEQ ID NO: 248956 - RNA, 32 nt, Human
ugaugccuguaaucccaacacuuuguugggag

SEQ ID NO: 248957 - RNA, 32 nt, Human
ugaugccuguaaucccagcacuuugggaggcc

SEQ ID NO: 248958 - RNA, 32 nt, Human
ugaugccuucuuuggggcucugcaguuccugc

SEQ ID NO: 248959 - RNA, 32 nt, Human
ugaugccuuuaaaucauaaggcuggcuuccau

SEQ ID NO: 248960 - RNA, 32 nt, Human
ugaugccuuugacuccaggcugggcgauuccg

SEQ ID NO: 248961 - RNA, 32 nt, Human
ugaugccuuuuugugcccagacuguuuuccuc

SEQ ID NO: 248962 - RNA, 32 nt, Human
ugaugcgaaugaacuucacguucuccaaagca

SEQ ID NO: 248963 - RNA, 23 nt, Human
ugaugcgaucucagcucacugca

SEQ ID NO: 248964 - RNA, 23 nt, Human
ugaugcgaucucggcucucugca

SEQ ID NO: 248965 - RNA, 32 nt, Human
ugaugcgcacaaaugucuucugccucucucuc

SEQ ID NO: 248966 - RNA, 32 nt, Human
ugaugcgcugggaucugauugaggauaaaaag

SEQ ID NO: 248967 - RNA, 32 nt, Human
ugaugcgugccuguaaucccagcuacccagga

SEQ ID NO: 248968 - RNA, 21 nt, Human
ugaugcuaaaagaagaggcau

SEQ ID NO: 248969 - RNA, 32 nt, Human
ugaugcuccuugggugcugcugcuacucagac

SEQ ID NO: 248970 - RNA, 32 nt, Human
ugaugcucgggcagggaggagcuguacaccgu

SEQ ID NO: 248971 - RNA, 32 nt, Human
ugaugcucugggggcagcaucuccccaccgag

SEQ ID NO: 248972 - RNA, 32 nt, Human
ugaugcucuugccuugucaucaugccugaaac

SEQ ID NO: 248973 - RNA, 32 nt, Human
ugaugcucuuggagggaugaaaggaggcaacg

SEQ ID NO: 248974 - RNA, 20 nt, Human
ugaugcugaaaacagcacag

SEQ ID NO: 248975 - RNA, 32 nt, Human
ugaugcugacaucaguaagugaucucucaaca

SEQ ID NO: 248976 - RNA, 32 nt, Human
ugaugcugagucuguggaaugauacuucugaa

SEQ ID NO: 248977 - RNA, 32 nt, Human
ugaugcugcagaacugccaccuccuggucaag

SEQ ID NO: 248978 - RNA, 32 nt, Human
ugaugcugccacaggacacagagcagcaggcc

SEQ ID NO: 248979 - RNA, 31 nt, Human
ugaugcugccucuccucucuguguugucugg

SEQ ID NO: 248980 - RNA, 32 nt, Human
ugaugcugcuaugauaccacgccuuaaaaauu

SEQ ID NO: 248981 - RNA, 32 nt, Human
ugaugcugcucauuuagaaauaaaucaucugg

SEQ ID NO: 248982 - RNA, 32 nt, Human
ugaugcuggaagcaagaagaagccagggagca

SEQ ID NO: 248983 - RNA, 32 nt, Human
ugaugcuggagagguuaaggugcaauaagaau

SEQ ID NO: 248984 - RNA, 32 nt, Human
ugaugcuggaugaccuuggccugacccugguc

SEQ ID NO: 248985 - RNA, 32 nt, Human
ugaugcuggcccggaaggcagaaagaggcagc

SEQ ID NO: 248986 - RNA, 32 nt, Human
ugaugcugggggcagagacagaggagaagcug

SEQ ID NO: 248987 - RNA, 22 nt, Human
ugaugcuguauaaauuggauua

SEQ ID NO: 248988 - RNA, 32 nt, Human
ugaugcugucagccacagcuuccugccguaga

SEQ ID NO: 248989 - RNA, 32 nt, Human
ugaugcugucugcagugaaggcucgucuagaa

SEQ ID NO: 248990 - RNA, 32 nt, Human
ugaugcugugaccucaccucucuggcuuuggg

SEQ ID NO: 248991 - RNA, 32 nt, Human
ugaugcugugugacccacugggcacucuggug

SEQ ID NO: 248992 - RNA, 32 nt, Human
ugaugcuuaagccuggugagguuuguacucua

SEQ ID NO: 248993 - RNA, 32 nt, Human
ugaugcuuaauggagaacagagaagaucuugu

SEQ ID NO: 248994 - RNA, 32 nt, Human
ugaugcuuauccuuucaucugugugauuguuu

SEQ ID NO: 248995 - RNA, 20 nt, Human
ugaugcuuauucaaaaggca

SEQ ID NO: 248996 - RNA, 32 nt, Human
ugaugcuucaacaacauggauucuacaaagug

SEQ ID NO: 248997 - RNA, 22 nt, Human
ugaugcuucuaaagaaagccau

SEQ ID NO: 248998 - RNA, 32 nt, Human
ugaugcuucugcccuggccugcucuggguggu

SEQ ID NO: 248999 - RNA, 32 nt, Human
ugaugcuugggguguuccguguugacucccag

SEQ ID NO: 249000 - RNA, 32 nt, Human
ugauggaaaagauauaugacugcuucaugaca

SEQ ID NO: 249001 - RNA, 32 nt, Human
ugauggaaacacacaaacaccaagcuaauaau

SEQ ID NO: 249002 - RNA, 32 nt, Human
ugauggaacagcuugcaaggcuugugagcagu

SEQ ID NO: 249003 - RNA, 32 nt, Human
ugauggaacuuaacagcaaggccagaugcaca

SEQ ID NO: 249004 - RNA, 32 nt, Human
ugauggaacuuccauucuguggggaagagacu

SEQ ID NO: 249005 - RNA, 32 nt, Human
ugauggaagaggcggagguggaggcgaccgag

SEQ ID NO: 249006 - RNA, 19 nt, Human
ugauggaagaugagcccca

SEQ ID NO: 249007 - RNA, 32 nt, Human
ugauggaagccuugcuuucacaucagcagggg

SEQ ID NO: 249008 - RNA, 32 nt, Human
ugauggaaggaagagaguagggccagugaagg

SEQ ID NO: 249009 - RNA, 32 nt, Human
ugauggaaggaggaaguagaaagugguaaaga

SEQ ID NO: 249010 - RNA, 32 nt, Human
ugauggaaucagauuuuaacagcucucuucaa

SEQ ID NO: 249011 - RNA, 32 nt, Human
ugauggacaaaguggcacauccaguggagcgg

SEQ ID NO: 249012 - RNA, 32 nt, Human
ugauggacacccuugggucugcaaggagccag

SEQ ID NO: 249013 - RNA, 32 nt, Human
ugauggacacugcaccagcuuccuucagguuc

SEQ ID NO: 249014 - RNA, 32 nt, Human
ugauggacggauggcuacauggaugugaugga

SEQ ID NO: 249015 - RNA, 32 nt, Human
ugauggacgucccaccgggcaggaugaaggca

SEQ ID NO: 249016 - RNA, 32 nt, Human
ugauggacuccacccuuuacuaccuugaacuu

SEQ ID NO: 249017 - RNA, 32 nt, Human
ugauggagaagguguuaauaaugcagauuaga

SEQ ID NO: 249018 - RNA, 32 nt, Human
ugauggagacccagcagagggaggcagaaggg

SEQ ID NO: 249019 - RNA, 32 nt, Human
ugauggagaggacagagcaggggcuccagcac

SEQ ID NO: 249020 - RNA, 32 nt, Human
ugauggagcagucuguaagcacgaucaaauaa

SEQ ID NO: 249021 - RNA, 32 nt, Human
ugauggagcucagcccuccaccuccacagcuc

SEQ ID NO: 249022 - RNA, 32 nt, Human
ugauggaggaaggauggauuugguuaccagau

SEQ ID NO: 249023 - RNA, 32 nt, Human
ugauggaggaauuacguuauacauucauauuu

SEQ ID NO: 249024 - RNA, 32 nt, Human
ugauggaggagggagaugccuggggaggggcu

SEQ ID NO: 249025 - RNA, 32 nt, Human
ugauggagggagacaccucuucauagacggca

SEQ ID NO: 249026 - RNA, 32 nt, Human
ugauggagggcggccgccagcccagggccugc

SEQ ID NO: 249027 - RNA, 32 nt, Human
ugauggaggggagaagggagggcaaagaaguu

SEQ ID NO: 249028 - RNA, 32 nt, Human
ugauggagucuggccaaggcccuccugagccu

SEQ ID NO: 249029 - RNA, 32 nt, Human
ugauggaucaaaucacuuuccucagaacaaaa

SEQ ID NO: 249030 - RNA, 32 nt, Human
ugauggaucucaguacugagcugggcauuucu

SEQ ID NO: 249031 - RNA, 19 nt, Human
ugauggaugagcugguaga

SEQ ID NO: 249032 - RNA, 32 nt, Human
ugauggaugcagaggagcgccugacauggaug

SEQ ID NO: 249033 - RNA, 32 nt, Human
ugauggaugcauggggcucugggggaaugcug

SEQ ID NO: 249034 - RNA, 32 nt, Human
ugauggaugggucucaucucaauuauagaagg

SEQ ID NO: 249035 - RNA, 32 nt, Human
ugauggauuaacauauagccuuuguuuucuaa

SEQ ID NO: 249036 - RNA, 32 nt, Human
ugauggcaaaccugccgcagguggccaccccg

SEQ ID NO: 249037 - RNA, 32 nt, Human
ugauggcaacacugaaggaacaguuacccugc

SEQ ID NO: 249038 - RNA, 22 nt, Human
ugauggcaagaucaccaaucca

SEQ ID NO: 249039 - RNA, 32 nt, Human
ugauggcaccacugcacuccagccugggagac

SEQ ID NO: 249040 - RNA, 32 nt, Human
ugauggcaccacugcacuccagccugggcaac

SEQ ID NO: 249041 - RNA, 32 nt, Human
ugauggcaccacugcacuucagccugggugac

SEQ ID NO: 249042 - RNA, 32 nt, Human
ugauggcaccacuguacuccagccugggugac

SEQ ID NO: 249043 - RNA, 32 nt, Human
ugauggcaccgcugcacuccaaccugggcaac

SEQ ID NO: 249044 - RNA, 32 nt, Human
ugauggcaccugcuggaggaaaggggcacggc

SEQ ID NO: 249045 - RNA, 32 nt, Human
ugauggcacugcugcacuccagccugcgggac

SEQ ID NO: 249046 - RNA, 32 nt, Human
ugauggcaggagacuguuucacacacaggaga

SEQ ID NO: 249047 - RNA, 32 nt, Human
ugauggcagugcuugacggggugcagggaaca

SEQ ID NO: 249048 - RNA, 25 nt, Human
ugauggcaucacaugaaagcauuga

SEQ ID NO: 249049 - RNA, 32 nt, Human
ugauggcaucugcagacucuguuuccaaauaa

SEQ ID NO: 249050 - RNA, 32 nt, Human
ugauggccagcagugaggaaucuguguguucu

SEQ ID NO: 249051 - RNA, 32 nt, Human
ugauggccaggggaaagagcaucguauaggcu

SEQ ID NO: 249052 - RNA, 27 nt, Human
ugauggccaggugcuucagccuggugu

SEQ ID NO: 249053 - RNA, 32 nt, Human
ugauggcccugagcacuggccucuuccauggg

SEQ ID NO: 249054 - RNA, 32 nt, Human
ugauggccugugagccacaggccacaucagga

SEQ ID NO: 249055 - RNA, 32 nt, Human
ugauggcgccacugcacuccagucugggcaac

SEQ ID NO: 249056 - RNA, 32 nt, Human
ugauggcgccacugcacuucagccuuggagac

SEQ ID NO: 249057 - RNA, 32 nt, Human
ugauggcgccacuucacugcagccuggguggc

SEQ ID NO: 249058 - RNA, 32 nt, Human
ugauggcgguggagguggugguuguaguguga

SEQ ID NO: 249059 - RNA, 32 nt, Human
ugauggcgucaguguucuccagccugggcaac

SEQ ID NO: 249060 - RNA, 32 nt, Human
ugauggcuacagccauaccuugagucaaggca

SEQ ID NO: 249061 - RNA, 23 nt, Human
ugauggcucaggguggucaucca

SEQ ID NO: 249062 - RNA, 32 nt, Human
ugauggcucaugggagugcaggggacauugau

SEQ ID NO: 249063 - RNA, 32 nt, Human
ugauggcucauuuacacucagcugcucugcaa

SEQ ID NO: 249064 - RNA, 32 nt, Human
ugauggcucauuuccacccaaccccaggauuu

SEQ ID NO: 249065 - RNA, 32 nt, Human
ugauggcucauuuccacccagccccaggauuu

SEQ ID NO: 249066 - RNA, 22 nt, Human
ugauggcucccagcuucaucca

SEQ ID NO: 249067 - RNA, 32 nt, Human
ugauggcucugggaucugaaaucuuuccuucc

SEQ ID NO: 249068 - RNA, 32 nt, Human
ugauggcugggcugagcagccugagcagcggc

SEQ ID NO: 249069 - RNA, 32 nt, Human
ugauggcugugagggaggaaugaggauagaca

SEQ ID NO: 249070 - RNA, 32 nt, Human
ugauggcuguguuuagagaaguuuagaccuaa

SEQ ID NO: 249071 - RNA, 32 nt, Human
ugauggcuuauggaaggcuguuaaauuaauau

SEQ ID NO: 249072 - RNA, 32 nt, Human
ugauggcuuuacucacaugccuggcaucuuga

SEQ ID NO: 249073 - RNA, 23 nt, Human
ugaugggaacaagggcccgccca

SEQ ID NO: 249074 - RNA, 32 nt, Human
ugaugggaacggcagaggcuggcaggugacug

SEQ ID NO: 249075 - RNA, 32 nt, Human
ugaugggaagauuacagucugagggccaaacg

SEQ ID NO: 249076 - RNA, 32 nt, Human
ugaugggaagccggggaaggccaggguggaag

SEQ ID NO: 249077 - RNA, 21 nt, Human
ugaugggaagggcccagcgaa

SEQ ID NO: 249078 - RNA, 32 nt, Human
ugaugggacagaauuggauacauacaccagca

SEQ ID NO: 249079 - RNA, 21 nt, Human
ugaugggacgguacugagaua

SEQ ID NO: 249080 - RNA, 32 nt, Human
ugaugggacucuccucuuucuccuggaaccug

SEQ ID NO: 249081 - RNA, 32 nt, Human
ugaugggacugaggacauggaugagaaggagg

SEQ ID NO: 249082 - RNA, 32 nt, Human
ugaugggagagggugaggaaaucagcugaaug

SEQ ID NO: 249083 - RNA, 32 nt, Human
ugaugggaggagagacgaggcauucgggccgg

SEQ ID NO: 249084 - RNA, 32 nt, Human
ugaugggagugggacugccaggaggaggagag

SEQ ID NO: 249085 - RNA, 32 nt, Human
ugaugggauccagcaauguacaagaaagaggc

SEQ ID NO: 249086 - RNA, 32 nt, Human
ugaugggaucuauccucuuccucucuccaugc

SEQ ID NO: 249087 - RNA, 32 nt, Human
ugaugggauuacaggcaugagccaccgugccc

SEQ ID NO: 249088 - RNA, 32 nt, Human
ugaugggcaaaccaaacuccuacugagguguc

SEQ ID NO: 249089 - RNA, 32 nt, Human
ugaugggccccuguaaucccagcuacuuggga

SEQ ID NO: 249090 - RNA, 32 nt, Human
ugaugggcccucacgccugaagcgggcaggaa

SEQ ID NO: 249091 - RNA, 32 nt, Human
ugaugggcuucugggcccagccccagacaaac

SEQ ID NO: 249092 - RNA, 32 nt, Human
ugaugggcuuucucccacccuggagucuuccg

SEQ ID NO: 249093 - RNA, 32 nt, Human
ugauggggaagaaaggaagucggagggcucag

SEQ ID NO: 249094 - RNA, 32 nt, Human
ugauggggagaaggugaggaagggucacccuc

SEQ ID NO: 249095 - RNA, 32 nt, Human
ugauggggagagaaguguugcaucgcggauag

SEQ ID NO: 249096 - RNA, 32 nt, Human
ugauggggaggagggauuaaaagagucaggaa

SEQ ID NO: 249097 - RNA, 32 nt, Human
ugauggggccuggagugcaggaggggcagcuc

SEQ ID NO: 249098 - RNA, 19 nt, Human
ugauggggccuuugaggca

SEQ ID NO: 249099 - RNA, 32 nt, Human
ugauggggcugaacuggaaggagccagaaaag

SEQ ID NO: 249100 - RNA, 32 nt, Human
ugauggggcuugaugcaguagggaagagacga

SEQ ID NO: 249101 - RNA, 32 nt, Human
ugaugggggaggaggagggaaauuuuagcggg

SEQ ID NO: 249102 - RNA, 32 nt, Human
ugaugggggaggcaagagagggcaaagaguaa

SEQ ID NO: 249103 - RNA, 32 nt, Human
ugaugggggagguuuggggugcggugaggggg

SEQ ID NO: 249104 - RNA, 32 nt, Human
ugaugggggauucaguucuggaaaagaauuug

SEQ ID NO: 249105 - RNA, 32 nt, Human
ugaugggggugaggagacuguugggcccuuau

SEQ ID NO: 249106 - RNA, 32 nt, Human
ugaugggguaugaaccugugucuccuuuguau

SEQ ID NO: 249107 - RNA, 32 nt, Human
ugaugggugacaaagugucacaggugugaugc

SEQ ID NO: 249108 - RNA, 32 nt, Human
ugaugggugccuguaaucccagcuacguggga

SEQ ID NO: 249109 - RNA, 32 nt, Human
ugauggguucccaggggccauuggagucccug

SEQ ID NO: 249110 - RNA, 32 nt, Human
ugauggguugacaggugcagcaaaccaccaug

SEQ ID NO: 249111 - RNA, 32 nt, Human
ugauggguugccccacccucuggcaggcguaa

SEQ ID NO: 249112 - RNA, 32 nt, Human
ugauggguuuaugauucaguuuauacugacuu

SEQ ID NO: 249113 - RNA, 27 nt, Human
ugaugguacaaggacgaguucagcagc

SEQ ID NO: 249114 - RNA, 32 nt, Human
ugaugguaccacugcacuccagccugggugac

SEQ ID NO: 249115 - RNA, 32 nt, Human
ugaugguaccccugcacuccagcccagguuac

SEQ ID NO: 249116 - RNA, 32 nt, Human
ugaugguaggggacaggaccaugaugggggug

SEQ ID NO: 249117 - RNA, 32 nt, Human
ugaugguauagaacacuguauuagagacaugg

SEQ ID NO: 249118 - RNA, 32 nt, Human
ugauggucagacacaaacaaacaagcuaggug

SEQ ID NO: 249119 - RNA, 32 nt, Human
ugauggucagccagggccgggauggauacccg

SEQ ID NO: 249120 - RNA, 32 nt, Human
ugauggucauuuuucuaaacagaggcccugcu

SEQ ID NO: 249121 - RNA, 32 nt, Human
ugaugguccagaccaggucucuggaagaauug

SEQ ID NO: 249122 - RNA, 32 nt, Human
ugauggucuuggauugucugaccucaguagcu

SEQ ID NO: 249123 - RNA, 21 nt, Human
ugauggugacagcagcaguga

SEQ ID NO: 249124 - RNA, 32 nt, Human
ugauggugacuuccucgccucucccaccccau

SEQ ID NO: 249125 - RNA, 32 nt, Human
ugauggugccacuacacuccagccuggguaaa

SEQ ID NO: 249126 - RNA, 32 nt, Human
ugauggugccacugcacuccagccugggggac

SEQ ID NO: 249127 - RNA, 32 nt, Human
ugauggugccacugcacuccagccuggguggc

SEQ ID NO: 249128 - RNA, 32 nt, Human
ugauggugccacugcacuccaguauggaugac

SEQ ID NO: 249129 - RNA, 32 nt, Human
ugauggugccacugcauuccagccugggugac

SEQ ID NO: 249130 - RNA, 32 nt, Human
ugauggugccugcugguuugacguggagcuau

SEQ ID NO: 249131 - RNA, 32 nt, Human
ugauggugcucugcaucagugguucagagccu

SEQ ID NO: 249132 - RNA, 32 nt, Human
ugaugguggcccugaaccucauucugguuccc

SEQ ID NO: 249133 - RNA, 32 nt, Human
ugaugguggcugucccgggaacuuggucgucu

SEQ ID NO: 249134 - RNA, 32 nt, Human
ugaugguggggaggggaggauggggaagcuuu

SEQ ID NO: 249135 - RNA, 32 nt, Human
ugaugguguccccagggcugagcaccacccca

SEQ ID NO: 249136 - RNA, 32 nt, Human
ugaugguguugaagcaggucacugcugguuua

SEQ ID NO: 249137 - RNA, 32 nt, Human
ugaugguucagguugucugucuuacuaccuac

SEQ ID NO: 249138 - RNA, 32 nt, Human
ugaugguucagguugucugucuuacuaucuac

SEQ ID NO: 249139 - RNA, 32 nt, Human
ugaugguuccagcaagccugcggugcuggcgg

SEQ ID NO: 249140 - RNA, 32 nt, Human
ugaugguucucucuugauuggcugccagaauu

SEQ ID NO: 249141 - RNA, 31 nt, Human
ugauguaaggacuucuuuuccuuuggguaga

SEQ ID NO: 249142 - RNA, 32 nt, Human
ugauguaauauuccaggaugcugcugcagguc

SEQ ID NO: 249143 - RNA, 32 nt, Human
ugauguacauuugagauuuuuggcaauuauga

SEQ ID NO: 249144 - RNA, 32 nt, Human
ugauguaccagcaagccagaaaagcaagccag

SEQ ID NO: 249145 - RNA, 31 nt, Human
ugauguagaugaaccuguucacuggaaaauu

SEQ ID NO: 249146 - RNA, 21 nt, Human
ugauguaggaggggcacacag

SEQ ID NO: 249147 - RNA, 32 nt, Human
ugauguaucugggucuccucuggagcacucug

SEQ ID NO: 249148 - RNA, 32 nt, Human
ugauguaugucaggaggccacagggagcggag

SEQ ID NO: 249149 - RNA, 31 nt, Human
ugauguauguuuggaaagaugugugaauacu

SEQ ID NO: 249150 - RNA, 32 nt, Human
ugauguauguuuggaaagaugugugaauacuu

SEQ ID NO: 249151 - RNA, 32 nt, Human
ugauguauucaugucagcaccugagucacagc

SEQ ID NO: 249152 - RNA, 32 nt, Human
ugauguauugaauaucaagauaaagaaaaaug

SEQ ID NO: 249153 - RNA, 32 nt, Human
ugauguauugcuagagccaggagugccuuggg

SEQ ID NO: 249154 - RNA, 19 nt, Human
ugaugucaaaaacuucaau

SEQ ID NO: 249155 - RNA, 32 nt, Human
ugaugucaaagcuuccacuggaaaauccagua

SEQ ID NO: 249156 - RNA, 32 nt, Human
ugaugucaagguccccaaagaccagguuaagu

SEQ ID NO: 249157 - RNA, 32 nt, Human
ugaugucaauugguucuugucuugagucgacu

SEQ ID NO: 249158 - RNA, 31 nt, Human
ugaugucacagcugcaggugguacagagcca

SEQ ID NO: 249159 - RNA, 32 nt, Human
ugaugucagaaacuuuaaauuuuuaaaaggcu

SEQ ID NO: 249160 - RNA, 32 nt, Human
ugaugucaggaguucaagaccagccuggccaa

SEQ ID NO: 249161 - RNA, 32 nt, Human
ugaugucaggcuguggccauagguagcaugag

SEQ ID NO: 249162 - RNA, 32 nt, Human
ugaugucaucauuuuuggcaggauuuacauag

SEQ ID NO: 249163 - RNA, 32 nt, Human
ugaugucauuucuuucaaguugcccacaguau

SEQ ID NO: 249164 - RNA, 32 nt, Human
ugauguccauaggcucaaaguaaaagaaugga

SEQ ID NO: 249165 - RNA, 32 nt, Human
ugaugucccauuauuauccacccugagccacc

SEQ ID NO: 249166 - RNA, 29 nt, Human
ugaugucggcugcuagcuuccuucagaug

SEQ ID NO: 249167 - RNA, 32 nt, Human
ugaugucuccccugagccugagguuugguuca

SEQ ID NO: 249168 - RNA, 32 nt, Human
ugaugucugggaaccugaucaccagcuucucu

SEQ ID NO: 249169 - RNA, 32 nt, Human
ugaugucuggguacacggcagucuuagagaag

SEQ ID NO: 249170 - RNA, 32 nt, Human
ugaugucuguaaccacuggggagcacugccaa

SEQ ID NO: 249171 - RNA, 32 nt, Human
ugaugucugucuggcugaggauuucaagccug

SEQ ID NO: 249172 - RNA, 32 nt, Human
ugaugugaccgggaucccacucugauugcauc

SEQ ID NO: 249173 - RNA, 32 nt, Human
ugaugugagaggaucacuugagccagggaggu

SEQ ID NO: 249174 - RNA, 32 nt, Human
ugaugugagagugcacaugacugugugcacau

SEQ ID NO: 249175 - RNA, 32 nt, Human
ugaugugagcaaguuaccuauaccugaauaug

SEQ ID NO: 249176 - RNA, 32 nt, Human
ugaugugagcaucuccuccuuaucccucgaug

SEQ ID NO: 249177 - RNA, 32 nt, Human
ugaugugaggccauggaugcaggcaguaaggu

SEQ ID NO: 249178 - RNA, 32 nt, Human
ugaugugauagagugacagagcugaaaaacuc

SEQ ID NO: 249179 - RNA, 32 nt, Human
ugaugugauugcagcuccugagguggccugcu

SEQ ID NO: 249180 - RNA, 32 nt, Human
ugaugugcaaaguguuuucucacuggauuugc

SEQ ID NO: 249181 - RNA, 32 nt, Human
ugaugugcaggcacagaagaaaggcacagcuc

SEQ ID NO: 249182 - RNA, 24 nt, Human
ugaugugcccacuucggccuucca

SEQ ID NO: 249183 - RNA, 32 nt, Human
ugaugugccucggggcccucuugccuuggagc

SEQ ID NO: 249184 - RNA, 24 nt, Human
ugaugugccugcuucagccuccca

SEQ ID NO: 249185 - RNA, 32 nt, Human
ugaugugccuugguguauuuuuccuugguuuc

SEQ ID NO: 249186 - RNA, 31 nt, Human
ugaugugcgcuucucccgcacuaagggaaac

SEQ ID NO: 249187 - RNA, 32 nt, Human
ugaugugcugagccaccauuucagacugaguc

SEQ ID NO: 249188 - RNA, 32 nt, Human
ugauguggaaagacaggagguguggggaagga

SEQ ID NO: 249189 - RNA, 32 nt, Human
ugauguggaaggaggggaagcacugugaccuc

SEQ ID NO: 249190 - RNA, 32 nt, Human
ugaugugggaaaccuucaggaaccuggccacu

SEQ ID NO: 249191 - RNA, 19 nt, Human
ugaugugggcuggggccag

SEQ ID NO: 249192 - RNA, 32 nt, Human
ugaugugguacgucccuccacccccggaccca

SEQ ID NO: 249193 - RNA, 32 nt, Human
ugaugugguagaguugggagguuucaggguuu

SEQ ID NO: 249194 - RNA, 32 nt, Human
ugaugugguuugcagguugcugugccugauuc

SEQ ID NO: 249195 - RNA, 32 nt, Human
ugaugugguuuucaucuuucauucuguucaag

SEQ ID NO: 249196 - RNA, 32 nt, Human
ugauguguaaacugaggcauguggagauggaa

SEQ ID NO: 249197 - RNA, 32 nt, Human
ugauguguaauacggaauuacuucacaguagc

SEQ ID NO: 249198 - RNA, 32 nt, Human
ugauguguagacugaagagcuagcagccugca

SEQ ID NO: 249199 - RNA, 32 nt, Human
ugauguguagucuugugguagauuugugcaua

SEQ ID NO: 249200 - RNA, 32 nt, Human
ugauguguccccaucucuggcagagccucugc

SEQ ID NO: 249201 - RNA, 32 nt, Human
ugaugugugaauguccucuaggaacaagccuu

SEQ ID NO: 249202 - RNA, 32 nt, Human
ugaugugugccuguaaucccaccuacuuggga

SEQ ID NO: 249203 - RNA, 32 nt, Human
ugauguguguuauaacccaucugagcccccug

SEQ ID NO: 249204 - RNA, 32 nt, Human
ugauguguguuauaacccaucugagccuccug

SEQ ID NO: 249205 - RNA, 32 nt, Human
ugauguguuacccaggaugcagcaggugugug

SEQ ID NO: 249206 - RNA, 32 nt, Human
ugauguguuguucacuuguuaguaacugauuu

SEQ ID NO: 249207 - RNA, 32 nt, Human
ugauguuagcccagaagcuccugcucuggcca

SEQ ID NO: 249208 - RNA, 24 nt, Human
ugauguuaguagcuucaauuuaca

SEQ ID NO: 249209 - RNA, 32 nt, Human
ugauguuauaaauagagaaaaaguguguguga

SEQ ID NO: 249210 - RNA, 32 nt, Human
ugauguuaucuagccuagaaaugacacagaac

SEQ ID NO: 249211 - RNA, 32 nt, Human
ugauguuaucugcaauacccuagaaggauguu

SEQ ID NO: 249212 - RNA, 32 nt, Human
ugauguuauuagccugcaguuggcuagguuuu

SEQ ID NO: 249213 - RNA, 32 nt, Human
ugauguucggcucacauauuguuugcagacac

SEQ ID NO: 249214 - RNA, 32 nt, Human
ugauguucgugccucagagcuaaaacuaugag

SEQ ID NO: 249215 - RNA, 32 nt, Human
ugauguucuaaggcucugagagucuagauucu

SEQ ID NO: 249216 - RNA, 32 nt, Human
ugauguucuugcuuuguguuguguucugguaa

SEQ ID NO: 249217 - RNA, 32 nt, Human
ugauguugagcaccugcugaauacugagcacu

SEQ ID NO: 249218 - RNA, 32 nt, Human
ugauguugcaacuuuuggguucuuuuaaacug

SEQ ID NO: 249219 - RNA, 32 nt, Human
ugauguugcccaggcuagagugcaguggcaca

SEQ ID NO: 249220 - RNA, 32 nt, Human
ugauguuggcuuccuguaggaggcuggcgggc

SEQ ID NO: 249221 - RNA, 32 nt, Human
ugauguuggcuugucuccagaaugacaaaaag

SEQ ID NO: 249222 - RNA, 32 nt, Human
ugauguuggggaagggacauggagggagguga

SEQ ID NO: 249223 - RNA, 31 nt, Human
ugauguuggguggaugaaucugugagugaau

SEQ ID NO: 249224 - RNA, 32 nt, Human
ugauguuguaaucuaaacaagugccuuauguu

SEQ ID NO: 249225 - RNA, 32 nt, Human
ugauguuguccguggccagcucuccccaggga

SEQ ID NO: 249226 - RNA, 32 nt, Human
ugauguuuaauuuugcacacuuauuuguaaug

SEQ ID NO: 249227 - RNA, 31 nt, Human
ugauguuuacucucugggcacuguuguaaga

SEQ ID NO: 249228 - RNA, 32 nt, Human
ugauguuuccaaugcugaaugccuguuagcau

SEQ ID NO: 249229 - RNA, 32 nt, Human
ugauguuuuguauauuuuaauagacugauagg

SEQ ID NO: 249230 - RNA, 32 nt, Human
ugauguuuuuaagaggugauucagaaugauag

SEQ ID NO: 249231 - RNA, 32 nt, Human
ugauuaaaaagaauaaacacaguguuuccuga

SEQ ID NO: 249232 - RNA, 32 nt, Human
ugauuaaaaguaacagugguccguugauguug

SEQ ID NO: 249233 - RNA, 32 nt, Human
ugauuaaacauaaaucacauucuuacauugcu

SEQ ID NO: 249234 - RNA, 32 nt, Human
ugauuaaaccaaggcacuccagccugggugac

SEQ ID NO: 249235 - RNA, 32 nt, Human
ugauuaaaggugccccugucuccaguuuuucu

SEQ ID NO: 249236 - RNA, 32 nt, Human
ugauuaaaguaucuccgcuuucuugggaggga

SEQ ID NO: 249237 - RNA, 32 nt, Human
ugauuaaauacugugccuuaggagacuggaag

SEQ ID NO: 249238 - RNA, 32 nt, Human
ugauuaacauucucuuuggaacuagguaagag

SEQ ID NO: 249239 - RNA, 32 nt, Human
ugauuaaccugccucgacugugcugagggcaa

SEQ ID NO: 249240 - RNA, 32 nt, Human
ugauuaacuuggcaaggcuuccuuccguguuu

SEQ ID NO: 249241 - RNA, 32 nt, Human
ugauuaagucuuauaugcagagaggacagagc

SEQ ID NO: 249242 - RNA, 32 nt, Human
ugauuaagugaaccaaacuaguucucagaauu

SEQ ID NO: 249243 - RNA, 32 nt, Human
ugauuaaucuggggaagaacagagccagggaa

SEQ ID NO: 249244 - RNA, 32 nt, Human
ugauuaauugaacuggcuaguauuccaucuca

SEQ ID NO: 249245 - RNA, 32 nt, Human
ugauuaauugcccggcaucacaguuuacuaga

SEQ ID NO: 249246 - RNA, 32 nt, Human
ugauuacaaacagucuccacauugcaguucca

SEQ ID NO: 249247 - RNA, 32 nt, Human
ugauuacaauugccaguagaguuguuguuugg

SEQ ID NO: 249248 - RNA, 32 nt, Human
ugauuacacaugcacaccaacaugcaugccgc

SEQ ID NO: 249249 - RNA, 32 nt, Human
ugauuacaccacugcacuucagucugugugac

SEQ ID NO: 249250 - RNA, 32 nt, Human
ugauuacaccacugcacuugagccugggcagc

SEQ ID NO: 249251 - RNA, 32 nt, Human
ugauuacaccccugcacuccagccugggcggc

SEQ ID NO: 249252 - RNA, 32 nt, Human
ugauuacacggccuggggucucugccuucucc

SEQ ID NO: 249253 - RNA, 32 nt, Human
ugauuacagaauaacugguacacuucauuugu

SEQ ID NO: 249254 - RNA, 32 nt, Human
ugauuacaggcaaugagagcugugagugggga

SEQ ID NO: 249255 - RNA, 32 nt, Human
ugauuacaggcacgugccaccaugcccacaua

SEQ ID NO: 249256 - RNA, 32 nt, Human
ugauuacaggccucagccaccaugcccagccc

SEQ ID NO: 249257 - RNA, 32 nt, Human
ugauuacaggcgugcaccaccacgcccggcua

SEQ ID NO: 249258 - RNA, 32 nt, Human
ugauuacaggugugaaccaccaugcccagcca

SEQ ID NO: 249259 - RNA, 32 nt, Human
ugauuacaucaucuuucugacaucauuguuaa

SEQ ID NO: 249260 - RNA, 32 nt, Human
ugauuaccucacugcauuccagccugggcaac

SEQ ID NO: 249261 - RNA, 32 nt, Human
ugauuaccucacugcauuccggccugggcaac

SEQ ID NO: 249262 - RNA, 32 nt, Human
ugauuacgccacugcauuguagccugggcaac

SEQ ID NO: 249263 - RNA, 32 nt, Human
ugauuacucacaccuggugauuucugcucaau

SEQ ID NO: 249264 - RNA, 32 nt, Human
ugauuacucacucaccagccucccucuuuugu

SEQ ID NO: 249265 - RNA, 32 nt, Human
ugauuacuccacugcacuccagccugggcaac

SEQ ID NO: 249266 - RNA, 32 nt, Human
ugauuacuguguaucaguucuuuguuaggcau

SEQ ID NO: 249267 - RNA, 32 nt, Human
ugauuagaaugcuguucgaguauaccuacccu

SEQ ID NO: 249268 - RNA, 32 nt, Human
ugauuagcaaagcaggccuuucacauuuacag

SEQ ID NO: 249269 - RNA, 32 nt, Human
ugauuagcagaauauaguuuggaguuuggcuu

SEQ ID NO: 249270 - RNA, 32 nt, Human
ugauuagccugaggaccuuccugaggaggaau

SEQ ID NO: 249271 - RNA, 32 nt, Human
ugauuaggaaaacucauuuucuuuucaagccu

SEQ ID NO: 249272 - RNA, 32 nt, Human
ugauuagugaugucugccacgggcagggaugg

SEQ ID NO: 249273 - RNA, 32 nt, Human
ugauuaguuguuuagagaaugagaaauggaac

SEQ ID NO: 249274 - RNA, 32 nt, Human
ugauuauaccacugcacuccagccugggugac

SEQ ID NO: 249275 - RNA, 32 nt, Human
ugauuauacucacgaggaauggccuuucuaca

SEQ ID NO: 249276 - RNA, 32 nt, Human
ugauuauagcugugaaccaccaugcccggcca

SEQ ID NO: 249277 - RNA, 32 nt, Human
ugauuauauuagccaaauuuaauuaccagguu

SEQ ID NO: 249278 - RNA, 32 nt, Human
ugauuauccaaagaauugaaacuccuagcaca

SEQ ID NO: 249279 - RNA, 32 nt, Human
ugauuaucucaaaucaaaucacuuugauggag

SEQ ID NO: 249280 - RNA, 32 nt, Human
ugauuaucucagaaauaaaaagagaugcagca

SEQ ID NO: 249281 - RNA, 32 nt, Human
ugauuaucuucagcccaggcuuuugcuagaug

SEQ ID NO: 249282 - RNA, 32 nt, Human
ugauuaugaaaggugaaguugagugagaggag

SEQ ID NO: 249283 - RNA, 32 nt, Human
ugauuaugaucucaucaucaucgguggugguu

SEQ ID NO: 249284 - RNA, 32 nt, Human
ugauuaugccacugcuuuccagccugggcaac

SEQ ID NO: 249285 - RNA, 32 nt, Human
ugauuaugccauuacacuccagccugggcaac

SEQ ID NO: 249286 - RNA, 32 nt, Human
ugauuaugccauugcacuccagccugggugac

SEQ ID NO: 249287 - RNA, 32 nt, Human
ugauuaugccccugcacaucagccugggugau

SEQ ID NO: 249288 - RNA, 32 nt, Human
ugauuaugcugcugcacuccagccuggacaac

SEQ ID NO: 249289 - RNA, 32 nt, Human
ugauuauguagcaaaauacaugacauuuauuu

SEQ ID NO: 249290 - RNA, 32 nt, Human
ugauuauguuagaaggaaaacauugcucgugu

SEQ ID NO: 249291 - RNA, 32 nt, Human
ugauuauguucucuguaaaacucuucaagacu

SEQ ID NO: 249292 - RNA, 32 nt, Human
ugauuauucugugccauuuacaguuucuaaua

SEQ ID NO: 249293 - RNA, 32 nt, Human
ugauuauuucagguugaaaaguagaaguucca

SEQ ID NO: 249294 - RNA, 32 nt, Human
ugauuauuugcagcugcgauggauguuuacag

SEQ ID NO: 249295 - RNA, 32 nt, Human
ugauucaaacaacauguagucacucagacaua

SEQ ID NO: 249296 - RNA, 18 nt, Human
ugauucaaacuguucccu

SEQ ID NO: 249297 - RNA, 21 nt, Human
ugauucaagugagccaggaaa

SEQ ID NO: 249298 - RNA, 32 nt, Human
ugauucaaucugcaugccagccuggaggagga

SEQ ID NO: 249299 - RNA, 32 nt, Human
ugauucaauuccaccuagcaagaaggagauuc

SEQ ID NO: 249300 - RNA, 32 nt, Human
ugauucacagcacugcacugcagccuggguga

SEQ ID NO: 249301 - RNA, 32 nt, Human
ugauucacagcccaggcaggacagagcagauc

SEQ ID NO: 249302 - RNA, 32 nt, Human
ugauucacaggcacuuuguaguuugagaagca

SEQ ID NO: 249303 - RNA, 21 nt, Human
ugauucacgccuguaauccca

SEQ ID NO: 249304 - RNA, 32 nt, Human
ugauucacgccuguaaucccagaacucuggga

SEQ ID NO: 249305 - RNA, 32 nt, Human
ugauucacgccuguaaucccagcacuuugaga

SEQ ID NO: 249306 - RNA, 32 nt, Human
ugauucacgccuguaaucccagcacuuuggga

SEQ ID NO: 249307 - RNA, 32 nt, Human
ugauucacugcacuuggaaccagaugauguug

SEQ ID NO: 249308 - RNA, 21 nt, Human
ugauucagaaacaaaacaaua

SEQ ID NO: 249309 - RNA, 32 nt, Human
ugauucagucacacaguggcccugugagcucu

SEQ ID NO: 249310 - RNA, 32 nt, Human
ugauucagugguuuguuccuucuuauuucuga

SEQ ID NO: 249311 - RNA, 32 nt, Human
ugauucauauccucuuuccuuuauggagaccc

SEQ ID NO: 249312 - RNA, 32 nt, Human
ugauucauccccaggcuggagucaggcucagc

SEQ ID NO: 249313 - RNA, 32 nt, Human
ugauucaugccugaaaucccacuacuuuggga

SEQ ID NO: 249314 - RNA, 32 nt, Human
ugauucauggcucugugaauuugaggugaaug

SEQ ID NO: 249315 - RNA, 32 nt, Human
ugauucauguucaucaauaccugcugagagua

SEQ ID NO: 249316 - RNA, 32 nt, Human
ugauuccaagcaaaaaccagacaauguaauaa

SEQ ID NO: 249317 - RNA, 32 nt, Human
ugauuccaccauugcacuccagucugggcaac

SEQ ID NO: 249318 - RNA, 32 nt, Human
ugauuccacuuagaaauucuuaaaaccagauu

SEQ ID NO: 249319 - RNA, 32 nt, Human
ugauuccagcacacacugaguuugagagccac

SEQ ID NO: 249320 - RNA, 32 nt, Human
ugauuccaggagauuggauuugcugugacuag

SEQ ID NO: 249321 - RNA, 32 nt, Human
ugauuccaguauugggggugcagagaaggcac

SEQ ID NO: 249322 - RNA, 32 nt, Human
ugauuccauaucuuugcuaaugugaauagugc

SEQ ID NO: 249323 - RNA, 32 nt, Human
ugauuccauuccauggaaauaaaaaguauguu

SEQ ID NO: 249324 - RNA, 32 nt, Human
ugauucccaagcucugcuccucuccccagcaa

SEQ ID NO: 249325 - RNA, 32 nt, Human
ugauuccccacucaaugacaucauguuagucu

SEQ ID NO: 249326 - RNA, 32 nt, Human
ugauuccccugccucagccuccccaguagcug

SEQ ID NO: 249327 - RNA, 32 nt, Human
ugauuccccugccucagccucgcgaguagcua

SEQ ID NO: 249328 - RNA, 32 nt, Human
ugauuccccugccuuagccuccuaaguagcug

SEQ ID NO: 249329 - RNA, 32 nt, Human
ugauuccgagagggugugguggcacugccagc

SEQ ID NO: 249330 - RNA, 32 nt, Human
ugauuccggcuacuugggaggcugagguggga

SEQ ID NO: 249331 - RNA, 32 nt, Human
ugauuccuaaagauugccauugcuuuguauaa

SEQ ID NO: 249332 - RNA, 32 nt, Human
ugauuccuccaggcucugccuggccugacccu

SEQ ID NO: 249333 - RNA, 32 nt, Human
ugauuccucccaggaggugcuugaggccccga

SEQ ID NO: 249334 - RNA, 32 nt, Human
ugauuccugacaccugcugccugcaggcauuc

SEQ ID NO: 249335 - RNA, 32 nt, Human
ugauuccugagauaagaaaguggauuugaucc

SEQ ID NO: 249336 - RNA, 32 nt, Human
ugauuccuguuguuauggaaacuguugccaga

SEQ ID NO: 249337 - RNA, 32 nt, Human
ugauuccuguuuugucaucugaugcaauuugc

SEQ ID NO: 249338 - RNA, 32 nt, Human
ugauuccuuaucuuugcuauugugaacagugc

SEQ ID NO: 249339 - RNA, 32 nt, Human
ugauucgcccaacacagccucucaaagugcug

SEQ ID NO: 249340 - RNA, 32 nt, Human
ugauucuaaagcaucuuuaaucugccaggcgg

SEQ ID NO: 249341 - RNA, 32 nt, Human
ugauucuacuccugcuauugcucacaacccuc

SEQ ID NO: 249342 - RNA, 32 nt, Human
ugauucuagaaaagucccuccugcuuuggcug

SEQ ID NO: 249343 - RNA, 32 nt, Human
ugauucuagugcuucugccuuaccguguuucc

SEQ ID NO: 249344 - RNA, 32 nt, Human
ugauucuauggaugaucauuuguaucauguug

SEQ ID NO: 249345 - RNA, 21 nt, Human
ugauucuauuuuucuauagca

SEQ ID NO: 249346 - RNA, 32 nt, Human
ugauucucacacaucaaaccaccaagauuccu

SEQ ID NO: 249347 - RNA, 32 nt, Human
ugauucucaccuuuacuccucaguaaucagga

SEQ ID NO: 249348 - RNA, 32 nt, Human
ugauucucaguuuugcuggaggccgcaaccag

SEQ ID NO: 249349 - RNA, 32 nt, Human
ugauucuccagccauggucagacaggucaccc

SEQ ID NO: 249350 - RNA, 32 nt, Human
ugauucuccagccucagccuccugaguagcug

SEQ ID NO: 249351 - RNA, 32 nt, Human
ugauucuccagccugggcaacggagugagacu

SEQ ID NO: 249352 - RNA, 32 nt, Human
ugauucuccaguauuccuguuuccauccaguu

SEQ ID NO: 249353 - RNA, 32 nt, Human
ugauucuccugccucagacuccugaguagcug

SEQ ID NO: 249354 - RNA, 32 nt, Human
ugauucuccugccucagccucacgaguagcug

SEQ ID NO: 249355 - RNA, 32 nt, Human
ugauucuccugccucagccuccccaguagcug

SEQ ID NO: 249356 - RNA, 32 nt, Human
ugauucuccugccucagccucccgaguagcua

SEQ ID NO: 249357 - RNA, 32 nt, Human
ugauucuccugccucagccucccgaguagcug

SEQ ID NO: 249358 - RNA, 32 nt, Human
ugauucuccugccucagccucccgaguugcug

SEQ ID NO: 249359 - RNA, 32 nt, Human
ugauucuccugccucagccucccggguagcug

SEQ ID NO: 249360 - RNA, 32 nt, Human
ugauucuccugccucagccucccuaguagcug

SEQ ID NO: 249361 - RNA, 32 nt, Human
ugauucuccugccucagccucccuaguugcua

SEQ ID NO: 249362 - RNA, 32 nt, Human
ugauucuccugccucagccucccucgcaagua

SEQ ID NO: 249363 - RNA, 32 nt, Human
ugauucuccugccucagccuccugaauagcug

SEQ ID NO: 249364 - RNA, 32 nt, Human
ugauucuccugccucagccuccugaauaucug

SEQ ID NO: 249365 - RNA, 32 nt, Human
ugauucuccugccucagccuccugagcagcug

SEQ ID NO: 249366 - RNA, 32 nt, Human
ugauucuccugccucagccuccugaggagcug

SEQ ID NO: 249367 - RNA, 32 nt, Human
ugauucuccugccucagccuccugaguagcua

SEQ ID NO: 249368 - RNA, 32 nt, Human
ugauucuccugccucagccuccugaguagcug

SEQ ID NO: 249369 - RNA, 32 nt, Human
ugauucuccugccucagccuccugagucgcug

SEQ ID NO: 249370 - RNA, 32 nt, Human
ugauucuccugccucagccucgugaguagcug

SEQ ID NO: 249371 - RNA, 32 nt, Human
ugauucuccugccucagccucugaguagcugg

SEQ ID NO: 249372 - RNA, 32 nt, Human
ugauucuccugccucagccucuuuagcuggga

SEQ ID NO: 249373 - RNA, 32 nt, Human
ugauucuccugccucagccugcugaguagcug

SEQ ID NO: 249374 - RNA, 24 nt, Human
ugauucuccugccucagccuucca

SEQ ID NO: 249375 - RNA, 32 nt, Human
ugauucuccugccucagucuccugaguagcug

SEQ ID NO: 249376 - RNA, 32 nt, Human
ugauucuccugccucauccuccugaguagcug

SEQ ID NO: 249377 - RNA, 32 nt, Human
ugauucuccugccuccgccucccgaguagcug

SEQ ID NO: 249378 - RNA, 32 nt, Human
ugauucuccugccucggccuccugaguagcug

SEQ ID NO: 249379 - RNA, 32 nt, Human
ugauucuccugccucugccuccugaguagcug

SEQ ID NO: 249380 - RNA, 24 nt, Human
ugauucuccugcuucagccuccca

SEQ ID NO: 249381 - RNA, 32 nt, Human
ugauucucuccaccuggugcucauaugaaggu

SEQ ID NO: 249382 - RNA, 32 nt, Human
ugauucucucucccucuccgcguccagugcug

SEQ ID NO: 249383 - RNA, 32 nt, Human
ugauucucuucgucccucccucggcuucucug

SEQ ID NO: 249384 - RNA, 32 nt, Human
ugauucucuuucuccuucucucagggcuuuua

SEQ ID NO: 249385 - RNA, 18 nt, Human
ugauucugcacuuuguaa

SEQ ID NO: 249386 - RNA, 32 nt, Human
ugauucugcagccucagcuccagcaucccuca

SEQ ID NO: 249387 - RNA, 32 nt, Human
ugauucugccaccauauagugaacacgauuaa

SEQ ID NO: 249388 - RNA, 32 nt, Human
ugauucugccacuuacccacacugucucuagu

SEQ ID NO: 249389 - RNA, 18 nt, Human
ugauucugcccacuguaa

SEQ ID NO: 249390 - RNA, 32 nt, Human
ugauucugccugaauagcugagagguuccagc

SEQ ID NO: 249391 - RNA, 20 nt, Human
ugauucugccuguaauccca

SEQ ID NO: 249392 - RNA, 32 nt, Human
ugauucugccuguaaucccagaauuuugggag

SEQ ID NO: 249393 - RNA, 18 nt, Human
ugauucugcugaugaaca

SEQ ID NO: 249394 - RNA, 32 nt, Human
ugauucuggaaacccucuugacacuguguuaa

SEQ ID NO: 249395 - RNA, 32 nt, Human
ugauucuggagcucuguguucugagaucaugc

SEQ ID NO: 249396 - RNA, 19 nt, Human
ugauucuggauucuaaaca

SEQ ID NO: 249397 - RNA, 32 nt, Human
ugauucuggggacaggacuaaagccugagagg

SEQ ID NO: 249398 - RNA, 32 nt, Human
ugauucuggggucuccuuagaggcucaggcca

SEQ ID NO: 249399 - RNA, 21 nt, Human
ugauucugucauucuguuaca

SEQ ID NO: 249400 - RNA, 32 nt, Human
ugauucuguuucucaguaguccuuuuagaggc

SEQ ID NO: 249401 - RNA, 32 nt, Human
ugauucuuaaauuuuaacuaccuucacuuaau

SEQ ID NO: 249402 - RNA, 32 nt, Human
ugauucuuaagcuucaucagcaccagaacacu

SEQ ID NO: 249403 - RNA, 32 nt, Human
ugauucuuauggaaaucucuguuauuaagaua

SEQ ID NO: 249404 - RNA, 32 nt, Human
ugauucuuauggaaaucucuguuauuaaguca

SEQ ID NO: 249405 - RNA, 32 nt, Human
ugauucuuauuguauuacaaaggaaccaugaa

SEQ ID NO: 249406 - RNA, 32 nt, Human
ugauucuucugccucagccucucaaguaacug

SEQ ID NO: 249407 - RNA, 24 nt, Human
ugauucuucugcuucagccuccca

SEQ ID NO: 249408 - RNA, 32 nt, Human
ugauucuugacaccagaugcaggauggugucc

SEQ ID NO: 249409 - RNA, 32 nt, Human
ugauucuugcuaguucccagcucacaguuugg

SEQ ID NO: 249410 - RNA, 32 nt, Human
ugauucuugucagaaacauuuccccaggcaga

SEQ ID NO: 249411 - RNA, 32 nt, Human
ugauucuugugccauuuuuguauauguaauug

SEQ ID NO: 249412 - RNA, 19 nt, Human
ugauucuuugacugugaca

SEQ ID NO: 249413 - RNA, 32 nt, Human
ugauugaaaguguuugcaguuccucuuccgua

SEQ ID NO: 249414 - RNA, 32 nt, Human
ugauugaagaccuauugggagugaagacuuga

SEQ ID NO: 249415 - RNA, 32 nt, Human
ugauugaagagucacugucugaaagaagcaaa

SEQ ID NO: 249416 - RNA, 32 nt, Human
ugauugaaggaagguuuucuccacuuuguugg

SEQ ID NO: 249417 - RNA, 32 nt, Human
ugauugacacauauuuuuaaauaaauauaaua

SEQ ID NO: 249418 - RNA, 32 nt, Human
ugauugacaggcagauuucccuaccgggauuu

SEQ ID NO: 249419 - RNA, 32 nt, Human
ugauugacgcuugcaaacugucugaauuugcc

SEQ ID NO: 249420 - RNA, 32 nt, Human
ugauugacucaaucuuugccuaauccaaugag

SEQ ID NO: 249421 - RNA, 32 nt, Human
ugauugacuuacaagugaaacugucuuauaau

SEQ ID NO: 249422 - RNA, 32 nt, Human
ugauugagaaccaccaguuuagcuagucaaua

SEQ ID NO: 249423 - RNA, 32 nt, Human
ugauugagccaauauacaaauaccucaucugu

SEQ ID NO: 249424 - RNA, 32 nt, Human
ugauugagccaccacacuccaaccuaggugac

SEQ ID NO: 249425 - RNA, 32 nt, Human
ugauugagccacugcacuccaaucugggugac

SEQ ID NO: 249426 - RNA, 32 nt, Human
ugauugagccacugcacuccagccucggccac

SEQ ID NO: 249427 - RNA, 32 nt, Human
ugauugagggaggaggaggaggaagagguaug

SEQ ID NO: 249428 - RNA, 32 nt, Human
ugauugagucuauuuuucacugaucucagcaa

SEQ ID NO: 249429 - RNA, 32 nt, Human
ugauugauaagaaccuuuugagugccuuacac

SEQ ID NO: 249430 - RNA, 32 nt, Human
ugauugauacaguuuguacuuauuucaucaag

SEQ ID NO: 249431 - RNA, 32 nt, Human
ugauugauggccugagccugggguccugguag

SEQ ID NO: 249432 - RNA, 32 nt, Human
ugauugauugugcaaacuacuuuuuaugacaa

SEQ ID NO: 249433 - RNA, 32 nt, Human
ugauugcacagcugcacuccagccugugcuga

SEQ ID NO: 249434 - RNA, 32 nt, Human
ugauugcaccaccacacuccagccugggugac

SEQ ID NO: 249435 - RNA, 32 nt, Human
ugauugcaccacugcacucaagccugggcaac

SEQ ID NO: 249436 - RNA, 32 nt, Human
ugauugcaccacugcacuccaaccugggcaac

SEQ ID NO: 249437 - RNA, 32 nt, Human
ugauugcaccacugcacuccaaccugggugac

SEQ ID NO: 249438 - RNA, 32 nt, Human
ugauugcaccacugcacuccagccugagugac

SEQ ID NO: 249439 - RNA, 32 nt, Human
ugauugcaccacugcacuccagccuggaaaac

SEQ ID NO: 249440 - RNA, 32 nt, Human
ugauugcaccacugcacuccagccugggcaac

SEQ ID NO: 249441 - RNA, 32 nt, Human
ugauugcaccacugcacuccagccugggcgac

SEQ ID NO: 249442 - RNA, 32 nt, Human
ugauugcaccacugcacuccagccugggugac

SEQ ID NO: 249443 - RNA, 32 nt, Human
ugauugcaccacugcacuccagccugggugau

SEQ ID NO: 249444 - RNA, 32 nt, Human
ugauugcaccacugcacuccagccuggguguc

SEQ ID NO: 249445 - RNA, 32 nt, Human
ugauugcaccacugcacuccaggcuggguaac

SEQ ID NO: 249446 - RNA, 32 nt, Human
ugauugcaccacugcacuccagucugguugag

SEQ ID NO: 249447 - RNA, 32 nt, Human
ugauugcaccacugcacucuaacuugggcaac

SEQ ID NO: 249448 - RNA, 32 nt, Human
ugauugcaccacugcacucuacucugggugac

SEQ ID NO: 249449 - RNA, 32 nt, Human
ugauugcaccacugcacucuagccugcgugac

SEQ ID NO: 249450 - RNA, 32 nt, Human
ugauugcaccacugcacucuagccuggggaac

SEQ ID NO: 249451 - RNA, 32 nt, Human
ugauugcaccacugcacuucagcuugggcaac

SEQ ID NO: 249452 - RNA, 32 nt, Human
ugauugcaccacugcacuuuagucugggugac

SEQ ID NO: 249453 - RNA, 32 nt, Human
ugauugcaccacuggacgccagccuaggcaac

SEQ ID NO: 249454 - RNA, 32 nt, Human
ugauugcaccacuguacuccagacuggauaac

SEQ ID NO: 249455 - RNA, 32 nt, Human
ugauugcaccacuguacuccagccugggcaac

SEQ ID NO: 249456 - RNA, 32 nt, Human
ugauugcaccacuguacuccagccugggugac

SEQ ID NO: 249457 - RNA, 32 nt, Human
ugauugcaccacuuguaacuccagccugggca

SEQ ID NO: 249458 - RNA, 32 nt, Human
ugauugcaccauugcaccuccagccugggcaa

SEQ ID NO: 249459 - RNA, 32 nt, Human
ugauugcaccccugcacuccagccugggugac

SEQ ID NO: 249460 - RNA, 32 nt, Human
ugauugcaccgugacacuccagccugggcaac

SEQ ID NO: 249461 - RNA, 32 nt, Human
ugauugcacgacugcacuccagccugggcaau

SEQ ID NO: 249462 - RNA, 32 nt, Human
ugauugcacugucgcacuccagccuggaugau

SEQ ID NO: 249463 - RNA, 32 nt, Human
ugauugcaggaauaucuggaugugaguuaguu

SEQ ID NO: 249464 - RNA, 32 nt, Human
ugauugcagugagcugagauagcaccacugca

SEQ ID NO: 249465 - RNA, 32 nt, Human
ugauugcaucacugcacugcagccugggcaac

SEQ ID NO: 249466 - RNA, 32 nt, Human
ugauugccacagugcaagaccccaucucaaaa

SEQ ID NO: 249467 - RNA, 32 nt, Human
ugauugccagaacucgagaucacuacacaugg

SEQ ID NO: 249468 - RNA, 32 nt, Human
ugauugccgggggaggagaagcucccagaucc

SEQ ID NO: 249469 - RNA, 32 nt, Human
ugauugccggggugaaggcaagagaugaauug

SEQ ID NO: 249470 - RNA, 32 nt, Human
ugauugccucuucucaucaggagccaggagag

SEQ ID NO: 249471 - RNA, 32 nt, Human
ugauugcgccacagcauuccagccugggcgau

SEQ ID NO: 249472 - RNA, 32 nt, Human
ugauugcgccacugcacuccagccugggcagc

SEQ ID NO: 249473 - RNA, 32 nt, Human
ugauugcgccacugcauuccagcuugggcgac

SEQ ID NO: 249474 - RNA, 32 nt, Human
ugauugcgccgcugcacuccagccugggcaac

SEQ ID NO: 249475 - RNA, 32 nt, Human
ugauugcucacaccaaagccuuggaccccucc

SEQ ID NO: 249476 - RNA, 32 nt, Human
ugauugcucacugaaagacucagcacccccaa

SEQ ID NO: 249477 - RNA, 32 nt, Human
ugauugcucagggagugcuggggagaaugagg

SEQ ID NO: 249478 - RNA, 32 nt, Human
ugauugcucccaggaucuccugccagcccagc

SEQ ID NO: 249479 - RNA, 32 nt, Human
ugauugcugauaguagugaccaaaacuacuuu

SEQ ID NO: 249480 - RNA, 32 nt, Human
ugauugcugcuuggcuggaagauuaucaauuc

SEQ ID NO: 249481 - RNA, 32 nt, Human
ugauugcuugagcucaggaguuugagaccagg

SEQ ID NO: 249482 - RNA, 32 nt, Human
ugauugcuuugaccaacagaauguggcagaag

SEQ ID NO: 249483 - RNA, 32 nt, Human
ugauuggaccacuauacuccagccuggcaaca

SEQ ID NO: 249484 - RNA, 32 nt, Human
ugauuggaucauaggagcggauuucccccuug

SEQ ID NO: 249485 - RNA, 32 nt, Human
ugauuggcagccggagucacugccuggaguug

SEQ ID NO: 249486 - RNA, 32 nt, Human
ugauuggcaucugcuuuucucuuuucuuugcu

SEQ ID NO: 249487 - RNA, 32 nt, Human
ugauugggaucuacugugauguugucuucaaa

SEQ ID NO: 249488 - RNA, 32 nt, Human
ugauugggcuuccugaggaagugagaacgccu

SEQ ID NO: 249489 - RNA, 32 nt, Human
ugauuggguccaggcugggcugucagggaagc

SEQ ID NO: 249490 - RNA, 19 nt, Human
ugauugguccguuuuacag

SEQ ID NO: 249491 - RNA, 20 nt, Human
ugauugguccguuuugacag

SEQ ID NO: 249492 - RNA, 24 nt, Human
ugauugguccguuuugacagagug

SEQ ID NO: 249493 - RNA, 32 nt, Human
ugauuggugagcugaagucuguccuugcacca

SEQ ID NO: 249494 - RNA, 32 nt, Human
ugauuggugcucccugggccucccggguggau

SEQ ID NO: 249495 - RNA, 32 nt, Human
ugauugguuaagugaaaaccagaacucaaaau

SEQ ID NO: 249496 - RNA, 32 nt, Human
ugauugguuagcaauguugacuacccacguag

SEQ ID NO: 249497 - RNA, 32 nt, Human
ugauugguuccccaaagaaggucuggaacucc

SEQ ID NO: 249498 - RNA, 32 nt, Human
ugauugguuuuccuguaggcuggaaguaaaaa

SEQ ID NO: 249499 - RNA, 32 nt, Human
ugauuguaaugauuuugagcugcagcagcuuu

SEQ ID NO: 249500 - RNA, 32 nt, Human
ugauuguaccacugcacuccagccugggcaac

SEQ ID NO: 249501 - RNA, 32 nt, Human
ugauuguaccacugcacuccagccugggugac

SEQ ID NO: 249502 - RNA, 32 nt, Human
ugauuguaccacugcacuccagcucggggaac

SEQ ID NO: 249503 - RNA, 32 nt, Human
ugauuguaccacuguauuccagccuggacgac

SEQ ID NO: 249504 - RNA, 32 nt, Human
ugauuguagggucucauuuucucaccgauauu

SEQ ID NO: 249505 - RNA, 32 nt, Human
ugauuguaugacugcacuccagccugggugac

SEQ ID NO: 249506 - RNA, 32 nt, Human
ugauugucagggaggugccaguuacagcaggu

SEQ ID NO: 249507 - RNA, 32 nt, Human
ugauuguccaagcagcuuuagauguguuuagg

SEQ ID NO: 249508 - RNA, 32 nt, Human
ugauugucucugcuuuagcgucucuaaauccg

SEQ ID NO: 249509 - RNA, 32 nt, Human
ugauugucugagugagugaaacuacaagaggu

SEQ ID NO: 249510 - RNA, 32 nt, Human
ugauugugacacugcccuccagccugggugac

SEQ ID NO: 249511 - RNA, 31 nt, Human
ugauugugacuucuaguucuuuucuagagga

SEQ ID NO: 249512 - RNA, 32 nt, Human
ugauugugaggccuccccagccacuuggaacu

SEQ ID NO: 249513 - RNA, 32 nt, Human
ugauugugauggaagccccugcccuuccugug

SEQ ID NO: 249514 - RNA, 32 nt, Human
ugauugugcacagugaccuggcuguucacuuc

SEQ ID NO: 249515 - RNA, 32 nt, Human
ugauugugccaauguacuccagccuaggugac

SEQ ID NO: 249516 - RNA, 32 nt, Human
ugauugugccacacacuccagccuggguggca

SEQ ID NO: 249517 - RNA, 32 nt, Human
ugauugugccaccgcacuccagcaugggugac

SEQ ID NO: 249518 - RNA, 32 nt, Human
ugauugugccacugcacucauccuggaagaca

SEQ ID NO: 249519 - RNA, 32 nt, Human
ugauugugccacugcacuccagccugggcaac

SEQ ID NO: 249520 - RNA, 32 nt, Human
ugauugugccacugcacuccagccugggcacc

SEQ ID NO: 249521 - RNA, 32 nt, Human
ugauugugccacugcacuccagccugggccac

SEQ ID NO: 249522 - RNA, 32 nt, Human
ugauugugccacugcacuccagccugggcgac

SEQ ID NO: 249523 - RNA, 32 nt, Human
ugauugugccacugcacuccagccuggguaac

SEQ ID NO: 249524 - RNA, 32 nt, Human
ugauugugccacugcacuccagccuggguggc

SEQ ID NO: 249525 - RNA, 32 nt, Human
ugauugugccacugcacuccagccuggguuac

SEQ ID NO: 249526 - RNA, 32 nt, Human
ugauugugccacugcacuccagccuuggcaac

SEQ ID NO: 249527 - RNA, 32 nt, Human
ugauugugccacugcacuccagcuuggugaca

SEQ ID NO: 249528 - RNA, 32 nt, Human
ugauugugccacugcacuccagucuggacaac

SEQ ID NO: 249529 - RNA, 32 nt, Human
ugauugugccacugcauaccagccuaggugac

SEQ ID NO: 249530 - RNA, 32 nt, Human
ugauugugccacuguacuccagccugggagau

SEQ ID NO: 249531 - RNA, 32 nt, Human
ugauugugccacuguacuccagccugggugac

SEQ ID NO: 249532 - RNA, 32 nt, Human
ugauugugccacuguuuuccagccugggcaau

SEQ ID NO: 249533 - RNA, 32 nt, Human
ugauugugccacuucccuccagccugggcaau

SEQ ID NO: 249534 - RNA, 32 nt, Human
ugauugugccagugcacuccaggcuggacgac

SEQ ID NO: 249535 - RNA, 32 nt, Human
ugauugugccagugcacuccggccugggugac

SEQ ID NO: 249536 - RNA, 32 nt, Human
ugauugugccauuccaaagugcaucagaacug

SEQ ID NO: 249537 - RNA, 32 nt, Human
ugauugugccauugcacuccagccuggacaac

SEQ ID NO: 249538 - RNA, 32 nt, Human
ugauugugccauugcacuccagccugggugac

SEQ ID NO: 249539 - RNA, 32 nt, Human
ugauugugccauuguacuccagccugggcgac

SEQ ID NO: 249540 - RNA, 32 nt, Human
ugauugugcuacugcacuccaaucuggcaaca

SEQ ID NO: 249541 - RNA, 32 nt, Human
ugauugugcuuauuacauucauuaucacgaug

SEQ ID NO: 249542 - RNA, 32 nt, Human
ugauuguggcauugcacuccagccuggguggu

SEQ ID NO: 249543 - RNA, 32 nt, Human
ugauugugucacugcacuccagccugggcaac

SEQ ID NO: 249544 - RNA, 32 nt, Human
ugauugugucacugcacuccagcuugggugac

SEQ ID NO: 249545 - RNA, 32 nt, Human
ugauugugugggcugcacaggcugaagguuag

SEQ ID NO: 249546 - RNA, 32 nt, Human
ugauuguuagcuuucagaaagcuaaugauugu

SEQ ID NO: 249547 - RNA, 32 nt, Human
ugauuguucagccuuuuguuuuguuagcuugu

SEQ ID NO: 249548 - RNA, 32 nt, Human
ugauuguuguacuucugggucaaaacucaaau

SEQ ID NO: 249549 - RNA, 17 nt, Human
ugauuguuguugucauc

SEQ ID NO: 249550 - RNA, 32 nt, Human
ugauuguuucaaggaagugacaguucuacuuu

SEQ ID NO: 249551 - RNA, 32 nt, Human
ugauuguuucuucuucaugcuuuugcuugcaa

SEQ ID NO: 249552 - RNA, 20 nt, Human
ugauuguuuuguaaauaucu

SEQ ID NO: 249553 - RNA, 32 nt, Human
ugauuuaaaacuuuuaacauuuuguuuggcug

SEQ ID NO: 249554 - RNA, 32 nt, Human
ugauuuaaccauuguauuuaauuucccaccuu

SEQ ID NO: 249555 - RNA, 19 nt, Human
ugauuuaaccucuguaaua

SEQ ID NO: 249556 - RNA, 32 nt, Human
ugauuuaacuauuccauauuguauccacaauu

SEQ ID NO: 249557 - RNA, 32 nt, Human
ugauuuaagaaguggcuggauuggaacuuuua

SEQ ID NO: 249558 - RNA, 32 nt, Human
ugauuuacaaguccuaauuguuggagcucagu

SEQ ID NO: 249559 - RNA, 32 nt, Human
ugauuuacacuucuguuuucugcuacaaacuu

SEQ ID NO: 249560 - RNA, 32 nt, Human
ugauuuacaggugagcaaacaggcucagagac

SEQ ID NO: 249561 - RNA, 32 nt, Human
ugauuuaccucaaggugcaaaauaauuaaacc

SEQ ID NO: 249562 - RNA, 32 nt, Human
ugauuuacucuuagagaugauucagaggucac

SEQ ID NO: 249563 - RNA, 32 nt, Human
ugauuuagagagaagagagcagcuccuagcag

SEQ ID NO: 249564 - RNA, 32 nt, Human
ugauuuagcugcugccuccagccucuggcuug

SEQ ID NO: 249565 - RNA, 32 nt, Human
ugauuuagggaaacuguggcagaugaguggga

SEQ ID NO: 249566 - RNA, 32 nt, Human
ugauuuauaauuagagcauguuuaauaaguuu

SEQ ID NO: 249567 - RNA, 32 nt, Human
ugauuuauauugauugcacuugccugccauga

SEQ ID NO: 249568 - RNA, 32 nt, Human
ugauuuaucaaauuaaugugcugaugauaaua

SEQ ID NO: 249569 - RNA, 31 nt, Human
ugauuuaugcaaagggcuggcauucugaugc

SEQ ID NO: 249570 - RNA, 32 nt, Human
ugauuuauggaauuugaaaaagauaauuauaa

SEQ ID NO: 249571 - RNA, 32 nt, Human
ugauuucaaaaauguccugccaguuuaagggu

SEQ ID NO: 249572 - RNA, 32 nt, Human
ugauuucaaaagguuucacaauuccccaagac

SEQ ID NO: 249573 - RNA, 32 nt, Human
ugauuucaacagccaagccaaguuucaugaau

SEQ ID NO: 249574 - RNA, 20 nt, Human
ugauuucaaggagucuggca

SEQ ID NO: 249575 - RNA, 32 nt, Human
ugauuucaccaccacuccagccugggugagaa

SEQ ID NO: 249576 - RNA, 32 nt, Human
ugauuucaccacugcauucuagccugggcaac

SEQ ID NO: 249577 - RNA, 32 nt, Human
ugauuucacccuugcauuccagccugugaaau

SEQ ID NO: 249578 - RNA, 32 nt, Human
ugauuucacuguguggucucaggggaagcugg

SEQ ID NO: 249579 - RNA, 32 nt, Human
ugauuucagaaggagaaggaaaaagaaaguaa

SEQ ID NO: 249580 - RNA, 32 nt, Human
ugauuucagacucccgcucucccagcuguccu

SEQ ID NO: 249581 - RNA, 32 nt, Human
ugauuucaggcagcaggggcugcugugaugcc

SEQ ID NO: 249582 - RNA, 32 nt, Human
ugauuucaguguucaagacagaagaagacugg

SEQ ID NO: 249583 - RNA, 32 nt, Human
ugauuucauacaggcggccggucuccagcacc

SEQ ID NO: 249584 - RNA, 32 nt, Human
ugauuucauauucgcccucuggcuucaggcac

SEQ ID NO: 249585 - RNA, 32 nt, Human
ugauuucauccagcagccaagacaguaaguga

SEQ ID NO: 249586 - RNA, 32 nt, Human
ugauuucauggugucuuuccaggcucuugaua

SEQ ID NO: 249587 - RNA, 32 nt, Human
ugauuucauucugccguguugcuaacccccuc

SEQ ID NO: 249588 - RNA, 32 nt, Human
ugauuucauugagcuucauugcagccugaaau

SEQ ID NO: 249589 - RNA, 32 nt, Human
ugauuuccaaccaacaugaaaugacuauaaac

SEQ ID NO: 249590 - RNA, 32 nt, Human
ugauuucccacugcacuccagccugagugaca

SEQ ID NO: 249591 - RNA, 32 nt, Human
ugauuuccuggcuggccaacugguggccagug

SEQ ID NO: 249592 - RNA, 20 nt, Human
ugauuucgcccacccaccuc

SEQ ID NO: 249593 - RNA, 32 nt, Human
ugauuucuacuacccucucagucaccauguug

SEQ ID NO: 249594 - RNA, 24 nt, Human
ugauuucuagaacuauccaccuca

SEQ ID NO: 249595 - RNA, 32 nt, Human
ugauuucuaggguccaaaaguugacaaaacca

SEQ ID NO: 249596 - RNA, 32 nt, Human
ugauuucucccaaagaauaacuuggagguuga

SEQ ID NO: 249597 - RNA, 32 nt, Human
ugauuucucugggcuuccuucaucucaauucu

SEQ ID NO: 249598 - RNA, 24 nt, Human
ugauuucugugucaccuacuguca

SEQ ID NO: 249599 - RNA, 32 nt, Human
ugauuucuuauuacccccuuuccucuugggcu

SEQ ID NO: 249600 - RNA, 32 nt, Human
ugauuucuuccauccagaaagacagaaagcca

SEQ ID NO: 249601 - RNA, 32 nt, Human
ugauuucuuccuccucuucagugugguagaug

SEQ ID NO: 249602 - RNA, 32 nt, Human
ugauuucuucuuuuccuauugaccaguacaga

SEQ ID NO: 249603 - RNA, 32 nt, Human
ugauuucuuggagccugaaaagaaggagcagc

SEQ ID NO: 249604 - RNA, 32 nt, Human
ugauuucuugucucccuguggcuuguuccacu

SEQ ID NO: 249605 - RNA, 32 nt, Human
ugauuugagaaaagggaggaggggaagacagu

SEQ ID NO: 249606 - RNA, 32 nt, Human
ugauuugagaaaagggaggaggggaagauagu

SEQ ID NO: 249607 - RNA, 32 nt, Human
ugauuugagucuguccuaacugcuccauugag

SEQ ID NO: 249608 - RNA, 32 nt, Human
ugauuugauuuauccuuguacucuccaagcuc

SEQ ID NO: 249609 - RNA, 32 nt, Human
ugauuugcaaacauuucuauagccgaacuugu

SEQ ID NO: 249610 - RNA, 32 nt, Human
ugauuugcaacaggucuuccacuggcucgagg

SEQ ID NO: 249611 - RNA, 32 nt, Human
ugauuugcaacuuuucuuguugaugucguguu

SEQ ID NO: 249612 - RNA, 32 nt, Human
ugauuugcauaaauggagauaaaacuuguauu

SEQ ID NO: 249613 - RNA, 24 nt, Human
ugauuugcccgccucagccuccca

SEQ ID NO: 249614 - RNA, 32 nt, Human
ugauuugcuauuuuugacauuuccucgucucu

SEQ ID NO: 249615 - RNA, 32 nt, Human
ugauuugcugugguguuggguggcuccuaucu

SEQ ID NO: 249616 - RNA, 22 nt, Human
ugauuugcuucccuuccugcca

SEQ ID NO: 249617 - RNA, 32 nt, Human
ugauuugcuuccuaacagcucuguucccuccu

SEQ ID NO: 249618 - RNA, 32 nt, Human
ugauuuggcuuuuugugccuaauggacauaca

SEQ ID NO: 249619 - RNA, 32 nt, Human
ugauuugggcuacucauuuaaccuuuuugugc

SEQ ID NO: 249620 - RNA, 32 nt, Human
ugauuugggcuucauuucguguguaggagcac

SEQ ID NO: 249621 - RNA, 32 nt, Human
ugauuugggugagggacgggaaggggagaauu

SEQ ID NO: 249622 - RNA, 19 nt, Human
ugauuugguuugcugcauc

SEQ ID NO: 249623 - RNA, 32 nt, Human
ugauuuguacuuggaagcauucacaaaguagc

SEQ ID NO: 249624 - RNA, 32 nt, Human
ugauuuguauccuuuugcuauaauaaacugua

SEQ ID NO: 249625 - RNA, 32 nt, Human
ugauuuguauuuuucuaugcacugggcaucuu

SEQ ID NO: 249626 - RNA, 32 nt, Human
ugauuugucagagaaccuguugaaaugugaau

SEQ ID NO: 249627 - RNA, 32 nt, Human
ugauuugucauugcuuuauagacuguaagaag

SEQ ID NO: 249628 - RNA, 32 nt, Human
ugauuugugguuuguuuucuuucacuuuguac

SEQ ID NO: 249629 - RNA, 32 nt, Human
ugauuuguguagugagccuuugaaaaugguua

SEQ ID NO: 249630 - RNA, 32 nt, Human
ugauuuguguuuucaguguguggggaagcugu

SEQ ID NO: 249631 - RNA, 32 nt, Human
ugauuuguuuuuaaaaauuuuuacacuucuug

SEQ ID NO: 249632 - RNA, 22 nt, Human
ugauuuguuuuuguuuuguuuu

SEQ ID NO: 249633 - RNA, 20 nt, Human
ugauuuuaacccgcugcaca

SEQ ID NO: 249634 - RNA, 32 nt, Human
ugauuuuaauugcuugaaacaacuuucagggu

SEQ ID NO: 249635 - RNA, 32 nt, Human
ugauuuuaccacugcacuccagcuugggcgac

SEQ ID NO: 249636 - RNA, 32 nt, Human
ugauuuuaccucuucagcuuuauuuacuaugc

SEQ ID NO: 249637 - RNA, 32 nt, Human
ugauuuuacugaaauaaagaugagcuacuucu

SEQ ID NO: 249638 - RNA, 32 nt, Human
ugauuuuacugagguuucaucacaagaaggga

SEQ ID NO: 249639 - RNA, 32 nt, Human
ugauuuuacuucagaaaccaaaucagucuucu

SEQ ID NO: 249640 - RNA, 32 nt, Human
ugauuuuaguacaucuuaaaugauaucuuauu

SEQ ID NO: 249641 - RNA, 32 nt, Human
ugauuuuagugguauuuuuggcacccuuauau

SEQ ID NO: 249642 - RNA, 32 nt, Human
ugauuuuaguguguuagacuugcugaguccua

SEQ ID NO: 249643 - RNA, 32 nt, Human
ugauuuuauauacuuaugcuuucauacauaaa

SEQ ID NO: 249644 - RNA, 21 nt, Human
ugauuuuauauccaccuaccu

SEQ ID NO: 249645 - RNA, 32 nt, Human
ugauuuuaucucuucuuucuguaucuauaggu

SEQ ID NO: 249646 - RNA, 32 nt, Human
ugauuuuauggaagugggcgaaaacaaucaaa

SEQ ID NO: 249647 - RNA, 32 nt, Human
ugauuuucaaacccauaugcuucuaaccacua

SEQ ID NO: 249648 - RNA, 32 nt, Human
ugauuuucacacaaauacuauaugaaauuuuu

SEQ ID NO: 249649 - RNA, 32 nt, Human
ugauuuucacugcaacucugccuuugugugua

SEQ ID NO: 249650 - RNA, 32 nt, Human
ugauuuucaguuauaauaauguguacuggcau

SEQ ID NO: 249651 - RNA, 32 nt, Human
ugauuuucauauuuucacacaugguauguuau

SEQ ID NO: 249652 - RNA, 32 nt, Human
ugauuuuccaauaaacugcuaucacaauguca

SEQ ID NO: 249653 - RNA, 32 nt, Human
ugauuuuccucaccugaguacaugaaaagaaa

SEQ ID NO: 249654 - RNA, 32 nt, Human
ugauuuuccuggaggauuaggguauuuagcag

SEQ ID NO: 249655 - RNA, 32 nt, Human
ugauuuucucuaauguaacuuccucuuaggau

SEQ ID NO: 249656 - RNA, 32 nt, Human
ugauuuucugaaagcaccugcuaacaccuuga

SEQ ID NO: 249657 - RNA, 24 nt, Human
ugauuuucuggauuccccaucuca

SEQ ID NO: 249658 - RNA, 32 nt, Human
ugauuuucuucuggauguggucuuugguuuuc

SEQ ID NO: 249659 - RNA, 32 nt, Human
ugauuuucuuucuccucugauuucaguucacu

SEQ ID NO: 249660 - RNA, 32 nt, Human
ugauuuugaaaccaugaagagauuuuucauga

SEQ ID NO: 249661 - RNA, 18 nt, Human
ugauuuugaccuccucuu

SEQ ID NO: 249662 - RNA, 32 nt, Human
ugauuuugaugggcaugaaugagacccagcug

SEQ ID NO: 249663 - RNA, 20 nt, Human
ugauuuugcagguugucuuc

SEQ ID NO: 249664 - RNA, 32 nt, Human
ugauuuugccacugcacuccugccugggugac

SEQ ID NO: 249665 - RNA, 32 nt, Human
ugauuuugcccgaaguugugagacugaaacca

SEQ ID NO: 249666 - RNA, 18 nt, Human
ugauuuugcccuuguuau

SEQ ID NO: 249667 - RNA, 32 nt, Human
ugauuuugccuagagcugaucuuuaauggaca

SEQ ID NO: 249668 - RNA, 32 nt, Human
ugauuuugcuacccaugaaauacaguucggcc

SEQ ID NO: 249669 - RNA, 32 nt, Human
ugauuuuggaaagauauaauuucuugaaaauc

SEQ ID NO: 249670 - RNA, 32 nt, Human
ugauuuuggaaauuuuaaaaaucagauuuaau

SEQ ID NO: 249671 - RNA, 32 nt, Human
ugauuuuggagauggagcaggacaagugggga

SEQ ID NO: 249672 - RNA, 20 nt, Human
ugauuuuggugacccacuuc

SEQ ID NO: 249673 - RNA, 23 nt, Human
ugauuuuguaucccccuguagca

SEQ ID NO: 249674 - RNA, 19 nt, Human
ugauuuugucacugacauc

SEQ ID NO: 249675 - RNA, 32 nt, Human
ugauuuuguugcucccucucuccuggaaccua

SEQ ID NO: 249676 - RNA, 32 nt, Human
ugauuuuuaaaaccagcacaagcaaaugagua

SEQ ID NO: 249677 - RNA, 22 nt, Human
ugauuuuuaaaccugguuuaca

SEQ ID NO: 249678 - RNA, 20 nt, Human
ugauuuuuaccucuguaaca

SEQ ID NO: 249679 - RNA, 32 nt, Human
ugauuuuuacucuguuugcuguaguaguuuua

SEQ ID NO: 249680 - RNA, 32 nt, Human
ugauuuuuagugggcagaugggagaaggaaag

SEQ ID NO: 249681 - RNA, 32 nt, Human
ugauuuuuaucuguuuacaaucaugucacacu

SEQ ID NO: 249682 - RNA, 16 nt, Human
ugauuuuucugucauc

SEQ ID NO: 249683 - RNA, 32 nt, Human
ugauuuuucuuuaaaaucagugagauuugaaa

SEQ ID NO: 249684 - RNA, 21 nt, Human
ugcaaaaaagguuuuguguca

SEQ ID NO: 249685 - RNA, 32 nt, Human
ugcaaaaacccaaagccuccaaaacuaaccag

SEQ ID NO: 249686 - RNA, 27 nt, Human
ugcaaaaaggaaaacacacacaaccaa

SEQ ID NO: 249687 - RNA, 32 nt, Human
ugcaaaaaguuagccaggcaugguggugggca

SEQ ID NO: 249688 - RNA, 22 nt, Human
ugcaaaacaaggaaaucacaca

SEQ ID NO: 249689 - RNA, 32 nt, Human
ugcaaaacagccagacuugagcugugcucugg

SEQ ID NO: 249690 - RNA, 18 nt, Human
ugcaaaacccuuccuggg

SEQ ID NO: 249691 - RNA, 32 nt, Human
ugcaaaacugugucacaguuucaggcuuuuau

SEQ ID NO: 249692 - RNA, 32 nt, Human
ugcaaaacuuccuggaguucagcccagcaagg

SEQ ID NO: 249693 - RNA, 32 nt, Human
ugcaaaagagaaccagagcaucagagccuuca

SEQ ID NO: 249694 - RNA, 32 nt, Human
ugcaaaagcagccugagcaacauagugagacc

SEQ ID NO: 249695 - RNA, 32 nt, Human
ugcaaaagcuguggcugccaggucugggccac

SEQ ID NO: 249696 - RNA, 32 nt, Human
ugcaaaagcuguucuauaugcaaacaugaugu

SEQ ID NO: 249697 - RNA, 32 nt, Human
ugcaaaaggaaggcauuuuaauuccuuucuau

SEQ ID NO: 249698 - RNA, 18 nt, Human
ugcaaaaguaauuguggu

SEQ ID NO: 249699 - RNA, 32 nt, Human
ugcaaaauacaaaaauuagccgggcuuggugg

SEQ ID NO: 249700 - RNA, 32 nt, Human
ugcaaaaucacugcaccuuguccaacuccauu

SEQ ID NO: 249701 - RNA, 32 nt, Human
ugcaaaaucagauuaaacugcacuccaaaaca

SEQ ID NO: 249702 - RNA, 32 nt, Human
ugcaaaaucccaauggcccgguccuuuucuuu

SEQ ID NO: 249703 - RNA, 32 nt, Human
ugcaaaauggagagaauacaauaacuacuaca

SEQ ID NO: 249704 - RNA, 32 nt, Human
ugcaaaauuaacaugguagccauuguuugaau

SEQ ID NO: 249705 - RNA, 32 nt, Human
ugcaaacaaacugcuuaacaacugacaagaca

SEQ ID NO: 249706 - RNA, 32 nt, Human
ugcaaacacaggcacacacaugcacacaccca

SEQ ID NO: 249707 - RNA, 32 nt, Human
ugcaaacaccugggagguacccagaaaacagc

SEQ ID NO: 249708 - RNA, 32 nt, Human
ugcaaacauagcucauugcagcuuugaccucc

SEQ ID NO: 249709 - RNA, 32 nt, Human
ugcaaacaugggguuggcugggcccagaaggu

SEQ ID NO: 249710 - RNA, 32 nt, Human
ugcaaaccagccugggcaauagagugagaccc

SEQ ID NO: 249711 - RNA, 32 nt, Human
ugcaaaccauucugucucccagccuuucuucu

SEQ ID NO: 249712 - RNA, 32 nt, Human
ugcaaaccuaguaccugccauuuuuacuaauu

SEQ ID NO: 249713 - RNA, 32 nt, Human
ugcaaaccugcuugcugaccucaggcuuggcc

SEQ ID NO: 249714 - RNA, 32 nt, Human
ugcaaaccuuccugggaggacaggcaggccag

SEQ ID NO: 249715 - RNA, 32 nt, Human
ugcaaacgaccugcuuucuuucugaucccggg

SEQ ID NO: 249716 - RNA, 32 nt, Human
ugcaaacggggaggcagagggaggagggaagg

SEQ ID NO: 249717 - RNA, 32 nt, Human
ugcaaacucugccucccgaauucaagugauuc

SEQ ID NO: 249718 - RNA, 32 nt, Human
ugcaaacugcagcuuucacauuuauggcauuu

SEQ ID NO: 249719 - RNA, 32 nt, Human
ugcaaacuguguaaacagggccucuuauuuuu

SEQ ID NO: 249720 - RNA, 32 nt, Human
ugcaaacuuccaucccugucaugucuucaguu

SEQ ID NO: 249721 - RNA, 23 nt, Human
ugcaaagaaaguccaacauggug

SEQ ID NO: 249722 - RNA, 31 nt, Human
ugcaaagaaauuugccagucacuggaaguua

SEQ ID NO: 249723 - RNA, 32 nt, Human
ugcaaagacaaaacaauuaggucacaggauac

SEQ ID NO: 249724 - RNA, 23 nt, Human
ugcaaagagaggcacagacaugg

SEQ ID NO: 249725 - RNA, 32 nt, Human
ugcaaagauaaauaagaaaguugcuuugggca

SEQ ID NO: 249726 - RNA, 32 nt, Human
ugcaaagaugugccacuuuaucuaugaaaugg

SEQ ID NO: 249727 - RNA, 32 nt, Human
ugcaaagauguucuuccucuuccccgacccac

SEQ ID NO: 249728 - RNA, 32 nt, Human
ugcaaagauugaugguagagagcuugacuuuu

SEQ ID NO: 249729 - RNA, 32 nt, Human
ugcaaagcacccaaaccacuaacacauccaac

SEQ ID NO: 249730 - RNA, 32 nt, Human
ugcaaagcaccuggagauguuugcugggagau

SEQ ID NO: 249731 - RNA, 24 nt, Human
ugcaaagcagaaagaaaucaaaca

SEQ ID NO: 249732 - RNA, 18 nt, Human
ugcaaagcauccaggcgg

SEQ ID NO: 249733 - RNA, 32 nt, Human
ugcaaagcaucucuguagcccagauuuugugg

SEQ ID NO: 249734 - RNA, 32 nt, Human
ugcaaagcauuaugauaggcaccguggggaaa

SEQ ID NO: 249735 - RNA, 32 nt, Human
ugcaaagccacagcauuaaggagcucaauauu

SEQ ID NO: 249736 - RNA, 32 nt, Human
ugcaaagccagccaucacccuccggccagagc

SEQ ID NO: 249737 - RNA, 32 nt, Human
ugcaaagcccaauccaagacuggcauggcuca

SEQ ID NO: 249738 - RNA, 32 nt, Human
ugcaaagccugcuguuucaggcugucaggaag

SEQ ID NO: 249739 - RNA, 32 nt, Human
ugcaaagcuccucaugcuaugauaucuucuug

SEQ ID NO: 249740 - RNA, 32 nt, Human
ugcaaagcugacucaugaaaggagacaaggca

SEQ ID NO: 249741 - RNA, 32 nt, Human
ugcaaagcugggacucgucuuugaaggaaaaa

SEQ ID NO: 249742 - RNA, 32 nt, Human
ugcaaagcuguauguaguuagaugaugugaca

SEQ ID NO: 249743 - RNA, 32 nt, Human
ugcaaagcuguugccaugcuguggaagcucug

SEQ ID NO: 249744 - RNA, 32 nt, Human
ugcaaagcuucucaagugaggacagggcuacc

SEQ ID NO: 249745 - RNA, 32 nt, Human
ugcaaaggaaauggacaaaaaugagaaugaag

SEQ ID NO: 249746 - RNA, 32 nt, Human
ugcaaaggaaccagauauugugcucgcgguuc

SEQ ID NO: 249747 - RNA, 32 nt, Human
ugcaaaggacuaugcauucugaaaugcauagg

SEQ ID NO: 249748 - RNA, 32 nt, Human
ugcaaaggagaaaugaggaaaggugaagcugg

SEQ ID NO: 249749 - RNA, 32 nt, Human
ugcaaaggagacagaagaaggaagagagacgg

SEQ ID NO: 249750 - RNA, 27 nt, Human
ugcaaaggcugacagauucuguggcca

SEQ ID NO: 249751 - RNA, 32 nt, Human
ugcaaagggaaucucuugccugcuccaucuca

SEQ ID NO: 249752 - RNA, 32 nt, Human
ugcaaagggcaggugggcucggccuuucaagc

SEQ ID NO: 249753 - RNA, 32 nt, Human
ugcaaagggcccuuucaucuugaaguuuuucc

SEQ ID NO: 249754 - RNA, 32 nt, Human
ugcaaagggcuggcauucugaugcuuuucagg

SEQ ID NO: 249755 - RNA, 32 nt, Human
ugcaaaggguuggcacagggagagggagcuug

SEQ ID NO: 249756 - RNA, 32 nt, Human
ugcaaagguacugaugcuguaaagucaaaaca

SEQ ID NO: 249757 - RNA, 32 nt, Human
ugcaaaggucaggaacucucuccacugcauga

SEQ ID NO: 249758 - RNA, 32 nt, Human
ugcaaaggucugcaacuucacuucugaggcca

SEQ ID NO: 249759 - RNA, 32 nt, Human
ugcaaaguagaaggggccuggccacucauaga

SEQ ID NO: 249760 - RNA, 32 nt, Human
ugcaaaguccagaguggcauuuugcuacucug

SEQ ID NO: 249761 - RNA, 32 nt, Human
ugcaaagucucugaagagaacucucucuuccc

SEQ ID NO: 249762 - RNA, 32 nt, Human
ugcaaagucugucccuccuccuggagccucag

SEQ ID NO: 249763 - RNA, 32 nt, Human
ugcaaagugacccccuuugucacuggaaacaa

SEQ ID NO: 249764 - RNA, 32 nt, Human
ugcaaagugauccagcccuaccugucuuccca

SEQ ID NO: 249765 - RNA, 32 nt, Human
ugcaaagugcaaauacuccaagcuucaaguga

SEQ ID NO: 249766 - RNA, 31 nt, Human
ugcaaaguuggccauguuucacagggaaacu

SEQ ID NO: 249767 - RNA, 32 nt, Human
ugcaaaguuuugucuagcuuggccuccaaggc

SEQ ID NO: 249768 - RNA, 24 nt, Human
ugcaaauaagccugagaucagcuu

SEQ ID NO: 249769 - RNA, 32 nt, Human
ugcaaauaagcuccaccucccugcacuuguag

SEQ ID NO: 249770 - RNA, 32 nt, Human
ugcaaauaaguccugcauacggacccuggaac

SEQ ID NO: 249771 - RNA, 32 nt, Human
ugcaaauacacacuucuuuccccaaauaucau

SEQ ID NO: 249772 - RNA, 32 nt, Human
ugcaaauacagucgguguuucucucuaagugu

SEQ ID NO: 249773 - RNA, 32 nt, Human
ugcaaauagaaaucagcacauuccuccuacuu

SEQ ID NO: 249774 - RNA, 32 nt, Human
ugcaaauaggggauaaucagcccugcacggcc

SEQ ID NO: 249775 - RNA, 32 nt, Human
ugcaaauauagcugcauuuauaccucagaggg

SEQ ID NO: 249776 - RNA, 32 nt, Human
ugcaaauauauguacauauacauguauauaca

SEQ ID NO: 249777 - RNA, 32 nt, Human
ugcaaauaucccccacccaauaccuuugaggu

SEQ ID NO: 249778 - RNA, 32 nt, Human
ugcaaauaugaaucccugccucagguuagggu

SEQ ID NO: 249779 - RNA, 32 nt, Human
ugcaaaucaguaaacugaagcaagagaggcug

SEQ ID NO: 249780 - RNA, 32 nt, Human
ugcaaauccugcaguccauccauuugugcugu

SEQ ID NO: 249781 - RNA, 32 nt, Human
ugcaaaucuccccugugccugaucuguguguu

SEQ ID NO: 249782 - RNA, 18 nt, Human
ugcaaaugaacuugcucc

SEQ ID NO: 249783 - RNA, 32 nt, Human
ugcaaaugaaggaggaggauguccuuaagcuc

SEQ ID NO: 249784 - RNA, 32 nt, Human
ugcaaaugaaggaggaggauguccuuaaguuc

SEQ ID NO: 249785 - RNA, 32 nt, Human
ugcaaaugaggagagagaagaugagguuggac

SEQ ID NO: 249786 - RNA, 32 nt, Human
ugcaaaugagucgcuuaacccuugacaagguc

SEQ ID NO: 249787 - RNA, 32 nt, Human
ugcaaaugccaguuugacaagcacugcccaga

SEQ ID NO: 249788 - RNA, 32 nt, Human
ugcaaauggauucauguucucacuacaggcaa

SEQ ID NO: 249789 - RNA, 32 nt, Human
ugcaaaugggucagugacuggaagaggcggac

SEQ ID NO: 249790 - RNA, 32 nt, Human
ugcaaaugguucccuucuuguguccuuucaau

SEQ ID NO: 249791 - RNA, 23 nt, Human
ugcaaauuccaagguugcugcua

SEQ ID NO: 249792 - RNA, 24 nt, Human
ugcaaauucccagauuugaagaca

SEQ ID NO: 249793 - RNA, 32 nt, Human
ugcaaauugccacccuguguaccuccuccaug

SEQ ID NO: 249794 - RNA, 32 nt, Human
ugcaaauugccuucagggucucagccagaagg

SEQ ID NO: 249795 - RNA, 32 nt, Human
ugcaaauuguacacaaacaaacaaaaaggugg

SEQ ID NO: 249796 - RNA, 32 nt, Human
ugcaaauuguccuugccagcucuugggauccu

SEQ ID NO: 249797 - RNA, 21 nt, Human
ugcaaauuuccagggcuggcu

SEQ ID NO: 249798 - RNA, 22 nt, Human
ugcaaauuugauuuucuugcca

SEQ ID NO: 249799 - RNA, 32 nt, Human
ugcaacaaaacaccauggcacacauauaccua

SEQ ID NO: 249800 - RNA, 32 nt, Human
ugcaacaaaauggaugacuuaguggagaugga

SEQ ID NO: 249801 - RNA, 32 nt, Human
ugcaacaaaauguagaauauucagacaaaaug

SEQ ID NO: 249802 - RNA, 32 nt, Human
ugcaacaaaggugacucugucccuggacacug

SEQ ID NO: 249803 - RNA, 32 nt, Human
ugcaacaacagcaggcucuccaggcagcaaga

SEQ ID NO: 249804 - RNA, 32 nt, Human
ugcaacaaccaccaccuuauacaucacuuccu

SEQ ID NO: 249805 - RNA, 32 nt, Human
ugcaacaagacuagccaacaccuggccaugaa

SEQ ID NO: 249806 - RNA, 32 nt, Human
ugcaacacaaaagauuuuaucuguaaacacaa

SEQ ID NO: 249807 - RNA, 32 nt, Human
ugcaacacaacaacauggcacauguauacaua

SEQ ID NO: 249808 - RNA, 32 nt, Human
ugcaacacaggcuucagauucauguauuugaa

SEQ ID NO: 249809 - RNA, 16 nt, Human
ugcaacacucuccuca

SEQ ID NO: 249810 - RNA, 32 nt, Human
ugcaacacugccacuccagccugggugacaga

SEQ ID NO: 249811 - RNA, 32 nt, Human
ugcaacacuguacuccagccugggcaacagag

SEQ ID NO: 249812 - RNA, 32 nt, Human
ugcaacagaagggagagaagcggccccaagug

SEQ ID NO: 249813 - RNA, 32 nt, Human
ugcaacagaauagauguggccuuugcaaccag

SEQ ID NO: 249814 - RNA, 32 nt, Human
ugcaacagaguuuccauuguucagcucugugc

SEQ ID NO: 249815 - RNA, 32 nt, Human
ugcaacagcagaaaaguuucagauggaaaacc

SEQ ID NO: 249816 - RNA, 32 nt, Human
ugcaacagccuguuugggaggcuggaguggaa

SEQ ID NO: 249817 - RNA, 21 nt, Human
ugcaacaggcauugcugaggu

SEQ ID NO: 249818 - RNA, 32 nt, Human
ugcaacaggcugggcuucaguggcagcugcuu

SEQ ID NO: 249819 - RNA, 32 nt, Human
ugcaacagguccaggcugcuguggaagcugcu

SEQ ID NO: 249820 - RNA, 19 nt, Human
ugcaacagucuucuuccca

SEQ ID NO: 249821 - RNA, 32 nt, Human
ugcaacagugccugguacacaguugauccuca

SEQ ID NO: 249822 - RNA, 32 nt, Human
ugcaacaguuuuucacugagcaugucaagaaa

SEQ ID NO: 249823 - RNA, 20 nt, Human
ugcaacaucacaucucccca

SEQ ID NO: 249824 - RNA, 32 nt, Human
ugcaacaucccaauggcccuguccuuuucuuu

SEQ ID NO: 249825 - RNA, 32 nt, Human
ugcaacauccuucaagacaccaugaagcucca

SEQ ID NO: 249826 - RNA, 24 nt, Human
ugcaacaucugccucccggguuca

SEQ ID NO: 249827 - RNA, 31 nt, Human
ugcaacauggccaggggcugccucugcugcu

SEQ ID NO: 249828 - RNA, 21 nt, Human
ugcaacauuacugcacaccaa

SEQ ID NO: 249829 - RNA, 25 nt, Human
ugcaaccaaccugcggucucggucc

SEQ ID NO: 249830 - RNA, 32 nt, Human
ugcaaccacucucuauuacauuucucaacacc

SEQ ID NO: 249831 - RNA, 24 nt, Human
ugcaaccacugccucccaggcuca

SEQ ID NO: 249832 - RNA, 32 nt, Human
ugcaaccagcucuccgugaaucauuuccauuc

SEQ ID NO: 249833 - RNA, 26 nt, Human
ugcaaccagucccagauauugugcca

SEQ ID NO: 249834 - RNA, 28 nt, Human
ugcaacccaaguggccuuauccgugcag

SEQ ID NO: 249835 - RNA, 32 nt, Human
ugcaacccaaguggccuuauccgugcaguggu

SEQ ID NO: 249836 - RNA, 32 nt, Human
ugcaaccccagcuccacuccagccuggcgucc

SEQ ID NO: 249837 - RNA, 24 nt, Human
ugcaacccccaccucccagguuca

SEQ ID NO: 249838 - RNA, 24 nt, Human
ugcaacccccaucucccagguuca

SEQ ID NO: 249839 - RNA, 24 nt, Human
ugcaacccccgccucccggguuca

SEQ ID NO: 249840 - RNA, 24 nt, Human
ugcaacccccgucucccggguuca

SEQ ID NO: 249841 - RNA, 23 nt, Human
ugcaaccccgccucccagguuca

SEQ ID NO: 249842 - RNA, 32 nt, Human
ugcaacccugcaaccucugccuaccggguuca

SEQ ID NO: 249843 - RNA, 32 nt, Human
ugcaacccugcucuaugcugacccuugucacu

SEQ ID NO: 249844 - RNA, 32 nt, Human
ugcaaccgcuggugagggcagcgaccuuuggg

SEQ ID NO: 249845 - RNA, 24 nt, Human
ugcaaccucaaacuccugggcuca

SEQ ID NO: 249846 - RNA, 32 nt, Human
ugcaaccucaaaggagcaagccuugaaacagu

SEQ ID NO: 249847 - RNA, 24 nt, Human
ugcaaccucaaauuccugggcuca

SEQ ID NO: 249848 - RNA, 22 nt, Human
ugcaaccucaauccugggcuca

SEQ ID NO: 249849 - RNA, 23 nt, Human
ugcaaccucaccucccggguuca

SEQ ID NO: 249850 - RNA, 24 nt, Human
ugcaaccucagccucccagguuca

SEQ ID NO: 249851 - RNA, 24 nt, Human
ugcaaccucagccuccugggcuca

SEQ ID NO: 249852 - RNA, 24 nt, Human
ugcaaccuccacauccuggguuca

SEQ ID NO: 249853 - RNA, 23 nt, Human
ugcaaccuccacccauggguuca

SEQ ID NO: 249854 - RNA, 24 nt, Human
ugcaaccuccaccccccagguuca

SEQ ID NO: 249855 - RNA, 24 nt, Human
ugcaaccuccacccccggggauca

SEQ ID NO: 249856 - RNA, 23 nt, Human
ugcaaccuccacccccugaguuc

SEQ ID NO: 249857 - RNA, 24 nt, Human
ugcaaccuccacccgccggguuca

SEQ ID NO: 249858 - RNA, 24 nt, Human
ugcaaccuccacccugcagguuca

SEQ ID NO: 249859 - RNA, 24 nt, Human
ugcaaccuccaccucacagguuca

SEQ ID NO: 249860 - RNA, 24 nt, Human
ugcaaccuccaccuccaggguuca

SEQ ID NO: 249861 - RNA, 23 nt, Human
ugcaaccuccaccuccagguuca

SEQ ID NO: 249862 - RNA, 24 nt, Human
ugcaaccuccaccucccagacuca

SEQ ID NO: 249863 - RNA, 24 nt, Human
ugcaaccuccaccucccaggauca

SEQ ID NO: 249864 - RNA, 27 nt, Human
ugcauacccucaucaaaaacacucuca

SEQ ID NO: 249865 - RNA, 21 nt, Human
ugcauacccuccuccugcuuc

SEQ ID NO: 249866 - RNA, 32 nt, Human
ugcauaccuccagggacagagagcuuacuacc

SEQ ID NO: 249867 - RNA, 32 nt, Human
ugcauacgcuguuuucuccaccugccacguuc

SEQ ID NO: 249868 - RNA, 32 nt, Human
ugcauacucuugggaagcagcuuccugggaga

SEQ ID NO: 249869 - RNA, 32 nt, Human
ugcauacuguccaaagauuaggguugguggug

SEQ ID NO: 249870 - RNA, 32 nt, Human
ugcauacuguugaaguugagugcuguuuugcu

SEQ ID NO: 249871 - RNA, 32 nt, Human
ugcauacuuccuuugugcgcccaguguugugu

SEQ ID NO: 249872 - RNA, 32 nt, Human
ugcauagacuuauacccagcccugcacuguua

SEQ ID NO: 249873 - RNA, 32 nt, Human
ugcauagaguccguggcuuacagugagaacuu

SEQ ID NO: 249874 - RNA, 32 nt, Human
ugcauagcaccucuuuucauggaguagaguca

SEQ ID NO: 249875 - RNA, 32 nt, Human
ugcauagcagcgagagagucacuguuaccaca

SEQ ID NO: 249876 - RNA, 32 nt, Human
ugcauagcccuucucuauguaagcagccaugg

SEQ ID NO: 249877 - RNA, 16 nt, Human
ugcauaggaauggcca

SEQ ID NO: 249878 - RNA, 32 nt, Human
ugcauaggagugaaugagacagaaagcaagac

SEQ ID NO: 249879 - RNA, 23 nt, Human
ugcauaggcacaagugggccagg

SEQ ID NO: 249880 - RNA, 32 nt, Human
ugcauaggcuccuuccuguggguggggcuucu

SEQ ID NO: 249881 - RNA, 32 nt, Human
ugcauaggugaucucauuuaauccucucaacc

SEQ ID NO: 249882 - RNA, 32 nt, Human
ugcauaguagcuaaggccuggcuguagcaguu

SEQ ID NO: 249883 - RNA, 32 nt, Human
ugcauauacacacaugcauacaugagccucca

SEQ ID NO: 249884 - RNA, 32 nt, Human
ugcauauacuauauacagccaguaaauacaug

SEQ ID NO: 249885 - RNA, 32 nt, Human
ugcauauaucauugaacacacauaccagagau

SEQ ID NO: 249886 - RNA, 32 nt, Human
ugcauaugaaaauguccauuucuggugugugc

SEQ ID NO: 249887 - RNA, 32 nt, Human
ugcauaugccaaggaaaugucacuaaucccaa

SEQ ID NO: 249888 - RNA, 32 nt, Human
ugcauaugcuucuguuucaucuacuugggcau

SEQ ID NO: 249889 - RNA, 32 nt, Human
ugcauauggaaagauugugaaagagugugucu

SEQ ID NO: 249890 - RNA, 32 nt, Human
ugcauauggagguaggcugaaaagaauguaau

SEQ ID NO: 249891 - RNA, 23 nt, Human
ugcauaugucgaaagagcuggcu

SEQ ID NO: 249892 - RNA, 32 nt, Human
ugcauaugugaaagagaaugaugcauuaacug

SEQ ID NO: 249893 - RNA, 16 nt, Human
ugcauauuaccuacuc

SEQ ID NO: 249894 - RNA, 32 nt, Human
ugcauauuacucugccuaaucuugugcauguu

SEQ ID NO: 249895 - RNA, 32 nt, Human
ugcauauucacacauggucaacugggacaugu

SEQ ID NO: 249896 - RNA, 18 nt, Human
ugcauauucagggugcuc

SEQ ID NO: 249897 - RNA, 19 nt, Human
ugcauauucauccugcuuc

SEQ ID NO: 249898 - RNA, 17 nt, Human
ugcauauuccaugacuc

SEQ ID NO: 249899 - RNA, 18 nt, Human
ugcauauucucauguucc

SEQ ID NO: 249900 - RNA, 20 nt, Human
ugcauauucuccuuucaucc

SEQ ID NO: 249901 - RNA, 20 nt, Human
ugcauauucugcugagcuuc

SEQ ID NO: 249902 - RNA, 21 nt, Human
ugcauauuguuuaucugcucu

SEQ ID NO: 249903 - RNA, 32 nt, Human
ugcauauuuauaggugugucucugugcaugug

SEQ ID NO: 249904 - RNA, 32 nt, Human
ugcauauuuauauaaucucugacuuguaaugg

SEQ ID NO: 249905 - RNA, 20 nt, Human
ugcauauuuauguccucucc

SEQ ID NO: 249906 - RNA, 17 nt, Human
ugcauauuucaaugucc

SEQ ID NO: 249907 - RNA, 18 nt, Human
ugcauauuucauucccca

SEQ ID NO: 249908 - RNA, 32 nt, Human
ugcauauuucauugaauaaaaaugccaaagcu

SEQ ID NO: 249909 - RNA, 20 nt, Human
ugcauauuuguuacugcugc

SEQ ID NO: 249910 - RNA, 19 nt, Human
ugcauauuuguuucgcucu

SEQ ID NO: 249911 - RNA, 32 nt, Human
ugcaucaacuccauucaacaccuacugugugc

SEQ ID NO: 249912 - RNA, 32 nt, Human
ugcaucaaguuuaugaauaaagaaccauuuaa

SEQ ID NO: 249913 - RNA, 32 nt, Human
ugcaucaauggagcacauacagggagcuugga

SEQ ID NO: 249914 - RNA, 32 nt, Human
ugcaucacaaaugacagacagugcagagauuu

SEQ ID NO: 249915 - RNA, 32 nt, Human
ugcaucacaccuguaaucccagcacuuuggga

SEQ ID NO: 249916 - RNA, 32 nt, Human
ugcaucacaugucagcauacuggagcauagug

SEQ ID NO: 249917 - RNA, 32 nt, Human
ugcaucaccauaugugggugguggaggaaccg

SEQ ID NO: 249918 - RNA, 32 nt, Human
ugcaucaccucugcuuuccuccacugccauca

SEQ ID NO: 249919 - RNA, 32 nt, Human
ugcaucaccucuggccucucaucccccacucu

SEQ ID NO: 249920 - RNA, 20 nt, Human
ugcaucaccucugggccaag

SEQ ID NO: 249921 - RNA, 32 nt, Human
ugcaucacuccccuccucucccuuccugugug

SEQ ID NO: 249922 - RNA, 32 nt, Human
ugcaucacucucccuucugccuccuucaacuu

SEQ ID NO: 249923 - RNA, 32 nt, Human
ugcaucacugcacuccaaccugggcaacagag

SEQ ID NO: 249924 - RNA, 32 nt, Human
ugcaucacugcacuccagccugggcaacacag

SEQ ID NO: 249925 - RNA, 32 nt, Human
ugcaucacugcacuccagccugggcaacagag

SEQ ID NO: 249926 - RNA, 32 nt, Human
ugcaucacugcacuccagccugggcagcagag

SEQ ID NO: 249927 - RNA, 32 nt, Human
ugcaucacugcacuccagccugggcgauggag

SEQ ID NO: 249928 - RNA, 32 nt, Human
ugcaucacugcacuccagccugggugacagag

SEQ ID NO: 249929 - RNA, 32 nt, Human
ugcaucacugcacuccagcuugggugacagag

SEQ ID NO: 249930 - RNA, 32 nt, Human
ugcaucacugcacugcagccugggcaacauag

SEQ ID NO: 249931 - RNA, 17 nt, Human
ugcaucagaccuguucc

SEQ ID NO: 249932 - RNA, 32 nt, Human
ugcaucagcccaaacucacuggcguuguguuu

SEQ ID NO: 249933 - RNA, 32 nt, Human
ugcaucagccucucaaguagcugggacuacag

SEQ ID NO: 249934 - RNA, 32 nt, Human
ugcaucagccuucaagguuccugcaccuaaaa

SEQ ID NO: 249935 - RNA, 32 nt, Human
ugcaucaggaggucuggggcggugacacgauu

SEQ ID NO: 249936 - RNA, 32 nt, Human
ugcaucagggaacaggaggaggaagaggguca

SEQ ID NO: 249937 - RNA, 32 nt, Human
ugcaucagggcaggacggggucucagcccacc

SEQ ID NO: 249938 - RNA, 32 nt, Human
ugcaucauaccugcaagccaacaguucagugu

SEQ ID NO: 249939 - RNA, 22 nt, Human
ugcaucauagcccacuuucucc

SEQ ID NO: 249940 - RNA, 32 nt, Human
ugcaucaucccccagccagguccccaccaggc

SEQ ID NO: 249941 - RNA, 25 nt, Human
ugcaucauccuucugcuuguuuaca

SEQ ID NO: 249942 - RNA, 32 nt, Human
ugcaucaucuuugucaccuccacccccauaaa

SEQ ID NO: 249943 - RNA, 32 nt, Human
ugcaucauugcacuccagccugggcaacaaga

SEQ ID NO: 249944 - RNA, 32 nt, Human
ugcaucauugcacuccagccugggcaacagag

SEQ ID NO: 249945 - RNA, 32 nt, Human
ugcaucauugcacuccagccugggugacagag

SEQ ID NO: 249946 - RNA, 32 nt, Human
ugcauccaaucagaugauacaggauuuugauu

SEQ ID NO: 249947 - RNA, 24 nt, Human
ugcauccacccaggcccccgaccc

SEQ ID NO: 249948 - RNA, 32 nt, Human
ugcauccaccucugaagguacaucccagcuuc

SEQ ID NO: 249949 - RNA, 32 nt, Human
ugcauccagagaccugcccuucuaccuuccuc

SEQ ID NO: 249950 - RNA, 32 nt, Human
ugcauccagagaugccucccucaggggugugg

SEQ ID NO: 249951 - RNA, 23 nt, Human
ugcauccagcucccggguucuca

SEQ ID NO: 249952 - RNA, 32 nt, Human
ugcauccagcuggggaguacagccccuuccgc

SEQ ID NO: 249953 - RNA, 32 nt, Human
ugcauccaggagauagaaguugcagugagcug

SEQ ID NO: 249954 - RNA, 32 nt, Human
ugcauccaggagauggaaguugcugugagcug

SEQ ID NO: 249955 - RNA, 23 nt, Human
ugcauccauuccucagggacaga

SEQ ID NO: 249956 - RNA, 32 nt, Human
ugcaucccaaagaaggcgcagaacagcacgug

SEQ ID NO: 249957 - RNA, 32 nt, Human
ugcaucccagcccuucaggaagccugugaaaa

SEQ ID NO: 249958 - RNA, 32 nt, Human
ugcaucccuauaaacccaucauaaagucaaaa

SEQ ID NO: 249959 - RNA, 32 nt, Human
ugcaucccuccaccccaguaucccugcaccuc

SEQ ID NO: 249960 - RNA, 32 nt, Human
ugcaucccucccccacuggagugauuucagug

SEQ ID NO: 249961 - RNA, 32 nt, Human
ugcaucccuccccuguccaccuuuguccagug

SEQ ID NO: 249962 - RNA, 22 nt, Human
ugcauccgcuaaaaauguuaaa

SEQ ID NO: 249963 - RNA, 32 nt, Human
ugcauccggcuuuccaccuuaaacugguuucu

SEQ ID NO: 249964 - RNA, 32 nt, Human
ugcauccguccaaguucacugccuuuauuuuc

SEQ ID NO: 249965 - RNA, 22 nt, Human
ugcauccguguugguucuuuua

SEQ ID NO: 249966 - RNA, 32 nt, Human
ugcauccucauagcuuagcucccacuuaaaag

SEQ ID NO: 249967 - RNA, 24 nt, Human
ugcauccuccaccuccuggguuca

SEQ ID NO: 249968 - RNA, 32 nt, Human
ugcauccuggaggugaagguugcagugagcca

SEQ ID NO: 249969 - RNA, 32 nt, Human
ugcauccuguaaucauagcuacuugggagguu

SEQ ID NO: 249970 - RNA, 32 nt, Human
ugcaucgagcccugggccucaggcuucaaugu

SEQ ID NO: 249971 - RNA, 32 nt, Human
ugcaucgcccacccugcgguccugauuucagc

SEQ ID NO: 249972 - RNA, 32 nt, Human
ugcaucgcggagccucgacuccggacacgcgc

SEQ ID NO: 249973 - RNA, 21 nt, Human
ugcaucggaaaguggcuguga

SEQ ID NO: 249974 - RNA, 18 nt, Human
ugcaucggccugccugug

SEQ ID NO: 249975 - RNA, 32 nt, Human
ugcaucgguugcagauacaauagaagaaaaau

SEQ ID NO: 249976 - RNA, 32 nt, Human
ugcaucuaccuccucuuccuccaucuuuggcu

SEQ ID NO: 249977 - RNA, 32 nt, Human
ugcaucuaccuucccccaguucaucaaagccu

SEQ ID NO: 249978 - RNA, 32 nt, Human
ugcaucuaccuuuaucccugacugccuugaag

SEQ ID NO: 249979 - RNA, 32 nt, Human
ugcaucuauagucccugcuauuugagaggcug

SEQ ID NO: 249980 - RNA, 32 nt, Human
ugcaucuaucucuucgcucugucuuccacaaa

SEQ ID NO: 249981 - RNA, 32 nt, Human
ugcaucucacuggagacugaacacuagucccu

SEQ ID NO: 249982 - RNA, 32 nt, Human
ugcaucucaguguuaaggggugcagucucccc

SEQ ID NO: 249983 - RNA, 32 nt, Human
ugcaucucauuuuuauagagcuacucauccuu

SEQ ID NO: 249984 - RNA, 18 nt, Human
ugcaucuccaccugcucc

SEQ ID NO: 249985 - RNA, 32 nt, Human
ugcaucucccagaagggaugagucuuuguccc

SEQ ID NO: 249986 - RNA, 32 nt, Human
ugcaucuccucccaggauuccacaacaaaauu

SEQ ID NO: 249987 - RNA, 32 nt, Human
ugcaucuccugggguguguccucgucuguccc

SEQ ID NO: 249988 - RNA, 32 nt, Human
ugcaucuccuucuccucucugccugccuccuc

SEQ ID NO: 249989 - RNA, 32 nt, Human
ugcaucugaaucugcaugauuuccaaacccug

SEQ ID NO: 249990 - RNA, 32 nt, Human
ugcaucugacucugaaaguuccucccucucgc

SEQ ID NO: 249991 - RNA, 32 nt, Human
ugcaucugaggcggacgccgcaguguagggca

SEQ ID NO: 249992 - RNA, 32 nt, Human
ugcaucugcacccagggucccagccuggccac

SEQ ID NO: 249993 - RNA, 32 nt, Human
ugcaucugcaccugacuuuggggccacgugcc

SEQ ID NO: 249994 - RNA, 32 nt, Human
ugcaucugcacugucaccaugugcccagagcc

SEQ ID NO: 249995 - RNA, 32 nt, Human
ugcaucugccacugcuuuuauaaauggcucug

SEQ ID NO: 249996 - RNA, 32 nt, Human
ugcaucugcccacgauggcagugcagucauca

SEQ ID NO: 249997 - RNA, 32 nt, Human
ugcaucugccccaacccauccagccugcaugu

SEQ ID NO: 249998 - RNA, 32 nt, Human
ugcaucuggaacacacuuguccucagcuuacc

SEQ ID NO: 249999 - RNA, 32 nt, Human
ugcaucugggaggugguaggccacaguccuga

SEQ ID NO: 250000 - RNA, 32 nt, Human
ugcaucugguucugaaaaaguauagcauguag

SEQ ID NO: 250001 - RNA, 32 nt, Human
ugcaucuguaaucccagcuacuugggaggcug

SEQ ID NO: 250002 - RNA, 32 nt, Human
ugcaucuguagucccaccuauucaggagauua

SEQ ID NO: 250003 - RNA, 32 nt, Human
ugcaucuguagucccagcuacucgggaggcug

SEQ ID NO: 250004 - RNA, 32 nt, Human
ugcaucuguagucccagcuacuugggaggcug

SEQ ID NO: 250005 - RNA, 32 nt, Human
ugcaucugugccaggcugaccugccccaugcc

SEQ ID NO: 250006 - RNA, 32 nt, Human
ugcaucuguggauagaacgccacccagccgcc

SEQ ID NO: 250007 - RNA, 32 nt, Human
ugcaucuguugggccucacaaggaccagggcc

SEQ ID NO: 250008 - RNA, 32 nt, Human
ugcaucuuaauucaauauaaagccugacaaua

SEQ ID NO: 250009 - RNA, 32 nt, Human
ugcaucuuccucuccuuucccaaggcauccuc

SEQ ID NO: 250010 - RNA, 31 nt, Human
ugcaucuuccucucuggguuucaguuuuccu

SEQ ID NO: 250011 - RNA, 32 nt, Human
ugcaucuucugggcccuucucuccuuuaggcc

SEQ ID NO: 250012 - RNA, 32 nt, Human
ugcaucuuucuuucucuuugguuccugcacau

SEQ ID NO: 250013 - RNA, 32 nt, Human
ugcaucuuugcaggaagguucucuccauguga

SEQ ID NO: 250014 - RNA, 32 nt, Human
ugcaucuuuuuaucuucugguuucuagggaua

SEQ ID NO: 250015 - RNA, 18 nt, Human
ugcaugaaagcucuaccc

SEQ ID NO: 250016 - RNA, 32 nt, Human
ugcaugaccccuucaugaauaaucauguaaaa

SEQ ID NO: 250017 - RNA, 28 nt, Human
ugcaugacccuccggcggcgcggggaga

SEQ ID NO: 250018 - RNA, 32 nt, Human
ugcaugagacacacaccuacccuccccagcuu

SEQ ID NO: 250019 - RNA, 32 nt, Human
ugcaugagagguuacccuucaggaugacagag

SEQ ID NO: 250020 - RNA, 32 nt, Human
ugcaugagcaaggaguugggagguugcuuacu

SEQ ID NO: 250021 - RNA, 32 nt, Human
ugcaugagccacugugcugggcuucauuuaca

SEQ ID NO: 250022 - RNA, 32 nt, Human
ugcaugagcucuccuucccagagaccaacucu

SEQ ID NO: 250023 - RNA, 32 nt, Human
ugcaugaggcucauggaccagcucugauccca

SEQ ID NO: 250024 - RNA, 32 nt, Human
ugcaugaugccucugaauucaggaauugcagg

SEQ ID NO: 250025 - RNA, 32 nt, Human
ugcaugauucacacccagucccugccacagac

SEQ ID NO: 250026 - RNA, 32 nt, Human
ugcaugauugccuuuuucucuucuuuuuaaaa

SEQ ID NO: 250027 - RNA, 32 nt, Human
ugcaugauuuuuaaaagcaguacuccuaggga

SEQ ID NO: 250028 - RNA, 32 nt, Human
ugcaugcacaccuuccuccacccuccacccug

SEQ ID NO: 250029 - RNA, 32 nt, Human
ugcaugcagagaggaggagguggagcaggagu

SEQ ID NO: 250030 - RNA, 32 nt, Human
ugcaugcagccccagcaggcugcguguuuaag

SEQ ID NO: 250031 - RNA, 32 nt, Human
ugcaugcagucaggcuggcaguggcgcgguac

SEQ ID NO: 250032 - RNA, 32 nt, Human
ugcaugcaugugacuugcuucuuuuugcauug

SEQ ID NO: 250033 - RNA, 32 nt, Human
ugcaugcauucacacacacauauguacaugca

SEQ ID NO: 250034 - RNA, 32 nt, Human
ugcaugcauugagcugccuccagccugguggc

SEQ ID NO: 250035 - RNA, 32 nt, Human
ugcaugccagagacuucaguuucugcucugca

SEQ ID NO: 250036 - RNA, 21 nt, Human
ugcaugccagcccacugcuca

SEQ ID NO: 250037 - RNA, 32 nt, Human
ugcaugccagccugggcaacaagagugaaacu

SEQ ID NO: 250038 - RNA, 20 nt, Human
ugcaugccaggugggccgag

SEQ ID NO: 250039 - RNA, 32 nt, Human
ugcaugcccaggagcacaggagugccugccuu

SEQ ID NO: 250040 - RNA, 32 nt, Human
ugcaugcccaggcuugugagccaaggugcuuu

SEQ ID NO: 250041 - RNA, 19 nt, Human
ugcaugcccuccccacuuc

SEQ ID NO: 250042 - RNA, 32 nt, Human
ugcaugccggcuugagacuggagccccgcggu

SEQ ID NO: 250043 - RNA, 32 nt, Human
ugcaugccuaucuccucaucucccccucccuu

SEQ ID NO: 250044 - RNA, 32 nt, Human
ugcaugccuguaauccagcuacuugggaggcu

SEQ ID NO: 250045 - RNA, 32 nt, Human
ugcaugccuguaaucccagcauuuugggaggc

SEQ ID NO: 250046 - RNA, 32 nt, Human
ugcaugccuguaaucccagcuacucuggaggc

SEQ ID NO: 250047 - RNA, 32 nt, Human
ugcaugccuguaaucccagcuacuuggaaggc

SEQ ID NO: 250048 - RNA, 32 nt, Human
ugcaugccuguaaucccagcuacuugggaggc

SEQ ID NO: 250049 - RNA, 32 nt, Human
ugcaugccuguaaucccagcugcuugggaggc

SEQ ID NO: 250050 - RNA, 32 nt, Human
ugcaugccuguaaucccugcuacuugggagac

SEQ ID NO: 250051 - RNA, 32 nt, Human
ugcaugccuguaauccuagcuacucaggagcc

SEQ ID NO: 250052 - RNA, 32 nt, Human
ugcaugccuguaauccuagcuacucgggaggc

SEQ ID NO: 250053 - RNA, 32 nt, Human
ugcaugccuguaauccuagcugcuugggugcu

SEQ ID NO: 250054 - RNA, 32 nt, Human
ugcaugccuguaaucucagcuacuugggaggc

SEQ ID NO: 250055 - RNA, 32 nt, Human
ugcaugccuguaucccagcuacuugggaggcu

SEQ ID NO: 250056 - RNA, 32 nt, Human
ugcaugccuguauuccaggugcucaggaggcu

SEQ ID NO: 250057 - RNA, 32 nt, Human
ugcaugccugugauccuagcugcuggggaggc

SEQ ID NO: 250058 - RNA, 32 nt, Human
ugcaugccuuucccaggcucuccccaggcgga

SEQ ID NO: 250059 - RNA, 32 nt, Human
ugcaugcuacauauguguacgcucagaccaca

SEQ ID NO: 250060 - RNA, 22 nt, Human
ugcaugcuacuguucucuuuca

SEQ ID NO: 250061 - RNA, 32 nt, Human
ugcaugcuauuccauuuugcagccagaccgau

SEQ ID NO: 250062 - RNA, 32 nt, Human
ugcaugcugccgucauggaauguggcccacag

SEQ ID NO: 250063 - RNA, 32 nt, Human
ugcaugcugggagggaggaugugugcauuuug

SEQ ID NO: 250064 - RNA, 32 nt, Human
ugcaugcuuguaaucccagcuacuugggaggc

SEQ ID NO: 250065 - RNA, 32 nt, Human
ugcauggaaagggagccugggagccagcagcc

SEQ ID NO: 250066 - RNA, 32 nt, Human
ugcauggaacaugcuuaaucuaaacaaugauu

SEQ ID NO: 250067 - RNA, 32 nt, Human
ugcauggaagaaacaguaaucggauggcuacc

SEQ ID NO: 250068 - RNA, 17 nt, Human
ugcauggacaccugcuc

SEQ ID NO: 250069 - RNA, 18 nt, Human
ugcauggacccggugcaa

SEQ ID NO: 250070 - RNA, 32 nt, Human
ugcauggacucugcccucagggugccugucca

SEQ ID NO: 250071 - RNA, 21 nt, Human
ugcauggacugugaaaccuca

SEQ ID NO: 250072 - RNA, 32 nt, Human
ugcauggagagggaaacaugagcaugcagcag

SEQ ID NO: 250073 - RNA, 32 nt, Human
ugcauggagcuucucauuugucuucaggauuc

SEQ ID NO: 250074 - RNA, 19 nt, Human
ugcauggaucugggucaag

SEQ ID NO: 250075 - RNA, 17 nt, Human
ugcauggcaccugcucu

SEQ ID NO: 250076 - RNA, 32 nt, Human
ugcauggccaaguucaguguuuacagauaaaa

SEQ ID NO: 250077 - RNA, 32 nt, Human
ugcauggccacagccaccuccacccccaagaa

SEQ ID NO: 250078 - RNA, 32 nt, Human
ugcauggccaggcagagucagcagcugcagug

SEQ ID NO: 250079 - RNA, 17 nt, Human
ugcauggccaucucccc

SEQ ID NO: 250080 - RNA, 32 nt, Human
ugcauggccaucucccccucccuuuuuccuuc

SEQ ID NO: 250081 - RNA, 32 nt, Human
ugcauggcugcacucuagccugggugacagug

SEQ ID NO: 250082 - RNA, 28 nt, Human
ugcauggcuggguggggacugguggaug

SEQ ID NO: 250083 - RNA, 32 nt, Human
ugcaugggaggaauucaucuucagucuaccag

SEQ ID NO: 250084 - RNA, 32 nt, Human
ugcaugggaucuggugccccucuucuccugga

SEQ ID NO: 250085 - RNA, 32 nt, Human
ugcaugggcauggugaccccaguuuugcccgu

SEQ ID NO: 250086 - RNA, 32 nt, Human
ugcaugggcugagucccugggcucagaccuag

SEQ ID NO: 250087 - RNA, 32 nt, Human
ugcauggggaggcggcggcagcggguggaccc

SEQ ID NO: 250088 - RNA, 32 nt, Human
ugcauggggccccucccuucuuccacacccac

SEQ ID NO: 250089 - RNA, 32 nt, Human
ugcaugggggccugagggccuguggguuugau

SEQ ID NO: 250090 - RNA, 32 nt, Human
ugcaugggguggagaacagggaaggagaaaaa

SEQ ID NO: 250091 - RNA, 32 nt, Human
ugcaugggguggucuuuauuuuucccuuucaa

SEQ ID NO: 250092 - RNA, 32 nt, Human
ugcaugggugcagaggauggaggcugagaaag

SEQ ID NO: 250093 - RNA, 32 nt, Human
ugcaugguacuccaaggagaaaaguuucuauu

SEQ ID NO: 250094 - RNA, 32 nt, Human
ugcauggucaaguggugcuaacccaagacugu

SEQ ID NO: 250095 - RNA, 18 nt, Human
ugcauguaccuacugcuc

SEQ ID NO: 250096 - RNA, 32 nt, Human
ugcauguaguugacgaaaacaaaaaugaaucc

SEQ ID NO: 250097 - RNA, 32 nt, Human
ugcauguaguuggguauaauuuuuauccaguc

SEQ ID NO: 250098 - RNA, 32 nt, Human
ugcauguaguugucacuugcagcuccauuucc

SEQ ID NO: 250099 - RNA, 32 nt, Human
ugcauguauacaaacgaauagcagauaaugau

SEQ ID NO: 250100 - RNA, 18 nt, Human
ugcauguauaccugcacc

SEQ ID NO: 250101 - RNA, 32 nt, Human
ugcauguaugucuuugucucucuugucuaaua

SEQ ID NO: 250102 - RNA, 32 nt, Human
ugcaugucaaaucacauugaagccugaagauu

SEQ ID NO: 250103 - RNA, 32 nt, Human
ugcaugucaguaguugguucuuuuuauugcug

SEQ ID NO: 250104 - RNA, 32 nt, Human
ugcaugucccccacccuccacagucuuccuug

SEQ ID NO: 250105 - RNA, 18 nt, Human
ugcauguccuucucccca

SEQ ID NO: 250106 - RNA, 32 nt, Human
ugcaugucucucucacccccauguccaaucag

SEQ ID NO: 250107 - RNA, 32 nt, Human
ugcaugugacggggugggagggggagguuucu

SEQ ID NO: 250108 - RNA, 24 nt, Human
ugcaugugcagccgccgccgccac

SEQ ID NO: 250109 - RNA, 32 nt, Human
ugcaugugccuguaaucccagcuacucaggag

SEQ ID NO: 250110 - RNA, 32 nt, Human
ugcaugugcuacugcugcuacaggccugucua

SEQ ID NO: 250111 - RNA, 32 nt, Human
ugcaugugcucaugugaacacacacgugcguc

SEQ ID NO: 250112 - RNA, 31 nt, Human
ugcauguggacaauacucugagaacaugucu

SEQ ID NO: 250113 - RNA, 32 nt, Human
ugcauguggcccaggacaguuuugaaugcagu

SEQ ID NO: 250114 - RNA, 32 nt, Human
ugcauguggcuuggcaaugucacagacagcaa

SEQ ID NO: 250115 - RNA, 32 nt, Human
ugcaugugggaagggagcaggagggccuggcu

SEQ ID NO: 250116 - RNA, 32 nt, Human
ugcauguggguagaggauguacugggacuugg

SEQ ID NO: 250117 - RNA, 32 nt, Human
ugcaugugggugggggagagcauauuggcuau

SEQ ID NO: 250118 - RNA, 32 nt, Human
ugcauguguagccugugcauguaugucuugga

SEQ ID NO: 250119 - RNA, 29 nt, Human
ugcaugugucuguguguguggaacuuuug

SEQ ID NO: 250120 - RNA, 32 nt, Human
ugcaugugucuguguguguggaacuuuuguac

SEQ ID NO: 250121 - RNA, 32 nt, Human
ugcauguguuggugcugaccuccaggccgaga

SEQ ID NO: 250122 - RNA, 32 nt, Human
ugcauguuaguccacagaguugcccagaaccc

SEQ ID NO: 250123 - RNA, 16 nt, Human
ugcauguucacugccc

SEQ ID NO: 250124 - RNA, 32 nt, Human
ugcauguuccuguuucagccucugccuuucca

SEQ ID NO: 250125 - RNA, 32 nt, Human
ugcauguuccuuggacaccugccucagugugc

SEQ ID NO: 250126 - RNA, 32 nt, Human
ugcauguucuauagagggccagagagugaaua

SEQ ID NO: 250127 - RNA, 32 nt, Human
ugcauguuuagucccagcuacacagcagggag

SEQ ID NO: 250128 - RNA, 32 nt, Human
ugcauguuugugugugcgugcauauguguaug

SEQ ID NO: 250129 - RNA, 32 nt, Human
ugcauuaaaauggguuucacugugaaugcgug

SEQ ID NO: 250130 - RNA, 32 nt, Human
ugcauuaagcuugaaacaugaggcagagaaag

SEQ ID NO: 250131 - RNA, 32 nt, Human
ugcauuacgcucggaacacauucuccaggggc

SEQ ID NO: 250132 - RNA, 32 nt, Human
ugcauuacuguaugucuucugccuccacacuu

SEQ ID NO: 250133 - RNA, 32 nt, Human
ugcauuagauaggauccucacaucccauucag

SEQ ID NO: 250134 - RNA, 32 nt, Human
ugcauuaucugaggucacagggccuggggaga

SEQ ID NO: 250135 - RNA, 32 nt, Human
ugcauuauuuuuaacaaaugguauuggcuuaa

SEQ ID NO: 250136 - RNA, 32 nt, Human
ugcauucaacaaacacuuaugagugccuggag

SEQ ID NO: 250137 - RNA, 32 nt, Human
ugcauucaccaccuuuuaaauuuuggucacug

SEQ ID NO: 250138 - RNA, 32 nt, Human
ugcauucaccuaggccaagaaacaguguugua

SEQ ID NO: 250139 - RNA, 32 nt, Human
ugcauucaucacuuuaaacaucauguuucagg

SEQ ID NO: 250140 - RNA, 32 nt, Human
ugcauucauccagcucaccccagcaaggacgg

SEQ ID NO: 250141 - RNA, 32 nt, Human
ugcauucauccccuccuccucaucucucccuu

SEQ ID NO: 250142 - RNA, 32 nt, Human
ugcauuccaccacauauccacccuugagaagu

SEQ ID NO: 250143 - RNA, 32 nt, Human
ugcauuccagagaugcacuccgcucuggaacu

SEQ ID NO: 250144 - RNA, 32 nt, Human
ugcauuccagccugagcaacagagcaagacac

SEQ ID NO: 250145 - RNA, 32 nt, Human
ugcauuccagccugagcgacagaguaagacuc

SEQ ID NO: 250146 - RNA, 32 nt, Human
ugcauuccagccuggauaauagagugagaccc

SEQ ID NO: 250147 - RNA, 32 nt, Human
ugcauuccagccuggcgacagagugagacucc

SEQ ID NO: 250148 - RNA, 32 nt, Human
ugcauuccagccugggcaacaagagugaaacu

SEQ ID NO: 250149 - RNA, 32 nt, Human
ugcauuccagccugggcaacagagcaagaccc

SEQ ID NO: 250150 - RNA, 32 nt, Human
ugcauuccagccugggcaacagagcaagaccu

SEQ ID NO: 250151 - RNA, 32 nt, Human
ugcauuccagccugggcaacagagcaagacug

SEQ ID NO: 250152 - RNA, 32 nt, Human
ugcauuccagccugggcaacagcgugagacuu

SEQ ID NO: 250153 - RNA, 32 nt, Human
ugcauuccagccugggcacuagagugagacuc

SEQ ID NO: 250154 - RNA, 32 nt, Human
ugcauuccagccugggcgacagagugagaccc

SEQ ID NO: 250155 - RNA, 32 nt, Human
ugcauuccagccugggugacagagugagaccc

SEQ ID NO: 250156 - RNA, 32 nt, Human
ugcauuccagccugggugacagagugagacuc

SEQ ID NO: 250157 - RNA, 32 nt, Human
ugcauuccagccugggugacagagugagaucc

SEQ ID NO: 250158 - RNA, 32 nt, Human
ugcauuccagccuggguggacagaacaaggcc

SEQ ID NO: 250159 - RNA, 32 nt, Human
ugcauuccagccugguugacagagugagacuc

SEQ ID NO: 250160 - RNA, 32 nt, Human
ugcauuccauuuuaacucuucuugagcuaaaa

SEQ ID NO: 250161 - RNA, 32 nt, Human
ugcauucccaggagguuaagacauucuaaguc

SEQ ID NO: 250162 - RNA, 32 nt, Human
ugcauucccugaaucugugccugcacugagag

SEQ ID NO: 250163 - RNA, 32 nt, Human
ugcauuccuauguaaaugcccuccauaaaaac

SEQ ID NO: 250164 - RNA, 32 nt, Human
ugcauuccucccacccuggccucccagagugc

SEQ ID NO: 250165 - RNA, 32 nt, Human
ugcauuccugaccggcaccuggcgaggcucau

SEQ ID NO: 250166 - RNA, 32 nt, Human
ugcauuccugccuuccgugaaggagugcccag

SEQ ID NO: 250167 - RNA, 32 nt, Human
ugcauuccugggggcuggaggguggggugcca

SEQ ID NO: 250168 - RNA, 18 nt, Human
ugcauucgacucucccca

SEQ ID NO: 250169 - RNA, 32 nt, Human
ugcauucgagacugguggagggugggcugggc

SEQ ID NO: 250170 - RNA, 32 nt, Human
ugcauucuacugucacccaucuggagcagcuu

SEQ ID NO: 250171 - RNA, 32 nt, Human
ugcauucuccaccccuccgccaauggcuucca

SEQ ID NO: 250172 - RNA, 32 nt, Human
ugcauucuccauccucauccucugcccuccca

SEQ ID NO: 250173 - RNA, 32 nt, Human
ugcauucucuccugccccaaagugccaagcca

SEQ ID NO: 250174 - RNA, 32 nt, Human
ugcauucugccaccccucacacagccaaaccc

SEQ ID NO: 250175 - RNA, 32 nt, Human
ugcauucuggaaagcucucccaggaggaagca

SEQ ID NO: 250176 - RNA, 32 nt, Human
ugcauucugggcacuggugcagcugcuggcca

SEQ ID NO: 250177 - RNA, 32 nt, Human
ugcauucugucuguccuuuuccuccuuggagc

SEQ ID NO: 250178 - RNA, 32 nt, Human
ugcauucuugagaucuuuuauuuuggaaugau

SEQ ID NO: 250179 - RNA, 32 nt, Human
ugcauucuugucgugccguccugggccucagg

SEQ ID NO: 250180 - RNA, 32 nt, Human
ugcauucuuuuaacuucuaccuccuggcucua

SEQ ID NO: 250181 - RNA, 32 nt, Human
ugcauugagaacacaggaacaggugaucguuu

SEQ ID NO: 250182 - RNA, 32 nt, Human
ugcauugagccaagaucacaccgcugcacuca

SEQ ID NO: 250183 - RNA, 32 nt, Human
ugcauugagccaagaucacgccacugcauucc

SEQ ID NO: 250184 - RNA, 32 nt, Human
ugcauugagcugccuccagccugguggcccag

SEQ ID NO: 250185 - RNA, 32 nt, Human
ugcauugaggaacccuuuuucuccccgcugug

SEQ ID NO: 250186 - RNA, 32 nt, Human
ugcauugccgcuucugucuguguuguuggugu

SEQ ID NO: 250187 - RNA, 32 nt, Human
ugcauugccugggacuagaggcuggggaggcu

SEQ ID NO: 250188 - RNA, 32 nt, Human
ugcauugccuguagucccagcuacuugggagg

SEQ ID NO: 250189 - RNA, 20 nt, Human
ugcauugcugugaauuagcu

SEQ ID NO: 250190 - RNA, 32 nt, Human
ugcauugcuuugacuucccucuccuugguuaa

SEQ ID NO: 250191 - RNA, 32 nt, Human
ugcauuggaaagacuggcaaagucuuuuggau

SEQ ID NO: 250192 - RNA, 32 nt, Human
ugcauuggagagaaaggcgccgggacagaaaa

SEQ ID NO: 250193 - RNA, 32 nt, Human
ugcauuggagcagcagucccucacuuugaaac

SEQ ID NO: 250194 - RNA, 32 nt, Human
ugcauuggagucagagguacagaucuauuguu

SEQ ID NO: 250195 - RNA, 31 nt, Human
ugcauuggcacaaucucggcucauggcaagc

SEQ ID NO: 250196 - RNA, 32 nt, Human
ugcauuggcaccccuccagccuggaggccagg

SEQ ID NO: 250197 - RNA, 31 nt, Human
ugcauuggcaugaucucagcucacuacaacc

SEQ ID NO: 250198 - RNA, 32 nt, Human
ugcauuggccuggagcuggagaguaaggcugu

SEQ ID NO: 250199 - RNA, 32 nt, Human
ugcauuggcucaauacaugaauuggaucaauu

SEQ ID NO: 250200 - RNA, 21 nt, Human
ugcauuggcugggugcagugg

SEQ ID NO: 250201 - RNA, 32 nt, Human
ugcauugggaggagaaggcagggugagggauc

SEQ ID NO: 250202 - RNA, 32 nt, Human
ugcauugguucaugccuauaaucccagcgcuu

SEQ ID NO: 250203 - RNA, 32 nt, Human
ugcauuguaggagcaaacaaggcuucauauuc

SEQ ID NO: 250204 - RNA, 32 nt, Human
ugcauuguaggaugcugagcagcaucccgggc

SEQ ID NO: 250205 - RNA, 32 nt, Human
ugcauugucuugucacaccucccucacagucu

SEQ ID NO: 250206 - RNA, 32 nt, Human
ugcauugugauggaagacagagaagaaaagca

SEQ ID NO: 250207 - RNA, 32 nt, Human
ugcauugugauggucugcgagcagccggaggu

SEQ ID NO: 250208 - RNA, 22 nt, Human
ugcauuguuuugugcucaacuu

SEQ ID NO: 250209 - RNA, 22 nt, Human
ugcauuguuuuuagcucagguu

SEQ ID NO: 250210 - RNA, 32 nt, Human
ugcauuuaaccaacauggcacauguauacaua

SEQ ID NO: 250211 - RNA, 32 nt, Human
ugcauuuaagcaggaguaaggaagaaagugac

SEQ ID NO: 250212 - RNA, 32 nt, Human
ugcauuuaaguuguuugaaggcauguauuuug

SEQ ID NO: 250213 - RNA, 32 nt, Human
ugcauuuaaucaagacuucugugucucacaca

SEQ ID NO: 250214 - RNA, 22 nt, Human
ugcauuuaauucugaaaucagu

SEQ ID NO: 250215 - RNA, 32 nt, Human
ugcauuuauaagccuuaauauaauauacauaa

SEQ ID NO: 250216 - RNA, 32 nt, Human
ugcauuuauggugaaaacagucuuugcucauu

SEQ ID NO: 250217 - RNA, 32 nt, Human
ugcauuuauucaucaccccuguccucucaucc

SEQ ID NO: 250218 - RNA, 22 nt, Human
ugcauuucaaucagaagcaaag

SEQ ID NO: 250219 - RNA, 32 nt, Human
ugcauuucagugagccggguccugaccugccg

SEQ ID NO: 250220 - RNA, 32 nt, Human
ugcauuucauaaaaggcaaaguuuacagaacc

SEQ ID NO: 250221 - RNA, 32 nt, Human
ugcauuucauuuccugcucucuugcuaccacc

SEQ ID NO: 250222 - RNA, 32 nt, Human
ugcauuucauuucuucaguuaaagccuucaga

SEQ ID NO: 250223 - RNA, 32 nt, Human
ugcauuuccaagaaaagacuucuaagagugcu

SEQ ID NO: 250224 - RNA, 32 nt, Human
ugcauuuccaccauagacuuguucacaugcac

SEQ ID NO: 250225 - RNA, 32 nt, Human
ugcauuuccagccccagcaucuugcuggagcc

SEQ ID NO: 250226 - RNA, 32 nt, Human
ugcauuuccagcugcugccagccuuccugcag

SEQ ID NO: 250227 - RNA, 17 nt, Human
ugcauuuccucucccca

SEQ ID NO: 250228 - RNA, 32 nt, Human
ugcauuuccugacagaaggacucagguugucu

SEQ ID NO: 250229 - RNA, 32 nt, Human
ugcauuuccuggaacucugccaccucauuuca

SEQ ID NO: 250230 - RNA, 32 nt, Human
ugcauuuccuggcugaggaaggguggucaucc

SEQ ID NO: 250231 - RNA, 32 nt, Human
ugcauuucgugagcccugcaaaggugauggug

SEQ ID NO: 250232 - RNA, 32 nt, Human
ugcauuucuagauaaaaguauuuuucagaaaa

SEQ ID NO: 250233 - RNA, 32 nt, Human
ugcauuucucaauugucaucagccuggugggg

SEQ ID NO: 250234 - RNA, 32 nt, Human
ugcauuucuccuagcuuuucaucaggaaaucc

SEQ ID NO: 250235 - RNA, 32 nt, Human
ugcauuucuggcuucucucaauggcuuguguu

SEQ ID NO: 250236 - RNA, 32 nt, Human
ugcauuucuuuccaaaaucuaauuauuaauag

SEQ ID NO: 250237 - RNA, 32 nt, Human
ugcauuucuuuuugugggaaugugggaggaga

SEQ ID NO: 250238 - RNA, 17 nt, Human
ugcauuugaccugcucu

SEQ ID NO: 250239 - RNA, 32 nt, Human
ugcauuugagaaggcaggcuuucauaugcugu

SEQ ID NO: 250240 - RNA, 32 nt, Human
ugcauuugcaagagcuugucuccugaggugga

SEQ ID NO: 250241 - RNA, 32 nt, Human
ugcauuugcaccagaugaauguuugugcuaug

SEQ ID NO: 250242 - RNA, 32 nt, Human
ugcauuugcggguggucugccuguguauuuug

SEQ ID NO: 250243 - RNA, 32 nt, Human
ugcauuuggcugcuucucuugugaccacaauu

SEQ ID NO: 250244 - RNA, 32 nt, Human
ugcauuugguaggaagccugaggcaaaaacug

SEQ ID NO: 250245 - RNA, 32 nt, Human
ugcauuuggucuucucuguuuugacucuuuca

SEQ ID NO: 250246 - RNA, 32 nt, Human
ugcauuuguagcucuguaauccuugaauacgg

SEQ ID NO: 250247 - RNA, 32 nt, Human
ugcauuuguauaaaaauauauguguguaauua

SEQ ID NO: 250248 - RNA, 32 nt, Human
ugcauuuguccaccuuugauuugaggcuuuag

SEQ ID NO: 250249 - RNA, 32 nt, Human
ugcauuugugcacaaggagcaggcaagcaggc

SEQ ID NO: 250250 - RNA, 32 nt, Human
ugcauuuguucaauaaauauuuaacugaaaaa

SEQ ID NO: 250251 - RNA, 32 nt, Human
ugcauuuucaccucaagaaugccaucauguuu

SEQ ID NO: 250252 - RNA, 32 nt, Human
ugcauuuucgaucaugggcuacaugccgagug

SEQ ID NO: 250253 - RNA, 32 nt, Human
ugcauuuucuaaacagagaugaggugguaucu

SEQ ID NO: 250254 - RNA, 32 nt, Human
ugcauuuucuagauccacaccuggauacugcc

SEQ ID NO: 250255 - RNA, 32 nt, Human
ugcauuuucucagcuccuggggauggaaaugg

SEQ ID NO: 250256 - RNA, 32 nt, Human
ugcauuuucucucuacguuagucucagguccu

SEQ ID NO: 250257 - RNA, 32 nt, Human
ugcauuuucucuuccaaaaaggaaagguucuu

SEQ ID NO: 250258 - RNA, 32 nt, Human
ugcauuuucuggcccggaguugccugcaucca

SEQ ID NO: 250259 - RNA, 32 nt, Human
ugcauuuuggugguaauuuuaaaggucuugau

SEQ ID NO: 250260 - RNA, 32 nt, Human
ugcauuuuucaguucagccacuggggagcaua

SEQ ID NO: 250261 - RNA, 32 nt, Human
ugcauuuuugugaaaugaaaacauguaauaaa

SEQ ID NO: 250262 - RNA, 32 nt, Human
ugccaaaaacaacaaauagccacagaacguag

SEQ ID NO: 250263 - RNA, 32 nt, Human
ugccaaaaaccagcacaaggagacaaagcaga

SEQ ID NO: 250264 - RNA, 23 nt, Human
ugccaaaaacuuggagugaagga

SEQ ID NO: 250265 - RNA, 32 nt, Human
ugccaaaaagggacaggaggcaugggauagca

SEQ ID NO: 250266 - RNA, 32 nt, Human
ugccaaaagagcauaguuacaaccccuaggag

SEQ ID NO: 250267 - RNA, 32 nt, Human
ugccaaacacagugccuucuacauugcaggcg

SEQ ID NO: 250268 - RNA, 32 nt, Human
ugccaaacacccugcucagggcuggaaaugca

SEQ ID NO: 250269 - RNA, 32 nt, Human
ugccaaacaugggaacagccuugaauaggaua

SEQ ID NO: 250270 - RNA, 32 nt, Human
ugccaaaccccaguucugauggggcuccaaca

SEQ ID NO: 250271 - RNA, 22 nt, Human
ugccaaaccucugacugccaca

SEQ ID NO: 250272 - RNA, 32 nt, Human
ugccaaacucaaggcuccucuggcccagcuug

SEQ ID NO: 250273 - RNA, 32 nt, Human
ugccaaacucagaacuauuccaugcaggugcc

SEQ ID NO: 250274 - RNA, 32 nt, Human
ugccaaacucagccaaggagcagccccagugg

SEQ ID NO: 250275 - RNA, 32 nt, Human
ugccaaacugaaaugaagaauggccaaguuuu

SEQ ID NO: 250276 - RNA, 32 nt, Human
ugccaaacugauuucaguuguguaacuaguuu

SEQ ID NO: 250277 - RNA, 32 nt, Human
ugccaaacuguacaguuucuuccccaagagcu

SEQ ID NO: 250278 - RNA, 32 nt, Human
ugccaaagacaagcugugugauuuugugaaug

SEQ ID NO: 250279 - RNA, 32 nt, Human
ugccaaagauggagaagagugccagggacccc

SEQ ID NO: 250280 - RNA, 32 nt, Human
ugccaaagccaagaacugccggggccagggcu

SEQ ID NO: 250281 - RNA, 32 nt, Human
ugccaaaggaaggggccagcuucucugugugu

SEQ ID NO: 250282 - RNA, 32 nt, Human
ugccaaaggacagcccucagcaguuggaacuc

SEQ ID NO: 250283 - RNA, 32 nt, Human
ugccaaaguagaagaaauaguaguaccauaug

SEQ ID NO: 250284 - RNA, 32 nt, Human
ugccaaauagccccagacugggcccaggcagg

SEQ ID NO: 250285 - RNA, 32 nt, Human
ugccaaaucguacuuauuucagaugaugcagc

SEQ ID NO: 250286 - RNA, 32 nt, Human
ugccaaaugcaagcccuuuuuaauuuaguuug

SEQ ID NO: 250287 - RNA, 32 nt, Human
ugccaaaugcuucccaccucugucuguccugu

SEQ ID NO: 250288 - RNA, 32 nt, Human
ugccaaauuuagauuugugugcaucaggcuuu

SEQ ID NO: 250289 - RNA, 32 nt, Human
ugccaacaagcagggugaucucccacagugug

SEQ ID NO: 250290 - RNA, 32 nt, Human
ugccaacaagccauggccuaccuugacacuug

SEQ ID NO: 250291 - RNA, 32 nt, Human
ugccaacaagcugaaaccccaucuccacuaaa

SEQ ID NO: 250292 - RNA, 32 nt, Human
ugccaacacagugaaacccugucucuacuaaa

SEQ ID NO: 250293 - RNA, 32 nt, Human
ugccaacaccugcuggucagaugucccccuac

SEQ ID NO: 250294 - RNA, 32 nt, Human
ugccaacauagugaaacccugucuuuacuaaa

SEQ ID NO: 250295 - RNA, 32 nt, Human
ugccaacaucuucaucacaguuggcuguuagg

SEQ ID NO: 250296 - RNA, 32 nt, Human
ugccaacauggugaaaccccaucucuacuaaa

SEQ ID NO: 250297 - RNA, 32 nt, Human
ugccaacauggugaaacccugucucuacuaaa

SEQ ID NO: 250298 - RNA, 32 nt, Human
ugccaacauggugaaacccugucucugcuaaa

SEQ ID NO: 250299 - RNA, 32 nt, Human
ugccaacauggugaaacuccaucucuacugaa

SEQ ID NO: 250300 - RNA, 22 nt, Human
ugccaaccagauguuacugguc

SEQ ID NO: 250301 - RNA, 32 nt, Human
ugccaaccccaaagcuuccacccuucuccccu

SEQ ID NO: 250302 - RNA, 32 nt, Human
ugccaaccucacugacacagggucauagugua

SEQ ID NO: 250303 - RNA, 32 nt, Human
ugccaaccuccuccucuccugccagccuccuc

SEQ ID NO: 250304 - RNA, 32 nt, Human
ugccaaccuccuccucuccugccagccuccug

SEQ ID NO: 250305 - RNA, 32 nt, Human
ugccaacgcaugcaccagccugcguggucccc

SEQ ID NO: 250306 - RNA, 32 nt, Human
ugccaacucaagagggaaguuggaguaugucu

SEQ ID NO: 250307 - RNA, 32 nt, Human
ugccaacucccgucagcagauccggaagcuga

SEQ ID NO: 250308 - RNA, 32 nt, Human
ugccaacucucugcauucccugaucuccaucc

SEQ ID NO: 250309 - RNA, 32 nt, Human
ugccaacugcagcucgcgcugccuccugcucg

SEQ ID NO: 250310 - RNA, 32 nt, Human
ugccaacuggcucauuggugggagacacagua

SEQ ID NO: 250311 - RNA, 32 nt, Human
ugccaacuuaacugagauucugagugugcaag

SEQ ID NO: 250312 - RNA, 32 nt, Human
ugccaacuuagagccucguaccaaucucucug

SEQ ID NO: 250313 - RNA, 32 nt, Human
ugccaacuuuccaauuaaagguugacauuccu

SEQ ID NO: 250314 - RNA, 32 nt, Human
ugccaagaagacgcccucugaagccauguccu

SEQ ID NO: 250315 - RNA, 32 nt, Human
ugccaagaagcuguccucugagaagccauggc

SEQ ID NO: 250316 - RNA, 32 nt, Human
ugccaagaaguagauauaaccaauaccuuagc

SEQ ID NO: 250317 - RNA, 24 nt, Human
ugccaagaauuuuagaugugauca

SEQ ID NO: 250318 - RNA, 32 nt, Human
ugccaagagcccgucugcuccugcgaggcuau

SEQ ID NO: 250319 - RNA, 32 nt, Human
ugccaagagccugagugacagagcaagacccc

SEQ ID NO: 250320 - RNA, 32 nt, Human
ugccaagagucacaucccugcccaggggcacc

SEQ ID NO: 250321 - RNA, 32 nt, Human
ugccaagaguccaagccaucuggcccaacaua

SEQ ID NO: 250322 - RNA, 19 nt, Human
ugccaagauucuuugaaua

SEQ ID NO: 250323 - RNA, 32 nt, Human
ugccaagauugccugugccugccugacaaagg

SEQ ID NO: 250324 - RNA, 31 nt, Human
ugccaagcacuuuucuaggcaaaggaaaugc

SEQ ID NO: 250325 - RNA, 22 nt, Human
ugccaagccgcggcucugcgga

SEQ ID NO: 250326 - RNA, 32 nt, Human
ugccaagccuggugccuuuccaaaggacuagc

SEQ ID NO: 250327 - RNA, 32 nt, Human
ugccaagcucucagauugaaugcuaguucucu

SEQ ID NO: 250328 - RNA, 32 nt, Human
ugccaagcugccugugcacuggcccugcgggg

SEQ ID NO: 250329 - RNA, 32 nt, Human
ugccaagcuggagcagcuggccagcagaagca

SEQ ID NO: 250330 - RNA, 32 nt, Human
ugccaaggaagugggcuccaggugaaggccag

SEQ ID NO: 250331 - RNA, 32 nt, Human
ugccaaggagaaaaauggccaguuaggaucaa

SEQ ID NO: 250332 - RNA, 32 nt, Human
ugccaaggagccgggacccaggagagggcugc

SEQ ID NO: 250333 - RNA, 32 nt, Human
ugccaaggaguaaauugcugggcugcuuucua

SEQ ID NO: 250334 - RNA, 32 nt, Human
ugccaaggaguagggugggggucaguggauug

SEQ ID NO: 250335 - RNA, 21 nt, Human
ugccaaggccaggugcagugg

SEQ ID NO: 250336 - RNA, 32 nt, Human
ugccaaggccagucugaaauccugggcucaag

SEQ ID NO: 250337 - RNA, 32 nt, Human
ugccaaggcugcuugugcuaccaguuuguugg

SEQ ID NO: 250338 - RNA, 21 nt, Human
ugccaaggcuggaaugcagug

SEQ ID NO: 250339 - RNA, 21 nt, Human
ugccaaggcuggagugcagug

SEQ ID NO: 250340 - RNA, 32 nt, Human
ugccaagggcagcaggugauccgggcagagcu

SEQ ID NO: 250341 - RNA, 32 nt, Human
ugccaagggcuggaggcccugccgcuggccuu

SEQ ID NO: 250342 - RNA, 32 nt, Human
ugccaaggggcugcuggcacugggcagcagca

SEQ ID NO: 250343 - RNA, 32 nt, Human
ugccaagguguuuucuguguauacauggauau

SEQ ID NO: 250344 - RNA, 32 nt, Human
ugccaaguagaucuccuccuccuucaugcagc

SEQ ID NO: 250345 - RNA, 23 nt, Human
ugccaagucaccuaaacucugga

SEQ ID NO: 250346 - RNA, 32 nt, Human
ugccaaguccucccccugcccauucucauggg

SEQ ID NO: 250347 - RNA, 32 nt, Human
ugccaaguccucccggaccagaucucccaucc

SEQ ID NO: 250348 - RNA, 21 nt, Human
ugccaaguccuggcccuggcc

SEQ ID NO: 250349 - RNA, 25 nt, Human
ugccaagugcugcguccuccuggug

SEQ ID NO: 250350 - RNA, 23 nt, Human
ugccaaguucccccagucccuca

SEQ ID NO: 250351 - RNA, 32 nt, Human
ugccaaguugcacgcgcuuagaacggaguacu

SEQ ID NO: 250352 - RNA, 32 nt, Human
ugccaaguugcacgcgcuuagaacggagucua

SEQ ID NO: 250353 - RNA, 32 nt, Human
ugccaaguuugacggugaagugaucugugaac

SEQ ID NO: 250354 - RNA, 32 nt, Human
ugccaauaaaaauuuaugguccaagggaaaaa

SEQ ID NO: 250355 - RNA, 32 nt, Human
ugccaauaccaccaccagauucuucuuugaag

SEQ ID NO: 250356 - RNA, 31 nt, Human
ugccaauaucuugacaccugccaaagcuucc

SEQ ID NO: 250357 - RNA, 32 nt, Human
ugccaaucauuuuuagagggaggaaucagugu

SEQ ID NO: 250358 - RNA, 21 nt, Human
ugccaaucugcugggcugguc

SEQ ID NO: 250359 - RNA, 32 nt, Human
ugccaaucuucugccaucaauuuugggaaacc

SEQ ID NO: 250360 - RNA, 32 nt, Human
ugccaaucuuucacugcaugugaaaaugugac

SEQ ID NO: 250361 - RNA, 32 nt, Human
ugccaaugaagauuuaaagacagagcaggagc

SEQ ID NO: 250362 - RNA, 32 nt, Human
ugccaaugagcauggcaagaaaaugcucgagc

SEQ ID NO: 250363 - RNA, 32 nt, Human
ugccaaugagcuagauauuugcugcagaucuu

SEQ ID NO: 250364 - RNA, 32 nt, Human
ugccaaugcacgcacacaucagugcacacgga

SEQ ID NO: 250365 - RNA, 32 nt, Human
ugccaaugcacuccagucugggcaacagagug

SEQ ID NO: 250366 - RNA, 32 nt, Human
ugccaaugcacuccauccugggcaaaaagagc

SEQ ID NO: 250367 - RNA, 32 nt, Human
ugccaaugcauuccagccuggaugauggagcg

SEQ ID NO: 250368 - RNA, 32 nt, Human
ugccaaugccuguacauuaacagauuuuuaaa

SEQ ID NO: 250369 - RNA, 32 nt, Human
ugccaaugcuccagcugucgucugacucuggg

SEQ ID NO: 250370 - RNA, 32 nt, Human
ugccaauguacuccagccuaggugacagagug

SEQ ID NO: 250371 - RNA, 32 nt, Human
ugccaauguauuccagucugggugacagagug

SEQ ID NO: 250372 - RNA, 32 nt, Human
ugccaauguccaaguugcagauuuccccuuuu

SEQ ID NO: 250373 - RNA, 32 nt, Human
ugccaauuccagcaaggugucuugagauuguu

SEQ ID NO: 250374 - RNA, 32 nt, Human
ugccaauuccuuccuucucuucuguacagcag

SEQ ID NO: 250375 - RNA, 32 nt, Human
ugccaauugucauuaaaaggcuuuucauggcu

SEQ ID NO: 250376 - RNA, 32 nt, Human
ugccaauuucucuaguguaauaacucccaacc

SEQ ID NO: 250377 - RNA, 32 nt, Human
ugccacaaaggauggcauggcccgggagugcc

SEQ ID NO: 250378 - RNA, 32 nt, Human
ugccacaaccgcgcguccucagagccagcccg

SEQ ID NO: 250379 - RNA, 32 nt, Human
ugccacacacccagccugaaguucuaaaagaa

SEQ ID NO: 250380 - RNA, 32 nt, Human
ugccacacagcaaguuccgagaccauggauuc

SEQ ID NO: 250381 - RNA, 32 nt, Human
ugccacacauccuuucccuccuggccugcccu

SEQ ID NO: 250382 - RNA, 21 nt, Human
ugccacacccacccgcugcca

SEQ ID NO: 250383 - RNA, 32 nt, Human
ugccacaccccaccaugcaccuccaguccucc

SEQ ID NO: 250384 - RNA, 32 nt, Human
ugccacaccguacuccagccugggcgacaucu

SEQ ID NO: 250385 - RNA, 32 nt, Human
ugccacaccucgcucucagucucuccacauuu

SEQ ID NO: 250386 - RNA, 32 nt, Human
ugccacacggaacccuguauuuugcacacagc

SEQ ID NO: 250387 - RNA, 18 nt, Human
ugccacacggugcugguc

SEQ ID NO: 250388 - RNA, 32 nt, Human
ugccacacuagacagccaggagcccagcagaa

SEQ ID NO: 250389 - RNA, 32 nt, Human
ugccacacucacaaccgcagaccucggugagg

SEQ ID NO: 250390 - RNA, 32 nt, Human
ugccacacucuccugguuugggcccugcucau

SEQ ID NO: 250391 - RNA, 25 nt, Human
ugccacacuguauguuucuaacaua

SEQ ID NO: 250392 - RNA, 32 nt, Human
ugccacacugucuuccacaaugguugaacuaa

SEQ ID NO: 250393 - RNA, 32 nt, Human
ugccacagacucgaguaagaaaauguucucuu

SEQ ID NO: 250394 - RNA, 32 nt, Human
ugccacagagcucagaaagcuaaagcaauguu

SEQ ID NO: 250395 - RNA, 32 nt, Human
ugccacagagguuucuggcuggcaaaucgaca

SEQ ID NO: 250396 - RNA, 32 nt, Human
ugccacagaguucauugcucucaguauaagau

SEQ ID NO: 250397 - RNA, 32 nt, Human
ugccacagaucugucccaccucccaggcucca

SEQ ID NO: 250398 - RNA, 32 nt, Human
ugccacagccuccugaguaccugagauuacag

SEQ ID NO: 250399 - RNA, 32 nt, Human
ugccacagccuccugaguagcugggauuacag

SEQ ID NO: 250400 - RNA, 32 nt, Human
ugccacagccucucccccagucccugucuccg

SEQ ID NO: 250401 - RNA, 32 nt, Human
ugccacagccucuuuccgucccucucuuucug

SEQ ID NO: 250402 - RNA, 32 nt, Human
ugccacagccuucucaaguccuuccugcagag

SEQ ID NO: 250403 - RNA, 32 nt, Human
ugccacagccuucugacaaaguuuacaguuau

SEQ ID NO: 250404 - RNA, 32 nt, Human
ugccacagcucuccagccugggcgacagagug

SEQ ID NO: 250405 - RNA, 32 nt, Human
ugccacagcuggaagcagaggccuucguaggu

SEQ ID NO: 250406 - RNA, 32 nt, Human
ugccacaggaagcugggccgggcugcugugcc

SEQ ID NO: 250407 - RNA, 32 nt, Human
ugccacaggaggaggaggaggacaugggguuu

SEQ ID NO: 250408 - RNA, 32 nt, Human
ugccacaggaggagugggaggagaagcuguug

SEQ ID NO: 250409 - RNA, 32 nt, Human
ugccacaggcacuggggaucucaccagaaagg

SEQ ID NO: 250410 - RNA, 32 nt, Human
ugccacaggcauucccgccgucagugccuucu

SEQ ID NO: 250411 - RNA, 32 nt, Human
ugccacaggccagcaaaagcacuucagaguca

SEQ ID NO: 250412 - RNA, 21 nt, Human
ugccacaggcuuagggacagg

SEQ ID NO: 250413 - RNA, 32 nt, Human
ugccacagggguagacaggggucugggggaga

SEQ ID NO: 250414 - RNA, 32 nt, Human
ugccacaguaccacugccaccaugcugcucac

SEQ ID NO: 250415 - RNA, 32 nt, Human
ugccacaguccagagaaggccaccucuaaugg

SEQ ID NO: 250416 - RNA, 32 nt, Human
ugccacauacugcggaccaagggacuccaauc

SEQ ID NO: 250417 - RNA, 32 nt, Human
ugccacauagcuggcugaccuuugccaaguua

SEQ ID NO: 250418 - RNA, 32 nt, Human
ugccacaucaauaacauccuuccccagcacau

SEQ ID NO: 250419 - RNA, 32 nt, Human
ugccacaucacuccagccugggcaacagaaca

SEQ ID NO: 250420 - RNA, 32 nt, Human
ugccacaugccuguaauuccagcuacuuggga

SEQ ID NO: 250421 - RNA, 32 nt, Human
ugccacaugccuguagucccagcuacuuggga

SEQ ID NO: 250422 - RNA, 32 nt, Human
ugccacauugcccaggcuggucucaaacuccu

SEQ ID NO: 250423 - RNA, 32 nt, Human
ugccaccaaaggacuugaucugaguugggagu

SEQ ID NO: 250424 - RNA, 32 nt, Human
ugccaccaacucccacuguccagggcuucugg

SEQ ID NO: 250425 - RNA, 32 nt, Human
ugccaccaagcccucaagaaguugugcccuuc

SEQ ID NO: 250426 - RNA, 32 nt, Human
ugccaccacacuccagccugggcgacagaaug

SEQ ID NO: 250427 - RNA, 24 nt, Human
ugccaccaccaacgccgccgccau

SEQ ID NO: 250428 - RNA, 20 nt, Human
ugccaccaccaagucauuga

SEQ ID NO: 250429 - RNA, 18 nt, Human
ugccaccaccaugccuga

SEQ ID NO: 250430 - RNA, 19 nt, Human
ugccaccaccuuugucuga

SEQ ID NO: 250431 - RNA, 32 nt, Human
ugccaccacgcauggcuaaucuuuuuguguuu

SEQ ID NO: 250432 - RNA, 32 nt, Human
ugccaccacgccugggcaacauggugaaaccc

SEQ ID NO: 250433 - RNA, 32 nt, Human
ugccaccacucagaaguuuauucuuccagacg

SEQ ID NO: 250434 - RNA, 32 nt, Human
ugccaccacucccuauacuucucccuccuucu

SEQ ID NO: 250435 - RNA, 32 nt, Human
ugccaccacucugcucccugcuugccuccacu

SEQ ID NO: 250436 - RNA, 32 nt, Human
ugccaccacugcaagcaaaagucuggagaagu

SEQ ID NO: 250437 - RNA, 32 nt, Human
ugccaccagcaaugcccugccuugcugccuuc

SEQ ID NO: 250438 - RNA, 32 nt, Human
ugccaccagcugggggagcuccuggccggcca

SEQ ID NO: 250439 - RNA, 32 nt, Human
ugccaccaggccuggccaaguuuuguaguuuu

SEQ ID NO: 250440 - RNA, 20 nt, Human
ugccaccaggcugccuggca

SEQ ID NO: 250441 - RNA, 32 nt, Human
ugccaccagggagggguggaggggcuuucuuu

SEQ ID NO: 250442 - RNA, 24 nt, Human
ugccaccaguagauaccggccaca

SEQ ID NO: 250443 - RNA, 23 nt, Human
ugccaccaguccccagcugcaga

SEQ ID NO: 250444 - RNA, 32 nt, Human
ugccaccaucccgcgggggccugggugaggca

SEQ ID NO: 250445 - RNA, 32 nt, Human
ugccaccaugaggaacauuuucaagaggaacc

SEQ ID NO: 250446 - RNA, 32 nt, Human
ugccaccaugccacugcacuccagccugggug

SEQ ID NO: 250447 - RNA, 32 nt, Human
ugccaccauggccaugcagcaggcuaugaugg

SEQ ID NO: 250448 - RNA, 32 nt, Human
ugccaccauucauuuaagugcuguuuguucuu

SEQ ID NO: 250449 - RNA, 32 nt, Human
ugccacccaagaaggacaugaaggaacaggag

SEQ ID NO: 250450 - RNA, 24 nt, Human
ugccacccaagcuggagugcagug

SEQ ID NO: 250451 - RNA, 32 nt, Human
ugccacccacagugaaaccagaucccauuaau

SEQ ID NO: 250452 - RNA, 32 nt, Human
ugccacccaccagcaggaaggaggaccuggaa

SEQ ID NO: 250453 - RNA, 32 nt, Human
ugccacccacugcacuggggccagcugggaag

SEQ ID NO: 250454 - RNA, 21 nt, Human
ugccacccagaucagaucaca

SEQ ID NO: 250455 - RNA, 19 nt, Human
ugccacccaggcuggagua

SEQ ID NO: 250456 - RNA, 24 nt, Human
ugccacccaggcuggaguacagug

SEQ ID NO: 250457 - RNA, 24 nt, Human
ugccacccaggcuggaguccagug

SEQ ID NO: 250458 - RNA, 21 nt, Human
ugccacccagggcccugcaca

SEQ ID NO: 250459 - RNA, 23 nt, Human
ugccacccaggugaggugcugug

SEQ ID NO: 250460 - RNA, 32 nt, Human
ugccacccagugaguguccagaccauugucuu

SEQ ID NO: 250461 - RNA, 32 nt, Human
ugccacccaugccucuucaggcuggaaauaau

SEQ ID NO: 250462 - RNA, 32 nt, Human
ugccacccccagguuagcaacaugguggccaa

SEQ ID NO: 250463 - RNA, 32 nt, Human
ugccacccccuucccuguccuuccccaacucc

SEQ ID NO: 250464 - RNA, 32 nt, Human
ugccaccccucagcccaggacuaccgcuauua

SEQ ID NO: 250465 - RNA, 32 nt, Human
ugccaccccucucucccuuucucccucgcucc

SEQ ID NO: 250466 - RNA, 32 nt, Human
ugccaccccugccccgugugugccccgggugu

SEQ ID NO: 250467 - RNA, 32 nt, Human
ugccaccccugcccugauuccacggcugccuc

SEQ ID NO: 250468 - RNA, 32 nt, Human
ugccaccccugcuucucgccuggaccucuugg

SEQ ID NO: 250469 - RNA, 32 nt, Human
ugccacccucauuccuccagagcuugaccccu

SEQ ID NO: 250470 - RNA, 32 nt, Human
ugccacccucccccuucaaugcaccucuggug

SEQ ID NO: 250471 - RNA, 32 nt, Human
ugccacccucuucuuucuccccagccuucuca

SEQ ID NO: 250472 - RNA, 32 nt, Human
ugccacccugcaacccacccucccagccaagg

SEQ ID NO: 250473 - RNA, 20 nt, Human
ugccacccugcugccgccac

SEQ ID NO: 250474 - RNA, 32 nt, Human
ugccacccugggugccagucucuccuucugua

SEQ ID NO: 250475 - RNA, 16 nt, Human
ugccacccugugccau

SEQ ID NO: 250476 - RNA, 32 nt, Human
ugccaccgagacaccagccucugauggcucag

SEQ ID NO: 250477 - RNA, 24 nt, Human
ugccaccgaggcuggagugcagug

SEQ ID NO: 250478 - RNA, 32 nt, Human
ugccaccgcacuccagcaugggugacagagug

SEQ ID NO: 250479 - RNA, 32 nt, Human
ugccaccgcacuucagccugggugacagagaa

SEQ ID NO: 250480 - RNA, 32 nt, Human
ugccaccgcacuuccagccugggugacagagu

SEQ ID NO: 250481 - RNA, 21 nt, Human
ugccaccgccgccgccgucac

SEQ ID NO: 250482 - RNA, 21 nt, Human
ugccaccgccgccgcguccac

SEQ ID NO: 250483 - RNA, 32 nt, Human
ugccaccggcuucucugauucuccagcuugca

SEQ ID NO: 250484 - RNA, 32 nt, Human
ugccaccguacucuagccugggcgacagagca

SEQ ID NO: 250485 - RNA, 32 nt, Human
ugccaccgugugaagaaaaaugaaagcacaga

SEQ ID NO: 250486 - RNA, 32 nt, Human
ugccaccuacacuccagccugggugacagagc

SEQ ID NO: 250487 - RNA, 20 nt, Human
ugccaccuaccaaacucugg

SEQ ID NO: 250488 - RNA, 21 nt, Human
ugccaccuaccaaacucugga

SEQ ID NO: 250489 - RNA, 32 nt, Human
ugccaccuacuucccguccaguuccugccaga

SEQ ID NO: 250490 - RNA, 32 nt, Human
ugccaccuacuuccuggagcugucuuugcugg

SEQ ID NO: 250491 - RNA, 32 nt, Human
ugccaccucagcccccuccagacuuugggcac

SEQ ID NO: 250492 - RNA, 32 nt, Human
ugccaccucauguucacaccuaucuuucucac

SEQ ID NO: 250493 - RNA, 24 nt, Human
ugccaccuccaccucccgaguuca

SEQ ID NO: 250494 - RNA, 24 nt, Human
ugccaccuccaccuccuggguuca

SEQ ID NO: 250495 - RNA, 32 nt, Human
ugccaccuccagcagaccucagggaggguugg

SEQ ID NO: 250496 - RNA, 32 nt, Human
ugccaccuccccauucaggccugguggcagga

SEQ ID NO: 250497 - RNA, 32 nt, Human
ugccaccuccccucuguccucgaggcccacag

SEQ ID NO: 250498 - RNA, 32 nt, Human
ugccaccuccucccaucaccuccugcggcaga

SEQ ID NO: 250499 - RNA, 32 nt, Human
ugccaccucggcccccuccagacuuugggcag

SEQ ID NO: 250500 - RNA, 32 nt, Human
ugccaccugagaggagcuucuguuuggcauuc

SEQ ID NO: 250501 - RNA, 32 nt, Human
ugccaccugcugcugcuaucuguccuuacuug

SEQ ID NO: 250502 - RNA, 32 nt, Human
ugccaccugcuguggguccagcagguuuuuac

SEQ ID NO: 250503 - RNA, 23 nt, Human
ugccaccuguuugaugugcagug

SEQ ID NO: 250504 - RNA, 19 nt, Human
ugccaccuucaaguucugg

SEQ ID NO: 250505 - RNA, 32 nt, Human
ugccaccuucauccuugccucccuuccugcag

SEQ ID NO: 250506 - RNA, 32 nt, Human
ugccaccuucuuucaugcacauuccucuuugg

SEQ ID NO: 250507 - RNA, 32 nt, Human
ugccaccuugucuucuucugcaagaacugaau

SEQ ID NO: 250508 - RNA, 24 nt, Human
ugccacgaucuuggcucccugcag

SEQ ID NO: 250509 - RNA, 32 nt, Human
ugccacgcacugcaaccugggugacagagcga

SEQ ID NO: 250510 - RNA, 32 nt, Human
ugccacgcccggcucauuuuuguguuuuagua

SEQ ID NO: 250511 - RNA, 32 nt, Human
ugccacgccggggccuccaccgccugggccug

SEQ ID NO: 250512 - RNA, 32 nt, Human
ugccacgcugccuuccgcuccuccuggucuuu

SEQ ID NO: 250513 - RNA, 32 nt, Human
ugccacggcacuccagccugggcagcagagug

SEQ ID NO: 250514 - RNA, 32 nt, Human
ugccacgggagggggcccccaaacuuucuucc

SEQ ID NO: 250515 - RNA, 20 nt, Human
ugccacguccauaguucuga

SEQ ID NO: 250516 - RNA, 32 nt, Human
ugccacuaaccuuccaaaaauuacuuaguauu

SEQ ID NO: 250517 - RNA, 32 nt, Human
ugccacuaagagaaggcagagaggucccuagu

SEQ ID NO: 250518 - RNA, 32 nt, Human
ugccacuaagccccauggcccuuggggccugu

SEQ ID NO: 250519 - RNA, 32 nt, Human
ugccacuacacuccagccuggccgacagagca

SEQ ID NO: 250520 - RNA, 32 nt, Human
ugccacuacacuccagccugggcaaaagagug

SEQ ID NO: 250521 - RNA, 32 nt, Human
ugccacuacacuccagccugggcaacagagug

SEQ ID NO: 250522 - RNA, 32 nt, Human
ugccacuacacuccagccugggggacagagag

SEQ ID NO: 250523 - RNA, 32 nt, Human
ugccacuacacuccagccugggugacaaagcg

SEQ ID NO: 250524 - RNA, 32 nt, Human
ugccacuacacuccagccugggugacagagug

SEQ ID NO: 250525 - RNA, 32 nt, Human
ugccacuacccgcccauguccuggaagauggc

SEQ ID NO: 250526 - RNA, 32 nt, Human
ugccacuacugcccagaacuccucugggacuc

SEQ ID NO: 250527 - RNA, 32 nt, Human
ugccacuacuguacucuagccugggcagcaga

SEQ ID NO: 250528 - RNA, 32 nt, Human
ugccacuaguacuccagccugggugacagagc

SEQ ID NO: 250529 - RNA, 21 nt, Human
ugccacucaacuucagaugca

SEQ ID NO: 250530 - RNA, 32 nt, Human
ugccacucacuggggugaggcugggggucagc

SEQ ID NO: 250531 - RNA, 32 nt, Human
ugccacuccacuccagccugggcaacagugug

SEQ ID NO: 250532 - RNA, 32 nt, Human
ugccacuccacuccagucugggcgacagagca

SEQ ID NO: 250533 - RNA, 32 nt, Human
ugccacuccagccuggccucacugucccaccc

SEQ ID NO: 250534 - RNA, 32 nt, Human
ugccacuccaucucccuccgugcuccagccac

SEQ ID NO: 250535 - RNA, 32 nt, Human
ugccacuccccauagaagcuugaaguuacaca

SEQ ID NO: 250536 - RNA, 32 nt, Human
ugccacucuacuccagccugggcaacacagca

SEQ ID NO: 250537 - RNA, 32 nt, Human
ugccacucuccaacuucuaaaccucccaaacc

SEQ ID NO: 250538 - RNA, 32 nt, Human
ugccacucugauuccuccuuucuuuuggucac

SEQ ID NO: 250539 - RNA, 32 nt, Human
ugccacucugggcaaaugcucuuccuugagcc

SEQ ID NO: 250540 - RNA, 32 nt, Human
ugccacucugggcagucuuuugugucaguguc

SEQ ID NO: 250541 - RNA, 32 nt, Human
ugccacugaacuccagccugggcaacagagug

SEQ ID NO: 250542 - RNA, 32 nt, Human
ugccacugaacuccagccugggugacagagca

SEQ ID NO: 250543 - RNA, 32 nt, Human
ugccacugaacucuagccuggguaacagagug

SEQ ID NO: 250544 - RNA, 32 nt, Human
ugccacugacccaccgccaccuccgcggagag

SEQ ID NO: 250545 - RNA, 32 nt, Human
ugccacugaccuccagccugggggacagagca

SEQ ID NO: 250546 - RNA, 32 nt, Human
ugccacugcaauccagccugggcaacagagcg

SEQ ID NO: 250547 - RNA, 32 nt, Human
ugccacugcaaucuagccugggugacagagca

SEQ ID NO: 250548 - RNA, 32 nt, Human
ugccacugcaauucagccugggugacauagag

SEQ ID NO: 250549 - RNA, 32 nt, Human
ugccacugcacaccagccugggugacagagcg

SEQ ID NO: 250550 - RNA, 32 nt, Human
ugccacugcacaccggccugggugacagcaug

SEQ ID NO: 250551 - RNA, 32 nt, Human
ugccacugcacacuccaaucugggugaaagac

SEQ ID NO: 250552 - RNA, 32 nt, Human
ugccacugcaccacuccagccugggcaacaag

SEQ ID NO: 250553 - RNA, 32 nt, Human
ugccacugcaccccagccugggcaacagagua

SEQ ID NO: 250554 - RNA, 32 nt, Human
ugccacugcaccguagccugggugauaagagu

SEQ ID NO: 250555 - RNA, 32 nt, Human
ugccacugcacgcacuccagccugggcgacag

SEQ ID NO: 250556 - RNA, 32 nt, Human
ugccacugcacuacaaccugggugauagagca

SEQ ID NO: 250557 - RNA, 32 nt, Human
ugccacugcacuacagccugggcgacaaagug

SEQ ID NO: 250558 - RNA, 32 nt, Human
ugccacugcacucaaaccuggcggacagagug

SEQ ID NO: 250559 - RNA, 32 nt, Human
ugccacugcacucaagccugggugacagagcg

SEQ ID NO: 250560 - RNA, 32 nt, Human
ugccacugcacucaagccugggugacgaguga

SEQ ID NO: 250561 - RNA, 32 nt, Human
ugccacugcacucaagccuggugacagagcga

SEQ ID NO: 250562 - RNA, 32 nt, Human
ugccacugcacuccaaccugagugacagcaag

SEQ ID NO: 250563 - RNA, 32 nt, Human
ugccacugcacuccaaccugggcaacagaaug

SEQ ID NO: 250564 - RNA, 32 nt, Human
ugccacugcacuccaaccugggcagcagagca

SEQ ID NO: 250565 - RNA, 32 nt, Human
ugccacugcacuccaaccugggcgacagagug

SEQ ID NO: 250566 - RNA, 32 nt, Human
ugccacugcacuccaaccugggggacagagga

SEQ ID NO: 250567 - RNA, 32 nt, Human
ugccacugcacuccaaccugggugacagagcg

SEQ ID NO: 250568 - RNA, 32 nt, Human
ugccacugcacuccaaccugggugacagagug

SEQ ID NO: 250569 - RNA, 32 nt, Human
ugccacugcacuccaaccugggugagagagcg

SEQ ID NO: 250570 - RNA, 32 nt, Human
ugccacugcacuccacucugggcaacagaaug

SEQ ID NO: 250571 - RNA, 32 nt, Human
ugccacugcacuccagacugggugacacagcg

SEQ ID NO: 250572 - RNA, 32 nt, Human
ugccacugcacuccagacuuggugacagagca

SEQ ID NO: 250573 - RNA, 32 nt, Human
ugccacugcacuccagagccugggcgacagag

SEQ ID NO: 250574 - RNA, 32 nt, Human
ugccacugcacuccagcaugcaugacagagug

SEQ ID NO: 250575 - RNA, 32 nt, Human
ugccacugcacuccagcaugggugauggagag

SEQ ID NO: 250576 - RNA, 32 nt, Human
ugccacugcacuccagcccaggcaacagagua

SEQ ID NO: 250577 - RNA, 32 nt, Human
ugccacugcacuccagcccaggugacagaggg

SEQ ID NO: 250578 - RNA, 32 nt, Human
ugccacugcacuccagccggggugacagaaga

SEQ ID NO: 250579 - RNA, 32 nt, Human
ugccacugcacuccagccuaagcaaauagcaa

SEQ ID NO: 250580 - RNA, 32 nt, Human
ugccacugcacuccagccuaggugacaaagag

SEQ ID NO: 250581 - RNA, 32 nt, Human
ugccacugcacuccagccuaggugacagagca

SEQ ID NO: 250582 - RNA, 32 nt, Human
ugccacugcacuccagccuaugugacuaguga

SEQ ID NO: 250583 - RNA, 32 nt, Human
ugccacugcacuccagccugagcaacagagca

SEQ ID NO: 250584 - RNA, 32 nt, Human
ugccacugcacuccagccugagugacagagag

SEQ ID NO: 250585 - RNA, 32 nt, Human
ugccacugcacuccagccugccuggaugacag

SEQ ID NO: 250586 - RNA, 32 nt, Human
ugccacugcacuccagccugcgggacagagug

SEQ ID NO: 250587 - RNA, 32 nt, Human
ugccacugcacuccagccuggacaacagagca

SEQ ID NO: 250588 - RNA, 32 nt, Human
ugccacugcacuccagccuggacaacggagug

SEQ ID NO: 250589 - RNA, 32 nt, Human
ugccacugcacuccagccuggacgacagagca

SEQ ID NO: 250590 - RNA, 32 nt, Human
ugccacugcacuccagccuggaggacagagcg

SEQ ID NO: 250591 - RNA, 32 nt, Human
ugccacugcacuccagccuggaugacagagca

SEQ ID NO: 250592 - RNA, 32 nt, Human
ugccacugcacuccagccuggaugacagcgag

SEQ ID NO: 250593 - RNA, 32 nt, Human
ugccacugcacuccagccuggcaacagagcaa

SEQ ID NO: 250594 - RNA, 32 nt, Human
ugccacugcacuccagccuggcaacagaguga

SEQ ID NO: 250595 - RNA, 32 nt, Human
ugccacugcacuccagccuggccugggcaaca

SEQ ID NO: 250596 - RNA, 32 nt, Human
ugccacugcacuccagccuggcgacacaguga

SEQ ID NO: 250597 - RNA, 32 nt, Human
ugccacugcacuccagccugggagacagagca

SEQ ID NO: 250598 - RNA, 32 nt, Human
ugccacugcacuccagccugggagacagagcg

SEQ ID NO: 250599 - RNA, 32 nt, Human
ugccacugcacuccagccugggagacagagug

SEQ ID NO: 250600 - RNA, 32 nt, Human
ugccacugcacuccagccugggcaacaaaacg

SEQ ID NO: 250601 - RNA, 32 nt, Human
ugccacugcacuccagccugggcaacaagaac

SEQ ID NO: 250602 - RNA, 32 nt, Human
ugccacugcacuccagccugggcaacaagagc

SEQ ID NO: 250603 - RNA, 32 nt, Human
ugccacugcacuccagccugggcaacaagagu

SEQ ID NO: 250604 - RNA, 32 nt, Human
ugccacugcacuccagccugggcaacaagcga

SEQ ID NO: 250605 - RNA, 32 nt, Human
ugccacugcacuccagccugggcaacaagggc

SEQ ID NO: 250606 - RNA, 32 nt, Human
ugccacugcacuccagccugggcaacacaggg

SEQ ID NO: 250607 - RNA, 32 nt, Human
ugccacugcacuccagccugggcaacacagug

SEQ ID NO: 250608 - RNA, 32 nt, Human
ugccacugcacuccagccugggcaacagagua

SEQ ID NO: 250609 - RNA, 32 nt, Human
ugccacugcacuccagccugggcaacagagug

SEQ ID NO: 250610 - RNA, 32 nt, Human
ugccacugcacuccagccugggcaacagcaag

SEQ ID NO: 250611 - RNA, 32 nt, Human
ugccacugcacuccagccugggcaaccaggug

SEQ ID NO: 250612 - RNA, 32 nt, Human
ugccacugcacuccagccugggcaacugagca

SEQ ID NO: 250613 - RNA, 32 nt, Human
ugccacugcacuccagccugggcaauagagca

SEQ ID NO: 250614 - RNA, 32 nt, Human
ugccacugcacuccagccugggcaauagagug

SEQ ID NO: 250615 - RNA, 32 nt, Human
ugccacugcacuccagccugggcaauggagag

SEQ ID NO: 250616 - RNA, 32 nt, Human
ugccacugcacuccagccugggcaccaaugug

SEQ ID NO: 250617 - RNA, 32 nt, Human
ugccacugcacuccagccugggcaccacagca

SEQ ID NO: 250618 - RNA, 32 nt, Human
ugccacugcacuccagccugggcagcagagcg

SEQ ID NO: 250619 - RNA, 32 nt, Human
ugccacugcacuccagccugggcaugagacuc

SEQ ID NO: 250620 - RNA, 32 nt, Human
ugccacugcacuccagccugggcgaaagagcg

SEQ ID NO: 250621 - RNA, 32 nt, Human
ugccacugcacuccagccugggcgacaagagc

SEQ ID NO: 250622 - RNA, 32 nt, Human
ugccacugcacuccagccugggcgacagagac

SEQ ID NO: 250623 - RNA, 32 nt, Human
ugccacugcacuccagccugggcgacagagca

SEQ ID NO: 250624 - RNA, 32 nt, Human
ugccacugcacuccagccugggcgacagagcc

SEQ ID NO: 250625 - RNA, 32 nt, Human
ugccacugcacuccagccugggcgacagagcg

SEQ ID NO: 250626 - RNA, 32 nt, Human
ugccacugcacuccagccugggcgacagagug

SEQ ID NO: 250627 - RNA, 32 nt, Human
ugccacugcacuccagccugggcgacagcgug

SEQ ID NO: 250628 - RNA, 32 nt, Human
ugccacugcacuccagccugggcgacagugag

SEQ ID NO: 250629 - RNA, 32 nt, Human
ugccacugcacuccagccugggcgacgaguga

SEQ ID NO: 250630 - RNA, 32 nt, Human
ugccacugcacuccagccugggcgacggagug

SEQ ID NO: 250631 - RNA, 32 nt, Human
ugccacugcacuccagccugggcgauagagcu

SEQ ID NO: 250632 - RNA, 32 nt, Human
ugccacugcacuccagccugggcgauggagug

SEQ ID NO: 250633 - RNA, 32 nt, Human
ugccacugcacuccagccugggcggcagagca

SEQ ID NO: 250634 - RNA, 32 nt, Human
ugccacugcacuccagccuggggaacagagca

SEQ ID NO: 250635 - RNA, 32 nt, Human
ugccacugcacuccagccuggggcugacagag

SEQ ID NO: 250636 - RNA, 32 nt, Human
ugccacugcacuccagccugggggacagagca

SEQ ID NO: 250637 - RNA, 32 nt, Human
ugccacugcacuccagccugggggacagagcu

SEQ ID NO: 250638 - RNA, 32 nt, Human
ugccacugcacuccagccugggggacagagug

SEQ ID NO: 250639 - RNA, 32 nt, Human
ugccacugcacuccagccugggugaaagagcu

SEQ ID NO: 250640 - RNA, 32 nt, Human
ugccacugcacuccagccugggugacaaaagu

SEQ ID NO: 250641 - RNA, 32 nt, Human
ugccacugcacuccagccugggugacacagcg

SEQ ID NO: 250642 - RNA, 32 nt, Human
ugccacugcacuccagccugggugacagaaca

SEQ ID NO: 250643 - RNA, 32 nt, Human
ugccacugcacuccagccugggugacagagag

SEQ ID NO: 250644 - RNA, 32 nt, Human
ugccacugcacuccagccugggugacagagca

SEQ ID NO: 250645 - RNA, 32 nt, Human
ugccacugcacuccagccugggugacagagcc

SEQ ID NO: 250646 - RNA, 32 nt, Human
ugccacugcacuccagccugggugacagagcg

SEQ ID NO: 250647 - RNA, 32 nt, Human
ugccacugcacuccagccugggugacagagua

SEQ ID NO: 250648 - RNA, 32 nt, Human
ugccacugcacuccagccugggugacagaguc

SEQ ID NO: 250649 - RNA, 32 nt, Human
ugccacugcacuccagccugggugacagagug

SEQ ID NO: 250650 - RNA, 32 nt, Human
ugccacugcacuccagccugggugacagcgag

SEQ ID NO: 250651 - RNA, 32 nt, Human
ugccacugcacuccagccugggugacagggca

SEQ ID NO: 250652 - RNA, 32 nt, Human
ugccacugcacuccagccugggugacugagug

SEQ ID NO: 250653 - RNA, 32 nt, Human
ugccacugcacuccagccugggugauagagca

SEQ ID NO: 250654 - RNA, 32 nt, Human
ugccacugcacuccagccuggguggacagagc

SEQ ID NO: 250655 - RNA, 32 nt, Human
ugccacugcacuccagccuggguggcagagcc

SEQ ID NO: 250656 - RNA, 32 nt, Human
ugccacugcacuccagccuggguggcagagug

SEQ ID NO: 250657 - RNA, 32 nt, Human
ugccacugcacuccagccuggucaacaaagca

SEQ ID NO: 250658 - RNA, 32 nt, Human
ugccacugcacuccagccuggucaacagagca

SEQ ID NO: 250659 - RNA, 32 nt, Human
ugccacugcacuccagccuggugacagagcga

SEQ ID NO: 250660 - RNA, 32 nt, Human
ugccacugcacuccagccuggugacagaguga

SEQ ID NO: 250661 - RNA, 32 nt, Human
ugccacugcacuccagccuggugagagcaaga

SEQ ID NO: 250662 - RNA, 32 nt, Human
ugccacugcacuccagccugguugacagagca

SEQ ID NO: 250663 - RNA, 32 nt, Human
ugccacugcacuccagccuuggugacagagca

SEQ ID NO: 250664 - RNA, 32 nt, Human
ugccacugcacuccagcgugggcaacggagag

SEQ ID NO: 250665 - RNA, 32 nt, Human
ugccacugcacuccagcuggguggcagagacu

SEQ ID NO: 250666 - RNA, 32 nt, Human
ugccacugcacuccagcuuaggugacagagug

SEQ ID NO: 250667 - RNA, 32 nt, Human
ugccacugcacuccagcuugggcaacaaagug

SEQ ID NO: 250668 - RNA, 32 nt, Human
ugccacugcacuccagcuugggcgacagagcg

SEQ ID NO: 250669 - RNA, 32 nt, Human
ugccacugcacuccagcuugggugacagagug

SEQ ID NO: 250670 - RNA, 32 nt, Human
ugccacugcacuccagcuugggugagaguggg

SEQ ID NO: 250671 - RNA, 32 nt, Human
ugccacugcacuccagcuuggugacagaguga

SEQ ID NO: 250672 - RNA, 32 nt, Human
ugccacugcacuccaggcugggcgacagagug

SEQ ID NO: 250673 - RNA, 32 nt, Human
ugccacugcacuccaggcugggugacagagcg

SEQ ID NO: 250674 - RNA, 32 nt, Human
ugccacugcacuccaguauggaugacauagua

SEQ ID NO: 250675 - RNA, 32 nt, Human
ugccacugcacuccagucuggacaacagagca

SEQ ID NO: 250676 - RNA, 32 nt, Human
ugccacugcacuccagucuggaugacagagag

SEQ ID NO: 250677 - RNA, 32 nt, Human
ugccacugcacuccagucugggugacagagug

SEQ ID NO: 250678 - RNA, 32 nt, Human
ugccacugcacuccagucugggugacagcaag

SEQ ID NO: 250679 - RNA, 32 nt, Human
ugccacugcacuccauccuggacgacagagug

SEQ ID NO: 250680 - RNA, 32 nt, Human
ugccacugcacuccauccugggcaacaagaac

SEQ ID NO: 250681 - RNA, 32 nt, Human
ugccacugcacuccauccugggugacagcaag

SEQ ID NO: 250682 - RNA, 32 nt, Human
ugccacugcacucccagccugggcaacggagu

SEQ ID NO: 250683 - RNA, 32 nt, Human
ugccacugcacucccgccugggcgacagagcg

SEQ ID NO: 250684 - RNA, 32 nt, Human
ugccacugcacucccgccugggugacaaagca

SEQ ID NO: 250685 - RNA, 32 nt, Human
ugccacugcacuccggccuaggugacagaggg

SEQ ID NO: 250686 - RNA, 32 nt, Human
ugccacugcacuccggccugggugacaaagca

SEQ ID NO: 250687 - RNA, 32 nt, Human
ugccacugcacuccggccugggugauggagca

SEQ ID NO: 250688 - RNA, 32 nt, Human
ugccacugcacuccuccgugggugacagagcg

SEQ ID NO: 250689 - RNA, 32 nt, Human
ugccacugcacuccugccugggugacaaagug

SEQ ID NO: 250690 - RNA, 32 nt, Human
ugccacugcacuccugccugggugacagaaga

SEQ ID NO: 250691 - RNA, 32 nt, Human
ugccacugcacucgagccugggugacagagug

SEQ ID NO: 250692 - RNA, 32 nt, Human
ugccacugcacucuaaccugggcgacagagug

SEQ ID NO: 250693 - RNA, 32 nt, Human
ugccacugcacucuagccggggcgacagagcg

SEQ ID NO: 250694 - RNA, 32 nt, Human
ugccacugcacucuagccuaggcuacagagca

SEQ ID NO: 250695 - RNA, 32 nt, Human
ugccacugcacucuagccuagguggcugagcg

SEQ ID NO: 250696 - RNA, 32 nt, Human
ugccacugcacucuagccucggugacagagua

SEQ ID NO: 250697 - RNA, 32 nt, Human
ugccacugcacucuagccuggacagcagagca

SEQ ID NO: 250698 - RNA, 32 nt, Human
ugccacugcacucuagccugggcaauaagcaa

SEQ ID NO: 250699 - RNA, 32 nt, Human
ugccacugcacucuagccugggcgacagagca

SEQ ID NO: 250700 - RNA, 32 nt, Human
ugccacugcacucuagccugggcgacagagcg

SEQ ID NO: 250701 - RNA, 32 nt, Human
ugccacugcacucuagccugggugacaaagca

SEQ ID NO: 250702 - RNA, 32 nt, Human
ugccacugcacucuagccugggugacagagag

SEQ ID NO: 250703 - RNA, 32 nt, Human
ugccacugcacucuagccugggugacagagca

SEQ ID NO: 250704 - RNA, 32 nt, Human
ugccacugcacucuagccugggugacagagcg

SEQ ID NO: 250705 - RNA, 32 nt, Human
ugccacugcacucugggcuggguaacagagug

SEQ ID NO: 250706 - RNA, 32 nt, Human
ugccacugcacugcacuccagccugggugaca

SEQ ID NO: 250707 - RNA, 32 nt, Human
ugccacugcacugcagcccgggcgacagagag

SEQ ID NO: 250708 - RNA, 32 nt, Human
ugccacugcacugcagccugggcgacaauuug

SEQ ID NO: 250709 - RNA, 32 nt, Human
ugccacugcacugcagccugggcgacagagcg

SEQ ID NO: 250710 - RNA, 32 nt, Human
ugccacugcacugcagccugggcuacagagag

SEQ ID NO: 250711 - RNA, 32 nt, Human
ugccacugcacugcaggcugggugacagagug

SEQ ID NO: 250712 - RNA, 32 nt, Human
ugccacugcacuucagccugggcaacagagug

SEQ ID NO: 250713 - RNA, 32 nt, Human
ugccacugcacuucagccugggcgacagagug

SEQ ID NO: 250714 - RNA, 32 nt, Human
ugccacugcacuucagccugggugacagaaag

SEQ ID NO: 250715 - RNA, 32 nt, Human
ugccacugcacuucagccugggugacagagca

SEQ ID NO: 250716 - RNA, 32 nt, Human
ugccacugcacuucagccugggugacagagug

SEQ ID NO: 250717 - RNA, 32 nt, Human
ugccacugcacuuccagccugggugacacagu

SEQ ID NO: 250718 - RNA, 32 nt, Human
ugccacugcacuuccagccugggugacagagu

SEQ ID NO: 250719 - RNA, 32 nt, Human
ugccacugcacuuuagccugggcaacagauca

SEQ ID NO: 250720 - RNA, 32 nt, Human
ugccacugcacuuuagccugggugacagagcg

SEQ ID NO: 250721 - RNA, 32 nt, Human
ugccacugcacuuuucagccugggugccacag

SEQ ID NO: 250722 - RNA, 32 nt, Human
ugccacugcaggagacaggccccaugucagga

SEQ ID NO: 250723 - RNA, 32 nt, Human
ugccacugcaguccagccugggugacagagcc

SEQ ID NO: 250724 - RNA, 32 nt, Human
ugccacugcaugccagccugggcaacaagagu

SEQ ID NO: 250725 - RNA, 32 nt, Human
ugccacugcaugccagccugggcaacagaaca

SEQ ID NO: 250726 - RNA, 32 nt, Human
ugccacugcauuccagccugggcgacagagca

SEQ ID NO: 250727 - RNA, 32 nt, Human
ugccacugcauuccagccugggcgacagagug

SEQ ID NO: 250728 - RNA, 32 nt, Human
ugccacugcauuccagccugggugacagaaug

SEQ ID NO: 250729 - RNA, 32 nt, Human
ugccacugcauuccagccugguugacagagug

SEQ ID NO: 250730 - RNA, 32 nt, Human
ugccacugcauuccagccugugugauggagag

SEQ ID NO: 250731 - RNA, 32 nt, Human
ugccacugcauucuagccugggcaacagagua

SEQ ID NO: 250732 - RNA, 32 nt, Human
ugccacugcauucuagccugggcgauagagug

SEQ ID NO: 250733 - RNA, 32 nt, Human
ugccacugccagcaaccaaagaagccaccugg

SEQ ID NO: 250734 - RNA, 32 nt, Human
ugccacugccaggccucugcccugcagcugaa

SEQ ID NO: 250735 - RNA, 32 nt, Human
ugccacugccccacccugccccacugcugucu

SEQ ID NO: 250736 - RNA, 32 nt, Human
ugccacugcccuccagccugggugacagagug

SEQ ID NO: 250737 - RNA, 32 nt, Human
ugccacugccuugcucugggccuguggugcuc

SEQ ID NO: 250738 - RNA, 32 nt, Human
ugccacugccuuggacaacuugccuacuucca

SEQ ID NO: 250739 - RNA, 32 nt, Human
ugccacugcgcuccagccugggcgacagagug

SEQ ID NO: 250740 - RNA, 32 nt, Human
ugccacugcgcuccagccugggggagggggac

SEQ ID NO: 250741 - RNA, 32 nt, Human
ugccacugcgcuccagccugggugacagagug

SEQ ID NO: 250742 - RNA, 32 nt, Human
ugccacugcgcuccagccuggguggcagagag

SEQ ID NO: 250743 - RNA, 32 nt, Human
ugccacugcucuccagccugggaggcacagca

SEQ ID NO: 250744 - RNA, 32 nt, Human
ugccacugcucuccagccugggugacagagga

SEQ ID NO: 250745 - RNA, 32 nt, Human
ugccacugcuuuccagccugggcaacauagua

SEQ ID NO: 250746 - RNA, 32 nt, Human
ugccacugcuuugucuuucuguuacacauaca

SEQ ID NO: 250747 - RNA, 32 nt, Human
ugccacuggacuccagccugggugaaagagcg

SEQ ID NO: 250748 - RNA, 32 nt, Human
ugccacuggagugugaaugcagucaugaauaa

SEQ ID NO: 250749 - RNA, 32 nt, Human
ugccacugggacaacaugaggccucuaacagc

SEQ ID NO: 250750 - RNA, 32 nt, Human
ugccacugguaccgcggcccagccuggggccu

SEQ ID NO: 250751 - RNA, 32 nt, Human
ugccacuguacaccagccugggugacagagca

SEQ ID NO: 250752 - RNA, 32 nt, Human
ugccacuguacaucaccagccugggcgacaga

SEQ ID NO: 250753 - RNA, 32 nt, Human
ugccacuguacuccagccuaggugacagagca

SEQ ID NO: 250754 - RNA, 32 nt, Human
ugccacuguacuccagccugaagagcgagacu

SEQ ID NO: 250755 - RNA, 32 nt, Human
ugccacuguacuccagccugagcuacagagca

SEQ ID NO: 250756 - RNA, 32 nt, Human
ugccacuguacuccagccugggagauagagca

SEQ ID NO: 250757 - RNA, 32 nt, Human
ugccacuguacuccagccugggcagcagagca

SEQ ID NO: 250758 - RNA, 32 nt, Human
ugccacuguacuccagccugggcgacagaggg

SEQ ID NO: 250759 - RNA, 32 nt, Human
ugccacuguacuccagccugggcgacagcaag

SEQ ID NO: 250760 - RNA, 32 nt, Human
ugccacuguacuccagccugggugacagagcg

SEQ ID NO: 250761 - RNA, 32 nt, Human
ugccacuguacuccagccugggugacagagug

SEQ ID NO: 250762 - RNA, 32 nt, Human
ugccacuguacuccagccugggugauaggaug

SEQ ID NO: 250763 - RNA, 32 nt, Human
ugccacuguacuccagccuggugacagagcga

SEQ ID NO: 250764 - RNA, 32 nt, Human
ugccacuguacuccagcgugggugacagagug

SEQ ID NO: 250765 - RNA, 32 nt, Human
ugccacuguacucuagccuggaagacagagug

SEQ ID NO: 250766 - RNA, 32 nt, Human
ugccacuguacugcagccugggugacagaaug

SEQ ID NO: 250767 - RNA, 32 nt, Human
ugccacuguagucccagcuauucagaaggcug

SEQ ID NO: 250768 - RNA, 32 nt, Human
ugccacuguauuccagacugggugacagagug

SEQ ID NO: 250769 - RNA, 32 nt, Human
ugccacugucagcuuuucuccaaaaagcagcc

SEQ ID NO: 250770 - RNA, 32 nt, Human
ugccacugucugggccccaucugggauuccug

SEQ ID NO: 250771 - RNA, 32 nt, Human
ugccacugugcccagcucuggcccagagggua

SEQ ID NO: 250772 - RNA, 32 nt, Human
ugccacuguggcuccaggaggcccuugggagc

SEQ ID NO: 250773 - RNA, 32 nt, Human
ugccacuguggggcuucugccggccgguaguc

SEQ ID NO: 250774 - RNA, 32 nt, Human
ugccacuguuuuccagccugggcaauacagug

SEQ ID NO: 250775 - RNA, 32 nt, Human
ugccacuuaaagcaauccugaagaaccagaga

SEQ ID NO: 250776 - RNA, 32 nt, Human
ugccacuuacguuuuaaguuauuuaggaacac

SEQ ID NO: 250777 - RNA, 32 nt, Human
ugccacuucacuccagccugggugacaaagug

SEQ ID NO: 250778 - RNA, 32 nt, Human
ugccacuucauuccagccugggcgacagagca

SEQ ID NO: 250779 - RNA, 32 nt, Human
ugccacuucccaggguggagacaguggaaaag

SEQ ID NO: 250780 - RNA, 32 nt, Human
ugccacuucuuaccugcugaaggaucuugcuc

SEQ ID NO: 250781 - RNA, 23 nt, Human
ugccacuucuuccaggggacaga

SEQ ID NO: 250782 - RNA, 32 nt, Human
ugccacuugcccacccacuccccucagaucuc

SEQ ID NO: 250783 - RNA, 32 nt, Human
ugccacuugccuggccaugucaccuugaagcu

SEQ ID NO: 250784 - RNA, 32 nt, Human
ugccacuugcuagcugugagacuguggacaaa

SEQ ID NO: 250785 - RNA, 32 nt, Human
ugccacuugcugccaccaccucuuccuggggc

SEQ ID NO: 250786 - RNA, 32 nt, Human
ugccacuuguggauugucauuuugccaugacu

SEQ ID NO: 250787 - RNA, 21 nt, Human
ugccacuuuaacacuaaugca

SEQ ID NO: 250788 - RNA, 32 nt, Human
ugccacuuuaauccuuccacuaucauucccau

SEQ ID NO: 250789 - RNA, 32 nt, Human
ugccacuuucaucagguuugugucucaucucc

SEQ ID NO: 250790 - RNA, 32 nt, Human
ugccacuuuugcuugcccuccuggcuggggug

SEQ ID NO: 250791 - RNA, 32 nt, Human
ugccacuuuuggacuuucaucauccuccugaa

SEQ ID NO: 250792 - RNA, 32 nt, Human
ugccagaaagcuguacuugaguuaaacauagg

SEQ ID NO: 250793 - RNA, 32 nt, Human
ugccagaaaugagagauuaggagcugggagaa

SEQ ID NO: 250794 - RNA, 32 nt, Human
ugccagaaauuauaucuuugguugugauuuaa

SEQ ID NO: 250795 - RNA, 32 nt, Human
ugccagaagcagcauccuccacuuguucaggg

SEQ ID NO: 250796 - RNA, 32 nt, Human
ugccagaagccaggggaccaucaggggcuggu

SEQ ID NO: 250797 - RNA, 32 nt, Human
ugccagaagguaaucacucagauacacuuggg

SEQ ID NO: 250798 - RNA, 32 nt, Human
ugccagaaugaaguaggaaagaggagggaucc

SEQ ID NO: 250799 - RNA, 32 nt, Human
ugccagaauguaagaguugcaagugauuuugu

SEQ ID NO: 250800 - RNA, 32 nt, Human
ugccagaaugucucuuuagaacaagaguuaga

SEQ ID NO: 250801 - RNA, 32 nt, Human
ugccagaauuacaggcaugagccaccaugccu

SEQ ID NO: 250802 - RNA, 32 nt, Human
ugccagacaucaucugauuuacaaucaaaaau

SEQ ID NO: 250803 - RNA, 32 nt, Human
ugccagacccaggaguggagggcucugugagg

SEQ ID NO: 250804 - RNA, 32 nt, Human
ugccagacuucugagaagcaccugccagcaac

SEQ ID NO: 250805 - RNA, 32 nt, Human
ugccagagaaaccacccccacuccaugagaag

SEQ ID NO: 250806 - RNA, 32 nt, Human
ugccagagaaagcagagaugcugagagacauu

SEQ ID NO: 250807 - RNA, 32 nt, Human
ugccagagaagcaggaggaggauggagagaau

SEQ ID NO: 250808 - RNA, 32 nt, Human
ugccagagacgccucauuuucuuuccaucccc

SEQ ID NO: 250809 - RNA, 32 nt, Human
ugccagagauucaccaccuggggcccaggauc

SEQ ID NO: 250810 - RNA, 32 nt, Human
ugccagagcaagacucaaagaggcagagguuu

SEQ ID NO: 250811 - RNA, 22 nt, Human
ugccagagcccagccggcgcgg

SEQ ID NO: 250812 - RNA, 32 nt, Human
ugccagagccucuuccugugaggcggggguaa

SEQ ID NO: 250813 - RNA, 32 nt, Human
ugccagagccuugaucccucccuaggcccugc

SEQ ID NO: 250814 - RNA, 23 nt, Human
ugccagagcugauccucccuagg

SEQ ID NO: 250815 - RNA, 32 nt, Human
ugccagagcugggagcucugcagguaugaguc

SEQ ID NO: 250816 - RNA, 32 nt, Human
ugccagaggacgcaggaaauuagccagguugc

SEQ ID NO: 250817 - RNA, 32 nt, Human
ugccagaggaggcagcgggauuguaguggcgc

SEQ ID NO: 250818 - RNA, 31 nt, Human
ugccagaggagugcucccaugccagcuuccc

SEQ ID NO: 250819 - RNA, 32 nt, Human
ugccagagguucagggagaacagcugcguugc

SEQ ID NO: 250820 - RNA, 32 nt, Human
ugccagauaaaugaucagauauucuauagagu

SEQ ID NO: 250821 - RNA, 19 nt, Human
ugccagauaccgggcuaag

SEQ ID NO: 250822 - RNA, 32 nt, Human
ugccagaucuucucagagcuuuagcuuuucua

SEQ ID NO: 250823 - RNA, 32 nt, Human
ugccagaugccgggggcagucagcauuaauga

SEQ ID NO: 250824 - RNA, 32 nt, Human
ugccagaugugggcucagauccugggcaugau

SEQ ID NO: 250825 - RNA, 32 nt, Human
ugccagcaacaucucuauugcuggaugguccc

SEQ ID NO: 250826 - RNA, 32 nt, Human
ugccagcaacugcagaggaugcagccaccugc

SEQ ID NO: 250827 - RNA, 32 nt, Human
ugccagcaaggcagcaagacuuccugcuaucc

SEQ ID NO: 250828 - RNA, 23 nt, Human
ugccagcacaggccccucccugg

SEQ ID NO: 250829 - RNA, 32 nt, Human
ugccagcaccugcggggcagguguuuucugug

SEQ ID NO: 250830 - RNA, 32 nt, Human
ugccagcaccuugaucuugaacuucucagccu

SEQ ID NO: 250831 - RNA, 32 nt, Human
ugccagcaccuugccuggccccuccccaggcu

SEQ ID NO: 250832 - RNA, 32 nt, Human
ugccagcaccuugcuccccacugcccagggcu

SEQ ID NO: 250833 - RNA, 32 nt, Human
ugccagcaccuuggucuuggacuucccagccu

SEQ ID NO: 250834 - RNA, 32 nt, Human
ugccagcacgggaucccugaagugacucagcc

SEQ ID NO: 250835 - RNA, 24 nt, Human
ugccagcacucccccuucacccca

SEQ ID NO: 250836 - RNA, 32 nt, Human
ugccagcacuuaguacagccucaggccuauac

SEQ ID NO: 250837 - RNA, 23 nt, Human
ugccagcagaaggucccccaggu

SEQ ID NO: 250838 - RNA, 32 nt, Human
ugccagcagccccgucugcccaccauucccgg

SEQ ID NO: 250839 - RNA, 21 nt, Human
ugccagcagccuagacccugg

SEQ ID NO: 250840 - RNA, 18 nt, Human
ugccagcagcugagcugg

SEQ ID NO: 250841 - RNA, 20 nt, Human
ugccagcagcugcgccccgg

SEQ ID NO: 250842 - RNA, 24 nt, Human
ugccagcagcuguccucccuggug

SEQ ID NO: 250843 - RNA, 19 nt, Human
ugccagcagcuguuucugg

SEQ ID NO: 250844 - RNA, 21 nt, Human
ugccagcagcuuguacccagg

SEQ ID NO: 250845 - RNA, 32 nt, Human
ugccagcaggguguacggaguggaggguacag

SEQ ID NO: 250846 - RNA, 32 nt, Human
ugccagcaguagcagggcugcccacgccccuu

SEQ ID NO: 250847 - RNA, 32 nt, Human
ugccagcagugcccgcccccacccucaaagcu

SEQ ID NO: 250848 - RNA, 32 nt, Human
ugccagcauccagcaugagcagaugucgggga

SEQ ID NO: 250849 - RNA, 32 nt, Human
ugccagcauccagcgugagcagacgucgggga

SEQ ID NO: 250850 - RNA, 20 nt, Human
ugccagcauccccuccaggg

SEQ ID NO: 250851 - RNA, 32 nt, Human
ugccagcaugacaagcuccagcaucaguggag

SEQ ID NO: 250852 - RNA, 32 nt, Human
ugccagcaugccugccugcccaccucagagcc

SEQ ID NO: 250853 - RNA, 32 nt, Human
ugccagccaacaacaaaugccugaucuuccgg

SEQ ID NO: 250854 - RNA, 32 nt, Human
ugccagccacugcucuagagaugggaaaacag

SEQ ID NO: 250855 - RNA, 32 nt, Human
ugccagccagaggcgcugggugugcugggugc

SEQ ID NO: 250856 - RNA, 32 nt, Human
ugccagccagccugucccaccacagcgggcuc

SEQ ID NO: 250857 - RNA, 21 nt, Human
ugccagccagccuuggggaca

SEQ ID NO: 250858 - RNA, 23 nt, Human
ugccagccaggcuggagugcagu

SEQ ID NO: 250859 - RNA, 24 nt, Human
ugccagccaggcuggagugcagug

SEQ ID NO: 250860 - RNA, 23 nt, Human
ugccagccaggucagaacauccu

SEQ ID NO: 250861 - RNA, 21 nt, Human
ugccagccauaccuuccuggu

SEQ ID NO: 250862 - RNA, 32 nt, Human
ugccagccauuucucaaacccaccucggacca

SEQ ID NO: 250863 - RNA, 23 nt, Human
ugccagcccacccugcagcccug

SEQ ID NO: 250864 - RNA, 32 nt, Human
ugccagccccacccuccagucgguccggacgc

SEQ ID NO: 250865 - RNA, 32 nt, Human
ugccagccccacucaacuuucaguuggcucug

SEQ ID NO: 250866 - RNA, 32 nt, Human
ugccagccccagagacagaugugggcacagga

SEQ ID NO: 250867 - RNA, 32 nt, Human
ugccagccccagcuucagccccggcucagguc

SEQ ID NO: 250868 - RNA, 32 nt, Human
ugccagccccggaugaggccaucuggccucca

SEQ ID NO: 250869 - RNA, 32 nt, Human
ugccagccccucuccacugagaaguugggcug

SEQ ID NO: 250870 - RNA, 32 nt, Human
ugccagcccggccuggccacaggugaggucug

SEQ ID NO: 250871 - RNA, 32 nt, Human
ugccagcccugccuguucucucaccccgcuuc

SEQ ID NO: 250872 - RNA, 32 nt, Human
ugccagcccugcggaaccagagccucaggcug

SEQ ID NO: 250873 - RNA, 32 nt, Human
ugccagcccugcugcacagggugcaggcauug

SEQ ID NO: 250874 - RNA, 21 nt, Human
ugccagcccuggcccggcugc

SEQ ID NO: 250875 - RNA, 21 nt, Human
ugccagccgccgccgccgccg

SEQ ID NO: 250876 - RNA, 22 nt, Human
ugccagccgccgccgccgccgc

SEQ ID NO: 250877 - RNA, 32 nt, Human
ugccagccuccuugcugaccccaggucagccc

SEQ ID NO: 250878 - RNA, 32 nt, Human
ugccagccucgaagccucuuugcugaccugga

SEQ ID NO: 250879 - RNA, 32 nt, Human
ugccagccugcagcucuccugcuugacacuga

SEQ ID NO: 250880 - RNA, 32 nt, Human
ugccagccuggaggaggaaagggagccugcuc

SEQ ID NO: 250881 - RNA, 32 nt, Human
ugccagccuggcaacagagcaagacucugucu

SEQ ID NO: 250882 - RNA, 18 nt, Human
ugccagccuucuccccag

SEQ ID NO: 250883 - RNA, 32 nt, Human
ugccagccuuucuacuccuuugcccuuuuccc

SEQ ID NO: 250884 - RNA, 18 nt, Human
ugccagcgacucccagga

SEQ ID NO: 250885 - RNA, 32 nt, Human
ugccagcgacugucucagacugggcagggagg

SEQ ID NO: 250886 - RNA, 20 nt, Human
ugccagcgagagccgcggga

SEQ ID NO: 250887 - RNA, 21 nt, Human
ugccagcgagagggaccaggg

SEQ ID NO: 250888 - RNA, 22 nt, Human
ugccagcgagcccaacccgcga

SEQ ID NO: 250889 - RNA, 21 nt, Human
ugccagcgaguuaccacggga

SEQ ID NO: 250890 - RNA, 22 nt, Human
ugccagcgcaacgccucccugg

SEQ ID NO: 250891 - RNA, 32 nt, Human
ugccagcgcagcguucugggcuccucagucgc

SEQ ID NO: 250892 - RNA, 32 nt, Human
ugccagcgcagucugcugggacaugcacauau

SEQ ID NO: 250893 - RNA, 32 nt, Human
ugccagcggagcagugcccugguacuugcugu

SEQ ID NO: 250894 - RNA, 32 nt, Human
ugccagcggccucuguucccugcagucugugc

SEQ ID NO: 250895 - RNA, 32 nt, Human
ugccagcgggcucggcccuguccuccucacag

SEQ ID NO: 250896 - RNA, 32 nt, Human
ugccagcgugccucagagaccccacaccaaca

SEQ ID NO: 250897 - RNA, 32 nt, Human
ugccagcuacuuccuccuccccacuuguccgc

SEQ ID NO: 250898 - RNA, 32 nt, Human
ugccagcucacaaggggaggcugcaguggguu

SEQ ID NO: 250899 - RNA, 32 nt, Human
ugccagcucauuuccuucaauuuccuuugacc

SEQ ID NO: 250900 - RNA, 32 nt, Human
ugccagcuccaauguaccagcagcuggaaucu

SEQ ID NO: 250901 - RNA, 32 nt, Human
ugccagcuccacaagcccuggacuucagggag

SEQ ID NO: 250902 - RNA, 27 nt, Human
ugccagcucccaacacccuuccuggug

SEQ ID NO: 250903 - RNA, 21 nt, Human
ugccagcuccgagacccggga

SEQ ID NO: 250904 - RNA, 32 nt, Human
ugccagcucugcugccaccucugacaggugug

SEQ ID NO: 250905 - RNA, 32 nt, Human
ugccagcucugggccaugaucucuuggcacug

SEQ ID NO: 250906 - RNA, 32 nt, Human
ugccagcucuguucugauucaccagggguccg

SEQ ID NO: 250907 - RNA, 23 nt, Human
ugccagcucuuaauugcauccuu

SEQ ID NO: 250908 - RNA, 32 nt, Human
ugccagcugcaaccuccgcuagguacgauaca

SEQ ID NO: 250909 - RNA, 32 nt, Human
ugccagcugcaaccuccgguagguacgauaca

SEQ ID NO: 250910 - RNA, 32 nt, Human
ugccagcuggccuaccugacugugccaggggc

SEQ ID NO: 250911 - RNA, 32 nt, Human
ugccagcuggccuggggauucugagugguguc

SEQ ID NO: 250912 - RNA, 22 nt, Human
ugccagcugggaguccucccgg

SEQ ID NO: 250913 - RNA, 32 nt, Human
ugccagcugggcugaaggauccuguucccaug

SEQ ID NO: 250914 - RNA, 21 nt, Human
ugccagcuggggcccucccug

SEQ ID NO: 250915 - RNA, 32 nt, Human
ugccagcugggugggaggagcagccgagugaa

SEQ ID NO: 250916 - RNA, 32 nt, Human
ugccagcuugcaucugccaucauuugaugccc

SEQ ID NO: 250917 - RNA, 32 nt, Human
ugccaggaaaaucuacccccuuccuccagcac

SEQ ID NO: 250918 - RNA, 32 nt, Human
ugccaggaaaccagauguggcccagaugucca

SEQ ID NO: 250919 - RNA, 32 nt, Human
ugccaggaacacugagggcggagccaggggaa

SEQ ID NO: 250920 - RNA, 32 nt, Human
ugccaggaagagaagaaagggggugcagucug

SEQ ID NO: 250921 - RNA, 32 nt, Human
ugccaggaagccaaauuccaaaugucuaaacu

SEQ ID NO: 250922 - RNA, 32 nt, Human
ugccaggaauggcgggccugcccaacguguuu

SEQ ID NO: 250923 - RNA, 32 nt, Human
ugccaggacaccugccccagcgcggcuuggcc

SEQ ID NO: 250924 - RNA, 24 nt, Human
ugccaggacacuguccuggugccc

SEQ ID NO: 250925 - RNA, 18 nt, Human
ugccaggaccgggccgag

SEQ ID NO: 250926 - RNA, 32 nt, Human
ugccaggaccugcucccagcuccacgacgugu

SEQ ID NO: 250927 - RNA, 31 nt, Human
ugccaggacuccucugggcuugcagucgcuc

SEQ ID NO: 250928 - RNA, 23 nt, Human
ugccaggacucucuuucuuccac

SEQ ID NO: 250929 - RNA, 32 nt, Human
ugccaggacuugggaagcagucacugugaaau

SEQ ID NO: 250930 - RNA, 32 nt, Human
ugccaggagcagagacaggguggccgaagucc

SEQ ID NO: 250931 - RNA, 32 nt, Human
ugccaggagcccuucucccaaagauggagaaa

SEQ ID NO: 250932 - RNA, 32 nt, Human
ugccaggagccuuccugugcuccccauugccu

SEQ ID NO: 250933 - RNA, 32 nt, Human
ugccaggagcuaauggagccaggccugacacc

SEQ ID NO: 250934 - RNA, 23 nt, Human
ugccaggagcucagggcugagcu

SEQ ID NO: 250935 - RNA, 31 nt, Human
ugccaggaggugugagagugaucuguccugu

SEQ ID NO: 250936 - RNA, 32 nt, Human
ugccaggagugaugcauccagaaaagaaguca

SEQ ID NO: 250937 - RNA, 32 nt, Human
ugccaggauccuccgaggucagcugcuggguc

SEQ ID NO: 250938 - RNA, 23 nt, Human
ugccaggaucuguuuccgccaca

SEQ ID NO: 250939 - RNA, 19 nt, Human
ugccaggauggagugcagu

SEQ ID NO: 250940 - RNA, 20 nt, Human
ugccaggauggagugcagug

SEQ ID NO: 250941 - RNA, 21 nt, Human
ugccaggauggagugcagugg

SEQ ID NO: 250942 - RNA, 32 nt, Human
ugccaggauuacaggcaugagccacugugucc

SEQ ID NO: 250943 - RNA, 32 nt, Human
ugccaggcaacaggacuaaacuaccuccaaag

SEQ ID NO: 250944 - RNA, 32 nt, Human
ugccaggcagcacacccaggaggccggcccug

SEQ ID NO: 250945 - RNA, 32 nt, Human
ugccaggcagggacugucggguugacccugag

SEQ ID NO: 250946 - RNA, 32 nt, Human
ugccaggcauguccuaggcucugggugcagua

SEQ ID NO: 250947 - RNA, 32 nt, Human
ugccaggccacugaggaugggcaggggucucu

SEQ ID NO: 250948 - RNA, 20 nt, Human
ugccaggccagagugcagug

SEQ ID NO: 250949 - RNA, 32 nt, Human
ugccaggcccacacauccccaguuguugguuu

SEQ ID NO: 250950 - RNA, 32 nt, Human
ugccaggcccaggcccggucucagucccagag

SEQ ID NO: 250951 - RNA, 32 nt, Human
ugccaggccccaaauugaggaaguugacugcc

SEQ ID NO: 250952 - RNA, 32 nt, Human
ugccaggcccgccucuggcuccugggccuggg

SEQ ID NO: 250953 - RNA, 32 nt, Human
ugccaggcccgcugccaagagcuagagaggag

SEQ ID NO: 250954 - RNA, 22 nt, Human
ugccaggcccucuccugccaca

SEQ ID NO: 250955 - RNA, 21 nt, Human
ugccaggccuccaacucggga

SEQ ID NO: 250956 - RNA, 32 nt, Human
ugccaggccuccugggucugcagugagucugg

SEQ ID NO: 250957 - RNA, 32 nt, Human
ugccaggccuucucccccuccccaguguccuc

SEQ ID NO: 250958 - RNA, 32 nt, Human
ugccaggcucaagcaguucuccugccucagcc

SEQ ID NO: 250959 - RNA, 32 nt, Human
ugccaggcugcccuauacacugggggauucug

SEQ ID NO: 250960 - RNA, 18 nt, Human
ugccaggcugggugcagu

SEQ ID NO: 250961 - RNA, 19 nt, Human
ugccaggcugggugcagug

SEQ ID NO: 250962 - RNA, 20 nt, Human
ugccaggcugggugcagugg

SEQ ID NO: 250963 - RNA, 32 nt, Human
ugccaggcuggucucaaacuccuggguucaag

SEQ ID NO: 250964 - RNA, 32 nt, Human
ugccaggcuguuuucuguagccucagauugcc

SEQ ID NO: 250965 - RNA, 21 nt, Human
ugccaggcuuccuuuugggca

SEQ ID NO: 250966 - RNA, 32 nt, Human
ugccagggaagaagguuugaaagauacgguug

SEQ ID NO: 250967 - RNA, 32 nt, Human
ugccagggagggcuggccucaccaccaccguc

SEQ ID NO: 250968 - RNA, 32 nt, Human
ugccagggaugccgggaacacugucgaagaac

SEQ ID NO: 250969 - RNA, 32 nt, Human
ugccagggaugucuucacugagggcuauggau

SEQ ID NO: 250970 - RNA, 32 nt, Human
ugccagggccacugcaaagaguucugugucua

SEQ ID NO: 250971 - RNA, 32 nt, Human
ugccagggccuggaguggagguucaggaccaa

SEQ ID NO: 250972 - RNA, 32 nt, Human
ugccagggcucauuugaccucuacuucaucuu

SEQ ID NO: 250973 - RNA, 32 nt, Human
ugccagggcuccugccugcuccuccuguguua

SEQ ID NO: 250974 - RNA, 32 nt, Human
ugccagggcugcugccccgcucccuccuccuc

SEQ ID NO: 250975 - RNA, 31 nt, Human
ugccaggggagaccugggaccuggacggcca

SEQ ID NO: 250976 - RNA, 32 nt, Human
ugccaggggagagacagccacgguccucuuug

SEQ ID NO: 250977 - RNA, 32 nt, Human
ugccaggggaggaggagaagccagcaggcacc

SEQ ID NO: 250978 - RNA, 32 nt, Human
ugccaggggccugggggugggucucuugcugu

SEQ ID NO: 250979 - RNA, 32 nt, Human
ugccagggggaggcggcagugggcagggggug

SEQ ID NO: 250980 - RNA, 32 nt, Human
ugccagggucagaucucgccuccgaggaaggu

SEQ ID NO: 250981 - RNA, 32 nt, Human
ugccaggguccugguagcuuccucuucaacag

SEQ ID NO: 250982 - RNA, 32 nt, Human
ugccagguacaaauuuguuuauuccaggauca

SEQ ID NO: 250983 - RNA, 32 nt, Human
ugccagguacccagagaugucaucucucucca

SEQ ID NO: 250984 - RNA, 32 nt, Human
ugccagguaggcagcaggcggcaggggguuaa

SEQ ID NO: 250985 - RNA, 32 nt, Human
ugccaggucaucucugccagggcacaguucau

SEQ ID NO: 250986 - RNA, 32 nt, Human
ugccaggucccaggaacucaggcuucagguga

SEQ ID NO: 250987 - RNA, 32 nt, Human
ugccagguccuccuccucacucagcccugccg

SEQ ID NO: 250988 - RNA, 32 nt, Human
ugccaggugaccuugggcaagugucuuuacug

SEQ ID NO: 250989 - RNA, 32 nt, Human
ugccaggugagcugcccuggggguucacugga

SEQ ID NO: 250990 - RNA, 32 nt, Human
ugccagguggaggacucccaucaccuucucuc

SEQ ID NO: 250991 - RNA, 32 nt, Human
ugccagguggaggugauuagggggaggaugcu

SEQ ID NO: 250992 - RNA, 32 nt, Human
ugccaggugggagcugccuuccccagcccagu

SEQ ID NO: 250993 - RNA, 32 nt, Human
ugccagguggguccuacagcaggucacaaaug

SEQ ID NO: 250994 - RNA, 32 nt, Human
ugccagguuaccacggugugcacagggcagag

SEQ ID NO: 250995 - RNA, 23 nt, Human
ugccagguuuuacccucccuggu

SEQ ID NO: 250996 - RNA, 32 nt, Human
ugccagguuuuucugacuugauuucuguaauu

SEQ ID NO: 250997 - RNA, 32 nt, Human
ugccaguaagguucuacauaccacugaccauc

SEQ ID NO: 250998 - RNA, 19 nt, Human
ugccaguaagugacuggau

SEQ ID NO: 250999 - RNA, 32 nt, Human
ugccaguacugaugcccaguuugcauuuuaaa

SEQ ID NO: 251000 - RNA, 24 nt, Human
ugccaguagcacccccgcuagagc

SEQ ID NO: 251001 - RNA, 32 nt, Human
ugccaguaggacaucugggcucugggcugcau

SEQ ID NO: 251002 - RNA, 32 nt, Human
ugccaguauccagcaguaucuggaccacaggc

SEQ ID NO: 251003 - RNA, 32 nt, Human
ugccaguauguuccaaacccuccugggaaggc

SEQ ID NO: 251004 - RNA, 22 nt, Human
ugccagucacccuaaaaugcuu

SEQ ID NO: 251005 - RNA, 32 nt, Human
ugccagucagcccuuuugaguucccgccucac

SEQ ID NO: 251006 - RNA, 32 nt, Human
ugccaguccaggcuuucuuccuuguccuugcc

SEQ ID NO: 251007 - RNA, 32 nt, Human
ugccagucccugugccuggacugauuggaaca

SEQ ID NO: 251008 - RNA, 21 nt, Human
ugccagucggcucccugcuca

SEQ ID NO: 251009 - RNA, 32 nt, Human
ugccagucucacugcgcccucuccuccaaccu

SEQ ID NO: 251010 - RNA, 32 nt, Human
ugccagucucagccuccggucuccguuccccc

SEQ ID NO: 251011 - RNA, 32 nt, Human
ugccagucucugcugucucacccuuaugagca

SEQ ID NO: 251012 - RNA, 32 nt, Human
ugccagucuuucuccccugcagcuuccucugc

SEQ ID NO: 251013 - RNA, 32 nt, Human
ugccagugaagccaggccuggggaaggcuccu

SEQ ID NO: 251014 - RNA, 32 nt, Human
ugccagugagccacacuccuggacacucucua

SEQ ID NO: 251015 - RNA, 24 nt, Human
ugccagugagccacguccaugccc

SEQ ID NO: 251016 - RNA, 32 nt, Human
ugccagugaugaugcaguuagcugcucaguga

SEQ ID NO: 251017 - RNA, 32 nt, Human
ugccagugcacuccagccugggcaacagagua

SEQ ID NO: 251018 - RNA, 32 nt, Human
ugccagugcacuccagccugggugacagcgag

SEQ ID NO: 251019 - RNA, 32 nt, Human
ugccagugcacuccaggcuggacgacagagca

SEQ ID NO: 251020 - RNA, 32 nt, Human
ugccagugcacuccggccugggugacagagug

SEQ ID NO: 251021 - RNA, 32 nt, Human
ugccagugcagaaguuucuccagguggccucc

SEQ ID NO: 251022 - RNA, 32 nt, Human
ugccagugccacuuuuaagaagugaaucacua

SEQ ID NO: 251023 - RNA, 21 nt, Human
ugccagugccgcccgcagccc

SEQ ID NO: 251024 - RNA, 32 nt, Human
ugccagugcuuugcacacaagcucugcgccaa

SEQ ID NO: 251025 - RNA, 32 nt, Human
ugccaguggaagagagaaagcaggcgaguguu

SEQ ID NO: 251026 - RNA, 32 nt, Human
ugccaguggaggccucucacauccggagccca

SEQ ID NO: 251027 - RNA, 32 nt, Human
ugccaguggaggcugcggggcaccagggcggg

SEQ ID NO: 251028 - RNA, 32 nt, Human
ugccaguggccaccgcuagggucuccacaggc

SEQ ID NO: 251029 - RNA, 32 nt, Human
ugccaguggcccagggugugugcagggcagcu

SEQ ID NO: 251030 - RNA, 32 nt, Human
ugccaguggcuuagcuugaauuacaggguaaa

SEQ ID NO: 251031 - RNA, 32 nt, Human
ugccaguggugacugccaggaacguccuauga

SEQ ID NO: 251032 - RNA, 32 nt, Human
ugccagugucccuccgucccagggggcugugc

SEQ ID NO: 251033 - RNA, 32 nt, Human
ugccagugucuucaucucuucauaaaggugcc

SEQ ID NO: 251034 - RNA, 32 nt, Human
ugccagugugaccucacccucuccagucaccc

SEQ ID NO: 251035 - RNA, 32 nt, Human
ugccagugugggcaagggcucagccucucugc

SEQ ID NO: 251036 - RNA, 32 nt, Human
ugccaguguuacuccagcaggcaaccaagaag

SEQ ID NO: 251037 - RNA, 32 nt, Human
ugccaguuauagguggaugugccaagaugcug

SEQ ID NO: 251038 - RNA, 32 nt, Human
ugccaguuaucauaggcuguuuuaaguuagaa

SEQ ID NO: 251039 - RNA, 32 nt, Human
ugccaguuauccuggcuucccaacuggucaga

SEQ ID NO: 251040 - RNA, 32 nt, Human
ugccaguuccaaugcucccagauucuaaucuc

SEQ ID NO: 251041 - RNA, 32 nt, Human
ugccaguuccacagacuggagugagaacuuau

SEQ ID NO: 251042 - RNA, 32 nt, Human
ugccaguucccauccagcaccgaagaaaauca

SEQ ID NO: 251043 - RNA, 32 nt, Human
ugccaguuccuucccucuuuccuuccuuucuu

SEQ ID NO: 251044 - RNA, 32 nt, Human
ugccaguucucccuggaacuccuggccuuuug

SEQ ID NO: 251045 - RNA, 32 nt, Human
ugccaguugggcucgcacugcccacaugggac

SEQ ID NO: 251046 - RNA, 32 nt, Human
ugccaguuuucccuggaacuccuggccuuuug

SEQ ID NO: 251047 - RNA, 24 nt, Human
ugccaguuuucuuccuuguuuaca

SEQ ID NO: 251048 - RNA, 32 nt, Human
ugccaguuuugucaaagggaagguaaagccgu

SEQ ID NO: 251049 - RNA, 19 nt, Human
ugccauaacauccugcucc

SEQ ID NO: 251050 - RNA, 32 nt, Human
ugccauaauauacaaacuucuacuuucgucag

SEQ ID NO: 251051 - RNA, 32 nt, Human
ugccauaauguugaauaaaacucucuucuuau

SEQ ID NO: 251052 - RNA, 31 nt, Human
ugccauacaaaaacuuaacauuuaaaacuga

SEQ ID NO: 251053 - RNA, 32 nt, Human
ugccauacccugcucacccuagucucugcagg

SEQ ID NO: 251054 - RNA, 32 nt, Human
ugccauaggccauacauguuacuguaaucagu

SEQ ID NO: 251055 - RNA, 32 nt, Human
ugccauagggaaauggauuugguccugggggu

SEQ ID NO: 251056 - RNA, 24 nt, Human
ugccauaguucauugauuuuuaca

SEQ ID NO: 251057 - RNA, 32 nt, Human
ugccauauaaaggagauguuucucauucgccc

SEQ ID NO: 251058 - RNA, 32 nt, Human
ugccauauccuccccauuaucucccccuuguc

SEQ ID NO: 251059 - RNA, 32 nt, Human
ugccaucaacuuuguuuccucaucucaaauaa

SEQ ID NO: 251060 - RNA, 32 nt, Human
ugccaucaccacggcucacugcagccucagcg

SEQ ID NO: 251061 - RNA, 21 nt, Human
ugccaucaccggugaacagcu

SEQ ID NO: 251062 - RNA, 32 nt, Human
ugccaucacuggcucuuguccucucuuuacug

SEQ ID NO: 251063 - RNA, 32 nt, Human
ugccaucagcuccuuccuccccuguucauucu

SEQ ID NO: 251064 - RNA, 32 nt, Human
ugccaucaucugcuauuucugccacuucucuu

SEQ ID NO: 251065 - RNA, 32 nt, Human
ugccaucaugaggaaucaaugagagaucugug

SEQ ID NO: 251066 - RNA, 32 nt, Human
ugccaucauugcugucugcagccuugaacucu

SEQ ID NO: 251067 - RNA, 32 nt, Human
ugccaucauuguuuagaagucauagaaagaau

SEQ ID NO: 251068 - RNA, 32 nt, Human
ugccauccacguaagaugugacuugcaccucc

SEQ ID NO: 251069 - RNA, 32 nt, Human
ugccauccacugcagacgccuggagagggaca

SEQ ID NO: 251070 - RNA, 23 nt, Human
ugccauccagguuugagugcagu

SEQ ID NO: 251071 - RNA, 20 nt, Human
ugccauccagugagaacagc

SEQ ID NO: 251072 - RNA, 32 nt, Human
ugccaucccagccucacccugcauuuuauucg

SEQ ID NO: 251073 - RNA, 32 nt, Human
ugccauccccuggguuuugcccaaaccugaac

SEQ ID NO: 251074 - RNA, 32 nt, Human
ugccaucccugcacacagccuggggagaagcc

SEQ ID NO: 251075 - RNA, 32 nt, Human
ugccaucccugcagcccagcugguggugcugc

SEQ ID NO: 251076 - RNA, 32 nt, Human
ugccaucccugccugugccuagaucagagccc

SEQ ID NO: 251077 - RNA, 32 nt, Human
ugccaucccuggcagcccccaccgguguccug

SEQ ID NO: 251078 - RNA, 32 nt, Human
ugccaucccugucuccuccauccuggcugugc

SEQ ID NO: 251079 - RNA, 32 nt, Human
ugccauccgccuggccuucgucauuguguuug

SEQ ID NO: 251080 - RNA, 32 nt, Human
ugccauccuccagcaagaugcuagggucuuug

SEQ ID NO: 251081 - RNA, 32 nt, Human
ugccauccuccugccuccucuucacucagugc

SEQ ID NO: 251082 - RNA, 32 nt, Human
ugccauccucuccuauuuaucucugaggaucg

SEQ ID NO: 251083 - RNA, 32 nt, Human
ugccauccuucccucuuccugccugccagaag

SEQ ID NO: 251084 - RNA, 22 nt, Human
ugccauccuucucaaaagacuu

SEQ ID NO: 251085 - RNA, 32 nt, Human
ugccauccuuggcuggagugucuaaggcucca

SEQ ID NO: 251086 - RNA, 32 nt, Human
ugccaucgcacucuagccuggggaauagagug

SEQ ID NO: 251087 - RNA, 32 nt, Human
ugccaucgugguguguucuugacuccacccuc

SEQ ID NO: 251088 - RNA, 32 nt, Human
ugccaucguuguucuuguuacugguuuuauuu

SEQ ID NO: 251089 - RNA, 32 nt, Human
ugccaucuacagccacacugccaccuaugguu

SEQ ID NO: 251090 - RNA, 21 nt, Human
ugccaucuauccaccugccca

SEQ ID NO: 251091 - RNA, 32 nt, Human
ugccaucucagaccagaggaacagggaggggg

SEQ ID NO: 251092 - RNA, 32 nt, Human
ugccaucucaguugcugcagugcagugaauua

SEQ ID NO: 251093 - RNA, 32 nt, Human
ugccaucuccucaucccugagccaucucccug

SEQ ID NO: 251094 - RNA, 32 nt, Human
ugccaucucugagauacugaugacguuugccu

SEQ ID NO: 251095 - RNA, 32 nt, Human
ugccaucugcucugggaagcaccagggugucc

SEQ ID NO: 251096 - RNA, 32 nt, Human
ugccaucugcuuugaaaacgucucauucauuu

SEQ ID NO: 251097 - RNA, 32 nt, Human
ugccaucugggagucugugugcucagccuccg

SEQ ID NO: 251098 - RNA, 32 nt, Human
ugccaucugggcauacaaauaagaaguuuguc

SEQ ID NO: 251099 - RNA, 32 nt, Human
ugccaucuggggagggacaggcauaagccacu

SEQ ID NO: 251100 - RNA, 32 nt, Human
ugccaucuguagauucaaaaauccagagacua

SEQ ID NO: 251101 - RNA, 32 nt, Human
ugccaucugucagugucugccugcgccaccuc

SEQ ID NO: 251102 - RNA, 32 nt, Human
ugccaucuugcccaggcuggucucaaauuccu

SEQ ID NO: 251103 - RNA, 32 nt, Human
ugccaucuuuagcgcuggcuucauucucagac

SEQ ID NO: 251104 - RNA, 32 nt, Human
ugccaugaccaccacccauaccgcccguggaa

SEQ ID NO: 251105 - RNA, 29 nt, Human
ugccaugacgaccgcguccaccucgcagg

SEQ ID NO: 251106 - RNA, 32 nt, Human
ugccaugauccaggcugaaccaauauacagug

SEQ ID NO: 251107 - RNA, 32 nt, Human
ugccaugauggaaacagauagugaagaguuac

SEQ ID NO: 251108 - RNA, 32 nt, Human
ugccaugcacauagggaagggucaguaagaga

SEQ ID NO: 251109 - RNA, 32 nt, Human
ugccaugccaggugguuuggggaccaagaugu

SEQ ID NO: 251110 - RNA, 32 nt, Human
ugccaugccugcucccugucugugucccagcc

SEQ ID NO: 251111 - RNA, 32 nt, Human
ugccaugcgccgaggcacuuccaggcuucacu

SEQ ID NO: 251112 - RNA, 32 nt, Human
ugccaugcuaucugcucugcucagcgacugaa

SEQ ID NO: 251113 - RNA, 18 nt, Human
ugccaugcucugcugccu

SEQ ID NO: 251114 - RNA, 32 nt, Human
ugccaugcucuguaccaugugaccucacaauc

SEQ ID NO: 251115 - RNA, 29 nt, Human
ugccauggaaccuggcccugcucuggccu

SEQ ID NO: 251116 - RNA, 32 nt, Human
ugccauggaagaggcaggaugagcagcucagc

SEQ ID NO: 251117 - RNA, 32 nt, Human
ugccauggaagcuucccaucagucucccagcu

SEQ ID NO: 251118 - RNA, 32 nt, Human
ugccauggacacuucacccacccuccaggacc

SEQ ID NO: 251119 - RNA, 29 nt, Human
ugccauggagccagcacccccuagccagg

SEQ ID NO: 251120 - RNA, 32 nt, Human
ugccauggagcggcucugauuggaggcuugag

SEQ ID NO: 251121 - RNA, 32 nt, Human
ugccauggaggcacacagcugcagagacagag

SEQ ID NO: 251122 - RNA, 32 nt, Human
ugccauggagggaucuggugccuccagacaug

SEQ ID NO: 251123 - RNA, 32 nt, Human
ugccauggagggaucuggugccuccagacgug

SEQ ID NO: 251124 - RNA, 32 nt, Human
ugccauggagggcugaggagcacuuuggcuug

SEQ ID NO: 251125 - RNA, 32 nt, Human
ugccauggaucucuugggcccaggacuguuga

SEQ ID NO: 251126 - RNA, 31 nt, Human
ugccauggcaaagaaacagcguccagagcag

SEQ ID NO: 251127 - RNA, 32 nt, Human
ugccauggcacuccauccugggugacaaagug

SEQ ID NO: 251128 - RNA, 32 nt, Human
ugccauggcauauaagucaguguagacuggug

SEQ ID NO: 251129 - RNA, 21 nt, Human
ugccauggccgggugcagugg

SEQ ID NO: 251130 - RNA, 32 nt, Human
ugccauggccugaagcagccacagguuggcca

SEQ ID NO: 251131 - RNA, 32 nt, Human
ugccauggcucacaccuguaaucuuaacacug

SEQ ID NO: 251132 - RNA, 32 nt, Human
ugccauggcucacaucuguaaucccagcacuu

SEQ ID NO: 251133 - RNA, 32 nt, Human
ugccauggcucucucuacuucugccauucgag

SEQ ID NO: 251134 - RNA, 32 nt, Human
ugccauggcuuacaccuguaagcccagcacuu

SEQ ID NO: 251135 - RNA, 32 nt, Human
ugccaugggacccugcuccaaucuaacugccu

SEQ ID NO: 251136 - RNA, 32 nt, Human
ugccaugggcaggcccgcaggaagagccggua

SEQ ID NO: 251137 - RNA, 23 nt, Human
ugccaugggccacaggggcauug

SEQ ID NO: 251138 - RNA, 32 nt, Human
ugccaugggcugggugagaugaggggagacag

SEQ ID NO: 251139 - RNA, 32 nt, Human
ugccauggggcagaggaagggaggacccuagu

SEQ ID NO: 251140 - RNA, 32 nt, Human
ugccauggugacauaaaggggcgcggaggaag

SEQ ID NO: 251141 - RNA, 32 nt, Human
ugccaugguggaaaaguacuaucggaauaacu

SEQ ID NO: 251142 - RNA, 32 nt, Human
ugccaugguuggaagaugguaucagagggccu

SEQ ID NO: 251143 - RNA, 32 nt, Human
ugccauguaggaugguaugacaaggcaacacu

SEQ ID NO: 251144 - RNA, 32 nt, Human
ugccaugucaucugcuguggccccaucuggcc

SEQ ID NO: 251145 - RNA, 29 nt, Human
ugccauguccaaaagcuugaaaaagaaaa

SEQ ID NO: 251146 - RNA, 32 nt, Human
ugccauguccagccaggggcagagccauggcu

SEQ ID NO: 251147 - RNA, 32 nt, Human
ugccauguccauccuccacaggcagaacagga

SEQ ID NO: 251148 - RNA, 29 nt, Human
ugccaugucucucuccccaugccgggccc

SEQ ID NO: 251149 - RNA, 23 nt, Human
ugccaugucuuggcugggauuac

SEQ ID NO: 251150 - RNA, 32 nt, Human
ugccaugucuuuccaccacugccugcacauuu

SEQ ID NO: 251151 - RNA, 32 nt, Human
ugccaugugcugggugguagauuuccuccucc

SEQ ID NO: 251152 - RNA, 32 nt, Human
ugccaugugguaggacacaggacacaggaauu

SEQ ID NO: 251153 - RNA, 32 nt, Human
ugccauguuacccaggcuggucucaaacuccu

SEQ ID NO: 251154 - RNA, 32 nt, Human
ugccauguuacccaggcuggucucaacuccug

SEQ ID NO: 251155 - RNA, 32 nt, Human
ugccauguuagacaggcuggucuggaacaccu

SEQ ID NO: 251156 - RNA, 29 nt, Human
ugccauguucucucuuccaucccuccccu

SEQ ID NO: 251157 - RNA, 32 nt, Human
ugccauguugaccaggcuggucucaaacuccu

SEQ ID NO: 251158 - RNA, 21 nt, Human
ugccauguugacuccugggca

SEQ ID NO: 251159 - RNA, 32 nt, Human
ugccauguugcccaggcuggaagugucuaugu

SEQ ID NO: 251160 - RNA, 32 nt, Human
ugccauguugcccaggcuggucucgaauuccu

SEQ ID NO: 251161 - RNA, 32 nt, Human
ugccauguugcccaggcuggucugaagcugcu

SEQ ID NO: 251162 - RNA, 32 nt, Human
ugccauguugcucaggcuggucucaaacuccu

SEQ ID NO: 251163 - RNA, 32 nt, Human
ugccauguuggccaggcuggucucaaacuccu

SEQ ID NO: 251164 - RNA, 32 nt, Human
ugccauguuggccaggcuggucucgaacuccu

SEQ ID NO: 251165 - RNA, 32 nt, Human
ugccauguuggccaggcuggucucgaacucuu

SEQ ID NO: 251166 - RNA, 32 nt, Human
ugccauguuggccaggcuggucucgaagccug

SEQ ID NO: 251167 - RNA, 32 nt, Human
ugccauguuggccaggcuggucucgaauuccu

SEQ ID NO: 251168 - RNA, 32 nt, Human
ugccauguuggccaggcugguuucaaacuccu

SEQ ID NO: 251169 - RNA, 32 nt, Human
ugccauguuggccaggcugguuucgaacuccu

SEQ ID NO: 251170 - RNA, 32 nt, Human
ugccauguugggcuccucacacaugaucgugu

SEQ ID NO: 251171 - RNA, 32 nt, Human
ugccauguuguccaggcuggugucgaaauccu

SEQ ID NO: 251172 - RNA, 32 nt, Human
ugccauguuuauaguaccaauuuugggggcca

SEQ ID NO: 251173 - RNA, 32 nt, Human
ugccauuaaacuuguacagaaaauguuuuuau

SEQ ID NO: 251174 - RNA, 32 nt, Human
ugccauuaacaugcagguucacuccugugcca

SEQ ID NO: 251175 - RNA, 32 nt, Human
ugccauuacacuccagccugggcgacagaacg

SEQ ID NO: 251176 - RNA, 32 nt, Human
ugccauuacacuccagccugggugacagagug

SEQ ID NO: 251177 - RNA, 32 nt, Human
ugccauuacucacuccaaccagccagcuccug

SEQ ID NO: 251178 - RNA, 32 nt, Human
ugccauuaucucugugagggaggccagguagc

SEQ ID NO: 251179 - RNA, 32 nt, Human
ugccauucaaugauuaaugcaugauagggccu

SEQ ID NO: 251180 - RNA, 32 nt, Human
ugccauucagagcucauccccaagagcccagu

SEQ ID NO: 251181 - RNA, 17 nt, Human
ugccauucaucucucca

SEQ ID NO: 251182 - RNA, 32 nt, Human
ugccauuccacuccagccugagcaacacagug

SEQ ID NO: 251183 - RNA, 32 nt, Human
ugccauuccacuccagccugggcaacgagagg

SEQ ID NO: 251184 - RNA, 32 nt, Human
ugccauuccacugucuccuagcuuaaauugcu

SEQ ID NO: 251185 - RNA, 23 nt, Human
ugccauuccuccccuccaagagg

SEQ ID NO: 251186 - RNA, 32 nt, Human
ugccauuccugcugcccugccgcugccucccu

SEQ ID NO: 251187 - RNA, 32 nt, Human
ugccauucggcagugcauuccagccugcagaa

SEQ ID NO: 251188 - RNA, 32 nt, Human
ugccauucuccucucuguucagguaaauguca

SEQ ID NO: 251189 - RNA, 32 nt, Human
ugccauucugaccucuucucagagcaccuaau

SEQ ID NO: 251190 - RNA, 20 nt, Human
ugccauucuguuuuuauaag

SEQ ID NO: 251191 - RNA, 32 nt, Human
ugccauucuuccuauauccuggaauauaucuu

SEQ ID NO: 251192 - RNA, 31 nt, Human
ugccauucuuccucugggccuucaugcuuuu

SEQ ID NO: 251193 - RNA, 32 nt, Human
ugccauucuuguagccucucuugacccaucaa

SEQ ID NO: 251194 - RNA, 32 nt, Human
ugccauugagaaggggaaauuuuucaauaugu

SEQ ID NO: 251195 - RNA, 32 nt, Human
ugccauugcacagcagccugggugacagagcg

SEQ ID NO: 251196 - RNA, 32 nt, Human
ugccauugcacuacagccugggcaacaagagc

SEQ ID NO: 251197 - RNA, 32 nt, Human
ugccauugcacuacagccuggucaacagagca

SEQ ID NO: 251198 - RNA, 32 nt, Human
ugccauugcacuccaaccugggcaacaagagu

SEQ ID NO: 251199 - RNA, 32 nt, Human
ugccauugcacuccaaccugggugacagagug

SEQ ID NO: 251200 - RNA, 32 nt, Human
ugccauugcacuccaagccugggcaacagagu

SEQ ID NO: 251201 - RNA, 32 nt, Human
ugccauugcacuccagcccagguaacagagug

SEQ ID NO: 251202 - RNA, 32 nt, Human
ugccauugcacuccagcccggaugacagagca

SEQ ID NO: 251203 - RNA, 32 nt, Human
ugccauugcacuccagccuaggcaauaagagc

SEQ ID NO: 251204 - RNA, 32 nt, Human
ugccauugcacuccagccugagugacaagaga

SEQ ID NO: 251205 - RNA, 32 nt, Human
ugccauugcacuccagccuggacaacagagca

SEQ ID NO: 251206 - RNA, 32 nt, Human
ugccauugcacuccagccuggaugacaagagu

SEQ ID NO: 251207 - RNA, 32 nt, Human
ugccauugcacuccagccuggcgacagaguga

SEQ ID NO: 251208 - RNA, 32 nt, Human
ugccauugcacuccagccugggcaacaagaac

SEQ ID NO: 251209 - RNA, 32 nt, Human
ugccauugcacuccagccugggcaacaagaga

SEQ ID NO: 251210 - RNA, 32 nt, Human
ugccauugcacuccagccugggcaacaagagc

SEQ ID NO: 251211 - RNA, 32 nt, Human
ugccauugcacuccagccugggcaacaagagg

SEQ ID NO: 251212 - RNA, 32 nt, Human
ugccauugcacuccagccugggcaacaagagu

SEQ ID NO: 251213 - RNA, 32 nt, Human
ugccauugcacuccagccugggcaacagagug

SEQ ID NO: 251214 - RNA, 32 nt, Human
ugccauugcacuccagccugggcaacagggca

SEQ ID NO: 251215 - RNA, 32 nt, Human
ugccauugcacuccagccugggcaacgagcga

SEQ ID NO: 251216 - RNA, 32 nt, Human
ugccauugcacuccagccugggcaauagagug

SEQ ID NO: 251217 - RNA, 32 nt, Human
ugccauugcacuccagccugggcgacaagagc

SEQ ID NO: 251218 - RNA, 32 nt, Human
ugccauugcacuccagccugggcgacaagagu

SEQ ID NO: 251219 - RNA, 32 nt, Human
ugccauugcacuccagccugggcgacaagcga

SEQ ID NO: 251220 - RNA, 32 nt, Human
ugccauugcacuccagccugggcgacagagca

SEQ ID NO: 251221 - RNA, 32 nt, Human
ugccauugcacuccagccugggcgacagagcg

SEQ ID NO: 251222 - RNA, 32 nt, Human
ugccauugcacuccagccugggcgacagagga

SEQ ID NO: 251223 - RNA, 32 nt, Human
ugccauugcacuccagccugggcgacagagug

SEQ ID NO: 251224 - RNA, 32 nt, Human
ugccauugcacuccagccugggcgacagugca

SEQ ID NO: 251225 - RNA, 32 nt, Human
ugccauugcacuccagccugggugacaaagca

SEQ ID NO: 251226 - RNA, 32 nt, Human
ugccauugcacuccagccugggugacaagagc

SEQ ID NO: 251227 - RNA, 32 nt, Human
ugccauugcacuccagccugggugacaaggga

SEQ ID NO: 251228 - RNA, 32 nt, Human
ugccauugcacuccagccugggugacagagca

SEQ ID NO: 251229 - RNA, 32 nt, Human
ugccauugcacuccagccugggugacagagcg

SEQ ID NO: 251230 - RNA, 32 nt, Human
ugccauugcacuccagccugggugacagagua

SEQ ID NO: 251231 - RNA, 32 nt, Human
ugccauugcacuccagccugggugacagugag

SEQ ID NO: 251232 - RNA, 32 nt, Human
ugccauugcacuccagccugggugauaagagc

SEQ ID NO: 251233 - RNA, 32 nt, Human
ugccauugcacuccagcuugggugacagagug

SEQ ID NO: 251234 - RNA, 32 nt, Human
ugccauugcacuccagucggguuaacagagca

SEQ ID NO: 251235 - RNA, 32 nt, Human
ugccauugcacuccagucugggcgacaggagc

SEQ ID NO: 251236 - RNA, 32 nt, Human
ugccauugcacuccggccugggcaacaacagc

SEQ ID NO: 251237 - RNA, 32 nt, Human
ugccauugcacuccggccugggcaacagagga

SEQ ID NO: 251238 - RNA, 32 nt, Human
ugccauugcacucuagccugggcaacaggagc

SEQ ID NO: 251239 - RNA, 32 nt, Human
ugccauugcacugcaccugggcaacaagagug

SEQ ID NO: 251240 - RNA, 32 nt, Human
ugccauugcacugcagccuggaugacagagcg

SEQ ID NO: 251241 - RNA, 32 nt, Human
ugccauugcauuccagccuaggcaacacgagc

SEQ ID NO: 251242 - RNA, 21 nt, Human
ugccauugcccccuccaccca

SEQ ID NO: 251243 - RNA, 32 nt, Human
ugccauugcccuccagccugggcaagaacugg

SEQ ID NO: 251244 - RNA, 32 nt, Human
ugccauugcgcuccagccuaggugacagagca

SEQ ID NO: 251245 - RNA, 32 nt, Human
ugccauugcgcuccagccugggcaacaagagc

SEQ ID NO: 251246 - RNA, 32 nt, Human
ugccauugcucuccagccugggcgacaagagc

SEQ ID NO: 251247 - RNA, 32 nt, Human
ugccauuggaacuuggauuacugugaacauug

SEQ ID NO: 251248 - RNA, 32 nt, Human
ugccauuggacuccagccugggcaaaaagggc

SEQ ID NO: 251249 - RNA, 32 nt, Human
ugccauuggccaggaccacauggagcaggggg

SEQ ID NO: 251250 - RNA, 32 nt, Human
ugccauugggcagaggaguauaggacuggggu

SEQ ID NO: 251251 - RNA, 32 nt, Human
ugccauuguacuccagccugggcaacaagagc

SEQ ID NO: 251252 - RNA, 32 nt, Human
ugccauuguacuccagccugggcgacaaaagu

SEQ ID NO: 251253 - RNA, 32 nt, Human
ugccauuguacuccagcuugggcaacagagua

SEQ ID NO: 251254 - RNA, 32 nt, Human
ugccauuguagugcaaaagcagccauagacaa

SEQ ID NO: 251255 - RNA, 32 nt, Human
ugccauuguauaaggacaugaugucaagaagu

SEQ ID NO: 251256 - RNA, 32 nt, Human
ugccauuguauuccagccucggcaacacagca

SEQ ID NO: 251257 - RNA, 32 nt, Human
ugccauugugcuccagccugggcaacaagagu

SEQ ID NO: 251258 - RNA, 32 nt, Human
ugccauugugcuccagccugggcaacagagug

SEQ ID NO: 251259 - RNA, 32 nt, Human
ugccauuguuauuguccagcaguugccgaaua

SEQ ID NO: 251260 - RNA, 32 nt, Human
ugccauuuagagcucucagagcagggcagauu

SEQ ID NO: 251261 - RNA, 32 nt, Human
ugccauuuaguuauuauaccagcauagagaau

SEQ ID NO: 251262 - RNA, 32 nt, Human
ugccauuuauuuccucagcuguacaaauccuc

SEQ ID NO: 251263 - RNA, 32 nt, Human
ugccauuucacuccagccuggacaacaagagc

SEQ ID NO: 251264 - RNA, 21 nt, Human
ugccauuucaguggcuuccca

SEQ ID NO: 251265 - RNA, 32 nt, Human
ugccauuuccacccuccagucauuucucuaug

SEQ ID NO: 251266 - RNA, 32 nt, Human
ugccauuuccaucaaggacacuggaacaagag

SEQ ID NO: 251267 - RNA, 32 nt, Human
ugccauuucugcaucucccagaagggaugagu

SEQ ID NO: 251268 - RNA, 32 nt, Human
ugccauuucuugcacucagaccuguguaauau

SEQ ID NO: 251269 - RNA, 32 nt, Human
ugccauuugaugauuccaccacuccuuuucca

SEQ ID NO: 251270 - RNA, 32 nt, Human
ugccauuugcacccuccgccuucacuccggug

SEQ ID NO: 251271 - RNA, 32 nt, Human
ugccauuugcugcugccgccaggaccagagca

SEQ ID NO: 251272 - RNA, 32 nt, Human
ugccauuuggcugaagugugguguggcucugu

SEQ ID NO: 251273 - RNA, 32 nt, Human
ugccauuuuacaugauagcuucaaugcagaaa

SEQ ID NO: 251274 - RNA, 32 nt, Human
ugccauuuuccccaugacuuugguuuuguuua

SEQ ID NO: 251275 - RNA, 32 nt, Human
ugccauuuugggguggagaagguagaugugau

SEQ ID NO: 251276 - RNA, 32 nt, Human
ugccauuuugggguggagaagguggaugugau

SEQ ID NO: 251277 - RNA, 32 nt, Human
ugccauuuuguggaaacuggaguagauuaaau

SEQ ID NO: 251278 - RNA, 32 nt, Human
ugccauuuuguugcaguugacucacgauuaua

SEQ ID NO: 251279 - RNA, 32 nt, Human
ugccauuuuuacugaugcugggauuauaggug

SEQ ID NO: 251280 - RNA, 32 nt, Human
ugcccaaaagagaguguuuggucuugaacuuu

SEQ ID NO: 251281 - RNA, 32 nt, Human
ugcccaaaccucuacuguuugggacaguaagc

SEQ ID NO: 251282 - RNA, 32 nt, Human
ugcccaaagcaacaccagaaccaagaaggagc

SEQ ID NO: 251283 - RNA, 32 nt, Human
ugcccaaagucccccagcacugaagagcuggg

SEQ ID NO: 251284 - RNA, 32 nt, Human
ugcccaaagugcugggauuacaggcaagagcc

SEQ ID NO: 251285 - RNA, 32 nt, Human
ugcccaaaguucagaaagaugaaguuuccaga

SEQ ID NO: 251286 - RNA, 32 nt, Human
ugcccaaauggugaaaccccaucucuacuaaa

SEQ ID NO: 251287 - RNA, 32 nt, Human
ugcccaacauagugaaacuccgucucuaccaa

SEQ ID NO: 251288 - RNA, 32 nt, Human
ugcccaacaugcuggggguccagaagccaccu

SEQ ID NO: 251289 - RNA, 32 nt, Human
ugcccaacauggcaaaaccucgucucuacuaa

SEQ ID NO: 251290 - RNA, 32 nt, Human
ugcccaacccagauccagagacauugaaggaa

SEQ ID NO: 251291 - RNA, 32 nt, Human
ugcccaaccccagauagucaggugugcugggg

SEQ ID NO: 251292 - RNA, 23 nt, Human
ugcccaacccucucugggacaga

SEQ ID NO: 251293 - RNA, 21 nt, Human
ugcccaaccuggagugcaaug

SEQ ID NO: 251294 - RNA, 21 nt, Human
ugcccaaccuggagugcagug

SEQ ID NO: 251295 - RNA, 25 nt, Human
ugcccaacgguccugccuucugcca

SEQ ID NO: 251296 - RNA, 18 nt, Human
ugcccaacuccgccuugc

SEQ ID NO: 251297 - RNA, 32 nt, Human
ugcccaacucuugcacagcacaaguaccuaau

SEQ ID NO: 251298 - RNA, 32 nt, Human
ugcccaacuuacugucuucuucaugucaucaa

SEQ ID NO: 251299 - RNA, 19 nt, Human
ugcccaagaaggcucagca

SEQ ID NO: 251300 - RNA, 32 nt, Human
ugcccaagacuggccuggggugcccggcaccc

SEQ ID NO: 251301 - RNA, 32 nt, Human
ugcccaagcagagcuggagagagauggccuaa

SEQ ID NO: 251302 - RNA, 32 nt, Human
ugcccaagccaacccugugacugacauguacg

SEQ ID NO: 251303 - RNA, 30 nt, Human
ugcccaagccucuccugaugcauuuguaaa

SEQ ID NO: 251304 - RNA, 32 nt, Human
ugcccaagcggaggaggagaaaaaggaauaag

SEQ ID NO: 251305 - RNA, 21 nt, Human
ugcccaagcuggaguggcagu

SEQ ID NO: 251306 - RNA, 22 nt, Human
ugcccaagcuggaguggcagug

SEQ ID NO: 251307 - RNA, 32 nt, Human
ugcccaagcuugcagggaacaauaccugggca

SEQ ID NO: 251308 - RNA, 32 nt, Human
ugcccaaggacacuccugcagagccauuuuug

SEQ ID NO: 251309 - RNA, 23 nt, Human
ugcccaaggccuggccugccugc

SEQ ID NO: 251310 - RNA, 32 nt, Human
ugcccaagggcagccuggaggaggggaaggcc

SEQ ID NO: 251311 - RNA, 32 nt, Human
ugcccaaggggcaggguggaaguggcugcagg

SEQ ID NO: 251312 - RNA, 32 nt, Human
ugcccaaggucucucugcaccccaccauccac

SEQ ID NO: 251313 - RNA, 32 nt, Human
ugcccaagugcaccccucuggacuugccagcg

SEQ ID NO: 251314 - RNA, 32 nt, Human
ugcccaauacuuuucugcugugagaauguaag

SEQ ID NO: 251315 - RNA, 19 nt, Human
ugcccaauuucugcuucca

SEQ ID NO: 251316 - RNA, 28 nt, Human
ugcccacaagaucuagccucaucuggag

SEQ ID NO: 251317 - RNA, 32 nt, Human
ugcccacaagccccagcauccccguaggcauc

SEQ ID NO: 251318 - RNA, 32 nt, Human
ugcccacacaauacuuuccagcuacuuuaccc

SEQ ID NO: 251319 - RNA, 32 nt, Human
ugcccacacaugcacuacauaacacacuauau

SEQ ID NO: 251320 - RNA, 32 nt, Human
ugcccacaccacugcagcuggcaugcuuggcu

SEQ ID NO: 251321 - RNA, 32 nt, Human
ugcccacacuacaggccagggcugcggggcug

SEQ ID NO: 251322 - RNA, 21 nt, Human
ugcccacacuagagugcaaug

SEQ ID NO: 251323 - RNA, 32 nt, Human
ugcccacacugggguaugccugggugaugggc

SEQ ID NO: 251324 - RNA, 32 nt, Human
ugcccacagacaggaacagaagagcacagugg

SEQ ID NO: 251325 - RNA, 31 nt, Human
ugcccacagcaccagcaccugagcucaccuc

SEQ ID NO: 251326 - RNA, 32 nt, Human
ugcccacagcaggggcuggcccacguaggggg

SEQ ID NO: 251327 - RNA, 32 nt, Human
ugcccacaggaucagucugauucccaagcucu

SEQ ID NO: 251328 - RNA, 32 nt, Human
ugcccacaggcuuugcuucucucccaaugcaa

SEQ ID NO: 251329 - RNA, 32 nt, Human
ugcccacagggcuguguggauggaggaagcug

SEQ ID NO: 251330 - RNA, 32 nt, Human
ugcccacaucugcugguuuggggcuucagugg

SEQ ID NO: 251331 - RNA, 32 nt, Human
ugcccacaugccacuggaagggaagugggugu

SEQ ID NO: 251332 - RNA, 31 nt, Human
ugcccacauguguccaucccagcggcuggug

SEQ ID NO: 251333 - RNA, 21 nt, Human
ugcccacauuggagugcagug

SEQ ID NO: 251334 - RNA, 24 nt, Human
ugcccaccaacccagccacugcca

SEQ ID NO: 251335 - RNA, 32 nt, Human
ugcccaccaagcucuugauuuucucauuucuu

SEQ ID NO: 251336 - RNA, 21 nt, Human
ugcccaccacacauacccucu

SEQ ID NO: 251337 - RNA, 21 nt, Human
ugcccaccaccacccacugcc

SEQ ID NO: 251338 - RNA, 18 nt, Human
ugcccaccaccaccccug

SEQ ID NO: 251339 - RNA, 32 nt, Human
ugcccaccagcccucacuaucuacugcuugac

SEQ ID NO: 251340 - RNA, 23 nt, Human
ugcccaccagggugaucccccug

SEQ ID NO: 251341 - RNA, 32 nt, Human
ugcccacccaggccguggggccaggggccugc

SEQ ID NO: 251342 - RNA, 32 nt, Human
ugcccaccccacccacuguggucuguuguacc

SEQ ID NO: 251343 - RNA, 32 nt, Human
ugcccacccuccacucuccucuuccagggccc

SEQ ID NO: 251344 - RNA, 23 nt, Human
ugcccacccuccccacgcugcag

SEQ ID NO: 251345 - RNA, 32 nt, Human
ugcccacccuccugccuggaucccaaggccaa

SEQ ID NO: 251346 - RNA, 32 nt, Human
ugcccacccugacugaaaguagggggcuuucu

SEQ ID NO: 251347 - RNA, 32 nt, Human
ugcccacccuggacaacaaccagcacagugca

SEQ ID NO: 251348 - RNA, 32 nt, Human
ugcccacccuuguuucucauaagcgaugucug

SEQ ID NO: 251349 - RNA, 32 nt, Human
ugcccaccgaagcccccucuggcugcacugug

SEQ ID NO: 251350 - RNA, 32 nt, Human
ugcccaccgaccacagcugacugaaccacaga

SEQ ID NO: 251351 - RNA, 32 nt, Human
ugcccaccgaccugagccugaguaaguggcug

SEQ ID NO: 251352 - RNA, 32 nt, Human
ugcccaccgcugcuucagcugccuccucgccc

SEQ ID NO: 251353 - RNA, 19 nt, Human
ugcccaccuccagaagaga

SEQ ID NO: 251354 - RNA, 32 nt, Human
ugcccaccucggccuccugaagugcugggauu

SEQ ID NO: 251355 - RNA, 32 nt, Human
ugcccaccucucucucugguccuguucaucuc

SEQ ID NO: 251356 - RNA, 32 nt, Human
ugcccaccugaggugacaccuguccauuuuag

SEQ ID NO: 251357 - RNA, 32 nt, Human
ugcccaccugccaggcugcagggacaguuggg

SEQ ID NO: 251358 - RNA, 32 nt, Human
ugcccaccugccccugcccagaauuccuagcu

SEQ ID NO: 251359 - RNA, 32 nt, Human
ugcccaccugccuucccacacacucacuaucc

SEQ ID NO: 251360 - RNA, 20 nt, Human
ugcccaccugugccauggag

SEQ ID NO: 251361 - RNA, 32 nt, Human
ugcccaccugugugcugaccccagggccugag

SEQ ID NO: 251362 - RNA, 32 nt, Human
ugcccaccuuccacacugagguagccgagccu

SEQ ID NO: 251363 - RNA, 32 nt, Human
ugcccaccuucucucccuccucccgacccgcc

SEQ ID NO: 251364 - RNA, 32 nt, Human
ugcccaccuuggggcucuguuguuugaguugc

SEQ ID NO: 251365 - RNA, 21 nt, Human
ugcccacgcaggagugcagug

SEQ ID NO: 251366 - RNA, 23 nt, Human
ugcccacgcagugagugcucaug

SEQ ID NO: 251367 - RNA, 21 nt, Human
ugcccacgcuggagugcaaug

SEQ ID NO: 251368 - RNA, 21 nt, Human
ugcccacgcuggagugcagug

SEQ ID NO: 251369 - RNA, 32 nt, Human
ugcccacgggguccaccuucugcuccagccag

SEQ ID NO: 251370 - RNA, 32 nt, Human
ugcccacgugguauugcugggcuccuggcuag

SEQ ID NO: 251371 - RNA, 32 nt, Human
ugcccacuacaaccuccaccuccuggguuuga

SEQ ID NO: 251372 - RNA, 32 nt, Human
ugcccacuagaugacucugcuuuucccugcau

SEQ ID NO: 251373 - RNA, 32 nt, Human
ugcccacuagcccacaaccacauagcaagguc

SEQ ID NO: 251374 - RNA, 32 nt, Human
ugcccacucaggaugcaggcucuccccagggg

SEQ ID NO: 251375 - RNA, 21 nt, Human
ugcccacucccacuccagaug

SEQ ID NO: 251376 - RNA, 32 nt, Human
ugcccacucccgccagccccugccucgaggac

SEQ ID NO: 251377 - RNA, 32 nt, Human
ugcccacuccugggcagcuucuuagcugggug

SEQ ID NO: 251378 - RNA, 20 nt, Human
ugcccacucuccaucagaug

SEQ ID NO: 251379 - RNA, 32 nt, Human
ugcccacucuucugcuggucucauggaaggca

SEQ ID NO: 251380 - RNA, 21 nt, Human
ugcccacugaacaugcucaug

SEQ ID NO: 251381 - RNA, 25 nt, Human
ugcccacugacccacccacccaccu

SEQ ID NO: 251382 - RNA, 27 nt, Human
ugcccacugagccaagagcagcaggga

SEQ ID NO: 251383 - RNA, 32 nt, Human
ugcccacugaugaggacucccuggagagggac

SEQ ID NO: 251384 - RNA, 32 nt, Human
ugcccacugcacuccagccugggcaacagagc

SEQ ID NO: 251385 - RNA, 32 nt, Human
ugcccacugcacugccccagcccagccccagc

SEQ ID NO: 251386 - RNA, 32 nt, Human
ugcccacugcagcccuccagccucuggucccc

SEQ ID NO: 251387 - RNA, 32 nt, Human
ugcccacugcagcucucugcagucuccggcuc

SEQ ID NO: 251388 - RNA, 32 nt, Human
ugcccacugccagcucugcuccccaggcuauu

SEQ ID NO: 251389 - RNA, 32 nt, Human
ugcccacugccuccucuucagacucuuugcau

SEQ ID NO: 251390 - RNA, 32 nt, Human
ugcccacugcggcaaaccccuacuucugguuu

SEQ ID NO: 251391 - RNA, 32 nt, Human
ugcccacugcucaauacagccuccgauccuca

SEQ ID NO: 251392 - RNA, 32 nt, Human
ugcccacuggacuguccuguuugccuccagga

SEQ ID NO: 251393 - RNA, 18 nt, Human
ugcccacuguuaucuuca

SEQ ID NO: 251394 - RNA, 32 nt, Human
ugcccacuucccucccccugccgaggcugugg

SEQ ID NO: 251395 - RNA, 32 nt, Human
ugcccacuucggccuuccaaaguggccgcaaa

SEQ ID NO: 251396 - RNA, 32 nt, Human
ugcccagaaaaaucuguccuuuuugguaccaa

SEQ ID NO: 251397 - RNA, 20 nt, Human
ugcccagaaaaaugcuggag

SEQ ID NO: 251398 - RNA, 23 nt, Human
ugcccagaaaaugggacuggagu

SEQ ID NO: 251399 - RNA, 32 nt, Human
ugcccagaaaccucaacuguuccccagcuacu

SEQ ID NO: 251400 - RNA, 25 nt, Human
ugcccagaagaacuuugccuuaagu

SEQ ID NO: 251401 - RNA, 19 nt, Human
ugcccagaagacaacugga

SEQ ID NO: 251402 - RNA, 20 nt, Human
ugcccagaagagaggccggg

SEQ ID NO: 251403 - RNA, 32 nt, Human
ugcccagaagcagaaaugaguaaaguuuguuu

SEQ ID NO: 251404 - RNA, 32 nt, Human
ugcccagaagucagcccagaccuuccugucug

SEQ ID NO: 251405 - RNA, 32 nt, Human
ugcccagaccaacagagagagcugucccugag

SEQ ID NO: 251406 - RNA, 32 nt, Human
ugcccagaccuccccugcccaccugcuggagc

SEQ ID NO: 251407 - RNA, 24 nt, Human
ugcccagacuggagugcaauggca

SEQ ID NO: 251408 - RNA, 24 nt, Human
ugcccagacuggagugcaguggca

SEQ ID NO: 251409 - RNA, 32 nt, Human
ugcccagacuggucucaaacuccuggguucaa

SEQ ID NO: 251410 - RNA, 32 nt, Human
ugcccagacuggucucgaacuccugggcucaa

SEQ ID NO: 251411 - RNA, 32 nt, Human
ugcccagagacagggaaaagaaugccuggggg

SEQ ID NO: 251412 - RNA, 32 nt, Human
ugcccagagagcugcccuaacagaacacuuca

SEQ ID NO: 251413 - RNA, 32 nt, Human
ugcccagagccagagggauggugguagucacg

SEQ ID NO: 251414 - RNA, 32 nt, Human
ugcccagagcuccuaacugggguggggugcaa

SEQ ID NO: 251415 - RNA, 32 nt, Human
ugcccagaggaagcuuggaggcugcuaccucu

SEQ ID NO: 251416 - RNA, 32 nt, Human
ugcccagaggaguguguguggagcagcuggag

SEQ ID NO: 251417 - RNA, 20 nt, Human
ugcccagaggcccagcugcu

SEQ ID NO: 251418 - RNA, 21 nt, Human
ugcccagaggggcugcagcca

SEQ ID NO: 251419 - RNA, 32 nt, Human
ugcccagaguccagagagcagccucagcugag

SEQ ID NO: 251420 - RNA, 25 nt, Human
ugcccagauaaaguagcacaguggc

SEQ ID NO: 251421 - RNA, 32 nt, Human
ugcccagauguggcgauuucaugaaaaauauc

SEQ ID NO: 251422 - RNA, 32 nt, Human
ugcccagauugaauccagcaagaaaugacauu

SEQ ID NO: 251423 - RNA, 20 nt, Human
ugcccagcaaccugugcagc

SEQ ID NO: 251424 - RNA, 32 nt, Human
ugcccagcaaucacccuccucacuuccuuguc

SEQ ID NO: 251425 - RNA, 32 nt, Human
ugcccagcacagagccggagagcgucgggccu

SEQ ID NO: 251426 - RNA, 19 nt, Human
ugcccagcacagucugccc

SEQ ID NO: 251427 - RNA, 19 nt, Human
ugcccagcacaugugcugc

SEQ ID NO: 251428 - RNA, 32 nt, Human
ugcccagcaccuccucaggccagccuggugcc

SEQ ID NO: 251429 - RNA, 17 nt, Human
ugcccagcaccugugcu

SEQ ID NO: 251430 - RNA, 22 nt, Human
ugcccagcacggccugcacugu

SEQ ID NO: 251431 - RNA, 32 nt, Human
ugcccagcacuugaggcaguucuugaaagcuu

SEQ ID NO: 251432 - RNA, 32 nt, Human
ugcccagcagccgccccgucugagaagugagg

SEQ ID NO: 251433 - RNA, 21 nt, Human
ugcccagcaggcaguguaaug

SEQ ID NO: 251434 - RNA, 24 nt, Human
ugcccagcaggcuagagugcgaug

SEQ ID NO: 251435 - RNA, 32 nt, Human
ugcccagccaaaacaaacacagagcugcccag

SEQ ID NO: 251436 - RNA, 32 nt, Human
ugcccagccaccaggauuucugccuggagccc

SEQ ID NO: 251437 - RNA, 32 nt, Human
ugcccagccagccaggaagucuggcuuucaga

SEQ ID NO: 251438 - RNA, 32 nt, Human
ugcccagccagccugaacaucugcagugucgu

SEQ ID NO: 251439 - RNA, 32 nt, Human
ugcccagccagcugccuccuguccugggagga

SEQ ID NO: 251440 - RNA, 32 nt, Human
ugcccagccauccucccauccugcacuuuagc

SEQ ID NO: 251441 - RNA, 23 nt, Human
ugcccagccaugaaucgcuuggc

SEQ ID NO: 251442 - RNA, 25 nt, Human
ugcccagcccagauucuucuuugga

SEQ ID NO: 251443 - RNA, 24 nt, Human
ugcccagcccagcagcuucuguug

SEQ ID NO: 251444 - RNA, 18 nt, Human
ugcccagcccagcccugc

SEQ ID NO: 251445 - RNA, 32 nt, Human
ugcccagcccaggagagagugucucacuccca

SEQ ID NO: 251446 - RNA, 21 nt, Human
ugcccagcccaggcucuggga

SEQ ID NO: 251447 - RNA, 24 nt, Human
ugcccagcccaguccaggcugcug

SEQ ID NO: 251448 - RNA, 22 nt, Human
ugcccagcccauuugggcucug

SEQ ID NO: 251449 - RNA, 32 nt, Human
ugcccagccccagcuccuuaagaacgggcuuc

SEQ ID NO: 251450 - RNA, 32 nt, Human
ugcccagccccagcugcauggacucugagcug

SEQ ID NO: 251451 - RNA, 24 nt, Human
ugcccagcccucagauggcucucc

SEQ ID NO: 251452 - RNA, 24 nt, Human
ugcccagcccuuccuugucugcug

SEQ ID NO: 251453 - RNA, 21 nt, Human
ugcccagccgggcacaguggc

SEQ ID NO: 251454 - RNA, 24 nt, Human
ugcccagccggugcccggccacug

SEQ ID NO: 251455 - RNA, 24 nt, Human
ugcccagccuagcgauggccucug

SEQ ID NO: 251456 - RNA, 32 nt, Human
ugcccagccucagcaggcugucccagaagcgc

SEQ ID NO: 251457 - RNA, 32 nt, Human
ugcccagccuccaacuccagcugaguccuggg

SEQ ID NO: 251458 - RNA, 19 nt, Human
ugcccagccucccaccugu

SEQ ID NO: 251459 - RNA, 32 nt, Human
ugcccagccucgcaugccagagccuggggcau

SEQ ID NO: 251460 - RNA, 19 nt, Human
ugcccagccucgcugccgc

SEQ ID NO: 251461 - RNA, 32 nt, Human
ugcccagccucuccaccgucacuguccgcugc

SEQ ID NO: 251462 - RNA, 17 nt, Human
ugcccagccucugcugc

SEQ ID NO: 251463 - RNA, 24 nt, Human
ugcccagccugagcagggcagcug

SEQ ID NO: 251464 - RNA, 22 nt, Human
ugcccagccugagugcuggcug

SEQ ID NO: 251465 - RNA, 21 nt, Human
ugcccagccugauucucugcu

SEQ ID NO: 251466 - RNA, 32 nt, Human
ugcccagccugauucucugcucccaggagcca

SEQ ID NO: 251467 - RNA, 32 nt, Human
ugcccagccugccacaccgccuccaggaagca

SEQ ID NO: 251468 - RNA, 32 nt, Human
ugcccagccugccaccaccgggccaugcggau

SEQ ID NO: 251469 - RNA, 26 nt, Human
ugcccagccuggcucugucuacacug

SEQ ID NO: 251470 - RNA, 32 nt, Human
ugcccagcgaaugagggguagagccacucugg

SEQ ID NO: 251471 - RNA, 32 nt, Human
ugcccagcgaugcuuucgucuccuccauaaac

SEQ ID NO: 251472 - RNA, 20 nt, Human
ugcccagcgcuggagugcag

SEQ ID NO: 251473 - RNA, 32 nt, Human
ugcccagcgcuggagugcagcgugccacgagg

SEQ ID NO: 251474 - RNA, 18 nt, Human
ugcccagcggacaguggc

SEQ ID NO: 251475 - RNA, 22 nt, Human
ugcccagcguuuaccacugcug

SEQ ID NO: 251476 - RNA, 32 nt, Human
ugcccagcuagugcuguccucccaucuccugu

SEQ ID NO: 251477 - RNA, 22 nt, Human
ugcccagcucagcuagcucugc

SEQ ID NO: 251478 - RNA, 32 nt, Human
ugcccagcuccaaacugucccagggggaacug

SEQ ID NO: 251479 - RNA, 32 nt, Human
ugcccagcucccaggcagcuuauggucuugug

SEQ ID NO: 251480 - RNA, 23 nt, Human
ugcccagcuccugcccgcacucc

SEQ ID NO: 251481 - RNA, 32 nt, Human
ugcccagcugagugcuggcucugaggaagccc

SEQ ID NO: 251482 - RNA, 32 nt, Human
ugcccagcugcagaaccacauucuugucccau

SEQ ID NO: 251483 - RNA, 32 nt, Human
ugcccagcugcccaggcugaggcaagagaagg

SEQ ID NO: 251484 - RNA, 20 nt, Human
ugcccagcuggagugcagug

SEQ ID NO: 251485 - RNA, 23 nt, Human
ugcccagcuuauuuuguguuuuu

SEQ ID NO: 251486 - RNA, 22 nt, Human
ugcccagcuuccaugcugacug

SEQ ID NO: 251487 - RNA, 21 nt, Human
ugcccagcuuggaguugucug

SEQ ID NO: 251488 - RNA, 20 nt, Human
ugcccagcuuuauugcugcu

SEQ ID NO: 251489 - RNA, 20 nt, Human
ugcccagcuuuucugcugcu

SEQ ID NO: 251490 - RNA, 32 nt, Human
ugcccaggaaggagccugggaaagccagggca

SEQ ID NO: 251491 - RNA, 32 nt, Human
ugcccaggacaguaggagaauuggagccgccu

SEQ ID NO: 251492 - RNA, 32 nt, Human
ugcccaggaccggggcagucacccagcagaua

SEQ ID NO: 251493 - RNA, 32 nt, Human
ugcccaggacgggagcuggggagccagggcug

SEQ ID NO: 251494 - RNA, 32 nt, Human
ugcccaggaggaguaggagcaggagcagaagc

SEQ ID NO: 251495 - RNA, 17 nt, Human
ugcccaggaggcagugg

SEQ ID NO: 251496 - RNA, 32 nt, Human
ugcccaggagggcugaaggcaggggccacuca

SEQ ID NO: 251497 - RNA, 17 nt, Human
ugcccaggagugaguag

SEQ ID NO: 251498 - RNA, 32 nt, Human
ugcccaggaucguguguguggggcuugcgcug

SEQ ID NO: 251499 - RNA, 32 nt, Human
ugcccaggaucuuacaacacagcaaguagcau

SEQ ID NO: 251500 - RNA, 21 nt, Human
ugcccaggauggagugcagug

SEQ ID NO: 251501 - RNA, 32 nt, Human
ugcccaggauguuguuaaaugcagaucugaag

SEQ ID NO: 251502 - RNA, 19 nt, Human
ugcccaggcaaagucagug

SEQ ID NO: 251503 - RNA, 21 nt, Human
ugcccaggcaagagugcagug

SEQ ID NO: 251504 - RNA, 32 nt, Human
ugcccaggcacacgcuggacuccuguggggug

SEQ ID NO: 251505 - RNA, 32 nt, Human
ugcccaggcacugcaaaccgccaccucccuau

SEQ ID NO: 251506 - RNA, 20 nt, Human
ugcccaggcaggaguacagu

SEQ ID NO: 251507 - RNA, 32 nt, Human
ugcccaggcagugguaccagcaccagaguccc

SEQ ID NO: 251508 - RNA, 21 nt, Human
ugcccaggccacaccaguggc

SEQ ID NO: 251509 - RNA, 23 nt, Human
ugcccaggccagucucaaacucc

SEQ ID NO: 251510 - RNA, 32 nt, Human
ugcccaggcccaggugagacaggcaacgccag

SEQ ID NO: 251511 - RNA, 32 nt, Human
ugcccaggccccuugcacuguguuuggaaaag

SEQ ID NO: 251512 - RNA, 22 nt, Human
ugcccaggccgcccugcugcug

SEQ ID NO: 251513 - RNA, 20 nt, Human
ugcccaggccgcgccgccac

SEQ ID NO: 251514 - RNA, 21 nt, Human
ugcccaggccggagugcaaug

SEQ ID NO: 251515 - RNA, 32 nt, Human
ugcccaggccuggguggggaguugggugggcc

SEQ ID NO: 251516 - RNA, 20 nt, Human
ugcccaggcuacagugcagu

SEQ ID NO: 251517 - RNA, 21 nt, Human
ugcccaggcuacagugcagug

SEQ ID NO: 251518 - RNA, 22 nt, Human
ugcccaggcuacagugcagugg

SEQ ID NO: 251519 - RNA, 23 nt, Human
ugcccaggcuacagugcaguggc

SEQ ID NO: 251520 - RNA, 20 nt, Human
ugcccaggcuagagugcaau

SEQ ID NO: 251521 - RNA, 21 nt, Human
ugcccaggcuagagugcaaug

SEQ ID NO: 251522 - RNA, 22 nt, Human
ugcccaggcuagagugcaaugg

SEQ ID NO: 251523 - RNA, 23 nt, Human
ugcccaggcuagagugcaauggu

SEQ ID NO: 251524 - RNA, 21 nt, Human
ugcccaggcuagagugcagug

SEQ ID NO: 251525 - RNA, 22 nt, Human
ugcccaggcuagagugcagugg

SEQ ID NO: 251526 - RNA, 23 nt, Human
ugcccaggcuagagugcaguggc

SEQ ID NO: 251527 - RNA, 21 nt, Human
ugcccaggcuaggaggccggc

SEQ ID NO: 251528 - RNA, 21 nt, Human
ugcccaggcugaauggcagug

SEQ ID NO: 251529 - RNA, 23 nt, Human
ugcccaggcugaucucaaacucc

SEQ ID NO: 251530 - RNA, 21 nt, Human
ugcccaggcugcagugcagug

SEQ ID NO: 251531 - RNA, 32 nt, Human
ugcccaggcugccagccucacacagaucuucc

SEQ ID NO: 251532 - RNA, 24 nt, Human
ugcccaggcugcuggagugccgug

SEQ ID NO: 251533 - RNA, 22 nt, Human
ugcccaggcuggaauccaagag

SEQ ID NO: 251534 - RNA, 21 nt, Human
ugcccaggcuggacugcagug

SEQ ID NO: 251535 - RNA, 21 nt, Human
ugcccaggcuggagcauagug

SEQ ID NO: 251536 - RNA, 22 nt, Human
ugcccaggcuggagcauagugg

SEQ ID NO: 251537 - RNA, 23 nt, Human
ugcccaggcuggagcauaguggc

SEQ ID NO: 251538 - RNA, 21 nt, Human
ugcccaggcuggaguacaaug

SEQ ID NO: 251539 - RNA, 21 nt, Human
ugcccaggcuggaguacagug

SEQ ID NO: 251540 - RNA, 22 nt, Human
ugcccaggcuggaguacagugg

SEQ ID NO: 251541 - RNA, 23 nt, Human
ugcccaggcuggaguacaguggc

SEQ ID NO: 251542 - RNA, 18 nt, Human
ugcccaggcuggagugca

SEQ ID NO: 251543 - RNA, 20 nt, Human
ugcccaggcuggagugcaau

SEQ ID NO: 251544 - RNA, 21 nt, Human
ugcccaggcuggagugcaaug

SEQ ID NO: 251545 - RNA, 22 nt, Human
ugcccaggcuggagugcaaugg

SEQ ID NO: 251546 - RNA, 19 nt, Human
ugcccaggcuggagugcag

SEQ ID NO: 251547 - RNA, 20 nt, Human
ugcccaggcuggagugcagu

SEQ ID NO: 251548 - RNA, 21 nt, Human
ugcccaggcuggagugcagug

SEQ ID NO: 251549 - RNA, 22 nt, Human
ugcccaggcuggagugcagugg

SEQ ID NO: 251550 - RNA, 23 nt, Human
ugcccaggcuggagugcaguggc

SEQ ID NO: 251551 - RNA, 21 nt, Human
ugcccaggcuggagugcgaug

SEQ ID NO: 251552 - RNA, 21 nt, Human
ugcccaggcuggagugcggug

SEQ ID NO: 251553 - RNA, 22 nt, Human
ugcccaggcuggaguguggugg

SEQ ID NO: 251554 - RNA, 32 nt, Human
ugcccaggcuggauggagugcaguggcgugau

SEQ ID NO: 251555 - RNA, 19 nt, Human
ugcccaggcuggggugcag

SEQ ID NO: 251556 - RNA, 32 nt, Human
ugcccaggcuggucccgaacucauggacucaa

SEQ ID NO: 251557 - RNA, 32 nt, Human
ugcccaggcuggucuccaacuccugggcucaa

SEQ ID NO: 251558 - RNA, 23 nt, Human
ugcccaggcuggucucgagcucc

SEQ ID NO: 251559 - RNA, 32 nt, Human
ugcccaggcuggucuugaaccccuggccucaa

SEQ ID NO: 251560 - RNA, 23 nt, Human
ugcccaggcuggucuugaacucc

SEQ ID NO: 251561 - RNA, 32 nt, Human
ugcccaggcuggucuugacuccugggcucaaa

SEQ ID NO: 251562 - RNA, 32 nt, Human
ugcccaggcugguguguagugaucucagcuca

SEQ ID NO: 251563 - RNA, 21 nt, Human
ugcccaggcuguagugcagug

SEQ ID NO: 251564 - RNA, 32 nt, Human
ugcccaggcugucuuugaacuccugggaucaa

SEQ ID NO: 251565 - RNA, 19 nt, Human
ugcccaggcugugcagcgc

SEQ ID NO: 251566 - RNA, 32 nt, Human
ugcccaggcuguuccuucugccaggcaggccc

SEQ ID NO: 251567 - RNA, 32 nt, Human
ugcccaggcuguucucaaacuccugggcugaa

SEQ ID NO: 251568 - RNA, 32 nt, Human
ugcccaggcuguucuucaacuccugggcucaa

SEQ ID NO: 251569 - RNA, 32 nt, Human
ugcccagggaacaggcucccggcagcccccgc

SEQ ID NO: 251570 - RNA, 32 nt, Human
ugcccagggaccagggcaggcagaggucuucc

SEQ ID NO: 251571 - RNA, 32 nt, Human
ugcccagggacccccaucaccagcucuccagc

SEQ ID NO: 251572 - RNA, 32 nt, Human
ugcccagggagagagagggaguggagcccagg

SEQ ID NO: 251573 - RNA, 32 nt, Human
ugcccagggagcccacggagaggucaacaugg

SEQ ID NO: 251574 - RNA, 32 nt, Human
ugcccagggaggaacggaggaggacucgcgcu

SEQ ID NO: 251575 - RNA, 32 nt, Human
ugcccagggagggagaaggaagagggggagcu

SEQ ID NO: 251576 - RNA, 32 nt, Human
ugcccagggcacacccuauaccuccucaucug

SEQ ID NO: 251577 - RNA, 32 nt, Human
ugcccagggcacuuguauuccagccucgcugc

SEQ ID NO: 251578 - RNA, 32 nt, Human
ugcccagggcagaacccgcugguguugaugac

SEQ ID NO: 251579 - RNA, 32 nt, Human
ugcccagggcccuguccccugcuggggccucu

SEQ ID NO: 251580 - RNA, 32 nt, Human
ugcccagggccuggcccugcugcacaugcccu

SEQ ID NO: 251581 - RNA, 32 nt, Human
ugcccagggcuggaggggacgcuguuccuccc

SEQ ID NO: 251582 - RNA, 22 nt, Human
ugcccagggcuggagugcagug

SEQ ID NO: 251583 - RNA, 32 nt, Human
ugcccagggguugcaggcugcagugagcugug

SEQ ID NO: 251584 - RNA, 32 nt, Human
ugcccagggucggaggcccaacgcccccugag

SEQ ID NO: 251585 - RNA, 21 nt, Human
ugcccaggguggagugcagug

SEQ ID NO: 251586 - RNA, 32 nt, Human
ugcccagguacccacuacagagcuuaagaaaa

SEQ ID NO: 251587 - RNA, 22 nt, Human
ugcccagguagcuggagcugau

SEQ ID NO: 251588 - RNA, 32 nt, Human
ugcccaggugaggccaggcugacugaaaaaga

SEQ ID NO: 251589 - RNA, 32 nt, Human
ugcccagguggaggguccuggggacggcagag

SEQ ID NO: 251590 - RNA, 32 nt, Human
ugcccaggugugagucgcugcagaccuggucc

SEQ ID NO: 251591 - RNA, 18 nt, Human
ugcccagguuccuugcug

SEQ ID NO: 251592 - RNA, 17 nt, Human
ugcccagguugccgugg

SEQ ID NO: 251593 - RNA, 32 nt, Human
ugcccaguaugccuccuggacccuccaguucu

SEQ ID NO: 251594 - RNA, 32 nt, Human
ugcccagucaccaauauuuauaaugaggucua

SEQ ID NO: 251595 - RNA, 21 nt, Human
ugcccaguccuauuucugcca

SEQ ID NO: 251596 - RNA, 21 nt, Human
ugcccagucucugcccugcug

SEQ ID NO: 251597 - RNA, 20 nt, Human
ugcccagucuggccugcgcu

SEQ ID NO: 251598 - RNA, 32 nt, Human
ugcccagucuugucucaaacuccugggcucaa

SEQ ID NO: 251599 - RNA, 32 nt, Human
ugcccagugagccuccuugacaugcuuauucc

SEQ ID NO: 251600 - RNA, 22 nt, Human
ugcccagugccccuagcugcug

SEQ ID NO: 251601 - RNA, 22 nt, Human
ugcccagugccccuccucccca

SEQ ID NO: 251602 - RNA, 32 nt, Human
ugcccaguggugcuucaacugguaucuaugag

SEQ ID NO: 251603 - RNA, 20 nt, Human
ugcccaguguuaugccuaug

SEQ ID NO: 251604 - RNA, 32 nt, Human
ugcccaguucucuguccuuauccacaggcccc

SEQ ID NO: 251605 - RNA, 32 nt, Human
ugcccauaaccccuacuuuguucaagugucaa

SEQ ID NO: 251606 - RNA, 24 nt, Human
ugcccauagcacggagagaagggc

SEQ ID NO: 251607 - RNA, 32 nt, Human
ugcccauaggaagcccuuuugauugacaguau

SEQ ID NO: 251608 - RNA, 24 nt, Human
ugcccauagucccagcuacucagg

SEQ ID NO: 251609 - RNA, 32 nt, Human
ugcccauaguggccuauccucugugauuaugc

SEQ ID NO: 251610 - RNA, 21 nt, Human
ugcccauauggaaaagagggc

SEQ ID NO: 251611 - RNA, 32 nt, Human
ugcccauauuuugcucuuucuuugacuucuau

SEQ ID NO: 251612 - RNA, 32 nt, Human
ugcccaucacccaggugcucagucccuggugc

SEQ ID NO: 251613 - RNA, 32 nt, Human
ugcccaucaccucccucuccccaacaucccca

SEQ ID NO: 251614 - RNA, 22 nt, Human
ugcccaucagcagguucccaug

SEQ ID NO: 251615 - RNA, 32 nt, Human
ugcccaucauccccuuccugcucuggcgcuca

SEQ ID NO: 251616 - RNA, 22 nt, Human
ugcccaucccuggcugaagcuc

SEQ ID NO: 251617 - RNA, 32 nt, Human
ugcccauccugcucuccuccagccgagggacc

SEQ ID NO: 251618 - RNA, 32 nt, Human
ugcccauccuuccacugcaaagccgcugggac

SEQ ID NO: 251619 - RNA, 32 nt, Human
ugcccaucuacuuccaaucccucucucccuua

SEQ ID NO: 251620 - RNA, 32 nt, Human
ugcccaucuccauggugugcagucucuggguu

SEQ ID NO: 251621 - RNA, 32 nt, Human
ugcccaucuccccaacccagucacagagagau

SEQ ID NO: 251622 - RNA, 32 nt, Human
ugcccaucuccccugcucaacuucuccaccaa

SEQ ID NO: 251623 - RNA, 32 nt, Human
ugcccaucuguuucuccucgggugccagccag

SEQ ID NO: 251624 - RNA, 32 nt, Human
ugcccaucuuuguugccauucagugcuacgcg

SEQ ID NO: 251625 - RNA, 32 nt, Human
ugcccaugaacauuauucuauugauguguuua

SEQ ID NO: 251626 - RNA, 32 nt, Human
ugcccaugacaucucccugaaagaggacacca

SEQ ID NO: 251627 - RNA, 32 nt, Human
ugcccaugcaggcagggccugcaggaggggag

SEQ ID NO: 251628 - RNA, 21 nt, Human
ugcccaugcuggagugcaaug

SEQ ID NO: 251629 - RNA, 32 nt, Human
ugcccaugcugguucugaacuccugggcucaa

SEQ ID NO: 251630 - RNA, 30 nt, Human
ugcccauggaccaauccgcacacacuuccu

SEQ ID NO: 251631 - RNA, 32 nt, Human
ugcccaugggccuucucguugcagggaggcgg

SEQ ID NO: 251632 - RNA, 32 nt, Human
ugcccauggugggagcguggucacugugcagu

SEQ ID NO: 251633 - RNA, 32 nt, Human
ugcccauuccccagccucucuuccuaucccau

SEQ ID NO: 251634 - RNA, 32 nt, Human
ugcccauugcagagaaggggacugggaccaaa

SEQ ID NO: 251635 - RNA, 32 nt, Human
ugcccauuucacgacuccucugagacuaauug

SEQ ID NO: 251636 - RNA, 32 nt, Human
ugcccauuugggccugcauagugccaugauug

SEQ ID NO: 251637 - RNA, 32 nt, Human
ugcccauuuguaggugguaaaaucaauuguuu

SEQ ID NO: 251638 - RNA, 32 nt, Human
ugcccauuugucggcuuacagcucuuccggag

SEQ ID NO: 251639 - RNA, 32 nt, Human
ugccccaaagccccagagagcuccuuagacau

SEQ ID NO: 251640 - RNA, 32 nt, Human
ugccccaacaaaugcaaaugcacacaaaccca

SEQ ID NO: 251641 - RNA, 32 nt, Human
ugccccaaccaucuuggccacaugucaucagg

SEQ ID NO: 251642 - RNA, 20 nt, Human
ugccccaacucggcgcccga

SEQ ID NO: 251643 - RNA, 22 nt, Human
ugccccaacuucucggauguca

SEQ ID NO: 251644 - RNA, 24 nt, Human
ugccccaacuuuccuggagcccga

SEQ ID NO: 251645 - RNA, 32 nt, Human
ugccccaacuuugcuucuagaucucuggggug

SEQ ID NO: 251646 - RNA, 32 nt, Human
ugccccaagagcaggaggugccugaaagcugg

SEQ ID NO: 251647 - RNA, 32 nt, Human
ugccccaagcagcuggccaacauguguagaga

SEQ ID NO: 251648 - RNA, 32 nt, Human
ugccccaaggcucccgccgcugcuccagcgcg

SEQ ID NO: 251649 - RNA, 32 nt, Human
ugccccaaguaggaauauagcucugcauuuac

SEQ ID NO: 251650 - RNA, 32 nt, Human
ugccccaaguugcugucuccccuucccucacc

SEQ ID NO: 251651 - RNA, 32 nt, Human
ugccccaaguuuuaggaacauguuaggauaua

SEQ ID NO: 251652 - RNA, 26 nt, Human
ugccccaaucaucucgcuggaugcca

SEQ ID NO: 251653 - RNA, 32 nt, Human
ugccccacacuuuccuccuccccacugcagug

SEQ ID NO: 251654 - RNA, 32 nt, Human
ugccccacagcccugaggaaggcacauauuua

SEQ ID NO: 251655 - RNA, 32 nt, Human
ugccccacagggaccccagccuggguggucac

SEQ ID NO: 251656 - RNA, 32 nt, Human
ugccccacaguccucaggcuccagcuuucucg

SEQ ID NO: 251657 - RNA, 32 nt, Human
ugccccaccaugucagacgcagccguagacac

SEQ ID NO: 251658 - RNA, 32 nt, Human
ugccccaccaugucagacgcagccguagacgc

SEQ ID NO: 251659 - RNA, 21 nt, Human
ugccccacccacccagugccu

SEQ ID NO: 251660 - RNA, 32 nt, Human
ugccccacccacccuccugggcccaggcagca

SEQ ID NO: 251661 - RNA, 19 nt, Human
ugccccacccaucccugca

SEQ ID NO: 251662 - RNA, 31 nt, Human
ugccccaccccagccucuuccaggagagcac

SEQ ID NO: 251663 - RNA, 32 nt, Human
ugccccaccccagccucuuccaggagagcacc

SEQ ID NO: 251664 - RNA, 17 nt, Human
ugccccaccccaggaaa

SEQ ID NO: 251665 - RNA, 32 nt, Human
ugccccaccccauuccuuauauucagcaagca

SEQ ID NO: 251666 - RNA, 19 nt, Human
ugccccaccccucccugca

SEQ ID NO: 251667 - RNA, 32 nt, Human
ugccccacccuccaaucugcacuuugauuugc

SEQ ID NO: 251668 - RNA, 32 nt, Human
ugccccacccuccacaggcaggugaccuggag

SEQ ID NO: 251669 - RNA, 32 nt, Human
ugccccacccugcagagaaggaagaaagguga

SEQ ID NO: 251670 - RNA, 32 nt, Human
ugccccaccucuccccaauuaagugccuucac

SEQ ID NO: 251671 - RNA, 32 nt, Human
ugccccaccuggauuccugccugcuguaggua

SEQ ID NO: 251672 - RNA, 32 nt, Human
ugccccaccuuuccuuuccuuccugugggccc

SEQ ID NO: 251673 - RNA, 19 nt, Human
ugccccacguccguuugca

SEQ ID NO: 251674 - RNA, 32 nt, Human
ugccccacuccgaaggaaaccccacguacagg

SEQ ID NO: 251675 - RNA, 32 nt, Human
ugccccacugcacuccacccugggcaauggag

SEQ ID NO: 251676 - RNA, 32 nt, Human
ugccccacugcacuccagccuaggcaacagag

SEQ ID NO: 251677 - RNA, 32 nt, Human
ugccccacugcacuccagccugggcgacagaa

SEQ ID NO: 251678 - RNA, 32 nt, Human
ugccccacugcacuccagccugggugacagag

SEQ ID NO: 251679 - RNA, 32 nt, Human
ugccccacugucccaacuccucuccucuuaga

SEQ ID NO: 251680 - RNA, 32 nt, Human
ugccccacugugcuccugggccugugacccca

SEQ ID NO: 251681 - RNA, 32 nt, Human
ugccccacuucugcuuugugucucccucuguc

SEQ ID NO: 251682 - RNA, 32 nt, Human
ugccccagaaguuugagaccagccugggcaac

SEQ ID NO: 251683 - RNA, 32 nt, Human
ugccccagacagacuucaucauugugcuagcu

SEQ ID NO: 251684 - RNA, 32 nt, Human
ugccccagagacugaaggaaugcccaggagag

SEQ ID NO: 251685 - RNA, 22 nt, Human
ugccccagagccccgcagugag

SEQ ID NO: 251686 - RNA, 32 nt, Human
ugccccagagcccgaggccaggggacagggcu

SEQ ID NO: 251687 - RNA, 32 nt, Human
ugccccagaugccaccggaaaugucaucuucu

SEQ ID NO: 251688 - RNA, 22 nt, Human
ugccccagcaaguguaaccuug

SEQ ID NO: 251689 - RNA, 32 nt, Human
ugccccagccagauggacuccagccugccugg

SEQ ID NO: 251690 - RNA, 18 nt, Human
ugccccagccccauuccc

SEQ ID NO: 251691 - RNA, 32 nt, Human
ugccccagccuaucugauggcauggucccugg

SEQ ID NO: 251692 - RNA, 32 nt, Human
ugccccagccuccugaguagcugggauuacag

SEQ ID NO: 251693 - RNA, 32 nt, Human
ugccccagccuccugggccugcccuucccucu

SEQ ID NO: 251694 - RNA, 32 nt, Human
ugccccagccugacauguguccaggccccucc

SEQ ID NO: 251695 - RNA, 32 nt, Human
ugccccagccuggggugaggguaagggguagg

SEQ ID NO: 251696 - RNA, 32 nt, Human
ugccccagccuguguagcucuuccugcaugug

SEQ ID NO: 251697 - RNA, 32 nt, Human
ugccccagccuucuccaggacaaccugcugga

SEQ ID NO: 251698 - RNA, 32 nt, Human
ugccccagcugauacgcaaggugccagugugu

SEQ ID NO: 251699 - RNA, 21 nt, Human
ugccccagcugggaagagggc

SEQ ID NO: 251700 - RNA, 32 nt, Human
ugccccaggagcuaguggagggugaggucaau

SEQ ID NO: 251701 - RNA, 32 nt, Human
ugccccaggaggugagguuaaggaguuggggg

SEQ ID NO: 251702 - RNA, 24 nt, Human
ugccccaggcagcccacccacgcc

SEQ ID NO: 251703 - RNA, 32 nt, Human
ugccccaggcagcccacccacgcccagugcgg

SEQ ID NO: 251704 - RNA, 32 nt, Human
ugccccaggcagcccgggcacagugagcuuag

SEQ ID NO: 251705 - RNA, 32 nt, Human
ugccccaggccaucaucuccccaccucuccuc

SEQ ID NO: 251706 - RNA, 20 nt, Human
ugccccaggccaucccgccg

SEQ ID NO: 251707 - RNA, 32 nt, Human
ugccccaggccauuucucccaccuuuacucac

SEQ ID NO: 251708 - RNA, 22 nt, Human
ugccccaggcccacccaggggg

SEQ ID NO: 251709 - RNA, 32 nt, Human
ugccccaggcccugugcagacacaccaggccc

SEQ ID NO: 251710 - RNA, 32 nt, Human
ugccccaggccgggcucaguggcucacaccug

SEQ ID NO: 251711 - RNA, 32 nt, Human
ugccccaggccugaguccuuagcaaggguugg

SEQ ID NO: 251712 - RNA, 32 nt, Human
ugccccaggccugccuuccauucuuuaacagc

SEQ ID NO: 251713 - RNA, 32 nt, Human
ugccccaggcuggagugcaguggcgugaucuu

SEQ ID NO: 251714 - RNA, 32 nt, Human
ugccccaggcuggagugcaguggugugauccu

SEQ ID NO: 251715 - RNA, 26 nt, Human
ugccccaggcugggaggaacucugua

SEQ ID NO: 251716 - RNA, 32 nt, Human
ugccccagggcugaggccuccgcucaggcagc

SEQ ID NO: 251717 - RNA, 23 nt, Human
ugccccaggggcaccacgccuga

SEQ ID NO: 251718 - RNA, 32 nt, Human
ugccccagggggaucagggauccucacccucc

SEQ ID NO: 251719 - RNA, 32 nt, Human
ugccccagggugagaacgugcccagccacauc

SEQ ID NO: 251720 - RNA, 32 nt, Human
ugccccaguccggccaucaccaugcuccggac

SEQ ID NO: 251721 - RNA, 32 nt, Human
ugccccaguccuuuccuacuccagaaaugcuc

SEQ ID NO: 251722 - RNA, 22 nt, Human
ugccccagucuccucuccacca

SEQ ID NO: 251723 - RNA, 23 nt, Human
ugccccagucucucuguugagcc

SEQ ID NO: 251724 - RNA, 32 nt, Human
ugccccagugcuggauccacugggugaagcca

SEQ ID NO: 251725 - RNA, 32 nt, Human
ugccccaguggugcgggccaggucuggcgcca

SEQ ID NO: 251726 - RNA, 32 nt, Human
ugccccagugugcagccccugccagauguggg

SEQ ID NO: 251727 - RNA, 22 nt, Human
ugccccaguguuuuggauacca

SEQ ID NO: 251728 - RNA, 32 nt, Human
ugccccaguugcucauacaaacagaucagcau

SEQ ID NO: 251729 - RNA, 32 nt, Human
ugccccaguuuucuccuccucacuagucugug

SEQ ID NO: 251730 - RNA, 32 nt, Human
ugccccaucacaggcgagagugugcugagugc

SEQ ID NO: 251731 - RNA, 32 nt, Human
ugccccaucuucuggcacaggccaucccgagu

SEQ ID NO: 251732 - RNA, 32 nt, Human
ugccccaucuuucaaaucaucuggaagagacg

SEQ ID NO: 251733 - RNA, 23 nt, Human
ugccccaugaccccagaugccuc

SEQ ID NO: 251734 - RNA, 32 nt, Human
ugccccaugccuguccagccugggcagccagg

SEQ ID NO: 251735 - RNA, 31 nt, Human
ugccccaugguggcagugguggcggucagau

SEQ ID NO: 251736 - RNA, 32 nt, Human
ugccccauuuuagaagaagacagaguaguuga

SEQ ID NO: 251737 - RNA, 32 nt, Human
ugcccccaacccacccuccaccccguccccca

SEQ ID NO: 251738 - RNA, 32 nt, Human
ugcccccaaugccaccauugcaguggccauuu

SEQ ID NO: 251739 - RNA, 32 nt, Human
ugcccccaccaccaccacccccaucacugcuu

SEQ ID NO: 251740 - RNA, 32 nt, Human
ugcccccacccccucacagggucccucagauu

SEQ ID NO: 251741 - RNA, 21 nt, Human
ugcccccaccgcccaccaccu

SEQ ID NO: 251742 - RNA, 21 nt, Human
ugcccccaccucccaccgccu

SEQ ID NO: 251743 - RNA, 19 nt, Human
ugcccccacguccccuuca

SEQ ID NO: 251744 - RNA, 32 nt, Human
ugcccccagaaacuugccccgaguuucucugg

SEQ ID NO: 251745 - RNA, 21 nt, Human
ugcccccagcccaccccugcc

SEQ ID NO: 251746 - RNA, 32 nt, Human
ugcccccagccugugugcccuguuccuugccc

SEQ ID NO: 251747 - RNA, 32 nt, Human
ugcccccaggacuaguggagguucucugccca

SEQ ID NO: 251748 - RNA, 32 nt, Human
ugcccccaggagauggagggccugguggaugc

SEQ ID NO: 251749 - RNA, 32 nt, Human
ugcccccaguuccccucucugcccccacacuc

SEQ ID NO: 251750 - RNA, 32 nt, Human
ugcccccaucaucgugcaauaccucagugcag

SEQ ID NO: 251751 - RNA, 32 nt, Human
ugcccccaucucggacccucaggcuguugguu

SEQ ID NO: 251752 - RNA, 19 nt, Human
ugccccccacagaggcugg

SEQ ID NO: 251753 - RNA, 22 nt, Human
ugccccccgggcuuccugccca

SEQ ID NO: 251754 - RNA, 22 nt, Human
ugccccccgucccuccacccca

SEQ ID NO: 251755 - RNA, 16 nt, Human
ugccccccucaucuca

SEQ ID NO: 251756 - RNA, 23 nt, Human
ugccccccuuggacucccgccca

SEQ ID NO: 251757 - RNA, 23 nt, Human
ugccccccuugggcacccacuca

SEQ ID NO: 251758 - RNA, 32 nt, Human
ugcccccgagccaccaucaugccugggcacuu

SEQ ID NO: 251759 - RNA, 32 nt, Human
ugcccccgcuacacuccagccuggucgacaga

SEQ ID NO: 251760 - RNA, 32 nt, Human
ugcccccggaagagaaacaaagcagcaggaca

SEQ ID NO: 251761 - RNA, 32 nt, Human
ugcccccggacccggggguggggaggggagca

SEQ ID NO: 251762 - RNA, 23 nt, Human
ugcccccgucacaacucuguaga

SEQ ID NO: 251763 - RNA, 32 nt, Human
ugcccccgugagccucccucgccgccccuccc

SEQ ID NO: 251764 - RNA, 32 nt, Human
ugcccccguucccggguagccacuggacugac

SEQ ID NO: 251765 - RNA, 32 nt, Human
ugcccccuacagcagcagcccagauccucccc

SEQ ID NO: 251766 - RNA, 21 nt, Human
ugcccccuccaaggcugugca

SEQ ID NO: 251767 - RNA, 32 nt, Human
ugcccccuccaaugcuacccccggccccaggg

SEQ ID NO: 251768 - RNA, 21 nt, Human
ugcccccuccccacccucccu

SEQ ID NO: 251769 - RNA, 20 nt, Human
ugcccccuccccacccugcc

SEQ ID NO: 251770 - RNA, 23 nt, Human
ugcccccuccccgcccacugucu

SEQ ID NO: 251771 - RNA, 24 nt, Human
ugcccccuccgccaccgccgccgc

SEQ ID NO: 251772 - RNA, 32 nt, Human
ugcccccuccuggagcagcuccugggcugugc

SEQ ID NO: 251773 - RNA, 24 nt, Human
ugcccccuccuugcccaccugccu

SEQ ID NO: 251774 - RNA, 32 nt, Human
ugcccccuccuuuaucccagcagcagcgucuc

SEQ ID NO: 251775 - RNA, 22 nt, Human
ugcccccucgcggagugcgugg

SEQ ID NO: 251776 - RNA, 32 nt, Human
ugcccccucuauucuccucucucccccagggg

SEQ ID NO: 251777 - RNA, 32 nt, Human
ugcccccucuccccgcccccugcccggccaac

SEQ ID NO: 251778 - RNA, 32 nt, Human
ugcccccucugccuccaccccggcuccuggcc

SEQ ID NO: 251779 - RNA, 23 nt, Human
ugcccccugacccacaucugcug

SEQ ID NO: 251780 - RNA, 32 nt, Human
ugcccccugagcagcugggacuacaggcacac

SEQ ID NO: 251781 - RNA, 31 nt, Human
ugcccccugagcgccaggcuucgggcccggg

SEQ ID NO: 251782 - RNA, 32 nt, Human
ugcccccugcaaccuccuucaggggccucugg

SEQ ID NO: 251783 - RNA, 32 nt, Human
ugcccccugcagcugcugccauccccaccccu

SEQ ID NO: 251784 - RNA, 32 nt, Human
ugcccccugcaggaaggagcugccuggacccg

SEQ ID NO: 251785 - RNA, 31 nt, Human
ugcccccugcagucucccacagccagggccc

SEQ ID NO: 251786 - RNA, 32 nt, Human
ugcccccugccaggcugagggacagugacaca

SEQ ID NO: 251787 - RNA, 32 nt, Human
ugcccccugccugcugcuccugucacagacca

SEQ ID NO: 251788 - RNA, 32 nt, Human
ugcccccugugucauucuucuaauccaaugua

SEQ ID NO: 251789 - RNA, 20 nt, Human
ugcccccuuccagccuggag

SEQ ID NO: 251790 - RNA, 32 nt, Human
ugcccccuucgcuccuccucucaucauuugca

SEQ ID NO: 251791 - RNA, 24 nt, Human
ugcccccuucucuagccacagccu

SEQ ID NO: 251792 - RNA, 32 nt, Human
ugcccccuuucagaugucuucugccuguuaua

SEQ ID NO: 251793 - RNA, 32 nt, Human
ugcccccuuugcaaggccugcugcagucccca

SEQ ID NO: 251794 - RNA, 32 nt, Human
ugcccccuuuucugaggaggugcauggccuga

SEQ ID NO: 251795 - RNA, 18 nt, Human
ugccccgaccccgccugc

SEQ ID NO: 251796 - RNA, 32 nt, Human
ugccccgagccuuucuggggaagaacuccagg

SEQ ID NO: 251797 - RNA, 32 nt, Human
ugccccgagucugggucaggugccuccuguga

SEQ ID NO: 251798 - RNA, 32 nt, Human
ugccccgauacucaucuugcacggccagaacu

SEQ ID NO: 251799 - RNA, 32 nt, Human
ugccccgcagaagguguuuuugcgcugguuca

SEQ ID NO: 251800 - RNA, 32 nt, Human
ugccccgcagaggccacgccuauuuauucugu

SEQ ID NO: 251801 - RNA, 32 nt, Human
ugccccgcccuuccagcugaggacaggcuggc

SEQ ID NO: 251802 - RNA, 18 nt, Human
ugccccgccguccuccuu

SEQ ID NO: 251803 - RNA, 32 nt, Human
ugccccgccucagccccagcugcccuggcgug

SEQ ID NO: 251804 - RNA, 22 nt, Human
ugccccgcgcccgcugcugcug

SEQ ID NO: 251805 - RNA, 32 nt, Human
ugccccgcuggucccaggcuggauugccgugg

SEQ ID NO: 251806 - RNA, 32 nt, Human
ugccccggaauagcacuuuaauagucaaaaau

SEQ ID NO: 251807 - RNA, 32 nt, Human
ugccccggaggcccagcuagccccagacuucg

SEQ ID NO: 251808 - RNA, 32 nt, Human
ugccccggcaggccuggggucugcaguccucu

SEQ ID NO: 251809 - RNA, 19 nt, Human
ugccccggccaggccugca

SEQ ID NO: 251810 - RNA, 32 nt, Human
ugccccggccuccugaguaccugggauuauag

SEQ ID NO: 251811 - RNA, 32 nt, Human
ugccccggcugcaaccucucccacucaagaga

SEQ ID NO: 251812 - RNA, 23 nt, Human
ugccccgggcucaauggcuggau

SEQ ID NO: 251813 - RNA, 32 nt, Human
ugccccgggguucuguccaccggggaggaaag

SEQ ID NO: 251814 - RNA, 32 nt, Human
ugccccggucaccuagcaagcugccgaaccaa

SEQ ID NO: 251815 - RNA, 32 nt, Human
ugccccgguggugggaagcgccuggacagacc

SEQ ID NO: 251816 - RNA, 32 nt, Human
ugccccgucaugccaaagaggaaagugaccuu

SEQ ID NO: 251817 - RNA, 32 nt, Human
ugccccgucuuucugccgcagcccucgcagag

SEQ ID NO: 251818 - RNA, 32 nt, Human
ugccccgugccuggcagaggucuggugccagc

SEQ ID NO: 251819 - RNA, 32 nt, Human
ugccccuaaagccacagcagaagagccauuca

SEQ ID NO: 251820 - RNA, 32 nt, Human
ugccccuacaucucagcugaaucuccagggag

SEQ ID NO: 251821 - RNA, 32 nt, Human
ugccccuagaagggaaggggagagggaaacgu

SEQ ID NO: 251822 - RNA, 21 nt, Human
ugccccuagucugggugcccg

SEQ ID NO: 251823 - RNA, 32 nt, Human
ugccccuauggaacuggguuccuuccaugaca

SEQ ID NO: 251824 - RNA, 24 nt, Human
ugccccucaaagugcugggauuac

SEQ ID NO: 251825 - RNA, 32 nt, Human
ugccccucaaagugcugggauuacgugaucca

SEQ ID NO: 251826 - RNA, 32 nt, Human
ugccccucacaccuccacaucccagauaccca

SEQ ID NO: 251827 - RNA, 32 nt, Human
ugccccucagagacacagcugugggugccucu

SEQ ID NO: 251828 - RNA, 32 nt, Human
ugccccucagcccugcuggaacagggucugcc

SEQ ID NO: 251829 - RNA, 32 nt, Human
ugccccucagcgguuccagugcccucaaagca

SEQ ID NO: 251830 - RNA, 32 nt, Human
ugccccucauucuggccaguucuuuccaguag

SEQ ID NO: 251831 - RNA, 32 nt, Human
ugccccuccagcgccuaucauacgccugacac

SEQ ID NO: 251832 - RNA, 32 nt, Human
ugccccucccagucccguuucuccccucuagg

SEQ ID NO: 251833 - RNA, 32 nt, Human
ugccccucccuccagcccagcuccauucuuug

SEQ ID NO: 251834 - RNA, 22 nt, Human
ugccccuccuccgaugcauaca

SEQ ID NO: 251835 - RNA, 32 nt, Human
ugccccuccugaauuggaguuagcguccucuu

SEQ ID NO: 251836 - RNA, 32 nt, Human
ugccccuccugccccgaaagugcugacuaugg

SEQ ID NO: 251837 - RNA, 18 nt, Human
ugccccuccugcccugca

SEQ ID NO: 251838 - RNA, 32 nt, Human
ugccccucggccacuccuggguuggagcccga

SEQ ID NO: 251839 - RNA, 32 nt, Human
ugccccucuccuccucacuauucucaccaggc

SEQ ID NO: 251840 - RNA, 32 nt, Human
ugccccucucgccucuggaguggcugccugag

SEQ ID NO: 251841 - RNA, 32 nt, Human
ugccccucucuacaaggucuuuuugguuucac

SEQ ID NO: 251842 - RNA, 32 nt, Human
ugccccucucucccucugccccucucuccucu

SEQ ID NO: 251843 - RNA, 32 nt, Human
ugccccucugccuugcccuccugggcccuggg

SEQ ID NO: 251844 - RNA, 32 nt, Human
ugccccucugcuccggcccuugcccuuugacc

SEQ ID NO: 251845 - RNA, 32 nt, Human
ugccccucuggugaccaggucacagcucccuu

SEQ ID NO: 251846 - RNA, 32 nt, Human
ugccccucuuccacucugcucucggccacuug

SEQ ID NO: 251847 - RNA, 32 nt, Human
ugccccucuuccucccccuccucuucuuccuc

SEQ ID NO: 251848 - RNA, 32 nt, Human
ugccccugaagucuaucugcaggauggucuuc

SEQ ID NO: 251849 - RNA, 32 nt, Human
ugccccugacacugcacugagcacuuuaugag

SEQ ID NO: 251850 - RNA, 32 nt, Human
ugccccugaccccuccagucuuagcuccugcu

SEQ ID NO: 251851 - RNA, 32 nt, Human
ugccccugagccuucugcuccaaggaaccagc

SEQ ID NO: 251852 - RNA, 32 nt, Human
ugccccugagcuguaccccacuccaggacaag

SEQ ID NO: 251853 - RNA, 32 nt, Human
ugccccugcacagcagaauuucccugccagag

SEQ ID NO: 251854 - RNA, 32 nt, Human
ugccccugcacagcaggcugccagugccuggg

SEQ ID NO: 251855 - RNA, 32 nt, Human
ugccccugcacaucagccugggugauagauug

SEQ ID NO: 251856 - RNA, 32 nt, Human
ugccccugcacuccagccugagcgacagugag

SEQ ID NO: 251857 - RNA, 32 nt, Human
ugccccugcacugaagugugaggagcaggaau

SEQ ID NO: 251858 - RNA, 32 nt, Human
ugccccugcaugguaugggaucaaagaggaca

SEQ ID NO: 251859 - RNA, 32 nt, Human
ugccccugcauucuagccugggugacagugag

SEQ ID NO: 251860 - RNA, 32 nt, Human
ugccccugccaccacagcugcuuaugugugac

SEQ ID NO: 251861 - RNA, 32 nt, Human
ugccccugcccaccuccuccagccuagguugu

SEQ ID NO: 251862 - RNA, 32 nt, Human
ugccccugcccaggcugccaugugagggugug

SEQ ID NO: 251863 - RNA, 22 nt, Human
ugccccugcccccuccccgcca

SEQ ID NO: 251864 - RNA, 31 nt, Human
ugccccugccucucccugugucccuuccccu

SEQ ID NO: 251865 - RNA, 32 nt, Human
ugccccugccucucccugugucccuuccccug

SEQ ID NO: 251866 - RNA, 32 nt, Human
ugccccugcugccucagcccucaggcuccuaa

SEQ ID NO: 251867 - RNA, 32 nt, Human
ugccccugcugccuccccaacccugccccugc

SEQ ID NO: 251868 - RNA, 32 nt, Human
ugccccugcugcugccccgagggcugcccugc

SEQ ID NO: 251869 - RNA, 21 nt, Human
ugccccugcugugcugcucaa

SEQ ID NO: 251870 - RNA, 32 nt, Human
ugccccuggaaaccuuccugcaauggccccuu

SEQ ID NO: 251871 - RNA, 32 nt, Human
ugccccuggaggugggggcugcuggcugagga

SEQ ID NO: 251872 - RNA, 32 nt, Human
ugccccuggcccccacgcccucccucuccagu

SEQ ID NO: 251873 - RNA, 29 nt, Human
ugccccuggcugcugucgaucucuccacg

SEQ ID NO: 251874 - RNA, 32 nt, Human
ugccccuggcugcugucgaucucuccacggcg

SEQ ID NO: 251875 - RNA, 29 nt, Human
ugccccuggcugcuguuucccagccuuuc

SEQ ID NO: 251876 - RNA, 32 nt, Human
ugccccuggcuuucugggucugugccucucca

SEQ ID NO: 251877 - RNA, 32 nt, Human
ugccccugggagacgagugaaggagccccaga

SEQ ID NO: 251878 - RNA, 32 nt, Human
ugccccugggauucucaggccaaccugccaac

SEQ ID NO: 251879 - RNA, 32 nt, Human
ugccccugggcaaggaagcgaggcccucuggg

SEQ ID NO: 251880 - RNA, 32 nt, Human
ugccccugggccuguccuucugccugugaccc

SEQ ID NO: 251881 - RNA, 32 nt, Human
ugccccugggcuggugcuggcagugggagccg

SEQ ID NO: 251882 - RNA, 32 nt, Human
ugccccuguacuccagccugggugacagagca

SEQ ID NO: 251883 - RNA, 32 nt, Human
ugccccuguagucccagcuacuugggaggcug

SEQ ID NO: 251884 - RNA, 32 nt, Human
ugccccugucacugcacccagcuuggcauuua

SEQ ID NO: 251885 - RNA, 22 nt, Human
ugccccugucccaccccuaccu

SEQ ID NO: 251886 - RNA, 32 nt, Human
ugccccugucugcugcucccagucucucgcuc

SEQ ID NO: 251887 - RNA, 32 nt, Human
ugccccugugaagaaauguggccauguucauu

SEQ ID NO: 251888 - RNA, 32 nt, Human
ugccccugugcccagugguugaugauaccacc

SEQ ID NO: 251889 - RNA, 32 nt, Human
ugccccuguggugagucaugaaaccuccuugg

SEQ ID NO: 251890 - RNA, 32 nt, Human
ugccccuguucucuuccacucuccuugcuacc

SEQ ID NO: 251891 - RNA, 32 nt, Human
ugccccuguuucagucucaucuguacucacgg

SEQ ID NO: 251892 - RNA, 32 nt, Human
ugccccuuauguuuacguuugcagccugaagc

SEQ ID NO: 251893 - RNA, 32 nt, Human
ugccccuucacugcauguccccaaacucagca

SEQ ID NO: 251894 - RNA, 32 nt, Human
ugccccuuccaggccuccucugucaccagagg

SEQ ID NO: 251895 - RNA, 32 nt, Human
ugccccuuccuccuucaugccugggccugcag

SEQ ID NO: 251896 - RNA, 32 nt, Human
ugccccuuccuuguuuuuccuccuacuggucu

SEQ ID NO: 251897 - RNA, 18 nt, Human
ugccccuucuaccaggug

SEQ ID NO: 251898 - RNA, 17 nt, Human
ugccccuucuccaggau

SEQ ID NO: 251899 - RNA, 32 nt, Human
ugccccuucucgggggucaugaugggcagcaa

SEQ ID NO: 251900 - RNA, 17 nt, Human
ugccccuucucugggug

SEQ ID NO: 251901 - RNA, 23 nt, Human
ugccccuucugccccuccaccca

SEQ ID NO: 251902 - RNA, 32 nt, Human
ugccccuucuuucugcccuuccucaccgaaga

SEQ ID NO: 251903 - RNA, 32 nt, Human
ugccccuugccugccuuccucgccaguagcuu

SEQ ID NO: 251904 - RNA, 32 nt, Human
ugccccuugugauggaugaggaaagguaucca

SEQ ID NO: 251905 - RNA, 32 nt, Human
ugccccuuucuauccaugcuguguccaggagg

SEQ ID NO: 251906 - RNA, 32 nt, Human
ugccccuuuguccccaugucaggcggaggcgg

SEQ ID NO: 251907 - RNA, 32 nt, Human
ugccccuuuucuccuugcauuagcaagcuagg

SEQ ID NO: 251908 - RNA, 32 nt, Human
ugccccuuuugaugcccuugaauagccugaag

SEQ ID NO: 251909 - RNA, 18 nt, Human
ugccccuuuuuauccaga

SEQ ID NO: 251910 - RNA, 32 nt, Human
ugcccgaaccucaugccucuugcccccagauc

SEQ ID NO: 251911 - RNA, 17 nt, Human
ugcccgaccccaucuca

SEQ ID NO: 251912 - RNA, 32 nt, Human
ugcccgacugugcuuucaagagcucggccauc

SEQ ID NO: 251913 - RNA, 32 nt, Human
ugcccgacuuccucuuuggcaccuccauuccc

SEQ ID NO: 251914 - RNA, 32 nt, Human
ugcccgaggagaccagggaggcuuggacccca

SEQ ID NO: 251915 - RNA, 32 nt, Human
ugcccgagggucuccgcccaccccggccggac

SEQ ID NO: 251916 - RNA, 32 nt, Human
ugcccgaguagcugggacuacaggcaugugcc

SEQ ID NO: 251917 - RNA, 32 nt, Human
ugcccgaguuuucuuuauggaguacuucuuuc

SEQ ID NO: 251918 - RNA, 32 nt, Human
ugcccgcagcaaggcccagcugagguggugga

SEQ ID NO: 251919 - RNA, 21 nt, Human
ugcccgcagcccaggcuccug

SEQ ID NO: 251920 - RNA, 20 nt, Human
ugcccgcauccuccaggggg

SEQ ID NO: 251921 - RNA, 32 nt, Human
ugcccgcaucuucuguuccaugggugcccagc

SEQ ID NO: 251922 - RNA, 32 nt, Human
ugcccgccaccauuuugcacacugccuguuca

SEQ ID NO: 251923 - RNA, 32 nt, Human
ugcccgccagccugaccugugcccggcucgcg

SEQ ID NO: 251924 - RNA, 32 nt, Human
ugcccgccaggccagucuugaccugcaguggc

SEQ ID NO: 251925 - RNA, 31 nt, Human
ugcccgcccagcugcuccaugccaggaggag

SEQ ID NO: 251926 - RNA, 19 nt, Human
ugcccgcccccugcugcug

SEQ ID NO: 251927 - RNA, 21 nt, Human
ugcccgccccgccccauccca

SEQ ID NO: 251928 - RNA, 32 nt, Human
ugcccgcccgccagugucagugguguuggcau

SEQ ID NO: 251929 - RNA, 21 nt, Human
ugcccgccgccccuccaccca

SEQ ID NO: 251930 - RNA, 32 nt, Human
ugcccgccggcccgcggcuccugggccuccca

SEQ ID NO: 251931 - RNA, 32 nt, Human
ugcccgccuccuaucagccucugggaaggcca

SEQ ID NO: 251932 - RNA, 32 nt, Human
ugcccgccucugccgggagggagggaggcaca

SEQ ID NO: 251933 - RNA, 32 nt, Human
ugcccgccugcccccauccccuccaggccacg

SEQ ID NO: 251934 - RNA, 32 nt, Human
ugcccgccugcccgugggucauggccugccag

SEQ ID NO: 251935 - RNA, 22 nt, Human
ugcccgcgccacccgcagcccc

SEQ ID NO: 251936 - RNA, 21 nt, Human
ugcccgcuacucccacucuca

SEQ ID NO: 251937 - RNA, 32 nt, Human
ugcccgcuaugggcuguguccaugaccagagg

SEQ ID NO: 251938 - RNA, 21 nt, Human
ugcccgcucaccccacuccac

SEQ ID NO: 251939 - RNA, 32 nt, Human
ugcccgcucaccuggaugaccaugccucaccu

SEQ ID NO: 251940 - RNA, 32 nt, Human
ugcccgcuccagccucuccagugcugggagag

SEQ ID NO: 251941 - RNA, 32 nt, Human
ugcccgcugccucuugucuagcugcugucagg

SEQ ID NO: 251942 - RNA, 32 nt, Human
ugcccgcuggacagcacuaucucuaccagcgg

SEQ ID NO: 251943 - RNA, 32 nt, Human
ugcccgcuggagacaguguuugucgugggcgu

SEQ ID NO: 251944 - RNA, 32 nt, Human
ugcccgcuuccgcuguccugguguuuuacuac

SEQ ID NO: 251945 - RNA, 32 nt, Human
ugcccggaaguuggucuuccauggacaacaca

SEQ ID NO: 251946 - RNA, 32 nt, Human
ugcccggacccgacaccgccacccucgcuccc

SEQ ID NO: 251947 - RNA, 32 nt, Human
ugcccggagccccagccccaggggaccaugcc

SEQ ID NO: 251948 - RNA, 32 nt, Human
ugcccggagccuggaggagcugcugcuggacg

SEQ ID NO: 251949 - RNA, 17 nt, Human
ugcccggagcgcggcgg

SEQ ID NO: 251950 - RNA, 25 nt, Human
ugcccggagcuggccgugucuccca

SEQ ID NO: 251951 - RNA, 23 nt, Human
ugcccggccaaggccacgccggc

SEQ ID NO: 251952 - RNA, 32 nt, Human
ugcccggccagcugcgccacggaugccuccag

SEQ ID NO: 251953 - RNA, 32 nt, Human
ugcccggccaucauuccuuuuuacugcugacu

SEQ ID NO: 251954 - RNA, 24 nt, Human
ugcccggcccaccccuccaagggg

SEQ ID NO: 251955 - RNA, 32 nt, Human
ugcccggcccaggagcgcagcugcauuugggg

SEQ ID NO: 251956 - RNA, 22 nt, Human
ugcccggcccggcccucccugg

SEQ ID NO: 251957 - RNA, 32 nt, Human
ugcccggcccgguuuacccaggagaggauggg

SEQ ID NO: 251958 - RNA, 32 nt, Human
ugcccggcccuugagcuucuugcccacugucu

SEQ ID NO: 251959 - RNA, 32 nt, Human
ugcccggccuccguugagguucuugauggaga

SEQ ID NO: 251960 - RNA, 32 nt, Human
ugcccggccucugugccccaacugugcuuggu

SEQ ID NO: 251961 - RNA, 32 nt, Human
ugcccggccugauguuuuugaaugauuaugaa

SEQ ID NO: 251962 - RNA, 32 nt, Human
ugcccgggaccaccucaucagagaugcuuacu

SEQ ID NO: 251963 - RNA, 32 nt, Human
ugcccgggacgaggaggaggaggaggaagagg

SEQ ID NO: 251964 - RNA, 32 nt, Human
ugcccgggacgcccccucccaggggucaggcu

SEQ ID NO: 251965 - RNA, 24 nt, Human
ugcccgggacuuuuccagcucucc

SEQ ID NO: 251966 - RNA, 32 nt, Human
ugcccgggaggaacgccggcguccagcccgcu

SEQ ID NO: 251967 - RNA, 32 nt, Human
ugcccgggcacgacagccuggugcacagccga

SEQ ID NO: 251968 - RNA, 32 nt, Human
ugcccgggcaggcuucacuguggucacauccg

SEQ ID NO: 251969 - RNA, 32 nt, Human
ugcccgggccauggcgaccugcauuuggcugc

SEQ ID NO: 251970 - RNA, 32 nt, Human
ugcccgggcccaagcccugccccuccagaguc

SEQ ID NO: 251971 - RNA, 32 nt, Human
ugcccgggcugccucucccccgcuagggccug

SEQ ID NO: 251972 - RNA, 21 nt, Human
ugcccgggcuggaaugcaaug

SEQ ID NO: 251973 - RNA, 21 nt, Human
ugcccgggcuggagugcaaug

SEQ ID NO: 251974 - RNA, 32 nt, Human
ugcccggggagggagacggagcaguacuggcc

SEQ ID NO: 251975 - RNA, 32 nt, Human
ugcccggggagucccgccugaccugccuucau

SEQ ID NO: 251976 - RNA, 32 nt, Human
ugcccgggggcuggucacgcuggagucccugg

SEQ ID NO: 251977 - RNA, 32 nt, Human
ugcccgguacuaggaaggagugagguguguuc

SEQ ID NO: 251978 - RNA, 32 nt, Human
ugcccggucaccaugggggucagguuauuuuu

SEQ ID NO: 251979 - RNA, 32 nt, Human
ugcccggucaguacacaugcuguaccuccugc

SEQ ID NO: 251980 - RNA, 21 nt, Human
ugcccggugcccacccugcug

SEQ ID NO: 251981 - RNA, 32 nt, Human
ugcccgguguaucucaguggccaucugccaug

SEQ ID NO: 251982 - RNA, 22 nt, Human
ugcccgguucccccagggacag

SEQ ID NO: 251983 - RNA, 24 nt, Human
ugcccguaaucccagcuacucagg

SEQ ID NO: 251984 - RNA, 32 nt, Human
ugcccguagcuugccaggucuccuacccacac

SEQ ID NO: 251985 - RNA, 19 nt, Human
ugcccguauccagagugau

SEQ ID NO: 251986 - RNA, 32 nt, Human
ugcccgucacacuugaggacaccaaggcugug

SEQ ID NO: 251987 - RNA, 32 nt, Human
ugcccgucagcggggaguggaacucaucaggc

SEQ ID NO: 251988 - RNA, 32 nt, Human
ugcccguccgagaggcagagcugacaaggaag

SEQ ID NO: 251989 - RNA, 32 nt, Human
ugcccguccucgggaagaaguggacccaacca

SEQ ID NO: 251990 - RNA, 32 nt, Human
ugcccgucuccccuccuccaucagacacaccu

SEQ ID NO: 251991 - RNA, 32 nt, Human
ugcccgucucugagacagucucuguguggaau

SEQ ID NO: 251992 - RNA, 32 nt, Human
ugcccgugauggggucaucguucuccaugacc

SEQ ID NO: 251993 - RNA, 19 nt, Human
ugcccgugcacagcaucau

SEQ ID NO: 251994 - RNA, 18 nt, Human
ugcccgugcauagcucau

SEQ ID NO: 251995 - RNA, 32 nt, Human
ugcccguggagugcaggagcgaaggggcuggc

SEQ ID NO: 251996 - RNA, 32 nt, Human
ugcccguggcucugcugccgcccacucccugc

SEQ ID NO: 251997 - RNA, 32 nt, Human
ugcccgugggaggauguacuuaucucagaugc

SEQ ID NO: 251998 - RNA, 31 nt, Human
ugcccgugggugggaugggaguggaggguuc

SEQ ID NO: 251999 - RNA, 32 nt, Human
ugcccgugugacuccucuggccugugucuagu

SEQ ID NO: 252000 - RNA, 32 nt, Human
ugcccgugugccccagggcaggaaagcaucuc

SEQ ID NO: 252001 - RNA, 32 nt, Human
ugcccguuagacaaaggaaaggccccaagucc

SEQ ID NO: 252002 - RNA, 20 nt, Human
ugcccguuugccuguuccua

SEQ ID NO: 252003 - RNA, 32 nt, Human
ugcccuaauauuuaaaauuuacacuucuaaga

SEQ ID NO: 252004 - RNA, 32 nt, Human
ugcccuaauugagguauauuucugaauaguuu

SEQ ID NO: 252005 - RNA, 32 nt, Human
ugcccuacagggucucaugccauuccgaccuu

SEQ ID NO: 252006 - RNA, 32 nt, Human
ugcccuacgggaacuccacucucccagcccca

SEQ ID NO: 252007 - RNA, 32 nt, Human
ugcccuagaaauacauuuacaggcauguugaa

SEQ ID NO: 252008 - RNA, 32 nt, Human
ugcccuagacuggagugcaauggcgccaucuc

SEQ ID NO: 252009 - RNA, 20 nt, Human
ugcccuaugaaaacuuuaaa

SEQ ID NO: 252010 - RNA, 32 nt, Human
ugcccuauuccucuccuccuccuccuccuggg

SEQ ID NO: 252011 - RNA, 32 nt, Human
ugcccuauucuccucaucuccccaucauuggu

SEQ ID NO: 252012 - RNA, 32 nt, Human
ugcccucaagccccagagagccccucauccuu

SEQ ID NO: 252013 - RNA, 32 nt, Human
ugcccucaccucacccuuuuccaacuugccca

SEQ ID NO: 252014 - RNA, 23 nt, Human
ugcccucaccugacuuugugucc

SEQ ID NO: 252015 - RNA, 21 nt, Human
ugcccucagaccauccaggug

SEQ ID NO: 252016 - RNA, 32 nt, Human
ugcccucagccccacuucucagccugguacuu

SEQ ID NO: 252017 - RNA, 32 nt, Human
ugcccucagccuguugcccugccucccaaacc

SEQ ID NO: 252018 - RNA, 32 nt, Human
ugcccucaggaccugccugaccugccagugau

SEQ ID NO: 252019 - RNA, 20 nt, Human
ugcccucaggugguccacca

SEQ ID NO: 252020 - RNA, 32 nt, Human
ugcccucaguggcuggauugcagccacccaug

SEQ ID NO: 252021 - RNA, 32 nt, Human
ugcccucauaacuguugcucuggauggaccug

SEQ ID NO: 252022 - RNA, 32 nt, Human
ugcccucauccacaauguccccaaagccaucc

SEQ ID NO: 252023 - RNA, 32 nt, Human
ugcccuccacagccaccuggucagccaccagc

SEQ ID NO: 252024 - RNA, 32 nt, Human
ugcccuccaccuggcuggagagauggcacauc

SEQ ID NO: 252025 - RNA, 32 nt, Human
ugcccuccacgccuccaaucccccaccuccac

SEQ ID NO: 252026 - RNA, 32 nt, Human
ugcccuccagccuggaugacagagugagaucu

SEQ ID NO: 252027 - RNA, 32 nt, Human
ugcccuccagccugggcaauagagcaagacuc

SEQ ID NO: 252028 - RNA, 32 nt, Human
ugcccuccagccugggugacagagugagaccc

SEQ ID NO: 252029 - RNA, 32 nt, Human
ugcccuccagccugggugacagagugagauuc

SEQ ID NO: 252030 - RNA, 32 nt, Human
ugcccuccagguguacuuuaggccuguggagg

SEQ ID NO: 252031 - RNA, 32 nt, Human
ugcccuccaucccgccagguacggcgacagcc

SEQ ID NO: 252032 - RNA, 25 nt, Human
ugcccucccaaagugcugggauuac

SEQ ID NO: 252033 - RNA, 32 nt, Human
ugcccucccagugguugguaugugggaagccc

SEQ ID NO: 252034 - RNA, 32 nt, Human
ugcccucccccaggaacaugcacgcucacucu

SEQ ID NO: 252035 - RNA, 32 nt, Human
ugcccucccccuccucuccaccaucgucuucu

SEQ ID NO: 252036 - RNA, 32 nt, Human
ugcccucccccuuagcucacagugccugcggu

SEQ ID NO: 252037 - RNA, 22 nt, Human
ugcccuccccggccccggggug

SEQ ID NO: 252038 - RNA, 32 nt, Human
ugcccuccccuccaaaauuuuuauauugaaau

SEQ ID NO: 252039 - RNA, 32 nt, Human
ugcccuccccucucccccaggcucuuucucca

SEQ ID NO: 252040 - RNA, 32 nt, Human
ugcccuccccugucccccucucgccgcccgcc

SEQ ID NO: 252041 - RNA, 32 nt, Human
ugcccucccucagacccagggccauccucaga

SEQ ID NO: 252042 - RNA, 32 nt, Human
ugcccucccucuuacccugccucuguguuucg

SEQ ID NO: 252043 - RNA, 32 nt, Human
ugcccucccugacccuauagccccaggccuca

SEQ ID NO: 252044 - RNA, 21 nt, Human
ugcccucccugcccugggcag

SEQ ID NO: 252045 - RNA, 24 nt, Human
ugcccucccugccuuccccagggu

SEQ ID NO: 252046 - RNA, 32 nt, Human
ugcccuccgcaggccgggccuccugggcgccc

SEQ ID NO: 252047 - RNA, 23 nt, Human
ugcccuccgcucccuccggggug

SEQ ID NO: 252048 - RNA, 32 nt, Human
ugcccuccuacagcacuccaccuugggaccug

SEQ ID NO: 252049 - RNA, 32 nt, Human
ugcccuccucaccccaccucugcuguccuuuc

SEQ ID NO: 252050 - RNA, 32 nt, Human
ugcccuccucaccuguugccggcaugcgggua

SEQ ID NO: 252051 - RNA, 32 nt, Human
ugcccuccuccccucucagccuccucuuuagc

SEQ ID NO: 252052 - RNA, 32 nt, Human
ugcccuccuccucccaguuucucccucuuauu

SEQ ID NO: 252053 - RNA, 32 nt, Human
ugcccuccuccucgugcuguguuuucuagugc

SEQ ID NO: 252054 - RNA, 18 nt, Human
ugcccuccucucuccagg

SEQ ID NO: 252055 - RNA, 32 nt, Human
ugcccuccucuuccuuccucuuuauagggaga

SEQ ID NO: 252056 - RNA, 32 nt, Human
ugcccuccugagccuccgccuucccagcagcg

SEQ ID NO: 252057 - RNA, 32 nt, Human
ugcccuccugcccacccucccacccacccgac

SEQ ID NO: 252058 - RNA, 24 nt, Human
ugcccuccugcuccccccacccca

SEQ ID NO: 252059 - RNA, 32 nt, Human
ugcccuccugcucucccaugaggguuauugaa

SEQ ID NO: 252060 - RNA, 32 nt, Human
ugcccuccugugggcauggcucagguugugcg

SEQ ID NO: 252061 - RNA, 32 nt, Human
ugcccuccuucaccuaauagcuucuggacuaa

SEQ ID NO: 252062 - RNA, 32 nt, Human
ugcccuccuugcaaguagcuccagaaauaauu

SEQ ID NO: 252063 - RNA, 32 nt, Human
ugcccuccuugcacuccggacgugagcauucg

SEQ ID NO: 252064 - RNA, 21 nt, Human
ugcccucgccgccgccggcac

SEQ ID NO: 252065 - RNA, 32 nt, Human
ugcccucggaggccggcguggggaagauggcc

SEQ ID NO: 252066 - RNA, 32 nt, Human
ugcccucgucguuccuccuccuuccauuugac

SEQ ID NO: 252067 - RNA, 21 nt, Human
ugcccucuaacaucggacucc

SEQ ID NO: 252068 - RNA, 32 nt, Human
ugcccucuaccuaguuauuagugcaaauauuu

SEQ ID NO: 252069 - RNA, 32 nt, Human
ugcccucuagcaggccaggccucccaguggga

SEQ ID NO: 252070 - RNA, 32 nt, Human
ugcccucucaggccggcagccccagccugcua

SEQ ID NO: 252071 - RNA, 32 nt, Human
ugcccucuccccucagccucuccccugccugc

SEQ ID NO: 252072 - RNA, 32 nt, Human
ugcccucucccuuccuggcacucucauguugc

SEQ ID NO: 252073 - RNA, 32 nt, Human
ugcccucuccucacuccucuggacuuggcccu

SEQ ID NO: 252074 - RNA, 32 nt, Human
ugcccucuccucuauacuuucuuccaaugcag

SEQ ID NO: 252075 - RNA, 32 nt, Human
ugcccucuccuugccagcuucuccccaggcca

SEQ ID NO: 252076 - RNA, 32 nt, Human
ugcccucucgccaggcuggaguguaguggcac

SEQ ID NO: 252077 - RNA, 32 nt, Human
ugcccucucuccuaccuccaccuucucagaug

SEQ ID NO: 252078 - RNA, 32 nt, Human
ugcccucucuugacuccagccuagggaauggu

SEQ ID NO: 252079 - RNA, 20 nt, Human
ugcccucugccguccagaug

SEQ ID NO: 252080 - RNA, 32 nt, Human
ugcccucugccugggccucggucccuccugca

SEQ ID NO: 252081 - RNA, 32 nt, Human
ugcccucugcuccccagugcuaccucucucuu

SEQ ID NO: 252082 - RNA, 32 nt, Human
ugcccucuggauucucugggucuauguaggcc

SEQ ID NO: 252083 - RNA, 32 nt, Human
ugcccucugggcugagaaggaugcacuuugga

SEQ ID NO: 252084 - RNA, 32 nt, Human
ugcccucuggggacaugcggagugggggucuu

SEQ ID NO: 252085 - RNA, 32 nt, Human
ugcccucuuccuccucuuuccuggaagaagua

SEQ ID NO: 252086 - RNA, 32 nt, Human
ugcccucuugugagcagcaauaccucacuuuu

SEQ ID NO: 252087 - RNA, 32 nt, Human
ugcccucuuucagggguccuaagcccacaauc

SEQ ID NO: 252088 - RNA, 32 nt, Human
ugcccucuuuguuuccuuaucucccucagacg

SEQ ID NO: 252089 - RNA, 32 nt, Human
ugcccugaaaaggaaaggaaaagggaagcuuc

SEQ ID NO: 252090 - RNA, 32 nt, Human
ugcccugaaauuggacauauugccaagcaagc

SEQ ID NO: 252091 - RNA, 21 nt, Human
ugcccugaagcugacugcagu

SEQ ID NO: 252092 - RNA, 32 nt, Human
ugcccugaauguacccugccucugcuuucucc

SEQ ID NO: 252093 - RNA, 18 nt, Human
ugcccugaauuaggggga

SEQ ID NO: 252094 - RNA, 32 nt, Human
ugcccugaccccuuguucccuggaccagggug

SEQ ID NO: 252095 - RNA, 32 nt, Human
ugcccugagccacggccgucucugauucuccc

SEQ ID NO: 252096 - RNA, 32 nt, Human
ugcccugagccaggcucucgaggucccggccc

SEQ ID NO: 252097 - RNA, 21 nt, Human
ugcccugagcccacccugcug

SEQ ID NO: 252098 - RNA, 32 nt, Human
ugcccugagcccaggaguccaagggcagggug

SEQ ID NO: 252099 - RNA, 32 nt, Human
ugcccugaggagaaggcugaagacugaggaau

SEQ ID NO: 252100 - RNA, 32 nt, Human
ugcccugaggcagccucugccuaccuagaucu

SEQ ID NO: 252101 - RNA, 22 nt, Human
ugcccugaggcugggcacagug

SEQ ID NO: 252102 - RNA, 18 nt, Human
ugcccugagggggcgccu

SEQ ID NO: 252103 - RNA, 32 nt, Human
ugcccugauuaugcacgucugcuccugagugg

SEQ ID NO: 252104 - RNA, 32 nt, Human
ugcccugcaaagauggggcugaaggaaguccu

SEQ ID NO: 252105 - RNA, 21 nt, Human
ugcccugcacaccggugcccg

SEQ ID NO: 252106 - RNA, 32 nt, Human
ugcccugcacccuggggagaggaccagggaug

SEQ ID NO: 252107 - RNA, 32 nt, Human
ugcccugcagaggcgguuggcagugccgccug

SEQ ID NO: 252108 - RNA, 27 nt, Human
ugcccugcauagccgccugcgaccccg

SEQ ID NO: 252109 - RNA, 19 nt, Human
ugcccugccaagccuggag

SEQ ID NO: 252110 - RNA, 32 nt, Human
ugcccugccaucccgucugccugccaugggac

SEQ ID NO: 252111 - RNA, 32 nt, Human
ugcccugccauccugaccuccagagcccucac

SEQ ID NO: 252112 - RNA, 32 nt, Human
ugcccugcccgccgccacuggggaaggcccag

SEQ ID NO: 252113 - RNA, 32 nt, Human
ugcccugcccucucagcuugugagacaacaca

SEQ ID NO: 252114 - RNA, 32 nt, Human
ugcccugcccugcagugucugcucagcuccca

SEQ ID NO: 252115 - RNA, 32 nt, Human
ugcccugcccugcccuguuccgcaugagcugc

SEQ ID NO: 252116 - RNA, 32 nt, Human
ugcccugcccuugcugcccugccugucacgug

SEQ ID NO: 252117 - RNA, 32 nt, Human
ugcccugccucuccaucucucaccaaggcugc

SEQ ID NO: 252118 - RNA, 32 nt, Human
ugcccugccuguugagccccauucuacauccc

SEQ ID NO: 252119 - RNA, 21 nt, Human
ugcccugcgccucagcccgcg

SEQ ID NO: 252120 - RNA, 32 nt, Human
ugcccugcguggcugccagcuggcccaggauu

SEQ ID NO: 252121 - RNA, 32 nt, Human
ugcccugcuaucuccagcugcugagcagcuga

SEQ ID NO: 252122 - RNA, 32 nt, Human
ugcccugcuccugugugcaguugggguagggg

SEQ ID NO: 252123 - RNA, 22 nt, Human
ugcccugcucucuggggacaga

SEQ ID NO: 252124 - RNA, 32 nt, Human
ugcccugcugccugcacacugcaugccugccc

SEQ ID NO: 252125 - RNA, 29 nt, Human
ugcccugcuggccucucaucccccuucuu

SEQ ID NO: 252126 - RNA, 32 nt, Human
ugcccugcugucucuggacuucccaucggccc

SEQ ID NO: 252127 - RNA, 32 nt, Human
ugcccugcuugguguuuugcaggaugauggug

SEQ ID NO: 252128 - RNA, 32 nt, Human
ugcccuggaagccccuccccucucacacugac

SEQ ID NO: 252129 - RNA, 19 nt, Human
ugcccuggaccagccugga

SEQ ID NO: 252130 - RNA, 32 nt, Human
ugcccuggacugcucacucucuggucucaauu

SEQ ID NO: 252131 - RNA, 32 nt, Human
ugcccuggacugcucacucucuggucuuaauu

SEQ ID NO: 252132 - RNA, 32 nt, Human
ugcccuggagugaccccuaccaggggagaagc

SEQ ID NO: 252133 - RNA, 32 nt, Human
ugcccuggcacagcugcaugcacuucaagggc

SEQ ID NO: 252134 - RNA, 32 nt, Human
ugcccuggcccagccuggcugggucuuggagg

SEQ ID NO: 252135 - RNA, 20 nt, Human
ugcccuggcccuuucuuccu

SEQ ID NO: 252136 - RNA, 32 nt, Human
ugcccuggccugcuucccagcacacacuucuu

SEQ ID NO: 252137 - RNA, 18 nt, Human
ugcccuggccuucuugca

SEQ ID NO: 252138 - RNA, 32 nt, Human
ugcccuggcuacugcuggcuuucuucauggcc

SEQ ID NO: 252139 - RNA, 32 nt, Human
ugcccuggcucacgucccccuucaccacuggc

SEQ ID NO: 252140 - RNA, 32 nt, Human
ugcccuggcuccauggggcccagcacaagcuc

SEQ ID NO: 252141 - RNA, 32 nt, Human
ugcccuggcugaugaccacuaguggggagccg

SEQ ID NO: 252142 - RNA, 32 nt, Human
ugcccuggcugcagucagugcccagggcgagg

SEQ ID NO: 252143 - RNA, 32 nt, Human
ugcccugggaagggaaggagcacugauuuggg

SEQ ID NO: 252144 - RNA, 32 nt, Human
ugcccugggaccccgccuggacuccccagccu

SEQ ID NO: 252145 - RNA, 32 nt, Human
ugcccugggagaccuggggugggcagggaacc

SEQ ID NO: 252146 - RNA, 32 nt, Human
ugcccugggaggcagugauggguuaguggaug

SEQ ID NO: 252147 - RNA, 32 nt, Human
ugcccugggaugccuacccugcccaccuccgg

SEQ ID NO: 252148 - RNA, 32 nt, Human
ugcccugggccagccuuugugaagugggcccc

SEQ ID NO: 252149 - RNA, 21 nt, Human
ugcccugggcccaccacugcc

SEQ ID NO: 252150 - RNA, 32 nt, Human
ugcccugggcugaggccaggcugcuccagggg

SEQ ID NO: 252151 - RNA, 18 nt, Human
ugcccugggcugcugccu

SEQ ID NO: 252152 - RNA, 32 nt, Human
ugcccugggcuggcuggcgugaguugucugcg

SEQ ID NO: 252153 - RNA, 31 nt, Human
ugcccugggcuuuggccuugccagggaacuu

SEQ ID NO: 252154 - RNA, 23 nt, Human
ugcccuggugauccacccgccuc

SEQ ID NO: 252155 - RNA, 32 nt, Human
ugcccuggugcuguaucugcccccuuuucaca

SEQ ID NO: 252156 - RNA, 32 nt, Human
ugcccuggugcuguaucugcccucuuuucaca

SEQ ID NO: 252157 - RNA, 32 nt, Human
ugcccugguggcaguggcugaaguggcggcgg

SEQ ID NO: 252158 - RNA, 32 nt, Human
ugcccugguguguccuccucucuacugacuac

SEQ ID NO: 252159 - RNA, 32 nt, Human
ugcccuguagccugaagccuuggaggaagaaa

SEQ ID NO: 252160 - RNA, 32 nt, Human
ugcccugucacccaggcuggagugcaauggug

SEQ ID NO: 252161 - RNA, 32 nt, Human
ugcccugucacccaggcugggguacgguggca

SEQ ID NO: 252162 - RNA, 32 nt, Human
ugcccuguccuccagauaccacuggcucacug

SEQ ID NO: 252163 - RNA, 32 nt, Human
ugcccuguccuguccuguccugacuucaucuc

SEQ ID NO: 252164 - RNA, 32 nt, Human
ugcccugucgccuggcuggaguggaguggcac

SEQ ID NO: 252165 - RNA, 32 nt, Human
ugcccugucuccugggaucagaggguaguaca

SEQ ID NO: 252166 - RNA, 32 nt, Human
ugcccugugacuccgucauacucuccaaaggc

SEQ ID NO: 252167 - RNA, 32 nt, Human
ugcccugugcacugcaaggccaccuggugucg

SEQ ID NO: 252168 - RNA, 32 nt, Human
ugcccugugcuuccuguacagcugcggaaccg

SEQ ID NO: 252169 - RNA, 32 nt, Human
ugcccuguggagcugcucaccuaaguuccugc

SEQ ID NO: 252170 - RNA, 32 nt, Human
ugcccuguggaucaagucuagggggccucagg

SEQ ID NO: 252171 - RNA, 32 nt, Human
ugcccuguggcaccccagcucacugggagucu

SEQ ID NO: 252172 - RNA, 19 nt, Human
ugcccuguggcacccucug

SEQ ID NO: 252173 - RNA, 23 nt, Human
ugcccuguggcugccugcacccc

SEQ ID NO: 252174 - RNA, 32 nt, Human
ugcccuguggcugggcuggagugcaauggcgc

SEQ ID NO: 252175 - RNA, 32 nt, Human
ugcccugugguguuuggcaugugcccccuguc

SEQ ID NO: 252176 - RNA, 32 nt, Human
ugcccuguguguggacagccugugggagacuc

SEQ ID NO: 252177 - RNA, 32 nt, Human
ugcccuguuccccaccuccuggcuccagucca

SEQ ID NO: 252178 - RNA, 32 nt, Human
ugcccuguucccguuccucccugcugcucucu

SEQ ID NO: 252179 - RNA, 32 nt, Human
ugcccuguuccuugcccaccucaggccuggug

SEQ ID NO: 252180 - RNA, 23 nt, Human
ugcccuguucucucucagugcca

SEQ ID NO: 252181 - RNA, 32 nt, Human
ugcccuguugccaggcuggaaugcaguggcgu

SEQ ID NO: 252182 - RNA, 32 nt, Human
ugcccuguugcccaggcuggagagcaguggug

SEQ ID NO: 252183 - RNA, 32 nt, Human
ugcccuguugcccaggcuggaguauaguagug

SEQ ID NO: 252184 - RNA, 32 nt, Human
ugcccuguugcccaggcuggagugcaguggca

SEQ ID NO: 252185 - RNA, 32 nt, Human
ugcccuguugcccaugcuggagugcaauggca

SEQ ID NO: 252186 - RNA, 32 nt, Human
ugcccuguuggugaggagggucggaggggcga

SEQ ID NO: 252187 - RNA, 32 nt, Human
ugcccuuaaaacugggcccugaagacgguucc

SEQ ID NO: 252188 - RNA, 19 nt, Human
ugcccuuaaguacaguggu

SEQ ID NO: 252189 - RNA, 32 nt, Human
ugcccuuaauccucuacuacugccugcucuuc

SEQ ID NO: 252190 - RNA, 21 nt, Human
ugcccuuaggauucacugcuc

SEQ ID NO: 252191 - RNA, 32 nt, Human
ugcccuucaccaugagagggugcagugagaag

SEQ ID NO: 252192 - RNA, 32 nt, Human
ugcccuucaguuauuuauagcuggagcuggag

SEQ ID NO: 252193 - RNA, 32 nt, Human
ugcccuuccagccugaagaucugggggcacag

SEQ ID NO: 252194 - RNA, 32 nt, Human
ugcccuuccuaccccuuccucccuucagucag

SEQ ID NO: 252195 - RNA, 26 nt, Human
ugcccuuccucucuggcuauagcucu

SEQ ID NO: 252196 - RNA, 32 nt, Human
ugcccuuccucuucccccuuccacccucacau

SEQ ID NO: 252197 - RNA, 32 nt, Human
ugcccuuccuuccccuguccuuucauuucucu

SEQ ID NO: 252198 - RNA, 19 nt, Human
ugcccuuccuugccuugca

SEQ ID NO: 252199 - RNA, 21 nt, Human
ugcccuuccuuucccuggggu

SEQ ID NO: 252200 - RNA, 32 nt, Human
ugcccuucucaggccugcuccccacccucuau

SEQ ID NO: 252201 - RNA, 32 nt, Human
ugcccuucuccaggauggcagaggcggaauug

SEQ ID NO: 252202 - RNA, 32 nt, Human
ugcccuucucccaggcccccagacagaagaga

SEQ ID NO: 252203 - RNA, 32 nt, Human
ugcccuucucccucccgcuccugggcggaggc

SEQ ID NO: 252204 - RNA, 32 nt, Human
ugcccuucuccuccacaaaggucuggcugguu

SEQ ID NO: 252205 - RNA, 32 nt, Human
ugcccuucuccuccuuccuggcugggaaugaa

SEQ ID NO: 252206 - RNA, 32 nt, Human
ugcccuucucuucuuuauuccucucuccucuu

SEQ ID NO: 252207 - RNA, 32 nt, Human
ugcccuucucuugcugccuccugggcagggcc

SEQ ID NO: 252208 - RNA, 24 nt, Human
ugcccuucuuggccuguggcgcug

SEQ ID NO: 252209 - RNA, 32 nt, Human
ugcccuugaaagucaccugaggaaguuucccc

SEQ ID NO: 252210 - RNA, 32 nt, Human
ugcccuugaauuggaaggaauggagauuaggg

SEQ ID NO: 252211 - RNA, 32 nt, Human
ugcccuugaugucccucaauaggaucaggagu

SEQ ID NO: 252212 - RNA, 32 nt, Human
ugcccuugcagggugggugagcucucaggccg

SEQ ID NO: 252213 - RNA, 32 nt, Human
ugcccuugccauccucccaucgaugugccacg

SEQ ID NO: 252214 - RNA, 32 nt, Human
ugcccuugcccucccuucuccaugcucauuaa

SEQ ID NO: 252215 - RNA, 32 nt, Human
ugcccuugccugagguugcagucugcgguucc

SEQ ID NO: 252216 - RNA, 21 nt, Human
ugcccuugcucagucgugcug

SEQ ID NO: 252217 - RNA, 32 nt, Human
ugcccuugcucucuaacuucugagcccaccuc

SEQ ID NO: 252218 - RNA, 32 nt, Human
ugcccuuggcccguuccuuggcugccccggcu

SEQ ID NO: 252219 - RNA, 32 nt, Human
ugcccuuggcugccagccuacccugccugcac

SEQ ID NO: 252220 - RNA, 32 nt, Human
ugcccuugggagucgcuguugggagccggagc

SEQ ID NO: 252221 - RNA, 32 nt, Human
ugcccuuggggagggggagggaugaccagcuc

SEQ ID NO: 252222 - RNA, 21 nt, Human
ugcccuuggggcaccugcuca

SEQ ID NO: 252223 - RNA, 24 nt, Human
ugcccuugugauccacccaccuca

SEQ ID NO: 252224 - RNA, 32 nt, Human
ugcccuuguggaauauuggagucucuauggau

SEQ ID NO: 252225 - RNA, 32 nt, Human
ugcccuuguuccuggcagcagggacgacggga

SEQ ID NO: 252226 - RNA, 32 nt, Human
ugcccuuuaucucucuuccuccugguuauuaa

SEQ ID NO: 252227 - RNA, 32 nt, Human
ugcccuuuccuggaaugcaaagaagguggaag

SEQ ID NO: 252228 - RNA, 32 nt, Human
ugcccuuuccugggcaugcuuggugacucaga

SEQ ID NO: 252229 - RNA, 32 nt, Human
ugcccuuucuuuccuucuuugcucacuuuacu

SEQ ID NO: 252230 - RNA, 32 nt, Human
ugcccuuugagacucacaugacuuucugguuu

SEQ ID NO: 252231 - RNA, 25 nt, Human
ugcccuuugccucugcucugcacag

SEQ ID NO: 252232 - RNA, 32 nt, Human
ugcccuuuuaaucuuuacuaguuauugugaga

SEQ ID NO: 252233 - RNA, 32 nt, Human
ugcccuuuucggaguauugcaaaggagcuaaa

SEQ ID NO: 252234 - RNA, 32 nt, Human
ugcccuuuuugguagguggugauuuugaggcu

SEQ ID NO: 252235 - RNA, 32 nt, Human
ugccgaaaaccuuuggacaguccagugucaac

SEQ ID NO: 252236 - RNA, 32 nt, Human
ugccgaaaccaccaaagggcaugucugauggg

SEQ ID NO: 252237 - RNA, 32 nt, Human
ugccgaaccuauacccauucuucagugccuag

SEQ ID NO: 252238 - RNA, 32 nt, Human
ugccgaagguccucgccagcaggaugaaguua

SEQ ID NO: 252239 - RNA, 32 nt, Human
ugccgacacugcagcagaaucucuccgggugg

SEQ ID NO: 252240 - RNA, 32 nt, Human
ugccgacacuggcugguguggccgccacagag

SEQ ID NO: 252241 - RNA, 32 nt, Human
ugccgaccggcuucugcuucauggguuuucac

SEQ ID NO: 252242 - RNA, 32 nt, Human
ugccgacgcagggagcagagacuugccggcau

SEQ ID NO: 252243 - RNA, 32 nt, Human
ugccgacggacaccagcgaggggccaggccgg

SEQ ID NO: 252244 - RNA, 32 nt, Human
ugccgacuccuggguugagcuguugccucagu

SEQ ID NO: 252245 - RNA, 32 nt, Human
ugccgacuucuucuccccagagccuggcuuuu

SEQ ID NO: 252246 - RNA, 32 nt, Human
ugccgagaccucaagcccugaggggcaguccc

SEQ ID NO: 252247 - RNA, 32 nt, Human
ugccgagaggggcaggugccagccuccacugg

SEQ ID NO: 252248 - RNA, 32 nt, Human
ugccgagauggcccugagcgacgaaccggccg

SEQ ID NO: 252249 - RNA, 22 nt, Human
ugccgagauugccaaaaugcuu

SEQ ID NO: 252250 - RNA, 32 nt, Human
ugccgagcaagucccugcagcuggccagggac

SEQ ID NO: 252251 - RNA, 25 nt, Human
ugccgagcccaggacgcccccggcc

SEQ ID NO: 252252 - RNA, 17 nt, Human
ugccgagccucuuugga

SEQ ID NO: 252253 - RNA, 32 nt, Human
ugccgaggaagaaaauggaaaugugguuccug

SEQ ID NO: 252254 - RNA, 32 nt, Human
ugccgaggaaugaagagaggcggccgggcccc

SEQ ID NO: 252255 - RNA, 32 nt, Human
ugccgaggacaggcacugggcaugcagcccca

SEQ ID NO: 252256 - RNA, 32 nt, Human
ugccgaggacaguggggaggagaggagagggg

SEQ ID NO: 252257 - RNA, 32 nt, Human
ugccgaggccagccuuccuuccugcucugcuc

SEQ ID NO: 252258 - RNA, 32 nt, Human
ugccgaggcugaaggagucucgcucccacgag

SEQ ID NO: 252259 - RNA, 21 nt, Human
ugccgaggcuggagugcaaug

SEQ ID NO: 252260 - RNA, 32 nt, Human
ugccgagggaggaagagcaggauucgcacccc

SEQ ID NO: 252261 - RNA, 32 nt, Human
ugccgagggcuggccgggacugcugcucuccc

SEQ ID NO: 252262 - RNA, 32 nt, Human
ugccgagguggagguaguggaggaagcuaagu

SEQ ID NO: 252263 - RNA, 21 nt, Human
ugccgaguguccgcccaggcc

SEQ ID NO: 252264 - RNA, 32 nt, Human
ugccgaucaaggcucuggcauucagagaaccc

SEQ ID NO: 252265 - RNA, 32 nt, Human
ugccgcaagggcuuucugcucuggccuuaacu

SEQ ID NO: 252266 - RNA, 20 nt, Human
ugccgcacacgacuccugaa

SEQ ID NO: 252267 - RNA, 32 nt, Human
ugccgcacagcccagcaggagggaggcggaca

SEQ ID NO: 252268 - RNA, 32 nt, Human
ugccgcacagccgcaggugcaccuccaggcca

SEQ ID NO: 252269 - RNA, 32 nt, Human
ugccgcaccgcugcaguggcucagccacaggg

SEQ ID NO: 252270 - RNA, 32 nt, Human
ugccgcacucugcugcuaugagcuuccucaaa

SEQ ID NO: 252271 - RNA, 32 nt, Human
ugccgcagacucugcaaccuucaugcugcccg

SEQ ID NO: 252272 - RNA, 32 nt, Human
ugccgcagcugacggggaaacugaggcacgga

SEQ ID NO: 252273 - RNA, 32 nt, Human
ugccgcagcugccucccuucucucggaaccca

SEQ ID NO: 252274 - RNA, 32 nt, Human
ugccgcagggagggugcguggggaagaugcuu

SEQ ID NO: 252275 - RNA, 32 nt, Human
ugccgcagggauggggcagcugugcuggcugc

SEQ ID NO: 252276 - RNA, 32 nt, Human
ugccgcagucaccacaggguucugagaacauu

SEQ ID NO: 252277 - RNA, 32 nt, Human
ugccgcaguggagccagcacagcggauguuuu

SEQ ID NO: 252278 - RNA, 32 nt, Human
ugccgcaguucugccaccgucacugagaagcu

SEQ ID NO: 252279 - RNA, 32 nt, Human
ugccgcaucugccuggagccugggcagcaccu

SEQ ID NO: 252280 - RNA, 32 nt, Human
ugccgcaugccuguaaucccagcuacuugggu

SEQ ID NO: 252281 - RNA, 32 nt, Human
ugccgcauuccugcacucagaagucugcaggg

SEQ ID NO: 252282 - RNA, 21 nt, Human
ugccgccaccaccaccaccaa

SEQ ID NO: 252283 - RNA, 32 nt, Human
ugccgccaccgcaucgcgcagcucuuugccgu

SEQ ID NO: 252284 - RNA, 26 nt, Human
ugccgccaccgccgugccgccgccau

SEQ ID NO: 252285 - RNA, 32 nt, Human
ugccgccaccuucacaccgucugcccuggcca

SEQ ID NO: 252286 - RNA, 32 nt, Human
ugccgccacuggcugugccucccccgccaccu

SEQ ID NO: 252287 - RNA, 32 nt, Human
ugccgccagcugggcuguggucgggccgucgc

SEQ ID NO: 252288 - RNA, 32 nt, Human
ugccgccauaagaagacagagagaacugagua

SEQ ID NO: 252289 - RNA, 32 nt, Human
ugccgccaucucucccuuccugccucauuuca

SEQ ID NO: 252290 - RNA, 32 nt, Human
ugccgccaugcugccacucucaugccccugcg

SEQ ID NO: 252291 - RNA, 23 nt, Human
ugccgcccaaacuggagugcagu

SEQ ID NO: 252292 - RNA, 24 nt, Human
ugccgcccaaacuggagugcagug

SEQ ID NO: 252293 - RNA, 23 nt, Human
ugccgcccaggcgggagugcagu

SEQ ID NO: 252294 - RNA, 23 nt, Human
ugccgcccaggcuagagugcagu

SEQ ID NO: 252295 - RNA, 24 nt, Human
ugccgcccaggcuagagugcagug

SEQ ID NO: 252296 - RNA, 23 nt, Human
ugccgcccaggcuggacugcagu

SEQ ID NO: 252297 - RNA, 23 nt, Human
ugccgcccaggcuggagugcagu

SEQ ID NO: 252298 - RNA, 24 nt, Human
ugccgcccaggcuggagugcagug

SEQ ID NO: 252299 - RNA, 32 nt, Human
ugccgccccaacugcugccagaccaugugcug

SEQ ID NO: 252300 - RNA, 32 nt, Human
ugccgcccgugcccugcggcccugcacgcccc

SEQ ID NO: 252301 - RNA, 32 nt, Human
ugccgcccuucccaucgcucucuuccccuuca

SEQ ID NO: 252302 - RNA, 21 nt, Human
ugccgccgccaccgccaccac

SEQ ID NO: 252303 - RNA, 24 nt, Human
ugccgccgccaccgccgccgccgc

SEQ ID NO: 252304 - RNA, 23 nt, Human
ugccgccgcccuggggccgccgc

SEQ ID NO: 252305 - RNA, 32 nt, Human
ugccgccgccgccaccaccaucagcgcgcggg

SEQ ID NO: 252306 - RNA, 21 nt, Human
ugccgccgccgccacccccgc

SEQ ID NO: 252307 - RNA, 26 nt, Human
ugccgccgccgccaccgagccgccgc

SEQ ID NO: 252308 - RNA, 21 nt, Human
ugccgccgccgccaccgccac

SEQ ID NO: 252309 - RNA, 21 nt, Human
ugccgccgccgccgcccgccc

SEQ ID NO: 252310 - RNA, 22 nt, Human
ugccgccgccgccgcccgccgc

SEQ ID NO: 252311 - RNA, 19 nt, Human
ugccgccgccgccgccgcc

SEQ ID NO: 252312 - RNA, 20 nt, Human
ugccgccgccgccgccgcca

SEQ ID NO: 252313 - RNA, 21 nt, Human
ugccgccgccgccgccgccac

SEQ ID NO: 252314 - RNA, 20 nt, Human
ugccgccgccgccgccgccg

SEQ ID NO: 252315 - RNA, 21 nt, Human
ugccgccgccgccgccgccgc

SEQ ID NO: 252316 - RNA, 24 nt, Human
ugccgccgccgccgccgccgccgc

SEQ ID NO: 252317 - RNA, 18 nt, Human
ugccgccgccgccgcgcc

SEQ ID NO: 252318 - RNA, 21 nt, Human
ugccgccgccgccgcugccgc

SEQ ID NO: 252319 - RNA, 21 nt, Human
ugccgccgccgccuccaccau

SEQ ID NO: 252320 - RNA, 21 nt, Human
ugccgccgccgccugcgccgc

SEQ ID NO: 252321 - RNA, 19 nt, Human
ugccgccgccgcugccgcc

SEQ ID NO: 252322 - RNA, 24 nt, Human
ugccgccgccgcugccgccgccau

SEQ ID NO: 252323 - RNA, 30 nt, Human
ugccgccgccucuccaaguucuuguggccc

SEQ ID NO: 252324 - RNA, 20 nt, Human
ugccgccgcgccgccgccac

SEQ ID NO: 252325 - RNA, 24 nt, Human
ugccgccgcugccgccgccgccac

SEQ ID NO: 252326 - RNA, 32 nt, Human
ugccgccgcugccucugggcccucccagcaca

SEQ ID NO: 252327 - RNA, 32 nt, Human
ugccgccgggauuacaggcgugagccaccaug

SEQ ID NO: 252328 - RNA, 32 nt, Human
ugccgccuacuucuuccagcugggacuucagg

SEQ ID NO: 252329 - RNA, 32 nt, Human
ugccgccuccacccagccuccgccauggaccu

SEQ ID NO: 252330 - RNA, 32 nt, Human
ugccgccuccuccuagcgcuccugccucgccu

SEQ ID NO: 252331 - RNA, 32 nt, Human
ugccgccuccuucuucugcagcuccuggugcu

SEQ ID NO: 252332 - RNA, 32 nt, Human
ugccgccucgaaucaaccucucuccccaggca

SEQ ID NO: 252333 - RNA, 32 nt, Human
ugccgccugcacuccucagggcagccuccccc

SEQ ID NO: 252334 - RNA, 32 nt, Human
ugccgccugcacugcccuggggcacagacuag

SEQ ID NO: 252335 - RNA, 32 nt, Human
ugccgccugcuuccuguuccuggggacccgcu

SEQ ID NO: 252336 - RNA, 32 nt, Human
ugccgccuguaaucccagcuucucaggagucu

SEQ ID NO: 252337 - RNA, 32 nt, Human
ugccgccuguagucccagcuacucaggaggcu

SEQ ID NO: 252338 - RNA, 32 nt, Human
ugccgccuucucuccagccucugugccuuugu

SEQ ID NO: 252339 - RNA, 21 nt, Human
ugccgcgcaaggcucugugga

SEQ ID NO: 252340 - RNA, 32 nt, Human
ugccgcgcagccgccgcuccauccccagcccc

SEQ ID NO: 252341 - RNA, 32 nt, Human
ugccgcggagaauugcuuucugccauuguuau

SEQ ID NO: 252342 - RNA, 31 nt, Human
ugccgcgggacucugcaccuaccucacaggg

SEQ ID NO: 252343 - RNA, 32 nt, Human
ugccgcgggcggcaaagcccacggcaucugcc

SEQ ID NO: 252344 - RNA, 32 nt, Human
ugccgcggucaccccggccucugccucugucc

SEQ ID NO: 252345 - RNA, 21 nt, Human
ugccgcgucccugccccgacc

SEQ ID NO: 252346 - RNA, 32 nt, Human
ugccgcgugccuguaaucccagcuacuuggga

SEQ ID NO: 252347 - RNA, 22 nt, Human
ugccgcguuccgcgccccggcc

SEQ ID NO: 252348 - RNA, 32 nt, Human
ugccgcuacacuccagccugaugacagaccga

SEQ ID NO: 252349 - RNA, 32 nt, Human
ugccgcuagggagccgagacugccggaaagag

SEQ ID NO: 252350 - RNA, 32 nt, Human
ugccgcucagaggcuucagccugacuuccagc

SEQ ID NO: 252351 - RNA, 32 nt, Human
ugccgcucaggccucagaggcccugccgggca

SEQ ID NO: 252352 - RNA, 32 nt, Human
ugccgcuccgcccgcgccgccugcugccggcg

SEQ ID NO: 252353 - RNA, 32 nt, Human
ugccgcugcacuccagccugggagacugcauc

SEQ ID NO: 252354 - RNA, 32 nt, Human
ugccgcugcacuccagccugggggacagagca

SEQ ID NO: 252355 - RNA, 32 nt, Human
ugccgcugcacuccauucugggcaagagcuag

SEQ ID NO: 252356 - RNA, 32 nt, Human
ugccgcugcauccugcauccagcaccuaccuc

SEQ ID NO: 252357 - RNA, 32 nt, Human
ugccgcugcccagcagagcuggcuucuggguc

SEQ ID NO: 252358 - RNA, 32 nt, Human
ugccgcugcuaacccugccacuuuaaaaugac

SEQ ID NO: 252359 - RNA, 32 nt, Human
ugccgcuggggaagcaguugcgauuuagccau

SEQ ID NO: 252360 - RNA, 23 nt, Human
ugccgcugugccagguugaagua

SEQ ID NO: 252361 - RNA, 32 nt, Human
ugccgcuugccuggaagcugcguuaggagcga

SEQ ID NO: 252362 - RNA, 32 nt, Human
ugccggaagccgcgagaacagcggccgccuca

SEQ ID NO: 252363 - RNA, 32 nt, Human
ugccggaagggccgggcucaaagcuccgccuc

SEQ ID NO: 252364 - RNA, 32 nt, Human
ugccggacagaucccuuccucccuccgacuca

SEQ ID NO: 252365 - RNA, 32 nt, Human
ugccggacccuggggccucccaccccagccuc

SEQ ID NO: 252366 - RNA, 19 nt, Human
ugccggacgccagguguag

SEQ ID NO: 252367 - RNA, 32 nt, Human
ugccggacucggaggagcaggaggcgaggucc

SEQ ID NO: 252368 - RNA, 32 nt, Human
ugccggagaacagccaaguggcucagcugcca

SEQ ID NO: 252369 - RNA, 32 nt, Human
ugccggagccucccccuggaccccuggugccc

SEQ ID NO: 252370 - RNA, 32 nt, Human
ugccggaggauuccgcgggagaggaggagcag

SEQ ID NO: 252371 - RNA, 32 nt, Human
ugccggaggccuggcagcuccgcuaacuccau

SEQ ID NO: 252372 - RNA, 32 nt, Human
ugccggaguuguguucucaccacccacuuugu

SEQ ID NO: 252373 - RNA, 32 nt, Human
ugccggcaacaccagugccaggaaaaggccaa

SEQ ID NO: 252374 - RNA, 32 nt, Human
ugccggcaaucagccaugacugccuuugcacu

SEQ ID NO: 252375 - RNA, 32 nt, Human
ugccggcaccuugcugugagauuuccagcccc

SEQ ID NO: 252376 - RNA, 32 nt, Human
ugccggcagcagcuagcaaagccagaaagcaa

SEQ ID NO: 252377 - RNA, 32 nt, Human
ugccggcccacaguacacagcugcaguucuuc

SEQ ID NO: 252378 - RNA, 22 nt, Human
ugccggcccagccaccugcuca

SEQ ID NO: 252379 - RNA, 32 nt, Human
ugccggcccccuugaguaugcaucacccccac

SEQ ID NO: 252380 - RNA, 21 nt, Human
ugccggccccgccgccgccgc

SEQ ID NO: 252381 - RNA, 32 nt, Human
ugccggcccugagugccucccuugccucacuc

SEQ ID NO: 252382 - RNA, 32 nt, Human
ugccggcccugccuucuccaguauuucccaca

SEQ ID NO: 252383 - RNA, 32 nt, Human
ugccggccgcccagacaccacagacgccacug

SEQ ID NO: 252384 - RNA, 32 nt, Human
ugccggccggcacuucggcugcagaguuuugc

SEQ ID NO: 252385 - RNA, 32 nt, Human
ugccggcgaagaaggugagcgcagugcugugu

SEQ ID NO: 252386 - RNA, 32 nt, Human
ugccggcucacugcaaccucugucuucugggu

SEQ ID NO: 252387 - RNA, 32 nt, Human
ugccggcuggacccgccccgagcuccaugguu

SEQ ID NO: 252388 - RNA, 32 nt, Human
ugccgggagcccaggguggcagagcuguggug

SEQ ID NO: 252389 - RNA, 32 nt, Human
ugccgggaggcugaggcgggagaaucgcuuga

SEQ ID NO: 252390 - RNA, 32 nt, Human
ugccgggaggggcgaggcuggcugaucugcac

SEQ ID NO: 252391 - RNA, 32 nt, Human
ugccgggauccaggucuccgggguccgcuuug

SEQ ID NO: 252392 - RNA, 32 nt, Human
ugccgggaugacaggcaugagccaccgcgccu

SEQ ID NO: 252393 - RNA, 32 nt, Human
ugcucaauaucauuguauuuugugcuuuguaa

SEQ ID NO: 252394 - RNA, 32 nt, Human
ugcucaaucugaagacaauggacccauguuag

SEQ ID NO: 252395 - RNA, 24 nt, Human
ugcucaaugagaaacguugccuug

SEQ ID NO: 252396 - RNA, 32 nt, Human
ugcucaaugccaccugucugccugggcuccaa

SEQ ID NO: 252397 - RNA, 32 nt, Human
ugcucaauggugcccaggcuggagugcagugg

SEQ ID NO: 252398 - RNA, 32 nt, Human
ugcucaaugucaggaaaaccggaacuuguuga

SEQ ID NO: 252399 - RNA, 32 nt, Human
ugcucaauguugcccaggcuggagugcagugg

SEQ ID NO: 252400 - RNA, 32 nt, Human
ugcucaauuucuagguccuuugucuagaaagg

SEQ ID NO: 252401 - RNA, 31 nt, Human
ugcucaauuuugugagagaaagacuguacuc

SEQ ID NO: 252402 - RNA, 32 nt, Human
ugcucaauuuuuccucuucacuggcacaagua

SEQ ID NO: 252403 - RNA, 32 nt, Human
ugcucacaaaccugcagcuggaagcuagacuu

SEQ ID NO: 252404 - RNA, 32 nt, Human
ugcucacaaaccugcaggcauaucauuggcgu

SEQ ID NO: 252405 - RNA, 32 nt, Human
ugcucacacaauugcacuccauucuuccgccu

SEQ ID NO: 252406 - RNA, 32 nt, Human
ugcucacacacuugcccacacacucacuucuu

SEQ ID NO: 252407 - RNA, 32 nt, Human
ugcucacacaugcagacacaccugggcguccc

SEQ ID NO: 252408 - RNA, 32 nt, Human
ugcucacaccacugcacuccagccugggugac

SEQ ID NO: 252409 - RNA, 32 nt, Human
ugcucacaccacugcacuccauccugggcaac

SEQ ID NO: 252410 - RNA, 32 nt, Human
ugcucacaccacugcugcucgagucuccugca

SEQ ID NO: 252411 - RNA, 32 nt, Human
ugcucacaccgguaaucccagcacuuugggag

SEQ ID NO: 252412 - RNA, 32 nt, Human
ugcucacaccuguaaucccagcacuuugggag

SEQ ID NO: 252413 - RNA, 32 nt, Human
ugcucacaccuguaucccagcacuuugggaga

SEQ ID NO: 252414 - RNA, 32 nt, Human
ugcucacacuauauacagaugcaagcaagggg

SEQ ID NO: 252415 - RNA, 32 nt, Human
ugcucacagacaccagcaaagcaaugugcucc

SEQ ID NO: 252416 - RNA, 32 nt, Human
ugcucacagauggaggagaaggagcucuauag

SEQ ID NO: 252417 - RNA, 32 nt, Human
ugcucacagcuguaaucccagcacuuugaggu

SEQ ID NO: 252418 - RNA, 32 nt, Human
ugcucacaggaggcggcggcggcccuggcacu

SEQ ID NO: 252419 - RNA, 32 nt, Human
ugcucacaggcuguccccacucugccuguucc

SEQ ID NO: 252420 - RNA, 32 nt, Human
ugcucacaguggggugcugcuccaguauuaug

SEQ ID NO: 252421 - RNA, 32 nt, Human
ugcucacauaccgguccccacgcccagcggcc

SEQ ID NO: 252422 - RNA, 32 nt, Human
ugcucacaugcgcacacauggcucauugugua

SEQ ID NO: 252423 - RNA, 32 nt, Human
ugcucacauuaauuugcacuccuguuggaaag

SEQ ID NO: 252424 - RNA, 32 nt, Human
ugcucaccaagcucuugaccuucuuacacacu

SEQ ID NO: 252425 - RNA, 32 nt, Human
ugcucaccaagcuguuccacuucucuagagaa

SEQ ID NO: 252426 - RNA, 32 nt, Human
ugcucaccauccccuuaacauaugaaaauccu

SEQ ID NO: 252427 - RNA, 32 nt, Human
ugcucacccacuguccaaccagaugccuugcu

SEQ ID NO: 252428 - RNA, 32 nt, Human
ugcucacccagagacuggaauguggcacaugc

SEQ ID NO: 252429 - RNA, 32 nt, Human
ugcucacccaggaccucuggggguuguuggga

SEQ ID NO: 252430 - RNA, 32 nt, Human
ugcucacccaggcugagggugccuuuguggcu

SEQ ID NO: 252431 - RNA, 32 nt, Human
ugcucacccagugcccucuccccucagccucu

SEQ ID NO: 252432 - RNA, 32 nt, Human
ugcucaccccugggcugagggaagggagagga

SEQ ID NO: 252433 - RNA, 23 nt, Human
ugcucacccgacggcagcucaca

SEQ ID NO: 252434 - RNA, 32 nt, Human
ugcucacccuccacuuguccgucuaccucauu

SEQ ID NO: 252435 - RNA, 32 nt, Human
ugcucacccucuuccaucccucuaacccagcu

SEQ ID NO: 252436 - RNA, 32 nt, Human
ugcucacccugccuuuuucugggggcugagcc

SEQ ID NO: 252437 - RNA, 32 nt, Human
ugcucacccuuucccuuuauuccuugccugga

SEQ ID NO: 252438 - RNA, 32 nt, Human
ugcucaccgcaaccuccgccucccagguucaa

SEQ ID NO: 252439 - RNA, 32 nt, Human
ugcucaccgcaaccuccgccuuccagguucaa

SEQ ID NO: 252440 - RNA, 32 nt, Human
ugcucaccgucuuccuccuccuggucuucuac

SEQ ID NO: 252441 - RNA, 32 nt, Human
ugcucaccugccuccagcaucucucuaggccu

SEQ ID NO: 252442 - RNA, 32 nt, Human
ugcucaccugcucuggcugugaaccaccuggg

SEQ ID NO: 252443 - RNA, 32 nt, Human
ugcucaccuucccaaguucuguuauuucaaac

SEQ ID NO: 252444 - RNA, 32 nt, Human
ugcucacgcacauguucacacaugcacacuca

SEQ ID NO: 252445 - RNA, 32 nt, Human
ugcucacgccuguaauaccagcacuuugggag

SEQ ID NO: 252446 - RNA, 32 nt, Human
ugcucacgccuguaaucccagaacuuuaggag

SEQ ID NO: 252447 - RNA, 32 nt, Human
ugcucacgccuguaaucccagaauuuuaggag

SEQ ID NO: 252448 - RNA, 32 nt, Human
ugcucacgccuguaaucccagcacuuugggag

SEQ ID NO: 252449 - RNA, 32 nt, Human
ugcucacgccuguaaucccagcacuuugggga

SEQ ID NO: 252450 - RNA, 32 nt, Human
ugcucacgccuguaaucccagcacuuuucaga

SEQ ID NO: 252451 - RNA, 32 nt, Human
ugcucacgccuguaauccuagcacuuuuggga

SEQ ID NO: 252452 - RNA, 32 nt, Human
ugcucacgccuguaauuccagcacuuugggag

SEQ ID NO: 252453 - RNA, 32 nt, Human
ugcucacgccugucaucccagcacuuugggag

SEQ ID NO: 252454 - RNA, 32 nt, Human
ugcucacgccuuguaaucccagcacuuuggga

SEQ ID NO: 252455 - RNA, 32 nt, Human
ugcucacuaacacagguggaguagaaggcagg

SEQ ID NO: 252456 - RNA, 32 nt, Human
ugcucacuacaaccucugccucccagguucag

SEQ ID NO: 252457 - RNA, 32 nt, Human
ugcucacuacagcacccgcuucccagguugaa

SEQ ID NO: 252458 - RNA, 32 nt, Human
ugcucacuacagccucccaacucccaggcuca

SEQ ID NO: 252459 - RNA, 32 nt, Human
ugcucacucacugcccucccucccuccugggc

SEQ ID NO: 252460 - RNA, 32 nt, Human
ugcucacucagcugcccugggggcugcuuucc

SEQ ID NO: 252461 - RNA, 32 nt, Human
ugcucacuccaccccacccacaucugcccugu

SEQ ID NO: 252462 - RNA, 32 nt, Human
ugcucacucuucucucagccaaagccuccaaa

SEQ ID NO: 252463 - RNA, 32 nt, Human
ugcucacugaaagcuccgccucccggguucau

SEQ ID NO: 252464 - RNA, 32 nt, Human
ugcucacugcaacauccaccucaugggcucaa

SEQ ID NO: 252465 - RNA, 32 nt, Human
ugcucacugcaaccuccgccucccagguucaa

SEQ ID NO: 252466 - RNA, 32 nt, Human
ugcucacugcaaccuccgccucccggguucaa

SEQ ID NO: 252467 - RNA, 32 nt, Human
ugcucacugcaaccucugccacccggguucaa

SEQ ID NO: 252468 - RNA, 32 nt, Human
ugcucacugcaaccucugccuccuggguuuaa

SEQ ID NO: 252469 - RNA, 32 nt, Human
ugcucacugcaagcucagccucucggguucac

SEQ ID NO: 252470 - RNA, 32 nt, Human
ugcucacugcaagcuccgccaucuggguucaa

SEQ ID NO: 252471 - RNA, 32 nt, Human
ugcucacugcaagcuccgccucccggguucac

SEQ ID NO: 252472 - RNA, 32 nt, Human
ugcucacugcaagcuccgccuccuggguucau

SEQ ID NO: 252473 - RNA, 32 nt, Human
ugcucacugcagccuccaccuccugggcucaa

SEQ ID NO: 252474 - RNA, 32 nt, Human
ugcucacugcagccucgaccucccaaggccua

SEQ ID NO: 252475 - RNA, 32 nt, Human
ugcucacuguaaccucugccuccuggguucaa

SEQ ID NO: 252476 - RNA, 32 nt, Human
ugcucacuguucuccccauccuuguccuuccc

SEQ ID NO: 252477 - RNA, 32 nt, Human
ugcucacuugaagaagugugauuccagcaccg

SEQ ID NO: 252478 - RNA, 32 nt, Human
ugcucacuuggucugagcucagcugaaugcag

SEQ ID NO: 252479 - RNA, 23 nt, Human
ugcucagacuggagugcgagcua

SEQ ID NO: 252480 - RNA, 18 nt, Human
ugcucagagcacgguggc

SEQ ID NO: 252481 - RNA, 32 nt, Human
ugcucagagcucagaauucaguggggaccaga

SEQ ID NO: 252482 - RNA, 32 nt, Human
ugcucagagcuuuccacccacagggagaagca

SEQ ID NO: 252483 - RNA, 32 nt, Human
ugcucagaggaggcagagauggggugguggcu

SEQ ID NO: 252484 - RNA, 24 nt, Human
ugcucagaggucaggaacggcaug

SEQ ID NO: 252485 - RNA, 32 nt, Human
ugcucagagugggagcaagggagccagggaga

SEQ ID NO: 252486 - RNA, 32 nt, Human
ugcucagaucagaucgaugggauuggaauaca

SEQ ID NO: 252487 - RNA, 32 nt, Human
ugcucagauggaaccacuguucccucaguguc

SEQ ID NO: 252488 - RNA, 32 nt, Human
ugcucagauuuguguguucaaucaaugggcuu

SEQ ID NO: 252489 - RNA, 32 nt, Human
ugcucagcaaaugucagcagguccagaagcaa

SEQ ID NO: 252490 - RNA, 32 nt, Human
ugcucagcacacucuguaucuccuguccuuaa

SEQ ID NO: 252491 - RNA, 32 nt, Human
ugcucagcaccguuucuccaucaaugccguga

SEQ ID NO: 252492 - RNA, 18 nt, Human
ugcucagcagccccaccc

SEQ ID NO: 252493 - RNA, 32 nt, Human
ugcucagcauuuuugucaucccugcccuuggc

SEQ ID NO: 252494 - RNA, 22 nt, Human
ugcucagccaaggaacaccaug

SEQ ID NO: 252495 - RNA, 21 nt, Human
ugcucagccacauucccuugc

SEQ ID NO: 252496 - RNA, 21 nt, Human
ugcucagccacucugcccagc

SEQ ID NO: 252497 - RNA, 20 nt, Human
ugcucagccagaaaacuuag

SEQ ID NO: 252498 - RNA, 32 nt, Human
ugcucagccaggcuggaggcggcaggcggcag

SEQ ID NO: 252499 - RNA, 24 nt, Human
ugcucagcccagcccacguugcug

SEQ ID NO: 252500 - RNA, 32 nt, Human
ugcucagcccuagaggcaguugacuuacccuc

SEQ ID NO: 252501 - RNA, 32 nt, Human
ugcucagcccugcaccaugcugcuggggaaga

SEQ ID NO: 252502 - RNA, 32 nt, Human
ugcucagccucagauauccucugacaauugcu

SEQ ID NO: 252503 - RNA, 32 nt, Human
ugcucagcggccugggcucuugcccaaguucu

SEQ ID NO: 252504 - RNA, 30 nt, Human
ugcucagcugcugcucugcuccugucuccu

SEQ ID NO: 252505 - RNA, 32 nt, Human
ugcucagcuguggcuggaggagcuggccugug

SEQ ID NO: 252506 - RNA, 32 nt, Human
ugcucagcuucuccugugugauugacagcuuu

SEQ ID NO: 252507 - RNA, 32 nt, Human
ugcucagcuucuccuuguaaauuccuggugag

SEQ ID NO: 252508 - RNA, 32 nt, Human
ugcucagcuuuuccauaugauuaggugaguga

SEQ ID NO: 252509 - RNA, 32 nt, Human
ugcucaggaaguggguaucaaauugagguggg

SEQ ID NO: 252510 - RNA, 32 nt, Human
ugcucaggacacgcuccuauaggaccaagaug

SEQ ID NO: 252511 - RNA, 32 nt, Human
ugcucaggacagugguggagcugggucuugaa

SEQ ID NO: 252512 - RNA, 32 nt, Human
ugcucaggacucagaagccucugggucagugg

SEQ ID NO: 252513 - RNA, 32 nt, Human
ugcucaggauguccccgcugcccucgaggcuc

SEQ ID NO: 252514 - RNA, 32 nt, Human
ugcucaggcaucccugcccugcucuccuugag

SEQ ID NO: 252515 - RNA, 32 nt, Human
ugcucaggcccaggacaguggguggucaacag

SEQ ID NO: 252516 - RNA, 32 nt, Human
ugcucaggcccaggcuuugccagguccgaagc

SEQ ID NO: 252517 - RNA, 22 nt, Human
ugcucaggccgggcaucucaaa

SEQ ID NO: 252518 - RNA, 32 nt, Human
ugcucaggcucaggacccuaugggauugcaca

SEQ ID NO: 252519 - RNA, 32 nt, Human
ugcucaggcugacagggagggcaaagagugaa

SEQ ID NO: 252520 - RNA, 21 nt, Human
ugcucaggcuggaguacagug

SEQ ID NO: 252521 - RNA, 21 nt, Human
ugcucaggcuggagugcagug

SEQ ID NO: 252522 - RNA, 21 nt, Human
ugcucaggcuggauugcagug

SEQ ID NO: 252523 - RNA, 32 nt, Human
ugcucaggcuggccuugaacuccugggcucaa

SEQ ID NO: 252524 - RNA, 32 nt, Human
ugcucaggcuggucuggaaccccuaggcucaa

SEQ ID NO: 252525 - RNA, 32 nt, Human
ugcucaggcugguuuugaaccccuggguucaa

SEQ ID NO: 252526 - RNA, 32 nt, Human
ugcucagggaaaugaagacaggagaacugcug

SEQ ID NO: 252527 - RNA, 32 nt, Human
ugcucagggaaguccuuccagccucagaaacc

SEQ ID NO: 252528 - RNA, 32 nt, Human
ugcucagggcaaaggcaacuuggcuucacagg

SEQ ID NO: 252529 - RNA, 32 nt, Human
ugcucagggcuggagagaggguggcggggcug

SEQ ID NO: 252530 - RNA, 32 nt, Human
ugcucaggggacagagaggcagagggacuauc

SEQ ID NO: 252531 - RNA, 32 nt, Human
ugcucaggggcuccuucuggcugcaguaagcu

SEQ ID NO: 252532 - RNA, 32 nt, Human
ugcucaggggcugaagcagaggcauugccuuu

SEQ ID NO: 252533 - RNA, 32 nt, Human
ugcucaggugccuguuccagcccaggcagaga

SEQ ID NO: 252534 - RNA, 32 nt, Human
ugcucagguucacauaauggcuaucugugguc

SEQ ID NO: 252535 - RNA, 16 nt, Human
ugcucaguaacuguga

SEQ ID NO: 252536 - RNA, 32 nt, Human
ugcucagucacuaauccagcuugaguguccgu

SEQ ID NO: 252537 - RNA, 32 nt, Human
ugcucaguccuggcugcuuuggcuccaccuuc

SEQ ID NO: 252538 - RNA, 32 nt, Human
ugcucagucgcucaggcuggagugcaauggug

SEQ ID NO: 252539 - RNA, 32 nt, Human
ugcucagucugaagacauuggacccaaguuag

SEQ ID NO: 252540 - RNA, 32 nt, Human
ugcucagucugaagacguuggacccaaguuag

SEQ ID NO: 252541 - RNA, 32 nt, Human
ugcucagugcaaccucugccucccaggaucaa

SEQ ID NO: 252542 - RNA, 32 nt, Human
ugcucagugcuuugccccaggauugccucaaa

SEQ ID NO: 252543 - RNA, 32 nt, Human
ugcucaguguagaggacauuccugucauccau

SEQ ID NO: 252544 - RNA, 24 nt, Human
ugcucagugucuuuggccucagag

SEQ ID NO: 252545 - RNA, 21 nt, Human
ugcucaguugucacaucaaag

SEQ ID NO: 252546 - RNA, 32 nt, Human
ugcucauagcuaguccauggggagagggaaga

SEQ ID NO: 252547 - RNA, 32 nt, Human
ugcucauaucaauccuauaaggcacagggaac

SEQ ID NO: 252548 - RNA, 32 nt, Human
ugcucaucaaggaggugcuggacuacccuugc

SEQ ID NO: 252549 - RNA, 24 nt, Human
ugcucaucagaggugcuuuccuca

SEQ ID NO: 252550 - RNA, 24 nt, Human
ugcucaucagcuccuucugccucc

SEQ ID NO: 252551 - RNA, 32 nt, Human
ugcucaucccuaacuccuguuccuucaucugu

SEQ ID NO: 252552 - RNA, 32 nt, Human
ugcucauccucuucuuagugcugugcggcggg

SEQ ID NO: 252553 - RNA, 32 nt, Human
ugcucauccucuugguuuccccaaagaccggg

SEQ ID NO: 252554 - RNA, 21 nt, Human
ugcucaucuaaaguguuugcc

SEQ ID NO: 252555 - RNA, 32 nt, Human
ugcucaucuaugaucugagaucaugccgaagu

SEQ ID NO: 252556 - RNA, 32 nt, Human
ugcucaucucagaaggauggggaugcuugauu

SEQ ID NO: 252557 - RNA, 32 nt, Human
ugcucaucuucauugagguccacccagggaug

SEQ ID NO: 252558 - RNA, 32 nt, Human
ugcucaugagacaacucacugucaugaccauu

SEQ ID NO: 252559 - RNA, 22 nt, Human
ugcucaugccacuaacagcaug

SEQ ID NO: 252560 - RNA, 32 nt, Human
ugcucaugccuauaaucccagcacuuuaggag

SEQ ID NO: 252561 - RNA, 32 nt, Human
ugcucaugccuguagucccagcuacuugggag

SEQ ID NO: 252562 - RNA, 25 nt, Human
ugcucaugcugaaauuucuggcaua

SEQ ID NO: 252563 - RNA, 30 nt, Human
ugcucauggaggaaccaaggccuucgaagc

SEQ ID NO: 252564 - RNA, 32 nt, Human
ugcucauggaguugcaguucuugccuaacagg

SEQ ID NO: 252565 - RNA, 32 nt, Human
ugcucaugggagaaggcuguggucucugcccc

SEQ ID NO: 252566 - RNA, 32 nt, Human
ugcucaugggagaauggcagagggauccccaa

SEQ ID NO: 252567 - RNA, 32 nt, Human
ugcucaugguuaaugcaggcaggugugaacau

SEQ ID NO: 252568 - RNA, 32 nt, Human
ugcucauguccuccccuccacccgcacauggg

SEQ ID NO: 252569 - RNA, 32 nt, Human
ugcucauguucugugccccacacccaccaaua

SEQ ID NO: 252570 - RNA, 32 nt, Human
ugcucauuccuaacaguggauuuacuuguaag

SEQ ID NO: 252571 - RNA, 32 nt, Human
ugcucauucucauucugucuucucagugacac

SEQ ID NO: 252572 - RNA, 32 nt, Human
ugcucauugcaacugccgccucccggguucaa

SEQ ID NO: 252573 - RNA, 32 nt, Human
ugcucauuggcucccuuccaccugucauuccc

SEQ ID NO: 252574 - RNA, 32 nt, Human
ugcucauuucuuuccuuuucuccuuggguuaa

SEQ ID NO: 252575 - RNA, 32 nt, Human
ugcuccaaauuccuccucugcguccaggagag

SEQ ID NO: 252576 - RNA, 32 nt, Human
ugcuccaagaugacuugcaucauaccccaauu

SEQ ID NO: 252577 - RNA, 32 nt, Human
ugcuccacauccaggcagccugggugaccacu

SEQ ID NO: 252578 - RNA, 32 nt, Human
ugcuccaccaggggaaugcacuggcccuagac

SEQ ID NO: 252579 - RNA, 32 nt, Human
ugcuccaccugggacucugcugugcugcgggc

SEQ ID NO: 252580 - RNA, 32 nt, Human
ugcuccaccuggugccccaggccacagcugcu

SEQ ID NO: 252581 - RNA, 32 nt, Human
ugcuccacguucucuucugucuguugcagcgg

SEQ ID NO: 252582 - RNA, 32 nt, Human
ugcuccacugucugcagcccagauccuguugg

SEQ ID NO: 252583 - RNA, 32 nt, Human
ugcuccacuucucagcucuccccugcccugca

SEQ ID NO: 252584 - RNA, 32 nt, Human
ugcuccagacacagacaccauucacuccagau

SEQ ID NO: 252585 - RNA, 32 nt, Human
ugcuccagacauaaauagcucacugcaggaac

SEQ ID NO: 252586 - RNA, 18 nt, Human
ugcuccagagcgccugca

SEQ ID NO: 252587 - RNA, 32 nt, Human
ugcuccagaggugggugggaggugagcugggg

SEQ ID NO: 252588 - RNA, 21 nt, Human
ugcuccagaucuggaaugcca

SEQ ID NO: 252589 - RNA, 32 nt, Human
ugcuccagcaggcccugcagcucuggggagcc

SEQ ID NO: 252590 - RNA, 32 nt, Human
ugcuccagcccaggcuggagugcaguggcaug

SEQ ID NO: 252591 - RNA, 32 nt, Human
ugcuccagcccccauuucccugacggcccuug

SEQ ID NO: 252592 - RNA, 23 nt, Human
ugcuccagccucugccgcugcca

SEQ ID NO: 252593 - RNA, 32 nt, Human
ugcuccagccuggaugacggagccagauccug

SEQ ID NO: 252594 - RNA, 32 nt, Human
ugcuccagccugggcaacaaagugagacucug

SEQ ID NO: 252595 - RNA, 32 nt, Human
ugcuccagccugggcaacagagcaagacucca

SEQ ID NO: 252596 - RNA, 32 nt, Human
ugcuccagccugggcaacagagugagacuacg

SEQ ID NO: 252597 - RNA, 32 nt, Human
ugcuccagccugggcaacagagugagacucca

SEQ ID NO: 252598 - RNA, 32 nt, Human
ugcuccagccugggcgacagagcgagacuccg

SEQ ID NO: 252599 - RNA, 32 nt, Human
ugcuccagccugggugacaaagcaaggcccug

SEQ ID NO: 252600 - RNA, 32 nt, Human
ugcuccagcucauaaagcuuccuugaaacagu

SEQ ID NO: 252601 - RNA, 24 nt, Human
ugcuccagcucugcccaggugcca

SEQ ID NO: 252602 - RNA, 32 nt, Human
ugcuccagcugcagggccagggggugcaggug

SEQ ID NO: 252603 - RNA, 32 nt, Human
ugcuccaggaggucugggguaccagugggcuc

SEQ ID NO: 252604 - RNA, 32 nt, Human
ugcuccaggcagcguggucuguauggcuccgc

SEQ ID NO: 252605 - RNA, 32 nt, Human
ugcuccaggccaggcagcaggcuguggacacc

SEQ ID NO: 252606 - RNA, 22 nt, Human
ugcuccaggcuggcggcgcuca

SEQ ID NO: 252607 - RNA, 32 nt, Human
ugcuccagggacuauccuguguuuguagcugc

SEQ ID NO: 252608 - RNA, 18 nt, Human
ugcuccagggcgccugca

SEQ ID NO: 252609 - RNA, 32 nt, Human
ugcuccagggcugugggcuggggcaugacggc

SEQ ID NO: 252610 - RNA, 32 nt, Human
ugcuccaggugagcuggcuggggaggaggaug

SEQ ID NO: 252611 - RNA, 23 nt, Human
ugcuccagugggagacccuggua

SEQ ID NO: 252612 - RNA, 32 nt, Human
ugcuccaguguagcuuucuacaucccacauca

SEQ ID NO: 252613 - RNA, 32 nt, Human
ugcuccaguuguuucuggaguuggaggcagcu

SEQ ID NO: 252614 - RNA, 32 nt, Human
ugcuccaucacaaccuccuuccccaggaaaac

SEQ ID NO: 252615 - RNA, 32 nt, Human
ugcuccaucagcugccgcacccgccgccuccc

SEQ ID NO: 252616 - RNA, 32 nt, Human
ugcuccaucauccuauuuccauggcuauuucc

SEQ ID NO: 252617 - RNA, 32 nt, Human
ugcuccaucucaccucugcuccagaaauaaau

SEQ ID NO: 252618 - RNA, 32 nt, Human
ugcuccaucuugcagaggcuucauucuugguu

SEQ ID NO: 252619 - RNA, 32 nt, Human
ugcuccaugacuggcugucugccuguauuuuc

SEQ ID NO: 252620 - RNA, 32 nt, Human
ugcuccauuacucaagacacugaagacuccaa

SEQ ID NO: 252621 - RNA, 32 nt, Human
ugcuccauuacugaggcugugacgauccuggg

SEQ ID NO: 252622 - RNA, 32 nt, Human
ugcuccauucagaacaagacuggaugcuucug

SEQ ID NO: 252623 - RNA, 32 nt, Human
ugcuccauugcacuccagccugggcaacgagc

SEQ ID NO: 252624 - RNA, 32 nt, Human
ugcuccauugcacuccagccugggcgauagag

SEQ ID NO: 252625 - RNA, 32 nt, Human
ugcucccaaacuguccccagacuuccucucca

SEQ ID NO: 252626 - RNA, 32 nt, Human
ugcucccaaccaggaagccaucaugucuugcc

SEQ ID NO: 252627 - RNA, 32 nt, Human
ugcucccaaggcaagaagaaagagaugacaga

SEQ ID NO: 252628 - RNA, 32 nt, Human
ugcucccacaccccucuccucgucccuccugg

SEQ ID NO: 252629 - RNA, 19 nt, Human
ugcucccacaggccucuca

SEQ ID NO: 252630 - RNA, 32 nt, Human
ugcucccacauccugcuuauugccugccaccc

SEQ ID NO: 252631 - RNA, 32 nt, Human
ugcucccaccacugcacuccagccugggaagc

SEQ ID NO: 252632 - RNA, 32 nt, Human
ugcucccacccuccucccagcagcagacaccc

SEQ ID NO: 252633 - RNA, 32 nt, Human
ugcucccacguccugcacugcaauaccagucu

SEQ ID NO: 252634 - RNA, 32 nt, Human
ugcucccacuccagaagaacugcggcacgugc

SEQ ID NO: 252635 - RNA, 32 nt, Human
ugcucccacugucuguguucuccucacuguua

SEQ ID NO: 252636 - RNA, 32 nt, Human
ugcucccagagaaccuuauggaagaggacauc

SEQ ID NO: 252637 - RNA, 32 nt, Human
ugcucccagaggcugaagucacccugggaauc

SEQ ID NO: 252638 - RNA, 32 nt, Human
ugcucccagcaaccucuacauccaggaaugag

SEQ ID NO: 252639 - RNA, 32 nt, Human
ugcucccagcaccuccugacccuucccucuuu

SEQ ID NO: 252640 - RNA, 32 nt, Human
ugcucccagcacuuugggaggcugagguagga

SEQ ID NO: 252641 - RNA, 32 nt, Human
ugcucccagcagagguggggccggcagagaag

SEQ ID NO: 252642 - RNA, 32 nt, Human
ugcucccagcaucccuuccccuucucuccucc

SEQ ID NO: 252643 - RNA, 32 nt, Human
ugcucccagcuccucacgaggcugagguggaa

SEQ ID NO: 252644 - RNA, 32 nt, Human
ugcucccaggaccugccucuucccaggcuucc

SEQ ID NO: 252645 - RNA, 32 nt, Human
ugcucccaggagcuggcuauuagguaugucuu

SEQ ID NO: 252646 - RNA, 22 nt, Human
ugcucccagucucccagaacca

SEQ ID NO: 252647 - RNA, 32 nt, Human
ugcucccaucauuccuucuggccucugcugaa

SEQ ID NO: 252648 - RNA, 32 nt, Human
ugcucccaucuauuuucuucucuagaauccac

SEQ ID NO: 252649 - RNA, 32 nt, Human
ugcucccauguccagugcccugggucagggcu

SEQ ID NO: 252650 - RNA, 18 nt, Human
ugcucccauuucuguccu

SEQ ID NO: 252651 - RNA, 28 nt, Human
ugcuccccaagugggccugauuuagcag

SEQ ID NO: 252652 - RNA, 23 nt, Human
ugcuccccacagggccaggcugg

SEQ ID NO: 252653 - RNA, 32 nt, Human
ugcuccccaccagggcagcacgggacagaaac

SEQ ID NO: 252654 - RNA, 32 nt, Human
ugcuccccacccccuaccuccaccugagccuc

SEQ ID NO: 252655 - RNA, 19 nt, Human
ugcuccccacgucagcugg

SEQ ID NO: 252656 - RNA, 32 nt, Human
ugcuccccacguugggcaacuccagccaagau

SEQ ID NO: 252657 - RNA, 32 nt, Human
ugcuccccacuccuggugugcggucuugcgcc

SEQ ID NO: 252658 - RNA, 20 nt, Human
ugcuccccagaaccccgggg

SEQ ID NO: 252659 - RNA, 32 nt, Human
ugcuccccagagggcagggugagugcguggca

SEQ ID NO: 252660 - RNA, 32 nt, Human
ugcuccccagcaaacggugccucccaggcauu

SEQ ID NO: 252661 - RNA, 22 nt, Human
ugcuccccagcucucggauaca

SEQ ID NO: 252662 - RNA, 32 nt, Human
ugcucccccaacccagcgucaggcugggacac

SEQ ID NO: 252663 - RNA, 32 nt, Human
ugcucccccaggagacucaacacuaaauaaag

SEQ ID NO: 252664 - RNA, 32 nt, Human
ugcucccccgacccccuccacccagcaguaga

SEQ ID NO: 252665 - RNA, 32 nt, Human
ugcucccccugccucagacaucuacgcagcga

SEQ ID NO: 252666 - RNA, 32 nt, Human
ugcucccccugccuugucccaccagggaggca

SEQ ID NO: 252667 - RNA, 32 nt, Human
ugcuccccucaacccccucccaccccauccac

SEQ ID NO: 252668 - RNA, 32 nt, Human
ugcuccccuccaggauggagugggggucggca

SEQ ID NO: 252669 - RNA, 32 nt, Human
ugcuccccucccccacagccucuuccucccuu

SEQ ID NO: 252670 - RNA, 32 nt, Human
ugcuccccucccccugcaggucccccuccccu

SEQ ID NO: 252671 - RNA, 23 nt, Human
ugcuccccugagcgcugggcugg

SEQ ID NO: 252672 - RNA, 32 nt, Human
ugcuccccugcucccuguuguguuagggaugu

SEQ ID NO: 252673 - RNA, 32 nt, Human
ugcuccccuguucaaagaugcauuuugagugu

SEQ ID NO: 252674 - RNA, 32 nt, Human
ugcuccccuuacacuccuccagggaccccgga

SEQ ID NO: 252675 - RNA, 32 nt, Human
ugcuccccuucccaccaccacugccauauaaa

SEQ ID NO: 252676 - RNA, 32 nt, Human
ugcuccccuucccucccugaaccgggaguuuc

SEQ ID NO: 252677 - RNA, 21 nt, Human
ugcucccgccgccgccgccgc

SEQ ID NO: 252678 - RNA, 32 nt, Human
ugcucccgccuggaaucccagcacuuugggag

SEQ ID NO: 252679 - RNA, 32 nt, Human
ugcucccggggaggaaaggcuaaagcugcugg

SEQ ID NO: 252680 - RNA, 32 nt, Human
ugcucccgguggaagcaagggagcccagccgg

SEQ ID NO: 252681 - RNA, 32 nt, Human
ugcucccgucugucuguccugucugauucucu

SEQ ID NO: 252682 - RNA, 32 nt, Human
ugcucccgugaaggaaugcacuuugccuugua

SEQ ID NO: 252683 - RNA, 32 nt, Human
ugcucccguuguucucuuuccauuugccuccc

SEQ ID NO: 252684 - RNA, 32 nt, Human
ugcucccuauacucccuuguuccaucagaagc

SEQ ID NO: 252685 - RNA, 32 nt, Human
ugcucccucccccagcaucaaauuguuaucag

SEQ ID NO: 252686 - RNA, 32 nt, Human
ugcucccuccuaggaccucgcagccaggcaag

SEQ ID NO: 252687 - RNA, 32 nt, Human
ugcucccucgagcacuuguugugugcacuuua

SEQ ID NO: 252688 - RNA, 32 nt, Human
ugcucccucguccugugaacuuucucugagcu

SEQ ID NO: 252689 - RNA, 22 nt, Human
ugcucccucuaccucacugcca

SEQ ID NO: 252690 - RNA, 22 nt, Human
ugcucccucugaagugcagugg

SEQ ID NO: 252691 - RNA, 32 nt, Human
ugcucccugcaaccuccaccucccggguucaa

SEQ ID NO: 252692 - RNA, 32 nt, Human
ugcucccugcaagcuccgccucccggguucac

SEQ ID NO: 252693 - RNA, 32 nt, Human
ugcucccugcagcugccaucggcccgcuuugc

SEQ ID NO: 252694 - RNA, 25 nt, Human
ugcucccugccaggcgcgugcggga

SEQ ID NO: 252695 - RNA, 23 nt, Human
ugcucccugcccccucccugcua

SEQ ID NO: 252696 - RNA, 32 nt, Human
ugcucccugccuccugccuaugucuccucuau

SEQ ID NO: 252697 - RNA, 32 nt, Human
ugcucccugccugggcuccaugcugucgcggg

SEQ ID NO: 252698 - RNA, 32 nt, Human
ugcucccugcucuuucugccucugggcucaug

SEQ ID NO: 252699 - RNA, 32 nt, Human
ugcucccuggacugccuagcccugagugccac

SEQ ID NO: 252700 - RNA, 32 nt, Human
ugcucccugggaggcaggcuccagaagcaccc

SEQ ID NO: 252701 - RNA, 32 nt, Human
ugcucccuggucccuucccuguugccugagca

SEQ ID NO: 252702 - RNA, 32 nt, Human
ugcucccuguguccuuggacagcagauccaca

SEQ ID NO: 252703 - RNA, 32 nt, Human
ugcucccuuagcccagaagcccugccaggucc

SEQ ID NO: 252704 - RNA, 32 nt, Human
ugcucccuuccuauuccauggcuucaggugcc

SEQ ID NO: 252705 - RNA, 32 nt, Human
ugcucccuuccuucuucuguccuguuuccagc

SEQ ID NO: 252706 - RNA, 32 nt, Human
ugcucccuucuuccuuuccuuguuauucaccu

SEQ ID NO: 252707 - RNA, 32 nt, Human
ugcucccuuuccaaucuguauaccuuuuauuu

SEQ ID NO: 252708 - RNA, 32 nt, Human
ugcucccuuuccaguucuggcaucuccccagu

SEQ ID NO: 252709 - RNA, 32 nt, Human
ugcucccuuuuacauucuguguguaucuaaag

SEQ ID NO: 252710 - RNA, 32 nt, Human
ugcuccgaagacaaaccaaccuccguuucuuu

SEQ ID NO: 252711 - RNA, 32 nt, Human
ugcuccgagaagaggcugggucgagcugggcc

SEQ ID NO: 252712 - RNA, 32 nt, Human
ugcuccgaggagggguggacuccaccuuggac

SEQ ID NO: 252713 - RNA, 32 nt, Human
ugcuccgagguaguagcucucuugccuggagg

SEQ ID NO: 252714 - RNA, 32 nt, Human
ugcuccgccuguccugcccuugcucagaccac

SEQ ID NO: 252715 - RNA, 24 nt, Human
ugcuccgcgccgccucagccgccg

SEQ ID NO: 252716 - RNA, 32 nt, Human
ugcuccgcgccugagccaugcccagcagcccu

SEQ ID NO: 252717 - RNA, 21 nt, Human
ugcuccgcggcugcggccccg

SEQ ID NO: 252718 - RNA, 32 nt, Human
ugcuccggagggaagcauuuccugguaggcuu

SEQ ID NO: 252719 - RNA, 32 nt, Human
ugcuccggcccaggcgggggagucagugccca

SEQ ID NO: 252720 - RNA, 32 nt, Human
ugcuccggccuguacugaccagccugcgccuu

SEQ ID NO: 252721 - RNA, 25 nt, Human
ugcuccggcuucgcccgcagcuccg

SEQ ID NO: 252722 - RNA, 32 nt, Human
ugcuccgggagccaucacucuccaguuuucuc

SEQ ID NO: 252723 - RNA, 19 nt, Human
ugcuccgggccugccugca

SEQ ID NO: 252724 - RNA, 32 nt, Human
ugcuccgguagguuuggcgugcgcggguuucu

SEQ ID NO: 252725 - RNA, 32 nt, Human
ugcuccguacccugugcuguccugccucagau

SEQ ID NO: 252726 - RNA, 32 nt, Human
ugcuccgucauucccuuccccaccuccuugug

SEQ ID NO: 252727 - RNA, 32 nt, Human
ugcuccguccagauguugagggccagucuagg

SEQ ID NO: 252728 - RNA, 32 nt, Human
ugcuccgucgcccaggcuggcaugcaguugcg

SEQ ID NO: 252729 - RNA, 21 nt, Human
ugcuccgucucccuccccggg

SEQ ID NO: 252730 - RNA, 32 nt, Human
ugcuccgugaaccuuaugaaugcugcuuaaaa

SEQ ID NO: 252731 - RNA, 32 nt, Human
ugcuccgugaccccaccauguccucuccuacc

SEQ ID NO: 252732 - RNA, 32 nt, Human
ugcuccguggaacacgaggagcacacgaaacc

SEQ ID NO: 252733 - RNA, 32 nt, Human
ugcuccguugcccagguuggagugcaguggcc

SEQ ID NO: 252734 - RNA, 32 nt, Human
ugcuccguugccuagcuggagugcacgaucuc

SEQ ID NO: 252735 - RNA, 32 nt, Human
ugcuccuaaggguagaaaacuccagggucccc

SEQ ID NO: 252736 - RNA, 32 nt, Human
ugcuccuagcagccuccccaggaagggacugc

SEQ ID NO: 252737 - RNA, 32 nt, Human
ugcuccuauagucccagcuuggagauugaggu

SEQ ID NO: 252738 - RNA, 19 nt, Human
ugcuccucacccaggcugg

SEQ ID NO: 252739 - RNA, 32 nt, Human
ugcuccucacccaggcuggaaugcaguggugu

SEQ ID NO: 252740 - RNA, 32 nt, Human
ugcuccucacccuccucucacccuccacccuc

SEQ ID NO: 252741 - RNA, 32 nt, Human
ugcuccucacuuccucuucuucauugcaguua

SEQ ID NO: 252742 - RNA, 32 nt, Human
ugcuccucagcguccaguccuccugggcggcc

SEQ ID NO: 252743 - RNA, 32 nt, Human
ugcuccuccaccccuaaguuaaagcuaugaac

SEQ ID NO: 252744 - RNA, 32 nt, Human
ugcuccuccagccccagcugcccuggcuuccc

SEQ ID NO: 252745 - RNA, 32 nt, Human
ugcuccuccagccugcacugggccccagcccu

SEQ ID NO: 252746 - RNA, 32 nt, Human
ugcuccuccagcugcugcaccugccucuccgc

SEQ ID NO: 252747 - RNA, 32 nt, Human
ugcuccuccaggucucacucaggcucacucug

SEQ ID NO: 252748 - RNA, 20 nt, Human
ugcuccuccauuccuaacgc

SEQ ID NO: 252749 - RNA, 32 nt, Human
ugcuccuccauuugaaaugacagccccgagcu

SEQ ID NO: 252750 - RNA, 22 nt, Human
ugcuccuccccuuucacaggug

SEQ ID NO: 252751 - RNA, 24 nt, Human
ugcuccucccucccugcagccccg

SEQ ID NO: 252752 - RNA, 19 nt, Human
ugcuccucccuccuguccu

SEQ ID NO: 252753 - RNA, 32 nt, Human
ugcuccucccucugacccagacuccgccugag

SEQ ID NO: 252754 - RNA, 19 nt, Human
ugcuccucccucuucccgg

SEQ ID NO: 252755 - RNA, 32 nt, Human
ugcuccuccuacccuuccagugcccuaggccu

SEQ ID NO: 252756 - RNA, 23 nt, Human
ugcuccuccucccagccccggcc

SEQ ID NO: 252757 - RNA, 32 nt, Human
ugcuccuccucuucccuuuggggcuggugcug

SEQ ID NO: 252758 - RNA, 32 nt, Human
ugcuccuccucuuccuccuccuccuccaaacu

SEQ ID NO: 252759 - RNA, 32 nt, Human
ugcuccucucacugcccucugcaccagcaaca

SEQ ID NO: 252760 - RNA, 32 nt, Human
ugcuccucucccgugugagugcagagaagguc

SEQ ID NO: 252761 - RNA, 32 nt, Human
ugcuccucucccuccaccuccuggcuucaacu

SEQ ID NO: 252762 - RNA, 32 nt, Human
ugcuccucucggccccuccuccugggccgccu

SEQ ID NO: 252763 - RNA, 32 nt, Human
ugcuccucucucaguggccaucaugucuuuga

SEQ ID NO: 252764 - RNA, 32 nt, Human
ugcuccucugaccucccggucucccucugcag

SEQ ID NO: 252765 - RNA, 32 nt, Human
ugcuccucuggcagagagaaggagcucaaaag

SEQ ID NO: 252766 - RNA, 32 nt, Human
ugcuccucuguggccuuccugggcugcccucc

SEQ ID NO: 252767 - RNA, 32 nt, Human
ugcuccugagccuccacuaucucccugugacg

SEQ ID NO: 252768 - RNA, 32 nt, Human
ugcuccugaggaggcggcggcagcagcgccua

SEQ ID NO: 252769 - RNA, 32 nt, Human
ugcuccugaggcgaugaugggcaaggaagagg

SEQ ID NO: 252770 - RNA, 32 nt, Human
ugcuccugauuucccaggucuuaggccaccuu

SEQ ID NO: 252771 - RNA, 32 nt, Human
ugcuccugcacauguuggaguguggugccucc

SEQ ID NO: 252772 - RNA, 32 nt, Human
ugcuccugccaccucccaccucucugagggcu

SEQ ID NO: 252773 - RNA, 32 nt, Human
ugcuccugcccuccugucucucuugucccucg

SEQ ID NO: 252774 - RNA, 32 nt, Human
ugcuccugccgcccucugcccugccggagaca

SEQ ID NO: 252775 - RNA, 31 nt, Human
ugcuccugccucuagggugcaguguccguac

SEQ ID NO: 252776 - RNA, 32 nt, Human
ugcuccugcgguuggugagauuaccugggucu

SEQ ID NO: 252777 - RNA, 32 nt, Human
ugcuccugcugaggaccagcuguggcugggcc

SEQ ID NO: 252778 - RNA, 32 nt, Human
ugcuccugcuucuuucuacacacacaucuaaa

SEQ ID NO: 252779 - RNA, 32 nt, Human
ugcuccuggaccuggccaaugagguggacuau

SEQ ID NO: 252780 - RNA, 21 nt, Human
ugcuccuggagccuuugaaua

SEQ ID NO: 252781 - RNA, 32 nt, Human
ugcuccuggaucucccugagaugggcuuccca

SEQ ID NO: 252782 - RNA, 32 nt, Human
ugcuccuggccugggcucugauuucacugugu

SEQ ID NO: 252783 - RNA, 32 nt, Human
ugcuccuggccuugcugaccucagcgguugcc

SEQ ID NO: 252784 - RNA, 29 nt, Human
ugcuccuggcugccacucaccccugugag

SEQ ID NO: 252785 - RNA, 32 nt, Human
ugcuccugggagaagagaaggaucccaguauc

SEQ ID NO: 252786 - RNA, 32 nt, Human
ugcuccugggaggugagcgugcacaggugugu

SEQ ID NO: 252787 - RNA, 21 nt, Human
ugcuccugggccccagccccg

SEQ ID NO: 252788 - RNA, 32 nt, Human
ugcuccugguaguaaggagcacaaagacguuu

SEQ ID NO: 252789 - RNA, 32 nt, Human
ugcuccuggugagaggacgugggcagggaucc

SEQ ID NO: 252790 - RNA, 32 nt, Human
ugcuccugguggaagcaagggagcccagccga

SEQ ID NO: 252791 - RNA, 18 nt, Human
ugcuccuguaauugugau

SEQ ID NO: 252792 - RNA, 32 nt, Human
ugcuccuguaguacagaaggugcaguacaucu

SEQ ID NO: 252793 - RNA, 32 nt, Human
ugcuccugucauccuccacauuucugcuccaa

SEQ ID NO: 252794 - RNA, 32 nt, Human
ugcuccuguccccacucacaggcccacgcagc

SEQ ID NO: 252795 - RNA, 31 nt, Human
ugcuccugucucucuggcaggagugccugua

SEQ ID NO: 252796 - RNA, 32 nt, Human
ugcuccugugccacaggacuccuguggcucgg

SEQ ID NO: 252797 - RNA, 32 nt, Human
ugcuccuguggcugugaugugggguuaaguga

SEQ ID NO: 252798 - RNA, 32 nt, Human
ugcuccuguuggcaaaucgcaccuuaucugaa

SEQ ID NO: 252799 - RNA, 32 nt, Human
ugcuccuguuggucccuguccuugcugcccag

SEQ ID NO: 252800 - RNA, 32 nt, Human
ugcuccuuaccuccccacccugaugucauuuc

SEQ ID NO: 252801 - RNA, 32 nt, Human
ugcuccuuaccuggaagaugcagggaaccucc

SEQ ID NO: 252802 - RNA, 32 nt, Human
ugcuccuuagggcagagguuuuauugaauaga

SEQ ID NO: 252803 - RNA, 32 nt, Human
ugcuccuuaugggcugggguguaaugugcaga

SEQ ID NO: 252804 - RNA, 32 nt, Human
ugcuccuucaaggcccuuaaaacugugggcuc

SEQ ID NO: 252805 - RNA, 32 nt, Human
ugcuccuucagcauuugugcugucuaccucuc

SEQ ID NO: 252806 - RNA, 23 nt, Human
ugcuccuucagccuccuugcuca

SEQ ID NO: 252807 - RNA, 32 nt, Human
ugcuccuucagggauggaggcaauggcggcca

SEQ ID NO: 252808 - RNA, 32 nt, Human
ugcuccuucaucaccuuucccucucucuuuga

SEQ ID NO: 252809 - RNA, 32 nt, Human
ugcuccuuccacaagaagugcauagguccaua

SEQ ID NO: 252810 - RNA, 32 nt, Human
ugcuccuuccaggcaggggcugaggggacugu

SEQ ID NO: 252811 - RNA, 24 nt, Human
ugcuccuuccccaguggauggggu

SEQ ID NO: 252812 - RNA, 16 nt, Human
ugcuccuuccuguccu

SEQ ID NO: 252813 - RNA, 29 nt, Human
ugcuccuuccugugugugcucuggacccu

SEQ ID NO: 252814 - RNA, 32 nt, Human
ugcuccuucgacucugcagcucaggccugucc

SEQ ID NO: 252815 - RNA, 32 nt, Human
ugcuccuucuacuacacaacacugccuaguug

SEQ ID NO: 252816 - RNA, 32 nt, Human
ugcuccuucuucugccgccacgcccagcuccc

SEQ ID NO: 252817 - RNA, 32 nt, Human
ugcuccuugacugucucuccccaccgggguca

SEQ ID NO: 252818 - RNA, 32 nt, Human
ugcuccuuggagcuggugugcaguguccugac

SEQ ID NO: 252819 - RNA, 32 nt, Human
ugcuccuugggugcugcugcuacucagacuag

SEQ ID NO: 252820 - RNA, 32 nt, Human
ugcuccuuguccaucccuuggagcagauuuug

SEQ ID NO: 252821 - RNA, 32 nt, Human
ugcuccuugugggcgcucacacugcccccgga

SEQ ID NO: 252822 - RNA, 32 nt, Human
ugcuccuuugagagauuccuggaccacaaugg

SEQ ID NO: 252823 - RNA, 32 nt, Human
ugcucgccaccugguggccacgcguaccugca

SEQ ID NO: 252824 - RNA, 32 nt, Human
ugcucgccaugucuucucacaagacuuucagg

SEQ ID NO: 252825 - RNA, 32 nt, Human
ugcucgcccaggguggagugcaguggugugau

SEQ ID NO: 252826 - RNA, 32 nt, Human
ugcucgccuguaaucccagcuacuugggaggc

SEQ ID NO: 252827 - RNA, 32 nt, Human
ugcucgccuuggucauguacagcacugaaagg

SEQ ID NO: 252828 - RNA, 32 nt, Human
ugcucgcucaauaugcaaugugcuguuauucu

SEQ ID NO: 252829 - RNA, 32 nt, Human
ugcucgcucagugccauagccuuaccgcagcc

SEQ ID NO: 252830 - RNA, 32 nt, Human
ugcucgcugagcagaccuugggcuugugcugu

SEQ ID NO: 252831 - RNA, 32 nt, Human
ugcucgcugggcagacccaggucgcgcuccca

SEQ ID NO: 252832 - RNA, 32 nt, Human
ugcucgcuguccuacauaucacaauauagugu

SEQ ID NO: 252833 - RNA, 32 nt, Human
ugcucgcuucauuugccuuguuuacucauccu

SEQ ID NO: 252834 - RNA, 32 nt, Human
ugcucgcuugaggagcuucagaggaaucuuag

SEQ ID NO: 252835 - RNA, 32 nt, Human
ugcucggaacuauccauguauaagcacugcaa

SEQ ID NO: 252836 - RNA, 32 nt, Human
ugcucggaagagaccgagccccagggccgccg

SEQ ID NO: 252837 - RNA, 32 nt, Human
ugcucggagagggcggcugggcggcggcgggg

SEQ ID NO: 252838 - RNA, 32 nt, Human
ugcucggaggcagaggcagcaagaggcggcgg

SEQ ID NO: 252839 - RNA, 32 nt, Human
ugcucggaguccuggcuccaccucucacuagc

SEQ ID NO: 252840 - RNA, 32 nt, Human
ugcucggcacuucugcgucaagaggcacuggg

SEQ ID NO: 252841 - RNA, 32 nt, Human
ugcucggcccaaggcaggagaaucucuugaag

SEQ ID NO: 252842 - RNA, 32 nt, Human
ugcucggcguugagcuccugcagccgccgccg

SEQ ID NO: 252843 - RNA, 32 nt, Human
ugcucgggagagaagugagggaagccggcagu

SEQ ID NO: 252844 - RNA, 32 nt, Human
ugcucgggaggcagaggcaggagaauggcgug

SEQ ID NO: 252845 - RNA, 32 nt, Human
ugcucgggaggcagcagacagggagccaccag

SEQ ID NO: 252846 - RNA, 32 nt, Human
ugcucgggaggcuaaggcaggagaauugcuug

SEQ ID NO: 252847 - RNA, 32 nt, Human
ugcucgggaggcugaggcaggagaauagcaug

SEQ ID NO: 252848 - RNA, 32 nt, Human
ugcucgggaggcugaggcaggagaaucgcuug

SEQ ID NO: 252849 - RNA, 32 nt, Human
ugcucgggaggcugaggcaggagaauugcuug

SEQ ID NO: 252850 - RNA, 32 nt, Human
ugcucgggagggugaggcaggagaauggcaug

SEQ ID NO: 252851 - RNA, 22 nt, Human
ugcucgggccccagccccggcc

SEQ ID NO: 252852 - RNA, 32 nt, Human
ugcucgggggaugcagggaugagucaaaucca

SEQ ID NO: 252853 - RNA, 32 nt, Human
ugcucggucaccuaggcuggaguguaguggcg

SEQ ID NO: 252854 - RNA, 32 nt, Human
ugcucggucuccgcuggaggugauggccuccc

SEQ ID NO: 252855 - RNA, 21 nt, Human
ugcucggugcccuggcccgca

SEQ ID NO: 252856 - RNA, 32 nt, Human
ugcucgguggagggacagugauggccuuugac

SEQ ID NO: 252857 - RNA, 32 nt, Human
ugcucgguggugagaagguuagguccggcuca

SEQ ID NO: 252858 - RNA, 32 nt, Human
ugcucgguugcccagccuccugaaugaugcca

SEQ ID NO: 252859 - RNA, 32 nt, Human
ugcucgucaaugaucaguaucaacacagaaga

SEQ ID NO: 252860 - RNA, 32 nt, Human
ugcucgucacccaggcuggagugcaauugugc

SEQ ID NO: 252861 - RNA, 32 nt, Human
ugcucguccacgcaggugugugguguaaacau

SEQ ID NO: 252862 - RNA, 32 nt, Human
ugcucguccgccucggcuccagaagcuggggc

SEQ ID NO: 252863 - RNA, 32 nt, Human
ugcucgucuccaacuccugaccucagguaauc

SEQ ID NO: 252864 - RNA, 32 nt, Human
ugcucgucugcagucaggccacugccugaggg

SEQ ID NO: 252865 - RNA, 32 nt, Human
ugcucgugggcugugagcaagggaugcaaagg

SEQ ID NO: 252866 - RNA, 21 nt, Human
ugcucguugcucgcagccccg

SEQ ID NO: 252867 - RNA, 32 nt, Human
ugcucguuucuuuccuccuuuugacuaugugu

SEQ ID NO: 252868 - RNA, 32 nt, Human
ugcucuaaaaacaaaccacccagaauugauac

SEQ ID NO: 252869 - RNA, 20 nt, Human
ugcucuaauacuguacugug

SEQ ID NO: 252870 - RNA, 32 nt, Human
ugcucuaccacccaggcuggagugcaguggug

SEQ ID NO: 252871 - RNA, 32 nt, Human
ugcucuaccucucccugacauuuugcuccggg

SEQ ID NO: 252872 - RNA, 32 nt, Human
ugcucuacuacuaacaaacaggccugcugcua

SEQ ID NO: 252873 - RNA, 18 nt, Human
ugcucuagauuuucugaa

SEQ ID NO: 252874 - RNA, 32 nt, Human
ugcucuagccugggugacaaagugagacccug

SEQ ID NO: 252875 - RNA, 32 nt, Human
ugcucuagcuucagaaccacagaaccaccgcc

SEQ ID NO: 252876 - RNA, 32 nt, Human
ugcucuaggaagcagauacaguuauuaagucc

SEQ ID NO: 252877 - RNA, 21 nt, Human
ugcucuaggaguuccuggcca

SEQ ID NO: 252878 - RNA, 32 nt, Human
ugcucuagggaaaugcuugcugauugaaagga

SEQ ID NO: 252879 - RNA, 18 nt, Human
ugcucuagggucuggaua

SEQ ID NO: 252880 - RNA, 32 nt, Human
ugcucuaguccuugccacacaugcccuggggu

SEQ ID NO: 252881 - RNA, 32 nt, Human
ugcucuagugccugucaagaccacggauggcg

SEQ ID NO: 252882 - RNA, 32 nt, Human
ugcucuaucaccaggugggagugcaguggcac

SEQ ID NO: 252883 - RNA, 32 nt, Human
ugcucuaucacccaggcuggagugcaguggug

SEQ ID NO: 252884 - RNA, 32 nt, Human
ugcucuaucaccuaggcuggagugcagcggca

SEQ ID NO: 252885 - RNA, 32 nt, Human
ugcucuaucgcccaggcuggagugcaguggcg

SEQ ID NO: 252886 - RNA, 32 nt, Human
ugcucuaucuccagucugucucuguguacugg

SEQ ID NO: 252887 - RNA, 23 nt, Human
ugcucuaucuugcucuguaaucu

SEQ ID NO: 252888 - RNA, 32 nt, Human
ugcucuauggcugcuguaaugggggcagagaa

SEQ ID NO: 252889 - RNA, 22 nt, Human
ugcucuauguccuaguaacucu

SEQ ID NO: 252890 - RNA, 32 nt, Human
ugcucuauugcccaggcuggagugcaguggcu

SEQ ID NO: 252891 - RNA, 32 nt, Human
ugcucuauugcccaggcuggagugcaguggua

SEQ ID NO: 252892 - RNA, 32 nt, Human
ugcucuauuggccaggcuggaguguaguggca

SEQ ID NO: 252893 - RNA, 32 nt, Human
ugcucuauuguagcauuucuugauguugcuua

SEQ ID NO: 252894 - RNA, 32 nt, Human
ugcucucaagagcaaagguuaauuuaaggaca

SEQ ID NO: 252895 - RNA, 32 nt, Human
ugcucucaagaggcagcuagguuuuuggagcu

SEQ ID NO: 252896 - RNA, 32 nt, Human
ugcucucaccaugaccucgccuggugggcagc

SEQ ID NO: 252897 - RNA, 23 nt, Human
ugcucucaccccagggaugaaac

SEQ ID NO: 252898 - RNA, 32 nt, Human
ugcucucaccuguggguucuugcccaucaggg

SEQ ID NO: 252899 - RNA, 32 nt, Human
ugcucucagaagcaggggucacuggcgagagg

SEQ ID NO: 252900 - RNA, 32 nt, Human
ugcucucagacucugauuacugccuccccuuc

SEQ ID NO: 252901 - RNA, 32 nt, Human
ugcucucagaguucuucuguuucgugacccac

SEQ ID NO: 252902 - RNA, 32 nt, Human
ugcucucagccuguuugucgguaggcuucaga

SEQ ID NO: 252903 - RNA, 23 nt, Human
ugcucucagcuggcagugcaaug

SEQ ID NO: 252904 - RNA, 32 nt, Human
ugcucucaggaagugggucaagcccugggaac

SEQ ID NO: 252905 - RNA, 30 nt, Human
ugcucucaggccucucugcuccugucuuuu

SEQ ID NO: 252906 - RNA, 32 nt, Human
ugcucucaucucugaccagcagaauccacccg

SEQ ID NO: 252907 - RNA, 32 nt, Human
ugcucucaugggcucaccugggcccaaggcac

SEQ ID NO: 252908 - RNA, 32 nt, Human
ugcucucauuuuugucaucgucugacuugaag

SEQ ID NO: 252909 - RNA, 32 nt, Human
ugcucuccaaaccugcuugcuugcaccccucu

SEQ ID NO: 252910 - RNA, 32 nt, Human
ugcucuccagccugggaggcacagcaaacugu

SEQ ID NO: 252911 - RNA, 32 nt, Human
ugcucuccagccugggcaacagaguaaaacuc

SEQ ID NO: 252912 - RNA, 32 nt, Human
ugcucuccaucgcuaccacucuagccuguggc

SEQ ID NO: 252913 - RNA, 32 nt, Human
ugcucucccaccucuaccuccacccccaccgg

SEQ ID NO: 252914 - RNA, 32 nt, Human
ugcucucccagagggaaggucuugcuguuugg

SEQ ID NO: 252915 - RNA, 32 nt, Human
ugcucucccaggcuggagugcagugguguaau

SEQ ID NO: 252916 - RNA, 32 nt, Human
ugcucucccaugggugauggugauccagaggc

SEQ ID NO: 252917 - RNA, 32 nt, Human
ugcucuccccuccuugaagaagccgcggacac

SEQ ID NO: 252918 - RNA, 32 nt, Human
ugcucucccuccuuuccucucccuugagcuug

SEQ ID NO: 252919 - RNA, 32 nt, Human
ugcucucccugaagaccccuccagagagaaaa

SEQ ID NO: 252920 - RNA, 32 nt, Human
ugcucucccuggaaggaagaguguucucggau

SEQ ID NO: 252921 - RNA, 32 nt, Human
ugcucuccgccucuccccucgcggggccggcu

SEQ ID NO: 252922 - RNA, 32 nt, Human
ugcucuccucaaagacgcaaaacauuuuccaa

SEQ ID NO: 252923 - RNA, 32 nt, Human
ugcucuccucaaggguaucagacggucguagg

SEQ ID NO: 252924 - RNA, 32 nt, Human
ugcucuccuccagccgagggacccuggugggg

SEQ ID NO: 252925 - RNA, 32 nt, Human
ugcucuccugcacugacccuuuggaggggguc

SEQ ID NO: 252926 - RNA, 32 nt, Human
ugcucuccuuggccggggacagcuccagcagc

SEQ ID NO: 252927 - RNA, 32 nt, Human
ugcucucgagagcuccagcaggagaggcccuu

SEQ ID NO: 252928 - RNA, 32 nt, Human
ugcucucgcccaggcuggagugcagugggugg

SEQ ID NO: 252929 - RNA, 32 nt, Human
ugcucucggaacccuggcgucucuccaccagc

SEQ ID NO: 252930 - RNA, 32 nt, Human
ugcucucguggcuucacuggccacuuucucaa

SEQ ID NO: 252931 - RNA, 32 nt, Human
ugcucucuaccagauugcucagcuacuccuaa

SEQ ID NO: 252932 - RNA, 32 nt, Human
ugcucucuacccagcccaucuugccuccaugg

SEQ ID NO: 252933 - RNA, 32 nt, Human
ugcucucucaacaucacauacagcuucagcug

SEQ ID NO: 252934 - RNA, 32 nt, Human
ugcucucucacccaggcuggaguguaagugac

SEQ ID NO: 252935 - RNA, 32 nt, Human
ugcucucuccagggccagucucuguguguggg

SEQ ID NO: 252936 - RNA, 32 nt, Human
ugcucucugccuggcuccugaguccucugcca

SEQ ID NO: 252937 - RNA, 21 nt, Human
ugcucucuggagcugcccgcc

SEQ ID NO: 252938 - RNA, 32 nt, Human
ugcucucuggcaggcaggcuaggaagcucuag

SEQ ID NO: 252939 - RNA, 32 nt, Human
ugcucucuggccaagcccugggugggaggcca

SEQ ID NO: 252940 - RNA, 32 nt, Human
ugcucucugggagcccugaggaccgaguggcc

SEQ ID NO: 252941 - RNA, 32 nt, Human
ugcucucuguccgaucugugcauguuauuuuu

SEQ ID NO: 252942 - RNA, 32 nt, Human
ugcucucuuacccaagcuggagugcagugaca

SEQ ID NO: 252943 - RNA, 32 nt, Human
ugcucucuuccugguccucugcuucucuggau

SEQ ID NO: 252944 - RNA, 32 nt, Human
ugcucucuuuaaaucaaguccuuuaauuaaga

SEQ ID NO: 252945 - RNA, 32 nt, Human
ugcucugaaaguaacccagcuuguugcucuaa

SEQ ID NO: 252946 - RNA, 20 nt, Human
ugcucugaacccagggcaac

SEQ ID NO: 252947 - RNA, 32 nt, Human
ugcucugacagagaagucauggagucauugcc

SEQ ID NO: 252948 - RNA, 32 nt, Human
ugcucugacaggagucaggauucggucuguuu

SEQ ID NO: 252949 - RNA, 32 nt, Human
ugcucugaccacacuugaggagcccuucagcc

SEQ ID NO: 252950 - RNA, 32 nt, Human
ugcucugacggccucguuccccuagcaguugc

SEQ ID NO: 252951 - RNA, 19 nt, Human
ugcucugacucucugaaug

SEQ ID NO: 252952 - RNA, 32 nt, Human
ugcucugagagcagaccacucuugccuugaug

SEQ ID NO: 252953 - RNA, 32 nt, Human
ugcucugagauggggaacagaacacacaagua

SEQ ID NO: 252954 - RNA, 32 nt, Human
ugcucugagcaaccccagcucugccucacagg

SEQ ID NO: 252955 - RNA, 32 nt, Human
ugcucugagcaccuccacaccccacugccucu

SEQ ID NO: 252956 - RNA, 32 nt, Human
ugcucugagcagugaccucccuuuccuccgug

SEQ ID NO: 252957 - RNA, 32 nt, Human
ugcucugagcuucuucauauuucaccuucacc

SEQ ID NO: 252958 - RNA, 32 nt, Human
ugcucugaggggcaggaguuauccagauccca

SEQ ID NO: 252959 - RNA, 32 nt, Human
ugcucugaggguggguccaggcagacaugugg

SEQ ID NO: 252960 - RNA, 32 nt, Human
ugcucugauggggacaggcaggaaguccuucg

SEQ ID NO: 252961 - RNA, 32 nt, Human
ugcucugaugucccuccuaugaggggacucug

SEQ ID NO: 252962 - RNA, 32 nt, Human
ugcucugcaacaaguccugucugacccccaau

SEQ ID NO: 252963 - RNA, 32 nt, Human
ugcucugcacccggacacuugcucuguccccg

SEQ ID NO: 252964 - RNA, 32 nt, Human
ugcucugcagguucuucauacagcugccucug

SEQ ID NO: 252965 - RNA, 32 nt, Human
ugcucugcaucaacauggcccaugucagcccc

SEQ ID NO: 252966 - RNA, 32 nt, Human
ugcucugccacccaggcuggagugcaguggug

SEQ ID NO: 252967 - RNA, 32 nt, Human
ugcucugccacucuccugucauccaguuggcu

SEQ ID NO: 252968 - RNA, 31 nt, Human
ugcucugccauccuugucccugugucuccug

SEQ ID NO: 252969 - RNA, 32 nt, Human
ugcucugcccacuccaucaccaugaagccugg

SEQ ID NO: 252970 - RNA, 32 nt, Human
ugcucugcccagccucgcgugaccucagagag

SEQ ID NO: 252971 - RNA, 32 nt, Human
ugcucugcccaggagguggcguccagcagucc

SEQ ID NO: 252972 - RNA, 23 nt, Human
ugcucugcccccaacucccggag

SEQ ID NO: 252973 - RNA, 32 nt, Human
ugcucugccccuucugcucacugugaaggccg

SEQ ID NO: 252974 - RNA, 32 nt, Human
ugcucugccugggagggguggcuguaucccug

SEQ ID NO: 252975 - RNA, 32 nt, Human
ugcucugccugggauaaacacauuucaagagu

SEQ ID NO: 252976 - RNA, 32 nt, Human
ugcucugccuuuuagcuucuaaaaggaaagau

SEQ ID NO: 252977 - RNA, 32 nt, Human
ugcucugcgcccaggauggagugcaguggcau

SEQ ID NO: 252978 - RNA, 19 nt, Human
ugcucugcgggacaguccc

SEQ ID NO: 252979 - RNA, 32 nt, Human
ugcucugcuacuugagaugauggagagcaggu

SEQ ID NO: 252980 - RNA, 25 nt, Human
ugcucugcugcacccaccagccccg

SEQ ID NO: 252981 - RNA, 22 nt, Human
ugcucugcugccugcccggggu

SEQ ID NO: 252982 - RNA, 20 nt, Human
ugcucugcuggagugcggug

SEQ ID NO: 252983 - RNA, 32 nt, Human
ugcucugcugggucagcaucuccagccaccug

SEQ ID NO: 252984 - RNA, 32 nt, Human
ugcucugcuuguagacuggccaguguccauga

SEQ ID NO: 252985 - RNA, 32 nt, Human
ugcucuggagagguagggccagaggaaugcug

SEQ ID NO: 252986 - RNA, 32 nt, Human
ugcucuggaggaaguucuccagcuucagcuca

SEQ ID NO: 252987 - RNA, 19 nt, Human
ugcucuggaggcaggcugg

SEQ ID NO: 252988 - RNA, 32 nt, Human
ugcucuggaggcaggcugggcgguggcggccg

SEQ ID NO: 252989 - RNA, 32 nt, Human
ugcucuggagugggggagguugguggaccaug

SEQ ID NO: 252990 - RNA, 20 nt, Human
ugcucuggauuucuagcaca

SEQ ID NO: 252991 - RNA, 31 nt, Human
ugcucuggccucucugguucuguucuuggcc

SEQ ID NO: 252992 - RNA, 21 nt, Human
ugcucuggccugccuagcaca

SEQ ID NO: 252993 - RNA, 32 nt, Human
ugcucuggcgcccaggcuggaguacaguggca

SEQ ID NO: 252994 - RNA, 32 nt, Human
ugcucuggcggugguuguccaggcucugcaga

SEQ ID NO: 252995 - RNA, 32 nt, Human
ugcucugggauccuccugccucagcugggcuu

SEQ ID NO: 252996 - RNA, 32 nt, Human
ugcucugggaucugcuuuuccacaugugugua

SEQ ID NO: 252997 - RNA, 32 nt, Human
ugcucugggaucugguggauagaugccaagga

SEQ ID NO: 252998 - RNA, 32 nt, Human
ugcucugggcuucucuccuguuuuccccaaua

SEQ ID NO: 252999 - RNA, 32 nt, Human
ugcucuggggacucucgccggggaagaugggg

SEQ ID NO: 253000 - RNA, 32 nt, Human
ugcucuggggcccaugugcaagugaccugugc

SEQ ID NO: 253001 - RNA, 23 nt, Human
ugcucuggggccucgcagccccg

SEQ ID NO: 253002 - RNA, 21 nt, Human
ugcucugggguccuugacaca

SEQ ID NO: 253003 - RNA, 32 nt, Human
ugcucugguaugacagacuaucagagguucca

SEQ ID NO: 253004 - RNA, 32 nt, Human
ugcucugguccaccccguccugacccccucug

SEQ ID NO: 253005 - RNA, 32 nt, Human
ugcucugguggaggugggcauggggucuguuc

SEQ ID NO: 253006 - RNA, 32 nt, Human
ugcucugguggaguugggaagggauaggaccu

SEQ ID NO: 253007 - RNA, 32 nt, Human
ugcucugguucauuggaacagaaagaaaugga

SEQ ID NO: 253008 - RNA, 32 nt, Human
ugcucuguagggcugaaggccgcccgagguuc

SEQ ID NO: 253009 - RNA, 32 nt, Human
ugcucuguagucaugcagaucccagcuuuacc

SEQ ID NO: 253010 - RNA, 32 nt, Human
ugcucugucaccaaggcuggagugcagcggug

SEQ ID NO: 253011 - RNA, 32 nt, Human
ugcucugucaccaggccggagugcaguggugu

SEQ ID NO: 253012 - RNA, 32 nt, Human
ugcucugucaccaggcuggagggcaguggcgc

SEQ ID NO: 253013 - RNA, 32 nt, Human
ugcucugucaccaggcuggagugcagcggcgc

SEQ ID NO: 253014 - RNA, 32 nt, Human
ugcucugucaccaggcuggagugcaguggagg

SEQ ID NO: 253015 - RNA, 32 nt, Human
ugcucugucaccaggcuggagugcaguggcau

SEQ ID NO: 253016 - RNA, 32 nt, Human
ugcucugucaccaggcuggagugcgguggcau

SEQ ID NO: 253017 - RNA, 32 nt, Human
ugcucugucacccaagcuggagugcaguggca

SEQ ID NO: 253018 - RNA, 32 nt, Human
ugcucugucacccagacuggagugcaguggca

SEQ ID NO: 253019 - RNA, 32 nt, Human
ugcucugucacccagacuggagugcaguggug

SEQ ID NO: 253020 - RNA, 32 nt, Human
ugcucugucacccaggcuagagugcaauggca

SEQ ID NO: 253021 - RNA, 32 nt, Human
ugcucugucacccaggcuagagugcaguagca

SEQ ID NO: 253022 - RNA, 32 nt, Human
ugcucugucacccaggcuggaaugcagugcag

SEQ ID NO: 253023 - RNA, 32 nt, Human
ugcucugucacccaggcuggaaugcaguggca

SEQ ID NO: 253024 - RNA, 32 nt, Human
ugcucugucacccaggcuggagcguaauggca

SEQ ID NO: 253025 - RNA, 32 nt, Human
ugcucugucacccaggcuggaguacacuggca

SEQ ID NO: 253026 - RNA, 32 nt, Human
ugcucugucacccaggcuggaguacaguggcg

SEQ ID NO: 253027 - RNA, 32 nt, Human
ugcucugucacccaggcuggagugcaaugacg

SEQ ID NO: 253028 - RNA, 32 nt, Human
ugcucugucacccaggcuggagugcaaugggc

SEQ ID NO: 253029 - RNA, 32 nt, Human
ugcucugucacccaggcuggagugcaauggug

SEQ ID NO: 253030 - RNA, 32 nt, Human
ugcucugucacccaggcuggagugcaguagca

SEQ ID NO: 253031 - RNA, 32 nt, Human
ugcucugucacccaggcuggagugcagugaca

SEQ ID NO: 253032 - RNA, 32 nt, Human
ugcucugucacccaggcuggagugcagugcug

SEQ ID NO: 253033 - RNA, 32 nt, Human
ugcucugucacccaggcuggagugcaguggca

SEQ ID NO: 253034 - RNA, 32 nt, Human
ugcucugucacccaggcuggagugcaguggcg

SEQ ID NO: 253035 - RNA, 32 nt, Human
ugcucugucacccaggcuggagugcaguggua

SEQ ID NO: 253036 - RNA, 32 nt, Human
ugcucugucacccaggcuggagugcaguggug

SEQ ID NO: 253037 - RNA, 32 nt, Human
ugcucugucacccaggcuggagugccauggca

SEQ ID NO: 253038 - RNA, 32 nt, Human
ugcucugucacccaggcuggagugccguggca

SEQ ID NO: 253039 - RNA, 32 nt, Human
ugcucugucacccaggcuggagugcgauggcg

SEQ ID NO: 253040 - RNA, 32 nt, Human
ugcucugucacccaggcuggagugcgguggcg

SEQ ID NO: 253041 - RNA, 32 nt, Human
ugcucugucacccaggcuggagugcuauggcu

SEQ ID NO: 253042 - RNA, 32 nt, Human
ugcucugucacccaggcuggagugcuguggug

SEQ ID NO: 253043 - RNA, 32 nt, Human
ugcucugucacccaggcuggggcgcaauggca

SEQ ID NO: 253044 - RNA, 32 nt, Human
ugcucugucacccaggcugucguaaguggcaa

SEQ ID NO: 253045 - RNA, 32 nt, Human
ugcucugucacccaggcuugagugcaguggug

SEQ ID NO: 253046 - RNA, 32 nt, Human
ugcucugucacccagguuggagugcaguggug

SEQ ID NO: 253047 - RNA, 32 nt, Human
ugcucugucacccagguuggagugcauuggug

SEQ ID NO: 253048 - RNA, 32 nt, Human
ugcucugucacccagguuggagugccauggca

SEQ ID NO: 253049 - RNA, 32 nt, Human
ugcucugucacccagucuggagugcaguggca

SEQ ID NO: 253050 - RNA, 32 nt, Human
ugcucugucacccaguuuggagugcaguggug

SEQ ID NO: 253051 - RNA, 32 nt, Human
ugcucugucacccauccuggagugcaguagug

SEQ ID NO: 253052 - RNA, 32 nt, Human
ugcucugucacccgggcuggagugcaguggcg

SEQ ID NO: 253053 - RNA, 32 nt, Human
ugcucugucacccgggcuggagugcaguggug

SEQ ID NO: 253054 - RNA, 32 nt, Human
ugcucugucacccgggcuggagugcuguggcu

SEQ ID NO: 253055 - RNA, 32 nt, Human
ugcucugucaccuaggcuggagugcaguggca

SEQ ID NO: 253056 - RNA, 32 nt, Human
ugcucugucaccuaggcuggagugcagugggg

SEQ ID NO: 253057 - RNA, 32 nt, Human
ugcucugucacucaggcuggaaugcaguggcg

SEQ ID NO: 253058 - RNA, 32 nt, Human
ugcucugucacucaggcuggaguacaguggca

SEQ ID NO: 253059 - RNA, 32 nt, Human
ugcucugucacucaugcuggagugcaguggcg

SEQ ID NO: 253060 - RNA, 32 nt, Human
ugcucugucacugaggcuggagugcaguggcg

SEQ ID NO: 253061 - RNA, 32 nt, Human
ugcucugucacuuggguuggagugcaguugca

SEQ ID NO: 253062 - RNA, 32 nt, Human
ugcucugucaucaggcuggagugcaguggcgc

SEQ ID NO: 253063 - RNA, 32 nt, Human
ugcucugucaucaggcuggagugcaguggcuc

SEQ ID NO: 253064 - RNA, 32 nt, Human
ugcucugucauccaaacuggagugcaguggca

SEQ ID NO: 253065 - RNA, 32 nt, Human
ugcucugucauccaggcuggaggguaguggcg

SEQ ID NO: 253066 - RNA, 32 nt, Human
ugcucugucauccaggcuggagugcagugaug

SEQ ID NO: 253067 - RNA, 32 nt, Human
ugcucugucauccagguuggagugcaguggca

SEQ ID NO: 253068 - RNA, 18 nt, Human
ugcucugucaucucccua

SEQ ID NO: 253069 - RNA, 32 nt, Human
ugcucugucaugcaggcuggagugcgguggug

SEQ ID NO: 253070 - RNA, 32 nt, Human
ugcucugucauucaggcuggagugcaguggug

SEQ ID NO: 253071 - RNA, 23 nt, Human
ugcucuguccacuggccacacuc

SEQ ID NO: 253072 - RNA, 26 nt, Human
ugcucuguccagcuuuccccagggug

SEQ ID NO: 253073 - RNA, 32 nt, Human
ugcucuguccagggaggagcugccucagaacu

SEQ ID NO: 253074 - RNA, 28 nt, Human
ugcucuguccccacacguuccucacaua

SEQ ID NO: 253075 - RNA, 32 nt, Human
ugcucugucccccaggcuggagugcaguggca

SEQ ID NO: 253076 - RNA, 32 nt, Human
ugcucugucccccaugcuggagugcaguggca

SEQ ID NO: 253077 - RNA, 32 nt, Human
ugcucugucccucaggcuggagugcaguagcg

SEQ ID NO: 253078 - RNA, 32 nt, Human
ugcucugucgaccaggcuggagugcaggggca

SEQ ID NO: 253079 - RNA, 32 nt, Human
ugcucugucgccaagccagagugcaguggugu

SEQ ID NO: 253080 - RNA, 32 nt, Human
ugcucugucgccaaggcuggagggcaauggca

SEQ ID NO: 253081 - RNA, 32 nt, Human
ugcucugucgccaaguuggagcuugcagugag

SEQ ID NO: 253082 - RNA, 32 nt, Human
ugcucugucgccaaguuggagugcaauggugc

SEQ ID NO: 253083 - RNA, 32 nt, Human
ugcucugucgccagacuggagugcaguggcgc

SEQ ID NO: 253084 - RNA, 32 nt, Human
ugcucugucgccaggcuggagugcaauggcgu

SEQ ID NO: 253085 - RNA, 32 nt, Human
ugcucugucgccaggcuggagugcaguggcgc

SEQ ID NO: 253086 - RNA, 32 nt, Human
ugcucugucgcccacguuggagugcagugaug

SEQ ID NO: 253087 - RNA, 32 nt, Human
ugcucugucgcccagacuggagugcaauggug

SEQ ID NO: 253088 - RNA, 32 nt, Human
ugcucugucgcccaggauggagugcaguggcg

SEQ ID NO: 253089 - RNA, 32 nt, Human
ugcucugucgcccaggcuagagugcaguggua

SEQ ID NO: 253090 - RNA, 32 nt, Human
ugcucugucgcccaggcucgagugcaguggca

SEQ ID NO: 253091 - RNA, 32 nt, Human
ugcucugucgcccaggcugcagugcgguggug

SEQ ID NO: 253092 - RNA, 32 nt, Human
ugcucugucgcccaggcuggaaugcaguggcg

SEQ ID NO: 253093 - RNA, 32 nt, Human
ugcucugucgcccaggcuggaaugcaguggug

SEQ ID NO: 253094 - RNA, 32 nt, Human
ugcucugucgcccaggcuggaguacaguggug

SEQ ID NO: 253095 - RNA, 32 nt, Human
ugcucugucgcccaggcuggagugcagaggug

SEQ ID NO: 253096 - RNA, 32 nt, Human
ugcucugucgcccaggcuggagugcagucgug

SEQ ID NO: 253097 - RNA, 32 nt, Human
ugcucugucgcccaggcuggagugcagugaug

SEQ ID NO: 253098 - RNA, 32 nt, Human
ugcucugucgcccaggcuggagugcaguggca

SEQ ID NO: 253099 - RNA, 32 nt, Human
ugcucugucgcccaggcuggagugcaguggcc

SEQ ID NO: 253100 - RNA, 32 nt, Human
ugcucugucgcccaggcuggagugcaguggcg

SEQ ID NO: 253101 - RNA, 32 nt, Human
ugcucugucgcccaggcuggagugcaguggua

SEQ ID NO: 253102 - RNA, 32 nt, Human
ugcucugucgcccaggcuggagugcaguggug

SEQ ID NO: 253103 - RNA, 32 nt, Human
ugcucugucgcccaggcuggaguucaguggcg

SEQ ID NO: 253104 - RNA, 32 nt, Human
ugcucugucgcccaggcuguagugcaauggcg

SEQ ID NO: 253105 - RNA, 32 nt, Human
ugcucugucgcccagguuggagugcaguggca

SEQ ID NO: 253106 - RNA, 32 nt, Human
ugcucugucgcccagguuggagugcaguggcg

SEQ ID NO: 253107 - RNA, 32 nt, Human
ugcucugucgcccaugcuggagugcaguggcg

SEQ ID NO: 253108 - RNA, 32 nt, Human
ugcucugucgcgcaggguggagugcgguggca

SEQ ID NO: 253109 - RNA, 32 nt, Human
ugcucugucgcucaggcuggagagcgguggug

SEQ ID NO: 253110 - RNA, 32 nt, Human
ugcucugucgcucaggcuggagugcaguggcg

SEQ ID NO: 253111 - RNA, 32 nt, Human
ugcucugucgcucgcgcuggagugcaguggca

SEQ ID NO: 253112 - RNA, 32 nt, Human
ugcucugucgucgaggcuggaguguaguggug

SEQ ID NO: 253113 - RNA, 32 nt, Human
ugcucugucuccaggcuggaguacaguggugc

SEQ ID NO: 253114 - RNA, 32 nt, Human
ugcucugucucccaggcuagagugcaauggca

SEQ ID NO: 253115 - RNA, 32 nt, Human
ugcucugucucccaggcuggagcguaguaaug

SEQ ID NO: 253116 - RNA, 32 nt, Human
ugcucugucucccaggcuggaggucaguggca

SEQ ID NO: 253117 - RNA, 32 nt, Human
ugcucugucucccaggcuggagugcaggcuug

SEQ ID NO: 253118 - RNA, 32 nt, Human
ugcucugucucccaggcuggagugcagugaca

SEQ ID NO: 253119 - RNA, 32 nt, Human
ugcucugucucccaggcuggagugcaguggca

SEQ ID NO: 253120 - RNA, 32 nt, Human
ugcucugucucccaggcuggagugcuauggug

SEQ ID NO: 253121 - RNA, 32 nt, Human
ugcucugucuccccuguuucugaggggccuug

SEQ ID NO: 253122 - RNA, 32 nt, Human
ugcucugucucccgggcuggagugcaguggcg

SEQ ID NO: 253123 - RNA, 32 nt, Human
ugcucugucuccuaggcuggagcgcaguggug

SEQ ID NO: 253124 - RNA, 32 nt, Human
ugcucugucuccucccaccaguccaguuagcu

SEQ ID NO: 253125 - RNA, 23 nt, Human
ugcucugucucguucuuuacaca

SEQ ID NO: 253126 - RNA, 32 nt, Human
ugcucugucugucacccaggcuggaguacagu

SEQ ID NO: 253127 - RNA, 32 nt, Human
ugcucugugaccugaggguauuggacaauuug

SEQ ID NO: 253128 - RNA, 32 nt, Human
ugcucugugagacuagagacuguguccacgga

SEQ ID NO: 253129 - RNA, 27 nt, Human
ugcucugugagaggcauucacuaguau

SEQ ID NO: 253130 - RNA, 24 nt, Human
ugcucugugagccccacagcccug

SEQ ID NO: 253131 - RNA, 32 nt, Human
ugcucugugauacccaauaacuccuucaccua

SEQ ID NO: 253132 - RNA, 23 nt, Human
ugcucugugcauuuuuugagaca

SEQ ID NO: 253133 - RNA, 32 nt, Human
ugcucugugcccacccuccacucuccucuucc

SEQ ID NO: 253134 - RNA, 32 nt, Human
ugcucugugcuagacagaugugcggagggacu

SEQ ID NO: 253135 - RNA, 32 nt, Human
ugcucugugcucagcugcaaccacagccucgu

SEQ ID NO: 253136 - RNA, 32 nt, Human
ugcucugugcuccccacuccauuucucugucc

SEQ ID NO: 253137 - RNA, 32 nt, Human
ugcucuguggcccaggcuggagugcaguggca

SEQ ID NO: 253138 - RNA, 32 nt, Human
ugcucuguggcccaggcuggaguguaguggcg

SEQ ID NO: 253139 - RNA, 24 nt, Human
ugcucuguggcuuuucccaacaca

SEQ ID NO: 253140 - RNA, 32 nt, Human
ugcucugugguguuggacaucccuggaaaccu

SEQ ID NO: 253141 - RNA, 18 nt, Human
ugcucuguguacacugug

SEQ ID NO: 253142 - RNA, 32 nt, Human
ugcucuguguccucccugugguggggcucccu

SEQ ID NO: 253143 - RNA, 32 nt, Human
ugcucuguguuugggccucucuugcugucauu

SEQ ID NO: 253144 - RNA, 32 nt, Human
ugcucuguuacccaggcuggagugcagugggu

SEQ ID NO: 253145 - RNA, 32 nt, Human
ugcucuguuacccaggcuggagugcaguggug

SEQ ID NO: 253146 - RNA, 32 nt, Human
ugcucuguuacccaggcuggaguguaguggug

SEQ ID NO: 253147 - RNA, 32 nt, Human
ugcucuguuacccaugcuggaguacgguggcg

SEQ ID NO: 253148 - RNA, 22 nt, Human
ugcucuguuacuacuuugacca

SEQ ID NO: 253149 - RNA, 32 nt, Human
ugcucuguuauccaggcuggugugcagugaua

SEQ ID NO: 253150 - RNA, 32 nt, Human
ugcucuguucauuuucuguuguuuuucugcac

SEQ ID NO: 253151 - RNA, 20 nt, Human
ugcucuguuccauuuuaaca

SEQ ID NO: 253152 - RNA, 32 nt, Human
ugcucuguuccucagguggggcccagagcccu

SEQ ID NO: 253153 - RNA, 31 nt, Human
ugcucuguucucaaggauuguugagauggag

SEQ ID NO: 253154 - RNA, 32 nt, Human
ugcucuguugccaaguuaagugcagugguaug

SEQ ID NO: 253155 - RNA, 32 nt, Human
ugcucuguugccacugcacucuggccugggca

SEQ ID NO: 253156 - RNA, 32 nt, Human
ugcucuguugcccacauuggagugcaguggca

SEQ ID NO: 253157 - RNA, 32 nt, Human
ugcucuguugcccacgcaggagugcaguggca

SEQ ID NO: 253158 - RNA, 32 nt, Human
ugcucuguugcccagacuggagugcaguggcg

SEQ ID NO: 253159 - RNA, 32 nt, Human
ugcucuguugcccagcuggagugcaguggugu

SEQ ID NO: 253160 - RNA, 32 nt, Human
ugcucuguugcccaggcuagagugcaguggca

SEQ ID NO: 253161 - RNA, 32 nt, Human
ugcucuguugcccaggcuagagugcaguggug

SEQ ID NO: 253162 - RNA, 32 nt, Human
ugcucuguugcccaggcuccagugcaguggug

SEQ ID NO: 253163 - RNA, 32 nt, Human
ugcucuguugcccaggcuggaaugcaguggca

SEQ ID NO: 253164 - RNA, 32 nt, Human
ugcucuguugcccaggcuggaaugcaguggcg

SEQ ID NO: 253165 - RNA, 32 nt, Human
ugcucuguugcccaggcuggaguacagugguc

SEQ ID NO: 253166 - RNA, 32 nt, Human
ugcucuguugcccaggcuggaguacauuggug

SEQ ID NO: 253167 - RNA, 32 nt, Human
ugcucuguugcccaggcuggaguacauuugcc

SEQ ID NO: 253168 - RNA, 32 nt, Human
ugcucuguugcccaggcuggaguccaguggca

SEQ ID NO: 253169 - RNA, 32 nt, Human
ugcucuguugcccaggcuggagugcaauggca

SEQ ID NO: 253170 - RNA, 32 nt, Human
ugcucuguugcccaggcuggagugcacuggcu

SEQ ID NO: 253171 - RNA, 32 nt, Human
ugcucuguugcccaggcuggagugcagcggca

SEQ ID NO: 253172 - RNA, 32 nt, Human
ugcucuguugcccaggcuggagugcagggaca

SEQ ID NO: 253173 - RNA, 32 nt, Human
ugcucuguugcccaggcuggagugcaguagca

SEQ ID NO: 253174 - RNA, 32 nt, Human
ugcucuguugcccaggcuggagugcagucgca

SEQ ID NO: 253175 - RNA, 32 nt, Human
ugcucuguugcccaggcuggagugcagugacg

SEQ ID NO: 253176 - RNA, 32 nt, Human
ugcucuguugcccaggcuggagugcaguggca

SEQ ID NO: 253177 - RNA, 32 nt, Human
ugcucuguugcccaggcuggagugcaguggcg

SEQ ID NO: 253178 - RNA, 32 nt, Human
ugcucuguugcccaggcuggagugcaguggua

SEQ ID NO: 253179 - RNA, 32 nt, Human
ugcucuguugcccaggcuggagugcaguggug

SEQ ID NO: 253180 - RNA, 32 nt, Human
ugcucuguugcccaggcuggagugcgguggac

SEQ ID NO: 253181 - RNA, 32 nt, Human
ugcucuguugcccaggcuggaguguagagaca

SEQ ID NO: 253182 - RNA, 32 nt, Human
ugcucuguugcccaggcuggaguguaguggua

SEQ ID NO: 253183 - RNA, 32 nt, Human
ugcucuguugcccaggcuggaguguaguggug

SEQ ID NO: 253184 - RNA, 32 nt, Human
ugcucuguugcccaggcugggugcagcggugc

SEQ ID NO: 253185 - RNA, 32 nt, Human
ugcucuguugcccaggcugguguguagugauc

SEQ ID NO: 253186 - RNA, 32 nt, Human
ugcucuguugcccagguuggagugcaguggca

SEQ ID NO: 253187 - RNA, 32 nt, Human
ugcucuguugcccaugcuggagugcauuggca

SEQ ID NO: 253188 - RNA, 32 nt, Human
ugcucuguugcccgggcuggaguacaauggca

SEQ ID NO: 253189 - RNA, 32 nt, Human
ugcucuguugcccgggcuggagugcaguggug

SEQ ID NO: 253190 - RNA, 32 nt, Human
ugcucuguugccuaggcuggagugcaguggcg

SEQ ID NO: 253191 - RNA, 32 nt, Human
ugcucuguugccugggcuggagaacaguggca

SEQ ID NO: 253192 - RNA, 32 nt, Human
ugcucuguugccugggcuggagugcagugcca

SEQ ID NO: 253193 - RNA, 32 nt, Human
ugcucuguugcugaggcuggagugcagugaug

SEQ ID NO: 253194 - RNA, 32 nt, Human
ugcucuguuggccaggcuggaaugcaguggca

SEQ ID NO: 253195 - RNA, 32 nt, Human
ugcucuguuguccaggcuggagggcagugaca

SEQ ID NO: 253196 - RNA, 32 nt, Human
ugcucuguuguccaggcuggagugcaguggca

SEQ ID NO: 253197 - RNA, 25 nt, Human
ugcucuguuuacuuauuucugcaua

SEQ ID NO: 253198 - RNA, 20 nt, Human
ugcucuguuugcuugauaca

SEQ ID NO: 253199 - RNA, 22 nt, Human
ugcucuguuuguccuuuauaca

SEQ ID NO: 253200 - RNA, 18 nt, Human
ugcucuguuuuuaccaca

SEQ ID NO: 253201 - RNA, 22 nt, Human
ugcucuguuuuuuccuaaaaua

SEQ ID NO: 253202 - RNA, 32 nt, Human
ugcucuuacccaggcugagugcaguggcagaa

SEQ ID NO: 253203 - RNA, 32 nt, Human
ugcucuuagggagggcaaagguucgggggcag

SEQ ID NO: 253204 - RNA, 32 nt, Human
ugcucuuaguacugagggaugaaaguuccaga

SEQ ID NO: 253205 - RNA, 18 nt, Human
ugcucuucacucucccca

SEQ ID NO: 253206 - RNA, 32 nt, Human
ugcucuucagguagaaagcccugguugaacaa

SEQ ID NO: 253207 - RNA, 32 nt, Human
ugcucuucaguuccucacugccuucuugggau

SEQ ID NO: 253208 - RNA, 32 nt, Human
ugcucuucauagacacaucuugcagcauuuuu

SEQ ID NO: 253209 - RNA, 32 nt, Human
ugcucuucaucccauuccaggcagccucuguc

SEQ ID NO: 253210 - RNA, 32 nt, Human
ugcucuuccauggcuaacggggcagaacuguu

SEQ ID NO: 253211 - RNA, 32 nt, Human
ugcucuucccacggggcagacagcaggacaca

SEQ ID NO: 253212 - RNA, 32 nt, Human
ugcucuucccuugcuguuauucauacacacuu

SEQ ID NO: 253213 - RNA, 32 nt, Human
ugcucuuccucccucacucugccuuccgagcu

SEQ ID NO: 253214 - RNA, 32 nt, Human
ugcucuuccuucaccucuagucacuuucuauu

SEQ ID NO: 253215 - RNA, 32 nt, Human
ugcucuuccuucaucaaccaccuuccccaagc

SEQ ID NO: 253216 - RNA, 32 nt, Human
ugcucuuccuucaugauccuaacauucugcua

SEQ ID NO: 253217 - RNA, 32 nt, Human
ugcucuucuaucuccacaacgugagccuggaa

SEQ ID NO: 253218 - RNA, 32 nt, Human
ugcucuucucaccucucccuuaccccguuccc

SEQ ID NO: 253219 - RNA, 21 nt, Human
ugcucuucucccagcuggaug

SEQ ID NO: 253220 - RNA, 20 nt, Human
ugcucuucuccguccccagg

SEQ ID NO: 253221 - RNA, 32 nt, Human
ugcucuucucuaauggacaaacaaacaggcuc

SEQ ID NO: 253222 - RNA, 32 nt, Human
ugcucuucucucuaucuaugcuuaaugccuuu

SEQ ID NO: 253223 - RNA, 32 nt, Human
ugcucuucugaugaguuggagaggaggcagcc

SEQ ID NO: 253224 - RNA, 32 nt, Human
ugcucuucugcagccucaucucugccauucuu

SEQ ID NO: 253225 - RNA, 32 nt, Human
ugcucuucugcagucaggccacugccuggggg

SEQ ID NO: 253226 - RNA, 32 nt, Human
ugcucuucugcagucaggucacugccuacugc

SEQ ID NO: 253227 - RNA, 21 nt, Human
ugcucuucugugcccagggug

SEQ ID NO: 253228 - RNA, 32 nt, Human
ugcucuugacaucacuguacucccucucccuc

SEQ ID NO: 253229 - RNA, 32 nt, Human
ugcucuugauuccuugugucuccagucaugac

SEQ ID NO: 253230 - RNA, 32 nt, Human
ugcucuugcccaggcaggaguacaguagugca

SEQ ID NO: 253231 - RNA, 32 nt, Human
ugcucuugccgccccuuccuggguacagagcu

SEQ ID NO: 253232 - RNA, 22 nt, Human
ugcucuugcucucaaggggcug

SEQ ID NO: 253233 - RNA, 32 nt, Human
ugcucuugcuguagagagcagcugcuucugcc

SEQ ID NO: 253234 - RNA, 31 nt, Human
ugcucuuggguggaggagacgaggggagggc

SEQ ID NO: 253235 - RNA, 32 nt, Human
ugcucuuggugaggagagcaagaggaaccaaa

SEQ ID NO: 253236 - RNA, 32 nt, Human
ugcucuugguuuuucugccuucugauuucuuu

SEQ ID NO: 253237 - RNA, 22 nt, Human
ugcucuuguaagaaguuagcug

SEQ ID NO: 253238 - RNA, 32 nt, Human
ugcucuugucgccuccugacccauucuuuuua

SEQ ID NO: 253239 - RNA, 32 nt, Human
ugcucuuuacuuucuuuacuugcugauuccuu

SEQ ID NO: 253240 - RNA, 32 nt, Human
ugcucuuuagcagccaaacaggagcaaaaugu

SEQ ID NO: 253241 - RNA, 32 nt, Human
ugcucuuuaugaccugcuuggcugccacugug

SEQ ID NO: 253242 - RNA, 32 nt, Human
ugcucuuucaaugcagcacccuugccauccca

SEQ ID NO: 253243 - RNA, 32 nt, Human
ugcucuuucugguacuggaggguggguaccuu

SEQ ID NO: 253244 - RNA, 32 nt, Human
ugcucuuugcaaucccuaagcccucugguccu

SEQ ID NO: 253245 - RNA, 32 nt, Human
ugcucuuuggcaccaggcaggagaugcugcag

SEQ ID NO: 253246 - RNA, 32 nt, Human
ugcucuuuguugcccaggcuggagugcagugg

SEQ ID NO: 253247 - RNA, 20 nt, Human
ugcugaaaaaagugugguca

SEQ ID NO: 253248 - RNA, 32 nt, Human
ugcugaaaaccuuugaaccucacgguguccug

SEQ ID NO: 253249 - RNA, 32 nt, Human
ugcugaaaacucgaauuacacacuucaguugg

SEQ ID NO: 253250 - RNA, 20 nt, Human
ugcugaaaaguggcucagau

SEQ ID NO: 253251 - RNA, 32 nt, Human
ugcugaaaaguggcucagaugcagaguguucu

SEQ ID NO: 253252 - RNA, 19 nt, Human
ugcugaaacguacuguggu

SEQ ID NO: 253253 - RNA, 20 nt, Human
ugcugaaacguacugugguc

SEQ ID NO: 253254 - RNA, 32 nt, Human
ugcugaaacuuguuccaccucaguccccucau

SEQ ID NO: 253255 - RNA, 32 nt, Human
ugcugaacaucauagccgaucuugccuucaga

SEQ ID NO: 253256 - RNA, 32 nt, Human
ugcugaacaucccugucuagugcacaggacag

SEQ ID NO: 253257 - RNA, 32 nt, Human
ugcugaacaucuaaaaggagagagggcccggu

SEQ ID NO: 253258 - RNA, 31 nt, Human
ugcugaacgauggcgaacacagcagaauggg

SEQ ID NO: 253259 - RNA, 21 nt, Human
ugcugaacggcggcagcggug

SEQ ID NO: 253260 - RNA, 32 nt, Human
ugcugaacugccacuccuccauccuccauggc

SEQ ID NO: 253261 - RNA, 21 nt, Human
ugcugaacuuggcugugacca

SEQ ID NO: 253262 - RNA, 32 nt, Human
ugcugaagaugccuagcguggcccaguuugug

SEQ ID NO: 253263 - RNA, 32 nt, Human
ugcugaagaugccuugaggugaaaugggggca

SEQ ID NO: 253264 - RNA, 32 nt, Human
ugcugaagcaagaaaccgacagauguugagga

SEQ ID NO: 253265 - RNA, 32 nt, Human
ugcugaagccccuagcacacacugcaugccuu

SEQ ID NO: 253266 - RNA, 32 nt, Human
ugcugaaggaacagguugcagcuaccuggugc

SEQ ID NO: 253267 - RNA, 32 nt, Human
ugcugaaggaggagaggauagugaagaagauu

SEQ ID NO: 253268 - RNA, 21 nt, Human
ugcugaaggagguggcugugg

SEQ ID NO: 253269 - RNA, 32 nt, Human
ugcugaaggcuccagccagcuguccuggguuu

SEQ ID NO: 253270 - RNA, 32 nt, Human
ugcugaaggcuggaguggguguggcaauuccu

SEQ ID NO: 253271 - RNA, 32 nt, Human
ugcugaagggaagagagguugcagcugagcaa

SEQ ID NO: 253272 - RNA, 32 nt, Human
ugcugaaggggacccucaugcuggaugguugg

SEQ ID NO: 253273 - RNA, 32 nt, Human
ugcugaaguaugucagcaccuuuucucacccu

SEQ ID NO: 253274 - RNA, 31 nt, Human
ugcugaagugagaggaagagucugaguuguc

SEQ ID NO: 253275 - RNA, 32 nt, Human
ugcugaagugauaucuggucucagggauugcu

SEQ ID NO: 253276 - RNA, 32 nt, Human
ugcugaagugauuuccagaaggacucauuuga

SEQ ID NO: 253277 - RNA, 32 nt, Human
ugcugaaguggggccuuccugauucuggggac

SEQ ID NO: 253278 - RNA, 32 nt, Human
ugcugaagugugucugugggaggcaggagaug

SEQ ID NO: 253279 - RNA, 19 nt, Human
ugcugaaguuucccuuaga

SEQ ID NO: 253280 - RNA, 22 nt, Human
ugcugaauacaaacagaugcag

SEQ ID NO: 253281 - RNA, 32 nt, Human
ugcugaauaggcaguaguugggagagagccuc

SEQ ID NO: 253282 - RNA, 24 nt, Human
ugcugaauaugggaagcaggggug

SEQ ID NO: 253283 - RNA, 20 nt, Human
ugcugaaucacuguugcuga

SEQ ID NO: 253284 - RNA, 32 nt, Human
ugcugaaucuucccuguugccuagaagggcuc

SEQ ID NO: 253285 - RNA, 32 nt, Human
ugcugaaucuuucugauccugcgguuucuccu

SEQ ID NO: 253286 - RNA, 32 nt, Human
ugcugaaugccaccucugggccucugcuccug

SEQ ID NO: 253287 - RNA, 22 nt, Human
ugcugaauuauauccuuuauua

SEQ ID NO: 253288 - RNA, 32 nt, Human
ugcugaauucuuuugaacgaugaucuuaaagg

SEQ ID NO: 253289 - RNA, 32 nt, Human
ugcugaauuggcuucuuuucuuuugaacuuaa

SEQ ID NO: 253290 - RNA, 32 nt, Human
ugcugacaaauacauaacauaguccgggacga

SEQ ID NO: 253291 - RNA, 32 nt, Human
ugcugacaaauagaggaugugggacccugacu

SEQ ID NO: 253292 - RNA, 32 nt, Human
ugcugacaccaucacaguauguucccuucuca

SEQ ID NO: 253293 - RNA, 32 nt, Human
ugcugacagccauagaccuuccugggcuucuc

SEQ ID NO: 253294 - RNA, 32 nt, Human
ugcugacagcucuucacaguccuggacuccug

SEQ ID NO: 253295 - RNA, 32 nt, Human
ugcugacagcugaaauaggcucugccuaccag

SEQ ID NO: 253296 - RNA, 32 nt, Human
ugcugacagcugccaagaaaaugcuucacuca

SEQ ID NO: 253297 - RNA, 32 nt, Human
ugcugacaggagacccagagagcuagggcugg

SEQ ID NO: 253298 - RNA, 32 nt, Human
ugcugacaggcagaagcugagguccucaguca

SEQ ID NO: 253299 - RNA, 32 nt, Human
ugcugacaggguccccagggagaccgugucag

SEQ ID NO: 253300 - RNA, 32 nt, Human
ugcugacaguccugcccugccugcuccucguu

SEQ ID NO: 253301 - RNA, 20 nt, Human
ugcugacauaaaaccaggac

SEQ ID NO: 253302 - RNA, 32 nt, Human
ugcugacaugacuucuuugccacucgguguca

SEQ ID NO: 253303 - RNA, 32 nt, Human
ugcugaccacaagcucugugcuggggguaccu

SEQ ID NO: 253304 - RNA, 32 nt, Human
ugcugaccacacuccggcuccuaugucaccuu

SEQ ID NO: 253305 - RNA, 32 nt, Human
ugcugaccacagucacaucacccaucagcaca

SEQ ID NO: 253306 - RNA, 32 nt, Human
ugcugaccagccuggccggcuggcggagaaaa

SEQ ID NO: 253307 - RNA, 32 nt, Human
ugcugacccagaucgacagcgagcccgagugc

SEQ ID NO: 253308 - RNA, 32 nt, Human
ugcugacccaggaaguucugggaguugccguu

SEQ ID NO: 253309 - RNA, 32 nt, Human
ugcugacccccugcagccuggagccagcccgg

SEQ ID NO: 253310 - RNA, 32 nt, Human
ugcugacccugccucggguugugucugcuaag

SEQ ID NO: 253311 - RNA, 32 nt, Human
ugcugacccuguaacccaaaggaggaaacagc

SEQ ID NO: 253312 - RNA, 32 nt, Human
ugcugaccuaaccagagucaucaugccucuug

SEQ ID NO: 253313 - RNA, 32 nt, Human
ugcugaccucaagugauccucccaccucagcc

SEQ ID NO: 253314 - RNA, 32 nt, Human
ugcugaccucaagugaucugcccacuuuggcc

SEQ ID NO: 253315 - RNA, 32 nt, Human
ugcugaccuggggcuuuuuaccugguggucug

SEQ ID NO: 253316 - RNA, 32 nt, Human
ugcugacggggagggggacaggcagggaguua

SEQ ID NO: 253317 - RNA, 32 nt, Human
ugcugacuccaugugugcuguccucugaaggc

SEQ ID NO: 253318 - RNA, 32 nt, Human
ugcugacugagugacuggagacagggaugaug

SEQ ID NO: 253319 - RNA, 32 nt, Human
ugcugacuggacuguguuuuuccuaugcagug

SEQ ID NO: 253320 - RNA, 32 nt, Human
ugcugacuggagagcugggaauauggcauuug

SEQ ID NO: 253321 - RNA, 32 nt, Human
ugcugacuggcagggcuuugggcaguuggcca

SEQ ID NO: 253322 - RNA, 32 nt, Human
ugcugacuggcaucugugccugccuuucuggc

SEQ ID NO: 253323 - RNA, 31 nt, Human
ugcugacugggcacacucaugccaaguuuca

SEQ ID NO: 253324 - RNA, 32 nt, Human
ugcugacuggggacccagaccgggagcugagc

SEQ ID NO: 253325 - RNA, 32 nt, Human
ugcugacuggucucucugccuccagaggggau

SEQ ID NO: 253326 - RNA, 32 nt, Human
ugcugacuucccaagcccuggugaccagacca

SEQ ID NO: 253327 - RNA, 32 nt, Human
ugcugacuugcagugugacucgggcccauugu

SEQ ID NO: 253328 - RNA, 32 nt, Human
ugcugacuuucuccuguccucuuccaguuuag

SEQ ID NO: 253329 - RNA, 21 nt, Human
ugcugagaaaagcugccugug

SEQ ID NO: 253330 - RNA, 32 nt, Human
ugcugagaaacggaggaggaggaggguuugcu

SEQ ID NO: 253331 - RNA, 18 nt, Human
ugcugagaaagagcuuga

SEQ ID NO: 253332 - RNA, 20 nt, Human
ugcugagaaauaaguaauca

SEQ ID NO: 253333 - RNA, 18 nt, Human
ugcugagaacucuuggau

SEQ ID NO: 253334 - RNA, 32 nt, Human
ugcugagaagcaguauaagccuuuuuaaccuu

SEQ ID NO: 253335 - RNA, 20 nt, Human
ugcugagaaggagcuguggu

SEQ ID NO: 253336 - RNA, 16 nt, Human
ugcugagaaggcugug

SEQ ID NO: 253337 - RNA, 22 nt, Human
ugcugagaaguagacaaaauca

SEQ ID NO: 253338 - RNA, 32 nt, Human
ugcugagaaugaggccuuccagcuucauccac

SEQ ID NO: 253339 - RNA, 18 nt, Human
ugcugagaauucuauggu

SEQ ID NO: 253340 - RNA, 20 nt, Human
ugcugagaauucuaugguca

SEQ ID NO: 253341 - RNA, 28 nt, Human
ugcugagacacuuucuuuuguguuuaca

SEQ ID NO: 253342 - RNA, 17 nt, Human
ugcugagagagacugug

SEQ ID NO: 253343 - RNA, 22 nt, Human
ugcugagagcauagccagauca

SEQ ID NO: 253344 - RNA, 32 nt, Human
ugcugagagccaaacagagcccagggagacuc

SEQ ID NO: 253345 - RNA, 32 nt, Human
ugcugagagccuaguccagcagguuucugccc

SEQ ID NO: 253346 - RNA, 32 nt, Human
ugcugagagcguuguccccuucccagggccuc

SEQ ID NO: 253347 - RNA, 32 nt, Human
ugcugagaggccccuagagacaacacccuucc

SEQ ID NO: 253348 - RNA, 32 nt, Human
ugcugagaucaaggcucacugcagccuugaac

SEQ ID NO: 253349 - RNA, 17 nt, Human
ugcugagauggcuguga

SEQ ID NO: 253350 - RNA, 32 nt, Human
ugcugagaugugggucuugaagagaauagcca

SEQ ID NO: 253351 - RNA, 32 nt, Human
ugcugagauuacaggcaugaaccacugugccc

SEQ ID NO: 253352 - RNA, 32 nt, Human
ugcugagauuacaggcaugacccaccgcguca

SEQ ID NO: 253353 - RNA, 32 nt, Human
ugcugagauuacaggcaugagccaccacaccc

SEQ ID NO: 253354 - RNA, 32 nt, Human
ugcugagauuacaggcaugagccaccacgccc

SEQ ID NO: 253355 - RNA, 32 nt, Human
ugcugagauuacaggcaugagccaccaugccu

SEQ ID NO: 253356 - RNA, 32 nt, Human
ugcugagauuacaggcaugagccaccgcaccc

SEQ ID NO: 253357 - RNA, 32 nt, Human
ugcugagauuacaggcaugagcuaccacgccu

SEQ ID NO: 253358 - RNA, 32 nt, Human
ugcugagauuacaggcaugagucacuacgccc

SEQ ID NO: 253359 - RNA, 32 nt, Human
ugcugagauuacaggcaugggccaccacgccc

SEQ ID NO: 253360 - RNA, 21 nt, Human
ugcugagauuacaggugugag

SEQ ID NO: 253361 - RNA, 32 nt, Human
ugcugagcacagagcccacagcccaucugccu

SEQ ID NO: 253362 - RNA, 32 nt, Human
ugcugagcacagugccuggugcaaaggaaaug

SEQ ID NO: 253363 - RNA, 24 nt, Human
ugcugagccagagaagcccuggcc

SEQ ID NO: 253364 - RNA, 32 nt, Human
ugcugagccagcacccucagaugauuucccuc

SEQ ID NO: 253365 - RNA, 32 nt, Human
ugcugagccagccuguucuccgggccugaaug

SEQ ID NO: 253366 - RNA, 32 nt, Human
ugcugagccaucaugcccaccguggaugacau

SEQ ID NO: 253367 - RNA, 23 nt, Human
ugcugagccccaggcucccggcc

SEQ ID NO: 253368 - RNA, 20 nt, Human
ugcugagcccggggcagggg

SEQ ID NO: 253369 - RNA, 32 nt, Human
ugcugagcccucauccccuccuggggccaggc

SEQ ID NO: 253370 - RNA, 32 nt, Human
ugcugagcccugagggcagagaggauggcaug

SEQ ID NO: 253371 - RNA, 32 nt, Human
ugcugagccuccuugucuauccuuccuccccc

SEQ ID NO: 253372 - RNA, 32 nt, Human
ugcugagccugcaucugugccucccagccccc

SEQ ID NO: 253373 - RNA, 32 nt, Human
ugcugagccuuugcucucuuuccaaaugguua

SEQ ID NO: 253374 - RNA, 23 nt, Human
ugcugagcgugaaacagaagcaa

SEQ ID NO: 253375 - RNA, 32 nt, Human
ugcugagcucacugaaauaucucucccuuaug

SEQ ID NO: 253376 - RNA, 32 nt, Human
ugcugagcugaucgagcacccgcugaacauca

SEQ ID NO: 253377 - RNA, 32 nt, Human
ugcugagcugggaugaggcagguaagggugga

SEQ ID NO: 253378 - RNA, 32 nt, Human
ugcugaggaaaagguggcgaagaggcugccug

SEQ ID NO: 253379 - RNA, 17 nt, Human
ugcugaggaaaauguga

SEQ ID NO: 253380 - RNA, 32 nt, Human
ugcugaggaaacaccacaggcugaacggggga

SEQ ID NO: 253381 - RNA, 21 nt, Human
ugcugaggaaugaauguguca

SEQ ID NO: 253382 - RNA, 32 nt, Human
ugcugaggacucuugggcucucacuaucugcc

SEQ ID NO: 253383 - RNA, 32 nt, Human
ugcugaggagcagccccaggaggggaccagag

SEQ ID NO: 253384 - RNA, 22 nt, Human
ugcugaggagggggcaggguug

SEQ ID NO: 253385 - RNA, 18 nt, Human
ugcugaggaguugguggu

SEQ ID NO: 253386 - RNA, 32 nt, Human
ugcugaggccaaaucacucugcuucaaauaca

SEQ ID NO: 253387 - RNA, 32 nt, Human
ugcugaggccaaaucacucugcuucaaauacg

SEQ ID NO: 253388 - RNA, 17 nt, Human
ugcugaggccuuguggu

SEQ ID NO: 253389 - RNA, 32 nt, Human
ugcugaggcugauggagcugccuccagggcua

SEQ ID NO: 253390 - RNA, 32 nt, Human
ugcugaggcugcaguggugucguggguguuac

SEQ ID NO: 253391 - RNA, 21 nt, Human
ugcugaggcuggagugcagug

SEQ ID NO: 253392 - RNA, 32 nt, Human
ugcugaggcuggguuuggugcauguggguuga

SEQ ID NO: 253393 - RNA, 32 nt, Human
ugcugagggagguggggagagggaggagaaag

SEQ ID NO: 253394 - RNA, 32 nt, Human
ugcugagggcgcuggcucugcagaucagaaca

SEQ ID NO: 253395 - RNA, 32 nt, Human
ugcugagggcugggccacugaccaccuccccg

SEQ ID NO: 253396 - RNA, 32 nt, Human
ugcugagggggcccugaggcaggaccgcccuc

SEQ ID NO: 253397 - RNA, 32 nt, Human
ugcugagggucugggaucuguuuucuggaagu

SEQ ID NO: 253398 - RNA, 32 nt, Human
ugcugagggucuggggccgggacuguggccug

SEQ ID NO: 253399 - RNA, 32 nt, Human
ugcugagggugcaucaauuacaagcauugaau

SEQ ID NO: 253400 - RNA, 32 nt, Human
ugcugagguuuacuuccuugagaucacagaca

SEQ ID NO: 253401 - RNA, 20 nt, Human
ugcugaguaggcgcugugau

SEQ ID NO: 253402 - RNA, 21 nt, Human
ugcugagucacccacccagcc

SEQ ID NO: 253403 - RNA, 32 nt, Human
ugcugagucccaggcugagccucagucucccu

SEQ ID NO: 253404 - RNA, 21 nt, Human
ugcugaguccccuccccggcc

SEQ ID NO: 253405 - RNA, 22 nt, Human
ugcugagucccgauccccggcu

SEQ ID NO: 253406 - RNA, 20 nt, Human
ugcugagucccuuuguggcc

SEQ ID NO: 253407 - RNA, 32 nt, Human
ugcugaguccucagcacugagugcagugcgug

SEQ ID NO: 253408 - RNA, 22 nt, Human
ugcugagucucggacuccggcc

SEQ ID NO: 253409 - RNA, 32 nt, Human
ugcugagugaagccugaagaccaagcccccuc

SEQ ID NO: 253410 - RNA, 32 nt, Human
ugcugagugagguugaggggugucucgguaug

SEQ ID NO: 253411 - RNA, 32 nt, Human
ugcugagugcugccgccccuucccaggacagc

SEQ ID NO: 253412 - RNA, 32 nt, Human
ugcugagugcuggggauaaaggaacaaauaaa

SEQ ID NO: 253413 - RNA, 32 nt, Human
ugcugaguguccugcagcagcauuucauccca

SEQ ID NO: 253414 - RNA, 32 nt, Human
ugcugaguguucccacuggauccucuguagaa

SEQ ID NO: 253415 - RNA, 32 nt, Human
ugcugaguugcugccuuuccccgucauguauc

SEQ ID NO: 253416 - RNA, 32 nt, Human
ugcugauaucucuacaagauccugauuuuaau

SEQ ID NO: 253417 - RNA, 32 nt, Human
ugcugaucaccaccaccugcuugcuccaguug

SEQ ID NO: 253418 - RNA, 32 nt, Human
ugcugaucagagacuggagagguggagugaga

SEQ ID NO: 253419 - RNA, 32 nt, Human
ugcugauccaaccugaguggagucaggugagg

SEQ ID NO: 253420 - RNA, 32 nt, Human
ugcugaucccaggagugcccacgaggaguggg

SEQ ID NO: 253421 - RNA, 32 nt, Human
ugcugauccuccugccuuuaguucuaaauggu

SEQ ID NO: 253422 - RNA, 32 nt, Human
ugcugauccucucaguccccugcucaucaacu

SEQ ID NO: 253423 - RNA, 32 nt, Human
ugcugauccuuucugaacacuggaaaaugggg

SEQ ID NO: 253424 - RNA, 32 nt, Human
ugcugaucucacugcacacagccuagggcccc

SEQ ID NO: 253425 - RNA, 32 nt, Human
ugcugaucuuggaggcagaguggcugccugca

SEQ ID NO: 253426 - RNA, 31 nt, Human
ugcugaugacuucuuuaaugcuugaaguccg

SEQ ID NO: 253427 - RNA, 32 nt, Human
ugcugaugagcaccuccaggagccucaguuuc

SEQ ID NO: 253428 - RNA, 21 nt, Human
ugcugaugauauaaacuggcu

SEQ ID NO: 253429 - RNA, 30 nt, Human
ugcugaugcugaagccgagcgucacuucgg

SEQ ID NO: 253430 - RNA, 32 nt, Human
ugcugauggaaaugauccagaagagaaggaca

SEQ ID NO: 253431 - RNA, 32 nt, Human
ugcugauggccccuccagcacacacacauaag

SEQ ID NO: 253432 - RNA, 32 nt, Human
ugcugaugggcaggaggaugggagacaggaau

SEQ ID NO: 253433 - RNA, 23 nt, Human
ugcugaugucacccaccagggca

SEQ ID NO: 253434 - RNA, 32 nt, Human
ugcugaugugugugcaugagcuguauguacac

SEQ ID NO: 253435 - RNA, 32 nt, Human
ugcugauuaacaggaccccaaagguuugggug

SEQ ID NO: 253436 - RNA, 32 nt, Human
ugcugauuagaacauagcucucuccaggaagu

SEQ ID NO: 253437 - RNA, 32 nt, Human
ugcugauucaagaaacagaaguagaagaggag

SEQ ID NO: 253438 - RNA, 21 nt, Human
ugcugauucagccuggccauc

SEQ ID NO: 253439 - RNA, 32 nt, Human
ugcugauugggcagggaaaacauccuuucauu

SEQ ID NO: 253440 - RNA, 32 nt, Human
ugcugauuucuugaaggugaaguggcacaaug

SEQ ID NO: 253441 - RNA, 21 nt, Human
ugcugcaaaaguaauuguggu

SEQ ID NO: 253442 - RNA, 32 nt, Human
ugcugcaaaauacauuauucuucuuuauggcu

SEQ ID NO: 253443 - RNA, 32 nt, Human
ugcugcaaaguuggccauguuucacagggaaa

SEQ ID NO: 253444 - RNA, 32 nt, Human
ugcugcaaccaugcagcuacccugccaggggc

SEQ ID NO: 253445 - RNA, 32 nt, Human
ugcugcaacuucucuucucucuggacuucggu

SEQ ID NO: 253446 - RNA, 32 nt, Human
ugcugcaagcugacuccagccuuggggucagc

SEQ ID NO: 253447 - RNA, 32 nt, Human
ugcugcaaggugaggccugcugugcugcccgc

SEQ ID NO: 253448 - RNA, 32 nt, Human
ugcugcaagucaaccagcaugcagggggccuu

SEQ ID NO: 253449 - RNA, 32 nt, Human
ugcugcaauacucgcucugccugccuuugccc

SEQ ID NO: 253450 - RNA, 32 nt, Human
ugcugcaauacugcucccccagccucuccccu

SEQ ID NO: 253451 - RNA, 32 nt, Human
ugcugcaauuauauagcaucacagugcucugc

SEQ ID NO: 253452 - RNA, 32 nt, Human
ugcugcacaagccugggugcuccacgcuguca

SEQ ID NO: 253453 - RNA, 19 nt, Human
ugcugcacagagcuguggu

SEQ ID NO: 253454 - RNA, 32 nt, Human
ugcugcacagcccucucagacccuucuuggcc

SEQ ID NO: 253455 - RNA, 32 nt, Human
ugcugcacaucacaccagccccugccaagagc

SEQ ID NO: 253456 - RNA, 32 nt, Human
ugcugcaccacugcccugccuucgggcugcug

SEQ ID NO: 253457 - RNA, 19 nt, Human
ugcugcaccagaaggaggg

SEQ ID NO: 253458 - RNA, 32 nt, Human
ugcugcaccagcugcagaaccaacugcucaaa

SEQ ID NO: 253459 - RNA, 32 nt, Human
ugcugcaccauucccccagcugggcuggaagg

SEQ ID NO: 253460 - RNA, 32 nt, Human
ugcugcaccauuuuguauucccaugagcaggu

SEQ ID NO: 253461 - RNA, 32 nt, Human
ugcugcacccaccaacccaucaucuacauuag

SEQ ID NO: 253462 - RNA, 32 nt, Human
ugcugcaccccuggugucccugccuggcccuc

SEQ ID NO: 253463 - RNA, 32 nt, Human
ugcugcaccgaccucgacgucuugccuguguc

SEQ ID NO: 253464 - RNA, 32 nt, Human
ugcugcacgcccgccucaccauugcugagcac

SEQ ID NO: 253465 - RNA, 32 nt, Human
ugcugcacguagugccucaccagagccagauu

SEQ ID NO: 253466 - RNA, 22 nt, Human
ugcugcacguguguguauuuca

SEQ ID NO: 253467 - RNA, 32 nt, Human
ugcugcagacaggcccauggugaugcucaggc

SEQ ID NO: 253468 - RNA, 32 nt, Human
ugcugcagaccacgugugcugugcacagcggc

SEQ ID NO: 253469 - RNA, 32 nt, Human
ugcugcagaccgaggcugggccaagauggcgu

SEQ ID NO: 253470 - RNA, 32 nt, Human
ugcugcagaggacacgaggcggcgggcuggag

SEQ ID NO: 253471 - RNA, 32 nt, Human
ugcugcagaguugguggagaacagaaauccac

SEQ ID NO: 253472 - RNA, 32 nt, Human
ugcugcagaugggggaggagccauaagccucu

SEQ ID NO: 253473 - RNA, 32 nt, Human
ugcugcagauucaucugaugaagaggaggaac

SEQ ID NO: 253474 - RNA, 32 nt, Human
ugcugcagcccgggcgccuggagcugggcgac

SEQ ID NO: 253475 - RNA, 32 nt, Human
ugcugcagcuccaggaaguccccgcaaugucu

SEQ ID NO: 253476 - RNA, 32 nt, Human
ugcugcagcugcaugggugccugcugcugccu

SEQ ID NO: 253477 - RNA, 32 nt, Human
ugcugcagcugccgggagacucacgccuuagu

SEQ ID NO: 253478 - RNA, 32 nt, Human
ugcugcaggaccuggaggucaggugugaaugc

SEQ ID NO: 253479 - RNA, 32 nt, Human
ugcugcaggacuuugggcaagugaccugcccu

SEQ ID NO: 253480 - RNA, 32 nt, Human
ugcugcaggagguggguauuguguguguggga

SEQ ID NO: 253481 - RNA, 32 nt, Human
ugcugcaggcagcagaguaugucugaacucgg

SEQ ID NO: 253482 - RNA, 32 nt, Human
ugcugcaggccaugguggaggaggugcggcac

SEQ ID NO: 253483 - RNA, 32 nt, Human
ugcugcaggcucccccugaggccccucuccaa

SEQ ID NO: 253484 - RNA, 32 nt, Human
ugcugcaggcugucucgcacuugucauugguc

SEQ ID NO: 253485 - RNA, 32 nt, Human
ugcugcagggacagcccugacacuccuuucag

SEQ ID NO: 253486 - RNA, 32 nt, Human
ugcugcaggggacccucaugcuggaugguugg

SEQ ID NO: 253487 - RNA, 32 nt, Human
ugcugcaggucacacagcaaugcagcucagga

SEQ ID NO: 253488 - RNA, 32 nt, Human
ugcugcagguggcagguggccccaggccuguu

SEQ ID NO: 253489 - RNA, 19 nt, Human
ugcugcagugagcugugau

SEQ ID NO: 253490 - RNA, 32 nt, Human
ugcugcagugcagugaauuaccccagagccac

SEQ ID NO: 253491 - RNA, 32 nt, Human
ugcugcagugugacaugcagaaguaaagcugg

SEQ ID NO: 253492 - RNA, 32 nt, Human
ugcugcaguuaucuccugaaucaggcugaggg

SEQ ID NO: 253493 - RNA, 32 nt, Human
ugcugcaguucuguguccugugcuuggaugcu

SEQ ID NO: 253494 - RNA, 32 nt, Human
ugcugcaguuggagaagaaacugaauuugaaa

SEQ ID NO: 253495 - RNA, 32 nt, Human
ugcugcaguuuuuccgcgauaguuuggggcag

SEQ ID NO: 253496 - RNA, 32 nt, Human
ugcugcaucccuccaguguccucuauugacag

SEQ ID NO: 253497 - RNA, 32 nt, Human
ugcugcaugggacccaugucuccugggacaga

SEQ ID NO: 253498 - RNA, 32 nt, Human
ugcugcaugugggggccgaugggcaggggacc

SEQ ID NO: 253499 - RNA, 32 nt, Human
ugcugcauucauaggagaauugaauaauuucu

SEQ ID NO: 253500 - RNA, 32 nt, Human
ugcugcauuuuucuacaacaucaugccucuag

SEQ ID NO: 253501 - RNA, 32 nt, Human
ugcugccaagauaugaccuccaggaaggccca

SEQ ID NO: 253502 - RNA, 24 nt, Human
ugcugccaccaccgccgcugcuau

SEQ ID NO: 253503 - RNA, 32 nt, Human
ugcugccaccagcauccucuggaguccuucca

SEQ ID NO: 253504 - RNA, 32 nt, Human
ugcugccaccccggccucugaguaagacucgu

SEQ ID NO: 253505 - RNA, 32 nt, Human
ugcugccacgcccaaccucuuugggagaagua

SEQ ID NO: 253506 - RNA, 32 nt, Human
ugcugccacuguacuccaaccuggguaacaga

SEQ ID NO: 253507 - RNA, 32 nt, Human
ugcugccagaggaauuguuaauaaaagcaccu

SEQ ID NO: 253508 - RNA, 32 nt, Human
ugcugccagagucaucauccucaaaaaugaaa

SEQ ID NO: 253509 - RNA, 32 nt, Human
ugcugccagccugugucugugcagucccccug

SEQ ID NO: 253510 - RNA, 32 nt, Human
ugcugccagcuaccagccuggcuggcccuguc

SEQ ID NO: 253511 - RNA, 32 nt, Human
ugcugccaggauucagaucagcccuucccagg

SEQ ID NO: 253512 - RNA, 32 nt, Human
ugcugccaggggcagagccucugugcccaagu

SEQ ID NO: 253513 - RNA, 32 nt, Human
ugcugccagguguucaagagcuagaugaaggu

SEQ ID NO: 253514 - RNA, 32 nt, Human
ugcugccaguaucgacuucaugacauuugcca

SEQ ID NO: 253515 - RNA, 19 nt, Human
ugcugccagugacuguggu

SEQ ID NO: 253516 - RNA, 21 nt, Human
ugcugccaucgccgcugccac

SEQ ID NO: 253517 - RNA, 32 nt, Human
ugcugccaucuuccucaucauaaaguguggaa

SEQ ID NO: 253518 - RNA, 32 nt, Human
ugcugccaucuucuccgcgcuauggcugcguu

SEQ ID NO: 253519 - RNA, 32 nt, Human
ugcugccaucuucucuccccaccacccuuuca

SEQ ID NO: 253520 - RNA, 32 nt, Human
ugcugccauugcugcugccucugccucggaga

SEQ ID NO: 253521 - RNA, 32 nt, Human
ugcugcccaaccaugggccacugugaacagac

SEQ ID NO: 253522 - RNA, 24 nt, Human
ugcugcccaggcuagagugcaaug

SEQ ID NO: 253523 - RNA, 23 nt, Human
ugcugcccaggcuagagugcagu

SEQ ID NO: 253524 - RNA, 24 nt, Human
ugcugcccaggcuagagugcagug

SEQ ID NO: 253525 - RNA, 23 nt, Human
ugcugcccaggcuggaguacagu

SEQ ID NO: 253526 - RNA, 24 nt, Human
ugcugcccaggcuggaguacagug

SEQ ID NO: 253527 - RNA, 24 nt, Human
ugcugcccaggcuggagugcaaug

SEQ ID NO: 253528 - RNA, 23 nt, Human
ugcugcccaggcuggagugcagu

SEQ ID NO: 253529 - RNA, 24 nt, Human
ugcugcccaggcuggagugcagug

SEQ ID NO: 253530 - RNA, 32 nt, Human
ugcugccccacugugcugagucccaacaccca

SEQ ID NO: 253531 - RNA, 32 nt, Human
ugcugccccagccaggaucuggucgcugcccc

SEQ ID NO: 253532 - RNA, 32 nt, Human
ugcugccccagccaggguuggagucuuagccu

SEQ ID NO: 253533 - RNA, 32 nt, Human
ugcugccccagccugugucuguucuccucgag

SEQ ID NO: 253534 - RNA, 32 nt, Human
ugcugccccagcugccuccuacccauugccaa

SEQ ID NO: 253535 - RNA, 32 nt, Human
ugcugccccaggaagacuccucuaggcucucc

SEQ ID NO: 253536 - RNA, 32 nt, Human
ugcugccccaggaggacuguccucgggaauga

SEQ ID NO: 253537 - RNA, 32 nt, Human
ugcugccccguucugucacccagggcuccuag

SEQ ID NO: 253538 - RNA, 32 nt, Human
ugcugccccugccaggcccagcugccacaccc

SEQ ID NO: 253539 - RNA, 32 nt, Human
ugcugccccugccccuacucucagccucacgu

SEQ ID NO: 253540 - RNA, 32 nt, Human
ugcugccccugccuuggggucagguugacagg

SEQ ID NO: 253541 - RNA, 32 nt, Human
ugcugccccuucccagcugccugccugcccua

SEQ ID NO: 253542 - RNA, 32 nt, Human
ugcugcccguggaagccagggagggauggacc

SEQ ID NO: 253543 - RNA, 32 nt, Human
ugcugcccuccagcuuccuuagcauguggguc

SEQ ID NO: 253544 - RNA, 32 nt, Human
ugcugcccucccuucccugccucuugccugug

SEQ ID NO: 253545 - RNA, 32 nt, Human
ugcugcccuccucugccccaugccuuuggggu

SEQ ID NO: 253546 - RNA, 32 nt, Human
ugcugcccuccuggcccugcuccuuccgcagu

SEQ ID NO: 253547 - RNA, 32 nt, Human
ugcugcccucuccucaaccucucacgcucugc

SEQ ID NO: 253548 - RNA, 32 nt, Human
ugcugcccugccucucgugccggguguugcuu

SEQ ID NO: 253549 - RNA, 32 nt, Human
ugcugcccugcuggccccuugugcacggcagc

SEQ ID NO: 253550 - RNA, 32 nt, Human
ugcugccgcaggcagggagugagcugggggug

SEQ ID NO: 253551 - RNA, 21 nt, Human
ugcugccgccaccgcagugcu

SEQ ID NO: 253552 - RNA, 19 nt, Human
ugcugccgccaccgcccac

SEQ ID NO: 253553 - RNA, 23 nt, Human
ugcugccgccaccgccgcugcac

SEQ ID NO: 253554 - RNA, 20 nt, Human
ugcugccgccgccacccccc

SEQ ID NO: 253555 - RNA, 24 nt, Human
ugcugccgccgccaccgccaccac

SEQ ID NO: 253556 - RNA, 23 nt, Human
ugcugccgccgcccguggccgcc

SEQ ID NO: 253557 - RNA, 22 nt, Human
ugcugccgccgccgccacccgc

SEQ ID NO: 253558 - RNA, 23 nt, Human
ugcugccgccgccgccaccgccg

SEQ ID NO: 253559 - RNA, 19 nt, Human
ugcugccgccgccgcccgc

SEQ ID NO: 253560 - RNA, 23 nt, Human
ugcugccgccgccgccgccgccg

SEQ ID NO: 253561 - RNA, 24 nt, Human
ugcugccgccgccgccgccgccgc

SEQ ID NO: 253562 - RNA, 25 nt, Human
ugcugccgccgccgccgccggccgc

SEQ ID NO: 253563 - RNA, 24 nt, Human
ugcugccgccgccgccgccucuau

SEQ ID NO: 253564 - RNA, 24 nt, Human
ugcugccgccgccgccgcugccau

SEQ ID NO: 253565 - RNA, 24 nt, Human
ugcugccgccgccgccgcugcucc

SEQ ID NO: 253566 - RNA, 20 nt, Human
ugcugccgccgccgcgcccc

SEQ ID NO: 253567 - RNA, 25 nt, Human
ugcugccgccgccgcuccuggccac

SEQ ID NO: 253568 - RNA, 32 nt, Human
ugcugccgccgccucugcuuccacucggcucu

SEQ ID NO: 253569 - RNA, 24 nt, Human
ugcugccgccgcugccgccgccgc

SEQ ID NO: 253570 - RNA, 24 nt, Human
ugcugccgccgcuguugcagccac

SEQ ID NO: 253571 - RNA, 22 nt, Human
ugcugccgccuccccaccacca

SEQ ID NO: 253572 - RNA, 32 nt, Human
ugcugccggccacgccagaggcugcaacacca

SEQ ID NO: 253573 - RNA, 20 nt, Human
ugcugccggcgaagaaggug

SEQ ID NO: 253574 - RNA, 32 nt, Human
ugcugccgggaucaucagccuccagggaugug

SEQ ID NO: 253575 - RNA, 32 nt, Human
ugcugccggggacuguccuggguggacggcag

SEQ ID NO: 253576 - RNA, 24 nt, Human
ugcugccguagcugccgccgccgc

SEQ ID NO: 253577 - RNA, 32 nt, Human
ugcugccuaagcugccggcugcaggagccaga

SEQ ID NO: 253578 - RNA, 32 nt, Human
ugcugccuaccagaaaacaugucaguuucguc

SEQ ID NO: 253579 - RNA, 32 nt, Human
ugcugccuccacuaucgaugccuccugacugc

SEQ ID NO: 253580 - RNA, 32 nt, Human
ugcugccucccaaaaugguguucagaucuaug

SEQ ID NO: 253581 - RNA, 32 nt, Human
ugcugccucccucugcugucaccuugcucagc

SEQ ID NO: 253582 - RNA, 32 nt, Human
ugcugccuccuccuccuccaccugcucuccuc

SEQ ID NO: 253583 - RNA, 32 nt, Human
ugcugccucggccucugcucuguucaguuugc

SEQ ID NO: 253584 - RNA, 32 nt, Human
ugcugccucgucugaggggacaggaggaucac

SEQ ID NO: 253585 - RNA, 32 nt, Human
ugcugccugccuaggaaggaaaccugaagauu

SEQ ID NO: 253586 - RNA, 32 nt, Human
ugcugccugccugcccacccgccugggcuugc

SEQ ID NO: 253587 - RNA, 32 nt, Human
ugcugccugccuggacuugccccugccaccuc

SEQ ID NO: 253588 - RNA, 32 nt, Human
ugcugccugccugucugcugagguaagguggg

SEQ ID NO: 253589 - RNA, 32 nt, Human
ugcugccugccugucugucucuccaucuguuu

SEQ ID NO: 253590 - RNA, 32 nt, Human
ugcugccugcucuccugccaucauggauuuuc

SEQ ID NO: 253591 - RNA, 32 nt, Human
ugcugccuggacugggacuguuagagcugcuu

SEQ ID NO: 253592 - RNA, 32 nt, Human
ugcugccuggccaagccccacacccgcagacc

SEQ ID NO: 253593 - RNA, 32 nt, Human
ugcugccugggagccagggugagagucugggu

SEQ ID NO: 253594 - RNA, 32 nt, Human
ugcugccuggggcugugggaugaaucagucac

SEQ ID NO: 253595 - RNA, 32 nt, Human
ugcugccugugaagcagugagccaccuguccc

SEQ ID NO: 253596 - RNA, 32 nt, Human
ugcugccuucacccuuccccuguguggcuccc

SEQ ID NO: 253597 - RNA, 32 nt, Human
ugcugccuucaguuaaucaaccaaugaguggu

SEQ ID NO: 253598 - RNA, 32 nt, Human
ugcugccuucucccaggacggaggcuuuugga

SEQ ID NO: 253599 - RNA, 20 nt, Human
ugcugccuucucccuguccu

SEQ ID NO: 253600 - RNA, 32 nt, Human
ugcugccuuugcugcugacuugcagugugacu

SEQ ID NO: 253601 - RNA, 32 nt, Human
ugcugcgaggaugcugccugggcggcugugcu

SEQ ID NO: 253602 - RNA, 32 nt, Human
ugcugcgauccccagggaacaaggucagcgac

SEQ ID NO: 253603 - RNA, 32 nt, Human
ugcugcgauuacaggcaugagccaccgcgccu

SEQ ID NO: 253604 - RNA, 23 nt, Human
ugcugcgauuauauaggcgugag

SEQ ID NO: 253605 - RNA, 32 nt, Human
ugcugcgauuauauaggcgugagccaccacgc

SEQ ID NO: 253606 - RNA, 32 nt, Human
ugcugcgcggcgcaggucucucgguuuccuca

SEQ ID NO: 253607 - RNA, 32 nt, Human
ugcugcggaggcaggcugagggcgcaggggcu

SEQ ID NO: 253608 - RNA, 22 nt, Human
ugcugcggccgggcucugccga

SEQ ID NO: 253609 - RNA, 19 nt, Human
ugcugcggcguguuaggaa

SEQ ID NO: 253610 - RNA, 32 nt, Human
ugcugcgggaggcggcggcgguaggaagccgg

SEQ ID NO: 253611 - RNA, 32 nt, Human
ugcugcgggcgcccaccucgcccagccaugcc

SEQ ID NO: 253612 - RNA, 32 nt, Human
ugcugcgucaucugaaaucggcacauuccaug

SEQ ID NO: 253613 - RNA, 32 nt, Human
ugcugcgucucaggagucugugagcugauagu

SEQ ID NO: 253614 - RNA, 32 nt, Human
ugcugcgucucccaucuuaacucuuugccuuu

SEQ ID NO: 253615 - RNA, 32 nt, Human
ugcugcgucugccugguccugggagagagaaa

SEQ ID NO: 253616 - RNA, 32 nt, Human
ugcugcgugaagucugcccuucccaggcuaaa

SEQ ID NO: 253617 - RNA, 32 nt, Human
ugcugcguggacgcaggcucugucuccuaggc

SEQ ID NO: 253618 - RNA, 32 nt, Human
ugcugcguggccuggaugguuggaggcagagc

SEQ ID NO: 253619 - RNA, 32 nt, Human
ugcugcuaaaacuucuuaaaugguuguuucug

SEQ ID NO: 253620 - RNA, 32 nt, Human
ugcugcuaaacagggucaggugaacccacugc

SEQ ID NO: 253621 - RNA, 32 nt, Human
ugcugcuaacacugagguagcucucuucaucu

SEQ ID NO: 253622 - RNA, 32 nt, Human
ugcugcuaaccccacaccacccaggccuccac

SEQ ID NO: 253623 - RNA, 32 nt, Human
ugcugcuaagaguuugcuaaagugucaugaau

SEQ ID NO: 253624 - RNA, 32 nt, Human
ugcugcuaagucggcuccagcacacaggagcc

SEQ ID NO: 253625 - RNA, 32 nt, Human
ugcugcuaauaaacacauacccgagacugggu

SEQ ID NO: 253626 - RNA, 32 nt, Human
ugcugcuaauauauacauauauuguauaaaaa

SEQ ID NO: 253627 - RNA, 32 nt, Human
ugcugcuacaagauguuucuguuucuuagauu

SEQ ID NO: 253628 - RNA, 32 nt, Human
ugcugcuaccugcuuuccagagccuuucauca

SEQ ID NO: 253629 - RNA, 32 nt, Human
ugcugcuacuucuguggaaguagcuuugaacu

SEQ ID NO: 253630 - RNA, 32 nt, Human
ugcugcuagaggguguggaaaagaccaagaug

SEQ ID NO: 253631 - RNA, 32 nt, Human
ugcugcuaggucauaugucaauaggaguucua

SEQ ID NO: 253632 - RNA, 22 nt, Human
ugcugcucaacauggugaaaug

SEQ ID NO: 253633 - RNA, 18 nt, Human
ugcugcucagagugcagg

SEQ ID NO: 253634 - RNA, 32 nt, Human
ugcugcucagugugguucucaccccugcaagc

SEQ ID NO: 253635 - RNA, 32 nt, Human
ugcugcucaucccagggaaaucccggccccac

SEQ ID NO: 253636 - RNA, 17 nt, Human
ugcugcucaucucccua

SEQ ID NO: 253637 - RNA, 32 nt, Human
ugcugcucccagcccccuccuccuggggcccu

SEQ ID NO: 253638 - RNA, 32 nt, Human
ugcugcucccagucucucgcucugccugccug

SEQ ID NO: 253639 - RNA, 32 nt, Human
ugcugcucccagucuucuguccauaccauucc

SEQ ID NO: 253640 - RNA, 32 nt, Human
ugcugcucccuacugacucuagcuuacuuccc

SEQ ID NO: 253641 - RNA, 32 nt, Human
ugcugcuccuccagcuguaucugcaccugccu

SEQ ID NO: 253642 - RNA, 32 nt, Human
ugcugcuccucuuccugcccuuaucaaccugg

SEQ ID NO: 253643 - RNA, 32 nt, Human
ugcugcuccuggcugccacucaccccugugag

SEQ ID NO: 253644 - RNA, 32 nt, Human
ugcugcuccuuuggggcaacgacgguuucaaa

SEQ ID NO: 253645 - RNA, 32 nt, Human
ugcugcucuagggauacucagggggcuccugc

SEQ ID NO: 253646 - RNA, 32 nt, Human
ugcugcucucguacuaacugugccagugccca

SEQ ID NO: 253647 - RNA, 32 nt, Human
ugcugcucucugagggagaggcugugguggcu

SEQ ID NO: 253648 - RNA, 21 nt, Human
ugcugcucucuuagcugugau

SEQ ID NO: 253649 - RNA, 32 nt, Human
ugcugcucugacccuuggccucaggcuuggcc

SEQ ID NO: 253650 - RNA, 32 nt, Human
ugcugcucugggaaccaccucucugcucucca

SEQ ID NO: 253651 - RNA, 32 nt, Human
ugcugcucugggaggcuaaggcucaucucucu

SEQ ID NO: 253652 - RNA, 19 nt, Human
ugcugcucuuuccaccugc

SEQ ID NO: 253653 - RNA, 32 nt, Human
ugcugcugaaggaggagaggauagugaagaag

SEQ ID NO: 253654 - RNA, 32 nt, Human
ugcugcugacagccaccaugcucucacccaaa

SEQ ID NO: 253655 - RNA, 32 nt, Human
ugcugcugacgucacauggagcacagaaauca

SEQ ID NO: 253656 - RNA, 32 nt, Human
ugcugcugacugcugcaccuccuacaucucac

SEQ ID NO: 253657 - RNA, 32 nt, Human
ugcugcugagaggaggaggaggaugaagaguu

SEQ ID NO: 253658 - RNA, 32 nt, Human
ugcugcugagcuugugugaaaaucagaccuga

SEQ ID NO: 253659 - RNA, 32 nt, Human
ugcugcugaucugaauauggaaaccccauggu

SEQ ID NO: 253660 - RNA, 32 nt, Human
ugcugcugauggauacuuuucccucacugcca

SEQ ID NO: 253661 - RNA, 32 nt, Human
ugcugcugcacuccagccugggagacagagcg

SEQ ID NO: 253662 - RNA, 32 nt, Human
ugcugcugcacuccagccugggcaauagagug

SEQ ID NO: 253663 - RNA, 32 nt, Human
ugcugcugcacuccagccugggugaaaaagac

SEQ ID NO: 253664 - RNA, 32 nt, Human
ugcugcugccaccgccuccucaucuucugccc

SEQ ID NO: 253665 - RNA, 32 nt, Human
ugcugcugcccaggcuggagugcaguggcacg

SEQ ID NO: 253666 - RNA, 32 nt, Human
ugcugcugcccaggcuggagugcaguggugca

SEQ ID NO: 253667 - RNA, 32 nt, Human
ugcugcugccccuagccugccugcacggccgc

SEQ ID NO: 253668 - RNA, 32 nt, Human
ugcugcugcuaccagcgccaaauguucauccu

SEQ ID NO: 253669 - RNA, 32 nt, Human
ugcugcugcuacugcugccgcugcugcucugu

SEQ ID NO: 253670 - RNA, 32 nt, Human
ugcugcugcuacugcuguuuccaggggcugca

SEQ ID NO: 253671 - RNA, 32 nt, Human
ugcugcugcucaggaagagagacaaggaauau

SEQ ID NO: 253672 - RNA, 32 nt, Human
ugcugcugcuccugaaauacccaccccuuucc

SEQ ID NO: 253673 - RNA, 32 nt, Human
ugcugcugcuccugcucagcuccugggaccaa

SEQ ID NO: 253674 - RNA, 32 nt, Human
ugcugcugcugcacucacgcggcugggcuuuc

SEQ ID NO: 253675 - RNA, 21 nt, Human
ugcugcugcugccaccgccac

SEQ ID NO: 253676 - RNA, 32 nt, Human
ugcugcugcugccuccgccgccacugcugcug

SEQ ID NO: 253677 - RNA, 32 nt, Human
ugcugcugcuugcccaaauguuuucccauggg

SEQ ID NO: 253678 - RNA, 32 nt, Human
ugcugcugcuuguaguugggggagaggugccc

SEQ ID NO: 253679 - RNA, 32 nt, Human
ugcugcuggagcggagagccaaagggaagccu

SEQ ID NO: 253680 - RNA, 32 nt, Human
ugcugcuggaggauuaagagcagugggaaaac

SEQ ID NO: 253681 - RNA, 32 nt, Human
ugcugcuggagugcccgcugggcagugaacag

SEQ ID NO: 253682 - RNA, 32 nt, Human
ugcugcuggcagccugugccuuugucagcucu

SEQ ID NO: 253683 - RNA, 31 nt, Human
ugcugcuggcuuuucugguugcaggcuuucc

SEQ ID NO: 253684 - RNA, 32 nt, Human
ugcugcugggagcuccugccucccacaggauu

SEQ ID NO: 253685 - RNA, 32 nt, Human
ugcugcugggaggccagccuggaagaggcagc

SEQ ID NO: 253686 - RNA, 32 nt, Human
ugcugcugggauuacaggcgugagccaccacu

SEQ ID NO: 253687 - RNA, 32 nt, Human
ugcugcugggcaacaguguuggcuucuuuuaa

SEQ ID NO: 253688 - RNA, 32 nt, Human
ugcugcugggccucccuuuggcccucgcuucc

SEQ ID NO: 253689 - RNA, 32 nt, Human
ugcugcuggggcuggcagagcaguuggcugac

SEQ ID NO: 253690 - RNA, 32 nt, Human
ugcugcugggguaccuggaugagcacacagaa

SEQ ID NO: 253691 - RNA, 32 nt, Human
ugcugcugggucaugauuuccacaucaugagc

SEQ ID NO: 253692 - RNA, 32 nt, Human
ugcugcuggguguggaguggagagugacagga

SEQ ID NO: 253693 - RNA, 32 nt, Human
ugcugcuggugcuccucgccucuuggggccug

SEQ ID NO: 253694 - RNA, 32 nt, Human
ugcugcugucaugaguggcgagcuucuguuuc

SEQ ID NO: 253695 - RNA, 20 nt, Human
ugcugcuguccccaaggugu

SEQ ID NO: 253696 - RNA, 32 nt, Human
ugcugcuguccucugagacugccuguuccucc

SEQ ID NO: 253697 - RNA, 24 nt, Human
ugcugcugugaagaugagaaggug

SEQ ID NO: 253698 - RNA, 19 nt, Human
ugcugcugugcugagugug

SEQ ID NO: 253699 - RNA, 20 nt, Human
ugcugcuguggagcuaggug

SEQ ID NO: 253700 - RNA, 32 nt, Human
ugcugcugugugguuccccuguuggcuagggu

SEQ ID NO: 253701 - RNA, 20 nt, Human
ugcugcuguguguggaggug

SEQ ID NO: 253702 - RNA, 32 nt, Human
ugcugcuguuaguuuagagaaggagagauguc

SEQ ID NO: 253703 - RNA, 23 nt, Human
ugcugcuguuuuaauaagaugua

SEQ ID NO: 253704 - RNA, 32 nt, Human
ugcugcuuaaugauuugcucacaucuaguaaa

SEQ ID NO: 253705 - RNA, 32 nt, Human
ugcugcuucagccccuaucacauagcucacug

SEQ ID NO: 253706 - RNA, 32 nt, Human
ugcugcuucaucucucccccagccugccaugu

SEQ ID NO: 253707 - RNA, 32 nt, Human
ugcugcuuccauguucagucccuucccugcuu

SEQ ID NO: 253708 - RNA, 32 nt, Human
ugcugcuucccaagauccucagcagggauuaa

SEQ ID NO: 253709 - RNA, 32 nt, Human
ugcugcuucccacccagcugagaaugcccccu

SEQ ID NO: 253710 - RNA, 32 nt, Human
ugcugcuucccaucaccagcagcugcucgaca

SEQ ID NO: 253711 - RNA, 32 nt, Human
ugcugcuuccggacacagcugugggcggagcu

SEQ ID NO: 253712 - RNA, 32 nt, Human
ugcugcuuccuccacguuugcugugccaacag

SEQ ID NO: 253713 - RNA, 32 nt, Human
ugcugcuuccuugggcugccuuucugggggca

SEQ ID NO: 253714 - RNA, 22 nt, Human
ugcugcuucuaacagauggcca

SEQ ID NO: 253715 - RNA, 32 nt, Human
ugcugcuucucccaucguuagacaucugccag

SEQ ID NO: 253716 - RNA, 32 nt, Human
ugcugcuucucccugcucccaucucaucccca

SEQ ID NO: 253717 - RNA, 31 nt, Human
ugcugcuucucuauauaccugugaauaugug

SEQ ID NO: 253718 - RNA, 32 nt, Human
ugcugcuucuucuacuggacugucuuucacug

SEQ ID NO: 253719 - RNA, 32 nt, Human
ugcugcuugaauugccguguagacauuugcuu

SEQ ID NO: 253720 - RNA, 32 nt, Human
ugcugcuugcacauguugguucuugaaaccuu

SEQ ID NO: 253721 - RNA, 17 nt, Human
ugcugcuugcagucaua

SEQ ID NO: 253722 - RNA, 32 nt, Human
ugcugcuugcccacaccuucguccccuuugca

SEQ ID NO: 253723 - RNA, 32 nt, Human
ugcugcuugggaggcagaggcaggagaauugc

SEQ ID NO: 253724 - RNA, 32 nt, Human
ugcugcuugggccgguggaggauugcaagcug

SEQ ID NO: 253725 - RNA, 32 nt, Human
ugcugcuuuagagugcggcugaacccgggccu

SEQ ID NO: 253726 - RNA, 32 nt, Human
ugcugcuuucucuguuccugugaugcaugaau

SEQ ID NO: 253727 - RNA, 32 nt, Human
ugcugcuuugcauccucuccaggcucuggacu

SEQ ID NO: 253728 - RNA, 32 nt, Human
ugcugcuuuuacuuugaugugaucucauugau

SEQ ID NO: 253729 - RNA, 32 nt, Human
ugcugcuuuuucuccccaaggcaggccauaga

SEQ ID NO: 253730 - RNA, 32 nt, Human
ugcugcuuuuucucccuccuccucaaguuccu

SEQ ID NO: 253731 - RNA, 32 nt, Human
ugcuggaaaccagcccaggccucccagggaag

SEQ ID NO: 253732 - RNA, 32 nt, Human
ugcuggaaaugcagcccccacccucccacuca

SEQ ID NO: 253733 - RNA, 32 nt, Human
ugcuggaaaugcccccuccacaccccugguag

SEQ ID NO: 253734 - RNA, 23 nt, Human
ugcuggaacccaggagguggagg

SEQ ID NO: 253735 - RNA, 32 nt, Human
ugcuggaacccugcucucagccuggaggcugg

SEQ ID NO: 253736 - RNA, 32 nt, Human
ugcuggaaccucaggguauggagcucacauca

SEQ ID NO: 253737 - RNA, 32 nt, Human
ugcuggaacuacaggcacgcaccaccacgccc

SEQ ID NO: 253738 - RNA, 32 nt, Human
ugcuggaacuuagcacugucuugauuugaagc

SEQ ID NO: 253739 - RNA, 32 nt, Human
ugcuggaaggacgaaggugagugaagauggca

SEQ ID NO: 253740 - RNA, 32 nt, Human
ugcuggaaggcgcagagauuggagugcccugc

SEQ ID NO: 253741 - RNA, 32 nt, Human
ugcuggaagucccucacccagagaccagugcu

SEQ ID NO: 253742 - RNA, 32 nt, Human
ugcuggaaugaguuaagauuugggggacugua

SEQ ID NO: 253743 - RNA, 32 nt, Human
ugcuggaauuacaggcaugagccaccacaccc

SEQ ID NO: 253744 - RNA, 32 nt, Human
ugcuggaauuacaggcaugagccaccaugccu

SEQ ID NO: 253745 - RNA, 32 nt, Human
ugcuggaauuacaggcaugagccaccgcgccc

SEQ ID NO: 253746 - RNA, 32 nt, Human
ugcuggaauuacaggcauuagccaccaugccu

SEQ ID NO: 253747 - RNA, 32 nt, Human
ugcuggaauugcagacgugagccaccaugccc

SEQ ID NO: 253748 - RNA, 32 nt, Human
ugcuggaauugcaggcaugagccaccacuccc

SEQ ID NO: 253749 - RNA, 21 nt, Human
ugcuggacaccgggcaggggu

SEQ ID NO: 253750 - RNA, 32 nt, Human
ugcuggacacuggccucgggauagccaugggc

SEQ ID NO: 253751 - RNA, 32 nt, Human
ugcuggacaggaugguucaccugcugagucga

SEQ ID NO: 253752 - RNA, 32 nt, Human
ugcuggacagucagacccggagcccagaggca

SEQ ID NO: 253753 - RNA, 32 nt, Human
ugcuggacaguccuugacauguguucugugug

SEQ ID NO: 253754 - RNA, 32 nt, Human
ugcuggaccaaggcaucucucaagugggccgc

SEQ ID NO: 253755 - RNA, 32 nt, Human
ugcuggaccccacucucuggaucgucucugau

SEQ ID NO: 253756 - RNA, 32 nt, Human
ugcuggaccuaaaauacugacuuuaguuagua

SEQ ID NO: 253757 - RNA, 32 nt, Human
ugcuggaccuggucagagacugaugugccuua

SEQ ID NO: 253758 - RNA, 32 nt, Human
ugcuggacggccagugggagagcgaggccuga

SEQ ID NO: 253759 - RNA, 32 nt, Human
ugcuggacugacaccuauggcuggaagaugac

SEQ ID NO: 253760 - RNA, 21 nt, Human
ugcuggacugcuccuggcucu

SEQ ID NO: 253761 - RNA, 23 nt, Human
ugcuggacuggcccuccagaggg

SEQ ID NO: 253762 - RNA, 32 nt, Human
ugcuggacuuacccugggcugcaguccauugu

SEQ ID NO: 253763 - RNA, 32 nt, Human
ugcuggagaacagagacccuucaagaggugag

SEQ ID NO: 253764 - RNA, 21 nt, Human
ugcuggagagauaauguggug

SEQ ID NO: 253765 - RNA, 32 nt, Human
ugcuggagagugagaaugggggugagcaggcg

SEQ ID NO: 253766 - RNA, 32 nt, Human
ugcuggagaucuauagccaccuggucucaaug

SEQ ID NO: 253767 - RNA, 32 nt, Human
ugcuggagaugggguucuuaccaggaugggcu

SEQ ID NO: 253768 - RNA, 32 nt, Human
ugcuggagcaucuguucuacauguggauaucu

SEQ ID NO: 253769 - RNA, 32 nt, Human
ugcuggagcauuagaaugcaacagaaagagcc

SEQ ID NO: 253770 - RNA, 32 nt, Human
ugcuggagccaaagcuucuggcccaggggcag

SEQ ID NO: 253771 - RNA, 32 nt, Human
ugcuggagccacagggccagggccaugcagau

SEQ ID NO: 253772 - RNA, 23 nt, Human
ugcuggagcccaggaaauugagg

SEQ ID NO: 253773 - RNA, 32 nt, Human
ugcuggagccucuaguccacccucuccagugg

SEQ ID NO: 253774 - RNA, 32 nt, Human
ugcuggaggaagaggaagauuugugcagacca

SEQ ID NO: 253775 - RNA, 32 nt, Human
ugcuggaggaagaggauuccagccuguuggcc

SEQ ID NO: 253776 - RNA, 32 nt, Human
ugcuggaggagagguuuccuucagauugcuga

SEQ ID NO: 253777 - RNA, 32 nt, Human
ugcuggaggaggccaguguagagccagugaga

SEQ ID NO: 253778 - RNA, 32 nt, Human
ugcuggaggccugggauggaguucugggcuua

SEQ ID NO: 253779 - RNA, 21 nt, Human
ugcuggaggcuggaggcagug

SEQ ID NO: 253780 - RNA, 32 nt, Human
ugcuggagggcagacuggaggaaggggaaggc

SEQ ID NO: 253781 - RNA, 32 nt, Human
ugcuggagggcauccuggauggaauugaagug

SEQ ID NO: 253782 - RNA, 32 nt, Human
ugcuggagggcugugggcuccucugucucugg

SEQ ID NO: 253783 - RNA, 32 nt, Human
ugcuggaggggcuguccuccuuccugggaccc

SEQ ID NO: 253784 - RNA, 22 nt, Human
ugcuggagugggauccuuguua

SEQ ID NO: 253785 - RNA, 32 nt, Human
ugcuggaguguuuccagugcaccuguaggaac

SEQ ID NO: 253786 - RNA, 32 nt, Human
ugcuggaguuccugccaucggaggcuuccuga

SEQ ID NO: 253787 - RNA, 32 nt, Human
ugcuggauaaagaaaaggaauuuuagaaguga

SEQ ID NO: 253788 - RNA, 32 nt, Human
ugcuggauacuggaguuugagaggagggaggu

SEQ ID NO: 253789 - RNA, 32 nt, Human
ugcuggaucucaaagaugugccaagccaagga

SEQ ID NO: 253790 - RNA, 32 nt, Human
ugcuggaucucccagggcuacucacucaaguu

SEQ ID NO: 253791 - RNA, 32 nt, Human
ugcuggaugcuauacuguccagccaggacaca

SEQ ID NO: 253792 - RNA, 32 nt, Human
ugcuggauggacaccaaaccccaaggcccuca

SEQ ID NO: 253793 - RNA, 32 nt, Human
ugcuggaugucugccaauuuuugccuucauua

SEQ ID NO: 253794 - RNA, 32 nt, Human
ugcuggauuaggaaaggugacaugacacaggc

SEQ ID NO: 253795 - RNA, 32 nt, Human
ugcuggauuccagauucuggguccccaauccc

SEQ ID NO: 253796 - RNA, 32 nt, Human
ugcuggcaaauccuccuacccaaaaagggguc

SEQ ID NO: 253797 - RNA, 32 nt, Human
ugcuggcacagaacaguuccagaucuagacug

SEQ ID NO: 253798 - RNA, 18 nt, Human
ugcuggcacauuucccca

SEQ ID NO: 253799 - RNA, 18 nt, Human
ugcuggcaccaccaggca

SEQ ID NO: 253800 - RNA, 32 nt, Human
ugcuggcaccccggugcggaccacagagcaga

SEQ ID NO: 253801 - RNA, 32 nt, Human
ugcuggcaccuugaucuugaacuucccagccu

SEQ ID NO: 253802 - RNA, 32 nt, Human
ugcuggcaccuugaucuuggacuucccagccu

SEQ ID NO: 253803 - RNA, 32 nt, Human
ugcuggcacuucuccccucccuggcccuucuc

SEQ ID NO: 253804 - RNA, 32 nt, Human
ugcuggcagccugugccuuugucagcucuucu

SEQ ID NO: 253805 - RNA, 32 nt, Human
ugcuggcaggaaauaaaugaauguuuacugag

SEQ ID NO: 253806 - RNA, 32 nt, Human
ugcuggcaggaggcagacuugcagagcuuguu

SEQ ID NO: 253807 - RNA, 21 nt, Human
ugcuggcaggagggcggggug

SEQ ID NO: 253808 - RNA, 32 nt, Human
ugcuggcaggcaggcagggccaggaggguagg

SEQ ID NO: 253809 - RNA, 19 nt, Human
ugcuggcagguggcuggau

SEQ ID NO: 253810 - RNA, 32 nt, Human
ugcuggcaguugagcaauaauaucuuccuccu

SEQ ID NO: 253811 - RNA, 32 nt, Human
ugcuggcauaggaucugcccagaagagaaaau

SEQ ID NO: 253812 - RNA, 32 nt, Human
ugcuggcauccagcagauccccauggccagga

SEQ ID NO: 253813 - RNA, 32 nt, Human
ugcuggcauuacaggcaugagccaccacaccc

SEQ ID NO: 253814 - RNA, 21 nt, Human
ugcuggcauuacaggugugag

SEQ ID NO: 253815 - RNA, 31 nt, Human
ugcuggcauuuucagcagauccucauguguu

SEQ ID NO: 253816 - RNA, 32 nt, Human
ugcuggccaugaaucucugccucucccaggcu

SEQ ID NO: 253817 - RNA, 32 nt, Human
ugcuggccauggagccucauugcaaguuguuc

SEQ ID NO: 253818 - RNA, 32 nt, Human
ugcuggccauucugccuuucugacauuuccuu

SEQ ID NO: 253819 - RNA, 32 nt, Human
ugcuggcccacugugaccugacccgaccuugu

SEQ ID NO: 253820 - RNA, 32 nt, Human
ugcuggccccggcgagguagcuucuggaaggc

SEQ ID NO: 253821 - RNA, 32 nt, Human
ugcuggccccuggcuggaggggagggcagugg

SEQ ID NO: 253822 - RNA, 29 nt, Human
ugcuggccccugggugugccuggaggggg

SEQ ID NO: 253823 - RNA, 32 nt, Human
ugcuggcccucagaucaauggucguggcaggu

SEQ ID NO: 253824 - RNA, 32 nt, Human
ugcuggcccugagacauccagucuuccacacu

SEQ ID NO: 253825 - RNA, 32 nt, Human
ugcuggcccuggcuccgcagccuggauacuua

SEQ ID NO: 253826 - RNA, 32 nt, Human
ugcuggcccugggggcacucugugaguggggg

SEQ ID NO: 253827 - RNA, 32 nt, Human
ugcuggccucaaacuccugggcucuagcaauc

SEQ ID NO: 253828 - RNA, 32 nt, Human
ugcuggccucauuccuuccugaagggccuagg

SEQ ID NO: 253829 - RNA, 32 nt, Human
ugcuggccuccccuuacagugcuuguucgggg

SEQ ID NO: 253830 - RNA, 32 nt, Human
ugcuggccuuucuccuucgcaggaguccccca

SEQ ID NO: 253831 - RNA, 32 nt, Human
ugcuggcgcugggaucccgccucugccuggug

SEQ ID NO: 253832 - RNA, 32 nt, Human
ugcuggcuagggagggacagggcagggaggcu

SEQ ID NO: 253833 - RNA, 32 nt, Human
ugcuggcucaccuucuagcuguguggcccugg

SEQ ID NO: 253834 - RNA, 32 nt, Human
ugcuggcucacugcagccuccaccucccaggu

SEQ ID NO: 253835 - RNA, 21 nt, Human
ugcuggcucaugccuguaauc

SEQ ID NO: 253836 - RNA, 32 nt, Human
ugcuggcuccagccacagacuucaguuuucuu

SEQ ID NO: 253837 - RNA, 32 nt, Human
ugcuggcucccuuacuuuaccucucugucaug

SEQ ID NO: 253838 - RNA, 32 nt, Human
ugcuggcuccugcaucuucuucaagucugcuc

SEQ ID NO: 253839 - RNA, 32 nt, Human
ugcuggcucuggaggcuggaguucccgugcug

SEQ ID NO: 253840 - RNA, 23 nt, Human
ugcuggcucuucuucccuuugua

SEQ ID NO: 253841 - RNA, 32 nt, Human
ugcuggcugagcugcaagaggcucuauggcau

SEQ ID NO: 253842 - RNA, 32 nt, Human
ugcuggcugcagggucccaggugcaggagugg

SEQ ID NO: 253843 - RNA, 32 nt, Human
ugcuggcugcagguauuaaguccaaguuuauu

SEQ ID NO: 253844 - RNA, 32 nt, Human
ugcuggcugccucucugcuccaccuugugacc

SEQ ID NO: 253845 - RNA, 21 nt, Human
ugcuggcugcucccccuggug

SEQ ID NO: 253846 - RNA, 32 nt, Human
ugcuggcuggcgggacaggugggcaggacuga

SEQ ID NO: 253847 - RNA, 32 nt, Human
ugcuggcugggaaggaggagcaucagaccaca

SEQ ID NO: 253848 - RNA, 19 nt, Human
ugcuggcugggcgcagugg

SEQ ID NO: 253849 - RNA, 20 nt, Human
ugcuggcuguaaccagggca

SEQ ID NO: 253850 - RNA, 32 nt, Human
ugcuggcuuaccacucuucucucauggauccu

SEQ ID NO: 253851 - RNA, 32 nt, Human
ugcuggcuuggaggccgggugcaguggcucac

SEQ ID NO: 253852 - RNA, 22 nt, Human
ugcugggaaaagugacugcgau

SEQ ID NO: 253853 - RNA, 19 nt, Human
ugcugggaaccucagggua

SEQ ID NO: 253854 - RNA, 32 nt, Human
ugcugggaagaagagaccugggcuuggaagga

SEQ ID NO: 253855 - RNA, 18 nt, Human
ugcugggaagaucuggau

SEQ ID NO: 253856 - RNA, 32 nt, Human
ugcugggaagcaucugcgugugugagggggcu

SEQ ID NO: 253857 - RNA, 32 nt, Human
ugcugggaauacaggcaugagccaccgcacuc

SEQ ID NO: 253858 - RNA, 32 nt, Human
ugcugggaauacaggugugaaccaccacguuu

SEQ ID NO: 253859 - RNA, 32 nt, Human
ugcugggaccuccccugugaggggacagcgga

SEQ ID NO: 253860 - RNA, 32 nt, Human
ugcugggacuacaggcaucagccaccgugacc

SEQ ID NO: 253861 - RNA, 32 nt, Human
ugcugggacuacaggcaugagccaccacgccu

SEQ ID NO: 253862 - RNA, 32 nt, Human
ugcugggacuacaggcaugagccacugugccu

SEQ ID NO: 253863 - RNA, 32 nt, Human
ugcugggacuacaggugcaugcaaccacaccu

SEQ ID NO: 253864 - RNA, 32 nt, Human
ugcugggacuacaggugcaugcuacaaugccc

SEQ ID NO: 253865 - RNA, 32 nt, Human
ugcugggacugcaggcgugagccaccgcgccc

SEQ ID NO: 253866 - RNA, 19 nt, Human
ugcugggagaaguauguga

SEQ ID NO: 253867 - RNA, 20 nt, Human
ugcugggagaggaauuagau

SEQ ID NO: 253868 - RNA, 32 nt, Human
ugcugggagaggguugggggcagggggcaagg

SEQ ID NO: 253869 - RNA, 19 nt, Human
ugcugggagcaacuaguga

SEQ ID NO: 253870 - RNA, 32 nt, Human
ugcugggagcaucuccuugaugccuccaccau

SEQ ID NO: 253871 - RNA, 19 nt, Human
ugcugggagccaccaggca

SEQ ID NO: 253872 - RNA, 32 nt, Human
ugcugggagcucccccugccucuuuccccuac

SEQ ID NO: 253873 - RNA, 19 nt, Human
ugcugggaggcugcuggau

SEQ ID NO: 253874 - RNA, 32 nt, Human
ugcugggaggggcuggugaggcugcagcagag

SEQ ID NO: 253875 - RNA, 32 nt, Human
ugcugggaguucaccugccucuugcuuuuugu

SEQ ID NO: 253876 - RNA, 32 nt, Human
ugcugggaucacaggcaugaaccaccgcuccu

SEQ ID NO: 253877 - RNA, 32 nt, Human
ugcugggaucacaggcaugagccaccgaaccc

SEQ ID NO: 253878 - RNA, 32 nt, Human
ugcugggaucacaggcaugagccacugugccc

SEQ ID NO: 253879 - RNA, 32 nt, Human
ugcugggaugaaaggcacccuggaaguggaag

SEQ ID NO: 253880 - RNA, 32 nt, Human
ugcugggaugacaggcaugaaucacugugcuc

SEQ ID NO: 253881 - RNA, 32 nt, Human
ugcugggaugacaggcaugagccaccacgccu

SEQ ID NO: 253882 - RNA, 32 nt, Human
ugcugggaugacaggcaugagccaccgugccc

SEQ ID NO: 253883 - RNA, 20 nt, Human
ugcugggaugacaggcgugc

SEQ ID NO: 253884 - RNA, 32 nt, Human
ugcugggauuaauggcgugagccaccguaccu

SEQ ID NO: 253885 - RNA, 21 nt, Human
ugcugggauuacaagcgugag

SEQ ID NO: 253886 - RNA, 21 nt, Human
ugcugggauuacagaugugag

SEQ ID NO: 253887 - RNA, 21 nt, Human
ugcugggauuacaggagugag

SEQ ID NO: 253888 - RNA, 24 nt, Human
ugcugggauuacaggagugugcca

SEQ ID NO: 253889 - RNA, 32 nt, Human
ugcugggauuacaggcaagagccaccauacca

SEQ ID NO: 253890 - RNA, 32 nt, Human
ugcugggauuacaggcacgcgccaccacgccu

SEQ ID NO: 253891 - RNA, 32 nt, Human
ugcugggauuacaggcacgcucuaccacaccu

SEQ ID NO: 253892 - RNA, 18 nt, Human
ugcugggauuacaggcau

SEQ ID NO: 253893 - RNA, 32 nt, Human
ugcugggauuacaggcauaagacaccaugccu

SEQ ID NO: 253894 - RNA, 32 nt, Human
ugcugggauuacaggcauaagccaccgugccu

SEQ ID NO: 253895 - RNA, 32 nt, Human
ugcugggauuacaggcauaagcuaccacgcug

SEQ ID NO: 253896 - RNA, 32 nt, Human
ugcugggauuacaggcaucagccaccacaccc

SEQ ID NO: 253897 - RNA, 32 nt, Human
ugcugggauuacaggcaucagccaccaugccc

SEQ ID NO: 253898 - RNA, 32 nt, Human
ugcugggauuacaggcaucagccaccgcacca

SEQ ID NO: 253899 - RNA, 32 nt, Human
ugcugggauuacaggcaucagccacuaugccc

SEQ ID NO: 253900 - RNA, 32 nt, Human
ugcugggauuacaggcaucugccaccgcacuc

SEQ ID NO: 253901 - RNA, 32 nt, Human
ugcugggauuacaggcaugaaccaccacgccu

SEQ ID NO: 253902 - RNA, 32 nt, Human
ugcugggauuacaggcaugaaccaccaugccu

SEQ ID NO: 253903 - RNA, 32 nt, Human
ugcugggauuacaggcaugaaccaccgcuccc

SEQ ID NO: 253904 - RNA, 32 nt, Human
ugcugggauuacaggcaugaaccaccgugccc

SEQ ID NO: 253905 - RNA, 32 nt, Human
ugcugggauuacaggcaugaaccacugugccc

SEQ ID NO: 253906 - RNA, 32 nt, Human
ugcugggauuacaggcaugaaccaucauaccu

SEQ ID NO: 253907 - RNA, 32 nt, Human
ugcugggauuacaggcaugaaccgccaugccu

SEQ ID NO: 253908 - RNA, 32 nt, Human
ugcugggauuacaggcaugaaucaccacaacu

SEQ ID NO: 253909 - RNA, 32 nt, Human
ugcugggauuacaggcaugacccaccgcuccc

SEQ ID NO: 253910 - RNA, 21 nt, Human
ugcugggauuacaggcaugag

SEQ ID NO: 253911 - RNA, 32 nt, Human
ugcugggauuacaggcaugagccaccaaaccc

SEQ ID NO: 253912 - RNA, 32 nt, Human
ugcugggauuacaggcaugagccaccacaacc

SEQ ID NO: 253913 - RNA, 32 nt, Human
ugcugggauuacaggcaugagccaccacaccc

SEQ ID NO: 253914 - RNA, 32 nt, Human
ugcugggauuacaggcaugagccaccacaccu

SEQ ID NO: 253915 - RNA, 32 nt, Human
ugcugggauuacaggcaugagccaccacacug

SEQ ID NO: 253916 - RNA, 32 nt, Human
ugcugggauuacaggcaugagccaccacagcu

SEQ ID NO: 253917 - RNA, 32 nt, Human
ugcugggauuacaggcaugagccaccacaucu

SEQ ID NO: 253918 - RNA, 32 nt, Human
ugcugggauuacaggcaugagccaccacgccc

SEQ ID NO: 253919 - RNA, 32 nt, Human
ugcugggauuacaggcaugagccaccacgccu

SEQ ID NO: 253920 - RNA, 32 nt, Human
ugcugggauuacaggcaugagccaccacggcc

SEQ ID NO: 253921 - RNA, 32 nt, Human
ugcugggauuacaggcaugagccaccacuccu

SEQ ID NO: 253922 - RNA, 32 nt, Human
ugcugggauuacaggcaugagccaccaggccc

SEQ ID NO: 253923 - RNA, 32 nt, Human
ugcugggauuacaggcaugagccaccaucuuc

SEQ ID NO: 253924 - RNA, 32 nt, Human
ugcugggauuacaggcaugagccaccaugcca

SEQ ID NO: 253925 - RNA, 32 nt, Human
ugcugggauuacaggcaugagccaccaugccc

SEQ ID NO: 253926 - RNA, 32 nt, Human
ugcugggauuacaggcaugagccaccaugccu

SEQ ID NO: 253927 - RNA, 32 nt, Human
ugcugggauuacaggcaugagccaccaugucu

SEQ ID NO: 253928 - RNA, 32 nt, Human
ugcugggauuacaggcaugagccaccccgccc

SEQ ID NO: 253929 - RNA, 32 nt, Human
ugcugggauuacaggcaugagccaccccgccu

SEQ ID NO: 253930 - RNA, 27 nt, Human
ugcugggauuacaggcaugagccaccg

SEQ ID NO: 253931 - RNA, 32 nt, Human
ugcugggauuacaggcaugagccaccgagcuc

SEQ ID NO: 253932 - RNA, 32 nt, Human
ugcugggauuacaggcaugagccaccgcaccc

SEQ ID NO: 253933 - RNA, 32 nt, Human
ugcugggauuacaggcaugagccaccgcaccu

SEQ ID NO: 253934 - RNA, 32 nt, Human
ugcugggauuacaggcaugagccaccgcagcc

SEQ ID NO: 253935 - RNA, 32 nt, Human
ugcugggauuacaggcaugagccaccgcgcca

SEQ ID NO: 253936 - RNA, 32 nt, Human
ugcugggauuacaggcaugagccaccgcgccc

SEQ ID NO: 253937 - RNA, 32 nt, Human
ugcugggauuacaggcaugagccaccgcgccu

SEQ ID NO: 253938 - RNA, 32 nt, Human
ugcugggauuacaggcaugagccaccgcgcuu

SEQ ID NO: 253939 - RNA, 32 nt, Human
ugcugggauuacaggcaugagccaccgcucuc

SEQ ID NO: 253940 - RNA, 32 nt, Human
ugcugggauuacaggcaugagccaccgugccc

SEQ ID NO: 253941 - RNA, 32 nt, Human
ugcugggauuacaggcaugagccaccgugccu

SEQ ID NO: 253942 - RNA, 32 nt, Human
ugcugggauuacaggcaugagccaccgugcgg

SEQ ID NO: 253943 - RNA, 32 nt, Human
ugcugggauuacaggcaugagccaccguggcc

SEQ ID NO: 253944 - RNA, 32 nt, Human
ugcugggauuacaggcaugagccaccucaccc

SEQ ID NO: 253945 - RNA, 32 nt, Human
ugcugggauuacaggcaugagccaccucacuu

SEQ ID NO: 253946 - RNA, 32 nt, Human
ugcugggauuacaggcaugagccaccucgccu

SEQ ID NO: 253947 - RNA, 32 nt, Human
ugcugggauuacaggcaugagccaccugccca

SEQ ID NO: 253948 - RNA, 32 nt, Human
ugcugggauuacaggcaugagccacuacgccu

SEQ ID NO: 253949 - RNA, 32 nt, Human
ugcugggauuacaggcaugagccacugcaccc

SEQ ID NO: 253950 - RNA, 32 nt, Human
ugcugggauuacaggcaugagccacugcaccu

SEQ ID NO: 253951 - RNA, 32 nt, Human
ugcugggauuacaggcaugagccacugcaucc

SEQ ID NO: 253952 - RNA, 32 nt, Human
ugcugggauuacaggcaugagccacugcgcca

SEQ ID NO: 253953 - RNA, 32 nt, Human
ugcugggauuacaggcaugagccacugcgccc

SEQ ID NO: 253954 - RNA, 32 nt, Human
ugcugggauuacaggcaugagccacugcgccu

SEQ ID NO: 253955 - RNA, 32 nt, Human
ugcugggauuacaggcaugagccacugggcgc

SEQ ID NO: 253956 - RNA, 32 nt, Human
ugcugggauuacaggcaugagccacuguaccc

SEQ ID NO: 253957 - RNA, 32 nt, Human
ugcugggauuacaggcaugagccacugugccc

SEQ ID NO: 253958 - RNA, 32 nt, Human
ugcugggauuacaggcaugagccacugugccu

SEQ ID NO: 253959 - RNA, 32 nt, Human
ugcugggauuacaggcaugagccacugugcuc

SEQ ID NO: 253960 - RNA, 32 nt, Human
ugcugggauuacaggcaugagccacugugucc

SEQ ID NO: 253961 - RNA, 32 nt, Human
ugcugggauuacaggcaugagccacuguguuc

SEQ ID NO: 253962 - RNA, 32 nt, Human
ugcugggauuacaggcaugagccaucacaccu

SEQ ID NO: 253963 - RNA, 32 nt, Human
ugcugggauuacaggcaugagccaucgcccag

SEQ ID NO: 253964 - RNA, 32 nt, Human
ugcugggauuacaggcaugagccaucgcgccc

SEQ ID NO: 253965 - RNA, 32 nt, Human
ugcugggauuacaggcaugagcuaccacgccu

SEQ ID NO: 253966 - RNA, 32 nt, Human
ugcugggauuacaggcaugagcuaccgugccu

SEQ ID NO: 253967 - RNA, 32 nt, Human
ugcugggauuacaggcaugagcuacuaugccc

SEQ ID NO: 253968 - RNA, 32 nt, Human
ugcugggauuacaggcaugagggaccaagcuc

SEQ ID NO: 253969 - RNA, 32 nt, Human
ugcugggauuacaggcaugagucaccauaucc

SEQ ID NO: 253970 - RNA, 32 nt, Human
ugcugggauuacaggcauggagcaccgugccu

SEQ ID NO: 253971 - RNA, 32 nt, Human
ugcugggauuacaggcauggccaccacgccca

SEQ ID NO: 253972 - RNA, 32 nt, Human
ugcugggauuacaggcaugggccaccacgccu

SEQ ID NO: 253973 - RNA, 21 nt, Human
ugcugggauuacaggccugag

SEQ ID NO: 253974 - RNA, 18 nt, Human
ugcugggauuacaggcgu

SEQ ID NO: 253975 - RNA, 20 nt, Human
ugcugggauuacaggcguga

SEQ ID NO: 253976 - RNA, 21 nt, Human
ugcugggauuacaggcgugag

SEQ ID NO: 253977 - RNA, 32 nt, Human
ugcugggauuacaggcgugagccacccugacu

SEQ ID NO: 253978 - RNA, 32 nt, Human
ugcugggauuacaggcgugagccaccucaccc

SEQ ID NO: 253979 - RNA, 32 nt, Human
ugcugggauuacaggcgugagccaccucaccu

SEQ ID NO: 253980 - RNA, 32 nt, Human
ugcugggauuacaggcgugagccaccuugccc

SEQ ID NO: 253981 - RNA, 32 nt, Human
ugcugggauuacaggcgugagccacuccaccc

SEQ ID NO: 253982 - RNA, 32 nt, Human
ugcugggauuacaggcgugagccacucugccc

SEQ ID NO: 253983 - RNA, 32 nt, Human
ugcugggauuacaggcgugcaccacugagucc

SEQ ID NO: 253984 - RNA, 21 nt, Human
ugcugggauuacaggcguggg

SEQ ID NO: 253985 - RNA, 32 nt, Human
ugcugggauuacaggcgugugagccaccacgc

SEQ ID NO: 253986 - RNA, 32 nt, Human
ugcugggauuacaggcgugugccaccacccug

SEQ ID NO: 253987 - RNA, 32 nt, Human
ugcugggauuacaggcgugugccaccaugccu

SEQ ID NO: 253988 - RNA, 32 nt, Human
ugcugggauuacaggcuucagccaccacaccc

SEQ ID NO: 253989 - RNA, 21 nt, Human
ugcugggauuacaggcuugag

SEQ ID NO: 253990 - RNA, 21 nt, Human
ugcugggauuacaggggugag

SEQ ID NO: 253991 - RNA, 32 nt, Human
ugcugggauuacaggugcgagccaccgugccc

SEQ ID NO: 253992 - RNA, 18 nt, Human
ugcugggauuacaggugu

SEQ ID NO: 253993 - RNA, 21 nt, Human
ugcugggauuacaggugugag

SEQ ID NO: 253994 - RNA, 32 nt, Human
ugcugggauuacaggugugagcauccagccag

SEQ ID NO: 253995 - RNA, 22 nt, Human
ugcugggauuacaggugugcca

SEQ ID NO: 253996 - RNA, 21 nt, Human
ugcugggauuacaugcaugag

SEQ ID NO: 253997 - RNA, 21 nt, Human
ugcugggauuagaggugugag

SEQ ID NO: 253998 - RNA, 20 nt, Human
ugcugggauuauagcuguga

SEQ ID NO: 253999 - RNA, 18 nt, Human
ugcugggauuauaggcau

SEQ ID NO: 254000 - RNA, 32 nt, Human
ugcugggauuauaggcaugcgccaccaugccc

SEQ ID NO: 254001 - RNA, 32 nt, Human
ugcugggauuauaggcaugugccaccacaucu

SEQ ID NO: 254002 - RNA, 21 nt, Human
ugcugggauuauaggcgugag

SEQ ID NO: 254003 - RNA, 32 nt, Human
ugcugggauuauaggcuggguguggugagcca

SEQ ID NO: 254004 - RNA, 32 nt, Human
ugcugggauuauaggugugagccacccugcuc

SEQ ID NO: 254005 - RNA, 21 nt, Human
ugcugggauuccaggcaugag

SEQ ID NO: 254006 - RNA, 18 nt, Human
ugcugggauugcaggcau

SEQ ID NO: 254007 - RNA, 32 nt, Human
ugcugggauugcaggcaugagccaccaugccu

SEQ ID NO: 254008 - RNA, 32 nt, Human
ugcugggauugcaggcaugagccaccgcgccc

SEQ ID NO: 254009 - RNA, 32 nt, Human
ugcugggauugcaggcaugagccaccgugccc

SEQ ID NO: 254010 - RNA, 32 nt, Human
ugcugggauugcaggcgugagccacuuuccca

SEQ ID NO: 254011 - RNA, 22 nt, Human
ugcugggauuuacaggcaugag

SEQ ID NO: 254012 - RNA, 32 nt, Human
ugcugggcaaagcacgaucugcagcuuugaag

SEQ ID NO: 254013 - RNA, 32 nt, Human
ugcugggcacaacugggcucuaccuuugaguu

SEQ ID NO: 254014 - RNA, 21 nt, Human
ugcugggcacauagcugugau

SEQ ID NO: 254015 - RNA, 23 nt, Human
ugcugggcacauagcugugauca

SEQ ID NO: 254016 - RNA, 32 nt, Human
ugcugggcacuaugcuaagcacuuugggagca

SEQ ID NO: 254017 - RNA, 32 nt, Human
ugcugggcacuugcacugugacuuuggagugc

SEQ ID NO: 254018 - RNA, 32 nt, Human
ugcugggcagcaccuccuaacuucagggaaua

SEQ ID NO: 254019 - RNA, 32 nt, Human
ugcugggcaggcaaccugggguccagcucaaa

SEQ ID NO: 254020 - RNA, 32 nt, Human
ugcugggcaggcgggcaggcaggccuggggcu

SEQ ID NO: 254021 - RNA, 32 nt, Human
ugcugggcaugcuguguuaggcuccaagggaa

SEQ ID NO: 254022 - RNA, 32 nt, Human
ugcugggccagccccaccuggagcucaguaaa

SEQ ID NO: 254023 - RNA, 32 nt, Human
ugcugggcccagggcccuagguuugcucguca

SEQ ID NO: 254024 - RNA, 32 nt, Human
ugcugggccuccugccuggccgcccagggcug

SEQ ID NO: 254025 - RNA, 32 nt, Human
ugcugggccugaacauaauuucaagaggagga

SEQ ID NO: 254026 - RNA, 32 nt, Human
ugcugggccugagcugucugucucguuucugu

SEQ ID NO: 254027 - RNA, 32 nt, Human
ugcugggcuaaccagcccacagagcucacauu

SEQ ID NO: 254028 - RNA, 32 nt, Human
ugcugggcucaagcaauccucccaccucagcc

SEQ ID NO: 254029 - RNA, 32 nt, Human
ugcugggcucaaggaauccuccugccccagcc

SEQ ID NO: 254030 - RNA, 32 nt, Human
ugcugggcucaagugauccuccugccucagcc

SEQ ID NO: 254031 - RNA, 32 nt, Human
ugcugggcucucucacacagcacccggcccca

SEQ ID NO: 254032 - RNA, 32 nt, Human
ugcugggcugguggcucaucaggccugggccc

SEQ ID NO: 254033 - RNA, 32 nt, Human
ugcugggcuuaagugauccuccugccucagcc

SEQ ID NO: 254034 - RNA, 21 nt, Human
ugcuggggaaaguggcuuggu

SEQ ID NO: 254035 - RNA, 20 nt, Human
ugcuggggaaguucccugug

SEQ ID NO: 254036 - RNA, 20 nt, Human
ugcuggggaaguuuguuggu

SEQ ID NO: 254037 - RNA, 32 nt, Human
ugcuggggaaucaauaaaggaggcagagcaac

SEQ ID NO: 254038 - RNA, 20 nt, Human
ugcuggggacacuacaggca

SEQ ID NO: 254039 - RNA, 21 nt, Human
ugcuggggacagcagcugggu

SEQ ID NO: 254040 - RNA, 32 nt, Human
ugcuggggacaggacagaugaggcagaagggg

SEQ ID NO: 254041 - RNA, 32 nt, Human
ugcuggggagagaagccgggaggcucagccug

SEQ ID NO: 254042 - RNA, 19 nt, Human
ugcuggggagccaaaggca

SEQ ID NO: 254043 - RNA, 32 nt, Human
ugcuggggagccaaaggcauccaggccagggc

SEQ ID NO: 254044 - RNA, 32 nt, Human
ugcuggggaggcuaaagcaggaggauggcuuu

SEQ ID NO: 254045 - RNA, 32 nt, Human
ugcuggggaggcugaggcaggagaauggcugg

SEQ ID NO: 254046 - RNA, 32 nt, Human
ugcuggggagggggugaguggugaggaccagg

SEQ ID NO: 254047 - RNA, 20 nt, Human
ugcuggggagguaaccguga

SEQ ID NO: 254048 - RNA, 21 nt, Human
ugcuggggaguggggcaaggg

SEQ ID NO: 254049 - RNA, 19 nt, Human
ugcuggggaugccagagca

SEQ ID NO: 254050 - RNA, 21 nt, Human
ugcuggggcagaggcaggggu

SEQ ID NO: 254051 - RNA, 32 nt, Human
ugcuggggccagaaccccagcccugugccucc

SEQ ID NO: 254052 - RNA, 30 nt, Human
ugcuggggccucuccuugcugugugugagg

SEQ ID NO: 254053 - RNA, 24 nt, Human
ugcuggggccuuggggcaggagug

SEQ ID NO: 254054 - RNA, 32 nt, Human
ugcuggggcugaccauuagaacugagauggag

SEQ ID NO: 254055 - RNA, 32 nt, Human
ugcuggggcugcagcgcugccuccgagaccga

SEQ ID NO: 254056 - RNA, 32 nt, Human
ugcugggggaaagggaaaggaaaucagcaacu

SEQ ID NO: 254057 - RNA, 19 nt, Human
ugcugggggagagcugggu

SEQ ID NO: 254058 - RNA, 32 nt, Human
ugcugggggagcggcacuggggacuggaggcu

SEQ ID NO: 254059 - RNA, 32 nt, Human
ugcugggggagucaggcugcacuggcgggggu

SEQ ID NO: 254060 - RNA, 32 nt, Human
ugcugggggauggguggguacuagggagacug

SEQ ID NO: 254061 - RNA, 32 nt, Human
ugcugggggcagagacagaggagaagcuguuu

SEQ ID NO: 254062 - RNA, 32 nt, Human
ugcugggggcggggcuugguggugacugcugg

SEQ ID NO: 254063 - RNA, 20 nt, Human
ugcugggggcugggcagggg

SEQ ID NO: 254064 - RNA, 16 nt, Human
ugcugggggcuguggg

SEQ ID NO: 254065 - RNA, 32 nt, Human
ugcuggggguagaccgggccucaccagcuucc

SEQ ID NO: 254066 - RNA, 32 nt, Human
ugcugggggugagcuguacucuucugacugcc

SEQ ID NO: 254067 - RNA, 32 nt, Human
ugcugggggugcuaauuacauggcaggaagaa

SEQ ID NO: 254068 - RNA, 20 nt, Human
ugcugggggugggggcgggg

SEQ ID NO: 254069 - RNA, 32 nt, Human
ugcuggggguuaggacuuaagcacagaagauu

SEQ ID NO: 254070 - RNA, 32 nt, Human
ugcuggggucccauccuuucucccuggcugcc

SEQ ID NO: 254071 - RNA, 32 nt, Human
ugcugggguccugugugucgugcauuguugau

SEQ ID NO: 254072 - RNA, 26 nt, Human
ugcuggggugcuccggauuuugcggg

SEQ ID NO: 254073 - RNA, 32 nt, Human
ugcuggggugguaauaaaauguuaccugcaaa

SEQ ID NO: 254074 - RNA, 32 nt, Human
ugcugggguuacaggcaugagccaccacaccc

SEQ ID NO: 254075 - RNA, 32 nt, Human
ugcugggguuacaggugugugccaccacgccu

SEQ ID NO: 254076 - RNA, 23 nt, Human
ugcuggguacuccagaggugcca

SEQ ID NO: 254077 - RNA, 32 nt, Human
ugcuggguacuccagaggugccacugguggaa

SEQ ID NO: 254078 - RNA, 32 nt, Human
ugcuggguagagaagaaagcgagggugaggga

SEQ ID NO: 254079 - RNA, 22 nt, Human
ugcugggucaccagcagcgggu

SEQ ID NO: 254080 - RNA, 22 nt, Human
ugcugggucaccagcgggggug

SEQ ID NO: 254081 - RNA, 32 nt, Human
ugcugggucaccaggagaauggacccuuccuc

SEQ ID NO: 254082 - RNA, 32 nt, Human
ugcugggucaccaggagaauggacgcuuccuc

SEQ ID NO: 254083 - RNA, 32 nt, Human
ugcugggucaccaguagaauggacccuuccuc

SEQ ID NO: 254084 - RNA, 20 nt, Human
ugcugggucagaacguguca

SEQ ID NO: 254085 - RNA, 19 nt, Human
ugcugggucccgggaaggg

SEQ ID NO: 254086 - RNA, 23 nt, Human
ugcugggucgggccgacgugcca

SEQ ID NO: 254087 - RNA, 32 nt, Human
ugcugggucugaggccccugccuccaagauuu

SEQ ID NO: 254088 - RNA, 32 nt, Human
ugcugggucugucagcucucggaauagggaca

SEQ ID NO: 254089 - RNA, 28 nt, Human
ugcugggucuuguuuaguaaacuuguua

SEQ ID NO: 254090 - RNA, 32 nt, Human
ugcugggugauauagucaaaauuugcuuauuu

SEQ ID NO: 254091 - RNA, 32 nt, Human
ugcugggugaucucuaggacccaggagcagag

SEQ ID NO: 254092 - RNA, 32 nt, Human
ugcuggguggaaauauucagaugcugcuuaaa

SEQ ID NO: 254093 - RNA, 19 nt, Human
ugcuggguggaugcagugg

SEQ ID NO: 254094 - RNA, 32 nt, Human
ugcuggguggccuggcugaugcucagaggccu

SEQ ID NO: 254095 - RNA, 32 nt, Human
ugcugggugggaggaggagggugggauuugug

SEQ ID NO: 254096 - RNA, 32 nt, Human
ugcuggguggggugccacagggcgggguucag

SEQ ID NO: 254097 - RNA, 19 nt, Human
ugcuggguggugacuggau

SEQ ID NO: 254098 - RNA, 32 nt, Human
ugcuggguguucucaguccuugccaugaagua

SEQ ID NO: 254099 - RNA, 22 nt, Human
ugcuggguguuggagcagagug

SEQ ID NO: 254100 - RNA, 32 nt, Human
ugcuggguucaagcgauucuccugccucagcc

SEQ ID NO: 254101 - RNA, 22 nt, Human
ugcuggguucccacucccggcc

SEQ ID NO: 254102 - RNA, 20 nt, Human
ugcuggguugcaggggcagg

SEQ ID NO: 254103 - RNA, 32 nt, Human
ugcuggguugggggcgugggaggcagaagaca

SEQ ID NO: 254104 - RNA, 32 nt, Human
ugcuggguugguuaggucuggugacccuggag

SEQ ID NO: 254105 - RNA, 22 nt, Human
ugcuggguugucagugaugcca

SEQ ID NO: 254106 - RNA, 32 nt, Human
ugcuggguugucuuuuuccauguaacuuaagc

SEQ ID NO: 254107 - RNA, 21 nt, Human
ugcuggguuuacaggcaugag

SEQ ID NO: 254108 - RNA, 32 nt, Human
ugcuggguuuacaggcaugagccaccacaccc

SEQ ID NO: 254109 - RNA, 32 nt, Human
ugcuggguuuacaggcaugagccaccacgccc

SEQ ID NO: 254110 - RNA, 18 nt, Human
ugcuggguuucaacagac

SEQ ID NO: 254111 - RNA, 21 nt, Human
ugcuggguuucagggaguguc

SEQ ID NO: 254112 - RNA, 20 nt, Human
ugcuggguuucugaacugcu

SEQ ID NO: 254113 - RNA, 32 nt, Human
ugcugguaaucucccuguagcguaaacauagu

SEQ ID NO: 254114 - RNA, 32 nt, Human
ugcugguagagccacaucacccuuacauauac

SEQ ID NO: 254115 - RNA, 32 nt, Human
ugcugguaucaugggaacuccagccugcuauc

SEQ ID NO: 254116 - RNA, 32 nt, Human
ugcugguauucuccucuuuaccugguagggau

SEQ ID NO: 254117 - RNA, 31 nt, Human
ugcuggucaauaaaugugucagaaaaugagu

SEQ ID NO: 254118 - RNA, 32 nt, Human
ugcuggucacugcaaccucugccuccuggguu

SEQ ID NO: 254119 - RNA, 32 nt, Human
ugcugguccgggcuggccucucuaagacagug

SEQ ID NO: 254120 - RNA, 32 nt, Human
ugcugguccuggcuauuuuugugucauuuauu

SEQ ID NO: 254121 - RNA, 32 nt, Human
ugcugguccuucagacccugcccgaacuccca

SEQ ID NO: 254122 - RNA, 32 nt, Human
ugcuggucgauguccacuuucugcuuuucuuu

SEQ ID NO: 254123 - RNA, 32 nt, Human
ugcuggucucaaacucccaaccucaggugauc

SEQ ID NO: 254124 - RNA, 32 nt, Human
ugcuggucucaaacuccugaccucgggugauc

SEQ ID NO: 254125 - RNA, 32 nt, Human
ugcuggucucaaacuccugggcucaagcaauc

SEQ ID NO: 254126 - RNA, 32 nt, Human
ugcuggucuccugugugggcaggugugggggu

SEQ ID NO: 254127 - RNA, 32 nt, Human
ugcuggucucgaacuccugaccucagaugauu

SEQ ID NO: 254128 - RNA, 32 nt, Human
ugcuggucucgaacuccugaccucagguguuc

SEQ ID NO: 254129 - RNA, 32 nt, Human
ugcuggucucgaacuccugggcucaagcgauc

SEQ ID NO: 254130 - RNA, 32 nt, Human
ugcuggucucucucuuuaauacuucucaaauc

SEQ ID NO: 254131 - RNA, 32 nt, Human
ugcuggucucuucugguagggcagcagugucc

SEQ ID NO: 254132 - RNA, 32 nt, Human
ugcuggugaagcuccuggaagugauggaagga

SEQ ID NO: 254133 - RNA, 32 nt, Human
ugcuggugacccagcuuccuuuauaggcggac

SEQ ID NO: 254134 - RNA, 19 nt, Human
ugcuggugacgugcaggug

SEQ ID NO: 254135 - RNA, 32 nt, Human
ugcuggugagcagcagcaugcagaccagcugu

SEQ ID NO: 254136 - RNA, 32 nt, Human
ugcuggugagccaggugaccaucgccauguac

SEQ ID NO: 254137 - RNA, 32 nt, Human
ugcuggugaggguggucgcauguccauggauc

SEQ ID NO: 254138 - RNA, 32 nt, Human
ugcuggugaguggaaagcagagggugaucuuu

SEQ ID NO: 254139 - RNA, 32 nt, Human
ugcuggugccagugggagacugccgccuccuc

SEQ ID NO: 254140 - RNA, 32 nt, Human
ugcuggugcucccguuccccagacccuacccc

SEQ ID NO: 254141 - RNA, 32 nt, Human
ugcuggugcugguguaggcaagugcugcuuug

SEQ ID NO: 254142 - RNA, 19 nt, Human
ugcugguggaggcuguggu

SEQ ID NO: 254143 - RNA, 32 nt, Human
ugcugguggcucugaccugcuacuucuggaaa

SEQ ID NO: 254144 - RNA, 32 nt, Human
ugcuggugggcugggagucugagcccaucuug

SEQ ID NO: 254145 - RNA, 17 nt, Human
ugcuggugugccuggag

SEQ ID NO: 254146 - RNA, 29 nt, Human
ugcuggugugucuuggugccuggacuuga

SEQ ID NO: 254147 - RNA, 32 nt, Human
ugcugguguuaugauucaguauuaacucucaa

SEQ ID NO: 254148 - RNA, 32 nt, Human
ugcugguguuucccgcccagacagaucugcau

SEQ ID NO: 254149 - RNA, 32 nt, Human
ugcugguguuuggugaggaagcuccuaggaau

SEQ ID NO: 254150 - RNA, 32 nt, Human
ugcugguucauaaucagcugucugaccacguu

SEQ ID NO: 254151 - RNA, 32 nt, Human
ugcugguucuacauuaggguccauauuuaguu

SEQ ID NO: 254152 - RNA, 25 nt, Human
ugcugguucuguugccaccugggca

SEQ ID NO: 254153 - RNA, 32 nt, Human
ugcugguugggguugcucugauauacagcccu

SEQ ID NO: 254154 - RNA, 32 nt, Human
ugcugguuuucaucguaacacagaacgagguu

SEQ ID NO: 254155 - RNA, 32 nt, Human
ugcuguaaacuuaacuguucuuugccagaaca

SEQ ID NO: 254156 - RNA, 22 nt, Human
ugcuguaaccuaagaaacugcu

SEQ ID NO: 254157 - RNA, 32 nt, Human
ugcuguaacuuccuccccuuucugucaauugg

SEQ ID NO: 254158 - RNA, 32 nt, Human
ugcuguaaucccaucacuuugggaggccaggg

SEQ ID NO: 254159 - RNA, 32 nt, Human
ugcuguaauuggcagcagaaauccaaauuugu

SEQ ID NO: 254160 - RNA, 32 nt, Human
ugcuguacauacccuccuuuccuucuaccuau

SEQ ID NO: 254161 - RNA, 32 nt, Human
ugcuguaccagcuggcucacacgcugcccuuc

SEQ ID NO: 254162 - RNA, 32 nt, Human
ugcuguacuccaauuuucuuugcaaggccuua

SEQ ID NO: 254163 - RNA, 32 nt, Human
ugcuguagaagaggggaggaaacaagccagug

SEQ ID NO: 254164 - RNA, 32 nt, Human
ugcuguagacacugcccaugguccacuucgua

SEQ ID NO: 254165 - RNA, 32 nt, Human
ugcuguagagauagcccccacccaggggaugg

SEQ ID NO: 254166 - RNA, 32 nt, Human
ugcuguagagcucucccugccucucucucugg

SEQ ID NO: 254167 - RNA, 32 nt, Human
ugcuguagcaagagugucucucuagauuccuc

SEQ ID NO: 254168 - RNA, 32 nt, Human
ugcuguagccugggugacagugugagauucug

SEQ ID NO: 254169 - RNA, 24 nt, Human
ugcuguagcguagauagcugugau

SEQ ID NO: 254170 - RNA, 24 nt, Human
ugcuguagcguggauagcugugau

SEQ ID NO: 254171 - RNA, 32 nt, Human
ugcuguaggaguugaacaucuuugccagcucc

SEQ ID NO: 254172 - RNA, 32 nt, Human
ugcuguaggauggaacaggauauuguugaagc

SEQ ID NO: 254173 - RNA, 32 nt, Human
ugcuguaggcagcagagaagcauggaggaaaa

SEQ ID NO: 254174 - RNA, 24 nt, Human
ugcuguagucuuccccaguccuca

SEQ ID NO: 254175 - RNA, 32 nt, Human
ugcuguaucugugcuuugcccacaugcccuug

SEQ ID NO: 254176 - RNA, 32 nt, Human
ugcuguaugaagcacaaaagcagccauagaca

SEQ ID NO: 254177 - RNA, 32 nt, Human
ugcuguaugcugggcccugcgcugugcacguu

SEQ ID NO: 254178 - RNA, 32 nt, Human
ugcuguauggagucugcagguaaacaugccug

SEQ ID NO: 254179 - RNA, 32 nt, Human
ugcuguauuaacaucccuccccagacauccau

SEQ ID NO: 254180 - RNA, 32 nt, Human
ugcuguauugcccaggcuggagugugguggca

SEQ ID NO: 254181 - RNA, 32 nt, Human
ugcuguauuuguucaucucaaaccuagaugua

SEQ ID NO: 254182 - RNA, 32 nt, Human
ugcugucaagacuguguguguggauuucccac

SEQ ID NO: 254183 - RNA, 32 nt, Human
ugcugucacagaaggacaaaauauuccuagac

SEQ ID NO: 254184 - RNA, 32 nt, Human
ugcugucacccauuccagccuaaaugugacca

SEQ ID NO: 254185 - RNA, 32 nt, Human
ugcugucaccugcacuauccaauuaguauuuu

SEQ ID NO: 254186 - RNA, 32 nt, Human
ugcugucacgcccaaccucuuugggagaagua

SEQ ID NO: 254187 - RNA, 32 nt, Human
ugcugucacugucaaucugcuauauuuuucac

SEQ ID NO: 254188 - RNA, 32 nt, Human
ugcugucagaaagugggagugauuuugcaacu

SEQ ID NO: 254189 - RNA, 32 nt, Human
ugcugucagccaacaggugccaaaaaugcaaa

SEQ ID NO: 254190 - RNA, 32 nt, Human
ugcugucagccacccuuccuucauacacauag

SEQ ID NO: 254191 - RNA, 32 nt, Human
ugcugucagcccagggugggagcaggaaauga

SEQ ID NO: 254192 - RNA, 32 nt, Human
ugcugucagggagaggauggcagauggaggca

SEQ ID NO: 254193 - RNA, 32 nt, Human
ugcugucaggucugagucgguuggagucugac

SEQ ID NO: 254194 - RNA, 20 nt, Human
ugcugucagugccgcaggug

SEQ ID NO: 254195 - RNA, 32 nt, Human
ugcugucaguguccuugggagucaccagcacc

SEQ ID NO: 254196 - RNA, 32 nt, Human
ugcugucaucuuggugguauuucuuggcucac

SEQ ID NO: 254197 - RNA, 32 nt, Human
ugcugucauggguuaaucucucaggccuccag

SEQ ID NO: 254198 - RNA, 32 nt, Human
ugcugucauucaaagcuagauguaacuccuac

SEQ ID NO: 254199 - RNA, 32 nt, Human
ugcugucauucuauaugauauugcucaaugug

SEQ ID NO: 254200 - RNA, 32 nt, Human
ugcugucauuggagcggugggcacuguuaaga

SEQ ID NO: 254201 - RNA, 32 nt, Human
ugcuguccaaaccagcaaacuuccugggcaaa

SEQ ID NO: 254202 - RNA, 17 nt, Human
ugcuguccaccugcucc

SEQ ID NO: 254203 - RNA, 32 nt, Human
ugcuguccacgucaguucaugaggcaacgucg

SEQ ID NO: 254204 - RNA, 32 nt, Human
ugcuguccacuaagcacugcacaaacaagcaa

SEQ ID NO: 254205 - RNA, 17 nt, Human
ugcuguccaucuuccca

SEQ ID NO: 254206 - RNA, 32 nt, Human
ugcuguccaugcugggagaucagagcaacagc

SEQ ID NO: 254207 - RNA, 32 nt, Human
ugcugucccauggacgcuccagucucuuccgu

SEQ ID NO: 254208 - RNA, 32 nt, Human
ugcuguccccuccccucuguuuacaucucccc

SEQ ID NO: 254209 - RNA, 32 nt, Human
ugcuguccccucccucucccucagucuccucu

SEQ ID NO: 254210 - RNA, 32 nt, Human
ugcugucccugccuauuccccuucaugcuggc

SEQ ID NO: 254211 - RNA, 32 nt, Human
ugcuguccggacuaggaggccauguucaaugg

SEQ ID NO: 254212 - RNA, 32 nt, Human
ugcuguccuccccugcacugaccccacucgcc

SEQ ID NO: 254213 - RNA, 32 nt, Human
ugcuguccugaaacccagaagugauggagaga

SEQ ID NO: 254214 - RNA, 32 nt, Human
ugcuguccugagagacaacacugggguuagac

SEQ ID NO: 254215 - RNA, 32 nt, Human
ugcuguccugggaggugguguuggaggcccca

SEQ ID NO: 254216 - RNA, 32 nt, Human
ugcuguccuggggcgggcacucucaggcaacc

SEQ ID NO: 254217 - RNA, 32 nt, Human
ugcuguccugugccugccuccaccucuuuaac

SEQ ID NO: 254218 - RNA, 32 nt, Human
ugcuguccuucccagccgccucugcuccucgg

SEQ ID NO: 254219 - RNA, 32 nt, Human
ugcugucguuaagagcuuucgaggaaggagua

SEQ ID NO: 254220 - RNA, 32 nt, Human
ugcugucuauccucucuucucuccuugcagga

SEQ ID NO: 254221 - RNA, 32 nt, Human
ugcugucucacccaggcuggagugcaguggca

SEQ ID NO: 254222 - RNA, 32 nt, Human
ugcugucuccccggcuggagcgcaguggcacg

SEQ ID NO: 254223 - RNA, 27 nt, Human
ugcugucuccgaacuucucuguugcaa

SEQ ID NO: 254224 - RNA, 32 nt, Human
ugcugucucuaauugauucaagggccuagauu

SEQ ID NO: 254225 - RNA, 32 nt, Human
ugcugucucugccuccuuucugcugucaccac

SEQ ID NO: 254226 - RNA, 32 nt, Human
ugcugucucuuuccuuuugccuauucuggcaa

SEQ ID NO: 254227 - RNA, 32 nt, Human
ugcugucugaaggucacgaucauguuaccaua

SEQ ID NO: 254228 - RNA, 32 nt, Human
ugcugucuggacuuugcugucucugaacagua

SEQ ID NO: 254229 - RNA, 32 nt, Human
ugcugucuggcugacauuaauggccaauauuu

SEQ ID NO: 254230 - RNA, 23 nt, Human
ugcugucugucuccaccccagcc

SEQ ID NO: 254231 - RNA, 32 nt, Human
ugcugucuucaagaucuaccugucuacagcau

SEQ ID NO: 254232 - RNA, 32 nt, Human
ugcugucuuggaccugucuguuggguuuaguc

SEQ ID NO: 254233 - RNA, 32 nt, Human
ugcugucuuggucuccccuguggaaacccuuc

SEQ ID NO: 254234 - RNA, 32 nt, Human
ugcugucuuucuacuuuuuaauuuaaauaccc

SEQ ID NO: 254235 - RNA, 32 nt, Human
ugcugugaagagaguucuuuauaaagccugua

SEQ ID NO: 254236 - RNA, 32 nt, Human
ugcugugaccauagcccacugcagccuccacc

SEQ ID NO: 254237 - RNA, 32 nt, Human
ugcugugaccucgugcagccuuggggacccug

SEQ ID NO: 254238 - RNA, 32 nt, Human
ugcugugagauccuggacaagccauguaacuu

SEQ ID NO: 254239 - RNA, 32 nt, Human
ugcugugagccaccuccagccucggguggcug

SEQ ID NO: 254240 - RNA, 32 nt, Human
ugcugugagggaggggaaaagcauuuuucaau

SEQ ID NO: 254241 - RNA, 21 nt, Human
ugcugugaucauaacugugau

SEQ ID NO: 254242 - RNA, 32 nt, Human
ugcugugaucggccuggaaugucaggcuguga

SEQ ID NO: 254243 - RNA, 32 nt, Human
ugcugugaugugccuuucccugcaguccuucc

SEQ ID NO: 254244 - RNA, 32 nt, Human
ugcugugauucuguuuuaaguccauaccuugu

SEQ ID NO: 254245 - RNA, 32 nt, Human
ugcugugcacacugugugugaugaaucucgcc

SEQ ID NO: 254246 - RNA, 32 nt, Human
ugcugugcagccugcagaacugugagccaauu

SEQ ID NO: 254247 - RNA, 32 nt, Human
ugcugugcagggcucccggaggacaggaccuu

SEQ ID NO: 254248 - RNA, 32 nt, Human
ugcugugcauucacucuaagaugaggagaaca

SEQ ID NO: 254249 - RNA, 32 nt, Human
ugcugugccacauugucuuccccagaagcuca

SEQ ID NO: 254250 - RNA, 32 nt, Human
ugcugugccaugaccagcaguguugguggcca

SEQ ID NO: 254251 - RNA, 32 nt, Human
ugcugugccccaccacgucuggcucccugccc

SEQ ID NO: 254252 - RNA, 32 nt, Human
ugcugugccucugaagcaccugcucacagaag

SEQ ID NO: 254253 - RNA, 32 nt, Human
ugcugugccugggguccacagagccgggaggu

SEQ ID NO: 254254 - RNA, 32 nt, Human
ugcugugccuuagggcccuucucauagcuguu

SEQ ID NO: 254255 - RNA, 32 nt, Human
ugcugugcucacaacacuugugucugccacau

SEQ ID NO: 254256 - RNA, 32 nt, Human
ugcugugcuccuguggcagugauggggccugg

SEQ ID NO: 254257 - RNA, 32 nt, Human
ugcugugcugcugcuuuuccuacuucugcccu

SEQ ID NO: 254258 - RNA, 32 nt, Human
ugcugugcugggaaggccgaggaugggggccc

SEQ ID NO: 254259 - RNA, 32 nt, Human
ugcugugcuggggcagcuuccucugcuacgcc

SEQ ID NO: 254260 - RNA, 32 nt, Human
ugcugugcuguuucuuuuucuucuuccugcug

SEQ ID NO: 254261 - RNA, 32 nt, Human
ugcugugcuucaaagccuuaacugucaaaucu

SEQ ID NO: 254262 - RNA, 32 nt, Human
ugcugugcuuggcugggcucugcugugccccu

SEQ ID NO: 254263 - RNA, 32 nt, Human
ugcuguggacugcaucaggucucagugucccu

SEQ ID NO: 254264 - RNA, 32 nt, Human
ugcuguggacuucuuccagcagguuugaagau

SEQ ID NO: 254265 - RNA, 32 nt, Human
ugcuguggaggcagccucaaugcugaaaaugg

SEQ ID NO: 254266 - RNA, 32 nt, Human
ugcuguggaguucuuuacaaagggcuuaggcu

SEQ ID NO: 254267 - RNA, 32 nt, Human
ugcuguggauagucuuucccucuccccuccug

SEQ ID NO: 254268 - RNA, 31 nt, Human
ugcuguggcacgaucucagcucacugcaauc

SEQ ID NO: 254269 - RNA, 32 nt, Human
ugcuguggcaggcagauugggugguaguggga

SEQ ID NO: 254270 - RNA, 32 nt, Human
ugcuguggcccuggugauggcagagccuuggg

SEQ ID NO: 254271 - RNA, 32 nt, Human
ugcuguggcucacaccuguaaucccagcacuu

SEQ ID NO: 254272 - RNA, 32 nt, Human
ugcuguggcucacgccucuaaucccagcacuu

SEQ ID NO: 254273 - RNA, 32 nt, Human
ugcuguggcucacgccugcaaucccagcacuu

SEQ ID NO: 254274 - RNA, 32 nt, Human
ugcuguggcucacgccuguaaucccagcacuc

SEQ ID NO: 254275 - RNA, 32 nt, Human
ugcuguggcucacgccuguaaucccagcacuu

SEQ ID NO: 254276 - RNA, 32 nt, Human
ugcuguggcucaugccuguaaucccagcacuu

SEQ ID NO: 254277 - RNA, 21 nt, Human
ugcuguggcucuccccggggu

SEQ ID NO: 254278 - RNA, 32 nt, Human
ugcuguggcuguuccuuauccuaaugaugcgc

SEQ ID NO: 254279 - RNA, 32 nt, Human
ugcuguggcuuccucuugagagaggacaggga

SEQ ID NO: 254280 - RNA, 32 nt, Human
ugcugugggaagagagcagccguguggcaguu

SEQ ID NO: 254281 - RNA, 32 nt, Human
ugcugugggacuggcccugcuccuguacugcu

SEQ ID NO: 254282 - RNA, 32 nt, Human
ugcugugggaggcaugagcuggagaugggggc

SEQ ID NO: 254283 - RNA, 32 nt, Human
ugcugugggcccaggacaggaggcugagaagg

SEQ ID NO: 254284 - RNA, 31 nt, Human
ugcugugggccuggaagaugggaggaggggc

SEQ ID NO: 254285 - RNA, 30 nt, Human
ugcugugggcuccuuggcacaugaggccgg

SEQ ID NO: 254286 - RNA, 30 nt, Human
ugcugugggcuuucuggaacugcuggcugg

SEQ ID NO: 254287 - RNA, 32 nt, Human
ugcuguggggaggacuccauccaccucaucac

SEQ ID NO: 254288 - RNA, 32 nt, Human
ugcugugggugccaccaggcccagggacugca

SEQ ID NO: 254289 - RNA, 32 nt, Human
ugcuguggguggaagagggaguagcugauuuc

SEQ ID NO: 254290 - RNA, 32 nt, Human
ugcugugguggaagggccuagucugaaucugg

SEQ ID NO: 254291 - RNA, 32 nt, Human
ugcugugguggucccacccaggagagccugug

SEQ ID NO: 254292 - RNA, 32 nt, Human
ugcuguguacccaggccaggaaccugaccugc

SEQ ID NO: 254293 - RNA, 32 nt, Human
ugcuguguauaugggauuagagccacuacaua

SEQ ID NO: 254294 - RNA, 32 nt, Human
ugcuguguaugaggucacagggcccagcugug

SEQ ID NO: 254295 - RNA, 32 nt, Human
ugcugugucaccaaggcuggagggcaauagca

SEQ ID NO: 254296 - RNA, 32 nt, Human
ugcugugucaccaggauggagugcaguggcau

SEQ ID NO: 254297 - RNA, 32 nt, Human
ugcugugucaccaggcuggagcaguggcacga

SEQ ID NO: 254298 - RNA, 32 nt, Human
ugcugugucaccaucacuacucaagaccggag

SEQ ID NO: 254299 - RNA, 32 nt, Human
ugcugugucaccuaggcuggagugcaguggca

SEQ ID NO: 254300 - RNA, 32 nt, Human
ugcugugucaucugaaaucggcacauuccaug

SEQ ID NO: 254301 - RNA, 32 nt, Human
ugcuguguccuuuccagacuccagggcucccc

SEQ ID NO: 254302 - RNA, 32 nt, Human
ugcugugucgccuaggcuggagugcaguggcg

SEQ ID NO: 254303 - RNA, 32 nt, Human
ugcugugucgggaggaaggucagggcuccuga

SEQ ID NO: 254304 - RNA, 32 nt, Human
ugcugugugcacauguguacacacagcuaauu

SEQ ID NO: 254305 - RNA, 32 nt, Human
ugcugugugcucuggggagcugcaaaagggca

SEQ ID NO: 254306 - RNA, 32 nt, Human
ugcugugugcugaauuacuaugccaugugcua

SEQ ID NO: 254307 - RNA, 32 nt, Human
ugcugugugcuugugugcaugugccuaugugg

SEQ ID NO: 254308 - RNA, 23 nt, Human
ugcuguguggcacaaauguguua

SEQ ID NO: 254309 - RNA, 32 nt, Human
ugcuguguggcccaggcuggagugcaguggcg

SEQ ID NO: 254310 - RNA, 32 nt, Human
ugcuguguuacccaggguggauugcagcugau

SEQ ID NO: 254311 - RNA, 32 nt, Human
ugcuguguuagacugcaugcuugaguguuugg

SEQ ID NO: 254312 - RNA, 32 nt, Human
ugcuguguugcccaggcuagagugcagcagug

SEQ ID NO: 254313 - RNA, 32 nt, Human
ugcuguguugcccaggcuggacucaaauuccu

SEQ ID NO: 254314 - RNA, 32 nt, Human
ugcuguguugcccaggcuggagugcaguggcc

SEQ ID NO: 254315 - RNA, 32 nt, Human
ugcuguguugcccaggcuggagugcaguggug

SEQ ID NO: 254316 - RNA, 32 nt, Human
ugcuguguugcccaggcuggagugcgguggcu

SEQ ID NO: 254317 - RNA, 32 nt, Human
ugcuguguugcgggggaagcuguguggaagga

SEQ ID NO: 254318 - RNA, 32 nt, Human
ugcuguguugcucaggcuggucuggaaccccu

SEQ ID NO: 254319 - RNA, 32 nt, Human
ugcuguguuguccaggcuggagugcaauggug

SEQ ID NO: 254320 - RNA, 21 nt, Human
ugcuguuaauaaagucaacuu

SEQ ID NO: 254321 - RNA, 32 nt, Human
ugcuguuaauugauuaaaaucuggcaaaguua

SEQ ID NO: 254322 - RNA, 32 nt, Human
ugcuguuacguuugaagucugacaauccuuga

SEQ ID NO: 254323 - RNA, 32 nt, Human
ugcuguuagaagcaggaggugugcagggggug

SEQ ID NO: 254324 - RNA, 32 nt, Human
ugcuguuagauucuguucuccuuugagguagg

SEQ ID NO: 254325 - RNA, 17 nt, Human
ugcuguuaguaacugug

SEQ ID NO: 254326 - RNA, 32 nt, Human
ugcuguuauaucagccucuaccucucaggucc

SEQ ID NO: 254327 - RNA, 32 nt, Human
ugcuguuaucucacauuauaaauuucuaaauc

SEQ ID NO: 254328 - RNA, 32 nt, Human
ugcuguuauuuuuccaagucuuggggagaaaa

SEQ ID NO: 254329 - RNA, 32 nt, Human
ugcuguucagcccuuacacugccaagccaucc

SEQ ID NO: 254330 - RNA, 32 nt, Human
ugcuguucaggaccacuaaaugcugaaaugug

SEQ ID NO: 254331 - RNA, 32 nt, Human
ugcuguucaucacuuuuuccaucaagugaaau

SEQ ID NO: 254332 - RNA, 32 nt, Human
ugcuguuccaacgcugccugcacuacaacaga

SEQ ID NO: 254333 - RNA, 32 nt, Human
ugcuguuccaccuccccucagacuagcuuuca

SEQ ID NO: 254334 - RNA, 32 nt, Human
ugcuguuccaccuccccucagacuaucuuuca

SEQ ID NO: 254335 - RNA, 32 nt, Human
ugcuguuccaggagagcaacccuggggugcac

SEQ ID NO: 254336 - RNA, 32 nt, Human
ugcuguuccaguucuggucaagggccuugggg

SEQ ID NO: 254337 - RNA, 32 nt, Human
ugcuguucuagguacuggccugggugacagag

SEQ ID NO: 254338 - RNA, 32 nt, Human
ugcuguucucagcagccacuucccaggcugcc

SEQ ID NO: 254339 - RNA, 32 nt, Human
ugcuguucuccacuucucaccugccauccacg

SEQ ID NO: 254340 - RNA, 32 nt, Human
ugcuguucugggucucaggcugcuggacccca

SEQ ID NO: 254341 - RNA, 32 nt, Human
ugcuguugauuuucucugcucugcucuuagcu

SEQ ID NO: 254342 - RNA, 32 nt, Human
ugcuguugcccaggcuggagugcaguggugcg

SEQ ID NO: 254343 - RNA, 32 nt, Human
ugcuguugcccaggcuggagugcagugucccg

SEQ ID NO: 254344 - RNA, 32 nt, Human
ugcuguugcccuuuuaaacugcggcuugacgg

SEQ ID NO: 254345 - RNA, 32 nt, Human
ugcuguugcucuugcucucaccccuguugaca

SEQ ID NO: 254346 - RNA, 32 nt, Human
ugcuguugcuggcgugagaaggggcgacggag

SEQ ID NO: 254347 - RNA, 32 nt, Human
ugcuguuggaaaacauggaaaaugcauccuua

SEQ ID NO: 254348 - RNA, 32 nt, Human
ugcuguuggcaucuugcugcuaauccugaggc

SEQ ID NO: 254349 - RNA, 24 nt, Human
ugcuguugggauauagucaacuua

SEQ ID NO: 254350 - RNA, 32 nt, Human
ugcuguuguacuucugaaaucagaccugugug

SEQ ID NO: 254351 - RNA, 32 nt, Human
ugcuguugucauggagcugugggaguuggcac

SEQ ID NO: 254352 - RNA, 18 nt, Human
ugcuguugugcuuggaga

SEQ ID NO: 254353 - RNA, 32 nt, Human
ugcuguuguugcuggucuagagacuauuuuga

SEQ ID NO: 254354 - RNA, 23 nt, Human
ugcuguuguuucaugaaugugcc

SEQ ID NO: 254355 - RNA, 32 nt, Human
ugcuguuuacacaguucucaggaggcuguggu

SEQ ID NO: 254356 - RNA, 32 nt, Human
ugcuguuuagguaaauaaacuguuuauauaaa

SEQ ID NO: 254357 - RNA, 32 nt, Human
ugcuguuuaucugucaccuccacuugcucccc

SEQ ID NO: 254358 - RNA, 32 nt, Human
ugcuguuucaugccuucauuccuuccuauaca

SEQ ID NO: 254359 - RNA, 32 nt, Human
ugcuguuuccagccgcugaaucugcugagugu

SEQ ID NO: 254360 - RNA, 32 nt, Human
ugcuguuucccaaguuucccacccuccacccu

SEQ ID NO: 254361 - RNA, 32 nt, Human
ugcuguuucucaguauuaugacaugugacagg

SEQ ID NO: 254362 - RNA, 32 nt, Human
ugcuguuucucccauucuuuacagcucaccgg

SEQ ID NO: 254363 - RNA, 32 nt, Human
ugcuguuucucgccaacacuacccaggacucu

SEQ ID NO: 254364 - RNA, 22 nt, Human
ugcuguuucuuccacauauuca

SEQ ID NO: 254365 - RNA, 32 nt, Human
ugcuguuugguugcugaagggggucagugugu

SEQ ID NO: 254366 - RNA, 31 nt, Human
ugcuguuuguccucuugaccugugucugacu

SEQ ID NO: 254367 - RNA, 32 nt, Human
ugcuguuugucuacuuccuccugcuuccccgc

SEQ ID NO: 254368 - RNA, 32 nt, Human
ugcuuaaaacccuuuccuacaggaugaaguug

SEQ ID NO: 254369 - RNA, 21 nt, Human
ugcuuaaaaccucuuuuugga

SEQ ID NO: 254370 - RNA, 32 nt, Human
ugcuuaaaauuuuguaauuuguauuuauaagc

SEQ ID NO: 254371 - RNA, 32 nt, Human
ugcuuaaagcuucuuguccauggcuuuuguuu

SEQ ID NO: 254372 - RNA, 32 nt, Human
ugcuuaacucaaccagcagcagagccagggcc

SEQ ID NO: 254373 - RNA, 32 nt, Human
ugcuuaacugaggggcaugaugggggaggcgg

SEQ ID NO: 254374 - RNA, 32 nt, Human
ugcuuaagaggaaaaugaaaguguuccugggg

SEQ ID NO: 254375 - RNA, 32 nt, Human
ugcuuaagagguuuaucaugcauggcaagauu

SEQ ID NO: 254376 - RNA, 23 nt, Human
ugcuuaagcccaggaguuugaga

SEQ ID NO: 254377 - RNA, 32 nt, Human
ugcuuaagcucuggcccugcccuguauuccuc

SEQ ID NO: 254378 - RNA, 23 nt, Human
ugcuuaaguccaggaguucaaga

SEQ ID NO: 254379 - RNA, 32 nt, Human
ugcuuaagucugggagguugaggcugcaguga

SEQ ID NO: 254380 - RNA, 22 nt, Human
ugcuuaauaaaugucugcucaa

SEQ ID NO: 254381 - RNA, 32 nt, Human
ugcuuaaucaagagcuggaguucaaugagucc

SEQ ID NO: 254382 - RNA, 21 nt, Human
ugcuuaaucugaccccuggca

SEQ ID NO: 254383 - RNA, 32 nt, Human
ugcuuaauggagaacagagaagaucuuguugc

SEQ ID NO: 254384 - RNA, 32 nt, Human
ugcuuaauggugcugggaagccuagaggaauu

SEQ ID NO: 254385 - RNA, 32 nt, Human
ugcuuacaaacugguagacagaauguagcuua

SEQ ID NO: 254386 - RNA, 31 nt, Human
ugcuuacacagcuacagagccaccuccucac

SEQ ID NO: 254387 - RNA, 32 nt, Human
ugcuuacacaucucuccucagagcugucccuu

SEQ ID NO: 254388 - RNA, 32 nt, Human
ugcuuacaccuguaaucccagcacuuugggag

SEQ ID NO: 254389 - RNA, 32 nt, Human
ugcuuacacugacuuuucuucuuguaggacuc

SEQ ID NO: 254390 - RNA, 32 nt, Human
ugcuuaccaucccccacccccaaccaaguucu

SEQ ID NO: 254391 - RNA, 32 nt, Human
ugcuuacccacugccugcccagacuuucuauc

SEQ ID NO: 254392 - RNA, 32 nt, Human
ugcuuacccuagauuucuccaggauuuuggug

SEQ ID NO: 254393 - RNA, 19 nt, Human
ugcuuaccugcacucucug

SEQ ID NO: 254394 - RNA, 32 nt, Human
ugcuuaccugggaggcagaggguguuauggga

SEQ ID NO: 254395 - RNA, 32 nt, Human
ugcuuacuccacuucgcuucucugcuccaggu

SEQ ID NO: 254396 - RNA, 32 nt, Human
ugcuuacucucccacgugccaugcaguuccug

SEQ ID NO: 254397 - RNA, 18 nt, Human
ugcuuacugcugcaggug

SEQ ID NO: 254398 - RNA, 32 nt, Human
ugcuuagaaaagcagagggucagggaaaucua

SEQ ID NO: 254399 - RNA, 32 nt, Human
ugcuuagacagagaagagauuaacuucagugg

SEQ ID NO: 254400 - RNA, 32 nt, Human
ugcuuagagaaaacguguugccaucccaucau

SEQ ID NO: 254401 - RNA, 32 nt, Human
ugcuuagagagaucugcugucucccaaauaag

SEQ ID NO: 254402 - RNA, 32 nt, Human
ugcuuagagcacaggaagugacaacuuaggga

SEQ ID NO: 254403 - RNA, 32 nt, Human
ugcuuagaggccucuauaauuuaaacaugaac

SEQ ID NO: 254404 - RNA, 32 nt, Human
ugcuuagauaaauguaaucacuguaaacaucu

SEQ ID NO: 254405 - RNA, 32 nt, Human
ugcuuagaucacugcagcuucuaggacccggu

SEQ ID NO: 254406 - RNA, 32 nt, Human
ugcuuagcaugcaaguucccuccaucauugcc

SEQ ID NO: 254407 - RNA, 32 nt, Human
ugcuuagccaguaacccaggaggcucagaugc

SEQ ID NO: 254408 - RNA, 21 nt, Human
ugcuuagcccugcucugaaua

SEQ ID NO: 254409 - RNA, 32 nt, Human
ugcuuagcuaccugcgggugucauuggccccg

SEQ ID NO: 254410 - RNA, 32 nt, Human
ugcuuagcugggcuguaaagaugaaggcauca

SEQ ID NO: 254411 - RNA, 32 nt, Human
ugcuuaggcgcugagggggaaaaagaggggga

SEQ ID NO: 254412 - RNA, 32 nt, Human
ugcuuagucauuucuauguucauuccacuuug

SEQ ID NO: 254413 - RNA, 32 nt, Human
ugcuuagugggacugguggcccagagagggcu

SEQ ID NO: 254414 - RNA, 19 nt, Human
ugcuuaguuacucugaaua

SEQ ID NO: 254415 - RNA, 32 nt, Human
ugcuuauagugauguguucccaggcaaaugcu

SEQ ID NO: 254416 - RNA, 19 nt, Human
ugcuuauauugucugaaua

SEQ ID NO: 254417 - RNA, 32 nt, Human
ugcuuaucaguuaucaaaguaaggaagacuuu

SEQ ID NO: 254418 - RNA, 32 nt, Human
ugcuuaucauuaggauaggguaagugaaguuu

SEQ ID NO: 254419 - RNA, 32 nt, Human
ugcuuaucugggagguguugggcgcggacagu

SEQ ID NO: 254420 - RNA, 32 nt, Human
ugcuuaugacaccuccuugcugcaaaucauug

SEQ ID NO: 254421 - RNA, 32 nt, Human
ugcuuauggaaagggauccugauugauugaaa

SEQ ID NO: 254422 - RNA, 32 nt, Human
ugcuuauguguagcuuuuuacuuuuuauggug

SEQ ID NO: 254423 - RNA, 32 nt, Human
ugcuuauucauugcauuuccuuccucauugcu

SEQ ID NO: 254424 - RNA, 32 nt, Human
ugcuuauugcagccuucuugcuuuaagagcga

SEQ ID NO: 254425 - RNA, 32 nt, Human
ugcuuauugcagcuuugucuccucagcacucu

SEQ ID NO: 254426 - RNA, 32 nt, Human
ugcuuauuucaaggaggcccuuaccuggaagg

SEQ ID NO: 254427 - RNA, 32 nt, Human
ugcuuauuuuaaaagaaauauucugauucaua

SEQ ID NO: 254428 - RNA, 32 nt, Human
ugcuucaaaacaauauaaauggauaauaguug

SEQ ID NO: 254429 - RNA, 32 nt, Human
ugcuucaaacaugcugaagaacuaacaggaac

SEQ ID NO: 254430 - RNA, 32 nt, Human
ugcuucaaacugucuuaaacaauguuugucac

SEQ ID NO: 254431 - RNA, 32 nt, Human
ugcuucaagcugguagagaaggccccucccuc

SEQ ID NO: 254432 - RNA, 19 nt, Human
ugcuucaaggcagcuguga

SEQ ID NO: 254433 - RNA, 32 nt, Human
ugcuucaagguagaugaugcuguuaucuuugg

SEQ ID NO: 254434 - RNA, 32 nt, Human
ugcuucaauucugaguccucuggacuuccccu

SEQ ID NO: 254435 - RNA, 32 nt, Human
ugcuucacccugaccucucacuccaggacagc

SEQ ID NO: 254436 - RNA, 32 nt, Human
ugcuucacugguucagcucuguuguuuccuua

SEQ ID NO: 254437 - RNA, 32 nt, Human
ugcuucacuuccguuccagccucagcggcagc

SEQ ID NO: 254438 - RNA, 32 nt, Human
ugcuucacuuguacaagaaucggcucccagac

SEQ ID NO: 254439 - RNA, 23 nt, Human
ugcuucagauuguuugauuugua

SEQ ID NO: 254440 - RNA, 32 nt, Human
ugcuucagccuccugaguagcugggauuacag

SEQ ID NO: 254441 - RNA, 19 nt, Human
ugcuucagccuucugagua

SEQ ID NO: 254442 - RNA, 32 nt, Human
ugcuucagcucuguacaacgagggcaaagaug

SEQ ID NO: 254443 - RNA, 32 nt, Human
ugcuucagcugcagccugccugugcuggcugc

SEQ ID NO: 254444 - RNA, 32 nt, Human
ugcuucaggaugugcggcaccuccuuacugac

SEQ ID NO: 254445 - RNA, 32 nt, Human
ugcuucagguaaccucccuugaccuucaggag

SEQ ID NO: 254446 - RNA, 32 nt, Human
ugcuucaggugugauccagcacuuucccagcu

SEQ ID NO: 254447 - RNA, 32 nt, Human
ugcuucagguucugagcaacaguguauauuau

SEQ ID NO: 254448 - RNA, 32 nt, Human
ugcuucaguaaaauccaguaauggguaugcga

SEQ ID NO: 254449 - RNA, 22 nt, Human
ugcuucagucgagagcccugua

SEQ ID NO: 254450 - RNA, 30 nt, Human
ugcuucagugaugugguccauuauaagaua

SEQ ID NO: 254451 - RNA, 20 nt, Human
ugcuucaguggaagugugua

SEQ ID NO: 254452 - RNA, 24 nt, Human
ugcuucaguuuccucaucugugaa

SEQ ID NO: 254453 - RNA, 32 nt, Human
ugcuucaucacuguagcacuggggcuucacac

SEQ ID NO: 254454 - RNA, 32 nt, Human
ugcuucaucucuaaagguccuucuaggagaga

SEQ ID NO: 254455 - RNA, 32 nt, Human
ugcuucaucucuaguuuuccuucuuugugagg

SEQ ID NO: 254456 - RNA, 32 nt, Human
ugcuucaucugugggaugcugaaggagaugag

SEQ ID NO: 254457 - RNA, 32 nt, Human
ugcuucaugccuguaauccaagcacuuugaga

SEQ ID NO: 254458 - RNA, 32 nt, Human
ugcuucaugguuccugagcucuuucuccuguu

SEQ ID NO: 254459 - RNA, 32 nt, Human
ugcuucauuaggucugaagggggccaaggaau

SEQ ID NO: 254460 - RNA, 32 nt, Human
ugcuucauucacaaccuccauuuucagcaaca

SEQ ID NO: 254461 - RNA, 32 nt, Human
ugcuuccaagcugaccaaauucugagcugcug

SEQ ID NO: 254462 - RNA, 32 nt, Human
ugcuuccacagcuugcuaguucuguguuuacu

SEQ ID NO: 254463 - RNA, 32 nt, Human
ugcuuccacaucuagcuuccucccucuccucu

SEQ ID NO: 254464 - RNA, 30 nt, Human
ugcuuccacuuauuacccauccuuccucuu

SEQ ID NO: 254465 - RNA, 32 nt, Human
ugcuuccagaagcaagaaaaguuucuucucuc

SEQ ID NO: 254466 - RNA, 32 nt, Human
ugcuuccagagucccaagagcuucucugggau

SEQ ID NO: 254467 - RNA, 32 nt, Human
ugcuuccagcuccaguugcucaucugagaacu

SEQ ID NO: 254468 - RNA, 32 nt, Human
ugcuuccagcuuuugcccauucaguauuaugu

SEQ ID NO: 254469 - RNA, 32 nt, Human
ugcuuccaggcagaagcagccaaggaccgauu

SEQ ID NO: 254470 - RNA, 32 nt, Human
ugcuuccaucaucaguacuccuuguuuuucug

SEQ ID NO: 254471 - RNA, 32 nt, Human
ugcuuccauccaugggugggaagacuucagca

SEQ ID NO: 254472 - RNA, 32 nt, Human
ugcuuccaucucacuaaccacccaccccuacc

SEQ ID NO: 254473 - RNA, 32 nt, Human
ugcuuccauguguucuggguucagaggucaug

SEQ ID NO: 254474 - RNA, 32 nt, Human
ugcuucccaaggaccaugaaacuccugcugcu

SEQ ID NO: 254475 - RNA, 32 nt, Human
ugcuucccaccagcaaagaccacgacuggaga

SEQ ID NO: 254476 - RNA, 32 nt, Human
ugcuucccacguccaccaugcccagcugggcc

SEQ ID NO: 254477 - RNA, 32 nt, Human
ugcuucccagaaccuccucacuagggcugagc

SEQ ID NO: 254478 - RNA, 32 nt, Human
ugcuucccagaggagcagcucuccccaggcau

SEQ ID NO: 254479 - RNA, 32 nt, Human
ugcuucccagcccuagaaauucuaucauugcu

SEQ ID NO: 254480 - RNA, 32 nt, Human
ugcuucccagcuagaccugugugagagguguc

SEQ ID NO: 254481 - RNA, 24 nt, Human
ugcuucccaggcuggagugcagug

SEQ ID NO: 254482 - RNA, 32 nt, Human
ugcuucccaguaagaauccaggagcaagcuuu

SEQ ID NO: 254483 - RNA, 32 nt, Human
ugcuucccagugacccuggccuuggagggcag

SEQ ID NO: 254484 - RNA, 32 nt, Human
ugcuucccauuuccucuuucuagccguccuuu

SEQ ID NO: 254485 - RNA, 32 nt, Human
ugcuuccccaaaacagacucauggacauuaaa

SEQ ID NO: 254486 - RNA, 32 nt, Human
ugcuuccccagaacuucccuggcuccuggccu

SEQ ID NO: 254487 - RNA, 32 nt, Human
ugcuuccccagcaugcagccaaguguggccac

SEQ ID NO: 254488 - RNA, 32 nt, Human
ugcuucccccucccccuccugcugugcuggaa

SEQ ID NO: 254489 - RNA, 32 nt, Human
ugcuuccccuagaaggguucugaucaccggag

SEQ ID NO: 254490 - RNA, 32 nt, Human
ugcuuccccugccugguccagcccugguuggg

SEQ ID NO: 254491 - RNA, 32 nt, Human
ugcuuccccuuuuaccccuccucgcccccucu

SEQ ID NO: 254492 - RNA, 32 nt, Human
ugcuucccgggguggggaggaggcaggaggcg

SEQ ID NO: 254493 - RNA, 32 nt, Human
ugcuucccuagacuugcagcuuauguacgccc

SEQ ID NO: 254494 - RNA, 32 nt, Human
ugcuucccuccccugccucguuucucgucgcc

SEQ ID NO: 254495 - RNA, 32 nt, Human
ugcuucccuccuccucgugauccugguuccau

SEQ ID NO: 254496 - RNA, 32 nt, Human
ugcuucccugagcuuagggaaaguaggcccca

SEQ ID NO: 254497 - RNA, 32 nt, Human
ugcuucccugaugagcuguccucucugcagac

SEQ ID NO: 254498 - RNA, 32 nt, Human
ugcuucccuggggccuuggcucuugggccugc

SEQ ID NO: 254499 - RNA, 32 nt, Human
ugcuucccuugggacaagucccagaagaacua

SEQ ID NO: 254500 - RNA, 32 nt, Human
ugcuucccuuugaugcccauugagugccagcu

SEQ ID NO: 254501 - RNA, 32 nt, Human
ugcuuccgaugccaccauugcaacaguaaacu

SEQ ID NO: 254502 - RNA, 32 nt, Human
ugcuuccgcagccucaggccucccggugcgac

SEQ ID NO: 254503 - RNA, 32 nt, Human
ugcuuccggguaacaagcaaaagucaggccaa

SEQ ID NO: 254504 - RNA, 32 nt, Human
ugcuuccuacuaaaggacggacagagcauuug

SEQ ID NO: 254505 - RNA, 32 nt, Human
ugcuuccuagagcucuguccacacagcugucc

SEQ ID NO: 254506 - RNA, 32 nt, Human
ugcuuccuagccccaggcuugcagagaacaca

SEQ ID NO: 254507 - RNA, 32 nt, Human
ugcuuccucaaaggaggcuccccauggggccc

SEQ ID NO: 254508 - RNA, 32 nt, Human
ugcuuccucaucucagcccacucugaaaaugu

SEQ ID NO: 254509 - RNA, 32 nt, Human
ugcuuccucccccucacuaccuccuuuaauac

SEQ ID NO: 254510 - RNA, 32 nt, Human
ugcuuccuccuuggccccucaggcccuuggaa

SEQ ID NO: 254511 - RNA, 32 nt, Human
ugcuuccuccuugugguuccguugcaaacauu

SEQ ID NO: 254512 - RNA, 32 nt, Human
ugcuuccucugccucugaccucguggccacuc

SEQ ID NO: 254513 - RNA, 32 nt, Human
ugcuuccucuggaggccugggcugagacagug

SEQ ID NO: 254514 - RNA, 32 nt, Human
ugcuuccugaauaaaaaggagccaaaguugau

SEQ ID NO: 254515 - RNA, 32 nt, Human
ugcuuccugagaaacaacagauccacuuaaag

SEQ ID NO: 254516 - RNA, 32 nt, Human
ugcuuccugagccucuuugcucugccucuugg

SEQ ID NO: 254517 - RNA, 32 nt, Human
ugcuuccugauaguacuuucuagaguaaaaga

SEQ ID NO: 254518 - RNA, 32 nt, Human
ugcuuccugcaaccccuugcuggccuggggcc

SEQ ID NO: 254519 - RNA, 32 nt, Human
ugcuuccugcacgugcugggccugcuggagcu

SEQ ID NO: 254520 - RNA, 32 nt, Human
ugcuuccugcagcaccuccuacccugcuccgu

SEQ ID NO: 254521 - RNA, 32 nt, Human
ugcuuccugcagcuggccuagaugaugucagc

SEQ ID NO: 254522 - RNA, 32 nt, Human
ugcuuccugccucugcuucugccguaucccua

SEQ ID NO: 254523 - RNA, 32 nt, Human
ugcuuccugccugcaccugcggugacugugag

SEQ ID NO: 254524 - RNA, 32 nt, Human
ugcuuccugccuggccuucgucucgcuccacu

SEQ ID NO: 254525 - RNA, 32 nt, Human
ugcuuccuguaauucuggcuguuuuuccagac

SEQ ID NO: 254526 - RNA, 32 nt, Human
ugcuuccugucccuggaacucuuccagccuuu

SEQ ID NO: 254527 - RNA, 24 nt, Human
ugcuuccuguucgcagcugcggca

SEQ ID NO: 254528 - RNA, 32 nt, Human
ugcuuccuuccagagcagaguucccuauuccc

SEQ ID NO: 254529 - RNA, 32 nt, Human
ugcuuccuuccuuccccucugcugcugcugcc

SEQ ID NO: 254530 - RNA, 32 nt, Human
ugcuuccuucuccucaccaucuucccagacgg

SEQ ID NO: 254531 - RNA, 32 nt, Human
ugcuuccuucuugccagcucucccaacauacc

SEQ ID NO: 254532 - RNA, 23 nt, Human
ugcuuccuuuccaucuucuuccu

SEQ ID NO: 254533 - RNA, 21 nt, Human
ugcuucgaggguagcugagau

SEQ ID NO: 254534 - RNA, 32 nt, Human
ugcuucgcagaggcacugugcucacgguugga

SEQ ID NO: 254535 - RNA, 32 nt, Human
ugcuucgcaguaaaguuuccagccugggcccc

SEQ ID NO: 254536 - RNA, 32 nt, Human
ugcuucgucccacugcaccgccuggcugaggg

SEQ ID NO: 254537 - RNA, 32 nt, Human
ugcuucgucucuguuccugagagaccagaauu

SEQ ID NO: 254538 - RNA, 32 nt, Human
ugcuucuaaacauuggaaaaagcaaugaaaaa

SEQ ID NO: 254539 - RNA, 32 nt, Human
ugcuucuaccacccucacacuggugacccacc

SEQ ID NO: 254540 - RNA, 20 nt, Human
ugcuucuacuccuucuuccu

SEQ ID NO: 254541 - RNA, 32 nt, Human
ugcuucuaggaacccucaucauagcuccuuca

SEQ ID NO: 254542 - RNA, 20 nt, Human
ugcuucuagggcucugaaua

SEQ ID NO: 254543 - RNA, 21 nt, Human
ugcuucuagguauacuguggu

SEQ ID NO: 254544 - RNA, 32 nt, Human
ugcuucuaguguccugcauuuuauugacuggg

SEQ ID NO: 254545 - RNA, 24 nt, Human
ugcuucuauuccauagcuacggca

SEQ ID NO: 254546 - RNA, 21 nt, Human
ugcuucucaagggacacagug

SEQ ID NO: 254547 - RNA, 32 nt, Human
ugcuucucacuaccaccugugucuggacacau

SEQ ID NO: 254548 - RNA, 19 nt, Human
ugcuucucacuccauuccu

SEQ ID NO: 254549 - RNA, 18 nt, Human
ugcuucucacucucuucc

SEQ ID NO: 254550 - RNA, 27 nt, Human
ugcuucucaguuuacauuucugauaca

SEQ ID NO: 254551 - RNA, 25 nt, Human
ugcuucucauccccugguuguggua

SEQ ID NO: 254552 - RNA, 32 nt, Human
ugcuucucauucucugcagacucuucucagau

SEQ ID NO: 254553 - RNA, 32 nt, Human
ugcuucucauuuccuggaauuuaucuucccag

SEQ ID NO: 254554 - RNA, 32 nt, Human
ugcuucuccaaccugagaaacucaagacccau

SEQ ID NO: 254555 - RNA, 32 nt, Human
ugcuucuccacuccugcugcaaaggcugcugg

SEQ ID NO: 254556 - RNA, 32 nt, Human
ugcuucuccagccauccaggaguggcuguccu

SEQ ID NO: 254557 - RNA, 24 nt, Human
ugcuucuccagccucuucggccuc

SEQ ID NO: 254558 - RNA, 32 nt, Human
ugcuucuccagccucuucggccuccucgcccg

SEQ ID NO: 254559 - RNA, 32 nt, Human
ugcuucuccagccuuucucccauuucaguaag

SEQ ID NO: 254560 - RNA, 22 nt, Human
ugcuucuccaggccucuugccu

SEQ ID NO: 254561 - RNA, 21 nt, Human
ugcuucucccaucucucuccu

SEQ ID NO: 254562 - RNA, 21 nt, Human
ugcuucucccguuugccuccu

SEQ ID NO: 254563 - RNA, 32 nt, Human
ugcuucuccuccagugcugaucuugcugggcc

SEQ ID NO: 254564 - RNA, 32 nt, Human
ugcuucuccuccugccgcugaccagagcaugg

SEQ ID NO: 254565 - RNA, 32 nt, Human
ugcuucucgaccgcacuccucacuucagauuu

SEQ ID NO: 254566 - RNA, 22 nt, Human
ugcuucucucauuugucuuccu

SEQ ID NO: 254567 - RNA, 32 nt, Human
ugcuucucuccaagcaauucgugcagugggau

SEQ ID NO: 254568 - RNA, 32 nt, Human
ugcuucucuccucaucaucauucccaacaaca

SEQ ID NO: 254569 - RNA, 32 nt, Human
ugcuucucucucagacugccuuccugcuucug

SEQ ID NO: 254570 - RNA, 32 nt, Human
ugcuucucucuccuuuuccuuuacacacccac

SEQ ID NO: 254571 - RNA, 32 nt, Human
ugcuucucuuaugaucgccccaccucauuucc

SEQ ID NO: 254572 - RNA, 21 nt, Human
ugcuucucuugcccucuucuu

SEQ ID NO: 254573 - RNA, 32 nt, Human
ugcuucucuuucccccacccuacucccuccaa

SEQ ID NO: 254574 - RNA, 18 nt, Human
ugcuucugaaauauggua

SEQ ID NO: 254575 - RNA, 32 nt, Human
ugcuucugaacggccucggggagggagccugc

SEQ ID NO: 254576 - RNA, 32 nt, Human
ugcuucugacuggccagcccccuccccugcug

SEQ ID NO: 254577 - RNA, 32 nt, Human
ugcuucugagccagaccagcuguaagcugaaa

SEQ ID NO: 254578 - RNA, 32 nt, Human
ugcuucugagcuucagccugggagcaagcuug

SEQ ID NO: 254579 - RNA, 32 nt, Human
ugcuucugagguacauuuugaaugacagcaua

SEQ ID NO: 254580 - RNA, 32 nt, Human
ugcuucugagguuggcucuaacaucucugguc

SEQ ID NO: 254581 - RNA, 32 nt, Human
ugcuucugcauucacagcgccuccuggaccug

SEQ ID NO: 254582 - RNA, 32 nt, Human
ugcuucugccacuuccagcuguguggcuuuag

SEQ ID NO: 254583 - RNA, 32 nt, Human
ugcuucugcccaggccuggucugggggcagag

SEQ ID NO: 254584 - RNA, 21 nt, Human
ugcuucugccgcggcugcggc

SEQ ID NO: 254585 - RNA, 32 nt, Human
ugcuucugcuauagagaacauucuuccaagau

SEQ ID NO: 254586 - RNA, 32 nt, Human
ugcuucugcugccgcucugcagccuggaccug

SEQ ID NO: 254587 - RNA, 32 nt, Human
ugcuucuggaaaccucugccugcugcccuggc

SEQ ID NO: 254588 - RNA, 32 nt, Human
ugcuucuggaagugcuggaagcaucaccccaa

SEQ ID NO: 254589 - RNA, 32 nt, Human
ugcuucuggaccucacuccucacuucagacuu

SEQ ID NO: 254590 - RNA, 32 nt, Human
ugcuucuggaccucacuccucacuucagauuu

SEQ ID NO: 254591 - RNA, 32 nt, Human
ugcuucuggagacuuccugccuaggccucauc

SEQ ID NO: 254592 - RNA, 32 nt, Human
ugcuucuggagcuguggagcuuguaaagucac

SEQ ID NO: 254593 - RNA, 32 nt, Human
ugcuucuggcaggaaaaguucaguuugguuau

SEQ ID NO: 254594 - RNA, 32 nt, Human
ugcuucuggccaggaauccugggucugcaacu

SEQ ID NO: 254595 - RNA, 32 nt, Human
ugcuucuggccccugugugcucuguccugugu

SEQ ID NO: 254596 - RNA, 32 nt, Human
ugcuucugguaguaaggagcacaaagacguuu

SEQ ID NO: 254597 - RNA, 32 nt, Human
ugcuucuguaagcuugcuuuccccaccccaca

SEQ ID NO: 254598 - RNA, 23 nt, Human
ugcuucugucucccccaccccac

SEQ ID NO: 254599 - RNA, 32 nt, Human
ugcuucugucucuguuuugauucuccaaacug

SEQ ID NO: 254600 - RNA, 32 nt, Human
ugcuucuguucuguucuugcaauaacaaugac

SEQ ID NO: 254601 - RNA, 24 nt, Human
ugcuucuguuucaauaccugcggu

SEQ ID NO: 254602 - RNA, 32 nt, Human
ugcuucuuaccuggcccuaagccgggcgcuuc

SEQ ID NO: 254603 - RNA, 32 nt, Human
ugcuucuuagagcaucuuccacaucaacuccc

SEQ ID NO: 254604 - RNA, 32 nt, Human
ugcuucuuagaggggaaaugagagggcaugaa

SEQ ID NO: 254605 - RNA, 21 nt, Human
ugcuucuuagccagcuaccuc

SEQ ID NO: 254606 - RNA, 22 nt, Human
ugcuucuucaauggcaccuuca

SEQ ID NO: 254607 - RNA, 21 nt, Human
ugcuucuucaguccacacuca

SEQ ID NO: 254608 - RNA, 32 nt, Human
ugcuucuucauaccauucuccuugucccuugc

SEQ ID NO: 254609 - RNA, 32 nt, Human
ugcuucuuccagagaaauaaaguuaguuucua

SEQ ID NO: 254610 - RNA, 32 nt, Human
ugcuucuucccagagacagagcuguguaccug

SEQ ID NO: 254611 - RNA, 32 nt, Human
ugcuucuucucuucccacuugcagagccugcu

SEQ ID NO: 254612 - RNA, 32 nt, Human
ugcuucuuggacuaccuucacuggcauuucca

SEQ ID NO: 254613 - RNA, 32 nt, Human
ugcuucuuggaucagauccuggaacagaaaaa

SEQ ID NO: 254614 - RNA, 32 nt, Human
ugcuucuuggcuggggccacuaccuccuuucc

SEQ ID NO: 254615 - RNA, 32 nt, Human
ugcuucuuucauuuucuguuuguuuuauacaa

SEQ ID NO: 254616 - RNA, 32 nt, Human
ugcuucuuugcuuuaaaaaggauucuuaagua

SEQ ID NO: 254617 - RNA, 32 nt, Human
ugcuugaaacucauggcuucaagggaaacucc

SEQ ID NO: 254618 - RNA, 32 nt, Human
ugcuugaaagagacugcucuauuuauucugug

SEQ ID NO: 254619 - RNA, 32 nt, Human
ugcuugaaagugaaaagcaaucaauuauaccc

SEQ ID NO: 254620 - RNA, 32 nt, Human
ugcuugaaauaugcacuuagcacuuugguucc

SEQ ID NO: 254621 - RNA, 23 nt, Human
ugcuugaacccaggaguucaaga

SEQ ID NO: 254622 - RNA, 23 nt, Human
ugcuugaacccaggaguucgaga

SEQ ID NO: 254623 - RNA, 32 nt, Human
ugcuugaacccaggcaguggagguugcaguga

SEQ ID NO: 254624 - RNA, 32 nt, Human
ugcuugaacccagggcugugcugguguaggca

SEQ ID NO: 254625 - RNA, 32 nt, Human
ugcuugaacccgggggcagaggcugcagugag

SEQ ID NO: 254626 - RNA, 23 nt, Human
ugcuugaacucagaaguucaaga

SEQ ID NO: 254627 - RNA, 23 nt, Human
ugcuugaacucaggaguucaaga

SEQ ID NO: 254628 - RNA, 23 nt, Human
ugcuugaacucaggaguuggaga

SEQ ID NO: 254629 - RNA, 32 nt, Human
ugcuugaacucaugagacgguccaaaucucau

SEQ ID NO: 254630 - RNA, 32 nt, Human
ugcuugaagccucgugccacacuggcuuugag

SEQ ID NO: 254631 - RNA, 32 nt, Human
ugcuugaagcuguuuccuuuacucacauugaa

SEQ ID NO: 254632 - RNA, 32 nt, Human
ugcuugaaggaugguuugggaggcagggaauc

SEQ ID NO: 254633 - RNA, 32 nt, Human
ugcuugaagucagcgucuuccauuccagaaag

SEQ ID NO: 254634 - RNA, 32 nt, Human
ugcuugaaguccucucuuucugcugcuagccu

SEQ ID NO: 254635 - RNA, 32 nt, Human
ugcuugaaguuuaagaaagcugagcagaggug

SEQ ID NO: 254636 - RNA, 23 nt, Human
ugcuugaauccaggaguucaaga

SEQ ID NO: 254637 - RNA, 32 nt, Human
ugcuugaauguucuuggaggcuguuucuuaug

SEQ ID NO: 254638 - RNA, 32 nt, Human
ugcuugacaacaaccuaugcaccagguauuua

SEQ ID NO: 254639 - RNA, 32 nt, Human
ugcuugacccaggaggcagagguugcagugag

SEQ ID NO: 254640 - RNA, 32 nt, Human
ugcuugaccccagcagcccgagggacugucug

SEQ ID NO: 254641 - RNA, 32 nt, Human
ugcuugaccuccacuuuucaggagacuugggg

SEQ ID NO: 254642 - RNA, 32 nt, Human
ugcuugacucacugccaucugcuuugaaaacg

SEQ ID NO: 254643 - RNA, 32 nt, Human
ugcuugacuucacuccagggugagacuugacc

SEQ ID NO: 254644 - RNA, 32 nt, Human
ugcuugacuucaguuauugguggaaucuuuag

SEQ ID NO: 254645 - RNA, 18 nt, Human
ugcuugacuucucugaau

SEQ ID NO: 254646 - RNA, 32 nt, Human
ugcuugagaccagccugggugacacagcaaga

SEQ ID NO: 254647 - RNA, 19 nt, Human
ugcuugagaugacuguggu

SEQ ID NO: 254648 - RNA, 23 nt, Human
ugcuugagccaaggaauucgaga

SEQ ID NO: 254649 - RNA, 23 nt, Human
ugcuugagcccaagaguuggaga

SEQ ID NO: 254650 - RNA, 23 nt, Human
ugcuugagcccagaaguucaaga

SEQ ID NO: 254651 - RNA, 23 nt, Human
ugcuugagcccagaaguugaaga

SEQ ID NO: 254652 - RNA, 23 nt, Human
ugcuugagcccaggaauucgaga

SEQ ID NO: 254653 - RNA, 23 nt, Human
ugcuugagcccaggagcuggaga

SEQ ID NO: 254654 - RNA, 23 nt, Human
ugcuugagcccaggaguuagaga

SEQ ID NO: 254655 - RNA, 23 nt, Human
ugcuugagcccaggaguucaaga

SEQ ID NO: 254656 - RNA, 23 nt, Human
ugcuugagcccaggaguucgagg

SEQ ID NO: 254657 - RNA, 23 nt, Human
ugcuugagcccaggaguuugaga

SEQ ID NO: 254658 - RNA, 32 nt, Human
ugcuugagcccaggcugugugguucaccauaa

SEQ ID NO: 254659 - RNA, 32 nt, Human
ugcuugagcccaugaagucaggcugcagugag

SEQ ID NO: 254660 - RNA, 23 nt, Human
ugcuugagccuaggaguucgaga

SEQ ID NO: 254661 - RNA, 23 nt, Human
ugcuugagcucaggaguucaagg

SEQ ID NO: 254662 - RNA, 23 nt, Human
ugcuugagcucaggaguucgaga

SEQ ID NO: 254663 - RNA, 23 nt, Human
ugcuugagcucaggaguuugaga

SEQ ID NO: 254664 - RNA, 23 nt, Human
ugcuugagcucaugaguucaaga

SEQ ID NO: 254665 - RNA, 23 nt, Human
ugcuugagcugaggaguucgaga

SEQ ID NO: 254666 - RNA, 32 nt, Human
ugcuugaggaagcagaacacacagcuggaggc

SEQ ID NO: 254667 - RNA, 32 nt, Human
ugcuugaggccuggcagcugggccaagacaga

SEQ ID NO: 254668 - RNA, 17 nt, Human
ugcuugaguaacuguga

SEQ ID NO: 254669 - RNA, 23 nt, Human
ugcuugaguccaggaguucaaga

SEQ ID NO: 254670 - RNA, 23 nt, Human
ugcuugaguccaggaguucgaga

SEQ ID NO: 254671 - RNA, 32 nt, Human
ugcuugaguguggccccaccuccugggaccug

SEQ ID NO: 254672 - RNA, 32 nt, Human
ugcuugauaaucacucucagguguaaagcucc

SEQ ID NO: 254673 - RNA, 32 nt, Human
ugcuugaucacacuuauuugugcaaaauugau

SEQ ID NO: 254674 - RNA, 32 nt, Human
ugcuugaucaucuuugcacucugccuuaaaga

SEQ ID NO: 254675 - RNA, 32 nt, Human
ugcuugauccugggaggcagagguuguaguga

SEQ ID NO: 254676 - RNA, 32 nt, Human
ugcuugauugucuccccuucaagccccugccc

SEQ ID NO: 254677 - RNA, 32 nt, Human
ugcuugcagauggucugaguucuuguguccug

SEQ ID NO: 254678 - RNA, 32 nt, Human
ugcuugcagggagccgagaucgugccacugca

SEQ ID NO: 254679 - RNA, 32 nt, Human
ugcuugcagguaaaugugccacaaagaaagug

SEQ ID NO: 254680 - RNA, 32 nt, Human
ugcuugcagucacucgcauagcacagaggugg

SEQ ID NO: 254681 - RNA, 32 nt, Human
ugcuugcauguggggauacaggagaauucaga

SEQ ID NO: 254682 - RNA, 32 nt, Human
ugcuugccaccuggucaccagaccuccaaaua

SEQ ID NO: 254683 - RNA, 32 nt, Human
ugcuugccucaccagcucucugcucacauuuc

SEQ ID NO: 254684 - RNA, 32 nt, Human
ugcuugccuggagacguggaaccucugucuca

SEQ ID NO: 254685 - RNA, 32 nt, Human
ugcuugccuugcacuacgugccuggauaguuu

SEQ ID NO: 254686 - RNA, 32 nt, Human
ugcuugcgcugagggcucugcaguggcuggga

SEQ ID NO: 254687 - RNA, 32 nt, Human
ugcuugcuaaacuacaguggcagcagcuggga

SEQ ID NO: 254688 - RNA, 32 nt, Human
ugcuugcuaugucuguuaauacagcugagcuu

SEQ ID NO: 254689 - RNA, 18 nt, Human
ugcuugcucaucucccua

SEQ ID NO: 254690 - RNA, 32 nt, Human
ugcuugcucucuggcugugcuccugcuuaaag

SEQ ID NO: 254691 - RNA, 32 nt, Human
ugcuugcugccuggcucaggcagguccugugc

SEQ ID NO: 254692 - RNA, 32 nt, Human
ugcuugcugccugucugcuuuccuugguggcu

SEQ ID NO: 254693 - RNA, 32 nt, Human
ugcuugcugucucucagaauuguuuucuuacc

SEQ ID NO: 254694 - RNA, 32 nt, Human
ugcuugcugucugagaugaggguuccuaaacc

SEQ ID NO: 254695 - RNA, 32 nt, Human
ugcuugcugugucugagccucaguuuacucau

SEQ ID NO: 254696 - RNA, 32 nt, Human
ugcuugcuguuagagauguagcacuuuauccu

SEQ ID NO: 254697 - RNA, 32 nt, Human
ugcuugcuuccucccuuccccauuccuagcag

SEQ ID NO: 254698 - RNA, 32 nt, Human
ugcuugcuuucugccaaaccugugcuaugcau

SEQ ID NO: 254699 - RNA, 32 nt, Human
ugcuugcuuuugguuucucuuuacuuggaaua

SEQ ID NO: 254700 - RNA, 32 nt, Human
ugcuuggaaaucuagacaagaagagaauccau

SEQ ID NO: 254701 - RNA, 21 nt, Human
ugcuuggaauacuucugaaua

SEQ ID NO: 254702 - RNA, 32 nt, Human
ugcuuggaaugcugacagcaucaggcaacucu

SEQ ID NO: 254703 - RNA, 32 nt, Human
ugcuuggacaacccucagcaaugaacgaacca

SEQ ID NO: 254704 - RNA, 32 nt, Human
ugcuuggacagagaacuugaaauaaguggacc

SEQ ID NO: 254705 - RNA, 32 nt, Human
ugcuuggacuugcccaucuagcacuuuggaaa

SEQ ID NO: 254706 - RNA, 32 nt, Human
ugcuuggagaggggcgggaccuggagagaggc

SEQ ID NO: 254707 - RNA, 32 nt, Human
ugcuuggagcagcauuucauguucuuuugcug

SEQ ID NO: 254708 - RNA, 32 nt, Human
ugcuuggagccccugcuccugaacacgcauua

SEQ ID NO: 254709 - RNA, 32 nt, Human
ugcuuggaggaaggaaacccagcucuggucca

SEQ ID NO: 254710 - RNA, 32 nt, Human
ugcuuggaugagagccuggcugcaguacaugc

SEQ ID NO: 254711 - RNA, 32 nt, Human
ugcuuggauuacaggcaugaaccacugcaucu

SEQ ID NO: 254712 - RNA, 32 nt, Human
ugcuuggauuacaggcaugagccaccgcaccc

SEQ ID NO: 254713 - RNA, 32 nt, Human
ugcuuggcaacuucuaggauaaaucaguacuc

SEQ ID NO: 254714 - RNA, 32 nt, Human
ugcuuggcagaccuucaucuucugccucaacu

SEQ ID NO: 254715 - RNA, 32 nt, Human
ugcuuggcagcccagccuggaggagaaggcua

SEQ ID NO: 254716 - RNA, 26 nt, Human
ugcuuggcagguuccguggcugggca

SEQ ID NO: 254717 - RNA, 19 nt, Human
ugcuuggccacagaaccac

SEQ ID NO: 254718 - RNA, 32 nt, Human
ugcuuggcccccacuuuccagaccauuccagg

SEQ ID NO: 254719 - RNA, 32 nt, Human
ugcuuggcccugccaccuuccuccaggggagg

SEQ ID NO: 254720 - RNA, 21 nt, Human
ugcuuggcgcgacccugcggg

SEQ ID NO: 254721 - RNA, 21 nt, Human
ugcuuggcuauugucugaaua

SEQ ID NO: 254722 - RNA, 32 nt, Human
ugcuuggcucacugggaccaggaaagccuguc

SEQ ID NO: 254723 - RNA, 32 nt, Human
ugcuuggcugcccauuugccucuugagugggc

SEQ ID NO: 254724 - RNA, 32 nt, Human
ugcuuggcugcggugcucacacucaugaggag

SEQ ID NO: 254725 - RNA, 32 nt, Human
ugcuugggaaucugcccugcucucucagaaag

SEQ ID NO: 254726 - RNA, 32 nt, Human
ugcuugggacuugaaaucuguggccgaaggac

SEQ ID NO: 254727 - RNA, 32 nt, Human
ugcuugggaggcagaggcaggagaauugcuug

SEQ ID NO: 254728 - RNA, 32 nt, Human
ugcuugggaggcugaggcaggaagcucgcuug

SEQ ID NO: 254729 - RNA, 32 nt, Human
ugcuugggaggcugaggcaggagaaucgcuug

SEQ ID NO: 254730 - RNA, 32 nt, Human
ugcuugggaggcugagguugcaggaucgcuug

SEQ ID NO: 254731 - RNA, 32 nt, Human
ugcuugggagggugggggugggggagggucuu

SEQ ID NO: 254732 - RNA, 32 nt, Human
ugcuugggaggucgaggcugcagugagucaug

SEQ ID NO: 254733 - RNA, 32 nt, Human
ugcuugggcagacgagaccacacuggccuccc

SEQ ID NO: 254734 - RNA, 32 nt, Human
ugcuugggccccagcuggccagccuggcgaug

SEQ ID NO: 254735 - RNA, 32 nt, Human
ugcuugggcuuguucccagagacucagugaaa

SEQ ID NO: 254736 - RNA, 32 nt, Human
ugcuuggggaaaggggaaguaauuggcauucu

SEQ ID NO: 254737 - RNA, 32 nt, Human
ugcuuggggaaccucucagugaccucagguga

SEQ ID NO: 254738 - RNA, 25 nt, Human
ugcuuggggaccccaaguuugugga

SEQ ID NO: 254739 - RNA, 32 nt, Human
ugcuuggggaccccaccaccacccgcaacacu

SEQ ID NO: 254740 - RNA, 32 nt, Human
ugcuuggggagggggagcaucccacccacaug

SEQ ID NO: 254741 - RNA, 32 nt, Human
ugcuuggggugaggggcgggagaguggaauau

SEQ ID NO: 254742 - RNA, 32 nt, Human
ugcuuggguaaucccuuuuaauggugacugaa

SEQ ID NO: 254743 - RNA, 32 nt, Human
ugcuuggguuugccaugaugcgaggcugaguu

SEQ ID NO: 254744 - RNA, 32 nt, Human
ugcuuggucucuuccucuuuggccuaaucucu

SEQ ID NO: 254745 - RNA, 21 nt, Human
ugcuugguggcugugcugcug

SEQ ID NO: 254746 - RNA, 32 nt, Human
ugcuugguggugccagccccuuguccaccuuc

SEQ ID NO: 254747 - RNA, 22 nt, Human
ugcuugguugcauucuuggaca

SEQ ID NO: 254748 - RNA, 32 nt, Human
ugcuuguaaugcucacuuauguuuucucugua

SEQ ID NO: 254749 - RNA, 19 nt, Human
ugcuuguaccucuggcuga

SEQ ID NO: 254750 - RNA, 32 nt, Human
ugcuuguagaaaacaugguaggcuuccccaag

SEQ ID NO: 254751 - RNA, 32 nt, Human
ugcuuguagaaguaauaagaagaaagggaaca

SEQ ID NO: 254752 - RNA, 32 nt, Human
ugcuuguaggagagauggccaggguggcagcc

SEQ ID NO: 254753 - RNA, 32 nt, Human
ugcuuguaggcagcaaccauaugcuacaagaa

SEQ ID NO: 254754 - RNA, 32 nt, Human
ugcuuguauaugcucacagcagggcacaaaau

SEQ ID NO: 254755 - RNA, 32 nt, Human
ugcuugucacccaggcuggagugcaauggcau

SEQ ID NO: 254756 - RNA, 32 nt, Human
ugcuugucagccacauguaugucuucuuuuga

SEQ ID NO: 254757 - RNA, 32 nt, Human
ugcuugucagccugugugcguguggugcagga

SEQ ID NO: 254758 - RNA, 32 nt, Human
ugcuugucauccaagcuggaguacagugccau

SEQ ID NO: 254759 - RNA, 32 nt, Human
ugcuuguccaguuucaauuaaagcuggcuguu

SEQ ID NO: 254760 - RNA, 32 nt, Human
ugcuuguccuccccuggccuccagucuccccu

SEQ ID NO: 254761 - RNA, 32 nt, Human
ugcuugucucauccuccagagauucaccaaca

SEQ ID NO: 254762 - RNA, 32 nt, Human
ugcuugucugcagagucaugaccucuuuccgc

SEQ ID NO: 254763 - RNA, 32 nt, Human
ugcuugucugggugggagggagccugguccug

SEQ ID NO: 254764 - RNA, 32 nt, Human
ugcuugucuuguuuucuuguugacucuacucu

SEQ ID NO: 254765 - RNA, 32 nt, Human
ugcuugugaaaugcugagcuuugauggccaua

SEQ ID NO: 254766 - RNA, 32 nt, Human
ugcuugugagccuuuccucugggauucacaca

SEQ ID NO: 254767 - RNA, 32 nt, Human
ugcuugugauuccaguuuaucucugaaacuau

SEQ ID NO: 254768 - RNA, 32 nt, Human
ugcuugugccacuguacuccagccuggcccac

SEQ ID NO: 254769 - RNA, 32 nt, Human
ugcuugugcuucccacucuccccgacuucauu

SEQ ID NO: 254770 - RNA, 32 nt, Human
ugcuugugggggcaccugggaggucaaagguc

SEQ ID NO: 254771 - RNA, 32 nt, Human
ugcuuguguauccucagaccaaacugauucau

SEQ ID NO: 254772 - RNA, 32 nt, Human
ugcuugugugggcacgaggagcugguacucua

SEQ ID NO: 254773 - RNA, 32 nt, Human
ugcuugugugguuccugggacacuuaaccaau

SEQ ID NO: 254774 - RNA, 32 nt, Human
ugcuuguucucccauggauuccugucccaagc

SEQ ID NO: 254775 - RNA, 32 nt, Human
ugcuuguucuggaaggaugacaugggcccaga

SEQ ID NO: 254776 - RNA, 32 nt, Human
ugcuuguugaagucuugccagaacaaacugau

SEQ ID NO: 254777 - RNA, 32 nt, Human
ugcuuguugcccaggcuggagugcaguggugc

SEQ ID NO: 254778 - RNA, 32 nt, Human
ugcuuguuguguuugcuuggaggcgacaguug

SEQ ID NO: 254779 - RNA, 20 nt, Human
ugcuuguuguucuuggcaca

SEQ ID NO: 254780 - RNA, 32 nt, Human
ugcuuguuuagagaucagcagucuuggauggg

SEQ ID NO: 254781 - RNA, 32 nt, Human
ugcuuuaaagaaugcaugcccaaaacacuacu

SEQ ID NO: 254782 - RNA, 32 nt, Human
ugcuuuaaagaauguugguaaugccaugucau

SEQ ID NO: 254783 - RNA, 23 nt, Human
ugcuuuaaggaaaauguauuuca

SEQ ID NO: 254784 - RNA, 32 nt, Human
ugcuuuaaugaaauggaugugccuaaaagcuc

SEQ ID NO: 254785 - RNA, 32 nt, Human
ugcuuuaaugagugcaccugccuccaccagca

SEQ ID NO: 254786 - RNA, 32 nt, Human
ugcuuuacacucaugaguaaaagcacuccaga

SEQ ID NO: 254787 - RNA, 32 nt, Human
ugcuuuacagauguuggagcugccucaaggca

SEQ ID NO: 254788 - RNA, 32 nt, Human
ugcuuuacagccaucacacacaugcuaguuau

SEQ ID NO: 254789 - RNA, 32 nt, Human
ugcuuuacccacaacagacaaguaauugucua

SEQ ID NO: 254790 - RNA, 19 nt, Human
ugcuuuagaacugugaaua

SEQ ID NO: 254791 - RNA, 32 nt, Human
ugcuuuagaauagaauugguauuucugugauu

SEQ ID NO: 254792 - RNA, 16 nt, Human
ugcuuuagaaucugaa

SEQ ID NO: 254793 - RNA, 32 nt, Human
ugcuuuagaaugagaauuaugccugaaaucug

SEQ ID NO: 254794 - RNA, 17 nt, Human
ugcuuuagaguucugaa

SEQ ID NO: 254795 - RNA, 18 nt, Human
ugcuuuagaucuugaaua

SEQ ID NO: 254796 - RNA, 32 nt, Human
ugcuuuagccguuucucaccaugcaaugcaga

SEQ ID NO: 254797 - RNA, 19 nt, Human
ugcuuuagccucccgagua

SEQ ID NO: 254798 - RNA, 32 nt, Human
ugcuuuagccucucaaguagcugggauuacag

SEQ ID NO: 254799 - RNA, 32 nt, Human
ugcuuuaggaggccaaggcaggaggacugcuu

SEQ ID NO: 254800 - RNA, 32 nt, Human
ugcuuuagggucaucauuuucuaaagaaucag

SEQ ID NO: 254801 - RNA, 32 nt, Human
ugcuuuaggugcagggacaccacccacucagg

SEQ ID NO: 254802 - RNA, 16 nt, Human
ugcuuuagucccugaa

SEQ ID NO: 254803 - RNA, 32 nt, Human
ugcuuuagucguuccuccugcuaccaguagcg

SEQ ID NO: 254804 - RNA, 31 nt, Human
ugcuuuagugagaggacaauuucugauugau

SEQ ID NO: 254805 - RNA, 32 nt, Human
ugcuuuauauuugccaaaguccuaacugacua

SEQ ID NO: 254806 - RNA, 32 nt, Human
ugcuuuauccauuugugcaaagguaaacgcag

SEQ ID NO: 254807 - RNA, 32 nt, Human
ugcuuuaucugugggaugcugaaggagaugag

SEQ ID NO: 254808 - RNA, 32 nt, Human
ugcuuuaucuucagaaacuggaaagggucaaa

SEQ ID NO: 254809 - RNA, 32 nt, Human
ugcuuuauucauccuccaucucaaaaugaacu

SEQ ID NO: 254810 - RNA, 32 nt, Human
ugcuuucaauaugacggcugucaauguugccc

SEQ ID NO: 254811 - RNA, 32 nt, Human
ugcuuucaauaugcauuuuucugcugacuaau

SEQ ID NO: 254812 - RNA, 32 nt, Human
ugcuuucacagaauuauuccagaguuuauaug

SEQ ID NO: 254813 - RNA, 32 nt, Human
ugcuuucacagaauuauuccaggguuuaugug

SEQ ID NO: 254814 - RNA, 32 nt, Human
ugcuuucacuauaaugcugauaguaauaugga

SEQ ID NO: 254815 - RNA, 32 nt, Human
ugcuuucagaaaaccauuuucucugcaaagaa

SEQ ID NO: 254816 - RNA, 32 nt, Human
ugcuuucagaagugcccuuccugcugcgcagu

SEQ ID NO: 254817 - RNA, 32 nt, Human
ugcuuucagccccauuccccauccucuggggu

SEQ ID NO: 254818 - RNA, 32 nt, Human
ugcuuucagcuuugaggagacaagaguugcag

SEQ ID NO: 254819 - RNA, 32 nt, Human
ugcuuucaggagacauguaagcuuccugggug

SEQ ID NO: 254820 - RNA, 32 nt, Human
ugcuuucaguaggaagagcugaggcugccugg

SEQ ID NO: 254821 - RNA, 32 nt, Human
ugcuuucaucacagccugaaaauucacuggag

SEQ ID NO: 254822 - RNA, 21 nt, Human
ugcuuucauucuuucugaaua

SEQ ID NO: 254823 - RNA, 32 nt, Human
ugcuuuccaagacccuguucagucucuuucuc

SEQ ID NO: 254824 - RNA, 32 nt, Human
ugcuuuccaagugcaaaacuacagacacgcgc

SEQ ID NO: 254825 - RNA, 32 nt, Human
ugcuuuccacaccugcacugcugugcugugcc

SEQ ID NO: 254826 - RNA, 32 nt, Human
ugcuuuccagccugggcaacauaguaagaccc

SEQ ID NO: 254827 - RNA, 32 nt, Human
ugcuuucccagaggacaccuaaugucccgaug

SEQ ID NO: 254828 - RNA, 32 nt, Human
ugcuuuccccuuccuccucccucucucccuuu

SEQ ID NO: 254829 - RNA, 32 nt, Human
ugcuuucccuccccaaacccaucagacaggua

SEQ ID NO: 254830 - RNA, 28 nt, Human
ugcuuucccucuccugccucauuccuug

SEQ ID NO: 254831 - RNA, 32 nt, Human
ugcuuucccugagucccuuauucccgcucacu

SEQ ID NO: 254832 - RNA, 32 nt, Human
ugcuuuccuccacugccaucauuaaaccucag

SEQ ID NO: 254833 - RNA, 32 nt, Human
ugcuuuccugaaaggccagaaguucaaagaug

SEQ ID NO: 254834 - RNA, 32 nt, Human
ugcuuuccugucuguagugccugcuguuugga

SEQ ID NO: 254835 - RNA, 32 nt, Human
ugcuuuccuguucaugggguuuuugcccugga

SEQ ID NO: 254836 - RNA, 32 nt, Human
ugcuuuccuuguagcacugcugugaagauuca

SEQ ID NO: 254837 - RNA, 32 nt, Human
ugcuuucgccuguaaucccaacacuuugggag

SEQ ID NO: 254838 - RNA, 32 nt, Human
ugcuuucggaacgcccuugugauuggccgagc

SEQ ID NO: 254839 - RNA, 21 nt, Human
ugcuuucggaagugcuguggu

SEQ ID NO: 254840 - RNA, 32 nt, Human
ugcuuucgggcgcagcuccugcugcagccagg

SEQ ID NO: 254841 - RNA, 32 nt, Human
ugcuuucuaagugggaagaggaagggagaggc

SEQ ID NO: 254842 - RNA, 31 nt, Human
ugcuuucucagcuagaccagggugggcauca

SEQ ID NO: 254843 - RNA, 32 nt, Human
ugcuuucuccacccccacacucccugcucagc

SEQ ID NO: 254844 - RNA, 32 nt, Human
ugcuuucuccauuuucuuuuauguugucuuaa

SEQ ID NO: 254845 - RNA, 32 nt, Human
ugcuuucuccccucccuucuugacucucuguu

SEQ ID NO: 254846 - RNA, 32 nt, Human
ugcuuucuccucccuuuuccuccccacuccuu

SEQ ID NO: 254847 - RNA, 32 nt, Human
ugcuuucuccugggcccgcuuugccugcuuga

SEQ ID NO: 254848 - RNA, 32 nt, Human
ugcuuucucuggcuggaguguaggcuguaccc

SEQ ID NO: 254849 - RNA, 32 nt, Human
ugcuuucucuguuccugugaugcaugaauaac

SEQ ID NO: 254850 - RNA, 32 nt, Human
ugcuuucucuuccuuuuuagcauacaaaguuu

SEQ ID NO: 254851 - RNA, 32 nt, Human
ugcuuucucuuuccuagacucgcggugcucac

SEQ ID NO: 254852 - RNA, 32 nt, Human
ugcuuucucuuuccuuuuaggaauucucuucu

SEQ ID NO: 254853 - RNA, 32 nt, Human
ugcuuucugaaguggcugaaccagguuaugcu

SEQ ID NO: 254854 - RNA, 32 nt, Human
ugcuuucugaucuaugcccuccacaagaagac

SEQ ID NO: 254855 - RNA, 32 nt, Human
ugcuuucugccuccucuuccacacauccuggg

SEQ ID NO: 254856 - RNA, 32 nt, Human
ugcuuucugccuuuugaaaacuccugaaaacc

SEQ ID NO: 254857 - RNA, 32 nt, Human
ugcuuucugcugugcugugauccugcagucag

SEQ ID NO: 254858 - RNA, 25 nt, Human
ugcuuucugggaucuggcuacggca

SEQ ID NO: 254859 - RNA, 32 nt, Human
ugcuuucugucuuucucccucuccuuguauug

SEQ ID NO: 254860 - RNA, 32 nt, Human
ugcuuucuucucuauccaagagcaccaggcug

SEQ ID NO: 254861 - RNA, 32 nt, Human
ugcuuucuucuuuccuuuacuccuggcucaag

SEQ ID NO: 254862 - RNA, 32 nt, Human
ugcuuucuuucacaagcccuccaggaguugcu

SEQ ID NO: 254863 - RNA, 32 nt, Human
ugcuuucuuuccucaucuccccacuccccacu

SEQ ID NO: 254864 - RNA, 32 nt, Human
ugcuuucuuuccuggugaaaauuuugguuaca

SEQ ID NO: 254865 - RNA, 32 nt, Human
ugcuuucuuucggaucccgggcugcuuucgga

SEQ ID NO: 254866 - RNA, 32 nt, Human
ugcuuugaaagagaaccuagauucuauaguug

SEQ ID NO: 254867 - RNA, 32 nt, Human
ugcuuugaaaucugguugaaaugagaaaaagc

SEQ ID NO: 254868 - RNA, 32 nt, Human
ugcuuugaaaucuuagaagagagcccacuaau

SEQ ID NO: 254869 - RNA, 32 nt, Human
ugcuuugaagaaacauacuguccauuugucua

SEQ ID NO: 254870 - RNA, 19 nt, Human
ugcuuugaagaucucugaa

SEQ ID NO: 254871 - RNA, 32 nt, Human
ugcuuugaagccugaagccaugaaaaugcaga

SEQ ID NO: 254872 - RNA, 32 nt, Human
ugcuuugaggcccaagcacuaguagagaugcg

SEQ ID NO: 254873 - RNA, 32 nt, Human
ugcuuugauagcugcuaucaugaccccuuuuu

SEQ ID NO: 254874 - RNA, 32 nt, Human
ugcuuugaucggagcacccagcgcugcuugaa

SEQ ID NO: 254875 - RNA, 32 nt, Human
ugcuuugcaaaguggggccugagguagaagaa

SEQ ID NO: 254876 - RNA, 32 nt, Human
ugcuuugcacacaagcucugcgccaaucacag

SEQ ID NO: 254877 - RNA, 31 nt, Human
ugcuuugcacuuugguuugauauuaagaaac

SEQ ID NO: 254878 - RNA, 31 nt, Human
ugcuuugcacuuuuccguuucagcggaagac

SEQ ID NO: 254879 - RNA, 32 nt, Human
ugcuuugcauuugccucugccaucuaggaaag

SEQ ID NO: 254880 - RNA, 32 nt, Human
ugcuuugccaugacccuggucauccuccucgu

SEQ ID NO: 254881 - RNA, 32 nt, Human
ugcuuugccaugaggccacauucagcugcuau

SEQ ID NO: 254882 - RNA, 32 nt, Human
ugcuuugcccacugaaucaucaugcacugacc

SEQ ID NO: 254883 - RNA, 21 nt, Human
ugcuuugccccuuuucuuccu

SEQ ID NO: 254884 - RNA, 32 nt, Human
ugcuuugccgacuguccuuccaccucuaagug

SEQ ID NO: 254885 - RNA, 32 nt, Human
ugcuuugccuccagcugccucagucucuucau

SEQ ID NO: 254886 - RNA, 24 nt, Human
ugcuuugcgucuaaccuuuguggg

SEQ ID NO: 254887 - RNA, 32 nt, Human
ugcuuugcuccagcacagcagagaccagcagg

SEQ ID NO: 254888 - RNA, 32 nt, Human
ugcuuugcucucacaggaccucagcccgucgu

SEQ ID NO: 254889 - RNA, 32 nt, Human
ugcuuugcuguugccgagcacgaguaaagcuu

SEQ ID NO: 254890 - RNA, 32 nt, Human
ugcuuugcuucccuuauuuauaagggaaugcc

SEQ ID NO: 254891 - RNA, 17 nt, Human
ugcuuuggaaccugaau

SEQ ID NO: 254892 - RNA, 18 nt, Human
ugcuuuggcaucugaaua

SEQ ID NO: 254893 - RNA, 32 nt, Human
ugcuuuggcugcuggggagcucagaagggagc

SEQ ID NO: 254894 - RNA, 32 nt, Human
ugcuuugggaaacccuuccagggcucugguug

SEQ ID NO: 254895 - RNA, 32 nt, Human
ugcuuugggaccugggaaguggggaccugggc

SEQ ID NO: 254896 - RNA, 32 nt, Human
ugcuuugggagagaguagcaaggagagaagaa

SEQ ID NO: 254897 - RNA, 32 nt, Human
ugcuuugggaggauuucuugaggccaggaguu

SEQ ID NO: 254898 - RNA, 31 nt, Human
ugcuuugggaggccaagaugggaggaucauu

SEQ ID NO: 254899 - RNA, 32 nt, Human
ugcuuugggaggcugaggugggaggauugcuu

SEQ ID NO: 254900 - RNA, 32 nt, Human
ugcuuugggauuacgggugugagccgccgcgc

SEQ ID NO: 254901 - RNA, 32 nt, Human
ugcuuugggcaggacucgucacuguguccccc

SEQ ID NO: 254902 - RNA, 20 nt, Human
uggaguguaccguggggccu

SEQ ID NO: 254903 - RNA, 32 nt, Human
uggaguguacugugugguaacugugguagugc

SEQ ID NO: 254904 - RNA, 32 nt, Human
uggaguguaguggcaugaucucggcucacugc

SEQ ID NO: 254905 - RNA, 32 nt, Human
uggaguguaguggcaugaucucggcuuauugc

SEQ ID NO: 254906 - RNA, 32 nt, Human
uggaguguaguggcaugaucugggcucacugc

SEQ ID NO: 254907 - RNA, 32 nt, Human
uggaguguagugguaugaucauagcucaccac

SEQ ID NO: 254908 - RNA, 32 nt, Human
uggagugucggagaagagagcuugccgacgau

SEQ ID NO: 254909 - RNA, 32 nt, Human
uggagugugaagcccagggcaagaggaugcgg

SEQ ID NO: 254910 - RNA, 32 nt, Human
uggagugugacggaggcauggggccugugcuc

SEQ ID NO: 254911 - RNA, 32 nt, Human
uggagugugcgugcuucuucagagggacgggu

SEQ ID NO: 254912 - RNA, 32 nt, Human
uggagugugguggcaggaucauagcucacugu

SEQ ID NO: 254913 - RNA, 32 nt, Human
uggaguguguccuuggccuuggcuccacaggg

SEQ ID NO: 254914 - RNA, 32 nt, Human
uggaguguuaaccucagacucugggucccuuu

SEQ ID NO: 254915 - RNA, 32 nt, Human
uggaguguucucucagcuuaggucuggacagg

SEQ ID NO: 254916 - RNA, 32 nt, Human
uggaguguugguggaaaggaaacugaagguaa

SEQ ID NO: 254917 - RNA, 32 nt, Human
uggaguguuucauaagcagaaaagccaugaug

SEQ ID NO: 254918 - RNA, 19 nt, Human
uggaguguuuguggccuuc

SEQ ID NO: 254919 - RNA, 32 nt, Human
uggaguuaauguaugcuggagcugcucuaaag

SEQ ID NO: 254920 - RNA, 32 nt, Human
uggaguuacacaaaccuguguuaaaacaugua

SEQ ID NO: 254921 - RNA, 21 nt, Human
uggaguuacaggcaugagcca

SEQ ID NO: 254922 - RNA, 32 nt, Human
uggaguuagagcagaagaaaaugaaauuacau

SEQ ID NO: 254923 - RNA, 21 nt, Human
uggaguuagaucuggguuaug

SEQ ID NO: 254924 - RNA, 32 nt, Human
uggaguuaggggaauggccuacaacucugcau

SEQ ID NO: 254925 - RNA, 19 nt, Human
uggaguuagucuuaguaaa

SEQ ID NO: 254926 - RNA, 32 nt, Human
uggaguucaacagauguaaagacuucagugaa

SEQ ID NO: 254927 - RNA, 32 nt, Human
uggaguucaagaccagccuggccaacagggug

SEQ ID NO: 254928 - RNA, 32 nt, Human
uggaguucaagaccagccugugcaauuuagcu

SEQ ID NO: 254929 - RNA, 32 nt, Human
uggaguucaauaagcaggugugcauugcuaag

SEQ ID NO: 254930 - RNA, 32 nt, Human
uggaguucacaaugccucccuaccucuauucu

SEQ ID NO: 254931 - RNA, 32 nt, Human
uggaguucagccaguguacucagaaagggaac

SEQ ID NO: 254932 - RNA, 32 nt, Human
uggaguucauuugaacucuugaaccuuaguuu

SEQ ID NO: 254933 - RNA, 22 nt, Human
uggaguuccacuucuccccgca

SEQ ID NO: 254934 - RNA, 32 nt, Human
uggaguucgagaccagccuggccaacauagcg

SEQ ID NO: 254935 - RNA, 32 nt, Human
uggaguucggaagccauugcagcaaccuuccu

SEQ ID NO: 254936 - RNA, 20 nt, Human
uggaguucuagaaagcagca

SEQ ID NO: 254937 - RNA, 32 nt, Human
uggaguucuuacuugacuugaaugugcaccug

SEQ ID NO: 254938 - RNA, 22 nt, Human
uggaguugaagaggcucugaug

SEQ ID NO: 254939 - RNA, 32 nt, Human
uggaguugaagucuaauacaugauacaugugg

SEQ ID NO: 254940 - RNA, 32 nt, Human
uggaguugaauccuuucucugccacucuuuga

SEQ ID NO: 254941 - RNA, 32 nt, Human
uggaguugagccugaccuuggcacgaaggacu

SEQ ID NO: 254942 - RNA, 32 nt, Human
uggaguugaggugucagagaaaaugaauuuuu

SEQ ID NO: 254943 - RNA, 32 nt, Human
uggaguugauuucucuacuaaauaacagaaac

SEQ ID NO: 254944 - RNA, 32 nt, Human
uggaguugcccaggcccugugagcaaguggca

SEQ ID NO: 254945 - RNA, 32 nt, Human
uggaguugcuaccugucuucuccuggggccuu

SEQ ID NO: 254946 - RNA, 24 nt, Human
uggaguugcugaaauccuggcaaa

SEQ ID NO: 254947 - RNA, 32 nt, Human
uggaguugggauguggaaguggggcuggaaca

SEQ ID NO: 254948 - RNA, 32 nt, Human
uggaguuggggagaggucuggaagaggaccau

SEQ ID NO: 254949 - RNA, 32 nt, Human
uggaguuguguuuuauuuuccaaagggcucag

SEQ ID NO: 254950 - RNA, 32 nt, Human
uggaguuuacaugggccucugauggaagaaag

SEQ ID NO: 254951 - RNA, 32 nt, Human
uggaguuucacucuugucaccgaggcuggagu

SEQ ID NO: 254952 - RNA, 32 nt, Human
uggaguuucauuauacuuuucucuccacguuu

SEQ ID NO: 254953 - RNA, 20 nt, Human
uggaguuucauuccauccca

SEQ ID NO: 254954 - RNA, 18 nt, Human
uggaguuuccaacccagu

SEQ ID NO: 254955 - RNA, 21 nt, Human
uggaguuuccuugccccucug

SEQ ID NO: 254956 - RNA, 32 nt, Human
uggaguuugagaccagccuggccaacauggag

SEQ ID NO: 254957 - RNA, 32 nt, Human
uggaguuugagaccagccuggccaacauggug

SEQ ID NO: 254958 - RNA, 32 nt, Human
uggaguuugagaccagccugggcaacagagug

SEQ ID NO: 254959 - RNA, 32 nt, Human
uggaguuugaggaggaagaggaagaggaggaa

SEQ ID NO: 254960 - RNA, 32 nt, Human
uggaguuugcggucaacucagcagugcccaug

SEQ ID NO: 254961 - RNA, 32 nt, Human
uggaguuugggaccccagggagggagggugug

SEQ ID NO: 254962 - RNA, 32 nt, Human
uggaguuuucuauuuuaaagaggaaucugaaa

SEQ ID NO: 254963 - RNA, 23 nt, Human
uggaguuuucuugaaguacaacu

SEQ ID NO: 254964 - RNA, 32 nt, Human
uggaguuuugaagccuuuauuaauacuacuuu

SEQ ID NO: 254965 - RNA, 32 nt, Human
uggaguuuugcucuugcacuccauccuggaca

SEQ ID NO: 254966 - RNA, 32 nt, Human
uggaguuuuuaaaagaagcaaggaguuaaaug

SEQ ID NO: 254967 - RNA, 32 nt, Human
uggaguuuuucuuuagaaacagugccaagaau

SEQ ID NO: 254968 - RNA, 32 nt, Human
uggauaaaacagccacaguccuugcccuuugg

SEQ ID NO: 254969 - RNA, 32 nt, Human
uggauaaaaugcuggggagcaggacauugaca

SEQ ID NO: 254970 - RNA, 32 nt, Human
uggauaaacacagcaugguccaaccagacagu

SEQ ID NO: 254971 - RNA, 30 nt, Human
uggauaaagaccuuccagcuccuguguucu

SEQ ID NO: 254972 - RNA, 32 nt, Human
uggauaaauacugaaugaggccgggugcaaug

SEQ ID NO: 254973 - RNA, 32 nt, Human
uggauaaauauaaaccagaaacucagcaugaa

SEQ ID NO: 254974 - RNA, 32 nt, Human
uggauaaaugaggcugauguuuggagggagag

SEQ ID NO: 254975 - RNA, 21 nt, Human
uggauaaauuauauugcuaug

SEQ ID NO: 254976 - RNA, 32 nt, Human
uggauaacaacugcacuccagccuggaugaca

SEQ ID NO: 254977 - RNA, 32 nt, Human
uggauaacacagugaaaccccgucucuacuaa

SEQ ID NO: 254978 - RNA, 32 nt, Human
uggauaacacggagaaaccccgucucuacuaa

SEQ ID NO: 254979 - RNA, 32 nt, Human
uggauaacgacugcacuccagccuggaugaca

SEQ ID NO: 254980 - RNA, 32 nt, Human
uggauaacuauauuuucuggauucuggagguu

SEQ ID NO: 254981 - RNA, 32 nt, Human
uggauaagaaacuaagggccacagaccaaaug

SEQ ID NO: 254982 - RNA, 32 nt, Human
uggauaagacaagagggguauuuuggagucca

SEQ ID NO: 254983 - RNA, 32 nt, Human
uggauaagagacuugacagaaagcuuucaaag

SEQ ID NO: 254984 - RNA, 19 nt, Human
uggauaagaucccaggaag

SEQ ID NO: 254985 - RNA, 31 nt, Human
uggauaagugagagagagucagguugcaugu

SEQ ID NO: 254986 - RNA, 32 nt, Human
uggauaauacuagggagaaaaacaaaugugug

SEQ ID NO: 254987 - RNA, 32 nt, Human
uggauaauauuccucuuggccuugugagaaac

SEQ ID NO: 254988 - RNA, 32 nt, Human
uggauaaucagugaaacuacuuaacacagcua

SEQ ID NO: 254989 - RNA, 32 nt, Human
uggauaaugcuggccauucugccuuucugaca

SEQ ID NO: 254990 - RNA, 32 nt, Human
uggauaaugcuggccauuuugccuuucugaca

SEQ ID NO: 254991 - RNA, 32 nt, Human
uggauacaauaacaggaccuuaccucacagga

SEQ ID NO: 254992 - RNA, 32 nt, Human
uggauacccacugucaccugcacuaugaagug

SEQ ID NO: 254993 - RNA, 32 nt, Human
uggauacccucuauuggucaggcauuguguua

SEQ ID NO: 254994 - RNA, 32 nt, Human
uggauaccuacuuagugcucauggaagaaggg

SEQ ID NO: 254995 - RNA, 32 nt, Human
uggauaccugcauuuaacuuguggacuaugua

SEQ ID NO: 254996 - RNA, 32 nt, Human
uggauaccuggcuucucuuuccuuagagaugc

SEQ ID NO: 254997 - RNA, 32 nt, Human
uggauacgugcaaggucgcugaggcagugcug

SEQ ID NO: 254998 - RNA, 32 nt, Human
uggauacuaaaauguuacggaaguagcucuuu

SEQ ID NO: 254999 - RNA, 32 nt, Human
uggauacucagcccugugagugcaauaaaugc

SEQ ID NO: 255000 - RNA, 23 nt, Human
uggauacucuuggcccaccgcag

SEQ ID NO: 255001 - RNA, 32 nt, Human
uggauacuuuauuuucuuuuauguuucuauau

SEQ ID NO: 255002 - RNA, 32 nt, Human
uggauagaaaugucaccuauaugggauuugcc

SEQ ID NO: 255003 - RNA, 32 nt, Human
uggauagaacugggacaaacacagacccaucu

SEQ ID NO: 255004 - RNA, 32 nt, Human
uggauagacuaggcaauucaucagcucaccug

SEQ ID NO: 255005 - RNA, 32 nt, Human
uggauagagaaacgguuucaguucaucugguu

SEQ ID NO: 255006 - RNA, 32 nt, Human
uggauagagacaggauuucaucguguugccca

SEQ ID NO: 255007 - RNA, 32 nt, Human
uggauagaugaggagacacagugcagacuggg

SEQ ID NO: 255008 - RNA, 32 nt, Human
uggauagaugugagacauggagccuaaggaga

SEQ ID NO: 255009 - RNA, 32 nt, Human
uggauagcagaguaauguuugaccucuggaaa

SEQ ID NO: 255010 - RNA, 32 nt, Human
uggauagccuaucaguuuauggaaggauauaa

SEQ ID NO: 255011 - RNA, 32 nt, Human
uggauagcgcauauaucagaagauucaccggc

SEQ ID NO: 255012 - RNA, 32 nt, Human
uggauagcucauaguuggcucuuucuggguga

SEQ ID NO: 255013 - RNA, 32 nt, Human
uggauaggggaugagguugcugugaaagcagc

SEQ ID NO: 255014 - RNA, 19 nt, Human
uggauaguauauuucuaug

SEQ ID NO: 255015 - RNA, 32 nt, Human
uggauagucauuuugaaaccaccuuugcaaaa

SEQ ID NO: 255016 - RNA, 18 nt, Human
uggauaguccaagcuuug

SEQ ID NO: 255017 - RNA, 32 nt, Human
uggauaguguggaguguggggaagaaaagaua

SEQ ID NO: 255018 - RNA, 17 nt, Human
uggauaguugccaguua

SEQ ID NO: 255019 - RNA, 20 nt, Human
uggauaguugcguauuccug

SEQ ID NO: 255020 - RNA, 19 nt, Human
uggauaguuucuauugcua

SEQ ID NO: 255021 - RNA, 32 nt, Human
uggauauagaugcacacauaucuguacauaua

SEQ ID NO: 255022 - RNA, 32 nt, Human
uggauauagcaacuucuuuucucuucaaauga

SEQ ID NO: 255023 - RNA, 32 nt, Human
uggauauaggucagugaggcccagggagaggc

SEQ ID NO: 255024 - RNA, 32 nt, Human
uggauaucaccaccucauguuuccagaguccc

SEQ ID NO: 255025 - RNA, 32 nt, Human
uggauaucuagcuuccuuuaccccuguucugc

SEQ ID NO: 255026 - RNA, 32 nt, Human
uggauaucucuccugcagcccagcaccgagau

SEQ ID NO: 255027 - RNA, 32 nt, Human
uggauaugaagugccuagaaccaccacaaccu

SEQ ID NO: 255028 - RNA, 32 nt, Human
uggauauggugcagagaagcuggacuucugug

SEQ ID NO: 255029 - RNA, 32 nt, Human
uggauaugugccaggcccucuccugccacaca

SEQ ID NO: 255030 - RNA, 32 nt, Human
uggauaugugguuccugaugcauuuggacuug

SEQ ID NO: 255031 - RNA, 32 nt, Human
uggauauguguguauacacauauacacaucuc

SEQ ID NO: 255032 - RNA, 32 nt, Human
uggauauuacucugccucauaaugaagccaac

SEQ ID NO: 255033 - RNA, 32 nt, Human
uggauauuaucccggcuuggagauuuugccag

SEQ ID NO: 255034 - RNA, 32 nt, Human
uggauauuccuuaaaauggaauaagauuaagc

SEQ ID NO: 255035 - RNA, 32 nt, Human
uggauauugcagaaucaugccuggcacacggc

SEQ ID NO: 255036 - RNA, 32 nt, Human
uggauauugggcaaggcaggaaaccucuggag

SEQ ID NO: 255037 - RNA, 32 nt, Human
uggauauuuacagcuucuuuuguuuuuaauug

SEQ ID NO: 255038 - RNA, 32 nt, Human
uggauauuucaaggauuuauaucuauucaucc

SEQ ID NO: 255039 - RNA, 32 nt, Human
uggaucaaauccagccugcugccugcuuuuua

SEQ ID NO: 255040 - RNA, 22 nt, Human
uggaucaagcaaugguggugaa

SEQ ID NO: 255041 - RNA, 32 nt, Human
uggaucacaaggucaagagauagagaccaucu

SEQ ID NO: 255042 - RNA, 32 nt, Human
uggaucacaaggucaagaguucgagaccagcc

SEQ ID NO: 255043 - RNA, 32 nt, Human
uggaucacaccuguaaucccagcacuuuggga

SEQ ID NO: 255044 - RNA, 32 nt, Human
uggaucacagcacacacauacauacacccucc

SEQ ID NO: 255045 - RNA, 32 nt, Human
uggaucacagccucucuugggccguacugugu

SEQ ID NO: 255046 - RNA, 32 nt, Human
uggaucacagccucucuugggcuguacugugu

SEQ ID NO: 255047 - RNA, 32 nt, Human
uggaucaccacaaccuccgucucccagguuca

SEQ ID NO: 255048 - RNA, 23 nt, Human
uggaucacccaggucccagcaga

SEQ ID NO: 255049 - RNA, 32 nt, Human
uggaucacccccaggaggggaaaaugguggca

SEQ ID NO: 255050 - RNA, 32 nt, Human
uggaucaccgaccucucccaagaggggccugg

SEQ ID NO: 255051 - RNA, 32 nt, Human
uggaucaccugaguucgagaccagccuaacca

SEQ ID NO: 255052 - RNA, 32 nt, Human
uggaucaccuugaauuuccuuuuggacguuau

SEQ ID NO: 255053 - RNA, 21 nt, Human
uggaucacgccuguaauccca

SEQ ID NO: 255054 - RNA, 32 nt, Human
uggaucacgccuguaaucccagcgcuuuggga

SEQ ID NO: 255055 - RNA, 23 nt, Human
uggaucacgggauaccacuuccu

SEQ ID NO: 255056 - RNA, 32 nt, Human
uggaucacuacaaccuccaccucccggguuca

SEQ ID NO: 255057 - RNA, 32 nt, Human
uggaucacuuccaaguggacagccuggaugaa

SEQ ID NO: 255058 - RNA, 32 nt, Human
uggaucacuuuucuuucaucacuugaguauuc

SEQ ID NO: 255059 - RNA, 32 nt, Human
uggaucagaggacuuggacuagauagaagcau

SEQ ID NO: 255060 - RNA, 32 nt, Human
uggaucagccaagcgaaacuuggagcuuugac

SEQ ID NO: 255061 - RNA, 32 nt, Human
uggaucagcuggaacagaugaaggagaaaaug

SEQ ID NO: 255062 - RNA, 32 nt, Human
uggaucaggcaggccagaggggcaguucaugg

SEQ ID NO: 255063 - RNA, 32 nt, Human
uggaucagggccuuccugccucccgcugggca

SEQ ID NO: 255064 - RNA, 32 nt, Human
uggaucagguacugugucugcucauaaguacu

SEQ ID NO: 255065 - RNA, 32 nt, Human
uggaucaguaaaauuauacugugugugagugu

SEQ ID NO: 255066 - RNA, 24 nt, Human
uggaucagugaagauccuaggaaa

SEQ ID NO: 255067 - RNA, 32 nt, Human
uggaucaguucacagcauuaacuacaagugaa

SEQ ID NO: 255068 - RNA, 32 nt, Human
uggaucaucuaaggccgggaguucaagaccag

SEQ ID NO: 255069 - RNA, 17 nt, Human
uggaucaugagggugaa

SEQ ID NO: 255070 - RNA, 32 nt, Human
uggaucaugccacugcacuccaaccugggcag

SEQ ID NO: 255071 - RNA, 32 nt, Human
uggaucaugccuguaaucccagcacuuuggga

SEQ ID NO: 255072 - RNA, 32 nt, Human
uggaucaugccuguaaucccaguacuuuggga

SEQ ID NO: 255073 - RNA, 19 nt, Human
uggaucauggcauguagaa

SEQ ID NO: 255074 - RNA, 32 nt, Human
uggaucaugggggaguuuucucaugauuuaac

SEQ ID NO: 255075 - RNA, 18 nt, Human
uggaucauguggagugaa

SEQ ID NO: 255076 - RNA, 19 nt, Human
uggaucauuugugguugaa

SEQ ID NO: 255077 - RNA, 32 nt, Human
uggauccaaagucauguguccacacauucaua

SEQ ID NO: 255078 - RNA, 32 nt, Human
uggauccaacagagaagacaggugaguugcug

SEQ ID NO: 255079 - RNA, 32 nt, Human
uggauccagccacucuggcacagcguucuugc

SEQ ID NO: 255080 - RNA, 32 nt, Human
uggauccagcucugggagcccugccgaggugu

SEQ ID NO: 255081 - RNA, 32 nt, Human
uggauccagcugguuuuuguuuugcugaggcu

SEQ ID NO: 255082 - RNA, 32 nt, Human
uggauccaggugaagggggcagaggacuggga

SEQ ID NO: 255083 - RNA, 24 nt, Human
uggaucccacccaaauccaacuca

SEQ ID NO: 255084 - RNA, 32 nt, Human
uggauccccugcccaccugguccgacgcuuug

SEQ ID NO: 255085 - RNA, 32 nt, Human
uggaucccugcuccccacacggaggacccaac

SEQ ID NO: 255086 - RNA, 32 nt, Human
uggaucccuuucuccuguuucugcaagugucc

SEQ ID NO: 255087 - RNA, 32 nt, Human
uggauccguuugaccaauuugcaccaguuuua

SEQ ID NO: 255088 - RNA, 32 nt, Human
uggauccuagccuuauccucugaucuccaugg

SEQ ID NO: 255089 - RNA, 21 nt, Human
uggauccuccccuuccuggca

SEQ ID NO: 255090 - RNA, 32 nt, Human
uggauccucuaucacgaagauauugagauaag

SEQ ID NO: 255091 - RNA, 32 nt, Human
uggauccucugccugcccccucccccgugacg

SEQ ID NO: 255092 - RNA, 32 nt, Human
uggauccugaaacugcaucuuggcccuguugc

SEQ ID NO: 255093 - RNA, 32 nt, Human
uggauccugagcuagcccauguaaauccgggu

SEQ ID NO: 255094 - RNA, 21 nt, Human
uggauccugcauaguggugag

SEQ ID NO: 255095 - RNA, 32 nt, Human
uggauccugccagcccugccagcuuucccaga

SEQ ID NO: 255096 - RNA, 32 nt, Human
uggauccuggcaacugcagcugcuggauucca

SEQ ID NO: 255097 - RNA, 32 nt, Human
uggauccugggcuggguggccccugucucggg

SEQ ID NO: 255098 - RNA, 32 nt, Human
uggauccuuacugcucuuccucgguggcagga

SEQ ID NO: 255099 - RNA, 32 nt, Human
uggauccuucaaauaggcccugagaugugagg

SEQ ID NO: 255100 - RNA, 32 nt, Human
uggauccuuucacgacagugacccugggcugg

SEQ ID NO: 255101 - RNA, 32 nt, Human
uggaucgccgcggccccuccucccagagcggc

SEQ ID NO: 255102 - RNA, 22 nt, Human
uggaucgcgagcucccagcaga

SEQ ID NO: 255103 - RNA, 32 nt, Human
uggaucggccacugcacuccgggcugggcgac

SEQ ID NO: 255104 - RNA, 24 nt, Human
uggaucguggccucugagcuccac

SEQ ID NO: 255105 - RNA, 32 nt, Human
uggaucuccaggguacccuccaccccagcugc

SEQ ID NO: 255106 - RNA, 32 nt, Human
uggaucucccucagauccccucuucucagaca

SEQ ID NO: 255107 - RNA, 32 nt, Human
uggaucucggagcauucuggauuuugaauuuu

SEQ ID NO: 255108 - RNA, 32 nt, Human
uggaucucuccugcuguaaccccacgcacaag

SEQ ID NO: 255109 - RNA, 32 nt, Human
uggaucucuccugggucucccugcugcgccug

SEQ ID NO: 255110 - RNA, 32 nt, Human
uggaucugcagagccuuccugcccuggccacg

SEQ ID NO: 255111 - RNA, 32 nt, Human
uggaucugcccaggcggcggcggcggcggcgg

SEQ ID NO: 255112 - RNA, 32 nt, Human
uggaucuggagucugcauucacgcacgcuggu

SEQ ID NO: 255113 - RNA, 32 nt, Human
uggaucugggagaaggaaaaugcuucuuucuu

SEQ ID NO: 255114 - RNA, 32 nt, Human
uggaucugggcaaaugaaaauguuucaggaag

SEQ ID NO: 255115 - RNA, 19 nt, Human
uggaucugggcccagcaaa

SEQ ID NO: 255116 - RNA, 32 nt, Human
uggaucugggggugucagacaggcuacccugu

SEQ ID NO: 255117 - RNA, 32 nt, Human
uggaucuggggugggaguaacagggcagaaau

SEQ ID NO: 255118 - RNA, 32 nt, Human
uggaucuguguguauguacauaguagacaugu

SEQ ID NO: 255119 - RNA, 32 nt, Human
uggaucuucaacuuugccauucaugcuucuau

SEQ ID NO: 255120 - RNA, 32 nt, Human
uggaucuugcucacacucuuucaagagaagcu

SEQ ID NO: 255121 - RNA, 32 nt, Human
uggaucuugggcugggacuggaugugccaaug

SEQ ID NO: 255122 - RNA, 32 nt, Human
uggaucuugguucugcucuucuugccucugga

SEQ ID NO: 255123 - RNA, 32 nt, Human
uggaucuuguguccagggacauggggugacau

SEQ ID NO: 255124 - RNA, 32 nt, Human
uggaugaaaaggagggagagaagguggaaaug

SEQ ID NO: 255125 - RNA, 21 nt, Human
uggaugaaaaguuuuagcaaa

SEQ ID NO: 255126 - RNA, 32 nt, Human
uggaugaagagcugucaccucugccuugcccu

SEQ ID NO: 255127 - RNA, 32 nt, Human
uggaugaaggugaaugacuaaagcuuugcuac

SEQ ID NO: 255128 - RNA, 32 nt, Human
uggaugacaaaucucugcuuuauuucuugucu

SEQ ID NO: 255129 - RNA, 32 nt, Human
uggaugacacccgccucacuguggcaguguau

SEQ ID NO: 255130 - RNA, 32 nt, Human
uggaugacagaaacugaauacauugcucccuu

SEQ ID NO: 255131 - RNA, 32 nt, Human
uggaugacagggcagagcaggaaggacaggaa

SEQ ID NO: 255132 - RNA, 22 nt, Human
uggaugaccaacacugcacuca

SEQ ID NO: 255133 - RNA, 32 nt, Human
uggaugaccgggagagccggagcccaggaagc

SEQ ID NO: 255134 - RNA, 32 nt, Human
uggaugaccuugccaccucccucuccuccuuu

SEQ ID NO: 255135 - RNA, 32 nt, Human
uggaugacuauggagccagaacaggcaaaucc

SEQ ID NO: 255136 - RNA, 32 nt, Human
uggaugacuuggagauuuaucucuguuuccuu

SEQ ID NO: 255137 - RNA, 18 nt, Human
uggaugagaaccugcucc

SEQ ID NO: 255138 - RNA, 32 nt, Human
uggaugagaaccugcuccguucugcuaccuug

SEQ ID NO: 255139 - RNA, 32 nt, Human
uggaugagaagaggagaaaaauaaaacaagga

SEQ ID NO: 255140 - RNA, 22 nt, Human
uggaugagaagugcaaugggca

SEQ ID NO: 255141 - RNA, 32 nt, Human
uggaugagacuuccaaaccugacagaugucag

SEQ ID NO: 255142 - RNA, 32 nt, Human
uggaugagagaugagagcagaccggcuucucc

SEQ ID NO: 255143 - RNA, 32 nt, Human
uggaugagagccucuuuggagauaucaagucc

SEQ ID NO: 255144 - RNA, 32 nt, Human
uggaugagccaggggacacagaagagaagccc

SEQ ID NO: 255145 - RNA, 32 nt, Human
uggaugaggagaaaggaugggccauccaggca

SEQ ID NO: 255146 - RNA, 32 nt, Human
uggaugaggagcuggaggggacacuggcccag

SEQ ID NO: 255147 - RNA, 17 nt, Human
uggaugagggggccaga

SEQ ID NO: 255148 - RNA, 32 nt, Human
uggaugagugcuggacgaagaauggccugggc

SEQ ID NO: 255149 - RNA, 32 nt, Human
uggaugagugucaaagugaauuugauuuguac

SEQ ID NO: 255150 - RNA, 32 nt, Human
uggaugaguguggcauuccgugaagaggaagg

SEQ ID NO: 255151 - RNA, 32 nt, Human
uggaugauacacaagcuucauucccaucuaua

SEQ ID NO: 255152 - RNA, 28 nt, Human
uggaugaucugcaaaagaggaaaacaac

SEQ ID NO: 255153 - RNA, 32 nt, Human
uggaugaugaggaggaggaugaggaugaggag

SEQ ID NO: 255154 - RNA, 32 nt, Human
uggaugaugcuggccauuuugccuuucugaca

SEQ ID NO: 255155 - RNA, 20 nt, Human
uggaugauggauuccacaaa

SEQ ID NO: 255156 - RNA, 23 nt, Human
uggaugaugucugauugguucca

SEQ ID NO: 255157 - RNA, 32 nt, Human
uggaugcaaaauccaaagcaccucuggguuua

SEQ ID NO: 255158 - RNA, 32 nt, Human
uggaugcaaagccaccacaaugccuacaggaa

SEQ ID NO: 255159 - RNA, 32 nt, Human
uggaugcaaucucucagggaagugaaucacaa

SEQ ID NO: 255160 - RNA, 32 nt, Human
uggaugcagagacagagccauugaaaguguuu

SEQ ID NO: 255161 - RNA, 32 nt, Human
uggaugcagagggacuccucccuaucugauuc

SEQ ID NO: 255162 - RNA, 32 nt, Human
uggaugcagagguggagguugaggccgugacu

SEQ ID NO: 255163 - RNA, 32 nt, Human
uggaugcagcagccugaaacuugagagcgaaa

SEQ ID NO: 255164 - RNA, 32 nt, Human
uggaugcaggaagcugggaaagacugauguug

SEQ ID NO: 255165 - RNA, 32 nt, Human
uggaugcaggaggacgaggagugaggggucca

SEQ ID NO: 255166 - RNA, 24 nt, Human
uggaugcaguggcucacaccugua

SEQ ID NO: 255167 - RNA, 24 nt, Human
uggaugcaguggcucaugccugua

SEQ ID NO: 255168 - RNA, 24 nt, Human
uggaugcaguggcucaugcuugua

SEQ ID NO: 255169 - RNA, 19 nt, Human
uggaugcagugguggugag

SEQ ID NO: 255170 - RNA, 28 nt, Human
uggaugcaucggaaagagccuggggcaa

SEQ ID NO: 255171 - RNA, 32 nt, Human
uggaugcauguucugauugccucuuuggagaa

SEQ ID NO: 255172 - RNA, 22 nt, Human
uggaugccaacucuggcgaaug

SEQ ID NO: 255173 - RNA, 22 nt, Human
uggaugccagcccaggaugagu

SEQ ID NO: 255174 - RNA, 32 nt, Human
uggaugccagugccaaauuuaaagagcuugaa

SEQ ID NO: 255175 - RNA, 22 nt, Human
uggaugccaugggcuaugggag

SEQ ID NO: 255176 - RNA, 32 nt, Human
uggaugcccaagugauuuucucuaauaaucgg

SEQ ID NO: 255177 - RNA, 21 nt, Human
uggaugcccagcgcugggaag

SEQ ID NO: 255178 - RNA, 32 nt, Human
uggaugcccaggacaggacuguucuacauuug

SEQ ID NO: 255179 - RNA, 28 nt, Human
uggaugcccuggaggaacaaggaggccu

SEQ ID NO: 255180 - RNA, 18 nt, Human
uggaugccuauaauccca

SEQ ID NO: 255181 - RNA, 32 nt, Human
uggaugccugccugcccugcccugugcugugg

SEQ ID NO: 255182 - RNA, 32 nt, Human
uggaugccugggaacuuuuuguacccauugua

SEQ ID NO: 255183 - RNA, 18 nt, Human
uggaugccuguaauccua

SEQ ID NO: 255184 - RNA, 32 nt, Human
uggaugccuguaauccuagcuccucgggaggc

SEQ ID NO: 255185 - RNA, 32 nt, Human
uggaugcgggcuggccguggcccagugaagcc

SEQ ID NO: 255186 - RNA, 24 nt, Human
uggaugcgguggcucacaauugua

SEQ ID NO: 255187 - RNA, 24 nt, Human
uggaugcgguggcucacgccugua

SEQ ID NO: 255188 - RNA, 32 nt, Human
uggaugcguccccagaucgcaggauuuccaag

SEQ ID NO: 255189 - RNA, 32 nt, Human
uggaugcucauggccagcugggggcucugugg

SEQ ID NO: 255190 - RNA, 32 nt, Human
uggaugcuccuccuguuuaccccacauccacu

SEQ ID NO: 255191 - RNA, 24 nt, Human
uggaugcugcaauucccaaugcag

SEQ ID NO: 255192 - RNA, 32 nt, Human
uggaugcugcauaauccaccuggguacuucag

SEQ ID NO: 255193 - RNA, 23 nt, Human
uggaugcugccauguugggaagu

SEQ ID NO: 255194 - RNA, 32 nt, Human
uggaugcugcguuuuaaggaagugagugagaa

SEQ ID NO: 255195 - RNA, 32 nt, Human
uggaugcuggcgggugacuugcagugggcgcc

SEQ ID NO: 255196 - RNA, 32 nt, Human
uggaugcugggaaguccaagaucaaggcucug

SEQ ID NO: 255197 - RNA, 32 nt, Human
uggaugcugggcuucauaccugggugaugaga

SEQ ID NO: 255198 - RNA, 21 nt, Human
uggaugcuggggugcugagug

SEQ ID NO: 255199 - RNA, 28 nt, Human
uggaugcuggguggcgccucaucugcau

SEQ ID NO: 255200 - RNA, 19 nt, Human
uggaugcugugccggggag

SEQ ID NO: 255201 - RNA, 32 nt, Human
uggaugcuguucugugaucuaaaacaacucuu

SEQ ID NO: 255202 - RNA, 32 nt, Human
uggaugcuuaaagcugcagcaaaaagaccaga

SEQ ID NO: 255203 - RNA, 32 nt, Human
uggaugcuuccagcucaugagaugucucagca

SEQ ID NO: 255204 - RNA, 32 nt, Human
uggaugcuuccugcccuugaacaucagacucc

SEQ ID NO: 255205 - RNA, 32 nt, Human
uggaugcuuucaccagcagacccggccaugug

SEQ ID NO: 255206 - RNA, 32 nt, Human
uggauggaacaggaaaccaaucaccuggcacc

SEQ ID NO: 255207 - RNA, 32 nt, Human
uggauggaaggugcccgcacaccagcugagaa

SEQ ID NO: 255208 - RNA, 32 nt, Human
uggauggacacauugcuguggguagucccucc

SEQ ID NO: 255209 - RNA, 32 nt, Human
uggauggagagcagcagcaggggaagaggugc

SEQ ID NO: 255210 - RNA, 32 nt, Human
uggauggagaggggaggggagggugcaggcau

SEQ ID NO: 255211 - RNA, 28 nt, Human
uggauggagcagcaggagccagugaguc

SEQ ID NO: 255212 - RNA, 32 nt, Human
uggauggagcccaggcgggagcgguggcccug

SEQ ID NO: 255213 - RNA, 32 nt, Human
uggauggagguggggagugugguguguaaagu

SEQ ID NO: 255214 - RNA, 32 nt, Human
uggauggauacuccaugagaaaagccgugggu

SEQ ID NO: 255215 - RNA, 32 nt, Human
uggauggaugaaaaggagagggaaggaaggaa

SEQ ID NO: 255216 - RNA, 32 nt, Human
uggauggauggagggauggaaggagggaggga

SEQ ID NO: 255217 - RNA, 32 nt, Human
uggauggcaaaguggugucugagaccagugau

SEQ ID NO: 255218 - RNA, 32 nt, Human
uggauggcacaccacaguuuguuugcauuuca

SEQ ID NO: 255219 - RNA, 23 nt, Human
uggauggcagugcccaaaacagg

SEQ ID NO: 255220 - RNA, 32 nt, Human
uggauggcgugcugggaauagaaagcagcucu

SEQ ID NO: 255221 - RNA, 32 nt, Human
uggauggcucaagucugcacagagcaaguccu

SEQ ID NO: 255222 - RNA, 32 nt, Human
uggauggcuccuccucuuccuucugcuccaag

SEQ ID NO: 255223 - RNA, 32 nt, Human
uggauggcuggccugugguggaugggugcucu

SEQ ID NO: 255224 - RNA, 32 nt, Human
uggauggcuucaaaggaauauaccacuagagc

SEQ ID NO: 255225 - RNA, 32 nt, Human
uggaugggaaacuagggauggcaggagagucu

SEQ ID NO: 255226 - RNA, 19 nt, Human
uggaugggaaacugcucca

SEQ ID NO: 255227 - RNA, 32 nt, Human
uggaugggaaugaggaaggagugaggggaaga

SEQ ID NO: 255228 - RNA, 22 nt, Human
uggaugggacacguggggagug

SEQ ID NO: 255229 - RNA, 32 nt, Human
uggaugggacucuuaugucauaacuucuguua

SEQ ID NO: 255230 - RNA, 32 nt, Human
uggaugggccauuccgaucugccuuaugaaau

SEQ ID NO: 255231 - RNA, 32 nt, Human
uggaugggccugugacaccccaaagagaagaa

SEQ ID NO: 255232 - RNA, 18 nt, Human
uggaugggcugcacccag

SEQ ID NO: 255233 - RNA, 32 nt, Human
uggauggggaggaggcaccauuugcuggaacu

SEQ ID NO: 255234 - RNA, 32 nt, Human
uggauggggauccagauggagguggagcugca

SEQ ID NO: 255235 - RNA, 32 nt, Human
uggauggggauccagauggagguggaggguug

SEQ ID NO: 255236 - RNA, 32 nt, Human
uggauggggcuuccagcucagaacccaucccu

SEQ ID NO: 255237 - RNA, 32 nt, Human
uggauggggguguccggcugagccccgggauc

SEQ ID NO: 255238 - RNA, 32 nt, Human
uggauggggguuggcaggaagcuguuaaagau

SEQ ID NO: 255239 - RNA, 32 nt, Human
uggauggguauaaggugggcuugguccaacag

SEQ ID NO: 255240 - RNA, 32 nt, Human
uggaugggugaggcaagccaggagagcaagca

SEQ ID NO: 255241 - RNA, 32 nt, Human
uggauggguuacagucguguggauggcuuacc

SEQ ID NO: 255242 - RNA, 32 nt, Human
uggauggucaucucggaguuccaguaccgccc

SEQ ID NO: 255243 - RNA, 19 nt, Human
uggaugguccacugcuuug

SEQ ID NO: 255244 - RNA, 32 nt, Human
uggaugguccuguuagaaaggcagcaugccag

SEQ ID NO: 255245 - RNA, 32 nt, Human
uggauggucucgauuuucugaucuuaugauuc

SEQ ID NO: 255246 - RNA, 32 nt, Human
uggauggucucuaauacuaucuccuuccuucc

SEQ ID NO: 255247 - RNA, 32 nt, Human
uggauggugaaaugugcauggugcacagucug

SEQ ID NO: 255248 - RNA, 32 nt, Human
uggauggugcaaccuguggcccagggagcuac

SEQ ID NO: 255249 - RNA, 32 nt, Human
uggauggugcuggguccccacagggagcgaga

SEQ ID NO: 255250 - RNA, 32 nt, Human
uggaugguggaguggacacugggugaaccacg

SEQ ID NO: 255251 - RNA, 32 nt, Human
uggaugguggugaguggaucauuucuuucagc

SEQ ID NO: 255252 - RNA, 32 nt, Human
uggaugguuagaaacaauaauauauaggguuu

SEQ ID NO: 255253 - RNA, 32 nt, Human
uggauguaaccaacaaccacagaacuacagaa

SEQ ID NO: 255254 - RNA, 32 nt, Human
uggauguaagagaauccagcagagauggacug

SEQ ID NO: 255255 - RNA, 32 nt, Human
uggauguaauauauguagcacacacacauaga

SEQ ID NO: 255256 - RNA, 19 nt, Human
uggauguaauuacugaaga

SEQ ID NO: 255257 - RNA, 32 nt, Human
uggauguacacacggaaguggaggaggaggag

SEQ ID NO: 255258 - RNA, 32 nt, Human
uggauguagauggugcccagaccuuuucccuc

SEQ ID NO: 255259 - RNA, 32 nt, Human
uggauguauaaccuguuuccagccuggccuga

SEQ ID NO: 255260 - RNA, 32 nt, Human
uggauguauacuauuuggaugauccaguagua

SEQ ID NO: 255261 - RNA, 32 nt, Human
uggauguaucccaacagaggaacagguaucuu

SEQ ID NO: 255262 - RNA, 32 nt, Human
uggauguaucuauucaauuucucaguuuaugu

SEQ ID NO: 255263 - RNA, 32 nt, Human
uggaugucaggggacgggugugaggcaugagc

SEQ ID NO: 255264 - RNA, 32 nt, Human
uggaugucagugcagugcacugcuacuguuuu

SEQ ID NO: 255265 - RNA, 24 nt, Human
uggauguccagccagcugcccccu

SEQ ID NO: 255266 - RNA, 22 nt, Human
uggaugucgagggugguuugug

SEQ ID NO: 255267 - RNA, 32 nt, Human
uggaugucggcggugaagagcugugcaggccg

SEQ ID NO: 255268 - RNA, 32 nt, Human
uggaugucggugacaccugccucccagguggu

SEQ ID NO: 255269 - RNA, 28 nt, Human
uggaugucuaucucccuggcuuggugcc

SEQ ID NO: 255270 - RNA, 32 nt, Human
uggaugucucucgcuacguuuccccagagcag

SEQ ID NO: 255271 - RNA, 32 nt, Human
uggaugucuugccuugagauaaggcugccgga

SEQ ID NO: 255272 - RNA, 32 nt, Human
uggaugucuuucuucuucauccaagcacccua

SEQ ID NO: 255273 - RNA, 19 nt, Human
uggaugugagaguggugaa

SEQ ID NO: 255274 - RNA, 24 nt, Human
uggaugugaugacucaugccugug

SEQ ID NO: 255275 - RNA, 32 nt, Human
uggaugugcaaacccaacccaagaauaccuug

SEQ ID NO: 255276 - RNA, 32 nt, Human
uggaugugcaagaccagccacuggagguagcu

SEQ ID NO: 255277 - RNA, 32 nt, Human
uggaugugcaaguuguggagagaaggagcacc

SEQ ID NO: 255278 - RNA, 32 nt, Human
uggaugugccugaaaugcccagccaggagccc

SEQ ID NO: 255279 - RNA, 32 nt, Human
uggaugugcuccugaaucuacuuuuuauaaaa

SEQ ID NO: 255280 - RNA, 32 nt, Human
uggauguggcagaguccugaugaaagauguau

SEQ ID NO: 255281 - RNA, 32 nt, Human
uggauguggcaggagccccaucaaggaaggac

SEQ ID NO: 255282 - RNA, 32 nt, Human
uggauguggcugcaguccagagaaaggaaaga

SEQ ID NO: 255283 - RNA, 32 nt, Human
uggaugugggaaagccuacaguuggaaaucac

SEQ ID NO: 255284 - RNA, 32 nt, Human
uggauguggucucuacacuaaccuucuugaug

SEQ ID NO: 255285 - RNA, 24 nt, Human
uggauguggugacucaugccugua

SEQ ID NO: 255286 - RNA, 23 nt, Human
uggaugugguggcagugccugua

SEQ ID NO: 255287 - RNA, 24 nt, Human
uggaugugguggcauacgccugua

SEQ ID NO: 255288 - RNA, 24 nt, Human
uggaugugguggcucacaacugua

SEQ ID NO: 255289 - RNA, 24 nt, Human
uggaugugguggcucacaccugua

SEQ ID NO: 255290 - RNA, 24 nt, Human
uggaugugguggcucauaccugua

SEQ ID NO: 255291 - RNA, 24 nt, Human
uggaugugguggugcacaccugug

SEQ ID NO: 255292 - RNA, 24 nt, Human
uggaugugguggugugcaccugua

SEQ ID NO: 255293 - RNA, 32 nt, Human
uggaugugguuagagggaugggcugaauaggc

SEQ ID NO: 255294 - RNA, 32 nt, Human
uggauguguagcaaggaugggagaagcgaaau

SEQ ID NO: 255295 - RNA, 32 nt, Human
uggauguguccagaagcuuuaccauccacacc

SEQ ID NO: 255296 - RNA, 19 nt, Human
uggauguguguguggugaa

SEQ ID NO: 255297 - RNA, 32 nt, Human
uggauguucaggccuagcuccaaccaagagug

SEQ ID NO: 255298 - RNA, 23 nt, Human
uggauguucaguauguuugugag

SEQ ID NO: 255299 - RNA, 32 nt, Human
uggauguugaaaucuuugccuccucagucggg

SEQ ID NO: 255300 - RNA, 32 nt, Human
uggauguugcuugacuccuuccauccuuccug

SEQ ID NO: 255301 - RNA, 32 nt, Human
uggauguuggggaggaagagaggagauggauu

SEQ ID NO: 255302 - RNA, 32 nt, Human
uggauguuguuaucucccuccuggccuuugua

SEQ ID NO: 255303 - RNA, 32 nt, Human
uggauguuguugccaaggaaaccaccuccuuc

SEQ ID NO: 255304 - RNA, 32 nt, Human
uggauguuuccucuuccucccuuaugucuacc

SEQ ID NO: 255305 - RNA, 21 nt, Human
uggauguuugaacuugcucca

SEQ ID NO: 255306 - RNA, 23 nt, Human
uggauguuugccugguccgugag

SEQ ID NO: 255307 - RNA, 32 nt, Human
uggauuaaagacggcccacagaccagaacuuc

SEQ ID NO: 255308 - RNA, 32 nt, Human
uggauuaauuccuuuuggcaaggaggcccuuu

SEQ ID NO: 255309 - RNA, 32 nt, Human
uggauuacccaggaagguugagcugcugagau

SEQ ID NO: 255310 - RNA, 17 nt, Human
uggauuaccugguggug

SEQ ID NO: 255311 - RNA, 32 nt, Human
uggauuacgggaguucgagaccagccugggca

SEQ ID NO: 255312 - RNA, 32 nt, Human
uggauuacuucaguugaccuuugugaagguuu

SEQ ID NO: 255313 - RNA, 32 nt, Human
uggauuagaaagcugcaggagggucaucgcuu

SEQ ID NO: 255314 - RNA, 32 nt, Human
uggauuagacccaagggcugagcuccucuagg

SEQ ID NO: 255315 - RNA, 32 nt, Human
uggauuagcagggguggguccaggaagaugau

SEQ ID NO: 255316 - RNA, 32 nt, Human
uggauuaggaacaggauucauuccuuuaacuu

SEQ ID NO: 255317 - RNA, 32 nt, Human
uggauuagggcugcucagccuguuuucucucu

SEQ ID NO: 255318 - RNA, 32 nt, Human
uggauuauaaaaauaugggggaaagugcuaug

SEQ ID NO: 255319 - RNA, 32 nt, Human
uggauuauauacuaguuaauuucuuccauucc

SEQ ID NO: 255320 - RNA, 32 nt, Human
uggauuauauugcuugacuucuaccucagaau

SEQ ID NO: 255321 - RNA, 32 nt, Human
uggauuaucccuuuuuccuauaccugaaaaca

SEQ ID NO: 255322 - RNA, 32 nt, Human
uggauuauguaauacauuguaaaguuuuaauu

SEQ ID NO: 255323 - RNA, 32 nt, Human
uggauuauuuggaagcucggaagugaaauucu

SEQ ID NO: 255324 - RNA, 32 nt, Human
uggauucaagcgauucuccugucccagccucc

SEQ ID NO: 255325 - RNA, 32 nt, Human
uggauucacaccauucuccugccucagccucc

SEQ ID NO: 255326 - RNA, 32 nt, Human
uggauucaccacugcuaacaccuccugguugg

SEQ ID NO: 255327 - RNA, 32 nt, Human
uggauucagacugaauuauaccacaggccuuc

SEQ ID NO: 255328 - RNA, 32 nt, Human
uggauucagccaugcauggacugggguguucc

SEQ ID NO: 255329 - RNA, 32 nt, Human
uggauucagccccaccuccugcucacagaccc

SEQ ID NO: 255330 - RNA, 32 nt, Human
uggauucagcucccccagguuccccaugauga

SEQ ID NO: 255331 - RNA, 32 nt, Human
uggauucaucugcaacacaggcugccggguug

SEQ ID NO: 255332 - RNA, 32 nt, Human
uggauucaugccacguugaagauaaaauuauc

SEQ ID NO: 255333 - RNA, 32 nt, Human
uggauucauguggacauucaggaagcuuauuc

SEQ ID NO: 255334 - RNA, 32 nt, Human
uggauucauuuacauuguuuacacuucuauga

SEQ ID NO: 255335 - RNA, 21 nt, Human
uggauuccagaaugauugcuu

SEQ ID NO: 255336 - RNA, 32 nt, Human
uggauuccagcacuggaggacccccugccacg

SEQ ID NO: 255337 - RNA, 32 nt, Human
uggauuccagcauucagcaggugcagaucucg

SEQ ID NO: 255338 - RNA, 32 nt, Human
uggauuccauauuuuuguuucucuccaauuca

SEQ ID NO: 255339 - RNA, 32 nt, Human
uggauuccaucacauggugagccuugaggaag

SEQ ID NO: 255340 - RNA, 32 nt, Human
uggauuccaucuuucugcaguaacagcgggca

SEQ ID NO: 255341 - RNA, 21 nt, Human
uggauuccauggggucugcuu

SEQ ID NO: 255342 - RNA, 32 nt, Human
uggauucccacauuugucuucuuucugucuuu

SEQ ID NO: 255343 - RNA, 32 nt, Human
uggauuccguauguucuucauagagaguguuu

SEQ ID NO: 255344 - RNA, 32 nt, Human
uggauuccuaucucguuacucugucuccauua

SEQ ID NO: 255345 - RNA, 32 nt, Human
uggauuccuccagggccugauccugggugcag

SEQ ID NO: 255346 - RNA, 32 nt, Human
uggauuccuccaggucaggggcuggcugggac

SEQ ID NO: 255347 - RNA, 32 nt, Human
uggauuccuccuccucuuccuccgcggcgggu

SEQ ID NO: 255348 - RNA, 32 nt, Human
uggauuccucuccugaaaaugcuuuuuccuuu

SEQ ID NO: 255349 - RNA, 21 nt, Human
uggauuccugaaccaggggga

SEQ ID NO: 255350 - RNA, 32 nt, Human
uggauuccugcacgaaguggcugaugggaacc

SEQ ID NO: 255351 - RNA, 32 nt, Human
uggauucgggagcugggaguaaccaggcaaag

SEQ ID NO: 255352 - RNA, 19 nt, Human
uggauucuaucauccaggu

SEQ ID NO: 255353 - RNA, 32 nt, Human
uggauucuccaggacaaaccuguguucaugga

SEQ ID NO: 255354 - RNA, 32 nt, Human
uggauucuccugcucgcugccucccagcaucu

SEQ ID NO: 255355 - RNA, 32 nt, Human
uggauucucuuucauggcagaugcucuuggac

SEQ ID NO: 255356 - RNA, 32 nt, Human
uggauucugauucaggaggagccucccagucu

SEQ ID NO: 255357 - RNA, 32 nt, Human
uggauucugccuccaucucugccuccauggcu

SEQ ID NO: 255358 - RNA, 32 nt, Human
uggauucuggaaauauuuugaagauugaauug

SEQ ID NO: 255359 - RNA, 32 nt, Human
uggauucuggaagucagguugcacagagucac

SEQ ID NO: 255360 - RNA, 32 nt, Human
uggauucugugcagugcuaggagggaggagag

SEQ ID NO: 255361 - RNA, 32 nt, Human
uggauucugugccaucugaacaugcucuccug

SEQ ID NO: 255362 - RNA, 32 nt, Human
uggauucuguggccccaaauguuaauagugcc

SEQ ID NO: 255363 - RNA, 32 nt, Human
uggauucuuaaccuugaauccaaagugucugc

SEQ ID NO: 255364 - RNA, 32 nt, Human
uggauucuugucuuccccaaccucucaguggu

SEQ ID NO: 255365 - RNA, 32 nt, Human
uggauugacuggucaguugcuacaaucagaau

SEQ ID NO: 255366 - RNA, 32 nt, Human
uggauugagagggaggcccugggaggagagaa

SEQ ID NO: 255367 - RNA, 23 nt, Human
uggauugaucagagagaauugaa

SEQ ID NO: 255368 - RNA, 32 nt, Human
uggauugauguucacagcuuuauacuucagaa

SEQ ID NO: 255369 - RNA, 32 nt, Human
uggauugcacacuguagugagacauccauccu

SEQ ID NO: 255370 - RNA, 22 nt, Human
uggauugcaccucuguaaacua

SEQ ID NO: 255371 - RNA, 32 nt, Human
uggauugcacguggccucuugagcaguggcug

SEQ ID NO: 255372 - RNA, 32 nt, Human
uggauugcaguggcgugaucaugccucacugc

SEQ ID NO: 255373 - RNA, 32 nt, Human
uggauugccguuuguaccuguaucaguauugc

SEQ ID NO: 255374 - RNA, 32 nt, Human
uggauugcgccacugcacuccagccugggcaa

SEQ ID NO: 255375 - RNA, 32 nt, Human
uggauugcgcuacugcacuccagccuggguga

SEQ ID NO: 255376 - RNA, 32 nt, Human
uggauuggaaugcagaggucuccaaacugauu

SEQ ID NO: 255377 - RNA, 21 nt, Human
uggauuggaugcuggggugug

SEQ ID NO: 255378 - RNA, 32 nt, Human
uggauugggauagaaguauuuguguaccugga

SEQ ID NO: 255379 - RNA, 32 nt, Human
uggauugggguggcuuucucuucuaagucacu

SEQ ID NO: 255380 - RNA, 32 nt, Human
uggauugggucagccccucugcauuuaccuau

SEQ ID NO: 255381 - RNA, 32 nt, Human
uggauuguagccaguucagcuaggcaaaagcc

SEQ ID NO: 255382 - RNA, 22 nt, Human
uggauuguauaacccauauacu

SEQ ID NO: 255383 - RNA, 32 nt, Human
uggauuguauuaucugcuuuccuuuaccaagg

SEQ ID NO: 255384 - RNA, 32 nt, Human
uggauugucaucagcccugccuguuuugcacc

SEQ ID NO: 255385 - RNA, 32 nt, Human
uggauugugcugcucucguuucagcuuugauu

SEQ ID NO: 255386 - RNA, 32 nt, Human
uggauugugcugcuguuagccuuaguuucagu

SEQ ID NO: 255387 - RNA, 32 nt, Human
uggauuuaaaggacaguggcacacuggggaga

SEQ ID NO: 255388 - RNA, 32 nt, Human
uggauuuacccaggucgaguucagagagccuc

SEQ ID NO: 255389 - RNA, 32 nt, Human
uggauuuagccaaggaccuggcaacccaggaa

SEQ ID NO: 255390 - RNA, 32 nt, Human
uggauuuagggagggggcugugauguaaaacg

SEQ ID NO: 255391 - RNA, 32 nt, Human
uggauuuagggauagugucccucuccaugucc

SEQ ID NO: 255392 - RNA, 32 nt, Human
uggauuuaucacauugaguuaugaaauuaccu

SEQ ID NO: 255393 - RNA, 32 nt, Human
uggauuucaagcacuuucacacuuaacaaaau

SEQ ID NO: 255394 - RNA, 23 nt, Human
uggauuucaaguuggcggcugcc

SEQ ID NO: 255395 - RNA, 32 nt, Human
uggauuucacccaggaggaguggcagcaacug

SEQ ID NO: 255396 - RNA, 32 nt, Human
uggauuucacccaggaggaguggcggcaacug

SEQ ID NO: 255397 - RNA, 32 nt, Human
uggauuucagcccucaaagcguuccgugagcc

SEQ ID NO: 255398 - RNA, 32 nt, Human
uggauuucauuuccccaggucuucaguguuga

SEQ ID NO: 255399 - RNA, 32 nt, Human
uggauuuccacuuauguaacuaguggugcuau

SEQ ID NO: 255400 - RNA, 32 nt, Human
uggauuuccuccagaguucggauuuccugaga

SEQ ID NO: 255401 - RNA, 32 nt, Human
uggauuuccugcuuggagucucaggccccagc

SEQ ID NO: 255402 - RNA, 32 nt, Human
uggauuuccuggaagacguggauuuuccugga

SEQ ID NO: 255403 - RNA, 32 nt, Human
uggauuucuacccccuugcuauccucucuggc

SEQ ID NO: 255404 - RNA, 32 nt, Human
uggauuucuccugccaggagaaucuccugcag

SEQ ID NO: 255405 - RNA, 32 nt, Human
uggauuucugaacgaagcagagcucagcucuu

SEQ ID NO: 255406 - RNA, 24 nt, Human
uggauuucuucucccaacaacuac

SEQ ID NO: 255407 - RNA, 32 nt, Human
uggauuugaccuucaaaauugaaggucguucu

SEQ ID NO: 255408 - RNA, 32 nt, Human
uggauuugaggcagauaccauaaagaaaaguu

SEQ ID NO: 255409 - RNA, 32 nt, Human
uggauuugaguuuccauauuguucaucauuac

SEQ ID NO: 255410 - RNA, 19 nt, Human
uggauuugcucauugcugu

SEQ ID NO: 255411 - RNA, 32 nt, Human
uggauuugcuguucuugccugcagggccucag

SEQ ID NO: 255412 - RNA, 32 nt, Human
uggauuugggaugucaggggaagaacucagug

SEQ ID NO: 255413 - RNA, 32 nt, Human
uggauuugggcuagucuugugauugcuuugac

SEQ ID NO: 255414 - RNA, 32 nt, Human
uggauuuggggguuaugagaacuccauguuuu

SEQ ID NO: 255415 - RNA, 32 nt, Human
uggauuuggucaucucaagaagagucuucaga

SEQ ID NO: 255416 - RNA, 32 nt, Human
uggauuugucaggugcaucacagaggucaaag

SEQ ID NO: 255417 - RNA, 32 nt, Human
uggauuugugcaauauguaaaaauguaucaaa

SEQ ID NO: 255418 - RNA, 32 nt, Human
uggauuuuacuucuaagagcaaaggaaagccc

SEQ ID NO: 255419 - RNA, 32 nt, Human
uggauuuuccagauccuugugguccuggaaau

SEQ ID NO: 255420 - RNA, 32 nt, Human
uggauuuucuagaauuaguuguaggcgacagu

SEQ ID NO: 255421 - RNA, 32 nt, Human
uggauuuucuucuuucuuuguuuagaaaggga

SEQ ID NO: 255422 - RNA, 32 nt, Human
uggauuuugcaccuggcuuuggggcaggggug

SEQ ID NO: 255423 - RNA, 32 nt, Human
uggauuuugguaucugcagggguccugggaac

SEQ ID NO: 255424 - RNA, 32 nt, Human
uggauuuuguuucauuuaaccucucuuugcac

SEQ ID NO: 255425 - RNA, 21 nt, Human
uggauuuuuagguggugggaa

SEQ ID NO: 255426 - RNA, 32 nt, Human
uggauuuuuccuccacuaaaucugcaggaaac

SEQ ID NO: 255427 - RNA, 32 nt, Human
uggauuuuucugaauaaaguucugcaugagau

SEQ ID NO: 255428 - RNA, 32 nt, Human
uggauuuuuguguguauguauguaugugauua

SEQ ID NO: 255429 - RNA, 32 nt, Human
uggauuuuuguguuguuuuuguucuguuuuac

SEQ ID NO: 255430 - RNA, 32 nt, Human
uggcaaaaacaugcugagcagcuuugaaggcu

SEQ ID NO: 255431 - RNA, 32 nt, Human
uggcaaaaagacgucaggccacccucauagua

SEQ ID NO: 255432 - RNA, 32 nt, Human
uggcaaaaagaugucaaggaugucacugggag

SEQ ID NO: 255433 - RNA, 32 nt, Human
uggcaaaaaggaagacccccacccucaccugc

SEQ ID NO: 255434 - RNA, 21 nt, Human
uggcaaaacaguccuugcccu

SEQ ID NO: 255435 - RNA, 32 nt, Human
uggcaaaaccccaucucuaccaaaaauacaaa

SEQ ID NO: 255436 - RNA, 32 nt, Human
uggcaaaaccccaucuuuaccaaaaauaagcu

SEQ ID NO: 255437 - RNA, 32 nt, Human
uggcaaaaccccaugucuacuaaaaauauuua

SEQ ID NO: 255438 - RNA, 32 nt, Human
uggcaaaacccccacucuugccuggauucuga

SEQ ID NO: 255439 - RNA, 21 nt, Human
uggcaaaagaagagauaagag

SEQ ID NO: 255440 - RNA, 32 nt, Human
uggcaaaagcuacauuuuuacuguccuuacca

SEQ ID NO: 255441 - RNA, 24 nt, Human
uggcaaaaucauggcucacugcag

SEQ ID NO: 255442 - RNA, 32 nt, Human
uggcaaaaucauggcucacugcagccuggagc

SEQ ID NO: 255443 - RNA, 32 nt, Human
uggcaaaaugcacaggggaaugugaaaagacu

SEQ ID NO: 255444 - RNA, 32 nt, Human
uggcaaacagaaguucaggaugagacccugcu

SEQ ID NO: 255445 - RNA, 32 nt, Human
uggcaaacauggcaaaacugucucuauuaaaa

SEQ ID NO: 255446 - RNA, 32 nt, Human
uggcaaacauggcgacacccugucucuacuaa

SEQ ID NO: 255447 - RNA, 32 nt, Human
uggcaaacauggugaaaccccaucucuaguaa

SEQ ID NO: 255448 - RNA, 32 nt, Human
uggcaaacauggugaaacgccgucucuacuga

SEQ ID NO: 255449 - RNA, 32 nt, Human
uggcaaaccuucgacuucauuuugccaccucu

SEQ ID NO: 255450 - RNA, 32 nt, Human
uggcaaacuaguaucugcuguaaaacaaccua

SEQ ID NO: 255451 - RNA, 32 nt, Human
uggcaaacucuccaccacacguaaugaaacuu

SEQ ID NO: 255452 - RNA, 32 nt, Human
uggcaaagaaacagcguccagagcagacacag

SEQ ID NO: 255453 - RNA, 32 nt, Human
uggcaaagagaagaaaggcccaagagcgagac

SEQ ID NO: 255454 - RNA, 32 nt, Human
uggcaaagagucggccacccagauuuaccaca

SEQ ID NO: 255455 - RNA, 32 nt, Human
uggcaaagcagacucaaugcacugucgacauc

SEQ ID NO: 255456 - RNA, 32 nt, Human
uggcaaaggagaggacaccgccagugguccaa

SEQ ID NO: 255457 - RNA, 32 nt, Human
uggcaaagggagugccugggccuggugaccca

SEQ ID NO: 255458 - RNA, 32 nt, Human
uggcaaagguccaagccccaaccaaggggauu

SEQ ID NO: 255459 - RNA, 18 nt, Human
uggcaaauaaaauguaaa

SEQ ID NO: 255460 - RNA, 32 nt, Human
uggcaaauaagauucuaaaagcacuuauaucc

SEQ ID NO: 255461 - RNA, 32 nt, Human
uggcaaauauagaauauuucacauucucagag

SEQ ID NO: 255462 - RNA, 32 nt, Human
uggcaaaucugccagggaugucuucaccaagg

SEQ ID NO: 255463 - RNA, 32 nt, Human
uggcaaaugaagcacagaaaucucuuugcucu

SEQ ID NO: 255464 - RNA, 32 nt, Human
uggcaaaugccuguaauaccagcuacucagga

SEQ ID NO: 255465 - RNA, 32 nt, Human
uggcaaaugccuguaaucccagcacuuuggga

SEQ ID NO: 255466 - RNA, 24 nt, Human
uggcaaaugccuguaaucccagcu

SEQ ID NO: 255467 - RNA, 32 nt, Human
uggcaaauggggcuccugggcccaguccugcu

SEQ ID NO: 255468 - RNA, 32 nt, Human
uggcaaauguuucucagucauaguuggacugu

SEQ ID NO: 255469 - RNA, 32 nt, Human
uggcaaauuauuuuaaacugugcucaacccuu

SEQ ID NO: 255470 - RNA, 32 nt, Human
uggcaacaagguaggcccuggugcagggcaag

SEQ ID NO: 255471 - RNA, 31 nt, Human
uggcaacacagcuacaaaggcauaaacaaga

SEQ ID NO: 255472 - RNA, 32 nt, Human
uggcaacacugcgcuccagccuggcagacaga

SEQ ID NO: 255473 - RNA, 32 nt, Human
uggcaacauggugaaaccccaucuccaccaaa

SEQ ID NO: 255474 - RNA, 32 nt, Human
uggcaaccaucagaagcuuggaagaggcaaag

SEQ ID NO: 255475 - RNA, 32 nt, Human
uggcaacccaguagcuggagucugaagaugga

SEQ ID NO: 255476 - RNA, 28 nt, Human
uggcaacccucagcugccucaucguggc

SEQ ID NO: 255477 - RNA, 32 nt, Human
uggcaacccuccuggacuaggcugcucuuguu

SEQ ID NO: 255478 - RNA, 32 nt, Human
uggcaacccuggggucuuugaugucuugacag

SEQ ID NO: 255479 - RNA, 32 nt, Human
uggcaaccgcagguggcucugaggugagagac

SEQ ID NO: 255480 - RNA, 21 nt, Human
uggcaaccuaacauaccagug

SEQ ID NO: 255481 - RNA, 32 nt, Human
uggcaaccugagccacacaggccuccaccccu

SEQ ID NO: 255482 - RNA, 32 nt, Human
uggcaacguccucccacagagacagaggggaa

SEQ ID NO: 255483 - RNA, 32 nt, Human
uggcaacuagcauggugccugccccuaauaca

SEQ ID NO: 255484 - RNA, 32 nt, Human
uggcaacuccaaagucaucuugccagucccgg

SEQ ID NO: 255485 - RNA, 32 nt, Human
uggcaacugcagcugcuggauuccagauucug

SEQ ID NO: 255486 - RNA, 20 nt, Human
uggcaacugcugaucgacuu

SEQ ID NO: 255487 - RNA, 32 nt, Human
uggcaacuuacuacugaaucucuaaucaaugu

SEQ ID NO: 255488 - RNA, 32 nt, Human
uggcaagaaacagacaaagccccaugaaaaau

SEQ ID NO: 255489 - RNA, 32 nt, Human
uggcaagacauuuccuagcugagagaugcuuu

SEQ ID NO: 255490 - RNA, 23 nt, Human
uggcaagaccuuuguucaaaauu

SEQ ID NO: 255491 - RNA, 32 nt, Human
uggcaagagauggguuuauggguuggggcgcc

SEQ ID NO: 255492 - RNA, 32 nt, Human
uggcaagagcgcugucaggccuggugaagggu

SEQ ID NO: 255493 - RNA, 32 nt, Human
uggcaagagcuccugaaccaguuucauuucug

SEQ ID NO: 255494 - RNA, 32 nt, Human
uggcaagaggagguggcggcggugguaguggu

SEQ ID NO: 255495 - RNA, 32 nt, Human
uggcaagagggagggaaggaaggagagcaaaa

SEQ ID NO: 255496 - RNA, 23 nt, Human
uggcaagaucucggcucacugca

SEQ ID NO: 255497 - RNA, 24 nt, Human
uggcaagaucucggcucacugcag

SEQ ID NO: 255498 - RNA, 23 nt, Human
uggcaagaucuuggcucacugca

SEQ ID NO: 255499 - RNA, 32 nt, Human
uggcaagauggaaaccaacuucuccacuccuc

SEQ ID NO: 255500 - RNA, 32 nt, Human
uggcaagcacuggagguggaaggggucauggg

SEQ ID NO: 255501 - RNA, 19 nt, Human
uggcaagcagccuucugaa

SEQ ID NO: 255502 - RNA, 32 nt, Human
uggcaagccccgaggcagggauggccggccca

SEQ ID NO: 255503 - RNA, 21 nt, Human
uggcaagcgccuguaguccca

SEQ ID NO: 255504 - RNA, 24 nt, Human
uggcaagcgccuguagucccagcu

SEQ ID NO: 255505 - RNA, 32 nt, Human
uggcaagcuauguccgcaguucccaggaauuu

SEQ ID NO: 255506 - RNA, 32 nt, Human
uggcaagcugccucuugaguuuguuauaaaag

SEQ ID NO: 255507 - RNA, 32 nt, Human
uggcaaggaagagagagccuucauggcaauuu

SEQ ID NO: 255508 - RNA, 32 nt, Human
uggcaaggacaggagagcagugcagugacaca

SEQ ID NO: 255509 - RNA, 32 nt, Human
uggcaaggacuagagagcaggagugccuggcc

SEQ ID NO: 255510 - RNA, 32 nt, Human
uggcaaggcccaggcaguuccagaucccugca

SEQ ID NO: 255511 - RNA, 32 nt, Human
uggcaaggcugacagagcucuggguugugcac

SEQ ID NO: 255512 - RNA, 32 nt, Human
uggcaagggagcauuccaggagagaaagggac

SEQ ID NO: 255513 - RNA, 22 nt, Human
uggcaagguagaccucauagca

SEQ ID NO: 255514 - RNA, 23 nt, Human
uggcaaggucuucagucaaaguu

SEQ ID NO: 255515 - RNA, 30 nt, Human
uggcaagguuuuuaaucagaaagcacaccu

SEQ ID NO: 255516 - RNA, 32 nt, Human
uggcaaguaaaugacaaaagggacauugauag

SEQ ID NO: 255517 - RNA, 32 nt, Human
uggcaaguuacuuccucuccccaggucucucg

SEQ ID NO: 255518 - RNA, 32 nt, Human
uggcaaguucaucucagagaaaggggauucag

SEQ ID NO: 255519 - RNA, 32 nt, Human
uggcaaguuuguuaccucacuugagugggguu

SEQ ID NO: 255520 - RNA, 32 nt, Human
uggcaauaaaguggaaguugccgucaaacaga

SEQ ID NO: 255521 - RNA, 32 nt, Human
uggcaauacagguaucuguuguaaugacauca

SEQ ID NO: 255522 - RNA, 32 nt, Human
uggcaauacuauccuaacugacaugcagauuc

SEQ ID NO: 255523 - RNA, 32 nt, Human
uggcaauagaguuccuugccauuccugguuuu

SEQ ID NO: 255524 - RNA, 32 nt, Human
uggcaaucaaugcuccauccugccagcccugg

SEQ ID NO: 255525 - RNA, 32 nt, Human
uggcaauccacagaaagagaagagccuuaauu

SEQ ID NO: 255526 - RNA, 32 nt, Human
uggcaaugccaguggaaccacacugcuugagg

SEQ ID NO: 255527 - RNA, 32 nt, Human
uggcaaugccuugcuuuccugcuguugaacau

SEQ ID NO: 255528 - RNA, 32 nt, Human
uggcaaugcuuaaaucucagcauuuccacuga

SEQ ID NO: 255529 - RNA, 32 nt, Human
uggcaauggaaaguccagaguuguuauuguau

SEQ ID NO: 255530 - RNA, 29 nt, Human
uggcaauggcugcucucaaucccuugagg

SEQ ID NO: 255531 - RNA, 32 nt, Human
uggcaauugcuuucugauaucagcucguuuga

SEQ ID NO: 255532 - RNA, 32 nt, Human
uggcaauuggcacugaaggcaccccaggcccc

SEQ ID NO: 255533 - RNA, 32 nt, Human
uggcaauuggugguggggaggcaucugcucca

SEQ ID NO: 255534 - RNA, 32 nt, Human
uggcaauugugaacugcuugaacaguaacuau

SEQ ID NO: 255535 - RNA, 32 nt, Human
uggcaauuucauuuuuggcagucuauuucugu

SEQ ID NO: 255536 - RNA, 32 nt, Human
uggcaauuuuuacacaaaccugaaaagauguu

SEQ ID NO: 255537 - RNA, 32 nt, Human
uggcacaaaaaccuggugaggccucccccuuc

SEQ ID NO: 255538 - RNA, 32 nt, Human
uggcacaaacauagcucacugcagccuugaac

SEQ ID NO: 255539 - RNA, 32 nt, Human
uggcacaaacauggcucacugcagccucgacc

SEQ ID NO: 255540 - RNA, 32 nt, Human
uggcacaaauaauguacacccaccucaacaug

SEQ ID NO: 255541 - RNA, 32 nt, Human
uggcacaaauggagccccuccaugcagagauc

SEQ ID NO: 255542 - RNA, 18 nt, Human
uggcacaaccucagcuca

SEQ ID NO: 255543 - RNA, 23 nt, Human
uggcacaaccucagcucacugca

SEQ ID NO: 255544 - RNA, 23 nt, Human
uggcacaaccucggcucacugca

SEQ ID NO: 255545 - RNA, 23 nt, Human
uggcacaaccuuggcucacugca

SEQ ID NO: 255546 - RNA, 26 nt, Human
uggcacaagauuaugacucacuguag

SEQ ID NO: 255547 - RNA, 32 nt, Human
uggcacaagcagguaaccaggauggcuaacag

SEQ ID NO: 255548 - RNA, 24 nt, Human
uggcacaaucaaagcucacugcag

SEQ ID NO: 255549 - RNA, 32 nt, Human
uggcacaaucaaagcucacugcagccuugaau

SEQ ID NO: 255550 - RNA, 23 nt, Human
uggcacaaucaaggcucacugca

SEQ ID NO: 255551 - RNA, 24 nt, Human
uggcacaaucaaggcucacugcag

SEQ ID NO: 255552 - RNA, 18 nt, Human
uggcacaaucaauguaag

SEQ ID NO: 255553 - RNA, 32 nt, Human
uggcacaaucacagcucacugcagccuggacc

SEQ ID NO: 255554 - RNA, 24 nt, Human
uggcacaaucacagcucacuguag

SEQ ID NO: 255555 - RNA, 24 nt, Human
uggcacaaucacagcucauugcag

SEQ ID NO: 255556 - RNA, 32 nt, Human
uggcacaaucacagcucauugcagccucaacc

SEQ ID NO: 255557 - RNA, 24 nt, Human
uggcacaaucacaguucacugcag

SEQ ID NO: 255558 - RNA, 24 nt, Human
uggcacaaucacggcucacugcag

SEQ ID NO: 255559 - RNA, 21 nt, Human
uggcacaaucagcucacugca

SEQ ID NO: 255560 - RNA, 24 nt, Human
uggcacaaucauaccucacugcag

SEQ ID NO: 255561 - RNA, 32 nt, Human
uggcacaaucauaccucacugcagccucuugg

SEQ ID NO: 255562 - RNA, 24 nt, Human
uggcacaaucauagcucacugcag

SEQ ID NO: 255563 - RNA, 32 nt, Human
uggcacaaucauagcucacugcagcuuugacc

SEQ ID NO: 255564 - RNA, 24 nt, Human
uggcacaaucauagcucgcugcag

SEQ ID NO: 255565 - RNA, 32 nt, Human
uggcacaaucauagcucgcugcagccucgacc

SEQ ID NO: 255566 - RNA, 24 nt, Human
uggcacaaucauggcucacugcag

SEQ ID NO: 255567 - RNA, 32 nt, Human
uggcacaaucauggcucacugcagccccgaac

SEQ ID NO: 255568 - RNA, 32 nt, Human
uggcacaaucauggcucacugcagccucaacc

SEQ ID NO: 255569 - RNA, 32 nt, Human
uggcacaaucauggcucacugcagccucgagc

SEQ ID NO: 255570 - RNA, 32 nt, Human
uggcacaaucauggcucacugcagccuugaac

SEQ ID NO: 255571 - RNA, 32 nt, Human
uggcacaaucauggcucacugcagucucaauc

SEQ ID NO: 255572 - RNA, 32 nt, Human
uggcacaaucauggcucacugcagucucugcc

SEQ ID NO: 255573 - RNA, 32 nt, Human
uggcacaaucauggcugauugcagccuugacc

SEQ ID NO: 255574 - RNA, 24 nt, Human
uggcacaaucauugcucacuguag

SEQ ID NO: 255575 - RNA, 19 nt, Human
uggcacaaucccucacugc

SEQ ID NO: 255576 - RNA, 32 nt, Human
uggcacaauccguuguucugucguuuagugca

SEQ ID NO: 255577 - RNA, 23 nt, Human
uggcacaaucucaacucacugca

SEQ ID NO: 255578 - RNA, 23 nt, Human
uggcacaaucucagcucacugca

SEQ ID NO: 255579 - RNA, 23 nt, Human
uggcacaaucucagcucacugua

SEQ ID NO: 255580 - RNA, 23 nt, Human
uggcacaaucucaguucacugca

SEQ ID NO: 255581 - RNA, 24 nt, Human
uggcacaaucucgacucacugcag

SEQ ID NO: 255582 - RNA, 24 nt, Human
uggcacaaucucggcccacugcag

SEQ ID NO: 255583 - RNA, 24 nt, Human
uggcacaaucucggcccgcugcag

SEQ ID NO: 255584 - RNA, 23 nt, Human
uggcacaaucucggcucacugca

SEQ ID NO: 255585 - RNA, 23 nt, Human
uggcacaaucucggcucauugca

SEQ ID NO: 255586 - RNA, 23 nt, Human
uggcacaaucucgguucacugca

SEQ ID NO: 255587 - RNA, 23 nt, Human
uggcacaaucuuagcucacugca

SEQ ID NO: 255588 - RNA, 24 nt, Human
uggcacaaucuugacucgcugcag

SEQ ID NO: 255589 - RNA, 23 nt, Human
uggcacaaucuugccucacugca

SEQ ID NO: 255590 - RNA, 23 nt, Human
uggcacaaucuuggcucacugca

SEQ ID NO: 255591 - RNA, 23 nt, Human
uggcacaaucuuggcucagugca

SEQ ID NO: 255592 - RNA, 32 nt, Human
uggcacaaugacgacucacugcagccucaacc

SEQ ID NO: 255593 - RNA, 32 nt, Human
uggcacaauugcacuccagcccgagugacaga

SEQ ID NO: 255594 - RNA, 23 nt, Human
uggcacaauuucagcucacugca

SEQ ID NO: 255595 - RNA, 23 nt, Human
uggcacaauuuuggcucacugca

SEQ ID NO: 255596 - RNA, 23 nt, Human
uggcacaauuuuggcucccugca

SEQ ID NO: 255597 - RNA, 21 nt, Human
uggcacacaccaguaauccca

SEQ ID NO: 255598 - RNA, 21 nt, Human
uggcacacacccguaauccca

SEQ ID NO: 255599 - RNA, 24 nt, Human
uggcacacacccguaguuccagcu

SEQ ID NO: 255600 - RNA, 21 nt, Human
uggcacacaccuauaaucuca

SEQ ID NO: 255601 - RNA, 21 nt, Human
uggcacacaccuauaguccca

SEQ ID NO: 255602 - RNA, 21 nt, Human
uggcacacaccuguaauccca

SEQ ID NO: 255603 - RNA, 24 nt, Human
uggcacacaccuguaaucccaacu

SEQ ID NO: 255604 - RNA, 24 nt, Human
uggcacacaccuguaaucccagcu

SEQ ID NO: 255605 - RNA, 24 nt, Human
uggcacacaccuguaaucccaguu

SEQ ID NO: 255606 - RNA, 21 nt, Human
uggcacacaccuguaaucuca

SEQ ID NO: 255607 - RNA, 21 nt, Human
uggcacacaccuguaguccca

SEQ ID NO: 255608 - RNA, 24 nt, Human
uggcacacaccuguagucccagcu

SEQ ID NO: 255609 - RNA, 32 nt, Human
uggcacacagcagggacccaggcaguggggcu

SEQ ID NO: 255610 - RNA, 32 nt, Human
uggcacacagguguccauucagaugagaguug

SEQ ID NO: 255611 - RNA, 32 nt, Human
uggcacacagugcucacccagaggaccgcagg

SEQ ID NO: 255612 - RNA, 21 nt, Human
uggcacaccccuguaguccca

SEQ ID NO: 255613 - RNA, 24 nt, Human
uggcacaccccuguagucccagcu

SEQ ID NO: 255614 - RNA, 32 nt, Human
uggcacaccugucccuuauguaaaaggagucg

SEQ ID NO: 255615 - RNA, 25 nt, Human
uggcacacgaucucggcucaccgca

SEQ ID NO: 255616 - RNA, 21 nt, Human
uggcacacgccuguaaaccca

SEQ ID NO: 255617 - RNA, 24 nt, Human
uggcacacgccuguaaacccaacu

SEQ ID NO: 255618 - RNA, 21 nt, Human
uggcacacgccuguaauacca

SEQ ID NO: 255619 - RNA, 24 nt, Human
uggcacacgccuguaauaccagcu

SEQ ID NO: 255620 - RNA, 24 nt, Human
uggcacacgccuguaaucacagcu

SEQ ID NO: 255621 - RNA, 32 nt, Human
uggcacacgccuguaaucacagcuacuuggga

SEQ ID NO: 255622 - RNA, 21 nt, Human
uggcacacgccuguaauccca

SEQ ID NO: 255623 - RNA, 22 nt, Human
uggcacacgccuguaaucccag

SEQ ID NO: 255624 - RNA, 23 nt, Human
uggcacacgccuguaaucccagc

SEQ ID NO: 255625 - RNA, 24 nt, Human
uggcacacgccuguaaucccagcu

SEQ ID NO: 255626 - RNA, 32 nt, Human
uggcacacgccuguaaucccagguacuuggaa

SEQ ID NO: 255627 - RNA, 24 nt, Human
uggcacacgccuguaaucccaguu

SEQ ID NO: 255628 - RNA, 32 nt, Human
uggcacacgccuguaaucccaguuacuuggga

SEQ ID NO: 255629 - RNA, 21 nt, Human
uggcacacgccuguaaucuca

SEQ ID NO: 255630 - RNA, 24 nt, Human
uggcacacgccuguaaucucagcu

SEQ ID NO: 255631 - RNA, 21 nt, Human
uggcacacgccuguaguccca

SEQ ID NO: 255632 - RNA, 24 nt, Human
uggcacacgccuguagucccagcu

SEQ ID NO: 255633 - RNA, 21 nt, Human
uggcacacggcuguaauccca

SEQ ID NO: 255634 - RNA, 21 nt, Human
uggcacacuccuguaauccca

SEQ ID NO: 255635 - RNA, 24 nt, Human
uggcacacuccuguaaucccagcu

SEQ ID NO: 255636 - RNA, 32 nt, Human
uggcacacuccuguaaucccagcuacuuagga

SEQ ID NO: 255637 - RNA, 23 nt, Human
uggcacacucuccgcucacugca

SEQ ID NO: 255638 - RNA, 23 nt, Human
uggcacagagaacccugcuucaa

SEQ ID NO: 255639 - RNA, 21 nt, Human
uggcacagagcaguggcaggg

SEQ ID NO: 255640 - RNA, 21 nt, Human
uggcacagagcauugaaagga

SEQ ID NO: 255641 - RNA, 32 nt, Human
uggcacagaggcccccugauccaauucugugc

SEQ ID NO: 255642 - RNA, 32 nt, Human
uggcacagaguuucccacgggggcugcagugg

SEQ ID NO: 255643 - RNA, 32 nt, Human
uggcacagaucucuuucccucugccucaaagc

SEQ ID NO: 255644 - RNA, 32 nt, Human
uggcacagcagacuggagacugaggcagggcc

SEQ ID NO: 255645 - RNA, 32 nt, Human
uggcacagcccaggcaccuuaugguuauggug

SEQ ID NO: 255646 - RNA, 32 nt, Human
uggcacagccugggcaaggggagaaggugguc

SEQ ID NO: 255647 - RNA, 32 nt, Human
uggcacagcucagggcacccaggcuggacccc

SEQ ID NO: 255648 - RNA, 32 nt, Human
uggcacaggaagcacaugauaaagcaugcuca

SEQ ID NO: 255649 - RNA, 32 nt, Human
uggcacaggaucugaguugcagcucugcaccc

SEQ ID NO: 255650 - RNA, 20 nt, Human
uggcacaggccagugcugaa

SEQ ID NO: 255651 - RNA, 32 nt, Human
uggcacaggccugcuuugugauagggguuuua

SEQ ID NO: 255652 - RNA, 32 nt, Human
uggcacagguaacauuuggacauguucaucuu

SEQ ID NO: 255653 - RNA, 24 nt, Human
uggcacagguuuaagaacgaagga

SEQ ID NO: 255654 - RNA, 32 nt, Human
uggcacaguaaacaaacccuguuaugcuguau

SEQ ID NO: 255655 - RNA, 32 nt, Human
uggcacaguagcuggggagaccucagcagggc

SEQ ID NO: 255656 - RNA, 24 nt, Human
uggcacagucauagcucacugcag

SEQ ID NO: 255657 - RNA, 24 nt, Human
uggcacagucauggcucgcugcag

SEQ ID NO: 255658 - RNA, 32 nt, Human
uggcacagucauggcucgcugcagccuugacc

SEQ ID NO: 255659 - RNA, 23 nt, Human
uggcacagucucagcucacugca

SEQ ID NO: 255660 - RNA, 23 nt, Human
uggcacagucucggcucacugca

SEQ ID NO: 255661 - RNA, 32 nt, Human
uggcacagucucuacucaggaggcugaggcag

SEQ ID NO: 255662 - RNA, 23 nt, Human
uggcacagucuuggcucacugca

SEQ ID NO: 255663 - RNA, 32 nt, Human
uggcacaguucugccugugaccugccgccuaa

SEQ ID NO: 255664 - RNA, 19 nt, Human
uggcacauaccuguaaucc

SEQ ID NO: 255665 - RNA, 24 nt, Human
uggcacauaccuguaauccaagcu

SEQ ID NO: 255666 - RNA, 21 nt, Human
uggcacauaccuguaauccca

SEQ ID NO: 255667 - RNA, 24 nt, Human
uggcacauaccuguaaucccagcu

SEQ ID NO: 255668 - RNA, 32 nt, Human
uggcacauaccuguaaucccagcuacucggga

SEQ ID NO: 255669 - RNA, 32 nt, Human
uggcacauaccuguaaucccagcuacuuggaa

SEQ ID NO: 255670 - RNA, 21 nt, Human
uggcacauaccuguaaugcca

SEQ ID NO: 255671 - RNA, 24 nt, Human
uggcacauaccuguaaugccagcu

SEQ ID NO: 255672 - RNA, 32 nt, Human
uggcacauaccuguaaugccagcuacuuggga

SEQ ID NO: 255673 - RNA, 32 nt, Human
uggcacaucacacuaaugcauggagcuucuca

SEQ ID NO: 255674 - RNA, 32 nt, Human
uggcacaucauaaccaauuggaaaccugcagu

SEQ ID NO: 255675 - RNA, 21 nt, Human
uggcacaucccuauaauucca

SEQ ID NO: 255676 - RNA, 24 nt, Human
uggcacaucccuauaauuccagcu

SEQ ID NO: 255677 - RNA, 21 nt, Human
uggcacaucccuguaauucca

SEQ ID NO: 255678 - RNA, 24 nt, Human
uggcacaucccuguaauuccagcu

SEQ ID NO: 255679 - RNA, 19 nt, Human
uggcacaucugugguccca

SEQ ID NO: 255680 - RNA, 21 nt, Human
uggcacaugacuguaauccca

SEQ ID NO: 255681 - RNA, 32 nt, Human
uggcacaugauagugcaaacugcucugacacc

SEQ ID NO: 255682 - RNA, 21 nt, Human
uggcacaugccuauaauccca

SEQ ID NO: 255683 - RNA, 21 nt, Human
uggcacaugccuauaguccca

SEQ ID NO: 255684 - RNA, 21 nt, Human
uggcacaugccuaugauccca

SEQ ID NO: 255685 - RNA, 24 nt, Human
uggcacaugccugcaaucccagcu

SEQ ID NO: 255686 - RNA, 32 nt, Human
uggcacaugccugcaaucccagcuacuugaga

SEQ ID NO: 255687 - RNA, 32 nt, Human
uggcacaugccugcagucccaguuacuugggu

SEQ ID NO: 255688 - RNA, 32 nt, Human
uggcacaugccuggagucccagcuacucggga

SEQ ID NO: 255689 - RNA, 32 nt, Human
uggcacaugccuguaaaccuagcuacuugaga

SEQ ID NO: 255690 - RNA, 21 nt, Human
uggcacaugccuguaacucca

SEQ ID NO: 255691 - RNA, 24 nt, Human
uggcacaugccuguaacuccagcu

SEQ ID NO: 255692 - RNA, 32 nt, Human
uggcacaugccuguaacuccagcuacuuggga

SEQ ID NO: 255693 - RNA, 32 nt, Human
uggcacaugccuguaauaucagcuacucagga

SEQ ID NO: 255694 - RNA, 19 nt, Human
uggcacaugccuguaaucc

SEQ ID NO: 255695 - RNA, 21 nt, Human
uggcacaugccuguaauccca

SEQ ID NO: 255696 - RNA, 32 nt, Human
uggcacaugccuguaaucccaacuacuuggga

SEQ ID NO: 255697 - RNA, 22 nt, Human
uggcacaugccuguaaucccag

SEQ ID NO: 255698 - RNA, 32 nt, Human
uggcacaugccuguaaucccagauacuuggga

SEQ ID NO: 255699 - RNA, 23 nt, Human
uggcacaugccuguaaucccagc

SEQ ID NO: 255700 - RNA, 32 nt, Human
uggcacaugccuguaaucccagcacuuuggga

SEQ ID NO: 255701 - RNA, 32 nt, Human
uggcacaugccuguaaucccagcacuuugggg

SEQ ID NO: 255702 - RNA, 24 nt, Human
uggcacaugccuguaaucccagcu

SEQ ID NO: 255703 - RNA, 32 nt, Human
uggcacaugccuguaaucccagcuacccgggg

SEQ ID NO: 255704 - RNA, 32 nt, Human
uggcacaugccuguaaucccagcuacgucagg

SEQ ID NO: 255705 - RNA, 29 nt, Human
uggcacaugccuguaaucccagcuacuca

SEQ ID NO: 255706 - RNA, 32 nt, Human
uggcacaugccuguaaucccagcuacucagga

SEQ ID NO: 255707 - RNA, 32 nt, Human
uggcacaugccuguaaucccagcuacucaggg

SEQ ID NO: 255708 - RNA, 32 nt, Human
uggcacaugccuguaaucccagcuacucauga

SEQ ID NO: 255709 - RNA, 32 nt, Human
uggcacaugccuguaaucccagcuacuccgga

SEQ ID NO: 255710 - RNA, 32 nt, Human
uggcacaugccuguaaucccagcuacucggag

SEQ ID NO: 255711 - RNA, 32 nt, Human
uggcacaugccuguaaucccagcuacucggga

SEQ ID NO: 255712 - RNA, 32 nt, Human
uggcacaugccuguaaucccagcuacuuggca

SEQ ID NO: 255713 - RNA, 32 nt, Human
uggcacaugccuguaaucccagcuacuuggga

SEQ ID NO: 255714 - RNA, 32 nt, Human
uggcacaugccuguaaucccagcugcucagga

SEQ ID NO: 255715 - RNA, 32 nt, Human
uggcacaugccuguaaucccagcugcuggaga

SEQ ID NO: 255716 - RNA, 24 nt, Human
uggcacaugccuguaaucccaguu

SEQ ID NO: 255717 - RNA, 32 nt, Human
uggcacaugccuguaaucccgguauuugggag

SEQ ID NO: 255718 - RNA, 32 nt, Human
uggcacaugccuguaauccgagugcuuuggga

SEQ ID NO: 255719 - RNA, 32 nt, Human
uggcacaugccuguaauccuagcacuuuggga

SEQ ID NO: 255720 - RNA, 32 nt, Human
uggcacaugccuguaauccuagcuacucggga

SEQ ID NO: 255721 - RNA, 21 nt, Human
uggcacaugccuguaaucgca

SEQ ID NO: 255722 - RNA, 24 nt, Human
uggcacaugccuguaaucgcagcu

SEQ ID NO: 255723 - RNA, 32 nt, Human
uggcacaugccuguaaucgcagcuacucagga

SEQ ID NO: 255724 - RNA, 21 nt, Human
uggcacaugccuguaaucuca

SEQ ID NO: 255725 - RNA, 32 nt, Human
uggcacaugccuguaaucucaacugcuuggga

SEQ ID NO: 255726 - RNA, 32 nt, Human
uggcacaugccuguaaucucagcgacuuggga

SEQ ID NO: 255727 - RNA, 24 nt, Human
uggcacaugccuguaaucucagcu

SEQ ID NO: 255728 - RNA, 32 nt, Human
uggcacaugccuguaaucucagcuacuagaga

SEQ ID NO: 255729 - RNA, 32 nt, Human
uggcacaugccuguaaucucagcuacucagga

SEQ ID NO: 255730 - RNA, 32 nt, Human
uggcacaugccuguaaucucagcuacuuggga

SEQ ID NO: 255731 - RNA, 21 nt, Human
uggcacaugccuguaaugcca

SEQ ID NO: 255732 - RNA, 24 nt, Human
uggcacaugccuguaaugccagcu

SEQ ID NO: 255733 - RNA, 32 nt, Human
uggcacaugccuguaaugccagcuacucggga

SEQ ID NO: 255734 - RNA, 21 nt, Human
uggcacaugccuguaauucca

SEQ ID NO: 255735 - RNA, 24 nt, Human
uggcacaugccuguaauuccagcu

SEQ ID NO: 255736 - RNA, 32 nt, Human
uggcacaugccuguaauuccagcugcuuggga

SEQ ID NO: 255737 - RNA, 21 nt, Human
uggcacaugccuguaguccca

SEQ ID NO: 255738 - RNA, 32 nt, Human
uggcacaugccuguagucccaccuacuuggga

SEQ ID NO: 255739 - RNA, 32 nt, Human
uggcacaugccuguagucccagauacuuggga

SEQ ID NO: 255740 - RNA, 23 nt, Human
uggcacaugccuguagucccagc

SEQ ID NO: 255741 - RNA, 32 nt, Human
uggcacaugccuguagucccagccacuagggc

SEQ ID NO: 255742 - RNA, 24 nt, Human
uggcacaugccuguagucccagcu

SEQ ID NO: 255743 - RNA, 32 nt, Human
uggcacaugccuguagucccagcuacguggga

SEQ ID NO: 255744 - RNA, 32 nt, Human
uggcacaugccuguagucccagcuacucaaga

SEQ ID NO: 255745 - RNA, 32 nt, Human
uggcacaugccuguagucccagcuacuccaga

SEQ ID NO: 255746 - RNA, 32 nt, Human
uggcacaugccuguagucccagcuacucggga

SEQ ID NO: 255747 - RNA, 32 nt, Human
uggcacaugccuguagucccagcuacugggga

SEQ ID NO: 255748 - RNA, 32 nt, Human
uggcacaugccuguagucccagcuacuugaga

SEQ ID NO: 255749 - RNA, 32 nt, Human
uggcacaugccuguaguuccagccacccggga

SEQ ID NO: 255750 - RNA, 24 nt, Human
uggcacaugccuguaguuccagcu

SEQ ID NO: 255751 - RNA, 32 nt, Human
uggcacaugccuguaguuccagcuacucagga

SEQ ID NO: 255752 - RNA, 24 nt, Human
uggcacaugccuguauucccagcu

SEQ ID NO: 255753 - RNA, 32 nt, Human
uggcacaugccuguauucccagcugcuuggga

SEQ ID NO: 255754 - RNA, 21 nt, Human
uggcacaugccugugauccca

SEQ ID NO: 255755 - RNA, 32 nt, Human
uggcacaugccugugaucccagcacuuuggga

SEQ ID NO: 255756 - RNA, 24 nt, Human
uggcacaugccugugaucccagcu

SEQ ID NO: 255757 - RNA, 32 nt, Human
uggcacaugccugugaucccagcuacucagga

SEQ ID NO: 255758 - RNA, 32 nt, Human
uggcacaugccugugaucccagcuacugagga

SEQ ID NO: 255759 - RNA, 32 nt, Human
uggcacaugccuguggccccagccacucugaa

SEQ ID NO: 255760 - RNA, 32 nt, Human
uggcacaugccuguggucccagguacuugaga

SEQ ID NO: 255761 - RNA, 32 nt, Human
uggcacaugccugugguccuagccacuagagg

SEQ ID NO: 255762 - RNA, 32 nt, Human
uggcacaugccuguggucucagcuacuuggga

SEQ ID NO: 255763 - RNA, 32 nt, Human
uggcacaugccugugguuccagccacucagga

SEQ ID NO: 255764 - RNA, 32 nt, Human
uggcacaugccuguugucccagcugcuuggga

SEQ ID NO: 255765 - RNA, 21 nt, Human
uggcacaugcuuguaauccca

SEQ ID NO: 255766 - RNA, 24 nt, Human
uggcacaugcuuguaaucccagcu

SEQ ID NO: 255767 - RNA, 21 nt, Human
uggcacauuccuguaauccca

SEQ ID NO: 255768 - RNA, 24 nt, Human
uggcacauuccuguaaucccagcu

SEQ ID NO: 255769 - RNA, 32 nt, Human
uggcacauuccuguaaucccagcuacucggga

SEQ ID NO: 255770 - RNA, 32 nt, Human
uggcacauuguggcauuuuuccuugccuuccu

SEQ ID NO: 255771 - RNA, 32 nt, Human
uggcacauuucugcuauaaugaagauuaaaua

SEQ ID NO: 255772 - RNA, 32 nt, Human
uggcaccaaaguggaccucuuugcaccuugca

SEQ ID NO: 255773 - RNA, 16 nt, Human
uggcaccaaaugugaa

SEQ ID NO: 255774 - RNA, 32 nt, Human
uggcaccaagccauuggugaaggaucugccuc

SEQ ID NO: 255775 - RNA, 32 nt, Human
uggcaccaagggacaggagaagagaggaaaua

SEQ ID NO: 255776 - RNA, 32 nt, Human
uggcaccaauccaggcagauccaggacuauau

SEQ ID NO: 255777 - RNA, 32 nt, Human
uggcaccacagaggcccucagccgaguccagc

SEQ ID NO: 255778 - RNA, 32 nt, Human
uggcaccacggccggcaccugggggcacacac

SEQ ID NO: 255779 - RNA, 32 nt, Human
uggcaccacuacacuccagcccgggcgacaga

SEQ ID NO: 255780 - RNA, 32 nt, Human
uggcaccacugcacuccagccuaggugacaga

SEQ ID NO: 255781 - RNA, 32 nt, Human
uggcaccacugcacuccagccuggacgacaga

SEQ ID NO: 255782 - RNA, 32 nt, Human
uggcaccacugcacuccagccugggagacaca

SEQ ID NO: 255783 - RNA, 32 nt, Human
uggcaccacugcacuccagccugggagacaga

SEQ ID NO: 255784 - RNA, 32 nt, Human
uggcaccacugcacuccagccugggcaacaga

SEQ ID NO: 255785 - RNA, 32 nt, Human
uggcaccacugcacuccagccugggugacaga

SEQ ID NO: 255786 - RNA, 32 nt, Human
uggcaccacugcacuccagccugggugagaga

SEQ ID NO: 255787 - RNA, 32 nt, Human
uggcaccacugcacuccagcuugggugacaga

SEQ ID NO: 255788 - RNA, 32 nt, Human
uggcaccacugcacuccauccugggugacaga

SEQ ID NO: 255789 - RNA, 32 nt, Human
uggcaccacugcacuccggccuaggcaacgag

SEQ ID NO: 255790 - RNA, 32 nt, Human
uggcaccacugcacuucagccugggugacaga

SEQ ID NO: 255791 - RNA, 32 nt, Human
uggcaccacugcauuccagccugggugacaga

SEQ ID NO: 255792 - RNA, 32 nt, Human
uggcaccacugcccuccagccuggaugacaga

SEQ ID NO: 255793 - RNA, 32 nt, Human
uggcaccacuggacuccagccugggcgacaga

SEQ ID NO: 255794 - RNA, 32 nt, Human
uggcaccacuguacuccagccugggugacaga

SEQ ID NO: 255795 - RNA, 32 nt, Human
uggcaccacuuauugcacuccagcccgggcga

SEQ ID NO: 255796 - RNA, 32 nt, Human
uggcaccagacauuugcagucuggaccagugu

SEQ ID NO: 255797 - RNA, 32 nt, Human
uggcaccagacucuugcuuuugcccaucugga

SEQ ID NO: 255798 - RNA, 32 nt, Human
uggcaccagcaacuacuucuuuauauuguucu

SEQ ID NO: 255799 - RNA, 32 nt, Human
uggcaccagcagugccccagugcccacgguac

SEQ ID NO: 255800 - RNA, 32 nt, Human
uggcaccagcuagucaccucccagaagaaacu

SEQ ID NO: 255801 - RNA, 32 nt, Human
uggcaccagcuccuguggaauguuugguugcu

SEQ ID NO: 255802 - RNA, 31 nt, Human
uggcaccaguuucagggccucacccaagcuu

SEQ ID NO: 255803 - RNA, 23 nt, Human
uggcaccaucucagcucacugca

SEQ ID NO: 255804 - RNA, 23 nt, Human
uggcaccaucucagcucacugcg

SEQ ID NO: 255805 - RNA, 23 nt, Human
uggcaccaucuccgcucacugca

SEQ ID NO: 255806 - RNA, 23 nt, Human
uggcaccaucucggcucacucca

SEQ ID NO: 255807 - RNA, 23 nt, Human
uggcaccaucucggcucacugca

SEQ ID NO: 255808 - RNA, 23 nt, Human
uggcaccaucucgucucacugca

SEQ ID NO: 255809 - RNA, 23 nt, Human
uggcaccaucuuggcucacugca

SEQ ID NO: 255810 - RNA, 23 nt, Human
uggcaccaucuuggcucacuuca

SEQ ID NO: 255811 - RNA, 32 nt, Human
uggcaccaugaccaccugcagccgccaguuca

SEQ ID NO: 255812 - RNA, 32 nt, Human
uggcaccauuacacuccagccugggcaacagu

SEQ ID NO: 255813 - RNA, 32 nt, Human
uggcaccauugcacccuagccugggcaacaga

SEQ ID NO: 255814 - RNA, 32 nt, Human
uggcaccauugcacuccagccugggugacaag

SEQ ID NO: 255815 - RNA, 23 nt, Human
uggcaccauuucggcucacugca

SEQ ID NO: 255816 - RNA, 32 nt, Human
uggcacccaaucucccuguccuucacuguccc

SEQ ID NO: 255817 - RNA, 32 nt, Human
uggcacccaggccacgugggaccuggaggagc

SEQ ID NO: 255818 - RNA, 32 nt, Human
uggcacccaucugcaaauaucucccucucucc

SEQ ID NO: 255819 - RNA, 31 nt, Human
uggcacccaugcaccuuacauuugaaaucua

SEQ ID NO: 255820 - RNA, 32 nt, Human
uggcaccccaacaccggcagggaaccuacccu

SEQ ID NO: 255821 - RNA, 21 nt, Human
uggcacccccaccccaucccu

SEQ ID NO: 255822 - RNA, 32 nt, Human
uggcaccccuacugcuggggaccacaguccug

SEQ ID NO: 255823 - RNA, 32 nt, Human
uggcaccccugcugcugacaggggccgguggg

SEQ ID NO: 255824 - RNA, 21 nt, Human
uggcacccgccuguaauccca

SEQ ID NO: 255825 - RNA, 24 nt, Human
uggcacccgccuguaaucccagcu

SEQ ID NO: 255826 - RNA, 32 nt, Human
uggcacccgguaccuggugacagcacucauca

SEQ ID NO: 255827 - RNA, 32 nt, Human
uggcacccgguuuacagggaggugauugagga

SEQ ID NO: 255828 - RNA, 32 nt, Human
uggcacccuccagcccucagaaguugcguagg

SEQ ID NO: 255829 - RNA, 32 nt, Human
uggcacccuccucugcugucugccugggagcc

SEQ ID NO: 255830 - RNA, 32 nt, Human
uggcacccugguuucgcugagaacaaacucug

SEQ ID NO: 255831 - RNA, 32 nt, Human
uggcaccgagagggcuggagugcaguggcgug

SEQ ID NO: 255832 - RNA, 32 nt, Human
uggcaccgcugcacuccaaccugggcaacaga

SEQ ID NO: 255833 - RNA, 32 nt, Human
uggcaccggaaggccagcagagggcacggccc

SEQ ID NO: 255834 - RNA, 32 nt, Human
uggcaccgggcauccacccaucagcccccgcc

SEQ ID NO: 255835 - RNA, 32 nt, Human
uggcaccguccccucagugcuggucucaugac

SEQ ID NO: 255836 - RNA, 23 nt, Human
uggcaccgucuuggcucacugca

SEQ ID NO: 255837 - RNA, 32 nt, Human
uggcaccgugcuguguggaaacccuccccucu

SEQ ID NO: 255838 - RNA, 32 nt, Human
uggcaccguggcaagaugguaucagagagaaa

SEQ ID NO: 255839 - RNA, 32 nt, Human
uggcaccguuucucccuccacagggccaaagc

SEQ ID NO: 255840 - RNA, 32 nt, Human
uggcaccuagugcagugcugggcacagaguag

SEQ ID NO: 255841 - RNA, 32 nt, Human
uggcaccuauaaucccaguuacucgggaggau

SEQ ID NO: 255842 - RNA, 32 nt, Human
uggcaccuauagucccagcuacucggaaggcu

SEQ ID NO: 255843 - RNA, 32 nt, Human
uggcaccucacagaggugggaccuaagaggac

SEQ ID NO: 255844 - RNA, 32 nt, Human
uggcaccuccacuacucuuuucuguuuguuga

SEQ ID NO: 255845 - RNA, 32 nt, Human
uggcaccuccuuuggugaaaccacggccaaug

SEQ ID NO: 255846 - RNA, 32 nt, Human
uggcaccugcacacuccaucuccugcucacca

SEQ ID NO: 255847 - RNA, 32 nt, Human
uggcaccugcagccacagaucgcuuaggcacc

SEQ ID NO: 255848 - RNA, 32 nt, Human
uggcaccugcaucaccuccuccucuugcagug

SEQ ID NO: 255849 - RNA, 32 nt, Human
uggcaccugcauugaggggagucugggugcau

SEQ ID NO: 255850 - RNA, 32 nt, Human
uggcaccugccagaggggaaagcaggcaugac

SEQ ID NO: 255851 - RNA, 32 nt, Human
uggcaccugccccugaggguccugagacuugg

SEQ ID NO: 255852 - RNA, 21 nt, Human
uggcaccugccuauaauccca

SEQ ID NO: 255853 - RNA, 32 nt, Human
uggcaccugccugggggccauccagcugugug

SEQ ID NO: 255854 - RNA, 21 nt, Human
uggcaccugccuguaauccca

SEQ ID NO: 255855 - RNA, 24 nt, Human
uggcaccugccuguaaucccagcu

SEQ ID NO: 255856 - RNA, 32 nt, Human
uggcaccugccuguaaucccagcuacuuggga

SEQ ID NO: 255857 - RNA, 21 nt, Human
uggcaccugccuguaaucuca

SEQ ID NO: 255858 - RNA, 24 nt, Human
uggcaccugccuguaaucucagcu

SEQ ID NO: 255859 - RNA, 32 nt, Human
uggcaccuggaaaacccacaggucagaguaag

SEQ ID NO: 255860 - RNA, 21 nt, Human
uggcaccuggagagcccuuaa

SEQ ID NO: 255861 - RNA, 32 nt, Human
uggcaccuguaaucccagcauuuugggagacc

SEQ ID NO: 255862 - RNA, 32 nt, Human
uggcaccuguagucccagcuacucaggaggcu

SEQ ID NO: 255863 - RNA, 32 nt, Human
uggcaccuguagucccagcuacucuggaggcu

SEQ ID NO: 255864 - RNA, 32 nt, Human
uggcaccuguagucccagcuacuugggaggcu

SEQ ID NO: 255865 - RNA, 32 nt, Human
uggcaccuguagucuuagcuacucaggaggcu

SEQ ID NO: 255866 - RNA, 32 nt, Human
uggcaccuugacugcagccccaugagacagaa

SEQ ID NO: 255867 - RNA, 32 nt, Human
uggcaccuuggaaagaaaaaugaagaacaacu

SEQ ID NO: 255868 - RNA, 32 nt, Human
uggcacgaaauggcugaagugcaugggucagg

SEQ ID NO: 255869 - RNA, 22 nt, Human
uggcacgaacacggcucacugc

SEQ ID NO: 255870 - RNA, 23 nt, Human
uggcacgaccucugcucgcugca

SEQ ID NO: 255871 - RNA, 24 nt, Human
uggcacgaucacagcucacugcag

SEQ ID NO: 255872 - RNA, 21 nt, Human
uggcacgaucauagcucacug

SEQ ID NO: 255873 - RNA, 23 nt, Human
uggcacgaucauagcucacugua

SEQ ID NO: 255874 - RNA, 24 nt, Human
uggcacgaucauggcucacugcag

SEQ ID NO: 255875 - RNA, 32 nt, Human
uggcacgaucauggcucacugcagccuugacu

SEQ ID NO: 255876 - RNA, 23 nt, Human
uggcacgauccuggcucacugca

SEQ ID NO: 255877 - RNA, 23 nt, Human
uggcacgauccugguucacugca

SEQ ID NO: 255878 - RNA, 23 nt, Human
uggcacgaucgcggcucacugca

SEQ ID NO: 255879 - RNA, 23 nt, Human
uggcacgaucucaacucacugca

SEQ ID NO: 255880 - RNA, 23 nt, Human
uggcacgaucucagcucacugca

SEQ ID NO: 255881 - RNA, 24 nt, Human
uggcacgaucucagcucacugcag

SEQ ID NO: 255882 - RNA, 24 nt, Human
uggcacgaucucagcucauugcag

SEQ ID NO: 255883 - RNA, 23 nt, Human
uggcacgaucucagcucccugca

SEQ ID NO: 255884 - RNA, 23 nt, Human
uggcacgaucucaggucacugca

SEQ ID NO: 255885 - RNA, 23 nt, Human
uggcacgaucuccacgcacuaca

SEQ ID NO: 255886 - RNA, 23 nt, Human
uggcacgaucucgacucacugca

SEQ ID NO: 255887 - RNA, 23 nt, Human
uggcacgaucucgccucacugca

SEQ ID NO: 255888 - RNA, 23 nt, Human
uggcacgaucucggcucaccgca

SEQ ID NO: 255889 - RNA, 23 nt, Human
uggcacgaucucggcucacggca

SEQ ID NO: 255890 - RNA, 21 nt, Human
uggcacgaucucggcucacug

SEQ ID NO: 255891 - RNA, 23 nt, Human
uggcacgaucucggcucacugca

SEQ ID NO: 255892 - RNA, 24 nt, Human
uggcacgaucucggcucacugcag

SEQ ID NO: 255893 - RNA, 23 nt, Human
uggcacgaucucggcugacugca

SEQ ID NO: 255894 - RNA, 23 nt, Human
uggcacgaucucggcuuauggca

SEQ ID NO: 255895 - RNA, 23 nt, Human
uggcacgaucucgguucacugca

SEQ ID NO: 255896 - RNA, 23 nt, Human
uggcacgaucugggcucauugca

SEQ ID NO: 255897 - RNA, 23 nt, Human
uggcacgaucuuagcucacuaca

SEQ ID NO: 255898 - RNA, 23 nt, Human
uggcacgaucuuggcucacucca

SEQ ID NO: 255899 - RNA, 23 nt, Human
uggcacgaucuuggcucacugca

SEQ ID NO: 255900 - RNA, 24 nt, Human
uggcacgaucuuggcucacugcag

SEQ ID NO: 255901 - RNA, 23 nt, Human
uggcacgaucuuggcuuacuaca

SEQ ID NO: 255902 - RNA, 23 nt, Human
uggcacgaucuuggcuuacugca

SEQ ID NO: 255903 - RNA, 23 nt, Human
uggcacgaucuuggcuuucugca

SEQ ID NO: 255904 - RNA, 23 nt, Human
uggcacgaucuugguucacugca

SEQ ID NO: 255905 - RNA, 24 nt, Human
uggcacgauuauggcucauugcag

SEQ ID NO: 255906 - RNA, 32 nt, Human
uggcacgauuauggcucauugcagccucgacu

SEQ ID NO: 255907 - RNA, 23 nt, Human
uggcacgauuuuagcucacugca

SEQ ID NO: 255908 - RNA, 21 nt, Human
uggcacgcaccaguaauccca

SEQ ID NO: 255909 - RNA, 21 nt, Human
uggcacgcaccuauaguccca

SEQ ID NO: 255910 - RNA, 21 nt, Human
uggcacgcaccuguaauccca

SEQ ID NO: 255911 - RNA, 24 nt, Human
uggcacgcaccuguaaucccagcu

SEQ ID NO: 255912 - RNA, 21 nt, Human
uggcacgcaccuguaguccca

SEQ ID NO: 255913 - RNA, 24 nt, Human
uggcacgcaccuguagucccagcu

SEQ ID NO: 255914 - RNA, 32 nt, Human
uggcacgcaccuuguaggcuccugcccucacc

SEQ ID NO: 255915 - RNA, 32 nt, Human
uggcacgccucccgaggagggguggguuuggg

SEQ ID NO: 255916 - RNA, 21 nt, Human
uggcacgcgccuaugauccca

SEQ ID NO: 255917 - RNA, 21 nt, Human
uggcacgcgccuguaauacca

SEQ ID NO: 255918 - RNA, 24 nt, Human
uggcacgcgccuguaauaccagcu

SEQ ID NO: 255919 - RNA, 21 nt, Human
uggcacgcgccuguaauccca

SEQ ID NO: 255920 - RNA, 24 nt, Human
uggcacgcgccuguaaucccagcu

SEQ ID NO: 255921 - RNA, 32 nt, Human
uggcacgcgccuguaaucccagcuacuuggga

SEQ ID NO: 255922 - RNA, 21 nt, Human
uggcacgcgccuguaguccca

SEQ ID NO: 255923 - RNA, 24 nt, Human
uggcacgcgccuguagucccagcu

SEQ ID NO: 255924 - RNA, 25 nt, Human
uggcacgcuccagcagcccuccucu

SEQ ID NO: 255925 - RNA, 21 nt, Human
uggcacgcuccuguaguccca

SEQ ID NO: 255926 - RNA, 24 nt, Human
uggcacgcuccuguagucccagcu

SEQ ID NO: 255927 - RNA, 20 nt, Human
uggcacgcucuguaauccca

SEQ ID NO: 255928 - RNA, 32 nt, Human
uggcacggauacaauaaaagacuuuuacaaac

SEQ ID NO: 255929 - RNA, 32 nt, Human
uggcacggcuaugccaucacugauuucugccc

SEQ ID NO: 255930 - RNA, 32 nt, Human
uggcacgggcagccaccauccuggccucaccu

SEQ ID NO: 255931 - RNA, 32 nt, Human
uggcacggggcagaggugccuggagcccacgc

SEQ ID NO: 255932 - RNA, 23 nt, Human
uggcacggucucaccucacugca

SEQ ID NO: 255933 - RNA, 23 nt, Human
uggcacgguggcucacgccugua

SEQ ID NO: 255934 - RNA, 21 nt, Human
uggcacguaccuguaaucuca

SEQ ID NO: 255935 - RNA, 24 nt, Human
uggcacguaccuguaaucucagcu

SEQ ID NO: 255936 - RNA, 21 nt, Human
uggcacgugccuauaguccca

SEQ ID NO: 255937 - RNA, 21 nt, Human
uggcacgugccuguaauccca

SEQ ID NO: 255938 - RNA, 24 nt, Human
uggcacgugccuguaaucccagcu

SEQ ID NO: 255939 - RNA, 32 nt, Human
uggcacgugccuguaaucccagcuaccuggga

SEQ ID NO: 255940 - RNA, 32 nt, Human
uggcacgugccuguaaucccagcuacucagga

SEQ ID NO: 255941 - RNA, 32 nt, Human
uggcacgugccuguaaucccagcuacucgcaa

SEQ ID NO: 255942 - RNA, 32 nt, Human
uggcacgugccuguaaucccagcuacucggga

SEQ ID NO: 255943 - RNA, 24 nt, Human
uggcacgugccuguaaucccaguu

SEQ ID NO: 255944 - RNA, 32 nt, Human
uggcacgugccuguaaucccaguuacucagga

SEQ ID NO: 255945 - RNA, 32 nt, Human
uggcacgugccuguaaucccaguuacuuggga

SEQ ID NO: 255946 - RNA, 32 nt, Human
uggcacgugccuguaaucucagcuacucagga

SEQ ID NO: 255947 - RNA, 21 nt, Human
uggcacgugccuguaauucca

SEQ ID NO: 255948 - RNA, 24 nt, Human
uggcacgugccuguaauuccagcu

SEQ ID NO: 255949 - RNA, 32 nt, Human
uggcacgugccuguaauuccagcuacuuggga

SEQ ID NO: 255950 - RNA, 24 nt, Human
uggcacgugccuguaauuucagcu

SEQ ID NO: 255951 - RNA, 21 nt, Human
uggcacgugccuguagcccca

SEQ ID NO: 255952 - RNA, 24 nt, Human
uggcacgugccuguagccccagcu

SEQ ID NO: 255953 - RNA, 32 nt, Human
uggcacgugccuguagccccagcuacuuggga

SEQ ID NO: 255954 - RNA, 21 nt, Human
uggcacgugccuguaguccca

SEQ ID NO: 255955 - RNA, 24 nt, Human
uggcacgugccuguagucccagcu

SEQ ID NO: 255956 - RNA, 32 nt, Human
uggcacgugccuguagucccagcuacucagga

SEQ ID NO: 255957 - RNA, 32 nt, Human
uggcacgugccuguagucccagcuacuccgga

SEQ ID NO: 255958 - RNA, 32 nt, Human
uggcacgugccuguagucccagcuacucggga

SEQ ID NO: 255959 - RNA, 32 nt, Human
uggcacgugccuguaguccuuccuacuugaag

SEQ ID NO: 255960 - RNA, 32 nt, Human
uggcacgugccuguagugccggcuacucagga

SEQ ID NO: 255961 - RNA, 24 nt, Human
uggcacgugccuguaguuccagcu

SEQ ID NO: 255962 - RNA, 32 nt, Human
uggcacgugccuguaguuccagcuacuuggga

SEQ ID NO: 255963 - RNA, 21 nt, Human
uggcacgugccugugauccca

SEQ ID NO: 255964 - RNA, 24 nt, Human
uggcacgugccugugaucccagcu

SEQ ID NO: 255965 - RNA, 32 nt, Human
uggcacgugggcggagacugaguggcugggca

SEQ ID NO: 255966 - RNA, 21 nt, Human
uggcacgugucuguaauccca

SEQ ID NO: 255967 - RNA, 24 nt, Human
uggcacgugucuguaaucccagcu

SEQ ID NO: 255968 - RNA, 23 nt, Human
uggcacguucucagcucacugca

SEQ ID NO: 255969 - RNA, 18 nt, Human
uggcacuacuugguccca

SEQ ID NO: 255970 - RNA, 32 nt, Human
uggcacuagcagggguguggagacaggccccc

SEQ ID NO: 255971 - RNA, 32 nt, Human
uggcacuaucaccaccucucugccuucaugcc

SEQ ID NO: 255972 - RNA, 23 nt, Human
uggcacuaucccaacucacugca

SEQ ID NO: 255973 - RNA, 23 nt, Human
uggcacuaucucagcucacugca

SEQ ID NO: 255974 - RNA, 23 nt, Human
uggcacuaucuuggcucacugca

SEQ ID NO: 255975 - RNA, 23 nt, Human
uggcacuaucuuggcucauugca

SEQ ID NO: 255976 - RNA, 23 nt, Human
uggcacuaucuuggcuuacugca

SEQ ID NO: 255977 - RNA, 32 nt, Human
uggcacuaugugcagugagccaccauggagga

SEQ ID NO: 255978 - RNA, 32 nt, Human
uggcacucacugcagacuuccucuuucaaggg

SEQ ID NO: 255979 - RNA, 32 nt, Human
uggcacuccagccuggacaacaagagcgaaau

SEQ ID NO: 255980 - RNA, 32 nt, Human
uggcacuccagccugggcaacagagugagacc

SEQ ID NO: 255981 - RNA, 32 nt, Human
uggcacucccagcccggggccugcugccucca

SEQ ID NO: 255982 - RNA, 32 nt, Human
uggcacucuggaauuguuucaguuaagucauu

SEQ ID NO: 255983 - RNA, 32 nt, Human
uggcacucuggaauuguuuuaguuaagucauu

SEQ ID NO: 255984 - RNA, 32 nt, Human
uggcacucuguucaaccaacuguggauggaaa

SEQ ID NO: 255985 - RNA, 32 nt, Human
uggcacucuucucaguguccccaaacucccug

SEQ ID NO: 255986 - RNA, 32 nt, Human
uggcacucuuguuugcuuucugcuucacuauc

SEQ ID NO: 255987 - RNA, 32 nt, Human
uggcacugaacaguaagcggcuccaggccucc

SEQ ID NO: 255988 - RNA, 32 nt, Human
uggcacugagcaugccaucugcuuuaggcccu

SEQ ID NO: 255989 - RNA, 24 nt, Human
uggcacugaucucggcucacugca

SEQ ID NO: 255990 - RNA, 21 nt, Human
uggcacugcaagccacacggu

SEQ ID NO: 255991 - RNA, 32 nt, Human
uggcacugcacgaggggccaggagagcagcag

SEQ ID NO: 255992 - RNA, 32 nt, Human
uggcacugcacuccagccugggcaacagagug

SEQ ID NO: 255993 - RNA, 32 nt, Human
uggcacugcacuccagucugggugacagagug

SEQ ID NO: 255994 - RNA, 22 nt, Human
uggcacugcagacgccacccag

SEQ ID NO: 255995 - RNA, 21 nt, Human
uggcacugcaggccaggccag

SEQ ID NO: 255996 - RNA, 19 nt, Human
uggcacugcccccucccag

SEQ ID NO: 255997 - RNA, 32 nt, Human
uggcacugccuaucugcacuuccaggugcccc

SEQ ID NO: 255998 - RNA, 32 nt, Human
uggcacugcgacugcccagucuggccugcgcu

SEQ ID NO: 255999 - RNA, 32 nt, Human
uggcacugcucccucugaagugcagugggauc

SEQ ID NO: 256000 - RNA, 32 nt, Human
uggcacugcugaggcacauggcagagcaggac

SEQ ID NO: 256001 - RNA, 32 nt, Human
uggcacugcugcacuccagccugcgggacaga

SEQ ID NO: 256002 - RNA, 23 nt, Human
uggcacuggagccacccauuuua

SEQ ID NO: 256003 - RNA, 32 nt, Human
uggcacuggcaauucaagacugccuuuccuac

SEQ ID NO: 256004 - RNA, 32 nt, Human
uggcacuggcagagaaggauaggaguggaaug

SEQ ID NO: 256005 - RNA, 16 nt, Human
uggcacugggcccgca

SEQ ID NO: 256006 - RNA, 19 nt, Human
uggcacugucagcccccag

SEQ ID NO: 256007 - RNA, 32 nt, Human
uggcacugucucacuuggccaaguuugcagcc

SEQ ID NO: 256008 - RNA, 32 nt, Human
uggcacuguggcucuggcgccuggugacuucu

SEQ ID NO: 256009 - RNA, 32 nt, Human
uggcacuguugcuggggugacggcagaauuca

SEQ ID NO: 256010 - RNA, 21 nt, Human
uggcacuuaccuguaguccca

SEQ ID NO: 256011 - RNA, 24 nt, Human
uggcacuuaccuguagucccagcu

SEQ ID NO: 256012 - RNA, 24 nt, Human
uggcacuuagguccaaggucucca

SEQ ID NO: 256013 - RNA, 32 nt, Human
uggcacuuauuucuuccaucugccucagaguu

SEQ ID NO: 256014 - RNA, 32 nt, Human
uggcacuuccaagcuggcaucuugccccuuga

SEQ ID NO: 256015 - RNA, 32 nt, Human
uggcacuuccuuggacuacuuguuucguaaag

SEQ ID NO: 256016 - RNA, 32 nt, Human
uggcacuucgagaaggaaguggagaguaaaga

SEQ ID NO: 256017 - RNA, 21 nt, Human
uggcacuugccuguaauccca

SEQ ID NO: 256018 - RNA, 24 nt, Human
uggcacuugccuguaaucccaucu

SEQ ID NO: 256019 - RNA, 32 nt, Human
uggcacuugccuguagucucagcuacuuagga

SEQ ID NO: 256020 - RNA, 20 nt, Human
uggcacuugggacuuccaua

SEQ ID NO: 256021 - RNA, 32 nt, Human
uggcacuuuaugcugaccaucgguaacggaca

SEQ ID NO: 256022 - RNA, 32 nt, Human
uggcacuuugagggggucucuaccuccccauc

SEQ ID NO: 256023 - RNA, 32 nt, Human
uggcacuuugcucagcacgucuucccaggccu

SEQ ID NO: 256024 - RNA, 32 nt, Human
uggcacuuugggaggcugaggcgggcagaucg

SEQ ID NO: 256025 - RNA, 20 nt, Human
uggcagaaacuuugguccca

SEQ ID NO: 256026 - RNA, 20 nt, Human
uggcagaaaggcucaguaag

SEQ ID NO: 256027 - RNA, 32 nt, Human
uggcagaaaucagcuagacgcuauaccgugga

SEQ ID NO: 256028 - RNA, 32 nt, Human
uggcagaacacugcacuccaauuuccucgggc

SEQ ID NO: 256029 - RNA, 32 nt, Human
uggcagaacagucacuguccuuguaaaguuuu

SEQ ID NO: 256030 - RNA, 32 nt, Human
uggcagaaccucggcucucaggagguccuugu

SEQ ID NO: 256031 - RNA, 27 nt, Human
uggcagaagagggagggagggagggcc

SEQ ID NO: 256032 - RNA, 21 nt, Human
uggcagaagagugacaaaauu

SEQ ID NO: 256033 - RNA, 32 nt, Human
uggcagaaggugaaagagguuguguugacugu

SEQ ID NO: 256034 - RNA, 32 nt, Human
uggcagaaguugcuucacagaggggaacaguu

SEQ ID NO: 256035 - RNA, 17 nt, Human
uggcagaaucuagcaug

SEQ ID NO: 256036 - RNA, 32 nt, Human
uggcagacaccaggaaggagaagaggaaccau

SEQ ID NO: 256037 - RNA, 32 nt, Human
uggcagacaccaggaaggaggagaggaaccau

SEQ ID NO: 256038 - RNA, 21 nt, Human
uggcagacaccugugguccca

SEQ ID NO: 256039 - RNA, 32 nt, Human
uggcagacagcccaggacaacgagagggacug

SEQ ID NO: 256040 - RNA, 18 nt, Human
uggcagaccaaauguaga

SEQ ID NO: 256041 - RNA, 32 nt, Human
uggcagaccugggagagccagggcaggguuuu

SEQ ID NO: 256042 - RNA, 32 nt, Human
uggcagacucagcccacugccuugccagucuu

SEQ ID NO: 256043 - RNA, 29 nt, Human
uggcagacucugugugugcccauggaaga

SEQ ID NO: 256044 - RNA, 18 nt, Human
uggcagacuuaaaguaaa

SEQ ID NO: 256045 - RNA, 25 nt, Human
uggcagagaaggcagaccgaagaga

SEQ ID NO: 256046 - RNA, 32 nt, Human
uggcagagagacaugcuuguuccucuggauug

SEQ ID NO: 256047 - RNA, 32 nt, Human
uggcagagagagaaguuggcuagcauggaauc

SEQ ID NO: 256048 - RNA, 32 nt, Human
uggcagagagccagggcagagagagacuggac

SEQ ID NO: 256049 - RNA, 23 nt, Human
uggcagagagggcucccagcaga

SEQ ID NO: 256050 - RNA, 32 nt, Human
uggcagagagugagguaguggcgagaaagcug

SEQ ID NO: 256051 - RNA, 32 nt, Human
uggcagagaucgugggcuggcuguguccacgu

SEQ ID NO: 256052 - RNA, 32 nt, Human
uggcagagaugggguuucaccauauuggccag

SEQ ID NO: 256053 - RNA, 32 nt, Human
uggcagagcaacuugcacaacagccuggaccu

SEQ ID NO: 256054 - RNA, 28 nt, Human
uggcagagcaagagggggaaagcaggau

SEQ ID NO: 256055 - RNA, 21 nt, Human
uggcagagcugggagcaagau

SEQ ID NO: 256056 - RNA, 32 nt, Human
uggcagagcugggagcaagauggacagagggg

SEQ ID NO: 256057 - RNA, 22 nt, Human
uggcagagcuuugacgguuuua

SEQ ID NO: 256058 - RNA, 32 nt, Human
uggcagaggaagcacagcucagguucccacac

SEQ ID NO: 256059 - RNA, 32 nt, Human
uggcagaggaagcacagcucggguucccacac

SEQ ID NO: 256060 - RNA, 32 nt, Human
uggcagaggagaagaaucgcuugaaccuggaa

SEQ ID NO: 256061 - RNA, 32 nt, Human
uggcagaggagguggaguucuuccaugcagga

SEQ ID NO: 256062 - RNA, 32 nt, Human
uggcagaggcacaugcagacccugccuggagc

SEQ ID NO: 256063 - RNA, 32 nt, Human
uggcagaggcaggauaagucaccugcacauga

SEQ ID NO: 256064 - RNA, 32 nt, Human
uggcagaggccaguaaauacaguuccuagaag

SEQ ID NO: 256065 - RNA, 21 nt, Human
uggcagaggccuguaauccca

SEQ ID NO: 256066 - RNA, 32 nt, Human
uggcagaggccuguaaucccagcuacuuggga

SEQ ID NO: 256067 - RNA, 19 nt, Human
uggcagaggcugagaacag

SEQ ID NO: 256068 - RNA, 21 nt, Human
uggcagagggaauugguucca

SEQ ID NO: 256069 - RNA, 32 nt, Human
uggcagagggagaggacaggaggaggagccuu

SEQ ID NO: 256070 - RNA, 32 nt, Human
uggcagagggcacccugggauaccugguagaa

SEQ ID NO: 256071 - RNA, 23 nt, Human
uggcagaggggaugucuggcuug

SEQ ID NO: 256072 - RNA, 32 nt, Human
uggcagaggggccguggcaggagcagguggug

SEQ ID NO: 256073 - RNA, 32 nt, Human
uggcagaggggcuggugcccuggagaaaauaa

SEQ ID NO: 256074 - RNA, 21 nt, Human
uggcagagggggccuggucuc

SEQ ID NO: 256075 - RNA, 32 nt, Human
uggcagagggguaaggagagccuucuuggcuu

SEQ ID NO: 256076 - RNA, 21 nt, Human
uggcagaggggucucgccaaa

SEQ ID NO: 256077 - RNA, 20 nt, Human
uggcagagggucucaggaaa

SEQ ID NO: 256078 - RNA, 32 nt, Human
uggcagaggugaaggacauggagcagcugcug

SEQ ID NO: 256079 - RNA, 17 nt, Human
uggcagaguaauguaaa

SEQ ID NO: 256080 - RNA, 22 nt, Human
uggcagaguagaguuccagggu

SEQ ID NO: 256081 - RNA, 32 nt, Human
uggcagaguggggcuuggaaccggguagccug

SEQ ID NO: 256082 - RNA, 22 nt, Human
uggcagaguucuauaauguaaa

SEQ ID NO: 256083 - RNA, 32 nt, Human
uggcagauacaaaagacaguggcuuuuaucau

SEQ ID NO: 256084 - RNA, 32 nt, Human
uggcagauaccugccuuggccugcuggcugcu

SEQ ID NO: 256085 - RNA, 32 nt, Human
uggcagauauagaccugcagcuaacuggauuu

SEQ ID NO: 256086 - RNA, 16 nt, Human
uggcagaugcaguaga

SEQ ID NO: 256087 - RNA, 19 nt, Human
uggcagaugucccggcgaa

SEQ ID NO: 256088 - RNA, 19 nt, Human
uggcagauuacacauguaa

SEQ ID NO: 256089 - RNA, 32 nt, Human
uggcagauucaaucacuugccuuucucauucu

SEQ ID NO: 256090 - RNA, 32 nt, Human
uggcagauucugcuuuccuugauccuuuguuu

SEQ ID NO: 256091 - RNA, 18 nt, Human
uggcagauuucaaguaaa

SEQ ID NO: 256092 - RNA, 18 nt, Human
uggcagauuuugguguaa

SEQ ID NO: 256093 - RNA, 32 nt, Human
uggcagcaaaacuaggaaaaugggaagaaauu

SEQ ID NO: 256094 - RNA, 32 nt, Human
uggcagcaaacaagauggaagcagggaucaaa

SEQ ID NO: 256095 - RNA, 32 nt, Human
uggcagcaaagaaguccaacugugcugguacc

SEQ ID NO: 256096 - RNA, 20 nt, Human
uggcagcaaaucuuugugca

SEQ ID NO: 256097 - RNA, 23 nt, Human
uggcagcaaggggucuuugugca

SEQ ID NO: 256098 - RNA, 32 nt, Human
uggcagcaagugugucauucacacacaucauu

SEQ ID NO: 256099 - RNA, 24 nt, Human
uggcagcaaguuaaauuuuuguca

SEQ ID NO: 256100 - RNA, 22 nt, Human
uggcagcacaagauccugcaga

SEQ ID NO: 256101 - RNA, 32 nt, Human
uggcagcacagcccagggccugcaugggggca

SEQ ID NO: 256102 - RNA, 32 nt, Human
uggcagcaccacugccugcucccuggaaggua

SEQ ID NO: 256103 - RNA, 32 nt, Human
uggcagcacccaggcauaacuggagauugcac

SEQ ID NO: 256104 - RNA, 32 nt, Human
uggcagcaccgggcuggacugcccugaucccu

SEQ ID NO: 256105 - RNA, 32 nt, Human
uggcagcaccuucaucuuucugaccuccuccu

SEQ ID NO: 256106 - RNA, 32 nt, Human
uggcagcacgccugccuugcucugccccaugc

SEQ ID NO: 256107 - RNA, 32 nt, Human
uggcagcacggcacuucagccuaggugacaga

SEQ ID NO: 256108 - RNA, 32 nt, Human
uggcagcacugagacuugaaccagggaauugu

SEQ ID NO: 256109 - RNA, 32 nt, Human
uggcagcagaaagagaaagaacagaaaagaga

SEQ ID NO: 256110 - RNA, 32 nt, Human
uggcagcagaggcuccucugauggcugacauc

SEQ ID NO: 256111 - RNA, 32 nt, Human
uggcagcagccgcggcggcuccgcgagcucgc

SEQ ID NO: 256112 - RNA, 32 nt, Human
uggcagcagcugcaccugggaggcaggcaggc

SEQ ID NO: 256113 - RNA, 32 nt, Human
uggcagcaggaggcacgcacccagagaaugcu

SEQ ID NO: 256114 - RNA, 32 nt, Human
uggcagcaggaggcagacagguuucugggcag

SEQ ID NO: 256115 - RNA, 32 nt, Human
uggcagcaggcagaugcacaccggaccugguc

SEQ ID NO: 256116 - RNA, 32 nt, Human
uggcagcagggaggaagcaggagugcccccuc

SEQ ID NO: 256117 - RNA, 32 nt, Human
uggcagcagucgagagagagugugugaaggag

SEQ ID NO: 256118 - RNA, 32 nt, Human
uggcagcauaaauauuaugauaagcuaaaagc

SEQ ID NO: 256119 - RNA, 32 nt, Human
uggcagcauggagcugaagagaggaaagaccu

SEQ ID NO: 256120 - RNA, 32 nt, Human
uggcagccaagaacagauaggaagggauuggc

SEQ ID NO: 256121 - RNA, 32 nt, Human
uggcagccacacacaggcggccagggcggcca

SEQ ID NO: 256122 - RNA, 32 nt, Human
uggcagccaccgcggcccucaucccccugcac

SEQ ID NO: 256123 - RNA, 32 nt, Human
uggcagccaguccggcuaaguggagcucagag

SEQ ID NO: 256124 - RNA, 32 nt, Human
uggcagccauugauaggaauucuaucacuaua

SEQ ID NO: 256125 - RNA, 21 nt, Human
uggcagccauuucucccagca

SEQ ID NO: 256126 - RNA, 32 nt, Human
uggcagcccagccugagaccguugcauugagg

SEQ ID NO: 256127 - RNA, 32 nt, Human
uggcagccccagggcaauagcucucagaucuc

SEQ ID NO: 256128 - RNA, 32 nt, Human
uggcagcccgagacccagaguuuguagaguuu

SEQ ID NO: 256129 - RNA, 32 nt, Human
uggcagcccugaggaagaugguugcagaggaa

SEQ ID NO: 256130 - RNA, 21 nt, Human
uggcagcccugccucauauca

SEQ ID NO: 256131 - RNA, 32 nt, Human
uggcagcccuggaagugcaguguuggggcgau

SEQ ID NO: 256132 - RNA, 32 nt, Human
uggcagcccuucuggaacccuggaccuggacc

SEQ ID NO: 256133 - RNA, 32 nt, Human
uggcagccgaggcugcagcccggcccagggcg

SEQ ID NO: 256134 - RNA, 22 nt, Human
uggcagccgggagcccagcgaa

SEQ ID NO: 256135 - RNA, 32 nt, Human
uggcagccuacuagggaccuggggaagcaaaa

SEQ ID NO: 256136 - RNA, 20 nt, Human
uggcagccucagcucccgca

SEQ ID NO: 256137 - RNA, 32 nt, Human
uggcagccucaguuggccccuggcagaggaac

SEQ ID NO: 256138 - RNA, 32 nt, Human
uggcagccuccaccaguucccugggcugcuau

SEQ ID NO: 256139 - RNA, 32 nt, Human
uggcagccuccacccuuucucuaugccugcaa

SEQ ID NO: 256140 - RNA, 21 nt, Human
uggcagccuccaucuccagca

SEQ ID NO: 256141 - RNA, 32 nt, Human
uggcagccuccccucagucuuccuccacccgc

SEQ ID NO: 256142 - RNA, 32 nt, Human
uggcagccuccuggugcccaaggacugaaaac

SEQ ID NO: 256143 - RNA, 21 nt, Human
uggcagccucuacucccagca

SEQ ID NO: 256144 - RNA, 32 nt, Human
uggcagccucuagcccucagcuucccacggaa

SEQ ID NO: 256145 - RNA, 32 nt, Human
uggcagccucuccaggcccagcuccugcaucu

SEQ ID NO: 256146 - RNA, 32 nt, Human
uggcagccuggcagagguuugcagacaggcug

SEQ ID NO: 256147 - RNA, 32 nt, Human
uggcagccuucagggauaugaggugaguccuu

SEQ ID NO: 256148 - RNA, 32 nt, Human
uggcagccuucccgccacaccaaccaaccaau

SEQ ID NO: 256149 - RNA, 32 nt, Human
uggcagccuuucucuaucaagggucagacggu

SEQ ID NO: 256150 - RNA, 32 nt, Human
uggcagcgaugauggggagacgccuggaagcu

SEQ ID NO: 256151 - RNA, 32 nt, Human
uggcagcgcauagaaggccagcagggagacug

SEQ ID NO: 256152 - RNA, 32 nt, Human
uggcagcggaggcagagagggagaggagacaa

SEQ ID NO: 256153 - RNA, 32 nt, Human
uggcagcggcagcccacgccucccagggauug

SEQ ID NO: 256154 - RNA, 32 nt, Human
uggcagcggcggccucccccagccuggacccc

SEQ ID NO: 256155 - RNA, 32 nt, Human
uggcagcgucggcagcagaggaugccccaggc

SEQ ID NO: 256156 - RNA, 32 nt, Human
uggcagcguggccgccuccuggaguuggcccu

SEQ ID NO: 256157 - RNA, 32 nt, Human
uggcagcucacacccagacucacuggccacac

SEQ ID NO: 256158 - RNA, 32 nt, Human
uggcagcucacacuuguaaucacugcacuuuc

SEQ ID NO: 256159 - RNA, 32 nt, Human
uggcagcucacacuuguaaucacugcacuuug

SEQ ID NO: 256160 - RNA, 32 nt, Human
uggcagcucacugaucucuugccucugcugau

SEQ ID NO: 256161 - RNA, 32 nt, Human
uggcagcucagaagguugguggcaccuuauca

SEQ ID NO: 256162 - RNA, 32 nt, Human
uggcagcuccacugccgucaacuccuguucuc

SEQ ID NO: 256163 - RNA, 32 nt, Human
uggcagcuccccuccaguuucagugucacugu

SEQ ID NO: 256164 - RNA, 32 nt, Human
uggcagcuccgcuaacuccaucauggcucauu

SEQ ID NO: 256165 - RNA, 32 nt, Human
uggcagcucgaagaagcugucggggcuugcag

SEQ ID NO: 256166 - RNA, 32 nt, Human
uggcagcucugaccaccucuggccccaggccc

SEQ ID NO: 256167 - RNA, 32 nt, Human
uggcagcucugccacgucaccgccugccuggc

SEQ ID NO: 256168 - RNA, 18 nt, Human
uggcagcucuugguccua

SEQ ID NO: 256169 - RNA, 23 nt, Human
uggcagcugaagaucccaguaga

SEQ ID NO: 256170 - RNA, 19 nt, Human
uggcagcugacuugguucu

SEQ ID NO: 256171 - RNA, 32 nt, Human
uggcagcugccugcauuucaggaaaagaggag

SEQ ID NO: 256172 - RNA, 32 nt, Human
uggcagcuucccaagguucuuccagagauuca

SEQ ID NO: 256173 - RNA, 32 nt, Human
uggcagcuuggaccuguuggaagcaguagagu

SEQ ID NO: 256174 - RNA, 32 nt, Human
uggcagcuugugauuuagaaaaguggguucau

SEQ ID NO: 256175 - RNA, 32 nt, Human
uggcagcuuugcaaauggcaucaacuggaagu

SEQ ID NO: 256176 - RNA, 32 nt, Human
uggcaggacacugagggccugccuguggugug

SEQ ID NO: 256177 - RNA, 32 nt, Human
uggcaggacauggagagagggagggauuccaa

SEQ ID NO: 256178 - RNA, 21 nt, Human
uggcaggacgacucacugcgg

SEQ ID NO: 256179 - RNA, 32 nt, Human
uggcaggacugaacuugaacaccagaaacaac

SEQ ID NO: 256180 - RNA, 32 nt, Human
uggcaggagaaaagcagacggaaguggcucca

SEQ ID NO: 256181 - RNA, 32 nt, Human
uggcaggagaggggcauuuggaggcucccucc

SEQ ID NO: 256182 - RNA, 32 nt, Human
uggcaggagcagcugggaugcagggcaccaag

SEQ ID NO: 256183 - RNA, 32 nt, Human
uggcaggagccagacgcugcugugcugccacg

SEQ ID NO: 256184 - RNA, 32 nt, Human
uggcaggagcccacccucccucugccauuacc

SEQ ID NO: 256185 - RNA, 32 nt, Human
uggcaggagcggugagaucacugccucacggc

SEQ ID NO: 256186 - RNA, 32 nt, Human
uggcaggagcucugguaccugggaagcuggau

SEQ ID NO: 256187 - RNA, 18 nt, Human
uggcaggaggagccgcag

SEQ ID NO: 256188 - RNA, 32 nt, Human
uggcaggaggcagacuugcagagcuuguuuug

SEQ ID NO: 256189 - RNA, 32 nt, Human
uggcaggagucccugaggacgggagcugccua

SEQ ID NO: 256190 - RNA, 21 nt, Human
uggcaggagugucccagcaag

SEQ ID NO: 256191 - RNA, 32 nt, Human
uggcaggaguuggaagugugugaucugugggc

SEQ ID NO: 256192 - RNA, 32 nt, Human
uggcaggauagaagcagcggcucacuuggacu

SEQ ID NO: 256193 - RNA, 32 nt, Human
uggcaggauauuuguguucuuccuuuaaccaa

SEQ ID NO: 256194 - RNA, 32 nt, Human
uggcaggaucacagcuuacugcagccuugacc

SEQ ID NO: 256195 - RNA, 23 nt, Human
uggcaggaucucagaucacugca

SEQ ID NO: 256196 - RNA, 23 nt, Human
uggcaggaucucagcucacugca

SEQ ID NO: 256197 - RNA, 24 nt, Human
uggcaggaucucagcuuacugcag

SEQ ID NO: 256198 - RNA, 32 nt, Human
uggcaggaucucagcuuacugcagcuuccauc

SEQ ID NO: 256199 - RNA, 23 nt, Human
uggcaggaucucggcucacugca

SEQ ID NO: 256200 - RNA, 19 nt, Human
uggcaggaugauugguucu

SEQ ID NO: 256201 - RNA, 32 nt, Human
uggcaggaugguggagguuucucaaggagcug

SEQ ID NO: 256202 - RNA, 32 nt, Human
uggcaggcaacuccaugaucugaccccgguua

SEQ ID NO: 256203 - RNA, 21 nt, Human
uggcaggcaccuguaauccca

SEQ ID NO: 256204 - RNA, 24 nt, Human
uggcaggcaccuguaaucccagcu

SEQ ID NO: 256205 - RNA, 21 nt, Human
uggcaggcaccuguaaucuca

SEQ ID NO: 256206 - RNA, 21 nt, Human
uggcaggcaccuguaguccca

SEQ ID NO: 256207 - RNA, 24 nt, Human
uggcaggcaccuguagucccagcu

SEQ ID NO: 256208 - RNA, 32 nt, Human
uggcaggcaggagccccgcccucccaggcaca

SEQ ID NO: 256209 - RNA, 21 nt, Human
uggcaggcaguaucgauuuua

SEQ ID NO: 256210 - RNA, 32 nt, Human
uggcaggcauacagcacccucuaccuccgugg

SEQ ID NO: 256211 - RNA, 32 nt, Human
uggcaggccacuggcaugugcugaguagcgca

SEQ ID NO: 256212 - RNA, 21 nt, Human
uggcaggccccuguaauccca

SEQ ID NO: 256213 - RNA, 24 nt, Human
uggcaggccccuguaaucccagcu

SEQ ID NO: 256214 - RNA, 32 nt, Human
uggcaggcccuggaggaugagaagguggcagg

SEQ ID NO: 256215 - RNA, 32 nt, Human
uggcaggccuuccugaguuagauuuguaguug

SEQ ID NO: 256216 - RNA, 21 nt, Human
uggcaggcgccuauaauccca

SEQ ID NO: 256217 - RNA, 21 nt, Human
uggcaggcgccuauaguccca

SEQ ID NO: 256218 - RNA, 19 nt, Human
uggcaggcgccuguaaucc

SEQ ID NO: 256219 - RNA, 23 nt, Human
uggcaggcgccuguaauccagcu

SEQ ID NO: 256220 - RNA, 21 nt, Human
uggcaggcgccuguaauccca

SEQ ID NO: 256221 - RNA, 24 nt, Human
uggcaggcgccuguaaucccagcu

SEQ ID NO: 256222 - RNA, 32 nt, Human
uggcaggcgccuguaaucccagcuacuuggaa

SEQ ID NO: 256223 - RNA, 32 nt, Human
uggcaggcgccuguaaucccagcuacuuggga

SEQ ID NO: 256224 - RNA, 32 nt, Human
uggcaggcgccuguaaucccagcuauuuggga

SEQ ID NO: 256225 - RNA, 21 nt, Human
uggcaggcgccuguaguccca

SEQ ID NO: 256226 - RNA, 32 nt, Human
uggcaggcgccuguagucccagcacuuuggga

SEQ ID NO: 256227 - RNA, 24 nt, Human
uggcaggcgccuguagucccagcu

SEQ ID NO: 256228 - RNA, 32 nt, Human
uggcaggcgccuguaucccagcuacuugggag

SEQ ID NO: 256229 - RNA, 21 nt, Human
uggcaggcgccugugguccca

SEQ ID NO: 256230 - RNA, 32 nt, Human
uggcaggcgcuuccgucggcagcacuguguuu

SEQ ID NO: 256231 - RNA, 21 nt, Human
uggcaggcgucuguaauccca

SEQ ID NO: 256232 - RNA, 24 nt, Human
uggcaggcgucuguaaucccagcu

SEQ ID NO: 256233 - RNA, 18 nt, Human
uggcaggcuauaauccca

SEQ ID NO: 256234 - RNA, 32 nt, Human
uggcaggcugccagggggaagugccuucuuca

SEQ ID NO: 256235 - RNA, 32 nt, Human
uggcaggcugggggcugggaugugaugggugu

SEQ ID NO: 256236 - RNA, 32 nt, Human
uggcagggaaggagguggcucuuggcccaggc

SEQ ID NO: 256237 - RNA, 32 nt, Human
uggcagggacagaaagguggacugggggccau

SEQ ID NO: 256238 - RNA, 32 nt, Human
uggcagggacgaggacaaauauggaugaggug

SEQ ID NO: 256239 - RNA, 32 nt, Human
uggcagggagacagccuggcccagugacccug

SEQ ID NO: 256240 - RNA, 32 nt, Human
uggcagggagagaagccagacaugaguucaac

SEQ ID NO: 256241 - RNA, 32 nt, Human
uggcagggagagaggaggccggaagaacaacc

SEQ ID NO: 256242 - RNA, 32 nt, Human
uggcagggagcacugcugcuccaugcuccauu

SEQ ID NO: 256243 - RNA, 32 nt, Human
uggcagggagcuguggucagugggggucagcc

SEQ ID NO: 256244 - RNA, 32 nt, Human
uggcagggaggcggcguugcgguggcugcauu

SEQ ID NO: 256245 - RNA, 32 nt, Human
uggcagggaucuuucuggaggaaaagcugggg

SEQ ID NO: 256246 - RNA, 32 nt, Human
uggcagggcacgguggcucacacuuguaaucc

SEQ ID NO: 256247 - RNA, 32 nt, Human
uggcagggcagaggagguagucuggaguugga

SEQ ID NO: 256248 - RNA, 32 nt, Human
uggcagggcccccagccccuccccuggcugag

SEQ ID NO: 256249 - RNA, 32 nt, Human
uggcagggccuggggagccccagcacaaugau

SEQ ID NO: 256250 - RNA, 32 nt, Human
uggcagggcuagccacaacggaggcuuucagu

SEQ ID NO: 256251 - RNA, 32 nt, Human
uggcagggcucagugcagggaggcggaggccc

SEQ ID NO: 256252 - RNA, 32 nt, Human
uggcagggcucuggacuggugacaugccaccc

SEQ ID NO: 256253 - RNA, 32 nt, Human
uggcagggcucuggacuggugacgugccaccc

SEQ ID NO: 256254 - RNA, 32 nt, Human
uggcaggggcuggcacaugacaguggagcaga

SEQ ID NO: 256255 - RNA, 32 nt, Human
uggcagggggagaucccaagccuagccuuggg

SEQ ID NO: 256256 - RNA, 32 nt, Human
uggcagggggaggcacguuucaucugucagcu

SEQ ID NO: 256257 - RNA, 32 nt, Human
uggcagggggcuggcaugucagcacugcccug

SEQ ID NO: 256258 - RNA, 32 nt, Human
uggcagggucugcacagggccauguccuggcu

SEQ ID NO: 256259 - RNA, 32 nt, Human
uggcagggugcuggggagaugccccucugagc

SEQ ID NO: 256260 - RNA, 32 nt, Human
uggcaggguucugugcucaggugggaaaucug

SEQ ID NO: 256261 - RNA, 32 nt, Human
uggcaggguuuuagugugugagugggauccag

SEQ ID NO: 256262 - RNA, 21 nt, Human
uggcagguaccuguaauccca

SEQ ID NO: 256263 - RNA, 32 nt, Human
uggcagguacuuggagagugggaccaagaccc

SEQ ID NO: 256264 - RNA, 32 nt, Human
uggcagguccccuguccuccugggugggagcu

SEQ ID NO: 256265 - RNA, 19 nt, Human
uggcaggucuuugcagcuc

SEQ ID NO: 256266 - RNA, 32 nt, Human
uggcaggugcagcccccacugccuuugaccug

SEQ ID NO: 256267 - RNA, 32 nt, Human
uggcaggugccuguaaucccagcuacucagga

SEQ ID NO: 256268 - RNA, 32 nt, Human
uggcaggugccuguaaucccagcuacucaggg

SEQ ID NO: 256269 - RNA, 32 nt, Human
uggcaggugccuguaaucccagcuacucggga

SEQ ID NO: 256270 - RNA, 32 nt, Human
uggcaggugccuguaaucccagcuacucuguc

SEQ ID NO: 256271 - RNA, 32 nt, Human
uggcaggugccuguaaucccagcuacuugaga

SEQ ID NO: 256272 - RNA, 32 nt, Human
uggcaggugccuguaaucccagcuacuuggga

SEQ ID NO: 256273 - RNA, 32 nt, Human
uggcaggugccuguaaucccauguacucugga

SEQ ID NO: 256274 - RNA, 21 nt, Human
uggcaggugccuguaauccua

SEQ ID NO: 256275 - RNA, 32 nt, Human
uggcaggugccuguaauccuagcuacuuggca

SEQ ID NO: 256276 - RNA, 32 nt, Human
uggcaggugccuguagucccagcuacucggca

SEQ ID NO: 256277 - RNA, 32 nt, Human
uggcaggugccuguagucccagcuacucggga

SEQ ID NO: 256278 - RNA, 32 nt, Human
uggcaggugccuguagucccagcuacucugga

SEQ ID NO: 256279 - RNA, 32 nt, Human
uggcaggugccuguagucccagcuacuuggga

SEQ ID NO: 256280 - RNA, 32 nt, Human
uggcaggugccuguagucucagcuacucagga

SEQ ID NO: 256281 - RNA, 21 nt, Human
uggcaggugcuuauaauccca

SEQ ID NO: 256282 - RNA, 21 nt, Human
uggcaggugcuuguaauccca

SEQ ID NO: 256283 - RNA, 24 nt, Human
uggcaggugcuuguaaucccagcu

SEQ ID NO: 256284 - RNA, 22 nt, Human
uggcaggugcuuuuugguucca

SEQ ID NO: 256285 - RNA, 32 nt, Human
uggcagguggagaggaggauggggaccagcag

SEQ ID NO: 256286 - RNA, 32 nt, Human
uggcagguggcugagcaggagcucccaagugc

SEQ ID NO: 256287 - RNA, 32 nt, Human
uggcaggugggucaaugcucucuccuuggagc

SEQ ID NO: 256288 - RNA, 32 nt, Human
uggcagguggucuccuggguagcaggaucugg

SEQ ID NO: 256289 - RNA, 32 nt, Human
uggcagguuccagagaaugcaguagaccuuuu

SEQ ID NO: 256290 - RNA, 31 nt, Human
uggcagguugagagaggagaaugcuggaaag

SEQ ID NO: 256291 - RNA, 32 nt, Human
uggcagguuucgaggcugcuugagaggacuug

SEQ ID NO: 256292 - RNA, 32 nt, Human
uggcagguuuggagagcuguaucuguugggcc

SEQ ID NO: 256293 - RNA, 32 nt, Human
uggcagguuugggaggaugagacaaucaacug

SEQ ID NO: 256294 - RNA, 17 nt, Human
uggcaguaaaauguaga

SEQ ID NO: 256295 - RNA, 32 nt, Human
uggcaguaauccagauugcuuuugccaccaac

SEQ ID NO: 256296 - RNA, 32 nt, Human
uggcaguagaugguaggcucuccagucucaaa

SEQ ID NO: 256297 - RNA, 19 nt, Human
uggcaguagcuuugguucc

SEQ ID NO: 256298 - RNA, 21 nt, Human
uggcagucaccuguaauccca

SEQ ID NO: 256299 - RNA, 24 nt, Human
uggcagucaccuguaaucccagcu

SEQ ID NO: 256300 - RNA, 21 nt, Human
uggcagucaccuguaguccca

SEQ ID NO: 256301 - RNA, 24 nt, Human
uggcagucaccuguagucccagcu

SEQ ID NO: 256302 - RNA, 32 nt, Human
uggcagucacuggaagucugggaagaauccuu

SEQ ID NO: 256303 - RNA, 19 nt, Human
uggcagucauuuggucuca

SEQ ID NO: 256304 - RNA, 32 nt, Human
uggcaguccuggucaugggcaggaugaagcgu

SEQ ID NO: 256305 - RNA, 32 nt, Human
uggcagucgaaggagcuucgucuggcagcaga

SEQ ID NO: 256306 - RNA, 32 nt, Human
uggcagucguccaaaccccaggaagagagcuc

SEQ ID NO: 256307 - RNA, 19 nt, Human
uggcagugaagagaacagg

SEQ ID NO: 256308 - RNA, 32 nt, Human
uggcagugagacugaggaugaggacagcaugg

SEQ ID NO: 256309 - RNA, 32 nt, Human
uggcagugagcaguugaauuuaucuugaauuu

SEQ ID NO: 256310 - RNA, 18 nt, Human
uggcagugagcugagauc

SEQ ID NO: 256311 - RNA, 21 nt, Human
uggcagugagcugagaucgcg

SEQ ID NO: 256312 - RNA, 32 nt, Human
uggcagugcaagacacugccgggaagacggau

SEQ ID NO: 256313 - RNA, 32 nt, Human
uggcagugccagagcccaggccccagagcccu

SEQ ID NO: 256314 - RNA, 32 nt, Human
uggcagugcccccagagugugcagcugugauu

SEQ ID NO: 256315 - RNA, 20 nt, Human
uggcagugccuguaauccca

SEQ ID NO: 256316 - RNA, 23 nt, Human
uggcagugccuguaaucccagcu

SEQ ID NO: 256317 - RNA, 32 nt, Human
uggcagugccuguaaucccagcuauuugggag

SEQ ID NO: 256318 - RNA, 32 nt, Human
uggcagugccuguagucccagcugcucgggag

SEQ ID NO: 256319 - RNA, 21 nt, Human
uggcagugccuucuguuccca

SEQ ID NO: 256320 - RNA, 19 nt, Human
uggcagugcucaggcgccc

SEQ ID NO: 256321 - RNA, 20 nt, Human
uggcagugcugaccauuuca

SEQ ID NO: 256322 - RNA, 19 nt, Human
uggcagugcugaccucgca

SEQ ID NO: 256323 - RNA, 18 nt, Human
uggcagugcugagggacc

SEQ ID NO: 256324 - RNA, 21 nt, Human
uggcagugcugaucgauccca

SEQ ID NO: 256325 - RNA, 20 nt, Human
uggcagugcugauucagccu

SEQ ID NO: 256326 - RNA, 19 nt, Human
uggcagugcugccgacuuc

SEQ ID NO: 256327 - RNA, 32 nt, Human
uggcagugcugccucuuguaggugcuggcuaa

SEQ ID NO: 256328 - RNA, 19 nt, Human
uggcagugcugcuacuccu

SEQ ID NO: 256329 - RNA, 21 nt, Human
uggcagugcuggagaugaccc

SEQ ID NO: 256330 - RNA, 19 nt, Human
uggcagugcuggguaucuu

SEQ ID NO: 256331 - RNA, 21 nt, Human
uggcagugcuggguucaccca

SEQ ID NO: 256332 - RNA, 18 nt, Human
uggcagugcugguaccca

SEQ ID NO: 256333 - RNA, 16 nt, Human
uggcagugcuguuccu

SEQ ID NO: 256334 - RNA, 19 nt, Human
uggcagugcuuccucuccu

SEQ ID NO: 256335 - RNA, 18 nt, Human
uggcagugcuugugauuc

SEQ ID NO: 256336 - RNA, 32 nt, Human
uggcaguggaggugggguguuugggaggcugc

SEQ ID NO: 256337 - RNA, 18 nt, Human
uggcaguggaugggaccc

SEQ ID NO: 256338 - RNA, 32 nt, Human
uggcaguggcacauaggcaagugucuuugcau

SEQ ID NO: 256339 - RNA, 19 nt, Human
uggcaguggcaugaucuca

SEQ ID NO: 256340 - RNA, 32 nt, Human
uggcaguggcccauccugucuucuacuugaaa

SEQ ID NO: 256341 - RNA, 31 nt, Human
uggcaguggcucucuggccgcgggcccuguc

SEQ ID NO: 256342 - RNA, 19 nt, Human
uggcaguggcuguguccca

SEQ ID NO: 256343 - RNA, 18 nt, Human
uggcagugggacagaucc

SEQ ID NO: 256344 - RNA, 20 nt, Human
uggcaguggggagauuucca

SEQ ID NO: 256345 - RNA, 20 nt, Human
uggcaguggugccggccuca

SEQ ID NO: 256346 - RNA, 18 nt, Human
uggcaguguaguauucca

SEQ ID NO: 256347 - RNA, 19 nt, Human
uggcaguguaucuaccuca

SEQ ID NO: 256348 - RNA, 32 nt, Human
uggcaguguaugguucaggaaugcugaauaug

SEQ ID NO: 256349 - RNA, 24 nt, Human
uggcagugucauggcucacugcag

SEQ ID NO: 256350 - RNA, 32 nt, Human
uggcagugucauggcucacugcagccucaacc

SEQ ID NO: 256351 - RNA, 19 nt, Human
uggcaguguccuucauccu

SEQ ID NO: 256352 - RNA, 19 nt, Human
uggcaguguggaaauucca

SEQ ID NO: 256353 - RNA, 32 nt, Human
uggcaguguggagccugcaggaggagaggcug

SEQ ID NO: 256354 - RNA, 32 nt, Human
uggcagugugggcaccgcggcccgggacgaca

SEQ ID NO: 256355 - RNA, 20 nt, Human
uggcaguguuaggcaucuua

SEQ ID NO: 256356 - RNA, 20 nt, Human
uggcaguguuaucucaucuc

SEQ ID NO: 256357 - RNA, 32 nt, Human
uggcaguguucauauucucaaacuagucaaaa

SEQ ID NO: 256358 - RNA, 21 nt, Human
uggcaguguugagaucuccca

SEQ ID NO: 256359 - RNA, 18 nt, Human
uggcaguguugguaacua

SEQ ID NO: 256360 - RNA, 19 nt, Human
uggcaguguugucagcuca

SEQ ID NO: 256361 - RNA, 21 nt, Human
uggcaguguuuuaaggaccca

SEQ ID NO: 256362 - RNA, 32 nt, Human
uggcaguuauuguugagagaaaagccuuccca

SEQ ID NO: 256363 - RNA, 32 nt, Human
uggcaguuccccaggccuucaggcuguuuucu

SEQ ID NO: 256364 - RNA, 32 nt, Human
uggcaguucccccagccccacccugucugcuc

SEQ ID NO: 256365 - RNA, 32 nt, Human
uggcaguuccucccagaagaucaaaggauccu

SEQ ID NO: 256366 - RNA, 32 nt, Human
uggcaguuccucgccucggugccaucagggag

SEQ ID NO: 256367 - RNA, 32 nt, Human
uggcaguugccuggugaucgagaaagaacgga

SEQ ID NO: 256368 - RNA, 32 nt, Human
uggcaguuuaggcugcacaacugguaaaauga

SEQ ID NO: 256369 - RNA, 32 nt, Human
uggcaguuucuccaaauguuaaacauagaauu

SEQ ID NO: 256370 - RNA, 32 nt, Human
uggcaguuuuucacagcucaucuugcuguguu

SEQ ID NO: 256371 - RNA, 21 nt, Human
uggcaguuuuugaaauguaaa

SEQ ID NO: 256372 - RNA, 32 nt, Human
uggcauaaaaacaagaaccacaaaaacuugaa

SEQ ID NO: 256373 - RNA, 32 nt, Human
uggcauaaauuauuccuggugagacauguggc

SEQ ID NO: 256374 - RNA, 23 nt, Human
uggcauaaucacagcucacugca

SEQ ID NO: 256375 - RNA, 32 nt, Human
uggcauaaucauaccucauugcagccucagac

SEQ ID NO: 256376 - RNA, 24 nt, Human
uggcauaaucucagcucacugcag

SEQ ID NO: 256377 - RNA, 32 nt, Human
uggcauaaucucagcucacugcagucucugcc

SEQ ID NO: 256378 - RNA, 23 nt, Human
uggcauaaucucggcucacugca

SEQ ID NO: 256379 - RNA, 21 nt, Human
uggcauacaccuguaguccca

SEQ ID NO: 256380 - RNA, 24 nt, Human
uggcauacaccuguagucccagcu

SEQ ID NO: 256381 - RNA, 32 nt, Human
uggcauacagcuccauuggaggggacacauca

SEQ ID NO: 256382 - RNA, 21 nt, Human
uggcauacgccuguaauccca

SEQ ID NO: 256383 - RNA, 24 nt, Human
uggcauacgccuguaaucccagcu

SEQ ID NO: 256384 - RNA, 32 nt, Human
uggcauacgccuguaauccuagcuacuuggga

SEQ ID NO: 256385 - RNA, 32 nt, Human
uggcauacucaacagcaacgccagcuuucugg

SEQ ID NO: 256386 - RNA, 21 nt, Human
uggcauacuccuguaguccca

SEQ ID NO: 256387 - RNA, 24 nt, Human
uggcauacuccuguagucccagcu

SEQ ID NO: 256388 - RNA, 32 nt, Human
uggcauacucucuuccagcccuaggaggaggg

SEQ ID NO: 256389 - RNA, 32 nt, Human
uggcauagaggaccuggaauugcuagaggggc

SEQ ID NO: 256390 - RNA, 26 nt, Human
uggcauagagugauucaaccaccuua

SEQ ID NO: 256391 - RNA, 32 nt, Human
uggcauaggaguguguuaugggugcugaacuc

SEQ ID NO: 256392 - RNA, 21 nt, Human
uggcauaggccuguaauucca

SEQ ID NO: 256393 - RNA, 32 nt, Human
uggcauaggccuguaauuccagcuacucuggc

SEQ ID NO: 256394 - RNA, 32 nt, Human
uggcauaugccauuucugggaaaugcaucugg

SEQ ID NO: 256395 - RNA, 32 nt, Human
uggcauaugccuguaaaucccagcuauuuggg

SEQ ID NO: 256396 - RNA, 21 nt, Human
uggcauaugccuguaguccca

SEQ ID NO: 256397 - RNA, 32 nt, Human
uggcauaugccuguagucccaguuacuuggga

SEQ ID NO: 256398 - RNA, 32 nt, Human
uggcauaugcuggggguagggguagcauuguu

SEQ ID NO: 256399 - RNA, 19 nt, Human
uggcauauggcauuuucua

SEQ ID NO: 256400 - RNA, 32 nt, Human
uggcauauuuugcaucuacaacuucuauaaua

SEQ ID NO: 256401 - RNA, 32 nt, Human
uggcaucaaauguuugcagcagucuccauaau

SEQ ID NO: 256402 - RNA, 32 nt, Human
uggcaucaaauucuaaggagcuugaucaggag

SEQ ID NO: 256403 - RNA, 32 nt, Human
uggcaucaaccaagcuaauucagcauuagaug

SEQ ID NO: 256404 - RNA, 31 nt, Human
uggcaucacagcuaaguagcuguggccaccg

SEQ ID NO: 256405 - RNA, 32 nt, Human
uggcaucacccaggugaaugguguccagguga

SEQ ID NO: 256406 - RNA, 21 nt, Human
uggcaucacccauaaagggaa

SEQ ID NO: 256407 - RNA, 32 nt, Human
uggcaucaccuuaggcagggaaguguaagaaa

SEQ ID NO: 256408 - RNA, 32 nt, Human
uggcaucagacaccggcccguguuccuuguca

SEQ ID NO: 256409 - RNA, 32 nt, Human
uggcaucagagcugagugauggacgaccugca

SEQ ID NO: 256410 - RNA, 32 nt, Human
uggcaucaggaguucaagaccaaccuggccaa

SEQ ID NO: 256411 - RNA, 16 nt, Human
uggcaucaggggcaaa

SEQ ID NO: 256412 - RNA, 32 nt, Human
uggcaucauaggaccuggcacagggaagggac

SEQ ID NO: 256413 - RNA, 32 nt, Human
uggcaucauccauucucucugcccaaguugcu

SEQ ID NO: 256414 - RNA, 23 nt, Human
uggcaucaucucagcucacugca

SEQ ID NO: 256415 - RNA, 32 nt, Human
uggcaucauugcauuccagccugggcaacaga

SEQ ID NO: 256416 - RNA, 24 nt, Human
uggcaucauuguaacucacugcag

SEQ ID NO: 256417 - RNA, 32 nt, Human
uggcaucauuguaacucacugcagccugaaac

SEQ ID NO: 256418 - RNA, 32 nt, Human
uggcauccagcagagaguuagaaaugcucugu

SEQ ID NO: 256419 - RNA, 32 nt, Human
uggcauccagggccaggcaggcagcuugaggu

SEQ ID NO: 256420 - RNA, 32 nt, Human
uggcauccauuuuuccaaagaagagucgaguc

SEQ ID NO: 256421 - RNA, 32 nt, Human
uggcaucccugaguccccuccggcuccuaugg

SEQ ID NO: 256422 - RNA, 32 nt, Human
uggcauccuggugugcuguucuugaguuuucg

SEQ ID NO: 256423 - RNA, 32 nt, Human
uggcauccuguguggcagacagcagaauuggg

SEQ ID NO: 256424 - RNA, 32 nt, Human
uggcauccuugaucucagggaucuucuccguu

SEQ ID NO: 256425 - RNA, 22 nt, Human
uggcaucgaauagccuuaauga

SEQ ID NO: 256426 - RNA, 32 nt, Human
uggcaucgaguggguggagaccagagaagccg

SEQ ID NO: 256427 - RNA, 32 nt, Human
uggcaucguugugccuaaccugggagacggaa

SEQ ID NO: 256428 - RNA, 32 nt, Human
uggcaucuaagugucuguguucuuguaagccu

SEQ ID NO: 256429 - RNA, 32 nt, Human
uggcaucuacggagcccagcaggcgugccagg

SEQ ID NO: 256430 - RNA, 32 nt, Human
uggcaucucccaggugccacugcagggauagc

SEQ ID NO: 256431 - RNA, 32 nt, Human
uggcaucuccccacugcuccucucuuucccca

SEQ ID NO: 256432 - RNA, 32 nt, Human
uggcaucugcccaccccaccccuugcccucuu

SEQ ID NO: 256433 - RNA, 32 nt, Human
uggcaucugccucccuagaccuccuucccucc

SEQ ID NO: 256434 - RNA, 32 nt, Human
uggcaucuggguucaccuccccacucugauga

SEQ ID NO: 256435 - RNA, 20 nt, Human
uggcaucuguggcgguccua

SEQ ID NO: 256436 - RNA, 32 nt, Human
uggcaucugugggauagaggccagccugcaua

SEQ ID NO: 256437 - RNA, 32 nt, Human
uggcaucuguugaacugaggagcauuucucau

SEQ ID NO: 256438 - RNA, 20 nt, Human
uggcaucuuagaccuccaca

SEQ ID NO: 256439 - RNA, 32 nt, Human
uggcaucuucucaggcagaggugcaaccuguc

SEQ ID NO: 256440 - RNA, 32 nt, Human
uggcaucuuuugggcauauucuuccuuuuaau

SEQ ID NO: 256441 - RNA, 32 nt, Human
uggcaucuuuuuaaaaaguuauauuuucuaaa

SEQ ID NO: 256442 - RNA, 32 nt, Human
uggcaugaaacauuaacacagcucuuuuuaua

SEQ ID NO: 256443 - RNA, 32 nt, Human
uggcaugaacacaacgcacugcagccucuacc

SEQ ID NO: 256444 - RNA, 32 nt, Human
uggcaugaacccaggaggcagagcuugcagug

SEQ ID NO: 256445 - RNA, 32 nt, Human
uggcaugaacccaggaggcagagcuuguagug

SEQ ID NO: 256446 - RNA, 32 nt, Human
uggcaugaacccaggaguuggagcuugcagug

SEQ ID NO: 256447 - RNA, 32 nt, Human
uggcaugaaccccaggcuggagugcaguggcu

SEQ ID NO: 256448 - RNA, 23 nt, Human
uggcaugaacucagcucacugca

SEQ ID NO: 256449 - RNA, 24 nt, Human
uggcaugaauaaggugccaggaaa

SEQ ID NO: 256450 - RNA, 32 nt, Human
uggcaugaauuaguguucuagacucugcuuug

SEQ ID NO: 256451 - RNA, 19 nt, Human
uggcaugagauucucauag

SEQ ID NO: 256452 - RNA, 32 nt, Human
uggcaugaggaguggguggccuccucuccauc

SEQ ID NO: 256453 - RNA, 32 nt, Human
uggcaugaucacaccucacugcagccuuggcc

SEQ ID NO: 256454 - RNA, 32 nt, Human
uggcaugaucacagcucacugcagccucgacc

SEQ ID NO: 256455 - RNA, 32 nt, Human
uggcaugaucacggcucacugcagcuucaaac

SEQ ID NO: 256456 - RNA, 24 nt, Human
uggcaugaucauaacucacugcag

SEQ ID NO: 256457 - RNA, 32 nt, Human
uggcaugaucauaacucacugcagccucaaac

SEQ ID NO: 256458 - RNA, 32 nt, Human
uggcaugaucauagaucacugcagccucaaac

SEQ ID NO: 256459 - RNA, 24 nt, Human
uggcaugaucauagcucacugcag

SEQ ID NO: 256460 - RNA, 32 nt, Human
uggcaugaucauagcucacugcagccucauac

SEQ ID NO: 256461 - RNA, 32 nt, Human
uggcaugaucauagcucacugcagccuugaac

SEQ ID NO: 256462 - RNA, 32 nt, Human
uggcaugaucauagcucauugcagccucaaac

SEQ ID NO: 256463 - RNA, 32 nt, Human
uggcaugaucaucagugagcgugagaucacug

SEQ ID NO: 256464 - RNA, 23 nt, Human
uggcaugaucauggcucacugca

SEQ ID NO: 256465 - RNA, 24 nt, Human
uggcaugaucauggcucacugcag

SEQ ID NO: 256466 - RNA, 32 nt, Human
uggcaugaucauggcucacugcagccuugacc

SEQ ID NO: 256467 - RNA, 32 nt, Human
uggcaugaucauggcuuacugcagccuugauc

SEQ ID NO: 256468 - RNA, 23 nt, Human
uggcaugaucucagcucacugca

SEQ ID NO: 256469 - RNA, 24 nt, Human
uggcaugaucucagcucacugcag

SEQ ID NO: 256470 - RNA, 32 nt, Human
uggcaugaucucagcucacugcagccuccguc

SEQ ID NO: 256471 - RNA, 23 nt, Human
uggcaugaucucagcucacugua

SEQ ID NO: 256472 - RNA, 24 nt, Human
uggcaugaucucagcucacuguag

SEQ ID NO: 256473 - RNA, 23 nt, Human
uggcaugaucucagcucgcugca

SEQ ID NO: 256474 - RNA, 23 nt, Human
uggcaugaucucaguucacugca

SEQ ID NO: 256475 - RNA, 23 nt, Human
uggcaugaucucgacucacugca

SEQ ID NO: 256476 - RNA, 32 nt, Human
uggcaugaucucgacucacugcagccuccgcc

SEQ ID NO: 256477 - RNA, 23 nt, Human
uggcaugaucucggcucaccgca

SEQ ID NO: 256478 - RNA, 24 nt, Human
uggcaugaucucggcucaccgcag

SEQ ID NO: 256479 - RNA, 23 nt, Human
uggcaugaucucggcucacggca

SEQ ID NO: 256480 - RNA, 23 nt, Human
uggcaugaucucggcucacuaca

SEQ ID NO: 256481 - RNA, 23 nt, Human
uggcaugaucucggcucacugca

SEQ ID NO: 256482 - RNA, 23 nt, Human
uggcaugaucucggcucacugcg

SEQ ID NO: 256483 - RNA, 23 nt, Human
uggcaugaucucggcucauugca

SEQ ID NO: 256484 - RNA, 23 nt, Human
uggcaugaucucggcucgcuaca

SEQ ID NO: 256485 - RNA, 23 nt, Human
uggcaugaucucggcucgcugca

SEQ ID NO: 256486 - RNA, 23 nt, Human
uggcaugaucucggcuuacugca

SEQ ID NO: 256487 - RNA, 23 nt, Human
uggcaugaucugggcucacugca

SEQ ID NO: 256488 - RNA, 23 nt, Human
uggcaugaucuggucucacugca

SEQ ID NO: 256489 - RNA, 21 nt, Human
uggcaugaucuuggcucacug

SEQ ID NO: 256490 - RNA, 23 nt, Human
uggcaugaucuuggcucacugca

SEQ ID NO: 256491 - RNA, 24 nt, Human
uggcaugaucuuggcucacugcag

SEQ ID NO: 256492 - RNA, 32 nt, Human
uggcaugaucuuggcucacugcagccucgacu

SEQ ID NO: 256493 - RNA, 24 nt, Human
uggcaugaucuuggcucacuucag

SEQ ID NO: 256494 - RNA, 23 nt, Human
uggcaugaucuuggcuuacugca

SEQ ID NO: 256495 - RNA, 23 nt, Human
uggcaugaugucggcucacugca

SEQ ID NO: 256496 - RNA, 32 nt, Human
uggcaugauucuggcucacugcagccucaaac

SEQ ID NO: 256497 - RNA, 24 nt, Human
uggcaugauuguagcucacugcag

SEQ ID NO: 256498 - RNA, 32 nt, Human
uggcaugauuguagcucacugcagucuucagc

SEQ ID NO: 256499 - RNA, 32 nt, Human
uggcaugauuucaguucacugcagccucgacc

SEQ ID NO: 256500 - RNA, 23 nt, Human
uggcaugauuucggcucacugca

SEQ ID NO: 256501 - RNA, 21 nt, Human
uggcaugcaccuauaauccca

SEQ ID NO: 256502 - RNA, 21 nt, Human
uggcaugcaccuguaauccca

SEQ ID NO: 256503 - RNA, 24 nt, Human
uggcaugcaccuguaaucccagcu

SEQ ID NO: 256504 - RNA, 32 nt, Human
uggcaugcaccuguaaucccagcuacuuggga

SEQ ID NO: 256505 - RNA, 21 nt, Human
uggcaugcaccuguaguccca

SEQ ID NO: 256506 - RNA, 24 nt, Human
uggcaugcaccuguagucccagcu

SEQ ID NO: 256507 - RNA, 32 nt, Human
uggcaugcaguggcaugaucucggcucaccgc

SEQ ID NO: 256508 - RNA, 32 nt, Human
uggcaugcagugguagucccagcuacucagga

SEQ ID NO: 256509 - RNA, 21 nt, Human
uggcaugcaucuguaauccca

SEQ ID NO: 256510 - RNA, 24 nt, Human
uggcaugcaucuguaaucccagcu

SEQ ID NO: 256511 - RNA, 32 nt, Human
uggcaugcaugcugcugguaggagacccccaa

SEQ ID NO: 256512 - RNA, 32 nt, Human
uggcaugccgggccccuccauccacccggggg

SEQ ID NO: 256513 - RNA, 32 nt, Human
uggcaugccuguguucccagcuacucaggagg

SEQ ID NO: 256514 - RNA, 32 nt, Human
uggcaugccuuggguuuccuauccugagagug

SEQ ID NO: 256515 - RNA, 21 nt, Human
uggcaugcgccuauaaucuca

SEQ ID NO: 256516 - RNA, 21 nt, Human
uggcaugcgccuauaguccca

SEQ ID NO: 256517 - RNA, 20 nt, Human
uggcaugcgccuguaauccc

SEQ ID NO: 256518 - RNA, 21 nt, Human
uggcaugcgccuguaauccca

SEQ ID NO: 256519 - RNA, 24 nt, Human
uggcaugcgccuguaaucccagcu

SEQ ID NO: 256520 - RNA, 32 nt, Human
uggcaugcgccuguaaucccagcuacuucgga

SEQ ID NO: 256521 - RNA, 24 nt, Human
uggcaugcgccuguaaucccggcu

SEQ ID NO: 256522 - RNA, 21 nt, Human
uggcaugcgccuguaguccca

SEQ ID NO: 256523 - RNA, 24 nt, Human
uggcaugcgccuguagucccagcu

SEQ ID NO: 256524 - RNA, 21 nt, Human
uggcaugcgccugugauccca

SEQ ID NO: 256525 - RNA, 24 nt, Human
uggcaugcgccugugaucccagcu

SEQ ID NO: 256526 - RNA, 32 nt, Human
uggcaugcguugcuagagucaugugaauagaa

SEQ ID NO: 256527 - RNA, 24 nt, Human
uggcaugcucucagcucacugcag

SEQ ID NO: 256528 - RNA, 32 nt, Human
uggcaugcucucagcucacugcagcccugacu

SEQ ID NO: 256529 - RNA, 32 nt, Human
uggcaugcuuccccugggcuccaggcugacuu

SEQ ID NO: 256530 - RNA, 21 nt, Human
uggcaugcuucuguaauccca

SEQ ID NO: 256531 - RNA, 32 nt, Human
uggcauggaaggcagaggcugggugggguggg

SEQ ID NO: 256532 - RNA, 32 nt, Human
uggcauggagaagccucagggaaaggccugcc

SEQ ID NO: 256533 - RNA, 32 nt, Human
uggcauggagccaggcccucaggcgagcaggg

SEQ ID NO: 256534 - RNA, 32 nt, Human
uggcauggaggagcccucuugcaccagguaga

SEQ ID NO: 256535 - RNA, 32 nt, Human
uggcauggaguauagugcaaauucauuuuuaa

SEQ ID NO: 256536 - RNA, 32 nt, Human
uggcauggagugaauuagaagacacgagacuu

SEQ ID NO: 256537 - RNA, 19 nt, Human
uggcauggccaggagcccu

SEQ ID NO: 256538 - RNA, 32 nt, Human
uggcauggcucacgccuguaaucccagcacuu

SEQ ID NO: 256539 - RNA, 32 nt, Human
uggcaugggaaacauggcaaaaccccaucucu

SEQ ID NO: 256540 - RNA, 32 nt, Human
uggcaugggaagaaugaaagaggcuuuguaac

SEQ ID NO: 256541 - RNA, 32 nt, Human
uggcauggggauggguucaggccaggucuuuu

SEQ ID NO: 256542 - RNA, 23 nt, Human
uggcauggucucagcucacugua

SEQ ID NO: 256543 - RNA, 32 nt, Human
uggcauggucucagcucacuguaaccuccacc

SEQ ID NO: 256544 - RNA, 32 nt, Human
uggcaugguguuuguggacugguucagggaag

SEQ ID NO: 256545 - RNA, 17 nt, Human
uggcauguaaauguaaa

SEQ ID NO: 256546 - RNA, 21 nt, Human
uggcauguaccuguaacccca

SEQ ID NO: 256547 - RNA, 32 nt, Human
uggcaugucagagaaggcaauugaaaaauuua

SEQ ID NO: 256548 - RNA, 32 nt, Human
uggcaugucauaagagaaacagaugugcauau

SEQ ID NO: 256549 - RNA, 32 nt, Human
uggcaugucauccucagggcgcuuccucgcuc

SEQ ID NO: 256550 - RNA, 32 nt, Human
uggcaugucaucuucugagcccuucuuucuac

SEQ ID NO: 256551 - RNA, 32 nt, Human
uggcaugucuggcacauggcccccaggcugcg

SEQ ID NO: 256552 - RNA, 32 nt, Human
uggcaugucuggcaguagucucucauucacuc

SEQ ID NO: 256553 - RNA, 32 nt, Human
uggcaugugccagcuacucgggaggcugaggc

SEQ ID NO: 256554 - RNA, 24 nt, Human
uggcaugugccugcaaucccagcu

SEQ ID NO: 256555 - RNA, 32 nt, Human
uggcaugugccuguaaccccagcuacucagga

SEQ ID NO: 256556 - RNA, 20 nt, Human
uggcaugugccuguaauccc

SEQ ID NO: 256557 - RNA, 21 nt, Human
uggcaugugccuguaauccca

SEQ ID NO: 256558 - RNA, 24 nt, Human
uggcaugugccuguaaucccagcu

SEQ ID NO: 256559 - RNA, 32 nt, Human
uggcaugugccuguaaucccagcuacucagga

SEQ ID NO: 256560 - RNA, 32 nt, Human
uggcaugugccuguaaucccagcuauuuggca

SEQ ID NO: 256561 - RNA, 24 nt, Human
uggcaugugccuguaaucccaguu

SEQ ID NO: 256562 - RNA, 32 nt, Human
uggcaugugccuguaaucccaguuacugggga

SEQ ID NO: 256563 - RNA, 24 nt, Human
uggcaugugccuguaaucccugcu

SEQ ID NO: 256564 - RNA, 21 nt, Human
uggcaugugccuguaguccca

SEQ ID NO: 256565 - RNA, 24 nt, Human
uggcaugugccuguagucccagcu

SEQ ID NO: 256566 - RNA, 32 nt, Human
uggcaugugccuguagucccagcuacucagga

SEQ ID NO: 256567 - RNA, 32 nt, Human
uggcaugugccuguagucccagcuacucugga

SEQ ID NO: 256568 - RNA, 32 nt, Human
uggcaugugccuguagucccagcuacuuggga

SEQ ID NO: 256569 - RNA, 24 nt, Human
uggcaugugccuguaguuccagcu

SEQ ID NO: 256570 - RNA, 32 nt, Human
uggcaugugccuguaguuccagcuacucagga

SEQ ID NO: 256571 - RNA, 24 nt, Human
uggcaugugccuguauucccagcu

SEQ ID NO: 256572 - RNA, 32 nt, Human
uggcaugugcucagcuccgucaacaucugcug

SEQ ID NO: 256573 - RNA, 21 nt, Human
uggcaugugcuuguaauccca

SEQ ID NO: 256574 - RNA, 24 nt, Human
uggcaugugcuuguaaucccagcu

SEQ ID NO: 256575 - RNA, 32 nt, Human
uggcauguguacccaggaugggccuauagguc

SEQ ID NO: 256576 - RNA, 23 nt, Human
uggcauguucauggcucacugca

SEQ ID NO: 256577 - RNA, 32 nt, Human
uggcauguucccauuuuugcuuagcucaauua

SEQ ID NO: 256578 - RNA, 32 nt, Human
uggcauuaaaaaggugggagaaauggaagaaa

SEQ ID NO: 256579 - RNA, 32 nt, Human
uggcauuagauucuuauagaagcacgaacacu

SEQ ID NO: 256580 - RNA, 23 nt, Human
uggcauuaucucagcucacugca

SEQ ID NO: 256581 - RNA, 31 nt, Human
uggcauucaauaaacauauguugaaagaaua

SEQ ID NO: 256582 - RNA, 32 nt, Human
uggcauucacagaccacagcuucuaugugagg

SEQ ID NO: 256583 - RNA, 32 nt, Human
uggcauucacaggcuugauguauuccacuguu

SEQ ID NO: 256584 - RNA, 32 nt, Human
uggcauucagccaguggaagacaaaggagcgu

SEQ ID NO: 256585 - RNA, 21 nt, Human
uggcauucgucuguaauccca

SEQ ID NO: 256586 - RNA, 24 nt, Human
uggcauucgucuguaaucccagcu

SEQ ID NO: 256587 - RNA, 32 nt, Human
uggcauucucuuuuccagagccucgaguuugg

SEQ ID NO: 256588 - RNA, 32 nt, Human
uggcauucugaugcuuuucagguuuaauccuu

SEQ ID NO: 256589 - RNA, 32 nt, Human
uggcauucuguguaacaagcagcagaaccuag

SEQ ID NO: 256590 - RNA, 21 nt, Human
uggcauugaagcaggcacuug

SEQ ID NO: 256591 - RNA, 21 nt, Human
uggcauugaggcuaaccucca

SEQ ID NO: 256592 - RNA, 32 nt, Human
uggcauugcacuccagccugggugguagauca

SEQ ID NO: 256593 - RNA, 31 nt, Human
uggcauugcacugcuuauaugccaagcuaau

SEQ ID NO: 256594 - RNA, 32 nt, Human
uggcauugccuuucaugaguuacuugucuaua

SEQ ID NO: 256595 - RNA, 18 nt, Human
uggcauugcuugauuuua

SEQ ID NO: 256596 - RNA, 21 nt, Human
uggcauuggcaguuacugguc

SEQ ID NO: 256597 - RNA, 20 nt, Human
uggcauuguggggucugggc

SEQ ID NO: 256598 - RNA, 32 nt, Human
uggcauuguuagcuggggacauggaaguggac

SEQ ID NO: 256599 - RNA, 32 nt, Human
uggcauuguucucuuggaaggcugcuuugcag

SEQ ID NO: 256600 - RNA, 17 nt, Human
uggcauuucaauguaaa

SEQ ID NO: 256601 - RNA, 32 nt, Human
uggcauuucuccuuucugugcacagcacuuua

SEQ ID NO: 256602 - RNA, 32 nt, Human
uggcauuucuggagcaggagguugucaggaca

SEQ ID NO: 256603 - RNA, 32 nt, Human
uggcauuucuguagcugagcacagcaggggag

SEQ ID NO: 256604 - RNA, 18 nt, Human
uggcauuugacgauucua

SEQ ID NO: 256605 - RNA, 32 nt, Human
uggcauuugcauuuuagagaagggaaaacagu

SEQ ID NO: 256606 - RNA, 21 nt, Human
uggcauuugccuguaauccca

SEQ ID NO: 256607 - RNA, 24 nt, Human
uggcauuugccuguaaucccagcu

SEQ ID NO: 256608 - RNA, 32 nt, Human
uggcauuuggcauguccaugacauuggagacu

SEQ ID NO: 256609 - RNA, 23 nt, Human
uggcauuuguggccacucacuuu

SEQ ID NO: 256610 - RNA, 32 nt, Human
uggcauuuuaaauauauuuggcaauuuuccca

SEQ ID NO: 256611 - RNA, 32 nt, Human
uggcauuuucucaaauaaaacucugcaagagu

SEQ ID NO: 256612 - RNA, 32 nt, Human
uggccaaaaaguucacagacagcaguguuugc

SEQ ID NO: 256613 - RNA, 32 nt, Human
uggccaaaacaacauuuuaaguagaagaucca

SEQ ID NO: 256614 - RNA, 32 nt, Human
uggccaaaacagugaaaccccgucucuacuaa

SEQ ID NO: 256615 - RNA, 32 nt, Human
uggccaaaaccagaaccagcagucuccugccu

SEQ ID NO: 256616 - RNA, 32 nt, Human
uggccaaaauggugaaacuccaucucuacuaa

SEQ ID NO: 256617 - RNA, 32 nt, Human
uggccaaacauggugaaacccugucuacaaaa

SEQ ID NO: 256618 - RNA, 32 nt, Human
uggccaaagacgccggcuugguguggccccag

SEQ ID NO: 256619 - RNA, 32 nt, Human
uggccaaagauaggaggaagaaagagaacucu

SEQ ID NO: 256620 - RNA, 24 nt, Human
uggccaaagcaucaggaaagggaa

SEQ ID NO: 256621 - RNA, 32 nt, Human
uggccaaagcuggacaccuccuugggacacug

SEQ ID NO: 256622 - RNA, 22 nt, Human
uggccaaagugcuuggaugcaa

SEQ ID NO: 256623 - RNA, 32 nt, Human
uggccaaaguguugaaaacuugcuagaaaggc

SEQ ID NO: 256624 - RNA, 32 nt, Human
uggccaaaguguugggauuacaggcauaagcc

SEQ ID NO: 256625 - RNA, 32 nt, Human
uggccaaauggugaaaccccaucucuacgaaa

SEQ ID NO: 256626 - RNA, 32 nt, Human
uggccaaauuuccuacagcgagauuaugaaac

SEQ ID NO: 256627 - RNA, 32 nt, Human
uggccaacaaggcaaaaccccgucucuaccaa

SEQ ID NO: 256628 - RNA, 32 nt, Human
uggccaacaaggcaaaaccccgucucuacuaa

SEQ ID NO: 256629 - RNA, 32 nt, Human
uggccaacaaggugaaaccccaucucuacuaa

SEQ ID NO: 256630 - RNA, 32 nt, Human
uggccaacaaggugaaaccccgucucuacuaa

SEQ ID NO: 256631 - RNA, 32 nt, Human
uggccaacaaggugaaccucaucucuacuaaa

SEQ ID NO: 256632 - RNA, 32 nt, Human
uggccaacacagugaaaccccaucucuacuaa

SEQ ID NO: 256633 - RNA, 32 nt, Human
uggccaacaccaaugccccaaccuucccccac

SEQ ID NO: 256634 - RNA, 32 nt, Human
uggccaacacggugaaaacccgucucuacaaa

SEQ ID NO: 256635 - RNA, 32 nt, Human
uggccaacacggugaaaccccaucucuacuaa

SEQ ID NO: 256636 - RNA, 32 nt, Human
uggccaacacggugaaaccccaucucucuaaa

SEQ ID NO: 256637 - RNA, 32 nt, Human
uggccaacacggugaaaccccgucucuacuaa

SEQ ID NO: 256638 - RNA, 32 nt, Human
uggccaacacggugaaaccccgucucuccuaa

SEQ ID NO: 256639 - RNA, 32 nt, Human
uggccaacagggugaaaccccgucucuacaaa

SEQ ID NO: 256640 - RNA, 32 nt, Human
uggccaacauaaugaaaccccaucucuacuaa

SEQ ID NO: 256641 - RNA, 32 nt, Human
uggccaacauagcaaaaccccaucucuauuaa

SEQ ID NO: 256642 - RNA, 32 nt, Human
uggccaacauagcgaaaccccgucucuacuaa

SEQ ID NO: 256643 - RNA, 32 nt, Human
uggccaacauagugaaaccccaucucuaccaa

SEQ ID NO: 256644 - RNA, 32 nt, Human
uggccaacauagugaaaccccaucucuacuaa

SEQ ID NO: 256645 - RNA, 32 nt, Human
uggccaacauagugaaaccccaucucuacuga

SEQ ID NO: 256646 - RNA, 32 nt, Human
uggccaacauagugaaaccccgucucuacuaa

SEQ ID NO: 256647 - RNA, 32 nt, Human
uggccaacauagugaaaccccgucucuaguaa

SEQ ID NO: 256648 - RNA, 32 nt, Human
uggccaacauagugaaaccccgucucuauuaa

SEQ ID NO: 256649 - RNA, 32 nt, Human
uggccaacauagugaaaccccgucucuucuaa

SEQ ID NO: 256650 - RNA, 32 nt, Human
uggccaacauagugaaacuccgucucuacuaa

SEQ ID NO: 256651 - RNA, 32 nt, Human
uggccaacauagugaaaucccaucucuacuaa

SEQ ID NO: 256652 - RNA, 22 nt, Human
uggccaacauagugagacccca

SEQ ID NO: 256653 - RNA, 20 nt, Human
uggccaacauaguggagaga

SEQ ID NO: 256654 - RNA, 32 nt, Human
uggccaacaucgugaaaccccaucucuacuaa

SEQ ID NO: 256655 - RNA, 32 nt, Human
uggccaacaugacaaaaccccgucucuacuaa

SEQ ID NO: 256656 - RNA, 32 nt, Human
uggccaacaugacgaaaccccaucucuacuaa

SEQ ID NO: 256657 - RNA, 32 nt, Human
uggccaacaugacgaaaccccgucucuacuaa

SEQ ID NO: 256658 - RNA, 32 nt, Human
uggccaacaugauaaaacaccgucucugcuag

SEQ ID NO: 256659 - RNA, 32 nt, Human
uggccaacaugaugaaaccccaucuccacuaa

SEQ ID NO: 256660 - RNA, 32 nt, Human
uggccaacaugaugaaaccccaucucuacuaa

SEQ ID NO: 256661 - RNA, 32 nt, Human
uggccaacaugaugaaaccccgucucuaccaa

SEQ ID NO: 256662 - RNA, 32 nt, Human
uggccaacaugaugaaaccccgucucuacuaa

SEQ ID NO: 256663 - RNA, 32 nt, Human
uggccaacaugaugaaaccccgucucuacuac

SEQ ID NO: 256664 - RNA, 32 nt, Human
uggccaacauggagaaaccccaucucuaccaa

SEQ ID NO: 256665 - RNA, 32 nt, Human
uggccaacauggagaaaccccaucucuacuaa

SEQ ID NO: 256666 - RNA, 32 nt, Human
uggccaacauggagaaaccccgucucuacuaa

SEQ ID NO: 256667 - RNA, 32 nt, Human
uggccaacauggcaaaaacccaucucuucuaa

SEQ ID NO: 256668 - RNA, 32 nt, Human
uggccaacauggcaaaaaccugucucuacuaa

SEQ ID NO: 256669 - RNA, 32 nt, Human
uggccaacauggcaaaaccacaucucuacuaa

SEQ ID NO: 256670 - RNA, 32 nt, Human
uggccaacauggcaaaaccaucucuacuaaaa

SEQ ID NO: 256671 - RNA, 32 nt, Human
uggccaacauggcaaaaccccaucacuaaaaa

SEQ ID NO: 256672 - RNA, 32 nt, Human
uggccaacauggcaaaaccccaucuccacaaa

SEQ ID NO: 256673 - RNA, 32 nt, Human
uggccaacauggcaaaaccccaucucuaccaa

SEQ ID NO: 256674 - RNA, 32 nt, Human
uggccaacauggcaaaaccccaucucuacuaa

SEQ ID NO: 256675 - RNA, 32 nt, Human
uggccaacauggcaaaaccccaucucuacuga

SEQ ID NO: 256676 - RNA, 32 nt, Human
uggccaacauggcaaaaccccaucuuuacuaa

SEQ ID NO: 256677 - RNA, 32 nt, Human
uggccaacauggcaaaaccccaugucuacuaa

SEQ ID NO: 256678 - RNA, 32 nt, Human
uggccaacauggcaaaacccccaucucgacua

SEQ ID NO: 256679 - RNA, 32 nt, Human
uggccaacauggcaaaacccccgucucuacua

SEQ ID NO: 256680 - RNA, 32 nt, Human
uggccaacauggcaaaacccccucuuuacuaa

SEQ ID NO: 256681 - RNA, 32 nt, Human
uggccaacauggcaaaaccccgucucuacuaa

SEQ ID NO: 256682 - RNA, 32 nt, Human
uggccaacauggcaaaaccccgucuguacuca

SEQ ID NO: 256683 - RNA, 32 nt, Human
uggccaacauggcaaaaccccuucucuacuaa

SEQ ID NO: 256684 - RNA, 32 nt, Human
uggccaacauggcaaaacccgucucuacuaaa

SEQ ID NO: 256685 - RNA, 32 nt, Human
uggccaacauggcaaaacccuaucucuacuaa

SEQ ID NO: 256686 - RNA, 29 nt, Human
uggccaacauggcaaaacccugccucuac

SEQ ID NO: 256687 - RNA, 32 nt, Human
uggccaacauggcaaaacccuguaucugugaa

SEQ ID NO: 256688 - RNA, 32 nt, Human
uggccaacauggcaaaacccugucgcuacaaa

SEQ ID NO: 256689 - RNA, 32 nt, Human
uggccaacauggcaaaacccugucuacuaaaa

SEQ ID NO: 256690 - RNA, 32 nt, Human
uggccaacauggcaaaacccugucucuacuaa

SEQ ID NO: 256691 - RNA, 32 nt, Human
uggccaacauggcaaaacccugucucugcuaa

SEQ ID NO: 256692 - RNA, 32 nt, Human
uggccaacauggcaaaaccucaucucuacuaa

SEQ ID NO: 256693 - RNA, 32 nt, Human
uggccaacauggcaaaaccuugucuccacuaa

SEQ ID NO: 256694 - RNA, 32 nt, Human
uggccaacauggcaaaaccuugucucuacuaa

SEQ ID NO: 256695 - RNA, 32 nt, Human
uggccaacauggcaaaaucccaucucuacuaa

SEQ ID NO: 256696 - RNA, 32 nt, Human
uggccaacauggcaaaaucccgucucuacuaa

SEQ ID NO: 256697 - RNA, 32 nt, Human
uggccaacauggcaacaccccgucucuaauaa

SEQ ID NO: 256698 - RNA, 32 nt, Human
uggccaacauggcaagaccccaucucuacuaa

SEQ ID NO: 256699 - RNA, 32 nt, Human
uggccaacauggcagaaaccccaucucuacua

SEQ ID NO: 256700 - RNA, 32 nt, Human
uggccaacauggcgaaaacccaucucuacuaa

SEQ ID NO: 256701 - RNA, 32 nt, Human
uggccaacauggcgaaacaccugucucuacua

SEQ ID NO: 256702 - RNA, 32 nt, Human
uggccaacauggcgaaaccccaucgcuacuaa

SEQ ID NO: 256703 - RNA, 32 nt, Human
uggccaacauggcgaaaccccaucucuaccga

SEQ ID NO: 256704 - RNA, 30 nt, Human
uggccaacauggcgaaaccccaucucuacu

SEQ ID NO: 256705 - RNA, 32 nt, Human
uggccaacauggcgaaaccccaucucuacuaa

SEQ ID NO: 256706 - RNA, 32 nt, Human
uggccaacauggcgaaaccccaucucuacuua

SEQ ID NO: 256707 - RNA, 32 nt, Human
uggccaacauggcgaaaccccaucucugcuaa

SEQ ID NO: 256708 - RNA, 32 nt, Human
uggccaacauggcgaaaccccauuucuacuaa

SEQ ID NO: 256709 - RNA, 30 nt, Human
uggccaacauggcgaaaccccgucucuacu

SEQ ID NO: 256710 - RNA, 32 nt, Human
uggccaacauggcgaaaccccgucucuacuaa

SEQ ID NO: 256711 - RNA, 32 nt, Human
uggccaacauggcgaaaccccgucucuacuau

SEQ ID NO: 256712 - RNA, 32 nt, Human
uggccaacauggcgaaaccccgucucuauuaa

SEQ ID NO: 256713 - RNA, 32 nt, Human
uggccaacauggcgaaaccccgucuuuacuaa

SEQ ID NO: 256714 - RNA, 32 nt, Human
uggccaacauggcgaaaccccucucuacuaaa

SEQ ID NO: 256715 - RNA, 32 nt, Human
uggccaacauggcgaaaccccuucucuacuaa

SEQ ID NO: 256716 - RNA, 32 nt, Human
uggccaacauggcgaaacccuaucucuacuaa

SEQ ID NO: 256717 - RNA, 32 nt, Human
uggccaacauggcgaaacccuaucucuccuaa

SEQ ID NO: 256718 - RNA, 32 nt, Human
uggccaacauggcgaaacccugucucuacuaa

SEQ ID NO: 256719 - RNA, 32 nt, Human
uggccaacauggcgaaaccucaucucuacuaa

SEQ ID NO: 256720 - RNA, 32 nt, Human
uggccaacauggcgaaaccucauuucuacuaa

SEQ ID NO: 256721 - RNA, 32 nt, Human
uggccaacauggcgaaaccucgccucuacuaa

SEQ ID NO: 256722 - RNA, 32 nt, Human
uggccaacauggcgaaaccucuucucuacuaa

SEQ ID NO: 256723 - RNA, 32 nt, Human
uggccaacauggcgaaacuccgucacuacuaa

SEQ ID NO: 256724 - RNA, 30 nt, Human
uggccaacauggcgaaaucccgucuuuacc

SEQ ID NO: 256725 - RNA, 32 nt, Human
uggccaacauggcgaaauuccaucucuaguaa

SEQ ID NO: 256726 - RNA, 32 nt, Human
uggccaacauggcgaauucccguucucuacua

SEQ ID NO: 256727 - RNA, 32 nt, Human
uggccaacauggcgagaccccaucucuacuaa

SEQ ID NO: 256728 - RNA, 32 nt, Human
uggccaacauggcggaaccccaucuccacuaa

SEQ ID NO: 256729 - RNA, 32 nt, Human
uggccaacauggcggaacccugucucuaccaa

SEQ ID NO: 256730 - RNA, 32 nt, Human
uggccaacauggggaaaccccaucucuacuaa

SEQ ID NO: 256731 - RNA, 32 nt, Human
uggccaacauggggaaaccccgucucuacuaa

SEQ ID NO: 256732 - RNA, 32 nt, Human
uggccaacauggggaaacuccgucucuacuaa

SEQ ID NO: 256733 - RNA, 32 nt, Human
uggccaacauggggaaaucccaucucuacuaa

SEQ ID NO: 256734 - RNA, 32 nt, Human
uggccaacaugguaaaaccccaucucuacuaa

SEQ ID NO: 256735 - RNA, 32 nt, Human
uggccaacaugguaaaaccccgucucuacuaa

SEQ ID NO: 256736 - RNA, 32 nt, Human
uggccaacaugguaaaacgccgucucuacuaa

SEQ ID NO: 256737 - RNA, 32 nt, Human
uggccaacaugguaaaaucccgucucuacuaa

SEQ ID NO: 256738 - RNA, 32 nt, Human
uggccaacauggucaaaacccgucucuacuaa

SEQ ID NO: 256739 - RNA, 32 nt, Human
uggccaacauggucccagcugcagggcagcca

SEQ ID NO: 256740 - RNA, 32 nt, Human
uggccaacauggugaaaacccaucucuauuaa

SEQ ID NO: 256741 - RNA, 32 nt, Human
uggccaacauggugaaaacccaucucugcuga

SEQ ID NO: 256742 - RNA, 32 nt, Human
uggccaacauggugaaaccccaucuccacaaa

SEQ ID NO: 256743 - RNA, 32 nt, Human
uggccaacauggugaaaccccaucuccacuaa

SEQ ID NO: 256744 - RNA, 32 nt, Human
uggccaacauggugaaaccccaucucuacaaa

SEQ ID NO: 256745 - RNA, 32 nt, Human
uggccaacauggugaaaccccaucucuacagu

SEQ ID NO: 256746 - RNA, 32 nt, Human
uggccaacauggugaaaccccaucucuaccaa

SEQ ID NO: 256747 - RNA, 30 nt, Human
uggccaacauggugaaaccccaucucuacu

SEQ ID NO: 256748 - RNA, 32 nt, Human
uggccaacauggugaaaccccaucucuacuaa

SEQ ID NO: 256749 - RNA, 32 nt, Human
uggccaacauggugaaaccccaucucuacuag

SEQ ID NO: 256750 - RNA, 32 nt, Human
uggccaacauggugaaaccccaucucuacuga

SEQ ID NO: 256751 - RNA, 32 nt, Human
uggccaacauggugaaaccccaucucuaucag

SEQ ID NO: 256752 - RNA, 32 nt, Human
uggccaacauggugaaaccccaucucuauuaa

SEQ ID NO: 256753 - RNA, 32 nt, Human
uggccaacauggugaaaccccaucucuauuau

SEQ ID NO: 256754 - RNA, 32 nt, Human
uggccaacauggugaaaccccaucucugcuaa

SEQ ID NO: 256755 - RNA, 32 nt, Human
uggccaacauggugaaaccccgucuccacuaa

SEQ ID NO: 256756 - RNA, 32 nt, Human
uggccaacauggugaaaccccgucucuacaaa

SEQ ID NO: 256757 - RNA, 32 nt, Human
uggccaacauggugaaaccccgucucuaccaa

SEQ ID NO: 256758 - RNA, 32 nt, Human
uggccaacauggugaaaccccgucucuacuaa

SEQ ID NO: 256759 - RNA, 32 nt, Human
uggccaacauggugaaaccccgucucuacuua

SEQ ID NO: 256760 - RNA, 32 nt, Human
uggccaacauggugaaaccccgucucuaguaa

SEQ ID NO: 256761 - RNA, 32 nt, Human
uggccaacauggugaaaccccgucucuauuaa

SEQ ID NO: 256762 - RNA, 32 nt, Human
uggccaacauggugaaaccccgucucuauuac

SEQ ID NO: 256763 - RNA, 32 nt, Human
uggccaacauggugaaacgccaucucuaccaa

SEQ ID NO: 256764 - RNA, 32 nt, Human
uggccaacauggugaaacgccaucucuacuaa

SEQ ID NO: 256765 - RNA, 32 nt, Human
uggccaacauggugaaacuccaucucuacuaa

SEQ ID NO: 256766 - RNA, 32 nt, Human
uggccaacauggugaaacuccaucucuccuaa

SEQ ID NO: 256767 - RNA, 32 nt, Human
uggccaacauggugaaacuccgucucuacuaa

SEQ ID NO: 256768 - RNA, 32 nt, Human
uggccaacauggugaaacuccgucucugcuaa

SEQ ID NO: 256769 - RNA, 32 nt, Human
uggccaacauggugaaaucccaucucuacuga

SEQ ID NO: 256770 - RNA, 32 nt, Human
uggccaacauggugaaaucccgucucuacuaa

SEQ ID NO: 256771 - RNA, 32 nt, Human
uggccaacauggugaaaucccgucucuacugc

SEQ ID NO: 256772 - RNA, 32 nt, Human
uggccaacauggugaaaugccgucucuacuaa

SEQ ID NO: 256773 - RNA, 32 nt, Human
uggccaacauggugaaccccaucucuacuaaa

SEQ ID NO: 256774 - RNA, 30 nt, Human
uggccaacauggugaagccccaucucuacu

SEQ ID NO: 256775 - RNA, 32 nt, Human
uggccaacauggugaagcuccgucucuacuaa

SEQ ID NO: 256776 - RNA, 32 nt, Human
uggccaacauggugaagucccgucucuacuaa

SEQ ID NO: 256777 - RNA, 32 nt, Human
uggccaacauggugaauccccgucucuauuaa

SEQ ID NO: 256778 - RNA, 32 nt, Human
uggccaacauggugacaccccgucucuacuaa

SEQ ID NO: 256779 - RNA, 32 nt, Human
uggccaacauggugagacaccgucucuacuaa

SEQ ID NO: 256780 - RNA, 32 nt, Human
uggccaacauggugagaccccaucucuacaaa

SEQ ID NO: 256781 - RNA, 32 nt, Human
uggccaacauggugagaccccaucucugcuaa

SEQ ID NO: 256782 - RNA, 32 nt, Human
uggccaacauggugagcccccgucucuacuaa

SEQ ID NO: 256783 - RNA, 32 nt, Human
uggccaacaugguuaaaccccaucucuacgaa

SEQ ID NO: 256784 - RNA, 32 nt, Human
uggccaacaugguuaaaccccgucucuacuaa

SEQ ID NO: 256785 - RNA, 32 nt, Human
uggccaacaugucgaagugccaucucuacuaa

SEQ ID NO: 256786 - RNA, 32 nt, Human
uggccaacaugugaaaccccgucuccacugaa

SEQ ID NO: 256787 - RNA, 32 nt, Human
uggccaacauuguaaaaccccaucucuacuaa

SEQ ID NO: 256788 - RNA, 32 nt, Human
uggccaacauugugaaaccccaucucuacaaa

SEQ ID NO: 256789 - RNA, 32 nt, Human
uggccaacauugugaaaccccaucucugccaa

SEQ ID NO: 256790 - RNA, 24 nt, Human
uggccaacccagcaguccuucccu

SEQ ID NO: 256791 - RNA, 32 nt, Human
uggccaacccagccuggucaacauggugaaac

SEQ ID NO: 256792 - RNA, 32 nt, Human
uggccaaccccacagggagcucuggaguuaaa

SEQ ID NO: 256793 - RNA, 32 nt, Human
uggccaaccugccuuuccccagaaggagugau

SEQ ID NO: 256794 - RNA, 32 nt, Human
uggccaaccuggugaaaccccaucucugcuaa

SEQ ID NO: 256795 - RNA, 32 nt, Human
uggccaaccuggugaaaccccgucucuauuaa

SEQ ID NO: 256796 - RNA, 32 nt, Human
uggccaacgcccgagugucuguuuucaggagc

SEQ ID NO: 256797 - RNA, 32 nt, Human
uggccaacguagugaaaccccgucucuacaaa

SEQ ID NO: 256798 - RNA, 32 nt, Human
uggccaacgugaugaaacuccaucucuacaaa

SEQ ID NO: 256799 - RNA, 32 nt, Human
uggccaacguggcaaaaccccaucucuacuaa

SEQ ID NO: 256800 - RNA, 32 nt, Human
uggccaacguggcaaaaccccgucucuacuaa

SEQ ID NO: 256801 - RNA, 32 nt, Human
uggccaacguggcaaaacuccaucucuauuaa

SEQ ID NO: 256802 - RNA, 32 nt, Human
uggccaacguggcaaauacccaucucuacuaa

SEQ ID NO: 256803 - RNA, 32 nt, Human
uggccaacguggggaaaccccaucucuacgaa

SEQ ID NO: 256804 - RNA, 32 nt, Human
uggccaacguggugaaacaccgucucuacuaa

SEQ ID NO: 256805 - RNA, 32 nt, Human
uggccaacguggugaaaccccaucucuacuaa

SEQ ID NO: 256806 - RNA, 32 nt, Human
uggccaacguggugaaaccccgucucuacuaa

SEQ ID NO: 256807 - RNA, 32 nt, Human
uggccaacguggugaaaccccgucucuacuga

SEQ ID NO: 256808 - RNA, 32 nt, Human
uggccaacuucaacauacccuggaccaaaaca

SEQ ID NO: 256809 - RNA, 32 nt, Human
uggccaacuucugaacaggaagcaguucgcuc

SEQ ID NO: 256810 - RNA, 32 nt, Human
uggccaacuugaugaaaccccaucucuacccg

SEQ ID NO: 256811 - RNA, 32 nt, Human
uggccaacuuggugaaaccccaucucuacaaa

SEQ ID NO: 256812 - RNA, 32 nt, Human
uggccaacuuggugaaaccccgucuuuacuaa

SEQ ID NO: 256813 - RNA, 32 nt, Human
uggccaagagggcugaggucugacccugcuuu

SEQ ID NO: 256814 - RNA, 32 nt, Human
uggccaagauggugaaaccccaucucuacuaa

SEQ ID NO: 256815 - RNA, 32 nt, Human
uggccaagauggugaaaccccaucucugcaaa

SEQ ID NO: 256816 - RNA, 32 nt, Human
uggccaagauggugaaaucccaucucuacaaa

SEQ ID NO: 256817 - RNA, 32 nt, Human
uggccaagcccuccucuucccagaauuggccc

SEQ ID NO: 256818 - RNA, 32 nt, Human
uggccaagccuggcccuuaaacaacugcagaa

SEQ ID NO: 256819 - RNA, 32 nt, Human
uggccaagcuacuagaaugcagcuaggaaagu

SEQ ID NO: 256820 - RNA, 32 nt, Human
uggccaaggagaaaucaaaguccuuccuaaau

SEQ ID NO: 256821 - RNA, 32 nt, Human
uggccaaggcuuccugcauugcuucccuguga

SEQ ID NO: 256822 - RNA, 32 nt, Human
uggccaagggccugaugcugugguccuguuug

SEQ ID NO: 256823 - RNA, 15 nt, Human
uggccaagguccagc

SEQ ID NO: 256824 - RNA, 32 nt, Human
uggccaaguaguacagcuagagcccagggucc

SEQ ID NO: 256825 - RNA, 17 nt, Human
uggccaaguaugggguc

SEQ ID NO: 256826 - RNA, 21 nt, Human
uggccaaguccaaggucacac

SEQ ID NO: 256827 - RNA, 32 nt, Human
uggccaagucucugagaucuucucccagggcg

SEQ ID NO: 256828 - RNA, 32 nt, Human
uggccaauaaggugaaacuccaucucuacuaa

SEQ ID NO: 256829 - RNA, 32 nt, Human
uggccaauagaagagacaggagacaggaagcc

SEQ ID NO: 256830 - RNA, 32 nt, Human
uggccaauaugaugaaaccccaucucuacuaa

SEQ ID NO: 256831 - RNA, 32 nt, Human
uggccaauaugcaaaaccacaucucuacuaaa

SEQ ID NO: 256832 - RNA, 32 nt, Human
uggccaauaugcgaaaccacaucucuacuaaa

SEQ ID NO: 256833 - RNA, 32 nt, Human
uggccaauauggcaaaaccccaucucuacuaa

SEQ ID NO: 256834 - RNA, 32 nt, Human
uggccaauauggcgaaaccccaucucuacuaa

SEQ ID NO: 256835 - RNA, 32 nt, Human
uggccaauauggugaaaccccaucucuacaaa

SEQ ID NO: 256836 - RNA, 32 nt, Human
uggccaauauggugaaaccccaucucuacuaa

SEQ ID NO: 256837 - RNA, 32 nt, Human
uggccaauauggugaaaccccgucucuacuaa

SEQ ID NO: 256838 - RNA, 32 nt, Human
uggccaauauggugagaccccaucucuacuaa

SEQ ID NO: 256839 - RNA, 31 nt, Human
uggccaaugaacacaagcagauuugcagauc

SEQ ID NO: 256840 - RNA, 32 nt, Human
uggccaauggagacagaggcuuagugcagagc

SEQ ID NO: 256841 - RNA, 32 nt, Human
uggccaaugugaugaaaccccgucucuacuaa

SEQ ID NO: 256842 - RNA, 32 nt, Human
uggccaauguggugaaaccccaucucuacuaa

SEQ ID NO: 256843 - RNA, 32 nt, Human
uggccaauguggugaaacuccaucucuucuaa

SEQ ID NO: 256844 - RNA, 32 nt, Human
uggccaauucucccaggaguccuggccacuuu

SEQ ID NO: 256845 - RNA, 32 nt, Human
uggccaauuggagcaucucugauguccagcaa

SEQ ID NO: 256846 - RNA, 32 nt, Human
uggccacaagcuuuuucuauccuguuuucaug

SEQ ID NO: 256847 - RNA, 32 nt, Human
uggccacaaggccaguggcaccugccagaggg

SEQ ID NO: 256848 - RNA, 26 nt, Human
uggccacaagugaucugcccgccuua

SEQ ID NO: 256849 - RNA, 18 nt, Human
uggccacacacucagcca

SEQ ID NO: 256850 - RNA, 32 nt, Human
uggccacacagcugcccccaucgccuggcggg

SEQ ID NO: 256851 - RNA, 32 nt, Human
uggccacaccagccgucggccucccaggcugu

SEQ ID NO: 256852 - RNA, 32 nt, Human
uggccacaccuugccuccucuucccgucccag

SEQ ID NO: 256853 - RNA, 32 nt, Human
uggccacacuggggcugccuuucucugacucu

SEQ ID NO: 256854 - RNA, 23 nt, Human
uggccacacuuggcagcccuccu

SEQ ID NO: 256855 - RNA, 32 nt, Human
uggccacagaacuuggcucaggagaugacaug

SEQ ID NO: 256856 - RNA, 32 nt, Human
uggccacagagcaugggcugggccugggcaca

SEQ ID NO: 256857 - RNA, 19 nt, Human
uggccacagcagcgcgagg

SEQ ID NO: 256858 - RNA, 32 nt, Human
uggccacagcugugugcucagucagugcacug

SEQ ID NO: 256859 - RNA, 32 nt, Human
uggccacaggcagguccagucacugcaaaagu

SEQ ID NO: 256860 - RNA, 32 nt, Human
uggccacaggcaguagaggaggaaugaggaug

SEQ ID NO: 256861 - RNA, 32 nt, Human
uggccacaggcuagauccccggugguuuugug

SEQ ID NO: 256862 - RNA, 32 nt, Human
uggccacaggggcucaccugggccccauggcu

SEQ ID NO: 256863 - RNA, 32 nt, Human
uggccacaggugacacuugguccuugcugcca

SEQ ID NO: 256864 - RNA, 32 nt, Human
uggccacauagcccccagccaggagagaugac

SEQ ID NO: 256865 - RNA, 32 nt, Human
uggccacauggugaaacccugucucuacuaaa

SEQ ID NO: 256866 - RNA, 32 nt, Human
uggccacauggugcaaccccgucuuaguaaaa

SEQ ID NO: 256867 - RNA, 32 nt, Human
uggccaccacuccaccagaugggcagagcagc

SEQ ID NO: 256868 - RNA, 21 nt, Human
uggccaccagcaggcccuugg

SEQ ID NO: 256869 - RNA, 32 nt, Human
uggccaccagccucgucacauacaccagcauc

SEQ ID NO: 256870 - RNA, 32 nt, Human
uggccaccauggcaaaugcugagaucugaggg

SEQ ID NO: 256871 - RNA, 32 nt, Human
uggccaccauggugagaccccgucucuacuaa

SEQ ID NO: 256872 - RNA, 32 nt, Human
uggccaccaugucugcacacaccagaaaugga

SEQ ID NO: 256873 - RNA, 32 nt, Human
uggccacccaccucacugacagucuuccuuuc

SEQ ID NO: 256874 - RNA, 32 nt, Human
uggccaccccgcugccccauggcuggcugggu

SEQ ID NO: 256875 - RNA, 21 nt, Human
uggccaccggcccaacugcag

SEQ ID NO: 256876 - RNA, 32 nt, Human
uggccaccguggcgaaacaccgucucuacuaa

SEQ ID NO: 256877 - RNA, 20 nt, Human
uggccaccguguucccagca

SEQ ID NO: 256878 - RNA, 19 nt, Human
uggccaccuacccgagaga

SEQ ID NO: 256879 - RNA, 19 nt, Human
uggccaccuccccucccca

SEQ ID NO: 256880 - RNA, 32 nt, Human
uggccaccuccccuccccacagccuuccucac

SEQ ID NO: 256881 - RNA, 32 nt, Human
uggccaccuccccugcuucucccugggcugug

SEQ ID NO: 256882 - RNA, 19 nt, Human
uggccaccuccucugcaca

SEQ ID NO: 256883 - RNA, 32 nt, Human
uggccaccucucuccuuugcugaggccuccag

SEQ ID NO: 256884 - RNA, 22 nt, Human
uggccaccugagaccugcucca

SEQ ID NO: 256885 - RNA, 32 nt, Human
uggccaccugcaggaugugcagggcugccuca

SEQ ID NO: 256886 - RNA, 32 nt, Human
uggccaccugugucacccuugugccuuagccu

SEQ ID NO: 256887 - RNA, 23 nt, Human
uggccacgacccagcccuccccc

SEQ ID NO: 256888 - RNA, 32 nt, Human
uggccacgccuccugagaccacuuggaaacag

SEQ ID NO: 256889 - RNA, 22 nt, Human
uggccacgcugcugaucguccu

SEQ ID NO: 256890 - RNA, 32 nt, Human
uggccacggaaacugguucacugguuggcacc

SEQ ID NO: 256891 - RNA, 32 nt, Human
uggccacggaacccaccaugcacugcaaggcu

SEQ ID NO: 256892 - RNA, 32 nt, Human
uggccacggcugcuugugaaugcagcuuugcc

SEQ ID NO: 256893 - RNA, 32 nt, Human
uggccacgggaggcggggcugcauggcugggg

SEQ ID NO: 256894 - RNA, 32 nt, Human
uggccacgucacaaccucugaucucagaccgu

SEQ ID NO: 256895 - RNA, 32 nt, Human
uggccacgugcagaagaagugcggcugggggc

SEQ ID NO: 256896 - RNA, 32 nt, Human
uggccacguguagccccagcugucugcaggca

SEQ ID NO: 256897 - RNA, 32 nt, Human
uggccacuagagacagcccagccugggccaug

SEQ ID NO: 256898 - RNA, 32 nt, Human
uggccacucacauccaggucucugccuggcua

SEQ ID NO: 256899 - RNA, 32 nt, Human
uggccacucccagcacaauuuggagugucaag

SEQ ID NO: 256900 - RNA, 21 nt, Human
uggccacugagcccccuugga

SEQ ID NO: 256901 - RNA, 32 nt, Human
uggccacugaggaaccacacugugcugcggaa

SEQ ID NO: 256902 - RNA, 32 nt, Human
uggccacugcaagcuccaccucccagguucac

SEQ ID NO: 256903 - RNA, 32 nt, Human
uggccacugcaauccagccugggcgauagagu

SEQ ID NO: 256904 - RNA, 32 nt, Human
uggccacugcauucaaauuccaauguguacuu

SEQ ID NO: 256905 - RNA, 32 nt, Human
uggccacugcccucguccccagccugcacucc

SEQ ID NO: 256906 - RNA, 32 nt, Human
uggccacugcgucuggcauuccugggucguua

SEQ ID NO: 256907 - RNA, 32 nt, Human
uggccacugcucccuaagccagccugguccau

SEQ ID NO: 256908 - RNA, 18 nt, Human
uggccacuggcacacuua

SEQ ID NO: 256909 - RNA, 32 nt, Human
uggccacugggcugggcuggagucuggcuggu

SEQ ID NO: 256910 - RNA, 32 nt, Human
uggccacugugcguuacagccuggaggggcgc

SEQ ID NO: 256911 - RNA, 19 nt, Human
uggccacugugggagggaa

SEQ ID NO: 256912 - RNA, 32 nt, Human
uggccacuucacuaucuucuucaaauacaaag

SEQ ID NO: 256913 - RNA, 32 nt, Human
uggccacuucucugauccucuggccaacacac

SEQ ID NO: 256914 - RNA, 32 nt, Human
uggccacuugacuuguggaaggccaucuugau

SEQ ID NO: 256915 - RNA, 32 nt, Human
uggccacuugaguuuguccuccaaggguaggu

SEQ ID NO: 256916 - RNA, 30 nt, Human
uggccagaaagccacaagcgcaaucaugcu

SEQ ID NO: 256917 - RNA, 32 nt, Human
uggccagaaagccacaagcgcaaucaugcuuu

SEQ ID NO: 256918 - RNA, 32 nt, Human
uggccagaaauaaaguuccucccaguuccaga

SEQ ID NO: 256919 - RNA, 32 nt, Human
uggccagaacuccaaccauguggaaucugagg

SEQ ID NO: 256920 - RNA, 32 nt, Human
uggccagaagauggcagcaaaccaccagcuuc

SEQ ID NO: 256921 - RNA, 32 nt, Human
uggccagacaacacucacugcaggccuuagcc

SEQ ID NO: 256922 - RNA, 27 nt, Human
uggccagacucugacccaccuaccuca

SEQ ID NO: 256923 - RNA, 32 nt, Human
uggccagacucugacccaccuaccucagcugg

SEQ ID NO: 256924 - RNA, 32 nt, Human
uggccagacuggucucaaacuccugggcugaa

SEQ ID NO: 256925 - RNA, 32 nt, Human
uggccagacugugccagaacauggugacagac

SEQ ID NO: 256926 - RNA, 32 nt, Human
uggccagagacaccuccaggccguagccuggg

SEQ ID NO: 256927 - RNA, 32 nt, Human
uggccagagagcuguucuuguuucugguguug

SEQ ID NO: 256928 - RNA, 32 nt, Human
uggccagagaggaggagaaggagggugagagg

SEQ ID NO: 256929 - RNA, 32 nt, Human
uggccagagagggaaggugaacagcagaagac

SEQ ID NO: 256930 - RNA, 32 nt, Human
uggccagagauaaaauuccucccaguuccaga

SEQ ID NO: 256931 - RNA, 32 nt, Human
uggccagagaugcuggacuugccuaaauauau

SEQ ID NO: 256932 - RNA, 32 nt, Human
uggccagagcacaggugcccuuuugucaggau

SEQ ID NO: 256933 - RNA, 32 nt, Human
uggccagagcuccuugccaucugcuaagaaga

SEQ ID NO: 256934 - RNA, 19 nt, Human
uggccagaggcaggguggc

SEQ ID NO: 256935 - RNA, 32 nt, Human
uggccagaggcucgaggggcucaggggcucag

SEQ ID NO: 256936 - RNA, 32 nt, Human
uggccagagucaggggacagggagagagcucc

SEQ ID NO: 256937 - RNA, 32 nt, Human
uggccagagucaggggacagggagggagcucc

SEQ ID NO: 256938 - RNA, 32 nt, Human
uggccagagugcccugaagcaccacuaccaac

SEQ ID NO: 256939 - RNA, 32 nt, Human
uggccagagugcgucuggagggaacacggcau

SEQ ID NO: 256940 - RNA, 32 nt, Human
uggccagauaaauuaagucaaacauuugguuu

SEQ ID NO: 256941 - RNA, 32 nt, Human
uggccagaugcacugggaacagagccacgggu

SEQ ID NO: 256942 - RNA, 32 nt, Human
uggccagauuccagauaguauugugaacaaga

SEQ ID NO: 256943 - RNA, 32 nt, Human
uggccagauucugcccuuaggauccaaaccuu

SEQ ID NO: 256944 - RNA, 32 nt, Human
uggccagcaaggugaaaccccaucucuacuaa

SEQ ID NO: 256945 - RNA, 32 nt, Human
uggccagcacacugcuaaccagucaccaaaug

SEQ ID NO: 256946 - RNA, 32 nt, Human
uggccagcacagagccggggcguugauucuga

SEQ ID NO: 256947 - RNA, 32 nt, Human
uggccagcacggugaaaccccgucucugcuga

SEQ ID NO: 256948 - RNA, 21 nt, Human
uggccagcacugcucccggca

SEQ ID NO: 256949 - RNA, 32 nt, Human
uggccagcacugggugagaguggggagggggc

SEQ ID NO: 256950 - RNA, 32 nt, Human
uggccagcaggguuuguggccgccucugcugu

SEQ ID NO: 256951 - RNA, 32 nt, Human
uggccagcaguguccuccagcacuuccauuuu

SEQ ID NO: 256952 - RNA, 32 nt, Human
uggccagcauagugaaaccccaucucuacuaa

SEQ ID NO: 256953 - RNA, 32 nt, Human
uggccagcauggcaaaaccccgucucuacuaa

SEQ ID NO: 256954 - RNA, 32 nt, Human
uggccagcauggcgaaaccccaucucuacuaa

SEQ ID NO: 256955 - RNA, 32 nt, Human
uggccagcauggugaaaccccaucucuaccaa

SEQ ID NO: 256956 - RNA, 32 nt, Human
uggccagcauggugaaaccccaucucuacuaa

SEQ ID NO: 256957 - RNA, 32 nt, Human
uggccagcauggugaaaccccaucucuacuau

SEQ ID NO: 256958 - RNA, 32 nt, Human
uggccagcauggugaaaccccgucucuacuaa

SEQ ID NO: 256959 - RNA, 32 nt, Human
uggccagcauggugaaacccugucuuuacuaa

SEQ ID NO: 256960 - RNA, 32 nt, Human
uggccagcauggugagaccccgucucuauuaa

SEQ ID NO: 256961 - RNA, 32 nt, Human
uggccagcauugaggaauuccacagacacaua

SEQ ID NO: 256962 - RNA, 32 nt, Human
uggccagccagccugacguggcugccuuccuc

SEQ ID NO: 256963 - RNA, 32 nt, Human
uggccagccagguggaagaaaguuuccaagcu

SEQ ID NO: 256964 - RNA, 32 nt, Human
uggccagcccagaaccccuggccagucgcugg

SEQ ID NO: 256965 - RNA, 32 nt, Human
uggccagcccaggagaucaucaugcaaucguc

SEQ ID NO: 256966 - RNA, 18 nt, Human
uggccagccuccacuccc

SEQ ID NO: 256967 - RNA, 32 nt, Human
uggccagccuccagcuccucagaccuccuggg

SEQ ID NO: 256968 - RNA, 32 nt, Human
uggccagccuccagcucucagccaggaggucc

SEQ ID NO: 256969 - RNA, 18 nt, Human
uggccagccuuccccagu

SEQ ID NO: 256970 - RNA, 32 nt, Human
uggccagcucaagguguuuccuuuugccuggu

SEQ ID NO: 256971 - RNA, 32 nt, Human
uggccagcucugcauuugacaaaugccaggaa

SEQ ID NO: 256972 - RNA, 21 nt, Human
uggccagcugcccaccccagu

SEQ ID NO: 256973 - RNA, 32 nt, Human
uggccagcugcucagggcucaggcuggggccu

SEQ ID NO: 256974 - RNA, 32 nt, Human
uggccagcugguccccgcuacauucaaccaau

SEQ ID NO: 256975 - RNA, 20 nt, Human
uggccagcuucuucagcaag

SEQ ID NO: 256976 - RNA, 32 nt, Human
uggccaggaaagggcaguccugagggagaaga

SEQ ID NO: 256977 - RNA, 32 nt, Human
uggccaggaaggcacaagguagcugugggcca

SEQ ID NO: 256978 - RNA, 32 nt, Human
uggccaggacagugaugccaccagggagagcu

SEQ ID NO: 256979 - RNA, 32 nt, Human
uggccaggagcuccuggcugggacacggagag

SEQ ID NO: 256980 - RNA, 32 nt, Human
uggccaggaguugggagaccagccuggggacc

SEQ ID NO: 256981 - RNA, 20 nt, Human
uggccaggaucccccacuuc

SEQ ID NO: 256982 - RNA, 32 nt, Human
uggccaggaugcauagaggagauucuagcagg

SEQ ID NO: 256983 - RNA, 32 nt, Human
uggccaggcacagagccaggugcuuuacaugu

SEQ ID NO: 256984 - RNA, 32 nt, Human
uggccaggcagaggucuguggaguggagaggc

SEQ ID NO: 256985 - RNA, 32 nt, Human
uggccaggcagagucagcagcugcagugugga

SEQ ID NO: 256986 - RNA, 32 nt, Human
uggccaggcagggagagaguagcugcagccuu

SEQ ID NO: 256987 - RNA, 18 nt, Human
uggccaggccacaguaaa

SEQ ID NO: 256988 - RNA, 21 nt, Human
uggccaggccagagcugcagc

SEQ ID NO: 256989 - RNA, 32 nt, Human
uggccaggccugagacacagaggcccacugcg

SEQ ID NO: 256990 - RNA, 32 nt, Human
uggccaggcuagucucaaaccccugaccuuag

SEQ ID NO: 256991 - RNA, 32 nt, Human
uggccaggcucgaagcagucucuguuuccagc

SEQ ID NO: 256992 - RNA, 20 nt, Human
uggccaggcugacugguccc

SEQ ID NO: 256993 - RNA, 32 nt, Human
uggccaggcugcucucaaaccccugaccucaa

SEQ ID NO: 256994 - RNA, 32 nt, Human
uggccaggcuggucucgaaccccugagcucag

SEQ ID NO: 256995 - RNA, 32 nt, Human
uggccaggcuggucuggaaccccuggccucgg

SEQ ID NO: 256996 - RNA, 32 nt, Human
uggccaggcuggucuugaaccccugaccucag

SEQ ID NO: 256997 - RNA, 32 nt, Human
uggccaggcuggucuugaauucuuggccccag

SEQ ID NO: 256998 - RNA, 32 nt, Human
uggccaggcuugguggcucaggccuguaaucc

SEQ ID NO: 256999 - RNA, 32 nt, Human
uggccagggaaaugccagcagcaauaaaagaa

SEQ ID NO: 257000 - RNA, 19 nt, Human
uggccagggaauaggggga

SEQ ID NO: 257001 - RNA, 18 nt, Human
uggccagggaccccauca

SEQ ID NO: 257002 - RNA, 32 nt, Human
uggccagggaggaaugucccuuuuguucuucc

SEQ ID NO: 257003 - RNA, 32 nt, Human
uggccagggaggaugcuggagcggagaagauc

SEQ ID NO: 257004 - RNA, 32 nt, Human
uggccagggaggcauugcugcaggugagccug

SEQ ID NO: 257005 - RNA, 32 nt, Human
uggccagggcaggcugggagggacauacuuuc

SEQ ID NO: 257006 - RNA, 32 nt, Human
uggccagggcugccguggcaaaaugagcuguc

SEQ ID NO: 257007 - RNA, 32 nt, Human
uggccagggcuggucucgaacuccugaccaca

SEQ ID NO: 257008 - RNA, 19 nt, Human
uggccaggggucaccagca

SEQ ID NO: 257009 - RNA, 32 nt, Human
uggccaggguucccagaaggaaggaacucacc

SEQ ID NO: 257010 - RNA, 32 nt, Human
uggccaggguucccuagccuauggagcacgca

SEQ ID NO: 257011 - RNA, 18 nt, Human
uggccagguacaggggga

SEQ ID NO: 257012 - RNA, 32 nt, Human
uggccagguauuuuaggaugugagaaggaaga

SEQ ID NO: 257013 - RNA, 32 nt, Human
uggccagguggaggagggaggggaggagcagg

SEQ ID NO: 257014 - RNA, 32 nt, Human
uggccaggugguggagacagagacaggcccug

SEQ ID NO: 257015 - RNA, 32 nt, Human
uggccagguuccuugcccuccccaccccaucc

SEQ ID NO: 257016 - RNA, 32 nt, Human
uggccaguagaggugguggagcagagcagcca

SEQ ID NO: 257017 - RNA, 32 nt, Human
uggccagucacgugaaggugggcagggcccuu

SEQ ID NO: 257018 - RNA, 32 nt, Human
uggccaguccacccugccugccgucugugcuu

SEQ ID NO: 257019 - RNA, 32 nt, Human
uggccagucccgagcccucccucccaggcacc

SEQ ID NO: 257020 - RNA, 18 nt, Human
uggccagucccucugcca

SEQ ID NO: 257021 - RNA, 32 nt, Human
uggccagugaggaagucuugaagaauagagcc

SEQ ID NO: 257022 - RNA, 22 nt, Human
uggccagugaggagcucacagg

SEQ ID NO: 257023 - RNA, 32 nt, Human
uggccagugauaagaaauuaaauaaguauuug

SEQ ID NO: 257024 - RNA, 17 nt, Human
uggccagugugauccca

SEQ ID NO: 257025 - RNA, 32 nt, Human
uggccaguuaagcagagacuucacugacugac

SEQ ID NO: 257026 - RNA, 32 nt, Human
uggccaguucauagcagcacugugaggacccc

SEQ ID NO: 257027 - RNA, 32 nt, Human
uggccaguuccaccugccccagccagagggca

SEQ ID NO: 257028 - RNA, 32 nt, Human
uggccaguugagucucucaaaugaggggcuac

SEQ ID NO: 257029 - RNA, 32 nt, Human
uggccauaaaaauacgggaauaaguuguggaa

SEQ ID NO: 257030 - RNA, 32 nt, Human
uggccauaaaccacagacucucuccaggcucu

SEQ ID NO: 257031 - RNA, 23 nt, Human
uggccauaaucuguaauuccugc

SEQ ID NO: 257032 - RNA, 32 nt, Human
uggccauagauguauuucuguguguacauaug

SEQ ID NO: 257033 - RNA, 32 nt, Human
uggccauagccccuccuggagauggggucaag

SEQ ID NO: 257034 - RNA, 32 nt, Human
uggccaucacuaccaaccaggguuucaaaaag

SEQ ID NO: 257035 - RNA, 32 nt, Human
uggccaucauaaccccaguacucaguaggcgc

SEQ ID NO: 257036 - RNA, 32 nt, Human
uggccaucauggugaaaccccaucucuacuaa

SEQ ID NO: 257037 - RNA, 32 nt, Human
uggccaucauggugucaggaaggcugagaugu

SEQ ID NO: 257038 - RNA, 32 nt, Human
uggccauccaccuaaggacugccugcuuucug

SEQ ID NO: 257039 - RNA, 32 nt, Human
uggccauccacucagcugauguuuccugggaa

SEQ ID NO: 257040 - RNA, 32 nt, Human
uggccauccuguugccccaggcacaugaccuu

SEQ ID NO: 257041 - RNA, 32 nt, Human
uggccaucucgcuccuccuccucuguuccaau

SEQ ID NO: 257042 - RNA, 32 nt, Human
uggccaucuggaccucaauccccagcuuuccc

SEQ ID NO: 257043 - RNA, 32 nt, Human
uggccaucuguggagccccagagccugcggcu

SEQ ID NO: 257044 - RNA, 32 nt, Human
uggccaucuucccacucucucuucgcaucauc

SEQ ID NO: 257045 - RNA, 32 nt, Human
uggccaucuuugcuacuuuccuagagaacccg

SEQ ID NO: 257046 - RNA, 30 nt, Human
uggccaugacgggcuggagcugccuuguga

SEQ ID NO: 257047 - RNA, 32 nt, Human
uggccaugccaaacagcacccagcacaaguag

SEQ ID NO: 257048 - RNA, 32 nt, Human
uggccaugcccagggcugguguugguugagga

SEQ ID NO: 257049 - RNA, 23 nt, Human
uggccaugccuccacccaccuua

SEQ ID NO: 257050 - RNA, 32 nt, Human
uggccaugcucaccgcccugcuucacugcccc

SEQ ID NO: 257051 - RNA, 32 nt, Human
uggccaugcugggcuggaguggcuguggggug

SEQ ID NO: 257052 - RNA, 32 nt, Human
uggccaugcuggucucaaauucugaaagagga

SEQ ID NO: 257053 - RNA, 32 nt, Human
uggccaugggcagaggcgaagggcuggugggc

SEQ ID NO: 257054 - RNA, 32 nt, Human
uggccaugggcuaugcccucccuuccuccuga

SEQ ID NO: 257055 - RNA, 32 nt, Human
uggccauggggaggggccauggcuuggcaugu

SEQ ID NO: 257056 - RNA, 32 nt, Human
uggccaugucccuugugcauugagugcauccc

SEQ ID NO: 257057 - RNA, 32 nt, Human
uggccaugucggcagggccagggccuccuaca

SEQ ID NO: 257058 - RNA, 32 nt, Human
uggccauguguauauuuauaucauguuuacca

SEQ ID NO: 257059 - RNA, 32 nt, Human
uggccauuaguauuuuuauaaaacucaaugcu

SEQ ID NO: 257060 - RNA, 32 nt, Human
uggccauuauggugaaaccccgucucuacuaa

SEQ ID NO: 257061 - RNA, 32 nt, Human
uggccauuccuucugggacagacagagagagg

SEQ ID NO: 257062 - RNA, 18 nt, Human
uggccauucucaaaggga

SEQ ID NO: 257063 - RNA, 32 nt, Human
uggccauugcacuccagccugggugacagagu

SEQ ID NO: 257064 - RNA, 32 nt, Human
uggccauugcacuccagcgugggcaacagagu

SEQ ID NO: 257065 - RNA, 32 nt, Human
uggccauuggugacccaaagaugaugaaaaau

SEQ ID NO: 257066 - RNA, 32 nt, Human
uggccauuggugacuaguggggccaagagaag

SEQ ID NO: 257067 - RNA, 22 nt, Human
uggccauugugugccugccuua

SEQ ID NO: 257068 - RNA, 32 nt, Human
uggccauuuccaccuggugaagauuuucauag

SEQ ID NO: 257069 - RNA, 32 nt, Human
uggcccaaaacacaaauuuauauucucacaua

SEQ ID NO: 257070 - RNA, 21 nt, Human
uggcccaaacauggaguuuug

SEQ ID NO: 257071 - RNA, 32 nt, Human
uggcccaacaaccgucuacagaacagcugcug

SEQ ID NO: 257072 - RNA, 32 nt, Human
uggcccaacuccaggaguuuccuuucauuccc

SEQ ID NO: 257073 - RNA, 32 nt, Human
uggcccaagagccaggcucaggaacaggaagc

SEQ ID NO: 257074 - RNA, 32 nt, Human
uggcccaagccgcaccggagcagcggcuggau

SEQ ID NO: 257075 - RNA, 21 nt, Human
uggcccaagccuguaguccca

SEQ ID NO: 257076 - RNA, 24 nt, Human
uggcccaagccuguagucccagcu

SEQ ID NO: 257077 - RNA, 32 nt, Human
uggcccaagcuacgcucacugcaggcuccgcc

SEQ ID NO: 257078 - RNA, 21 nt, Human
uggcccaaggucuccagcaga

SEQ ID NO: 257079 - RNA, 32 nt, Human
uggcccacaaaauuucacaaugacugcugagg

SEQ ID NO: 257080 - RNA, 32 nt, Human
uggcccacaaacagucuugggcucagacugua

SEQ ID NO: 257081 - RNA, 32 nt, Human
uggcccacaccuguaaucccagcacuuuggga

SEQ ID NO: 257082 - RNA, 24 nt, Human
uggcccacaccuguggucccagcu

SEQ ID NO: 257083 - RNA, 32 nt, Human
uggcccacacuauucuuuccaccugcagugcu

SEQ ID NO: 257084 - RNA, 32 nt, Human
uggcccacagccgcagcaauggcgcugaguuc

SEQ ID NO: 257085 - RNA, 21 nt, Human
uggcccacagcuguaauccca

SEQ ID NO: 257086 - RNA, 32 nt, Human
uggcccacaggauaagccucaggcccugggaa

SEQ ID NO: 257087 - RNA, 23 nt, Human
uggcccacaucagcauugaccac

SEQ ID NO: 257088 - RNA, 21 nt, Human
uggcccacaucuguaauccca

SEQ ID NO: 257089 - RNA, 22 nt, Human
uggcccacauguggaugccaca

SEQ ID NO: 257090 - RNA, 26 nt, Human
uggcccaccaccucccucuccugcca

SEQ ID NO: 257091 - RNA, 32 nt, Human
uggcccaccgugggccucagagcugcugcugg

SEQ ID NO: 257092 - RNA, 32 nt, Human
uggcccaccucaucccuccagccugggaucuc

SEQ ID NO: 257093 - RNA, 21 nt, Human
uggcccacgccuguaauccca

SEQ ID NO: 257094 - RNA, 23 nt, Human
uggcccacgccuguaaucccagc

SEQ ID NO: 257095 - RNA, 32 nt, Human
uggcccacgccuguaaucccagcacuuuggga

SEQ ID NO: 257096 - RNA, 24 nt, Human
uggcccacgccuguaaucccagcu

SEQ ID NO: 257097 - RNA, 32 nt, Human
uggcccacgccuguaaucccagcuacuuggaa

SEQ ID NO: 257098 - RNA, 32 nt, Human
uggcccacugcaaccucugccucccggguuca

SEQ ID NO: 257099 - RNA, 32 nt, Human
uggcccacugcaaccucugcuuccuagguuca

SEQ ID NO: 257100 - RNA, 32 nt, Human
uggcccacugcaagcuccgccucccagguuca

SEQ ID NO: 257101 - RNA, 32 nt, Human
uggcccacugguggcuaggucuccccuuaucc

SEQ ID NO: 257102 - RNA, 32 nt, Human
uggcccagaaaccaaaugugaacuuccugucu

SEQ ID NO: 257103 - RNA, 32 nt, Human
uggcccagaagacccaggcaguguagcgacag

SEQ ID NO: 257104 - RNA, 32 nt, Human
uggcccagacagguaggugugauaaacagagu

SEQ ID NO: 257105 - RNA, 24 nt, Human
uggcccagacgccagcccuucccu

SEQ ID NO: 257106 - RNA, 32 nt, Human
uggcccagaggagccaagccgcacagacccga

SEQ ID NO: 257107 - RNA, 32 nt, Human
uggcccagaguccuucagaggcaagucuggua

SEQ ID NO: 257108 - RNA, 32 nt, Human
uggcccagcaagcagaggcgggcaggaggauc

SEQ ID NO: 257109 - RNA, 32 nt, Human
uggcccagcccccacaccacaguucccugcca

SEQ ID NO: 257110 - RNA, 19 nt, Human
uggcccagcucccccggga

SEQ ID NO: 257111 - RNA, 32 nt, Human
uggcccagcucccugcccugaguccugagcca

SEQ ID NO: 257112 - RNA, 21 nt, Human
uggcccagcuccugcucacag

SEQ ID NO: 257113 - RNA, 32 nt, Human
uggcccagcuuggagugcuugugugguccaac

SEQ ID NO: 257114 - RNA, 32 nt, Human
uggcccaggaagggggcaguuucugucgcggg

SEQ ID NO: 257115 - RNA, 32 nt, Human
uggcccaggagaagagacacuagccauaaaau

SEQ ID NO: 257116 - RNA, 32 nt, Human
uggcccaggagaagucaggaagggagcccagc

SEQ ID NO: 257117 - RNA, 32 nt, Human
uggcccaggagccaccauggagagugagaagc

SEQ ID NO: 257118 - RNA, 32 nt, Human
uggcccaggagcucuguucuuuccuaaucuaa

SEQ ID NO: 257119 - RNA, 32 nt, Human
uggcccaggaggcagagguugcagugagcuga

SEQ ID NO: 257120 - RNA, 32 nt, Human
uggcccaggaucccugagcuuucccaguagcc

SEQ ID NO: 257121 - RNA, 32 nt, Human
uggcccaggcagcagaagguucccugaggucc

SEQ ID NO: 257122 - RNA, 32 nt, Human
uggcccaggcaugaccuggugccuggcccagc

SEQ ID NO: 257123 - RNA, 17 nt, Human
uggcccaggccugccca

SEQ ID NO: 257124 - RNA, 17 nt, Human
uggcccaggccugcccc

SEQ ID NO: 257125 - RNA, 32 nt, Human
uggcccaggccuggcgggcacugcuucccggc

SEQ ID NO: 257126 - RNA, 32 nt, Human
uggcccaggccugggcuucagccucccggggc

SEQ ID NO: 257127 - RNA, 32 nt, Human
uggcccaggccuguaaucccaucacuuuggga

SEQ ID NO: 257128 - RNA, 17 nt, Human
uggcccaggccugucca

SEQ ID NO: 257129 - RNA, 32 nt, Human
uggcccaggcgccaccacugaugccacccagg

SEQ ID NO: 257130 - RNA, 21 nt, Human
uggcccaggcuagagugcagu

SEQ ID NO: 257131 - RNA, 22 nt, Human
uggcccaggcuagagugcagug

SEQ ID NO: 257132 - RNA, 32 nt, Human
uggcccaggcuagagugcaguggugcgauuau

SEQ ID NO: 257133 - RNA, 25 nt, Human
uggcccaggcucuaagcucugcggg

SEQ ID NO: 257134 - RNA, 22 nt, Human
uggcccaggcugaagugcagug

SEQ ID NO: 257135 - RNA, 32 nt, Human
uggcccaggcugaagugcaguggugugauuac

SEQ ID NO: 257136 - RNA, 20 nt, Human
uggcccaggcuggacuccag

SEQ ID NO: 257137 - RNA, 20 nt, Human
uggcccaggcuggagugcag

SEQ ID NO: 257138 - RNA, 21 nt, Human
uggcccaggcuggagugcagg

SEQ ID NO: 257139 - RNA, 22 nt, Human
uggcccaggcuggagugcagug

SEQ ID NO: 257140 - RNA, 32 nt, Human
uggcccaggcuggagugcaguggcacaaccuc

SEQ ID NO: 257141 - RNA, 32 nt, Human
uggcccaggcuggagugcaguggcgcaaccuc

SEQ ID NO: 257142 - RNA, 32 nt, Human
uggcccaggcuggagugcaguggcgcaaucau

SEQ ID NO: 257143 - RNA, 32 nt, Human
uggcccaggcuggagugcaguggcgcggucuu

SEQ ID NO: 257144 - RNA, 32 nt, Human
uggcccaggcuggagugcaguggcuguucuca

SEQ ID NO: 257145 - RNA, 32 nt, Human
uggcccaggcuggagugcaguggugcgaucuc

SEQ ID NO: 257146 - RNA, 32 nt, Human
uggcccaggcuggaguguaguggcguggucuu

SEQ ID NO: 257147 - RNA, 20 nt, Human
uggcccaggcuggcgugcag

SEQ ID NO: 257148 - RNA, 32 nt, Human
uggcccaggcuggcgugcagugggccgucuca

SEQ ID NO: 257149 - RNA, 20 nt, Human
uggcccaggcugggaaucac

SEQ ID NO: 257150 - RNA, 22 nt, Human
uggcccaggcugggagcuugga

SEQ ID NO: 257151 - RNA, 32 nt, Human
uggcccaggcuggucucaaacuucuggccuua

SEQ ID NO: 257152 - RNA, 24 nt, Human
uggcccagggaggauuccaggaga

SEQ ID NO: 257153 - RNA, 26 nt, Human
uggcccagggcgggggcagcuccaag

SEQ ID NO: 257154 - RNA, 32 nt, Human
uggcccaggguaagggcuguugagguaccuua

SEQ ID NO: 257155 - RNA, 32 nt, Human
uggcccagguggacucaggagggaaccuggcc

SEQ ID NO: 257156 - RNA, 32 nt, Human
uggcccagguggagcaggagggaccacuggaa

SEQ ID NO: 257157 - RNA, 32 nt, Human
uggcccagucugcccacaauccuggcccugag

SEQ ID NO: 257158 - RNA, 32 nt, Human
uggcccagugaccacagagagaucugcaccuc

SEQ ID NO: 257159 - RNA, 32 nt, Human
uggcccaguggcuggagccucucaccugagcc

SEQ ID NO: 257160 - RNA, 32 nt, Human
uggcccaguguaggaagcccaguuugcucucu

SEQ ID NO: 257161 - RNA, 21 nt, Human
uggcccauacuuguaauccca

SEQ ID NO: 257162 - RNA, 24 nt, Human
uggcccauacuuguaaucccagcu

SEQ ID NO: 257163 - RNA, 32 nt, Human
uggcccauagaaacaugacacugaccuuggag

SEQ ID NO: 257164 - RNA, 32 nt, Human
uggcccaucaaaggaaccugggggaggaugca

SEQ ID NO: 257165 - RNA, 32 nt, Human
uggcccaucccugagugucuagaguucccagc

SEQ ID NO: 257166 - RNA, 21 nt, Human
uggcccauccuuggagcuuua

SEQ ID NO: 257167 - RNA, 32 nt, Human
uggcccaucucuucugugccuuagucacauau

SEQ ID NO: 257168 - RNA, 32 nt, Human
uggcccaucugccaccaucugugccuacaggg

SEQ ID NO: 257169 - RNA, 32 nt, Human
uggcccaucugccuccuggccuuccuguucca

SEQ ID NO: 257170 - RNA, 32 nt, Human
uggcccaucugucuccccuuggggccaccucu

SEQ ID NO: 257171 - RNA, 32 nt, Human
uggcccaucuuccuauucccacguguagcuag

SEQ ID NO: 257172 - RNA, 32 nt, Human
uggcccaucuuuuaugggaagacagagugaug

SEQ ID NO: 257173 - RNA, 32 nt, Human
uggcccaugagcugggaugguccuccagcugc

SEQ ID NO: 257174 - RNA, 32 nt, Human
uggcccaugcccacagcaggcaaccaaggcug

SEQ ID NO: 257175 - RNA, 21 nt, Human
uggcccaugccuauaauccca

SEQ ID NO: 257176 - RNA, 32 nt, Human
uggcccaugccuauaaucccagcacuuuggga

SEQ ID NO: 257177 - RNA, 23 nt, Human
uggcccaugccuguaaauccagc

SEQ ID NO: 257178 - RNA, 21 nt, Human
uggcccaugccuguaauccca

SEQ ID NO: 257179 - RNA, 23 nt, Human
uggcccaugccuguaaucccagc

SEQ ID NO: 257180 - RNA, 32 nt, Human
uggcccaugccuguaaucccagcacuuuggga

SEQ ID NO: 257181 - RNA, 32 nt, Human
uggcccaugccuguaaucccagcacuuugggg

SEQ ID NO: 257182 - RNA, 24 nt, Human
uggcccaugccuguaaucccagcu

SEQ ID NO: 257183 - RNA, 21 nt, Human
uggcccaugccuguaaucuca

SEQ ID NO: 257184 - RNA, 23 nt, Human
uggcccaugccuguaaucucagc

SEQ ID NO: 257185 - RNA, 32 nt, Human
uggcccaugccuguaaucucagcacucuggga

SEQ ID NO: 257186 - RNA, 21 nt, Human
uggcccaugccuguagcccca

SEQ ID NO: 257187 - RNA, 24 nt, Human
uggcccaugccuguagccccagcu

SEQ ID NO: 257188 - RNA, 21 nt, Human
uggcccaugccuguaguccca

SEQ ID NO: 257189 - RNA, 24 nt, Human
uggcccaugccuguagucccagcu

SEQ ID NO: 257190 - RNA, 32 nt, Human
uggcccaugccuguagucccagcuacucagga

SEQ ID NO: 257191 - RNA, 32 nt, Human
uggcccaugccuguagugccagcauuuuggga

SEQ ID NO: 257192 - RNA, 21 nt, Human
uggcccaugccuguuauccca

SEQ ID NO: 257193 - RNA, 23 nt, Human
uggcccaugccuguuaucccagc

SEQ ID NO: 257194 - RNA, 32 nt, Human
uggcccaugccuguuaucccagcacuugggga

SEQ ID NO: 257195 - RNA, 19 nt, Human
uggcccaugccuguucagu

SEQ ID NO: 257196 - RNA, 32 nt, Human
uggcccaugguggucuauccuguggcuaaugc

SEQ ID NO: 257197 - RNA, 32 nt, Human
uggcccaugucacauuggcaccugauggcauc

SEQ ID NO: 257198 - RNA, 28 nt, Human
uggcccauguuugcugccucuaucuggu

SEQ ID NO: 257199 - RNA, 32 nt, Human
uggcccauucagaaagacaggagaauuaggag

SEQ ID NO: 257200 - RNA, 32 nt, Human
uggccccaacaaccccagugagcaggagguga

SEQ ID NO: 257201 - RNA, 32 nt, Human
uggccccaaccagcacccccgccccagccuac

SEQ ID NO: 257202 - RNA, 32 nt, Human
uggccccacagcaaaccagaggguccaaggga

SEQ ID NO: 257203 - RNA, 32 nt, Human
uggccccacagcacauagcacggagggcggcg

SEQ ID NO: 257204 - RNA, 21 nt, Human
uggccccaccccuccuggcca

SEQ ID NO: 257205 - RNA, 32 nt, Human
uggccccacccucaccagccugggcagcagca

SEQ ID NO: 257206 - RNA, 20 nt, Human
uggccccaccucuucugcca

SEQ ID NO: 257207 - RNA, 32 nt, Human
uggccccacuuuccuuuuucuuccuccuccag

SEQ ID NO: 257208 - RNA, 32 nt, Human
uggccccagcaccccacugcccucucuccugc

SEQ ID NO: 257209 - RNA, 31 nt, Human
uggccccagcaguccccuaggaggggccuug

SEQ ID NO: 257210 - RNA, 20 nt, Human
uggccccagcagugcacagg

SEQ ID NO: 257211 - RNA, 19 nt, Human
uggccccagccccgcggga

SEQ ID NO: 257212 - RNA, 32 nt, Human
uggccccagccuuccucuucuuccugcucugu

SEQ ID NO: 257213 - RNA, 17 nt, Human
uggccccagcggcgcga

SEQ ID NO: 257214 - RNA, 32 nt, Human
uggccccagcuucucaguaggcugagguggga

SEQ ID NO: 257215 - RNA, 32 nt, Human
uggccccaggaccugcacucccaauccugcug

SEQ ID NO: 257216 - RNA, 32 nt, Human
uggccccaggagauagcuuuccggugacagcu

SEQ ID NO: 257217 - RNA, 32 nt, Human
uggccccaggagccuuugguucaguaaacgac

SEQ ID NO: 257218 - RNA, 32 nt, Human
uggccccaggcagaguuuugcaccagcaggac

SEQ ID NO: 257219 - RNA, 22 nt, Human
uggccccaggcagcccuuuucc

SEQ ID NO: 257220 - RNA, 17 nt, Human
uggccccaggccggggg

SEQ ID NO: 257221 - RNA, 20 nt, Human
uggccccaggcuggcucagg

SEQ ID NO: 257222 - RNA, 32 nt, Human
uggccccagggagggcaggaggcucuugaccc

SEQ ID NO: 257223 - RNA, 32 nt, Human
uggccccaggggugaagcaggaggggccaggc

SEQ ID NO: 257224 - RNA, 32 nt, Human
uggccccagguggggguuguagugagagcuuc

SEQ ID NO: 257225 - RNA, 32 nt, Human
uggccccagguugccagcgucgcuacagccca

SEQ ID NO: 257226 - RNA, 32 nt, Human
uggccccagucccagcccccaccuuuggcuga

SEQ ID NO: 257227 - RNA, 17 nt, Human
uggccccagugcugagg

SEQ ID NO: 257228 - RNA, 32 nt, Human
uggccccaguucuucucugcccucucucccaa

SEQ ID NO: 257229 - RNA, 32 nt, Human
uggccccaucacucuggccucugccuucaucu

SEQ ID NO: 257230 - RNA, 23 nt, Human
uggccccaucucugcucacugca

SEQ ID NO: 257231 - RNA, 32 nt, Human
uggccccaucuucuggcccuuagcuggugcca

SEQ ID NO: 257232 - RNA, 32 nt, Human
uggccccaugauguauaaaugugcccaaaagc

SEQ ID NO: 257233 - RNA, 32 nt, Human
uggccccauuacugcugccuugcuucagccac

SEQ ID NO: 257234 - RNA, 32 nt, Human
uggccccauucgcagaugugggagacucugcu

SEQ ID NO: 257235 - RNA, 32 nt, Human
uggccccauuucuccauuuuguggaccaagcc

SEQ ID NO: 257236 - RNA, 32 nt, Human
uggcccccaaaccaaauccaaagguucuggcc

SEQ ID NO: 257237 - RNA, 32 nt, Human
uggcccccaagugcccugggccguggcucccu

SEQ ID NO: 257238 - RNA, 19 nt, Human
uggcccccacccucugcca

SEQ ID NO: 257239 - RNA, 32 nt, Human
uggcccccacgagcagcuccaggcuggaguuc

SEQ ID NO: 257240 - RNA, 32 nt, Human
uggcccccagccuccagacccucuaaugcccu

SEQ ID NO: 257241 - RNA, 32 nt, Human
uggcccccagccuccuggaaaacagguuggcg

SEQ ID NO: 257242 - RNA, 32 nt, Human
uggcccccaggccacaugggaccuggaggagc

SEQ ID NO: 257243 - RNA, 32 nt, Human
uggcccccgaacccaagccucacuuuucugug

SEQ ID NO: 257244 - RNA, 32 nt, Human
uggcccccgaggaggagcagaggaucaaugcg

SEQ ID NO: 257245 - RNA, 21 nt, Human
uggcccccggcuccccacaca

SEQ ID NO: 257246 - RNA, 32 nt, Human
uggcccccucaccuuuuccuuuccagcuguuu

SEQ ID NO: 257247 - RNA, 32 nt, Human
uggcccccucaguucucccagguuguuccuca

SEQ ID NO: 257248 - RNA, 32 nt, Human
uggcccccuccagagucccagggcaauggguc

SEQ ID NO: 257249 - RNA, 32 nt, Human
uggcccccuccucugcuuuagccccggcaagc

SEQ ID NO: 257250 - RNA, 32 nt, Human
uggcccccucgaggaugacuccacuagcgccc

SEQ ID NO: 257251 - RNA, 32 nt, Human
uggcccccucuccaucucuccugaccuccuga

SEQ ID NO: 257252 - RNA, 32 nt, Human
uggcccccugcaaccuccgccucccggguucg

SEQ ID NO: 257253 - RNA, 17 nt, Human
uggcccccugcgcgagg

SEQ ID NO: 257254 - RNA, 19 nt, Human
uggcccccuucccccaggg

SEQ ID NO: 257255 - RNA, 32 nt, Human
uggccccgcagcugcccccacuuccuuugaga

SEQ ID NO: 257256 - RNA, 32 nt, Human
uggccccgcaugagccucggccaucucucccu

SEQ ID NO: 257257 - RNA, 21 nt, Human
uggccccgccccgccagccgc

SEQ ID NO: 257258 - RNA, 30 nt, Human
uggccccggagccacagcacaaucaucuca

SEQ ID NO: 257259 - RNA, 21 nt, Human
uggccccggccuuugccccaa

SEQ ID NO: 257260 - RNA, 31 nt, Human
uggccccggcucucuggaccuugucucgcuc

SEQ ID NO: 257261 - RNA, 19 nt, Human
uggccccggggagccgagg

SEQ ID NO: 257262 - RNA, 32 nt, Human
uggccccguguccagugccaggcaggcuucag

SEQ ID NO: 257263 - RNA, 32 nt, Human
uggccccuacagccgcuggaucuagugccagg

SEQ ID NO: 257264 - RNA, 32 nt, Human
uggccccuacccugcccugccugaagcucccc

SEQ ID NO: 257265 - RNA, 32 nt, Human
uggccccuagacccucucuauagccaugagac

SEQ ID NO: 257266 - RNA, 16 nt, Human
uggccccuaggcgagg

SEQ ID NO: 257267 - RNA, 32 nt, Human
uggccccuagggagaaaugcagaaggaguagc

SEQ ID NO: 257268 - RNA, 32 nt, Human
uggccccuaugcagaagggcagacaguucuuc

SEQ ID NO: 257269 - RNA, 32 nt, Human
uggccccucaaaccucacccugaccuccugcu

SEQ ID NO: 257270 - RNA, 32 nt, Human
uggccccuccacccucccuccccucccggcuc

SEQ ID NO: 257271 - RNA, 32 nt, Human
uggccccuccacccucucccccagccgcacgg

SEQ ID NO: 257272 - RNA, 32 nt, Human
uggccccuccacugcuucucuccccauccaca

SEQ ID NO: 257273 - RNA, 32 nt, Human
uggccccuccucugccaagcccccaggggagc

SEQ ID NO: 257274 - RNA, 32 nt, Human
uggccccuccuucuccccuccagaccccuacc

SEQ ID NO: 257275 - RNA, 32 nt, Human
uggccccucuacuguaaaugugccuuagccua

SEQ ID NO: 257276 - RNA, 19 nt, Human
uggccccucugaccugcac

SEQ ID NO: 257277 - RNA, 20 nt, Human
uggccccugaauucugcgca

SEQ ID NO: 257278 - RNA, 32 nt, Human
uggccccugcaaccgugcucuggcgggcacac

SEQ ID NO: 257279 - RNA, 32 nt, Human
uggccccugcagcacucaccaguugcaucuug

SEQ ID NO: 257280 - RNA, 32 nt, Human
uggccccugcccggcccugcgugcccgcgcgu

SEQ ID NO: 257281 - RNA, 32 nt, Human
uggccccugccuggcucccugccaggcucccu

SEQ ID NO: 257282 - RNA, 32 nt, Human
uggccccugcuccccgcccccucacuuagagg

SEQ ID NO: 257283 - RNA, 32 nt, Human
uggccccuggaacaugccagcacacacugcca

SEQ ID NO: 257284 - RNA, 32 nt, Human
uggccccuggacacacaguguggcauccucau

SEQ ID NO: 257285 - RNA, 32 nt, Human
uggccccuggagagacacaggagaaggagaga

SEQ ID NO: 257286 - RNA, 21 nt, Human
uggccccuggagggucagggg

SEQ ID NO: 257287 - RNA, 32 nt, Human
uggccccuggcagaggaacaaggacacagaca

SEQ ID NO: 257288 - RNA, 32 nt, Human
uggccccuggcccaucucuucugugccuuagu

SEQ ID NO: 257289 - RNA, 32 nt, Human
uggccccuggcuccuccagccugaaugagcua

SEQ ID NO: 257290 - RNA, 32 nt, Human
uggccccuggcucuggccuggugggcggaggc

SEQ ID NO: 257291 - RNA, 32 nt, Human
uggccccuggggauucugugguguggguggaa

SEQ ID NO: 257292 - RNA, 21 nt, Human
uggccccugucccuggcccca

SEQ ID NO: 257293 - RNA, 32 nt, Human
uggccccugugcaccguaguggccauggcaug

SEQ ID NO: 257294 - RNA, 32 nt, Human
uggccccuuagugucuggaauguggccuucca

SEQ ID NO: 257295 - RNA, 32 nt, Human
uggccccuuccccucacucucucucuugcucc

SEQ ID NO: 257296 - RNA, 32 nt, Human
uggccccuuccuccucugccuggugaguuggc

SEQ ID NO: 257297 - RNA, 32 nt, Human
uggccccuuccucuagggaggggauggggagg

SEQ ID NO: 257298 - RNA, 32 nt, Human
uggccccuuccuguccugucucaggccaggcu

SEQ ID NO: 257299 - RNA, 32 nt, Human
uggccccuucuggggguggugggcaggugaca

SEQ ID NO: 257300 - RNA, 32 nt, Human
uggcccgaggcacguguccaggagaccggccu

SEQ ID NO: 257301 - RNA, 32 nt, Human
uggcccgaggugaccuucuagcagguuccccc

SEQ ID NO: 257302 - RNA, 32 nt, Human
uggcccgcagagccugcgagucuagacuccag

SEQ ID NO: 257303 - RNA, 32 nt, Human
uggcccgcagaggcacugccacagcugugagg

SEQ ID NO: 257304 - RNA, 32 nt, Human
uggcccgcagccgccaccuacccagugaccau

SEQ ID NO: 257305 - RNA, 32 nt, Human
uggcccgcagccgccgcgacuucggcacaguu

SEQ ID NO: 257306 - RNA, 32 nt, Human
uggcccgccaagguugggaggauuguacacua

SEQ ID NO: 257307 - RNA, 32 nt, Human
uggcccggaaccaaggugggccaagguccgcc

SEQ ID NO: 257308 - RNA, 32 nt, Human
uggcccggacgggguuucuccauguuucccag

SEQ ID NO: 257309 - RNA, 32 nt, Human
uggcccggaggcaccuuccccagaguccugac

SEQ ID NO: 257310 - RNA, 32 nt, Human
uggcccggcaggcagcuucgugcuggaggaac

SEQ ID NO: 257311 - RNA, 32 nt, Human
uggcccggccacuccgaaggcagggaggagga

SEQ ID NO: 257312 - RNA, 21 nt, Human
uggcccggccuccuccugcca

SEQ ID NO: 257313 - RNA, 19 nt, Human
uggcccgggcgcgcugagg

SEQ ID NO: 257314 - RNA, 18 nt, Human
uggcccgguagucagggg

SEQ ID NO: 257315 - RNA, 32 nt, Human
uggcccuaaucuagccaagcaccauggagaga

SEQ ID NO: 257316 - RNA, 32 nt, Human
uggcccuacagcugccugaggucuccaucacc

SEQ ID NO: 257317 - RNA, 18 nt, Human
uggcccuacgucuggaug

SEQ ID NO: 257318 - RNA, 32 nt, Human
uggcccuacugcacauggcccccagccuccau

SEQ ID NO: 257319 - RNA, 18 nt, Human
uggcccuaggcagcgagg

SEQ ID NO: 257320 - RNA, 22 nt, Human
uggcccuaggccccuuccugcc

SEQ ID NO: 257321 - RNA, 32 nt, Human
uggcccuaugaucuauccuuuacuugaaagcu

SEQ ID NO: 257322 - RNA, 32 nt, Human
uggcccucacuguggcuagcuucugggcaagu

SEQ ID NO: 257323 - RNA, 18 nt, Human
uggcccucagcucugccc

SEQ ID NO: 257324 - RNA, 32 nt, Human
uggcccucaucuuaaucucugcugauuauuua

SEQ ID NO: 257325 - RNA, 32 nt, Human
uggcccucccaaaguguugggauuacaggcau

SEQ ID NO: 257326 - RNA, 32 nt, Human
uggcccucccagcugucugggacuucagugga

SEQ ID NO: 257327 - RNA, 32 nt, Human
uggcccuccuccccaucucaguuugcaacuca

SEQ ID NO: 257328 - RNA, 32 nt, Human
uggcccuccucucugcugccacucauuccaga

SEQ ID NO: 257329 - RNA, 32 nt, Human
uggcccucggggaacccgcacacacagcagga

SEQ ID NO: 257330 - RNA, 32 nt, Human
uggcccucuaccauaccacuuccccagccaga

SEQ ID NO: 257331 - RNA, 32 nt, Human
uggcccucuccucucuugaaaguucucugcuu

SEQ ID NO: 257332 - RNA, 32 nt, Human
uggcccucuccucugcccagccggggcagcug

SEQ ID NO: 257333 - RNA, 32 nt, Human
uggcccucucugcucugcuucuccuccugccg

SEQ ID NO: 257334 - RNA, 32 nt, Human
uggcccucugaguggugguggagggugggggu

SEQ ID NO: 257335 - RNA, 32 nt, Human
uggcccucugucugggcgaacagcccccuccu

SEQ ID NO: 257336 - RNA, 32 nt, Human
uggcccucuguggguucugcauccauggauuc

SEQ ID NO: 257337 - RNA, 32 nt, Human
uggcccucuuggaggucugugcucuuaccucc

SEQ ID NO: 257338 - RNA, 32 nt, Human
uggcccugagccuucuuuggauagugaaaagg

SEQ ID NO: 257339 - RNA, 20 nt, Human
uggcccugauccaccuaccu

SEQ ID NO: 257340 - RNA, 32 nt, Human
uggcccugcacuccgccuuaguccuggggccg

SEQ ID NO: 257341 - RNA, 32 nt, Human
uggcccugcagccuccaccucgccgcuggggg

SEQ ID NO: 257342 - RNA, 32 nt, Human
uggcccugccacagcccucccucggcacacuu

SEQ ID NO: 257343 - RNA, 32 nt, Human
uggcccugccacuccagccuggccucacuguc

SEQ ID NO: 257344 - RNA, 32 nt, Human
uggcccugcccagccaugaaucgcuuggccau

SEQ ID NO: 257345 - RNA, 32 nt, Human
uggcccugcccgccuccgccuucuggagagcc

SEQ ID NO: 257346 - RNA, 23 nt, Human
uggcccugcccugguuuccugcc

SEQ ID NO: 257347 - RNA, 32 nt, Human
uggcccugccguuuccccuccuuggguuuaug

SEQ ID NO: 257348 - RNA, 20 nt, Human
uggcccugccucuccccgcu

SEQ ID NO: 257349 - RNA, 17 nt, Human
uggcccugccucugcug

SEQ ID NO: 257350 - RNA, 31 nt, Human
uggcccugccucuucuggccuggugucuccu

SEQ ID NO: 257351 - RNA, 32 nt, Human
uggcccugcgcugccuggaggaauucucagcc

SEQ ID NO: 257352 - RNA, 32 nt, Human
uggcccugcugccucugucuauuucaauauag

SEQ ID NO: 257353 - RNA, 32 nt, Human
uggcccugcuguggcuccccagcuccagucgg

SEQ ID NO: 257354 - RNA, 21 nt, Human
uggcccugcuucuuccuccca

SEQ ID NO: 257355 - RNA, 18 nt, Human
uggcccuggacacccagu

SEQ ID NO: 257356 - RNA, 32 nt, Human
uggcccuggauggacucagggaagcacgggac

SEQ ID NO: 257357 - RNA, 32 nt, Human
uggcccuggcagcacagcucucaggcccagcc

SEQ ID NO: 257358 - RNA, 32 nt, Human
uggcccuggccuggcccguggcgcauccucac

SEQ ID NO: 257359 - RNA, 32 nt, Human
uggcccuggcuccaucucucugucaccucacc

SEQ ID NO: 257360 - RNA, 32 nt, Human
uggcccuggcugcuuuacacaaucuguucuau

SEQ ID NO: 257361 - RNA, 32 nt, Human
uggcccugggaaaauuuugaaugaaauuucaa

SEQ ID NO: 257362 - RNA, 32 nt, Human
uggcccugggacuucucucugcaggaggagag

SEQ ID NO: 257363 - RNA, 32 nt, Human
uggcccugggagaggcugggugagcuggggug

SEQ ID NO: 257364 - RNA, 32 nt, Human
uggcccugggcccggagucugcaggccgcgcu

SEQ ID NO: 257365 - RNA, 32 nt, Human
uggcccuggggaggacccucuugguggagggg

SEQ ID NO: 257366 - RNA, 18 nt, Human
uggcccuguacccagggc

SEQ ID NO: 257367 - RNA, 32 nt, Human
uggcccugugggcugaggguaaggcuggguag

SEQ ID NO: 257368 - RNA, 32 nt, Human
uggcccuuagacugagauucagagauaugaaa

SEQ ID NO: 257369 - RNA, 32 nt, Human
uggcccuuaggaggcccaaaagaggggcgaca

SEQ ID NO: 257370 - RNA, 32 nt, Human
uggcccuuccauugucagccuggaccugccaa

SEQ ID NO: 257371 - RNA, 32 nt, Human
uggcccuucucaaagugucccaugaaaaaguu

SEQ ID NO: 257372 - RNA, 32 nt, Human
uggcccuugcagcccauaccaguuucgacuga

SEQ ID NO: 257373 - RNA, 32 nt, Human
uggcccuugcccaaggcagggaagaaggaugu

SEQ ID NO: 257374 - RNA, 32 nt, Human
uggcccuugccuguagucucagcacuuuggga

SEQ ID NO: 257375 - RNA, 32 nt, Human
uggcccuuguuuucucccauguggacccugau

SEQ ID NO: 257376 - RNA, 32 nt, Human
uggcccuuucacucccccuuggcccuuucacu

SEQ ID NO: 257377 - RNA, 32 nt, Human
uggcccuuucuaaagggaaguauggcaguuag

SEQ ID NO: 257378 - RNA, 32 nt, Human
uggcccuuuucuuccuccuugaagcucccagu

SEQ ID NO: 257379 - RNA, 32 nt, Human
uggccgaacccccaccaccaccgccuccucca

SEQ ID NO: 257380 - RNA, 21 nt, Human
uggccgaacccccuuccugcc

SEQ ID NO: 257381 - RNA, 32 nt, Human
uggccgaaggggauguccuguuuucaccagag

SEQ ID NO: 257382 - RNA, 32 nt, Human
uggccgacauggcaaaaccccgucucuacuaa

SEQ ID NO: 257383 - RNA, 30 nt, Human
uggccgacauggugaaaccccaucucuacu

SEQ ID NO: 257384 - RNA, 32 nt, Human
uggccgacauggugaaaccccaucucuacuaa

SEQ ID NO: 257385 - RNA, 32 nt, Human
uggccgagaacugcacuugccucaguguucuc

SEQ ID NO: 257386 - RNA, 32 nt, Human
uggccgagacagcaggucccacccugcacagc

SEQ ID NO: 257387 - RNA, 17 nt, Human
uggccgagccacaggga

SEQ ID NO: 257388 - RNA, 32 nt, Human
uggccgagcugcagaacuccuugccaaagaac

SEQ ID NO: 257389 - RNA, 32 nt, Human
uggccgagcuuccucugggagggaggaaacag

SEQ ID NO: 257390 - RNA, 32 nt, Human
uggccgaggcgguugggcggaggcggagcagg

SEQ ID NO: 257391 - RNA, 32 nt, Human
uggccgagguuggucaugaggcugggguuccc

SEQ ID NO: 257392 - RNA, 23 nt, Human
uggccgcaccccccuuuccaggg

SEQ ID NO: 257393 - RNA, 21 nt, Human
uggccgcacguggacccaagg

SEQ ID NO: 257394 - RNA, 32 nt, Human
uggccgcaggcagauggauaugugggggacac

SEQ ID NO: 257395 - RNA, 32 nt, Human
uggccgcaguggccugcccugcucugagcacu

SEQ ID NO: 257396 - RNA, 32 nt, Human
uggccgcauucugcagacuuccuaucuucgug

SEQ ID NO: 257397 - RNA, 18 nt, Human
uggccgccaccuccggga

SEQ ID NO: 257398 - RNA, 18 nt, Human
uggccgccacucuccggg

SEQ ID NO: 257399 - RNA, 32 nt, Human
uggccgccauggagccucauccauccacacgu

SEQ ID NO: 257400 - RNA, 18 nt, Human
uggccgcccauuccgcga

SEQ ID NO: 257401 - RNA, 19 nt, Human
uggccgccccacuuuccgg

SEQ ID NO: 257402 - RNA, 32 nt, Human
uggccgcccccagcccccuccuggugccaccu

SEQ ID NO: 257403 - RNA, 25 nt, Human
uggccgccccgccccgcgccuccgg

SEQ ID NO: 257404 - RNA, 32 nt, Human
uggccgcccuggaggggagggugcgccugcaa

SEQ ID NO: 257405 - RNA, 27 nt, Human
uggccgccgccgcuccuccccccagga

SEQ ID NO: 257406 - RNA, 21 nt, Human
uggccgccgcgucccccgaga

SEQ ID NO: 257407 - RNA, 32 nt, Human
uggccgccguccccauccccugcccucagcac

SEQ ID NO: 257408 - RNA, 32 nt, Human
uggccgccuccucugugucauugucuguucuc

SEQ ID NO: 257409 - RNA, 32 nt, Human
uggccgccugcccuuucucuccgcuccagccu

SEQ ID NO: 257410 - RNA, 23 nt, Human
uggccgcgccuuaaagggccuca

SEQ ID NO: 257411 - RNA, 32 nt, Human
uggccgcggccaugcaguccugugccagggcg

SEQ ID NO: 257412 - RNA, 32 nt, Human
uggccgcggucuccauagagcugggggcgggc

SEQ ID NO: 257413 - RNA, 32 nt, Human
uggccgcguccagggucaccugugccuggucg

SEQ ID NO: 257414 - RNA, 32 nt, Human
uggccgcgucccacuccucaggccggggcgca

SEQ ID NO: 257415 - RNA, 32 nt, Human
uggccgcucacagacuggcaggcgggcgggcg

SEQ ID NO: 257416 - RNA, 32 nt, Human
uggccgcuccuggaggcggcggcgggagcgca

SEQ ID NO: 257417 - RNA, 32 nt, Human
uggccgcucucccgccccuccugggaucugug

SEQ ID NO: 257418 - RNA, 32 nt, Human
uggccgcugcaguuccagugguuauuucuaag

SEQ ID NO: 257419 - RNA, 32 nt, Human
uggccgcugccgccuccgccccagguuuugcg

SEQ ID NO: 257420 - RNA, 32 nt, Human
uggccgcugcugugacaggcaguguucuuggg

SEQ ID NO: 257421 - RNA, 17 nt, Human
uggccgcuggcccggga

SEQ ID NO: 257422 - RNA, 32 nt, Human
uggccgcuguaugaagcagccucgggcagggg

SEQ ID NO: 257423 - RNA, 20 nt, Human
uggccgcuguccucccgggg

SEQ ID NO: 257424 - RNA, 32 nt, Human
uggccggacgcugaagcccaggagagcgaugg

SEQ ID NO: 257425 - RNA, 32 nt, Human
uggccggagagggggcagccagagcggcagcc

SEQ ID NO: 257426 - RNA, 32 nt, Human
uggccggccacucccgucugcugugacgcgcg

SEQ ID NO: 257427 - RNA, 32 nt, Human
uggccggccaggcuucccgugcguuauacaca

SEQ ID NO: 257428 - RNA, 32 nt, Human
uggccggcccucccccugcucugcuucugcgc

SEQ ID NO: 257429 - RNA, 24 nt, Human
uggccggcgccuguaaucccagcu

SEQ ID NO: 257430 - RNA, 32 nt, Human
uggccggcgcugggccccagagcgaugacauc

SEQ ID NO: 257431 - RNA, 32 nt, Human
uggccggcuccucuccccaucugccuucuccu

SEQ ID NO: 257432 - RNA, 32 nt, Human
uggccggcuguggggagccaggcggccgcagu

SEQ ID NO: 257433 - RNA, 32 nt, Human
uggccgggacaagauaaacggagcugguggcg

SEQ ID NO: 257434 - RNA, 32 nt, Human
uggccgggagagggaggaagaggauggcaggg

SEQ ID NO: 257435 - RNA, 32 nt, Human
uggccgggcagggacagggcagaggacucuga

SEQ ID NO: 257436 - RNA, 19 nt, Human
uggccgggcaucgguccca

SEQ ID NO: 257437 - RNA, 32 nt, Human
uggccgggcggggcggugucuccuuucacagc

SEQ ID NO: 257438 - RNA, 30 nt, Human
uggccggggagccacaggcagggucugcug

SEQ ID NO: 257439 - RNA, 32 nt, Human
uggccggggccagaggcacaugcucugguuug

SEQ ID NO: 257440 - RNA, 18 nt, Human
uggccggggccccugcca

SEQ ID NO: 257441 - RNA, 32 nt, Human
uggccggggcugaagccacacagcccagaagg

SEQ ID NO: 257442 - RNA, 18 nt, Human
uggccgggguccuccaca

SEQ ID NO: 257443 - RNA, 32 nt, Human
uggccgggguggugaaaccccaucucuacuaa

SEQ ID NO: 257444 - RNA, 32 nt, Human
uggccgguaggcugcuggcgccuagguugugu

SEQ ID NO: 257445 - RNA, 19 nt, Human
uggccggugccuguaaucc

SEQ ID NO: 257446 - RNA, 20 nt, Human
uggccggugccuguaaucca

SEQ ID NO: 257447 - RNA, 24 nt, Human
uggccggugccuguaauccaagcu

SEQ ID NO: 257448 - RNA, 32 nt, Human
uggccgguggcucucauggccacugagggucu

SEQ ID NO: 257449 - RNA, 32 nt, Human
uggccguacaccugugcugaacggccagagac

SEQ ID NO: 257450 - RNA, 32 nt, Human
uggccguaugaaggugucucccagaagcauua

SEQ ID NO: 257451 - RNA, 32 nt, Human
uggccguaugugggugucuugaggcaguuuuu

SEQ ID NO: 257452 - RNA, 32 nt, Human
uggccguauucugccgucucacacuucuccau

SEQ ID NO: 257453 - RNA, 21 nt, Human
uggccgucacucccucugcca

SEQ ID NO: 257454 - RNA, 31 nt, Human
uggccguccaggugaaucacagcugaggagg

SEQ ID NO: 257455 - RNA, 32 nt, Human
uggccguccucacaccugugcgcagcccgacc

SEQ ID NO: 257456 - RNA, 32 nt, Human
uggccgucuucuuccagggaacgagaggucac

SEQ ID NO: 257457 - RNA, 32 nt, Human
uggccgugagagagacaggagaggaaggaggg

SEQ ID NO: 257458 - RNA, 32 nt, Human
uggccgugagaggacauugcugaggagagugg

SEQ ID NO: 257459 - RNA, 31 nt, Human
uggccgugcaauaaauaucugccgugaacag

SEQ ID NO: 257460 - RNA, 19 nt, Human
uggccgugcucccccggga

SEQ ID NO: 257461 - RNA, 32 nt, Human
uggccguggagagacacugcccccaggaugac

SEQ ID NO: 257462 - RNA, 32 nt, Human
uggccguggaggacccagagaagcgugugggc

SEQ ID NO: 257463 - RNA, 23 nt, Human
uggccgugucucguguguuguua

SEQ ID NO: 257464 - RNA, 22 nt, Human
uggccgugucugugugugugca

SEQ ID NO: 257465 - RNA, 31 nt, Human
uggccguuaaggaugccaaugccaagcucuc

SEQ ID NO: 257466 - RNA, 32 nt, Human
uggccguucagagcaccuugugguguaguggg

SEQ ID NO: 257467 - RNA, 16 nt, Human
uggccguucucugagc

SEQ ID NO: 257468 - RNA, 32 nt, Human
uggccuaaagaaucccacccccacuucaugcc

SEQ ID NO: 257469 - RNA, 32 nt, Human
uggccuaaauucucugccuuuuuaacuugcuu

SEQ ID NO: 257470 - RNA, 32 nt, Human
uggccuaauccuuccucuaggagaagagcauu

SEQ ID NO: 257471 - RNA, 23 nt, Human
uggccuaaugaucugcccaccuc

SEQ ID NO: 257472 - RNA, 32 nt, Human
uggccuacaugguugaaaccccaucucuacua

SEQ ID NO: 257473 - RNA, 32 nt, Human
uggcuuaugccuguaaucccagcaugcuggga

SEQ ID NO: 257474 - RNA, 32 nt, Human
uggcuuaugccuguaaucccgguacuuuggga

SEQ ID NO: 257475 - RNA, 32 nt, Human
uggcuuaugccuguaaucccugcacuuuggga

SEQ ID NO: 257476 - RNA, 21 nt, Human
uggcuuaugccuguaauccua

SEQ ID NO: 257477 - RNA, 32 nt, Human
uggcuuaugccuguaauccuagaacuuuggga

SEQ ID NO: 257478 - RNA, 32 nt, Human
uggcuuaugccuguaauccuagcgcuuuggga

SEQ ID NO: 257479 - RNA, 21 nt, Human
uggcuuaugccuguaaucuca

SEQ ID NO: 257480 - RNA, 32 nt, Human
uggcuuaugccuguaauugcagcacuuuuaga

SEQ ID NO: 257481 - RNA, 18 nt, Human
uggcuuaugccuguaguc

SEQ ID NO: 257482 - RNA, 21 nt, Human
uggcuuaugcuuguaauccca

SEQ ID NO: 257483 - RNA, 32 nt, Human
uggcuuaugcuuguaaucccagcacuuuggga

SEQ ID NO: 257484 - RNA, 32 nt, Human
uggcuuauucacauuaauaaaaaucacaagcu

SEQ ID NO: 257485 - RNA, 21 nt, Human
uggcuuauuccuguaauccca

SEQ ID NO: 257486 - RNA, 32 nt, Human
uggcuuauuugaaaaacaucuuuauguugaga

SEQ ID NO: 257487 - RNA, 32 nt, Human
uggcuucaagcaauccuuccacuuuggccuuc

SEQ ID NO: 257488 - RNA, 26 nt, Human
uggcuucaagcgauucucccaccuca

SEQ ID NO: 257489 - RNA, 32 nt, Human
uggcuucaagcgauucucccaccucagccucc

SEQ ID NO: 257490 - RNA, 32 nt, Human
uggcuucaccacagugcugccugggcaccucu

SEQ ID NO: 257491 - RNA, 32 nt, Human
uggcuucaccgcccuacuuccaccuccgccca

SEQ ID NO: 257492 - RNA, 22 nt, Human
uggcuucacgccuguaauacca

SEQ ID NO: 257493 - RNA, 32 nt, Human
uggcuucacuagagagaguccauucagcagaa

SEQ ID NO: 257494 - RNA, 32 nt, Human
uggcuucacugcagguaaugccuuucccuuca

SEQ ID NO: 257495 - RNA, 32 nt, Human
uggcuucagaggccuggcaucuucuggagaag

SEQ ID NO: 257496 - RNA, 18 nt, Human
uggcuucagaggcucaca

SEQ ID NO: 257497 - RNA, 32 nt, Human
uggcuucagcccaggcguggugucaguuuccu

SEQ ID NO: 257498 - RNA, 32 nt, Human
uggcuucagccucugcagucaggaugaagccc

SEQ ID NO: 257499 - RNA, 32 nt, Human
uggcuucaggcaauucuccugccuuugccucc

SEQ ID NO: 257500 - RNA, 24 nt, Human
uggcuucagggaggaccuagcaga

SEQ ID NO: 257501 - RNA, 32 nt, Human
uggcuucagggugggaguaguuggagcauugg

SEQ ID NO: 257502 - RNA, 32 nt, Human
uggcuucaggguggggccuugagaaggggaau

SEQ ID NO: 257503 - RNA, 32 nt, Human
uggcuucagggugggguuuggaagcuucugga

SEQ ID NO: 257504 - RNA, 21 nt, Human
uggcuucauaguacaggggga

SEQ ID NO: 257505 - RNA, 32 nt, Human
uggcuucauauauguaacgugagguauuaaug

SEQ ID NO: 257506 - RNA, 32 nt, Human
uggcuucaugacaccacaguccuggucuuucu

SEQ ID NO: 257507 - RNA, 32 nt, Human
uggcuuccaucuuuugcaucaccaccacuccu

SEQ ID NO: 257508 - RNA, 32 nt, Human
uggcuuccaugugcagcacucuucccaauugc

SEQ ID NO: 257509 - RNA, 32 nt, Human
uggcuuccauugaggagcccaggcuggggcca

SEQ ID NO: 257510 - RNA, 32 nt, Human
uggcuuccccuccccaccccacgcgugcauaa

SEQ ID NO: 257511 - RNA, 32 nt, Human
uggcuucccuggcaugauggacaaaggccugg

SEQ ID NO: 257512 - RNA, 32 nt, Human
uggcuuccucauucaucccucuugcuaaaaga

SEQ ID NO: 257513 - RNA, 32 nt, Human
uggcuuccugaaggagggggcaguggcgcagg

SEQ ID NO: 257514 - RNA, 32 nt, Human
uggcuuccugcucgaccucccugagucugauc

SEQ ID NO: 257515 - RNA, 32 nt, Human
uggcuuccuggaaucaaaaugugaauucaugu

SEQ ID NO: 257516 - RNA, 32 nt, Human
uggcuucgcuggucggaucguccuccuggccc

SEQ ID NO: 257517 - RNA, 28 nt, Human
uggcuucggggugcugccucucccuccc

SEQ ID NO: 257518 - RNA, 32 nt, Human
uggcuucguguaggauggugaucgggguggga

SEQ ID NO: 257519 - RNA, 32 nt, Human
uggcuucuagggaggccucaggaagcuuacag

SEQ ID NO: 257520 - RNA, 32 nt, Human
uggcuucuagguacugucuucuggaccucaga

SEQ ID NO: 257521 - RNA, 18 nt, Human
uggcuucuauucaagucc

SEQ ID NO: 257522 - RNA, 32 nt, Human
uggcuucucaauuuucuuccuucucugccccu

SEQ ID NO: 257523 - RNA, 32 nt, Human
uggcuucucacugccaccucaaacccgcugcc

SEQ ID NO: 257524 - RNA, 32 nt, Human
uggcuucucauggggaugguucauccccgacu

SEQ ID NO: 257525 - RNA, 32 nt, Human
uggcuucuccaccugcuccugccuggacggcg

SEQ ID NO: 257526 - RNA, 32 nt, Human
uggcuucuccaccuuugauccauucugcacag

SEQ ID NO: 257527 - RNA, 32 nt, Human
uggcuucuccauccuacccaagguaacagugu

SEQ ID NO: 257528 - RNA, 32 nt, Human
uggcuucuccauccucauuugcaaaccucaga

SEQ ID NO: 257529 - RNA, 32 nt, Human
uggcuucuccauccuguuuucugcaacauucu

SEQ ID NO: 257530 - RNA, 32 nt, Human
uggcuucucccauggggacccagaagucccua

SEQ ID NO: 257531 - RNA, 32 nt, Human
uggcuucuccucagggcaaccccugcccaacc

SEQ ID NO: 257532 - RNA, 32 nt, Human
uggcuucuccucggaccucugugaauauuuau

SEQ ID NO: 257533 - RNA, 32 nt, Human
uggcuucuccugggcucuggcauuaguugguc

SEQ ID NO: 257534 - RNA, 32 nt, Human
uggcuucucgugguuuuucccaccccagcugc

SEQ ID NO: 257535 - RNA, 32 nt, Human
uggcuucucugccuccagccuuugggguagcc

SEQ ID NO: 257536 - RNA, 19 nt, Human
uggcuucucuugagucaca

SEQ ID NO: 257537 - RNA, 32 nt, Human
uggcuucugaggcuacagaacuccaacccaga

SEQ ID NO: 257538 - RNA, 26 nt, Human
uggcuucugaucuccacuccacuuua

SEQ ID NO: 257539 - RNA, 32 nt, Human
uggcuucugcgugcuuucucccuuccguccua

SEQ ID NO: 257540 - RNA, 18 nt, Human
uggcuucugcugcugcug

SEQ ID NO: 257541 - RNA, 24 nt, Human
uggcuucuggauaucgcccaccuu

SEQ ID NO: 257542 - RNA, 32 nt, Human
uggcuucugggagcuggaaagagcuggcuuag

SEQ ID NO: 257543 - RNA, 32 nt, Human
uggcuucugggcacaaugggaaguuaucccuu

SEQ ID NO: 257544 - RNA, 32 nt, Human
uggcuucugggggagagcuuggggcagcagag

SEQ ID NO: 257545 - RNA, 32 nt, Human
uggcuucuguaaucccaggacuuugggaggcc

SEQ ID NO: 257546 - RNA, 32 nt, Human
uggcuucuguuuccagcucugacacaccgacc

SEQ ID NO: 257547 - RNA, 32 nt, Human
uggcuucuuagagugagagaaguauguggaca

SEQ ID NO: 257548 - RNA, 32 nt, Human
uggcuucuuccuauuugccaugggcuucacug

SEQ ID NO: 257549 - RNA, 32 nt, Human
uggcuucuuccuucaggaacugaagaaccccc

SEQ ID NO: 257550 - RNA, 18 nt, Human
uggcuucuucuagucgca

SEQ ID NO: 257551 - RNA, 17 nt, Human
uggcuucuucuggucac

SEQ ID NO: 257552 - RNA, 32 nt, Human
uggcuucuucuuugaucucucuuugaccauac

SEQ ID NO: 257553 - RNA, 32 nt, Human
uggcuucuugagaaggcucacagcuguggucu

SEQ ID NO: 257554 - RNA, 18 nt, Human
uggcuugaacccagcaga

SEQ ID NO: 257555 - RNA, 32 nt, Human
uggcuugaacccagcagauggagguugcagug

SEQ ID NO: 257556 - RNA, 32 nt, Human
uggcuugaacccaggaggcagagguugcagug

SEQ ID NO: 257557 - RNA, 32 nt, Human
uggcuugaacccaggagguggagguugcggug

SEQ ID NO: 257558 - RNA, 32 nt, Human
uggcuugaacccaggagguggagguugcugug

SEQ ID NO: 257559 - RNA, 32 nt, Human
uggcuugaaccccagaggcggagguugcagug

SEQ ID NO: 257560 - RNA, 32 nt, Human
uggcuugaaccuuuucccuucaguaauaacgu

SEQ ID NO: 257561 - RNA, 32 nt, Human
uggcuugaagaggaauaauauacacauaacuu

SEQ ID NO: 257562 - RNA, 24 nt, Human
uggcuugacuggauggaaggagac

SEQ ID NO: 257563 - RNA, 32 nt, Human
uggcuugagcccaggagguggagguugcagug

SEQ ID NO: 257564 - RNA, 32 nt, Human
uggcuugagcccaggagguugaggcugcagug

SEQ ID NO: 257565 - RNA, 32 nt, Human
uggcuugagcccaggagguugaggucacagug

SEQ ID NO: 257566 - RNA, 32 nt, Human
uggcuugagcccaggaguucaagaccagccug

SEQ ID NO: 257567 - RNA, 32 nt, Human
uggcuugagcccaggaguuugagguugcagug

SEQ ID NO: 257568 - RNA, 32 nt, Human
uggcuugagcccuagagguugaggcugcagug

SEQ ID NO: 257569 - RNA, 20 nt, Human
uggcuugagugauccucccg

SEQ ID NO: 257570 - RNA, 32 nt, Human
uggcuugaucaagugggcuuuggauccauaug

SEQ ID NO: 257571 - RNA, 32 nt, Human
uggcuugaucauagcucacugcagccuugagc

SEQ ID NO: 257572 - RNA, 32 nt, Human
uggcuugaucccuggcugaaucaccuggauga

SEQ ID NO: 257573 - RNA, 23 nt, Human
uggcuugaucucggcucacugca

SEQ ID NO: 257574 - RNA, 23 nt, Human
uggcuugaucucggcucauugca

SEQ ID NO: 257575 - RNA, 32 nt, Human
uggcuugauucagacuggaguggauaggauaa

SEQ ID NO: 257576 - RNA, 32 nt, Human
uggcuugcaagcuguucauuuuucugaaggag

SEQ ID NO: 257577 - RNA, 21 nt, Human
uggcuugcaccuguaauccca

SEQ ID NO: 257578 - RNA, 23 nt, Human
uggcuugcaccuguaaucccagc

SEQ ID NO: 257579 - RNA, 32 nt, Human
uggcuugcaccuguaaucccagcacuuuggga

SEQ ID NO: 257580 - RNA, 32 nt, Human
uggcuugccucccuccuuccuccccucucaac

SEQ ID NO: 257581 - RNA, 32 nt, Human
uggcuugcugcagccucaaccuccugggcuca

SEQ ID NO: 257582 - RNA, 32 nt, Human
uggcuugcugggaggugggcugcagcacagag

SEQ ID NO: 257583 - RNA, 32 nt, Human
uggcuugcuuugauguauguuuggaaagaugu

SEQ ID NO: 257584 - RNA, 32 nt, Human
uggcuuggaaucaccaacucugccuguauugu

SEQ ID NO: 257585 - RNA, 21 nt, Human
uggcuuggacagccccaguga

SEQ ID NO: 257586 - RNA, 19 nt, Human
uggcuuggacccagggaga

SEQ ID NO: 257587 - RNA, 32 nt, Human
uggcuuggacugugaggguagaguaggcucgc

SEQ ID NO: 257588 - RNA, 32 nt, Human
uggcuuggagcagaggugggggucggcgccuu

SEQ ID NO: 257589 - RNA, 32 nt, Human
uggcuuggcaucugcacuccagcccaggacug

SEQ ID NO: 257590 - RNA, 32 nt, Human
uggcuuggccagcagaaccagccccaagccag

SEQ ID NO: 257591 - RNA, 32 nt, Human
uggcuugggcccaggaggucgaggcugcggug

SEQ ID NO: 257592 - RNA, 32 nt, Human
uggcuugggcuggagucacgggggcggucucu

SEQ ID NO: 257593 - RNA, 19 nt, Human
uggcuuggggccagaagga

SEQ ID NO: 257594 - RNA, 32 nt, Human
uggcuugggggaaaaggauaguuuugucuccu

SEQ ID NO: 257595 - RNA, 32 nt, Human
uggcuuggugaggacagcaggaggggcccaca

SEQ ID NO: 257596 - RNA, 32 nt, Human
uggcuuggugucagggagaggcuguagagugg

SEQ ID NO: 257597 - RNA, 32 nt, Human
uggcuugguuacugugacuguagcuggagugg

SEQ ID NO: 257598 - RNA, 21 nt, Human
uggcuuguacccguaauccca

SEQ ID NO: 257599 - RNA, 32 nt, Human
uggcuuguccaaggccacacagcuggcuugaa

SEQ ID NO: 257600 - RNA, 32 nt, Human
uggcuugucucaggaguguugaaugugugccc

SEQ ID NO: 257601 - RNA, 32 nt, Human
uggcuugugagacucaugguguccuugucccu

SEQ ID NO: 257602 - RNA, 32 nt, Human
uggcuugugcacuccagagcagcauccugagu

SEQ ID NO: 257603 - RNA, 21 nt, Human
uggcuugugccuguaauccca

SEQ ID NO: 257604 - RNA, 32 nt, Human
uggcuugugccuguaaucccagaacuuuggaa

SEQ ID NO: 257605 - RNA, 32 nt, Human
uggcuugugccuguagucccagcuacuuggga

SEQ ID NO: 257606 - RNA, 32 nt, Human
uggcuuguguucuguuccuuucacaaaagcuc

SEQ ID NO: 257607 - RNA, 32 nt, Human
uggcuuguuccaagcgcugccuucuccaacug

SEQ ID NO: 257608 - RNA, 21 nt, Human
uggcuuguuccuguaguccca

SEQ ID NO: 257609 - RNA, 32 nt, Human
uggcuuguuuccaucacuggaaaucacuuaga

SEQ ID NO: 257610 - RNA, 21 nt, Human
uggcuuguuuuuaaagcuuua

SEQ ID NO: 257611 - RNA, 26 nt, Human
uggcuuuaaaggucuaccccacuuua

SEQ ID NO: 257612 - RNA, 32 nt, Human
uggcuuuaagcuccgcuucugucaguauuugc

SEQ ID NO: 257613 - RNA, 32 nt, Human
uggcuuuacaggguucucagagauguggggua

SEQ ID NO: 257614 - RNA, 32 nt, Human
uggcuuuaccaguguugacagaaaaauuuuaa

SEQ ID NO: 257615 - RNA, 32 nt, Human
uggcuuuagguuuuucuugaagaauuaggaaa

SEQ ID NO: 257616 - RNA, 32 nt, Human
uggcuuuauuaucaccucacuacuuuuuagag

SEQ ID NO: 257617 - RNA, 19 nt, Human
uggcuuuauucuaauccca

SEQ ID NO: 257618 - RNA, 32 nt, Human
uggcuuucaaauggucacccauuuuucuuuca

SEQ ID NO: 257619 - RNA, 32 nt, Human
uggcuuucagcagcuguggggaggugggacug

SEQ ID NO: 257620 - RNA, 32 nt, Human
uggcuuuccaucucagccucggagggcaacau

SEQ ID NO: 257621 - RNA, 32 nt, Human
uggcuuuccaugcuccucucccuccaccuccu

SEQ ID NO: 257622 - RNA, 31 nt, Human
uggcuuucccucucugggccucagucuguuc

SEQ ID NO: 257623 - RNA, 21 nt, Human
uggcuuucuaacccccugcca

SEQ ID NO: 257624 - RNA, 32 nt, Human
uggcuuucuaauaccaauuguaauauuuacaa

SEQ ID NO: 257625 - RNA, 32 nt, Human
uggcuuucuccucagcaggucccaccacccuc

SEQ ID NO: 257626 - RNA, 32 nt, Human
uggcuuucugcaaccucugccucccagguuca

SEQ ID NO: 257627 - RNA, 32 nt, Human
uggcuuucuggcugcuggaggcuggggagaag

SEQ ID NO: 257628 - RNA, 32 nt, Human
uggcuuugaaggaggaagacaccuugagccaa

SEQ ID NO: 257629 - RNA, 32 nt, Human
uggcuuugaccaugaaacugugaauggcccua

SEQ ID NO: 257630 - RNA, 32 nt, Human
uggcuuugagaaggaagggaagauggaacagg

SEQ ID NO: 257631 - RNA, 32 nt, Human
uggcuuugagauacaguucaguuuuuauuagg

SEQ ID NO: 257632 - RNA, 19 nt, Human
uggcuuugagcccucuaca

SEQ ID NO: 257633 - RNA, 32 nt, Human
uggcuuugaggagaauccucucugccauucuu

SEQ ID NO: 257634 - RNA, 22 nt, Human
uggcuuugaugaggcccacuuc

SEQ ID NO: 257635 - RNA, 17 nt, Human
uggcuuugauuucggca

SEQ ID NO: 257636 - RNA, 32 nt, Human
uggcuuugcacugagcagcucagucuacuggu

SEQ ID NO: 257637 - RNA, 32 nt, Human
uggcuuugcagaacagagguagcaaugucacc

SEQ ID NO: 257638 - RNA, 32 nt, Human
uggcuuugccagagguugcaacauguugagag

SEQ ID NO: 257639 - RNA, 32 nt, Human
uggcuuugcccaccccucacuccccagggagc

SEQ ID NO: 257640 - RNA, 30 nt, Human
uggcuuugccucuccuguguccugucuuuc

SEQ ID NO: 257641 - RNA, 31 nt, Human
uggcuuugccucuccuguguccugucuuucu

SEQ ID NO: 257642 - RNA, 32 nt, Human
uggcuuugcgcggucucugccugcugagcagu

SEQ ID NO: 257643 - RNA, 32 nt, Human
uggcuuugcggagaagguuccaccuuacgcuc

SEQ ID NO: 257644 - RNA, 32 nt, Human
uggcuuugcucuggacaaaggguuccagagag

SEQ ID NO: 257645 - RNA, 32 nt, Human
uggcuuugcucugugcagaacccagcacacgu

SEQ ID NO: 257646 - RNA, 23 nt, Human
uggcuuugcugaucccccaccuc

SEQ ID NO: 257647 - RNA, 32 nt, Human
uggcuuuggaaagaccugugaggggaaaccuu

SEQ ID NO: 257648 - RNA, 32 nt, Human
uggcuuuggcaguggagccgccagucuuggug

SEQ ID NO: 257649 - RNA, 32 nt, Human
uggcuuugggagagagcagcagcaagguauuc

SEQ ID NO: 257650 - RNA, 32 nt, Human
uggcuuugggcaguucaggaggaggacuccau

SEQ ID NO: 257651 - RNA, 32 nt, Human
uggcuuugggcugagaggaugagggaggucuu

SEQ ID NO: 257652 - RNA, 20 nt, Human
uggcuuugggcuuccuccgc

SEQ ID NO: 257653 - RNA, 32 nt, Human
uggcuuugguagagucuccucuuguguuucau

SEQ ID NO: 257654 - RNA, 32 nt, Human
uggcuuuggucaccacgagucuagcucagggc

SEQ ID NO: 257655 - RNA, 21 nt, Human
uggcuuuggugguugguucca

SEQ ID NO: 257656 - RNA, 18 nt, Human
uggcuuuguacugagaaa

SEQ ID NO: 257657 - RNA, 32 nt, Human
uggcuuuguaggcugugcugugucugaagggg

SEQ ID NO: 257658 - RNA, 22 nt, Human
uggcuuuguccucacucucuca

SEQ ID NO: 257659 - RNA, 20 nt, Human
uggcuuuguggugccaccuc

SEQ ID NO: 257660 - RNA, 32 nt, Human
uggcuuugugucuccccugcuuuccccacgca

SEQ ID NO: 257661 - RNA, 32 nt, Human
uggcuuuguugcuucucuaucuguauuuagcu

SEQ ID NO: 257662 - RNA, 31 nt, Human
uggcuuuuaauaaauacucauugguugaaac

SEQ ID NO: 257663 - RNA, 21 nt, Human
uggcuuuuauuccuuuccaca

SEQ ID NO: 257664 - RNA, 32 nt, Human
uggcuuuucccaaaguuucugacuuugugguu

SEQ ID NO: 257665 - RNA, 32 nt, Human
uggcuuuucuaccuguaacaugcacauagagc

SEQ ID NO: 257666 - RNA, 32 nt, Human
uggcuuuucucccaacuuuuuguuuuacguau

SEQ ID NO: 257667 - RNA, 32 nt, Human
uggcuuuucucccagccccuuuccaugccuuu

SEQ ID NO: 257668 - RNA, 32 nt, Human
uggcuuuucuuagagccucuuggagacaacau

SEQ ID NO: 257669 - RNA, 22 nt, Human
uggcuuuugaauaucuuccaca

SEQ ID NO: 257670 - RNA, 32 nt, Human
uggcuuuugagguuccugguucuugaagccag

SEQ ID NO: 257671 - RNA, 21 nt, Human
uggcuuuugccuguaauccca

SEQ ID NO: 257672 - RNA, 32 nt, Human
uggcuuuugccuguaaucccaacacuuuggga

SEQ ID NO: 257673 - RNA, 27 nt, Human
uggcuuuugcugauuucauuuauuuua

SEQ ID NO: 257674 - RNA, 32 nt, Human
uggcuuuugcugcucuguucucccucuacauu

SEQ ID NO: 257675 - RNA, 32 nt, Human
uggcuuuuugcacgugaguaugauccaggauu

SEQ ID NO: 257676 - RNA, 32 nt, Human
uggcuuuuuggagagggaaauuuggaaacggg

SEQ ID NO: 257677 - RNA, 32 nt, Human
uggcuuuuugggcuguuugcuuuugcuacuac

SEQ ID NO: 257678 - RNA, 32 nt, Human
uggcuuuuugugaaugugcagugcaacuuuuu

SEQ ID NO: 257679 - RNA, 16 nt, Human
ugggaaaaacugugau

SEQ ID NO: 257680 - RNA, 32 nt, Human
ugggaaaaagagacucuuuuaggaucagaucu

SEQ ID NO: 257681 - RNA, 32 nt, Human
ugggaaaacagcaagccacagagcggaacaag

SEQ ID NO: 257682 - RNA, 32 nt, Human
ugggaaaacagcuucugagccauuuuggggag

SEQ ID NO: 257683 - RNA, 32 nt, Human
ugggaaaaccaaaagaauucacggauccuuug

SEQ ID NO: 257684 - RNA, 22 nt, Human
ugggaaaacuggauuacuuuca

SEQ ID NO: 257685 - RNA, 32 nt, Human
ugggaaaagacaggagaaguacugacucaacu

SEQ ID NO: 257686 - RNA, 32 nt, Human
ugggaaaagacuugccuucugccagaacuuaa

SEQ ID NO: 257687 - RNA, 32 nt, Human
ugggaaaagagaucacguggauuccggucaaa

SEQ ID NO: 257688 - RNA, 32 nt, Human
ugggaaaagccagaagccagaggggcacaagg

SEQ ID NO: 257689 - RNA, 32 nt, Human
ugggaaaagcgggugagcaggaggcaugaggu

SEQ ID NO: 257690 - RNA, 32 nt, Human
ugggaaaaggaaaggucgagagaaucuugucc

SEQ ID NO: 257691 - RNA, 32 nt, Human
ugggaaaagggaggcagaggaggcagaggcag

SEQ ID NO: 257692 - RNA, 32 nt, Human
ugggaaaaggggauauucaaaaguucuguggu

SEQ ID NO: 257693 - RNA, 32 nt, Human
ugggaaaaggucaagaaagaggcagaaagaga

SEQ ID NO: 257694 - RNA, 32 nt, Human
ugggaaaagucaguaaaaaugauacugaagag

SEQ ID NO: 257695 - RNA, 32 nt, Human
ugggaaaaugcacacauuucugaggggagagg

SEQ ID NO: 257696 - RNA, 32 nt, Human
ugggaaaaugcacguggagaugaaaccagauu

SEQ ID NO: 257697 - RNA, 32 nt, Human
ugggaaaauuacuguuaccucuaccaucuuaa

SEQ ID NO: 257698 - RNA, 20 nt, Human
ugggaaacacacagaaauuu

SEQ ID NO: 257699 - RNA, 32 nt, Human
ugggaaacaggaacuccucgaccucaggccaa

SEQ ID NO: 257700 - RNA, 32 nt, Human
ugggaaacauaaagcagaauugggagggacuu

SEQ ID NO: 257701 - RNA, 32 nt, Human
ugggaaacauaacaagaccccgucucuacaaa

SEQ ID NO: 257702 - RNA, 32 nt, Human
ugggaaacauagugagaccccgucucuacaaa

SEQ ID NO: 257703 - RNA, 32 nt, Human
ugggaaacauggcaaaaccccaucucuauaaa

SEQ ID NO: 257704 - RNA, 32 nt, Human
ugggaaacauggcaaaacccgucuuuaugugc

SEQ ID NO: 257705 - RNA, 32 nt, Human
ugggaaacauggcaaaaucccaucucuacaac

SEQ ID NO: 257706 - RNA, 32 nt, Human
ugggaaacauggcaaaauccucucucuauuuu

SEQ ID NO: 257707 - RNA, 32 nt, Human
ugggaaacccagccugggaaggcagcauucca

SEQ ID NO: 257708 - RNA, 32 nt, Human
ugggaaacccucuccaucucccaaggcugcca

SEQ ID NO: 257709 - RNA, 32 nt, Human
ugggaaacguggcgaaaccccaucucuacuaa

SEQ ID NO: 257710 - RNA, 32 nt, Human
ugggaaacucacagcuggacucaggggacacg

SEQ ID NO: 257711 - RNA, 32 nt, Human
ugggaaacugcuuuuccacaaggaaucuccgu

SEQ ID NO: 257712 - RNA, 32 nt, Human
ugggaaacuguaccuaccucucuucccacugc

SEQ ID NO: 257713 - RNA, 32 nt, Human
ugggaaacuucucacugaugugcucaaguaca

SEQ ID NO: 257714 - RNA, 32 nt, Human
ugggaaagaaucaguaagaugcagggcugacu

SEQ ID NO: 257715 - RNA, 32 nt, Human
ugggaaagaaucaguaggaugacagggcugac

SEQ ID NO: 257716 - RNA, 32 nt, Human
ugggaaagacuggaguaucucagucccucuca

SEQ ID NO: 257717 - RNA, 32 nt, Human
ugggaaagaggacucacaguuagccagcugac

SEQ ID NO: 257718 - RNA, 23 nt, Human
ugggaaagcagagguugcaguga

SEQ ID NO: 257719 - RNA, 32 nt, Human
ugggaaagcccaaccugguucuuuaacaaggc

SEQ ID NO: 257720 - RNA, 32 nt, Human
ugggaaagcccaggccgcaggagugggaugcc

SEQ ID NO: 257721 - RNA, 20 nt, Human
ugggaaagcugucugagaca

SEQ ID NO: 257722 - RNA, 32 nt, Human
ugggaaaggaaaggaccacagcaaacaccauu

SEQ ID NO: 257723 - RNA, 32 nt, Human
ugggaaaggaagagaaggagcaaguaagaaug

SEQ ID NO: 257724 - RNA, 32 nt, Human
ugggaaaggaggaccugcaaccaucugacuug

SEQ ID NO: 257725 - RNA, 21 nt, Human
ugggaaaggauucacaguaag

SEQ ID NO: 257726 - RNA, 32 nt, Human
ugggaaaggcugggaucauauguauuucuaug

SEQ ID NO: 257727 - RNA, 32 nt, Human
ugggaaagggagcaaggggcagauagcucagc

SEQ ID NO: 257728 - RNA, 32 nt, Human
ugggaaagggguucauuucacaaaaggaaaau

SEQ ID NO: 257729 - RNA, 32 nt, Human
ugggaaagucuugggagugagggguuguggug

SEQ ID NO: 257730 - RNA, 32 nt, Human
ugggaaagugaaaacaacaagcuaacccacau

SEQ ID NO: 257731 - RNA, 21 nt, Human
ugggaaagugcccuggaccgg

SEQ ID NO: 257732 - RNA, 32 nt, Human
ugggaaagugcuagcugugcucaccuucaugg

SEQ ID NO: 257733 - RNA, 32 nt, Human
ugggaaaucagcgccuugcagagaugcugggg

SEQ ID NO: 257734 - RNA, 32 nt, Human
ugggaaaugagacuugcucucuggccuuuucc

SEQ ID NO: 257735 - RNA, 32 nt, Human
ugggaaaugcagauugcuagguucaccagccc

SEQ ID NO: 257736 - RNA, 32 nt, Human
ugggaaauuacuccgugcugugcaguggggcg

SEQ ID NO: 257737 - RNA, 32 nt, Human
ugggaaauucauguuguugaucuuuaauuauu

SEQ ID NO: 257738 - RNA, 32 nt, Human
ugggaaauucauuucaagcugcagaggaacgu

SEQ ID NO: 257739 - RNA, 32 nt, Human
ugggaaauucccaggguauuacuggaccuaug

SEQ ID NO: 257740 - RNA, 32 nt, Human
ugggaaauugcucuccccucuguggcuuggac

SEQ ID NO: 257741 - RNA, 32 nt, Human
ugggaacaaaggaggcucagagaggaaagacg

SEQ ID NO: 257742 - RNA, 32 nt, Human
ugggaacaagggaagagagagcaggagcuggg

SEQ ID NO: 257743 - RNA, 32 nt, Human
ugggaacacaaaccagcaucaccacagcaugu

SEQ ID NO: 257744 - RNA, 20 nt, Human
ugggaacacaauccagaaug

SEQ ID NO: 257745 - RNA, 21 nt, Human
ugggaacaccaguuucuagcu

SEQ ID NO: 257746 - RNA, 32 nt, Human
ugggaacagaagagagaaggaggcagggagau

SEQ ID NO: 257747 - RNA, 32 nt, Human
ugggaacagagagcaaacauuuugggaugaug

SEQ ID NO: 257748 - RNA, 32 nt, Human
ugggaacagaguccuugucacuccaggggaug

SEQ ID NO: 257749 - RNA, 32 nt, Human
ugggaacagcugcuacccccaagacuugccac

SEQ ID NO: 257750 - RNA, 32 nt, Human
ugggaacaggauuccaggaccccuuucuuguu

SEQ ID NO: 257751 - RNA, 32 nt, Human
ugggaacagguggcagagaagugccauguuug

SEQ ID NO: 257752 - RNA, 32 nt, Human
ugggaacaucugccuuuucagucucuucugaa

SEQ ID NO: 257753 - RNA, 32 nt, Human
ugggaacaucuucaaugacaucugcaaccauu

SEQ ID NO: 257754 - RNA, 32 nt, Human
ugggaaccaacauucuuuggauuuagugggga

SEQ ID NO: 257755 - RNA, 32 nt, Human
ugggaaccaagcuauuccuuucccuuccucuu

SEQ ID NO: 257756 - RNA, 18 nt, Human
ugggaaccaagggcccuc

SEQ ID NO: 257757 - RNA, 19 nt, Human
ugggaaccacagaggaagg

SEQ ID NO: 257758 - RNA, 21 nt, Human
ugggaaccacaguuccuggcu

SEQ ID NO: 257759 - RNA, 32 nt, Human
ugggaaccaguucuuagccacuuggacacuga

SEQ ID NO: 257760 - RNA, 32 nt, Human
ugggaaccaugccugggcuuucaccuugaagc

SEQ ID NO: 257761 - RNA, 32 nt, Human
ugggaaccauggugucaauacauaucauguag

SEQ ID NO: 257762 - RNA, 20 nt, Human
ugggaacccaagcugaggga

SEQ ID NO: 257763 - RNA, 24 nt, Human
ugggaacccccuugcucccagggg

SEQ ID NO: 257764 - RNA, 20 nt, Human
ugggaaccccggguucaggg

SEQ ID NO: 257765 - RNA, 22 nt, Human
ugggaaccccugugccaagggg

SEQ ID NO: 257766 - RNA, 21 nt, Human
ugggaacccgcagccugggga

SEQ ID NO: 257767 - RNA, 32 nt, Human
ugggaacccgggaggcagagcuugcagugagc

SEQ ID NO: 257768 - RNA, 32 nt, Human
ugggaacccgggaggcggagcuugcagugagc

SEQ ID NO: 257769 - RNA, 21 nt, Human
ugggaacccuggcccagagga

SEQ ID NO: 257770 - RNA, 32 nt, Human
ugggaacccugggccaggagguuacagugguc

SEQ ID NO: 257771 - RNA, 32 nt, Human
ugggaaccuccaccuccuacuccccacccacc

SEQ ID NO: 257772 - RNA, 32 nt, Human
ugggaaccucccccucccuugugguuucagca

SEQ ID NO: 257773 - RNA, 22 nt, Human
ugggaaccucggggcccagggg

SEQ ID NO: 257774 - RNA, 32 nt, Human
ugggaaccuggaaguggguugcaucugacucu

SEQ ID NO: 257775 - RNA, 32 nt, Human
ugggaaccugggacccagagagaaaggaugca

SEQ ID NO: 257776 - RNA, 32 nt, Human
ugggaaccuucauaugugcaguauuuauauug

SEQ ID NO: 257777 - RNA, 32 nt, Human
ugggaacgauuucgcgcugaggaagacccuuu

SEQ ID NO: 257778 - RNA, 32 nt, Human
ugggaacgucacaucagacaauaggaacggcu

SEQ ID NO: 257779 - RNA, 19 nt, Human
ugggaacuccacucgggga

SEQ ID NO: 257780 - RNA, 32 nt, Human
ugggaacugcagaccuguccuccugguggguc

SEQ ID NO: 257781 - RNA, 23 nt, Human
ugggaacugcagggaggcucuga

SEQ ID NO: 257782 - RNA, 32 nt, Human
ugggaacuggaaagaaaguuacagaaaggaua

SEQ ID NO: 257783 - RNA, 32 nt, Human
ugggaacuucaugcugauuuguacauauugaa

SEQ ID NO: 257784 - RNA, 32 nt, Human
ugggaacuucuuucuugcccgccaagcccgca

SEQ ID NO: 257785 - RNA, 32 nt, Human
ugggaacuuggaaaucaagugagacccaagca

SEQ ID NO: 257786 - RNA, 32 nt, Human
ugggaagaaaaauuggucagcuuggcucgggg

SEQ ID NO: 257787 - RNA, 21 nt, Human
ugggaagaaagaguuugcugg

SEQ ID NO: 257788 - RNA, 32 nt, Human
ugggaagaaaucugguauccaagcuuaaauuu

SEQ ID NO: 257789 - RNA, 23 nt, Human
ugggaagaacaacaggaaaccaa

SEQ ID NO: 257790 - RNA, 32 nt, Human
ugggaagaacaacaggaaaccaaggucugacc

SEQ ID NO: 257791 - RNA, 23 nt, Human
ugggaagaacaggguugcauuua

SEQ ID NO: 257792 - RNA, 32 nt, Human
ugggaagaacccuuucuuuugugaccauagga

SEQ ID NO: 257793 - RNA, 24 nt, Human
ugggaagaacuggauaugugcuaa

SEQ ID NO: 257794 - RNA, 32 nt, Human
ugggaagaagagaagcgaggcuggggacacag

SEQ ID NO: 257795 - RNA, 32 nt, Human
ugggaagaaugggaagugacugcuuaauggau

SEQ ID NO: 257796 - RNA, 21 nt, Human
ugggaagaauuuggauaccaa

SEQ ID NO: 257797 - RNA, 24 nt, Human
ugggaagacaacuaggauacuuuc

SEQ ID NO: 257798 - RNA, 32 nt, Human
ugggaagacagcagagguguguagacagguag

SEQ ID NO: 257799 - RNA, 20 nt, Human
ugggaagaccuaugcuuuca

SEQ ID NO: 257800 - RNA, 32 nt, Human
ugggaagaccucucacaggcagcacuggcagg

SEQ ID NO: 257801 - RNA, 19 nt, Human
ugggaagaccuuaagccau

SEQ ID NO: 257802 - RNA, 32 nt, Human
ugggaagacgcuggucaguucaccugccccac

SEQ ID NO: 257803 - RNA, 21 nt, Human
ugggaagacucaaaauguaaa

SEQ ID NO: 257804 - RNA, 32 nt, Human
ugggaagagaacugggcugacuccaggaccuc

SEQ ID NO: 257805 - RNA, 32 nt, Human
ugggaagagagccugauggccugcacuuuuag

SEQ ID NO: 257806 - RNA, 32 nt, Human
ugggaagagagguucacagaggcccuugucua

SEQ ID NO: 257807 - RNA, 19 nt, Human
ugggaagagaguuugcugg

SEQ ID NO: 257808 - RNA, 32 nt, Human
ugggaagagccuugugcucuccacuuugccac

SEQ ID NO: 257809 - RNA, 32 nt, Human
ugggaagaggagaaugguguggauaugguucu

SEQ ID NO: 257810 - RNA, 32 nt, Human
ugggaagaggugacgcgugucccuggaacccc

SEQ ID NO: 257811 - RNA, 23 nt, Human
ugggaagaguaaggguugguuca

SEQ ID NO: 257812 - RNA, 32 nt, Human
ugggaagagucaggauuggccacauugccaau

SEQ ID NO: 257813 - RNA, 32 nt, Human
ugggaagaguguaagugacuacaguagucauu

SEQ ID NO: 257814 - RNA, 32 nt, Human
ugggaagaguuuagugugaaacugggguggaa

SEQ ID NO: 257815 - RNA, 23 nt, Human
ugggaagaucacuugagccccgg

SEQ ID NO: 257816 - RNA, 32 nt, Human
ugggaagaucaucuuccccuggagcuuggcca

SEQ ID NO: 257817 - RNA, 32 nt, Human
ugggaagaucccgggggcggcuuuggacagcc

SEQ ID NO: 257818 - RNA, 32 nt, Human
ugggaagaucccuugagcccaggaguucgaga

SEQ ID NO: 257819 - RNA, 32 nt, Human
ugggaagaucuuuuaaaaaggcaguaggcccg

SEQ ID NO: 257820 - RNA, 21 nt, Human
ugggaagaugccccuggggua

SEQ ID NO: 257821 - RNA, 32 nt, Human
ugggaagauggacgcagcuacucugaccuacg

SEQ ID NO: 257822 - RNA, 32 nt, Human
ugggaagauggccaggaauggacucauaccau

SEQ ID NO: 257823 - RNA, 23 nt, Human
ugggaagauugcuugaacucagg

SEQ ID NO: 257824 - RNA, 22 nt, Human
ugggaagauuugaaaucuuuua

SEQ ID NO: 257825 - RNA, 32 nt, Human
ugggaagcaccuuugugcuuucaaaggcaaga

SEQ ID NO: 257826 - RNA, 32 nt, Human
ugggaagccagccaugguaagggcuggugagg

SEQ ID NO: 257827 - RNA, 32 nt, Human
ugggaagccaggaagugggagggguggggguc

SEQ ID NO: 257828 - RNA, 32 nt, Human
ugggaagccugaucccgguguguggcccagcu

SEQ ID NO: 257829 - RNA, 32 nt, Human
ugggaagccuguaaucccagcuacuugggagg

SEQ ID NO: 257830 - RNA, 21 nt, Human
ugggaagcggacccuccugcc

SEQ ID NO: 257831 - RNA, 22 nt, Human
ugggaagcggagguugcaguga

SEQ ID NO: 257832 - RNA, 32 nt, Human
ugggaagcucugaggagguucauuguaauuuc

SEQ ID NO: 257833 - RNA, 32 nt, Human
ugggaagcuggcaaucugcaccuuggggccug

SEQ ID NO: 257834 - RNA, 32 nt, Human
ugggaagcugugguguggcugcaguggagagu

SEQ ID NO: 257835 - RNA, 32 nt, Human
ugggaagcuuguugcaagaagguugugggaaa

SEQ ID NO: 257836 - RNA, 32 nt, Human
ugggaaggaaaggggagagggagauucccaag

SEQ ID NO: 257837 - RNA, 32 nt, Human
ugggaaggaaggcagugccugcucugcuguga

SEQ ID NO: 257838 - RNA, 32 nt, Human
ugggaaggagacaggacauuccuguacuaagg

SEQ ID NO: 257839 - RNA, 19 nt, Human
ugggaaggagggagccggg

SEQ ID NO: 257840 - RNA, 32 nt, Human
ugggaaggagggagggagggcggugacuuggg

SEQ ID NO: 257841 - RNA, 32 nt, Human
ugggaaggauaagguguccaacagaaagugug

SEQ ID NO: 257842 - RNA, 32 nt, Human
ugggaaggcaagaugcccaacaacagcacugc

SEQ ID NO: 257843 - RNA, 23 nt, Human
ugggaaggcccacagcccaaggg

SEQ ID NO: 257844 - RNA, 32 nt, Human
ugggaaggcccaggcgagggccaauguugugu

SEQ ID NO: 257845 - RNA, 22 nt, Human
ugggaaggccuuuagccagggg

SEQ ID NO: 257846 - RNA, 22 nt, Human
ugggaaggcgcugggaccaagg

SEQ ID NO: 257847 - RNA, 32 nt, Human
ugggaaggcggaaauggccaaaccccaggcau

SEQ ID NO: 257848 - RNA, 32 nt, Human
ugggaaggcuaaggugggagaauccuugaggc

SEQ ID NO: 257849 - RNA, 32 nt, Human
ugggaaggcugaggcaggagaauugcuugaac

SEQ ID NO: 257850 - RNA, 32 nt, Human
ugggaaggcugagguaggagaaucuuuugaau

SEQ ID NO: 257851 - RNA, 24 nt, Human
ugggaaggcugcuaaaacccaggg

SEQ ID NO: 257852 - RNA, 32 nt, Human
ugggaaggcuguagguggagagaugggcuuau

SEQ ID NO: 257853 - RNA, 32 nt, Human
ugggaagggagacagaggcggcggcggcucag

SEQ ID NO: 257854 - RNA, 32 nt, Human
ugggaagggagggagagggggcgcagcucgca

SEQ ID NO: 257855 - RNA, 32 nt, Human
ugggaagggaugggacacagcuucuggcacca

SEQ ID NO: 257856 - RNA, 32 nt, Human
ugggaagggcaggcaggagcuggcuauucugu

SEQ ID NO: 257857 - RNA, 32 nt, Human
ugggaagggcgcaccuuccugccaaaagcaau

SEQ ID NO: 257858 - RNA, 21 nt, Human
ugggaagggcugguccagggg

SEQ ID NO: 257859 - RNA, 32 nt, Human
ugggaaggggaggagagcaaugaaaggcgcgu

SEQ ID NO: 257860 - RNA, 32 nt, Human
ugggaaggggcagcucauguucagguuuccag

SEQ ID NO: 257861 - RNA, 32 nt, Human
ugggaagggggaccgaaucuucccugggagga

SEQ ID NO: 257862 - RNA, 32 nt, Human
ugggaagggggcaggggugaggagcugagccu

SEQ ID NO: 257863 - RNA, 32 nt, Human
ugggaagggguuuuaauaaacagacccuggcg

SEQ ID NO: 257864 - RNA, 23 nt, Human
ugggaaggucacuugagcccagg

SEQ ID NO: 257865 - RNA, 32 nt, Human
ugggaagguggaggccggcagggcggaggcgg

SEQ ID NO: 257866 - RNA, 32 nt, Human
ugggaaggugggaggugcagccagucuagacc

SEQ ID NO: 257867 - RNA, 21 nt, Human
ugggaagguuaaaccgcaggg

SEQ ID NO: 257868 - RNA, 32 nt, Human
ugggaaguaacugccucugacuucaacucaag

SEQ ID NO: 257869 - RNA, 32 nt, Human
ugggaaguaaugaguuguugaccuugaguuga

SEQ ID NO: 257870 - RNA, 32 nt, Human
ugggaaguagcuguacaaagaaaaugauauga

SEQ ID NO: 257871 - RNA, 32 nt, Human
ugggaaguaucucagagaaucagcuaaguuuc

SEQ ID NO: 257872 - RNA, 32 nt, Human
ugggaagucucagcagcucuucuggcuguguu

SEQ ID NO: 257873 - RNA, 32 nt, Human
ugggaagugccaagccacgcggccucaaggga

SEQ ID NO: 257874 - RNA, 32 nt, Human
ugggaaguggagcccccggagcugcuaccgug

SEQ ID NO: 257875 - RNA, 32 nt, Human
ugggaaguggggcuauaggcagccucucugau

SEQ ID NO: 257876 - RNA, 32 nt, Human
ugggaaguggguuggagggaggccaggccggc

SEQ ID NO: 257877 - RNA, 32 nt, Human
ugggaagugguaggacucuggaagaggccaca

SEQ ID NO: 257878 - RNA, 32 nt, Human
ugggaaguguucuuccugccuuucugcuaggu

SEQ ID NO: 257879 - RNA, 32 nt, Human
ugggaaguucaaaagaaagaauaacaggaccu

SEQ ID NO: 257880 - RNA, 32 nt, Human
ugggaaguucacugccccaacucuuuucccgg

SEQ ID NO: 257881 - RNA, 32 nt, Human
ugggaaguucaggaggugggaacuuuguacac

SEQ ID NO: 257882 - RNA, 32 nt, Human
ugggaaguugcaugcugccuccuggguuuuau

SEQ ID NO: 257883 - RNA, 32 nt, Human
ugggaauaaagauggccaugaacagucacaaa

SEQ ID NO: 257884 - RNA, 32 nt, Human
ugggaauaaauaugccucuccuuuguauauua

SEQ ID NO: 257885 - RNA, 32 nt, Human
ugggaauacaggcacgccaccaugcccagcua

SEQ ID NO: 257886 - RNA, 21 nt, Human
ugggaauacaggcaugagcca

SEQ ID NO: 257887 - RNA, 32 nt, Human
ugggaauacuuguguugagcacuugcugugug

SEQ ID NO: 257888 - RNA, 32 nt, Human
ugggaauaugccagaccugugcccguggaaga

SEQ ID NO: 257889 - RNA, 32 nt, Human
ugggaaucaaguuuggagacccacgcuggaca

SEQ ID NO: 257890 - RNA, 32 nt, Human
ugggaaucacauaagggugaaaccagaaacga

SEQ ID NO: 257891 - RNA, 32 nt, Human
ugggaaucacauuucaacaugagauuuggagg

SEQ ID NO: 257892 - RNA, 23 nt, Human
ugggaauccauuuuccugcggga

SEQ ID NO: 257893 - RNA, 32 nt, Human
ugggaaucgaucugugagcauauuuaacuauc

SEQ ID NO: 257894 - RNA, 32 nt, Human
ugggaaucucauaggaagagccaggacaugaa

SEQ ID NO: 257895 - RNA, 32 nt, Human
ugggaaucugagauaugaucccagaaaacauc

SEQ ID NO: 257896 - RNA, 32 nt, Human
ugggaaucuguuccucaccauaucaucccacg

SEQ ID NO: 257897 - RNA, 32 nt, Human
ugggaaugaaggugaaaacuuggagauuucac

SEQ ID NO: 257898 - RNA, 32 nt, Human
ugggaaugaccacucccuuccuaaagaugaga

SEQ ID NO: 257899 - RNA, 32 nt, Human
ugggaaugaggcaguggguggagagagaaugg

SEQ ID NO: 257900 - RNA, 32 nt, Human
ugggaaugcagucggcccugcgcauguggugu

SEQ ID NO: 257901 - RNA, 32 nt, Human
ugggaaugccgcagggagccaggcuggggcca

SEQ ID NO: 257902 - RNA, 32 nt, Human
ugggaauggaaaggacagcaagcacaggugag

SEQ ID NO: 257903 - RNA, 32 nt, Human
ugggaauggaaaugccugauguuaagggaaga

SEQ ID NO: 257904 - RNA, 21 nt, Human
ugggaauggccgggccggggg

SEQ ID NO: 257905 - RNA, 29 nt, Human
ugggaauggcugcuucauuccucgaggau

SEQ ID NO: 257906 - RNA, 32 nt, Human
ugggaauggcugcuucauuccucgaggaugcc

SEQ ID NO: 257907 - RNA, 32 nt, Human
ugggaaugggguggaagggugauggggagcua

SEQ ID NO: 257908 - RNA, 32 nt, Human
ugggaauggggugggagccacagggacgaccc

SEQ ID NO: 257909 - RNA, 32 nt, Human
ugggaauggucgcuuccuguuuucccuuuucc

SEQ ID NO: 257910 - RNA, 32 nt, Human
ugggaauguuugucucaucccauucugcguca

SEQ ID NO: 257911 - RNA, 22 nt, Human
ugggaauuacaggcgugagcca

SEQ ID NO: 257912 - RNA, 32 nt, Human
ugggaauuauaaugagcaccaagcagaaugaa

SEQ ID NO: 257913 - RNA, 32 nt, Human
ugggaauuauuuccuccucccuccaggcagau

SEQ ID NO: 257914 - RNA, 32 nt, Human
ugggaauucaaaggaagagaucuuaaaaguca

SEQ ID NO: 257915 - RNA, 32 nt, Human
ugggaauuguggcuuugaagaccucuggacau

SEQ ID NO: 257916 - RNA, 32 nt, Human
ugggaauuguuuuucaucuguuucuaugguug

SEQ ID NO: 257917 - RNA, 32 nt, Human
ugggacaaagaguuccucuggggcucuuguuc

SEQ ID NO: 257918 - RNA, 32 nt, Human
ugggacaaagccuggggcugggcgggggccau

SEQ ID NO: 257919 - RNA, 32 nt, Human
ugggacaagaugaccucugcagucucuccagc

SEQ ID NO: 257920 - RNA, 17 nt, Human
ugggacaagcgcacggg

SEQ ID NO: 257921 - RNA, 32 nt, Human
ugggacaaggcagggcuggcccaggugacccg

SEQ ID NO: 257922 - RNA, 32 nt, Human
ugggacaagggugggaacucaggaguuacuac

SEQ ID NO: 257923 - RNA, 32 nt, Human
ugggacaaugaccacgcugccuguuugucugu

SEQ ID NO: 257924 - RNA, 32 nt, Human
ugggacacacggguccuccugagucccguagc

SEQ ID NO: 257925 - RNA, 19 nt, Human
ugggacacacugccugcca

SEQ ID NO: 257926 - RNA, 32 nt, Human
ugggacacacugggcuggagcugccggcuggc

SEQ ID NO: 257927 - RNA, 32 nt, Human
ugggacacagaaucacuugcuccaucucauac

SEQ ID NO: 257928 - RNA, 32 nt, Human
ugggacacagccgcgcccgugccgcagaagga

SEQ ID NO: 257929 - RNA, 32 nt, Human
ugggacacaggcaggucauucuuugaacaggc

SEQ ID NO: 257930 - RNA, 18 nt, Human
ugggacacaggggccuuc

SEQ ID NO: 257931 - RNA, 32 nt, Human
ugggacacauggucugucaaugagagcauaau

SEQ ID NO: 257932 - RNA, 32 nt, Human
ugggacaccagcugguccaggcacagccuugc

SEQ ID NO: 257933 - RNA, 32 nt, Human
ugggacacggcugggggcaggccagaggccuc

SEQ ID NO: 257934 - RNA, 32 nt, Human
ugggacacuagaacaggaaggcuccugggccu

SEQ ID NO: 257935 - RNA, 32 nt, Human
ugggacacugcagauaaaaucacaaaaaccac

SEQ ID NO: 257936 - RNA, 32 nt, Human
ugggacacuuaaguaacaucuaaagcauuauu

SEQ ID NO: 257937 - RNA, 32 nt, Human
ugggacagaaagugccuccaccugcaucccca

SEQ ID NO: 257938 - RNA, 32 nt, Human
ugggacagaagcagaggaggcugccugcugug

SEQ ID NO: 257939 - RNA, 32 nt, Human
ugggacagaaggggcagagggagggcagaggc

SEQ ID NO: 257940 - RNA, 32 nt, Human
ugggacagacgcaggccagcugcccagagccc

SEQ ID NO: 257941 - RNA, 32 nt, Human
ugggacagacuggaggaugaggacaaaccaaa

SEQ ID NO: 257942 - RNA, 32 nt, Human
ugggacagagcagaggaaggcaggggauuuag

SEQ ID NO: 257943 - RNA, 32 nt, Human
ugggacagagguggagacaggugcagugaccc

SEQ ID NO: 257944 - RNA, 32 nt, Human
ugggacagagguuggaaggaaaggacuagggu

SEQ ID NO: 257945 - RNA, 32 nt, Human
ugggacagagucucauucugucacucaggcua

SEQ ID NO: 257946 - RNA, 22 nt, Human
ugggacagauuaggaugaggug

SEQ ID NO: 257947 - RNA, 32 nt, Human
ugggacagccuccccucugggaccuuucccug

SEQ ID NO: 257948 - RNA, 21 nt, Human
ugggacagcggaacccagagu

SEQ ID NO: 257949 - RNA, 32 nt, Human
ugggacagcuggucaccuuacgcaagagccag

SEQ ID NO: 257950 - RNA, 32 nt, Human
ugggacagcuuuggauuuguuuucauaaaauc

SEQ ID NO: 257951 - RNA, 32 nt, Human
ugggacaggaagagaagagccguguggccgcg

SEQ ID NO: 257952 - RNA, 32 nt, Human
ugggacaggagaagggaacgggcuuucuuuuc

SEQ ID NO: 257953 - RNA, 32 nt, Human
ugggacaggcagcucuagucagugagaaaucg

SEQ ID NO: 257954 - RNA, 32 nt, Human
ugggacaggccugcaggcacucaguuggccgg

SEQ ID NO: 257955 - RNA, 32 nt, Human
ugggacaggccugucaggccucugggaaucuc

SEQ ID NO: 257956 - RNA, 32 nt, Human
ugggacaggccuucacuuuggagccacgggau

SEQ ID NO: 257957 - RNA, 32 nt, Human
ugggacaggcuccugaggaggauugaggguga

SEQ ID NO: 257958 - RNA, 19 nt, Human
ugggacaggcuggggccag

SEQ ID NO: 257959 - RNA, 32 nt, Human
ugggacaggcuggggccaggaggcagaaacac

SEQ ID NO: 257960 - RNA, 32 nt, Human
ugggacagggaggauccugucuggccuucagu

SEQ ID NO: 257961 - RNA, 23 nt, Human
ugggacaggggagaaccuagggu

SEQ ID NO: 257962 - RNA, 21 nt, Human
ugggacagggucucacucugu

SEQ ID NO: 257963 - RNA, 32 nt, Human
ugggacagggucucacucugucacccaggcug

SEQ ID NO: 257964 - RNA, 32 nt, Human
ugggacaguugaguuaagggauggcuuucaca

SEQ ID NO: 257965 - RNA, 32 nt, Human
ugggacaugcagaaugcgugucuuugcaaaag

SEQ ID NO: 257966 - RNA, 32 nt, Human
ugggacaugccugugagcacguccagcacaga

SEQ ID NO: 257967 - RNA, 32 nt, Human
ugggacaugcucugguaacacacagauauggg

SEQ ID NO: 257968 - RNA, 32 nt, Human
ugggacauguacuccaagccuccgucacaaaa

SEQ ID NO: 257969 - RNA, 32 nt, Human
ugggacauuagcuuugggaaaaguaaugaaaa

SEQ ID NO: 257970 - RNA, 32 nt, Human
ugggacauugccacuucugcccuggaacucgu

SEQ ID NO: 257971 - RNA, 32 nt, Human
ugggaccaaagugcagggcgugcagugcggau

SEQ ID NO: 257972 - RNA, 32 nt, Human
ugggaccaacagcagccagagcaguuagccag

SEQ ID NO: 257973 - RNA, 32 nt, Human
ugggaccaagccuccaauaucucugaauagcc

SEQ ID NO: 257974 - RNA, 21 nt, Human
ugggaccacaggcaugcgcca

SEQ ID NO: 257975 - RNA, 18 nt, Human
ugggaccacagugcaagg

SEQ ID NO: 257976 - RNA, 32 nt, Human
ugggaccacauggggaagaucuagcaccauac

SEQ ID NO: 257977 - RNA, 32 nt, Human
ugggaccaccuacuccccuuggaggguccgga

SEQ ID NO: 257978 - RNA, 32 nt, Human
ugggaccacuagaauauagucacuguagaaua

SEQ ID NO: 257979 - RNA, 32 nt, Human
ugggaccacucuuuuucuuucucacaagcaag

SEQ ID NO: 257980 - RNA, 32 nt, Human
ugggaccacuggcugaucacaucaccucucug

SEQ ID NO: 257981 - RNA, 32 nt, Human
ugggaccagagcugacuccauuucucaaucug

SEQ ID NO: 257982 - RNA, 32 nt, Human
ugggaccagauuccagguccaaagucaccaug

SEQ ID NO: 257983 - RNA, 18 nt, Human
ugggaccagcagaccccu

SEQ ID NO: 257984 - RNA, 17 nt, Human
ugggaccagcagccccc

SEQ ID NO: 257985 - RNA, 23 nt, Human
ugggaccagguggccauagaggg

SEQ ID NO: 257986 - RNA, 32 nt, Human
ugggaccaugaaguggcucggcagccagaagu

SEQ ID NO: 257987 - RNA, 25 nt, Human
ugggacccaccagugggcaagaggg

SEQ ID NO: 257988 - RNA, 32 nt, Human
ugggacccaccgugggaccugaggcagaacug

SEQ ID NO: 257989 - RNA, 32 nt, Human
ugggacccagagccaagaaagcugagauaucc

SEQ ID NO: 257990 - RNA, 23 nt, Human
ugggacccaggaggccucugaug

SEQ ID NO: 257991 - RNA, 21 nt, Human
ugggacccauccucagugcuc

SEQ ID NO: 257992 - RNA, 32 nt, Human
ugggacccaucuuugcuuccuuucaguugccu

SEQ ID NO: 257993 - RNA, 32 nt, Human
ugggaccccacacacuccaggugggaucagau

SEQ ID NO: 257994 - RNA, 21 nt, Human
ugggacccccuguaccaaaac

SEQ ID NO: 257995 - RNA, 32 nt, Human
ugggacccccuucccaguguucugccgcuccu

SEQ ID NO: 257996 - RNA, 32 nt, Human
ugggacccguaaguggcuguccagaaaggcgg

SEQ ID NO: 257997 - RNA, 32 nt, Human
ugggacccucaccugucucuggcuucugccac

SEQ ID NO: 257998 - RNA, 32 nt, Human
ugggacccuccaggagccccgggauugaagga

SEQ ID NO: 257999 - RNA, 32 nt, Human
ugggacccuccugggcugccaggauuuagcag

SEQ ID NO: 258000 - RNA, 32 nt, Human
ugggacccucgguccucucuccugggccaugg

SEQ ID NO: 258001 - RNA, 32 nt, Human
ugggacccuggauuuucggacacugagcgcca

SEQ ID NO: 258002 - RNA, 21 nt, Human
ugggaccgaagccguaaccga

SEQ ID NO: 258003 - RNA, 32 nt, Human
ugggaccgcaggcacacaucacugugccuggc

SEQ ID NO: 258004 - RNA, 32 nt, Human
ugggaccgcugccucuggcuucugcugggccg

SEQ ID NO: 258005 - RNA, 24 nt, Human
ugggaccggccgcugagcccaagg

SEQ ID NO: 258006 - RNA, 32 nt, Human
ugggaccuagagcucucaaaagacuuagcaag

SEQ ID NO: 258007 - RNA, 32 nt, Human
ugggaccucaacacagacaucugggugaaggc

SEQ ID NO: 258008 - RNA, 19 nt, Human
ugggaccucaagggccuuc

SEQ ID NO: 258009 - RNA, 21 nt, Human
ugggaccucccacugcccccu

SEQ ID NO: 258010 - RNA, 22 nt, Human
ugggaccugagaccaagggggu

SEQ ID NO: 258011 - RNA, 32 nt, Human
ugggaccugaguagcugggaccacaggcaugc

SEQ ID NO: 258012 - RNA, 32 nt, Human
ugggaccugcagcucugccuuugcuggcuggg

SEQ ID NO: 258013 - RNA, 32 nt, Human
ugggaccugcccccagcuucugccacgcuuua

SEQ ID NO: 258014 - RNA, 32 nt, Human
ugggaccugcuccccugucucuucuccgugac

SEQ ID NO: 258015 - RNA, 32 nt, Human
ugggaccugcugcugugcuggguggcuggacg

SEQ ID NO: 258016 - RNA, 32 nt, Human
ugggaccuguaaucccagcuacuugggaggcu

SEQ ID NO: 258017 - RNA, 32 nt, Human
ugggaccugugcuugccgugagggccccagga

SEQ ID NO: 258018 - RNA, 32 nt, Human
ugggaccuuugggcaggguuugcccacugacg

SEQ ID NO: 258019 - RNA, 32 nt, Human
ugggacgaacaaggacugggcuggguccagcu

SEQ ID NO: 258020 - RNA, 32 nt, Human
ugggacgacuucagcaugucucaggccaccaa

SEQ ID NO: 258021 - RNA, 23 nt, Human
ugggacgauugcuugagcccggg

SEQ ID NO: 258022 - RNA, 32 nt, Human
ugggacgcauccugccucugugcgccauuccu

SEQ ID NO: 258023 - RNA, 32 nt, Human
ugggacgccuguccgaccgccucggcaggaac

SEQ ID NO: 258024 - RNA, 32 nt, Human
ugggacggagucucacuccauugcccaggcug

SEQ ID NO: 258025 - RNA, 32 nt, Human
ugggacggcagagagacaaguucuuauaucug

SEQ ID NO: 258026 - RNA, 32 nt, Human
ugggacgggaggcgggagggggcugguggugc

SEQ ID NO: 258027 - RNA, 32 nt, Human
ugggacgggagguggagaguuugcagagccgg

SEQ ID NO: 258028 - RNA, 32 nt, Human
ugggacgggcucucccucacagccuccagagg

SEQ ID NO: 258029 - RNA, 32 nt, Human
ugggacggggucucgcucugucgcccaggcug

SEQ ID NO: 258030 - RNA, 32 nt, Human
ugggacggucacccagcagugccgggcugggc

SEQ ID NO: 258031 - RNA, 32 nt, Human
ugggacgugcaguguggggauuacaggggagg

SEQ ID NO: 258032 - RNA, 32 nt, Human
ugggacguggugcugucaggacaggguccugc

SEQ ID NO: 258033 - RNA, 32 nt, Human
ugggacguuaggcagagagcucagauggcccu

SEQ ID NO: 258034 - RNA, 32 nt, Human
ugggacuaaccacuaaccucacccccaaacuc

SEQ ID NO: 258035 - RNA, 32 nt, Human
ugggacuacaggcacaagucaccaugccuggc

SEQ ID NO: 258036 - RNA, 32 nt, Human
ugggacuacaggcacacaucaccacauccagc

SEQ ID NO: 258037 - RNA, 32 nt, Human
ugggacuacaggcacacaucgccacacccggc

SEQ ID NO: 258038 - RNA, 32 nt, Human
ugggacuacaggcaccugccaccaccaccccc

SEQ ID NO: 258039 - RNA, 21 nt, Human
ugggacuacaggcauaugcca

SEQ ID NO: 258040 - RNA, 32 nt, Human
ugggacuacaggcaugagaaaccaagcccggc

SEQ ID NO: 258041 - RNA, 21 nt, Human
ugggacuacaggcaugaguca

SEQ ID NO: 258042 - RNA, 21 nt, Human
ugggacuacaggcaugcacca

SEQ ID NO: 258043 - RNA, 21 nt, Human
ugggacuacaggcaugcgcca

SEQ ID NO: 258044 - RNA, 21 nt, Human
ugggacuacaggcauguacca

SEQ ID NO: 258045 - RNA, 21 nt, Human
ugggacuacaggcaugugcca

SEQ ID NO: 258046 - RNA, 19 nt, Human
ugggacuacaggggcccuc

SEQ ID NO: 258047 - RNA, 32 nt, Human
ugggacuacaggugcccgccaccaccacgccc

SEQ ID NO: 258048 - RNA, 32 nt, Human
ugggacuacaugcacaugacacuaugcccagc

SEQ ID NO: 258049 - RNA, 32 nt, Human
ugggacuaccauuguauaugcgguccaucauu

SEQ ID NO: 258050 - RNA, 32 nt, Human
ugggacuacuggcugaaggcgagccccgcagc

SEQ ID NO: 258051 - RNA, 19 nt, Human
ugggacuagaucccgcgag

SEQ ID NO: 258052 - RNA, 32 nt, Human
ugggacuagggaggggguuccggguggaggcu

SEQ ID NO: 258053 - RNA, 31 nt, Human
ugggacucaauaaggaucccuuggaagaaau

SEQ ID NO: 258054 - RNA, 32 nt, Human
ugggacucacagucgugaugucuuucaagagg

SEQ ID NO: 258055 - RNA, 32 nt, Human
ugggacucaggcugcgugccuccgucugccug

SEQ ID NO: 258056 - RNA, 22 nt, Human
ugggacucauccagugcuccac

SEQ ID NO: 258057 - RNA, 22 nt, Human
ugggacuccacauccuccagcc

SEQ ID NO: 258058 - RNA, 17 nt, Human
ugggacuccagacagua

SEQ ID NO: 258059 - RNA, 32 nt, Human
ugggacuccuaauggcauuucagucuguugcu

SEQ ID NO: 258060 - RNA, 32 nt, Human
ugggacuccucccaucccccaggcugguacca

SEQ ID NO: 258061 - RNA, 32 nt, Human
ugggacuccuccugccagauuacagaugguuc

SEQ ID NO: 258062 - RNA, 24 nt, Human
ugggacucugcgggagggucccag

SEQ ID NO: 258063 - RNA, 32 nt, Human
ugggacucuggaggcuccuccccuucuuucuc

SEQ ID NO: 258064 - RNA, 32 nt, Human
ugggacucugucuuacauaucugggugccccu

SEQ ID NO: 258065 - RNA, 32 nt, Human
ugggacugaaccauauagacauggacauauca

SEQ ID NO: 258066 - RNA, 32 nt, Human
ugggacugacccaggggaaggaaguggggaag

SEQ ID NO: 258067 - RNA, 31 nt, Human
ugggacugacuucuccuucugaggaugcugg

SEQ ID NO: 258068 - RNA, 32 nt, Human
ugggacugacuuuccgagccuccaguccaaag

SEQ ID NO: 258069 - RNA, 32 nt, Human
ugggacugagccauacaugcccuugaauuccu

SEQ ID NO: 258070 - RNA, 32 nt, Human
ugggacugauguuuacaucuuuggaaagacaa

SEQ ID NO: 258071 - RNA, 32 nt, Human
ugggacugcaacucaugacuauccugauauug

SEQ ID NO: 258072 - RNA, 32 nt, Human
ugggacugcacuccagccugggugacagagcc

SEQ ID NO: 258073 - RNA, 32 nt, Human
ugggacugcaucuucguccuuguccacagcag

SEQ ID NO: 258074 - RNA, 32 nt, Human
ugggacugcccaggcuauggggacaaaggccu

SEQ ID NO: 258075 - RNA, 32 nt, Human
ugggacugcccagggaggaggccuuggaagag

SEQ ID NO: 258076 - RNA, 32 nt, Human
ugggacugcuggggcuucaccagcacgagcua

SEQ ID NO: 258077 - RNA, 32 nt, Human
ugggacuggaaacugcucaccuaugucaugga

SEQ ID NO: 258078 - RNA, 32 nt, Human
ugggacuggccagguuucugcccacauuggac

SEQ ID NO: 258079 - RNA, 32 nt, Human
ugggacuggcccaccccucuucccccuucccc

SEQ ID NO: 258080 - RNA, 32 nt, Human
ugggacuggcuuuccacaggaaguaaacugcu

SEQ ID NO: 258081 - RNA, 32 nt, Human
ugggacugggaucccuugcugauugacaaaca

SEQ ID NO: 258082 - RNA, 32 nt, Human
ugggacugugguuccaaggaugagagcagggg

SEQ ID NO: 258083 - RNA, 32 nt, Human
ugggacuguguuucccuguggguggggagcug

SEQ ID NO: 258084 - RNA, 32 nt, Human
ugggacuguuccagcccaccucccagaugcuu

SEQ ID NO: 258085 - RNA, 18 nt, Human
ugggacuuaagggcccuc

SEQ ID NO: 258086 - RNA, 32 nt, Human
ugggacuuacuuccaaccuccaccagcccugc

SEQ ID NO: 258087 - RNA, 32 nt, Human
ugggacuuccaggaccuccccucagguuguuc

SEQ ID NO: 258088 - RNA, 32 nt, Human
ugggacuucucucugcaggaggagagaacgcu

SEQ ID NO: 258089 - RNA, 32 nt, Human
ugggacuugcagccucugccccacgaguuugu

SEQ ID NO: 258090 - RNA, 32 nt, Human
ugggacuugccggcgcucagaaacgcgcccag

SEQ ID NO: 258091 - RNA, 23 nt, Human
ugggacuugccucagaucagccu

SEQ ID NO: 258092 - RNA, 32 nt, Human
ugggacuugccucagaucagccugcgacugca

SEQ ID NO: 258093 - RNA, 32 nt, Human
ugggacuuggcagaaggcgaggaacaagauuc

SEQ ID NO: 258094 - RNA, 32 nt, Human
ugggacuuggcccucuggcuggggcuucugaa

SEQ ID NO: 258095 - RNA, 32 nt, Human
ugggacuuggccucaccccacccauggaauac

SEQ ID NO: 258096 - RNA, 32 nt, Human
ugggacuugggagcuggggcugaaguugcucu

SEQ ID NO: 258097 - RNA, 32 nt, Human
ugggacuugggagggaacuggggucaggggcu

SEQ ID NO: 258098 - RNA, 32 nt, Human
ugggacuuggugguaagcaaguuuguaaauca

SEQ ID NO: 258099 - RNA, 32 nt, Human
ugggacuugguugggcaugcugugguugcuga

SEQ ID NO: 258100 - RNA, 32 nt, Human
ugggacuuucuacaacgcugcugugcacgacg

SEQ ID NO: 258101 - RNA, 32 nt, Human
ugggacuuugaccacacacagugaugccucac

SEQ ID NO: 258102 - RNA, 19 nt, Human
ugggacuuuuggacccguc

SEQ ID NO: 258103 - RNA, 32 nt, Human
ugggagaaaauagcagaucugcagcagauagg

SEQ ID NO: 258104 - RNA, 32 nt, Human
ugggagaaacaaggaggcagucgcuugugcau

SEQ ID NO: 258105 - RNA, 32 nt, Human
ugggagaaagagagagcuucuguugcugccuc

SEQ ID NO: 258106 - RNA, 31 nt, Human
ugggagaaaggcccuguuucccuggaacugc

SEQ ID NO: 258107 - RNA, 32 nt, Human
ugggagaaaugagauaaaagauguacuuguga

SEQ ID NO: 258108 - RNA, 32 nt, Human
ugggagaaauggccagcuccuucugggguggc

SEQ ID NO: 258109 - RNA, 32 nt, Human
ugggagaaaugugugucggagcugcagggguc

SEQ ID NO: 258110 - RNA, 18 nt, Human
ugggagaagaacccccca

SEQ ID NO: 258111 - RNA, 32 nt, Human
ugggagaagaagcagguagaccaccuguccca

SEQ ID NO: 258112 - RNA, 32 nt, Human
ugggagaagcacagagagguauugugagcaua

SEQ ID NO: 258113 - RNA, 32 nt, Human
ugggagaagcugccccaggaaucugugaggau

SEQ ID NO: 258114 - RNA, 32 nt, Human
ugggagaaggcaguccaacagcaccagcacgg

SEQ ID NO: 258115 - RNA, 21 nt, Human
ugggagaaggcccaggcugcu

SEQ ID NO: 258116 - RNA, 32 nt, Human
ugggagaauaaguuucuagggagccuuacuga

SEQ ID NO: 258117 - RNA, 32 nt, Human
ugggagaaucacaaggucaggagacugagacc

SEQ ID NO: 258118 - RNA, 23 nt, Human
ugggagaaucgcuugagcccagg

SEQ ID NO: 258119 - RNA, 32 nt, Human
ugggagaaucgcuugaguccaggaguuugagg

SEQ ID NO: 258120 - RNA, 23 nt, Human
ugggagaauugcuugaagccagg

SEQ ID NO: 258121 - RNA, 23 nt, Human
ugggagaauugcuugaguccagg

SEQ ID NO: 258122 - RNA, 32 nt, Human
ugggagacaaaggaggaauuuacuuucuucac

SEQ ID NO: 258123 - RNA, 32 nt, Human
ugggagacaauaggcaaacaaugaguacauuc

SEQ ID NO: 258124 - RNA, 32 nt, Human
ugggagacagaccccaccuccuuggguaguga

SEQ ID NO: 258125 - RNA, 32 nt, Human
ugggagacaggccucccucuggaguucauagc

SEQ ID NO: 258126 - RNA, 17 nt, Human
ugggagaccagaguccc

SEQ ID NO: 258127 - RNA, 32 nt, Human
ugggagaccagccuggggaccauagcgagacc

SEQ ID NO: 258128 - RNA, 32 nt, Human
ugggagacgcugcugcaucuccgggacaccac

SEQ ID NO: 258129 - RNA, 32 nt, Human
ugggagacguggcuggaggccauugggaagag

SEQ ID NO: 258130 - RNA, 32 nt, Human
ugggagacugacacugaagaagcuuaaaauca

SEQ ID NO: 258131 - RNA, 32 nt, Human
ugggagagacgguuaagcuggggacgguauuc

SEQ ID NO: 258132 - RNA, 32 nt, Human
ugggagagacuagagugaccagcaggaggaag

SEQ ID NO: 258133 - RNA, 32 nt, Human
ugggagagacugagcuacacuacugcuaaacu

SEQ ID NO: 258134 - RNA, 32 nt, Human
ugggagagagaaggggagaaccaaucucaacu

SEQ ID NO: 258135 - RNA, 32 nt, Human
ugggagagagacaagaccugucgggaacuggg

SEQ ID NO: 258136 - RNA, 32 nt, Human
ugggagagagccagagagaggagugagggugg

SEQ ID NO: 258137 - RNA, 32 nt, Human
ugggagagaggaaaggagggaaggcaagauuc

SEQ ID NO: 258138 - RNA, 32 nt, Human
ugggagagaggcagaaaaaggagcagcuccuc

SEQ ID NO: 258139 - RNA, 32 nt, Human
ugggagagauguauggucuugccuuccaccug

SEQ ID NO: 258140 - RNA, 32 nt, Human
ugggagagauguuguuucaccauguugcccgg

SEQ ID NO: 258141 - RNA, 32 nt, Human
ugggagagcccccauuggaccaguguuugcuu

SEQ ID NO: 258142 - RNA, 32 nt, Human
ugggagagcuguugacagaagcucuccgggcc

SEQ ID NO: 258143 - RNA, 32 nt, Human
ugggagaggacacgggcaugggcugcuggaug

SEQ ID NO: 258144 - RNA, 32 nt, Human
ugggagaggagagaugaaagaugaggaagugg

SEQ ID NO: 258145 - RNA, 32 nt, Human
ugggagaggaggggccuggaguugccgaggaa

SEQ ID NO: 258146 - RNA, 32 nt, Human
ugggagaggaucagguuagcugcugugacuau

SEQ ID NO: 258147 - RNA, 32 nt, Human
ugggagaggcugggugagcuggggugggaucu

SEQ ID NO: 258148 - RNA, 32 nt, Human
ugggagagggacugaguacagugcaacacuac

SEQ ID NO: 258149 - RNA, 32 nt, Human
ugggagagggagacagauggaggcaguggcug

SEQ ID NO: 258150 - RNA, 32 nt, Human
ugggagagggagggaggaaggaagggagggag

SEQ ID NO: 258151 - RNA, 32 nt, Human
ugggagagguagccgagucacacccgguggcu

SEQ ID NO: 258152 - RNA, 32 nt, Human
ugggagaggucacaccuggucucuccacaugu

SEQ ID NO: 258153 - RNA, 24 nt, Human
ugggagagguggcucaugccugua

SEQ ID NO: 258154 - RNA, 20 nt, Human
ugggagagguucugugcaaa

SEQ ID NO: 258155 - RNA, 32 nt, Human
ugggagaguggccuggccgagguguggggcgc

SEQ ID NO: 258156 - RNA, 22 nt, Human
ugggagaucccaggguccucca

SEQ ID NO: 258157 - RNA, 32 nt, Human
ugggagaugacagcuuggugaaaccucuguca

SEQ ID NO: 258158 - RNA, 32 nt, Human
ugggagaugagguuggaggaacgaaggcgagg

SEQ ID NO: 258159 - RNA, 32 nt, Human
ugggagauggagguagggcuggcuggaggaag

SEQ ID NO: 258160 - RNA, 32 nt, Human
ugggagauucuaagaggcuguugcaguauagu

SEQ ID NO: 258161 - RNA, 32 nt, Human
ugggagauugagcugggaggauugcuugagac

SEQ ID NO: 258162 - RNA, 32 nt, Human
ugggagauugcuugaguccaggagaccagccu

SEQ ID NO: 258163 - RNA, 32 nt, Human
ugggagauuuacugcacugauggaccucauca

SEQ ID NO: 258164 - RNA, 24 nt, Human
ugggagcaaagugacaggcacuua

SEQ ID NO: 258165 - RNA, 32 nt, Human
ugggagcaauuauaagacuggcuuauuuugaa

SEQ ID NO: 258166 - RNA, 32 nt, Human
ugggagcacaaagcccaugagggaaggugagu

SEQ ID NO: 258167 - RNA, 19 nt, Human
ugggagcacagcagaagug

SEQ ID NO: 258168 - RNA, 32 nt, Human
ugggagcaccugccagaggaugcucuuuccca

SEQ ID NO: 258169 - RNA, 32 nt, Human
ugggagcaccugcuggagaggguucaggggcc

SEQ ID NO: 258170 - RNA, 32 nt, Human
ugggagcacugguguucacgugggaccacagg

SEQ ID NO: 258171 - RNA, 18 nt, Human
ugggagcagaacaguccc

SEQ ID NO: 258172 - RNA, 32 nt, Human
ugggagcagagcgaucuggugccccggaaacc

SEQ ID NO: 258173 - RNA, 32 nt, Human
ugggagcagauguggaggcugacagccaggcg

SEQ ID NO: 258174 - RNA, 21 nt, Human
ugggagcagauucuuagcaaa

SEQ ID NO: 258175 - RNA, 32 nt, Human
ugggagcagcggcagcaagcugagggggcguc

SEQ ID NO: 258176 - RNA, 32 nt, Human
ugggagcaggaaggcuguuggggaaggaagcu

SEQ ID NO: 258177 - RNA, 32 nt, Human
ugggagcaggacugauugaauuacggaaaaug

SEQ ID NO: 258178 - RNA, 32 nt, Human
ugggagcaggagacaaggaguuugugauguug

SEQ ID NO: 258179 - RNA, 24 nt, Human
ugggagcaguggcucacaccugua

SEQ ID NO: 258180 - RNA, 24 nt, Human
ugggagcaguggcucacgccugua

SEQ ID NO: 258181 - RNA, 32 nt, Human
ugggagcagugugaaggagaagaggcaagaac

SEQ ID NO: 258182 - RNA, 32 nt, Human
ugggagcauagcagugugugagguucucgaga

SEQ ID NO: 258183 - RNA, 31 nt, Human
ugggagcauuaaaaguggugaucuguuacag

SEQ ID NO: 258184 - RNA, 24 nt, Human
ugggagccacccuuguccccagcu

SEQ ID NO: 258185 - RNA, 32 nt, Human
ugggagccaccgcacccagccugcaggucuuc

SEQ ID NO: 258186 - RNA, 32 nt, Human
ugggagccacugccacuccaguccugccacca

SEQ ID NO: 258187 - RNA, 21 nt, Human
ugggagccaggaugggaccaa

SEQ ID NO: 258188 - RNA, 32 nt, Human
ugggagccaggccacagggaggaggcuucuuu

SEQ ID NO: 258189 - RNA, 32 nt, Human
ugggagccaggccaccuuagaaugggguuugg

SEQ ID NO: 258190 - RNA, 32 nt, Human
ugggagccaggccagggugugagggaggugca

SEQ ID NO: 258191 - RNA, 32 nt, Human
ugggagccauuacuuccuuuccaucuugaaug

SEQ ID NO: 258192 - RNA, 32 nt, Human
ugggagcccaggaggcggggcgccugugggag

SEQ ID NO: 258193 - RNA, 32 nt, Human
ugggagcccaggaguuugagaccaguuugggc

SEQ ID NO: 258194 - RNA, 32 nt, Human
ugggagcccaggcagaggaggcaccgagagug

SEQ ID NO: 258195 - RNA, 22 nt, Human
ugggagcccccggccccgggcu

SEQ ID NO: 258196 - RNA, 32 nt, Human
ugggagcccccuggcuugcacugaacccucga

SEQ ID NO: 258197 - RNA, 32 nt, Human
ugggagccccgccucccuaccauggugccagg

SEQ ID NO: 258198 - RNA, 32 nt, Human
ugggagccccgcggguccugcccagaugugga

SEQ ID NO: 258199 - RNA, 32 nt, Human
ugggagccccggggaccccauggggugcugua

SEQ ID NO: 258200 - RNA, 32 nt, Human
ugggagccccuccaugggaccacucucacacu

SEQ ID NO: 258201 - RNA, 32 nt, Human
ugggagccccuccaugggaccccucucacacu

SEQ ID NO: 258202 - RNA, 32 nt, Human
ugggagccccucucagcuguggggcuggcaca

SEQ ID NO: 258203 - RNA, 21 nt, Human
ugggagcccgucgcuauggga

SEQ ID NO: 258204 - RNA, 32 nt, Human
ugggagcccucagacugggcggaggggcugga

SEQ ID NO: 258205 - RNA, 32 nt, Human
ugggagcccugagacuucuuucucuccuugcc

SEQ ID NO: 258206 - RNA, 32 nt, Human
ugggagcccuguggugauggcagccacaccuc

SEQ ID NO: 258207 - RNA, 20 nt, Human
ugggagccgcagcagcuccc

SEQ ID NO: 258208 - RNA, 32 nt, Human
ugggagccgccugucucccugcuucaccuccc

SEQ ID NO: 258209 - RNA, 25 nt, Human
ugggagccucagguucgcucagggg

SEQ ID NO: 258210 - RNA, 32 nt, Human
ugggagccuccaaacuccuagcugucucaucc

SEQ ID NO: 258211 - RNA, 22 nt, Human
ugggagccucuucccuuucuca

SEQ ID NO: 258212 - RNA, 32 nt, Human
ugggagccugagccccacaccugccgggcagu

SEQ ID NO: 258213 - RNA, 21 nt, Human
ugggagccugaggcaugagaa

SEQ ID NO: 258214 - RNA, 32 nt, Human
ugggagccugccugguggaguugagugaugcc

SEQ ID NO: 258215 - RNA, 32 nt, Human
ugggagccuggaggagcaaagacuggggucuu

SEQ ID NO: 258216 - RNA, 32 nt, Human
ugggagccugggaggucaaggcugcagugagc

SEQ ID NO: 258217 - RNA, 21 nt, Human
ugggagccuggggcaggagaa

SEQ ID NO: 258218 - RNA, 32 nt, Human
ugggagccuguggccccaggcacuuugcauca

SEQ ID NO: 258219 - RNA, 32 nt, Human
ugggagccuguggcuuauggcuucacuuaccc

SEQ ID NO: 258220 - RNA, 32 nt, Human
ugggagccuucuucccucuccccuccacuuuc

SEQ ID NO: 258221 - RNA, 20 nt, Human
ugggagcgaccagcagcccc

SEQ ID NO: 258222 - RNA, 32 nt, Human
ugggagcgccugccuucucuugccuugaaagc

SEQ ID NO: 258223 - RNA, 24 nt, Human
ugggagcgguggcucacgccugua

SEQ ID NO: 258224 - RNA, 32 nt, Human
ugggagcuaagcugcgaagaugcaaaggcaua

SEQ ID NO: 258225 - RNA, 32 nt, Human
ugggagcuaauacuccucuuugcucaccacca

SEQ ID NO: 258226 - RNA, 32 nt, Human
ugggagcuacuuccucgguucccuccccgaug

SEQ ID NO: 258227 - RNA, 19 nt, Human
ugggagcuauagggaccuc

SEQ ID NO: 258228 - RNA, 19 nt, Human
ugggagcucagccucccca

SEQ ID NO: 258229 - RNA, 26 nt, Human
ugggagcucagcucgcugcccaggga

SEQ ID NO: 258230 - RNA, 32 nt, Human
ugggagcuccaggcuauuuuugugcuuaguua

SEQ ID NO: 258231 - RNA, 20 nt, Human
ugggagcuccuugagcccgg

SEQ ID NO: 258232 - RNA, 32 nt, Human
ugggagcucugccugccggcaacuuugcugau

SEQ ID NO: 258233 - RNA, 32 nt, Human
ugggagcucugugccacugagguaugaacuug

SEQ ID NO: 258234 - RNA, 32 nt, Human
ugggagcugagggggaaggaaguaggggaaug

SEQ ID NO: 258235 - RNA, 32 nt, Human
ugggagcugaugggagaaugauuaagugguca

SEQ ID NO: 258236 - RNA, 32 nt, Human
ugggagcugcugcaggauggaguggaaagcug

SEQ ID NO: 258237 - RNA, 32 nt, Human
ugggagcuggaguccacugggguggccugacu

SEQ ID NO: 258238 - RNA, 32 nt, Human
ugggagcugggaaaggaaugagaagacagaag

SEQ ID NO: 258239 - RNA, 32 nt, Human
ugggagcugggaacaggaaugaagaggaagag

SEQ ID NO: 258240 - RNA, 32 nt, Human
ugggagcugggaugauaaagaugaggcuugcg

SEQ ID NO: 258241 - RNA, 32 nt, Human
ugggagcuggggcagggggagagccaggcaau

SEQ ID NO: 258242 - RNA, 32 nt, Human
ugggagcugucaccuccacuccuaggcuuuuc

SEQ ID NO: 258243 - RNA, 32 nt, Human
ugggagcuuccaagcccuugagguccagcugu

SEQ ID NO: 258244 - RNA, 32 nt, Human
ugggagcuugccugaccucccuuccugggcug

SEQ ID NO: 258245 - RNA, 32 nt, Human
ugggagcuuuaauccucuuucugcuucacacu

SEQ ID NO: 258246 - RNA, 32 nt, Human
ugggaggaaaaguugcugcuuccuucagcauc

SEQ ID NO: 258247 - RNA, 32 nt, Human
ugggaggaaaggacagauguguuuacaaggga

SEQ ID NO: 258248 - RNA, 32 nt, Human
ugggaggaagcacagaucucuagagcuguccu

SEQ ID NO: 258249 - RNA, 22 nt, Human
ugggaggaaggaauacauuuua

SEQ ID NO: 258250 - RNA, 32 nt, Human
ugggaggaaggaggcaggcuguggugggacug

SEQ ID NO: 258251 - RNA, 23 nt, Human
ugggaggaccauggggcacaaug

SEQ ID NO: 258252 - RNA, 22 nt, Human
ugggaggacuugcugcuguuca

SEQ ID NO: 258253 - RNA, 32 nt, Human
ugggaggagaagcagucugaugacagagagag

SEQ ID NO: 258254 - RNA, 32 nt, Human
ugggaggagagaagaaagcggggauggugcac

SEQ ID NO: 258255 - RNA, 32 nt, Human
ugggaggagaggaggaaaguggaaaaugcgcc

SEQ ID NO: 258256 - RNA, 32 nt, Human
ugggaggagaggaggcuucagucucaguggcu

SEQ ID NO: 258257 - RNA, 32 nt, Human
ugggaggagaggaggcuucagucucagugguu

SEQ ID NO: 258258 - RNA, 32 nt, Human
ugggaggagcacuucaagaccauucugcuccu

SEQ ID NO: 258259 - RNA, 32 nt, Human
ugggaggagccggaagagagcagugcuucaca

SEQ ID NO: 258260 - RNA, 32 nt, Human
ugggaggaggagaaggaggaggaggagagcgc

SEQ ID NO: 258261 - RNA, 32 nt, Human
ugggaggaggagggauagaacaucacaacacu

SEQ ID NO: 258262 - RNA, 32 nt, Human
ugggaggaggaguaugccuuuggugucccccu

SEQ ID NO: 258263 - RNA, 32 nt, Human
ugggaggaggcgaaggaggagggagaaccccg

SEQ ID NO: 258264 - RNA, 32 nt, Human
ugggaggaggcugcaguacuccugugugucac

SEQ ID NO: 258265 - RNA, 32 nt, Human
ugggaggagggaggaggagacagagaaggcuu

SEQ ID NO: 258266 - RNA, 32 nt, Human
ugggaggagggaggggccaggcagcugagggc

SEQ ID NO: 258267 - RNA, 32 nt, Human
ugggaggagggauagggacgggcagaucagua

SEQ ID NO: 258268 - RNA, 32 nt, Human
ugggaggaggggcuugagguuugcaaaggacu

SEQ ID NO: 258269 - RNA, 18 nt, Human
ugggaggagggggcccgg

SEQ ID NO: 258270 - RNA, 32 nt, Human
ugggaggaggugcuuucgggaggcggggccgc

SEQ ID NO: 258271 - RNA, 32 nt, Human
ugggaggagguggaggaggaggaagaggagaa

SEQ ID NO: 258272 - RNA, 32 nt, Human
ugggaggaggugggaggagcugagagggcuau

SEQ ID NO: 258273 - RNA, 32 nt, Human
ugggaggagucggagaggcaggggcuugcuuu

SEQ ID NO: 258274 - RNA, 32 nt, Human
ugggaggaguggugagaucauagcucacaccu

SEQ ID NO: 258275 - RNA, 32 nt, Human
ugggaggauaguaagagagggagcagggagac

SEQ ID NO: 258276 - RNA, 32 nt, Human
ugggaggaucacugagaccagccugggcaaca

SEQ ID NO: 258277 - RNA, 23 nt, Human
ugggaggaucacuugagcccagg

SEQ ID NO: 258278 - RNA, 32 nt, Human
ugggaggaucacuuuaguccaggaguuuugag

SEQ ID NO: 258279 - RNA, 32 nt, Human
ugggaggaucccuggagcccugaagauugagg

SEQ ID NO: 258280 - RNA, 32 nt, Human
ugggaggaucgcagucagcagagcagggcuga

SEQ ID NO: 258281 - RNA, 23 nt, Human
ugggaggaucgcuugagcccagg

SEQ ID NO: 258282 - RNA, 23 nt, Human
ugggaggaucucuugagcccagg

SEQ ID NO: 258283 - RNA, 23 nt, Human
ugggaggauggcuugagcccagg

SEQ ID NO: 258284 - RNA, 23 nt, Human
ugggaggauugccugagcccagg

SEQ ID NO: 258285 - RNA, 23 nt, Human
ugggaggauugcuugagcccagg

SEQ ID NO: 258286 - RNA, 23 nt, Human
ugggaggauugcuugaguccagg

SEQ ID NO: 258287 - RNA, 24 nt, Human
ugggaggauuguacacuacuuuca

SEQ ID NO: 258288 - RNA, 21 nt, Human
ugggaggauuuucaugcuuuc

SEQ ID NO: 258289 - RNA, 32 nt, Human
ugggaggcaaaaauucaggugccugggggaga

SEQ ID NO: 258290 - RNA, 32 nt, Human
ugggaggcacauccaggcuugggaaacggggg

SEQ ID NO: 258291 - RNA, 21 nt, Human
ugggaggcaccuguaauccca

SEQ ID NO: 258292 - RNA, 32 nt, Human
ugggaggcagaaggguaggcucagggaguuca

SEQ ID NO: 258293 - RNA, 22 nt, Human
ugggaggcagaaguugcaguga

SEQ ID NO: 258294 - RNA, 23 nt, Human
ugggaggcagaaguugcagugag

SEQ ID NO: 258295 - RNA, 32 nt, Human
ugggaggcagagaggggcaggcuugggcaccc

SEQ ID NO: 258296 - RNA, 22 nt, Human
ugggaggcagagguugcaguga

SEQ ID NO: 258297 - RNA, 23 nt, Human
ugggaggcagagguugcagugag

SEQ ID NO: 258298 - RNA, 23 nt, Human
ugggaggcagagguuucagugag

SEQ ID NO: 258299 - RNA, 32 nt, Human
ugggaggcaggcaggcaugcaugugggccucu

SEQ ID NO: 258300 - RNA, 32 nt, Human
ugggaggcagggcaaugcaggauccaaauccu

SEQ ID NO: 258301 - RNA, 32 nt, Human
ugggaggcagggccugggcagggcuucugcac

SEQ ID NO: 258302 - RNA, 32 nt, Human
ugggaggcagguaugauuaacccccugcagaa

SEQ ID NO: 258303 - RNA, 20 nt, Human
ugggaggcagguucugcaaa

SEQ ID NO: 258304 - RNA, 32 nt, Human
ugggaggcaugggaaacagugcagugacucac

SEQ ID NO: 258305 - RNA, 32 nt, Human
ugggaggccaaggcccucagaucuugagccca

SEQ ID NO: 258306 - RNA, 32 nt, Human
ugggaggccagccuggaagaggcagcaguggc

SEQ ID NO: 258307 - RNA, 32 nt, Human
ugggaggccaggaguucgagaccagccuggcc

SEQ ID NO: 258308 - RNA, 32 nt, Human
ugggaggccaggaguuuugagaccagccuggg

SEQ ID NO: 258309 - RNA, 32 nt, Human
ugggaggccauggaaccaggauuagacccaca

SEQ ID NO: 258310 - RNA, 23 nt, Human
ugggaggccaugucucccgggga

SEQ ID NO: 258311 - RNA, 31 nt, Human
ugggaggccaugucucccggggaggcucagg

SEQ ID NO: 258312 - RNA, 32 nt, Human
ugggaggccgaggcggguggaucaugugaggc

SEQ ID NO: 258313 - RNA, 32 nt, Human
ugggaggccuaggugggcagaucaugagguca

SEQ ID NO: 258314 - RNA, 32 nt, Human
ugggaggccugucugcacccagcacugcuccc

SEQ ID NO: 258315 - RNA, 32 nt, Human
ugggaggcgcuucuugccaaaugcagacgagg

SEQ ID NO: 258316 - RNA, 32 nt, Human
ugggaggcggaggagguugcagugaacugaga

SEQ ID NO: 258317 - RNA, 32 nt, Human
ugggaggcggaggcgguggaucacuugagccc

SEQ ID NO: 258318 - RNA, 22 nt, Human
ugggaggcggagguugcagcga

SEQ ID NO: 258319 - RNA, 23 nt, Human
ugggaggcggagguugcagcgag

SEQ ID NO: 258320 - RNA, 22 nt, Human
ugggaggcggagguugcaguga

SEQ ID NO: 258321 - RNA, 23 nt, Human
ugggaggcggagguugcagugag

SEQ ID NO: 258322 - RNA, 22 nt, Human
ugggaggcggagguuguaguga

SEQ ID NO: 258323 - RNA, 32 nt, Human
ugggaggcggugcaggcuguccuggcugcucu

SEQ ID NO: 258324 - RNA, 32 nt, Human
ugggaggcggugggcagcgacacuccuguugg

SEQ ID NO: 258325 - RNA, 32 nt, Human
ugggaggcuaaggcagggagaaucgcuugaag

SEQ ID NO: 258326 - RNA, 32 nt, Human
ugggaggcuccucaggucucaggcucaggugc

SEQ ID NO: 258327 - RNA, 32 nt, Human
ugggaggcucuuucaaggcagcucacccauca

SEQ ID NO: 258328 - RNA, 32 nt, Human
ugggaggcugaagcaggagaaucacuuuaacc

SEQ ID NO: 258329 - RNA, 32 nt, Human
ugggaggcugaggcaggagaauucuuugaacc

SEQ ID NO: 258330 - RNA, 32 nt, Human
ugggaggcugaggcaggagaauuguuugaccu

SEQ ID NO: 258331 - RNA, 32 nt, Human
ugggaggcugaggcaggcagauugcuugagcu

SEQ ID NO: 258332 - RNA, 32 nt, Human
ugggaggcugaggcauggagaaucgcuugaac

SEQ ID NO: 258333 - RNA, 32 nt, Human
ugggaggcugaggcgggagaguggcgugaaac

SEQ ID NO: 258334 - RNA, 32 nt, Human
ugggaggcugagggcaggagaauggcaugaac

SEQ ID NO: 258335 - RNA, 32 nt, Human
ugggaggcugagggcaggagaauugcuugaac

SEQ ID NO: 258336 - RNA, 32 nt, Human
ugggaggcugagggcaggagaauugcuugaau

SEQ ID NO: 258337 - RNA, 32 nt, Human
ugggaggcugcaggggacagcagggccugagg

SEQ ID NO: 258338 - RNA, 32 nt, Human
ugggaggcuggagaaagggaaguggaaggcag

SEQ ID NO: 258339 - RNA, 32 nt, Human
ugggaggcuggagccccaggugcaguggcucu

SEQ ID NO: 258340 - RNA, 32 nt, Human
ugggaggcuggaguuggggcagaggagaacuu

SEQ ID NO: 258341 - RNA, 32 nt, Human
ugggaggcuggcacaggagaaucgcuugaauc

SEQ ID NO: 258342 - RNA, 32 nt, Human
ugggaggcuggcuguggcuccuguuugugaag

SEQ ID NO: 258343 - RNA, 32 nt, Human
ugggaggcuggguggaggagggagcagaaaaa

SEQ ID NO: 258344 - RNA, 32 nt, Human
ugggaggcuggugggaggcagggggcaggccu

SEQ ID NO: 258345 - RNA, 32 nt, Human
ugggaggcugugugcaggcugcaggauaucug

SEQ ID NO: 258346 - RNA, 32 nt, Human
ugggaggcuugugcgaggucucaggccugugu

SEQ ID NO: 258347 - RNA, 21 nt, Human
ugggaggcuuuaaguauggug

SEQ ID NO: 258348 - RNA, 32 nt, Human
ugggaggcuuuuguggcuucugcagcagaagc

SEQ ID NO: 258349 - RNA, 32 nt, Human
ugggagggaccaagguuguaaggguggcuaag

SEQ ID NO: 258350 - RNA, 32 nt, Human
ugggagggacugccucaccaccccugucccgc

SEQ ID NO: 258351 - RNA, 32 nt, Human
ugggagggacuucgaagauaagagugagcggc

SEQ ID NO: 258352 - RNA, 32 nt, Human
ugggagggagacguuauagauuaagaaaugau

SEQ ID NO: 258353 - RNA, 32 nt, Human
ugggagggagagaagaguaagcuggagucacc

SEQ ID NO: 258354 - RNA, 32 nt, Human
ugggagggagagaccggagcagcgccaggagc

SEQ ID NO: 258355 - RNA, 32 nt, Human
ugggagggaggaacaccggugccucggucacu

SEQ ID NO: 258356 - RNA, 32 nt, Human
ugggagggaggaagaacggaagggagggaaag

SEQ ID NO: 258357 - RNA, 32 nt, Human
ugggagggaggacagggaaggccaggcuugcu

SEQ ID NO: 258358 - RNA, 32 nt, Human
ugggagggaggcagugggaaguaguugaauca

SEQ ID NO: 258359 - RNA, 23 nt, Human
ugggagggagggagggcuggcuc

SEQ ID NO: 258360 - RNA, 32 nt, Human
ugggagggcaaggcaagagcuugagcuugagc

SEQ ID NO: 258361 - RNA, 32 nt, Human
ugggagggcugaagccaggggauugcugggcc

SEQ ID NO: 258362 - RNA, 32 nt, Human
ugggaggggaaagaggaaacagagcuagucag

SEQ ID NO: 258363 - RNA, 32 nt, Human
ugggaggggaagggaagggagaggcaagcugg

SEQ ID NO: 258364 - RNA, 32 nt, Human
ugggaggggccagcugccucuuuaggccaguu

SEQ ID NO: 258365 - RNA, 32 nt, Human
ugggagggggaggaggaggagcucacacccuc

SEQ ID NO: 258366 - RNA, 32 nt, Human
ugggagggggcacuucacagggagaagauaaa

SEQ ID NO: 258367 - RNA, 32 nt, Human
ugggaggggguugagggcaggcagagguagcu

SEQ ID NO: 258368 - RNA, 17 nt, Human
ugggaggggugcagugg

SEQ ID NO: 258369 - RNA, 32 nt, Human
ugggagggguggggagggggagggggaagugu

SEQ ID NO: 258370 - RNA, 32 nt, Human
ugggaggguaaagccauuugaagaauaaaguc

SEQ ID NO: 258371 - RNA, 32 nt, Human
ugggaggguggaggcccaggaaugggcgggca

SEQ ID NO: 258372 - RNA, 32 nt, Human
ugggaggguggagggauggggaugggaaggga

SEQ ID NO: 258373 - RNA, 32 nt, Human
ugggaggguguauguguccaggaauuuaucca

SEQ ID NO: 258374 - RNA, 32 nt, Human
ugggaggguuggcaccugcacacuccaucucc

SEQ ID NO: 258375 - RNA, 32 nt, Human
ugggagguagagguuacagggagccaagaucg

SEQ ID NO: 258376 - RNA, 32 nt, Human
ugggagguaggcagagggcaggcaggagaaaa

SEQ ID NO: 258377 - RNA, 32 nt, Human
ugggagguaguguuauaacuggcacuuuaauu

SEQ ID NO: 258378 - RNA, 32 nt, Human
ugggaggucccaggcugugugcacagugacag

SEQ ID NO: 258379 - RNA, 21 nt, Human
ugggaggugccuggccggggg

SEQ ID NO: 258380 - RNA, 22 nt, Human
ugggagguggaggcugcaguga

SEQ ID NO: 258381 - RNA, 23 nt, Human
ugggagguggaggcugcagugag

SEQ ID NO: 258382 - RNA, 32 nt, Human
ugggagguggaggggaggcugcagugagcuga

SEQ ID NO: 258383 - RNA, 32 nt, Human
ugggagguggagguggcagugagccgagauag

SEQ ID NO: 258384 - RNA, 23 nt, Human
ugggagguggagguugcagugag

SEQ ID NO: 258385 - RNA, 32 nt, Human
ugggaggugggagccgcgucucaggcccggcc

SEQ ID NO: 258386 - RNA, 32 nt, Human
ugggaggugguuaggucaugaggguggagauc

SEQ ID NO: 258387 - RNA, 32 nt, Human
ugggaguaaaauuagaagacacugcugaacag

SEQ ID NO: 258388 - RNA, 32 nt, Human
ugggaguacaaggaagaacaaggcaauucuca

SEQ ID NO: 258389 - RNA, 32 nt, Human
ugggaguagacaggaaggccgccggguguugg

SEQ ID NO: 258390 - RNA, 32 nt, Human
ugggaguaggaaugugaccgaaaacaaguugu

SEQ ID NO: 258391 - RNA, 32 nt, Human
ugggaguaggcuccagacaggaggagugggac

SEQ ID NO: 258392 - RNA, 32 nt, Human
ugggagucagaggcgggaugugugcggugaag

SEQ ID NO: 258393 - RNA, 32 nt, Human
ugggagucauguugccugcagggacucuuucc

SEQ ID NO: 258394 - RNA, 32 nt, Human
ugggaguccagugugaucugccuggaucuugc

SEQ ID NO: 258395 - RNA, 32 nt, Human
ugggagucccuuggcccagacacccaccugac

SEQ ID NO: 258396 - RNA, 17 nt, Human
ugggaguccucucccca

SEQ ID NO: 258397 - RNA, 32 nt, Human
ugggagucucccuauguugcccaggcuggucu

SEQ ID NO: 258398 - RNA, 32 nt, Human
ugggagucuggcaagaggaaauuggaagauaa

SEQ ID NO: 258399 - RNA, 32 nt, Human
ugggagugaacugaauuguuuccgcgggcaga

SEQ ID NO: 258400 - RNA, 32 nt, Human
ugggagugaggaggaaaggcaaacucugucuu

SEQ ID NO: 258401 - RNA, 32 nt, Human
ugggagugaugagauucugagggacccaugaa

SEQ ID NO: 258402 - RNA, 32 nt, Human
ugggagugcaagaaauccuuggcaagacccuu

SEQ ID NO: 258403 - RNA, 32 nt, Human
ugggaguggagauacacaggcagacaggaaga

SEQ ID NO: 258404 - RNA, 32 nt, Human
ugggaguggcggauccucccaccccagccgga

SEQ ID NO: 258405 - RNA, 32 nt, Human
ugggagugggcagagguggcacccaggggccc

SEQ ID NO: 258406 - RNA, 32 nt, Human
ugggaguggggagccagagggagcagcucccc

SEQ ID NO: 258407 - RNA, 32 nt, Human
ugggaguggggguuugggagacgggugggaaa

SEQ ID NO: 258408 - RNA, 32 nt, Human
ugggaguggggugggagggggcagcaggcggg

SEQ ID NO: 258409 - RNA, 18 nt, Human
ugggaguggguaggggga

SEQ ID NO: 258410 - RNA, 21 nt, Human
ugggagugguggcucacgccu

SEQ ID NO: 258411 - RNA, 24 nt, Human
ugggagugguggcucaugccugua

SEQ ID NO: 258412 - RNA, 28 nt, Human
ugggaguuaagugcugcuugucuuccca

SEQ ID NO: 258413 - RNA, 32 nt, Human
ugggaguuagagcacggacucucuccaccugc

SEQ ID NO: 258414 - RNA, 32 nt, Human
ugggaguuaggaggagaguaggugagaugauc

SEQ ID NO: 258415 - RNA, 32 nt, Human
ugggaguucauuugggcugggguggaggcugg

SEQ ID NO: 258416 - RNA, 32 nt, Human
ugggaguucucccacccuaagucuuacauaau

SEQ ID NO: 258417 - RNA, 32 nt, Human
ugggaguucugaggcagggugagggggcaagg

SEQ ID NO: 258418 - RNA, 32 nt, Human
ugggaguucuuucauggccucugcuuggggug

SEQ ID NO: 258419 - RNA, 32 nt, Human
ugggaguugaguuccuggauaggcauacuauc

SEQ ID NO: 258420 - RNA, 32 nt, Human
ugggaguugcugcuguuuacagccacagucuc

SEQ ID NO: 258421 - RNA, 32 nt, Human
ugggaguuguguuguacuucauggcacucuga

SEQ ID NO: 258422 - RNA, 32 nt, Human
ugggaguuugcggugggcagggggagggagaa

SEQ ID NO: 258423 - RNA, 32 nt, Human
ugggaguuuugguggaguccgaugauucucuu

SEQ ID NO: 258424 - RNA, 23 nt, Human
ugggauaaagcccuggggacacu

SEQ ID NO: 258425 - RNA, 21 nt, Human
ugggauaacaggcaugagcca

SEQ ID NO: 258426 - RNA, 32 nt, Human
ugggauacaauuacugucaggcauuuuuggug

SEQ ID NO: 258427 - RNA, 32 nt, Human
ugggauacaugugcagaacaugcagguuuguu

SEQ ID NO: 258428 - RNA, 32 nt, Human
ugggauacguaggagguggggaugggggaggg

SEQ ID NO: 258429 - RNA, 32 nt, Human
ugggauagggaaccgugguggcuuccacggag

SEQ ID NO: 258430 - RNA, 32 nt, Human
ugggauaggggcagaggaggcgaggaggccgu

SEQ ID NO: 258431 - RNA, 32 nt, Human
ugggaucaaacuauggccccacccuuagcagu

SEQ ID NO: 258432 - RNA, 32 nt, Human
ugggaucacaccacugcacuccagccugggug

SEQ ID NO: 258433 - RNA, 32 nt, Human
ugggaucacaccacugcacuucagccugggca

SEQ ID NO: 258434 - RNA, 21 nt, Human
ugggaucacaggcgugagcca

SEQ ID NO: 258435 - RNA, 32 nt, Human
ugggaucacaggugggagccacugugccuggc

SEQ ID NO: 258436 - RNA, 32 nt, Human
ugggaucacaugcuuuugucuccacagcaacc

SEQ ID NO: 258437 - RNA, 32 nt, Human
ugggaucacgaggaaaagagaaggaaagugau

SEQ ID NO: 258438 - RNA, 32 nt, Human
ugggaucacgccacugcacuccagcuugggug

SEQ ID NO: 258439 - RNA, 32 nt, Human
ugggaucagagcagugggucacgugaccugcg

SEQ ID NO: 258440 - RNA, 32 nt, Human
ugggaucagaugggaagcagaagcucaucaug

SEQ ID NO: 258441 - RNA, 32 nt, Human
ugggaucaggagacccucccgccucagccccc

SEQ ID NO: 258442 - RNA, 32 nt, Human
ugggaucauaugcacaugcacacacauaccac

SEQ ID NO: 258443 - RNA, 32 nt, Human
ugggaucauauguauuucuauguucuguaaag

SEQ ID NO: 258444 - RNA, 32 nt, Human
ugggaucauccagaggagcuggaaccauggug

SEQ ID NO: 258445 - RNA, 32 nt, Human
ugggauccagaguugaagacccuucagcuggc

SEQ ID NO: 258446 - RNA, 32 nt, Human
ugggauccaguggagcuaaucaguccugccuc

SEQ ID NO: 258447 - RNA, 32 nt, Human
ugggaucccgggcuguaacuugcucuuuuguu

SEQ ID NO: 258448 - RNA, 18 nt, Human
ugggaucccgucucccca

SEQ ID NO: 258449 - RNA, 24 nt, Human
ugggaucccugccuggaccggagg

SEQ ID NO: 258450 - RNA, 32 nt, Human
ugggauccgaaggaacuguacucccccugccc

SEQ ID NO: 258451 - RNA, 32 nt, Human
ugggauccuaaaggaggggcagggagggcgca

SEQ ID NO: 258452 - RNA, 32 nt, Human
ugggauccuggacuacggcacugcuccaggca

SEQ ID NO: 258453 - RNA, 32 nt, Human
ugggaucgcgccauugcacuccagccuggcug

SEQ ID NO: 258454 - RNA, 20 nt, Human
ugggaucgcggcucacugca

SEQ ID NO: 258455 - RNA, 32 nt, Human
ugggaucggaagauggggugcggucacagugc

SEQ ID NO: 258456 - RNA, 32 nt, Human
ugggaucggcacucagggggucuggaaagaag

SEQ ID NO: 258457 - RNA, 32 nt, Human
ugggaucgggguggggacagguagaccaggug

SEQ ID NO: 258458 - RNA, 32 nt, Human
ugggaucguaccacugcacuccagccugggcu

SEQ ID NO: 258459 - RNA, 32 nt, Human
ugggaucguggcauugcacucuagccugggca

SEQ ID NO: 258460 - RNA, 32 nt, Human
ugggaucucaaggagcuuuaaagucuuaaugg

SEQ ID NO: 258461 - RNA, 20 nt, Human
ugggaucucagcucacugca

SEQ ID NO: 258462 - RNA, 32 nt, Human
ugggaucucccugagugucaauauucaguagc

SEQ ID NO: 258463 - RNA, 20 nt, Human
ugggaucucgccucacugca

SEQ ID NO: 258464 - RNA, 20 nt, Human
ugggaucucggcucacugca

SEQ ID NO: 258465 - RNA, 32 nt, Human
ugggaucucugcugccagcucucccagccccu

SEQ ID NO: 258466 - RNA, 32 nt, Human
ugggaucugacugaagccagaggcucuguaaa

SEQ ID NO: 258467 - RNA, 32 nt, Human
ugggaucugccaggcugggguguuuucgguau

SEQ ID NO: 258468 - RNA, 32 nt, Human
ugggaucuggggagagcggcuggagaaagaug

SEQ ID NO: 258469 - RNA, 32 nt, Human
ugggaucuggggaggccgccugguuuuccucc

SEQ ID NO: 258470 - RNA, 25 nt, Human
ugggaucugucccuccugaccgggg

SEQ ID NO: 258471 - RNA, 23 nt, Human
ugggaugaagaaaguuggacacu

SEQ ID NO: 258472 - RNA, 21 nt, Human
ugggaugacaggcaugagcca

SEQ ID NO: 258473 - RNA, 32 nt, Human
ugggaugacgugaguugaggaggcucagcgga

SEQ ID NO: 258474 - RNA, 32 nt, Human
ugggaugacuacaggcaugggccaccacagcc

SEQ ID NO: 258475 - RNA, 32 nt, Human
ugggaugacuccauuauauccugggguugugg

SEQ ID NO: 258476 - RNA, 32 nt, Human
ugggaugagaacauuuuaguuguuuaguuugu

SEQ ID NO: 258477 - RNA, 32 nt, Human
ugggaugagaugacacaagacacuccuaccac

SEQ ID NO: 258478 - RNA, 32 nt, Human
ugggaugaggaugacagagcaacccuucuccu

SEQ ID NO: 258479 - RNA, 32 nt, Human
ugggaugagggauggagagggacugggucucu

SEQ ID NO: 258480 - RNA, 32 nt, Human
ugggaugaguacccccucaaacccugcccucc

SEQ ID NO: 258481 - RNA, 32 nt, Human
ugggaugauggcucagaacauguacacagacu

SEQ ID NO: 258482 - RNA, 32 nt, Human
ugggaugauugcucgauuguuugguuuuuaaa

SEQ ID NO: 258483 - RNA, 32 nt, Human
ugggaugcaccacuggauuguagauugauuuu

SEQ ID NO: 258484 - RNA, 32 nt, Human
ugggaugcagcgaggcccugccuuccuagcag

SEQ ID NO: 258485 - RNA, 32 nt, Human
ugggaugcaggcugagcacccuugcccggcug

SEQ ID NO: 258486 - RNA, 32 nt, Human
ugggaugcagugaugugaucauagcucacugu

SEQ ID NO: 258487 - RNA, 19 nt, Human
ugggaugccaaggccacuc

SEQ ID NO: 258488 - RNA, 32 nt, Human
ugggaugccaucacuugguucaugcucauuca

SEQ ID NO: 258489 - RNA, 31 nt, Human
ugggaugcgcaagacuccacagcagcagagg

SEQ ID NO: 258490 - RNA, 32 nt, Human
ugggaugcgggcccuucuuccucccagaacac

SEQ ID NO: 258491 - RNA, 32 nt, Human
ugggaugcucugccugcugauguggcccugac

SEQ ID NO: 258492 - RNA, 32 nt, Human
ugggaugcuguugcaagaugguucugugacuc

SEQ ID NO: 258493 - RNA, 32 nt, Human
ugggaugcuguuguggcuuugacuuuggccag

SEQ ID NO: 258494 - RNA, 32 nt, Human
ugggaugcuuucucccugccauugucucuugc

SEQ ID NO: 258495 - RNA, 32 nt, Human
ugggauggaaggugaagucuugccaaagaaua

SEQ ID NO: 258496 - RNA, 32 nt, Human
ugggauggagaaaugaauuucuucccacugaa

SEQ ID NO: 258497 - RNA, 32 nt, Human
ugggauggagucucacuauguugcccagacug

SEQ ID NO: 258498 - RNA, 31 nt, Human
ugggauggcaaaggugguggugcuuucaucu

SEQ ID NO: 258499 - RNA, 32 nt, Human
ugggauggcaagagggagacuguggguggccc

SEQ ID NO: 258500 - RNA, 32 nt, Human
ugggaugggaacacuggugggcagcugaggac

SEQ ID NO: 258501 - RNA, 32 nt, Human
ugggaugggaauggggcguggggcuggggcag

SEQ ID NO: 258502 - RNA, 32 nt, Human
ugggaugggaggagugaggcagugggagaaga

SEQ ID NO: 258503 - RNA, 32 nt, Human
ugggaugggaggaucucuugagcccaggagau

SEQ ID NO: 258504 - RNA, 19 nt, Human
ugggaugggccagggcccu

SEQ ID NO: 258505 - RNA, 32 nt, Human
ugggaugggcuacauaaggcccagcucuggca

SEQ ID NO: 258506 - RNA, 32 nt, Human
ugggauggggagaacagagaguagcuguguuu

SEQ ID NO: 258507 - RNA, 32 nt, Human
ugggauggggcuugggaguugcagugaauguc

SEQ ID NO: 258508 - RNA, 32 nt, Human
ugggaugggggcugagcaugcuugugcagaaa

SEQ ID NO: 258509 - RNA, 24 nt, Human
ugggauggggggacagggagccaa

SEQ ID NO: 258510 - RNA, 32 nt, Human
ugggaugggguuuugcgauguugcccaggcug

SEQ ID NO: 258511 - RNA, 32 nt, Human
ugggaugggugaggacuuccugagcuggaaug

SEQ ID NO: 258512 - RNA, 32 nt, Human
ugggaugggugaguccacucuggcuagggcug

SEQ ID NO: 258513 - RNA, 32 nt, Human
ugggaugguggcaaagcccaggaucuggcuuu

SEQ ID NO: 258514 - RNA, 32 nt, Human
ugggaugguuaguguggaggggagauauagau

SEQ ID NO: 258515 - RNA, 17 nt, Human
ugggaugucggggcccu

SEQ ID NO: 258516 - RNA, 32 nt, Human
ugggaugugcauccugcuucccaacuccucua

SEQ ID NO: 258517 - RNA, 32 nt, Human
ugggaugugccccagcacugagaacaaaaugc

SEQ ID NO: 258518 - RNA, 32 nt, Human
ugggauguggagucaggagcaaccagagaccc

SEQ ID NO: 258519 - RNA, 32 nt, Human
ugggaugugguguuccacaugugccuguuucc

SEQ ID NO: 258520 - RNA, 32 nt, Human
ugggauguguccagggcagcacaggaggcagg

SEQ ID NO: 258521 - RNA, 32 nt, Human
ugggauguguuuugggggcagggguuaguucu

SEQ ID NO: 258522 - RNA, 32 nt, Human
ugggauuaaaaauugguuucuagagguaaccu

SEQ ID NO: 258523 - RNA, 32 nt, Human
ugggauuaagaaaccuugcuguccucaccucc

SEQ ID NO: 258524 - RNA, 21 nt, Human
ugggauuacaagaaugagcca

SEQ ID NO: 258525 - RNA, 21 nt, Human
ugggauuacaagcaugagcca

SEQ ID NO: 258526 - RNA, 21 nt, Human
ugggauuacaagcaugaguca

SEQ ID NO: 258527 - RNA, 21 nt, Human
ugggauuacaagcaugcgcca

SEQ ID NO: 258528 - RNA, 32 nt, Human
ugggauuacaccauugcauuccagccugggca

SEQ ID NO: 258529 - RNA, 21 nt, Human
ugggauuacagacaugugcca

SEQ ID NO: 258530 - RNA, 32 nt, Human
ugggauuacaggaauuuagugauugacaaugg

SEQ ID NO: 258531 - RNA, 21 nt, Human
ugggauuacaggcacacgcca

SEQ ID NO: 258532 - RNA, 21 nt, Human
ugggauuacaggcacaugcca

SEQ ID NO: 258533 - RNA, 21 nt, Human
ugggauuacaggcacgcgcca

SEQ ID NO: 258534 - RNA, 21 nt, Human
ugggauuacaggcacgugcca

SEQ ID NO: 258535 - RNA, 21 nt, Human
ugggauuacaggcaggagcca

SEQ ID NO: 258536 - RNA, 21 nt, Human
ugggauuacaggcauaagaca

SEQ ID NO: 258537 - RNA, 21 nt, Human
ugggauuacaggcauacgcca

SEQ ID NO: 258538 - RNA, 21 nt, Human
ugggauuacaggcaugaauca

SEQ ID NO: 258539 - RNA, 20 nt, Human
ugggauuacaggcaugagcc

SEQ ID NO: 258540 - RNA, 21 nt, Human
ugggauuacaggcaugagcca

SEQ ID NO: 258541 - RNA, 21 nt, Human
ugggauuacaggcaugaggca

SEQ ID NO: 258542 - RNA, 21 nt, Human
ugggauuacaggcaugaguca

SEQ ID NO: 258543 - RNA, 21 nt, Human
ugggauuacaggcaugcacca

SEQ ID NO: 258544 - RNA, 21 nt, Human
ugggauuacaggcaugcgcca

SEQ ID NO: 258545 - RNA, 21 nt, Human
ugggauuacaggcaugggcca

SEQ ID NO: 258546 - RNA, 21 nt, Human
ugggauuacaggcauguacca

SEQ ID NO: 258547 - RNA, 21 nt, Human
ugggauuacaggcaugugcca

SEQ ID NO: 258548 - RNA, 32 nt, Human
ugggauuacaggcgugagccaccaccacaccc

SEQ ID NO: 258549 - RNA, 21 nt, Human
ugggauuacagggauaagcca

SEQ ID NO: 258550 - RNA, 21 nt, Human
ugggauuacagggaugagcca

SEQ ID NO: 258551 - RNA, 21 nt, Human
ugggauuacagguaugaacca

SEQ ID NO: 258552 - RNA, 21 nt, Human
ugggauuacagguaugagcca

SEQ ID NO: 258553 - RNA, 32 nt, Human
ugggauuacaggugugagccacuguggccgac

SEQ ID NO: 258554 - RNA, 32 nt, Human
ugggauuacaggugugagucaccccgcacagc

SEQ ID NO: 258555 - RNA, 32 nt, Human
ugggauuacaucugcaggauaaauucuuagaa

SEQ ID NO: 258556 - RNA, 21 nt, Human
ugggauuacaugcaugagcca

SEQ ID NO: 258557 - RNA, 32 nt, Human
ugggauuagaaaauauggguccauuccuuucu

SEQ ID NO: 258558 - RNA, 21 nt, Human
ugggauuagaggcaugagcca

SEQ ID NO: 258559 - RNA, 32 nt, Human
ugggauuagauucaucuauggagggcagagug

SEQ ID NO: 258560 - RNA, 32 nt, Human
ugggauuagggguucugugcucuugccuaauu

SEQ ID NO: 258561 - RNA, 21 nt, Human
ugggauuauagacaugagcca

SEQ ID NO: 258562 - RNA, 32 nt, Human
ugggauuauaggcacacaccaccauacccagc

SEQ ID NO: 258563 - RNA, 21 nt, Human
ugggauuauaggcaugaacca

SEQ ID NO: 258564 - RNA, 21 nt, Human
ugggauuauaggcaugagcca

SEQ ID NO: 258565 - RNA, 32 nt, Human
ugggauuauaggcaugcaccaccaccacccag

SEQ ID NO: 258566 - RNA, 32 nt, Human
ugggauuauguucuucauuugacucucugcuu

SEQ ID NO: 258567 - RNA, 32 nt, Human
ugggauucaaacccgggagugucugcugccac

SEQ ID NO: 258568 - RNA, 32 nt, Human
ugggauucaaacgauuauccugccucagccuc

SEQ ID NO: 258569 - RNA, 32 nt, Human
ugggauucaagcaauucucccaccucagccuc

SEQ ID NO: 258570 - RNA, 32 nt, Human
ugggauucaucuucaaagacuaauccaagaaa

SEQ ID NO: 258571 - RNA, 32 nt, Human
ugggauuccacccucagagucagaugcccuug

SEQ ID NO: 258572 - RNA, 32 nt, Human
ugggauuccaccuggcaccucgaggagccagc

SEQ ID NO: 258573 - RNA, 32 nt, Human
ugggauuccuuuccuuuuuccugccuaacuuu

SEQ ID NO: 258574 - RNA, 32 nt, Human
ugggauucgcugcuuucuuugcacuggucuug

SEQ ID NO: 258575 - RNA, 32 nt, Human
ugggauucuagcugcuggcaggaagcacugua

SEQ ID NO: 258576 - RNA, 32 nt, Human
ugggauucuccuccucccuccgccccacucag

SEQ ID NO: 258577 - RNA, 23 nt, Human
ugggauugaaggggcuucuaaug

SEQ ID NO: 258578 - RNA, 32 nt, Human
ugggauugcaucacugcacuccagccugggug

SEQ ID NO: 258579 - RNA, 32 nt, Human
ugggauugcgggcacaugcaccacgcccggcu

SEQ ID NO: 258580 - RNA, 32 nt, Human
ugggauugcucacauuucucuaauguacugca

SEQ ID NO: 258581 - RNA, 32 nt, Human
ugggauuggcccagcuuggagugcuugugugg

SEQ ID NO: 258582 - RNA, 32 nt, Human
ugggauuguguaugucuauauguguuuaaagc

SEQ ID NO: 258583 - RNA, 32 nt, Human
ugggauuucuacugccaguggcucagccuacc

SEQ ID NO: 258584 - RNA, 32 nt, Human
ugggauuucuaugcaguggccccuuaggccag

SEQ ID NO: 258585 - RNA, 23 nt, Human
ugggauuucucccucucagugga

SEQ ID NO: 258586 - RNA, 32 nt, Human
ugggauuucuucuuuuacugcucugguuaagu

SEQ ID NO: 258587 - RNA, 32 nt, Human
ugggauuugcaugaacuccacucugagcugaa

SEQ ID NO: 258588 - RNA, 32 nt, Human
ugggauuugccugccacuugguuaucauuacu

SEQ ID NO: 258589 - RNA, 32 nt, Human
ugggauuugggugggagaggaaagcaaauuuu

SEQ ID NO: 258590 - RNA, 32 nt, Human
ugggauuuuaaaauuuuccugcccucauaauu

SEQ ID NO: 258591 - RNA, 32 nt, Human
ugggauuuuugagcuaaugggcagcagucagc

SEQ ID NO: 258592 - RNA, 32 nt, Human
ugggcaaaagagaauccccugccuucccuugu

SEQ ID NO: 258593 - RNA, 32 nt, Human
ugggcaaagaagcagagcuaacgaggaaaggg

SEQ ID NO: 258594 - RNA, 32 nt, Human
ugggcaaagcacgaucugcagcuuugaagacu

SEQ ID NO: 258595 - RNA, 20 nt, Human
ugggcaaagcugccugcuau

SEQ ID NO: 258596 - RNA, 32 nt, Human
ugggcaaaggagaguccugccuggcccuacga

SEQ ID NO: 258597 - RNA, 32 nt, Human
ugggcaaagugcugggauuacaagcaugagcu

SEQ ID NO: 258598 - RNA, 22 nt, Human
ugggcaaaguuaagacuugcuu

SEQ ID NO: 258599 - RNA, 32 nt, Human
ugggcaaaucauuccaggucuuugggccucca

SEQ ID NO: 258600 - RNA, 32 nt, Human
ugggcaaauuccaugauggacgagacaaggug

SEQ ID NO: 258601 - RNA, 32 nt, Human
ugggcaacaaagugagacuccaucucuauaua

SEQ ID NO: 258602 - RNA, 18 nt, Human
ugggcaacaagagugaaa

SEQ ID NO: 258603 - RNA, 32 nt, Human
ugggcaacacagcaagaccccaucucuuaaaa

SEQ ID NO: 258604 - RNA, 32 nt, Human
ugggcaacacagcgagaccccaucucuuaaaa

SEQ ID NO: 258605 - RNA, 32 nt, Human
ugggcaacacaggaagaccccgucucuaccaa

SEQ ID NO: 258606 - RNA, 32 nt, Human
ugggcaacacagggagacucaucucuacaaaa

SEQ ID NO: 258607 - RNA, 32 nt, Human
ugggcaacacagugagaccucaucucuaaaaa

SEQ ID NO: 258608 - RNA, 32 nt, Human
ugggcaacacagugagacuccaucucuuaaaa

SEQ ID NO: 258609 - RNA, 29 nt, Human
ugggcaacacagugagacuucauuucuac

SEQ ID NO: 258610 - RNA, 32 nt, Human
ugggcaacacagugagacuucauuucuacaaa

SEQ ID NO: 258611 - RNA, 29 nt, Human
ugggcaacaccgugagaccccaucucuac

SEQ ID NO: 258612 - RNA, 32 nt, Human
ugggcaacacgaugaaaccccaucucuacuaa

SEQ ID NO: 258613 - RNA, 32 nt, Human
ugggcaacacggugaaaccccaucucuauuaa

SEQ ID NO: 258614 - RNA, 32 nt, Human
ugggcaacacggugaaaccccgucucuacuaa

SEQ ID NO: 258615 - RNA, 22 nt, Human
ugggcaacagagcaagacccca

SEQ ID NO: 258616 - RNA, 32 nt, Human
ugggcaacagagcaagaccccaucucuaaaua

SEQ ID NO: 258617 - RNA, 32 nt, Human
ugggcaacagagccagacuccgucucuaaaca

SEQ ID NO: 258618 - RNA, 32 nt, Human
ugggcaacagagcgagacuccaucucuaaaua

SEQ ID NO: 258619 - RNA, 32 nt, Human
ugggcaacagagugagaaccaucucuacccaa

SEQ ID NO: 258620 - RNA, 32 nt, Human
ugggcaacagagugagaccccaucucuuuaaa

SEQ ID NO: 258621 - RNA, 32 nt, Human
ugggcaacaggugagauucugucuccaaauaa

SEQ ID NO: 258622 - RNA, 32 nt, Human
ugggcaacauaacgagaccccgucucuacaaa

SEQ ID NO: 258623 - RNA, 32 nt, Human
ugggcaacauaaugaaacaccaucucuuaaaa

SEQ ID NO: 258624 - RNA, 32 nt, Human
ugggcaacauaaugagacaggucucuacaaac

SEQ ID NO: 258625 - RNA, 32 nt, Human
ugggcaacauagagagaccccaucucugcaaa

SEQ ID NO: 258626 - RNA, 32 nt, Human
ugggcaacauagcaagaccccaucucuacaaa

SEQ ID NO: 258627 - RNA, 32 nt, Human
ugggcaacauagcaagaccccaucucuaccaa

SEQ ID NO: 258628 - RNA, 32 nt, Human
ugggcaacauagcaagaccccaucucuauaaa

SEQ ID NO: 258629 - RNA, 32 nt, Human
ugggcaacauagcaagaccccgucucuacaaa

SEQ ID NO: 258630 - RNA, 32 nt, Human
ugggcaacauagcaagaccccgucucuuaaaa

SEQ ID NO: 258631 - RNA, 32 nt, Human
ugggcaacauagcaagacuccaucucuaagua

SEQ ID NO: 258632 - RNA, 32 nt, Human
ugggcaacauagcaggaccccaucucuacuau

SEQ ID NO: 258633 - RNA, 32 nt, Human
ugggcaacauagcgagaccccaucucuacaaa

SEQ ID NO: 258634 - RNA, 32 nt, Human
ugggcaacauagcgagacuccaucucuauaaa

SEQ ID NO: 258635 - RNA, 32 nt, Human
ugggcaacauaggaagacuccgucucuacaua

SEQ ID NO: 258636 - RNA, 32 nt, Human
ugggcaacauagggagaccccaucucuacaga

SEQ ID NO: 258637 - RNA, 32 nt, Human
ugggcaacauagggaggccccgucucuuaaaa

SEQ ID NO: 258638 - RNA, 32 nt, Human
ugggcaacauagggggaucccaucucuacaca

SEQ ID NO: 258639 - RNA, 32 nt, Human
ugggcaacauaguaagaccccaucucuaugaa

SEQ ID NO: 258640 - RNA, 32 nt, Human
ugggcaacauaguaagaccccaucucuuaaaa

SEQ ID NO: 258641 - RNA, 32 nt, Human
ugggcaacauagugaagccccaucucugcaaa

SEQ ID NO: 258642 - RNA, 32 nt, Human
ugggcaacauagugagaccccaucucuacaaa

SEQ ID NO: 258643 - RNA, 32 nt, Human
ugggcaacauagugagaccccaucucuacaau

SEQ ID NO: 258644 - RNA, 32 nt, Human
ugggcaacauagugagaccccaucucuacauc

SEQ ID NO: 258645 - RNA, 32 nt, Human
ugggcaacauagugagaccccaucucuacuua

SEQ ID NO: 258646 - RNA, 32 nt, Human
ugggcaacauagugagaccccaucucuuuaaa

SEQ ID NO: 258647 - RNA, 23 nt, Human
ugggcaacauagugagacccugu

SEQ ID NO: 258648 - RNA, 22 nt, Human
ugggcaacauagugagaccuug

SEQ ID NO: 258649 - RNA, 32 nt, Human
ugggcaacauagugagaucccaucucuacaaa

SEQ ID NO: 258650 - RNA, 32 nt, Human
ugggcaacauagugaggccccaucucuagaaa

SEQ ID NO: 258651 - RNA, 32 nt, Human
ugggcaacauagugauaccccaucucuuaaaa

SEQ ID NO: 258652 - RNA, 32 nt, Human
ugggcaacaucgggagaccccaucucuacaaa

SEQ ID NO: 258653 - RNA, 32 nt, Human
ugggcaacaugacaagaccccaucucuacaaa

SEQ ID NO: 258654 - RNA, 32 nt, Human
ugggcaacaugaugaaaccccaucuccacugc

SEQ ID NO: 258655 - RNA, 32 nt, Human
ugggcaacauggcaaaaacccaccucuacaaa

SEQ ID NO: 258656 - RNA, 32 nt, Human
ugggcaacauggcaaaacaccgucucuacaaa

SEQ ID NO: 258657 - RNA, 32 nt, Human
ugggcaacauggcaaaaccccaucucuacaaa

SEQ ID NO: 258658 - RNA, 32 nt, Human
ugggcaacauggcaaaaccccauuucuacaaa

SEQ ID NO: 258659 - RNA, 23 nt, Human
ugggcaacauggcaaaacccugu

SEQ ID NO: 258660 - RNA, 32 nt, Human
ugggcaacauggcaaaacccugucucuacaaa

SEQ ID NO: 258661 - RNA, 32 nt, Human
ugggcaacauggcaaaacccugucucuacuaa

SEQ ID NO: 258662 - RNA, 32 nt, Human
ugggcaacauggcaaaacccugucucuauuaa

SEQ ID NO: 258663 - RNA, 32 nt, Human
ugggcaacauggcaaaacccuguuucuacaca

SEQ ID NO: 258664 - RNA, 30 nt, Human
ugggcaacauggcaaaacuuugucucucuu

SEQ ID NO: 258665 - RNA, 32 nt, Human
ugggcaacauggcaaaauccugucucuauaaa

SEQ ID NO: 258666 - RNA, 32 nt, Human
ugggcaacauggcaaagccccaucucuacaaa

SEQ ID NO: 258667 - RNA, 32 nt, Human
ugggcaacauggcaaaugccgucucugcaaaa

SEQ ID NO: 258668 - RNA, 32 nt, Human
ugggcaacauggcaagacccugucucuacuaa

SEQ ID NO: 258669 - RNA, 32 nt, Human
ugggcaacauggcaagacccugucucuuuaaa

SEQ ID NO: 258670 - RNA, 32 nt, Human
ugggcaacauggccagaccuccucucuacaaa

SEQ ID NO: 258671 - RNA, 32 nt, Human
ugggcaacauggcgaaaacccaucucuacaaa

SEQ ID NO: 258672 - RNA, 32 nt, Human
ugggcaacauggcgaaaccccauuucuacuaa

SEQ ID NO: 258673 - RNA, 32 nt, Human
ugggcaacauggcgaaaccccgucucuacuaa

SEQ ID NO: 258674 - RNA, 32 nt, Human
ugggcaacauggcgaaacccuaucucuacaaa

SEQ ID NO: 258675 - RNA, 22 nt, Human
ugggcaacauggcgaaacccug

SEQ ID NO: 258676 - RNA, 32 nt, Human
ugggcaacauggcgaaacccugccucuacaaa

SEQ ID NO: 258677 - RNA, 29 nt, Human
ugggcaacauggcgaaacccugucuccac

SEQ ID NO: 258678 - RNA, 32 nt, Human
ugggcaacauggcgaaacccugucucuacuaa

SEQ ID NO: 258679 - RNA, 32 nt, Human
ugggcaacauggcgagaccccaucucuacuaa

SEQ ID NO: 258680 - RNA, 32 nt, Human
ugggcaacauggcgagacccugucucuacaaa

SEQ ID NO: 258681 - RNA, 32 nt, Human
ugggcaacauggcgagauccugucucugcaaa

SEQ ID NO: 258682 - RNA, 32 nt, Human
ugggcaacauggcgaggccucugucucuacaa

SEQ ID NO: 258683 - RNA, 32 nt, Human
ugggcaacauggcuaaaccccgucucuacaaa

SEQ ID NO: 258684 - RNA, 32 nt, Human
ugggcaacauggggaaacuccaucucuacaaa

SEQ ID NO: 258685 - RNA, 32 nt, Human
ugggcaacauggugaaaccccaucuccaccaa

SEQ ID NO: 258686 - RNA, 29 nt, Human
ugggcaacauggugaaaccccaucucuac

SEQ ID NO: 258687 - RNA, 32 nt, Human
ugggcaacauggugaaaccccaucucuacaaa

SEQ ID NO: 258688 - RNA, 32 nt, Human
ugggcaacauggugaaaccccaucucuacuaa

SEQ ID NO: 258689 - RNA, 32 nt, Human
ugggcaacauggugaaaccccgucucuaccaa

SEQ ID NO: 258690 - RNA, 32 nt, Human
ugggcaacauggugaaaccccgucucuacccc

SEQ ID NO: 258691 - RNA, 32 nt, Human
ugggcaacauggugaaaccccgucucuacuaa

SEQ ID NO: 258692 - RNA, 23 nt, Human
ugggcaacauggugaaacccugu

SEQ ID NO: 258693 - RNA, 32 nt, Human
ugggcaacauggugaaagcccgucucuaccga

SEQ ID NO: 258694 - RNA, 32 nt, Human
ugggcaacauggugaagccccaucucuacaaa

SEQ ID NO: 258695 - RNA, 32 nt, Human
ugggcaacauggugaccucccgucucucucgg

SEQ ID NO: 258696 - RNA, 32 nt, Human
ugggcaacauggugagaccccaucucuacaaa

SEQ ID NO: 258697 - RNA, 32 nt, Human
ugggcaacauggugagaccccaucucuauuua

SEQ ID NO: 258698 - RNA, 32 nt, Human
ugggcaacauggugagaccccgucucuacaaa

SEQ ID NO: 258699 - RNA, 32 nt, Human
ugggcaacauugggagacuccaucucuacaaa

SEQ ID NO: 258700 - RNA, 32 nt, Human
ugggcaaccagcugccccgcuguuuggcccag

SEQ ID NO: 258701 - RNA, 32 nt, Human
ugggcaaccccugaagcauuuuagugaugcga

SEQ ID NO: 258702 - RNA, 32 nt, Human
ugggcaacguagagauccccaucucuaugaaa

SEQ ID NO: 258703 - RNA, 32 nt, Human
ugggcaacguagucagaccccaucucuacaaa

SEQ ID NO: 258704 - RNA, 32 nt, Human
ugggcaacgugacgaaaccccaucucuacgaa

SEQ ID NO: 258705 - RNA, 32 nt, Human
ugggcaacgugaugagacuccgucucuaccaa

SEQ ID NO: 258706 - RNA, 32 nt, Human
ugggcaacguggugaaaccccaucucuacaaa

SEQ ID NO: 258707 - RNA, 32 nt, Human
ugggcaacugucaaccugcagcuuugagucuc

SEQ ID NO: 258708 - RNA, 32 nt, Human
ugggcaacuuagcgagacuccaucucuacaaa

SEQ ID NO: 258709 - RNA, 32 nt, Human
ugggcaacuugguaaaaccccaucucuacaaa

SEQ ID NO: 258710 - RNA, 32 nt, Human
ugggcaagaagagagcggccaucucggaucau

SEQ ID NO: 258711 - RNA, 32 nt, Human
ugggcaagaccucugugaccucaguuucccca

SEQ ID NO: 258712 - RNA, 32 nt, Human
ugggcaagagacuuccucugguuuccucagga

SEQ ID NO: 258713 - RNA, 32 nt, Human
ugggcaagaucccuguccuccugggcccugag

SEQ ID NO: 258714 - RNA, 32 nt, Human
ugggcaagauggcaagaccuuguuucuguuua

SEQ ID NO: 258715 - RNA, 32 nt, Human
ugggcaagauggugaaaccccaucucuacugg

SEQ ID NO: 258716 - RNA, 23 nt, Human
ugggcaagcacaagguaggugcu

SEQ ID NO: 258717 - RNA, 17 nt, Human
ugggcaagcccagugga

SEQ ID NO: 258718 - RNA, 32 nt, Human
ugggcaagcuauagccauggcuguggcuguag

SEQ ID NO: 258719 - RNA, 32 nt, Human
ugggcaagcugauccugcugcaccacaagcac

SEQ ID NO: 258720 - RNA, 32 nt, Human
ugggcaagcugccucccaucacugccugcugg

SEQ ID NO: 258721 - RNA, 32 nt, Human
ugggcaagugaagagauaucagccuggucauc

SEQ ID NO: 258722 - RNA, 32 nt, Human
ugggcaagugcagugaaacaggugcuuccugc

SEQ ID NO: 258723 - RNA, 28 nt, Human
ugggcaauaaacaaguaaauauacaaac

SEQ ID NO: 258724 - RNA, 32 nt, Human
ugggcaauagagaugccuuccccuguagcagu

SEQ ID NO: 258725 - RNA, 32 nt, Human
ugggcaauauagcaagaccccaucucuaaaaa

SEQ ID NO: 258726 - RNA, 32 nt, Human
ugggcaauauagcaagaucccaucucuuuaaa

SEQ ID NO: 258727 - RNA, 32 nt, Human
ugggcaauauagugaaaccccaucucuuaaag

SEQ ID NO: 258728 - RNA, 32 nt, Human
ugggcaauauagugagaccccaucucuagaag

SEQ ID NO: 258729 - RNA, 32 nt, Human
ugggcaauaucgugagaccccaucucuacaaa

SEQ ID NO: 258730 - RNA, 32 nt, Human
ugggcaauauggugacaccccaucucuacaaa

SEQ ID NO: 258731 - RNA, 25 nt, Human
ugggcaaucaaaaaagccaguguga

SEQ ID NO: 258732 - RNA, 32 nt, Human
ugggcaauccaccacuuccucuuccuucugcu

SEQ ID NO: 258733 - RNA, 32 nt, Human
ugggcaauguggcgaaacuccaucucuacaaa

SEQ ID NO: 258734 - RNA, 30 nt, Human
ugggcaauguggggagaccccaucucuaca

SEQ ID NO: 258735 - RNA, 32 nt, Human
ugggcaauuccagagaauucaguaccugcuug

SEQ ID NO: 258736 - RNA, 19 nt, Human
ugggcacaagacagucaaa

SEQ ID NO: 258737 - RNA, 32 nt, Human
ugggcacaagugcagaaggugcaggugcagug

SEQ ID NO: 258738 - RNA, 24 nt, Human
ugggcacaauggcucgugcuugua

SEQ ID NO: 258739 - RNA, 22 nt, Human
ugggcacacuguaucugcuaca

SEQ ID NO: 258740 - RNA, 32 nt, Human
ugggcacagaccugcauuuguugaccuugcac

SEQ ID NO: 258741 - RNA, 32 nt, Human
ugggcacagaugaguccauccaugcucacugg

SEQ ID NO: 258742 - RNA, 32 nt, Human
ugggcacaggcugugagccagggugcugggaa

SEQ ID NO: 258743 - RNA, 24 nt, Human
ugggcacaguagcucaugccugua

SEQ ID NO: 258744 - RNA, 24 nt, Human
ugggcacaguggcucacaccugua

SEQ ID NO: 258745 - RNA, 24 nt, Human
ugggcacaguggcucacgccugua

SEQ ID NO: 258746 - RNA, 22 nt, Human
ugggcacaguggcucaugccug

SEQ ID NO: 258747 - RNA, 24 nt, Human
ugggcacaguggcucaugccugua

SEQ ID NO: 258748 - RNA, 24 nt, Human
ugggcacaguggcuuacaccugua

SEQ ID NO: 258749 - RNA, 19 nt, Human
ugggcacaguggugugcau

SEQ ID NO: 258750 - RNA, 24 nt, Human
ugggcacagugguuuauagcugua

SEQ ID NO: 258751 - RNA, 32 nt, Human
ugggcacaugggagauggggacaggaaagaug

SEQ ID NO: 258752 - RNA, 32 nt, Human
ugggcacauguaaucccagcuacuugggaggc

SEQ ID NO: 258753 - RNA, 28 nt, Human
ugggcaccacaggcugccucaugacccu

SEQ ID NO: 258754 - RNA, 32 nt, Human
ugggcaccaggucugugccaagcacagggacu

SEQ ID NO: 258755 - RNA, 32 nt, Human
ugggcaccaucagcuaaagaugcuggaagcca

SEQ ID NO: 258756 - RNA, 32 nt, Human
ugggcaccauggugagaccccaucucuauuau

SEQ ID NO: 258757 - RNA, 32 nt, Human
ugggcaccauguccuugaagcuucaggcaagc

SEQ ID NO: 258758 - RNA, 32 nt, Human
ugggcacccggauucaccucuggaccacccug

SEQ ID NO: 258759 - RNA, 32 nt, Human
ugggcacccugcacucaauggugaaggacuug

SEQ ID NO: 258760 - RNA, 32 nt, Human
ugggcacccugucuccccuggucucacugcug

SEQ ID NO: 258761 - RNA, 32 nt, Human
ugggcacccuuugggccaccuaguuuccccug

SEQ ID NO: 258762 - RNA, 32 nt, Human
ugggcaccgccagccgccugggcacgggacug

SEQ ID NO: 258763 - RNA, 24 nt, Human
ugggcaccguggcucacgccugua

SEQ ID NO: 258764 - RNA, 32 nt, Human
ugggcaccuauuaugcuacauaucauguuagg

SEQ ID NO: 258765 - RNA, 18 nt, Human
ugggcaccucccugcagu

SEQ ID NO: 258766 - RNA, 32 nt, Human
ugggcaccugaggcggagucugcguggagagg

SEQ ID NO: 258767 - RNA, 32 nt, Human
ugggcaccuggcacuaagggaguaccuuauua

SEQ ID NO: 258768 - RNA, 32 nt, Human
ugggcaccugggagcaccagcugcggcgcaug

SEQ ID NO: 258769 - RNA, 18 nt, Human
ugggcaccuguaauccca

SEQ ID NO: 258770 - RNA, 32 nt, Human
ugggcaccuguaaucccagcuacuagggagac

SEQ ID NO: 258771 - RNA, 32 nt, Human
ugggcaccuguaaucccagcuacucaggaggc

SEQ ID NO: 258772 - RNA, 32 nt, Human
ugggcaccuguaaucccagcuacucgggaggc

SEQ ID NO: 258773 - RNA, 32 nt, Human
ugggcaccuguaaucccagcuacucuggaggc

SEQ ID NO: 258774 - RNA, 32 nt, Human
ugggcaccuguaaucccagcuacuuggaaggc

SEQ ID NO: 258775 - RNA, 32 nt, Human
ugggcaccuguaaucccagcuacuugggaggc

SEQ ID NO: 258776 - RNA, 32 nt, Human
ugggcaccuguaaucucagcuacuugggaggc

SEQ ID NO: 258777 - RNA, 19 nt, Human
ugggcacgccagucugcac

SEQ ID NO: 258778 - RNA, 32 nt, Human
ugggcacgccuguaaucccagcuacucgggag

SEQ ID NO: 258779 - RNA, 32 nt, Human
ugggcacggugacugcgguuauuccuggaggu

SEQ ID NO: 258780 - RNA, 24 nt, Human
ugggcacggugccucaugccugua

SEQ ID NO: 258781 - RNA, 24 nt, Human
ugggcacgguggcucacaccugua

SEQ ID NO: 258782 - RNA, 24 nt, Human
ugggcacgguggcucacgccugua

SEQ ID NO: 258783 - RNA, 24 nt, Human
ugggcacgguggcucacgcuugua

SEQ ID NO: 258784 - RNA, 24 nt, Human
ugggcacgguggcucacuccugua

SEQ ID NO: 258785 - RNA, 24 nt, Human
ugggcacgguggcucauaccugua

SEQ ID NO: 258786 - RNA, 21 nt, Human
ugggcacgguggcucaugccu

SEQ ID NO: 258787 - RNA, 24 nt, Human
ugggcacgguggcucaugccugua

SEQ ID NO: 258788 - RNA, 32 nt, Human
ugggcacucccaggccccaggcagugcugcag

SEQ ID NO: 258789 - RNA, 21 nt, Human
ugggcacugccaccugacaca

SEQ ID NO: 258790 - RNA, 18 nt, Human
ugggcacugcugcugcau

SEQ ID NO: 258791 - RNA, 32 nt, Human
ugggcacuggccccuggcugggccauuucaug

SEQ ID NO: 258792 - RNA, 32 nt, Human
ugggcacugguguggcugcucugggcagauga

SEQ ID NO: 258793 - RNA, 24 nt, Human
ugggcacuguggcucacgccugua

SEQ ID NO: 258794 - RNA, 24 nt, Human
ugggcacuguggcucacuccugua

SEQ ID NO: 258795 - RNA, 32 nt, Human
ugggcacugugggccuguggccuuccuggcug

SEQ ID NO: 258796 - RNA, 32 nt, Human
ugggcacuugacucuauuccauugaccuguuu

SEQ ID NO: 258797 - RNA, 21 nt, Human
ugggcacuuugcacugccaca

SEQ ID NO: 258798 - RNA, 32 nt, Human
ugggcagaaagacuccagcaggugagcucuuc

SEQ ID NO: 258799 - RNA, 32 nt, Human
ugggcagaaagccaaaguacuggacugccugg

SEQ ID NO: 258800 - RNA, 32 nt, Human
ugggcagaaagggaggaggagggcaacaggga

SEQ ID NO: 258801 - RNA, 32 nt, Human
ugggcagaaaugugcugcaaagaguuauauga

SEQ ID NO: 258802 - RNA, 32 nt, Human
ugggcagaacauguuuauugcacagagugggc

SEQ ID NO: 258803 - RNA, 24 nt, Human
ugggcagaccuacaaggcugcgca

SEQ ID NO: 258804 - RNA, 32 nt, Human
ugggcagaccuguccuucugugccucacagua

SEQ ID NO: 258805 - RNA, 32 nt, Human
ugggcagacgcuggugcccgaguucagauccu

SEQ ID NO: 258806 - RNA, 32 nt, Human
ugggcagagacccuguaggauggggucaggaa

SEQ ID NO: 258807 - RNA, 32 nt, Human
ugggcagagagcuggggccaccucuggaggug

SEQ ID NO: 258808 - RNA, 32 nt, Human
ugggcagagcugagugugagaagauggaaaac

SEQ ID NO: 258809 - RNA, 32 nt, Human
ugggcagaggaaccucuagcucugacugucac

SEQ ID NO: 258810 - RNA, 32 nt, Human
ugggcagaggagguguagccuggggcaaagug

SEQ ID NO: 258811 - RNA, 32 nt, Human
ugggcagaggcagaggucagcacuggccauga

SEQ ID NO: 258812 - RNA, 32 nt, Human
ugggcagaggcgggacaguggagaagccugga

SEQ ID NO: 258813 - RNA, 32 nt, Human
ugggcagagggaaaggguggucagggugagga

SEQ ID NO: 258814 - RNA, 32 nt, Human
ugggcagaggggaaggguggucagggugagga

SEQ ID NO: 258815 - RNA, 32 nt, Human
ugggcagaguccugccuucuuccuugaggggc

SEQ ID NO: 258816 - RNA, 32 nt, Human
ugggcagaucacaugaggccaggaguucaaga

SEQ ID NO: 258817 - RNA, 23 nt, Human
ugggcagaucgccugagcccagg

SEQ ID NO: 258818 - RNA, 32 nt, Human
ugggcagaugcuggacauuugaggagccgucu

SEQ ID NO: 258819 - RNA, 32 nt, Human
ugggcagcaaaccugcuguuuaacaucagggu

SEQ ID NO: 258820 - RNA, 31 nt, Human
ugggcagcaaugucugcuacauggaagagau

SEQ ID NO: 258821 - RNA, 32 nt, Human
ugggcagcagagcaagacucugucucaaaagg

SEQ ID NO: 258822 - RNA, 32 nt, Human
ugggcagcagagcgagacucugucucaaaaau

SEQ ID NO: 258823 - RNA, 32 nt, Human
ugggcagcagagcgagacucugucucaacaac

SEQ ID NO: 258824 - RNA, 32 nt, Human
ugggcagcagaggcaacucccgcauccuuugc

SEQ ID NO: 258825 - RNA, 32 nt, Human
ugggcagcagaugcugagcuuuccucaccucc

SEQ ID NO: 258826 - RNA, 21 nt, Human
ugggcagcagcagcagcuucu

SEQ ID NO: 258827 - RNA, 32 nt, Human
ugggcagcauagcgagaccccaucucuauaua

SEQ ID NO: 258828 - RNA, 30 nt, Human
ugggcagcauagugugagacccugucucuu

SEQ ID NO: 258829 - RNA, 32 nt, Human
ugggcagcauggcgaaaucccaucucuacaaa

SEQ ID NO: 258830 - RNA, 32 nt, Human
ugggcagccaccuccuuugcccuagaccagcu

SEQ ID NO: 258831 - RNA, 32 nt, Human
ugggcagccagccugagcugccuccuccaugg

SEQ ID NO: 258832 - RNA, 32 nt, Human
ugggcagccauuugggcagacacuggcuagca

SEQ ID NO: 258833 - RNA, 32 nt, Human
ugggcagccauuuucucccgggagaggcugga

SEQ ID NO: 258834 - RNA, 32 nt, Human
ugggcagcccuggaagcucggaggagaggcca

SEQ ID NO: 258835 - RNA, 32 nt, Human
ugggcagcccuuggagcacacaguggugaaga

SEQ ID NO: 258836 - RNA, 19 nt, Human
ugggcagccggcggcgcgg

SEQ ID NO: 258837 - RNA, 32 nt, Human
ugggcagccuccucacaggugggcugggcugg

SEQ ID NO: 258838 - RNA, 32 nt, Human
ugggcagccugcuuuggccuuuccuuguaugu

SEQ ID NO: 258839 - RNA, 21 nt, Human
ugggcagccugggaagccugg

SEQ ID NO: 258840 - RNA, 32 nt, Human
ugggcagcgacaacgaggaggugguggcuggc

SEQ ID NO: 258841 - RNA, 32 nt, Human
ugggcagcgcacuccagucuucccaggcuagc

SEQ ID NO: 258842 - RNA, 32 nt, Human
ugggcagcggaugggcugggcgaugcagcugg

SEQ ID NO: 258843 - RNA, 32 nt, Human
ugggcagcggccagggcagccauggcuugggc

SEQ ID NO: 258844 - RNA, 32 nt, Human
ugggcagcuaauccuuuccugccugugcucuc

SEQ ID NO: 258845 - RNA, 21 nt, Human
ugggcagcucccaucccaguc

SEQ ID NO: 258846 - RNA, 32 nt, Human
ugggcagcucuauuccagcucaacugauuucu

SEQ ID NO: 258847 - RNA, 32 nt, Human
ugggcagcucuggucaagcacagcauggcgac

SEQ ID NO: 258848 - RNA, 18 nt, Human
ugggcagcugcccaccac

SEQ ID NO: 258849 - RNA, 32 nt, Human
ugggcagcugcuggagcacacgccucaaaguc

SEQ ID NO: 258850 - RNA, 32 nt, Human
ugggcagcuggcacagcugaggcaaggcaggg

SEQ ID NO: 258851 - RNA, 32 nt, Human
ugggcagcugggcccuccugggugggguggug

SEQ ID NO: 258852 - RNA, 32 nt, Human
ugggcagcuguggcagagcagcgacccgcggc

SEQ ID NO: 258853 - RNA, 32 nt, Human
ugggcagcuguggcagagcagucccgacaccu

SEQ ID NO: 258854 - RNA, 32 nt, Human
ugggcagcuguuuggggcucagcugggucccc

SEQ ID NO: 258855 - RNA, 32 nt, Human
ugggcagcuuagggcccugccucuguuucaug

SEQ ID NO: 258856 - RNA, 32 nt, Human
ugggcaggaagccagacacagagcggguggcu

SEQ ID NO: 258857 - RNA, 32 nt, Human
ugggcaggagcaauccagaguuguuauuuuuc

SEQ ID NO: 258858 - RNA, 32 nt, Human
ugggcaggagggcuggaaaagccggcgcugga

SEQ ID NO: 258859 - RNA, 32 nt, Human
ugggcaggaggggaaauggauuugaaccaucu

SEQ ID NO: 258860 - RNA, 32 nt, Human
ugggcaggaugaaggccaggggcacuggagug

SEQ ID NO: 258861 - RNA, 32 nt, Human
ugggcaggcacccggaggaggagcagcagcug

SEQ ID NO: 258862 - RNA, 20 nt, Human
ugggcaggcagagcuggggu

SEQ ID NO: 258863 - RNA, 32 nt, Human
ugggcaggcagccacagagggcauguuaucug

SEQ ID NO: 258864 - RNA, 32 nt, Human
ugggcaggcaggcagggcauagcgacagugug

SEQ ID NO: 258865 - RNA, 32 nt, Human
ugggcaggcaucggagcuuccagccuggggag

SEQ ID NO: 258866 - RNA, 32 nt, Human
ugggcaggcugcaccucaucugggcaggcgca

SEQ ID NO: 258867 - RNA, 32 nt, Human
ugggcaggcuuccuuccuccuggugauggggg

SEQ ID NO: 258868 - RNA, 32 nt, Human
ugggcagggagagugacggggagcagcacagu

SEQ ID NO: 258869 - RNA, 19 nt, Human
ugggcagggcagggcuggc

SEQ ID NO: 258870 - RNA, 32 nt, Human
ugggcagggcuggacgcugggaccuggagcug

SEQ ID NO: 258871 - RNA, 32 nt, Human
ugggcagggcuucugcacuucugcugcuuacc

SEQ ID NO: 258872 - RNA, 32 nt, Human
ugggcaggggaaagagaaagaagaugagagau

SEQ ID NO: 258873 - RNA, 32 nt, Human
ugggcaggggauguuuaaauacugauuaauua

SEQ ID NO: 258874 - RNA, 32 nt, Human
ugggcagggggcaugaugcgggccagugcucc

SEQ ID NO: 258875 - RNA, 32 nt, Human
ugggcagggggcggaggcugccgaggccaggg

SEQ ID NO: 258876 - RNA, 32 nt, Human
ugggcaggggugcucgagagguccccaggagu

SEQ ID NO: 258877 - RNA, 32 nt, Human
ugggcaggguggggcaggaugcagugagccag

SEQ ID NO: 258878 - RNA, 32 nt, Human
ugggcagguagcacgccugcuggcagagguac

SEQ ID NO: 258879 - RNA, 32 nt, Human
ugggcaggugagggcaggauggagaccaaggg

SEQ ID NO: 258880 - RNA, 32 nt, Human
ugggcaggugaguguccaggagaugagggcug

SEQ ID NO: 258881 - RNA, 32 nt, Human
ugggcaggugcagauccaagggcugugguaaa

SEQ ID NO: 258882 - RNA, 32 nt, Human
ugggcagguggccauggggaggggccauggcu

SEQ ID NO: 258883 - RNA, 32 nt, Human
ugggcaguagcuccucccauggccagugguca

SEQ ID NO: 258884 - RNA, 32 nt, Human
ugggcagucaguccagagaugcuggcccucgc

SEQ ID NO: 258885 - RNA, 32 nt, Human
ugggcagucuaaguaagcaacagcaaggcugg

SEQ ID NO: 258886 - RNA, 32 nt, Human
ugggcagugaugacaccaaauauaagcauaaa

SEQ ID NO: 258887 - RNA, 32 nt, Human
ugggcagugccacccacuccuugggccccuag

SEQ ID NO: 258888 - RNA, 32 nt, Human
ugggcagugccuccuccugggccugggucugg

SEQ ID NO: 258889 - RNA, 32 nt, Human
ugggcaguggcugccguaggggaggcgcucug

SEQ ID NO: 258890 - RNA, 32 nt, Human
ugggcaguggcugugggagcaggaauggcgca

SEQ ID NO: 258891 - RNA, 32 nt, Human
ugggcaguggguggagggcugccaggaaacau

SEQ ID NO: 258892 - RNA, 32 nt, Human
ugggcagugucuccugugagaccaaggaccug

SEQ ID NO: 258893 - RNA, 32 nt, Human
ugggcagugugguuuggggcccagggggaauu

SEQ ID NO: 258894 - RNA, 32 nt, Human
ugggcaguguugcugaaagggccagguugugg

SEQ ID NO: 258895 - RNA, 32 nt, Human
ugggcaguugaccugcacagacaggaaccuca

SEQ ID NO: 258896 - RNA, 32 nt, Human
ugggcaguuguucuggacaagucaucaguuuc

SEQ ID NO: 258897 - RNA, 32 nt, Human
ugggcauagccucagccccaggccucuguccu

SEQ ID NO: 258898 - RNA, 24 nt, Human
ugggcauaguagcucaugccugua

SEQ ID NO: 258899 - RNA, 24 nt, Human
ugggcauaguggcaugugccugua

SEQ ID NO: 258900 - RNA, 24 nt, Human
ugggcauaguggcgagugccugua

SEQ ID NO: 258901 - RNA, 24 nt, Human
ugggcauagugguguauaccugua

SEQ ID NO: 258902 - RNA, 24 nt, Human
ugggcauagugguucaugccugua

SEQ ID NO: 258903 - RNA, 32 nt, Human
ugggcaucaauggcaccuccacacagccgaag

SEQ ID NO: 258904 - RNA, 32 nt, Human
ugggcaucagggacuuugugcuaagccugaug

SEQ ID NO: 258905 - RNA, 32 nt, Human
ugggcauccacuucgacugcucagggaaguac

SEQ ID NO: 258906 - RNA, 32 nt, Human
ugggcauccagccucuggggccuuggcacaca

SEQ ID NO: 258907 - RNA, 32 nt, Human
ugggcauccggccugugcugggcauggguggu

SEQ ID NO: 258908 - RNA, 32 nt, Human
ugggcaucguagugagacuccaucucugucuu

SEQ ID NO: 258909 - RNA, 32 nt, Human
ugggcaucuggaagacaaacagcaacucucag

SEQ ID NO: 258910 - RNA, 20 nt, Human
ugggcaucugggauucggag

SEQ ID NO: 258911 - RNA, 32 nt, Human
ugggcaucuguaauccuagcugcucgggaggc

SEQ ID NO: 258912 - RNA, 32 nt, Human
ugggcaucuguggauuuuuggcuacuagaagu

SEQ ID NO: 258913 - RNA, 23 nt, Human
ugggcaucuuccccagcaacuac

SEQ ID NO: 258914 - RNA, 24 nt, Human
ugggcaugauggcgugugccugua

SEQ ID NO: 258915 - RNA, 24 nt, Human
ugggcaugauugcgcaugccugua

SEQ ID NO: 258916 - RNA, 20 nt, Human
ugggcaugcaggugacaagg

SEQ ID NO: 258917 - RNA, 32 nt, Human
ugggcaugccuguaaucccagaauuuugggag

SEQ ID NO: 258918 - RNA, 32 nt, Human
ugggcaugcugugguugcugagggaugagggg

SEQ ID NO: 258919 - RNA, 24 nt, Human
ugggcauggaggcucaugccugua

SEQ ID NO: 258920 - RNA, 32 nt, Human
ugggcauggaggcuugccccagauggggacca

SEQ ID NO: 258921 - RNA, 32 nt, Human
ugggcauggccuccccuccucugcuugccauc

SEQ ID NO: 258922 - RNA, 21 nt, Human
ugggcauggggggccccugau

SEQ ID NO: 258923 - RNA, 24 nt, Human
ugggcaugguagcacaugccugug

SEQ ID NO: 258924 - RNA, 24 nt, Human
ugggcaugguagcucaugccugua

SEQ ID NO: 258925 - RNA, 24 nt, Human
ugggcaugguagugcaugccugua

SEQ ID NO: 258926 - RNA, 24 nt, Human
ugggcauggugacucaugccugua

SEQ ID NO: 258927 - RNA, 24 nt, Human
ugggcaugguggagcaugccugua

SEQ ID NO: 258928 - RNA, 22 nt, Human
ugggcaugguggcacaugccug

SEQ ID NO: 258929 - RNA, 24 nt, Human
ugggcaugguggcacaugccugua

SEQ ID NO: 258930 - RNA, 24 nt, Human
ugggcaugguggcacgugccugug

SEQ ID NO: 258931 - RNA, 24 nt, Human
ugggcaugguggcaggugccugua

SEQ ID NO: 258932 - RNA, 24 nt, Human
ugggcaugguggcaguugccugua

SEQ ID NO: 258933 - RNA, 24 nt, Human
ugggcaugguggcauauaccugua

SEQ ID NO: 258934 - RNA, 24 nt, Human
ugggcaugguggcaugugccugua

SEQ ID NO: 258935 - RNA, 24 nt, Human
ugggcaugguggcgaaugccugua

SEQ ID NO: 258936 - RNA, 24 nt, Human
ugggcaugguggcgcauaccugua

SEQ ID NO: 258937 - RNA, 24 nt, Human
ugggcaugguggcgcaugccugua

SEQ ID NO: 258938 - RNA, 24 nt, Human
ugggcaugguggcgcgugccugua

SEQ ID NO: 258939 - RNA, 24 nt, Human
ugggcaugguggcgggugccugua

SEQ ID NO: 258940 - RNA, 20 nt, Human
ugggcaugguggcgugccug

SEQ ID NO: 258941 - RNA, 22 nt, Human
ugggcaugguggcgugccugua

SEQ ID NO: 258942 - RNA, 24 nt, Human
ugggcaugguggcucacaccugua

SEQ ID NO: 258943 - RNA, 24 nt, Human
ugggcaugguggcucaccccugua

SEQ ID NO: 258944 - RNA, 24 nt, Human
ugggcaugguggcucacgccugua

SEQ ID NO: 258945 - RNA, 24 nt, Human
ugggcaugguggcucacgccugug

SEQ ID NO: 258946 - RNA, 24 nt, Human
ugggcaugguggcucacgcuugua

SEQ ID NO: 258947 - RNA, 24 nt, Human
ugggcaugguggcucacuccugua

SEQ ID NO: 258948 - RNA, 24 nt, Human
ugggcaugguggcucauaccugua

SEQ ID NO: 258949 - RNA, 21 nt, Human
ugggcaugguggcucaugccu

SEQ ID NO: 258950 - RNA, 24 nt, Human
ugggcaugguggcucaugccugua

SEQ ID NO: 258951 - RNA, 24 nt, Human
ugggcaugguggcucgcgcuugug

SEQ ID NO: 258952 - RNA, 24 nt, Human
ugggcaugguggcucgugccugua

SEQ ID NO: 258953 - RNA, 24 nt, Human
ugggcaugguggcuggcgccugua

SEQ ID NO: 258954 - RNA, 24 nt, Human
ugggcaugguggcuuacgccugua

SEQ ID NO: 258955 - RNA, 24 nt, Human
ugggcaugguggcuuaugccugua

SEQ ID NO: 258956 - RNA, 24 nt, Human
ugggcaugguggggcaugccugua

SEQ ID NO: 258957 - RNA, 24 nt, Human
ugggcaugguggugcaugccugua

SEQ ID NO: 258958 - RNA, 24 nt, Human
ugggcauggugguucaugccugua

SEQ ID NO: 258959 - RNA, 32 nt, Human
ugggcaugucaggguuuggccaugacccgaag

SEQ ID NO: 258960 - RNA, 32 nt, Human
ugggcaugugccugucugagccccaggucugu

SEQ ID NO: 258961 - RNA, 32 nt, Human
ugggcauguggucccagcuacucuggaagcug

SEQ ID NO: 258962 - RNA, 31 nt, Human
ugggcauguuaacauugccuaccucauagga

SEQ ID NO: 258963 - RNA, 32 nt, Human
ugggcauuaggggcaacucaugcagaagaccc

SEQ ID NO: 258964 - RNA, 32 nt, Human
ugggcauuccccgcuuuguugcagagaaauua

SEQ ID NO: 258965 - RNA, 32 nt, Human
ugggcauugccaguaccugccuccaggcauau

SEQ ID NO: 258966 - RNA, 22 nt, Human
ugggcauuucaucuucaguccc

SEQ ID NO: 258967 - RNA, 32 nt, Human
ugggcauuuuccuccucugccuacagccaggu

SEQ ID NO: 258968 - RNA, 32 nt, Human
ugggcauuuucucugcuguuacuuuucugcua

SEQ ID NO: 258969 - RNA, 32 nt, Human
ugggccaaaagauagaucaggacgacagccuu

SEQ ID NO: 258970 - RNA, 32 nt, Human
ugggccaaacuaagcucugacaauuaauguua

SEQ ID NO: 258971 - RNA, 32 nt, Human
ugggccaaaggggcuuggagaggucaaaacau

SEQ ID NO: 258972 - RNA, 32 nt, Human
ugggccaacaugguuaaacccuauuucuacua

SEQ ID NO: 258973 - RNA, 32 nt, Human
ugggccaacguggugaaacccugucucuacuu

SEQ ID NO: 258974 - RNA, 32 nt, Human
ugggccaagcauguacaaauucuauuaauuaa

SEQ ID NO: 258975 - RNA, 32 nt, Human
ugggccaagcucugggggcagguggagagggc

SEQ ID NO: 258976 - RNA, 32 nt, Human
ugggccaaggagcagggagacaggaggcagag

SEQ ID NO: 258977 - RNA, 32 nt, Human
ugggccaaggguggggcugggaagcauccugu

SEQ ID NO: 258978 - RNA, 32 nt, Human
ugggccaaugcaugcuucagggccacacccag

SEQ ID NO: 258979 - RNA, 19 nt, Human
ugggccacacggcugcccc

SEQ ID NO: 258980 - RNA, 23 nt, Human
ugggccacagaggauccagcaag

SEQ ID NO: 258981 - RNA, 32 nt, Human
ugggccacaguuucagcagaccaucaggugaa

SEQ ID NO: 258982 - RNA, 32 nt, Human
ugggccacaguuucaguacuucagccucagug

SEQ ID NO: 258983 - RNA, 32 nt, Human
ugggccaccagcuucccucccuugacucuggg

SEQ ID NO: 258984 - RNA, 32 nt, Human
ugggccaccaggaguucaagaccagcccgggc

SEQ ID NO: 258985 - RNA, 32 nt, Human
ugggccaccaggaucagccaggagggcguucu

SEQ ID NO: 258986 - RNA, 21 nt, Human
ugggccacccagggccucuga

SEQ ID NO: 258987 - RNA, 32 nt, Human
ugggccaccgccuugcccagccuggaugccau

SEQ ID NO: 258988 - RNA, 32 nt, Human
ugggccacgggcugcaaccggagccucggacc

SEQ ID NO: 258989 - RNA, 32 nt, Human
ugggccacgguaaaagcaaacagagcagaacc

SEQ ID NO: 258990 - RNA, 32 nt, Human
ugggccacguguagcugggaggccggcaggac

SEQ ID NO: 258991 - RNA, 32 nt, Human
ugggccacuccaggagcugaguuggguggaag

SEQ ID NO: 258992 - RNA, 32 nt, Human
ugggccacugaggagaggggagagagcuggug

SEQ ID NO: 258993 - RNA, 32 nt, Human
ugggccacugcaaagauuccagccugggucca

SEQ ID NO: 258994 - RNA, 32 nt, Human
ugggccacugcacaucugccucucucagggac

SEQ ID NO: 258995 - RNA, 32 nt, Human
ugggccacugcaccccaccaggacggcaggac

SEQ ID NO: 258996 - RNA, 32 nt, Human
ugggccacugcacuccacccugggcgacagag

SEQ ID NO: 258997 - RNA, 32 nt, Human
ugggccacugcacuccagccuggaugacagag

SEQ ID NO: 258998 - RNA, 32 nt, Human
ugggccacugcacucuagccuggcaacagagc

SEQ ID NO: 258999 - RNA, 32 nt, Human
ugggccacugcagucgagccugggcgacacaa

SEQ ID NO: 259000 - RNA, 19 nt, Human
ugggccacugcccucucca

SEQ ID NO: 259001 - RNA, 23 nt, Human
ugggccacuggaggggucucuga

SEQ ID NO: 259002 - RNA, 32 nt, Human
ugggccacuucuuccccuguagaugugggcuu

SEQ ID NO: 259003 - RNA, 21 nt, Human
ugggccagaagauucugcaaa

SEQ ID NO: 259004 - RNA, 32 nt, Human
ugggccagaggacccuuucugauggacuucag

SEQ ID NO: 259005 - RNA, 23 nt, Human
ugggccagagggggucuuaguaa

SEQ ID NO: 259006 - RNA, 32 nt, Human
ugggccagcacacccagaaagccucacauugu

SEQ ID NO: 259007 - RNA, 32 nt, Human
ugggccagcauucucaugggguagagcagaau

SEQ ID NO: 259008 - RNA, 32 nt, Human
ugggccagccucccgaguuccaggagcgaauu

SEQ ID NO: 259009 - RNA, 32 nt, Human
ugggccagcugccugugccugccaugggccag

SEQ ID NO: 259010 - RNA, 32 nt, Human
ugggccagcuuauguaaugucuuuuuggauaa

SEQ ID NO: 259011 - RNA, 32 nt, Human
ugggccaggacugacuuccuccccacacaggg

SEQ ID NO: 259012 - RNA, 32 nt, Human
ugggccaggagaaggugauucucuucuaugcc

SEQ ID NO: 259013 - RNA, 32 nt, Human
ugggccaggaggagcugaggcugcagacccca

SEQ ID NO: 259014 - RNA, 32 nt, Human
ugggccaggaguucaagaucagccuggccaac

SEQ ID NO: 259015 - RNA, 32 nt, Human
ugggccaggaguuuaagaucagccuggccaac

SEQ ID NO: 259016 - RNA, 32 nt, Human
ugggccaggaguuugagaccagccuggccaac

SEQ ID NO: 259017 - RNA, 27 nt, Human
ugggccaggccuaaacaggagcaccug

SEQ ID NO: 259018 - RNA, 32 nt, Human
ugggccaggcugcaccugugcugggggaaggu

SEQ ID NO: 259019 - RNA, 32 nt, Human
ugggccaggcugcucagacuccuggguggcuu

SEQ ID NO: 259020 - RNA, 32 nt, Human
ugggccaggcuucaguucaggccuguugcuua

SEQ ID NO: 259021 - RNA, 32 nt, Human
ugggccaggucaguaaccagcccugcagcaca

SEQ ID NO: 259022 - RNA, 32 nt, Human
ugggccagguccuucacgaggagggagcuacc

SEQ ID NO: 259023 - RNA, 32 nt, Human
ugggccagucccagagaguuaggaagucaagg

SEQ ID NO: 259024 - RNA, 32 nt, Human
ugggccagugccucugccaaguccgaggagga

SEQ ID NO: 259025 - RNA, 32 nt, Human
ugggccagugucaggccagcaggugcagggac

SEQ ID NO: 259026 - RNA, 21 nt, Human
ugggccauagcuccugcucca

SEQ ID NO: 259027 - RNA, 32 nt, Human
ugggccauccccauagccauguuuacaugauu

SEQ ID NO: 259028 - RNA, 32 nt, Human
ugggccaucgccgcagcacaggcagcggcggc

SEQ ID NO: 259029 - RNA, 32 nt, Human
ugggccaugccaggccagagcaguggcccucc

SEQ ID NO: 259030 - RNA, 32 nt, Human
ugggccaugcuggucugacuuaugcuuacuaa

SEQ ID NO: 259031 - RNA, 32 nt, Human
ugggccaugggccccuguagagcugcuuaccu

SEQ ID NO: 259032 - RNA, 32 nt, Human
ugggccaugugacccaaggagggauccuuacc

SEQ ID NO: 259033 - RNA, 32 nt, Human
ugggccauugauagcaucucccaggaacaacg

SEQ ID NO: 259034 - RNA, 21 nt, Human
ugggccauugcaaccaaaaug

SEQ ID NO: 259035 - RNA, 32 nt, Human
ugggccauugggccuggaaaacgugcucugac

SEQ ID NO: 259036 - RNA, 32 nt, Human
ugggcccaaaaacaagcaaaaccaaagaauau

SEQ ID NO: 259037 - RNA, 32 nt, Human
ugggcccaagaguucgagaccagccugggcaa

SEQ ID NO: 259038 - RNA, 32 nt, Human
ugggcccaagcaauucucccaccucagccucc

SEQ ID NO: 259039 - RNA, 32 nt, Human
ugggcccaaggcacagccagggcacaguuagg

SEQ ID NO: 259040 - RNA, 31 nt, Human
ugggcccaagugucgauucaggaaggguguc

SEQ ID NO: 259041 - RNA, 32 nt, Human
ugggcccaauccagaagagacugcucuugaaa

SEQ ID NO: 259042 - RNA, 32 nt, Human
ugggcccacaaccgaagacauucuuuucaggg

SEQ ID NO: 259043 - RNA, 28 nt, Human
ugggcccacacugcugccuucucccagg

SEQ ID NO: 259044 - RNA, 32 nt, Human
ugggcccaccuagccuuucccugcugcccaac

SEQ ID NO: 259045 - RNA, 32 nt, Human
ugggcccaccucugccuccacccucacugugu

SEQ ID NO: 259046 - RNA, 32 nt, Human
ugggcccacuacucauagcagcuccugaggca

SEQ ID NO: 259047 - RNA, 32 nt, Human
ugggcccagagacagcccugggcugcuccuau

SEQ ID NO: 259048 - RNA, 32 nt, Human
ugggcccagccggccucacacucauucagcag

SEQ ID NO: 259049 - RNA, 32 nt, Human
ugggcccagccggccucacacucauucagcgg

SEQ ID NO: 259050 - RNA, 32 nt, Human
ugggcccagccuagggcaucccgggccugggc

SEQ ID NO: 259051 - RNA, 32 nt, Human
ugggcccagcgcagugccucgugccugugauc

SEQ ID NO: 259052 - RNA, 32 nt, Human
ugggcccaggagauggagguugcggugagugg

SEQ ID NO: 259053 - RNA, 32 nt, Human
ugggcccaggaggcagcuggguugcauggaga

SEQ ID NO: 259054 - RNA, 32 nt, Human
ugggcccaggaggucaagccugcagcgagcug

SEQ ID NO: 259055 - RNA, 32 nt, Human
ugggcccaggaggucgaggcugcggugagcca

SEQ ID NO: 259056 - RNA, 32 nt, Human
ugggcccaggagguggagguugcagugagccg

SEQ ID NO: 259057 - RNA, 32 nt, Human
ugggcccaggaguucaaggccagccugggcaa

SEQ ID NO: 259058 - RNA, 32 nt, Human
ugggcccaggcagggcuggggugugcuggcau

SEQ ID NO: 259059 - RNA, 32 nt, Human
ugggcccaggcugagugugagugagcauguca

SEQ ID NO: 259060 - RNA, 32 nt, Human
ugggcccagggcaaaggccucuccccagagga

SEQ ID NO: 259061 - RNA, 32 nt, Human
ugggcccagggcggcggcgggagaagccgggg

SEQ ID NO: 259062 - RNA, 22 nt, Human
ugggcccagggcucuaccugua

SEQ ID NO: 259063 - RNA, 32 nt, Human
ugggcccaggguggcuggcaggagucccagcu

SEQ ID NO: 259064 - RNA, 32 nt, Human
ugggcccaguugggagcucauaucuaacacag

SEQ ID NO: 259065 - RNA, 21 nt, Human
ugggcccauaaacaacaggag

SEQ ID NO: 259066 - RNA, 32 nt, Human
ugggcccauugucccccgcccuggguggcuuc

SEQ ID NO: 259067 - RNA, 32 nt, Human
ugggccccacagagaguccuugugcucagugc

SEQ ID NO: 259068 - RNA, 32 nt, Human
ugggccccacagaguccuugugcucaguguag

SEQ ID NO: 259069 - RNA, 32 nt, Human
ugggccccacuccagaccaagagcagaccauu

SEQ ID NO: 259070 - RNA, 32 nt, Human
ugggccccagcaccuggacucaaggcaguagc

SEQ ID NO: 259071 - RNA, 32 nt, Human
ugggccccaggcagaggaaggccgggagaagg

SEQ ID NO: 259072 - RNA, 32 nt, Human
ugggccccagugagaggggcaggggcagggcc

SEQ ID NO: 259073 - RNA, 32 nt, Human
ugggccccaucagcagagccaccaagagucca

SEQ ID NO: 259074 - RNA, 32 nt, Human
ugggccccaucagcagagccaccaagaguccg

SEQ ID NO: 259075 - RNA, 32 nt, Human
ugggccccaucuuccggcggucgccggaguuu

SEQ ID NO: 259076 - RNA, 32 nt, Human
ugggcccccacuguccccaggccucagaugcu

SEQ ID NO: 259077 - RNA, 32 nt, Human
ugggcccccacuguccccaggccucagcaagg

SEQ ID NO: 259078 - RNA, 32 nt, Human
ugggcccccagccuggccagacaagacgacug

SEQ ID NO: 259079 - RNA, 32 nt, Human
ugggcccccagccuguagggaacuuucuggac

SEQ ID NO: 259080 - RNA, 32 nt, Human
ugggcccccaggagacugaggucuuccugggc

SEQ ID NO: 259081 - RNA, 25 nt, Human
ugggcccccaugccacagucuggcu

SEQ ID NO: 259082 - RNA, 32 nt, Human
ugggcccccggcggaggugggagagagucagg

SEQ ID NO: 259083 - RNA, 32 nt, Human
ugggccccggagguagagguugcagugagcug

SEQ ID NO: 259084 - RNA, 32 nt, Human
ugggccccuaccaggaucagcacuccacuggc

SEQ ID NO: 259085 - RNA, 23 nt, Human
ugggccccucagaaagucgagcu

SEQ ID NO: 259086 - RNA, 21 nt, Human
ugggccccuccaggcucaguu

SEQ ID NO: 259087 - RNA, 32 nt, Human
ugggccccucucucccugaaggggcuuugugg

SEQ ID NO: 259088 - RNA, 32 nt, Human
ugggccccucucugucccaccuugcacaaagg

SEQ ID NO: 259089 - RNA, 32 nt, Human
ugggccccugccaucgggcuccagaaacuacc

SEQ ID NO: 259090 - RNA, 20 nt, Human
ugggccccugcucucuaguu

SEQ ID NO: 259091 - RNA, 32 nt, Human
ugggccccugcucuucccaaagcugcccccaa

SEQ ID NO: 259092 - RNA, 32 nt, Human
ugggccccugcucuucccgagagcugccccca

SEQ ID NO: 259093 - RNA, 32 nt, Human
ugggccccuguaaucccagcuacucgggaggu

SEQ ID NO: 259094 - RNA, 32 nt, Human
ugggccccuguaaucccagcuacuugggaggc

SEQ ID NO: 259095 - RNA, 23 nt, Human
ugggccccuguccccagucccca

SEQ ID NO: 259096 - RNA, 19 nt, Human
ugggccccugucuuccagc

SEQ ID NO: 259097 - RNA, 32 nt, Human
ugggccccuuccccaccagaccuuuguagcuc

SEQ ID NO: 259098 - RNA, 32 nt, Human
ugggcccgcggaggaggacgugguggggaguc

SEQ ID NO: 259099 - RNA, 32 nt, Human
ugggcccggaggcugagacuaaggcuuucgac

SEQ ID NO: 259100 - RNA, 32 nt, Human
ugggcccgggaggcagagguugcagugagccg

SEQ ID NO: 259101 - RNA, 32 nt, Human
ugggcccgggaggucaagguugcagugagcug

SEQ ID NO: 259102 - RNA, 32 nt, Human
ugggcccgggagguggagguugcagugagcug

SEQ ID NO: 259103 - RNA, 32 nt, Human
ugggcccgggagguggagguugcagugaguca

SEQ ID NO: 259104 - RNA, 32 nt, Human
ugggcccgggaguuugaaguugcagugagcua

SEQ ID NO: 259105 - RNA, 24 nt, Human
ugggcccgguggcucaugccugua

SEQ ID NO: 259106 - RNA, 32 nt, Human
ugggcccgugagccacucggccucaggucgcu

SEQ ID NO: 259107 - RNA, 32 nt, Human
ugggcccgugcagagaaggcaccugcagagag

SEQ ID NO: 259108 - RNA, 20 nt, Human
ugggcccuaagguacucuga

SEQ ID NO: 259109 - RNA, 32 nt, Human
ugggcccuacagccucacuuccccagccucac

SEQ ID NO: 259110 - RNA, 32 nt, Human
ugggcccuacuacccugaacacugccucccca

SEQ ID NO: 259111 - RNA, 23 nt, Human
ugggcccuacucugcaccucuga

SEQ ID NO: 259112 - RNA, 32 nt, Human
ugggcccuacugcccuccucugcccaggaaau

SEQ ID NO: 259113 - RNA, 31 nt, Human
ugggcccucaguaaauaccuggaggaaugug

SEQ ID NO: 259114 - RNA, 32 nt, Human
ugggcccucaguguauguuuaagcucaggcug

SEQ ID NO: 259115 - RNA, 28 nt, Human
ugggcccucaucagucgacgucagagaa

SEQ ID NO: 259116 - RNA, 32 nt, Human
ugggcccucccugagggucuggggucaggcuu

SEQ ID NO: 259117 - RNA, 32 nt, Human
ugggcccuccuggagccugccugcuccccagg

SEQ ID NO: 259118 - RNA, 32 nt, Human
ugggcccucggugccugcugugaacugcuuuc

SEQ ID NO: 259119 - RNA, 32 nt, Human
ugggcccucucagcaggggaggguagagcgga

SEQ ID NO: 259120 - RNA, 24 nt, Human
ugggcccucuccagggggccaguu

SEQ ID NO: 259121 - RNA, 32 nt, Human
ugggcccucucccauccagugucucacagccc

SEQ ID NO: 259122 - RNA, 32 nt, Human
ugggcccugaaggagcugagagggagcucaac

SEQ ID NO: 259123 - RNA, 17 nt, Human
ugggcccugagggccuc

SEQ ID NO: 259124 - RNA, 32 nt, Human
ugggcccugcagcuuucuaacuugccgggagg

SEQ ID NO: 259125 - RNA, 32 nt, Human
ugggcccugcaggcugcaggagggcacuggag

SEQ ID NO: 259126 - RNA, 32 nt, Human
ugggcccugccucuccaugccuguaggagcug

SEQ ID NO: 259127 - RNA, 32 nt, Human
ugggcccugccuggagugugugccgccuucuc

SEQ ID NO: 259128 - RNA, 32 nt, Human
ugggcccugcugcucucucaggaccauccgau

SEQ ID NO: 259129 - RNA, 32 nt, Human
ugggcccugcugucacguggcuggugcggcuu

SEQ ID NO: 259130 - RNA, 32 nt, Human
ugggcccuggggacccaugggagggggcugcu

SEQ ID NO: 259131 - RNA, 32 nt, Human
ugggcccuggggagcaagaagguaggguugca

SEQ ID NO: 259132 - RNA, 32 nt, Human
ugggcccuggggaugagccacaggggacccac

SEQ ID NO: 259133 - RNA, 32 nt, Human
ugggcccugggucugggaaguacucugaugag

SEQ ID NO: 259134 - RNA, 32 nt, Human
ugggcccuggucccagucccugccuggggcca

SEQ ID NO: 259135 - RNA, 32 nt, Human
ugggcccugucgccccuccuuuuggccugggg

SEQ ID NO: 259136 - RNA, 32 nt, Human
ugggcccugugcaugcugguggccucagggac

SEQ ID NO: 259137 - RNA, 32 nt, Human
ugggcccuguggccuugggccuagagaaggga

SEQ ID NO: 259138 - RNA, 32 nt, Human
ugggcccuuagggucugcuuagcucuucccca

SEQ ID NO: 259139 - RNA, 32 nt, Human
ugggcccuucccugcuauccuuuuucuccuuu

SEQ ID NO: 259140 - RNA, 22 nt, Human
ugggcccuucuucacccugaug

SEQ ID NO: 259141 - RNA, 32 nt, Human
ugggcccuucuuuccuggacuuuguggaggag

SEQ ID NO: 259142 - RNA, 32 nt, Human
ugggcccuugccucuaaauagcacuuuuuggg

SEQ ID NO: 259143 - RNA, 23 nt, Human
ugggcccuuggccagaguccacu

SEQ ID NO: 259144 - RNA, 32 nt, Human
ugggcccuuggucuggacugaauugcccaagc

SEQ ID NO: 259145 - RNA, 32 nt, Human
ugggccgagcaguggcagcagagaguggccuc

SEQ ID NO: 259146 - RNA, 32 nt, Human
ugggccgcaacuuccgagccucccagggcgcc

SEQ ID NO: 259147 - RNA, 32 nt, Human
ugggccgcagccgccgccgcgaugcccaguaa

SEQ ID NO: 259148 - RNA, 32 nt, Human
ugggccgcagugagugggggcaccagugauuc

SEQ ID NO: 259149 - RNA, 32 nt, Human
ugggccgcuagcgguccuccaguucgggcccg

SEQ ID NO: 259150 - RNA, 32 nt, Human
ugggccgcugccuucgcuuucucuucguuguu

SEQ ID NO: 259151 - RNA, 32 nt, Human
ugggccgcugggacgcgguggguguggagcag

SEQ ID NO: 259152 - RNA, 32 nt, Human
ugggccggaacuggagugaggggcacagagug

SEQ ID NO: 259153 - RNA, 20 nt, Human
ugggccggaugaguugugcu

SEQ ID NO: 259154 - RNA, 16 nt, Human
ugggccggcccucaca

SEQ ID NO: 259155 - RNA, 32 nt, Human
ugggccggcuccuuauuuuccugggcugagcc

SEQ ID NO: 259156 - RNA, 32 nt, Human
ugggccgggcgggccccugggagcagccccca

SEQ ID NO: 259157 - RNA, 32 nt, Human
ugggccgggcugggaugucaucuccugccggg

SEQ ID NO: 259158 - RNA, 32 nt, Human
ugggccgguaucuccggcagcuggcacgccau

SEQ ID NO: 259159 - RNA, 32 nt, Human
ugggccggucggggagggggaggcgggauggg

SEQ ID NO: 259160 - RNA, 32 nt, Human
ugggccggugaauuccguguaguggccaagcu

SEQ ID NO: 259161 - RNA, 32 nt, Human
ugggccgugcacucagcccugcccugugcagu

SEQ ID NO: 259162 - RNA, 32 nt, Human
ugggccgugccugcccuccaccuugagugcca

SEQ ID NO: 259163 - RNA, 32 nt, Human
ugggccguggaggugggggcgguggugcugga

SEQ ID NO: 259164 - RNA, 32 nt, Human
ugggccguuggagucugacugcaucuccuguu

SEQ ID NO: 259165 - RNA, 32 nt, Human
ugggccuaagccucgggugggagcucagggcc

SEQ ID NO: 259166 - RNA, 32 nt, Human
ugggccuagaaagccaagugcaaagaugaggg

SEQ ID NO: 259167 - RNA, 22 nt, Human
ugggccuagugggccucuggug

SEQ ID NO: 259168 - RNA, 32 nt, Human
ugggccuaucaggaggacacaggcugcagccu

SEQ ID NO: 259169 - RNA, 32 nt, Human
ugggccuaugaugacccacagaugacucagua

SEQ ID NO: 259170 - RNA, 22 nt, Human
ugggccucaaaauaccauagua

SEQ ID NO: 259171 - RNA, 32 nt, Human
ugggccucaaagccgggcaccagacgggaggg

SEQ ID NO: 259172 - RNA, 21 nt, Human
ugggccucaacgggaaccuga

SEQ ID NO: 259173 - RNA, 20 nt, Human
ugggccucaauguucucauu

SEQ ID NO: 259174 - RNA, 24 nt, Human
ugggccucagucuucccaucugua

SEQ ID NO: 259175 - RNA, 24 nt, Human
ugggccucagugugcccaucugua

SEQ ID NO: 259176 - RNA, 32 nt, Human
ugggccucaguuaugggcagaugagugagucu

SEQ ID NO: 259177 - RNA, 24 nt, Human
ugggccucaguuuccccaucugua

SEQ ID NO: 259178 - RNA, 21 nt, Human
ugggccucaucguucuuguca

SEQ ID NO: 259179 - RNA, 32 nt, Human
ugggccucaugaagaaucacacugcuugugaa

SEQ ID NO: 259180 - RNA, 32 nt, Human
ugggccuccagguggaggcgggcugaugcugg

SEQ ID NO: 259181 - RNA, 22 nt, Human
ugggccuccaugaugucaggaa

SEQ ID NO: 259182 - RNA, 32 nt, Human
ugggccucccaaaaugcugggauuacaggcau

SEQ ID NO: 259183 - RNA, 32 nt, Human
ugggccucccaaaguacugggauuacaggcau

SEQ ID NO: 259184 - RNA, 32 nt, Human
ugggccucccaaagugcuaggauuacagacau

SEQ ID NO: 259185 - RNA, 32 nt, Human
ugggccucccaaagugcuaggauuacaggcau

SEQ ID NO: 259186 - RNA, 32 nt, Human
ugggccucccaaagugcugggauuacaggagu

SEQ ID NO: 259187 - RNA, 32 nt, Human
ugggccucccaaagugcugggauuacaggcau

SEQ ID NO: 259188 - RNA, 32 nt, Human
ugggccucccaaagugcugggauuacaggcgu

SEQ ID NO: 259189 - RNA, 32 nt, Human
ugggccucccaaagugcugggauuacaggugu

SEQ ID NO: 259190 - RNA, 32 nt, Human
ugggccucccaaaguguugggauuacaggcgu

SEQ ID NO: 259191 - RNA, 32 nt, Human
ugggccucccacagugcugggauuacaggcgu

SEQ ID NO: 259192 - RNA, 24 nt, Human
ugggccuccgccggcuacgccgcu

SEQ ID NO: 259193 - RNA, 20 nt, Human
ugggccuccgccuaccagcu

SEQ ID NO: 259194 - RNA, 32 nt, Human
ugggccuccucaccaacggcagugccaaaauc

SEQ ID NO: 259195 - RNA, 32 nt, Human
ugggccuccuggaaggagguggccaccccgcg

SEQ ID NO: 259196 - RNA, 32 nt, Human
ugggccuccugggagguguccuccagccucuc

SEQ ID NO: 259197 - RNA, 32 nt, Human
ugggccucgucuccccuucaagcccccggccu

SEQ ID NO: 259198 - RNA, 32 nt, Human
ugggccucucagagggcucuucugccaucccu

SEQ ID NO: 259199 - RNA, 32 nt, Human
ugggccucuccugcccaccucuacuucucugu

SEQ ID NO: 259200 - RNA, 24 nt, Human
ugggccucugacucugaguccacu

SEQ ID NO: 259201 - RNA, 32 nt, Human
ugggccucugcucacaccugggaaggggcucu

SEQ ID NO: 259202 - RNA, 32 nt, Human
ugggccucugcucucuugccuggcuuccuucu

SEQ ID NO: 259203 - RNA, 32 nt, Human
ugggccugagguccucccucugaaaugcagag

SEQ ID NO: 259204 - RNA, 32 nt, Human
ugggccugagucuuggcacgaguguccuggcc

SEQ ID NO: 259205 - RNA, 32 nt, Human
ugggccugagugagaggggaggccaagagugg

SEQ ID NO: 259206 - RNA, 32 nt, Human
ugggccugcacacuccagcccaaagggucugu

SEQ ID NO: 259207 - RNA, 32 nt, Human
ugggccugcagcagacucaaggcuccgagugc

SEQ ID NO: 259208 - RNA, 32 nt, Human
ugggccugcagcucccuucuccugggacuuag

SEQ ID NO: 259209 - RNA, 32 nt, Human
ugggccugcagucccagcuaccugggaggcug

SEQ ID NO: 259210 - RNA, 32 nt, Human
ugggccugccuccugggcugguuccugggucc

SEQ ID NO: 259211 - RNA, 32 nt, Human
ugggccugcuccagaccugauccuggaggccc

SEQ ID NO: 259212 - RNA, 32 nt, Human
ugggccugcuccccgcuuccuccccuucaguc

SEQ ID NO: 259213 - RNA, 32 nt, Human
ugggccugcugccucuucccacucuacaccuu

SEQ ID NO: 259214 - RNA, 32 nt, Human
ugggccugcuggagcugcugcagccgcacgug

SEQ ID NO: 259215 - RNA, 32 nt, Human
ugggccugcugggaggaggagggggaagagga

SEQ ID NO: 259216 - RNA, 32 nt, Human
ugggccuggaaccgggccgcagucccacagcu

SEQ ID NO: 259217 - RNA, 32 nt, Human
ugggccuggaagaccaucccagccucugaguu

SEQ ID NO: 259218 - RNA, 32 nt, Human
ugggccuggcaggacuccagaugaggacaaga

SEQ ID NO: 259219 - RNA, 32 nt, Human
ugggccuggccgugcugccucuccugaguagg

SEQ ID NO: 259220 - RNA, 29 nt, Human
ugggccuggcugcacagcauccuccucug

SEQ ID NO: 259221 - RNA, 32 nt, Human
ugggccuggcuuuccagacuccuggcucuggc

SEQ ID NO: 259222 - RNA, 32 nt, Human
ugggccugggacuucugccucugccgccucca

SEQ ID NO: 259223 - RNA, 32 nt, Human
ugggccugggagacacacagaggccaggccuu

SEQ ID NO: 259224 - RNA, 32 nt, Human
ugggccugggaggcauagguugcagugagccg

SEQ ID NO: 259225 - RNA, 32 nt, Human
ugggccugggaggcggagguugcagugagccg

SEQ ID NO: 259226 - RNA, 32 nt, Human
ugggccugggaggucgaggcugcagugagcug

SEQ ID NO: 259227 - RNA, 32 nt, Human
ugggccugggcaaugggaaggagccagaaaug

SEQ ID NO: 259228 - RNA, 32 nt, Human
ugggccugggccggcccugcucugggcccgug

SEQ ID NO: 259229 - RNA, 32 nt, Human
ugggccugggcugggcuggggcuaggagggca

SEQ ID NO: 259230 - RNA, 32 nt, Human
ugggccugggcugggugggccugggcagcugg

SEQ ID NO: 259231 - RNA, 32 nt, Human
ugggccugggcugugggucuggcagacagacc

SEQ ID NO: 259232 - RNA, 32 nt, Human
ugggccugggggcugggcuggaccagggcgug

SEQ ID NO: 259233 - RNA, 32 nt, Human
ugggccuguccgcuggcgucauggcaccgaaa

SEQ ID NO: 259234 - RNA, 32 nt, Human
ugggccuguggacugcagccucggcgaucaga

SEQ ID NO: 259235 - RNA, 32 nt, Human
ugggccuuagcaccugcagugccucaaagccc

SEQ ID NO: 259236 - RNA, 32 nt, Human
ugggccuuagcuccucccugggcuugguagag

SEQ ID NO: 259237 - RNA, 32 nt, Human
ugggccuucagaauuaauggccagcaguguca

SEQ ID NO: 259238 - RNA, 32 nt, Human
ugggccuucaguggaugggcagugccacucag

SEQ ID NO: 259239 - RNA, 32 nt, Human
ugggccuucauguaaggaggcuggguggugag

SEQ ID NO: 259240 - RNA, 32 nt, Human
ugggccuuccccuguuacucagccucugacac

SEQ ID NO: 259241 - RNA, 21 nt, Human
ugggccuuccgaggccucuga

SEQ ID NO: 259242 - RNA, 32 nt, Human
ugggccuuccugguccccuccuuggcugcggu

SEQ ID NO: 259243 - RNA, 32 nt, Human
ugggccuucgaccucggaccuccgucuuccag

SEQ ID NO: 259244 - RNA, 18 nt, Human
ugggccuucucucuccca

SEQ ID NO: 259245 - RNA, 23 nt, Human
ugggccuucuuagaggguucagu

SEQ ID NO: 259246 - RNA, 32 nt, Human
ugggccuucuuagaggguucagucuaggaccc

SEQ ID NO: 259247 - RNA, 32 nt, Human
ugggccuugcccucccccucccagcccagggu

SEQ ID NO: 259248 - RNA, 32 nt, Human
ugggccuugcugcugcugcacccaacuacuga

SEQ ID NO: 259249 - RNA, 32 nt, Human
ugggccuugugaggcuguagugugucagcaca

SEQ ID NO: 259250 - RNA, 32 nt, Human
ugggccuuuccagagaacugcagaccucacug

SEQ ID NO: 259251 - RNA, 32 nt, Human
ugggccuuucccucucuuaucccugagggugg

SEQ ID NO: 259252 - RNA, 32 nt, Human
ugggccuuucuuucuuuucuucuccucuggga

SEQ ID NO: 259253 - RNA, 32 nt, Human
ugggcgaacagcccccuccucaccgcccgccg

SEQ ID NO: 259254 - RNA, 32 nt, Human
ugggcgaaggaggacauccucacuggacgagc

SEQ ID NO: 259255 - RNA, 32 nt, Human
ugggcgacagagcaagagacccugacuaaaac

SEQ ID NO: 259256 - RNA, 32 nt, Human
ugggcgacagagugagacuccaucucuaaaaa

SEQ ID NO: 259257 - RNA, 32 nt, Human
ugggcgacaggcugcucagugucgauggaauc

SEQ ID NO: 259258 - RNA, 32 nt, Human
ugggcgacgacgagacggacagugauguccag

SEQ ID NO: 259259 - RNA, 32 nt, Human
ugggcgacgaugagacggacagugauguccag

SEQ ID NO: 259260 - RNA, 32 nt, Human
ugggcgaggaggcguuuccacccccuggugcc

SEQ ID NO: 259261 - RNA, 32 nt, Human
ugggcgaucugcaggucuggaugaaggagccc

SEQ ID NO: 259262 - RNA, 32 nt, Human
ugggcgcaccugcugcucagggcaggguugcu

SEQ ID NO: 259263 - RNA, 32 nt, Human
ugggcgcagcaggcacgggccuggugggacua

SEQ ID NO: 259264 - RNA, 24 nt, Human
ugggcgcaguggcucacaccugua

SEQ ID NO: 259265 - RNA, 22 nt, Human
ugggcgcaguggcucaccugua

SEQ ID NO: 259266 - RNA, 24 nt, Human
ugggcgcaguggcucacgccugua

SEQ ID NO: 259267 - RNA, 24 nt, Human
ugggcgcaguggcucacgcuugua

SEQ ID NO: 259268 - RNA, 24 nt, Human
ugggcgcaguggcucaugccugua

SEQ ID NO: 259269 - RNA, 24 nt, Human
ugggcgcaguggcuuacaccugua

SEQ ID NO: 259270 - RNA, 24 nt, Human
ugggcgcaguggcuuacgccugua

SEQ ID NO: 259271 - RNA, 32 nt, Human
ugggcgccagggacacagcagugaauagaaca

SEQ ID NO: 259272 - RNA, 32 nt, Human
ugggcgccaguucuccacaaccacagggcaga

SEQ ID NO: 259273 - RNA, 32 nt, Human
ugggcgcccccggcggcgugugaauggcggcc

SEQ ID NO: 259274 - RNA, 32 nt, Human
ugggcgcccugagaccacucgcugcucucacc

SEQ ID NO: 259275 - RNA, 24 nt, Human
ugggcgccguggcucacaccugua

SEQ ID NO: 259276 - RNA, 21 nt, Human
ugggcgccucuuuccuuucuc

SEQ ID NO: 259277 - RNA, 18 nt, Human
ugggcgccuguaauccca

SEQ ID NO: 259278 - RNA, 32 nt, Human
ugggcgccuguaaucccagcuacucaggagaa

SEQ ID NO: 259279 - RNA, 32 nt, Human
ugggcgccuguaaucccagcuacucaggagac

SEQ ID NO: 259280 - RNA, 32 nt, Human
ugggcgccuguaaucccagcuacucaggaggc

SEQ ID NO: 259281 - RNA, 32 nt, Human
ugggcgccuguaaucccagcuacucgggaggc

SEQ ID NO: 259282 - RNA, 32 nt, Human
ugggcgccuguaaucccagcuacucgggaggu

SEQ ID NO: 259283 - RNA, 32 nt, Human
ugggcgccuguaaucccagcuacuggggaggc

SEQ ID NO: 259284 - RNA, 32 nt, Human
ugggcgccuguaaucccagcuacuugggaggc

SEQ ID NO: 259285 - RNA, 32 nt, Human
ugggcgccuguaaucccagcugcucaggagac

SEQ ID NO: 259286 - RNA, 32 nt, Human
ugggcgccuguaaucccagcugcucaggaggc

SEQ ID NO: 259287 - RNA, 32 nt, Human
ugggcgccuguaaucccaguuacucgggaggc

SEQ ID NO: 259288 - RNA, 32 nt, Human
ugggcgccuguaaucucagcuacuugggaggc

SEQ ID NO: 259289 - RNA, 32 nt, Human
ugggcgcgaccacuaacccgguuaaugaccuc

SEQ ID NO: 259290 - RNA, 32 nt, Human
ugggcgcgauggcggaggcuguacugaggguc

SEQ ID NO: 259291 - RNA, 32 nt, Human
ugggcgcgcgggagcugggaggcugcgagauc

SEQ ID NO: 259292 - RNA, 32 nt, Human
ugggcgcggccauguuggaggcuccgggcccg

SEQ ID NO: 259293 - RNA, 22 nt, Human
ugggcgcgggaaucccggcgga

SEQ ID NO: 259294 - RNA, 24 nt, Human
ugggcgcggugacucaugccugua

SEQ ID NO: 259295 - RNA, 24 nt, Human
ugggcgcgguggcgcaugccugua

SEQ ID NO: 259296 - RNA, 24 nt, Human
ugggcgcgguggcucacaccugua

SEQ ID NO: 259297 - RNA, 23 nt, Human
ugggcgcgguggcucacgccugu

SEQ ID NO: 259298 - RNA, 24 nt, Human
ugggcgcgguggcucacgccugua

SEQ ID NO: 259299 - RNA, 24 nt, Human
ugggcgcgguggcucacgcuugua

SEQ ID NO: 259300 - RNA, 24 nt, Human
ugggcgcgguggcucaugccugua

SEQ ID NO: 259301 - RNA, 24 nt, Human
ugggcgcgguggcucaugcuugua

SEQ ID NO: 259302 - RNA, 24 nt, Human
ugggcgcgguggcucgggccugua

SEQ ID NO: 259303 - RNA, 24 nt, Human
ugggcgcgguggcucuugccugua

SEQ ID NO: 259304 - RNA, 24 nt, Human
ugggcgcgguggcuuacgccugua

SEQ ID NO: 259305 - RNA, 24 nt, Human
ugggcgcgguggugcaugccugua

SEQ ID NO: 259306 - RNA, 24 nt, Human
ugggcgcggugguucacgccugua

SEQ ID NO: 259307 - RNA, 19 nt, Human
ugggcgcucagugacaagg

SEQ ID NO: 259308 - RNA, 32 nt, Human
ugggcgcuccucuccccuacagcagcccccuu

SEQ ID NO: 259309 - RNA, 32 nt, Human
ugggcgcugcagcugcucccggcgcguccccg

SEQ ID NO: 259310 - RNA, 32 nt, Human
ugggcgcugcgcggacucgcccccaggaaacg

SEQ ID NO: 259311 - RNA, 32 nt, Human
ugggcgcugcuugcuaaagagccgagcacgcg

SEQ ID NO: 259312 - RNA, 32 nt, Human
ugggcgcugucccuucucuuucccaggagccc

SEQ ID NO: 259313 - RNA, 32 nt, Human
ugggcggaaggggacuucgggagccaguagcc

SEQ ID NO: 259314 - RNA, 32 nt, Human
ugggcggacgcgugggcucugggagugugaaa

SEQ ID NO: 259315 - RNA, 32 nt, Human
ugggcggacuugagaguguccuccgcuucuga

SEQ ID NO: 259316 - RNA, 32 nt, Human
ugggcggagccccagccgcuagugcugguggc

SEQ ID NO: 259317 - RNA, 32 nt, Human
ugggcggaggcggaagcggaaguggcgagaaa

SEQ ID NO: 259318 - RNA, 32 nt, Human
ugggcggaggcugaggaccccagggugggagg

SEQ ID NO: 259319 - RNA, 32 nt, Human
ugggcggagggaggaaggaugggugcggguaa

SEQ ID NO: 259320 - RNA, 32 nt, Human
ugggcggaggugggcaggaugugagagguggg

SEQ ID NO: 259321 - RNA, 32 nt, Human
ugggcggauauuuucauaugaucccucccuca

SEQ ID NO: 259322 - RNA, 23 nt, Human
ugggcggauugcuugaggucagg

SEQ ID NO: 259323 - RNA, 32 nt, Human
ugggcggcaccacugggaacucuggacuugag

SEQ ID NO: 259324 - RNA, 32 nt, Human
ugggcggccagccagcccuggggcccauugcc

SEQ ID NO: 259325 - RNA, 32 nt, Human
ugggcggcucauggugccacagccccuggcag

SEQ ID NO: 259326 - RNA, 32 nt, Human
ugggcggcugaaagcuggaggggccaagacug

SEQ ID NO: 259327 - RNA, 32 nt, Human
ugggcggcuucccggcugaccacaguggcuug

SEQ ID NO: 259328 - RNA, 32 nt, Human
ugggcggcuuugaccgagaggcugcuggagcu

SEQ ID NO: 259329 - RNA, 32 nt, Human
ugggcgggaugagacaaaaggagggaugaaac

SEQ ID NO: 259330 - RNA, 32 nt, Human
ugggcgggcuaccucugagaacggcugaaaug

SEQ ID NO: 259331 - RNA, 32 nt, Human
ugggcggggagaagauagggaacacucauccc

SEQ ID NO: 259332 - RNA, 20 nt, Human
ugggcggggagcucggcaaa

SEQ ID NO: 259333 - RNA, 32 nt, Human
ugggcggggccugcccuacagugagcagccca

SEQ ID NO: 259334 - RNA, 32 nt, Human
ugggcgggggaugacucacagcccaucccauc

SEQ ID NO: 259335 - RNA, 32 nt, Human
ugggcggguagcagugcugggccugugucuug

SEQ ID NO: 259336 - RNA, 32 nt, Human
ugggcgggugugagccauugcgcccagccuug

SEQ ID NO: 259337 - RNA, 32 nt, Human
ugggcgguagaggggagguugggguuggagca

SEQ ID NO: 259338 - RNA, 24 nt, Human
ugggcguaguggcucacaccugua

SEQ ID NO: 259339 - RNA, 21 nt, Human
ugggcguaguggcucaugccu

SEQ ID NO: 259340 - RNA, 24 nt, Human
ugggcguaguggcucuugccugua

SEQ ID NO: 259341 - RNA, 32 nt, Human
ugggcguccaggacuucggcacugccuaugcc

SEQ ID NO: 259342 - RNA, 32 nt, Human
ugggcguccgggcagcugcagcugagaggacu

SEQ ID NO: 259343 - RNA, 32 nt, Human
ugggcgucugcucugggacaccccaaagagcu

SEQ ID NO: 259344 - RNA, 32 nt, Human
ugggcgugagccaccgugacuggccuguuuuu

SEQ ID NO: 259345 - RNA, 32 nt, Human
ugggcgugaggccuccugggccugucgggccu

SEQ ID NO: 259346 - RNA, 24 nt, Human
ugggcgugaugacacgugccugua

SEQ ID NO: 259347 - RNA, 24 nt, Human
ugggcgugauggcacgugccugua

SEQ ID NO: 259348 - RNA, 32 nt, Human
ugggcgugcuagagguugcagcaugagacuuu

SEQ ID NO: 259349 - RNA, 32 nt, Human
ugggcguggcagccucacagggaacacgggac

SEQ ID NO: 259350 - RNA, 24 nt, Human
ugggcguggcggcucaugccugua

SEQ ID NO: 259351 - RNA, 24 nt, Human
ugggcgugggggcucaugccugua

SEQ ID NO: 259352 - RNA, 24 nt, Human
ugggcgugguagcuugugccugug

SEQ ID NO: 259353 - RNA, 24 nt, Human
ugggcgugguggcacacacccgua

SEQ ID NO: 259354 - RNA, 24 nt, Human
ugggcgugguggcacacaccugua

SEQ ID NO: 259355 - RNA, 24 nt, Human
ugggcgugguggcacacgccugua

SEQ ID NO: 259356 - RNA, 24 nt, Human
ugggcgugguggcacauaccugua

SEQ ID NO: 259357 - RNA, 21 nt, Human
ugggcgugguggcacaugccu

SEQ ID NO: 259358 - RNA, 24 nt, Human
ugggcgugguggcacaugccugua

SEQ ID NO: 259359 - RNA, 24 nt, Human
ugggcgugguggcacgcgccugua

SEQ ID NO: 259360 - RNA, 24 nt, Human
ugggcgugguggcacgugccugua

SEQ ID NO: 259361 - RNA, 22 nt, Human
ugggcgugguggcacguuccug

SEQ ID NO: 259362 - RNA, 24 nt, Human
ugggcgugguggcagaugccugua

SEQ ID NO: 259363 - RNA, 24 nt, Human
ugggcgugguggcaggcgccugug

SEQ ID NO: 259364 - RNA, 24 nt, Human
ugggcgugguggcaugcaccugua

SEQ ID NO: 259365 - RNA, 24 nt, Human
ugggcgugguggcaugcgccugua

SEQ ID NO: 259366 - RNA, 24 nt, Human
ugggcgugguggcaugugccugua

SEQ ID NO: 259367 - RNA, 24 nt, Human
ugggcgugguggcauguggcugua

SEQ ID NO: 259368 - RNA, 24 nt, Human
ugggcgugguggcgagcgccugua

SEQ ID NO: 259369 - RNA, 21 nt, Human
ugggcgugguggcgcaugccu

SEQ ID NO: 259370 - RNA, 24 nt, Human
ugggcgugguggcgcaugccugua

SEQ ID NO: 259371 - RNA, 32 nt, Human
ugggcgugguggcgcauugccuguaaucccag

SEQ ID NO: 259372 - RNA, 24 nt, Human
ugggcgugguggcgcgcgccugua

SEQ ID NO: 259373 - RNA, 24 nt, Human
ugggcgugguggcgggcaccugua

SEQ ID NO: 259374 - RNA, 24 nt, Human
ugggcgugguggcgggcgccugua

SEQ ID NO: 259375 - RNA, 24 nt, Human
ugggcgugguggcgggcgccugug

SEQ ID NO: 259376 - RNA, 24 nt, Human
ugggcgugguggcgugcgccugua

SEQ ID NO: 259377 - RNA, 21 nt, Human
ugggcgugguggcucacaccu

SEQ ID NO: 259378 - RNA, 23 nt, Human
ugggcgugguggcucacaccugu

SEQ ID NO: 259379 - RNA, 24 nt, Human
ugggcgugguggcucacaccugua

SEQ ID NO: 259380 - RNA, 24 nt, Human
ugggcgugguggcucacaccugug

SEQ ID NO: 259381 - RNA, 24 nt, Human
ugggcgugguggcucacaucugua

SEQ ID NO: 259382 - RNA, 24 nt, Human
ugggcgugguggcucacgccugua

SEQ ID NO: 259383 - RNA, 24 nt, Human
ugggcgugguggcucacgccugug

SEQ ID NO: 259384 - RNA, 24 nt, Human
ugggcgugguggcucacgcuugua

SEQ ID NO: 259385 - RNA, 24 nt, Human
ugggcgugguggcucacuccugua

SEQ ID NO: 259386 - RNA, 24 nt, Human
ugggcgugguggcucaugccugua

SEQ ID NO: 259387 - RNA, 24 nt, Human
ugggcgugguggcucaugccugug

SEQ ID NO: 259388 - RNA, 24 nt, Human
ugggcgugguggcucaugcuugua

SEQ ID NO: 259389 - RNA, 24 nt, Human
ugggcgugguggcucucgccugua

SEQ ID NO: 259390 - RNA, 24 nt, Human
ugggcgugguggcuggcgccugua

SEQ ID NO: 259391 - RNA, 24 nt, Human
ugggcguggugguacacaccugug

SEQ ID NO: 259392 - RNA, 24 nt, Human
ugggcguggugguacaugccugua

SEQ ID NO: 259393 - RNA, 24 nt, Human
ugggcgugguggugcacgccugua

SEQ ID NO: 259394 - RNA, 24 nt, Human
ugggcgugguggugcaugccugua

SEQ ID NO: 259395 - RNA, 24 nt, Human
ugggcgugguggugcgcaccugua

SEQ ID NO: 259396 - RNA, 24 nt, Human
ugggcgugguggugggcaccugua

SEQ ID NO: 259397 - RNA, 24 nt, Human
ugggcguggugguguaccccugua

SEQ ID NO: 259398 - RNA, 24 nt, Human
ugggcguggugguucacaccugua

SEQ ID NO: 259399 - RNA, 32 nt, Human
ugggcgugugggguauucuccacccacuuaua

SEQ ID NO: 259400 - RNA, 32 nt, Human
ugggcguugccuggguucuugggagagagggg

SEQ ID NO: 259401 - RNA, 24 nt, Human
ugggcguuguggcucaugccugua

SEQ ID NO: 259402 - RNA, 32 nt, Human
ugggcguuuguggauucugaaagagaaagccg

SEQ ID NO: 259403 - RNA, 32 nt, Human
ugggcuaaaacagagccuucaaaacuucggcu

SEQ ID NO: 259404 - RNA, 32 nt, Human
ugggcuaaaugcugcuaucauaggcauccaua

SEQ ID NO: 259405 - RNA, 32 nt, Human
ugggcuaaauggguacuagaacaacaacugcc

SEQ ID NO: 259406 - RNA, 32 nt, Human
ugggcuaauugccaccaauuucagccugccac

SEQ ID NO: 259407 - RNA, 32 nt, Human
ugggcuacaugacgaaacuccaucucuaucaa

SEQ ID NO: 259408 - RNA, 32 nt, Human
ugggcuacaugcuggggucaaggcaguagaac

SEQ ID NO: 259409 - RNA, 32 nt, Human
ugggcuagaauguacacgucuccuugccugaa

SEQ ID NO: 259410 - RNA, 32 nt, Human
ugggcuaggcugcagccugccuccuggggacu

SEQ ID NO: 259411 - RNA, 32 nt, Human
ugggcuauacaguccagcaggcaguaugcacc

SEQ ID NO: 259412 - RNA, 32 nt, Human
ugggcuauaugaggagagaggagcagcaggca

SEQ ID NO: 259413 - RNA, 32 nt, Human
ugggcuaugcuggguaccaccauguacucagg

SEQ ID NO: 259414 - RNA, 32 nt, Human
ugggcucaaagugauccucccaugucagccuc

SEQ ID NO: 259415 - RNA, 32 nt, Human
ugggcucaaaugauccucccaccucagccucc

SEQ ID NO: 259416 - RNA, 32 nt, Human
ugggcucaagaguucaagaccagucugggcaa

SEQ ID NO: 259417 - RNA, 32 nt, Human
ugggcucaagcaauccucccaccucagcccga

SEQ ID NO: 259418 - RNA, 32 nt, Human
ugggcucaagcaauccucccaccucagccuau

SEQ ID NO: 259419 - RNA, 32 nt, Human
ugggcucaagcaauccucccaccucagccucc

SEQ ID NO: 259420 - RNA, 32 nt, Human
ugggcucaagcaauccucccaccucccagugu

SEQ ID NO: 259421 - RNA, 32 nt, Human
ugggcucaagcaauucucccaccucagccucc

SEQ ID NO: 259422 - RNA, 32 nt, Human
ugggcucaagcaauucucccaccucagccucu

SEQ ID NO: 259423 - RNA, 32 nt, Human
ugggcucaagcaauucuuccaccucagccucc

SEQ ID NO: 259424 - RNA, 32 nt, Human
ugggcucaagcaguccucccaccccagccucu

SEQ ID NO: 259425 - RNA, 32 nt, Human
ugggcucaagcaguccucccaccucagccucc

SEQ ID NO: 259426 - RNA, 32 nt, Human
ugggcucaagcaguccucccaccucagucucc

SEQ ID NO: 259427 - RNA, 32 nt, Human
ugggcucaagcgauccucccaccucagccucc

SEQ ID NO: 259428 - RNA, 32 nt, Human
ugggcucaagcgauccucccaccucagcuucu

SEQ ID NO: 259429 - RNA, 22 nt, Human
ugggcucaaggcucccagcaga

SEQ ID NO: 259430 - RNA, 32 nt, Human
ugggcucaagugauccucccaccucagccucc

SEQ ID NO: 259431 - RNA, 32 nt, Human
ugggcucaagugauccucccaccucagcuucc

SEQ ID NO: 259432 - RNA, 32 nt, Human
ugggcucaagugauccuccugucucggccucc

SEQ ID NO: 259433 - RNA, 32 nt, Human
ugggcucacaccauucuccugccucagccucc

SEQ ID NO: 259434 - RNA, 32 nt, Human
ugggcucacugcaaccuccgccucccugguuc

SEQ ID NO: 259435 - RNA, 32 nt, Human
ugggcucacugcaaccuccuccuccuggauuc

SEQ ID NO: 259436 - RNA, 32 nt, Human
ugggcucacugcaaccucugccucccggguuc

SEQ ID NO: 259437 - RNA, 32 nt, Human
ugggcucacugcaaccucugccuuccagguuc

SEQ ID NO: 259438 - RNA, 32 nt, Human
ugggcucacugcaaccuucaccuccagguuca

SEQ ID NO: 259439 - RNA, 32 nt, Human
ugggcucacugcagccuagaccugcugggcuc

SEQ ID NO: 259440 - RNA, 32 nt, Human
ugggcucacugcagccucaaccucccagguuc

SEQ ID NO: 259441 - RNA, 32 nt, Human
ugggcucagaauuugucacuaaggcugcuaac

SEQ ID NO: 259442 - RNA, 32 nt, Human
ugggcucagccacucccuccagucucaaguaa

SEQ ID NO: 259443 - RNA, 32 nt, Human
ugggcucaggcgauucuccugucucagccucc

SEQ ID NO: 259444 - RNA, 24 nt, Human
ugggcucaguggcucaccccugua

SEQ ID NO: 259445 - RNA, 32 nt, Human
ugggcucauccagaaucucaucaggacuggau

SEQ ID NO: 259446 - RNA, 32 nt, Human
ugggcucaugugauccucccaccucagccucc

SEQ ID NO: 259447 - RNA, 32 nt, Human
ugggcucauugcaaccuccgccucccggcuuc

SEQ ID NO: 259448 - RNA, 32 nt, Human
ugggcucauugcaaccucugccucccggguuc

SEQ ID NO: 259449 - RNA, 32 nt, Human
ugggcuccagccugggcgacagagugagaguc

SEQ ID NO: 259450 - RNA, 32 nt, Human
ugggcuccaggcaacagagcccuacuggcagg

SEQ ID NO: 259451 - RNA, 22 nt, Human
ugggcuccaggggccucuggug

SEQ ID NO: 259452 - RNA, 32 nt, Human
ugggcuccaugcggagccuggccugcaucccc

SEQ ID NO: 259453 - RNA, 32 nt, Human
ugggcucccaaaacaccugacagccccucccu

SEQ ID NO: 259454 - RNA, 32 nt, Human
ugggcucccacuuucuucccagaagagggcua

SEQ ID NO: 259455 - RNA, 32 nt, Human
ugggcucccagagagacccugaguuucaaaua

SEQ ID NO: 259456 - RNA, 22 nt, Human
ugggcucccagggauacuguuu

SEQ ID NO: 259457 - RNA, 32 nt, Human
ugggcuccccaggccugcccccggcugguccc

SEQ ID NO: 259458 - RNA, 32 nt, Human
ugggcuccccuucucucuaccuucucccccaa

SEQ ID NO: 259459 - RNA, 21 nt, Human
ugggcucccguccacuccacu

SEQ ID NO: 259460 - RNA, 32 nt, Human
ugggcucccucaggcucugguaugacauauuu

SEQ ID NO: 259461 - RNA, 32 nt, Human
ugggcucccugccccucucugccuguucugga

SEQ ID NO: 259462 - RNA, 32 nt, Human
ugggcucccugccuguggcucagccccagcuc

SEQ ID NO: 259463 - RNA, 32 nt, Human
ugggcucccuggcagcuguuggcaucucgugg

SEQ ID NO: 259464 - RNA, 23 nt, Human
ugggcuccgagguccgugcuccu

SEQ ID NO: 259465 - RNA, 32 nt, Human
ugggcuccguagcugcucagcaaaugucagca

SEQ ID NO: 259466 - RNA, 32 nt, Human
ugggcuccuaggagguaguuuucuugaagggg

SEQ ID NO: 259467 - RNA, 32 nt, Human
ugggcuccucaagggacuuccuggagaguagc

SEQ ID NO: 259468 - RNA, 32 nt, Human
ugggcuccugguggcugcucaguguucccagg

SEQ ID NO: 259469 - RNA, 21 nt, Human
ugggcuccuguagucccagcu

SEQ ID NO: 259470 - RNA, 32 nt, Human
ugggcuccugucacccuccacgucuccacaga

SEQ ID NO: 259471 - RNA, 32 nt, Human
ugggcucgggaugcugcucuuccuuccuucac

SEQ ID NO: 259472 - RNA, 32 nt, Human
ugggcucgggugauccucccaccucggccucc

SEQ ID NO: 259473 - RNA, 32 nt, Human
ugggcucuaauccaguugucuaucccuuucac

SEQ ID NO: 259474 - RNA, 32 nt, Human
ugggcucuacagugcuuacugcagccuugugu

SEQ ID NO: 259475 - RNA, 32 nt, Human
ugggcucuaggggaaccuggggucggaugagc

SEQ ID NO: 259476 - RNA, 32 nt, Human
ugggcucucagaugaaggcaaagcuuugaucc

SEQ ID NO: 259477 - RNA, 32 nt, Human
ugggcucucagggacugagggcagcugcccug

SEQ ID NO: 259478 - RNA, 32 nt, Human
ugggcucugaauacuccauucugccucacuuc

SEQ ID NO: 259479 - RNA, 18 nt, Human
ugggcucugaccuggggu

SEQ ID NO: 259480 - RNA, 32 nt, Human
ugggcucugaucagugccuguugcguguaaac

SEQ ID NO: 259481 - RNA, 32 nt, Human
ugggcucugaugggaagagggaggugggccug

SEQ ID NO: 259482 - RNA, 32 nt, Human
ugggcucugcccugggcagacaggcagagggc

SEQ ID NO: 259483 - RNA, 32 nt, Human
ugggcucugcuuccuccgccugcugccuggac

SEQ ID NO: 259484 - RNA, 32 nt, Human
ugggcucugggaacaggggacuacuuuggggc

SEQ ID NO: 259485 - RNA, 32 nt, Human
ugggcucugggauguggaaccauggcguccag

SEQ ID NO: 259486 - RNA, 32 nt, Human
ugggcucugggcagcagcagggaucugguggu

SEQ ID NO: 259487 - RNA, 31 nt, Human
ugggcucuggugucucccagucugcuaaagc

SEQ ID NO: 259488 - RNA, 32 nt, Human
ugggcucuguuuaggagggcagugagaccacc

SEQ ID NO: 259489 - RNA, 21 nt, Human
ugggcucuugaguugcugcuu

SEQ ID NO: 259490 - RNA, 21 nt, Human
ugggcucuugcgucuccagcu

SEQ ID NO: 259491 - RNA, 32 nt, Human
ugggcugaaagaaugauuuagaaaacuaguga

SEQ ID NO: 259492 - RNA, 25 nt, Human
ugggcugaacagcugugaccaaaac

SEQ ID NO: 259493 - RNA, 32 nt, Human
ugggcugaagaaaagagcaagggaagagguga

SEQ ID NO: 259494 - RNA, 32 nt, Human
ugggcugacaacacucccucuccugggaccuc

SEQ ID NO: 259495 - RNA, 32 nt, Human
ugggcugacagagcagguucucauuucucagc

SEQ ID NO: 259496 - RNA, 32 nt, Human
ugggcugacucuggcgccaugauguugccuua

SEQ ID NO: 259497 - RNA, 32 nt, Human
ugggcugacugagacaauucuguccauguaaa

SEQ ID NO: 259498 - RNA, 32 nt, Human
ugggcugacuuuugauaggccaugccuugcca

SEQ ID NO: 259499 - RNA, 19 nt, Human
ugggcugagaaaccaggga

SEQ ID NO: 259500 - RNA, 32 nt, Human
ugggcugagacccagcugagugcagcguggcg

SEQ ID NO: 259501 - RNA, 32 nt, Human
ugggcugagccaccuugugagugcaguuacug

SEQ ID NO: 259502 - RNA, 32 nt, Human
ugggcugagccgaguccucuuucagcagcagc

SEQ ID NO: 259503 - RNA, 32 nt, Human
ugggcugaggaugcagaaacaggcaggacaca

SEQ ID NO: 259504 - RNA, 32 nt, Human
ugggcugagggaagggagaggagaggaacaag

SEQ ID NO: 259505 - RNA, 32 nt, Human
ugggcugagggcaucuccaaagcuggccugau

SEQ ID NO: 259506 - RNA, 32 nt, Human
ugggcugaggggcagggagccggcugugccca

SEQ ID NO: 259507 - RNA, 32 nt, Human
ugggcugaguagaggcaccagauuugggcucc

SEQ ID NO: 259508 - RNA, 32 nt, Human
ugggcugaugagagguagagcagcaugcaucg

SEQ ID NO: 259509 - RNA, 32 nt, Human
ugggcugcagaaucgcugaacugugugccucu

SEQ ID NO: 259510 - RNA, 32 nt, Human
ugggcugcaggaggccaugaagguggccgugg

SEQ ID NO: 259511 - RNA, 32 nt, Human
ugggcugcaucuggcccuggcuggaggccuug

SEQ ID NO: 259512 - RNA, 32 nt, Human
ugggcugcaugggcugcuuuuauucauggugg

SEQ ID NO: 259513 - RNA, 32 nt, Human
ugggcugcauucccaugagcuuaggcauucua

SEQ ID NO: 259514 - RNA, 32 nt, Human
ugggcugccaggauuuagcagggagguggcug

SEQ ID NO: 259515 - RNA, 32 nt, Human
ugggcugcccagagccccacagcuucaaggcc

SEQ ID NO: 259516 - RNA, 32 nt, Human
ugggcugccuccagcccgggccugugucuugg

SEQ ID NO: 259517 - RNA, 32 nt, Human
ugggcugccucuucugucuuaacugguucugc

SEQ ID NO: 259518 - RNA, 32 nt, Human
ugggcugcgcggccccagccugggcacccuga

SEQ ID NO: 259519 - RNA, 32 nt, Human
ugggcugcggaagcucugccugccaaggauuc

SEQ ID NO: 259520 - RNA, 32 nt, Human
ugggcugcggaagguaacuggggacgucgcag

SEQ ID NO: 259521 - RNA, 32 nt, Human
ugggcugcgguggcucuggagcuggucagcgu

SEQ ID NO: 259522 - RNA, 32 nt, Human
ugggcugcgugugugguagggaugugcagguc

SEQ ID NO: 259523 - RNA, 20 nt, Human
ugggcugcuagaaagcagca

SEQ ID NO: 259524 - RNA, 21 nt, Human
ugggcugcucccgccccagcc

SEQ ID NO: 259525 - RNA, 32 nt, Human
ugggcugcucccucgugcacagcgcaggggag

SEQ ID NO: 259526 - RNA, 32 nt, Human
ugggcugcugaggggcuagugcagugguccug

SEQ ID NO: 259527 - RNA, 32 nt, Human
ugggcugcuggccaugaaucucugccucuccc

SEQ ID NO: 259528 - RNA, 32 nt, Human
ugggcugcugggacaugcaggcucugaguggg

SEQ ID NO: 259529 - RNA, 32 nt, Human
ugggcugcugggacuggguucauucucaugac

SEQ ID NO: 259530 - RNA, 32 nt, Human
ugggcugcugugggcugcauuuggauagcugu

SEQ ID NO: 259531 - RNA, 31 nt, Human
ugggcugcuugguucugacauucuggacugc

SEQ ID NO: 259532 - RNA, 32 nt, Human
ugggcuggaacagcagauuucagcuacauaua

SEQ ID NO: 259533 - RNA, 32 nt, Human
ugggcuggaagaggcagcaaaagggaaaauca

SEQ ID NO: 259534 - RNA, 32 nt, Human
ugggcuggagagaaggagaaggauuaggaaaa

SEQ ID NO: 259535 - RNA, 18 nt, Human
ugggcuggagcaggggga

SEQ ID NO: 259536 - RNA, 32 nt, Human
ugggcuggagugagagagaggcaggucuccag

SEQ ID NO: 259537 - RNA, 32 nt, Human
ugggcuggaguuaaauggaaguacaaugcagu

SEQ ID NO: 259538 - RNA, 32 nt, Human
ugggcuggauugagaagaaaacugacaagagu

SEQ ID NO: 259539 - RNA, 32 nt, Human
ugggcuggcaccugggcacagugcuuccaggu

SEQ ID NO: 259540 - RNA, 32 nt, Human
ugggcuggcaucugcauuacccaagcucugcu

SEQ ID NO: 259541 - RNA, 32 nt, Human
ugggcuggccgccugcagcccguguccaggag

SEQ ID NO: 259542 - RNA, 32 nt, Human
ugggcuggcugugguggagaauguagcgcaac

SEQ ID NO: 259543 - RNA, 32 nt, Human
ugggcuggcuuccguccugguagccaaggcua

SEQ ID NO: 259544 - RNA, 32 nt, Human
ugggcugggaccccucugccuccagggcgcgu

SEQ ID NO: 259545 - RNA, 32 nt, Human
ugggcugggaggagggaggcaggggagagccg

SEQ ID NO: 259546 - RNA, 32 nt, Human
ugggcugggagggagagaccggagcagcgcca

SEQ ID NO: 259547 - RNA, 32 nt, Human
ugggcugggagggagagcccuacagugcgugg

SEQ ID NO: 259548 - RNA, 32 nt, Human
ugggcugggauggugacuccugaaaccucuuc

SEQ ID NO: 259549 - RNA, 32 nt, Human
ugggcugggccccugaggccaggcugacuugg

SEQ ID NO: 259550 - RNA, 32 nt, Human
ugggcugggcccugggcuuggcucgaguucuc

SEQ ID NO: 259551 - RNA, 32 nt, Human
ugggcugggccgggcccaggaagugggcggcg

SEQ ID NO: 259552 - RNA, 32 nt, Human
ugggcugggccugagauucugcauuucuaagg

SEQ ID NO: 259553 - RNA, 32 nt, Human
ugggcugggccuggguggccucugucuuugca

SEQ ID NO: 259554 - RNA, 32 nt, Human
ugggcugggcgggccagcuggggaagcauuug

SEQ ID NO: 259555 - RNA, 32 nt, Human
ugggcugggcuggagucuggcugguccaacac

SEQ ID NO: 259556 - RNA, 32 nt, Human
ugggcugggcugggcugagccccuggucuucu

SEQ ID NO: 259557 - RNA, 32 nt, Human
ugggcugggcugggcuggacuggacgccucuc

SEQ ID NO: 259558 - RNA, 32 nt, Human
ugggcugggcugggcugggcugugggagcccu

SEQ ID NO: 259559 - RNA, 32 nt, Human
ugggcuggggcugcuccccuaacccuacuuug

SEQ ID NO: 259560 - RNA, 32 nt, Human
ugggcugggggaaggagccugaagguugcccc

SEQ ID NO: 259561 - RNA, 32 nt, Human
ugggcugggggaggggaacaggaugcccagcc

SEQ ID NO: 259562 - RNA, 32 nt, Human
ugggcugggguuggccaccguagcuuaguggg

SEQ ID NO: 259563 - RNA, 32 nt, Human
ugggcuggguaggguugcucagucuuuggggg

SEQ ID NO: 259564 - RNA, 32 nt, Human
ugggcugggugagcuugaaguccucugggaca

SEQ ID NO: 259565 - RNA, 32 nt, Human
ugggcugggugggccugggcagcugggugggc

SEQ ID NO: 259566 - RNA, 29 nt, Human
ugggcugggugucuggugccuggaacaga

SEQ ID NO: 259567 - RNA, 32 nt, Human
ugggcugguaaauccaaagggauaaggcuuca

SEQ ID NO: 259568 - RNA, 32 nt, Human
ugggcugguacccaggccuggagcagcgguac

SEQ ID NO: 259569 - RNA, 32 nt, Human
ugggcuggucuaggcuguggccugccaccuuc

SEQ ID NO: 259570 - RNA, 32 nt, Human
ugggcuggucucaaacuccugaccucaaguga

SEQ ID NO: 259571 - RNA, 32 nt, Human
ugggcuggucucaaacuccugaccucugguga

SEQ ID NO: 259572 - RNA, 32 nt, Human
ugggcuggucucaaacuccugauuucuuaguc

SEQ ID NO: 259573 - RNA, 32 nt, Human
ugggcuggucucaaacuccuggguucaagcaa

SEQ ID NO: 259574 - RNA, 32 nt, Human
ugggcuggucucaaacuucugaucucaaguga

SEQ ID NO: 259575 - RNA, 32 nt, Human
ugggcuggucucgaacuccuaaccucaaguga

SEQ ID NO: 259576 - RNA, 32 nt, Human
ugggcuggucugugucugggccugucccaugg

SEQ ID NO: 259577 - RNA, 32 nt, Human
ugggcuggugaguuuucgaggugacugugcug

SEQ ID NO: 259578 - RNA, 32 nt, Human
ugggcuggugcaggccccugagguuucuagug

SEQ ID NO: 259579 - RNA, 32 nt, Human
ugggcugguggaggcggggucgagauggcggc

SEQ ID NO: 259580 - RNA, 32 nt, Human
ugggcugguguuuguggcugacuugguacaga

SEQ ID NO: 259581 - RNA, 32 nt, Human
ugggcugugaaauuguacuuccaggcuuggau

SEQ ID NO: 259582 - RNA, 20 nt, Human
ugggcugugaucacaccacu

SEQ ID NO: 259583 - RNA, 31 nt, Human
ugggcugugauucccccuugcccaucagaga

SEQ ID NO: 259584 - RNA, 32 nt, Human
ugggcugugcuccccucuuccuacugucaguu

SEQ ID NO: 259585 - RNA, 32 nt, Human
ugggcugugcucuccccuguuuacccgaugua

SEQ ID NO: 259586 - RNA, 32 nt, Human
ugggcuguggaggugggcaugugggccccugg

SEQ ID NO: 259587 - RNA, 32 nt, Human
ugggcuguggucacgugcucccagaagaccug

SEQ ID NO: 259588 - RNA, 31 nt, Human
ugggcugugguggaaaaaugagggcuggagc

SEQ ID NO: 259589 - RNA, 32 nt, Human
ugggcuguuggcugggggcaugggggaggcuc

SEQ ID NO: 259590 - RNA, 32 nt, Human
ugggcuguugugcacacagugcagccuggauc

SEQ ID NO: 259591 - RNA, 32 nt, Human
ugggcuguuucacaggccuggccacgcucuca

SEQ ID NO: 259592 - RNA, 32 nt, Human
ugggcuguuucaugaagcuuucacuuuaaaau

SEQ ID NO: 259593 - RNA, 32 nt, Human
ugggcuuaaagcaguuaguaacaggaaagcuc

SEQ ID NO: 259594 - RNA, 32 nt, Human
ugggcuuaaucaggacggaagaggagggggug

SEQ ID NO: 259595 - RNA, 32 nt, Human
ugggcuuaaugauggagaaaaaguguacccug

SEQ ID NO: 259596 - RNA, 32 nt, Human
ugggcuuaccuugcccgucaguucccugccaa

SEQ ID NO: 259597 - RNA, 32 nt, Human
ugggcuuacugacaguugcccagaucugaagg

SEQ ID NO: 259598 - RNA, 32 nt, Human
ugggcuuagagcaguuucuguccugcugguua

SEQ ID NO: 259599 - RNA, 32 nt, Human
ugggcuuaguccauccuccacacuguugugca

SEQ ID NO: 259600 - RNA, 32 nt, Human
ugggcuuauuucccuggcuggguuauggggga

SEQ ID NO: 259601 - RNA, 32 nt, Human
ugggcuucaagcaauccuccugugucagccac

SEQ ID NO: 259602 - RNA, 32 nt, Human
ugggcuucaagcacugucuuccaucugcaucu

SEQ ID NO: 259603 - RNA, 32 nt, Human
ugggcuucacacaagaaccaccucucccgcag

SEQ ID NO: 259604 - RNA, 32 nt, Human
ugggcuucaguuuccuccuugcuccaugaggg

SEQ ID NO: 259605 - RNA, 32 nt, Human
ugggcuuccagggcagcgauugaggagaccuu

SEQ ID NO: 259606 - RNA, 32 nt, Human
ugggcuuccauggcaggaagaugagaagaaau

SEQ ID NO: 259607 - RNA, 32 nt, Human
ugggcuuccuggggccaguguugcaggcugaa

SEQ ID NO: 259608 - RNA, 32 nt, Human
ugggcuucguggugagcacugcagccucccug

SEQ ID NO: 259609 - RNA, 32 nt, Human
ugggcuucucagcgggucaagugcaguaccug

SEQ ID NO: 259610 - RNA, 32 nt, Human
ugggcuucuccaggagcagggaggguggaggg

SEQ ID NO: 259611 - RNA, 23 nt, Human
ugggcuucuccgggauuuuaguu

SEQ ID NO: 259612 - RNA, 32 nt, Human
ugggcuucugggagggacgggcugggaggaga

SEQ ID NO: 259613 - RNA, 32 nt, Human
ugggcuucuguccuccucugugucccggcaug

SEQ ID NO: 259614 - RNA, 32 nt, Human
ugggcuucugugagacuuaucacacauagugu

SEQ ID NO: 259615 - RNA, 32 nt, Human
ugggcuucuuucuccccagagggcccucugcc

SEQ ID NO: 259616 - RNA, 32 nt, Human
ugggcuugaccaggaacagcagagccaggccc

SEQ ID NO: 259617 - RNA, 32 nt, Human
ugggcuugagggaggcagcagcuccaacaccu

SEQ ID NO: 259618 - RNA, 32 nt, Human
ugggcuugcagcacugccaucuugccauguac

SEQ ID NO: 259619 - RNA, 32 nt, Human
ugggcuugccugcccuucaacagggucuauug

SEQ ID NO: 259620 - RNA, 32 nt, Human
ugggcuugcuccugcaaccaguaucuccuugg

SEQ ID NO: 259621 - RNA, 32 nt, Human
ugggcuugcuggucuaucacuuccuggccucu

SEQ ID NO: 259622 - RNA, 32 nt, Human
ugggcuuggagagugugcagugccuccugacu

SEQ ID NO: 259623 - RNA, 32 nt, Human
ugggcuuggcauacagcaggagcccaguaaau

SEQ ID NO: 259624 - RNA, 32 nt, Human
ugggcuuggccaaaacaggcucaggccaaaga

SEQ ID NO: 259625 - RNA, 32 nt, Human
ugggcuugggguggacaaacccagaggcugug

SEQ ID NO: 259626 - RNA, 24 nt, Human
ugggcuugguggcucacaccugua

SEQ ID NO: 259627 - RNA, 32 nt, Human
ugggcuuguagcugaccaacagccugcucucc

SEQ ID NO: 259628 - RNA, 32 nt, Human
ugggcuugugcgcggaccuggcgacgcucuag

SEQ ID NO: 259629 - RNA, 32 nt, Human
ugggcuuguucuucaugccuaacuuaauaauu

SEQ ID NO: 259630 - RNA, 32 nt, Human
ugggcuuuagcuguuuuucucauuuguuggug

SEQ ID NO: 259631 - RNA, 32 nt, Human
ugggcuuucagauuucucuuuuuaaccacauu

SEQ ID NO: 259632 - RNA, 32 nt, Human
ugggcuuucccaggaaggagaugaagguagaa

SEQ ID NO: 259633 - RNA, 32 nt, Human
ugggcuuuccuuguuugacuucagaccuggau

SEQ ID NO: 259634 - RNA, 32 nt, Human
ugggcuuucuguuccuccugaguagcugauuu

SEQ ID NO: 259635 - RNA, 32 nt, Human
ugggcuuugaacuuagacaucuaccucagagc

SEQ ID NO: 259636 - RNA, 32 nt, Human
ugggcuuugccucacguauuccugcugccacc

SEQ ID NO: 259637 - RNA, 32 nt, Human
ugggcuuugccuucugacaccucaguggugcu

SEQ ID NO: 259638 - RNA, 32 nt, Human
ugggcuuuuaauccugugugugauuacuagua

SEQ ID NO: 259639 - RNA, 32 nt, Human
uggggaaaacauccuuuaacuucggggucguc

SEQ ID NO: 259640 - RNA, 32 nt, Human
uggggaaaagcacuuuccuggugauggaaaaa

SEQ ID NO: 259641 - RNA, 32 nt, Human
uggggaaaaucccuuuuccugccugccugucu

SEQ ID NO: 259642 - RNA, 32 nt, Human
uggggaaacaaaggugggagggguggggaaua

SEQ ID NO: 259643 - RNA, 32 nt, Human
uggggaaacugaggccuugagaaggaaaaagg

SEQ ID NO: 259644 - RNA, 32 nt, Human
uggggaaagacacaccccucucuaugaaauga

SEQ ID NO: 259645 - RNA, 32 nt, Human
uggggaaagaggaggaagagcauuaggacaaa

SEQ ID NO: 259646 - RNA, 32 nt, Human
uggggaaagauggcugccgcccauggaccuuu

SEQ ID NO: 259647 - RNA, 32 nt, Human
uggggaaagcacaagaggaggaccgggaucca

SEQ ID NO: 259648 - RNA, 32 nt, Human
uggggaaagugccggaccaccaugccgcgcuc

SEQ ID NO: 259649 - RNA, 32 nt, Human
uggggaacaaguguccuucagaacccagagaa

SEQ ID NO: 259650 - RNA, 32 nt, Human
uggggaacauagugagauaccgucucuacaaa

SEQ ID NO: 259651 - RNA, 32 nt, Human
uggggaacauggcaagaccccaucucuacaaa

SEQ ID NO: 259652 - RNA, 32 nt, Human
uggggaaccaaggauaggggaaggagucagca

SEQ ID NO: 259653 - RNA, 32 nt, Human
uggggaacccagcaggaaauuagaauagaacc

SEQ ID NO: 259654 - RNA, 32 nt, Human
uggggaacgagaguaauuugaagaaugcuuga

SEQ ID NO: 259655 - RNA, 32 nt, Human
uggggaacugguuuauucuguacuccuaaaca

SEQ ID NO: 259656 - RNA, 32 nt, Human
uggggaagaacugggagcuccccaacuuggac

SEQ ID NO: 259657 - RNA, 32 nt, Human
uggggaagaagacaguggggagaaagugcagg

SEQ ID NO: 259658 - RNA, 32 nt, Human
uggggaagacagcauuccacagccuggucagg

SEQ ID NO: 259659 - RNA, 32 nt, Human
uggggaagagccggcagcuccuccucaucccc

SEQ ID NO: 259660 - RNA, 32 nt, Human
uggggaagagcugagcaaagagagaaaggagg

SEQ ID NO: 259661 - RNA, 32 nt, Human
uggggaagaggaacgggcagcugggagccuuc

SEQ ID NO: 259662 - RNA, 32 nt, Human
uggggaagcaaguuggcaguucuugaacagca

SEQ ID NO: 259663 - RNA, 32 nt, Human
uggggaagccaacagacacagcaggaggagag

SEQ ID NO: 259664 - RNA, 32 nt, Human
uggggaagccaccccauagaugacauugcccg

SEQ ID NO: 259665 - RNA, 32 nt, Human
uggggaagccugggugaggaugggccaggucc

SEQ ID NO: 259666 - RNA, 32 nt, Human
uggggaagcggcaaggaauuuucaccuccagc

SEQ ID NO: 259667 - RNA, 32 nt, Human
uggggaagcugaggcaggagaaucccuugaac

SEQ ID NO: 259668 - RNA, 32 nt, Human
uggggaagcugaggcaggagaauugcuugaac

SEQ ID NO: 259669 - RNA, 32 nt, Human
uggggaagcuguugcuguugcuagacgacggg

SEQ ID NO: 259670 - RNA, 32 nt, Human
uggggaaggaagagggcgagaucuuggcaucc

SEQ ID NO: 259671 - RNA, 32 nt, Human
uggggaaggagaaucacuugagcccaggaagc

SEQ ID NO: 259672 - RNA, 32 nt, Human
uggggaaggagagggaagaagggaggagcggu

SEQ ID NO: 259673 - RNA, 19 nt, Human
uggggaaggcaggaggcag

SEQ ID NO: 259674 - RNA, 32 nt, Human
uggggaaggggagccaggucagcugggucuag

SEQ ID NO: 259675 - RNA, 32 nt, Human
uggggaaggguuuucugucuuauggagugagu

SEQ ID NO: 259676 - RNA, 32 nt, Human
uggggaaguaucugcucuucucauguuaaaag

SEQ ID NO: 259677 - RNA, 32 nt, Human
uggggaaguccgaggggcuggggaaggguuuc

SEQ ID NO: 259678 - RNA, 32 nt, Human
uggggaagugaggaagaagggauucuagaguu

SEQ ID NO: 259679 - RNA, 32 nt, Human
uggggaagugauauuugcaacaucucauacuu

SEQ ID NO: 259680 - RNA, 32 nt, Human
uggggaaguucaggcuguccccagaagucaac

SEQ ID NO: 259681 - RNA, 32 nt, Human
uggggaaguucuuauguuuaucuugcuuuuca

SEQ ID NO: 259682 - RNA, 32 nt, Human
uggggaauaggucaucaaaaagagguaacuau

SEQ ID NO: 259683 - RNA, 32 nt, Human
uggggaauauaacauaucaaaauacaugaaca

SEQ ID NO: 259684 - RNA, 32 nt, Human
uggggaaugcagcccuggugucucccgaggcc

SEQ ID NO: 259685 - RNA, 31 nt, Human
uggggaauggcugcugccauggugccggggc

SEQ ID NO: 259686 - RNA, 32 nt, Human
uggggaaugggcagguggccucugcuggucuc

SEQ ID NO: 259687 - RNA, 32 nt, Human
uggggaaugugguaaccaggaggaagggucac

SEQ ID NO: 259688 - RNA, 24 nt, Human
uggggacaagcgguggagaagggu

SEQ ID NO: 259689 - RNA, 32 nt, Human
uggggacacagcaauaauguggguggcaguaa

SEQ ID NO: 259690 - RNA, 32 nt, Human
uggggacacagcacaaacgguguuuacgccac

SEQ ID NO: 259691 - RNA, 24 nt, Human
uggggacacagggcuccuagcaag

SEQ ID NO: 259692 - RNA, 32 nt, Human
uggggacacauaccccucaguacuguagcaug

SEQ ID NO: 259693 - RNA, 32 nt, Human
uggggacagaacucuccucucccacucuagca

SEQ ID NO: 259694 - RNA, 32 nt, Human
uggggacaggcaguggcaggcaccacuagcga

SEQ ID NO: 259695 - RNA, 24 nt, Human
uggggacaggcgcagugccugugg

SEQ ID NO: 259696 - RNA, 22 nt, Human
uggggacagguggccaaagugg

SEQ ID NO: 259697 - RNA, 24 nt, Human
uggggacaguggcucacaccugua

SEQ ID NO: 259698 - RNA, 32 nt, Human
uggggacaucccucucuaggccuaggccaugu

SEQ ID NO: 259699 - RNA, 32 nt, Human
uggggacauugccaccacgucgccaugacggc

SEQ ID NO: 259700 - RNA, 32 nt, Human
uggggacauugcucucugggcuuuugguuugg

SEQ ID NO: 259701 - RNA, 32 nt, Human
uggggaccaacggaaagaguucacgaugggag

SEQ ID NO: 259702 - RNA, 32 nt, Human
uggggaccacacaggcaccugccuuccuagau

SEQ ID NO: 259703 - RNA, 32 nt, Human
uggggaccagccgccgcgcccgccucggaguc

SEQ ID NO: 259704 - RNA, 32 nt, Human
uggggaccaggauaugacuccuggugcccagg

SEQ ID NO: 259705 - RNA, 32 nt, Human
uggggaccagggacugauuauuugucaccugg

SEQ ID NO: 259706 - RNA, 32 nt, Human
uggggaccagggaggugcaggugucugcagug

SEQ ID NO: 259707 - RNA, 32 nt, Human
uggggacccaaacuguaugcauuguuccagau

SEQ ID NO: 259708 - RNA, 32 nt, Human
uggggacccagagggaaggcagaaggagauga

SEQ ID NO: 259709 - RNA, 19 nt, Human
uggggacccagcucaggga

SEQ ID NO: 259710 - RNA, 32 nt, Human
uggggaccccaucuccccuuggagacuuuggg

SEQ ID NO: 259711 - RNA, 32 nt, Human
uggggaccccuccaggaagaugcugacaucca

SEQ ID NO: 259712 - RNA, 32 nt, Human
uggggaccccuguacuugggggagacacaccu

SEQ ID NO: 259713 - RNA, 32 nt, Human
uggggacccgggggagcugagauacaguuggc

SEQ ID NO: 259714 - RNA, 32 nt, Human
uggggacccuccaggcacuggugagagacaug

SEQ ID NO: 259715 - RNA, 32 nt, Human
uggggacccugggcccaucucucccugcgcac

SEQ ID NO: 259716 - RNA, 32 nt, Human
uggggacccuggggaccuugccgacucuauuc

SEQ ID NO: 259717 - RNA, 32 nt, Human
uggggaccgagauagagagggagaccccauuc

SEQ ID NO: 259718 - RNA, 32 nt, Human
uggggaccgggugaggggccugacggcagagu

SEQ ID NO: 259719 - RNA, 32 nt, Human
uggggaccuccacgggggaaugggauccaggc

SEQ ID NO: 259720 - RNA, 32 nt, Human
uggggaccugaccucugucacucucaugaaau

SEQ ID NO: 259721 - RNA, 18 nt, Human
uggggaccuggccaguga

SEQ ID NO: 259722 - RNA, 32 nt, Human
uggggaccuuggcugcuggaggcugcaccuac

SEQ ID NO: 259723 - RNA, 31 nt, Human
uggggacgaguguccaggcugaagucagggc

SEQ ID NO: 259724 - RNA, 32 nt, Human
uggggacgguggcccugccuucaugcccagga

SEQ ID NO: 259725 - RNA, 23 nt, Human
uggggacucaaaauuaucaaaag

SEQ ID NO: 259726 - RNA, 32 nt, Human
uggggacucaggaagggaggcuuggagggggu

SEQ ID NO: 259727 - RNA, 32 nt, Human
uggggacuccaggauuuucugcucuuggccua

SEQ ID NO: 259728 - RNA, 32 nt, Human
uggggacucccaggaccacaggcugagacgag

SEQ ID NO: 259729 - RNA, 32 nt, Human
uggggacucugcucacuaccugggugacagga

SEQ ID NO: 259730 - RNA, 32 nt, Human
uggggacugggcugagaggguggacgaguuca

SEQ ID NO: 259731 - RNA, 21 nt, Human
uggggacugucauuuuuguga

SEQ ID NO: 259732 - RNA, 32 nt, Human
uggggacugugccauuaaaccucuuuuucuuu

SEQ ID NO: 259733 - RNA, 32 nt, Human
uggggacugugcucacuaccugggugacagga

SEQ ID NO: 259734 - RNA, 32 nt, Human
uggggacuguggccgccacccuucccaccgcc

SEQ ID NO: 259735 - RNA, 32 nt, Human
uggggacuuccagagugggcucccuaaacagc

SEQ ID NO: 259736 - RNA, 32 nt, Human
uggggagaaaaaugggaaguuguucacagaug

SEQ ID NO: 259737 - RNA, 32 nt, Human
uggggagaaaaguucccugggacugcacaagu

SEQ ID NO: 259738 - RNA, 20 nt, Human
uggggagaaaccagagcaga

SEQ ID NO: 259739 - RNA, 19 nt, Human
uggggagaaaccccacaaa

SEQ ID NO: 259740 - RNA, 18 nt, Human
uggggagaaaccuacaga

SEQ ID NO: 259741 - RNA, 32 nt, Human
uggggagaaagaaaaaguguauuacuuaaaga

SEQ ID NO: 259742 - RNA, 17 nt, Human
uggggagaaagggcaaa

SEQ ID NO: 259743 - RNA, 21 nt, Human
uggggagaaauaacuaguaga

SEQ ID NO: 259744 - RNA, 32 nt, Human
uggggagaaauaagaauggaaagguggcuuga

SEQ ID NO: 259745 - RNA, 19 nt, Human
uggggagaaccacacuaaa

SEQ ID NO: 259746 - RNA, 19 nt, Human
uggggagaagaaaacagca

SEQ ID NO: 259747 - RNA, 32 nt, Human
uggggagaagaagggaagagagcagcaguagc

SEQ ID NO: 259748 - RNA, 21 nt, Human
uggggagaagagaacauuaga

SEQ ID NO: 259749 - RNA, 32 nt, Human
uggggagaagaguaugcuuccuuuuauccaug

SEQ ID NO: 259750 - RNA, 20 nt, Human
uggggagaagccccagcaag

SEQ ID NO: 259751 - RNA, 19 nt, Human
uggggagaagcccuacaaa

SEQ ID NO: 259752 - RNA, 26 nt, Human
uggggagaaggaagauccucagugaa

SEQ ID NO: 259753 - RNA, 21 nt, Human
uggggagaagggagaagcaag

SEQ ID NO: 259754 - RNA, 19 nt, Human
uggggagaaguccaccaag

SEQ ID NO: 259755 - RNA, 32 nt, Human
uggggagaagugguccagguggagggaacagc

SEQ ID NO: 259756 - RNA, 19 nt, Human
uggggagaaucuaugcaag

SEQ ID NO: 259757 - RNA, 20 nt, Human
uggggagaauuuccaucaag

SEQ ID NO: 259758 - RNA, 19 nt, Human
uggggagacaggcagcaaa

SEQ ID NO: 259759 - RNA, 32 nt, Human
uggggagacagguggagaugaggugaagauca

SEQ ID NO: 259760 - RNA, 24 nt, Human
uggggagaccucaggauacuuaca

SEQ ID NO: 259761 - RNA, 32 nt, Human
uggggagacucagacgagggagguuucugaua

SEQ ID NO: 259762 - RNA, 20 nt, Human
uggggagagacacagucaaa

SEQ ID NO: 259763 - RNA, 32 nt, Human
uggggagagacaccccaaccucccaggguggg

SEQ ID NO: 259764 - RNA, 32 nt, Human
uggggagagaggcagaggcagcuggagcgccg

SEQ ID NO: 259765 - RNA, 18 nt, Human
uggggagagauaaggcaa

SEQ ID NO: 259766 - RNA, 32 nt, Human
uggggagagcccagaaggacauugcagacaga

SEQ ID NO: 259767 - RNA, 20 nt, Human
uggggagaggaaggggcaga

SEQ ID NO: 259768 - RNA, 32 nt, Human
uggggagaggacucaauagcuccaccccuucu

SEQ ID NO: 259769 - RNA, 22 nt, Human
uggggagaggaggaugagcaga

SEQ ID NO: 259770 - RNA, 19 nt, Human
uggggagaggaggcgcaag

SEQ ID NO: 259771 - RNA, 20 nt, Human
uggggagaggaguccauaga

SEQ ID NO: 259772 - RNA, 32 nt, Human
uggggagagggaggagaaagaggaggaucucg

SEQ ID NO: 259773 - RNA, 32 nt, Human
uggggagagggagggccgggaagccaggaaag

SEQ ID NO: 259774 - RNA, 32 nt, Human
uggggagagggaggggagagaccacagccggg

SEQ ID NO: 259775 - RNA, 20 nt, Human
uggggagaggguggggcaga

SEQ ID NO: 259776 - RNA, 32 nt, Human
uggggagagguggaggcugacagcugagacgu

SEQ ID NO: 259777 - RNA, 32 nt, Human
uggggagagguguggagaaggagagaacaugg

SEQ ID NO: 259778 - RNA, 32 nt, Human
uggggagagguguucgguuuccccagccuguu

SEQ ID NO: 259779 - RNA, 32 nt, Human
uggggagaguagaagggaaagcugaccuugaa

SEQ ID NO: 259780 - RNA, 20 nt, Human
uggggagagucaacaggaaa

SEQ ID NO: 259781 - RNA, 32 nt, Human
uggggagaguuuacauaaggaagagaagaaau

SEQ ID NO: 259782 - RNA, 32 nt, Human
uggggagauccagcagccuaagcuuagaaagg

SEQ ID NO: 259783 - RNA, 32 nt, Human
uggggagaucugcagaagcaucagaccaggca

SEQ ID NO: 259784 - RNA, 16 nt, Human
uggggagaugagcaga

SEQ ID NO: 259785 - RNA, 32 nt, Human
uggggagaugggcugggaggggagaucccgga

SEQ ID NO: 259786 - RNA, 20 nt, Human
uggggagauuuugccacaaa

SEQ ID NO: 259787 - RNA, 32 nt, Human
uggggagcaaaccuggcuugauggcauuuugu

SEQ ID NO: 259788 - RNA, 26 nt, Human
uggggagcaacuuuugaguaucuuua

SEQ ID NO: 259789 - RNA, 32 nt, Human
uggggagcacagaaggccaguugcugagcagg

SEQ ID NO: 259790 - RNA, 32 nt, Human
uggggagcacagaggcugccugugucagggag

SEQ ID NO: 259791 - RNA, 32 nt, Human
uggggagcaggagagagaggguaggcuagggg

SEQ ID NO: 259792 - RNA, 22 nt, Human
uggggagcaggucucuggcaga

SEQ ID NO: 259793 - RNA, 32 nt, Human
uggggagcagucccucugcaccccagagugag

SEQ ID NO: 259794 - RNA, 32 nt, Human
uggggagcaguuuuccccuggccucaguuccc

SEQ ID NO: 259795 - RNA, 32 nt, Human
uggggagcauagaaaaacugggaagagagguu

SEQ ID NO: 259796 - RNA, 32 nt, Human
uggggagcauugcaccuggcaugaggaguggg

SEQ ID NO: 259797 - RNA, 32 nt, Human
uggggagccaaggcaggagaaucgcuuuaggc

SEQ ID NO: 259798 - RNA, 20 nt, Human
uggggagccagcccagcaag

SEQ ID NO: 259799 - RNA, 32 nt, Human
uggggagccaggagucgcggccccugccuccc

SEQ ID NO: 259800 - RNA, 32 nt, Human
uggggagcccaggauggagguggcggucgcgg

SEQ ID NO: 259801 - RNA, 32 nt, Human
uggggagcccccaguggcggggacagggccag

SEQ ID NO: 259802 - RNA, 32 nt, Human
uggggagccgcuggggagccaccccauucauc

SEQ ID NO: 259803 - RNA, 32 nt, Human
uggggagccugccucccuagcuccuggccccu

SEQ ID NO: 259804 - RNA, 32 nt, Human
uggggagccuuccccaccuuagcugucuccug

SEQ ID NO: 259805 - RNA, 32 nt, Human
uggggagcuacgacagauuggccaaagacuca

SEQ ID NO: 259806 - RNA, 32 nt, Human
uggggagcucagagcugagauccuacaggagu

SEQ ID NO: 259807 - RNA, 32 nt, Human
uggggagcugaacugcccgagacacugucgca

SEQ ID NO: 259808 - RNA, 32 nt, Human
uggggagcuggcagggcagaggagguagucug

SEQ ID NO: 259809 - RNA, 32 nt, Human
uggggagcuugcccuuuaccuccagggcugcu

SEQ ID NO: 259810 - RNA, 32 nt, Human
uggggagcuuggcugagggucugggaaaugag

SEQ ID NO: 259811 - RNA, 32 nt, Human
uggggagcuuuugcccacacacuuuccaucuc

SEQ ID NO: 259812 - RNA, 32 nt, Human
uggggaggaacagacuggcaggaagcacaccg

SEQ ID NO: 259813 - RNA, 18 nt, Human
uggggaggaacagucaag

SEQ ID NO: 259814 - RNA, 19 nt, Human
uggggaggaaccaugcaaa

SEQ ID NO: 259815 - RNA, 21 nt, Human
uggggaggaagagcaaguaga

SEQ ID NO: 259816 - RNA, 32 nt, Human
uggggaggaagaggaggaagaggaaggggaga

SEQ ID NO: 259817 - RNA, 20 nt, Human
uggggaggaagcucaccaaa

SEQ ID NO: 259818 - RNA, 21 nt, Human
uggggaggaagggccaggaga

SEQ ID NO: 259819 - RNA, 32 nt, Human
uggggaggaaugagaggguccaggcagggugu

SEQ ID NO: 259820 - RNA, 19 nt, Human
uggggaggaccagggcccu

SEQ ID NO: 259821 - RNA, 32 nt, Human
uggggaggacccagcuuccagcccaggaagcc

SEQ ID NO: 259822 - RNA, 32 nt, Human
uggggaggaccggaggagagaggaccccgccu

SEQ ID NO: 259823 - RNA, 18 nt, Human
uggggaggagaacucagc

SEQ ID NO: 259824 - RNA, 32 nt, Human
uggggaggagagagggggagaccccuuugccu

SEQ ID NO: 259825 - RNA, 18 nt, Human
uggggaggagaucccugu

SEQ ID NO: 259826 - RNA, 18 nt, Human
uggggaggaggaagcgga

SEQ ID NO: 259827 - RNA, 19 nt, Human
uggggaggaggacccggca

SEQ ID NO: 259828 - RNA, 32 nt, Human
uggggaggaggcaccauuugcuggaacugaag

SEQ ID NO: 259829 - RNA, 19 nt, Human
uggggaggaggcccgugca

SEQ ID NO: 259830 - RNA, 32 nt, Human
uggggaggaggcggaggcagcggcuggaggag

SEQ ID NO: 259831 - RNA, 21 nt, Human
uggggaggagggacauguaga

SEQ ID NO: 259832 - RNA, 20 nt, Human
uggggaggagggcaggcaga

SEQ ID NO: 259833 - RNA, 32 nt, Human
uggggaggagggcuggucuccgcuccucaggg

SEQ ID NO: 259834 - RNA, 21 nt, Human
uggggaggaggucagaggaga

SEQ ID NO: 259835 - RNA, 32 nt, Human
uggggaggagugagaaaaggagagcaggaaag

SEQ ID NO: 259836 - RNA, 19 nt, Human
uggggaggagugccagcaa

SEQ ID NO: 259837 - RNA, 32 nt, Human
uggggaggaguggggcagggcagagaaucccc

SEQ ID NO: 259838 - RNA, 19 nt, Human
uggggaggauggcugcaaa

SEQ ID NO: 259839 - RNA, 22 nt, Human
uggggaggcaagaucucaggga

SEQ ID NO: 259840 - RNA, 21 nt, Human
uggggaggcagagccaggaag

SEQ ID NO: 259841 - RNA, 31 nt, Human
uggggaggcagcuagauaccaaaccauucua

SEQ ID NO: 259842 - RNA, 32 nt, Human
uggggaggccacagcagggcugagggaacucu

SEQ ID NO: 259843 - RNA, 32 nt, Human
uggggaggccacccuuccugcccuacccgcag

SEQ ID NO: 259844 - RNA, 32 nt, Human
uggggaggcccagcuggagcggcgggcagugg

SEQ ID NO: 259845 - RNA, 32 nt, Human
uggggaggccccuccuuccugcagagccgucc

SEQ ID NO: 259846 - RNA, 32 nt, Human
uggggaggcccuccugcugccuuggggugaca

SEQ ID NO: 259847 - RNA, 32 nt, Human
uggggaggccgaggcaggcggaucacuugagg

SEQ ID NO: 259848 - RNA, 32 nt, Human
uggggaggccgaggcgggcagaucacgagauc

SEQ ID NO: 259849 - RNA, 32 nt, Human
uggggaggccgaggcggguggaucaggagguc

SEQ ID NO: 259850 - RNA, 32 nt, Human
uggggaggcguugccaucagaugcccugcggc

SEQ ID NO: 259851 - RNA, 32 nt, Human
uggggaggcuaaagcaggaggauggcuuuagc

SEQ ID NO: 259852 - RNA, 32 nt, Human
uggggaggcugaagcaggaaaaucgcuugaac

SEQ ID NO: 259853 - RNA, 32 nt, Human
uggggaggcugaaguaggaggaucauuuaugc

SEQ ID NO: 259854 - RNA, 32 nt, Human
uggggaggcugaggcacgagaaucacuugaac

SEQ ID NO: 259855 - RNA, 32 nt, Human
uggggaggcugaggcagcauugcuugaaccca

SEQ ID NO: 259856 - RNA, 32 nt, Human
uggggaggcugaggcaggaaaauggugucaac

SEQ ID NO: 259857 - RNA, 32 nt, Human
uggggaggcugaggcaggacaauggcgugaac

SEQ ID NO: 259858 - RNA, 32 nt, Human
uggggaggcugaggcaggagaauagcuugaac

SEQ ID NO: 259859 - RNA, 32 nt, Human
uggggaggcugaggcaggagaaucacuugaac

SEQ ID NO: 259860 - RNA, 32 nt, Human
uggggaggcugaggcaggagaaucacuugaau

SEQ ID NO: 259861 - RNA, 32 nt, Human
uggggaggcugaggcaggagaaucgcuugaac

SEQ ID NO: 259862 - RNA, 32 nt, Human
uggggaggcugaggcaggagaaucguuuuaac

SEQ ID NO: 259863 - RNA, 32 nt, Human
uggggaggcugaggcaggagaauggcaugaac

SEQ ID NO: 259864 - RNA, 32 nt, Human
uggggaggcugaggcaggagaauggcgugaac

SEQ ID NO: 259865 - RNA, 32 nt, Human
uggggaggcugaggcaggagaauggcuggaac

SEQ ID NO: 259866 - RNA, 32 nt, Human
uggggaggcugaggcaggagaauggcuuggag

SEQ ID NO: 259867 - RNA, 32 nt, Human
uggggaggcugaggcaggagaauugcuuaaau

SEQ ID NO: 259868 - RNA, 32 nt, Human
uggggaggcugaggcaggagaauugcuuugaa

SEQ ID NO: 259869 - RNA, 32 nt, Human
uggggaggcugaggcaggaggaucacuugaga

SEQ ID NO: 259870 - RNA, 32 nt, Human
uggggaggcugaggcaggcagaucacuuaggc

SEQ ID NO: 259871 - RNA, 32 nt, Human
uggggaggcugaggcgggagaaucgcuugaac

SEQ ID NO: 259872 - RNA, 32 nt, Human
uggggaggcugagguaggagaauucgcuugag

SEQ ID NO: 259873 - RNA, 32 nt, Human
uggggaggcugagucaggagaaucgcuugaac

SEQ ID NO: 259874 - RNA, 20 nt, Human
uggggaggcugcugcuuuca

SEQ ID NO: 259875 - RNA, 32 nt, Human
uggggaggcuggccggagagagagggaaggac

SEQ ID NO: 259876 - RNA, 32 nt, Human
uggggagggaaaggagagagaaggaaaggagu

SEQ ID NO: 259877 - RNA, 32 nt, Human
uggggagggaaagggcaccaggcagcccgugg

SEQ ID NO: 259878 - RNA, 32 nt, Human
uggggagggaagggaaggcagcuccaagaaga

SEQ ID NO: 259879 - RNA, 32 nt, Human
uggggagggagacauccagcuugggcuuuccc

SEQ ID NO: 259880 - RNA, 32 nt, Human
uggggagggagagagagggagggagagggagu

SEQ ID NO: 259881 - RNA, 32 nt, Human
uggggagggaggcagcgcggugguuaucaacc

SEQ ID NO: 259882 - RNA, 32 nt, Human
uggggagggagggagagaagagggggcuaaau

SEQ ID NO: 259883 - RNA, 32 nt, Human
uggggagggagggagaggccgccacccccgcc

SEQ ID NO: 259884 - RNA, 32 nt, Human
uggggagggaggguccggcuccccagcccuuc

SEQ ID NO: 259885 - RNA, 32 nt, Human
uggggagggagguggaggagccgugcaauccc

SEQ ID NO: 259886 - RNA, 32 nt, Human
uggggagggagugcccacgugggaucugagag

SEQ ID NO: 259887 - RNA, 32 nt, Human
uggggagggauaugauggagagccagccagug

SEQ ID NO: 259888 - RNA, 19 nt, Human
uggggagggauuucacaag

SEQ ID NO: 259889 - RNA, 21 nt, Human
uggggagggcaucccugcaaa

SEQ ID NO: 259890 - RNA, 32 nt, Human
uggggagggcccauuccauccaucuuaggccc

SEQ ID NO: 259891 - RNA, 32 nt, Human
uggggagggcuccagacccaaccuggucacaa

SEQ ID NO: 259892 - RNA, 22 nt, Human
uggggagggcugccucagcaga

SEQ ID NO: 259893 - RNA, 32 nt, Human
uggggagggcugggagggggagggaacuuuua

SEQ ID NO: 259894 - RNA, 32 nt, Human
uggggagggcuggggacuaugcaauuccaaag

SEQ ID NO: 259895 - RNA, 19 nt, Human
uggggaggggaagaguaaa

SEQ ID NO: 259896 - RNA, 32 nt, Human
uggggaggggaaggagcggcacaugggguuga

SEQ ID NO: 259897 - RNA, 32 nt, Human
uggggaggggagagaggugggggcaaggggga

SEQ ID NO: 259898 - RNA, 32 nt, Human
uggggaggggagcgggacaggcgacacaggag

SEQ ID NO: 259899 - RNA, 32 nt, Human
uggggaggggauguccaggcaggugcgagcau

SEQ ID NO: 259900 - RNA, 18 nt, Human
uggggaggggcaggggga

SEQ ID NO: 259901 - RNA, 19 nt, Human
uggggaggggccacgcgga

SEQ ID NO: 259902 - RNA, 21 nt, Human
uggggaggggcccagagcaaa

SEQ ID NO: 259903 - RNA, 32 nt, Human
uggggaggggcuccguguagcaacccaggugu

SEQ ID NO: 259904 - RNA, 32 nt, Human
uggggaggggcugcggaaggaggaggcucagg

SEQ ID NO: 259905 - RNA, 32 nt, Human
uggggagggggaggggagaguaucaugggaga

SEQ ID NO: 259906 - RNA, 32 nt, Human
uggggagggggaggggcaggagcuuggaccuu

SEQ ID NO: 259907 - RNA, 32 nt, Human
uggggagggggagggggaagugucugccuuua

SEQ ID NO: 259908 - RNA, 32 nt, Human
uggggagggggcuguaacucagugaguggcuu

SEQ ID NO: 259909 - RNA, 23 nt, Human
uggggagggggucaccuagggga

SEQ ID NO: 259910 - RNA, 22 nt, Human
uggggagggggucucucccgaa

SEQ ID NO: 259911 - RNA, 21 nt, Human
uggggaggggguggccggcga

SEQ ID NO: 259912 - RNA, 18 nt, Human
uggggagggguaggggga

SEQ ID NO: 259913 - RNA, 32 nt, Human
uggggaggggugggacaaacugcaagguucug

SEQ ID NO: 259914 - RNA, 32 nt, Human
uggggaggguuucuuggguuucuugaagccag

SEQ ID NO: 259915 - RNA, 32 nt, Human
uggggagguagagguuacagcgagccaagauc

SEQ ID NO: 259916 - RNA, 32 nt, Human
uggggaggucagggaggcggggccaagggugu

SEQ ID NO: 259917 - RNA, 32 nt, Human
uggggaggucccagaggugggaggcuggcauc

SEQ ID NO: 259918 - RNA, 32 nt, Human
uggggaggucuggauggaucuguguaggaguu

SEQ ID NO: 259919 - RNA, 32 nt, Human
uggggaggugaguucuggaaggcaggggcucu

SEQ ID NO: 259920 - RNA, 21 nt, Human
uggggagguggauuuagcaga

SEQ ID NO: 259921 - RNA, 32 nt, Human
uggggagguggcacuagggaucaaagaagaug

SEQ ID NO: 259922 - RNA, 21 nt, Human
uggggagguggcccaggcaga

SEQ ID NO: 259923 - RNA, 24 nt, Human
uggggagguggucccuccagcgga

SEQ ID NO: 259924 - RNA, 32 nt, Human
uggggaggugugaacucaagggccuagcccca

SEQ ID NO: 259925 - RNA, 32 nt, Human
uggggagucaacuaauuugccugaggccacac

SEQ ID NO: 259926 - RNA, 32 nt, Human
uggggagucacucagaauaucacuguaaauga

SEQ ID NO: 259927 - RNA, 32 nt, Human
uggggagucagaaaauugggaacucauaucaa

SEQ ID NO: 259928 - RNA, 32 nt, Human
uggggagucauccgcagagucacucacccacu

SEQ ID NO: 259929 - RNA, 32 nt, Human
uggggagucggggccuuccugggagcuggaac

SEQ ID NO: 259930 - RNA, 32 nt, Human
uggggagucugcuucauuucuaucauuccauu

SEQ ID NO: 259931 - RNA, 32 nt, Human
uggggagugagcugauggcuccgagacugguc

SEQ ID NO: 259932 - RNA, 32 nt, Human
uggggagugaucucuuggacacagagccccca

SEQ ID NO: 259933 - RNA, 32 nt, Human
uggggagugccacccuggagccuaccggcaca

SEQ ID NO: 259934 - RNA, 18 nt, Human
uggggagugcccagcaag

SEQ ID NO: 259935 - RNA, 32 nt, Human
uggggagugggaacagggaggggcagaaaacc

SEQ ID NO: 259936 - RNA, 32 nt, Human
uggggaguggguacuugugagccucggacaca

SEQ ID NO: 259937 - RNA, 21 nt, Human
uggggaguggguccaaguaag

SEQ ID NO: 259938 - RNA, 32 nt, Human
uggggaguggguggcaggugggggugggcugc

SEQ ID NO: 259939 - RNA, 32 nt, Human
uggggagugguuuccaggagcugccugguguc

SEQ ID NO: 259940 - RNA, 32 nt, Human
uggggagugugaggacauggagggugggaggc

SEQ ID NO: 259941 - RNA, 32 nt, Human
uggggaguugcugcuggguggggugccacagg

SEQ ID NO: 259942 - RNA, 32 nt, Human
uggggaguuggcugaaggacuuggggagccca

SEQ ID NO: 259943 - RNA, 32 nt, Human
uggggaguuucuuccuggcaucaugccuucug

SEQ ID NO: 259944 - RNA, 32 nt, Human
uggggauaccuuccugcuguccuuccugagca

SEQ ID NO: 259945 - RNA, 25 nt, Human
uggggauaguaaugcacaaaauggu

SEQ ID NO: 259946 - RNA, 32 nt, Human
uggggauaugguuucuugaagcauuuuuaggc

SEQ ID NO: 259947 - RNA, 21 nt, Human
uggggauaugucaucugugaa

SEQ ID NO: 259948 - RNA, 32 nt, Human
uggggaucacagccucaccccugccccugugg

SEQ ID NO: 259949 - RNA, 32 nt, Human
uggggaucagaaaggugggcuugcuggagcug

SEQ ID NO: 259950 - RNA, 32 nt, Human
uggggaucagaggaugggguggucagugguag

SEQ ID NO: 259951 - RNA, 19 nt, Human
uggggaucaggccccagag

SEQ ID NO: 259952 - RNA, 32 nt, Human
uggggaucagggagguggagggacagugugaa

SEQ ID NO: 259953 - RNA, 32 nt, Human
uggggaucauuuuucucuucugaaccccagaa

SEQ ID NO: 259954 - RNA, 32 nt, Human
uggggauccacaggaacgacauucauacaggg

SEQ ID NO: 259955 - RNA, 23 nt, Human
uggggauccccuggccaagaggg

SEQ ID NO: 259956 - RNA, 32 nt, Human
uggggaugacuauccccucucugguuauugua

SEQ ID NO: 259957 - RNA, 32 nt, Human
uggggaugagccaggcuggggacaguggggcu

SEQ ID NO: 259958 - RNA, 32 nt, Human
uggggaugaggguggugagccccugggcgugg

SEQ ID NO: 259959 - RNA, 32 nt, Human
uggggaugcagccagcuggccugcacugggug

SEQ ID NO: 259960 - RNA, 32 nt, Human
uggggaugccuauagguugucugugaaaucgc

SEQ ID NO: 259961 - RNA, 19 nt, Human
uggggauggccagggcccu

SEQ ID NO: 259962 - RNA, 30 nt, Human
uggggauggggaaggagcaggagcugcugg

SEQ ID NO: 259963 - RNA, 32 nt, Human
uggggaugggggugggauaugaggguggcaug

SEQ ID NO: 259964 - RNA, 32 nt, Human
uggggaugguaaccucacugccccgucacucc

SEQ ID NO: 259965 - RNA, 32 nt, Human
uggggauggugagaauggagguucuagaaggg

SEQ ID NO: 259966 - RNA, 24 nt, Human
uggggaugguggcucacaccugug

SEQ ID NO: 259967 - RNA, 32 nt, Human
uggggauggugggagcagaagagcagaggcug

SEQ ID NO: 259968 - RNA, 32 nt, Human
uggggaugguugucccugcaacauggugccac

SEQ ID NO: 259969 - RNA, 32 nt, Human
uggggaugugccacugucacucagaagggcaa

SEQ ID NO: 259970 - RNA, 18 nt, Human
uggggauucacccagugg

SEQ ID NO: 259971 - RNA, 32 nt, Human
uggggauuccagggaccccacuuagugcucua

SEQ ID NO: 259972 - RNA, 32 nt, Human
uggggauucugccacaccuccguguccugcuc

SEQ ID NO: 259973 - RNA, 18 nt, Human
uggggauucuggaugcaa

SEQ ID NO: 259974 - RNA, 32 nt, Human
uggggauucuuucuuuugguccuuccuggaau

SEQ ID NO: 259975 - RNA, 32 nt, Human
uggggauugcagcguucucgaaguggcuguag

SEQ ID NO: 259976 - RNA, 32 nt, Human
uggggauuugaacccaggucuaccuguugcag

SEQ ID NO: 259977 - RNA, 32 nt, Human
uggggauuugguuacauccuugcuaagcccca

SEQ ID NO: 259978 - RNA, 32 nt, Human
uggggcaaaauguggacaaggaaucuuauggc

SEQ ID NO: 259979 - RNA, 18 nt, Human
uggggcaaacagcccccu

SEQ ID NO: 259980 - RNA, 32 nt, Human
uggggcaacuccagagagaagcauccccuggc

SEQ ID NO: 259981 - RNA, 32 nt, Human
uggggcaagaguugguacaaacagaaauacua

SEQ ID NO: 259982 - RNA, 32 nt, Human
uggggcaagaucccccagcccgacuagaccca

SEQ ID NO: 259983 - RNA, 32 nt, Human
uggggcaagugaguuaggggcccaggggcaau

SEQ ID NO: 259984 - RNA, 23 nt, Human
uggggcaaucucggcucacugca

SEQ ID NO: 259985 - RNA, 23 nt, Human
uggggcaaucuuggcucccugca

SEQ ID NO: 259986 - RNA, 32 nt, Human
uggggcacaaggggacuggaggcaguugcuuu

SEQ ID NO: 259987 - RNA, 32 nt, Human
uggggcacagccugcccaaccccagauaguca

SEQ ID NO: 259988 - RNA, 32 nt, Human
uggggcaccaauaacaaggagcucacccugcc

SEQ ID NO: 259989 - RNA, 19 nt, Human
uggggcaccaccuagugga

SEQ ID NO: 259990 - RNA, 21 nt, Human
uggggcacccaggagggcccu

SEQ ID NO: 259991 - RNA, 32 nt, Human
uggggcaccugaaagaaauuagugugggugcu

SEQ ID NO: 259992 - RNA, 32 nt, Human
uggggcaccuugcuccuccuucugcugcugcc

SEQ ID NO: 259993 - RNA, 18 nt, Human
uggggcacgaacauuuua

SEQ ID NO: 259994 - RNA, 32 nt, Human
uggggcacucacugccccucauccccagaaau

SEQ ID NO: 259995 - RNA, 32 nt, Human
uggggcagagcuggaagaggaaaggucuuggg

SEQ ID NO: 259996 - RNA, 32 nt, Human
uggggcagaggacauguggcuggcaggcuaca

SEQ ID NO: 259997 - RNA, 32 nt, Human
uggggcagaggacccggugccugccuggcaga

SEQ ID NO: 259998 - RNA, 32 nt, Human
uggggcagagggacagggcagccagaccaagg

SEQ ID NO: 259999 - RNA, 32 nt, Human
uggggcagagguggggaugugaagguagauac

SEQ ID NO: 260000 - RNA, 32 nt, Human
uggggcagauggggcuuuaccagcgucgggug

SEQ ID NO: 260001 - RNA, 32 nt, Human
uggggcagcaauggcugugcauuuuucagguu

SEQ ID NO: 260002 - RNA, 32 nt, Human
uggggcagccacggggacaggacgggguuggg

SEQ ID NO: 260003 - RNA, 32 nt, Human
uggggcagccaucccggccauucugagguaug

SEQ ID NO: 260004 - RNA, 32 nt, Human
uggggcagccccggaaggaaccagggauuagg

SEQ ID NO: 260005 - RNA, 32 nt, Human
uggggcagccuccugauggggauguuuggccu

SEQ ID NO: 260006 - RNA, 32 nt, Human
uggggcagccuggcugugggaggugaugacau

SEQ ID NO: 260007 - RNA, 32 nt, Human
uggggcagccuggggcaaggggaggggccagc

SEQ ID NO: 260008 - RNA, 32 nt, Human
uggggcagcugaggcagggcuaggagaagagc

SEQ ID NO: 260009 - RNA, 32 nt, Human
uggggcagcuggcacucaccaggccuggguca

SEQ ID NO: 260010 - RNA, 32 nt, Human
uggggcaggacaacaucaccguacugcaugug

SEQ ID NO: 260011 - RNA, 32 nt, Human
ugguggaacauggugcccuggcccaucuuccc

SEQ ID NO: 260012 - RNA, 32 nt, Human
ugguggaaccagccccuccagccuggggucca

SEQ ID NO: 260013 - RNA, 32 nt, Human
ugguggaagaccaguaauugcuggaagacugg

SEQ ID NO: 260014 - RNA, 32 nt, Human
ugguggaagcaguucacuuaaaggccaugagu

SEQ ID NO: 260015 - RNA, 32 nt, Human
ugguggaaggugucgccugcucuggcugagua

SEQ ID NO: 260016 - RNA, 32 nt, Human
ugguggaaucucugcugacgucacgucacucc

SEQ ID NO: 260017 - RNA, 32 nt, Human
ugguggaaugcgagagucucagccugaagcag

SEQ ID NO: 260018 - RNA, 32 nt, Human
ugguggacagucagggggcaguggccuggggg

SEQ ID NO: 260019 - RNA, 32 nt, Human
ugguggacagugccccucccaccuuccuucuu

SEQ ID NO: 260020 - RNA, 32 nt, Human
ugguggaccaacaugaaacucacugcaaagga

SEQ ID NO: 260021 - RNA, 32 nt, Human
ugguggacgccuguaaucccagcuacuuggga

SEQ ID NO: 260022 - RNA, 25 nt, Human
ugguggacugcagagcugcuuccac

SEQ ID NO: 260023 - RNA, 32 nt, Human
ugguggacuguacugauacucaacuagagugu

SEQ ID NO: 260024 - RNA, 32 nt, Human
ugguggagaacagagagaugagaagcagaggg

SEQ ID NO: 260025 - RNA, 19 nt, Human
ugguggagaaccacagcug

SEQ ID NO: 260026 - RNA, 32 nt, Human
ugguggagaaggucuagccaggcuccagacug

SEQ ID NO: 260027 - RNA, 32 nt, Human
ugguggagacagggucucaccauguuggcuag

SEQ ID NO: 260028 - RNA, 32 nt, Human
ugguggagacgggguuucaccguguuggccgg

SEQ ID NO: 260029 - RNA, 32 nt, Human
ugguggagacgggguuucgcuguguuggccgg

SEQ ID NO: 260030 - RNA, 32 nt, Human
ugguggagacgggguuucuccauguuggucag

SEQ ID NO: 260031 - RNA, 32 nt, Human
ugguggagaggagagggagaaagggaaguccc

SEQ ID NO: 260032 - RNA, 32 nt, Human
ugguggagaugggguuucgccauauugaucag

SEQ ID NO: 260033 - RNA, 32 nt, Human
ugguggagauggguuuucaccauguuggccag

SEQ ID NO: 260034 - RNA, 32 nt, Human
ugguggagcccagccagcuguggacuuuaagu

SEQ ID NO: 260035 - RNA, 32 nt, Human
ugguggagcuccaggagguuugucucucuugu

SEQ ID NO: 260036 - RNA, 32 nt, Human
ugguggagcuggcaagagaccugcuggaguuc

SEQ ID NO: 260037 - RNA, 32 nt, Human
ugguggagcugggcugggaccuccgggcugcu

SEQ ID NO: 260038 - RNA, 32 nt, Human
ugguggagcugggguuucucuccuccccaguc

SEQ ID NO: 260039 - RNA, 32 nt, Human
ugguggaggacggagagaaaccucuuuauuuc

SEQ ID NO: 260040 - RNA, 32 nt, Human
ugguggaggaggaggaggaggaggaaggcaaa

SEQ ID NO: 260041 - RNA, 32 nt, Human
ugguggaggcggcggaggcggcggcggaggcg

SEQ ID NO: 260042 - RNA, 32 nt, Human
ugguggagugugacggaggcauggggccugug

SEQ ID NO: 260043 - RNA, 32 nt, Human
ugguggaugauggcagagcauagauucuacuc

SEQ ID NO: 260044 - RNA, 19 nt, Human
ugguggauggcucuggaga

SEQ ID NO: 260045 - RNA, 32 nt, Human
ugguggaugggcccugcaagacacaggcucag

SEQ ID NO: 260046 - RNA, 32 nt, Human
ugguggauguagcacaauuuccacacugugaa

SEQ ID NO: 260047 - RNA, 32 nt, Human
ugguggcaauuuaagcacaaagguacucauuu

SEQ ID NO: 260048 - RNA, 32 nt, Human
ugguggcacacauaccuguaaucccagcuacu

SEQ ID NO: 260049 - RNA, 32 nt, Human
ugguggcacaugcaccuguaaucccagcuacu

SEQ ID NO: 260050 - RNA, 32 nt, Human
ugguggcaccacugagccuagaccauggagcc

SEQ ID NO: 260051 - RNA, 32 nt, Human
ugguggcaccacugcacuccagccugggugac

SEQ ID NO: 260052 - RNA, 32 nt, Human
ugguggcaccacugcccuccagccuggaugac

SEQ ID NO: 260053 - RNA, 32 nt, Human
ugguggcacccaggcgaguggugcccagguga

SEQ ID NO: 260054 - RNA, 32 nt, Human
ugguggcacccaggugagugguguccagguga

SEQ ID NO: 260055 - RNA, 32 nt, Human
ugguggcaccugggaaacagagcgagacgcug

SEQ ID NO: 260056 - RNA, 32 nt, Human
ugguggcacucccugugccccugcugcugcug

SEQ ID NO: 260057 - RNA, 32 nt, Human
ugguggcacuucucuguaaucucagcuucuca

SEQ ID NO: 260058 - RNA, 32 nt, Human
ugguggcagaaacaugcauuugccauaaauaa

SEQ ID NO: 260059 - RNA, 32 nt, Human
ugguggcagaaccgagcacuacccagcaaggu

SEQ ID NO: 260060 - RNA, 32 nt, Human
ugguggcagagcaguuggcacaccugugggug

SEQ ID NO: 260061 - RNA, 32 nt, Human
ugguggcagagccagucuucugggccucacau

SEQ ID NO: 260062 - RNA, 32 nt, Human
ugguggcagagucucaaagcugagaugcugag

SEQ ID NO: 260063 - RNA, 32 nt, Human
ugguggcagcagcgucaguagagacagagaac

SEQ ID NO: 260064 - RNA, 32 nt, Human
ugguggcaggaggaaaauugauaaaucagagg

SEQ ID NO: 260065 - RNA, 32 nt, Human
ugguggcagggauggagguuacgcaugggcuc

SEQ ID NO: 260066 - RNA, 32 nt, Human
ugguggcaguggcucccagcacuuugggaggc

SEQ ID NO: 260067 - RNA, 19 nt, Human
ugguggcaguggcugugau

SEQ ID NO: 260068 - RNA, 21 nt, Human
ugguggccacaagcacucagg

SEQ ID NO: 260069 - RNA, 32 nt, Human
ugguggccacugcuacagcugguccacagaga

SEQ ID NO: 260070 - RNA, 23 nt, Human
ugguggccagagaggcuccaggg

SEQ ID NO: 260071 - RNA, 21 nt, Human
ugguggccaggggcugugggg

SEQ ID NO: 260072 - RNA, 32 nt, Human
ugguggccauguacuuggaaaaaggccgcaug

SEQ ID NO: 260073 - RNA, 21 nt, Human
ugguggccauugugcuugggg

SEQ ID NO: 260074 - RNA, 32 nt, Human
ugguggcccaggagacagcacaccaccaggcu

SEQ ID NO: 260075 - RNA, 32 nt, Human
ugguggcccaggaggcggcaggacggccaaga

SEQ ID NO: 260076 - RNA, 32 nt, Human
ugguggcccagggagugugaggcugcagccuc

SEQ ID NO: 260077 - RNA, 28 nt, Human
ugguggcccagggcugccuccuucccug

SEQ ID NO: 260078 - RNA, 32 nt, Human
ugguggcccaggucuucaggcugcaacaggcc

SEQ ID NO: 260079 - RNA, 32 nt, Human
ugguggccccuccagauggucuccaccagcac

SEQ ID NO: 260080 - RNA, 32 nt, Human
ugguggcccggcgggcagcccagcucuguggu

SEQ ID NO: 260081 - RNA, 32 nt, Human
ugguggcccuccuccccaucucaguuugcaac

SEQ ID NO: 260082 - RNA, 32 nt, Human
ugguggcccugggauggggaaccgcgguggcu

SEQ ID NO: 260083 - RNA, 32 nt, Human
ugguggccgagaggaggcacggaggagaguca

SEQ ID NO: 260084 - RNA, 23 nt, Human
ugguggccgggguguggcucagg

SEQ ID NO: 260085 - RNA, 32 nt, Human
ugguggccgucuccacucccuaggcaaguucu

SEQ ID NO: 260086 - RNA, 32 nt, Human
ugguggccgucuggcugaccugggccaauggg

SEQ ID NO: 260087 - RNA, 32 nt, Human
ugguggccuagacuccccaguauccacucuuc

SEQ ID NO: 260088 - RNA, 21 nt, Human
ugguggccuagugacucaggg

SEQ ID NO: 260089 - RNA, 32 nt, Human
ugguggccucaggcugucuggagguguuugga

SEQ ID NO: 260090 - RNA, 32 nt, Human
ugguggccugaggccaggaggcugcagcugcu

SEQ ID NO: 260091 - RNA, 32 nt, Human
ugguggccugggaggcagggccugggcagggc

SEQ ID NO: 260092 - RNA, 32 nt, Human
ugguggccugggaucuggcacacucccucucc

SEQ ID NO: 260093 - RNA, 32 nt, Human
ugguggccugguccuguuggggugggggucuu

SEQ ID NO: 260094 - RNA, 32 nt, Human
ugguggccuguaaucccagcuacuugggaggc

SEQ ID NO: 260095 - RNA, 32 nt, Human
ugguggcgaggugggagcuggcagagcgcagg

SEQ ID NO: 260096 - RNA, 32 nt, Human
ugguggcgcacaccuauaaucucagcuacuca

SEQ ID NO: 260097 - RNA, 32 nt, Human
ugguggcgcuggcugcgcucggccugcucgcc

SEQ ID NO: 260098 - RNA, 32 nt, Human
ugguggcggacaccuguaaucccugcugcuug

SEQ ID NO: 260099 - RNA, 32 nt, Human
ugguggcgggugccugggaggcugaggcagga

SEQ ID NO: 260100 - RNA, 32 nt, Human
ugguggcggucaccuguaacccaagcuacuug

SEQ ID NO: 260101 - RNA, 32 nt, Human
ugguggcgugagccuguaguccuagcuacucg

SEQ ID NO: 260102 - RNA, 32 nt, Human
ugguggcgugagccugucgucccagcuacuca

SEQ ID NO: 260103 - RNA, 32 nt, Human
ugguggcuaaugaagugaggggagggagggau

SEQ ID NO: 260104 - RNA, 32 nt, Human
ugguggcuacuuuuggucugaaacccacuugg

SEQ ID NO: 260105 - RNA, 32 nt, Human
ugguggcucaaaugccuguaaucccaguacuu

SEQ ID NO: 260106 - RNA, 21 nt, Human
ugguggcucaagccuguaauc

SEQ ID NO: 260107 - RNA, 32 nt, Human
ugguggcucacacccauaaucccaacacuuug

SEQ ID NO: 260108 - RNA, 32 nt, Human
ugguggcucacaccuauaaccccagcacuuug

SEQ ID NO: 260109 - RNA, 32 nt, Human
ugguggcucacaccuauaaucccaacacuuuc

SEQ ID NO: 260110 - RNA, 21 nt, Human
ugguggcucacaccuguaauc

SEQ ID NO: 260111 - RNA, 32 nt, Human
ugguggcucacaccuguaaucacugcacucca

SEQ ID NO: 260112 - RNA, 32 nt, Human
ugguggcucacaccuguaaucccaacccuuug

SEQ ID NO: 260113 - RNA, 32 nt, Human
ugguggcucacaccugucauuccggccucaga

SEQ ID NO: 260114 - RNA, 21 nt, Human
ugguggcucacgccuguaauc

SEQ ID NO: 260115 - RNA, 21 nt, Human
ugguggcucacgccuguaguc

SEQ ID NO: 260116 - RNA, 21 nt, Human
ugguggcucaggccuguaauc

SEQ ID NO: 260117 - RNA, 18 nt, Human
ugguggcucauaccugua

SEQ ID NO: 260118 - RNA, 32 nt, Human
ugguggcucauaccuguaaaucccagcacuuu

SEQ ID NO: 260119 - RNA, 21 nt, Human
ugguggcucauaccuguaauc

SEQ ID NO: 260120 - RNA, 32 nt, Human
ugguggcucauaccuguaaucccagcacuuug

SEQ ID NO: 260121 - RNA, 32 nt, Human
ugguggcucauaccuguaauccuagcacucug

SEQ ID NO: 260122 - RNA, 32 nt, Human
ugguggcucauaccuguaaucucagcacugug

SEQ ID NO: 260123 - RNA, 32 nt, Human
ugguggcucauaccuguuaauuccagcacuuu

SEQ ID NO: 260124 - RNA, 21 nt, Human
ugguggcucaugccuauaauc

SEQ ID NO: 260125 - RNA, 18 nt, Human
ugguggcucaugccugua

SEQ ID NO: 260126 - RNA, 21 nt, Human
ugguggcucaugccuguaauc

SEQ ID NO: 260127 - RNA, 21 nt, Human
ugguggcucaugccuguaguc

SEQ ID NO: 260128 - RNA, 21 nt, Human
ugguggcucaugucuauaauc

SEQ ID NO: 260129 - RNA, 23 nt, Human
ugguggcugacaucagcguccau

SEQ ID NO: 260130 - RNA, 32 nt, Human
ugguggcugagccagcuccuugaggauguggc

SEQ ID NO: 260131 - RNA, 22 nt, Human
ugguggcugagguguucacggg

SEQ ID NO: 260132 - RNA, 32 nt, Human
ugguggcugauguggaggagacagccagcacc

SEQ ID NO: 260133 - RNA, 32 nt, Human
ugguggcugcacccugccuggccccuguaacc

SEQ ID NO: 260134 - RNA, 32 nt, Human
ugguggcugggaaacauagaggauggaggugu

SEQ ID NO: 260135 - RNA, 32 nt, Human
ugguggcuggggaagaggaacgggcagcuggg

SEQ ID NO: 260136 - RNA, 32 nt, Human
ugguggcuguagucgcagcuacucaggaggcu

SEQ ID NO: 260137 - RNA, 32 nt, Human
ugguggcugugucuucaugugaaagaaacuga

SEQ ID NO: 260138 - RNA, 21 nt, Human
ugguggcuuacgccuguaauc

SEQ ID NO: 260139 - RNA, 32 nt, Human
ugguggcuuaggccaucacccuucccuuggcu

SEQ ID NO: 260140 - RNA, 21 nt, Human
ugguggcuuaugccuguaauc

SEQ ID NO: 260141 - RNA, 32 nt, Human
ugguggcuuuaaucccagcacuuugggaaccc

SEQ ID NO: 260142 - RNA, 32 nt, Human
uggugggaaaacacagguaagagggcauccuu

SEQ ID NO: 260143 - RNA, 32 nt, Human
uggugggaagagugccuggaggcccagaaguu

SEQ ID NO: 260144 - RNA, 32 nt, Human
uggugggaagccaguuggccagcuggggugag

SEQ ID NO: 260145 - RNA, 19 nt, Human
uggugggaaguaauugggu

SEQ ID NO: 260146 - RNA, 32 nt, Human
uggugggaauggcugcuucauuccucgaggau

SEQ ID NO: 260147 - RNA, 32 nt, Human
uggugggaaugggguuucaaccacguuggcca

SEQ ID NO: 260148 - RNA, 32 nt, Human
uggugggaauguaaauuaguucaaccauugug

SEQ ID NO: 260149 - RNA, 22 nt, Human
uggugggacacaccgaaagggu

SEQ ID NO: 260150 - RNA, 32 nt, Human
uggugggaccagggcuccacagaggccacaaa

SEQ ID NO: 260151 - RNA, 20 nt, Human
uggugggacccaggguccuc

SEQ ID NO: 260152 - RNA, 32 nt, Human
uggugggacuuguaucuugucugccauaucag

SEQ ID NO: 260153 - RNA, 32 nt, Human
uggugggagagggagacagauggaggcagugg

SEQ ID NO: 260154 - RNA, 32 nt, Human
uggugggagagggagaccuagagaucuggcug

SEQ ID NO: 260155 - RNA, 32 nt, Human
uggugggagagggaguggagugcaguguggcu

SEQ ID NO: 260156 - RNA, 32 nt, Human
uggugggaggauuggagguuggugggauaggg

SEQ ID NO: 260157 - RNA, 32 nt, Human
uggugggaggcgaugggauuauggggcagagu

SEQ ID NO: 260158 - RNA, 32 nt, Human
uggugggagucuagggccgaagaaaaacagcu

SEQ ID NO: 260159 - RNA, 32 nt, Human
uggugggaugcugaggucggaggcuucgcuug

SEQ ID NO: 260160 - RNA, 32 nt, Human
uggugggcaaacauguuaccaaguuaaacgcc

SEQ ID NO: 260161 - RNA, 32 nt, Human
uggugggcaaagcagccaccccacagccuugu

SEQ ID NO: 260162 - RNA, 32 nt, Human
uggugggcacagaaguagcucuggugaccuug

SEQ ID NO: 260163 - RNA, 32 nt, Human
uggugggcacagugccuguugcccugggaaag

SEQ ID NO: 260164 - RNA, 32 nt, Human
uggugggcaggcagucggacgcucagcaggac

SEQ ID NO: 260165 - RNA, 32 nt, Human
uggugggcaggggagagagggaaaugccaaaa

SEQ ID NO: 260166 - RNA, 32 nt, Human
uggugggcauaaggagaauuugugccuauaac

SEQ ID NO: 260167 - RNA, 32 nt, Human
uggugggcaugcugggcaggcuugggggugac

SEQ ID NO: 260168 - RNA, 32 nt, Human
uggugggcaugggguggggagcagggaguugc

SEQ ID NO: 260169 - RNA, 32 nt, Human
uggugggccaggcuggggcucgaggucucucc

SEQ ID NO: 260170 - RNA, 32 nt, Human
uggugggccaguguccaagcagagcuugugaa

SEQ ID NO: 260171 - RNA, 32 nt, Human
uggugggcgccuguaaucccagcuacuuggga

SEQ ID NO: 260172 - RNA, 32 nt, Human
uggugggcgccuguaaucucagcuacuuggga

SEQ ID NO: 260173 - RNA, 32 nt, Human
uggugggcgccuguaauuccagcuacucagga

SEQ ID NO: 260174 - RNA, 32 nt, Human
uggugggcgccuguaauuccagcuacucaggg

SEQ ID NO: 260175 - RNA, 32 nt, Human
uggugggcgccuguaauuccagcuacucggga

SEQ ID NO: 260176 - RNA, 32 nt, Human
uggugggcgccuguaauuccagcuacucugga

SEQ ID NO: 260177 - RNA, 32 nt, Human
uggugggcggccugaggugagagcccgaccgg

SEQ ID NO: 260178 - RNA, 32 nt, Human
uggugggcugagcccaggucuagguuucugug

SEQ ID NO: 260179 - RNA, 19 nt, Human
uggugggcuucagaugagu

SEQ ID NO: 260180 - RNA, 32 nt, Human
ugguggggaaggggccaucuguggaagaaaca

SEQ ID NO: 260181 - RNA, 32 nt, Human
ugguggggacugcucccuaacuccaggagcca

SEQ ID NO: 260182 - RNA, 32 nt, Human
ugguggggagacaaggaggagcgagggauacu

SEQ ID NO: 260183 - RNA, 32 nt, Human
ugguggggagaccauggcucagaggaagggug

SEQ ID NO: 260184 - RNA, 32 nt, Human
ugguggggagagaaagaauacagugaguucuu

SEQ ID NO: 260185 - RNA, 32 nt, Human
ugguggggagcacagacacaggauaggacucc

SEQ ID NO: 260186 - RNA, 32 nt, Human
ugguggggagcugggccaggagagggacugac

SEQ ID NO: 260187 - RNA, 22 nt, Human
ugguggggaggccuucuggaca

SEQ ID NO: 260188 - RNA, 17 nt, Human
ugguggggagucugaga

SEQ ID NO: 260189 - RNA, 21 nt, Human
ugguggggcaaagggcuggac

SEQ ID NO: 260190 - RNA, 32 nt, Human
ugguggggcaggaacgguggaggcagagguga

SEQ ID NO: 260191 - RNA, 20 nt, Human
ugguggggcagugggagaua

SEQ ID NO: 260192 - RNA, 32 nt, Human
ugguggggcccauggaggagacaggaagccuc

SEQ ID NO: 260193 - RNA, 32 nt, Human
ugguggggccugcagucaugaauggcaagugg

SEQ ID NO: 260194 - RNA, 18 nt, Human
ugguggggcggccugaga

SEQ ID NO: 260195 - RNA, 21 nt, Human
ugguggggcucuacugcgaca

SEQ ID NO: 260196 - RNA, 21 nt, Human
ugguggggcugggcgguccca

SEQ ID NO: 260197 - RNA, 22 nt, Human
ugguggggcuucuucuguaaca

SEQ ID NO: 260198 - RNA, 30 nt, Human
ugguggggcuuuuccaugcuuuuccucucc

SEQ ID NO: 260199 - RNA, 32 nt, Human
uggugggggaaagagacuuagaggagagaggc

SEQ ID NO: 260200 - RNA, 32 nt, Human
uggugggggaaggggaggaggggaagaaggaa

SEQ ID NO: 260201 - RNA, 19 nt, Human
uggugggggccccuggaca

SEQ ID NO: 260202 - RNA, 21 nt, Human
ugguggggggcagggccacuc

SEQ ID NO: 260203 - RNA, 32 nt, Human
ugguggggguuucucauuguucuccggcccug

SEQ ID NO: 260204 - RNA, 32 nt, Human
ugguggggucaccagaugggagggugggaggc

SEQ ID NO: 260205 - RNA, 32 nt, Human
ugguggguccucagagagagugucuggcgcau

SEQ ID NO: 260206 - RNA, 32 nt, Human
uggugggugagcagugguaugaagaggggaca

SEQ ID NO: 260207 - RNA, 22 nt, Human
uggugggugccccucugggaca

SEQ ID NO: 260208 - RNA, 32 nt, Human
uggugggugccuguaaccucagcuacuuggga

SEQ ID NO: 260209 - RNA, 32 nt, Human
uggugggugccuguaaucccagauacucagga

SEQ ID NO: 260210 - RNA, 32 nt, Human
uggugggugccuguaaucccagcuacauggga

SEQ ID NO: 260211 - RNA, 32 nt, Human
uggugggugccuguaaucccagcuacucaaga

SEQ ID NO: 260212 - RNA, 32 nt, Human
uggugggugccuguaaucccagcuacucagga

SEQ ID NO: 260213 - RNA, 32 nt, Human
uggugggugccuguaaucccagcuacucggga

SEQ ID NO: 260214 - RNA, 32 nt, Human
uggugggugccuguaaucccagcuacuuggga

SEQ ID NO: 260215 - RNA, 32 nt, Human
uggugggugccuguaaucccagcuucuuagga

SEQ ID NO: 260216 - RNA, 32 nt, Human
uggugggugccuguaaucccaguuacuuggga

SEQ ID NO: 260217 - RNA, 32 nt, Human
uggugggugccuguaauccuagcuacuuggga

SEQ ID NO: 260218 - RNA, 32 nt, Human
uggugggugccuguaaucucagcuacucggga

SEQ ID NO: 260219 - RNA, 32 nt, Human
uggugggugccuguaauuccagccacucgaga

SEQ ID NO: 260220 - RNA, 32 nt, Human
uggugggugccuguagucccagcuacucggga

SEQ ID NO: 260221 - RNA, 32 nt, Human
uggugggugccuguagucccagcuacucugga

SEQ ID NO: 260222 - RNA, 32 nt, Human
uggugggugccuguagucccagcuacuuggga

SEQ ID NO: 260223 - RNA, 32 nt, Human
uggugggugccuguaguuccagcuacuuggga

SEQ ID NO: 260224 - RNA, 32 nt, Human
ugguggguggcagucggggcugacggcggcgg

SEQ ID NO: 260225 - RNA, 32 nt, Human
ugguggguggggugggugguuuuuguuuuugu

SEQ ID NO: 260226 - RNA, 32 nt, Human
ugguggguggguggugugaguggcaucuuggc

SEQ ID NO: 260227 - RNA, 32 nt, Human
ugguggguuagugguccucaggaugugauaaa

SEQ ID NO: 260228 - RNA, 32 nt, Human
uggugguaaauggaugugagggcaaguacauc

SEQ ID NO: 260229 - RNA, 32 nt, Human
uggugguaaggcuuucaccaguucucaggaug

SEQ ID NO: 260230 - RNA, 32 nt, Human
uggugguacccuccucccccagcccaucuguu

SEQ ID NO: 260231 - RNA, 32 nt, Human
uggugguagcagcagacaagggaggagaaaug

SEQ ID NO: 260232 - RNA, 32 nt, Human
uggugguagggcaggagagcaaacaaacaguc

SEQ ID NO: 260233 - RNA, 32 nt, Human
ugguggucagcccucagagcuguuucuaggca

SEQ ID NO: 260234 - RNA, 32 nt, Human
ugguggucaguaguucaagaccaggcuggcca

SEQ ID NO: 260235 - RNA, 32 nt, Human
uggugguccaggagagacugggcugaagggag

SEQ ID NO: 260236 - RNA, 32 nt, Human
uggugguccugcccuucucccugcaugccugu

SEQ ID NO: 260237 - RNA, 31 nt, Human
ugguggucgagaccuguucacggaugguggg

SEQ ID NO: 260238 - RNA, 32 nt, Human
ugguggucuccuuuguguaaaauaacaacaga

SEQ ID NO: 260239 - RNA, 32 nt, Human
ugguggucucucuuacaccagcuccugccuca

SEQ ID NO: 260240 - RNA, 32 nt, Human
ugguggucucugcuuuguuuucugucuugucu

SEQ ID NO: 260241 - RNA, 32 nt, Human
ugguggucugggaggaucacaggaugucaagg

SEQ ID NO: 260242 - RNA, 32 nt, Human
ugguggugaagauggcaguuccauuuccauau

SEQ ID NO: 260243 - RNA, 32 nt, Human
ugguggugaagauggccaagauccccguaucg

SEQ ID NO: 260244 - RNA, 32 nt, Human
ugguggugacucugcuuccugcacugacccag

SEQ ID NO: 260245 - RNA, 32 nt, Human
ugguggugagagcacacguccuugucuuguuc

SEQ ID NO: 260246 - RNA, 32 nt, Human
ugguggugcaccacuguaccccagguucuagu

SEQ ID NO: 260247 - RNA, 24 nt, Human
ugguggugcaugccuauaauccca

SEQ ID NO: 260248 - RNA, 24 nt, Human
ugguggugcaugccugugguccca

SEQ ID NO: 260249 - RNA, 24 nt, Human
ugguggugcgugccugugauccca

SEQ ID NO: 260250 - RNA, 24 nt, Human
ugguggugcgugccugugguccca

SEQ ID NO: 260251 - RNA, 32 nt, Human
ugguggugcuacccuuggccucccagaguccu

SEQ ID NO: 260252 - RNA, 32 nt, Human
ugguggugcuuccaacugcgggacaggaagug

SEQ ID NO: 260253 - RNA, 32 nt, Human
uggugguggacaggaaggacuugggaagggga

SEQ ID NO: 260254 - RNA, 32 nt, Human
uggugguggacagucccugaggcaagccauuu

SEQ ID NO: 260255 - RNA, 32 nt, Human
uggugguggcaguggaggaggcugaggaggcu

SEQ ID NO: 260256 - RNA, 32 nt, Human
uggugguggccuguaaucccagcuacuuggga

SEQ ID NO: 260257 - RNA, 20 nt, Human
uggugguggcugagacccca

SEQ ID NO: 260258 - RNA, 24 nt, Human
ugguggugggcaccugugauccca

SEQ ID NO: 260259 - RNA, 32 nt, Human
ugguggugggcacgccuguaaucccagcuacu

SEQ ID NO: 260260 - RNA, 32 nt, Human
ugguggugguauccaaaaucuucaguaacuag

SEQ ID NO: 260261 - RNA, 32 nt, Human
ugguggugguggccaggggcuguggggaggga

SEQ ID NO: 260262 - RNA, 32 nt, Human
ugguggugucugucagacacacacaggucgcc

SEQ ID NO: 260263 - RNA, 32 nt, Human
ugguggugugagugggaggcggcggcgcuggu

SEQ ID NO: 260264 - RNA, 32 nt, Human
ugguggugugcgcaccuguagucccagcuacu

SEQ ID NO: 260265 - RNA, 32 nt, Human
uggugguguggaauccugcaaaugaucacaaa

SEQ ID NO: 260266 - RNA, 32 nt, Human
uggugguguggaccccacugccugcuagggaa

SEQ ID NO: 260267 - RNA, 32 nt, Human
ugguggugugggcaccugugaugcaggagacu

SEQ ID NO: 260268 - RNA, 32 nt, Human
uggugguuauguuugacagaaggcauuagguu

SEQ ID NO: 260269 - RNA, 32 nt, Human
uggugguuauuucuaaauuuuugaggugcuuu

SEQ ID NO: 260270 - RNA, 32 nt, Human
uggugguucaaagguuggaaggcagugcagag

SEQ ID NO: 260271 - RNA, 21 nt, Human
uggugguucacgccuguaauc

SEQ ID NO: 260272 - RNA, 32 nt, Human
uggugguucagcuggagauaaaaagaagaauu

SEQ ID NO: 260273 - RNA, 21 nt, Human
uggugguucaugccuguaauc

SEQ ID NO: 260274 - RNA, 32 nt, Human
uggugguuccugccagccucaggccagggguu

SEQ ID NO: 260275 - RNA, 22 nt, Human
uggugguucgggggcggugcua

SEQ ID NO: 260276 - RNA, 22 nt, Human
uggugguucugccugcuugcug

SEQ ID NO: 260277 - RNA, 20 nt, Human
uggugguucuggcuggugug

SEQ ID NO: 260278 - RNA, 32 nt, Human
uggugguucuuaauuuuuaauuuaguuugggg

SEQ ID NO: 260279 - RNA, 32 nt, Human
uggugguugggaggggaauaggaaaggagcau

SEQ ID NO: 260280 - RNA, 32 nt, Human
uggugguuguaguguuagagguguuagcuugc

SEQ ID NO: 260281 - RNA, 32 nt, Human
uggugguuguggugggggaauguggauggggg

SEQ ID NO: 260282 - RNA, 22 nt, Human
uggugguuucagggggcuguug

SEQ ID NO: 260283 - RNA, 32 nt, Human
uggugguuucugucuccuccucccgcugaaca

SEQ ID NO: 260284 - RNA, 32 nt, Human
uggugguuuggcuucuguucuuauucuugagu

SEQ ID NO: 260285 - RNA, 23 nt, Human
uggugguuuuggccccuuugcug

SEQ ID NO: 260286 - RNA, 32 nt, Human
ugguguaaaaguguuuacagaaacaucuuugu

SEQ ID NO: 260287 - RNA, 32 nt, Human
ugguguaagcaaccuguggccugcacuugugg

SEQ ID NO: 260288 - RNA, 32 nt, Human
ugguguaagggagggagggguagggacagaag

SEQ ID NO: 260289 - RNA, 32 nt, Human
ugguguaauucucguguccaagaaggaagcug

SEQ ID NO: 260290 - RNA, 32 nt, Human
ugguguacagauuauuucaucacucaggugau

SEQ ID NO: 260291 - RNA, 24 nt, Human
ugguguaccccuguaaucccagcu

SEQ ID NO: 260292 - RNA, 32 nt, Human
ugguguacgccuguaaucccagugacuuggga

SEQ ID NO: 260293 - RNA, 32 nt, Human
ugguguagcaugcaaggaagcagaagaccugg

SEQ ID NO: 260294 - RNA, 32 nt, Human
ugguguagggcugaguacugaauggucuucca

SEQ ID NO: 260295 - RNA, 32 nt, Human
ugguguagugcacaccuguaaucccagguacu

SEQ ID NO: 260296 - RNA, 32 nt, Human
ugguguaugccuguaaucccagcuacucggga

SEQ ID NO: 260297 - RNA, 32 nt, Human
ugguguaugccuguagucccagccacucagaa

SEQ ID NO: 260298 - RNA, 32 nt, Human
ugguguaugccuguagucccugcuacuuggga

SEQ ID NO: 260299 - RNA, 32 nt, Human
ugguguauuuugcacagacaagcaucugccuu

SEQ ID NO: 260300 - RNA, 32 nt, Human
uggugucaaagacauucacuauguuuuuaugg

SEQ ID NO: 260301 - RNA, 32 nt, Human
uggugucaaaguuucaggaaggauuuuacccu

SEQ ID NO: 260302 - RNA, 32 nt, Human
uggugucaaccauucuggcucuucuguauuua

SEQ ID NO: 260303 - RNA, 32 nt, Human
uggugucaagagggagguggaggcaggcacug

SEQ ID NO: 260304 - RNA, 32 nt, Human
uggugucaaucagcuagcaagugauggagccc

SEQ ID NO: 260305 - RNA, 31 nt, Human
uggugucacagcuuacaaaaguaucuugauc

SEQ ID NO: 260306 - RNA, 32 nt, Human
uggugucacaugcccacagcagccucggugac

SEQ ID NO: 260307 - RNA, 32 nt, Human
uggugucaccauccacgaagcugcugucucug

SEQ ID NO: 260308 - RNA, 32 nt, Human
uggugucacccaggcuggagugcaguggugug

SEQ ID NO: 260309 - RNA, 32 nt, Human
uggugucacccuggauaggcaagggauaacuc

SEQ ID NO: 260310 - RNA, 32 nt, Human
uggugucagagaccagggugugcagucugagc

SEQ ID NO: 260311 - RNA, 32 nt, Human
uggugucagcaagcacugucgacuucuuccuc

SEQ ID NO: 260312 - RNA, 32 nt, Human
uggugucagcuacucgggaggcugaggcagga

SEQ ID NO: 260313 - RNA, 32 nt, Human
uggugucaggcagguuugccagugaagacuuc

SEQ ID NO: 260314 - RNA, 32 nt, Human
uggugucagucuuuucugucucagccuuucaa

SEQ ID NO: 260315 - RNA, 32 nt, Human
uggugucauucuccagaaccagguguggauug

SEQ ID NO: 260316 - RNA, 32 nt, Human
ugguguccacccacauugagggugggucugcc

SEQ ID NO: 260317 - RNA, 32 nt, Human
uggugucccgcgugaggcacacugugaaggau

SEQ ID NO: 260318 - RNA, 32 nt, Human
ugguguccuaaagggggcugcagcaggggugu

SEQ ID NO: 260319 - RNA, 32 nt, Human
ugguguccuccaggccugggugggcggguuac

SEQ ID NO: 260320 - RNA, 32 nt, Human
ugguguccucuaguggaagaaauaguagcucc

SEQ ID NO: 260321 - RNA, 32 nt, Human
ugguguccugggacccagagcaacaggaucug

SEQ ID NO: 260322 - RNA, 32 nt, Human
ugguguccugggccugggaaacuagguuccca

SEQ ID NO: 260323 - RNA, 32 nt, Human
uggugucgccucucacacuuugcagucauuua

SEQ ID NO: 260324 - RNA, 32 nt, Human
uggugucucaaagaaggguagaaguucuaaug

SEQ ID NO: 260325 - RNA, 32 nt, Human
uggugucuccaaugaacuuguuuccugguuuu

SEQ ID NO: 260326 - RNA, 32 nt, Human
uggugucuccaccacugucccuucuccccgcu

SEQ ID NO: 260327 - RNA, 32 nt, Human
uggugucucugccaggcuccucaggcccagac

SEQ ID NO: 260328 - RNA, 32 nt, Human
uggugucucuuugaaagauuuugggaagauuu

SEQ ID NO: 260329 - RNA, 32 nt, Human
uggugucugaaauugaauaugcugugaaacug

SEQ ID NO: 260330 - RNA, 32 nt, Human
uggugucugaggcccaggcugaggccuccgcu

SEQ ID NO: 260331 - RNA, 32 nt, Human
uggugucugagggcccaggccuugccagccuc

SEQ ID NO: 260332 - RNA, 32 nt, Human
uggugucugcaccuccuuucccucucuccauc

SEQ ID NO: 260333 - RNA, 32 nt, Human
uggugucugcugucacugugcccucauuggcc

SEQ ID NO: 260334 - RNA, 32 nt, Human
uggugucugggcuguuuuugaaaaaguuucca

SEQ ID NO: 260335 - RNA, 32 nt, Human
uggugucuggggacagggagggaugggguccc

SEQ ID NO: 260336 - RNA, 32 nt, Human
uggugucuguaaucccagcugugggagguuga

SEQ ID NO: 260337 - RNA, 32 nt, Human
uggugucuuaugcuaaacgguggaauguauag

SEQ ID NO: 260338 - RNA, 32 nt, Human
uggugucuucuuucuccaacucuuggugggaa

SEQ ID NO: 260339 - RNA, 32 nt, Human
uggugucuugcuccacccuccuggcgagggga

SEQ ID NO: 260340 - RNA, 32 nt, Human
uggugucuuuuggggaaaauguuaugcaugga

SEQ ID NO: 260341 - RNA, 32 nt, Human
uggugugaaacaugaggccaaauaaauaagug

SEQ ID NO: 260342 - RNA, 32 nt, Human
uggugugaaagaucuaaaagcuguuucauuuu

SEQ ID NO: 260343 - RNA, 32 nt, Human
uggugugaacccaggaggcacagcuugcagug

SEQ ID NO: 260344 - RNA, 32 nt, Human
uggugugaacccaggaggcagagcuugcagug

SEQ ID NO: 260345 - RNA, 32 nt, Human
uggugugaacccaggaggcggagcuugcagug

SEQ ID NO: 260346 - RNA, 32 nt, Human
uggugugaacccaggaggcggugcuugcaggg

SEQ ID NO: 260347 - RNA, 32 nt, Human
uggugugacaccuucugccaccaucuccugcc

SEQ ID NO: 260348 - RNA, 32 nt, Human
uggugugacacuuuggagcaaaaaccuugcag

SEQ ID NO: 260349 - RNA, 32 nt, Human
uggugugagagggugaaggcggcgcuggaggc

SEQ ID NO: 260350 - RNA, 32 nt, Human
uggugugagauccucuuuacucugggcagaag

SEQ ID NO: 260351 - RNA, 32 nt, Human
uggugugagccccaccgcugugcaucgaauga

SEQ ID NO: 260352 - RNA, 32 nt, Human
uggugugaggacuucucagacaaaggcaaggc

SEQ ID NO: 260353 - RNA, 32 nt, Human
uggugugaguuccucuggugggagggagaacg

SEQ ID NO: 260354 - RNA, 32 nt, Human
uggugugaucacagcucacugcagccucaacc

SEQ ID NO: 260355 - RNA, 32 nt, Human
uggugugaucacagcucacugcagccucgacc

SEQ ID NO: 260356 - RNA, 32 nt, Human
uggugugaucacagcucacugcagccucgacu

SEQ ID NO: 260357 - RNA, 32 nt, Human
uggugugaucacagcucacugcagccuugacc

SEQ ID NO: 260358 - RNA, 32 nt, Human
uggugugaucacagcucauugcagccuccacu

SEQ ID NO: 260359 - RNA, 32 nt, Human
uggugugaucacggcucacugcagccuugacg

SEQ ID NO: 260360 - RNA, 32 nt, Human
uggugugaucauagcucacugcagccuggaau

SEQ ID NO: 260361 - RNA, 32 nt, Human
uggugugaucauagcucacugcagcuuugacu

SEQ ID NO: 260362 - RNA, 32 nt, Human
uggugugaucauagcucacugcauccuccagu

SEQ ID NO: 260363 - RNA, 32 nt, Human
uggugugaucauagcucacuggagccucuaau

SEQ ID NO: 260364 - RNA, 32 nt, Human
uggugugaucauagcucacuguaacuucgacc

SEQ ID NO: 260365 - RNA, 32 nt, Human
uggugugaucauaguucacuguauucucaacc

SEQ ID NO: 260366 - RNA, 32 nt, Human
uggugugaucauggcucacugcagccccaacc

SEQ ID NO: 260367 - RNA, 32 nt, Human
uggugugaucauggcucacugcagccucgacc

SEQ ID NO: 260368 - RNA, 32 nt, Human
uggugugaucaugguucacugcagucuugacc

SEQ ID NO: 260369 - RNA, 32 nt, Human
uggugugaucccagcucacugcagccucgacc

SEQ ID NO: 260370 - RNA, 32 nt, Human
uggugugaucucagcucacugcagccuccaac

SEQ ID NO: 260371 - RNA, 32 nt, Human
uggugugaucucagcucacugcagccucuguc

SEQ ID NO: 260372 - RNA, 32 nt, Human
uggugugauugcacuccagcccaggggacaau

SEQ ID NO: 260373 - RNA, 21 nt, Human
uggugugcaccuguaauccca

SEQ ID NO: 260374 - RNA, 21 nt, Human
uggugugcaccuguaauucca

SEQ ID NO: 260375 - RNA, 21 nt, Human
uggugugcaccuguaguccca

SEQ ID NO: 260376 - RNA, 21 nt, Human
uggugugcacuuguaauccca

SEQ ID NO: 260377 - RNA, 32 nt, Human
uggugugcagagccacaugaagccugcugggg

SEQ ID NO: 260378 - RNA, 32 nt, Human
uggugugcagccuggccaacauggugaaaccu

SEQ ID NO: 260379 - RNA, 32 nt, Human
uggugugcagugauacaaucuuggcucacugc

SEQ ID NO: 260380 - RNA, 32 nt, Human
uggugugcaguggcgugaucuuggcucacagc

SEQ ID NO: 260381 - RNA, 32 nt, Human
uggugugcaguggugugaucuuggcucgcugc

SEQ ID NO: 260382 - RNA, 21 nt, Human
uggugugcaucuguaauccca

SEQ ID NO: 260383 - RNA, 32 nt, Human
uggugugcaugcugggcugccuggcaaaucug

SEQ ID NO: 260384 - RNA, 21 nt, Human
uggugugccccuguaauccca

SEQ ID NO: 260385 - RNA, 24 nt, Human
uggugugccccuguaaucccagcu

SEQ ID NO: 260386 - RNA, 32 nt, Human
uggugugccugcucccagccucuugcucagag

SEQ ID NO: 260387 - RNA, 32 nt, Human
uggugugccuguagucccagcuacuugggagg

SEQ ID NO: 260388 - RNA, 21 nt, Human
uggugugcgcauguaauccca

SEQ ID NO: 260389 - RNA, 21 nt, Human
uggugugcgccuauaauccca

SEQ ID NO: 260390 - RNA, 21 nt, Human
uggugugcgccuguaauccca

SEQ ID NO: 260391 - RNA, 32 nt, Human
uggugugcgccuguaaucccagcuacuuggga

SEQ ID NO: 260392 - RNA, 32 nt, Human
uggugugcgccuguaauuccagcuacucggga

SEQ ID NO: 260393 - RNA, 21 nt, Human
uggugugcgucuguaauccca

SEQ ID NO: 260394 - RNA, 32 nt, Human
uggugugcguguguauguauguguauguauau

SEQ ID NO: 260395 - RNA, 32 nt, Human
uggugugcugcaagccacaaaagauguuuuga

SEQ ID NO: 260396 - RNA, 32 nt, Human
ugguguggaagaggagcucaagaggcuggaau

SEQ ID NO: 260397 - RNA, 32 nt, Human
ugguguggacagugguggagcucggaugugcu

SEQ ID NO: 260398 - RNA, 32 nt, Human
ugguguggagcuuucugccuuguaggugggcg

SEQ ID NO: 260399 - RNA, 24 nt, Human
ugguguggaguuggggcugccaua

SEQ ID NO: 260400 - RNA, 32 nt, Human
ugguguggcagccaucucuccucccagggguc

SEQ ID NO: 260401 - RNA, 32 nt, Human
ugguguggccugcugcuuccaggcugcaaacc

SEQ ID NO: 260402 - RNA, 32 nt, Human
ugguguggcgcaugccuauaaucccagcuacu

SEQ ID NO: 260403 - RNA, 32 nt, Human
ugguguggcuauagucugagcuacucaggagg

SEQ ID NO: 260404 - RNA, 32 nt, Human
ugguguggcugcagccaacacaaagggugauc

SEQ ID NO: 260405 - RNA, 32 nt, Human
ugguguggcuguaggggaggggagaccacacc

SEQ ID NO: 260406 - RNA, 32 nt, Human
uggugugggaagaagccagggguaagaagaua

SEQ ID NO: 260407 - RNA, 32 nt, Human
uggugugggaggcagaggugcugacguucugg

SEQ ID NO: 260408 - RNA, 32 nt, Human
uggugugggaggcgauggggguuggguggugg

SEQ ID NO: 260409 - RNA, 32 nt, Human
ugguguggggccugggcugccaggaaccucau

SEQ ID NO: 260410 - RNA, 32 nt, Human
uggugugggguuuugcuuugguuuuuaauuau

SEQ ID NO: 260411 - RNA, 32 nt, Human
ugguguggguaguuuagaaaaugaguuagguu

SEQ ID NO: 260412 - RNA, 32 nt, Human
uggugugggugacacggugauggccacaguca

SEQ ID NO: 260413 - RNA, 32 nt, Human
ugguguggugcugcucccucaccuccaaaaga

SEQ ID NO: 260414 - RNA, 32 nt, Human
uggugugguggaagaggggaugagggaaagaa

SEQ ID NO: 260415 - RNA, 32 nt, Human
uggugugguggaggaggauaaaaagggccacc

SEQ ID NO: 260416 - RNA, 32 nt, Human
ugguguggugggcaccuguagugccagcuacu

SEQ ID NO: 260417 - RNA, 32 nt, Human
ugguguggugucugcacaaggagugccuucuc

SEQ ID NO: 260418 - RNA, 32 nt, Human
uggugugguuaucuugggucauuuggauguuu

SEQ ID NO: 260419 - RNA, 21 nt, Human
ugguguguaccuguaguccca

SEQ ID NO: 260420 - RNA, 32 nt, Human
uggugugucacugcauccauugccaccuccug

SEQ ID NO: 260421 - RNA, 32 nt, Human
uggugugucuccucucccucccucccucuucu

SEQ ID NO: 260422 - RNA, 32 nt, Human
uggugugugauggacauggaagcagugguguc

SEQ ID NO: 260423 - RNA, 32 nt, Human
uggugugugauggacauggaugcagugguguc

SEQ ID NO: 260424 - RNA, 21 nt, Human
uggugugugccuauaauccca

SEQ ID NO: 260425 - RNA, 21 nt, Human
uggugugugccuguaauccca

SEQ ID NO: 260426 - RNA, 32 nt, Human
uggugugugccuguaaucccggcuacuuggga

SEQ ID NO: 260427 - RNA, 21 nt, Human
uggugugugccuguaaugcca

SEQ ID NO: 260428 - RNA, 32 nt, Human
uggugugugccuguaauuccagcuacucggga

SEQ ID NO: 260429 - RNA, 21 nt, Human
uggugugugccuguaguccca

SEQ ID NO: 260430 - RNA, 32 nt, Human
uggugugugccuguagucccagcuacuuguga

SEQ ID NO: 260431 - RNA, 32 nt, Human
uggugugugccuguaguccuagcugcuuggga

SEQ ID NO: 260432 - RNA, 32 nt, Human
uggugugugccuguagucucagcuacuuggga

SEQ ID NO: 260433 - RNA, 32 nt, Human
uggugugugccuguaguuccagcuacucagga

SEQ ID NO: 260434 - RNA, 32 nt, Human
uggugugugccuguauucacagcugcuuggau

SEQ ID NO: 260435 - RNA, 32 nt, Human
uggugugugccuguauuccuagcuacuuugau

SEQ ID NO: 260436 - RNA, 32 nt, Human
uggugugugcgagucuggcacuguucccgcug

SEQ ID NO: 260437 - RNA, 21 nt, Human
uggugugugcuuguaauccca

SEQ ID NO: 260438 - RNA, 32 nt, Human
ugguguguggcagaaaggucugaacagagcug

SEQ ID NO: 260439 - RNA, 32 nt, Human
uggugugugguuugacucugcuuuucuuccgg

SEQ ID NO: 260440 - RNA, 21 nt, Human
uggugugugucuguaauccca

SEQ ID NO: 260441 - RNA, 32 nt, Human
ugguguguuucuuugcuggucacacccaugau

SEQ ID NO: 260442 - RNA, 32 nt, Human
ugguguuaacugggaauauuaaagcauucuaa

SEQ ID NO: 260443 - RNA, 32 nt, Human
ugguguuagagaaacaucaaaugccauauuuu

SEQ ID NO: 260444 - RNA, 32 nt, Human
ugguguuagugaugcuggagaagagaauauua

SEQ ID NO: 260445 - RNA, 32 nt, Human
ugguguuaguguuuuguagcuaaugguucccu

SEQ ID NO: 260446 - RNA, 32 nt, Human
ugguguuaugaggaagaauaaaggggauaaaa

SEQ ID NO: 260447 - RNA, 32 nt, Human
ugguguuauuccauuugcuauuuaaagaaacc

SEQ ID NO: 260448 - RNA, 32 nt, Human
ugguguucaccaacgugggagacuucaccgga

SEQ ID NO: 260449 - RNA, 32 nt, Human
ugguguucaccagccuguaucuugucugagac

SEQ ID NO: 260450 - RNA, 32 nt, Human
ugguguucauuuccaucaugucuacauauucc

SEQ ID NO: 260451 - RNA, 32 nt, Human
ugguguuccacuguccagcccagcaugaguag

SEQ ID NO: 260452 - RNA, 32 nt, Human
ugguguuccugggcucugcacacagcaggagc

SEQ ID NO: 260453 - RNA, 32 nt, Human
ugguguucgagguggagguuaggcgggugaag

SEQ ID NO: 260454 - RNA, 32 nt, Human
ugguguucucccaucucugccucuggcacccu

SEQ ID NO: 260455 - RNA, 32 nt, Human
ugguguucuccucuuguugauguugaaauggu

SEQ ID NO: 260456 - RNA, 32 nt, Human
ugguguucucuuugauuguagguccuuagacu

SEQ ID NO: 260457 - RNA, 32 nt, Human
ugguguucuggcuguggcccugccuuagacug

SEQ ID NO: 260458 - RNA, 32 nt, Human
ugguguugagaagaaucaggagagggauacaa

SEQ ID NO: 260459 - RNA, 32 nt, Human
ugguguugcccaggcagagagggcagugugga

SEQ ID NO: 260460 - RNA, 32 nt, Human
ugguguugcuuccaaucuguugcugcuagauu

SEQ ID NO: 260461 - RNA, 32 nt, Human
ugguguugcuuccacccugcagcaggugggau

SEQ ID NO: 260462 - RNA, 32 nt, Human
ugguguuggaggccacuggguaacaacagaag

SEQ ID NO: 260463 - RNA, 32 nt, Human
ugguguuggccaaacucuuugccauuucacug

SEQ ID NO: 260464 - RNA, 32 nt, Human
ugguguuggcggucuggcucagcugggcaggg

SEQ ID NO: 260465 - RNA, 32 nt, Human
ugguguuuagagacuguaaaugcauauucaca

SEQ ID NO: 260466 - RNA, 32 nt, Human
ugguguuuguuaauguaaacauucagugaagg

SEQ ID NO: 260467 - RNA, 32 nt, Human
ugguguuuguuuuuagaaguuuugccaguccu

SEQ ID NO: 260468 - RNA, 32 nt, Human
ugguguuuucccaaggcucccuucccaagcuc

SEQ ID NO: 260469 - RNA, 32 nt, Human
ugguguuuuggggaugagagggugcuauccau

SEQ ID NO: 260470 - RNA, 32 nt, Human
ugguuaaacuaaauggaaccaugugcuaauuu

SEQ ID NO: 260471 - RNA, 32 nt, Human
ugguuaacacgcugaaaucccaucucuacaaa

SEQ ID NO: 260472 - RNA, 32 nt, Human
ugguuaacauggugaaacaccaucucuaguaa

SEQ ID NO: 260473 - RNA, 32 nt, Human
ugguuaacccuguaagaaaacuuauucuacau

SEQ ID NO: 260474 - RNA, 32 nt, Human
ugguuaagaaaauuauuuugcuuucaguguaa

SEQ ID NO: 260475 - RNA, 32 nt, Human
ugguuaaugaugguuaaugauaaccauuaaua

SEQ ID NO: 260476 - RNA, 32 nt, Human
ugguuaauggaaagcacugugcucugaagugg

SEQ ID NO: 260477 - RNA, 32 nt, Human
ugguuaauggaaaggaaaaauguugaacagau

SEQ ID NO: 260478 - RNA, 32 nt, Human
ugguuaauguauauuuuuauucuggcuuuuaa

SEQ ID NO: 260479 - RNA, 32 nt, Human
ugguuaauuccugccuuccucccuuuucccag

SEQ ID NO: 260480 - RNA, 32 nt, Human
ugguuacacagaacauugguuuccaauucagu

SEQ ID NO: 260481 - RNA, 32 nt, Human
ugguuacacagaacauugguuuccaauuuagu

SEQ ID NO: 260482 - RNA, 32 nt, Human
ugguuacaucucugccaugcaggccuggccuu

SEQ ID NO: 260483 - RNA, 20 nt, Human
ugguuaccacucaccugggg

SEQ ID NO: 260484 - RNA, 32 nt, Human
ugguuaccacuggaugagaaauucaguggugc

SEQ ID NO: 260485 - RNA, 32 nt, Human
ugguuaccauuuucuuuuugucauuggcuuag

SEQ ID NO: 260486 - RNA, 32 nt, Human
ugguuaccccucuucccuuguuaucuaagcuu

SEQ ID NO: 260487 - RNA, 32 nt, Human
ugguuaccuaguuuuauucacuuaauugugca

SEQ ID NO: 260488 - RNA, 21 nt, Human
ugguuaccuccccuuccucca

SEQ ID NO: 260489 - RNA, 32 nt, Human
ugguuacgaggaaauuguggauauuaaggaag

SEQ ID NO: 260490 - RNA, 32 nt, Human
ugguuacgcugcggggaucuguuucuuugccu

SEQ ID NO: 260491 - RNA, 32 nt, Human
ugguuacgugugagccaacaucacguuuuguu

SEQ ID NO: 260492 - RNA, 32 nt, Human
ugguuacuccacugccaugugacugaccacau

SEQ ID NO: 260493 - RNA, 32 nt, Human
ugguuacugauggggaagugggaggcauaagg

SEQ ID NO: 260494 - RNA, 32 nt, Human
ugguuacugccuggccgauccaaggcugugga

SEQ ID NO: 260495 - RNA, 32 nt, Human
ugguuacugcucacuuacuagucccaauuguu

SEQ ID NO: 260496 - RNA, 32 nt, Human
ugguuacuucaagggcagccagcaggccugga

SEQ ID NO: 260497 - RNA, 32 nt, Human
ugguuacuucuuucuucugccucgacucacau

SEQ ID NO: 260498 - RNA, 32 nt, Human
ugguuacuugcagccugaaguaccguaacugc

SEQ ID NO: 260499 - RNA, 32 nt, Human
ugguuagaaaugcaacaucaggcugagcaugu

SEQ ID NO: 260500 - RNA, 32 nt, Human
ugguuagaaaugcagaauccuaggcuccaccc

SEQ ID NO: 260501 - RNA, 32 nt, Human
ugguuagaguccugauuuuacugcaaaggugu

SEQ ID NO: 260502 - RNA, 18 nt, Human
ugguuagaucucagcaga

SEQ ID NO: 260503 - RNA, 32 nt, Human
ugguuagaugaugaauaaaaagguucugaaga

SEQ ID NO: 260504 - RNA, 32 nt, Human
ugguuagcacagagcucacccaccuugccugg

SEQ ID NO: 260505 - RNA, 32 nt, Human
ugguuaggaaagcccagggggaagggaggggg

SEQ ID NO: 260506 - RNA, 32 nt, Human
ugguuaggcacagauuuuuggaauccuuucag

SEQ ID NO: 260507 - RNA, 32 nt, Human
ugguuaguugcagaagauacauuggcucuaag

SEQ ID NO: 260508 - RNA, 32 nt, Human
ugguuaguuugggaaaaauaagaugguuaaau

SEQ ID NO: 260509 - RNA, 32 nt, Human
ugguuauacaaaccauauacaucugguuacca

SEQ ID NO: 260510 - RNA, 32 nt, Human
ugguuauacucauggcacgauggccaacuuuc

SEQ ID NO: 260511 - RNA, 32 nt, Human
ugguuaucaccucagugaaucuucccagggcu

SEQ ID NO: 260512 - RNA, 32 nt, Human
ugguuaucgaggcagagacuguaggaauaaug

SEQ ID NO: 260513 - RNA, 32 nt, Human
ugguuaucuccaggaaaaccucauuuagaugg

SEQ ID NO: 260514 - RNA, 32 nt, Human
ugguuaucugugcacauuuccacuugcaccau

SEQ ID NO: 260515 - RNA, 32 nt, Human
ugguuaugauuugugucuuaucagggaaaagg

SEQ ID NO: 260516 - RNA, 32 nt, Human
ugguuauucuacugccucuaggccaggguagu

SEQ ID NO: 260517 - RNA, 32 nt, Human
ugguuauugcccauccugggcauuaaacuugg

SEQ ID NO: 260518 - RNA, 32 nt, Human
ugguuauuucaagaagagagugugagauugca

SEQ ID NO: 260519 - RNA, 32 nt, Human
ugguuauuucuagcccacuccgaacaaugagu

SEQ ID NO: 260520 - RNA, 32 nt, Human
ugguucaaagucuuugcuauugugaauaaugc

SEQ ID NO: 260521 - RNA, 20 nt, Human
ugguucaaccauuguggaag

SEQ ID NO: 260522 - RNA, 32 nt, Human
ugguucaauaaugaaugaaaauucugggugua

SEQ ID NO: 260523 - RNA, 32 nt, Human
ugguucacaccuguaauccaagcacuuuggga

SEQ ID NO: 260524 - RNA, 20 nt, Human
ugguucacaccuguaauccc

SEQ ID NO: 260525 - RNA, 21 nt, Human
ugguucacaccuguaauccca

SEQ ID NO: 260526 - RNA, 32 nt, Human
ugguucacaccuguaaucccagcacuuuggga

SEQ ID NO: 260527 - RNA, 32 nt, Human
ugguucacaccuguaauugcagcacuuuggga

SEQ ID NO: 260528 - RNA, 24 nt, Human
ugguucaccacaauuuuuuaagaa

SEQ ID NO: 260529 - RNA, 32 nt, Human
ugguucacgccuggaaucccagcacuugaggc

SEQ ID NO: 260530 - RNA, 21 nt, Human
ugguucacgccuguaauccca

SEQ ID NO: 260531 - RNA, 32 nt, Human
ugguucacgccuguaaucccagcacuuuggga

SEQ ID NO: 260532 - RNA, 32 nt, Human
ugguucacgccuguaaucccagcacuuugggg

SEQ ID NO: 260533 - RNA, 32 nt, Human
ugguucacgccuguaaugccagcacuuuggga

SEQ ID NO: 260534 - RNA, 32 nt, Human
ugguucacgccuguaauuccagcacuuugaga

SEQ ID NO: 260535 - RNA, 32 nt, Human
ugguucacuacaguugacauccuggcugacaa

SEQ ID NO: 260536 - RNA, 32 nt, Human
ugguucacucuuccuacccucucccuccuaac

SEQ ID NO: 260537 - RNA, 32 nt, Human
ugguucacugcaaccuccaccuccaggguuca

SEQ ID NO: 260538 - RNA, 32 nt, Human
ugguucacugcaaccuccaccucccagguuca

SEQ ID NO: 260539 - RNA, 32 nt, Human
ugguucacugcaaccuccaccucuuggguuca

SEQ ID NO: 260540 - RNA, 32 nt, Human
ugguucacugcaaccuccgcauccgggguuca

SEQ ID NO: 260541 - RNA, 32 nt, Human
ugguucacugcaaccuccgccuccuggauuca

SEQ ID NO: 260542 - RNA, 32 nt, Human
ugguucacugcaaccucugccucccagguuca

SEQ ID NO: 260543 - RNA, 32 nt, Human
ugguucacugcaaccucugccucccggguuca

SEQ ID NO: 260544 - RNA, 32 nt, Human
ugguucacugcaagcuccaccucccggguuca

SEQ ID NO: 260545 - RNA, 32 nt, Human
ugguucacugcaaucucgacuuccaguuucag

SEQ ID NO: 260546 - RNA, 32 nt, Human
ugguucacugcacccucugccucccagguuca

SEQ ID NO: 260547 - RNA, 32 nt, Human
ugguucacugcagacuccaccucuccaggcuc

SEQ ID NO: 260548 - RNA, 32 nt, Human
ugguucacugcagccucgaccucccaggcuca

SEQ ID NO: 260549 - RNA, 32 nt, Human
ugguucacugcagccuugaccuccagggcuca

SEQ ID NO: 260550 - RNA, 32 nt, Human
ugguucacugcagucuugaccucccaggcuua

SEQ ID NO: 260551 - RNA, 32 nt, Human
ugguucagagcccugugucugucagucagucu

SEQ ID NO: 260552 - RNA, 32 nt, Human
ugguucagccccuucuccaaccccuucauaag

SEQ ID NO: 260553 - RNA, 21 nt, Human
ugguucaggccuguaauucca

SEQ ID NO: 260554 - RNA, 32 nt, Human
ugguucaggccuguaauuccagcacuuuggga

SEQ ID NO: 260555 - RNA, 32 nt, Human
ugguucagguuccugacugggccagcgaguga

SEQ ID NO: 260556 - RNA, 23 nt, Human
ugguucaguauucauugaucuca

SEQ ID NO: 260557 - RNA, 32 nt, Human
ugguucagugaucuuggagugaugaugguaac

SEQ ID NO: 260558 - RNA, 17 nt, Human
ugguucagugucuccug

SEQ ID NO: 260559 - RNA, 32 nt, Human
ugguucaguguugcaagagucugggcuugggg

SEQ ID NO: 260560 - RNA, 32 nt, Human
ugguucaguucccuuguccugaucucauccuc

SEQ ID NO: 260561 - RNA, 32 nt, Human
ugguucauccuucccccucucucccucccugc

SEQ ID NO: 260562 - RNA, 32 nt, Human
ugguucaucugaaggcuggauuccauuugaag

SEQ ID NO: 260563 - RNA, 32 nt, Human
ugguucaucuguggguguucagggaggugugg

SEQ ID NO: 260564 - RNA, 32 nt, Human
ugguucaucuucuguacucugucaguuuucug

SEQ ID NO: 260565 - RNA, 32 nt, Human
ugguucaugccaguaaucccagcacuuucgga

SEQ ID NO: 260566 - RNA, 21 nt, Human
ugguucaugccuauaauccca

SEQ ID NO: 260567 - RNA, 32 nt, Human
ugguucaugccuauaaucccagcacuuuggga

SEQ ID NO: 260568 - RNA, 23 nt, Human
ugguucaugccuauaaucccagu

SEQ ID NO: 260569 - RNA, 21 nt, Human
ugguucaugccuauaaucuca

SEQ ID NO: 260570 - RNA, 21 nt, Human
ugguucaugccuauaauucca

SEQ ID NO: 260571 - RNA, 21 nt, Human
ugguucaugccuaucauccca

SEQ ID NO: 260572 - RNA, 32 nt, Human
ugguucaugccuaucaucccagcacuuuggga

SEQ ID NO: 260573 - RNA, 32 nt, Human
ugguucaugccuggaaucccagcacuuuggga

SEQ ID NO: 260574 - RNA, 32 nt, Human
ugguucaugccuggaauccuagcacuuuggga

SEQ ID NO: 260575 - RNA, 32 nt, Human
ugguucaugccuguaauccagcacuuugggag

SEQ ID NO: 260576 - RNA, 21 nt, Human
ugguucaugccuguaauccca

SEQ ID NO: 260577 - RNA, 32 nt, Human
ugguucaugccuguaaucccaaugcuuuggga

SEQ ID NO: 260578 - RNA, 32 nt, Human
ugguucaugccuguaaucccagaacuucggga

SEQ ID NO: 260579 - RNA, 32 nt, Human
ugguucaugccuguaaucccagcacuauggga

SEQ ID NO: 260580 - RNA, 32 nt, Human
ugguucaugccuguaaucccagcacuucacuu

SEQ ID NO: 260581 - RNA, 32 nt, Human
ugguucaugccuguaaucccagcacuugggag

SEQ ID NO: 260582 - RNA, 32 nt, Human
ugguucaugccuguaaucccagcacuuuggaa

SEQ ID NO: 260583 - RNA, 32 nt, Human
ugguucaugccuguaaucccagcacuuuggga

SEQ ID NO: 260584 - RNA, 21 nt, Human
ugguucaugccuguaaucuca

SEQ ID NO: 260585 - RNA, 21 nt, Human
ugguucaugccugugauccca

SEQ ID NO: 260586 - RNA, 32 nt, Human
ugguucaugccuuaaucccagcacuuugggag

SEQ ID NO: 260587 - RNA, 20 nt, Human
ugguucaugcuguaauccca

SEQ ID NO: 260588 - RNA, 32 nt, Human
ugguucaugcuguaaucccaucacuuugggag

SEQ ID NO: 260589 - RNA, 32 nt, Human
ugguucaugucuguaaucccagcacuuuguga

SEQ ID NO: 260590 - RNA, 32 nt, Human
ugguucauguuacucuuucucucuccaucagc

SEQ ID NO: 260591 - RNA, 32 nt, Human
ugguucauucucaggcugggguggacucagau

SEQ ID NO: 260592 - RNA, 21 nt, Human
ugguuccaagaggcuguggcc

SEQ ID NO: 260593 - RNA, 32 nt, Human
ugguuccaaguauguuagaucagcuaacaucu

SEQ ID NO: 260594 - RNA, 32 nt, Human
ugguuccaagucuuugcuauuguaaauagugc

SEQ ID NO: 260595 - RNA, 32 nt, Human
ugguuccaagucuuugcuauugugaauaaugc

SEQ ID NO: 260596 - RNA, 32 nt, Human
ugguuccaagucuuugcuauugugaauagugc

SEQ ID NO: 260597 - RNA, 32 nt, Human
ugguuccaccaacauggagcucucgcagaugu

SEQ ID NO: 260598 - RNA, 32 nt, Human
ugguuccaccuucacaaguauccuucaaaggc

SEQ ID NO: 260599 - RNA, 21 nt, Human
ugguuccagcaaagcgggcuc

SEQ ID NO: 260600 - RNA, 32 nt, Human
ugguuccagcuacucaggaggcugagguggga

SEQ ID NO: 260601 - RNA, 32 nt, Human
ugguuccagcuauucgggaggcugagguaggu

SEQ ID NO: 260602 - RNA, 32 nt, Human
ugguuccagcuccucaguaggcugaggugaga

SEQ ID NO: 260603 - RNA, 31 nt, Human
ugguuccaguuucacagcuaccugcagaggc

SEQ ID NO: 260604 - RNA, 32 nt, Human
ugguuccauggugaaacacaucccugacccuu

SEQ ID NO: 260605 - RNA, 31 nt, Human
ugguuccauguuucucgcacagcagaguucu

SEQ ID NO: 260606 - RNA, 32 nt, Human
ugguuccauuuagacuacuuuccucuucuauu

SEQ ID NO: 260607 - RNA, 32 nt, Human
ugguucccaaaccaaagacagccugcagcccu

SEQ ID NO: 260608 - RNA, 32 nt, Human
ugguucccaagcuacagguggggugggaaagg

SEQ ID NO: 260609 - RNA, 23 nt, Human
ugguucccagggcaggcugacuc

SEQ ID NO: 260610 - RNA, 32 nt, Human
ugguuccccacacauccauaguucugccuccc

SEQ ID NO: 260611 - RNA, 32 nt, Human
ugguucccccuuccccacuucaccuccacuca

SEQ ID NO: 260612 - RNA, 32 nt, Human
ugguuccccugccucccagcccggcugugagu

SEQ ID NO: 260613 - RNA, 32 nt, Human
ugguucccucacagguuucuccagaaaguacu

SEQ ID NO: 260614 - RNA, 32 nt, Human
ugguucccuccccaaggccacagggagcuccg

SEQ ID NO: 260615 - RNA, 32 nt, Human
ugguucccugcagccuugcucugcauaggcuc

SEQ ID NO: 260616 - RNA, 32 nt, Human
ugguucccuggcaggcuggagggcaggagcug

SEQ ID NO: 260617 - RNA, 32 nt, Human
ugguucccuguggcugaccgcaggguguucuc

SEQ ID NO: 260618 - RNA, 32 nt, Human
ugguuccuagaggcagagguugaagauggaag

SEQ ID NO: 260619 - RNA, 32 nt, Human
ugguuccucaagggcagauauuggacacuccu

SEQ ID NO: 260620 - RNA, 31 nt, Human
ugguuccucccucucuggccugugccgccuc

SEQ ID NO: 260621 - RNA, 32 nt, Human
ugguuccuccucccaccaaccccacgcagccc

SEQ ID NO: 260622 - RNA, 32 nt, Human
ugguuccucuggggguugagaauaagaauagu

SEQ ID NO: 260623 - RNA, 32 nt, Human
ugguuccugaugcccauguuccagaggaauuc

SEQ ID NO: 260624 - RNA, 32 nt, Human
ugguuccugcaagcccucuaggaggccgaaag

SEQ ID NO: 260625 - RNA, 32 nt, Human
ugguuccugcagcagcugcugccacugcucag

SEQ ID NO: 260626 - RNA, 32 nt, Human
ugguuccugccaccaccaccuccccaggccgg

SEQ ID NO: 260627 - RNA, 32 nt, Human
ugguuccugcuguuuauucucuggucaugccu

SEQ ID NO: 260628 - RNA, 32 nt, Human
ugguuccugggggaacagagacuggagauguu

SEQ ID NO: 260629 - RNA, 32 nt, Human
ugguuccugugcacugagcccaccagccacag

SEQ ID NO: 260630 - RNA, 32 nt, Human
ugguuccuucugcaguaccucugugguuaaaa

SEQ ID NO: 260631 - RNA, 32 nt, Human
ugguuccuuucuuccucguuuguuacuuuaga

SEQ ID NO: 260632 - RNA, 32 nt, Human
ugguucgugccuguaaucccagcucuuuggga

SEQ ID NO: 260633 - RNA, 32 nt, Human
ugguucgugcuggaaauuucuccuggguuucu

SEQ ID NO: 260634 - RNA, 32 nt, Human
ugguucguuaguggauuacuucugagcuugca

SEQ ID NO: 260635 - RNA, 32 nt, Human
ugguucuaagaacggaagcaucugggcuggau

SEQ ID NO: 260636 - RNA, 32 nt, Human
ugguucuacaguccuggcugauucagauacca

SEQ ID NO: 260637 - RNA, 32 nt, Human
ugguucuacuucucaggcuggacacugacuga

SEQ ID NO: 260638 - RNA, 22 nt, Human
ugguucuaggcauuucugggaa

SEQ ID NO: 260639 - RNA, 32 nt, Human
ugguucuaguacagauacucuacuacacucag

SEQ ID NO: 260640 - RNA, 32 nt, Human
ugguucuaucuagauucuucugugaaucuaaa

SEQ ID NO: 260641 - RNA, 32 nt, Human
ugguucuaucuuccuuuuccucacugaauucc

SEQ ID NO: 260642 - RNA, 21 nt, Human
ugguucucacugagacguuuu

SEQ ID NO: 260643 - RNA, 32 nt, Human
ugguucucagcagaguggagcugaguuucugg

SEQ ID NO: 260644 - RNA, 32 nt, Human
ugguucuccagccucuugccuggcugccagug

SEQ ID NO: 260645 - RNA, 32 nt, Human
ugguucucccuuccucccugaggacaccaaau

SEQ ID NO: 260646 - RNA, 32 nt, Human
ugguucuccugccucagccucccuaguagcug

SEQ ID NO: 260647 - RNA, 32 nt, Human
ugguucuccugccucggccuccugaguggcug

SEQ ID NO: 260648 - RNA, 32 nt, Human
ugguucucuaacuccaucauuuccauuucaga

SEQ ID NO: 260649 - RNA, 22 nt, Human
ugguucucugauuaaaguuuug

SEQ ID NO: 260650 - RNA, 32 nt, Human
ugguucucuucccugcucaggcugccagagag

SEQ ID NO: 260651 - RNA, 32 nt, Human
ugguucugacacacaggaucccaggcaaggca

SEQ ID NO: 260652 - RNA, 32 nt, Human
ugguucugaggccccuacccucccaggcuguc

SEQ ID NO: 260653 - RNA, 32 nt, Human
ugguucugauaaaaucaguccagcacuuuuag

SEQ ID NO: 260654 - RNA, 32 nt, Human
ugguucugcaugucugugcucuuccucaaccc

SEQ ID NO: 260655 - RNA, 32 nt, Human
ugguucugcccuuaccccuccugcccgccuga

SEQ ID NO: 260656 - RNA, 32 nt, Human
ugguucugccugcacuuacuuuguaaugccac

SEQ ID NO: 260657 - RNA, 32 nt, Human
ugguucugcuccuggcccccuuguucagcccc

SEQ ID NO: 260658 - RNA, 32 nt, Human
ugguucugcuucuguggauguagaauggggca

SEQ ID NO: 260659 - RNA, 32 nt, Human
ugguucuggaagccugucccaagugaaugaau

SEQ ID NO: 260660 - RNA, 32 nt, Human
ugguucuggccuuuccugccuuuucucaagcu

SEQ ID NO: 260661 - RNA, 32 nt, Human
ugguucugggggagacagaaaagaggugcggc

SEQ ID NO: 260662 - RNA, 32 nt, Human
ugguucugguuuucaguccacugugaauaggu

SEQ ID NO: 260663 - RNA, 23 nt, Human
ugguucuguccucgugccuuccu

SEQ ID NO: 260664 - RNA, 32 nt, Human
ugguucugugagccucugccuuuuccugguuu

SEQ ID NO: 260665 - RNA, 21 nt, Human
ugguucuuauuuaagguuuug

SEQ ID NO: 260666 - RNA, 32 nt, Human
ugguucuucguucucugucacucuuguuuuug

SEQ ID NO: 260667 - RNA, 32 nt, Human
ugguucuucucccagguauucucuucccaggc

SEQ ID NO: 260668 - RNA, 32 nt, Human
ugguucuucuguuggggaccagugaguacaca

SEQ ID NO: 260669 - RNA, 32 nt, Human
ugguucuuguagcuccgugagcugcagccucu

SEQ ID NO: 260670 - RNA, 32 nt, Human
ugguucuuguuccugagaaggguggguaacag

SEQ ID NO: 260671 - RNA, 32 nt, Human
ugguucuuuacaugacugaaucaauuacaauu

SEQ ID NO: 260672 - RNA, 32 nt, Human
ugguugaaaaggagucaacauggccccaacua

SEQ ID NO: 260673 - RNA, 32 nt, Human
ugguugaaucuuaggaaugaacagugucucaa

SEQ ID NO: 260674 - RNA, 32 nt, Human
ugguugacaucaaaacagcauucuucuucuag

SEQ ID NO: 260675 - RNA, 32 nt, Human
ugguugacccagaggauccugauaaugugcaa

SEQ ID NO: 260676 - RNA, 32 nt, Human
ugguugacugaggagucgggugaggccacccu

SEQ ID NO: 260677 - RNA, 32 nt, Human
ugguugagaaccauuguuccaagugaaggcac

SEQ ID NO: 260678 - RNA, 31 nt, Human
ugguugagaaggagagaaaaagguggcagga

SEQ ID NO: 260679 - RNA, 32 nt, Human
ugguugagaaggagagaaaaagguggcaggaa

SEQ ID NO: 260680 - RNA, 32 nt, Human
ugguugagaugggcaccguuuugcaggaaaca

SEQ ID NO: 260681 - RNA, 32 nt, Human
ugguugagccccugucaagugccagucaugau

SEQ ID NO: 260682 - RNA, 32 nt, Human
ugguugagcgcuucacucuauuuucuggugcu

SEQ ID NO: 260683 - RNA, 32 nt, Human
ugguugagcuuaggagguugaggcugcaguga

SEQ ID NO: 260684 - RNA, 32 nt, Human
ugguugaggagaaaggcggggaagcuuccuca

SEQ ID NO: 260685 - RNA, 18 nt, Human
ugguugaggcccagcgaa

SEQ ID NO: 260686 - RNA, 32 nt, Human
ugguugauggacagcaggcucugccuucugga

SEQ ID NO: 260687 - RNA, 32 nt, Human
ugguugauuaccuguaccgaaaugcuguccag

SEQ ID NO: 260688 - RNA, 32 nt, Human
ugguugauucagcccaccucucugcaucccgc

SEQ ID NO: 260689 - RNA, 32 nt, Human
ugguugauugaaugauuguggaacucauugug

SEQ ID NO: 260690 - RNA, 32 nt, Human
ugguugcaacacuguacuccagccugggcaac

SEQ ID NO: 260691 - RNA, 32 nt, Human
ugguugcaccacuacacuguagccugggugac

SEQ ID NO: 260692 - RNA, 32 nt, Human
ugguugcaccacugcucuccaggcuugaguga

SEQ ID NO: 260693 - RNA, 32 nt, Human
ugguugcaccacuguacuccagccugggcgau

SEQ ID NO: 260694 - RNA, 32 nt, Human
ugguugcagacggagaaauggaggccagagac

SEQ ID NO: 260695 - RNA, 32 nt, Human
ugguugcaggcagaguuuuggggaccuggccc

SEQ ID NO: 260696 - RNA, 32 nt, Human
ugguugcagguucccuuuuuccuuccucaggu

SEQ ID NO: 260697 - RNA, 32 nt, Human
ugguugccacagagcugggacuucauguucuu

SEQ ID NO: 260698 - RNA, 20 nt, Human
ugguugccagccaccuaggg

SEQ ID NO: 260699 - RNA, 32 nt, Human
ugguugcccaggcuggagugcaguggugccau

SEQ ID NO: 260700 - RNA, 32 nt, Human
ugguugcccaggcugggguacagugguggaau

SEQ ID NO: 260701 - RNA, 32 nt, Human
ugguugcccugccucuggcuccagaacagaaa

SEQ ID NO: 260702 - RNA, 31 nt, Human
ugguugccucuauuugggccuggagcaggga

SEQ ID NO: 260703 - RNA, 32 nt, Human
ugguugccucugaagaaacugccuucauugua

SEQ ID NO: 260704 - RNA, 32 nt, Human
ugguugccugcagguauuucacuguuuacugu

SEQ ID NO: 260705 - RNA, 32 nt, Human
ugguugccugcucguccccaagugaccuauac

SEQ ID NO: 260706 - RNA, 32 nt, Human
ugguugccuggacaccccacgggaggaguggc

SEQ ID NO: 260707 - RNA, 32 nt, Human
ugguugccuggccugggcugcgcccagcagcu

SEQ ID NO: 260708 - RNA, 32 nt, Human
ugguugccuugcaggaaugcaaggucagggug

SEQ ID NO: 260709 - RNA, 32 nt, Human
ugguugccuuggaggcagaagcugugaguuuc

SEQ ID NO: 260710 - RNA, 32 nt, Human
ugguugcuagcacauacuuuauuaucccccaa

SEQ ID NO: 260711 - RNA, 32 nt, Human
ugguugcucccaggcugcuguucucagggacc

SEQ ID NO: 260712 - RNA, 32 nt, Human
ugguugcucuucucagcuucagcuguagccac

SEQ ID NO: 260713 - RNA, 32 nt, Human
ugguugcugaaggcuggaguggguguggcaau

SEQ ID NO: 260714 - RNA, 32 nt, Human
ugguugcugcugaaggaggaggcagcagcgag

SEQ ID NO: 260715 - RNA, 32 nt, Human
ugguugcuggcaguggcagcacugggccaggu

SEQ ID NO: 260716 - RNA, 32 nt, Human
ugguugcugggcuguagggugaguggcuugcu

SEQ ID NO: 260717 - RNA, 32 nt, Human
ugguugcugguuugugugugaaaaacauuuuc

SEQ ID NO: 260718 - RNA, 32 nt, Human
ugguugcuuuuauuccagauaauaacacuuaa

SEQ ID NO: 260719 - RNA, 32 nt, Human
ugguuggaaacaguguagucgcuucccuuuuu

SEQ ID NO: 260720 - RNA, 32 nt, Human
ugguuggaagaagacuuucuccccagcugcau

SEQ ID NO: 260721 - RNA, 32 nt, Human
ugguuggaagaccacagacauggaaggggccc

SEQ ID NO: 260722 - RNA, 32 nt, Human
ugguuggaagcauauguggggaggcuggcugg

SEQ ID NO: 260723 - RNA, 32 nt, Human
ugguuggaagugaaaaugccaaacgauauuuu

SEQ ID NO: 260724 - RNA, 32 nt, Human
ugguuggaggcagagcuuggaaaggaagcagc

SEQ ID NO: 260725 - RNA, 32 nt, Human
ugguuggagguuucacauauggcucaacucaa

SEQ ID NO: 260726 - RNA, 32 nt, Human
ugguuggaucccacacuggcagagauggggcc

SEQ ID NO: 260727 - RNA, 32 nt, Human
ugguuggauuuuuccacuaucuuuuuaguuug

SEQ ID NO: 260728 - RNA, 32 nt, Human
ugguuggcaacuguuucaacuuguuugaacca

SEQ ID NO: 260729 - RNA, 32 nt, Human
ugguuggcagaucuuuugggagauacuggaug

SEQ ID NO: 260730 - RNA, 32 nt, Human
ugguuggcagcugccguacuccaggcuugugu

SEQ ID NO: 260731 - RNA, 32 nt, Human
ugguuggcccaagcccugccugacugaccacc

SEQ ID NO: 260732 - RNA, 32 nt, Human
ugguuggcgacuguucuuuccagaccugcucc

SEQ ID NO: 260733 - RNA, 32 nt, Human
ugguuggcucucccucuccucucucccucucc

SEQ ID NO: 260734 - RNA, 31 nt, Human
ugguuggcugagagagaaugacugaccggau

SEQ ID NO: 260735 - RNA, 32 nt, Human
ugguugggagagggagucacaguuccuacucc

SEQ ID NO: 260736 - RNA, 32 nt, Human
ugguugggagugaagagaauccaggcuggcag

SEQ ID NO: 260737 - RNA, 32 nt, Human
ugguugggcuagugggucaucaugucacuuuc

SEQ ID NO: 260738 - RNA, 32 nt, Human
ugguuggggaaaauguggugacugagguacag

SEQ ID NO: 260739 - RNA, 32 nt, Human
ugguugggguugaacaguaagcacauugcugc

SEQ ID NO: 260740 - RNA, 32 nt, Human
ugguuggguccuaucucugagacauuuugaag

SEQ ID NO: 260741 - RNA, 32 nt, Human
ugguuggguuaccagcccuagggcuacagaau

SEQ ID NO: 260742 - RNA, 32 nt, Human
ugguugguauugaugacuucagccuggaaauu

SEQ ID NO: 260743 - RNA, 32 nt, Human
ugguuggugccuuucccccuccuuccucccca

SEQ ID NO: 260744 - RNA, 32 nt, Human
ugguuggugguggcggugacagagugugcagc

SEQ ID NO: 260745 - RNA, 32 nt, Human
ugguuguagauguugcucuacauucaaaccuu

SEQ ID NO: 260746 - RNA, 24 nt, Human
ugguuguauugggcaggguggcuc

SEQ ID NO: 260747 - RNA, 32 nt, Human
ugguugucacaugucacaugcgucuuuuucag

SEQ ID NO: 260748 - RNA, 32 nt, Human
ugguugucagaacaauucaucaacaucuucuu

SEQ ID NO: 260749 - RNA, 32 nt, Human
ugguugucccauagggacugguggaguucugu

SEQ ID NO: 260750 - RNA, 32 nt, Human
ugguugucugcaggagaugguggaugaaauca

SEQ ID NO: 260751 - RNA, 32 nt, Human
ugguugucuugucuuccagggugcaggucacu

SEQ ID NO: 260752 - RNA, 32 nt, Human
ugguugugcagaacaaacaaggcauucauggg

SEQ ID NO: 260753 - RNA, 32 nt, Human
ugguugugccacugcacuccagccuggguaag

SEQ ID NO: 260754 - RNA, 32 nt, Human
ugguugugcucuggggugggggugggguguuu

SEQ ID NO: 260755 - RNA, 32 nt, Human
ugguugugguguagacugugucaggccuacgg

SEQ ID NO: 260756 - RNA, 32 nt, Human
ugguugugucacaguucacugcagccugggug

SEQ ID NO: 260757 - RNA, 20 nt, Human
ugguuguuccacagaguuuu

SEQ ID NO: 260758 - RNA, 32 nt, Human
ugguuguugcagcauucaguuccuugcuguug

SEQ ID NO: 260759 - RNA, 32 nt, Human
ugguuguugcccaggcuggagugcaguggcgc

SEQ ID NO: 260760 - RNA, 32 nt, Human
ugguuguuggcuggggccagagccagagccuu

SEQ ID NO: 260761 - RNA, 32 nt, Human
ugguuguuuucagcuuaaucaccugcucagaa

SEQ ID NO: 260762 - RNA, 32 nt, Human
ugguuuaaaauguaagauuuuaagauccucua

SEQ ID NO: 260763 - RNA, 32 nt, Human
ugguuuaaaccugagacuaacuuaaacacuuc

SEQ ID NO: 260764 - RNA, 32 nt, Human
ugguuuaaaggcacaaggucauggccuuuguc

SEQ ID NO: 260765 - RNA, 32 nt, Human
ugguuuaaaguacaguuucucuaaagaucaga

SEQ ID NO: 260766 - RNA, 32 nt, Human
ugguuuacaccuguaaucccagcacuuuggga

SEQ ID NO: 260767 - RNA, 32 nt, Human
ugguuuacugcaaccuccaccuccuaggcuca

SEQ ID NO: 260768 - RNA, 32 nt, Human
ugguuuagcuaaauuauuuuuccaauguagga

SEQ ID NO: 260769 - RNA, 32 nt, Human
ugguuuaggccuugccaguuuuccgaagucuc

SEQ ID NO: 260770 - RNA, 32 nt, Human
ugguuuagguuucuuccuggguacaguacauu

SEQ ID NO: 260771 - RNA, 32 nt, Human
ugguuuagugacugguagauagcuauuaggua

SEQ ID NO: 260772 - RNA, 30 nt, Human
ugguuuauccucuccaaucugcuccucaca

SEQ ID NO: 260773 - RNA, 32 nt, Human
ugguuuaucuccagcccacagcucuuucccug

SEQ ID NO: 260774 - RNA, 32 nt, Human
ugguuuaugaaugaucuuaagguaauuacaaa

SEQ ID NO: 260775 - RNA, 32 nt, Human
ugguuuaugacucuuaacccccuagaaagaca

SEQ ID NO: 260776 - RNA, 32 nt, Human
ugguuuaugccuguaaucccagcacuguggga

SEQ ID NO: 260777 - RNA, 32 nt, Human
ugguuuaugguaauuucuugcagcagaccuag

SEQ ID NO: 260778 - RNA, 32 nt, Human
ugguuuauuucacuccaguccugaagcaggug

SEQ ID NO: 260779 - RNA, 32 nt, Human
ugguuucaaagcaguuuaugggaacuucucuu

SEQ ID NO: 260780 - RNA, 32 nt, Human
ugguuucaacagacacaaauuuauauguuaac

SEQ ID NO: 260781 - RNA, 32 nt, Human
ugguuucaagcgauccucccaccucggccucc

SEQ ID NO: 260782 - RNA, 32 nt, Human
ugguuucaagcgauccucccacuucagccuuu

SEQ ID NO: 260783 - RNA, 32 nt, Human
ugguuucacaagucauuugugauguacuguuu

SEQ ID NO: 260784 - RNA, 32 nt, Human
ugguuucacaccucuuguuauuccuuagaguc

SEQ ID NO: 260785 - RNA, 32 nt, Human
ugguuucacugagagcugccuccuggucucuu

SEQ ID NO: 260786 - RNA, 32 nt, Human
ugguuucacugccuuccuacccucucuaaugg

SEQ ID NO: 260787 - RNA, 32 nt, Human
ugguuucagcaguuaaugugcuuucuuggauc

SEQ ID NO: 260788 - RNA, 32 nt, Human
ugguuucagcgugccgcucugugucauucagg

SEQ ID NO: 260789 - RNA, 32 nt, Human
ugguuucaggagacucagaguccucugugaaa

SEQ ID NO: 260790 - RNA, 32 nt, Human
ugguuucagguuuuccuucccuuccuuuuucc

SEQ ID NO: 260791 - RNA, 32 nt, Human
ugguuucaucagugcccaugcucugcaucagc

SEQ ID NO: 260792 - RNA, 32 nt, Human
ugguuucaugccccucucuauaccuuucaaag

SEQ ID NO: 260793 - RNA, 32 nt, Human
ugguuuccacacccucuguuagggaagccaca

SEQ ID NO: 260794 - RNA, 32 nt, Human
ugguuuccacaccucagacacgcacaguucac

SEQ ID NO: 260795 - RNA, 32 nt, Human
ugguuuccaccuccagcccugggaaauuuccu

SEQ ID NO: 260796 - RNA, 32 nt, Human
ugguuuccacuggaguaccacucugagcucuu

SEQ ID NO: 260797 - RNA, 32 nt, Human
ugguuuccagagaaaaggccaauaccuaagca

SEQ ID NO: 260798 - RNA, 32 nt, Human
ugguuuccagcccuccggagagugggcuuggc

SEQ ID NO: 260799 - RNA, 32 nt, Human
ugguuuccaguucuacaccacacccauguggc

SEQ ID NO: 260800 - RNA, 32 nt, Human
ugguuucccuggaaguggcagcagcagugagc

SEQ ID NO: 260801 - RNA, 32 nt, Human
ugguuuccucacauccugccucagcuucacca

SEQ ID NO: 260802 - RNA, 32 nt, Human
ugguuuccucauucucuuccaccaaccucugu

SEQ ID NO: 260803 - RNA, 32 nt, Human
ugguuuccucugguuccugccaccaccaccuc

SEQ ID NO: 260804 - RNA, 32 nt, Human
ugguuuccugagauaaauggacaggaagcgca

SEQ ID NO: 260805 - RNA, 32 nt, Human
ugguuuccuguuguaaaaaccuucagugaguu

SEQ ID NO: 260806 - RNA, 32 nt, Human
ugguuuccuuuggaaaugcacuguucucagcc

SEQ ID NO: 260807 - RNA, 32 nt, Human
ugguuucuaagaggcagagggccaggcgcggu

SEQ ID NO: 260808 - RNA, 32 nt, Human
ugguuucuauacugcuguccaagcaggcucac

SEQ ID NO: 260809 - RNA, 32 nt, Human
ugguuucuaucaugcuaauuuauuuugcuuug

SEQ ID NO: 260810 - RNA, 32 nt, Human
ugguuucucagaauccaaagaucacauauucu

SEQ ID NO: 260811 - RNA, 32 nt, Human
ugguuucuccauccaauucuuugaauuuccca

SEQ ID NO: 260812 - RNA, 32 nt, Human
ugguuucuccuccugggagucaaaguccauag

SEQ ID NO: 260813 - RNA, 32 nt, Human
ugguuucucuaguugcaguauuggacaaagag

SEQ ID NO: 260814 - RNA, 32 nt, Human
ugguuucucugagucacagauaaacuucugcc

SEQ ID NO: 260815 - RNA, 32 nt, Human
ugguuucucuucuccccuuccauuucugccuu

SEQ ID NO: 260816 - RNA, 32 nt, Human
ugguuucugcagcagcucacacugauguagcu

SEQ ID NO: 260817 - RNA, 32 nt, Human
ugguuucugcagcuggccauggccaauucaua

SEQ ID NO: 260818 - RNA, 32 nt, Human
ugguuucugcccacucagaguggcagcggaag

SEQ ID NO: 260819 - RNA, 32 nt, Human
ugguuucugcuuucuuuugacuacuugacuga

SEQ ID NO: 260820 - RNA, 32 nt, Human
ugguuucuguucuguugaucccacuucacugu

SEQ ID NO: 260821 - RNA, 32 nt, Human
ugguuucuuauucaaagaugauaauuuagugg

SEQ ID NO: 260822 - RNA, 32 nt, Human
ugguuucuucagaaucaugaaguucuuuugcc

SEQ ID NO: 260823 - RNA, 32 nt, Human
ugguuucuuccucacguggcuuuuucuuccau

SEQ ID NO: 260824 - RNA, 32 nt, Human
ugguuucuuccucugcgguaaaggacuugguc

SEQ ID NO: 260825 - RNA, 32 nt, Human
ugguuucuuggaaagcaggcaagacuuuuucu

SEQ ID NO: 260826 - RNA, 32 nt, Human
ugguuugaaaucaagugguuggaacacuguuu

SEQ ID NO: 260827 - RNA, 32 nt, Human
ugguuugaaggugagcugugaggaugggacua

SEQ ID NO: 260828 - RNA, 32 nt, Human
ugguuugaaguaugacuuuguacugggcccac

SEQ ID NO: 260829 - RNA, 32 nt, Human
ugguuugaccaagucucccaaagcugaagaga

SEQ ID NO: 260830 - RNA, 32 nt, Human
ugguuugagccuugauuagacuuuugaugugc

SEQ ID NO: 260831 - RNA, 32 nt, Human
ugguuugaggguuuccuuuaguucacccucau

SEQ ID NO: 260832 - RNA, 32 nt, Human
ugguuugagguuugguaacuugaugccucccc

SEQ ID NO: 260833 - RNA, 32 nt, Human
ugguuugcaaaagggcuuccuaaaaauaaaaa

SEQ ID NO: 260834 - RNA, 32 nt, Human
ugguuugccccagggaagagcguauccuuacc

SEQ ID NO: 260835 - RNA, 32 nt, Human
ugguuugcgggagauuuccuccccucagucaa

SEQ ID NO: 260836 - RNA, 18 nt, Human
ugguuuggagcaagggga

SEQ ID NO: 260837 - RNA, 32 nt, Human
ugguuuggccacugaauuaauacuguauagca

SEQ ID NO: 260838 - RNA, 32 nt, Human
ugguuuggccacuuugccacagaggccucagg

SEQ ID NO: 260839 - RNA, 32 nt, Human
ugguuuggccagcauggcgaaaccccaucucu

SEQ ID NO: 260840 - RNA, 32 nt, Human
ugguuuggccuuggggcacagagcugagcuga

SEQ ID NO: 260841 - RNA, 32 nt, Human
ugguuugggagcugccagucuccugggaggau

SEQ ID NO: 260842 - RNA, 32 nt, Human
ugguuuggggaccugcaaaugggaggccugag

SEQ ID NO: 260843 - RNA, 20 nt, Human
ugguuuggggcccaggggga

SEQ ID NO: 260844 - RNA, 32 nt, Human
ugguuugggggaagaaaaguaguucugguaug

SEQ ID NO: 260845 - RNA, 32 nt, Human
ugguuugggggaggggacuggaaagcugagac

SEQ ID NO: 260846 - RNA, 32 nt, Human
ugguuuguaagaggggaaagaaaaggagaaag

SEQ ID NO: 260847 - RNA, 32 nt, Human
ugguuuguauacccuugcucccgccuucugau

SEQ ID NO: 260848 - RNA, 32 nt, Human
ugguuugugagaaaguagcugccccucauucu

SEQ ID NO: 260849 - RNA, 32 nt, Human
ugguuuguuucucaagcgcuauccacagaacc

SEQ ID NO: 260850 - RNA, 32 nt, Human
ugguuuguuuuguuuuuaaaccacaguuugau

SEQ ID NO: 260851 - RNA, 31 nt, Human
ugguuuuaaguacuggagcuuuacuguaugu

SEQ ID NO: 260852 - RNA, 32 nt, Human
ugguuuuaaguccucccugcccucucuccucu

SEQ ID NO: 260853 - RNA, 32 nt, Human
ugguuuuaauuuaaaggacaaggcuacauaua

SEQ ID NO: 260854 - RNA, 32 nt, Human
ugguuuuauaggggcuuccuccuucacuuggc

SEQ ID NO: 260855 - RNA, 32 nt, Human
ugguuuuaugcugcuuuguuaggacagaugug

SEQ ID NO: 260856 - RNA, 32 nt, Human
ugguuuuauguggauaugccacaaaacacaag

SEQ ID NO: 260857 - RNA, 32 nt, Human
ugguuuucaagaggaaugccucugguuuuugc

SEQ ID NO: 260858 - RNA, 32 nt, Human
ugguuuucaagcagugcuuuaucucauguccu

SEQ ID NO: 260859 - RNA, 32 nt, Human
ugguuuucagaauuccuguguggcccuccugu

SEQ ID NO: 260860 - RNA, 32 nt, Human
ugguuuucagcagucugugcugugccuggaug

SEQ ID NO: 260861 - RNA, 32 nt, Human
ugguuuucagucuucucucucuuucucucuuu

SEQ ID NO: 260862 - RNA, 32 nt, Human
ugguuuucauuauuaauuuuuaggguaugggc

SEQ ID NO: 260863 - RNA, 32 nt, Human
ugguuuucauuucucuucuucacugccuuuuc

SEQ ID NO: 260864 - RNA, 32 nt, Human
ugguuuucccgugcaucuucagccuggcacau

SEQ ID NO: 260865 - RNA, 32 nt, Human
ugguuuuccuacagcuucuccccaucuuucaa

SEQ ID NO: 260866 - RNA, 32 nt, Human
ugguuuuccucucaggugguugguuuucucca

SEQ ID NO: 260867 - RNA, 32 nt, Human
ugguuuuccuuuucucuucaucuuuggcuccu

SEQ ID NO: 260868 - RNA, 32 nt, Human
ugguuuucuaaccugugacuuuuugaaaugaa

SEQ ID NO: 260869 - RNA, 32 nt, Human
ugguuuucuaggagcuauggucucauaaugac

SEQ ID NO: 260870 - RNA, 28 nt, Human
ugguuuucugauguugccucauuuccug

SEQ ID NO: 260871 - RNA, 32 nt, Human
ugguuuucuucccauuucaaggauccuuuugu

SEQ ID NO: 260872 - RNA, 32 nt, Human
ugguuuugaaccccuggguucaaaugauccuc

SEQ ID NO: 260873 - RNA, 32 nt, Human
ugguuuugaagacccagucacauuggauguga

SEQ ID NO: 260874 - RNA, 32 nt, Human
ugguuuugacuaauccugcuucccucucuggg

SEQ ID NO: 260875 - RNA, 20 nt, Human
ugguuuugagcagucugaug

SEQ ID NO: 260876 - RNA, 18 nt, Human
ugguuuugauuguucaca

SEQ ID NO: 260877 - RNA, 32 nt, Human
ugguuuugcagugccaggaacaauuggggaca

SEQ ID NO: 260878 - RNA, 32 nt, Human
ugguuuugccuuucucuaugcuaacacuuuuu

SEQ ID NO: 260879 - RNA, 32 nt, Human
ugguuuugcuucuccuuuguguuccugugagu

SEQ ID NO: 260880 - RNA, 32 nt, Human
ugguuuuggagguggcugggcaguggcgggca

SEQ ID NO: 260881 - RNA, 32 nt, Human
ugguuuuggccacuacaacugcagaguugaau

SEQ ID NO: 260882 - RNA, 32 nt, Human
ugguuuuggucauacuugcuuugcuaccuaaa

SEQ ID NO: 260883 - RNA, 32 nt, Human
ugguuuuguaacuuguucugguaauguccuuc

SEQ ID NO: 260884 - RNA, 32 nt, Human
ugguuuugucggaaccuaggcaaaugaccaua

SEQ ID NO: 260885 - RNA, 32 nt, Human
ugguuuuguguaugugucugaugauauucagu

SEQ ID NO: 260886 - RNA, 32 nt, Human
ugguuuuguuuccuuuuguaacaaagugaaaa

SEQ ID NO: 260887 - RNA, 18 nt, Human
ugguuuuguuuuuccaua

SEQ ID NO: 260888 - RNA, 32 nt, Human
ugguuuuuaaaaacuaugauuguauuaguucg

SEQ ID NO: 260889 - RNA, 32 nt, Human
ugguuuuuagcuuguucaaaaacagaggccag

SEQ ID NO: 260890 - RNA, 32 nt, Human
ugguuuuuaguuguuuuucuuagucacucuua

SEQ ID NO: 260891 - RNA, 32 nt, Human
ugguuuuuaucugguacccacacacacauaau

SEQ ID NO: 260892 - RNA, 32 nt, Human
ugguuuuuauuccugcuuuguuucuggaaagg

SEQ ID NO: 260893 - RNA, 32 nt, Human
ugguuuuuauucucaguaccucaggcuccccu

SEQ ID NO: 260894 - RNA, 32 nt, Human
ugguuuuucaaaagugaacaauccugugauaa

SEQ ID NO: 260895 - RNA, 32 nt, Human
ugguuuuucaccucagcccucucauaggagca

SEQ ID NO: 260896 - RNA, 32 nt, Human
ugguuuuucuaggccuggugugagagguaggg

SEQ ID NO: 260897 - RNA, 32 nt, Human
ugguuuuucuuuuagcugaaucaucuaucucc

SEQ ID NO: 260898 - RNA, 32 nt, Human
  misc_feature (3)..(3): n is a, c, g or u
ugncaccugacccuugugccucccucccucug

SEQ ID NO: 260899 - RNA, 32 nt, Human
  misc_feature (3)..(5): n is a, c, g or u
ugnnncacgccuguaaucccagcacuuuggga

SEQ ID NO: 260900 - RNA, 31 nt, Human
uguaaaaagagacuguuuugggggaaugggg

SEQ ID NO: 260901 - RNA, 32 nt, Human
uguaaaaagcuucauucucacucugcuuugca

SEQ ID NO: 260902 - RNA, 32 nt, Human
uguaaaaaucaauuuuacguagagucaacauu

SEQ ID NO: 260903 - RNA, 32 nt, Human
uguaaaacaaauuuuaauuccucaggguuuua

SEQ ID NO: 260904 - RNA, 22 nt, Human
uguaaaacagauguuguaugua

SEQ ID NO: 260905 - RNA, 21 nt, Human
uguaaaacauugaugacuuua

SEQ ID NO: 260906 - RNA, 32 nt, Human
uguaaaacuauacugacccguuuucaguuuua

SEQ ID NO: 260907 - RNA, 32 nt, Human
uguaaaacugacuuuuucauuacguggguuuu

SEQ ID NO: 260908 - RNA, 32 nt, Human
uguaaaacuguugcagacaacaggauccugua

SEQ ID NO: 260909 - RNA, 32 nt, Human
uguaaaagagccuaguuuuuaauagcuaugga

SEQ ID NO: 260910 - RNA, 21 nt, Human
uguaaaagcaacaucagcuug

SEQ ID NO: 260911 - RNA, 32 nt, Human
uguaaaaggaagggguuggauugcaauaucug

SEQ ID NO: 260912 - RNA, 24 nt, Human
uguaaaaggagguaggaugaauug

SEQ ID NO: 260913 - RNA, 32 nt, Human
uguaaaaggccagcucagauugugagcccuuu

SEQ ID NO: 260914 - RNA, 32 nt, Human
uguaaaagucaguauccuaagagauuaaauug

SEQ ID NO: 260915 - RNA, 32 nt, Human
uguaaaaguuuaaugacccacuuuagaugcuc

SEQ ID NO: 260916 - RNA, 32 nt, Human
uguaaaauacagcacacauacagcaaagugua

SEQ ID NO: 260917 - RNA, 32 nt, Human
uguaaaauaccguguguauauguauguaugug

SEQ ID NO: 260918 - RNA, 32 nt, Human
uguaaaauauacuuucuuuuacagcacaacuu

SEQ ID NO: 260919 - RNA, 32 nt, Human
uguaaaauauuuauugucuucuagccuugagc

SEQ ID NO: 260920 - RNA, 32 nt, Human
uguaaaaucccuucuccuuuacacauccuuua

SEQ ID NO: 260921 - RNA, 32 nt, Human
uguaaaaugggguugauagcagcauucaccug

SEQ ID NO: 260922 - RNA, 32 nt, Human
uguaaaauguuuacuuauucugagcuuagaga

SEQ ID NO: 260923 - RNA, 32 nt, Human
uguaaacaaagacaugggauuuucugacguaa

SEQ ID NO: 260924 - RNA, 32 nt, Human
uguaaacaacagccaagagagcaggggugacg

SEQ ID NO: 260925 - RNA, 32 nt, Human
uguaaacacacgugcacacaucguacacaugu

SEQ ID NO: 260926 - RNA, 32 nt, Human
uguaaacacccuauaaccucaggccuuggcau

SEQ ID NO: 260927 - RNA, 32 nt, Human
uguaaacagaacuggcacacacacauuaagau

SEQ ID NO: 260928 - RNA, 31 nt, Human
uguaaacagaagccuguuucagaaaucugga

SEQ ID NO: 260929 - RNA, 32 nt, Human
uguaaacagaugggcugggcucuugcugccgc

SEQ ID NO: 260930 - RNA, 32 nt, Human
uguaaacaggagacaggaagguggugcuuaca

SEQ ID NO: 260931 - RNA, 32 nt, Human
uguaaacauauguccauuaagaaacauguagu

SEQ ID NO: 260932 - RNA, 32 nt, Human
uguaaacauccuguaauuuaagaucuuggugu

SEQ ID NO: 260933 - RNA, 32 nt, Human
uguaaacaucugcuuguccuucuuaggucgcc

SEQ ID NO: 260934 - RNA, 22 nt, Human
uguaaacauuagcucuuuccac

SEQ ID NO: 260935 - RNA, 32 nt, Human
uguaaacauuuaagauucuccuguggauuuug

SEQ ID NO: 260936 - RNA, 32 nt, Human
uguaaaccaagaagagaaaagcauuucaauuu

SEQ ID NO: 260937 - RNA, 32 nt, Human
uguaaaccaggauuugaaugggugagcugcac

SEQ ID NO: 260938 - RNA, 32 nt, Human
uguaaacccagugggcucugcccacgccgggc

SEQ ID NO: 260939 - RNA, 32 nt, Human
uguaaacccauucagauaaauggcaguacuuu

SEQ ID NO: 260940 - RNA, 20 nt, Human
uguaaaccccgucucuacua

SEQ ID NO: 260941 - RNA, 32 nt, Human
uguaaaccgacgccggaaagcaaaugguaucg

SEQ ID NO: 260942 - RNA, 32 nt, Human
uguaaaccucauuccaccacuuacuagucuca

SEQ ID NO: 260943 - RNA, 32 nt, Human
uguaaacgagcuuguaucuccuucccugugcc

SEQ ID NO: 260944 - RNA, 32 nt, Human
uguaaacgauccagagacaagacagcaccuag

SEQ ID NO: 260945 - RNA, 32 nt, Human
uguaaacgggaggagguggggcgaggcagcca

SEQ ID NO: 260946 - RNA, 20 nt, Human
uguaaacuaaggggaugguu

SEQ ID NO: 260947 - RNA, 32 nt, Human
uguaaacugcuguccuggugacuugucccucu

SEQ ID NO: 260948 - RNA, 21 nt, Human
uguaaacuuaccaguaugucu

SEQ ID NO: 260949 - RNA, 32 nt, Human
uguaaacuucuuucaaauuacucuuccucagu

SEQ ID NO: 260950 - RNA, 32 nt, Human
uguaaacuuggggaagauuaagaaaagaacca

SEQ ID NO: 260951 - RNA, 32 nt, Human
uguaaacuuuucucaguguccagacuuucugu

SEQ ID NO: 260952 - RNA, 32 nt, Human
uguaaagaaagaaaaagggaaguaccaauggg

SEQ ID NO: 260953 - RNA, 20 nt, Human
uguaaagaagaaggcgugca

SEQ ID NO: 260954 - RNA, 32 nt, Human
uguaaagacugaagcauccccaccucaggauu

SEQ ID NO: 260955 - RNA, 32 nt, Human
uguaaagagauucuuuaaaaugcugcuucuuc

SEQ ID NO: 260956 - RNA, 32 nt, Human
uguaaagagggagcacauugacuugggaauuu

SEQ ID NO: 260957 - RNA, 27 nt, Human
uguaaagaguccagguaacugacuuua

SEQ ID NO: 260958 - RNA, 25 nt, Human
uguaaagcaagcaaccucccuccac

SEQ ID NO: 260959 - RNA, 29 nt, Human
uguaaagcaauaaaucuugacuugaaauc

SEQ ID NO: 260960 - RNA, 32 nt, Human
uguaaagcaugugaagacaggccaggcgcggc

SEQ ID NO: 260961 - RNA, 32 nt, Human
uguaaagccagccaugcauuguuaaucaucca

SEQ ID NO: 260962 - RNA, 32 nt, Human
uguaaagccgguuucaggauggcugagcugac

SEQ ID NO: 260963 - RNA, 23 nt, Human
uguaaagccuuuccugccuugca

SEQ ID NO: 260964 - RNA, 32 nt, Human
uguaaagcuaucagucauuuaguagaauagaa

SEQ ID NO: 260965 - RNA, 32 nt, Human
uguaaaggaaauuuaaauucuggagaauucua

SEQ ID NO: 260966 - RNA, 32 nt, Human
uguaaaggagggggaagggaaggguugaccag

SEQ ID NO: 260967 - RNA, 21 nt, Human
uguaaagggaaaauuagcacu

SEQ ID NO: 260968 - RNA, 32 nt, Human
uguaaagggaaaggaugguaagaggagguuac

SEQ ID NO: 260969 - RNA, 32 nt, Human
uguaaaggggacagcucaggguuguuuuggag

SEQ ID NO: 260970 - RNA, 32 nt, Human
uguaaagggucuucugagcugcaguggcaauu

SEQ ID NO: 260971 - RNA, 32 nt, Human
uguaaaggugacaaaauaucugaacagaagag

SEQ ID NO: 260972 - RNA, 32 nt, Human
uguaaaguaaaaagauaaccauacuauacaua

SEQ ID NO: 260973 - RNA, 32 nt, Human
uguaaaguauuguuuuuaaauauugccagauu

SEQ ID NO: 260974 - RNA, 32 nt, Human
uguaaagucuauucuguuuaacaauaagaaau

SEQ ID NO: 260975 - RNA, 32 nt, Human
uguaaagucugcaucuuucacuggggguaaag

SEQ ID NO: 260976 - RNA, 32 nt, Human
uguaaagugcauucccuucaccagcuugugca

SEQ ID NO: 260977 - RNA, 32 nt, Human
uguaaagugucagaaggagcuacaaaaccuac

SEQ ID NO: 260978 - RNA, 30 nt, Human
uguaaaguuucuccucugcuccugaaaacu

SEQ ID NO: 260979 - RNA, 32 nt, Human
uguaaauaaauacaucgccucuuguucggauu

SEQ ID NO: 260980 - RNA, 32 nt, Human
uguaaauaagaaagcaaaguuuaugggaaaau

SEQ ID NO: 260981 - RNA, 32 nt, Human
uguaaauacaaaccgagcacuaguuuuaauau

SEQ ID NO: 260982 - RNA, 32 nt, Human
uguaaauacaugcuuuaauuugcaauuuaaaa

SEQ ID NO: 260983 - RNA, 32 nt, Human
uguaaauaccucaguaauauggguccuuucau

SEQ ID NO: 260984 - RNA, 32 nt, Human
uguaaauacuacuacuacaaaaaucagcuuuc

SEQ ID NO: 260985 - RNA, 32 nt, Human
uguaaauacuauaaugagagccacaucuguaa

SEQ ID NO: 260986 - RNA, 32 nt, Human
uguaaauauucugcaguuguuacuuaggaagc

SEQ ID NO: 260987 - RNA, 32 nt, Human
uguaaaucagaugccagcuguacugccggcuc

SEQ ID NO: 260988 - RNA, 32 nt, Human
uguaaaucugggcuugucuuccuaaugcuacc

SEQ ID NO: 260989 - RNA, 32 nt, Human
uguaaaugaccuuccaguucugucuccucaga

SEQ ID NO: 260990 - RNA, 32 nt, Human
uguaaaugagcaaagauggaucaggaaggugg

SEQ ID NO: 260991 - RNA, 32 nt, Human
uguaaaugauagauuccaugggugagacuuua

SEQ ID NO: 260992 - RNA, 32 nt, Human
uguaaaugcucaauaaauauugaugaugggag

SEQ ID NO: 260993 - RNA, 32 nt, Human
uguaaaugcugcacauccagauugcauaucag

SEQ ID NO: 260994 - RNA, 32 nt, Human
uguaaaugugauggauuucuuaaucauauuua

SEQ ID NO: 260995 - RNA, 32 nt, Human
uguaaauguguuuuacucagcuuucuuuaugu

SEQ ID NO: 260996 - RNA, 32 nt, Human
uguaaauuaauugucagcauuccaugucucaa

SEQ ID NO: 260997 - RNA, 32 nt, Human
uguaaauuaggaaagggagaccagccugacca

SEQ ID NO: 260998 - RNA, 32 nt, Human
uguaaauuauuaaaucggcaacagggcuucuc

SEQ ID NO: 260999 - RNA, 32 nt, Human
uguaaauucagguucaauuaguucucauugca

SEQ ID NO: 261000 - RNA, 22 nt, Human
uguaaauucucccagcaguguc

SEQ ID NO: 261001 - RNA, 32 nt, Human
uguaaauuggacugcagucugaggugcccauu

SEQ ID NO: 261002 - RNA, 32 nt, Human
uguaaauuggcauacaauacugccuuuaauag

SEQ ID NO: 261003 - RNA, 32 nt, Human
uguaaauuguguaguccauccuuuccuccuuu

SEQ ID NO: 261004 - RNA, 32 nt, Human
uguaaauuuauucaacuaacgaugggaaaugu

SEQ ID NO: 261005 - RNA, 32 nt, Human
uguaaauuucagaaugugucucugguacagaa

SEQ ID NO: 261006 - RNA, 32 nt, Human
uguaaauuucugugguugcuaucuuauguaaa

SEQ ID NO: 261007 - RNA, 32 nt, Human
uguaaauuuggucaagucuacucuuccguuca

SEQ ID NO: 261008 - RNA, 32 nt, Human
uguaacaaaacaacacaaauuaaguacaaagu

SEQ ID NO: 261009 - RNA, 32 nt, Human
uguaacaaacccccaugacacaccuuuaugua

SEQ ID NO: 261010 - RNA, 32 nt, Human
uguaacaaagaauguuuggaaaaugcuggaca

SEQ ID NO: 261011 - RNA, 32 nt, Human
uguaacaaaggauuuuuguugucuaaguccca

SEQ ID NO: 261012 - RNA, 32 nt, Human
uguaacaagaagcaaagccuucagcaagauca

SEQ ID NO: 261013 - RNA, 32 nt, Human
uguaacaaguauuuauccguccauccauucau

SEQ ID NO: 261014 - RNA, 32 nt, Human
uguaacacaagaaauaacuccuuuuuacauga

SEQ ID NO: 261015 - RNA, 32 nt, Human
uguaacaccaacacuuaacuucagaaagacau

SEQ ID NO: 261016 - RNA, 32 nt, Human
uguaacaccaugauuaaccacuucagcugacu

SEQ ID NO: 261017 - RNA, 32 nt, Human
uguaacacucacugcaaaggucuacagcuuca

SEQ ID NO: 261018 - RNA, 32 nt, Human
uguaacacucacugccaaggucuucagcuuca

SEQ ID NO: 261019 - RNA, 32 nt, Human
uguaacagagguuuuuacauuugcaaaccuuu

SEQ ID NO: 261020 - RNA, 32 nt, Human
uguaacaggcuucucggugcuccucacccgug

SEQ ID NO: 261021 - RNA, 32 nt, Human
uguaacagggucauacccccucccucuugucc

SEQ ID NO: 261022 - RNA, 32 nt, Human
uguaacaguaaaggcagaaagcuguagugaua

SEQ ID NO: 261023 - RNA, 32 nt, Human
uguaacauaugcugccuacccaccucaaaaug

SEQ ID NO: 261024 - RNA, 32 nt, Human
uguaacaugaccuuaaauagucuuccugcaua

SEQ ID NO: 261025 - RNA, 31 nt, Human
uguaacaugccugugucacucacuuagccuu

SEQ ID NO: 261026 - RNA, 32 nt, Human
uguaacaugccugugucacucacuuagccuug

SEQ ID NO: 261027 - RNA, 32 nt, Human
uguaacauggguuuguuggaguuuuccucauu

SEQ ID NO: 261028 - RNA, 32 nt, Human
uguaaccaaaaaccacuuguagggggaaaaac

SEQ ID NO: 261029 - RNA, 32 nt, Human
uguaaccaaagaagcaaagcuguguaauggag

SEQ ID NO: 261030 - RNA, 32 nt, Human
uguaaccagcuggucuggguguagcucuuaga

SEQ ID NO: 261031 - RNA, 32 nt, Human
uguaacccaacaagagcacauuuuaucauagc

SEQ ID NO: 261032 - RNA, 32 nt, Human
uguaacccagccaccaccaaaaagcaaacaga

SEQ ID NO: 261033 - RNA, 23 nt, Human
uguaacccaggcuggaaugcaau

SEQ ID NO: 261034 - RNA, 24 nt, Human
uguaacccaggcuggaaugcaaug

SEQ ID NO: 261035 - RNA, 32 nt, Human
uguaacccaucucaauuauagaagcaaguuca

SEQ ID NO: 261036 - RNA, 19 nt, Human
uguaaccccaucucuacua

SEQ ID NO: 261037 - RNA, 32 nt, Human
uguaaccuaggagcaggaaacuucagcuuaac

SEQ ID NO: 261038 - RNA, 32 nt, Human
uguaaccucagugcuggggacugaggcgagcc

SEQ ID NO: 261039 - RNA, 32 nt, Human
uguaaccucugccuccugccucccggguccaa

SEQ ID NO: 261040 - RNA, 32 nt, Human
uguaaccucugccuccuggauucaaguguuag

SEQ ID NO: 261041 - RNA, 19 nt, Human
uguaaccucuucccuccac

SEQ ID NO: 261042 - RNA, 22 nt, Human
uguaaccugcugcccccuccac

SEQ ID NO: 261043 - RNA, 32 nt, Human
uguaaccuggcugcauauccagccucgagaaa

SEQ ID NO: 261044 - RNA, 32 nt, Human
uguaacgcucacugcgaaggucugcagcuuca

SEQ ID NO: 261045 - RNA, 32 nt, Human
uguaacggcggaugccuguaaucccagcuacu

SEQ ID NO: 261046 - RNA, 32 nt, Human
uguaacggcuucugauuucugugaaagcugcu

SEQ ID NO: 261047 - RNA, 32 nt, Human
uguaacgugaugaccugcugcuccuggccgcg

SEQ ID NO: 261048 - RNA, 32 nt, Human
uguaacuaaaaguaaauauucuaaauuaaguc

SEQ ID NO: 261049 - RNA, 32 nt, Human
uguaacuaauuucaguuguacugugaaugcua

SEQ ID NO: 261050 - RNA, 32 nt, Human
uguaacuagagggagaacggaaagcugaggug

SEQ ID NO: 261051 - RNA, 32 nt, Human
uguaacuauagaagugaauuguggacguaaaa

SEQ ID NO: 261052 - RNA, 32 nt, Human
uguaacuaugcagaguuguuuggacuucuucc

SEQ ID NO: 261053 - RNA, 32 nt, Human
uguaacucacugcagccugaaacuccuuggcu

SEQ ID NO: 261054 - RNA, 23 nt, Human
uguaacucaggcuggagugcagu

SEQ ID NO: 261055 - RNA, 32 nt, Human
uguaacucaucuuuuaguuuacacuuccuggg

SEQ ID NO: 261056 - RNA, 32 nt, Human
uguaacuccagccugggcaacagagugagacc

SEQ ID NO: 261057 - RNA, 32 nt, Human
uguaacucccacuggaagauggauucucagcc

SEQ ID NO: 261058 - RNA, 32 nt, Human
uguaacucggggccuaacuauaugagauggcu

SEQ ID NO: 261059 - RNA, 32 nt, Human
uguaacucuggccucaaucauauuccucuggg

SEQ ID NO: 261060 - RNA, 32 nt, Human
uguaacugaccucuggccuggccugcacagag

SEQ ID NO: 261061 - RNA, 31 nt, Human
uguaacugaggacguugucagaugcuugucc

SEQ ID NO: 261062 - RNA, 32 nt, Human
uguaacugaggcuuuaaaaagccaagacaucu

SEQ ID NO: 261063 - RNA, 32 nt, Human
uguaacugaggugaggguuguaguagaugcuu

SEQ ID NO: 261064 - RNA, 32 nt, Human
uguaacugccaggacacuuuuguguuugccca

SEQ ID NO: 261065 - RNA, 32 nt, Human
uguaacugcccuuuuaaauggcaugacaaggu

SEQ ID NO: 261066 - RNA, 32 nt, Human
uguaacugcuccacagcucccuggauaacaac

SEQ ID NO: 261067 - RNA, 32 nt, Human
uguaacugcugugggaagaguugcuauauugu

SEQ ID NO: 261068 - RNA, 29 nt, Human
uguaacuggcugcucccugcucccaggga

SEQ ID NO: 261069 - RNA, 32 nt, Human
uguaacuggcugcucccugcucccagggacug

SEQ ID NO: 261070 - RNA, 32 nt, Human
uguaacugggauuacaggcucccaccacaccu

SEQ ID NO: 261071 - RNA, 32 nt, Human
uguaacuggugacacccuuacaagaaaacugg

SEQ ID NO: 261072 - RNA, 32 nt, Human
uguaacuuaaauuaguugugcucugcuauuuu

SEQ ID NO: 261073 - RNA, 22 nt, Human
uguaacuuauucacucuguaaa

SEQ ID NO: 261074 - RNA, 32 nt, Human
uguaacuucauaauuucuuaccauaaccucaa

SEQ ID NO: 261075 - RNA, 32 nt, Human
uguaacuucuaugaucauuacuccaaaguugu

SEQ ID NO: 261076 - RNA, 32 nt, Human
uguaacuuggauguagccaugaccuuacauuu

SEQ ID NO: 261077 - RNA, 32 nt, Human
uguaacuugguuccucccuuucuuaagcccuu

SEQ ID NO: 261078 - RNA, 23 nt, Human
uguaagaaaaaguugagugggga

SEQ ID NO: 261079 - RNA, 32 nt, Human
uguaagaaaagcuuccaguagagcuucuuaua

SEQ ID NO: 261080 - RNA, 32 nt, Human
uguaagaaacaguggcuuauuucuucauuucu

SEQ ID NO: 261081 - RNA, 32 nt, Human
uguaagaaagaaaaggucagccucccaggcaa

SEQ ID NO: 261082 - RNA, 24 nt, Human
uguaagaaagaaaauguuacgugu

SEQ ID NO: 261083 - RNA, 32 nt, Human
uguaagaaagaccuaagguggggaagacuccu

SEQ ID NO: 261084 - RNA, 22 nt, Human
uguaagaaauuucuuacaugua

SEQ ID NO: 261085 - RNA, 21 nt, Human
uguaagaagaagagaugagga

SEQ ID NO: 261086 - RNA, 32 nt, Human
uguaagaagacagauauugacaaggacacuua

SEQ ID NO: 261087 - RNA, 32 nt, Human
uguaagaaggccucuugcuccuugccaggugc

SEQ ID NO: 261088 - RNA, 19 nt, Human
uguaagaagugccuuucac

SEQ ID NO: 261089 - RNA, 32 nt, Human
uguaagaauccuucucauagugaagcacuguu

SEQ ID NO: 261090 - RNA, 21 nt, Human
uguaagacaggaggaugggga

SEQ ID NO: 261091 - RNA, 32 nt, Human
uguaagacauguugcaaaagugucacaagaua

SEQ ID NO: 261092 - RNA, 32 nt, Human
uguaagacuuccugaaacaaguucucaagaag

SEQ ID NO: 261093 - RNA, 32 nt, Human
uguaagacuuucuaagcgcauggcuuugucgu

SEQ ID NO: 261094 - RNA, 32 nt, Human
uguaagagcgcuggaacauucugccucuugag

SEQ ID NO: 261095 - RNA, 32 nt, Human
uguaagagcuaaauccucaucugucauaucaa

SEQ ID NO: 261096 - RNA, 32 nt, Human
uguaagaggcagaugagcugggaaccuggaag

SEQ ID NO: 261097 - RNA, 32 nt, Human
uguaagaugaacacugguuugauccgggacaa

SEQ ID NO: 261098 - RNA, 32 nt, Human
uguaagaugucacugucuggguuccagcccuc

SEQ ID NO: 261099 - RNA, 32 nt, Human
uguaagcaaaauguugaauaucagggcauuuu

SEQ ID NO: 261100 - RNA, 32 nt, Human
uguaagcaacccaguuuaagaaacauggcaac

SEQ ID NO: 261101 - RNA, 32 nt, Human
uguaagcaaggaggggagaggcuuccaccgaa

SEQ ID NO: 261102 - RNA, 32 nt, Human
uguaagcaccuugaucuuggacuucccagccu

SEQ ID NO: 261103 - RNA, 32 nt, Human
uguaagcagagguggcuggcucugcagccuua

SEQ ID NO: 261104 - RNA, 32 nt, Human
uguaagcagccucuccccaucuaccuagcaac

SEQ ID NO: 261105 - RNA, 32 nt, Human
uguaagcagccugagucugucuacaggacaca

SEQ ID NO: 261106 - RNA, 32 nt, Human
uguaagcagguccaucucuccacccacugagg

SEQ ID NO: 261107 - RNA, 32 nt, Human
uguaagccaucacaccuggcccuagugacagg

SEQ ID NO: 261108 - RNA, 32 nt, Human
uguaagcuaaaaagcugugugaacccaggugu

SEQ ID NO: 261109 - RNA, 32 nt, Human
uguaaggaaagauaggaccaaauauguaagug

SEQ ID NO: 261110 - RNA, 25 nt, Human
uguaaggaagauuagaauguaugca

SEQ ID NO: 261111 - RNA, 32 nt, Human
uguaaggacuccugagauauguguccagcaag

SEQ ID NO: 261112 - RNA, 32 nt, Human
uguaaggcaguuggggaguaucuauugaaagu

SEQ ID NO: 261113 - RNA, 32 nt, Human
uguaaggcauuuucaucuuuccuucggguugg

SEQ ID NO: 261114 - RNA, 32 nt, Human
uguaaggcguggaauaggaguugcucagugga

SEQ ID NO: 261115 - RNA, 32 nt, Human
uguaaggcuuaacacaguggguggugaguucu

SEQ ID NO: 261116 - RNA, 32 nt, Human
uguaagggagacucagucccagccucuccccu

SEQ ID NO: 261117 - RNA, 32 nt, Human
uguaaggggcagcaguugaggugggguagugc

SEQ ID NO: 261118 - RNA, 32 nt, Human
uguaaggguaccuuaaaacaagagacucgcuu

SEQ ID NO: 261119 - RNA, 32 nt, Human
uguaaggugccacccccaaacuuuaagguagc

SEQ ID NO: 261120 - RNA, 32 nt, Human
uguaagguggcuggaaagaaccuugaggagag

SEQ ID NO: 261121 - RNA, 32 nt, Human
uguaagguuaaguagcggcacagcauugacaa

SEQ ID NO: 261122 - RNA, 32 nt, Human
uguaaguaaagaaacaagcagaugguauccag

SEQ ID NO: 261123 - RNA, 32 nt, Human
uguaaguagcuggcuugggguaucagcaaauu

SEQ ID NO: 261124 - RNA, 32 nt, Human
uguaaguagggugggacagagauggcaccugg

SEQ ID NO: 261125 - RNA, 22 nt, Human
uguaaguauauguauauacaua

SEQ ID NO: 261126 - RNA, 32 nt, Human
uguaaguauauuuuggaacagauuuguaauuu

SEQ ID NO: 261127 - RNA, 32 nt, Human
uguaagucagcuucucagguggucggacguga

SEQ ID NO: 261128 - RNA, 32 nt, Human
uguaagucauuucuucaguccuucuccucugu

SEQ ID NO: 261129 - RNA, 32 nt, Human
uguaagucccagcuacucaggaggcuuaggua

SEQ ID NO: 261130 - RNA, 32 nt, Human
uguaaguccuuccucuggggaagugaagggua

SEQ ID NO: 261131 - RNA, 20 nt, Human
uguaagucugugccuggaga

SEQ ID NO: 261132 - RNA, 23 nt, Human
uguaagugaauggagaccucaaa

SEQ ID NO: 261133 - RNA, 32 nt, Human
uguaagugauguggacauaauugccuacaaua

SEQ ID NO: 261134 - RNA, 32 nt, Human
uguaagugauguggacguaauugccuacagua

SEQ ID NO: 261135 - RNA, 32 nt, Human
uguaagugcaggaaaccgaguagaaaauguga

SEQ ID NO: 261136 - RNA, 32 nt, Human
uguaagugcucaaauccuccaucuccucacuu

SEQ ID NO: 261137 - RNA, 32 nt, Human
uguaaguggaaauguaauuguguaccaguuuc

SEQ ID NO: 261138 - RNA, 32 nt, Human
uguaaguggagcuguuaaaaacagcagugcug

SEQ ID NO: 261139 - RNA, 32 nt, Human
uguaagugguggggcugggagaggaggaacag

SEQ ID NO: 261140 - RNA, 24 nt, Human
uguaaguguauauauguguguaua

SEQ ID NO: 261141 - RNA, 32 nt, Human
uguaaguguguaguuugaugagcuuggacaaa

SEQ ID NO: 261142 - RNA, 32 nt, Human
uguaaguucaucuagaucuccaccucaccugu

SEQ ID NO: 261143 - RNA, 32 nt, Human
uguaaguuucaguugcugaauauaucaguaua

SEQ ID NO: 261144 - RNA, 32 nt, Human
uguaauaaaacaaugacagcuguaguaacuau

SEQ ID NO: 261145 - RNA, 32 nt, Human
uguaauaaaaccagcagagacacacugagaau

SEQ ID NO: 261146 - RNA, 32 nt, Human
uguaauaacucacguacucugaagagagcuug

SEQ ID NO: 261147 - RNA, 32 nt, Human
uguaauaagcauauaauaaacacguauauaca

SEQ ID NO: 261148 - RNA, 32 nt, Human
uguaauacaagcuuucuuuucauugccuagua

SEQ ID NO: 261149 - RNA, 32 nt, Human
uguaauacaagugaucauagaaggugagaaug

SEQ ID NO: 261150 - RNA, 32 nt, Human
uguaauacgccaaccagucaaguuguguuuug

SEQ ID NO: 261151 - RNA, 32 nt, Human
uguaauaguucuauccuuuugccugcagguca

SEQ ID NO: 261152 - RNA, 32 nt, Human
uguaauauauuugcacaguagaugcuauggau

SEQ ID NO: 261153 - RNA, 32 nt, Human
uguaauaucccuccccauucuucucuuccccu

SEQ ID NO: 261154 - RNA, 32 nt, Human
uguaauauuccaggaugcugcugcaggucucg

SEQ ID NO: 261155 - RNA, 32 nt, Human
uguaauauuccaggaugcugcugcagguggcg

SEQ ID NO: 261156 - RNA, 32 nt, Human
uguaauauuccuuugggguaaguuuccgaaga

SEQ ID NO: 261157 - RNA, 20 nt, Human
uguaauauugcuguccucua

SEQ ID NO: 261158 - RNA, 32 nt, Human
uguaauauuggguggaagaagccaggaggaag

SEQ ID NO: 261159 - RNA, 32 nt, Human
uguaaucacaccacugcacuccagcuuggggg

SEQ ID NO: 261160 - RNA, 32 nt, Human
uguaaucacagguccagagagcuuuauggaag

SEQ ID NO: 261161 - RNA, 32 nt, Human
uguaaucacagugacucaggaggcugagguga

SEQ ID NO: 261162 - RNA, 32 nt, Human
uguaaucacucuggccaaagagagaagggagg

SEQ ID NO: 261163 - RNA, 32 nt, Human
uguaaucacugcacuccaaccuggcaacagag

SEQ ID NO: 261164 - RNA, 32 nt, Human
uguaaucacugcacuuucggaagcugaggugg

SEQ ID NO: 261165 - RNA, 32 nt, Human
uguaaucacugcacuuugggaagcugaggugg

SEQ ID NO: 261166 - RNA, 32 nt, Human
uguaaucagcaacauauucccaacaggaaaau

SEQ ID NO: 261167 - RNA, 32 nt, Human
uguaaucagcuacucgggaggcugaggcaggg

SEQ ID NO: 261168 - RNA, 19 nt, Human
uguaaucagcucccuccau

SEQ ID NO: 261169 - RNA, 32 nt, Human
uguaaucaggagaaagggacagaggaagcccc

SEQ ID NO: 261170 - RNA, 32 nt, Human
uguaaucaguuaugccuauguaaugaagcuuc

SEQ ID NO: 261171 - RNA, 32 nt, Human
uguaaucauacuauuaaaugacucuggaguca

SEQ ID NO: 261172 - RNA, 32 nt, Human
uguaaucauagagaaaagcaaagaagaaaucc

SEQ ID NO: 261173 - RNA, 32 nt, Human
uguaaucauucugaggugaggcuuuucuuauu

SEQ ID NO: 261174 - RNA, 32 nt, Human
uguaaucauugaaccucgagucacuguaaaag

SEQ ID NO: 261175 - RNA, 32 nt, Human
uguaaucauuuugaacaugugugaaaguugau

SEQ ID NO: 261176 - RNA, 32 nt, Human
uguaauccaaaucucuguggcuucaugcuugu

SEQ ID NO: 261177 - RNA, 32 nt, Human
uguaaucccaacacuuucuauuuucuagaauc

SEQ ID NO: 261178 - RNA, 32 nt, Human
uguaaucccagcacuugggaggccguggcagg

SEQ ID NO: 261179 - RNA, 32 nt, Human
uguaaucccagcuaaaggaggcugagguugca

SEQ ID NO: 261180 - RNA, 32 nt, Human
uguaaucccagcuacucaaggcugaggcagga

SEQ ID NO: 261181 - RNA, 20 nt, Human
uguaaucccagcuacucagg

SEQ ID NO: 261182 - RNA, 32 nt, Human
uguaaucccagcuacucccaaggcugaggcag

SEQ ID NO: 261183 - RNA, 20 nt, Human
uguaaucccagcuacucggg

SEQ ID NO: 261184 - RNA, 20 nt, Human
uguaaucccagcuacuuggg

SEQ ID NO: 261185 - RNA, 32 nt, Human
uguaaucccagcuucuggaggcugaggccaga

SEQ ID NO: 261186 - RNA, 32 nt, Human
uguaaucccuuagcuacucaggaggcugaggc

SEQ ID NO: 261187 - RNA, 32 nt, Human
uguaauccuaaguaacacuuugggaggcuggg

SEQ ID NO: 261188 - RNA, 32 nt, Human
uguaauccuagcacuuugggggaccaagucag

SEQ ID NO: 261189 - RNA, 32 nt, Human
uguaauccuagcagguugggaggccaaggugg

SEQ ID NO: 261190 - RNA, 32 nt, Human
uguaauccuggcuacucaggaggccgaggcag

SEQ ID NO: 261191 - RNA, 32 nt, Human
uguaauccugggguugguauguaggaggucua

SEQ ID NO: 261192 - RNA, 32 nt, Human
uguaaucguagcugaggcaggagaaucgccug

SEQ ID NO: 261193 - RNA, 32 nt, Human
uguaaucgugcaaauaaacgcucacuccgaau

SEQ ID NO: 261194 - RNA, 32 nt, Human
uguaaucuacauuccaucaccuuuaucaggug

SEQ ID NO: 261195 - RNA, 31 nt, Human
uguaaucucaauaaauguggauugaaguuuu

SEQ ID NO: 261196 - RNA, 32 nt, Human
uguaaucucccaacaccccaugaagcaaggcu

SEQ ID NO: 261197 - RNA, 32 nt, Human
uguaaucugcauucuccaggaguuuuaugugu

SEQ ID NO: 261198 - RNA, 32 nt, Human
uguaaucuguuucccagggaaauaagcuauug

SEQ ID NO: 261199 - RNA, 32 nt, Human
uguaaucuuugggagcacuuugggaggccgag

SEQ ID NO: 261200 - RNA, 24 nt, Human
uguaaugaaaacuuuacaugaaug

SEQ ID NO: 261201 - RNA, 32 nt, Human
uguaaugagucuggcaaagccuuaaugagcag

SEQ ID NO: 261202 - RNA, 32 nt, Human
uguaaugauccauucaugagcugguaugaaau

SEQ ID NO: 261203 - RNA, 32 nt, Human
uguaaugaucucuuucuuuuguuaauacugcu

SEQ ID NO: 261204 - RNA, 32 nt, Human
uguaaugauucuggcuauuaaucucuauuaug

SEQ ID NO: 261205 - RNA, 32 nt, Human
uguaaugcaaagcauauuuggcaagcaguuca

SEQ ID NO: 261206 - RNA, 32 nt, Human
uguaaugccuagugccuucuauuuacagugaa

SEQ ID NO: 261207 - RNA, 32 nt, Human
uguaaugcuaccucuugaaacugacauccuag

SEQ ID NO: 261208 - RNA, 32 nt, Human
uguaaugcugcagcugagccugggacaggucu

SEQ ID NO: 261209 - RNA, 32 nt, Human
uguaauggaucaauuuaaaauauuuuauuucu

SEQ ID NO: 261210 - RNA, 32 nt, Human
uguaaugggguugaaagcuggggaggaggauc

SEQ ID NO: 261211 - RNA, 32 nt, Human
uguaaugguauguccagccucacucucccucc

SEQ ID NO: 261212 - RNA, 32 nt, Human
uguaaugguggaggugugggcagaggagggag

SEQ ID NO: 261213 - RNA, 32 nt, Human
uguaauguucugaacaaacuugaaugaugaaa

SEQ ID NO: 261214 - RNA, 32 nt, Human
uguaauguugcagauccgcaggcagaagcucu

SEQ ID NO: 261215 - RNA, 32 nt, Human
uguaauguuggucauaauacugcuauaaauau

SEQ ID NO: 261216 - RNA, 32 nt, Human
uguaauuacagaauuuacgaaauguaaauggc

SEQ ID NO: 261217 - RNA, 32 nt, Human
uguaauuacagcccuaucuggagacagcgaau

SEQ ID NO: 261218 - RNA, 32 nt, Human
uguaauuaugugaacuuuugagagagaugaaa

SEQ ID NO: 261219 - RNA, 32 nt, Human
uguaauucaagaagugccuggaagagagggug

SEQ ID NO: 261220 - RNA, 32 nt, Human
uguaauuccagcugcuugggagccugaggcag

SEQ ID NO: 261221 - RNA, 32 nt, Human
uguaauucucacccucucccaagauguuugcc

SEQ ID NO: 261222 - RNA, 32 nt, Human
uguaauucugacacugugucucccgggcuugu

SEQ ID NO: 261223 - RNA, 32 nt, Human
uguaauugaaaccacauggaaagacuagaaau

SEQ ID NO: 261224 - RNA, 32 nt, Human
uguaauugcaccacugcacuccagccugggug

SEQ ID NO: 261225 - RNA, 32 nt, Human
uguaauugcaucacugcacuccaaccugggca

SEQ ID NO: 261226 - RNA, 32 nt, Human
uguaauuuaaggccuuccacaaugaacaguuc

SEQ ID NO: 261227 - RNA, 32 nt, Human
uguaauuuccuucccuccuuuaaccuggcgau

SEQ ID NO: 261228 - RNA, 32 nt, Human
uguaauuugcagggaaauugacugcaggugau

SEQ ID NO: 261229 - RNA, 32 nt, Human
uguaauuuguaagagacaguaaaugguggcau

SEQ ID NO: 261230 - RNA, 32 nt, Human
uguaauuuuccuuuucccagcaugacgaaaaa

SEQ ID NO: 261231 - RNA, 32 nt, Human
uguaauuuugugacacgcucucugccaagccc

SEQ ID NO: 261232 - RNA, 32 nt, Human
uguacaaaacauuugagaaaauauuuuaggac

SEQ ID NO: 261233 - RNA, 32 nt, Human
uguacaaaaguggacagaaaaguggcuggaca

SEQ ID NO: 261234 - RNA, 32 nt, Human
uguacaaacucaaguaugcaagaaauacaucu

SEQ ID NO: 261235 - RNA, 32 nt, Human
uguacaaagaaauuucccucccugccugcaca

SEQ ID NO: 261236 - RNA, 32 nt, Human
uguacaaagacacauguaauggagauuguaca

SEQ ID NO: 261237 - RNA, 23 nt, Human
uguacaaaggaggaagcuucaaa

SEQ ID NO: 261238 - RNA, 32 nt, Human
uguacaacacagaaccaaaugagaaacaguuc

SEQ ID NO: 261239 - RNA, 22 nt, Human
uguacaacaggaagacuugaaa

SEQ ID NO: 261240 - RNA, 32 nt, Human
uguacaacaugcugguuucuguaggguauuuu

SEQ ID NO: 261241 - RNA, 32 nt, Human
uguacaaccaaagagcuaucucaggagaagau

SEQ ID NO: 261242 - RNA, 32 nt, Human
uguacaaccagagaacaggauucuucccuucu

SEQ ID NO: 261243 - RNA, 32 nt, Human
uguacaagaagagauaucuguggaugcuaugc

SEQ ID NO: 261244 - RNA, 32 nt, Human
uguacaagauacaguuucccugggacauaaau

SEQ ID NO: 261245 - RNA, 21 nt, Human
uguacaagcaugacaccaaca

SEQ ID NO: 261246 - RNA, 32 nt, Human
uguacaagcaugcaccaacaguccuuaguuuu

SEQ ID NO: 261247 - RNA, 32 nt, Human
uguacaaggaacagcccucagacguguucugc

SEQ ID NO: 261248 - RNA, 32 nt, Human
uguacaagugaguccgggugguguggguguga

SEQ ID NO: 261249 - RNA, 32 nt, Human
uguacaaucuucccugucaugacuuuaaguuc

SEQ ID NO: 261250 - RNA, 32 nt, Human
uguacaauguacaauuguuucauuucagaaaa

SEQ ID NO: 261251 - RNA, 32 nt, Human
uguacaauucaaaaucaugcaauguuucacuu

SEQ ID NO: 261252 - RNA, 32 nt, Human
uguacaauugaauuggaaauggugcuagucag

SEQ ID NO: 261253 - RNA, 32 nt, Human
uguacaauuggauuccaggaaggaaggagccu

SEQ ID NO: 261254 - RNA, 32 nt, Human
uguacacaaggcagaaggaaguaaaauuucca

SEQ ID NO: 261255 - RNA, 32 nt, Human
uguacacacacuuccucaucacugcagccauu

SEQ ID NO: 261256 - RNA, 32 nt, Human
uguacacacagcaacucagaugaaacucaagg

SEQ ID NO: 261257 - RNA, 20 nt, Human
uguacacacaucccucugag

SEQ ID NO: 261258 - RNA, 32 nt, Human
uguacacagugccaccagugcuccugcagugc

SEQ ID NO: 261259 - RNA, 32 nt, Human
uguacacauaugcacacuuugcacacagacac

SEQ ID NO: 261260 - RNA, 32 nt, Human
uguacacaucugcuuuguuccacacacaugca

SEQ ID NO: 261261 - RNA, 24 nt, Human
uguacacauggugccuucuaagga

SEQ ID NO: 261262 - RNA, 32 nt, Human
uguacaccauggugguucaggcugcaguggcu

SEQ ID NO: 261263 - RNA, 32 nt, Human
uguacacugaucuuuuucaugaggaugggucc

SEQ ID NO: 261264 - RNA, 32 nt, Human
uguacacugcacgaauggaagaggcaccuguc

SEQ ID NO: 261265 - RNA, 32 nt, Human
uguacacuucagcagcuugcacaagggagcuc

SEQ ID NO: 261266 - RNA, 32 nt, Human
uguacacuuggcugucaggcuuucugugcaug

SEQ ID NO: 261267 - RNA, 32 nt, Human
uguacagaagcagcagacaagaucuuccagau

SEQ ID NO: 261268 - RNA, 32 nt, Human
uguacagacauguacucucacacacacaggca

SEQ ID NO: 261269 - RNA, 32 nt, Human
uguacagacucggaaaggucaggaaguucuua

SEQ ID NO: 261270 - RNA, 32 nt, Human
uguacagagcaugcaggccaugucugccagcc

SEQ ID NO: 261271 - RNA, 32 nt, Human
uguacagagccaggaacccuacugcaguaaac

SEQ ID NO: 261272 - RNA, 32 nt, Human
uguacagauaauuuugguggcuuuguuaaugu

SEQ ID NO: 261273 - RNA, 32 nt, Human
uguacagauagaaucccuaccccugcauuugu

SEQ ID NO: 261274 - RNA, 32 nt, Human
uguacagcacugaaaugaaaucaaagaugaag

SEQ ID NO: 261275 - RNA, 32 nt, Human
uguacagcaggcagaaucucuaugaugacugg

SEQ ID NO: 261276 - RNA, 32 nt, Human
uguacagcaggcaggagggugggcaggcaacc

SEQ ID NO: 261277 - RNA, 32 nt, Human
uguacagccagcauucagauuauagguguacc

SEQ ID NO: 261278 - RNA, 32 nt, Human
uguacagccaugaccacuagcuaauucagaau

SEQ ID NO: 261279 - RNA, 32 nt, Human
uguacagccucagcgcaccaggagacccuaga

SEQ ID NO: 261280 - RNA, 32 nt, Human
uguacagcucuucauguugccaaagcaccaag

SEQ ID NO: 261281 - RNA, 22 nt, Human
uguacagcuggcucuacuuccc

SEQ ID NO: 261282 - RNA, 32 nt, Human
uguacaggcacugucuucagcccgaguuccag

SEQ ID NO: 261283 - RNA, 32 nt, Human
uguacaggcccagccucugccucacagcagac

SEQ ID NO: 261284 - RNA, 32 nt, Human
uguacaggcccgggacccagagcgaggguccc

SEQ ID NO: 261285 - RNA, 32 nt, Human
uguacaggcugagacacagcccagagacugaa

SEQ ID NO: 261286 - RNA, 32 nt, Human
uguacagggguuggguggggguugcaggacuc

SEQ ID NO: 261287 - RNA, 32 nt, Human
uguacagguggguuugggagagaggagcaugc

SEQ ID NO: 261288 - RNA, 32 nt, Human
uguacaguaguuuugccccuuuaauuggggca

SEQ ID NO: 261289 - RNA, 32 nt, Human
uguacaguauggccuguugcucaagucuacac

SEQ ID NO: 261290 - RNA, 32 nt, Human
uguacagucacagggaauucugaucugaaggg

SEQ ID NO: 261291 - RNA, 32 nt, Human
uguacaguccccaucaguagcguauagaacac

SEQ ID NO: 261292 - RNA, 32 nt, Human
uguacaguccuuuuucuagaagugagacauac

SEQ ID NO: 261293 - RNA, 23 nt, Human
uguacagugacaucuucugggau

SEQ ID NO: 261294 - RNA, 32 nt, Human
uguacagugccuggcacucugggugcucaaua

SEQ ID NO: 261295 - RNA, 32 nt, Human
uguacaguggguggaaagggcauuuggagcuc

SEQ ID NO: 261296 - RNA, 18 nt, Human
uguacauacauaaacaca

SEQ ID NO: 261297 - RNA, 32 nt, Human
uguacauacauaaacacacauacauguagcac

SEQ ID NO: 261298 - RNA, 32 nt, Human
uguacauacauacuguaugaagcuuguccucu

SEQ ID NO: 261299 - RNA, 32 nt, Human
uguacauacaugcacauacucaaacaugcgua

SEQ ID NO: 261300 - RNA, 32 nt, Human
uguacauacuugcacacagguuccccauguac

SEQ ID NO: 261301 - RNA, 32 nt, Human
uguacauaguuugcuccucugcccuagcccuc

SEQ ID NO: 261302 - RNA, 32 nt, Human
uguacaucaaagaacucauacuggagagaaac

SEQ ID NO: 261303 - RNA, 32 nt, Human
uguacauccucuuuaccaucccuccuucucuc

SEQ ID NO: 261304 - RNA, 32 nt, Human
uguacaucgucuucgucuuccuccugggcgcc

SEQ ID NO: 261305 - RNA, 32 nt, Human
uguacaugagacaggauaccacugucuuuuau

SEQ ID NO: 261306 - RNA, 32 nt, Human
uguacaugcucggaggccuggccauauaggag

SEQ ID NO: 261307 - RNA, 32 nt, Human
uguacauggcaaaguuucaaagagcucuuggc

SEQ ID NO: 261308 - RNA, 32 nt, Human
uguacauggcguguuacauuccugaaccuacu

SEQ ID NO: 261309 - RNA, 32 nt, Human
uguacaugggaggcaugugugugauguguaca

SEQ ID NO: 261310 - RNA, 32 nt, Human
uguacaugggcaggugugucccccaggaaagc

SEQ ID NO: 261311 - RNA, 32 nt, Human
uguacaugugugugugagcacaugugugcaug

SEQ ID NO: 261312 - RNA, 24 nt, Human
uguacauguuuuggagacuucaaa

SEQ ID NO: 261313 - RNA, 32 nt, Human
uguacauuggucagguauauuaucucaaagga

SEQ ID NO: 261314 - RNA, 32 nt, Human
uguacauuguuugaaauguucuuuuuguaaca

SEQ ID NO: 261315 - RNA, 32 nt, Human
uguacauuuagacauuuggguucaguugcuug

SEQ ID NO: 261316 - RNA, 22 nt, Human
uguaccaaaacucaucaguggc

SEQ ID NO: 261317 - RNA, 32 nt, Human
uguaccaaaccacaugggaguauggaaaggcu

SEQ ID NO: 261318 - RNA, 32 nt, Human
uguaccacagaauucagaguccagcacaucac

SEQ ID NO: 261319 - RNA, 18 nt, Human
uguaccaccacacacgga

SEQ ID NO: 261320 - RNA, 21 nt, Human
uguaccaccacauagcacaug

SEQ ID NO: 261321 - RNA, 19 nt, Human
uguaccaccagcagcugga

SEQ ID NO: 261322 - RNA, 18 nt, Human
uguaccaccuaauguaga

SEQ ID NO: 261323 - RNA, 22 nt, Human
uguaccacugagugccuuucac

SEQ ID NO: 261324 - RNA, 32 nt, Human
uguaccacugcacuccaaccuggguuacagca

SEQ ID NO: 261325 - RNA, 32 nt, Human
uguaccacugcacuccagccuggcugacagug

SEQ ID NO: 261326 - RNA, 32 nt, Human
uguaccacugcacuccagccugggcaacagag

SEQ ID NO: 261327 - RNA, 32 nt, Human
uguaccacugcacuccagccugggcgacagag

SEQ ID NO: 261328 - RNA, 32 nt, Human
uguaccacugcacuccagccugggugacagag

SEQ ID NO: 261329 - RNA, 32 nt, Human
uguaccacugcacuccagccuggucaauggag

SEQ ID NO: 261330 - RNA, 32 nt, Human
uguaccacugcacuccagcucggggaacagag

SEQ ID NO: 261331 - RNA, 32 nt, Human
uguaccacugcacuccagucugggcaacagac

SEQ ID NO: 261332 - RNA, 32 nt, Human
uguaccacugcacuccaguuuggcaacagagu

SEQ ID NO: 261333 - RNA, 32 nt, Human
uguaccacugcgcuccaaacugggugacaugg

SEQ ID NO: 261334 - RNA, 32 nt, Human
uguaccacugggauagaggaaucaagaggaca

SEQ ID NO: 261335 - RNA, 32 nt, Human
uguaccacuguacuccagccugggcuggacag

SEQ ID NO: 261336 - RNA, 32 nt, Human
uguaccacuguauuccagccuggacgacugag

SEQ ID NO: 261337 - RNA, 19 nt, Human
uguaccagaaucucuggga

SEQ ID NO: 261338 - RNA, 32 nt, Human
uguaccagagaaggaaaagucugaucccgaaa

SEQ ID NO: 261339 - RNA, 32 nt, Human
uguaccagagcacauuccuuaggggacggcuu

SEQ ID NO: 261340 - RNA, 32 nt, Human
uguaccagagcaccuccaaacugcauugagga

SEQ ID NO: 261341 - RNA, 32 nt, Human
uguaccaggccccagacugagacuuaggcuuc

SEQ ID NO: 261342 - RNA, 32 nt, Human
uguaccaggugggcacaugaagacacaagaag

SEQ ID NO: 261343 - RNA, 32 nt, Human
uguaccagugucacucuggaguacagcgggag

SEQ ID NO: 261344 - RNA, 32 nt, Human
uguaccauaccugcugggccagucccacacau

SEQ ID NO: 261345 - RNA, 32 nt, Human
uguaccauccccauccugagugacuacuaagc

SEQ ID NO: 261346 - RNA, 23 nt, Human
uguaccaucucuaagcaucgagg

SEQ ID NO: 261347 - RNA, 32 nt, Human
uguaccaucugaauuuugcauuuuagcacuug

SEQ ID NO: 261348 - RNA, 32 nt, Human
uguaccaucuugaggcacagcagccacugcuc

SEQ ID NO: 261349 - RNA, 32 nt, Human
uguaccaugcacuccagccuggguaacagagc

SEQ ID NO: 261350 - RNA, 32 nt, Human
uguaccauggcacuccagccuggacaacaaga

SEQ ID NO: 261351 - RNA, 32 nt, Human
uguaccauugcacuccagccugggcaacaaga

SEQ ID NO: 261352 - RNA, 32 nt, Human
uguaccauugcacuccagccugggcaacagag

SEQ ID NO: 261353 - RNA, 32 nt, Human
uguacccaaccuucccuucucccuugagugcu

SEQ ID NO: 261354 - RNA, 32 nt, Human
uguacccacagcuugcugagggcugcucuucu

SEQ ID NO: 261355 - RNA, 32 nt, Human
uguacccagaacuuaaagugagacaaaaccaa

SEQ ID NO: 261356 - RNA, 31 nt, Human
uguacccagagaggcggcagcaggagagcca

SEQ ID NO: 261357 - RNA, 32 nt, Human
uguacccagcugguugggaggaccagagccug

SEQ ID NO: 261358 - RNA, 32 nt, Human
uguacccaggaggcagagauugcagugagcug

SEQ ID NO: 261359 - RNA, 32 nt, Human
uguacccaggaggcggagguuguagugagcug

SEQ ID NO: 261360 - RNA, 32 nt, Human
uguacccaggagguggagguugcagugagccg

SEQ ID NO: 261361 - RNA, 32 nt, Human
uguacccaggagguggagguugcggugaacug

SEQ ID NO: 261362 - RNA, 32 nt, Human
uguacccauucgacaggugagacaucuggggu

SEQ ID NO: 261363 - RNA, 32 nt, Human
uguacccccaaagugcuggauuacagguguga

SEQ ID NO: 261364 - RNA, 32 nt, Human
uguaccccucucagucugcaguauugaguugu

SEQ ID NO: 261365 - RNA, 32 nt, Human
uguaccccuuaaggagaagcucucauuuauuu

SEQ ID NO: 261366 - RNA, 32 nt, Human
uguaccccuuacccaggccucugaggggccag

SEQ ID NO: 261367 - RNA, 32 nt, Human
uguacccgaccuucccuucucccuugagugcu

SEQ ID NO: 261368 - RNA, 32 nt, Human
uguacccuccacccuuuuccuggcccccuaau

SEQ ID NO: 261369 - RNA, 32 nt, Human
uguacccuccuccccucuccuacugucauucu

SEQ ID NO: 261370 - RNA, 20 nt, Human
uguacccuggccccacgggg

SEQ ID NO: 261371 - RNA, 32 nt, Human
uguacccuggggacuaggaggaagggggcaga

SEQ ID NO: 261372 - RNA, 22 nt, Human
uguacccugucuuguggcagga

SEQ ID NO: 261373 - RNA, 23 nt, Human
uguacccuguguggucugcagga

SEQ ID NO: 261374 - RNA, 23 nt, Human
uguacccuucuggacuggcagga

SEQ ID NO: 261375 - RNA, 32 nt, Human
uguacccuucuucuuuuccuaggcccuguccu

SEQ ID NO: 261376 - RNA, 32 nt, Human
uguacccuuggaaaauucccuucccauggagc

SEQ ID NO: 261377 - RNA, 32 nt, Human
uguacccuuugaccauaucccaaaggauaguc

SEQ ID NO: 261378 - RNA, 32 nt, Human
uguaccgcgagggucugcggcuucauucuuga

SEQ ID NO: 261379 - RNA, 21 nt, Human
uguaccggaaguugccucuac

SEQ ID NO: 261380 - RNA, 32 nt, Human
uguaccggcuagguucagauuucagaaaucag

SEQ ID NO: 261381 - RNA, 32 nt, Human
uguaccgggggugggguggggagccaggcccg

SEQ ID NO: 261382 - RNA, 32 nt, Human
uguaccggugugacuagaaacagcucuucugg

SEQ ID NO: 261383 - RNA, 32 nt, Human
uguaccguucaucgccgucaccagcuuccugu

SEQ ID NO: 261384 - RNA, 32 nt, Human
uguaccuaaaaauucagaguaggagagaaauc

SEQ ID NO: 261385 - RNA, 32 nt, Human
uguaccuaaggcccuggguucaagagaguugg

SEQ ID NO: 261386 - RNA, 32 nt, Human
uguaccuaaggugauggggaacuccauucaga

SEQ ID NO: 261387 - RNA, 32 nt, Human
uguaccuauagccccugaauacaugcucaggu

SEQ ID NO: 261388 - RNA, 32 nt, Human
uguaccuauuaaaaguugcaaaguggaauuaa

SEQ ID NO: 261389 - RNA, 32 nt, Human
uguaccucaaagauuuccuaaagucagugccc

SEQ ID NO: 261390 - RNA, 32 nt, Human
uguaccucaaucuccauugcuuucagcaccac

SEQ ID NO: 261391 - RNA, 32 nt, Human
uguaccucacaaaaucaugcaaucuugcagug

SEQ ID NO: 261392 - RNA, 32 nt, Human
uguaccuccacucagcacaguucauguucagu

SEQ ID NO: 261393 - RNA, 32 nt, Human
uguaccuccagccuuucacuccucgguccucc

SEQ ID NO: 261394 - RNA, 32 nt, Human
uguaccucccucacuucucuccuaucacugcu

SEQ ID NO: 261395 - RNA, 32 nt, Human
uguaccuccuaccucagucuaugugagaggaa

SEQ ID NO: 261396 - RNA, 32 nt, Human
uguaccuccuggacuucuccccaggcucacuc

SEQ ID NO: 261397 - RNA, 32 nt, Human
uguaccucgcgcacuccucuugcuccaggucc

SEQ ID NO: 261398 - RNA, 32 nt, Human
uguaccucuagucccagcuacuugggaggcuu

SEQ ID NO: 261399 - RNA, 32 nt, Human
uguaccucuggcaaaugccccaccuuggugau

SEQ ID NO: 261400 - RNA, 32 nt, Human
uguaccucuguuacucucagccuggaaucccc

SEQ ID NO: 261401 - RNA, 28 nt, Human
uguaccugcagugcugcuuuucuugccu

SEQ ID NO: 261402 - RNA, 18 nt, Human
uguaccugcaguguagua

SEQ ID NO: 261403 - RNA, 32 nt, Human
uguaccugcauucccagcuacuugggaggcug

SEQ ID NO: 261404 - RNA, 32 nt, Human
uguaccuggcuucucuucuuccuuuccugcuc

SEQ ID NO: 261405 - RNA, 32 nt, Human
uguaccugggaagcgcagguugcagugagcug

SEQ ID NO: 261406 - RNA, 32 nt, Human
uguaccugggaggaggagguugcagugagcug

SEQ ID NO: 261407 - RNA, 32 nt, Human
uguaccuguagucccagcuacuugggaggcug

SEQ ID NO: 261408 - RNA, 32 nt, Human
uguaccuguaguccuagcuauuugggaagcug

SEQ ID NO: 261409 - RNA, 32 nt, Human
uguaccugugugugugcaugugcacguguuug

SEQ ID NO: 261410 - RNA, 32 nt, Human
uguaccuguuggcggccgggugcaguggcuca

SEQ ID NO: 261411 - RNA, 32 nt, Human
uguaccuuaaacuuccacaucacugcacccug

SEQ ID NO: 261412 - RNA, 32 nt, Human
uguaccuuaauuacuacuguauuugcaaauua

SEQ ID NO: 261413 - RNA, 32 nt, Human
uguaccuucuccaccugcccccaggaaaaaga

SEQ ID NO: 261414 - RNA, 32 nt, Human
uguacgagaaguggccgaagaggcucaggcag

SEQ ID NO: 261415 - RNA, 32 nt, Human
uguacgaggagaaugagugcucccugguggug

SEQ ID NO: 261416 - RNA, 32 nt, Human
uguacgaggaugacaucaccuucuguacccug

SEQ ID NO: 261417 - RNA, 32 nt, Human
uguacgaguggaggacagggacagagcccucu

SEQ ID NO: 261418 - RNA, 32 nt, Human
uguacgcaguuaccacacaguuaccaagcagu

SEQ ID NO: 261419 - RNA, 32 nt, Human
uguacgccaaggaugagcucuagaucauuuga

SEQ ID NO: 261420 - RNA, 32 nt, Human
uguacgcguugccggcgaagaggggagccuga

SEQ ID NO: 261421 - RNA, 32 nt, Human
uguacgcucacuugccccagaugccuccucug

SEQ ID NO: 261422 - RNA, 32 nt, Human
uguacgcugcucauaguagcuuccugccaaag

SEQ ID NO: 261423 - RNA, 32 nt, Human
uguacgcugugguggucacccccaugcugaac

SEQ ID NO: 261424 - RNA, 32 nt, Human
uguacggccuggacaggaugguggucuuucuc

SEQ ID NO: 261425 - RNA, 32 nt, Human
uguacgggaagaggcagagggaggcagccagc

SEQ ID NO: 261426 - RNA, 32 nt, Human
uguacggucugacuucuugagcccauacucaa

SEQ ID NO: 261427 - RNA, 32 nt, Human
uguacguaaaacaaaauagggcuuggcugguc

SEQ ID NO: 261428 - RNA, 29 nt, Human
uguacguaucugugugaguguggggguuu

SEQ ID NO: 261429 - RNA, 32 nt, Human
uguacguccucccagggagaccuaaaccuggc

SEQ ID NO: 261430 - RNA, 32 nt, Human
uguacgugcaugcuguagcugcagccugcauc

SEQ ID NO: 261431 - RNA, 32 nt, Human
uguacgugccuguagucucagcuacuugggag

SEQ ID NO: 261432 - RNA, 32 nt, Human
uguacgugcuccaugcauggccacuugggcua

SEQ ID NO: 261433 - RNA, 32 nt, Human
uguacguuccuaggaucggggcugcuuaugcc

SEQ ID NO: 261434 - RNA, 32 nt, Human
uguacguucuuccgaagcacugaugaucaaaa

SEQ ID NO: 261435 - RNA, 32 nt, Human
uguacuaaaaacacaaaauuagcugggugugg

SEQ ID NO: 261436 - RNA, 32 nt, Human
uguacuaaaaauacaaaauuagccgggcgugg

SEQ ID NO: 261437 - RNA, 32 nt, Human
uguacuaaaaauacaaaauuagcuggguuugg

SEQ ID NO: 261438 - RNA, 32 nt, Human
uguacuaaaaauacagaauuagccgggcaugg

SEQ ID NO: 261439 - RNA, 32 nt, Human
uguacuaaaauacaaaaaucagccaggcgugg

SEQ ID NO: 261440 - RNA, 20 nt, Human
uguacuaagccacccuccac

SEQ ID NO: 261441 - RNA, 32 nt, Human
uguacuaagccagauguuaaagagaucugcaa

SEQ ID NO: 261442 - RNA, 32 nt, Human
uguacuacuagaaaauaccaaauggauauauu

SEQ ID NO: 261443 - RNA, 32 nt, Human
uguacuacugcacuugagcaugaauggguagu

SEQ ID NO: 261444 - RNA, 32 nt, Human
uguacuacuguacuccagccugggggaaagag

SEQ ID NO: 261445 - RNA, 32 nt, Human
uguacuacugugaaguguaugugugcaauaca

SEQ ID NO: 261446 - RNA, 32 nt, Human
uguacuagaauuggauccuaggugcuuagccc

SEQ ID NO: 261447 - RNA, 32 nt, Human
uguacuagaugcuguuuuugucugacuucuac

SEQ ID NO: 261448 - RNA, 32 nt, Human
uguacuaguaccuguggauuacagucaguuaa

SEQ ID NO: 261449 - RNA, 32 nt, Human
uguacuaucagccauggucaacuccgucgucu

SEQ ID NO: 261450 - RNA, 32 nt, Human
uguacuauuccucugcagagcuugacuugaug

SEQ ID NO: 261451 - RNA, 32 nt, Human
uguacucagcccagagugaaagggcacugucu

SEQ ID NO: 261452 - RNA, 32 nt, Human
uguacucaggaccuuggcugggccuggucguc

SEQ ID NO: 261453 - RNA, 31 nt, Human
uguacucaguggacagugcuguugaagauuu

SEQ ID NO: 261454 - RNA, 32 nt, Human
uguacucaucugcuguguguggugccagaagu

SEQ ID NO: 261455 - RNA, 32 nt, Human
uguacuccagcacucuagccugggcgacagag

SEQ ID NO: 261456 - RNA, 32 nt, Human
uguacuccagcccggcacuccagccuggcgac

SEQ ID NO: 261457 - RNA, 32 nt, Human
uguacuccagccugaagagcgagacucugucu

SEQ ID NO: 261458 - RNA, 32 nt, Human
uguacuccagccuggaagacaagagugaaacu

SEQ ID NO: 261459 - RNA, 32 nt, Human
uguacuccagccuggacaacagcgagagcucc

SEQ ID NO: 261460 - RNA, 32 nt, Human
uguacuccagccuggaugacagaguggagacu

SEQ ID NO: 261461 - RNA, 32 nt, Human
uguacuccagccuggcaacagagugagacugu

SEQ ID NO: 261462 - RNA, 32 nt, Human
uguacuccagccuggcccacagagugagaucc

SEQ ID NO: 261463 - RNA, 32 nt, Human
uguacuccagccugggagacacagugagaccc

SEQ ID NO: 261464 - RNA, 32 nt, Human
uguacuccagccugggcaacaagagugaaacu

SEQ ID NO: 261465 - RNA, 32 nt, Human
uguacuccagccugggcaacaagagugaaaug

SEQ ID NO: 261466 - RNA, 32 nt, Human
uguacuccagccugggcaacagagugagaccc

SEQ ID NO: 261467 - RNA, 32 nt, Human
uguacuccagccugggcaacagagugagacug

SEQ ID NO: 261468 - RNA, 32 nt, Human
uguacuccagccugggcgacaaaagugaaacc

SEQ ID NO: 261469 - RNA, 32 nt, Human
uguacuccagccugggcgacagcaagacccug

SEQ ID NO: 261470 - RNA, 32 nt, Human
uguacuccagccugggcgacggagugagacuc

SEQ ID NO: 261471 - RNA, 32 nt, Human
uguacuccagccugggcgauacaacaagaccu

SEQ ID NO: 261472 - RNA, 32 nt, Human
uguacuccagccugggugacaaagugagacuc

SEQ ID NO: 261473 - RNA, 32 nt, Human
uguacuccagccugggugacagagugagaccc

SEQ ID NO: 261474 - RNA, 32 nt, Human
uguacuccagccugggugacagagugagacuc

SEQ ID NO: 261475 - RNA, 32 nt, Human
uguacuccagccugggugacagagugaggccc

SEQ ID NO: 261476 - RNA, 32 nt, Human
uguacuccagccugggugacagagugauacuc

SEQ ID NO: 261477 - RNA, 32 nt, Human
uguacuccaggcgaggccucuggaccuguguu

SEQ ID NO: 261478 - RNA, 32 nt, Human
uguacuccuuucuauuuuaaagagccaagccu

SEQ ID NO: 261479 - RNA, 32 nt, Human
uguacucgggauccucaggacgcaggucacau

SEQ ID NO: 261480 - RNA, 32 nt, Human
uguacucgggcuguucaugucacugcaagacu

SEQ ID NO: 261481 - RNA, 32 nt, Human
uguacucugcuuguacaguccuugagcccagu

SEQ ID NO: 261482 - RNA, 32 nt, Human
uguacucuggaucccuuccccugcuuugaccc

SEQ ID NO: 261483 - RNA, 32 nt, Human
uguacucugggggcagggagaggcuagagggg

SEQ ID NO: 261484 - RNA, 32 nt, Human
uguacucuuugcuaguaccaaaaguagacuga

SEQ ID NO: 261485 - RNA, 32 nt, Human
uguacugaacgccaagcugagaauggugauuc

SEQ ID NO: 261486 - RNA, 32 nt, Human
uguacugaagaaaaggggagcacaaggccuua

SEQ ID NO: 261487 - RNA, 32 nt, Human
uguacugacaguucuuacaguugaggauuugg

SEQ ID NO: 261488 - RNA, 32 nt, Human
uguacugaccaccuccacgugccacuggggcu

SEQ ID NO: 261489 - RNA, 32 nt, Human
uguacugaggguguuuuuaagugaauugcuua

SEQ ID NO: 261490 - RNA, 32 nt, Human
uguacugaguaucggagcacuuuacagaagcu

SEQ ID NO: 261491 - RNA, 32 nt, Human
uguacugagugguacaagccuuggggacugaa

SEQ ID NO: 261492 - RNA, 32 nt, Human
uguacugauaaaauacucuagccugggccaga

SEQ ID NO: 261493 - RNA, 32 nt, Human
uguacugcaaauaugcuguggguucucggugu

SEQ ID NO: 261494 - RNA, 32 nt, Human
uguacugcacacaccacagaaugugugagauu

SEQ ID NO: 261495 - RNA, 32 nt, Human
uguacugccacugucauaaccaauaccaugaa

SEQ ID NO: 261496 - RNA, 32 nt, Human
uguacugccugaguugugccucuugugugcua

SEQ ID NO: 261497 - RNA, 32 nt, Human
uguacugcuaguaccuguaagcauuuuagguc

SEQ ID NO: 261498 - RNA, 32 nt, Human
uguacugcucuucuuuugcucuaagguauggg

SEQ ID NO: 261499 - RNA, 32 nt, Human
uguacuggaaaggcuguggccauguccgcuuc

SEQ ID NO: 261500 - RNA, 32 nt, Human
uguacuggaggacggcccugcacggcucgcag

SEQ ID NO: 261501 - RNA, 32 nt, Human
uguacuggaugggacaucuaaguggucugcaa

SEQ ID NO: 261502 - RNA, 32 nt, Human
uguacuggcaggcagacgugggcacuguggga

SEQ ID NO: 261503 - RNA, 32 nt, Human
uguacuggccacacuuacuauugacagucacc

SEQ ID NO: 261504 - RNA, 32 nt, Human
uguacuggcccgcaguggcuccaauggccugc

SEQ ID NO: 261505 - RNA, 32 nt, Human
uguacuggcgcgggcugcggaagccugcguga

SEQ ID NO: 261506 - RNA, 32 nt, Human
uguacuggugcacaccugucaucccagcuacc

SEQ ID NO: 261507 - RNA, 32 nt, Human
uguacugguucucuucuuuugcucugaggugu

SEQ ID NO: 261508 - RNA, 29 nt, Human
uguacugguuuaaauaaaauguuaacauu

SEQ ID NO: 261509 - RNA, 32 nt, Human
uguacuguaccuccucucaagccaagaagggc

SEQ ID NO: 261510 - RNA, 32 nt, Human
uguacuguacuuuugcaguucuucccaguuca

SEQ ID NO: 261511 - RNA, 32 nt, Human
uguacuguaggggaagaagugggaacugaaau

SEQ ID NO: 261512 - RNA, 31 nt, Human
uguacugucccggaggagguugggaggugga

SEQ ID NO: 261513 - RNA, 32 nt, Human
uguacugugccagggauauugagaugcucugg

SEQ ID NO: 261514 - RNA, 32 nt, Human
uguacuguuuacuucccacuucccagaauccc

SEQ ID NO: 261515 - RNA, 23 nt, Human
uguacuuaagagauaccugugua

SEQ ID NO: 261516 - RNA, 21 nt, Human
uguacuuagcuguuacaugca

SEQ ID NO: 261517 - RNA, 32 nt, Human
uguacuucacccaggcggaaugggauggccug

SEQ ID NO: 261518 - RNA, 32 nt, Human
uguacuuccuguguacucuuuauuucuagcag

SEQ ID NO: 261519 - RNA, 32 nt, Human
uguacuucguuaacacgaaucuguuucagagc

SEQ ID NO: 261520 - RNA, 32 nt, Human
uguacuucuaguguguuucucagaauaucaac

SEQ ID NO: 261521 - RNA, 21 nt, Human
uguacuugacuucuugacgca

SEQ ID NO: 261522 - RNA, 32 nt, Human
uguacuugagugugugucugugugcagccuau

SEQ ID NO: 261523 - RNA, 32 nt, Human
uguacuuggguuuaagagaaguagcuggcucu

SEQ ID NO: 261524 - RNA, 32 nt, Human
uguacuugguggaggcagaggccaaaaagcac

SEQ ID NO: 261525 - RNA, 32 nt, Human
uguacuugguuuuucaccacugagcuuuaaau

SEQ ID NO: 261526 - RNA, 32 nt, Human
uguacuuguuaugaguggggcagcagcacagu

SEQ ID NO: 261527 - RNA, 32 nt, Human
uguacuuuaggaaacauacccaggaaguacag

SEQ ID NO: 261528 - RNA, 32 nt, Human
uguacuuuauuuugcaccuacagcgugccuug

SEQ ID NO: 261529 - RNA, 32 nt, Human
uguacuuucucaggaaccuuucaagcggccag

SEQ ID NO: 261530 - RNA, 32 nt, Human
uguacuuuuuaagagcucaauuugaaaaaucu

SEQ ID NO: 261531 - RNA, 32 nt, Human
uguacuuuuugugcaugaccuggaccugcuaa

SEQ ID NO: 261532 - RNA, 32 nt, Human
uguagaaaagugcuugucaguuguugaauaaa

SEQ ID NO: 261533 - RNA, 26 nt, Human
uguagaaaccauccuuguuacuugca

SEQ ID NO: 261534 - RNA, 32 nt, Human
uguagaaaguagaaaguguaagucccugguug

SEQ ID NO: 261535 - RNA, 32 nt, Human
uguagaacaucuccuggaucaggaaguagaug

SEQ ID NO: 261536 - RNA, 32 nt, Human
uguagaaccaaggacucaucuucauuuuauac

SEQ ID NO: 261537 - RNA, 32 nt, Human
uguagaacuagaggugggugaccuaugguuau

SEQ ID NO: 261538 - RNA, 32 nt, Human
uguagaacuauacaaaagugcuaacauucaug

SEQ ID NO: 261539 - RNA, 32 nt, Human
uguagaagagggagaaggagaggcucugaaag

SEQ ID NO: 261540 - RNA, 21 nt, Human
uguagaagaugcuuccuccau

SEQ ID NO: 261541 - RNA, 32 nt, Human
uguagaagaugguacaccacugccuuuugccc

SEQ ID NO: 261542 - RNA, 32 nt, Human
uguagaagccgaggggacagcaaggggcccag

SEQ ID NO: 261543 - RNA, 32 nt, Human
uguagaagcugaauguuacagugcaagcgcac

SEQ ID NO: 261544 - RNA, 32 nt, Human
uguagaaggacaaugcaucaagaguaguugaa

SEQ ID NO: 261545 - RNA, 32 nt, Human
uguagaaggagagagaagaagaugaaguuugc

SEQ ID NO: 261546 - RNA, 32 nt, Human
uguagaaguagaaagaaaagaaaaagaaaauc

SEQ ID NO: 261547 - RNA, 32 nt, Human
uguagaagucauggacuuuucugggaaaugac

SEQ ID NO: 261548 - RNA, 24 nt, Human
uguagaauaugcggcugcuuccau

SEQ ID NO: 261549 - RNA, 32 nt, Human
uguagaaucccaccaggacuuugcuaacaaua

SEQ ID NO: 261550 - RNA, 31 nt, Human
uguagaaugaggauagaagagaggaaauccc

SEQ ID NO: 261551 - RNA, 24 nt, Human
uguagacaaacauuagcucuuuac

SEQ ID NO: 261552 - RNA, 19 nt, Human
uguagacaagauguuucca

SEQ ID NO: 261553 - RNA, 20 nt, Human
uguagacaagguucauuuac

SEQ ID NO: 261554 - RNA, 32 nt, Human
uguagacaaguaugacacaguucuagaaaaua

SEQ ID NO: 261555 - RNA, 24 nt, Human
uguagacaaguauggcuccuccau

SEQ ID NO: 261556 - RNA, 19 nt, Human
uguagacacaggccucugc

SEQ ID NO: 261557 - RNA, 20 nt, Human
uguagacacccagcucucca

SEQ ID NO: 261558 - RNA, 21 nt, Human
uguagacacccgccgcccucu

SEQ ID NO: 261559 - RNA, 21 nt, Human
uguagacaccuucaccuccau

SEQ ID NO: 261560 - RNA, 32 nt, Human
uguagacacuccugcucucuuccauccccauc

SEQ ID NO: 261561 - RNA, 22 nt, Human
uguagacagagccaggccucac

SEQ ID NO: 261562 - RNA, 32 nt, Human
uguagacagagcggcggggaucccagaggggu

SEQ ID NO: 261563 - RNA, 32 nt, Human
uguagacagcuuuucagaguggcaguaucaua

SEQ ID NO: 261564 - RNA, 20 nt, Human
uguagacagggcuccuugca

SEQ ID NO: 261565 - RNA, 32 nt, Human
uguagacauaugcaugcauguauauguaaaau

SEQ ID NO: 261566 - RNA, 20 nt, Human
uguagacaucuguccuacac

SEQ ID NO: 261567 - RNA, 19 nt, Human
uguagacauguguccccac

SEQ ID NO: 261568 - RNA, 19 nt, Human
uguagacauuguauuccac

SEQ ID NO: 261569 - RNA, 18 nt, Human
uguagaccagagcccucc

SEQ ID NO: 261570 - RNA, 32 nt, Human
uguagacccagccucuaucuccugagccuaua

SEQ ID NO: 261571 - RNA, 32 nt, Human
uguagaccuaguuucacacacaucugugcaag

SEQ ID NO: 261572 - RNA, 32 nt, Human
uguagaccuggaauuuguuuucgucuguucag

SEQ ID NO: 261573 - RNA, 21 nt, Human
uguagacgaacuguuucucua

SEQ ID NO: 261574 - RNA, 32 nt, Human
uguagacggagcccuggcaugucaacagcguu

SEQ ID NO: 261575 - RNA, 32 nt, Human
uguagacggauucuguagaaggauguggcuuu

SEQ ID NO: 261576 - RNA, 21 nt, Human
uguagacuagcagcuuuuuau

SEQ ID NO: 261577 - RNA, 21 nt, Human
uguagacuaguguucuuccau

SEQ ID NO: 261578 - RNA, 32 nt, Human
uguagacucagggucccuguggaggugcugaa

SEQ ID NO: 261579 - RNA, 32 nt, Human
uguagacucccaggagagacuuguagguacaa

SEQ ID NO: 261580 - RNA, 32 nt, Human
uguagacuccugggugcuggaggaguagagac

SEQ ID NO: 261581 - RNA, 32 nt, Human
uguagacuugcagccaaugaccagaagccagg

SEQ ID NO: 261582 - RNA, 32 nt, Human
uguagagaaaaauggugaagaaaacaaagaug

SEQ ID NO: 261583 - RNA, 32 nt, Human
uguagagaagucagagagacuagaugcuuuca

SEQ ID NO: 261584 - RNA, 20 nt, Human
uguagagaaugucccuucac

SEQ ID NO: 261585 - RNA, 32 nt, Human
uguagagacaagggucuuaccauguugcccag

SEQ ID NO: 261586 - RNA, 32 nt, Human
uguagagacaggagucuugccauguugcccag

SEQ ID NO: 261587 - RNA, 32 nt, Human
uguagagacaguguugagaggaaaggggaggu

SEQ ID NO: 261588 - RNA, 32 nt, Human
uguagagacauaaaggagggugaugugauuuu

SEQ ID NO: 261589 - RNA, 32 nt, Human
uguagagacgggguugggggaggcggggguua

SEQ ID NO: 261590 - RNA, 32 nt, Human
uguagagacuagccagcucccgacggaagggg

SEQ ID NO: 261591 - RNA, 22 nt, Human
uguagagagcagcugcuucugc

SEQ ID NO: 261592 - RNA, 32 nt, Human
uguagagagcccgaggggaaguugcugcagag

SEQ ID NO: 261593 - RNA, 32 nt, Human
uguagagagugcacaggacacagaacaaggug

SEQ ID NO: 261594 - RNA, 32 nt, Human
uguagagaugagggucuugccauguuguccag

SEQ ID NO: 261595 - RNA, 32 nt, Human
uguagagauggggucucacuguuguucaaacu

SEQ ID NO: 261596 - RNA, 32 nt, Human
uguagagcaagcacguuuuccaccucacuguc

SEQ ID NO: 261597 - RNA, 32 nt, Human
uguagagcacaagccucuccacccuagagaaa

SEQ ID NO: 261598 - RNA, 32 nt, Human
uguagagcauucccugcgauguggaaaauucu

SEQ ID NO: 261599 - RNA, 32 nt, Human
uguagagccuuuccuauuucccuuccugcugu

SEQ ID NO: 261600 - RNA, 32 nt, Human
uguagagcugcuuguguucccuuuugauucuu

SEQ ID NO: 261601 - RNA, 32 nt, Human
uguagaggacaauuaucaagcuggagcuguca

SEQ ID NO: 261602 - RNA, 32 nt, Human
uguagaggcagaggucucucacuguguugccc

SEQ ID NO: 261603 - RNA, 32 nt, Human
uguagaggcucacaccuguaaucccaguacuu

SEQ ID NO: 261604 - RNA, 32 nt, Human
uguagaggcugcaggugcacacgugggcucca

SEQ ID NO: 261605 - RNA, 32 nt, Human
uguagaggcugcccagaggggccagguggcac

SEQ ID NO: 261606 - RNA, 32 nt, Human
uguagaggcuuccugaacugggagcaggguag

SEQ ID NO: 261607 - RNA, 19 nt, Human
uguagaggcuuuuuuccac

SEQ ID NO: 261608 - RNA, 24 nt, Human
uguagagggaaauuuauagcacua

SEQ ID NO: 261609 - RNA, 32 nt, Human
uguagagggaagcugucccagagauguuugga

SEQ ID NO: 261610 - RNA, 32 nt, Human
uguagagggacugaaaauauuuauuuuguuau

SEQ ID NO: 261611 - RNA, 32 nt, Human
uguagagggagagagaagagcaagggacgugg

SEQ ID NO: 261612 - RNA, 23 nt, Human
uguagagggaggagcgaugggga

SEQ ID NO: 261613 - RNA, 32 nt, Human
uguagaguaacacauaacauuguaugcaugga

SEQ ID NO: 261614 - RNA, 32 nt, Human
uguagaguaauauguaaccagacuggagaacc

SEQ ID NO: 261615 - RNA, 20 nt, Human
uguagaguucugcuuuccac

SEQ ID NO: 261616 - RNA, 21 nt, Human
uguagauaaggacugugccau

SEQ ID NO: 261617 - RNA, 20 nt, Human
uguagauaaggcuauaccgc

SEQ ID NO: 261618 - RNA, 21 nt, Human
uguagauaaggcuucagccau

SEQ ID NO: 261619 - RNA, 22 nt, Human
uguagauaccuugucucucuau

SEQ ID NO: 261620 - RNA, 20 nt, Human
uguagauagagauucucuac

SEQ ID NO: 261621 - RNA, 21 nt, Human
uguagauagccggcgccuucc

SEQ ID NO: 261622 - RNA, 32 nt, Human
uguagauauaaauuacaguuuucauuccuuau

SEQ ID NO: 261623 - RNA, 32 nt, Human
uguagauaucuuaaagguguaaaguuugcaaa

SEQ ID NO: 261624 - RNA, 18 nt, Human
uguagauauugaacuccu

SEQ ID NO: 261625 - RNA, 32 nt, Human
uguagauccuaccuggagggaauggcuuuagg

SEQ ID NO: 261626 - RNA, 25 nt, Human
uguagaucugucagaugcccuucau

SEQ ID NO: 261627 - RNA, 20 nt, Human
uguagaugagcugacuccau

SEQ ID NO: 261628 - RNA, 21 nt, Human
uguagaugaguugcccuccac

SEQ ID NO: 261629 - RNA, 32 nt, Human
uguagaugccaaaagacuaacaauaaccuccu

SEQ ID NO: 261630 - RNA, 20 nt, Human
uguagaugccugaccuccac

SEQ ID NO: 261631 - RNA, 32 nt, Human
uguagauggaguuucacuuuuguugcccaggc

SEQ ID NO: 261632 - RNA, 23 nt, Human
uguagauggccaccucccuccac

SEQ ID NO: 261633 - RNA, 32 nt, Human
uguagauugauucauucuucuucuagcauucu

SEQ ID NO: 261634 - RNA, 32 nt, Human
uguagauugcagagggcaacugguguguuuau

SEQ ID NO: 261635 - RNA, 19 nt, Human
uguagauugcuuccuucau

SEQ ID NO: 261636 - RNA, 25 nt, Human
uguagcaaaacgcauggagugugua

SEQ ID NO: 261637 - RNA, 24 nt, Human
uguagcaaaguuuuauauguggua

SEQ ID NO: 261638 - RNA, 32 nt, Human
uguagcaaaugacugaauacaugugaacaaac

SEQ ID NO: 261639 - RNA, 32 nt, Human
uguagcaaauuucgagcauaagaaauaaaauc

SEQ ID NO: 261640 - RNA, 32 nt, Human
uguagcaaguaaacaguggagcccaggucccc

SEQ ID NO: 261641 - RNA, 27 nt, Human
uguagcaauaaauauauucuaacauca

SEQ ID NO: 261642 - RNA, 25 nt, Human
uguagcaaucuuuuuucuguucacg

SEQ ID NO: 261643 - RNA, 32 nt, Human
uguagcacaccagcauggcacauguauacaua

SEQ ID NO: 261644 - RNA, 32 nt, Human
uguagcacccugguuccccugccuguagguga

SEQ ID NO: 261645 - RNA, 20 nt, Human
uguagcacuuucuugcaguu

SEQ ID NO: 261646 - RNA, 32 nt, Human
uguagcagaaaggcacguccacucacaaggga

SEQ ID NO: 261647 - RNA, 32 nt, Human
uguagcagacaagaucuagaucccagacagaa

SEQ ID NO: 261648 - RNA, 32 nt, Human
uguagcagacacugcaacagaugccuccuaga

SEQ ID NO: 261649 - RNA, 32 nt, Human
uguagcagcagcgggagccaggacuaaggaca

SEQ ID NO: 261650 - RNA, 32 nt, Human
uguagcagccgccuccccugugccccagccuc

SEQ ID NO: 261651 - RNA, 32 nt, Human
uguagcagccuccuggacuuccugaggacucg

SEQ ID NO: 261652 - RNA, 32 nt, Human
uguagcagcuugagaagaggcuugggagugca

SEQ ID NO: 261653 - RNA, 32 nt, Human
uguagcaggagagauagauucagugacuucau

SEQ ID NO: 261654 - RNA, 32 nt, Human
uguagcaggaguacauuuuauacuaguuuggc

SEQ ID NO: 261655 - RNA, 22 nt, Human
uguagcaggcugagcgcagugg

SEQ ID NO: 261656 - RNA, 32 nt, Human
uguagcaggucccgcacuccagccucucgcug

SEQ ID NO: 261657 - RNA, 32 nt, Human
uguagcaguaagacaucuaaaaucaagacaau

SEQ ID NO: 261658 - RNA, 32 nt, Human
uguagcaguacugagaggcagggcccuuaaga

SEQ ID NO: 261659 - RNA, 32 nt, Human
uguagcaguguacccacgcuggguauuaccau

SEQ ID NO: 261660 - RNA, 32 nt, Human
uguagcaucuaucuacccaucuaucuaucauc

SEQ ID NO: 261661 - RNA, 20 nt, Human
uguagcaucugcuccuccac

SEQ ID NO: 261662 - RNA, 32 nt, Human
uguagcauggauuauucuucucauguuaaacc

SEQ ID NO: 261663 - RNA, 32 nt, Human
uguagcauuucuuauccccugagagcugauga

SEQ ID NO: 261664 - RNA, 32 nt, Human
uguagccacuucaguccaucugcccuccagag

SEQ ID NO: 261665 - RNA, 32 nt, Human
uguagccagagaggaggaaggagggaaacuga

SEQ ID NO: 261666 - RNA, 32 nt, Human
uguagccaggccuugcacuacugccauagcca

SEQ ID NO: 261667 - RNA, 32 nt, Human
uguagccaggggacccuagaaguggggugggg

SEQ ID NO: 261668 - RNA, 32 nt, Human
uguagccauuccacaggugagaugucuagagu

SEQ ID NO: 261669 - RNA, 32 nt, Human
uguagcccaagaggaagaggucacuggggcua

SEQ ID NO: 261670 - RNA, 24 nt, Human
uguagcccaggccagagugcagug

SEQ ID NO: 261671 - RNA, 24 nt, Human
uguagcccaggcuggagugcaaug

SEQ ID NO: 261672 - RNA, 32 nt, Human
uguagcccaggcugggaugcaauggcaugguc

SEQ ID NO: 261673 - RNA, 32 nt, Human
uguagcccagucucaggcuuuccucuuccuga

SEQ ID NO: 261674 - RNA, 24 nt, Human
uguagcccagucuggagugcagug

SEQ ID NO: 261675 - RNA, 32 nt, Human
uguagcccagugcggcuccacagcauggaauc

SEQ ID NO: 261676 - RNA, 32 nt, Human
uguagcccauggccagucugucacuguguccu

SEQ ID NO: 261677 - RNA, 21 nt, Human
uguagcccccaucagacccug

SEQ ID NO: 261678 - RNA, 32 nt, Human
uguagcccugcucccucccuggaggcugcucu

SEQ ID NO: 261679 - RNA, 32 nt, Human
uguagcccuggcccagccgccuuccugggaga

SEQ ID NO: 261680 - RNA, 30 nt, Human
uguagccuacacuccaugcuuccuucauau

SEQ ID NO: 261681 - RNA, 32 nt, Human
uguagccucagcugccgcaacagauucagccu

SEQ ID NO: 261682 - RNA, 32 nt, Human
uguagccuccacuggccccaucacugccaacu

SEQ ID NO: 261683 - RNA, 32 nt, Human
uguagccuccacuucugcccuaaguuccccag

SEQ ID NO: 261684 - RNA, 32 nt, Human
uguagccuccaggcacuucugcucucuggcag

SEQ ID NO: 261685 - RNA, 32 nt, Human
uguagccucccacauuuuccccaaaguacagg

SEQ ID NO: 261686 - RNA, 32 nt, Human
uguagccucucugagcguucgcacugucaugc

SEQ ID NO: 261687 - RNA, 32 nt, Human
uguagccugaagccuuggaggaagaaacagga

SEQ ID NO: 261688 - RNA, 32 nt, Human
uguagccugggcaacagagcaagacccugucu

SEQ ID NO: 261689 - RNA, 32 nt, Human
uguagccugggugacaaagugagacccugucu

SEQ ID NO: 261690 - RNA, 32 nt, Human
uguagccugggugacagugugagauucugucu

SEQ ID NO: 261691 - RNA, 32 nt, Human
uguagcgccauggagaagagcaacgagaccaa

SEQ ID NO: 261692 - RNA, 32 nt, Human
uguagcgcccgcucgccgccucccggacucuc

SEQ ID NO: 261693 - RNA, 21 nt, Human
uguagcggcccccaaaccuug

SEQ ID NO: 261694 - RNA, 32 nt, Human
uguagcgggcuccggaucccagccucuccccu

SEQ ID NO: 261695 - RNA, 32 nt, Human
uguagcgucauccccuuggugcuguccuggca

SEQ ID NO: 261696 - RNA, 32 nt, Human
uguagcuacacaaaaguuaccuuaagcucaaa

SEQ ID NO: 261697 - RNA, 32 nt, Human
uguagcuagauaugaugacauuuucucuagaa

SEQ ID NO: 261698 - RNA, 32 nt, Human
uguagcuaucccgggaagacguggaaggccga

SEQ ID NO: 261699 - RNA, 32 nt, Human
uguagcucacugcagucuucagccuccccagu

SEQ ID NO: 261700 - RNA, 32 nt, Human
uguagcucaggagccucguucucaggccggac

SEQ ID NO: 261701 - RNA, 32 nt, Human
uguagcucauacaauuaggacaccuuaggaau

SEQ ID NO: 261702 - RNA, 32 nt, Human
uguagcucccacaauuccccugugucauggga

SEQ ID NO: 261703 - RNA, 21 nt, Human
uguagcuccugccggaggcau

SEQ ID NO: 261704 - RNA, 32 nt, Human
uguagcuccugccucuguagcagaggugacag

SEQ ID NO: 261705 - RNA, 32 nt, Human
uguagcugauauagugaugggcaaacaggaau

SEQ ID NO: 261706 - RNA, 32 nt, Human
uguagcugaucccaggagguggcggcugcgcc

SEQ ID NO: 261707 - RNA, 32 nt, Human
uguagcugcagggggaggggacuucauucaug

SEQ ID NO: 261708 - RNA, 32 nt, Human
uguagcugccgugguugccaggagagcugcgc

SEQ ID NO: 261709 - RNA, 32 nt, Human
uguagcugcucugaucaguuacagauuggcga

SEQ ID NO: 261710 - RNA, 32 nt, Human
uguagcugcucuguuuagacagcggacagacg

SEQ ID NO: 261711 - RNA, 32 nt, Human
uguagcugcuucguuccgccuccgucuuagca

SEQ ID NO: 261712 - RNA, 32 nt, Human
uguagcuggcagcagcgggcaggugaggaccc

SEQ ID NO: 261713 - RNA, 32 nt, Human
uguagcugggauuacagcugccugccaaauuu

SEQ ID NO: 261714 - RNA, 32 nt, Human
uguagcugggauuacaggcgcgcaccaacaca

SEQ ID NO: 261715 - RNA, 32 nt, Human
uguagcugucuugaugccucucugucacccac

SEQ ID NO: 261716 - RNA, 32 nt, Human
uguagcuguggggcccguuccuaggucuguac

SEQ ID NO: 261717 - RNA, 32 nt, Human
uguagcuuccaccucauggauugccacagcuc

SEQ ID NO: 261718 - RNA, 32 nt, Human
uguagcuuugucccuugccaucaugcccaaca

SEQ ID NO: 261719 - RNA, 32 nt, Human
uguaggaaaaacaggcaugacagaccagggug

SEQ ID NO: 261720 - RNA, 21 nt, Human
uguaggaaaagcuguucccau

SEQ ID NO: 261721 - RNA, 19 nt, Human
uguaggaaagaagcuaaag

SEQ ID NO: 261722 - RNA, 19 nt, Human
uguaggaaccgaucugcua

SEQ ID NO: 261723 - RNA, 32 nt, Human
uguaggaagcagugucauuacauucaagcuuc

SEQ ID NO: 261724 - RNA, 32 nt, Human
uguaggaaguguccuguauuuuacuaauuuuu

SEQ ID NO: 261725 - RNA, 32 nt, Human
uguaggaauccugguuguggggaccaagucug

SEQ ID NO: 261726 - RNA, 32 nt, Human
uguaggaaucuagacgccacgagcucuuggcu

SEQ ID NO: 261727 - RNA, 32 nt, Human
uguaggaaugaccacgggccucaguuucccca

SEQ ID NO: 261728 - RNA, 19 nt, Human
uguaggacaauuucuccac

SEQ ID NO: 261729 - RNA, 32 nt, Human
uguaggacuggugcuaaccaccugccaucaug

SEQ ID NO: 261730 - RNA, 32 nt, Human
uguaggagacuugccagagccgggcacauuga

SEQ ID NO: 261731 - RNA, 32 nt, Human
uguaggagaugguucucgccaugcugggggcu

SEQ ID NO: 261732 - RNA, 32 nt, Human
uguaggagauuagugaggcaaggugcugcuca

SEQ ID NO: 261733 - RNA, 32 nt, Human
uguaggagccugggcaauagggucagagggac

SEQ ID NO: 261734 - RNA, 32 nt, Human
uguaggagcuaaagcaggucuccagggagaga

SEQ ID NO: 261735 - RNA, 32 nt, Human
uguaggagcuccucucacaaguaguuguaaug

SEQ ID NO: 261736 - RNA, 32 nt, Human
uguaggaggccagggaggggaacucagcaguu

SEQ ID NO: 261737 - RNA, 32 nt, Human
uguaggagugccuguugccaguguggggugag

SEQ ID NO: 261738 - RNA, 25 nt, Human
uguaggcaaagguggaaguccucca

SEQ ID NO: 261739 - RNA, 28 nt, Human
uguaggcaacagagugagacccugucuc

SEQ ID NO: 261740 - RNA, 20 nt, Human
uguaggcacaugccuucugc

SEQ ID NO: 261741 - RNA, 32 nt, Human
uguaggcacugcagggagaguguggaggucug

SEQ ID NO: 261742 - RNA, 32 nt, Human
uguaggcagaacauacucuccuaagugguugu

SEQ ID NO: 261743 - RNA, 32 nt, Human
uguaggcagcagagaagcauggaggaaaacag

SEQ ID NO: 261744 - RNA, 32 nt, Human
uguaggcagcagagagagaggacagaggggua

SEQ ID NO: 261745 - RNA, 21 nt, Human
uguaggcagggagcccucugc

SEQ ID NO: 261746 - RNA, 23 nt, Human
uguaggcagggucuccccuuuau

SEQ ID NO: 261747 - RNA, 22 nt, Human
uguaggcagguuaauccuccac

SEQ ID NO: 261748 - RNA, 19 nt, Human
uguaggcaguggccccuau

SEQ ID NO: 261749 - RNA, 32 nt, Human
uguaggcagugugggaaaaccuucaaugguca

SEQ ID NO: 261750 - RNA, 32 nt, Human
uguaggcaguuuagugcaucuuugccucucag

SEQ ID NO: 261751 - RNA, 32 nt, Human
uguaggcauauguuucagaaauauuacaagau

SEQ ID NO: 261752 - RNA, 32 nt, Human
uguaggcauguaccaccaugcccagcuaauuu

SEQ ID NO: 261753 - RNA, 24 nt, Human
uguaggccucugacuccccuccac

SEQ ID NO: 261754 - RNA, 22 nt, Human
uguaggccuggagaaaguaaug

SEQ ID NO: 261755 - RNA, 32 nt, Human
uguaggcgguggcagaggguggugagggaggg

SEQ ID NO: 261756 - RNA, 32 nt, Human
uguaggcuacccgagggcagagacugagucug

SEQ ID NO: 261757 - RNA, 32 nt, Human
uguaggcuaugguacuucuuccucauuguuuu

SEQ ID NO: 261758 - RNA, 26 nt, Human
uguaggcuauuaaggguucccuccac

SEQ ID NO: 261759 - RNA, 32 nt, Human
uguaggcucacaccuuaaucucaggccccuau

SEQ ID NO: 261760 - RNA, 32 nt, Human
uguaggcuccaaugcugcuuucccaggagggu

SEQ ID NO: 261761 - RNA, 32 nt, Human
uguaggcuccaccuuaacugugcucagauaca

SEQ ID NO: 261762 - RNA, 32 nt, Human
uguaggcucucugcaaccugggccucccgggu

SEQ ID NO: 261763 - RNA, 32 nt, Human
uguaggcugcauucaggagacagaaggugucu

SEQ ID NO: 261764 - RNA, 32 nt, Human
uguaggcuggguugccagaaaagaugguggcc

SEQ ID NO: 261765 - RNA, 32 nt, Human
uguaggcuuucauguugcaaagaacuccagag

SEQ ID NO: 261766 - RNA, 32 nt, Human
uguagggaccaggcagguaacauagacgagug

SEQ ID NO: 261767 - RNA, 32 nt, Human
uguagggagaggaggccccggcagaggucuuc

SEQ ID NO: 261768 - RNA, 32 nt, Human
uguagggagagggaagggagggaaacaguuuu

SEQ ID NO: 261769 - RNA, 32 nt, Human
uguagggagcugaaauuccuccaccaaguugg

SEQ ID NO: 261770 - RNA, 32 nt, Human
uguagggaggaccagggcagggccagggggug

SEQ ID NO: 261771 - RNA, 32 nt, Human
uguagggaggggccgagcaggaggaggaggaa

SEQ ID NO: 261772 - RNA, 32 nt, Human
uguagggauaucagcguuucucugugugcuug

SEQ ID NO: 261773 - RNA, 32 nt, Human
uguagggcaagaggaugaaggaaggggcuauc

SEQ ID NO: 261774 - RNA, 32 nt, Human
uguagggccaugggccucagggccagaggugg

SEQ ID NO: 261775 - RNA, 32 nt, Human
uguagggcuggaccuauguccuaaggacacac

SEQ ID NO: 261776 - RNA, 32 nt, Human
uguagggcuggccagucaggcccagccaaagc

SEQ ID NO: 261777 - RNA, 32 nt, Human
uguaggggagccaaggccaguaguuugggggu

SEQ ID NO: 261778 - RNA, 32 nt, Human
uguaggggagggaggaaggagggccaggguag

SEQ ID NO: 261779 - RNA, 32 nt, Human
uguaggggugugggacagggagagacucacuu

SEQ ID NO: 261780 - RNA, 32 nt, Human
uguaggguaagaggaaaaacaaguaaaaccuu

SEQ ID NO: 261781 - RNA, 32 nt, Human
uguagggucuccugccuagcugccuagcaagc

SEQ ID NO: 261782 - RNA, 32 nt, Human
uguagggugacggaaaguaggaagugaauuug

SEQ ID NO: 261783 - RNA, 32 nt, Human
uguagggugcuggcugaauagacucuguccag

SEQ ID NO: 261784 - RNA, 32 nt, Human
uguagggugugacauuuuacccuaggguauaa

SEQ ID NO: 261785 - RNA, 32 nt, Human
uguaggguuucagagagguuggcaguggggca

SEQ ID NO: 261786 - RNA, 32 nt, Human
uguagguaaagaaauaggguguggucacucuc

SEQ ID NO: 261787 - RNA, 32 nt, Human
uguagguacacucuuuccuccucuucacuuaa

SEQ ID NO: 261788 - RNA, 32 nt, Human
uguagguagaagcagcagacggugagggaggc

SEQ ID NO: 261789 - RNA, 32 nt, Human
uguagguaggaaguaugugcaggugggaguca

SEQ ID NO: 261790 - RNA, 32 nt, Human
uguaggucacgggaaugucaagagcacccagg

SEQ ID NO: 261791 - RNA, 21 nt, Human
uguagguccugaggccaggga

SEQ ID NO: 261792 - RNA, 21 nt, Human
uguagguccuuggcuggucgg

SEQ ID NO: 261793 - RNA, 32 nt, Human
uguagguccuuucuuaguaguaaagaaucuuc

SEQ ID NO: 261794 - RNA, 32 nt, Human
uguaggucggaggaauggaggcuuacuaacca

SEQ ID NO: 261795 - RNA, 32 nt, Human
uguaggugagaggcggcugaagaguugcugua

SEQ ID NO: 261796 - RNA, 32 nt, Human
uguagguggacaggugacuggguggauguugu

SEQ ID NO: 261797 - RNA, 32 nt, Human
uguagguggaguuugugauugcagugaauaga

SEQ ID NO: 261798 - RNA, 32 nt, Human
uguagguggccaagccagucccuacucuuggg

SEQ ID NO: 261799 - RNA, 31 nt, Human
uguaggugggugggugaguguguccccuccc

SEQ ID NO: 261800 - RNA, 32 nt, Human
uguaggugugagccauggugcccggccgccac

SEQ ID NO: 261801 - RNA, 32 nt, Human
uguaggugugugugcaugcauacauaugccug

SEQ ID NO: 261802 - RNA, 32 nt, Human
uguagguuaucuccuaggcuugaguucaacau

SEQ ID NO: 261803 - RNA, 32 nt, Human
uguagguugcuuuuucuuccuccugggcaacu

SEQ ID NO: 261804 - RNA, 32 nt, Human
uguagguuucccccaucuguauuccaauugua

SEQ ID NO: 261805 - RNA, 32 nt, Human
uguaguaaguuuccuuuuccuuugguucuuuc

SEQ ID NO: 261806 - RNA, 32 nt, Human
uguaguaauaggcagggggcccugccacccca

SEQ ID NO: 261807 - RNA, 32 nt, Human
uguaguacauucuccaagaugcagcccaggag

SEQ ID NO: 261808 - RNA, 21 nt, Human
uguaguaccagcuacucugga

SEQ ID NO: 261809 - RNA, 24 nt, Human
uguaguaccuuuacuuguaucaca

SEQ ID NO: 261810 - RNA, 32 nt, Human
uguaguacuagaucuguaucucuugucugaau

SEQ ID NO: 261811 - RNA, 32 nt, Human
uguaguacuuguuuguaaagcacuuugagauc

SEQ ID NO: 261812 - RNA, 32 nt, Human
uguaguagcugcacuaggugauucuuggagcg

SEQ ID NO: 261813 - RNA, 31 nt, Human
uguaguaggauuuggccucagaucuuugacu

SEQ ID NO: 261814 - RNA, 32 nt, Human
uguaguaguugcuuuucuuccucucucauuug

SEQ ID NO: 261815 - RNA, 32 nt, Human
uguaguaguuuuuccaguuaacacuucauuau

SEQ ID NO: 261816 - RNA, 32 nt, Human
uguaguaucaaacuaccacagaugcuagaguu

SEQ ID NO: 261817 - RNA, 32 nt, Human
uguaguaucaaaggaggcucuagguuuugucu

SEQ ID NO: 261818 - RNA, 32 nt, Human
uguaguaucaucaugaagauucagagaauuua

SEQ ID NO: 261819 - RNA, 21 nt, Human
uguaguaugcugcagcuuuaa

SEQ ID NO: 261820 - RNA, 27 nt, Human
uguaguauuguucuauuuuuguuuaca

SEQ ID NO: 261821 - RNA, 32 nt, Human
uguaguauuuuaaaaugaguuaaaauagauuu

SEQ ID NO: 261822 - RNA, 32 nt, Human
uguagucaagggccugggcacaggagggagag

SEQ ID NO: 261823 - RNA, 32 nt, Human
uguagucacaccacuucaguucugggcccuac

SEQ ID NO: 261824 - RNA, 32 nt, Human
uguagucacagugugcuagagcagaguguugg

SEQ ID NO: 261825 - RNA, 32 nt, Human
uguagucacuucagagagcuggagcggcugcc

SEQ ID NO: 261826 - RNA, 32 nt, Human
uguagucauaauaauagcaagcacucaauaua

SEQ ID NO: 261827 - RNA, 32 nt, Human
uguaguccacuggucuucuauuugggaaacaa

SEQ ID NO: 261828 - RNA, 32 nt, Human
uguaguccagccugagugacagagugagaccc

SEQ ID NO: 261829 - RNA, 22 nt, Human
uguaguccagguugcccgccac

SEQ ID NO: 261830 - RNA, 32 nt, Human
uguagucccagcuacucagggcugaggcagga

SEQ ID NO: 261831 - RNA, 32 nt, Human
uguagucccagcuacucccuccagaggcugag

SEQ ID NO: 261832 - RNA, 20 nt, Human
uguagucccagcuacucggg

SEQ ID NO: 261833 - RNA, 21 nt, Human
uguagucccagcuacucugaa

SEQ ID NO: 261834 - RNA, 32 nt, Human
uguagucccaggcccacuggaaaaaugaaucu

SEQ ID NO: 261835 - RNA, 32 nt, Human
uguaguccgagguacucaggaggcagagacgu

SEQ ID NO: 261836 - RNA, 32 nt, Human
uguaguccuacuucuuccaacuuuccauuccc

SEQ ID NO: 261837 - RNA, 32 nt, Human
uguagucgaagcuacucaggaggcugaggcag

SEQ ID NO: 261838 - RNA, 32 nt, Human
uguagucuccaccacucccuuuugucuuucac

SEQ ID NO: 261839 - RNA, 32 nt, Human
uguagucuguugcugcugaaagaugucugugu

SEQ ID NO: 261840 - RNA, 32 nt, Human
uguagugaggcugacaguugcagaccauagag

SEQ ID NO: 261841 - RNA, 32 nt, Human
uguagugauaacuaguguugcuuuuguuuuag

SEQ ID NO: 261842 - RNA, 32 nt, Human
uguagugcaguggcacgaucuuggcucacugc

SEQ ID NO: 261843 - RNA, 32 nt, Human
uguagugcaguggcauaaucucagcucacugc

SEQ ID NO: 261844 - RNA, 32 nt, Human
uguagugccaaccacucaggaggcugagaugg

SEQ ID NO: 261845 - RNA, 32 nt, Human
uguagugccagcuacucaggaggccgaggcag

SEQ ID NO: 261846 - RNA, 32 nt, Human
uguagugccagcuacucaggaggcugaggcag

SEQ ID NO: 261847 - RNA, 32 nt, Human
uguagugccaggauucaggaaaauggcucccu

SEQ ID NO: 261848 - RNA, 32 nt, Human
uguagugccggcuacucaggaggcugaggcac

SEQ ID NO: 261849 - RNA, 32 nt, Human
uguagugccucaugccuguaauuccagcacuu

SEQ ID NO: 261850 - RNA, 21 nt, Human
uguagugcuagcuacucagaa

SEQ ID NO: 261851 - RNA, 32 nt, Human
uguagugcugagagcaagagcugaucuagcua

SEQ ID NO: 261852 - RNA, 27 nt, Human
uguagugcuguguguauggaguuagug

SEQ ID NO: 261853 - RNA, 23 nt, Human
uguaguggcaagcagccuuuuac

SEQ ID NO: 261854 - RNA, 31 nt, Human
uguaguggcacaaucucagcucacugcaacc

SEQ ID NO: 261855 - RNA, 31 nt, Human
uguaguggcacaaucucggcucacugcaacc

SEQ ID NO: 261856 - RNA, 32 nt, Human
uguaguggcacauggcuauaaucccagguacu

SEQ ID NO: 261857 - RNA, 32 nt, Human
uguaguggcagacgucuguaaucccagcuauu

SEQ ID NO: 261858 - RNA, 32 nt, Human
uguaguggcaggcaccuguaaucccagcuacu

SEQ ID NO: 261859 - RNA, 32 nt, Human
uguaguggcgggcgccuauaaucccagcuacu

SEQ ID NO: 261860 - RNA, 32 nt, Human
uguaguggcuaugcaguguggaaagugagaaa

SEQ ID NO: 261861 - RNA, 32 nt, Human
uguaguggcucacaccuguaaucccagcacuu

SEQ ID NO: 261862 - RNA, 32 nt, Human
uguaguggcucacaccuguaaucucagcacuu

SEQ ID NO: 261863 - RNA, 32 nt, Human
uguaguggcucacgccaguaaucccagcacuu

SEQ ID NO: 261864 - RNA, 32 nt, Human
uguaguggcucacgccuguaaucccagcacuu

SEQ ID NO: 261865 - RNA, 32 nt, Human
uguaguggcucacgccuguaaucccagcauuu

SEQ ID NO: 261866 - RNA, 32 nt, Human
uguaguggcucaugacuguaaucccaguacuu

SEQ ID NO: 261867 - RNA, 32 nt, Human
uguaguggcucaugccuguaaucccaacacuu

SEQ ID NO: 261868 - RNA, 32 nt, Human
uguaguggcucaugccuguaaucccagcacuu

SEQ ID NO: 261869 - RNA, 32 nt, Human
uguaguggcucaugccuguaauccgagcacuu

SEQ ID NO: 261870 - RNA, 32 nt, Human
uguaguggcucaugccuguaauccuagcacuu

SEQ ID NO: 261871 - RNA, 32 nt, Human
uguaguggcucaugcuuguaaucccaguacuu

SEQ ID NO: 261872 - RNA, 32 nt, Human
uguaguggcuuacaccuguagucccaggcacu

SEQ ID NO: 261873 - RNA, 32 nt, Human
uguaguggcuuaugccuguaaucccagcacuu

SEQ ID NO: 261874 - RNA, 21 nt, Human
uguagugggaggcccagcgga

SEQ ID NO: 261875 - RNA, 21 nt, Human
uguagugguaaguugcccucc

SEQ ID NO: 261876 - RNA, 32 nt, Human
uguagugguaaguugcccucccucuccuggcc

SEQ ID NO: 261877 - RNA, 32 nt, Human
uguaguggugcacaccuguaaucccagcuacu

SEQ ID NO: 261878 - RNA, 31 nt, Human
uguaguggugcgaucucagcucacugcaacc

SEQ ID NO: 261879 - RNA, 32 nt, Human
uguaguggugggcaccuguaguccuagcuacu

SEQ ID NO: 261880 - RNA, 32 nt, Human
uguaguggugugcaccuguagucccagcucuu

SEQ ID NO: 261881 - RNA, 32 nt, Human
uguaguggugugcaucuguaaucccagcuacu

SEQ ID NO: 261882 - RNA, 32 nt, Human
uguagugugguuggccaguaggugaguauccc

SEQ ID NO: 261883 - RNA, 32 nt, Human
uguaguguugugggguccucccauggaucauc

SEQ ID NO: 261884 - RNA, 32 nt, Human
uguaguuagaaaacaauugcuucuuuacacau

SEQ ID NO: 261885 - RNA, 32 nt, Human
uguaguuauuugggaguuucauaaccuguuau

SEQ ID NO: 261886 - RNA, 32 nt, Human
uguaguucaugguuuuucccuaccugcccggu

SEQ ID NO: 261887 - RNA, 32 nt, Human
uguaguuccuucccuuguggcaugucauaaga

SEQ ID NO: 261888 - RNA, 32 nt, Human
uguaguucugacagacauuacuggaagguaga

SEQ ID NO: 261889 - RNA, 32 nt, Human
uguaguugagaguccucucccuucuucccuaa

SEQ ID NO: 261890 - RNA, 32 nt, Human
uguaguugauuaugcuucaugugaacucuccu

SEQ ID NO: 261891 - RNA, 32 nt, Human
uguaguugcagaaucccaaacuaggcuacauu

SEQ ID NO: 261892 - RNA, 32 nt, Human
uguaguuugcccagaguugggggcuaggggag

SEQ ID NO: 261893 - RNA, 32 nt, Human
uguaguuuggggaagucaaauggccauuuuau

SEQ ID NO: 261894 - RNA, 32 nt, Human
uguaguuuguaaugugaguucaaucaguauuu

SEQ ID NO: 261895 - RNA, 32 nt, Human
uguaguuuugagauggagucuagcucuguccc

SEQ ID NO: 261896 - RNA, 22 nt, Human
uguaguuuuggaacccacugca

SEQ ID NO: 261897 - RNA, 28 nt, Human
uguauaaaaagugcugucucucaguagu

SEQ ID NO: 261898 - RNA, 32 nt, Human
uguauaaaacacaaugagggagugaaauguua

SEQ ID NO: 261899 - RNA, 32 nt, Human
uguauaaaauggaauuuaaaguucacuuauga

SEQ ID NO: 261900 - RNA, 32 nt, Human
uguauaaaccuugccucuuuucccaaauacug

SEQ ID NO: 261901 - RNA, 32 nt, Human
uguauaaagcagcagaacugaaggggaaaaau

SEQ ID NO: 261902 - RNA, 32 nt, Human
uguauaaauacugauauucuccaaaccuagug

SEQ ID NO: 261903 - RNA, 32 nt, Human
uguauaaauucugcccagaucucuccacaaga

SEQ ID NO: 261904 - RNA, 32 nt, Human
uguauaacaaaccugcacauguaucccugaac

SEQ ID NO: 261905 - RNA, 32 nt, Human
uguauaacaaggugaugucuguuucccagggc

SEQ ID NO: 261906 - RNA, 32 nt, Human
uguauaaccaguauuucccaucauguccuguu

SEQ ID NO: 261907 - RNA, 32 nt, Human
uguauaacguaaacacacuugcccucaugccu

SEQ ID NO: 261908 - RNA, 32 nt, Human
uguauaacugcuuccugccuccuuccaaacug

SEQ ID NO: 261909 - RNA, 32 nt, Human
uguauaacuuuaacuucuguuuuaccagcaua

SEQ ID NO: 261910 - RNA, 32 nt, Human
uguauaagcacugcaaucaauaccucacaaag

SEQ ID NO: 261911 - RNA, 32 nt, Human
uguauaagucauacuguguagaauuucuauuu

SEQ ID NO: 261912 - RNA, 32 nt, Human
uguauaauauacauacauacauaagcauauau

SEQ ID NO: 261913 - RNA, 32 nt, Human
uguauaauauacauacauacauaagcaugggu

SEQ ID NO: 261914 - RNA, 32 nt, Human
uguauaaucccacccaccucaccaaaacgaug

SEQ ID NO: 261915 - RNA, 32 nt, Human
uguauaaucucccaaagccaagguuugguaau

SEQ ID NO: 261916 - RNA, 32 nt, Human
uguauaauggugcuggccauguuguuguuuua

SEQ ID NO: 261917 - RNA, 32 nt, Human
uguauacaaauacaguauuuuccaugguucug

SEQ ID NO: 261918 - RNA, 32 nt, Human
uguauacaaucagcuucugagucucuuaacau

SEQ ID NO: 261919 - RNA, 32 nt, Human
uguauacacacagacacacacauguauguuug

SEQ ID NO: 261920 - RNA, 32 nt, Human
uguauacacagcccugcugggccacaucccgg

SEQ ID NO: 261921 - RNA, 32 nt, Human
uguauacacauacauauaauuuuguuuuccuu

SEQ ID NO: 261922 - RNA, 32 nt, Human
uguauacacauauacacauacagucacacauc

SEQ ID NO: 261923 - RNA, 22 nt, Human
uguauacaccuuggacaaguca

SEQ ID NO: 261924 - RNA, 23 nt, Human
uguauacacugaucuuucaaguc

SEQ ID NO: 261925 - RNA, 32 nt, Human
uguauacacuuacauuuugacagggucuucau

SEQ ID NO: 261926 - RNA, 32 nt, Human
uguauacagccccucccccacauacacacaca

SEQ ID NO: 261927 - RNA, 31 nt, Human
uguauacaguuucaucacugcugucagcuau

SEQ ID NO: 261928 - RNA, 32 nt, Human
uguauacauacauacacauacacacaugcaca

SEQ ID NO: 261929 - RNA, 26 nt, Human
uguauacauacauauauguguauaua

SEQ ID NO: 261930 - RNA, 22 nt, Human
uguauacauauacauauauaua

SEQ ID NO: 261931 - RNA, 22 nt, Human
uguauacauauauguguauaua

SEQ ID NO: 261932 - RNA, 32 nt, Human
uguauacauauguaacaaaccugcacauugug

SEQ ID NO: 261933 - RNA, 32 nt, Human
uguauacauauguaacaaaccugcauguugug

SEQ ID NO: 261934 - RNA, 32 nt, Human
uguauacauauguaacuaaccugcacaaugug

SEQ ID NO: 261935 - RNA, 32 nt, Human
uguauacauauguaacuaaccugcacauugug

SEQ ID NO: 261936 - RNA, 24 nt, Human
uguauacauaugugucuguauaua

SEQ ID NO: 261937 - RNA, 32 nt, Human
uguauacaucugaacuccuccugggcucagaa

SEQ ID NO: 261938 - RNA, 32 nt, Human
uguauaccccuggugggagagggagaccuaga

SEQ ID NO: 261939 - RNA, 32 nt, Human
uguauacccuucucuucucuuaucuucugucu

SEQ ID NO: 261940 - RNA, 32 nt, Human
uguauaccuauguaacaaacccgcauguucug

SEQ ID NO: 261941 - RNA, 29 nt, Human
uguauaccuauguaacaaaccugcacauu

SEQ ID NO: 261942 - RNA, 32 nt, Human
uguauaccuauguaacaaaccugcacauugug

SEQ ID NO: 261943 - RNA, 32 nt, Human
uguauaccuauguaacaaaccugcacguucag

SEQ ID NO: 261944 - RNA, 32 nt, Human
uguauaccuauguaacauggugguuacaguaa

SEQ ID NO: 261945 - RNA, 32 nt, Human
uguauaccuguguaacaaaccugcacauucag

SEQ ID NO: 261946 - RNA, 32 nt, Human
uguauaccuguguaacaaaccugcauguucug

SEQ ID NO: 261947 - RNA, 32 nt, Human
uguauacguauguaacuaaccugcacaaugcg

SEQ ID NO: 261948 - RNA, 26 nt, Human
uguauacguauguguguguauauaau

SEQ ID NO: 261949 - RNA, 32 nt, Human
uguauacucaacaaugucauuuugugacuuug

SEQ ID NO: 261950 - RNA, 32 nt, Human
uguauacucagggugcucugggugggguggcc

SEQ ID NO: 261951 - RNA, 32 nt, Human
uguauacuggacucuggccucagugcugacuu

SEQ ID NO: 261952 - RNA, 32 nt, Human
uguauacugucuguugcugccuggugauucau

SEQ ID NO: 261953 - RNA, 32 nt, Human
uguauacuuagcuuacugcccagaugcaacug

SEQ ID NO: 261954 - RNA, 32 nt, Human
uguauacuuguugccaggaaggugaccucaaa

SEQ ID NO: 261955 - RNA, 32 nt, Human
uguauagcagcuuauggaagucucagcugggc

SEQ ID NO: 261956 - RNA, 32 nt, Human
uguauagccccacaugguggaaguaucacggg

SEQ ID NO: 261957 - RNA, 32 nt, Human
uguauagccguguuaaaccauggccucagauu

SEQ ID NO: 261958 - RNA, 32 nt, Human
uguauagccuauacugcauuagcccaagagau

SEQ ID NO: 261959 - RNA, 32 nt, Human
uguauagcuuuagugggcucuaaaguugcccg

SEQ ID NO: 261960 - RNA, 32 nt, Human
uguauaggaaauuuuauguugugcacauuugc

SEQ ID NO: 261961 - RNA, 32 nt, Human
uguauaggaggaauugccuaaggguggcccac

SEQ ID NO: 261962 - RNA, 32 nt, Human
uguauaguccaagcuacucaggaggcugaggc

SEQ ID NO: 261963 - RNA, 32 nt, Human
uguauaguccuccuuagagaggccugcuccag

SEQ ID NO: 261964 - RNA, 32 nt, Human
uguauaguguuuugagggcagaggaugaucuc

SEQ ID NO: 261965 - RNA, 32 nt, Human
uguauaguucucuuccugcuuuaagcauuacc

SEQ ID NO: 261966 - RNA, 20 nt, Human
uguauauaacaucuaauaua

SEQ ID NO: 261967 - RNA, 32 nt, Human
uguauauaaucaggaggaagaggaaggaagga

SEQ ID NO: 261968 - RNA, 20 nt, Human
uguauauacacacguacaua

SEQ ID NO: 261969 - RNA, 32 nt, Human
uguauauacauacuuacuguaacacaucuaaa

SEQ ID NO: 261970 - RNA, 32 nt, Human
uguauauacauauacacauacacauauaugua

SEQ ID NO: 261971 - RNA, 20 nt, Human
uguauauacguauguauaca

SEQ ID NO: 261972 - RNA, 32 nt, Human
uguauauagcuuuucuucuuucuugagaauuc

SEQ ID NO: 261973 - RNA, 22 nt, Human
uguauauauacacauauauaua

SEQ ID NO: 261974 - RNA, 22 nt, Human
uguauauauacacauauaugua

SEQ ID NO: 261975 - RNA, 24 nt, Human
uguauauauauaccaucccauaua

SEQ ID NO: 261976 - RNA, 22 nt, Human
uguauauauauagauauauaua

SEQ ID NO: 261977 - RNA, 22 nt, Human
uguauauauaugcauauauaua

SEQ ID NO: 261978 - RNA, 22 nt, Human
uguauauauauguauguauaua

SEQ ID NO: 261979 - RNA, 24 nt, Human
uguauauaugcauacauguauaua

SEQ ID NO: 261980 - RNA, 22 nt, Human
uguauauauguauuucuauaua

SEQ ID NO: 261981 - RNA, 32 nt, Human
uguauaucagaaucuucagagcacugcgaugu

SEQ ID NO: 261982 - RNA, 32 nt, Human
uguauaucagcacauccuguggguucagcuuc

SEQ ID NO: 261983 - RNA, 32 nt, Human
uguauaucagcucuaaagcagagauguauuau

SEQ ID NO: 261984 - RNA, 22 nt, Human
uguauaucuauauacacaaaua

SEQ ID NO: 261985 - RNA, 32 nt, Human
uguauaugguauaaaccuugagaucaaagacu

SEQ ID NO: 261986 - RNA, 32 nt, Human
uguauauguaaggggaaagagagauugaucug

SEQ ID NO: 261987 - RNA, 32 nt, Human
uguauauguacuugcuuuaucucuuuacccuu

SEQ ID NO: 261988 - RNA, 32 nt, Human
uguauaugugccacacuuucuuuauccagucu

SEQ ID NO: 261989 - RNA, 32 nt, Human
uguauauguguauauaaauauaugugugugua

SEQ ID NO: 261990 - RNA, 32 nt, Human
uguauaugugugugggugcacacaucuguccc

SEQ ID NO: 261991 - RNA, 32 nt, Human
uguauauguuccacuauaaucuuaugggacca

SEQ ID NO: 261992 - RNA, 32 nt, Human
uguauauuauuacuuuuuaauuuucuaaguau

SEQ ID NO: 261993 - RNA, 32 nt, Human
uguauauucccuuuauuuccuuuaccuuuugu

SEQ ID NO: 261994 - RNA, 32 nt, Human
uguauauugaagaugucucuacacaguaucgu

SEQ ID NO: 261995 - RNA, 32 nt, Human
uguauauugggcucagagagugcacugugucu

SEQ ID NO: 261996 - RNA, 32 nt, Human
uguauauuuaaagccuuuaauacauuuuuggg

SEQ ID NO: 261997 - RNA, 32 nt, Human
uguauauuugugugugcagauguacauaaaga

SEQ ID NO: 261998 - RNA, 32 nt, Human
uguaucaacacuauagaagaugagccaccuug

SEQ ID NO: 261999 - RNA, 32 nt, Human
uguaucaaugagauccccucacccucacccca

SEQ ID NO: 262000 - RNA, 32 nt, Human
uguaucacagcaguaccucucauggcuuuuug

SEQ ID NO: 262001 - RNA, 32 nt, Human
uguaucacguaagugugugagugcagugcaga

SEQ ID NO: 262002 - RNA, 32 nt, Human
uguaucacgugugcuuuguaucuuaagaugug

SEQ ID NO: 262003 - RNA, 32 nt, Human
uguaucacuggcagcaggacgugaccauggag

SEQ ID NO: 262004 - RNA, 32 nt, Human
uguaucacuugcaaguuuuaggaguucauauc

SEQ ID NO: 262005 - RNA, 32 nt, Human
uguaucagagggcuuugaaaacauacacugag

SEQ ID NO: 262006 - RNA, 29 nt, Human
uguaucagucugugugugucugagagucu

SEQ ID NO: 262007 - RNA, 32 nt, Human
uguaucaguguugcucaugcugugucuuugug

SEQ ID NO: 262008 - RNA, 32 nt, Human
uguaucaguucugaguuccacuggccuauccc

SEQ ID NO: 262009 - RNA, 32 nt, Human
uguaucauaaagcacacacuuagcgcucugga

SEQ ID NO: 262010 - RNA, 32 nt, Human
uguaucauccaccucacgccgcauauaccggu

SEQ ID NO: 262011 - RNA, 32 nt, Human
uguaucaucccccagacccagagaaagaggug

SEQ ID NO: 262012 - RNA, 32 nt, Human
uguauccaacagcaaagucuacaauaaaacuu

SEQ ID NO: 262013 - RNA, 32 nt, Human
uguauccaaggaaauaaugugaaugcgaggaa

SEQ ID NO: 262014 - RNA, 32 nt, Human
uguauccaaggaguuugauccuuuugagcugu

SEQ ID NO: 262015 - RNA, 32 nt, Human
uguauccacagcgugggaccaugccaggcaca

SEQ ID NO: 262016 - RNA, 32 nt, Human
uguauccagagggugacccucuucucaaggaa

SEQ ID NO: 262017 - RNA, 32 nt, Human
uguauccagaguggaacccaggcugguguccg

SEQ ID NO: 262018 - RNA, 32 nt, Human
uguauccagcugcagccgccuccggagcuucg

SEQ ID NO: 262019 - RNA, 32 nt, Human
uguauccaggagguggaagugaauugcaagug

SEQ ID NO: 262020 - RNA, 22 nt, Human
uguauccaggucugcuuuccac

SEQ ID NO: 262021 - RNA, 32 nt, Human
uguauccagguucccucccagaggagccacca

SEQ ID NO: 262022 - RNA, 32 nt, Human
uguauccaguguccuaaaguuuuaggauuagu

SEQ ID NO: 262023 - RNA, 32 nt, Human
uguauccauugccggcaccuggugagauuccg

SEQ ID NO: 262024 - RNA, 28 nt, Human
uguaucccaagugcacuguccuucuguc

SEQ ID NO: 262025 - RNA, 32 nt, Human
uguaucccagaacacuagacacuucaaauugu

SEQ ID NO: 262026 - RNA, 32 nt, Human
uguaucccagcacuuugggaggccaaggauca

SEQ ID NO: 262027 - RNA, 32 nt, Human
uguaucccagugaccagccacaggagaugucc

SEQ ID NO: 262028 - RNA, 32 nt, Human
uguaucccaugguggucaaagcaguaaaggag

SEQ ID NO: 262029 - RNA, 32 nt, Human
uguaucccuccaggaguuccuggcacauggug

SEQ ID NO: 262030 - RNA, 32 nt, Human
uguauccugccugggcucuggccccugcucug

SEQ ID NO: 262031 - RNA, 32 nt, Human
uguauccugccugggcucuggccucuacucuc

SEQ ID NO: 262032 - RNA, 32 nt, Human
uguauccugccugggcuguggccucugcucug

SEQ ID NO: 262033 - RNA, 32 nt, Human
uguauccugccuguguuccugccuccugacua

SEQ ID NO: 262034 - RNA, 32 nt, Human
uguauccuggugguucuuacaucccccucugc

SEQ ID NO: 262035 - RNA, 32 nt, Human
uguauccuucuuucuucuuuucacgauaacuu

SEQ ID NO: 262036 - RNA, 32 nt, Human
uguauccuucuuucuucuuuucaugauaaauu

SEQ ID NO: 262037 - RNA, 32 nt, Human
uguauccuuuccucaaccuccuccuuucccaa

SEQ ID NO: 262038 - RNA, 32 nt, Human
uguaucgaguuagagaaauggaagaaacgacg

SEQ ID NO: 262039 - RNA, 32 nt, Human
uguaucgguguuuucuuuccuggugggguagu

SEQ ID NO: 262040 - RNA, 32 nt, Human
uguaucguuucgaugaccuagucucaaaaguc

SEQ ID NO: 262041 - RNA, 32 nt, Human
uguaucuaaaccagaauauuuuggucaaauau

SEQ ID NO: 262042 - RNA, 32 nt, Human
uguaucuacaaccaaaugccucuuaucccuga

SEQ ID NO: 262043 - RNA, 32 nt, Human
uguaucuacuaaaaauacaaaaauuagccagg

SEQ ID NO: 262044 - RNA, 32 nt, Human
uguaucuacuaaaaauacaaaaauuagccgga

SEQ ID NO: 262045 - RNA, 32 nt, Human
uguaucuacuuaaguuugucacugugacaaca

SEQ ID NO: 262046 - RNA, 32 nt, Human
uguaucuauuaaaagacaaaaauuagcugggc

SEQ ID NO: 262047 - RNA, 32 nt, Human
uguaucucacauuuuucccaggagguuaccca

SEQ ID NO: 262048 - RNA, 32 nt, Human
uguaucucaccagcagaccaggagacuggucc

SEQ ID NO: 262049 - RNA, 32 nt, Human
uguaucucagcaccacccucucccucugugcc

SEQ ID NO: 262050 - RNA, 32 nt, Human
uguaucucccaacuagaaacagcuccaguguu

SEQ ID NO: 262051 - RNA, 32 nt, Human
uguaucucccuucacugucucuuccuacauua

SEQ ID NO: 262052 - RNA, 32 nt, Human
uguaucuccgacacucagaggauuucccuaga

SEQ ID NO: 262053 - RNA, 20 nt, Human
uguaucuccugucaggaagc

SEQ ID NO: 262054 - RNA, 32 nt, Human
uguaucucuucccuuuggcuguucaucuacau

SEQ ID NO: 262055 - RNA, 32 nt, Human
uguaucugaacucaaaacaaaguaguuguaua

SEQ ID NO: 262056 - RNA, 32 nt, Human
uguaucugagucuugaagacucugcaaaguga

SEQ ID NO: 262057 - RNA, 32 nt, Human
uguaucugcaccugccucucuguccuggccag

SEQ ID NO: 262058 - RNA, 32 nt, Human
uguaucugcacuugcagccucagcuuucauac

SEQ ID NO: 262059 - RNA, 31 nt, Human
uguaucugccucugugccugugcacaugaag

SEQ ID NO: 262060 - RNA, 32 nt, Human
uguaucuggaaagagggaagacuugauccuca

SEQ ID NO: 262061 - RNA, 32 nt, Human
uguaucuggacaacagggaaagaaaggagcug

SEQ ID NO: 262062 - RNA, 32 nt, Human
uguaucuggcuggacugaucugucucacaaga

SEQ ID NO: 262063 - RNA, 22 nt, Human
uguaucugugccuggccagugg

SEQ ID NO: 262064 - RNA, 32 nt, Human
uguaucuuacucuguuuaagcagaacaccuug

SEQ ID NO: 262065 - RNA, 32 nt, Human
uguaucuuacuggucugaagggaccaagugug

SEQ ID NO: 262066 - RNA, 32 nt, Human
uguaucuucaggccaccugaggcacauccucu

SEQ ID NO: 262067 - RNA, 32 nt, Human
uguaucuucauacacguuuggaaauguuuccu

SEQ ID NO: 262068 - RNA, 32 nt, Human
uguaucuuccuugaccugcuuccuucaguccc

SEQ ID NO: 262069 - RNA, 32 nt, Human
uguaucuucucacuucucacugguguuggaaa

SEQ ID NO: 262070 - RNA, 32 nt, Human
uguaucuucuccccuucugagccuguccauuc

SEQ ID NO: 262071 - RNA, 32 nt, Human
uguaucuucugaacccuacaucaaguugaaaa

SEQ ID NO: 262072 - RNA, 32 nt, Human
uguaucuugcauucagaaaacaaacuguccua

SEQ ID NO: 262073 - RNA, 32 nt, Human
uguaucuuuggagaaggagaaagaaaggaaag

SEQ ID NO: 262074 - RNA, 32 nt, Human
uguaugaaaaugguguacuguauacuuuaaca

SEQ ID NO: 262075 - RNA, 32 nt, Human
uguaugaaaggagagagcaaagggugucugcg

SEQ ID NO: 262076 - RNA, 32 nt, Human
uguaugaaaguuaaggaagggggugaggaugu

SEQ ID NO: 262077 - RNA, 32 nt, Human
uguaugaagucccuccugauuuugugugugug

SEQ ID NO: 262078 - RNA, 32 nt, Human
uguaugaauguauauacaaagacucagcuacu

SEQ ID NO: 262079 - RNA, 32 nt, Human
uguaugacacuucucuuccacccugcacagca

SEQ ID NO: 262080 - RNA, 21 nt, Human
uguaugacagcuuuccuucac

SEQ ID NO: 262081 - RNA, 32 nt, Human
uguaugacccggauuugcuaugcaaaacaauc

SEQ ID NO: 262082 - RNA, 32 nt, Human
uguaugacugcacuccagccugggugacagac

SEQ ID NO: 262083 - RNA, 32 nt, Human
uguaugacugcacuccagccugggugacagag

SEQ ID NO: 262084 - RNA, 32 nt, Human
uguaugagcuguggcuuuuucccauugugaag

SEQ ID NO: 262085 - RNA, 32 nt, Human
uguaugagugugaaugagugugugcacaugag

SEQ ID NO: 262086 - RNA, 32 nt, Human
uguaugauaagaaaguaaguauuccaaaggga

SEQ ID NO: 262087 - RNA, 32 nt, Human
uguaugaucucaggagauguguauggguucaa

SEQ ID NO: 262088 - RNA, 32 nt, Human
uguaugcaguuguccuaucacaguuauauuag

SEQ ID NO: 262089 - RNA, 32 nt, Human
uguaugcauaugcauauguauguauagaaugg

SEQ ID NO: 262090 - RNA, 32 nt, Human
uguaugcaucuaauuucauuugcguaauacau

SEQ ID NO: 262091 - RNA, 32 nt, Human
uguaugccauuuucucccugcaaagcagcuca

SEQ ID NO: 262092 - RNA, 32 nt, Human
uguaugcccuggaagaggggauaguccgcuac

SEQ ID NO: 262093 - RNA, 32 nt, Human
uguaugccugcuccagccuggacugcaccguu

SEQ ID NO: 262094 - RNA, 32 nt, Human
uguaugccuguacuugggcugcacugagcuug

SEQ ID NO: 262095 - RNA, 32 nt, Human
uguaugccugugcagacugacaggauauggug

SEQ ID NO: 262096 - RNA, 32 nt, Human
uguaugcuagaaauagaaagaaaagaaaauug

SEQ ID NO: 262097 - RNA, 32 nt, Human
uguaugcuguuuuucucccaaaugaagacucu

SEQ ID NO: 262098 - RNA, 32 nt, Human
uguaugcuuggauuaucuacugcaauguaaua

SEQ ID NO: 262099 - RNA, 32 nt, Human
uguauggaaacacacaccuucacacaucaaaa

SEQ ID NO: 262100 - RNA, 32 nt, Human
uguauggaaaccuuaaaaaguaaacuuauuuu

SEQ ID NO: 262101 - RNA, 21 nt, Human
uguauggaacuuauagcacug

SEQ ID NO: 262102 - RNA, 32 nt, Human
uguauggacaucaagcaaaauguauuccccga

SEQ ID NO: 262103 - RNA, 32 nt, Human
uguauggaggaaagcacaguggaugcuaggcu

SEQ ID NO: 262104 - RNA, 32 nt, Human
uguauggaggaggccaggcucagagcugagau

SEQ ID NO: 262105 - RNA, 32 nt, Human
uguauggcaugcugggaugugccaggugccug

SEQ ID NO: 262106 - RNA, 32 nt, Human
uguauggcauuuucuuuauccugucugucauu

SEQ ID NO: 262107 - RNA, 32 nt, Human
uguauggccgcucuugggaugcagagacaagg

SEQ ID NO: 262108 - RNA, 32 nt, Human
uguauggccuuucgggaaaauucaaagggugg

SEQ ID NO: 262109 - RNA, 32 nt, Human
uguauggcgacuucuugagcuggaagcuagag

SEQ ID NO: 262110 - RNA, 32 nt, Human
uguauggcgucgugaugucaaaccagauugca

SEQ ID NO: 262111 - RNA, 32 nt, Human
uguauggcuacccuugugaucuacaguaauuu

SEQ ID NO: 262112 - RNA, 32 nt, Human
uguauggcuagaauauccuacuucuccagccu

SEQ ID NO: 262113 - RNA, 32 nt, Human
uguaugggagaggaauggaggaugccaggaug

SEQ ID NO: 262114 - RNA, 32 nt, Human
uguaugggcaaagcuuuugugaucacacacca

SEQ ID NO: 262115 - RNA, 32 nt, Human
uguaugggcaggaggaaaggugggagggggag

SEQ ID NO: 262116 - RNA, 32 nt, Human
uguaugggcucugugggcucugucccuggcug

SEQ ID NO: 262117 - RNA, 32 nt, Human
uguauggggaaaauaguucugaaaggcuagaa

SEQ ID NO: 262118 - RNA, 32 nt, Human
uguaugguagggugcucagcagcaucccuggc

SEQ ID NO: 262119 - RNA, 32 nt, Human
uguauggugggugguggggaaucugggagaga

SEQ ID NO: 262120 - RNA, 32 nt, Human
uguaugguugguuaacagucugcuccccucuu

SEQ ID NO: 262121 - RNA, 32 nt, Human
uguauguaaguugcuuucuauuccaguauauc

SEQ ID NO: 262122 - RNA, 32 nt, Human
uguauguacguacauaugauaaaguucaguuu

SEQ ID NO: 262123 - RNA, 21 nt, Human
uguauguacuuuccuuuaguu

SEQ ID NO: 262124 - RNA, 32 nt, Human
uguauguauaauauacauacauacauaagcau

SEQ ID NO: 262125 - RNA, 24 nt, Human
uguauguauauaccacauuuuguu

SEQ ID NO: 262126 - RNA, 32 nt, Human
uguauguauuaaaaauaauaaaauuccagaaa

SEQ ID NO: 262127 - RNA, 32 nt, Human
uguaugucauuuccuucaaggcaucaugcaga

SEQ ID NO: 262128 - RNA, 32 nt, Human
uguaugucuguguuuugaggaggagggugucu

SEQ ID NO: 262129 - RNA, 28 nt, Human
uguaugucuucccaccucauggauguua

SEQ ID NO: 262130 - RNA, 32 nt, Human
uguaugugaaugcacacaugugcacuuaguuc

SEQ ID NO: 262131 - RNA, 32 nt, Human
uguaugugaauggguguacauguaggaaccug

SEQ ID NO: 262132 - RNA, 31 nt, Human
uguaugugacuucccucccccugccagaaua

SEQ ID NO: 262133 - RNA, 32 nt, Human
uguaugugaugagaggcagagcuggauauugc

SEQ ID NO: 262134 - RNA, 32 nt, Human
uguaugugcaugcacacacgugcauauacaca

SEQ ID NO: 262135 - RNA, 32 nt, Human
uguaugugcaugcauucacacacacauaugua

SEQ ID NO: 262136 - RNA, 32 nt, Human
uguaugugcauguguacacauauguacauaua

SEQ ID NO: 262137 - RNA, 32 nt, Human
uguaugugcggccagugacuuccccaggagug

SEQ ID NO: 262138 - RNA, 32 nt, Human
uguauguggacacaggcuggagucagguucgc

SEQ ID NO: 262139 - RNA, 32 nt, Human
uguauguguauuuauauguauguauguaugug

SEQ ID NO: 262140 - RNA, 29 nt, Human
uguaugugucugugugaguuugguuucuc

SEQ ID NO: 262141 - RNA, 32 nt, Human
uguaugugugccuguguguguauaaaaauaac

SEQ ID NO: 262142 - RNA, 32 nt, Human
uguauguguguauguauguauccgcaugugug

SEQ ID NO: 262143 - RNA, 32 nt, Human
uguauguguguauguguguaugugugugcgug

SEQ ID NO: 262144 - RNA, 24 nt, Human
uguauguguguauguguguguaua

SEQ ID NO: 262145 - RNA, 32 nt, Human
uguaugugugugcuugcgugugugaaugugug

SEQ ID NO: 262146 - RNA, 32 nt, Human
uguaugugugugugcacgcgcgugcgcgcuug

SEQ ID NO: 262147 - RNA, 32 nt, Human
uguaugugugugugcgugcauaaauuauuuaa

SEQ ID NO: 262148 - RNA, 32 nt, Human
uguauguuaggagcauguguguuuguaggcag

SEQ ID NO: 262149 - RNA, 32 nt, Human
uguauguugcccauggugggagcguggucacu

SEQ ID NO: 262150 - RNA, 32 nt, Human
uguauguuggaguccuagagaggcagacaaug

SEQ ID NO: 262151 - RNA, 32 nt, Human
uguauguuuauauacacacauguaucuguaua

SEQ ID NO: 262152 - RNA, 32 nt, Human
uguauguuuaucucccuuuuacucaugggcuc

SEQ ID NO: 262153 - RNA, 32 nt, Human
uguauguuuccccucacuguuugcagcuccca

SEQ ID NO: 262154 - RNA, 32 nt, Human
uguauguuuucagcauuuuaaggcuagagauu

SEQ ID NO: 262155 - RNA, 32 nt, Human
uguauguuuugugcugaacuggcagcuauccc

SEQ ID NO: 262156 - RNA, 32 nt, Human
uguauuaaaaguuucaguuggagcucagaccu

SEQ ID NO: 262157 - RNA, 32 nt, Human
uguauuaacugaggaauaaaagacugaagaaa

SEQ ID NO: 262158 - RNA, 32 nt, Human
uguauuaauaguaaauccaaaaauuagcuggu

SEQ ID NO: 262159 - RNA, 32 nt, Human
uguauuaaugcuugaauauuacuggauaaauu

SEQ ID NO: 262160 - RNA, 31 nt, Human
uguauuagcacucccuccaugccaggcacug

SEQ ID NO: 262161 - RNA, 32 nt, Human
uguauuagccccggaggacgugaugugagacc

SEQ ID NO: 262162 - RNA, 31 nt, Human
uguauuagugagaggugaagccagcuggacu

SEQ ID NO: 262163 - RNA, 32 nt, Human
uguauuaguucugcugucacuucauuuccugu

SEQ ID NO: 262164 - RNA, 32 nt, Human
uguauuaguuugggauuuguuuuuaaauaauu

SEQ ID NO: 262165 - RNA, 32 nt, Human
uguauuaguuuucuauugcugugugacaaauu

SEQ ID NO: 262166 - RNA, 32 nt, Human
uguauuauagaguagaauaguaaagcucuagg

SEQ ID NO: 262167 - RNA, 32 nt, Human
uguauuaugccagauuuccagagccagugguu

SEQ ID NO: 262168 - RNA, 32 nt, Human
uguauuaugugaaucagugagauguuaguaga

SEQ ID NO: 262169 - RNA, 32 nt, Human
uguauuauuuuccuccuuugaguuaggucuug

SEQ ID NO: 262170 - RNA, 32 nt, Human
uguauucaauccagcgaacugcuguauguaua

SEQ ID NO: 262171 - RNA, 32 nt, Human
uguauucacagaaccaccaucaauucacagaa

SEQ ID NO: 262172 - RNA, 32 nt, Human
uguauucagaaauccaaguuggugucauacau

SEQ ID NO: 262173 - RNA, 32 nt, Human
uguauucaucuaagcauuugggcauuuggagu

SEQ ID NO: 262174 - RNA, 32 nt, Human
uguauucaucuauuuuaaauugccggcgacga

SEQ ID NO: 262175 - RNA, 32 nt, Human
uguauuccagccuggacgacugagugagaccc

SEQ ID NO: 262176 - RNA, 32 nt, Human
uguauuccagccugggcaauagagcaaguccc

SEQ ID NO: 262177 - RNA, 32 nt, Human
uguauuccagccugggugacagagugagaucc

SEQ ID NO: 262178 - RNA, 32 nt, Human
uguauuccaucaucuuccuuuuucauuccagu

SEQ ID NO: 262179 - RNA, 32 nt, Human
uguauuccauccugggcaacagagccagaccc

SEQ ID NO: 262180 - RNA, 32 nt, Human
uguauuccauuaucuucucuuuaccaaacuua

SEQ ID NO: 262181 - RNA, 32 nt, Human
uguauucccagccugugucccaugggcacaag

SEQ ID NO: 262182 - RNA, 32 nt, Human
uguauuccccgccaccauggaugacguccccg

SEQ ID NO: 262183 - RNA, 32 nt, Human
uguauucccuggcaaaauggacuuucucaaaa

SEQ ID NO: 262184 - RNA, 32 nt, Human
uguauucuacaacuucuuugguguuuugcucc

SEQ ID NO: 262185 - RNA, 32 nt, Human
uguauucuaccucacacuccagcgugggcuuu

SEQ ID NO: 262186 - RNA, 32 nt, Human
uguauucucacugcuccaucuccugauguagg

SEQ ID NO: 262187 - RNA, 32 nt, Human
uguauucucauggcaccuagugcagugcuggg

SEQ ID NO: 262188 - RNA, 32 nt, Human
uguauucucauuuuggcccuuguucuuaggcc

SEQ ID NO: 262189 - RNA, 32 nt, Human
uguauucuccaauaccaccaucgcucccacca

SEQ ID NO: 262190 - RNA, 32 nt, Human
uguauucuccacccuugaucuuucuccuuguc

SEQ ID NO: 262191 - RNA, 32 nt, Human
uguauucucugcucccuucuuccugcuggguu

SEQ ID NO: 262192 - RNA, 32 nt, Human
uguauucugccucuggacucacauuucucguc

SEQ ID NO: 262193 - RNA, 32 nt, Human
uguauucugggaaugggcagggucacucgucc

SEQ ID NO: 262194 - RNA, 32 nt, Human
uguauucuguguauuauucuuuauuuugggac

SEQ ID NO: 262195 - RNA, 32 nt, Human
uguauucuucagccauaggagugcggucuucc

SEQ ID NO: 262196 - RNA, 32 nt, Human
uguauucuugcuguccacuguuucuucuucuu

SEQ ID NO: 262197 - RNA, 32 nt, Human
uguauugaacuuauucuaaaggcuuaugcuaa

SEQ ID NO: 262198 - RNA, 32 nt, Human
uguauugaagcauugugcugucugaaaauaag

SEQ ID NO: 262199 - RNA, 32 nt, Human
uguauugaccaccacauaugcuaauaccuauc

SEQ ID NO: 262200 - RNA, 32 nt, Human
uguauugagcgguuugcagccugaugcucagc

SEQ ID NO: 262201 - RNA, 32 nt, Human
uguauugauaaauaauugcuuuauaacaaaug

SEQ ID NO: 262202 - RNA, 32 nt, Human
uguauugcaugggcugcauuaucuacagcauu

SEQ ID NO: 262203 - RNA, 32 nt, Human
uguauugccagacuggagugcaguggcgugau

SEQ ID NO: 262204 - RNA, 32 nt, Human
uguauugcccaggcuggagugcaguggcgcga

SEQ ID NO: 262205 - RNA, 32 nt, Human
uguauugccugccagagcuuggaagggaggac

SEQ ID NO: 262206 - RNA, 32 nt, Human
uguauugcucacugcagccccucugccccuau

SEQ ID NO: 262207 - RNA, 32 nt, Human
uguauugcucuaauuggccugcugcccaaggc

SEQ ID NO: 262208 - RNA, 32 nt, Human
uguauugggcaggguggcuccaggauguuagg

SEQ ID NO: 262209 - RNA, 32 nt, Human
uguauuggucagaaagaaaaagaaagaaaacc

SEQ ID NO: 262210 - RNA, 32 nt, Human
uguauuguaaagcucacagcaagcucaguggg

SEQ ID NO: 262211 - RNA, 32 nt, Human
uguauuguacaagcuagagagcugaauuucug

SEQ ID NO: 262212 - RNA, 32 nt, Human
uguauuguccauugauuccugauugacgccgu

SEQ ID NO: 262213 - RNA, 32 nt, Human
uguauuguucugcaguguugaaacagaaugga

SEQ ID NO: 262214 - RNA, 32 nt, Human
uguauuguuugcauccccuugcccucaauaaa

SEQ ID NO: 262215 - RNA, 21 nt, Human
uguauuuaagcaaacagugaa

SEQ ID NO: 262216 - RNA, 32 nt, Human
uguauuuacucugccaggugccuauauuccaa

SEQ ID NO: 262217 - RNA, 32 nt, Human
uguauuuagugcagugcccggcccgacccgcg

SEQ ID NO: 262218 - RNA, 24 nt, Human
uguauuuaguuuguucuacuuaaa

SEQ ID NO: 262219 - RNA, 32 nt, Human
uguauuuauaaagguuuuuggagcugcacuga

SEQ ID NO: 262220 - RNA, 32 nt, Human
uguauuuauauguauguauguaugugugugug

SEQ ID NO: 262221 - RNA, 32 nt, Human
uguauuuauguacguccuccuaggugauggag

SEQ ID NO: 262222 - RNA, 32 nt, Human
uguauuuauuaauuugaaaccaggacauuaaa

SEQ ID NO: 262223 - RNA, 32 nt, Human
uguauuuauuuggaagccagaacauggugggu

SEQ ID NO: 262224 - RNA, 32 nt, Human
uguauuucaagauucaaacaauaaccagcaau

SEQ ID NO: 262225 - RNA, 32 nt, Human
uguauuucaagcaguuugugugguguuucuau

SEQ ID NO: 262226 - RNA, 32 nt, Human
uguauuucagacuuauccauguugauacaugu

SEQ ID NO: 262227 - RNA, 32 nt, Human
uguauuucgauggccagcauuacccuuuaccu

SEQ ID NO: 262228 - RNA, 32 nt, Human
uguauuucuagaaaucaauggcagcugcugau

SEQ ID NO: 262229 - RNA, 32 nt, Human
uguauuucuagcccagcacugccaggaccaag

SEQ ID NO: 262230 - RNA, 32 nt, Human
uguauuucucagauuacaugacauuagucaac

SEQ ID NO: 262231 - RNA, 32 nt, Human
uguauuucucuggagugcaauggugcaaucuc

SEQ ID NO: 262232 - RNA, 32 nt, Human
uguauuucugucugggaccaggaagcugcagc

SEQ ID NO: 262233 - RNA, 32 nt, Human
uguauuucuuuuuccuccuuucugucccuuuc

SEQ ID NO: 262234 - RNA, 32 nt, Human
uguauuugagcuccucuaguugcuguugguuu

SEQ ID NO: 262235 - RNA, 31 nt, Human
uguauuugccucucgugauucuguuuguuac

SEQ ID NO: 262236 - RNA, 32 nt, Human
uguauuuggaaaacauuguaaaugaaacaccu

SEQ ID NO: 262237 - RNA, 32 nt, Human
uguauuuggaagccucugaagagaccaugucu

SEQ ID NO: 262238 - RNA, 32 nt, Human
uguauuuggcaauugcaaguugccugcagaua

SEQ ID NO: 262239 - RNA, 32 nt, Human
uguauuugggcagagucagauucucucagcua

SEQ ID NO: 262240 - RNA, 32 nt, Human
uguauuugguguuuggcccugcaguccccacu

SEQ ID NO: 262241 - RNA, 32 nt, Human
uguauuugucucaaagcuaccaaguuugugca

SEQ ID NO: 262242 - RNA, 32 nt, Human
uguauuugugaauaacaaacugcacaaccugc

SEQ ID NO: 262243 - RNA, 32 nt, Human
uguauuugugcaaguaaggagaugugacuucu

SEQ ID NO: 262244 - RNA, 32 nt, Human
uguauuuuaugaucuuggcuguauuuaauggc

SEQ ID NO: 262245 - RNA, 32 nt, Human
uguauuuuccagccuaggcuuugugugaauua

SEQ ID NO: 262246 - RNA, 32 nt, Human
uguauuuugaaguguagagauaaugagguagu

SEQ ID NO: 262247 - RNA, 32 nt, Human
uguauuuuguagccuuuuccugggcuucagcu

SEQ ID NO: 262248 - RNA, 32 nt, Human
uguauuuuguuaguugcuuagaaauggaaaua

SEQ ID NO: 262249 - RNA, 32 nt, Human
uguauuuuuacuccuuaaagagcuagaauaca

SEQ ID NO: 262250 - RNA, 21 nt, Human
uguauuuuucaaaacuacaaa

SEQ ID NO: 262251 - RNA, 32 nt, Human
uguauuuuucaucaguuguuucucaaagucau

SEQ ID NO: 262252 - RNA, 32 nt, Human
uguauuuuucccuugcuuuuggggguucagag

SEQ ID NO: 262253 - RNA, 32 nt, Human
uguauuuuucuuaauaaauaaaggacauuaca

SEQ ID NO: 262254 - RNA, 32 nt, Human
uguauuuuuguagacuuuaauagagaaguuga

SEQ ID NO: 262255 - RNA, 32 nt, Human
uguauuuuugugcucacugauggaugagcucu

SEQ ID NO: 262256 - RNA, 27 nt, Human
ugucaaaaaucaggcuggagugcagug

SEQ ID NO: 262257 - RNA, 32 nt, Human
ugucaaaaaucaggcuggagugcaguggcaug

SEQ ID NO: 262258 - RNA, 32 nt, Human
ugucaaaagcccgacucggcagcagcggcgga

SEQ ID NO: 262259 - RNA, 32 nt, Human
ugucaaaaggaggauugaggaggaucagauca

SEQ ID NO: 262260 - RNA, 32 nt, Human
ugucaaaagucaaaaccuccuagggguugucc

SEQ ID NO: 262261 - RNA, 32 nt, Human
ugucaaaauacagcuaucaagaaugaugaugu

SEQ ID NO: 262262 - RNA, 32 nt, Human
ugucaaacugcagagcaacagggcuucaguau

SEQ ID NO: 262263 - RNA, 32 nt, Human
ugucaaagaccaccaaugauuccuaaacucca

SEQ ID NO: 262264 - RNA, 32 nt, Human
ugucaaagagccuccuggaaagcugucaucuu

SEQ ID NO: 262265 - RNA, 32 nt, Human
ugucaaauacaaauaaaucugggcuuagggaa

SEQ ID NO: 262266 - RNA, 32 nt, Human
ugucaaauggcagacuugcagagcaaauaagg

SEQ ID NO: 262267 - RNA, 32 nt, Human
ugucaacaaauuugcaaucaugucaggcaugu

SEQ ID NO: 262268 - RNA, 32 nt, Human
ugucaacagaguggaggucucaguggggaaag

SEQ ID NO: 262269 - RNA, 32 nt, Human
ugucaacagauaguuguguuuuuauuguuaac

SEQ ID NO: 262270 - RNA, 32 nt, Human
ugucaacaucacacugugcauccucuuccggc

SEQ ID NO: 262271 - RNA, 32 nt, Human
ugucaaccagcagucaaggaugagcaccaggu

SEQ ID NO: 262272 - RNA, 32 nt, Human
ugucaaccaggacagaaagcauggacaaggga

SEQ ID NO: 262273 - RNA, 23 nt, Human
ugucaaccaggccagagugcagu

SEQ ID NO: 262274 - RNA, 24 nt, Human
ugucaaccaggccagagugcagug

SEQ ID NO: 262275 - RNA, 32 nt, Human
ugucaacccaaagaaguguggcaaacaccauc

SEQ ID NO: 262276 - RNA, 32 nt, Human
ugucaacccacaacaaccagcauagcaaauga

SEQ ID NO: 262277 - RNA, 32 nt, Human
ugucaacccagccauggggaagaucaccuucu

SEQ ID NO: 262278 - RNA, 32 nt, Human
ugucaacccgggaggcggagcuugcagugagc

SEQ ID NO: 262279 - RNA, 24 nt, Human
ugucaaccgggcuggagugcagug

SEQ ID NO: 262280 - RNA, 32 nt, Human
ugucaaccuuuaccacugaggcuggaaauugg

SEQ ID NO: 262281 - RNA, 24 nt, Human
ugucaacgcagacuggagugcagu

SEQ ID NO: 262282 - RNA, 25 nt, Human
ugucaacgcagacuggagugcagug

SEQ ID NO: 262283 - RNA, 32 nt, Human
ugucaacgcagacuggagugcaguggcacgau

SEQ ID NO: 262284 - RNA, 32 nt, Human
ugucaacuccauccuucugucaggccaaaauc

SEQ ID NO: 262285 - RNA, 32 nt, Human
ugucaacugggccagcuguugcucuggggaua

SEQ ID NO: 262286 - RNA, 32 nt, Human
ugucaacuugucauauacaccuccagggacca

SEQ ID NO: 262287 - RNA, 32 nt, Human
ugucaagaagugaacuaugacaauacaucaau

SEQ ID NO: 262288 - RNA, 32 nt, Human
ugucaagaaguuaaauugaggcuuaaugagca

SEQ ID NO: 262289 - RNA, 32 nt, Human
ugucaagaaugcucucugggcgcuguucuugc

SEQ ID NO: 262290 - RNA, 32 nt, Human
ugucaagagaauuuccuggcuguugugaaaga

SEQ ID NO: 262291 - RNA, 32 nt, Human
ugucaagagaggaagagagggaggagggguag

SEQ ID NO: 262292 - RNA, 32 nt, Human
ugucaagagcccagaggagaaagaauggcugu

SEQ ID NO: 262293 - RNA, 32 nt, Human
ugucaagaugcugcaaguacauaggacuggac

SEQ ID NO: 262294 - RNA, 32 nt, Human
ugucaagcacaguuguaaaauaaaguccaaaa

SEQ ID NO: 262295 - RNA, 32 nt, Human
ugucaagcacaucaugucagggugagcagagu

SEQ ID NO: 262296 - RNA, 32 nt, Human
ugucaagccagguguggacauuccaaguucau

SEQ ID NO: 262297 - RNA, 32 nt, Human
ugucaagcccacagggcaccagugccacccag

SEQ ID NO: 262298 - RNA, 21 nt, Human
ugucaagccuugaggacaccc

SEQ ID NO: 262299 - RNA, 32 nt, Human
ugucaagcgguggaguugauuucuccaaccau

SEQ ID NO: 262300 - RNA, 32 nt, Human
ugucaaggaaacaaagcccaaauguuuuuaaa

SEQ ID NO: 262301 - RNA, 32 nt, Human
ugucaaggaauaggguggggcaaugugucauu

SEQ ID NO: 262302 - RNA, 32 nt, Human
ugucaaggaggaaagagagggagauggaggau

SEQ ID NO: 262303 - RNA, 32 nt, Human
ugucaaggaugaugaaaaagaggcugaggaag

SEQ ID NO: 262304 - RNA, 32 nt, Human
ugucaaggccaucucaaaaggagaagcaaagc

SEQ ID NO: 262305 - RNA, 32 nt, Human
ugucaaggccuggucucaucugaaaagcccuc

SEQ ID NO: 262306 - RNA, 32 nt, Human
ugucaagggccagacgggcccagagcgcccaa

SEQ ID NO: 262307 - RNA, 32 nt, Human
ugucaagggguaggagaaagagacgcaaacac

SEQ ID NO: 262308 - RNA, 32 nt, Human
ugucaagggugagggcaacagaugcuggaccc

SEQ ID NO: 262309 - RNA, 32 nt, Human
ugucaaggucccaucuucacuucaagcucauu

SEQ ID NO: 262310 - RNA, 32 nt, Human
ugucaagucuccuguccuccuccuggagcagc

SEQ ID NO: 262311 - RNA, 32 nt, Human
ugucaagugccuuuguuagguggagaagaaau

SEQ ID NO: 262312 - RNA, 32 nt, Human
ugucaaguuagagagagacaauguguaggaaa

SEQ ID NO: 262313 - RNA, 32 nt, Human
ugucaaguuugcagggugcagcuuggaugugg

SEQ ID NO: 262314 - RNA, 32 nt, Human
ugucaaguuuugugucagacaugggaaaucau

SEQ ID NO: 262315 - RNA, 32 nt, Human
ugucaauaaagauggaaagccauuuccaguua

SEQ ID NO: 262316 - RNA, 32 nt, Human
ugucaauaagacgccuugccaacuuggcagcc

SEQ ID NO: 262317 - RNA, 32 nt, Human
ugucaauacacgggguucaguaugacacagaa

SEQ ID NO: 262318 - RNA, 32 nt, Human
ugucaauacccauuucuuuucugaaggucaga

SEQ ID NO: 262319 - RNA, 32 nt, Human
ugucaauacuucuggggucguacuuaggggga

SEQ ID NO: 262320 - RNA, 32 nt, Human
ugucaaucaggcgcgggcugagcucuacgagg

SEQ ID NO: 262321 - RNA, 32 nt, Human
ugucaaucuuucucccagccugccuccaaggg

SEQ ID NO: 262322 - RNA, 32 nt, Human
ugucaaugacauuuuuauuuuugaaguacucu

SEQ ID NO: 262323 - RNA, 32 nt, Human
ugucaauuaacuucuccuucccuuccccucag

SEQ ID NO: 262324 - RNA, 32 nt, Human
ugucaauuagcccacuucagaaaccucagacc

SEQ ID NO: 262325 - RNA, 32 nt, Human
ugucaauucaugacauuauguggaauccuaaa

SEQ ID NO: 262326 - RNA, 32 nt, Human
ugucaauuuaagaaaucuaaagugaaaauuuu

SEQ ID NO: 262327 - RNA, 32 nt, Human
ugucaauuucugcugcuugcaaggaaaggauc

SEQ ID NO: 262328 - RNA, 32 nt, Human
ugucaauuugauguccuugaguuucgaguggg

SEQ ID NO: 262329 - RNA, 32 nt, Human
ugucacaaaacaggaaccagcauucuaauuag

SEQ ID NO: 262330 - RNA, 32 nt, Human
ugucacaaaaggggaggccacaccuggcccag

SEQ ID NO: 262331 - RNA, 32 nt, Human
ugucacaaccaaaacuuuacaagcuuugcuuc

SEQ ID NO: 262332 - RNA, 32 nt, Human
ugucacaagucuuggauuucaaucccaacucu

SEQ ID NO: 262333 - RNA, 32 nt, Human
ugucacaaugcagugaccucacuggccugugg

SEQ ID NO: 262334 - RNA, 32 nt, Human
ugucacaaugcccagacuuggagcaaggcaac

SEQ ID NO: 262335 - RNA, 32 nt, Human
ugucacacagaaugccggaggggcgcagagca

SEQ ID NO: 262336 - RNA, 32 nt, Human
ugucacacagcccucuguagugguugaaucau

SEQ ID NO: 262337 - RNA, 24 nt, Human
ugucacacaggcuggagggcagug

SEQ ID NO: 262338 - RNA, 23 nt, Human
ugucacacaggcuggagugcagu

SEQ ID NO: 262339 - RNA, 24 nt, Human
ugucacacaggcuggagugcagug

SEQ ID NO: 262340 - RNA, 18 nt, Human
ugucacaccucccucaca

SEQ ID NO: 262341 - RNA, 32 nt, Human
ugucacaccuuaaaaucuucaugcuguaguca

SEQ ID NO: 262342 - RNA, 32 nt, Human
ugucacacgugugcuuuaacacaaaacagaua

SEQ ID NO: 262343 - RNA, 32 nt, Human
ugucacacucaccuggcuccagccuccccuac

SEQ ID NO: 262344 - RNA, 32 nt, Human
ugucacacuggauccuuggccuccagggucca

SEQ ID NO: 262345 - RNA, 32 nt, Human
ugucacacuguacaucuaucauaaugugcccu

SEQ ID NO: 262346 - RNA, 32 nt, Human
ugucacacuguacuguaauucccucugugcca

SEQ ID NO: 262347 - RNA, 32 nt, Human
ugucacacuguggccugaucagcaggagccaa

SEQ ID NO: 262348 - RNA, 32 nt, Human
ugucacacuguggccuuuaauaauucuaaaca

SEQ ID NO: 262349 - RNA, 32 nt, Human
ugucacagagaaaagaagagacccacccacuc

SEQ ID NO: 262350 - RNA, 32 nt, Human
ugucacagagaggagaucgggagcugccugcu

SEQ ID NO: 262351 - RNA, 18 nt, Human
ugucacagcgaagacuga

SEQ ID NO: 262352 - RNA, 32 nt, Human
ugucacagcugcaggugguacagagccagcac

SEQ ID NO: 262353 - RNA, 32 nt, Human
ugucacaggccuggacuaaauugauuuuacgu

SEQ ID NO: 262354 - RNA, 32 nt, Human
ugucacaggccuggcuguagcgagcaccuccc

SEQ ID NO: 262355 - RNA, 32 nt, Human
ugucacagggggaaagaaguggguaccacauu

SEQ ID NO: 262356 - RNA, 32 nt, Human
ugucacagguagcaccucccugugcuggggga

SEQ ID NO: 262357 - RNA, 32 nt, Human
ugucacagugacggagauaacacugccaugau

SEQ ID NO: 262358 - RNA, 32 nt, Human
ugucacaguucacugcagccugggugacacuc

SEQ ID NO: 262359 - RNA, 32 nt, Human
ugucacauauaaaaauuaagcugaugacuuug

SEQ ID NO: 262360 - RNA, 32 nt, Human
ugucacaucagguuguaugaugacgaauaaaa

SEQ ID NO: 262361 - RNA, 32 nt, Human
ugucacaucucuccuucuucucuuucaccacu

SEQ ID NO: 262362 - RNA, 32 nt, Human
ugucacaucuugaucacagagcagaaaggcac

SEQ ID NO: 262363 - RNA, 32 nt, Human
ugucacauggaguuagucaaagcacaaaguca

SEQ ID NO: 262364 - RNA, 32 nt, Human
ugucaccaaagugcccaacucuggcacggggc

SEQ ID NO: 262365 - RNA, 32 nt, Human
ugucaccaaccuuggcuaacacaaaugagagc

SEQ ID NO: 262366 - RNA, 23 nt, Human
ugucaccaagcuggacugcagug

SEQ ID NO: 262367 - RNA, 23 nt, Human
ugucaccaaggcuuagugcagug

SEQ ID NO: 262368 - RNA, 32 nt, Human
ugucaccacccaggcucccuugccuuuggcug

SEQ ID NO: 262369 - RNA, 32 nt, Human
ugucaccacucugaagguccagacagaagguu

SEQ ID NO: 262370 - RNA, 32 nt, Human
ugucaccacugcccuccagccugggugacaga

SEQ ID NO: 262371 - RNA, 32 nt, Human
ugucaccagaaaccacauguauuugcauguuu

SEQ ID NO: 262372 - RNA, 22 nt, Human
ugucaccagacuggagugcagu

SEQ ID NO: 262373 - RNA, 23 nt, Human
ugucaccagacuggagugcagug

SEQ ID NO: 262374 - RNA, 32 nt, Human
ugucaccagccuguuuuguccuggucucucug

SEQ ID NO: 262375 - RNA, 20 nt, Human
ugucaccagcuaaagcaaug

SEQ ID NO: 262376 - RNA, 22 nt, Human
ugucaccaggauggagugcagu

SEQ ID NO: 262377 - RNA, 23 nt, Human
ugucaccaggauggagugcagug

SEQ ID NO: 262378 - RNA, 22 nt, Human
ugucaccaggccggagugcagu

SEQ ID NO: 262379 - RNA, 23 nt, Human
ugucaccaggccggagugcagug

SEQ ID NO: 262380 - RNA, 22 nt, Human
ugucaccaggcuagagugcagu

SEQ ID NO: 262381 - RNA, 23 nt, Human
ugucaccaggcuagagugcagug

SEQ ID NO: 262382 - RNA, 22 nt, Human
ugucaccaggcuggaaugcagu

SEQ ID NO: 262383 - RNA, 23 nt, Human
ugucaccaggcuggaaugcagug

SEQ ID NO: 262384 - RNA, 23 nt, Human
ugucaccaggcuggagggcagug

SEQ ID NO: 262385 - RNA, 22 nt, Human
ugucaccaggcuggaguacagu

SEQ ID NO: 262386 - RNA, 23 nt, Human
ugucaccaggcuggaguacagug

SEQ ID NO: 262387 - RNA, 21 nt, Human
ugucaccaggcuggagugcag

SEQ ID NO: 262388 - RNA, 22 nt, Human
ugucaccaggcuggagugcagu

SEQ ID NO: 262389 - RNA, 23 nt, Human
ugucaccaggcuggagugcagua

SEQ ID NO: 262390 - RNA, 23 nt, Human
ugucaccaggcuggagugcagug

SEQ ID NO: 262391 - RNA, 19 nt, Human
ugucaccaggcuguacagu

SEQ ID NO: 262392 - RNA, 23 nt, Human
ugucaccaggcuguauuacagug

SEQ ID NO: 262393 - RNA, 32 nt, Human
ugucaccaguguagaggguggggaaggggugu

SEQ ID NO: 262394 - RNA, 32 nt, Human
ugucaccaucaucuuuugcaauguguugcuca

SEQ ID NO: 262395 - RNA, 23 nt, Human
ugucacccaaccugcaggcagug

SEQ ID NO: 262396 - RNA, 24 nt, Human
ugucacccaagcaggauugcagug

SEQ ID NO: 262397 - RNA, 23 nt, Human
ugucacccaagcuggagugcagu

SEQ ID NO: 262398 - RNA, 24 nt, Human
ugucacccaagcuggagugcagug

SEQ ID NO: 262399 - RNA, 23 nt, Human
ugucacccaaggcggagugcagu

SEQ ID NO: 262400 - RNA, 24 nt, Human
ugucacccaaggcggagugcagug

SEQ ID NO: 262401 - RNA, 32 nt, Human
ugucacccaaggcggagugcagugacgacauc

SEQ ID NO: 262402 - RNA, 23 nt, Human
ugucacccaaguuggagugcagu

SEQ ID NO: 262403 - RNA, 24 nt, Human
ugucacccaaguuggagugcagug

SEQ ID NO: 262404 - RNA, 32 nt, Human
ugucacccacacaguaggugcugagaguuagg

SEQ ID NO: 262405 - RNA, 24 nt, Human
ugucacccacgcuggaaugcagug

SEQ ID NO: 262406 - RNA, 24 nt, Human
ugucacccacgcuggagugcaaug

SEQ ID NO: 262407 - RNA, 24 nt, Human
ugucacccacgcuggagugcugug

SEQ ID NO: 262408 - RNA, 32 nt, Human
ugucacccacugcaucuggaguacagcuucuc

SEQ ID NO: 262409 - RNA, 23 nt, Human
ugucacccagacuagagugcagu

SEQ ID NO: 262410 - RNA, 24 nt, Human
ugucacccagacuagagugcagug

SEQ ID NO: 262411 - RNA, 24 nt, Human
ugucacccagacuggaacacagug

SEQ ID NO: 262412 - RNA, 23 nt, Human
ugucacccagacuggaaugcagu

SEQ ID NO: 262413 - RNA, 24 nt, Human
ugucacccagacuggaaugcagug

SEQ ID NO: 262414 - RNA, 24 nt, Human
ugucacccagacuggaguacaaug

SEQ ID NO: 262415 - RNA, 22 nt, Human
ugucacccagacuggagugcag

SEQ ID NO: 262416 - RNA, 23 nt, Human
ugucacccagacuggagugcagu

SEQ ID NO: 262417 - RNA, 24 nt, Human
ugucacccagacuggagugcagug

SEQ ID NO: 262418 - RNA, 24 nt, Human
ugucacccagacuggagugcgaug

SEQ ID NO: 262419 - RNA, 24 nt, Human
ugucacccagccuggaauguagug

SEQ ID NO: 262420 - RNA, 24 nt, Human
ugucacccaggauggagugcagug

SEQ ID NO: 262421 - RNA, 23 nt, Human
ugucacccaggcaggagugcagu

SEQ ID NO: 262422 - RNA, 24 nt, Human
ugucacccaggcaggagugcagug

SEQ ID NO: 262423 - RNA, 23 nt, Human
ugucacccaggccggagugcagu

SEQ ID NO: 262424 - RNA, 24 nt, Human
ugucacccaggccggagugcagug

SEQ ID NO: 262425 - RNA, 26 nt, Human
ugucacccaggcgggaguggugcaau

SEQ ID NO: 262426 - RNA, 27 nt, Human
ugucacccaggcgggaguggugcaaug

SEQ ID NO: 262427 - RNA, 32 nt, Human
ugucacccaggcgggaguggugcaauggcuug

SEQ ID NO: 262428 - RNA, 23 nt, Human
ugucacccaggcuagaaugcagu

SEQ ID NO: 262429 - RNA, 24 nt, Human
ugucacccaggcuagaaugcagug

SEQ ID NO: 262430 - RNA, 24 nt, Human
ugucacccaggcuagaggguggug

SEQ ID NO: 262431 - RNA, 23 nt, Human
ugucacccaggcuagaguacagu

SEQ ID NO: 262432 - RNA, 24 nt, Human
ugucacccaggcuagaguacagug

SEQ ID NO: 262433 - RNA, 23 nt, Human
ugucacccaggcuagagugcaau

SEQ ID NO: 262434 - RNA, 24 nt, Human
ugucacccaggcuagagugcaaug

SEQ ID NO: 262435 - RNA, 23 nt, Human
ugucacccaggcuagagugcagu

SEQ ID NO: 262436 - RNA, 24 nt, Human
ugucacccaggcuagagugcagug

SEQ ID NO: 262437 - RNA, 23 nt, Human
ugucacccaggcugaacugcagu

SEQ ID NO: 262438 - RNA, 24 nt, Human
ugucacccaggcugaacugcagug

SEQ ID NO: 262439 - RNA, 23 nt, Human
ugucacccaggcugaagugcagu

SEQ ID NO: 262440 - RNA, 24 nt, Human
ugucacccaggcugaagugcagug

SEQ ID NO: 262441 - RNA, 23 nt, Human
ugucacccaggcugcagugcaau

SEQ ID NO: 262442 - RNA, 24 nt, Human
ugucacccaggcugcagugcaaug

SEQ ID NO: 262443 - RNA, 24 nt, Human
ugucacccaggcugcaguguagug

SEQ ID NO: 262444 - RNA, 24 nt, Human
ugucacccaggcugcaguucacug

SEQ ID NO: 262445 - RNA, 32 nt, Human
ugucacccaggcugcuggaguacaguggcaca

SEQ ID NO: 262446 - RNA, 23 nt, Human
ugucacccaggcuggaauccagu

SEQ ID NO: 262447 - RNA, 24 nt, Human
ugucacccaggcuggaauccagug

SEQ ID NO: 262448 - RNA, 22 nt, Human
ugucacccaggcuggaaugacg

SEQ ID NO: 262449 - RNA, 23 nt, Human
ugucacccaggcuggaaugacga

SEQ ID NO: 262450 - RNA, 23 nt, Human
ugucacccaggcuggaaugcagu

SEQ ID NO: 262451 - RNA, 24 nt, Human
ugucacccaggcuggaaugcagug

SEQ ID NO: 262452 - RNA, 23 nt, Human
ugucacccaggcuggacugcaau

SEQ ID NO: 262453 - RNA, 24 nt, Human
ugucacccaggcuggacugcaaug

SEQ ID NO: 262454 - RNA, 23 nt, Human
ugucacccaggcuggacugcagu

SEQ ID NO: 262455 - RNA, 24 nt, Human
ugucacccaggcuggacugcagug

SEQ ID NO: 262456 - RNA, 23 nt, Human
ugucacccaggcuggagagcagu

SEQ ID NO: 262457 - RNA, 24 nt, Human
ugucacccaggcuggagagcagug

SEQ ID NO: 262458 - RNA, 24 nt, Human
ugucacccaggcuggagcacacug

SEQ ID NO: 262459 - RNA, 23 nt, Human
ugucacccaggcuggagcgcagu

SEQ ID NO: 262460 - RNA, 24 nt, Human
ugucacccaggcuggagcgcagug

SEQ ID NO: 262461 - RNA, 19 nt, Human
ugucacccaggcuggagua

SEQ ID NO: 262462 - RNA, 21 nt, Human
ugucacccaggcuggaguaca

SEQ ID NO: 262463 - RNA, 23 nt, Human
ugucacccaggcuggaguacaau

SEQ ID NO: 262464 - RNA, 24 nt, Human
ugucacccaggcuggaguacaaug

SEQ ID NO: 262465 - RNA, 24 nt, Human
ugucacccaggcuggaguacacug

SEQ ID NO: 262466 - RNA, 23 nt, Human
ugucacccaggcuggaguacagu

SEQ ID NO: 262467 - RNA, 24 nt, Human
ugucacccaggcuggaguacagug

SEQ ID NO: 262468 - RNA, 24 nt, Human
ugucacccaggcuggaguaccggu

SEQ ID NO: 262469 - RNA, 24 nt, Human
ugucacccaggcuggaguauagug

SEQ ID NO: 262470 - RNA, 26 nt, Human
ugucacccaggcuggaguauaguggu

SEQ ID NO: 262471 - RNA, 23 nt, Human
ugucacccaggcuggaguccaau

SEQ ID NO: 262472 - RNA, 24 nt, Human
ugucacccaggcuggaguccaaug

SEQ ID NO: 262473 - RNA, 24 nt, Human
ugucacccaggcuggaguccagug

SEQ ID NO: 262474 - RNA, 23 nt, Human
ugucacccaggcuggagucuagu

SEQ ID NO: 262475 - RNA, 24 nt, Human
ugucacccaggcuggagucuagug

SEQ ID NO: 262476 - RNA, 19 nt, Human
ugucacccaggcuggagug

SEQ ID NO: 262477 - RNA, 23 nt, Human
ugucacccaggcuggagugaggu

SEQ ID NO: 262478 - RNA, 24 nt, Human
ugucacccaggcuggagugaggug

SEQ ID NO: 262479 - RNA, 20 nt, Human
ugucacccaggcuggagugc

SEQ ID NO: 262480 - RNA, 21 nt, Human
ugucacccaggcuggagugca

SEQ ID NO: 262481 - RNA, 23 nt, Human
ugucacccaggcuggagugcaau

SEQ ID NO: 262482 - RNA, 24 nt, Human
ugucacccaggcuggagugcaaug

SEQ ID NO: 262483 - RNA, 24 nt, Human
ugucacccaggcuggagugcacug

SEQ ID NO: 262484 - RNA, 22 nt, Human
ugucacccaggcuggagugcag

SEQ ID NO: 262485 - RNA, 23 nt, Human
ugucacccaggcuggagugcagu

SEQ ID NO: 262486 - RNA, 24 nt, Human
ugucacccaggcuggagugcagug

SEQ ID NO: 262487 - RNA, 32 nt, Human
ugucacccaggcuggagugcaguggcgcaauc

SEQ ID NO: 262488 - RNA, 23 nt, Human
ugucacccaggcuggagugcaug

SEQ ID NO: 262489 - RNA, 24 nt, Human
ugucacccaggcuggagugccaug

SEQ ID NO: 262490 - RNA, 24 nt, Human
ugucacccaggcuggagugccgug

SEQ ID NO: 262491 - RNA, 23 nt, Human
ugucacccaggcuggagugcgau

SEQ ID NO: 262492 - RNA, 24 nt, Human
ugucacccaggcuggagugcgaug

SEQ ID NO: 262493 - RNA, 23 nt, Human
ugucacccaggcuggagugcggu

SEQ ID NO: 262494 - RNA, 24 nt, Human
ugucacccaggcuggagugcggug

SEQ ID NO: 262495 - RNA, 24 nt, Human
ugucacccaggcuggagugcuaug

SEQ ID NO: 262496 - RNA, 23 nt, Human
ugucacccaggcuggagugcugu

SEQ ID NO: 262497 - RNA, 24 nt, Human
ugucacccaggcuggagugcugug

SEQ ID NO: 262498 - RNA, 23 nt, Human
ugucacccaggcuggaguguagu

SEQ ID NO: 262499 - RNA, 24 nt, Human
ugucacccaggcuggaguguagug

SEQ ID NO: 262500 - RNA, 24 nt, Human
ugucacccaggcuggaguuauagu

SEQ ID NO: 262501 - RNA, 23 nt, Human
ugucacccaggcuggaguucagu

SEQ ID NO: 262502 - RNA, 24 nt, Human
ugucacccaggcuggaguucagug

SEQ ID NO: 262503 - RNA, 23 nt, Human
ugucacccaggcuggcgugcaau

SEQ ID NO: 262504 - RNA, 24 nt, Human
ugucacccaggcuggcgugcaaug

SEQ ID NO: 262505 - RNA, 32 nt, Human
ugucacccaggcugggaauugcaguggcacaa

SEQ ID NO: 262506 - RNA, 23 nt, Human
ugucacccaggcugggaugcagu

SEQ ID NO: 262507 - RNA, 24 nt, Human
ugucacccaggcugggaugcagug

SEQ ID NO: 262508 - RNA, 32 nt, Human
ugucacccaggcuggggcgcaauggcacgauc

SEQ ID NO: 262509 - RNA, 24 nt, Human
ugucacccaggcugggguacggug

SEQ ID NO: 262510 - RNA, 23 nt, Human
ugucacccaggcuggggugcagu

SEQ ID NO: 262511 - RNA, 24 nt, Human
ugucacccaggcuggggugcagug

SEQ ID NO: 262512 - RNA, 23 nt, Human
ugucacccaggcuguagugcagu

SEQ ID NO: 262513 - RNA, 24 nt, Human
ugucacccaggcuguagugcagug

SEQ ID NO: 262514 - RNA, 24 nt, Human
ugucacccaggcuguaguggagug

SEQ ID NO: 262515 - RNA, 23 nt, Human
ugucacccaggcuugacuacagu

SEQ ID NO: 262516 - RNA, 23 nt, Human
ugucacccaggcuugagugcagu

SEQ ID NO: 262517 - RNA, 24 nt, Human
ugucacccaggcuugagugcagug

SEQ ID NO: 262518 - RNA, 20 nt, Human
ugucacccagggugagugca

SEQ ID NO: 262519 - RNA, 32 nt, Human
ugugagccugcucaccuucauccugcugcuca

SEQ ID NO: 262520 - RNA, 32 nt, Human
ugugagccugggaggucaaggcugcagugagc

SEQ ID NO: 262521 - RNA, 32 nt, Human
ugugagccuucuagggccccaggcugggaggc

SEQ ID NO: 262522 - RNA, 32 nt, Human
ugugagccuuggcuguuggcagugagugagcc

SEQ ID NO: 262523 - RNA, 32 nt, Human
ugugagcgcuggugggagacgccaggcuggga

SEQ ID NO: 262524 - RNA, 32 nt, Human
ugugagcggcucggggccgggggugggcggcg

SEQ ID NO: 262525 - RNA, 32 nt, Human
ugugagcucucugucuuuuacacgcugaauuu

SEQ ID NO: 262526 - RNA, 32 nt, Human
ugugagcugacaaaugcucuggcuccgguggu

SEQ ID NO: 262527 - RNA, 32 nt, Human
ugugagcugagcgguggggucugcguacgccu

SEQ ID NO: 262528 - RNA, 32 nt, Human
ugugagcugccaguuucauuugucuccugacu

SEQ ID NO: 262529 - RNA, 32 nt, Human
ugugagcugcucccccugaccccuggcaggag

SEQ ID NO: 262530 - RNA, 32 nt, Human
ugugagcugcugccucuauccugggugccugc

SEQ ID NO: 262531 - RNA, 32 nt, Human
ugugagcuggagagagaaaaggugguaacugg

SEQ ID NO: 262532 - RNA, 32 nt, Human
ugugagcuggcgcguuuucuccacccggcucc

SEQ ID NO: 262533 - RNA, 23 nt, Human
ugugagcugggacaugccuguga

SEQ ID NO: 262534 - RNA, 32 nt, Human
ugugagcuguggugugagagggugaaggcggc

SEQ ID NO: 262535 - RNA, 32 nt, Human
ugugaggaaagaaaaguaaaacagaaaaagac

SEQ ID NO: 262536 - RNA, 32 nt, Human
ugugaggacacauagagcaugccaucuaugag

SEQ ID NO: 262537 - RNA, 32 nt, Human
ugugaggacacggccuccuguuggagucccau

SEQ ID NO: 262538 - RNA, 32 nt, Human
ugugaggacagcuucagccaggaggcugugag

SEQ ID NO: 262539 - RNA, 32 nt, Human
ugugaggacggcuuccagcagggagcuucccc

SEQ ID NO: 262540 - RNA, 32 nt, Human
ugugaggagaggguggcaucaggagcugcuca

SEQ ID NO: 262541 - RNA, 32 nt, Human
ugugaggagcaagaaagccaguucaaguccca

SEQ ID NO: 262542 - RNA, 32 nt, Human
ugugaggagcuggaguggaagcugcaccuuug

SEQ ID NO: 262543 - RNA, 28 nt, Human
ugugaggaggcuggggccaguugacacc

SEQ ID NO: 262544 - RNA, 19 nt, Human
ugugaggagggcgugggga

SEQ ID NO: 262545 - RNA, 32 nt, Human
ugugaggagguagauuuggcuccucugcuucu

SEQ ID NO: 262546 - RNA, 32 nt, Human
ugugaggaucagcuuguuagccugcagauucc

SEQ ID NO: 262547 - RNA, 32 nt, Human
ugugaggaugaaauaaugaccuugauuuuugg

SEQ ID NO: 262548 - RNA, 32 nt, Human
ugugaggccacuaccccuccagcaacugggag

SEQ ID NO: 262549 - RNA, 32 nt, Human
ugugaggccaggaguuccagaucagccugagc

SEQ ID NO: 262550 - RNA, 32 nt, Human
ugugaggccucuuccccggccauguggaacuc

SEQ ID NO: 262551 - RNA, 32 nt, Human
ugugaggccuggccugggcccagaugcugauc

SEQ ID NO: 262552 - RNA, 31 nt, Human
ugugaggcugcgagagaaagggagugcaugu

SEQ ID NO: 262553 - RNA, 32 nt, Human
ugugaggcugcgagagaaagggagugcaugug

SEQ ID NO: 262554 - RNA, 32 nt, Human
ugugaggcugggaugacaagccuggggccugg

SEQ ID NO: 262555 - RNA, 23 nt, Human
ugugaggcugggcagcccuucac

SEQ ID NO: 262556 - RNA, 19 nt, Human
ugugagggagagacgggga

SEQ ID NO: 262557 - RNA, 32 nt, Human
ugugagggagagugugcaugagcgugugugug

SEQ ID NO: 262558 - RNA, 32 nt, Human
ugugagggcaccccuccucugaagaucccugu

SEQ ID NO: 262559 - RNA, 32 nt, Human
ugugagggcccaggaaugagcaaggcaugguc

SEQ ID NO: 262560 - RNA, 32 nt, Human
ugugaggggaaaggggaaauaaaucuagcaua

SEQ ID NO: 262561 - RNA, 32 nt, Human
ugugaggggagguggaggagauggcggcgacg

SEQ ID NO: 262562 - RNA, 32 nt, Human
ugugaggggagguguaggugugugggugacug

SEQ ID NO: 262563 - RNA, 32 nt, Human
ugugaggggugcagcagccaggaggcgggcgg

SEQ ID NO: 262564 - RNA, 32 nt, Human
ugugagggguuucuuuuggaaauaauuacuuu

SEQ ID NO: 262565 - RNA, 32 nt, Human
ugugagggugccugaggcugaauggcuccacc

SEQ ID NO: 262566 - RNA, 32 nt, Human
ugugagguagguggcauggcagagggggcugg

SEQ ID NO: 262567 - RNA, 22 nt, Human
ugugaggucagccacuggguca

SEQ ID NO: 262568 - RNA, 32 nt, Human
ugugaggugaaugcacacaucacaaagaaguu

SEQ ID NO: 262569 - RNA, 32 nt, Human
ugugaggugcccaaagagguuauagugaaguu

SEQ ID NO: 262570 - RNA, 32 nt, Human
ugugaggugcugcugucucuccuccagcaagg

SEQ ID NO: 262571 - RNA, 32 nt, Human
ugugaggugcugugaggauagagcagagagga

SEQ ID NO: 262572 - RNA, 32 nt, Human
ugugaggugggaugagccgcagcccuuuccug

SEQ ID NO: 262573 - RNA, 32 nt, Human
ugugagguggguggggcagggcuguagcccac

SEQ ID NO: 262574 - RNA, 32 nt, Human
ugugaggugucagugugcaccugcuggagggu

SEQ ID NO: 262575 - RNA, 32 nt, Human
ugugaguaccagcagcccuggagagcagcagg

SEQ ID NO: 262576 - RNA, 32 nt, Human
ugugaguacuacaguccucccaucucacacau

SEQ ID NO: 262577 - RNA, 32 nt, Human
ugugaguagaauauguagcaaagcuuuuuagg

SEQ ID NO: 262578 - RNA, 32 nt, Human
ugugaguagagaaggacccaggucaucugagu

SEQ ID NO: 262579 - RNA, 32 nt, Human
ugugagucuuccagcuuucuucugcuuuuuca

SEQ ID NO: 262580 - RNA, 19 nt, Human
ugugagucuugccggaagc

SEQ ID NO: 262581 - RNA, 32 nt, Human
ugugagucuuucucagaauugauaucuuaaua

SEQ ID NO: 262582 - RNA, 32 nt, Human
ugugagugcaucauuuuaagacaguaugacuu

SEQ ID NO: 262583 - RNA, 32 nt, Human
ugugagugcauguacuaucuuaucucagauau

SEQ ID NO: 262584 - RNA, 32 nt, Human
ugugaguggaaagaaggcuggugcagacccag

SEQ ID NO: 262585 - RNA, 32 nt, Human
ugugaguggauucacccccaaggucagaaugg

SEQ ID NO: 262586 - RNA, 32 nt, Human
ugugaguggcuaccuggcucaacuggagggga

SEQ ID NO: 262587 - RNA, 32 nt, Human
ugugagugggaggcggcggcgcugguggcugc

SEQ ID NO: 262588 - RNA, 32 nt, Human
ugugagugucuuggcccugucccugcccuggg

SEQ ID NO: 262589 - RNA, 32 nt, Human
ugugaguguguuuucugugcugaguagaauag

SEQ ID NO: 262590 - RNA, 32 nt, Human
ugugaguugaaugcacacaucacaaagaacuu

SEQ ID NO: 262591 - RNA, 32 nt, Human
ugugaguugaaugcacacaucacaaagaaguu

SEQ ID NO: 262592 - RNA, 32 nt, Human
ugugaguugcugucugccccuugucaggcugu

SEQ ID NO: 262593 - RNA, 32 nt, Human
ugugaguugggaaucagacucuugaguugaca

SEQ ID NO: 262594 - RNA, 32 nt, Human
ugugaguuugucugauguucuaccacaacgug

SEQ ID NO: 262595 - RNA, 32 nt, Human
ugugaguuuguuguuuuucuguguaugggccu

SEQ ID NO: 262596 - RNA, 32 nt, Human
ugugaguuuuccuuuuggugcauggaacugug

SEQ ID NO: 262597 - RNA, 32 nt, Human
ugugaguuuuguguguacacacacagaaacau

SEQ ID NO: 262598 - RNA, 32 nt, Human
ugugauaaaaacaagcucaggacuuuauucua

SEQ ID NO: 262599 - RNA, 32 nt, Human
ugugauaaaaaucaaugacaucaugucucacu

SEQ ID NO: 262600 - RNA, 32 nt, Human
ugugauaaaacacagaauuuacauauacacug

SEQ ID NO: 262601 - RNA, 32 nt, Human
ugugauaaaauguaauuucaacuauuuuguac

SEQ ID NO: 262602 - RNA, 20 nt, Human
ugugauaaccaccauggaua

SEQ ID NO: 262603 - RNA, 32 nt, Human
ugugauaacuuaggaggcagcaauccuaauag

SEQ ID NO: 262604 - RNA, 20 nt, Human
ugugauaagauacccuccac

SEQ ID NO: 262605 - RNA, 21 nt, Human
ugugauaagcagaacuagaaa

SEQ ID NO: 262606 - RNA, 32 nt, Human
ugugauacaguuaucuaaacagaaugagucua

SEQ ID NO: 262607 - RNA, 32 nt, Human
ugugauacaucagguuucagcacacaacuuac

SEQ ID NO: 262608 - RNA, 32 nt, Human
ugugauagagggcuagaguuugaccuagagag

SEQ ID NO: 262609 - RNA, 32 nt, Human
ugugauagcaccacugcgcuccagccugggug

SEQ ID NO: 262610 - RNA, 32 nt, Human
ugugauaggguuaagagguggggccuuuagaa

SEQ ID NO: 262611 - RNA, 32 nt, Human
ugugauagugucuacuuugagcuagauaaaua

SEQ ID NO: 262612 - RNA, 32 nt, Human
ugugauauagcuaguucccaaagugauuguac

SEQ ID NO: 262613 - RNA, 21 nt, Human
ugugauaucaaaaauguauga

SEQ ID NO: 262614 - RNA, 32 nt, Human
ugugauaugaagacuauccaguucucaguuug

SEQ ID NO: 262615 - RNA, 32 nt, Human
ugugauauuuugcuuuugcaccuuuaaaacaa

SEQ ID NO: 262616 - RNA, 32 nt, Human
ugugaucaagaagguucugaccagcuucugca

SEQ ID NO: 262617 - RNA, 32 nt, Human
ugugaucacaccaccacacuccaaccugugua

SEQ ID NO: 262618 - RNA, 32 nt, Human
ugugaucacaccacugcacuccagccuggacg

SEQ ID NO: 262619 - RNA, 32 nt, Human
ugugaucacaccacugcacuccagccugggca

SEQ ID NO: 262620 - RNA, 32 nt, Human
ugugaucacaccacugcacuccagccugggug

SEQ ID NO: 262621 - RNA, 32 nt, Human
ugugaucacaccacugcacuccagccuuggcg

SEQ ID NO: 262622 - RNA, 32 nt, Human
ugugaucacaccacugcauucuggccugggug

SEQ ID NO: 262623 - RNA, 32 nt, Human
ugugaucacaccauugcaguccagccagguug

SEQ ID NO: 262624 - RNA, 32 nt, Human
ugugaucacacugcugcacuccagccugugca

SEQ ID NO: 262625 - RNA, 32 nt, Human
ugugaucaccucccccugcuuccugcugcugu

SEQ ID NO: 262626 - RNA, 32 nt, Human
ugugaucacgccacugcaccccagccugggug

SEQ ID NO: 262627 - RNA, 32 nt, Human
ugugaucagccugucaugguucugagcccuga

SEQ ID NO: 262628 - RNA, 23 nt, Human
ugugaucauaacugugaucuccu

SEQ ID NO: 262629 - RNA, 32 nt, Human
ugugaucauaccacugcacuccagccugggcg

SEQ ID NO: 262630 - RNA, 21 nt, Human
ugugaucauagaauacugcca

SEQ ID NO: 262631 - RNA, 32 nt, Human
ugugaucauagcucacugcagcuuugacuucc

SEQ ID NO: 262632 - RNA, 32 nt, Human
ugugaucauagcucauagcucacugcagccuc

SEQ ID NO: 262633 - RNA, 32 nt, Human
ugugaucauccagcaugaugcagcgugaggac

SEQ ID NO: 262634 - RNA, 32 nt, Human
ugugaucaugccaccgcacuuccagccugggu

SEQ ID NO: 262635 - RNA, 32 nt, Human
ugugaucaugccacugcacuccagccuggaug

SEQ ID NO: 262636 - RNA, 32 nt, Human
ugugaucaugccacugcacuuccagccugggu

SEQ ID NO: 262637 - RNA, 32 nt, Human
ugugaucaugccacugcauuccagccugggcg

SEQ ID NO: 262638 - RNA, 32 nt, Human
ugugaucaugccacuguacuccagccugggcg

SEQ ID NO: 262639 - RNA, 32 nt, Human
ugugaucaugccaucacaccgcugccuuguga

SEQ ID NO: 262640 - RNA, 32 nt, Human
ugugaucaugcuacugcacuccagccuaggug

SEQ ID NO: 262641 - RNA, 32 nt, Human
ugugaucauggcacugcacuccagccugggca

SEQ ID NO: 262642 - RNA, 32 nt, Human
ugugaucauugguuggacacugugguuaugca

SEQ ID NO: 262643 - RNA, 32 nt, Human
ugugauccagagagcagugggagacgcuggca

SEQ ID NO: 262644 - RNA, 32 nt, Human
ugugauccagugcccuauuuuauagugugguu

SEQ ID NO: 262645 - RNA, 20 nt, Human
ugugaucccagcuaccuggg

SEQ ID NO: 262646 - RNA, 32 nt, Human
ugugauccgccagccucggccucccaaagugc

SEQ ID NO: 262647 - RNA, 32 nt, Human
ugugauccgccauuacacuccagccuggguga

SEQ ID NO: 262648 - RNA, 21 nt, Human
ugugauccuaauccaccuggg

SEQ ID NO: 262649 - RNA, 26 nt, Human
ugugauccuggacccaagggcuuggg

SEQ ID NO: 262650 - RNA, 21 nt, Human
ugugauccugggagcccuggg

SEQ ID NO: 262651 - RNA, 32 nt, Human
ugugaucgcaccacugcacuccagcucgggug

SEQ ID NO: 262652 - RNA, 32 nt, Human
ugugaucgcaccacugcacuccagcuugguuc

SEQ ID NO: 262653 - RNA, 32 nt, Human
ugugaucgcaccacuguacuccagccugggug

SEQ ID NO: 262654 - RNA, 32 nt, Human
ugugaucgcaccacuguauuccagccuggaug

SEQ ID NO: 262655 - RNA, 32 nt, Human
ugugaucgugacauggccuccagccuggguga

SEQ ID NO: 262656 - RNA, 32 nt, Human
ugugaucgugccacugcacuccaaccugagug

SEQ ID NO: 262657 - RNA, 32 nt, Human
ugugaucgugccacugcauuccagccugggag

SEQ ID NO: 262658 - RNA, 32 nt, Human
ugugaucgugccacuguacucuagccuggaag

SEQ ID NO: 262659 - RNA, 32 nt, Human
ugugaucucaacagcacccaguguguuccccu

SEQ ID NO: 262660 - RNA, 32 nt, Human
ugugaucucacauugucuuugaaaguguggau

SEQ ID NO: 262661 - RNA, 32 nt, Human
ugugaucucugcguuucucuucuacacugcug

SEQ ID NO: 262662 - RNA, 32 nt, Human
ugugaucugacagaacccagcacauaaaagaa

SEQ ID NO: 262663 - RNA, 32 nt, Human
ugugaucugacuccugcagacucuuccagauu

SEQ ID NO: 262664 - RNA, 32 nt, Human
ugugaucugccucuugcugccauucuuucucu

SEQ ID NO: 262665 - RNA, 32 nt, Human
ugugaucugccuggaucuugcugcauugagaa

SEQ ID NO: 262666 - RNA, 32 nt, Human
ugugaucugccuggggcucaugcucuggggca

SEQ ID NO: 262667 - RNA, 32 nt, Human
ugugaucuguaacaggguagugugguauugua

SEQ ID NO: 262668 - RNA, 32 nt, Human
ugugaucuugaacaagaggcccaaucucacuu

SEQ ID NO: 262669 - RNA, 32 nt, Human
ugugaucuugggcaaguuacaagccuugauca

SEQ ID NO: 262670 - RNA, 24 nt, Human
ugugaugaagaagcuguuccccac

SEQ ID NO: 262671 - RNA, 32 nt, Human
ugugaugaauacuguauuuuguauuguuucaa

SEQ ID NO: 262672 - RNA, 32 nt, Human
ugugaugaauugaaccucaucggaugcugcug

SEQ ID NO: 262673 - RNA, 32 nt, Human
ugugaugacaccacugcacuccaaccuaggua

SEQ ID NO: 262674 - RNA, 32 nt, Human
ugugaugacagcugggacaugaaggauguggc

SEQ ID NO: 262675 - RNA, 32 nt, Human
ugugaugagcuuccaggucgcuggccuuacca

SEQ ID NO: 262676 - RNA, 32 nt, Human
ugugaugaggagagaguggaagaagcaaaacu

SEQ ID NO: 262677 - RNA, 29 nt, Human
ugugaugaggcugaaagaggaugaguggg

SEQ ID NO: 262678 - RNA, 29 nt, Human
ugugaugagggcccugggccagaacccua

SEQ ID NO: 262679 - RNA, 32 nt, Human
ugugaugaucaugguucacugcagccucgacc

SEQ ID NO: 262680 - RNA, 32 nt, Human
ugugaugcagagaccagagagugaaggcccgg

SEQ ID NO: 262681 - RNA, 32 nt, Human
ugugaugcagucagaggcaccugcggguuagc

SEQ ID NO: 262682 - RNA, 32 nt, Human
ugugaugccaacaaacauugagaaagguaauc

SEQ ID NO: 262683 - RNA, 32 nt, Human
ugugaugccauccugagggcuugcaaccagca

SEQ ID NO: 262684 - RNA, 32 nt, Human
ugugaugccgaggguggagugcaguggcacaa

SEQ ID NO: 262685 - RNA, 31 nt, Human
ugugaugcucucuucugacagccaaagauga

SEQ ID NO: 262686 - RNA, 32 nt, Human
ugugaugcugaagcagagugugucacaaagug

SEQ ID NO: 262687 - RNA, 32 nt, Human
ugugaugcugagauuugggguaugaaugaaag

SEQ ID NO: 262688 - RNA, 32 nt, Human
ugugaugcugagauuugggguaugaaugaagg

SEQ ID NO: 262689 - RNA, 32 nt, Human
ugugaugcugcugguuuuaucucuagugaaau

SEQ ID NO: 262690 - RNA, 32 nt, Human
ugugaugcuggcagaggugacacuaagaggga

SEQ ID NO: 262691 - RNA, 28 nt, Human
ugugauggaagagcugccucaucacgua

SEQ ID NO: 262692 - RNA, 32 nt, Human
ugugauggaagagcugccucaucacguagcag

SEQ ID NO: 262693 - RNA, 32 nt, Human
ugugauggacccaggaggucucugcagagcaa

SEQ ID NO: 262694 - RNA, 31 nt, Human
ugugauggagaucacccaaugccaagggcag

SEQ ID NO: 262695 - RNA, 32 nt, Human
ugugauggagauccacaagccuagccaagcuu

SEQ ID NO: 262696 - RNA, 32 nt, Human
ugugauggagucucacucuguugcccaggcug

SEQ ID NO: 262697 - RNA, 32 nt, Human
ugugauggagucucgcucugucacccaggcug

SEQ ID NO: 262698 - RNA, 32 nt, Human
ugugauggcacauaccuguaaucccagcuacu

SEQ ID NO: 262699 - RNA, 32 nt, Human
ugugauggcacaugccuguaaucccagcuacu

SEQ ID NO: 262700 - RNA, 29 nt, Human
ugugauggccaagaguucacagaggaagc

SEQ ID NO: 262701 - RNA, 32 nt, Human
ugugauggcgcaugccuguaaucccagcuacu

SEQ ID NO: 262702 - RNA, 32 nt, Human
ugugauggcgcaugccuguaaucccaguuacu

SEQ ID NO: 262703 - RNA, 32 nt, Human
ugugauggcgccacugcacuccagucugggca

SEQ ID NO: 262704 - RNA, 32 nt, Human
ugugauggcucacacccguaaucccagcacuu

SEQ ID NO: 262705 - RNA, 32 nt, Human
ugugauggcucacaccuguaauccccagcacu

SEQ ID NO: 262706 - RNA, 32 nt, Human
ugugauggcucacgccuguaaucccagcauuu

SEQ ID NO: 262707 - RNA, 32 nt, Human
ugugauggcucacgccuguaauccuagcacuu

SEQ ID NO: 262708 - RNA, 32 nt, Human
ugugauggcucaugcccauaaucccagcccuu

SEQ ID NO: 262709 - RNA, 32 nt, Human
ugugauggcucaugccuguaaucccagcacuu

SEQ ID NO: 262710 - RNA, 32 nt, Human
ugugaugggauccuuggcucuggcaggcgucc

SEQ ID NO: 262711 - RNA, 32 nt, Human
ugugaugggcacaguacgcagagcaagcucgg

SEQ ID NO: 262712 - RNA, 32 nt, Human
ugugauggggugaggguagggggagcauuugu

SEQ ID NO: 262713 - RNA, 32 nt, Human
ugugaugggguuucgcacuuguugcccaggcu

SEQ ID NO: 262714 - RNA, 32 nt, Human
ugugaugggguuuugcucuuguugcccaggcu

SEQ ID NO: 262715 - RNA, 32 nt, Human
ugugaugguauguuguccaucuucccauccca

SEQ ID NO: 262716 - RNA, 32 nt, Human
ugugauggugcaugccuguaaucccagcuccu

SEQ ID NO: 262717 - RNA, 29 nt, Human
ugugauggugccucuuccauucacaaggg

SEQ ID NO: 262718 - RNA, 32 nt, Human
ugugauggugggugccuguaaucccaguuacu

SEQ ID NO: 262719 - RNA, 32 nt, Human
ugugaugguguuaggagagggggccuuugggg

SEQ ID NO: 262720 - RNA, 32 nt, Human
ugugaugucuacaucuuuuaacuucugguucu

SEQ ID NO: 262721 - RNA, 32 nt, Human
ugugauguggguccugccagggagacauccag

SEQ ID NO: 262722 - RNA, 32 nt, Human
ugugaugugggugggggaggaagaguaaacac

SEQ ID NO: 262723 - RNA, 20 nt, Human
ugugauguguugcucuccau

SEQ ID NO: 262724 - RNA, 32 nt, Human
ugugauguucccaccugcuucuguagaaaugu

SEQ ID NO: 262725 - RNA, 32 nt, Human
ugugauguugcccaggcuagagugcaguggca

SEQ ID NO: 262726 - RNA, 32 nt, Human
ugugauguuuaugauggcuuaggcuuugugaa

SEQ ID NO: 262727 - RNA, 32 nt, Human
ugugauguuuucaggaugcuagggucaaagaa

SEQ ID NO: 262728 - RNA, 32 nt, Human
ugugauuaccugcugcaugaaaaguggcaugg

SEQ ID NO: 262729 - RNA, 32 nt, Human
ugugauuauaucuguaucaggucagcagaaga

SEQ ID NO: 262730 - RNA, 32 nt, Human
ugugauuaugccauugcacuccagccugggug

SEQ ID NO: 262731 - RNA, 32 nt, Human
ugugauuauuuaugcugccucccaaggauaga

SEQ ID NO: 262732 - RNA, 32 nt, Human
ugugauuauuugaugcaccugggaggccaugu

SEQ ID NO: 262733 - RNA, 32 nt, Human
ugugauucaaugcucauaccucucuaaacuua

SEQ ID NO: 262734 - RNA, 32 nt, Human
ugugauucacacagcuucacaccuuucagugu

SEQ ID NO: 262735 - RNA, 32 nt, Human
ugugauucacccagaucuguugugccaguuag

SEQ ID NO: 262736 - RNA, 32 nt, Human
ugugauucacugccuuccucucucuaccaguc

SEQ ID NO: 262737 - RNA, 32 nt, Human
ugugauucacuugccucagccucccagaagug

SEQ ID NO: 262738 - RNA, 32 nt, Human
ugugauucucuucaggaagucagaccuucccu

SEQ ID NO: 262739 - RNA, 21 nt, Human
ugugauugaaagcugccuuuc

SEQ ID NO: 262740 - RNA, 32 nt, Human
ugugauugaacaaaucaaugcucgcaugcaaa

SEQ ID NO: 262741 - RNA, 32 nt, Human
ugugauugaaucugauuggacauuuucuucag

SEQ ID NO: 262742 - RNA, 32 nt, Human
ugugauugacauguagguacccugccacggcc

SEQ ID NO: 262743 - RNA, 32 nt, Human
ugugauugacuucuagcucacugccuuuaaau

SEQ ID NO: 262744 - RNA, 32 nt, Human
ugugauugagccacugcacuccaaucugggug

SEQ ID NO: 262745 - RNA, 32 nt, Human
ugugauugaguugaagaucugcagugagaggg

SEQ ID NO: 262746 - RNA, 32 nt, Human
ugugauugaugucugacgugagucugucucag

SEQ ID NO: 262747 - RNA, 32 nt, Human
ugugauugcaccaccacacuccagccugggug

SEQ ID NO: 262748 - RNA, 32 nt, Human
ugugauugcaccacugcacucaagccugggca

SEQ ID NO: 262749 - RNA, 32 nt, Human
ugugauugcaccacugcacuccagccugggcg

SEQ ID NO: 262750 - RNA, 32 nt, Human
ugugauugcaccacugcacuucagcuugggca

SEQ ID NO: 262751 - RNA, 32 nt, Human
ugugauugcaccacugcacuuuagucugggug

SEQ ID NO: 262752 - RNA, 32 nt, Human
ugugauugcaccacuguacuccagacuggaua

SEQ ID NO: 262753 - RNA, 32 nt, Human
ugugauugcaccacuuguaacuccagccuggg

SEQ ID NO: 262754 - RNA, 32 nt, Human
ugugauugcaccgugacacuccagccugggca

SEQ ID NO: 262755 - RNA, 32 nt, Human
ugugauugcacgacugcacuccagccugggca

SEQ ID NO: 262756 - RNA, 32 nt, Human
ugugauugcacuccagcccaggggacaaugug

SEQ ID NO: 262757 - RNA, 32 nt, Human
ugugauugcgccacugcauuccagcuugggcg

SEQ ID NO: 262758 - RNA, 32 nt, Human
ugugauugcucccuccuguguggacguugccu

SEQ ID NO: 262759 - RNA, 32 nt, Human
ugugauuggguuccugcuggccuguguggcaa

SEQ ID NO: 262760 - RNA, 32 nt, Human
ugugauuguaaguuuucugaggccucgccagc

SEQ ID NO: 262761 - RNA, 32 nt, Human
ugugauuguaccacugcacuccagcucgggga

SEQ ID NO: 262762 - RNA, 32 nt, Human
ugugauugugccacugcacuccagccugggca

SEQ ID NO: 262763 - RNA, 32 nt, Human
ugugauugugccacugcacuccagccugggcc

SEQ ID NO: 262764 - RNA, 32 nt, Human
ugugauugugccacugcacuccagccuggguu

SEQ ID NO: 262765 - RNA, 32 nt, Human
ugugauugugccauugcacuccagccuggaca

SEQ ID NO: 262766 - RNA, 32 nt, Human
ugugauugugccauugcacuccagccugggug

SEQ ID NO: 262767 - RNA, 32 nt, Human
ugugauugugugacaaguguguuuacagauua

SEQ ID NO: 262768 - RNA, 32 nt, Human
ugugauuuacagugggaaugaaagaacagauu

SEQ ID NO: 262769 - RNA, 32 nt, Human
ugugauuuaggagguggagcagauucuaguac

SEQ ID NO: 262770 - RNA, 32 nt, Human
ugugauuuauuuucucccuuucuuuuuggacu

SEQ ID NO: 262771 - RNA, 32 nt, Human
ugugauuucagcuccugucaccucaugcaagg

SEQ ID NO: 262772 - RNA, 32 nt, Human
ugugauuucuacccauuuccugaggccugugg

SEQ ID NO: 262773 - RNA, 32 nt, Human
ugugauuucugagagaaggcucuauuuucgug

SEQ ID NO: 262774 - RNA, 32 nt, Human
ugugauuucuguaccuucuuccuccugccccu

SEQ ID NO: 262775 - RNA, 31 nt, Human
ugugauuucuuucucccugagacccauaagg

SEQ ID NO: 262776 - RNA, 32 nt, Human
ugugauuugcagaguccaugagacaggaacac

SEQ ID NO: 262777 - RNA, 32 nt, Human
ugugauuuguuucugcccucuguguuuccugu

SEQ ID NO: 262778 - RNA, 26 nt, Human
ugugauuuucucuaauguaacuuccu

SEQ ID NO: 262779 - RNA, 21 nt, Human
ugugauuuucuuacaugagua

SEQ ID NO: 262780 - RNA, 32 nt, Human
ugugauuuuuagaauagacuccuggguuguuu

SEQ ID NO: 262781 - RNA, 32 nt, Human
ugugcaaaagccuuggacuuggcugugaucuu

SEQ ID NO: 262782 - RNA, 32 nt, Human
ugugcaaacauguacagaagaaauagaauaca

SEQ ID NO: 262783 - RNA, 24 nt, Human
ugugcaaagggcuuagcuaaguua

SEQ ID NO: 262784 - RNA, 32 nt, Human
ugugcaaauuccacuuuccaucaugcaggaaa

SEQ ID NO: 262785 - RNA, 32 nt, Human
ugugcaacuguagaaacccuccagaaauuucc

SEQ ID NO: 262786 - RNA, 32 nt, Human
ugugcaagaaacagccugccagucugucauug

SEQ ID NO: 262787 - RNA, 32 nt, Human
ugugcaagagucuguuacaaagcuugcugugc

SEQ ID NO: 262788 - RNA, 32 nt, Human
ugugcaagauaaaagcagccugggucacccag

SEQ ID NO: 262789 - RNA, 32 nt, Human
ugugcaagauagaguguguuucauuuguucug

SEQ ID NO: 262790 - RNA, 32 nt, Human
ugugcaaguaagcaucuuacaacuggcucuuc

SEQ ID NO: 262791 - RNA, 32 nt, Human
ugugcaagucaggcccuucuggaacacagcag

SEQ ID NO: 262792 - RNA, 32 nt, Human
ugugcaagucauaccuccccauuuaugucugg

SEQ ID NO: 262793 - RNA, 32 nt, Human
ugugcaaucaaaacaaaaggcagaauagaaug

SEQ ID NO: 262794 - RNA, 32 nt, Human
ugugcaaugaagucugcaggccugaggaccau

SEQ ID NO: 262795 - RNA, 32 nt, Human
ugugcacaaaggaagggcccuggguagggguc

SEQ ID NO: 262796 - RNA, 32 nt, Human
ugugcacacagcugcauccuucugcccucccc

SEQ ID NO: 262797 - RNA, 32 nt, Human
ugugcacacauacucucaggucacauaaacac

SEQ ID NO: 262798 - RNA, 32 nt, Human
ugugcacacaugcacaguugcacagacacaca

SEQ ID NO: 262799 - RNA, 32 nt, Human
ugugcacacaugggugggagggaagaggggca

SEQ ID NO: 262800 - RNA, 32 nt, Human
ugugcacaccacccucggccgucauccuggag

SEQ ID NO: 262801 - RNA, 32 nt, Human
ugugcacagagcagugcuagucgggcuugggg

SEQ ID NO: 262802 - RNA, 32 nt, Human
ugugcacagaggcuguagcccagaggacauau

SEQ ID NO: 262803 - RNA, 32 nt, Human
ugugcacagaguucuuggggcagcucuggggg

SEQ ID NO: 262804 - RNA, 32 nt, Human
ugugcacagcccacccacuuuccucugcuucc

SEQ ID NO: 262805 - RNA, 32 nt, Human
ugugcacaggcagagcccgugagaggucaccc

SEQ ID NO: 262806 - RNA, 32 nt, Human
ugugcacaguggcuggaccccaugcucauucg

SEQ ID NO: 262807 - RNA, 32 nt, Human
ugugcacauaugcauauauuuuguguucauuc

SEQ ID NO: 262808 - RNA, 32 nt, Human
ugugcacaugauacaaaauauguucccguaca

SEQ ID NO: 262809 - RNA, 20 nt, Human
ugugcacaugcacacacaug

SEQ ID NO: 262810 - RNA, 32 nt, Human
ugugcacauggacugaaucacauagauucucc

SEQ ID NO: 262811 - RNA, 32 nt, Human
ugugcaccacauacccaggauguuugugggaa

SEQ ID NO: 262812 - RNA, 32 nt, Human
ugugcaccaguauguaccugcaggcaucaggg

SEQ ID NO: 262813 - RNA, 32 nt, Human
ugugcaccaguauguaccugcaggcauggggg

SEQ ID NO: 262814 - RNA, 32 nt, Human
ugugcaccccucccaccucugccucaguuuac

SEQ ID NO: 262815 - RNA, 32 nt, Human
ugugcaccccuccccauucacagagccuuuuu

SEQ ID NO: 262816 - RNA, 32 nt, Human
ugugcacccgggcuggagaaggcaggagguau

SEQ ID NO: 262817 - RNA, 32 nt, Human
ugugcacccuucucccuccagccugggcuacu

SEQ ID NO: 262818 - RNA, 32 nt, Human
ugugcaccuaaaggaggcgcaucuggggacgg

SEQ ID NO: 262819 - RNA, 32 nt, Human
ugugcaccuccccucuugcacuuucucuccag

SEQ ID NO: 262820 - RNA, 32 nt, Human
ugugcaccuguaaucccagcuacucuggaggc

SEQ ID NO: 262821 - RNA, 32 nt, Human
ugugcaccuguaaucccagcuacucuggaggg

SEQ ID NO: 262822 - RNA, 32 nt, Human
ugugcaccuguaaucccagcuacuugggaggc

SEQ ID NO: 262823 - RNA, 32 nt, Human
ugugcaccuguaauccccgcuacucuggaguc

SEQ ID NO: 262824 - RNA, 32 nt, Human
ugugcaccuguaguucuagcuacuagggaggc

SEQ ID NO: 262825 - RNA, 32 nt, Human
ugugcaccugugauccuagcuacuugggaggc

SEQ ID NO: 262826 - RNA, 32 nt, Human
ugugcaccuguggucccagcucccagggccgg

SEQ ID NO: 262827 - RNA, 32 nt, Human
ugugcaccuuucucccaccucucccuuucucc

SEQ ID NO: 262828 - RNA, 32 nt, Human
ugugcacuaccauagcuacaucaguuugauac

SEQ ID NO: 262829 - RNA, 32 nt, Human
ugugcacuagcucuuuuuaaauuccaugcuac

SEQ ID NO: 262830 - RNA, 32 nt, Human
ugugcacuccauccucauguauccuuuuucac

SEQ ID NO: 262831 - RNA, 32 nt, Human
ugugcacugcaagcugugucuacucaggcccc

SEQ ID NO: 262832 - RNA, 32 nt, Human
ugugcacugcacaucugucucuucccagcucc

SEQ ID NO: 262833 - RNA, 32 nt, Human
ugugcacugcacucuagccugggggaagagug

SEQ ID NO: 262834 - RNA, 32 nt, Human
ugugcacugggguggagcuucgggaaguggcg

SEQ ID NO: 262835 - RNA, 32 nt, Human
ugugcagaaagcccagacuaaggaacaggcug

SEQ ID NO: 262836 - RNA, 32 nt, Human
ugugcagaaguuagaagggucuggcgggggca

SEQ ID NO: 262837 - RNA, 32 nt, Human
ugugcagaaugagaggagagagggaaggcagg

SEQ ID NO: 262838 - RNA, 32 nt, Human
ugugcagaccccugcccugccgcugcagaaau

SEQ ID NO: 262839 - RNA, 32 nt, Human
ugugcagagagcaccaauuuuccuucaauauc

SEQ ID NO: 262840 - RNA, 32 nt, Human
ugugcagagagggaaggaaaagugccauguca

SEQ ID NO: 262841 - RNA, 32 nt, Human
ugugcagagccauagucccacuguggguccug

SEQ ID NO: 262842 - RNA, 32 nt, Human
ugugcagaggaagcucucagauagcagacuuc

SEQ ID NO: 262843 - RNA, 32 nt, Human
ugugcagaggaugggcuggaggacucuggaug

SEQ ID NO: 262844 - RNA, 32 nt, Human
ugugcagaggcagagggugaccgggagcagug

SEQ ID NO: 262845 - RNA, 32 nt, Human
ugugcagaggcagaguguguacugcucggagc

SEQ ID NO: 262846 - RNA, 32 nt, Human
ugugcagauccagcauggaggccacccucagg

SEQ ID NO: 262847 - RNA, 32 nt, Human
ugugcagauggcugugcacaccuggcccggga

SEQ ID NO: 262848 - RNA, 32 nt, Human
ugugcagcagaggccguguuuuucaugccaaa

SEQ ID NO: 262849 - RNA, 32 nt, Human
ugugcagccaaggacacacagcaaguuagugg

SEQ ID NO: 262850 - RNA, 32 nt, Human
ugugcagccacuguuaagccauguguuccaag

SEQ ID NO: 262851 - RNA, 32 nt, Human
ugugcagcccaggaccuaggcgcgguagcugg

SEQ ID NO: 262852 - RNA, 20 nt, Human
ugugcagccucuggugugca

SEQ ID NO: 262853 - RNA, 32 nt, Human
ugugcagcuaucacagguggcucugcugugaa

SEQ ID NO: 262854 - RNA, 32 nt, Human
ugugcagcugacugucucagccaaaccacuga

SEQ ID NO: 262855 - RNA, 32 nt, Human
ugugcagcugcaaccaccauauccagggccca

SEQ ID NO: 262856 - RNA, 17 nt, Human
ugugcagcuggcccgca

SEQ ID NO: 262857 - RNA, 28 nt, Human
ugugcagcugggagucugaaagacugag

SEQ ID NO: 262858 - RNA, 32 nt, Human
ugugcagcuuugaacuagggcugggguugugg

SEQ ID NO: 262859 - RNA, 32 nt, Human
ugugcaggaauggcagaacgcuauccaugacu

SEQ ID NO: 262860 - RNA, 32 nt, Human
ugugcaggagagaaucagaaugagcugggccc

SEQ ID NO: 262861 - RNA, 32 nt, Human
ugugcaggagugaauguauguggcagggagaa

SEQ ID NO: 262862 - RNA, 32 nt, Human
ugugcaggccuggaguaguuggagaguuggau

SEQ ID NO: 262863 - RNA, 32 nt, Human
ugugcaggcucugaggcugcccaggacgggaa

SEQ ID NO: 262864 - RNA, 32 nt, Human
ugugcaggcugucucauuuauuuuuagccauu

SEQ ID NO: 262865 - RNA, 32 nt, Human
ugugcagggaguuggccagcugccgcaucauc

SEQ ID NO: 262866 - RNA, 32 nt, Human
ugugcagggccuggguuugcagccuggcucug

SEQ ID NO: 262867 - RNA, 32 nt, Human
ugugcagggcugggucccgcugccugccgucg

SEQ ID NO: 262868 - RNA, 32 nt, Human
ugugcaggggcugcuggccaagcugcugucuc

SEQ ID NO: 262869 - RNA, 32 nt, Human
ugugcagggggaaacaaaucuauuuuguuuug

SEQ ID NO: 262870 - RNA, 32 nt, Human
ugugcaggggguggcuacagaaaagccccuuu

SEQ ID NO: 262871 - RNA, 32 nt, Human
ugugcagggucuuggguuagagccaaaaugga

SEQ ID NO: 262872 - RNA, 32 nt, Human
ugugcagggucuuuagagcucagcuuucugag

SEQ ID NO: 262873 - RNA, 32 nt, Human
ugugcagggugagggccaugcaugcuaguaug

SEQ ID NO: 262874 - RNA, 32 nt, Human
ugugcaggguggcagaggugccucugcagaga

SEQ ID NO: 262875 - RNA, 32 nt, Human
ugugcaggugugaccucaggugugugaguauc

SEQ ID NO: 262876 - RNA, 32 nt, Human
ugugcagguguuguucaugcgcuccgauggcg

SEQ ID NO: 262877 - RNA, 32 nt, Human
ugugcagucaucucuagaauagacaggauguu

SEQ ID NO: 262878 - RNA, 32 nt, Human
ugugcaguccagcccugccuugcugcagcccc

SEQ ID NO: 262879 - RNA, 32 nt, Human
ugugcagucccagcuacucaggaggcugaggc

SEQ ID NO: 262880 - RNA, 32 nt, Human
ugugcagucuauuuccagagcuuacuuaguug

SEQ ID NO: 262881 - RNA, 32 nt, Human
ugugcagucugagcuuaggcacacacaggagg

SEQ ID NO: 262882 - RNA, 32 nt, Human
ugugcagugaguguggccuaggaacagguccc

SEQ ID NO: 262883 - RNA, 32 nt, Human
ugugcaguggcgccgggcuggggauggaggag

SEQ ID NO: 262884 - RNA, 32 nt, Human
ugugcauaacaguaaugagaucuggaaacacc

SEQ ID NO: 262885 - RNA, 32 nt, Human
ugugcauaauuguagaaauacagauuuuguug

SEQ ID NO: 262886 - RNA, 32 nt, Human
ugugcauacaguggcaacucugucuucccugc

SEQ ID NO: 262887 - RNA, 32 nt, Human
ugugcauagccuugugaaaaaguaucuuucua

SEQ ID NO: 262888 - RNA, 32 nt, Human
ugugcauauagucccagcuacuugggaggcag

SEQ ID NO: 262889 - RNA, 24 nt, Human
ugugcauauauauacauauaugua

SEQ ID NO: 262890 - RNA, 32 nt, Human
ugugcaucagugugcuugaauuuaguagcuua

SEQ ID NO: 262891 - RNA, 32 nt, Human
ugugcaucccuccucugcucuccaucauaacu

SEQ ID NO: 262892 - RNA, 32 nt, Human
ugugcauccuacagugagggguaacugaucag

SEQ ID NO: 262893 - RNA, 32 nt, Human
ugugcauccuggaggugaagguugcagugagc

SEQ ID NO: 262894 - RNA, 32 nt, Human
ugugcaucugcuugucaggaagagucacauug

SEQ ID NO: 262895 - RNA, 32 nt, Human
ugugcaucugggaggugguaggccacaguccu

SEQ ID NO: 262896 - RNA, 32 nt, Human
ugugcaucuguaaucccagcuacuugggaggc

SEQ ID NO: 262897 - RNA, 32 nt, Human
ugugcaucuguaaucccggcuacuugggaggu

SEQ ID NO: 262898 - RNA, 32 nt, Human
ugugcaucuucugcuucugcauccuuggucac

SEQ ID NO: 262899 - RNA, 32 nt, Human
ugugcaucuuucucucugccuuugcauuuccu

SEQ ID NO: 262900 - RNA, 32 nt, Human
ugugcaugcaaaucaugcuuuaggcagugcgg

SEQ ID NO: 262901 - RNA, 32 nt, Human
ugugcaugcaggcaggaggcagggaaauguga

SEQ ID NO: 262902 - RNA, 32 nt, Human
ugugcaugcauguguauuucugccugguucua

SEQ ID NO: 262903 - RNA, 32 nt, Human
ugugcaugcauucacacacacauauguacaug

SEQ ID NO: 262904 - RNA, 32 nt, Human
ugugcauggaaauguccuccaacaauaaagag

SEQ ID NO: 262905 - RNA, 32 nt, Human
ugugcaugguuagggagccaggccuggaauau

SEQ ID NO: 262906 - RNA, 32 nt, Human
ugugcaugucauggaccagugagcuggagaug

SEQ ID NO: 262907 - RNA, 32 nt, Human
ugugcaugucuauaacuccacccuucacugug

SEQ ID NO: 262908 - RNA, 32 nt, Human
ugugcaugugccugugccacccugggugccag

SEQ ID NO: 262909 - RNA, 32 nt, Human
ugugcauguguaugugcguaugcauguguguu

SEQ ID NO: 262910 - RNA, 32 nt, Human
ugugcaugugucuguguguguggaacuuuugu

SEQ ID NO: 262911 - RNA, 32 nt, Human
ugugcaugugugugagcuccuugaacgcacgg

SEQ ID NO: 262912 - RNA, 32 nt, Human
ugugcaugugugugcacacgugugcaugugug

SEQ ID NO: 262913 - RNA, 32 nt, Human
ugugcauuaaacuguaacaaggcuucgggcaa

SEQ ID NO: 262914 - RNA, 21 nt, Human
ugugcauuaaguucccuccgc

SEQ ID NO: 262915 - RNA, 31 nt, Human
ugugcauucaauaaauagcuuuugaguuagg

SEQ ID NO: 262916 - RNA, 32 nt, Human
ugugcauucaguguauauucucaccuuuuaug

SEQ ID NO: 262917 - RNA, 32 nt, Human
ugugcauugcacuccagccugagcaacaggag

SEQ ID NO: 262918 - RNA, 32 nt, Human
ugugcauugcugucugucucuauugccaaaau

SEQ ID NO: 262919 - RNA, 32 nt, Human
ugugcauuggcuuuagagcuacuccucagcug

SEQ ID NO: 262920 - RNA, 32 nt, Human
ugugcauugucuuugagccaaugauccugcuu

SEQ ID NO: 262921 - RNA, 32 nt, Human
ugugcauuuccagaucugauuuucugcuaacu

SEQ ID NO: 262922 - RNA, 32 nt, Human
ugugcauuugcaaaugauaaaaggcaugcucu

SEQ ID NO: 262923 - RNA, 32 nt, Human
ugugcauuugcaccagaugaauguuugaugcu

SEQ ID NO: 262924 - RNA, 32 nt, Human
ugugcauuugugaaagucuugugcagggugag

SEQ ID NO: 262925 - RNA, 32 nt, Human
ugugcauuuuugcccuucuuucugccucucag

SEQ ID NO: 262926 - RNA, 32 nt, Human
ugugccaaaccugagcuaccugcacccgagcc

SEQ ID NO: 262927 - RNA, 32 nt, Human
ugugccaaagagccggugucugauaaucccau

SEQ ID NO: 262928 - RNA, 32 nt, Human
ugugccaaagagcucagcagaggcucacgugg

SEQ ID NO: 262929 - RNA, 32 nt, Human
ugugccaaagcagcuacaauaauagagaggaa

SEQ ID NO: 262930 - RNA, 32 nt, Human
ugugccaagaggagguggguagaugggagugg

SEQ ID NO: 262931 - RNA, 32 nt, Human
ugugccaagcaauagacuaggcaauuuuuaga

SEQ ID NO: 262932 - RNA, 32 nt, Human
ugugccaagcagagguugggaggccauuugug

SEQ ID NO: 262933 - RNA, 32 nt, Human
ugugccaagugguuuauaugcccagccucauu

SEQ ID NO: 262934 - RNA, 32 nt, Human
ugugccaauaagagaaguaaauaucaaacauu

SEQ ID NO: 262935 - RNA, 20 nt, Human
ugugccaaucccagcacucc

SEQ ID NO: 262936 - RNA, 32 nt, Human
ugugccaauguacuccagccuaggugacagag

SEQ ID NO: 262937 - RNA, 32 nt, Human
ugugccacacagaaaucaggugccauuguuac

SEQ ID NO: 262938 - RNA, 32 nt, Human
ugugccacacagugacuuggccccagacgcau

SEQ ID NO: 262939 - RNA, 32 nt, Human
ugugccacagcugcuaggagcugcaguuguac

SEQ ID NO: 262940 - RNA, 32 nt, Human
ugugccacaggcagaggccaggaggagcagua

SEQ ID NO: 262941 - RNA, 22 nt, Human
ugugccacaugcugcucucuac

SEQ ID NO: 262942 - RNA, 32 nt, Human
ugugccacauugucuuccccagaagcucaaac

SEQ ID NO: 262943 - RNA, 32 nt, Human
ugugccaccaaccccaucaggauuuccccagg

SEQ ID NO: 262944 - RNA, 32 nt, Human
ugugccaccacacuccagccugggcgacagaa

SEQ ID NO: 262945 - RNA, 32 nt, Human
ugugccaccacgcauggcuaaucuuuuugugu

SEQ ID NO: 262946 - RNA, 32 nt, Human
ugugccaccacgucuggcuaaucuuuuuauua

SEQ ID NO: 262947 - RNA, 32 nt, Human
ugugccaccauggcuuugacauguugguaggu

SEQ ID NO: 262948 - RNA, 32 nt, Human
ugugccaccgcacuccagcaugggugacagag

SEQ ID NO: 262949 - RNA, 19 nt, Human
ugugccaccuccugccugu

SEQ ID NO: 262950 - RNA, 32 nt, Human
ugugccaccucuccacccaggaggccauguag

SEQ ID NO: 262951 - RNA, 32 nt, Human
ugugccaccugcaguaguggaucauguggagu

SEQ ID NO: 262952 - RNA, 24 nt, Human
ugugccacggagcuugcucuccac

SEQ ID NO: 262953 - RNA, 32 nt, Human
ugugccacggcacuccagccugggcagcagag

SEQ ID NO: 262954 - RNA, 32 nt, Human
ugugccacuacacuccagccuggccacagagc

SEQ ID NO: 262955 - RNA, 32 nt, Human
ugugccacuacacuccagccuggccgacagag

SEQ ID NO: 262956 - RNA, 32 nt, Human
ugugccacuacacuccagccugggagacagag

SEQ ID NO: 262957 - RNA, 32 nt, Human
ugugccacuacacuccagccugggcaacacag

SEQ ID NO: 262958 - RNA, 32 nt, Human
ugugccacuacacuccagccugggcaacagag

SEQ ID NO: 262959 - RNA, 32 nt, Human
ugugccacuacacuccagccugggugacaaag

SEQ ID NO: 262960 - RNA, 32 nt, Human
ugugccacuacuguacucuagccugggcagca

SEQ ID NO: 262961 - RNA, 32 nt, Human
ugugccacuaguacuccagccugggugacaga

SEQ ID NO: 262962 - RNA, 32 nt, Human
ugugccacucacugccuugagccugcuuccuc

SEQ ID NO: 262963 - RNA, 32 nt, Human
ugugccacuccccuccagccugggcgacagag

SEQ ID NO: 262964 - RNA, 32 nt, Human
ugugccacucuacuccagccugggcaacacag

SEQ ID NO: 262965 - RNA, 32 nt, Human
ugugccacugaacucuagccuggguaacagag

SEQ ID NO: 262966 - RNA, 32 nt, Human
ugugccacugacuugcugugugacccugggca

SEQ ID NO: 262967 - RNA, 32 nt, Human
ugugccacugcacaccagccuggacaacagag

SEQ ID NO: 262968 - RNA, 32 nt, Human
ugugccacugcacaccggccugggugacagca

SEQ ID NO: 262969 - RNA, 32 nt, Human
ugugccacugcacacuccaaucugggugaaag

SEQ ID NO: 262970 - RNA, 32 nt, Human
ugugccacugcaccccagccuuggcaacagag

SEQ ID NO: 262971 - RNA, 32 nt, Human
ugugccacugcaccucuagucugggugacaga

SEQ ID NO: 262972 - RNA, 32 nt, Human
ugugccacugcacgcacuccagccugggcgac

SEQ ID NO: 262973 - RNA, 32 nt, Human
ugugccacugcacucaagccugggugacgagu

SEQ ID NO: 262974 - RNA, 32 nt, Human
ugugccacugcacucauccuggaagacagagu

SEQ ID NO: 262975 - RNA, 32 nt, Human
ugugccacugcacuccaacaaccgagcgagac

SEQ ID NO: 262976 - RNA, 32 nt, Human
ugugccacugcacuccaaccugggugacagag

SEQ ID NO: 262977 - RNA, 32 nt, Human
ugugccacugcacuccacccugggcaacagag

SEQ ID NO: 262978 - RNA, 32 nt, Human
ugugccacugcacuccagacugggugacacag

SEQ ID NO: 262979 - RNA, 32 nt, Human
ugugccacugcacuccagccagagugacagag

SEQ ID NO: 262980 - RNA, 32 nt, Human
ugugccacugcacuccagccggggugacagaa

SEQ ID NO: 262981 - RNA, 32 nt, Human
ugugccacugcacuccagccuaggcaacagag

SEQ ID NO: 262982 - RNA, 32 nt, Human
ugugccacugcacuccagccuaggcgacagag

SEQ ID NO: 262983 - RNA, 32 nt, Human
ugugccacugcacuccagccugagcaacaaaa

SEQ ID NO: 262984 - RNA, 32 nt, Human
ugugccacugcacuccagccuggacgacagag

SEQ ID NO: 262985 - RNA, 32 nt, Human
ugugccacugcacuccagccuggcaacagagc

SEQ ID NO: 262986 - RNA, 32 nt, Human
ugugccacugcacuccagccuggcaacagagu

SEQ ID NO: 262987 - RNA, 32 nt, Human
ugugccacugcacuccagccugggagacagag

SEQ ID NO: 262988 - RNA, 32 nt, Human
ugugccacugcacuccagccugggcaacaaga

SEQ ID NO: 262989 - RNA, 32 nt, Human
ugugccacugcacuccagccugggcaacaagg

SEQ ID NO: 262990 - RNA, 32 nt, Human
ugugccacugcacuccagccugggcaacacag

SEQ ID NO: 262991 - RNA, 32 nt, Human
ugugccacugcacuccagccugggcaacagag

SEQ ID NO: 262992 - RNA, 32 nt, Human
ugugccacugcacuccagccugggcaacugag

SEQ ID NO: 262993 - RNA, 32 nt, Human
ugugccacugcacuccagccugggcaauagag

SEQ ID NO: 262994 - RNA, 32 nt, Human
ugugccacugcacuccagccugggcaccaaug

SEQ ID NO: 262995 - RNA, 32 nt, Human
ugugccacugcacuccagccugggccacagaa

SEQ ID NO: 262996 - RNA, 32 nt, Human
ugugccacugcacuccagccugggccacagag

SEQ ID NO: 262997 - RNA, 32 nt, Human
ugugccacugcacuccagccugggcgacagag

SEQ ID NO: 262998 - RNA, 32 nt, Human
ugugccacugcacuccagccugggcgacagug

SEQ ID NO: 262999 - RNA, 32 nt, Human
ugugccacugcacuccagccugggcgauagag

SEQ ID NO: 263000 - RNA, 32 nt, Human
ugugccacugcacuccagccuggguaacagag

SEQ ID NO: 263001 - RNA, 32 nt, Human
ugugccacugcacuccagccuggguaacagug

SEQ ID NO: 263002 - RNA, 32 nt, Human
ugugccacugcacuccagccuggguaagagag

SEQ ID NO: 263003 - RNA, 32 nt, Human
ugugccacugcacuccagccugggugaaagag

SEQ ID NO: 263004 - RNA, 32 nt, Human
ugugccacugcacuccagccugggugacagag

SEQ ID NO: 263005 - RNA, 32 nt, Human
ugugccacugcacuccagccugggugacagcg

SEQ ID NO: 263006 - RNA, 32 nt, Human
ugugccacugcacuccagccugggugacaggg

SEQ ID NO: 263007 - RNA, 32 nt, Human
ugugccacugcacuccagccugggugacugag

SEQ ID NO: 263008 - RNA, 32 nt, Human
ugugccacugcacuccagccuggguggcagag

SEQ ID NO: 263009 - RNA, 32 nt, Human
ugugccacugcacuccagccuggguuacagag

SEQ ID NO: 263010 - RNA, 32 nt, Human
ugugccacugcacuccagccuggucaacaaag

SEQ ID NO: 263011 - RNA, 32 nt, Human
ugugccacugcacuccagccuuggcaacaaga

SEQ ID NO: 263012 - RNA, 32 nt, Human
ugugccacugcacuccagccuuggcaacacag

SEQ ID NO: 263013 - RNA, 32 nt, Human
ugugccacugcacuccagcgugggcaacggag

SEQ ID NO: 263014 - RNA, 32 nt, Human
ugugccacugcacuccagcuggguggcagaga

SEQ ID NO: 263015 - RNA, 32 nt, Human
ugugccacugcacuccagcuuggugacagagu

SEQ ID NO: 263016 - RNA, 32 nt, Human
ugugccacugcacuccagucuggacaacagag

SEQ ID NO: 263017 - RNA, 32 nt, Human
ugugccacugcacucccgccugggcgacagag

SEQ ID NO: 263018 - RNA, 32 nt, Human
ugugccacugcacucgagccugggugacagag

SEQ ID NO: 263019 - RNA, 32 nt, Human
ugugccacugcacucuagccuagguggcugag

SEQ ID NO: 263020 - RNA, 32 nt, Human
ugugccacugcacucuagccucggugacagag

SEQ ID NO: 263021 - RNA, 32 nt, Human
ugugccacugcacucuagccuggacagcagag

SEQ ID NO: 263022 - RNA, 32 nt, Human
ugugccacugcacucuagccugggcaauaagc

SEQ ID NO: 263023 - RNA, 32 nt, Human
ugugccacugcacucuagccugggugacaaag

SEQ ID NO: 263024 - RNA, 32 nt, Human
ugugccacugcacucuagccugggugacagag

SEQ ID NO: 263025 - RNA, 32 nt, Human
ugugccacugcacugcagccugggcgacaauu

SEQ ID NO: 263026 - RNA, 32 nt, Human
ugugccacugcacugcagccugggcuacagag

SEQ ID NO: 263027 - RNA, 32 nt, Human
ugugccacugcacugcaggcugggugacagag

SEQ ID NO: 263028 - RNA, 32 nt, Human
ugugccacugcacuucagccugggcgacagag

SEQ ID NO: 263029 - RNA, 32 nt, Human
ugugccacugcacuucagcuugggugacagag

SEQ ID NO: 263030 - RNA, 32 nt, Human
ugugccacugcacuuuucagccugggugccac

SEQ ID NO: 263031 - RNA, 32 nt, Human
ugugccacugcaguccagccugggugacagag

SEQ ID NO: 263032 - RNA, 32 nt, Human
ugugccacugcauaccagccuaggugacagaa

SEQ ID NO: 263033 - RNA, 32 nt, Human
ugugccacugcauucuagccugggcgauagag

SEQ ID NO: 263034 - RNA, 32 nt, Human
ugugccacugcccuccagccugggugacagag

SEQ ID NO: 263035 - RNA, 32 nt, Human
ugugccacugcgcuccagccugggcgacagag

SEQ ID NO: 263036 - RNA, 32 nt, Human
ugugccacugcucuccagccugggaggcacag

SEQ ID NO: 263037 - RNA, 32 nt, Human
ugugccacuggacucccagccugggugacaga

SEQ ID NO: 263038 - RNA, 32 nt, Human
ugugccacuggguggagugugccuucagggca

SEQ ID NO: 263039 - RNA, 32 nt, Human
ugugccacuguacaccagccugggugacagag

SEQ ID NO: 263040 - RNA, 32 nt, Human
ugugccacuguacuccagccaggccacagagu

SEQ ID NO: 263041 - RNA, 32 nt, Human
ugugccacuguacuccagccuggaagacaaga

SEQ ID NO: 263042 - RNA, 32 nt, Human
ugugccacuguacuccagccuggcccacagag

SEQ ID NO: 263043 - RNA, 32 nt, Human
ugugccacuguacuccagccugggagauagag

SEQ ID NO: 263044 - RNA, 32 nt, Human
ugugccacuguacuccagccugggcgacagag

SEQ ID NO: 263045 - RNA, 32 nt, Human
ugugccacuguacuccagccugggugacagag

SEQ ID NO: 263046 - RNA, 32 nt, Human
ugugccacuguacuccagccuggugacagagc

SEQ ID NO: 263047 - RNA, 32 nt, Human
ugugccacuguacuccauccugggcgacagag

SEQ ID NO: 263048 - RNA, 32 nt, Human
ugugccacuguacugcagccugggugacagaa

SEQ ID NO: 263049 - RNA, 32 nt, Human
ugugccacuguauuccagacugggugacagag

SEQ ID NO: 263050 - RNA, 32 nt, Human
ugugccacuguauuccauccugggcaacagag

SEQ ID NO: 263051 - RNA, 32 nt, Human
ugugccacuguuuuccagccugggcaauacag

SEQ ID NO: 263052 - RNA, 32 nt, Human
ugugccacuucacuccagccugggugacaaag

SEQ ID NO: 263053 - RNA, 32 nt, Human
ugugccacuucauuccagccugggcgacagag

SEQ ID NO: 263054 - RNA, 32 nt, Human
ugugccacuucccuccagccugggcaauagag

SEQ ID NO: 263055 - RNA, 32 nt, Human
ugugccagagcugugguugaggaggagccagu

SEQ ID NO: 263056 - RNA, 32 nt, Human
ugugccagaggacccccagaacuaagaaggga

SEQ ID NO: 263057 - RNA, 32 nt, Human
ugugccagcacggucuccugugcccaccagcc

SEQ ID NO: 263058 - RNA, 32 nt, Human
ugugccagcagaaaugucucuccucuagguau

SEQ ID NO: 263059 - RNA, 32 nt, Human
ugugccagcaguggcuccucucugccuuugag

SEQ ID NO: 263060 - RNA, 32 nt, Human
ugugccagcccugcucucagcacuucccaugu

SEQ ID NO: 263061 - RNA, 32 nt, Human
ugugccagcccuggcccggcugccacaccucu

SEQ ID NO: 263062 - RNA, 32 nt, Human
ugugccagccuccacccucacgccauuuccag

SEQ ID NO: 263063 - RNA, 32 nt, Human
ugugccagccuccuugguuguucuugggccac

SEQ ID NO: 263064 - RNA, 32 nt, Human
ugugccagccugacauggaaauggaggcaaac

SEQ ID NO: 263065 - RNA, 32 nt, Human
ugugccagcuacucgggaggcugaggcaagag

SEQ ID NO: 263066 - RNA, 32 nt, Human
ugugccagcugguucccccaagccagcucaug

SEQ ID NO: 263067 - RNA, 32 nt, Human
ugugccagcugguuuagcauucaauauggaaa

SEQ ID NO: 263068 - RNA, 32 nt, Human
ugugccaggcacuaugcuaagcacuuuacaua

SEQ ID NO: 263069 - RNA, 32 nt, Human
ugugccaggcacugugcugagugccauacaua

SEQ ID NO: 263070 - RNA, 21 nt, Human
ugugccaggccagagugcagu

SEQ ID NO: 263071 - RNA, 22 nt, Human
ugugccaggccagagugcagug

SEQ ID NO: 263072 - RNA, 32 nt, Human
ugugccaggccagagugcaguggugcaaucac

SEQ ID NO: 263073 - RNA, 32 nt, Human
ugugccaggcucuguucuaagcacuuugugag

SEQ ID NO: 263074 - RNA, 32 nt, Human
ugugccaggggucuucagccccggcugauggc

SEQ ID NO: 263075 - RNA, 32 nt, Human
ugugccagguacuguucugagcacuuuacaaa

SEQ ID NO: 263076 - RNA, 32 nt, Human
ugugccagguugaagagagugugccagugaca

SEQ ID NO: 263077 - RNA, 32 nt, Human
ugugccagugcacuccaggcuggacgacagag

SEQ ID NO: 263078 - RNA, 32 nt, Human
ugugccagugcacuccggccugggugacagag

SEQ ID NO: 263079 - RNA, 32 nt, Human
ugugccauagcaccuggucucaaaauccuaaa

SEQ ID NO: 263080 - RNA, 32 nt, Human
ugugccaugcguaaggugagucaaaccaaacc

SEQ ID NO: 263081 - RNA, 32 nt, Human
ugugccauguucguaaggcagcuucugaauug

SEQ ID NO: 263082 - RNA, 32 nt, Human
ugugccauugcacaccagucugggugacagag

SEQ ID NO: 263083 - RNA, 32 nt, Human
ugugccauugcacuacagccuggucaacagag

SEQ ID NO: 263084 - RNA, 32 nt, Human
ugugccauugcacuccaaccugggcaacaaga

SEQ ID NO: 263085 - RNA, 32 nt, Human
ugugccauugcacuccaagccugggcaacaga

SEQ ID NO: 263086 - RNA, 32 nt, Human
ugugccauugcacuccagccuggacaacaaga

SEQ ID NO: 263087 - RNA, 32 nt, Human
ugugccauugcacuccagccugggcaacaaga

SEQ ID NO: 263088 - RNA, 32 nt, Human
ugugccauugcacuccagccugggcaacagag

SEQ ID NO: 263089 - RNA, 32 nt, Human
ugugccauugcacuccagccugggcaacgagc

SEQ ID NO: 263090 - RNA, 32 nt, Human
ugugccauugcacuccagccugggcgacaagc

SEQ ID NO: 263091 - RNA, 32 nt, Human
ugugccauugcacuccagccugggcgacagag

SEQ ID NO: 263092 - RNA, 32 nt, Human
ugugccauugcacuccagccugggcgacagug

SEQ ID NO: 263093 - RNA, 32 nt, Human
ugugccauugcacuccagccugggcuacaaga

SEQ ID NO: 263094 - RNA, 32 nt, Human
ugugccauugcacuccagccugggugacagag

SEQ ID NO: 263095 - RNA, 32 nt, Human
ugugccauugcacuccagccugggugauaaga

SEQ ID NO: 263096 - RNA, 32 nt, Human
ugugccauugcacuccagucggguuaacagag

SEQ ID NO: 263097 - RNA, 32 nt, Human
ugugccauugcacucuagccugggcaacagga

SEQ ID NO: 263098 - RNA, 32 nt, Human
ugugccauugcacugcagccuggaugacagag

SEQ ID NO: 263099 - RNA, 32 nt, Human
ugugccauuguacuccagccugggcgacaaaa

SEQ ID NO: 263100 - RNA, 32 nt, Human
ugugccauuucucaugccaggagugccugucc

SEQ ID NO: 263101 - RNA, 32 nt, Human
ugugccauuuuauccaugguuguacuucuuuu

SEQ ID NO: 263102 - RNA, 28 nt, Human
ugugcccacgcugcugccugcuccagac

SEQ ID NO: 263103 - RNA, 32 nt, Human
ugugcccagaguagcccaggucacuguuaacu

SEQ ID NO: 263104 - RNA, 32 nt, Human
ugugcccagcacuccgccccaugccuugcuaa

SEQ ID NO: 263105 - RNA, 32 nt, Human
ugugcccagccuggaaaccuacagacaaggag

SEQ ID NO: 263106 - RNA, 32 nt, Human
ugugcccagcuuuggucccccuucccaacuuc

SEQ ID NO: 263107 - RNA, 32 nt, Human
ugugcccagcuuuugcaaucuuuuguugcagc

SEQ ID NO: 263108 - RNA, 32 nt, Human
ugugcccaggaguucaagaccagccugggcaa

SEQ ID NO: 263109 - RNA, 32 nt, Human
ugugcccaggcaaauggaaggaaaggaagagg

SEQ ID NO: 263110 - RNA, 20 nt, Human
ugugcccaggcuggagugca

SEQ ID NO: 263111 - RNA, 32 nt, Human
ugugcccauaugaaacaaacuuauuauucauu

SEQ ID NO: 263112 - RNA, 32 nt, Human
ugugcccauaugcacacauauauuuucccgca

SEQ ID NO: 263113 - RNA, 32 nt, Human
ugugcccaucuccugcuuucugcgccaaggga

SEQ ID NO: 263114 - RNA, 19 nt, Human
ugugcccaugagucccugu

SEQ ID NO: 263115 - RNA, 19 nt, Human
ugugccccaacccaggugg

SEQ ID NO: 263116 - RNA, 21 nt, Human
ugugccccaccacagauucug

SEQ ID NO: 263117 - RNA, 32 nt, Human
ugugccccaccaggauuggccugcugcuaggg

SEQ ID NO: 263118 - RNA, 32 nt, Human
ugugccccagaacaccagagauuucaacuuag

SEQ ID NO: 263119 - RNA, 32 nt, Human
ugugccccagcucuccccgagggcucugugcc

SEQ ID NO: 263120 - RNA, 32 nt, Human
ugugccccagcuguuccagcagcuugucuggc

SEQ ID NO: 263121 - RNA, 32 nt, Human
ugugccccaggccagaauaaagaauagagugu

SEQ ID NO: 263122 - RNA, 32 nt, Human
ugugcccccaacauggccagaaauauuugggu

SEQ ID NO: 263123 - RNA, 32 nt, Human
ugugcccccaagugaugggcagaaggagagaa

SEQ ID NO: 263124 - RNA, 32 nt, Human
ugugcccccacaggaaccagagguaggauggg

SEQ ID NO: 263125 - RNA, 22 nt, Human
ugugcccccgagcugcccccac

SEQ ID NO: 263126 - RNA, 23 nt, Human
ugugcccccugaaacagcugcca

SEQ ID NO: 263127 - RNA, 23 nt, Human
ugugcccccuucaagccugugca

SEQ ID NO: 263128 - RNA, 32 nt, Human
ugugccccuccaccaccucuccaucccaggga

SEQ ID NO: 263129 - RNA, 32 nt, Human
ugugccccuccugccccgaaagugcugacuau

SEQ ID NO: 263130 - RNA, 32 nt, Human
ugugccccuccugcccugcaggcuguccuccc

SEQ ID NO: 263131 - RNA, 18 nt, Human
ugugccccuccuuccugu

SEQ ID NO: 263132 - RNA, 22 nt, Human
ugugccccucuaagagugcaca

SEQ ID NO: 263133 - RNA, 32 nt, Human
ugugccccucuaagagugcacacacacgcaca

SEQ ID NO: 263134 - RNA, 32 nt, Human
ugugccccugcacuccagccugagcgacagug

SEQ ID NO: 263135 - RNA, 32 nt, Human
ugugccccugcaggaccucagagucauccccc

SEQ ID NO: 263136 - RNA, 32 nt, Human
ugugccccugcauucuagccugggugacagug

SEQ ID NO: 263137 - RNA, 32 nt, Human
ugugccccugccucucccugugucccuucccc

SEQ ID NO: 263138 - RNA, 32 nt, Human
ugugccccugcuccccacgucugaacguggac

SEQ ID NO: 263139 - RNA, 32 nt, Human
ugugccccugcucugcccaguugggcugagug

SEQ ID NO: 263140 - RNA, 32 nt, Human
ugugccccugcucugccccauccuggcuggca

SEQ ID NO: 263141 - RNA, 32 nt, Human
ugugccccuucucucaucucuuagcuccccuc

SEQ ID NO: 263142 - RNA, 32 nt, Human
ugugccccuugccccacugccugccagcuguc

SEQ ID NO: 263143 - RNA, 32 nt, Human
ugugcccgagguuccugucaauacagguuuua

SEQ ID NO: 263144 - RNA, 32 nt, Human
ugugcccgccccugccuuucucuuccuccauc

SEQ ID NO: 263145 - RNA, 32 nt, Human
ugugcccgcgggaccugugugugugcaaguuu

SEQ ID NO: 263146 - RNA, 32 nt, Human
ugugcccgcgugcaugaggcccugccacaauu

SEQ ID NO: 263147 - RNA, 32 nt, Human
ugugcccuaaagccucacuguccagagcuguu

SEQ ID NO: 263148 - RNA, 32 nt, Human
ugugcccuaacuuuucuuuccuugauguggga

SEQ ID NO: 263149 - RNA, 32 nt, Human
ugugcccucaccaagccaugcgagccccgggc

SEQ ID NO: 263150 - RNA, 32 nt, Human
ugugcccucagggacuggcagagcaagaggcc

SEQ ID NO: 263151 - RNA, 32 nt, Human
ugugcccuccucuuccuuccucuuuauaggga

SEQ ID NO: 263152 - RNA, 28 nt, Human
ugugcccugagagcugccucucaauccc

SEQ ID NO: 263153 - RNA, 32 nt, Human
ugugcccugcagcagcccaagugcuuuaaagc

SEQ ID NO: 263154 - RNA, 32 nt, Human
ugugcccugcauuuagucugccuuguuccuau

SEQ ID NO: 263155 - RNA, 32 nt, Human
ugugcccugccccucaugcucagaccucuccc

SEQ ID NO: 263156 - RNA, 32 nt, Human
ugugcccugccuggcauuggcccuguggccau

SEQ ID NO: 263157 - RNA, 24 nt, Human
ugugcccuggcacuaagacuggca

SEQ ID NO: 263158 - RNA, 32 nt, Human
ugugcccugggagcugagaugcacgucagugg

SEQ ID NO: 263159 - RNA, 32 nt, Human
ugugcccugggcugggcacacccccgggaagg

SEQ ID NO: 263160 - RNA, 32 nt, Human
ugugcccuuaugcuauagccugggcaagagcg

SEQ ID NO: 263161 - RNA, 32 nt, Human
ugugcccuuucucuggccuuacugaacugcug

SEQ ID NO: 263162 - RNA, 31 nt, Human
ugugccgaccucucugggccucaguuuuccc

SEQ ID NO: 263163 - RNA, 32 nt, Human
ugugccgcaaccaccucagccuggaugacgga

SEQ ID NO: 263164 - RNA, 32 nt, Human
ugugccgcgcacuugaggaggcugugguggug

SEQ ID NO: 263165 - RNA, 32 nt, Human
ugugccgcugcacuccagccuggcgacaaagc

SEQ ID NO: 263166 - RNA, 32 nt, Human
ugugccgcugcaucgcucucucccgggaaaga

SEQ ID NO: 263167 - RNA, 32 nt, Human
ugugccgcuuugggcaaguugcuuaccugucu

SEQ ID NO: 263168 - RNA, 32 nt, Human
ugugccggaggaguuccagucaccgagcgagg

SEQ ID NO: 263169 - RNA, 32 nt, Human
ugugccggcgcacgccuggaaucccagcacug

SEQ ID NO: 263170 - RNA, 22 nt, Human
ugugccgggcacuguagcuuua

SEQ ID NO: 263171 - RNA, 32 nt, Human
ugugccggggguguuugcugagggcuuccugu

SEQ ID NO: 263172 - RNA, 32 nt, Human
ugugccgggguguccuggaaucugugccagga

SEQ ID NO: 263173 - RNA, 32 nt, Human
ugugccggugccuggagcugcccacaccacug

SEQ ID NO: 263174 - RNA, 32 nt, Human
ugugccguagacacaaagaagggaacaauaga

SEQ ID NO: 263175 - RNA, 32 nt, Human
ugugccgugcuagaguccucagggagggagug

SEQ ID NO: 263176 - RNA, 32 nt, Human
ugugccuaacagcaaagcaugccacaagaggc

SEQ ID NO: 263177 - RNA, 32 nt, Human
ugugccuaccucagauagacagugccagaauu

SEQ ID NO: 263178 - RNA, 32 nt, Human
ugugccuaguggcaccugggcuggggaggaca

SEQ ID NO: 263179 - RNA, 32 nt, Human
ugugccuauaaucccagcuacuugggaggcua

SEQ ID NO: 263180 - RNA, 32 nt, Human
ugugccuauagucccagcuacuugggaggugg

SEQ ID NO: 263181 - RNA, 32 nt, Human
ugugccucaacucaccaaccacccuccugccu

SEQ ID NO: 263182 - RNA, 32 nt, Human
ugugccucaauccucuuuccaagcaggccuca

SEQ ID NO: 263183 - RNA, 32 nt, Human
ugugccucacacuccagccuggguaacagagu

SEQ ID NO: 263184 - RNA, 32 nt, Human
ugugccucacagcgcugugagccagacccucc

SEQ ID NO: 263185 - RNA, 32 nt, Human
ugugccucacaguaaaccagcaccccaaauuu

SEQ ID NO: 263186 - RNA, 32 nt, Human
ugugccucagaagccuguuuaguuuuccuccc

SEQ ID NO: 263187 - RNA, 32 nt, Human
ugugccucagcccacaggccacugugauaaug

SEQ ID NO: 263188 - RNA, 32 nt, Human
ugugccuccaaggacugucuggcaaugacuug

SEQ ID NO: 263189 - RNA, 32 nt, Human
ugugccuccauggccuagggcgguuggcaaau

SEQ ID NO: 263190 - RNA, 32 nt, Human
ugugccucccaggccugcugugguucugacac

SEQ ID NO: 263191 - RNA, 32 nt, Human
ugugccuccuagagugcagggauuacaggcgu

SEQ ID NO: 263192 - RNA, 32 nt, Human
ugugccuccugccucagaugcggccugugcca

SEQ ID NO: 263193 - RNA, 32 nt, Human
ugugccucguagaguuauuuuucuugaagagg

SEQ ID NO: 263194 - RNA, 32 nt, Human
ugugccucguugucugccuccuggggcuguua

SEQ ID NO: 263195 - RNA, 32 nt, Human
ugugccucuagucccagcuacuugggaggcug

SEQ ID NO: 263196 - RNA, 28 nt, Human
ugugccucucaugcugccuccucugccc

SEQ ID NO: 263197 - RNA, 22 nt, Human
ugugccucuccccaggaagcau

SEQ ID NO: 263198 - RNA, 32 nt, Human
ugugccucuccccucagugucccuucugacag

SEQ ID NO: 263199 - RNA, 32 nt, Human
ugugccucucucucccaacugcugcuuaaaau

SEQ ID NO: 263200 - RNA, 32 nt, Human
ugugccucucucuguugcccaggcuggagugc

SEQ ID NO: 263201 - RNA, 32 nt, Human
ugugccucucugggagaaaggagagaggauaa

SEQ ID NO: 263202 - RNA, 32 nt, Human
ugugccugauucaucucucccugccgaaaaug

SEQ ID NO: 263203 - RNA, 32 nt, Human
ugugccugcacucccagcaugccaugcaguca

SEQ ID NO: 263204 - RNA, 32 nt, Human
ugugccugcaggcagggaugcugcaggacucc

SEQ ID NO: 263205 - RNA, 32 nt, Human
ugugccugccacucaauaaacagugucugcgc

SEQ ID NO: 263206 - RNA, 32 nt, Human
ugugccugccuccaccucuuuaacgagccucu

SEQ ID NO: 263207 - RNA, 32 nt, Human
ugugccugcucacaccugcuccugcaggcaca

SEQ ID NO: 263208 - RNA, 32 nt, Human
ugugccugcuccaacugauggguaaugucugc

SEQ ID NO: 263209 - RNA, 32 nt, Human
ugugccugcucccagccucuugcucagagcua

SEQ ID NO: 263210 - RNA, 32 nt, Human
ugugccugcuuguggagaccaggcugggccua

SEQ ID NO: 263211 - RNA, 32 nt, Human
ugugccuggaccaucgcugccugccagcuucu

SEQ ID NO: 263212 - RNA, 32 nt, Human
ugugccuggacccagagagugugggacucccc

SEQ ID NO: 263213 - RNA, 32 nt, Human
ugugccuggagauaccauuguggacccuggag

SEQ ID NO: 263214 - RNA, 32 nt, Human
ugugccuggagaugacucucugcuauucauga

SEQ ID NO: 263215 - RNA, 32 nt, Human
ugugccuggagucccagcuacucaggaggcug

SEQ ID NO: 263216 - RNA, 32 nt, Human
ugugccuggccagaaauuguuuugaaaggcua

SEQ ID NO: 263217 - RNA, 32 nt, Human
ugugccugggguccacagagccgggaggucac

SEQ ID NO: 263218 - RNA, 32 nt, Human
ugugccuggucuguaacaguuuccaggccagc

SEQ ID NO: 263219 - RNA, 32 nt, Human
ugugccuggugacuuccugucccugggacagu

SEQ ID NO: 263220 - RNA, 23 nt, Human
ugugccuguaaucccagaacuuu

SEQ ID NO: 263221 - RNA, 32 nt, Human
ugugccuguaaucccagcuacucgggagguug

SEQ ID NO: 263222 - RNA, 32 nt, Human
ugugccuguaaucccagcuacuugggaggcug

SEQ ID NO: 263223 - RNA, 32 nt, Human
ugugccuguaaucccagcuauuugggaggcug

SEQ ID NO: 263224 - RNA, 32 nt, Human
ugugccuguaaucccagcuucuugggaagcug

SEQ ID NO: 263225 - RNA, 23 nt, Human
ugugccuguaaucucagcacuuu

SEQ ID NO: 263226 - RNA, 32 nt, Human
ugugccuguagucccagauacuugggaggcug

SEQ ID NO: 263227 - RNA, 32 nt, Human
ugugccuguagucccagcuacaugggaggcug

SEQ ID NO: 263228 - RNA, 32 nt, Human
ugugccuguagucccagcuacuauggagguug

SEQ ID NO: 263229 - RNA, 32 nt, Human
ugugccuguagucccagcuacucaggaggcug

SEQ ID NO: 263230 - RNA, 32 nt, Human
ugugccuguagucccagcuacucaggagucug

SEQ ID NO: 263231 - RNA, 32 nt, Human
ugugccuguagucccagcuacucgggaggcug

SEQ ID NO: 263232 - RNA, 32 nt, Human
ugugccuguagucccagcuacucuggagucug

SEQ ID NO: 263233 - RNA, 32 nt, Human
ugugccuguagucccagcuacuuaggaggcug

SEQ ID NO: 263234 - RNA, 32 nt, Human
ugugccuguagucccagcuacuugagaggcug

SEQ ID NO: 263235 - RNA, 32 nt, Human
ugugccuguagucccagcuacuugggaggcug

SEQ ID NO: 263236 - RNA, 32 nt, Human
ugugccuguagucccagcuacuugggagggcu

SEQ ID NO: 263237 - RNA, 32 nt, Human
ugugccuguagucccagcuacuugugaggcug

SEQ ID NO: 263238 - RNA, 32 nt, Human
ugugccuguagucccagcuauucuagaggcug

SEQ ID NO: 263239 - RNA, 32 nt, Human
ugugccuguagucccagcugcuugggaggcug

SEQ ID NO: 263240 - RNA, 32 nt, Human
ugugccuguagucccaggcugaggcaagagaa

SEQ ID NO: 263241 - RNA, 32 nt, Human
ugugccuguaguucagcuacucagggggcuga

SEQ ID NO: 263242 - RNA, 32 nt, Human
ugugccuguaguuccagcuacucaggaggcug

SEQ ID NO: 263243 - RNA, 32 nt, Human
ugugccugugccaggacagcugugcucucaga

SEQ ID NO: 263244 - RNA, 32 nt, Human
ugugccuguggucccagcuacucaggaggcug

SEQ ID NO: 263245 - RNA, 32 nt, Human
ugugccugugugugugggugcacauuugugug

SEQ ID NO: 263246 - RNA, 22 nt, Human
ugugccuguugcuguuaacuuu

SEQ ID NO: 263247 - RNA, 32 nt, Human
ugugccuguuucuucaugcaugcaguggggau

SEQ ID NO: 263248 - RNA, 32 nt, Human
ugugccuuaaucuucccuccccugugcugccc

SEQ ID NO: 263249 - RNA, 32 nt, Human
ugugccuucagggcaucuugaaaugucccgcu

SEQ ID NO: 263250 - RNA, 32 nt, Human
ugugccuucuguguguauugugcauuaaccuc

SEQ ID NO: 263251 - RNA, 32 nt, Human
ugugccuucuugcugcucuuagauuuauuuca

SEQ ID NO: 263252 - RNA, 32 nt, Human
ugugccuugcagagaugcacgugugcauuuca

SEQ ID NO: 263253 - RNA, 32 nt, Human
ugugccuugccucugcccuccacgccgccgcc

SEQ ID NO: 263254 - RNA, 32 nt, Human
ugugccuuggugacugucaaauaaaagcaagu

SEQ ID NO: 263255 - RNA, 32 nt, Human
ugugccuuguagaauugcauugucuauacaug

SEQ ID NO: 263256 - RNA, 20 nt, Human
ugugccuuuaaccagcuuua

SEQ ID NO: 263257 - RNA, 23 nt, Human
ugugccuuuaccuuguagcuuua

SEQ ID NO: 263258 - RNA, 32 nt, Human
ugugccuuuccagcuucuagaggcugccugcg

SEQ ID NO: 263259 - RNA, 20 nt, Human
ugugccuuucuguuagcuuu

SEQ ID NO: 263260 - RNA, 32 nt, Human
ugugccuuugugcaagcugcucccucuaccug

SEQ ID NO: 263261 - RNA, 32 nt, Human
ugugccuuuuaggagcuuuauguuuagaaacu

SEQ ID NO: 263262 - RNA, 32 nt, Human
ugugcgacccuccagggaugcaggggauccag

SEQ ID NO: 263263 - RNA, 32 nt, Human
ugugcgacuucaggcauaucacugccuucucu

SEQ ID NO: 263264 - RNA, 32 nt, Human
ugugcgagaaccuguucuuccugugcugcaca

SEQ ID NO: 263265 - RNA, 32 nt, Human
ugugcgagaccaccccuauuaggcccugggga

SEQ ID NO: 263266 - RNA, 32 nt, Human
ugugcgagcaugcaaggccccauggccucaca

SEQ ID NO: 263267 - RNA, 32 nt, Human
ugugcgaggaggugaaggccacagugacccaa

SEQ ID NO: 263268 - RNA, 32 nt, Human
ugugcgagugugugugcacauguuacaaaggc

SEQ ID NO: 263269 - RNA, 32 nt, Human
ugugcgcaaauucugguucuucccaagcucua

SEQ ID NO: 263270 - RNA, 32 nt, Human
ugugcgcaacaccuagagcccaaaaauaagca

SEQ ID NO: 263271 - RNA, 32 nt, Human
ugugcgcacaugcauguauaccugcacccugu

SEQ ID NO: 263272 - RNA, 32 nt, Human
ugugcgcagagcugucauagggucccuuuguc

SEQ ID NO: 263273 - RNA, 32 nt, Human
ugugcgcagccaguuuucuggcugaggaucgc

SEQ ID NO: 263274 - RNA, 32 nt, Human
ugugcgcagggugggagaaggggaaagaaucu

SEQ ID NO: 263275 - RNA, 32 nt, Human
ugugcgcaugcuugcuugaggcauuuuucucu

SEQ ID NO: 263276 - RNA, 32 nt, Human
ugugcgcauguguguuugcauguaggagaacg

SEQ ID NO: 263277 - RNA, 32 nt, Human
ugugcgccaguacuccuggcugugcugugguu

SEQ ID NO: 263278 - RNA, 32 nt, Human
ugugcgccuguaaucccagcuacucuggaggc

SEQ ID NO: 263279 - RNA, 32 nt, Human
ugugcgccuguaaucccagcuacuugggaggc

SEQ ID NO: 263280 - RNA, 32 nt, Human
ugugcgcgcacacaccacacaugcacacacgu

SEQ ID NO: 263281 - RNA, 32 nt, Human
ugugcgcguaugugcgcacauauguguaugug

SEQ ID NO: 263282 - RNA, 32 nt, Human
ugugcgcgugcuggugggcaugugagaugagu

SEQ ID NO: 263283 - RNA, 32 nt, Human
ugugcgcgugucucccugccaguuacccaggc

SEQ ID NO: 263284 - RNA, 32 nt, Human
ugugcgcgugugugugcgugugcgcacgcucu

SEQ ID NO: 263285 - RNA, 32 nt, Human
ugugcgcuacagacaccuucuggaagcugcgg

SEQ ID NO: 263286 - RNA, 32 nt, Human
ugugcgcuguggugcaccugucuucucuacua

SEQ ID NO: 263287 - RNA, 32 nt, Human
ugugcggaacacauaguuaagugcuugauaaa

SEQ ID NO: 263288 - RNA, 32 nt, Human
ugugcggaauacagaaaaugcagcuccagcuc

SEQ ID NO: 263289 - RNA, 32 nt, Human
ugugcggaugacugucaaggucacugagaccu

SEQ ID NO: 263290 - RNA, 32 nt, Human
ugugcggccgccgcgcuccgagguccccgggc

SEQ ID NO: 263291 - RNA, 32 nt, Human
ugugcggcucacugcgcggucccucucagcuc

SEQ ID NO: 263292 - RNA, 32 nt, Human
ugugcggcugacagccugacucccggguccug

SEQ ID NO: 263293 - RNA, 32 nt, Human
ugugcggcugcagacagcacagccugagggua

SEQ ID NO: 263294 - RNA, 32 nt, Human
ugugcggcugugugugcacgcgugugcaggag

SEQ ID NO: 263295 - RNA, 32 nt, Human
ugugcggggccaggcugggagcccaugcagua

SEQ ID NO: 263296 - RNA, 32 nt, Human
ugugcggugaagaucuguggagauggagcugg

SEQ ID NO: 263297 - RNA, 32 nt, Human
ugugcggugcaggauggcguggcuguggaggu

SEQ ID NO: 263298 - RNA, 32 nt, Human
ugugcgucauccuaaaccaucuaccucagaaa

SEQ ID NO: 263299 - RNA, 32 nt, Human
ugugcgucugugugugcgcgucugugcaugug

SEQ ID NO: 263300 - RNA, 32 nt, Human
ugugcgugaguguguggccccuguuuauuccc

SEQ ID NO: 263301 - RNA, 32 nt, Human
ugugcgugcaugugugcacuuacacacaugag

SEQ ID NO: 263302 - RNA, 32 nt, Human
ugugcgugcccucuacacaccuugucauggcc

SEQ ID NO: 263303 - RNA, 32 nt, Human
ugugcgugccuuggucgcuucuguagcuccga

SEQ ID NO: 263304 - RNA, 29 nt, Human
ugugcgugcgugugugugcgugugugggc

SEQ ID NO: 263305 - RNA, 32 nt, Human
ugugcguggggcucugcaggcccagccagucc

SEQ ID NO: 263306 - RNA, 32 nt, Human
ugugcgugugcaaauaugacucaauucacgua

SEQ ID NO: 263307 - RNA, 29 nt, Human
ugugcgugugcgugugugcaggggugaga

SEQ ID NO: 263308 - RNA, 32 nt, Human
ugugcgugugguuuguuccuucuccuugccgg

SEQ ID NO: 263309 - RNA, 32 nt, Human
ugugcguguguauguauguguauguauaugca

SEQ ID NO: 263310 - RNA, 32 nt, Human
ugugcguguguccaugugugugcagugugugc

SEQ ID NO: 263311 - RNA, 32 nt, Human
ugugcgugugugguccccagccccagacugga

SEQ ID NO: 263312 - RNA, 32 nt, Human
ugugcgugugugugcaugcacacgcauguaug

SEQ ID NO: 263313 - RNA, 32 nt, Human
ugugcgugugugugcuugugugugcgcacgug

SEQ ID NO: 263314 - RNA, 32 nt, Human
ugugcguuguggggugggggaggggguccacc

SEQ ID NO: 263315 - RNA, 32 nt, Human
ugugcuaaauccuagcagacacugccuugaag

SEQ ID NO: 263316 - RNA, 31 nt, Human
ugugcuaacuguucccagacagcagagcaag

SEQ ID NO: 263317 - RNA, 32 nt, Human
ugugcuaccaacuuacugcucuuuuguaaauu

SEQ ID NO: 263318 - RNA, 32 nt, Human
ugugcuacuaucugaaacucauuuuaccuaac

SEQ ID NO: 263319 - RNA, 32 nt, Human
ugugcuacucuacuccagccugggcaacacag

SEQ ID NO: 263320 - RNA, 32 nt, Human
ugugcuacugaacuucagaggugaucaauaaa

SEQ ID NO: 263321 - RNA, 32 nt, Human
ugugcuacugcacuccaaucuggcaacagagc

SEQ ID NO: 263322 - RNA, 32 nt, Human
ugugcuacugcacuccagccugggcaacagag

SEQ ID NO: 263323 - RNA, 32 nt, Human
ugugcuacugcacucuagauugggugacagag

SEQ ID NO: 263324 - RNA, 32 nt, Human
ugugcuacuguuggagacacgaggcccccagg

SEQ ID NO: 263325 - RNA, 32 nt, Human
ugugcuacuucaacauaagauuggacaugcuc

SEQ ID NO: 263326 - RNA, 20 nt, Human
ugugcuagcgccugccugug

SEQ ID NO: 263327 - RNA, 32 nt, Human
ugugcuagcuaguggggauguggcagugggga

SEQ ID NO: 263328 - RNA, 20 nt, Human
ugugcuaguaagcccugugg

SEQ ID NO: 263329 - RNA, 32 nt, Human
ugugcuaguuccgagcuagguaugacagggac

SEQ ID NO: 263330 - RNA, 32 nt, Human
ugugcuaucuucucuucuauccaaguagaaug

SEQ ID NO: 263331 - RNA, 32 nt, Human
ugugcuauucagccaauagugcugcuggccca

SEQ ID NO: 263332 - RNA, 18 nt, Human
ugugcuauugagauucca

SEQ ID NO: 263333 - RNA, 32 nt, Human
ugugcuauugcacuccagccugggugacagac

SEQ ID NO: 263334 - RNA, 32 nt, Human
ugugcuauuucauaucuguacuccaggcagaa

SEQ ID NO: 263335 - RNA, 32 nt, Human
ugugcuauuugcacucuagccugggugacaga

SEQ ID NO: 263336 - RNA, 32 nt, Human
ugugcucaaccgugggcucccagcacaccccc

SEQ ID NO: 263337 - RNA, 32 nt, Human
ugugcucacagaaacaugcgcuguaaugaauc

SEQ ID NO: 263338 - RNA, 32 nt, Human
ugugcucacccaggcugagggugccuuugugg

SEQ ID NO: 263339 - RNA, 32 nt, Human
ugugcucacuggguggagcuguggcagggggc

SEQ ID NO: 263340 - RNA, 32 nt, Human
ugugcucagagcugcugugugucauccugugu

SEQ ID NO: 263341 - RNA, 32 nt, Human
ugugcucagaggaggugagaggagaggaagga

SEQ ID NO: 263342 - RNA, 32 nt, Human
ugugcucagaugauccuuuucaucucagccuc

SEQ ID NO: 263343 - RNA, 18 nt, Human
ugugcucagcucuggaca

SEQ ID NO: 263344 - RNA, 32 nt, Human
ugugcucaggaaaccucacccaccucagcccu

SEQ ID NO: 263345 - RNA, 32 nt, Human
ugugcucaggaucagcagagcaggcaggcaga

SEQ ID NO: 263346 - RNA, 32 nt, Human
ugugcucaggggacaaucuccccucaaccgca

SEQ ID NO: 263347 - RNA, 32 nt, Human
ugugcucagugcacuggggauuuggagagaga

SEQ ID NO: 263348 - RNA, 32 nt, Human
ugugcucaucagagaccccagccuggggaaca

SEQ ID NO: 263349 - RNA, 32 nt, Human
ugugcucauccugaacuguuacuccaaaucca

SEQ ID NO: 263350 - RNA, 19 nt, Human
ugugcucaugcuggaagca

SEQ ID NO: 263351 - RNA, 32 nt, Human
ugugcuccaccaacuuuuuaguauaugaguca

SEQ ID NO: 263352 - RNA, 32 nt, Human
ugugcuccaccagggucaccaacugucccaau

SEQ ID NO: 263353 - RNA, 32 nt, Human
ugugcuccagccugggcaacaaagugagacuc

SEQ ID NO: 263354 - RNA, 32 nt, Human
ugugcuccagccugggcaacaagagugaaacu

SEQ ID NO: 263355 - RNA, 32 nt, Human
ugugcuccagccugggcaacagagugagacua

SEQ ID NO: 263356 - RNA, 32 nt, Human
ugugcuccagccugggcaacagagugagacuc

SEQ ID NO: 263357 - RNA, 32 nt, Human
ugugcucccaccacugcacuccagccugggaa

SEQ ID NO: 263358 - RNA, 32 nt, Human
ugugcucccagcagcucagacagggaaaggau

SEQ ID NO: 263359 - RNA, 32 nt, Human
ugugcucccagccuugaggcugcaguaggacu

SEQ ID NO: 263360 - RNA, 32 nt, Human
ugugcucccucgcuccuuccucugcauugccc

SEQ ID NO: 263361 - RNA, 32 nt, Human
ugugcucccugaccaaugacagagccugaaaa

SEQ ID NO: 263362 - RNA, 32 nt, Human
ugugcucccugcacuccacucaaguugagagu

SEQ ID NO: 263363 - RNA, 32 nt, Human
ugugcucccuuucucuccucucuccuuuucua

SEQ ID NO: 263364 - RNA, 32 nt, Human
ugugcuccgaggaucccaggaggaaggauggg

SEQ ID NO: 263365 - RNA, 32 nt, Human
ugugcuccuccaggucucacucaggcucacuc

SEQ ID NO: 263366 - RNA, 32 nt, Human
ugugcuccugcuacacugacagacugauugcg

SEQ ID NO: 263367 - RNA, 32 nt, Human
ugugcuccuuggagcuggugugcaguguccug

SEQ ID NO: 263368 - RNA, 32 nt, Human
ugugcucgauuucucacugggccuuagcugcc

SEQ ID NO: 263369 - RNA, 32 nt, Human
ugugcucgccuugccacaucugugucucugga

SEQ ID NO: 263370 - RNA, 32 nt, Human
ugugcucgggccccaacuccugacugggugca

SEQ ID NO: 263371 - RNA, 20 nt, Human
ugugcucggucuccaccugu

SEQ ID NO: 263372 - RNA, 32 nt, Human
ugugcucggucuccaccugucucccauucugu

SEQ ID NO: 263373 - RNA, 32 nt, Human
ugugcucguggacugaggcugcgcugcccggg

SEQ ID NO: 263374 - RNA, 32 nt, Human
ugugcucuaaacagugggaguaccaaagaaau

SEQ ID NO: 263375 - RNA, 32 nt, Human
ugugcucucaaaugagaggaacaggagugaca

SEQ ID NO: 263376 - RNA, 32 nt, Human
ugugcucuccagaacccaacugccucaucccg

SEQ ID NO: 263377 - RNA, 32 nt, Human
ugugcucucccagggcguccgcugggugggag

SEQ ID NO: 263378 - RNA, 32 nt, Human
ugugcucuccccaguaguggaaugcggggagg

SEQ ID NO: 263379 - RNA, 32 nt, Human
ugugcucucucccgucucuuccauucucuaug

SEQ ID NO: 263380 - RNA, 32 nt, Human
ugugcucucugcagcuacaaaacaucuuggca

SEQ ID NO: 263381 - RNA, 32 nt, Human
ugugcucugaaaugcuaaugucaacuacaaau

SEQ ID NO: 263382 - RNA, 32 nt, Human
ugugcucugauggcacccaucuguacuccagc

SEQ ID NO: 263383 - RNA, 32 nt, Human
ugugcucugcaguguccucccaacugaaaaca

SEQ ID NO: 263384 - RNA, 32 nt, Human
ugugcucugcucugcccugccaggcugcccuu

SEQ ID NO: 263385 - RNA, 32 nt, Human
ugugcucuggaaaguaacugcagccaccaggu

SEQ ID NO: 263386 - RNA, 32 nt, Human
ugugcucugggcccuuucucuuuuuccagcca

SEQ ID NO: 263387 - RNA, 32 nt, Human
ugugcucugguggaacaaguugggagaggcug

SEQ ID NO: 263388 - RNA, 32 nt, Human
ugugcucugucacccaggcuggagugcaaugg

SEQ ID NO: 263389 - RNA, 32 nt, Human
ugugcucugucugucugucuuugucugucugu

SEQ ID NO: 263390 - RNA, 32 nt, Human
ugugcucuucuucaggacucaggcuucuccau

SEQ ID NO: 263391 - RNA, 32 nt, Human
ugugcugaaauguuaucuacucagagaagaca

SEQ ID NO: 263392 - RNA, 32 nt, Human
ugugcugaacaaggacauuugcuucucagaua

SEQ ID NO: 263393 - RNA, 32 nt, Human
ugugcugaacccaguaacucgucauuugauuu

SEQ ID NO: 263394 - RNA, 28 nt, Human
ugugcugaaucaacagucauugcagauc

SEQ ID NO: 263395 - RNA, 32 nt, Human
ugugcugaccaugggcccugagcguccuaccc

SEQ ID NO: 263396 - RNA, 32 nt, Human
ugugcugacggcacagaugaggaggacugccc

SEQ ID NO: 263397 - RNA, 32 nt, Human
ugugcugacuccaugucccaggaccucauuuc

SEQ ID NO: 263398 - RNA, 32 nt, Human
ugugcugagagggagaggagcagagaugcugc

SEQ ID NO: 263399 - RNA, 23 nt, Human
ugugcugagagugacucgccgug

SEQ ID NO: 263400 - RNA, 32 nt, Human
ugugcugagauugcaggcaugagccacugcgc

SEQ ID NO: 263401 - RNA, 32 nt, Human
ugugcugagcaugguccuggacccggagcugg

SEQ ID NO: 263402 - RNA, 30 nt, Human
ugugcugagcucuccaugucgcuguugccg

SEQ ID NO: 263403 - RNA, 32 nt, Human
ugugcugaggaggauuaguaaaagaggaagga

SEQ ID NO: 263404 - RNA, 32 nt, Human
ugugcugaggaggauuaguaaaagaggaaggc

SEQ ID NO: 263405 - RNA, 32 nt, Human
ugugcugaguguuuuccucccuuugccucuac

SEQ ID NO: 263406 - RNA, 19 nt, Human
ugugcugauaagcuugaaa

SEQ ID NO: 263407 - RNA, 32 nt, Human
ugugcugaucuuggaggcagaguggcugccug

SEQ ID NO: 263408 - RNA, 32 nt, Human
ugugcugauguggccguugguggucagguaag

SEQ ID NO: 263409 - RNA, 32 nt, Human
ugugcugcaagcugacuccagccuugggcuca

SEQ ID NO: 263410 - RNA, 32 nt, Human
ugugcugcaagcugacuccagccuugggguca

SEQ ID NO: 263411 - RNA, 32 nt, Human
ugugcugcacgggacccagcuccuuuugcugg

SEQ ID NO: 263412 - RNA, 32 nt, Human
ugugcugcaggcucccccugaggccccucucc

SEQ ID NO: 263413 - RNA, 32 nt, Human
ugugcugcaggugcacaaagucaccgaggacc

SEQ ID NO: 263414 - RNA, 32 nt, Human
ugugcugcaucccaccagccugagcaagacgc

SEQ ID NO: 263415 - RNA, 32 nt, Human
ugugcugccaacacccccugaggcuccuaggc

SEQ ID NO: 263416 - RNA, 32 nt, Human
ugugcugccaccccggccucugaguaagacuc

SEQ ID NO: 263417 - RNA, 32 nt, Human
ugugcugccauccuguggccauugcaggaagu

SEQ ID NO: 263418 - RNA, 32 nt, Human
ugugcugcccaccauggcacacugcuucucca

SEQ ID NO: 263419 - RNA, 32 nt, Human
ugugcugccgccaccucugcuccagagugucc

SEQ ID NO: 263420 - RNA, 32 nt, Human
ugugcugccgccgcccguggccgccccucucc

SEQ ID NO: 263421 - RNA, 32 nt, Human
ugugcugccugguuugaccucaucucaccugg

SEQ ID NO: 263422 - RNA, 32 nt, Human
ugugcugcgccugcaggcagagcuggagcccc

SEQ ID NO: 263423 - RNA, 32 nt, Human
ugugcugcuaccuuccaugcagggcguugagg

SEQ ID NO: 263424 - RNA, 32 nt, Human
ugugcugcugcaaguccuccugggcuuccuuc

SEQ ID NO: 263425 - RNA, 32 nt, Human
ugugcugcugcacuccagccugggagacagag

SEQ ID NO: 263426 - RNA, 32 nt, Human
ugugcugcugcacuccagccugggugaaaaag

SEQ ID NO: 263427 - RNA, 32 nt, Human
ugugcugcugggacccaagaguggggcgucgc

SEQ ID NO: 263428 - RNA, 32 nt, Human
ugugcugcugugaugcugguccuucaucuuag

SEQ ID NO: 263429 - RNA, 32 nt, Human
ugugcuggaagcuucccugagcaacagaccag

SEQ ID NO: 263430 - RNA, 32 nt, Human
ugugcuggagugaggggaagaagcuguuacag

SEQ ID NO: 263431 - RNA, 32 nt, Human
ugugcuggcauuucucacccuuucaucuuuag

SEQ ID NO: 263432 - RNA, 32 nt, Human
ugugcuggcuccugccccuuccugcuuuugca

SEQ ID NO: 263433 - RNA, 32 nt, Human
ugugcuggcugagcugcaagaggcucuauggc

SEQ ID NO: 263434 - RNA, 32 nt, Human
ugugcuggcugccuccugaaggaagcccuccu

SEQ ID NO: 263435 - RNA, 32 nt, Human
ugugcugggaaagacuuucugggcaaaaggaa

SEQ ID NO: 263436 - RNA, 32 nt, Human
ugugcugggaagaagagaccugggcuuggaag

SEQ ID NO: 263437 - RNA, 32 nt, Human
ugugcugggauuacaggcaugagccaccgcac

SEQ ID NO: 263438 - RNA, 32 nt, Human
ugugcugggauuacaggcaugagcuacuaugc

SEQ ID NO: 263439 - RNA, 32 nt, Human
ugugcugggcuucauuuacauuuuaacugucu

SEQ ID NO: 263440 - RNA, 32 nt, Human
ugugcuggggccacgacuugcccacauaugug

SEQ ID NO: 263441 - RNA, 32 nt, Human
ugugcuggguuaacagcuuccuucccuuucug

SEQ ID NO: 263442 - RNA, 32 nt, Human
ugugcugguaacuugggcugaccuaccuacag

SEQ ID NO: 263443 - RNA, 32 nt, Human
ugugcugguacccagacugcagucaucaccag

SEQ ID NO: 263444 - RNA, 32 nt, Human
ugugcuggugcaugccuguaaucucagcuacu

SEQ ID NO: 263445 - RNA, 32 nt, Human
ugugcuggugggcgccuguaaucccagcuacu

SEQ ID NO: 263446 - RNA, 32 nt, Human
ugugcuguaaaauacagauuuggaagaaauga

SEQ ID NO: 263447 - RNA, 32 nt, Human
ugugcuguagcuccagccgggaugaggacugc

SEQ ID NO: 263448 - RNA, 32 nt, Human
ugugcugucccaggaagugucuggcgggcgug

SEQ ID NO: 263449 - RNA, 32 nt, Human
ugugcuguccuauccagccucucacagcugcc

SEQ ID NO: 263450 - RNA, 32 nt, Human
ugugcuguccugccucagaugcagagagagca

SEQ ID NO: 263451 - RNA, 20 nt, Human
ugugcuguccuuugcuguca

SEQ ID NO: 263452 - RNA, 32 nt, Human
ugugcugucgucaugccucaaacccgauccca

SEQ ID NO: 263453 - RNA, 32 nt, Human
ugugcugugaauucaguggggagcuguagcgg

SEQ ID NO: 263454 - RNA, 32 nt, Human
ugugcugugcucaagcgggcagccagggcuga

SEQ ID NO: 263455 - RNA, 32 nt, Human
ugugcuguuccuucuugccucuaacuuguaaa

SEQ ID NO: 263456 - RNA, 24 nt, Human
ugugcuguugcuuuucaucuuagu

SEQ ID NO: 263457 - RNA, 32 nt, Human
ugugcuuaaauauucuaggaguagaagcacuc

SEQ ID NO: 263458 - RNA, 32 nt, Human
ugugcuuaauccauuucugcagacacaacuca

SEQ ID NO: 263459 - RNA, 32 nt, Human
ugugcuuaugugaaccccuuggugaagguccc

SEQ ID NO: 263460 - RNA, 32 nt, Human
ugugcuuauucauacaagacaggaagcacggu

SEQ ID NO: 263461 - RNA, 32 nt, Human
ugugcuuauuuuguacugcagaauuccaauaa

SEQ ID NO: 263462 - RNA, 26 nt, Human
ugugcuucaaacugucuuaaacaaug

SEQ ID NO: 263463 - RNA, 32 nt, Human
ugugcuucagccccggccccagcuucagcucu

SEQ ID NO: 263464 - RNA, 32 nt, Human
ugugcuucaggcccuccaaaccccuguguucc

SEQ ID NO: 263465 - RNA, 32 nt, Human
ugugcuucauuuccuucugggcauuuuucauu

SEQ ID NO: 263466 - RNA, 32 nt, Human
ugugcuucccagccccaggguuucccuccuuc

SEQ ID NO: 263467 - RNA, 32 nt, Human
ugugcuuccggaggcucccuguguccuggagg

SEQ ID NO: 263468 - RNA, 32 nt, Human
ugugcuuccuucacuucaccuccauccucugu

SEQ ID NO: 263469 - RNA, 32 nt, Human
ugugcuucuccaggauacuuuagccucaauau

SEQ ID NO: 263470 - RNA, 32 nt, Human
ugugcuucucucuccgguacgugcccagcuca

SEQ ID NO: 263471 - RNA, 32 nt, Human
ugugcuucugggucagguggggacuuggagaa

SEQ ID NO: 263472 - RNA, 32 nt, Human
ugugcuugaacccagggcugugcugguguagg

SEQ ID NO: 263473 - RNA, 32 nt, Human
ugugcuugacucugcuucuugccacaucuucu

SEQ ID NO: 263474 - RNA, 32 nt, Human
ugugcuugagcucugguuugagagcuggcgcu

SEQ ID NO: 263475 - RNA, 32 nt, Human
ugugcuugaucugacauuuguauacauaaaag

SEQ ID NO: 263476 - RNA, 32 nt, Human
ugugcuugcagcccucaugagaaggcucagaa

SEQ ID NO: 263477 - RNA, 32 nt, Human
ugugcuugccuagggccucugugauggacauc

SEQ ID NO: 263478 - RNA, 32 nt, Human
ugugcuugcuucccgaagcagugagaagccag

SEQ ID NO: 263479 - RNA, 32 nt, Human
ugugcuugcuucuccuuuccugaggccuucaa

SEQ ID NO: 263480 - RNA, 32 nt, Human
ugugcuuggauacagggagcagccaggagacu

SEQ ID NO: 263481 - RNA, 32 nt, Human
ugugcuuggauguuaguucuccacccucgagg

SEQ ID NO: 263482 - RNA, 32 nt, Human
ugugcuuggcccacagucuggcucaugaugug

SEQ ID NO: 263483 - RNA, 32 nt, Human
ugugcuugggaugacgggugccucccaagagc

SEQ ID NO: 263484 - RNA, 32 nt, Human
ugugcuugggcccuguuuccagugugagguca

SEQ ID NO: 263485 - RNA, 32 nt, Human
ugugcuuguaaucccagcuacuugggaggcug

SEQ ID NO: 263486 - RNA, 32 nt, Human
ugugcuuguagucccagcuacuuaggaggcug

SEQ ID NO: 263487 - RNA, 32 nt, Human
ugugcuuguagucccagcuacuuuggaggcug

SEQ ID NO: 263488 - RNA, 32 nt, Human
ugugcuuguucuuuuaaauucuccuguuucag

SEQ ID NO: 263489 - RNA, 32 nt, Human
ugugcuuuacgauagcuuagugcaaugugcac

SEQ ID NO: 263490 - RNA, 32 nt, Human
ugugcuuucaaaggcaagacuugucuguaauu

SEQ ID NO: 263491 - RNA, 32 nt, Human
ugugcuuucccaagcguuccaccacccucuca

SEQ ID NO: 263492 - RNA, 32 nt, Human
ugugcuuuccucccucuccccugcccaccuca

SEQ ID NO: 263493 - RNA, 32 nt, Human
ugugcuuucucaggaaccuuucaagcggccag

SEQ ID NO: 263494 - RNA, 32 nt, Human
ugugcuuugaagagagugaauuuuggauaguc

SEQ ID NO: 263495 - RNA, 32 nt, Human
ugugcuuuucagcuugacacagguuuggagua

SEQ ID NO: 263496 - RNA, 32 nt, Human
ugugcuuuucuccaagucagcacccaaagguc

SEQ ID NO: 263497 - RNA, 32 nt, Human
ugugcuuuugcaccauugaguugacugccucu

SEQ ID NO: 263498 - RNA, 32 nt, Human
ugugcuuuugcacuugcagacugcucuaccuc

SEQ ID NO: 263499 - RNA, 32 nt, Human
ugugcuuuuggguggaaguuaggagaauguuu

SEQ ID NO: 263500 - RNA, 32 nt, Human
ugugcuuuuuaagccauuuccccaaaugggac

SEQ ID NO: 263501 - RNA, 21 nt, Human
uguggaaaaacugccuuccac

SEQ ID NO: 263502 - RNA, 21 nt, Human
uguggaaaaauugucuuccac

SEQ ID NO: 263503 - RNA, 32 nt, Human
uguggaaaaccugaagcuucccagccccacuu

SEQ ID NO: 263504 - RNA, 23 nt, Human
uguggaaaagaauggagagggga

SEQ ID NO: 263505 - RNA, 32 nt, Human
uguggaaacaucuauccuauagaucauccuau

SEQ ID NO: 263506 - RNA, 32 nt, Human
uguggaaacucaaaccguuaggcuccagucau

SEQ ID NO: 263507 - RNA, 32 nt, Human
uguggaaacuucagucccucaggcuggcagcu

SEQ ID NO: 263508 - RNA, 32 nt, Human
uguggaaagacaggagguguggggaaggaggg

SEQ ID NO: 263509 - RNA, 32 nt, Human
uguggaaagacuguuuuccauauguuauacuc

SEQ ID NO: 263510 - RNA, 32 nt, Human
uguggaaagccagaaagagaugaagggcaggc

SEQ ID NO: 263511 - RNA, 32 nt, Human
uguggaaagcuuuuagcacaguaucuggugau

SEQ ID NO: 263512 - RNA, 32 nt, Human
uguggaaagguugguucagugggggcuauucu

SEQ ID NO: 263513 - RNA, 32 nt, Human
uguggaaaucucacugggucucucucaaggcc

SEQ ID NO: 263514 - RNA, 32 nt, Human
uguggaacauaacaagaccccgucucuacuau

SEQ ID NO: 263515 - RNA, 32 nt, Human
uguggaaccuggaggcuccugaugccuuugac

SEQ ID NO: 263516 - RNA, 32 nt, Human
uguggaacuaugagccaauuaaaccucuuuuc

SEQ ID NO: 263517 - RNA, 32 nt, Human
uguggaacugugagucaauuacacucuuucca

SEQ ID NO: 263518 - RNA, 32 nt, Human
uguggaagagaaggaacccucacacaccacug

SEQ ID NO: 263519 - RNA, 21 nt, Human
uguggaagagaccuacuugca

SEQ ID NO: 263520 - RNA, 32 nt, Human
uguggaagaucuuguagggaaaagccaacggu

SEQ ID NO: 263521 - RNA, 32 nt, Human
uguggaagauucugagaaagaaaauaguuucc

SEQ ID NO: 263522 - RNA, 32 nt, Human
uguggaagcagcuucagguaggugagcucgug

SEQ ID NO: 263523 - RNA, 32 nt, Human
uguggaagcucugccuuuuugacuucauacuu

SEQ ID NO: 263524 - RNA, 32 nt, Human
uguggaaggcagcagagcggacuggugaggag

SEQ ID NO: 263525 - RNA, 20 nt, Human
uguggaaggcuucccuucau

SEQ ID NO: 263526 - RNA, 21 nt, Human
uguggaagggggaaaagggga

SEQ ID NO: 263527 - RNA, 32 nt, Human
uguggaaggucacucuguggccguguuccccu

SEQ ID NO: 263528 - RNA, 32 nt, Human
uguggaagguucugagaaagaaaauaguuucc

SEQ ID NO: 263529 - RNA, 32 nt, Human
uguggaagugagaaggagucacugugaugcuu

SEQ ID NO: 263530 - RNA, 24 nt, Human
uguggaauccaaucugucuuccau

SEQ ID NO: 263531 - RNA, 32 nt, Human
uguggaauccccaacuucauuagcuucugugg

SEQ ID NO: 263532 - RNA, 32 nt, Human
uguggaauccugcaaaugaucacaaagaaaga

SEQ ID NO: 263533 - RNA, 32 nt, Human
uguggaaucuggagugagggguaaaagcugau

SEQ ID NO: 263534 - RNA, 32 nt, Human
uguggaaugauacuucugaaaucaaaauuccu

SEQ ID NO: 263535 - RNA, 32 nt, Human
uguggaaugccccuggccagcaaggggugcuu

SEQ ID NO: 263536 - RNA, 32 nt, Human
uguggaauugagcagagaaccugcucucggag

SEQ ID NO: 263537 - RNA, 32 nt, Human
uguggaauuggggugaggggagcaagggaagc

SEQ ID NO: 263538 - RNA, 25 nt, Human
uguggacaaagugucuguuuucuac

SEQ ID NO: 263539 - RNA, 22 nt, Human
uguggacaacaagcgcugcuac

SEQ ID NO: 263540 - RNA, 32 nt, Human
uguggacaacacaguaagacccugucucuaca

SEQ ID NO: 263541 - RNA, 19 nt, Human
uguggacaagacaccucca

SEQ ID NO: 263542 - RNA, 22 nt, Human
uguggacaagagcugguuucua

SEQ ID NO: 263543 - RNA, 22 nt, Human
uguggacaagcucacuauucac

SEQ ID NO: 263544 - RNA, 31 nt, Human
uguggacaaguguucuaugagcagagacugg

SEQ ID NO: 263545 - RNA, 21 nt, Human
uguggacaaugggcuuuucau

SEQ ID NO: 263546 - RNA, 19 nt, Human
uguggacaauuggccucca

SEQ ID NO: 263547 - RNA, 26 nt, Human
uguggacacacugccugcucuuccau

SEQ ID NO: 263548 - RNA, 22 nt, Human
uguggacacagaggcuuuccau

SEQ ID NO: 263549 - RNA, 32 nt, Human
uguggacacagcacuccaacuuacuccagggc

SEQ ID NO: 263550 - RNA, 32 nt, Human
uguggacacagcuguuucuguuccugaacuag

SEQ ID NO: 263551 - RNA, 32 nt, Human
uguggacacaggcuggagucagguucgccauc

SEQ ID NO: 263552 - RNA, 20 nt, Human
uguggacacauccucuccac

SEQ ID NO: 263553 - RNA, 20 nt, Human
uguggacaccaccucuccau

SEQ ID NO: 263554 - RNA, 23 nt, Human
uguggacacuuacuguccucuac

SEQ ID NO: 263555 - RNA, 20 nt, Human
uguggacagacaacuacaaa

SEQ ID NO: 263556 - RNA, 32 nt, Human
uguggacagacacuacuugccuuugugguuua

SEQ ID NO: 263557 - RNA, 21 nt, Human
uguggacagagccccagucac

SEQ ID NO: 263558 - RNA, 32 nt, Human
uguggacagaggaaccaacaucugccaccucu

SEQ ID NO: 263559 - RNA, 32 nt, Human
uguggacagcaaggcuggaguugugaacccaa

SEQ ID NO: 263560 - RNA, 20 nt, Human
uguggacagccagcccccgc

SEQ ID NO: 263561 - RNA, 19 nt, Human
uguggacagccaucuucac

SEQ ID NO: 263562 - RNA, 22 nt, Human
uguggacagcccaccccuccgc

SEQ ID NO: 263563 - RNA, 32 nt, Human
uguggacaggcagcggcggcuggcgacgaacg

SEQ ID NO: 263564 - RNA, 32 nt, Human
uguggacaggcagggagaugcaugcgagugca

SEQ ID NO: 263565 - RNA, 32 nt, Human
uguggacaggcugacacguaccaguccccacu

SEQ ID NO: 263566 - RNA, 23 nt, Human
uguggacagucucuugaagcugg

SEQ ID NO: 263567 - RNA, 32 nt, Human
uguggacagugaacuguggcccacuguuaggg

SEQ ID NO: 263568 - RNA, 32 nt, Human
uguggacagugaacuguggcccacuguugggg

SEQ ID NO: 263569 - RNA, 20 nt, Human
uguggacauaagcucuuucu

SEQ ID NO: 263570 - RNA, 32 nt, Human
uguggacauacugacgcuccuccaugaagcag

SEQ ID NO: 263571 - RNA, 32 nt, Human
uguggacauagagagaggggaaggguuggaaa

SEQ ID NO: 263572 - RNA, 18 nt, Human
uguggacauccccuccac

SEQ ID NO: 263573 - RNA, 19 nt, Human
uguggacaucucccuguac

SEQ ID NO: 263574 - RNA, 19 nt, Human
uguggacaucuuuuuccac

SEQ ID NO: 263575 - RNA, 18 nt, Human
uguggacaugugcccuuc

SEQ ID NO: 263576 - RNA, 21 nt, Human
uguggacauuacucccucuua

SEQ ID NO: 263577 - RNA, 21 nt, Human
uguggacauugguuucuccau

SEQ ID NO: 263578 - RNA, 24 nt, Human
uguggacauuguugugaaauuggu

SEQ ID NO: 263579 - RNA, 22 nt, Human
uguggacauuuagcaucuccau

SEQ ID NO: 263580 - RNA, 20 nt, Human
uguggaccaaguccuuccau

SEQ ID NO: 263581 - RNA, 32 nt, Human
uguggaccacaucuccucaguugcugauucag

SEQ ID NO: 263582 - RNA, 32 nt, Human
uguggaccagaacuuucaccuugugaaugcau

SEQ ID NO: 263583 - RNA, 32 nt, Human
uguggaccagaacuuugaccuugugaaugcau

SEQ ID NO: 263584 - RNA, 32 nt, Human
uguggaccagagaaugauagugggacuuccug

SEQ ID NO: 263585 - RNA, 32 nt, Human
uguggaccaguaggacucaagguggacgugcg

SEQ ID NO: 263586 - RNA, 32 nt, Human
uguggacccacccuuccucuauaaguaccagc

SEQ ID NO: 263587 - RNA, 32 nt, Human
uguggacccaggaggcagagcuugcagugagc

SEQ ID NO: 263588 - RNA, 32 nt, Human
uguggaccccagagaagguggcagguggcccc

SEQ ID NO: 263589 - RNA, 32 nt, Human
uguggaccccugucugggccacccuagugugc

SEQ ID NO: 263590 - RNA, 23 nt, Human
uguggaccccuuugccuucacac

SEQ ID NO: 263591 - RNA, 32 nt, Human
uguggacccgagaagcagagagcgagaggggg

SEQ ID NO: 263592 - RNA, 32 nt, Human
uguggacccggcccuggcggcggagucagggu

SEQ ID NO: 263593 - RNA, 32 nt, Human
uguggacccucagaccccuaaauggggccguc

SEQ ID NO: 263594 - RNA, 32 nt, Human
uguggacccugacucacagcagaaucauucag

SEQ ID NO: 263595 - RNA, 32 nt, Human
uguggaccgcaggaucucagcacucugaccca

SEQ ID NO: 263596 - RNA, 22 nt, Human
uguggaccuaaagaggugggga

SEQ ID NO: 263597 - RNA, 32 nt, Human
uguggaccucagggaagccaggggcagcuguc

SEQ ID NO: 263598 - RNA, 32 nt, Human
uguggaccucucuugucuccccaccacuccag

SEQ ID NO: 263599 - RNA, 32 nt, Human
uguggaccuucaggaagccuuucuaggaagag

SEQ ID NO: 263600 - RNA, 32 nt, Human
uguggacggggcugggaaaaugaauaagaauu

SEQ ID NO: 263601 - RNA, 32 nt, Human
uguggacggugaccggcucacucugcggcgcc

SEQ ID NO: 263602 - RNA, 32 nt, Human
uguggacgugccuccuuccucuucaccuugug

SEQ ID NO: 263603 - RNA, 18 nt, Human
uguggacgugcuuugggg

SEQ ID NO: 263604 - RNA, 32 nt, Human
uguggacgugugcagaggugggggugcugagc

SEQ ID NO: 263605 - RNA, 32 nt, Human
uguggacuacagcuuauucagccugggaaaaa

SEQ ID NO: 263606 - RNA, 32 nt, Human
uguggacucaccugaggaagggaaggaaggga

SEQ ID NO: 263607 - RNA, 32 nt, Human
uguggacucccagcuaagcagaaaacuauugu

SEQ ID NO: 263608 - RNA, 32 nt, Human
uguggacucccgcuucccugcacugcugcucc

SEQ ID NO: 263609 - RNA, 32 nt, Human
uguggacuccuaaccaugcuaaccucacuggc

SEQ ID NO: 263610 - RNA, 22 nt, Human
uguggacuccugucccgggacu

SEQ ID NO: 263611 - RNA, 32 nt, Human
uguggacucugcucacuaccugggugacagga

SEQ ID NO: 263612 - RNA, 32 nt, Human
uguggacugaagaagaaagaaaacaauucaaa

SEQ ID NO: 263613 - RNA, 24 nt, Human
uguggacugaagcugacccuccau

SEQ ID NO: 263614 - RNA, 32 nt, Human
uguggacuuauucauuccucacaaugaggcua

SEQ ID NO: 263615 - RNA, 32 nt, Human
uguggacuuuaaacaaugaaacuuuuucaaaa

SEQ ID NO: 263616 - RNA, 32 nt, Human
uguggagaagcuggggagaaggcgugggagga

SEQ ID NO: 263617 - RNA, 32 nt, Human
uguggagaagguagcccaggagcagggcggcc

SEQ ID NO: 263618 - RNA, 32 nt, Human
uguggagacaacagugugucccaaugacuuuc

SEQ ID NO: 263619 - RNA, 32 nt, Human
uguggagacaacagugugucccaaugacuuuu

SEQ ID NO: 263620 - RNA, 32 nt, Human
uguggagacagugguucccugaugaaaaacug

SEQ ID NO: 263621 - RNA, 32 nt, Human
uguggagagaggaguccucacuugucuuccuu

SEQ ID NO: 263622 - RNA, 32 nt, Human
uguggagagcacgucuucucugccgcgcccuc

SEQ ID NO: 263623 - RNA, 32 nt, Human
uguggagagcugcagccaacuccaggguuucc

SEQ ID NO: 263624 - RNA, 32 nt, Human
uguggagaggagagaaugagagaguguggaaa

SEQ ID NO: 263625 - RNA, 32 nt, Human
uguggagagggagggaaugcagaggaaagaau

SEQ ID NO: 263626 - RNA, 19 nt, Human
uguggagauaagaagggga

SEQ ID NO: 263627 - RNA, 32 nt, Human
uguggagaucucaaacuuucuguacucagaag

SEQ ID NO: 263628 - RNA, 32 nt, Human
uguggagaugcagagguaaaagugugagcagu

SEQ ID NO: 263629 - RNA, 32 nt, Human
uguggagauggcaguguaucuaccucacaaag

SEQ ID NO: 263630 - RNA, 32 nt, Human
uguggagcaaaagguggccaugucugugagcu

SEQ ID NO: 263631 - RNA, 32 nt, Human
uguggagcaagaaaggauuuggggaagcuugg

SEQ ID NO: 263632 - RNA, 32 nt, Human
uguggagcacaauccugacuguaccugugaug

SEQ ID NO: 263633 - RNA, 32 nt, Human
uguggagcagcagggcuggagaucucugcagu

SEQ ID NO: 263634 - RNA, 32 nt, Human
uguggagcagggccaacuggaaagacguguuu

SEQ ID NO: 263635 - RNA, 32 nt, Human
uguggagcagggccacgugagguaccugagca

SEQ ID NO: 263636 - RNA, 32 nt, Human
uguggagcauugagggaguugcuucuuaggcc

SEQ ID NO: 263637 - RNA, 32 nt, Human
uguggagccagccacccucaccaggugccuuc

SEQ ID NO: 263638 - RNA, 32 nt, Human
uguggagcccacccuucuugcuccuccacacu

SEQ ID NO: 263639 - RNA, 32 nt, Human
uguggagccgcuggggcugcagccaccggauc

SEQ ID NO: 263640 - RNA, 32 nt, Human
uguggagcucacuuaggcagggccucuggcug

SEQ ID NO: 263641 - RNA, 32 nt, Human
uguggagcugugguaagagccucgggcgcauu

SEQ ID NO: 263642 - RNA, 32 nt, Human
uguggagcuuucuaguagguguccuucauagc

SEQ ID NO: 263643 - RNA, 32 nt, Human
uguggaggacaggccagagaggaggccagcag

SEQ ID NO: 263644 - RNA, 32 nt, Human
uguggaggagaaacucuuggccuaucaagugc

SEQ ID NO: 263645 - RNA, 19 nt, Human
uguggaggaggaagauggg

SEQ ID NO: 263646 - RNA, 32 nt, Human
uguggaggagguggaugcagccaugaauacaa

SEQ ID NO: 263647 - RNA, 32 nt, Human
uguggaggagguggcuuccagcagggugcugg

SEQ ID NO: 263648 - RNA, 23 nt, Human
uguggaggagguuguugcuuuau

SEQ ID NO: 263649 - RNA, 32 nt, Human
uguggaggauggaggugaccggggacgccggg

SEQ ID NO: 263650 - RNA, 32 nt, Human
uguggaggccaguucuggagcuauugcagccu

SEQ ID NO: 263651 - RNA, 32 nt, Human
uguggaggccucucccuggugugggcccacag

SEQ ID NO: 263652 - RNA, 16 nt, Human
uguggaggcggcgcga

SEQ ID NO: 263653 - RNA, 32 nt, Human
uguggaggcucacaccuguaaucucagcauuu

SEQ ID NO: 263654 - RNA, 32 nt, Human
uguggaggcugaauccuugaaggaggagguga

SEQ ID NO: 263655 - RNA, 32 nt, Human
uguggaggcugaggggucgggggaagaaaaca

SEQ ID NO: 263656 - RNA, 32 nt, Human
uguggagggagccacagagagggguccaggcu

SEQ ID NO: 263657 - RNA, 32 nt, Human
uguggagggcaaaaggagauaccaucccaggc

SEQ ID NO: 263658 - RNA, 32 nt, Human
uguggagggcucugucuguugcugaggaccaa

SEQ ID NO: 263659 - RNA, 32 nt, Human
uguggaggggagugccugguuggaucccacac

SEQ ID NO: 263660 - RNA, 32 nt, Human
uguggaggggcaggagcgugaugcagacaagg

SEQ ID NO: 263661 - RNA, 32 nt, Human
uguggaggggcccucugguaugugugucccug

SEQ ID NO: 263662 - RNA, 32 nt, Human
uguggagggugcaggaggaaggcauggacucg

SEQ ID NO: 263663 - RNA, 32 nt, Human
uguggagguacaugccuguaaucccagcuacu

SEQ ID NO: 263664 - RNA, 32 nt, Human
uguggagguagacaagcauuguacugagacag

SEQ ID NO: 263665 - RNA, 32 nt, Human
uguggagguagcuuuaacuugguucuguguaa

SEQ ID NO: 263666 - RNA, 32 nt, Human
uguggagguccucaggaguggagagaaugagu

SEQ ID NO: 263667 - RNA, 32 nt, Human
uguggaggugcugaagcccacaguuccacaca

SEQ ID NO: 263668 - RNA, 32 nt, Human
uguggagguucuuuugagucacacacaaagca

SEQ ID NO: 263669 - RNA, 22 nt, Human
uguggaguagcuguucuuucac

SEQ ID NO: 263670 - RNA, 32 nt, Human
uguggaguaggggaaagguucugcaaguugcc

SEQ ID NO: 263671 - RNA, 32 nt, Human
uguggaguggcauuuuagaugcccucacgaau

SEQ ID NO: 263672 - RNA, 32 nt, Human
uguggaguggggagguugggccuggacccuca

SEQ ID NO: 263673 - RNA, 32 nt, Human
uguggagugucaccgcguguacauacuguaaa

SEQ ID NO: 263674 - RNA, 32 nt, Human
uguggagugucagacggaggaggacuuaguga

SEQ ID NO: 263675 - RNA, 32 nt, Human
uguggaguguuugaauucugucucuaucauuu

SEQ ID NO: 263676 - RNA, 21 nt, Human
uguggauacagugcccaccgc

SEQ ID NO: 263677 - RNA, 32 nt, Human
uguggauagagaagcaggaagagcacuggacu

SEQ ID NO: 263678 - RNA, 32 nt, Human
uguggauagugaacuguggcccacuguuaggg

SEQ ID NO: 263679 - RNA, 32 nt, Human
uguggauaucucacagcacaaaguucaaaugu

SEQ ID NO: 263680 - RNA, 32 nt, Human
uguggauaucucacagcacaaaguucaagugu

SEQ ID NO: 263681 - RNA, 32 nt, Human
uguggauaucuucucucaucuuaugauuuguc

SEQ ID NO: 263682 - RNA, 32 nt, Human
uguggauaugccacaaaacacaagugguaugc

SEQ ID NO: 263683 - RNA, 32 nt, Human
uguggaucagcauuuuagaaacuacaaauaua

SEQ ID NO: 263684 - RNA, 32 nt, Human
uguggauccccugagaucuggcuucccaagag

SEQ ID NO: 263685 - RNA, 32 nt, Human
uguggaucccugggaacgcagagcaggaaugc

SEQ ID NO: 263686 - RNA, 32 nt, Human
uguggauccucuuguugaccucauauuggacu

SEQ ID NO: 263687 - RNA, 32 nt, Human
uguggaucgcccugggcugggcaccagugaca

SEQ ID NO: 263688 - RNA, 32 nt, Human
uguggaucuacaugggaagacuacccauauua

SEQ ID NO: 263689 - RNA, 32 nt, Human
uguggaucucugcuuuuguuuuguaccuagua

SEQ ID NO: 263690 - RNA, 21 nt, Human
uguggaucugcgcccauccca

SEQ ID NO: 263691 - RNA, 32 nt, Human
uguggaucugugacccugggcgcugaaaaugg

SEQ ID NO: 263692 - RNA, 32 nt, Human
uguggaucuguucaaaguagucacuguauaua

SEQ ID NO: 263693 - RNA, 32 nt, Human
uguggaucuguuccuaguauaggcaacauaau

SEQ ID NO: 263694 - RNA, 24 nt, Human
uguggaugaacugagacccuccau

SEQ ID NO: 263695 - RNA, 32 nt, Human
uguggaugacagagcgagacccugccucaaaa

SEQ ID NO: 263696 - RNA, 32 nt, Human
uguggaugacucuugccauuuccuaagagaua

SEQ ID NO: 263697 - RNA, 21 nt, Human
uguggaugccucuuccuccac

SEQ ID NO: 263698 - RNA, 32 nt, Human
uguggaugccugccugcccugcccugugcugu

SEQ ID NO: 263699 - RNA, 32 nt, Human
uguggaugcuguugccaagacugcaaaccacu

SEQ ID NO: 263700 - RNA, 21 nt, Human
uguggauggagcuaucucuac

SEQ ID NO: 263701 - RNA, 22 nt, Human
uguggauggauggacucugggg

SEQ ID NO: 263702 - RNA, 32 nt, Human
uguggaugggaaacugcuccagcuccaagagg

SEQ ID NO: 263703 - RNA, 24 nt, Human
uguggauggucacugccccuccac

SEQ ID NO: 263704 - RNA, 32 nt, Human
uguggauggugagagagagggcucagaagcag

SEQ ID NO: 263705 - RNA, 32 nt, Human
uguggauguagugcuuuuacuuuacagauuga

SEQ ID NO: 263706 - RNA, 32 nt, Human
uguggaugucuauaacuucauccucaguaugu

SEQ ID NO: 263707 - RNA, 19 nt, Human
uguggaugugaggugggga

SEQ ID NO: 263708 - RNA, 32 nt, Human
uguggaugugguuucugccuaugggaggaggu

SEQ ID NO: 263709 - RNA, 32 nt, Human
uguggauguucaggccuagcuccaaccaagag

SEQ ID NO: 263710 - RNA, 32 nt, Human
uguggauuaggcucuggcuucugugauggugc

SEQ ID NO: 263711 - RNA, 32 nt, Human
uguggauucaccccaucucccaaauaaaguuu

SEQ ID NO: 263712 - RNA, 32 nt, Human
uguggauuccacuggcauccagccucccacag

SEQ ID NO: 263713 - RNA, 17 nt, Human
uguggauuccugauccc

SEQ ID NO: 263714 - RNA, 32 nt, Human
uguggauucugaggcccugcccaaugagacuc

SEQ ID NO: 263715 - RNA, 32 nt, Human
uguggauugcggcagcagaggcugcagccuaa

SEQ ID NO: 263716 - RNA, 32 nt, Human
uguggauugugaaaucaaaaucuggagaaaug

SEQ ID NO: 263717 - RNA, 32 nt, Human
uguggauuuaucucccuuuggucuuugauguu

SEQ ID NO: 263718 - RNA, 32 nt, Human
uguggauuucccacccuuagaagcucuacuaa

SEQ ID NO: 263719 - RNA, 32 nt, Human
uguggauuuccugccagcaccagucagagauu

SEQ ID NO: 263720 - RNA, 18 nt, Human
uguggauuucugcccucc

SEQ ID NO: 263721 - RNA, 32 nt, Human
uguggauuugaggaccucugcagaccaucaga

SEQ ID NO: 263722 - RNA, 32 nt, Human
uguggcaaaaccacgacaccacugagaaaguc

SEQ ID NO: 263723 - RNA, 32 nt, Human
uguggcaaagcagcaacuauucacaaaauauc

SEQ ID NO: 263724 - RNA, 32 nt, Human
uguggcaaagcuuuuaaccaguccucaaacuu

SEQ ID NO: 263725 - RNA, 32 nt, Human
uguggcaaagcuuuuaaccaguccucaacccu

SEQ ID NO: 263726 - RNA, 32 nt, Human
uguggcaaagcuuuuaaccaguccucacaccu

SEQ ID NO: 263727 - RNA, 32 nt, Human
uguggcaaaggcuuuaauuaguucucaucccu

SEQ ID NO: 263728 - RNA, 25 nt, Human
uguggcaaauugugcagaguaguuu

SEQ ID NO: 263729 - RNA, 32 nt, Human
uguggcaacaccuuucucagaaaauccgaccu

SEQ ID NO: 263730 - RNA, 32 nt, Human
uguggcaagggaggggagggcaggagggcucg

SEQ ID NO: 263731 - RNA, 32 nt, Human
uguggcaagugacaaagauagcuguaugcuca

SEQ ID NO: 263732 - RNA, 32 nt, Human
uguggcaaguuacuuccucuccccaggucucu

SEQ ID NO: 263733 - RNA, 32 nt, Human
uguggcaauggcuguggcgauggcuacagcaa

SEQ ID NO: 263734 - RNA, 24 nt, Human
uguggcacaggaaagcugcccucu

SEQ ID NO: 263735 - RNA, 32 nt, Human
uguggcacaggcauugucuuuucuuugaaaua

SEQ ID NO: 263736 - RNA, 20 nt, Human
uguggcacauuccccuucac

SEQ ID NO: 263737 - RNA, 32 nt, Human
uguggcaccagccgguccugcccacgcuucag

SEQ ID NO: 263738 - RNA, 32 nt, Human
uguggcaccagcugcaccuguaccagcugccc

SEQ ID NO: 263739 - RNA, 32 nt, Human
uguggcaccaugagcuucaugguggcagaaga

SEQ ID NO: 263740 - RNA, 32 nt, Human
uguggcaccccagcucacugggagucucagga

SEQ ID NO: 263741 - RNA, 21 nt, Human
uguggcaccuagcauggugca

SEQ ID NO: 263742 - RNA, 32 nt, Human
uguggcacucuugccaguccuugacauugucg

SEQ ID NO: 263743 - RNA, 32 nt, Human
uguggcacugcacuccagucugggugacagag

SEQ ID NO: 263744 - RNA, 32 nt, Human
uguggcacuuccuggucuaaagcucugcuaga

SEQ ID NO: 263745 - RNA, 32 nt, Human
uguggcagaggaagcaugagguggggccuggc

SEQ ID NO: 263746 - RNA, 32 nt, Human
uguggcagaggcugggggagggaugcagugac

SEQ ID NO: 263747 - RNA, 32 nt, Human
uguggcagaguguucaguuagcauuaaagccc

SEQ ID NO: 263748 - RNA, 32 nt, Human
uguggcagaucauccaugauuuguuucccgug

SEQ ID NO: 263749 - RNA, 32 nt, Human
uguggcagcaagagccgccaguucgggaccac

SEQ ID NO: 263750 - RNA, 32 nt, Human
uguggcagcagcgagauuuccaaaaagaugaa

SEQ ID NO: 263751 - RNA, 32 nt, Human
uguggcagcucaugacuguaaucccagcacuu

SEQ ID NO: 263752 - RNA, 32 nt, Human
uguggcagcuuaugucuguaaucccagcacuu

SEQ ID NO: 263753 - RNA, 32 nt, Human
uguggcaggaaggacacagccggcuccugacg

SEQ ID NO: 263754 - RNA, 32 nt, Human
uguggcaggaggacaggaaugcaguggaacca

SEQ ID NO: 263755 - RNA, 32 nt, Human
uguggcaggagguuuuggacucgaugaguuuc

SEQ ID NO: 263756 - RNA, 32 nt, Human
uguggcaggcaggggugguaguaguagugaau

SEQ ID NO: 263757 - RNA, 32 nt, Human
uguggcaggcuggaguuauugaagcagagugg

SEQ ID NO: 263758 - RNA, 32 nt, Human
uguggcagggcugcccuggguuucucuuacuc

SEQ ID NO: 263759 - RNA, 32 nt, Human
uguggcaggggugagaguggagcugagugggg

SEQ ID NO: 263760 - RNA, 32 nt, Human
uguggcaggugucauuugcuaguagaauuugu

SEQ ID NO: 263761 - RNA, 32 nt, Human
uguggcagugagaagaagcaucgagggcgagg

SEQ ID NO: 263762 - RNA, 32 nt, Human
uguggcagugaugacugaagacuuuauuaaaa

SEQ ID NO: 263763 - RNA, 32 nt, Human
uguggcagugaugggguuuacuuucaugaauu

SEQ ID NO: 263764 - RNA, 32 nt, Human
uguggcagugccuauguucucuccuaggcaga

SEQ ID NO: 263765 - RNA, 32 nt, Human
uguggcagugccuguguucucuccuaggcagg

SEQ ID NO: 263766 - RNA, 32 nt, Human
uguggcagugccuguguucucuccuagguagg

SEQ ID NO: 263767 - RNA, 32 nt, Human
uguggcaguguuuaaaugcucuucugaaggcu

SEQ ID NO: 263768 - RNA, 21 nt, Human
uguggcauaguaauuuuuaua

SEQ ID NO: 263769 - RNA, 32 nt, Human
uguggcauauuuuuaggccucuccuaaaccca

SEQ ID NO: 263770 - RNA, 32 nt, Human
uguggcaucauccucucagcagucuuccuguc

SEQ ID NO: 263771 - RNA, 19 nt, Human
uguggcauccagacucccu

SEQ ID NO: 263772 - RNA, 20 nt, Human
uguggcaucgcagucucuua

SEQ ID NO: 263773 - RNA, 32 nt, Human
uguggcaucuacccucccucccugcugccaga

SEQ ID NO: 263774 - RNA, 32 nt, Human
uguggcaucucucccuucucucucuugcucuu

SEQ ID NO: 263775 - RNA, 32 nt, Human
uguggcaucuuccucuaguccuucccaccucc

SEQ ID NO: 263776 - RNA, 32 nt, Human
uguggcaugacugacauacauacucaaauaua

SEQ ID NO: 263777 - RNA, 32 nt, Human
uguggcaugucauaagagaaacagaugugcau

SEQ ID NO: 263778 - RNA, 32 nt, Human
uguggcaugucccaggagggugugcaugugug

SEQ ID NO: 263779 - RNA, 32 nt, Human
uguggcauuauccacaaccaucauguuucuua

SEQ ID NO: 263780 - RNA, 32 nt, Human
uguggcauugaaggaacaaagauacaggggca

SEQ ID NO: 263781 - RNA, 32 nt, Human
uguggcauugcacuccagccugggugguagau

SEQ ID NO: 263782 - RNA, 31 nt, Human
uguggcauugucaccuucacagcagacagag

SEQ ID NO: 263783 - RNA, 20 nt, Human
uguggcauuucauucacuua

SEQ ID NO: 263784 - RNA, 32 nt, Human
uguggccaaacagugcccagcuuaagcauccc

SEQ ID NO: 263785 - RNA, 20 nt, Human
uguggccaagcacaucuuug

SEQ ID NO: 263786 - RNA, 32 nt, Human
uguggccaagccuuucccucccuaccugauca

SEQ ID NO: 263787 - RNA, 20 nt, Human
uguggccaagcugcccccau

SEQ ID NO: 263788 - RNA, 32 nt, Human
uguggccacagcuuuuuggguuuggaauggag

SEQ ID NO: 263789 - RNA, 32 nt, Human
uguggccacugcaguucaucgagucuucaggg

SEQ ID NO: 263790 - RNA, 32 nt, Human
uguggccacuuacccuauccuuacccuccuua

SEQ ID NO: 263791 - RNA, 32 nt, Human
uguggccagaauacaacccuggaguuggcaag

SEQ ID NO: 263792 - RNA, 32 nt, Human
uguggccagaggacaggggaagcugaaggccc

SEQ ID NO: 263793 - RNA, 32 nt, Human
uguggccagccccuuggcaccagcaccaccac

SEQ ID NO: 263794 - RNA, 32 nt, Human
uguggccagcuguccagcccagcccugugugu

SEQ ID NO: 263795 - RNA, 32 nt, Human
uguggccaggaggcgagaagguggcuguuccc

SEQ ID NO: 263796 - RNA, 32 nt, Human
uguggccaggaguugggagaccagccugggga

SEQ ID NO: 263797 - RNA, 32 nt, Human
uguggccaggcacgccuguaaucccagcacuu

SEQ ID NO: 263798 - RNA, 32 nt, Human
uguggccaggcagggcggaggccugcugugca

SEQ ID NO: 263799 - RNA, 32 nt, Human
uguggccaggccccaccuguguuuccaagucg

SEQ ID NO: 263800 - RNA, 32 nt, Human
uguggccagggacacaggcuuggggcccaccc

SEQ ID NO: 263801 - RNA, 32 nt, Human
uguggccaguacuccggccuccuagcugcuac

SEQ ID NO: 263802 - RNA, 32 nt, Human
uguggccaguacucgggacagacuaagggcgc

SEQ ID NO: 263803 - RNA, 32 nt, Human
uguggccaugccacggagggggcaguggacaa

SEQ ID NO: 263804 - RNA, 32 nt, Human
uguggccaugucuguguacgcagggggccggg

SEQ ID NO: 263805 - RNA, 32 nt, Human
uguggccauucaaccugccaggacuaacauuu

SEQ ID NO: 263806 - RNA, 32 nt, Human
uguggccauuucugcagccuccuggccucacc

SEQ ID NO: 263807 - RNA, 32 nt, Human
uguggcccaacaagaggaagcucuccccugac

SEQ ID NO: 263808 - RNA, 32 nt, Human
uguggcccacacccagccugguggacauggaa

SEQ ID NO: 263809 - RNA, 19 nt, Human
uguggcccaccaguguaau

SEQ ID NO: 263810 - RNA, 24 nt, Human
uguggcccagccuggaguacagug

SEQ ID NO: 263811 - RNA, 24 nt, Human
uguggcccaggcugaagugcagug

SEQ ID NO: 263812 - RNA, 23 nt, Human
uguggcccaggcuggagugcagu

SEQ ID NO: 263813 - RNA, 24 nt, Human
uguggcccaggcuggagugcagug

SEQ ID NO: 263814 - RNA, 32 nt, Human
uguggcccagggaagccaaaagacuggccacc

SEQ ID NO: 263815 - RNA, 32 nt, Human
uguggcccauaucuuggucacucugaagcaca

SEQ ID NO: 263816 - RNA, 32 nt, Human
uguggcccaucugccaccaucugugccuacag

SEQ ID NO: 263817 - RNA, 32 nt, Human
uguggcccaugugcugcauccucugcccucag

SEQ ID NO: 263818 - RNA, 19 nt, Human
uguggcccccgggacccca

SEQ ID NO: 263819 - RNA, 32 nt, Human
uguggccccgggacccagcagagcugggggag

SEQ ID NO: 263820 - RNA, 32 nt, Human
uguggccccucagggccuugaguggcacgcug

SEQ ID NO: 263821 - RNA, 32 nt, Human
uguggccccuccauuuuccccauuuucuuauc

SEQ ID NO: 263822 - RNA, 32 nt, Human
uguggccccugccugugccagccaugggcucg

SEQ ID NO: 263823 - RNA, 32 nt, Human
uguggcccgggggccucuucuggaccaggaaa

SEQ ID NO: 263824 - RNA, 20 nt, Human
uguggcccucacugaugccc

SEQ ID NO: 263825 - RNA, 32 nt, Human
uguggcccuccccucccaccucccuguguaua

SEQ ID NO: 263826 - RNA, 32 nt, Human
uguggcccugcaguugaccugagcugcuucac

SEQ ID NO: 263827 - RNA, 32 nt, Human
uguggcccuggccgugaucuccaccuuucugu

SEQ ID NO: 263828 - RNA, 32 nt, Human
uguggcccuuccauugucagccuggaccugcc

SEQ ID NO: 263829 - RNA, 32 nt, Human
uguggcccuuccucccccucauugaggacuua

SEQ ID NO: 263830 - RNA, 32 nt, Human
uguggcccuuuagaaacacacagcuccauuuc

SEQ ID NO: 263831 - RNA, 32 nt, Human
uguggcccuuugacuuugugaaugagcacaau

SEQ ID NO: 263832 - RNA, 32 nt, Human
uguggccucacugcaacacaaagcuccaccag

SEQ ID NO: 263833 - RNA, 19 nt, Human
uguggccucagaagcagga

SEQ ID NO: 263834 - RNA, 32 nt, Human
uguggccucagaccucugggccugugugagcu

SEQ ID NO: 263835 - RNA, 32 nt, Human
uguggccucaggaggcaguggcuuggagcaga

SEQ ID NO: 263836 - RNA, 32 nt, Human
uguggccuccaaugcuagugcugugcaguuuu

SEQ ID NO: 263837 - RNA, 32 nt, Human
uguggccucuaucugcuaccaucuguguuuua

SEQ ID NO: 263838 - RNA, 32 nt, Human
uguggccucugacuucucuuucuucagccuuu

SEQ ID NO: 263839 - RNA, 32 nt, Human
uguggccucugcucuguacucccucuugcucu

SEQ ID NO: 263840 - RNA, 32 nt, Human
uguggccucuggggaucugcugggcagauguc

SEQ ID NO: 263841 - RNA, 32 nt, Human
uguggccucuugcuccuccuuccagauccccg

SEQ ID NO: 263842 - RNA, 21 nt, Human
uguggccugaagggaugggga

SEQ ID NO: 263843 - RNA, 32 nt, Human
uguggccugcaaugccaggccaugugccccuc

SEQ ID NO: 263844 - RNA, 32 nt, Human
uguggccugcagcccugcgcagggccagugcc

SEQ ID NO: 263845 - RNA, 28 nt, Human
uguggccugcaugcugccugaucuugcc

SEQ ID NO: 263846 - RNA, 32 nt, Human
uguggccugcuguuucuguugucuuguauguc

SEQ ID NO: 263847 - RNA, 32 nt, Human
uguggccuggaggggcuugcaacaaggaggca

SEQ ID NO: 263848 - RNA, 32 nt, Human
uguggccuggccagagccccuugcauaucccc

SEQ ID NO: 263849 - RNA, 22 nt, Human
uguggccugggagagcugggga

SEQ ID NO: 263850 - RNA, 32 nt, Human
uguggccugguggggcucugcaggcucccucg

SEQ ID NO: 263851 - RNA, 32 nt, Human
uguggccuguaaucccagcuacucgggaggcu

SEQ ID NO: 263852 - RNA, 32 nt, Human
uguggccugucuccuccacucuccuccucacc

SEQ ID NO: 263853 - RNA, 32 nt, Human
uguggccugugacuacuguauuggacaguuca

SEQ ID NO: 263854 - RNA, 32 nt, Human
uguggccuguguauuugcaauuuuucuuuguc

SEQ ID NO: 263855 - RNA, 32 nt, Human
uguggccuuaggaaagcaaaagagcacuuuuu

SEQ ID NO: 263856 - RNA, 32 nt, Human
uguggccuuaggagucaaauagucucugcaug

SEQ ID NO: 263857 - RNA, 32 nt, Human
uguggccuuccuauugugucuuguguuuuggu

SEQ ID NO: 263858 - RNA, 32 nt, Human
uguggccuugugcaaucucugccucucugacc

SEQ ID NO: 263859 - RNA, 32 nt, Human
uguggccuuugggcucugccaucuggggugug

SEQ ID NO: 263860 - RNA, 32 nt, Human
uguggccuuuuuauuuuuccuaauccacgccg

SEQ ID NO: 263861 - RNA, 32 nt, Human
uguggcgagaggaacacuugagccuggaaaag

SEQ ID NO: 263862 - RNA, 22 nt, Human
uguggcgcgcggcuguccccau

SEQ ID NO: 263863 - RNA, 32 nt, Human
uguggcggaguuuggagguuggagagaaaucc

SEQ ID NO: 263864 - RNA, 32 nt, Human
uguggcggcgagcaccuguaaucccagcuacu

SEQ ID NO: 263865 - RNA, 32 nt, Human
uguggcgggaggugaggcgggagguucagcag

SEQ ID NO: 263866 - RNA, 32 nt, Human
uguggcgggcaggccagcucccaggacgucuc

SEQ ID NO: 263867 - RNA, 32 nt, Human
uguggcgggcucaggggcuccugcugagcaaa

SEQ ID NO: 263868 - RNA, 32 nt, Human
uguggcggugcacaccuguagucccagcugcu

SEQ ID NO: 263869 - RNA, 32 nt, Human
uguggcggugcgugccuguaaucccagcuauu

SEQ ID NO: 263870 - RNA, 32 nt, Human
uguggcgguggccacagaccauguagccuucc

SEQ ID NO: 263871 - RNA, 32 nt, Human
uguggcuaaaguuauuuaugugguguuauaug

SEQ ID NO: 263872 - RNA, 32 nt, Human
uguggcuaaguguggggaccagacaggacucg

SEQ ID NO: 263873 - RNA, 32 nt, Human
uguggcuagccacugugcuccagccugggcaa

SEQ ID NO: 263874 - RNA, 32 nt, Human
uguggcuagcuucugggcaagucccucugcuc

SEQ ID NO: 263875 - RNA, 32 nt, Human
uguggcuauggguuuucauuuguaacuccauc

SEQ ID NO: 263876 - RNA, 32 nt, Human
uguggcuauugggaacaagcugggcaaaagca

SEQ ID NO: 263877 - RNA, 32 nt, Human
uguggcucaagaaggaaggggaaucauguacc

SEQ ID NO: 263878 - RNA, 32 nt, Human
uguggcucacguguugggagguuguggucugc

SEQ ID NO: 263879 - RNA, 32 nt, Human
uguggcucagcaccuagcaaauaugucacaau

SEQ ID NO: 263880 - RNA, 32 nt, Human
uguggcuccagccccagggauucugagucuga

SEQ ID NO: 263881 - RNA, 21 nt, Human
uguggcuccagcccggccugg

SEQ ID NO: 263882 - RNA, 32 nt, Human
uguggcuccagcugcucaaagacgagccuuca

SEQ ID NO: 263883 - RNA, 32 nt, Human
uguggcuccggaaaggcguuugggaugccaac

SEQ ID NO: 263884 - RNA, 32 nt, Human
uguggcucgucccuccuccccaucucggcccu

SEQ ID NO: 263885 - RNA, 32 nt, Human
uguggcucucagcucucaaggcuguuuucccc

SEQ ID NO: 263886 - RNA, 22 nt, Human
uguggcucucuuuucaucuuug

SEQ ID NO: 263887 - RNA, 32 nt, Human
uguggcucugaaaaugaagauuuggaaggaga

SEQ ID NO: 263888 - RNA, 32 nt, Human
uguggcucugaucaguuuccuccaacuccugg

SEQ ID NO: 263889 - RNA, 32 nt, Human
uguggcucugcagccccugcuccuuucugcgg

SEQ ID NO: 263890 - RNA, 32 nt, Human
uguggcucugucccuguguugccuuccacaga

SEQ ID NO: 263891 - RNA, 32 nt, Human
uguggcucuuacguguuuucuuugcuaaaaua

SEQ ID NO: 263892 - RNA, 20 nt, Human
uguggcucuucucaucuuug

SEQ ID NO: 263893 - RNA, 24 nt, Human
uguggcucuuguuuucauuuuugu

SEQ ID NO: 263894 - RNA, 32 nt, Human
uguggcugaagcuggcggaucgcuugaggccc

SEQ ID NO: 263895 - RNA, 32 nt, Human
uguggcugacaccugggcuaccuccaaccuac

SEQ ID NO: 263896 - RNA, 32 nt, Human
uguggcugacuugguacagaagacggcaaagg

SEQ ID NO: 263897 - RNA, 32 nt, Human
uguggcugagcagacuccagggccagggccag

SEQ ID NO: 263898 - RNA, 32 nt, Human
uguggcugagucucugacagcugugagugugu

SEQ ID NO: 263899 - RNA, 32 nt, Human
uguggcugaugugucuggaaaugauguaguuc

SEQ ID NO: 263900 - RNA, 32 nt, Human
uguggcugcaagcaaggggcuagaaguucacc

SEQ ID NO: 263901 - RNA, 32 nt, Human
uguggcugcacucauuuucucaguugguacuu

SEQ ID NO: 263902 - RNA, 32 nt, Human
uguggcugccacggccuccuggcuccagaggc

SEQ ID NO: 263903 - RNA, 32 nt, Human
uguggcugcccgaggcgguagagcggagaaag

SEQ ID NO: 263904 - RNA, 32 nt, Human
uguggcugcccuuugugauucccucagaucug

SEQ ID NO: 263905 - RNA, 32 nt, Human
uguggcugcucaauaaacacuuguugaaccau

SEQ ID NO: 263906 - RNA, 32 nt, Human
uguggcugcuuugcacggcaguggcaagggcc

SEQ ID NO: 263907 - RNA, 32 nt, Human
uguggcuggaaacccaggcagggcugcaccac

SEQ ID NO: 263908 - RNA, 32 nt, Human
uguggcuggaacccugcaccaaggcgaccgcu

SEQ ID NO: 263909 - RNA, 32 nt, Human
uguggcuggaaccuuuauaaagugaccaagca

SEQ ID NO: 263910 - RNA, 32 nt, Human
uguggcuggagugcugcaggugucaaggaaau

SEQ ID NO: 263911 - RNA, 32 nt, Human
uguggcuggauuaagagcagccuagcagcuug

SEQ ID NO: 263912 - RNA, 29 nt, Human
uguggcuggcugcuucccuuccuuccauc

SEQ ID NO: 263913 - RNA, 32 nt, Human
uguggcuggcugcuucccuuccuuccaucccc

SEQ ID NO: 263914 - RNA, 32 nt, Human
uguggcugggagagugggagggaagcccucag

SEQ ID NO: 263915 - RNA, 32 nt, Human
uguggcugggaggagcucuggggaagaugggc

SEQ ID NO: 263916 - RNA, 32 nt, Human
uguggcugggcugggcugggcggggcggccug

SEQ ID NO: 263917 - RNA, 32 nt, Human
uguggcuggggaggcccuggcagcaggaagcc

SEQ ID NO: 263918 - RNA, 32 nt, Human
uguggcugggucuucgaggagccgaaccaaug

SEQ ID NO: 263919 - RNA, 32 nt, Human
uguggcuguagucccagcuacucgggaggcug

SEQ ID NO: 263920 - RNA, 32 nt, Human
uguggcuguagucccagcuacuuuggaggcug

SEQ ID NO: 263921 - RNA, 32 nt, Human
uguggcugucauucucccagggcagaacccug

SEQ ID NO: 263922 - RNA, 32 nt, Human
uguggcugugaguggggacagcuccucgggac

SEQ ID NO: 263923 - RNA, 32 nt, Human
uguggcugugccugugggucucuagaaccauc

SEQ ID NO: 263924 - RNA, 32 nt, Human
uguggcuguggcugaagcuggcggaucgcuug

SEQ ID NO: 263925 - RNA, 32 nt, Human
uguggcugugggcuccgagcaugggcgcagua

SEQ ID NO: 263926 - RNA, 32 nt, Human
uguggcuguguggagcucagcuguguugugug

SEQ ID NO: 263927 - RNA, 32 nt, Human
uguggcuuacccaggauggaaacacugcaguu

SEQ ID NO: 263928 - RNA, 32 nt, Human
uguggcuuacugcaauaauguuucuuugauca

SEQ ID NO: 263929 - RNA, 32 nt, Human
uguggcuuaguuguagaagcaggugugucucu

SEQ ID NO: 263930 - RNA, 32 nt, Human
uguggcuuauucuucuagcugccaacccaaau

SEQ ID NO: 263931 - RNA, 32 nt, Human
uguggcuuauuuucucaauccuugauuccuuc

SEQ ID NO: 263932 - RNA, 32 nt, Human
uguggcuucagccgugguccuccugggaccgg

SEQ ID NO: 263933 - RNA, 32 nt, Human
uguggcuucaggggaaugcaccaaggcucuca

SEQ ID NO: 263934 - RNA, 32 nt, Human
uguggcuucauacccacucccugucaaugcag

SEQ ID NO: 263935 - RNA, 32 nt, Human
uguggcuuccagagccccucuucagcuccagg

SEQ ID NO: 263936 - RNA, 32 nt, Human
uguggcuucuccagccuuucucccucacauca

SEQ ID NO: 263937 - RNA, 32 nt, Human
uguggcuucugcucugagggcuuguguuccca

SEQ ID NO: 263938 - RNA, 32 nt, Human
uguggcuuggggucgggagugcaggaggcgaa

SEQ ID NO: 263939 - RNA, 32 nt, Human
uguggcuugugugcuggagguuguggccugcg

SEQ ID NO: 263940 - RNA, 32 nt, Human
uguggcuugugugcuggagguuguggucuacg

SEQ ID NO: 263941 - RNA, 32 nt, Human
uguggcuuugaagacccucacugugaaguugg

SEQ ID NO: 263942 - RNA, 32 nt, Human
uguggcuuuggugagagagugugcagagagca

SEQ ID NO: 263943 - RNA, 18 nt, Human
ugugggaaaaagagcugg

SEQ ID NO: 263944 - RNA, 20 nt, Human
ugugggaaaagcccuggggg

SEQ ID NO: 263945 - RNA, 32 nt, Human
ugugggaaaauaucccucccaccugcaacagc

SEQ ID NO: 263946 - RNA, 20 nt, Human
ugugggaaacugagagggga

SEQ ID NO: 263947 - RNA, 32 nt, Human
ugugggaaagacuacagacaauaggaaucuuu

SEQ ID NO: 263948 - RNA, 22 nt, Human
ugugggaaagccuugugcugca

SEQ ID NO: 263949 - RNA, 19 nt, Human
ugugggaaaggaaugugga

SEQ ID NO: 263950 - RNA, 32 nt, Human
ugugggaaaugaguugagaccauggacuuggg

SEQ ID NO: 263951 - RNA, 18 nt, Human
ugugggaacgagagggga

SEQ ID NO: 263952 - RNA, 32 nt, Human
ugugggaacggucuuccuccagccuggugccc

SEQ ID NO: 263953 - RNA, 32 nt, Human
ugugggaagaugaagaugguuuggagguguaa

SEQ ID NO: 263954 - RNA, 20 nt, Human
ugugggaagcagcucuccac

SEQ ID NO: 263955 - RNA, 32 nt, Human
ugugggaaggcagaggaucucugaggaguucc

SEQ ID NO: 263956 - RNA, 21 nt, Human
ugugggaaggggaaauggagg

SEQ ID NO: 263957 - RNA, 21 nt, Human
ugugggaaggggagauaaggg

SEQ ID NO: 263958 - RNA, 21 nt, Human
ugugggaaggguugccaggga

SEQ ID NO: 263959 - RNA, 32 nt, Human
ugugggaagguaaagaaacuugcuggacaagu

SEQ ID NO: 263960 - RNA, 32 nt, Human
ugugggaaugacuggggugaggcagggucaag

SEQ ID NO: 263961 - RNA, 32 nt, Human
ugugggaauuaugggagcuacaauucaagaug

SEQ ID NO: 263962 - RNA, 32 nt, Human
ugugggaauucugggagauacaauucaaguug

SEQ ID NO: 263963 - RNA, 32 nt, Human
ugugggacaggggcgauggugccuggucucug

SEQ ID NO: 263964 - RNA, 32 nt, Human
ugugggaccagcccugccaacuuccaucgugg

SEQ ID NO: 263965 - RNA, 32 nt, Human
ugugggacccuccaggugcacagugacaguca

SEQ ID NO: 263966 - RNA, 32 nt, Human
ugugggacccuugagaugcuuccacucugauu

SEQ ID NO: 263967 - RNA, 32 nt, Human
ugugggacggaggacccaggagacccagaauc

SEQ ID NO: 263968 - RNA, 32 nt, Human
ugugggacggcgugaaugugggguggaaggga

SEQ ID NO: 263969 - RNA, 24 nt, Human
ugugggacggggcugcuucucuac

SEQ ID NO: 263970 - RNA, 32 nt, Human
ugugggacucagaaagggaagcagaacugagg

SEQ ID NO: 263971 - RNA, 32 nt, Human
ugugggacugaggagagcagagcagagagcac

SEQ ID NO: 263972 - RNA, 18 nt, Human
ugugggagaagauuccag

SEQ ID NO: 263973 - RNA, 32 nt, Human
ugugggagaauccauuuccuggcucuggaggc

SEQ ID NO: 263974 - RNA, 32 nt, Human
ugugggagaccggccugccaggaggacccagg

SEQ ID NO: 263975 - RNA, 21 nt, Human
ugugggagagacuuauaggca

SEQ ID NO: 263976 - RNA, 32 nt, Human
ugugggagagaggcagaaaaaggagcagcucc

SEQ ID NO: 263977 - RNA, 32 nt, Human
ugugggagagcugaggucuagaaaggaggagu

SEQ ID NO: 263978 - RNA, 32 nt, Human
ugugggagaggucaccuuuaacacagcaacag

SEQ ID NO: 263979 - RNA, 32 nt, Human
ugugggagagguguggacagcaacuguggggg

SEQ ID NO: 263980 - RNA, 32 nt, Human
ugugggagaucuuacaagucaccccucauagg

SEQ ID NO: 263981 - RNA, 32 nt, Human
ugugggagcaggaagugaggcugcggcagcag

SEQ ID NO: 263982 - RNA, 32 nt, Human
ugugggagcagguggaggguggagaccuaaac

SEQ ID NO: 263983 - RNA, 32 nt, Human
ugugggagcccggggcccagacuccugcggcc

SEQ ID NO: 263984 - RNA, 32 nt, Human
ugugggagcgccuggcccucccucccuagccc

SEQ ID NO: 263985 - RNA, 32 nt, Human
ugugggaggaaugggggauuugggaggugaug

SEQ ID NO: 263986 - RNA, 32 nt, Human
ugugggaggagccagagagggaccuggcucug

SEQ ID NO: 263987 - RNA, 32 nt, Human
ugugggaggauguaaauaucuuguuucuccuc

SEQ ID NO: 263988 - RNA, 32 nt, Human
ugugggaggcagagagaggagcaggggccaug

SEQ ID NO: 263989 - RNA, 32 nt, Human
ugugggaggcggacagcagugaccaccucccc

SEQ ID NO: 263990 - RNA, 32 nt, Human
ugugggaggcggagguugcagugagucagauc

SEQ ID NO: 263991 - RNA, 32 nt, Human
ugugggaggcuaaggugggaggaucguuucag

SEQ ID NO: 263992 - RNA, 32 nt, Human
ugugggagggacccagugggagguaacugaau

SEQ ID NO: 263993 - RNA, 32 nt, Human
ugugggagggcagcgcacugacuggggccugg

SEQ ID NO: 263994 - RNA, 32 nt, Human
ugugggagggccugccccugcccccaccuccu

SEQ ID NO: 263995 - RNA, 32 nt, Human
ugugggagggccuguggauguccugaguggug

SEQ ID NO: 263996 - RNA, 32 nt, Human
ugugggagggcugggcuaggaauggccuugga

SEQ ID NO: 263997 - RNA, 32 nt, Human
ugugggagguuauguuuauuugagacuucucc

SEQ ID NO: 263998 - RNA, 32 nt, Human
ugugggagugcagagaaagaaagggaaacugg

SEQ ID NO: 263999 - RNA, 32 nt, Human
ugugggagugguggcauugagaagacuaccua

SEQ ID NO: 264000 - RNA, 32 nt, Human
ugugggauacagaaucaaagagccucaucuuu

SEQ ID NO: 264001 - RNA, 32 nt, Human
ugugggauccugcugugagcggcaccaguggg

SEQ ID NO: 264002 - RNA, 32 nt, Human
ugugggaugagcuccagcauggggugagguac

SEQ ID NO: 264003 - RNA, 32 nt, Human
ugugggauugggaagcgcaggagcuucaggac

SEQ ID NO: 264004 - RNA, 19 nt, Human
ugugggcaaagugccugcc

SEQ ID NO: 264005 - RNA, 32 nt, Human
ugugggcaacacagcaagaccccaucucuuaa

SEQ ID NO: 264006 - RNA, 22 nt, Human
ugugggcaacagugucucccgc

SEQ ID NO: 264007 - RNA, 32 nt, Human
ugugggcaacaucgaggagcuggcugcugaau

SEQ ID NO: 264008 - RNA, 22 nt, Human
ugugggcaaccaggcccugcau

SEQ ID NO: 264009 - RNA, 24 nt, Human
ugugggcaagagcuggcccuccau

SEQ ID NO: 264010 - RNA, 20 nt, Human
ugugggcaagcagccgccgc

SEQ ID NO: 264011 - RNA, 32 nt, Human
ugugggcaagggacaugaagccugaaguuuuu

SEQ ID NO: 264012 - RNA, 26 nt, Human
ugugggcaagggcucagccucucugc

SEQ ID NO: 264013 - RNA, 32 nt, Human
ugugggcacacaguugggucuuaggggaaaaa

SEQ ID NO: 264014 - RNA, 32 nt, Human
ugugggcacagcugugguuugggugcugagca

SEQ ID NO: 264015 - RNA, 32 nt, Human
ugugggcacaugggcacauacagacucacaua

SEQ ID NO: 264016 - RNA, 32 nt, Human
ugugggcaccugguggccaagccucaguuucc

SEQ ID NO: 264017 - RNA, 21 nt, Human
ugugggcacugacccugccac

SEQ ID NO: 264018 - RNA, 32 nt, Human
ugugggcagaacugaaagaucacugcagugga

SEQ ID NO: 264019 - RNA, 20 nt, Human
ugugggcagaaggaugggga

SEQ ID NO: 264020 - RNA, 21 nt, Human
ugugggcagagccugcccugc

SEQ ID NO: 264021 - RNA, 32 nt, Human
ugugggcagagggucugaaaggugggcuuugg

SEQ ID NO: 264022 - RNA, 19 nt, Human
ugugggcagcagcccccau

SEQ ID NO: 264023 - RNA, 32 nt, Human
ugugggcagccacagaugcccccaaaucagag

SEQ ID NO: 264024 - RNA, 32 nt, Human
ugugggcagccuggguuugcaggccugcacag

SEQ ID NO: 264025 - RNA, 32 nt, Human
ugugggcagcuucugaguggugacacagcaag

SEQ ID NO: 264026 - RNA, 32 nt, Human
ugugggcaggcaggcagggcauagcgacagug

SEQ ID NO: 264027 - RNA, 32 nt, Human
ugugggcagggcgcgcucucuccucugagcag

SEQ ID NO: 264028 - RNA, 22 nt, Human
ugugggcagggcugguuccucc

SEQ ID NO: 264029 - RNA, 23 nt, Human
ugugggcaggggcugcauuuuau

SEQ ID NO: 264030 - RNA, 32 nt, Human
ugugggcagguguggggguuggucuagcuaag

SEQ ID NO: 264031 - RNA, 32 nt, Human
ugugggcaguauucaggaagagcuacuucaaa

SEQ ID NO: 264032 - RNA, 32 nt, Human
ugugggcaucuucugcccaugggcuccauuug

SEQ ID NO: 264033 - RNA, 32 nt, Human
ugugggcaugagcugcugugcccagccuccau

SEQ ID NO: 264034 - RNA, 32 nt, Human
ugugggcauguuauucuuggugcugccugggg

SEQ ID NO: 264035 - RNA, 32 nt, Human
ugugggcauguuuacugccacuggccuagagg

SEQ ID NO: 264036 - RNA, 32 nt, Human
ugugggccacggucacugcgcccgcuugguuc

SEQ ID NO: 264037 - RNA, 32 nt, Human
ugugggccaugagacagaaagaaagacugaaa

SEQ ID NO: 264038 - RNA, 22 nt, Human
ugugggccaugcugucuuccau

SEQ ID NO: 264039 - RNA, 32 nt, Human
ugugggccaugguacauacugcauuugcauca

SEQ ID NO: 264040 - RNA, 32 nt, Human
ugugggcccaggacaggaggcugagaaggagc

SEQ ID NO: 264041 - RNA, 21 nt, Human
ugugggcccaggagauggaga

SEQ ID NO: 264042 - RNA, 32 nt, Human
ugugggcccggccuggccacagcggggaccag

SEQ ID NO: 264043 - RNA, 32 nt, Human
ugugggcccucugagcaacuuugcagcacccu

SEQ ID NO: 264044 - RNA, 28 nt, Human
ugugggccuaaauuugccucauucagac

SEQ ID NO: 264045 - RNA, 32 nt, Human
ugugggccucacaacucgugaccucagcuaug

SEQ ID NO: 264046 - RNA, 32 nt, Human
ugugggccucaguucuugcaguaguugugaau

SEQ ID NO: 264047 - RNA, 32 nt, Human
ugugggccucaguuuccccauuuuauaaaguu

SEQ ID NO: 264048 - RNA, 32 nt, Human
ugugggccucauucugccaaagcuggaccaag

SEQ ID NO: 264049 - RNA, 32 nt, Human
ugugggccugaagcaguuccacacugagcgcc

SEQ ID NO: 264050 - RNA, 32 nt, Human
ugugggccugcaacuuucuccauucccagcug

SEQ ID NO: 264051 - RNA, 32 nt, Human
ugugggccuguggccuuccuggcuguggcuac

SEQ ID NO: 264052 - RNA, 32 nt, Human
ugugggccuuucugucccaccccugucagcac

SEQ ID NO: 264053 - RNA, 18 nt, Human
ugugggcgaagcugcccu

SEQ ID NO: 264054 - RNA, 22 nt, Human
ugugggcgggccugucuuucac

SEQ ID NO: 264055 - RNA, 21 nt, Human
ugugggcgugagcuucuuuau

SEQ ID NO: 264056 - RNA, 32 nt, Human
ugugggcuagaggcugaccagcagcguuuauu

SEQ ID NO: 264057 - RNA, 32 nt, Human
ugugggcucaaaagcaucaucaugcccacgag

SEQ ID NO: 264058 - RNA, 32 nt, Human
ugugggcucacugcaaccucugccuuccaggu

SEQ ID NO: 264059 - RNA, 32 nt, Human
ugugggcucccagggcauaugucugcacgcug

SEQ ID NO: 264060 - RNA, 32 nt, Human
ugugggcucccugguccacuugcucagccccc

SEQ ID NO: 264061 - RNA, 23 nt, Human
ugugggcucgcguggggccugcg

SEQ ID NO: 264062 - RNA, 32 nt, Human
ugugggcucucuccaguaccagacucauuuca

SEQ ID NO: 264063 - RNA, 32 nt, Human
ugugggcucugcuucuccuccuggccucuguc

SEQ ID NO: 264064 - RNA, 24 nt, Human
ugugggcugaacugugcccuccac

SEQ ID NO: 264065 - RNA, 31 nt, Human
ugugggcugaagaacuaccuguuggguacug

SEQ ID NO: 264066 - RNA, 32 nt, Human
ugugggcugaagcacuagcuuuuugguagcua

SEQ ID NO: 264067 - RNA, 18 nt, Human
ugugggcugaccaggacc

SEQ ID NO: 264068 - RNA, 20 nt, Human
ugugggcugacugcccuccg

SEQ ID NO: 264069 - RNA, 32 nt, Human
ugugggcugagggcaucuccaaagcuggccug

SEQ ID NO: 264070 - RNA, 32 nt, Human
ugugggcugcagcugcucgagggacuccgccc

SEQ ID NO: 264071 - RNA, 32 nt, Human
ugugggcugcaugggggcaggguggggccucu

SEQ ID NO: 264072 - RNA, 32 nt, Human
ugugggcugcucccucuccgugcucugccugg

SEQ ID NO: 264073 - RNA, 32 nt, Human
ugugggcugggaaggaggaggaggacccugca

SEQ ID NO: 264074 - RNA, 32 nt, Human
ugugggcuguaagcaagcucaggcuagucucc

SEQ ID NO: 264075 - RNA, 32 nt, Human
ugugggcugugauaggagagggcagagcccau

SEQ ID NO: 264076 - RNA, 32 nt, Human
ugugggcuuccaggaacuggagccuggggagg

SEQ ID NO: 264077 - RNA, 32 nt, Human
ugugggcuuguguuuugucacugugaaggggg

SEQ ID NO: 264078 - RNA, 24 nt, Human
uguggggaaaaggaaagauggggg

SEQ ID NO: 264079 - RNA, 31 nt, Human
uguggggaaaaggaaagaugggggacacuuc

SEQ ID NO: 264080 - RNA, 19 nt, Human
uguggggaaaguauguaga

SEQ ID NO: 264081 - RNA, 32 nt, Human
uguggggaaagugggcuuugaacgggauccaa

SEQ ID NO: 264082 - RNA, 22 nt, Human
uguggggaagaaaagauagggg

SEQ ID NO: 264083 - RNA, 32 nt, Human
uguggggaagagauaggaaccagcaggauggc

SEQ ID NO: 264084 - RNA, 21 nt, Human
uguggggaagcaggaacggga

SEQ ID NO: 264085 - RNA, 32 nt, Human
uguggggaagcccauuccucugccaggcucua

SEQ ID NO: 264086 - RNA, 18 nt, Human
uguggggaagguaugggg

SEQ ID NO: 264087 - RNA, 32 nt, Human
uguggggacagagccacaucuugaaugugaga

SEQ ID NO: 264088 - RNA, 32 nt, Human
uguggggacuugggggacaguaaucaaguaau

SEQ ID NO: 264089 - RNA, 21 nt, Human
uguggggagaauggacaagga

SEQ ID NO: 264090 - RNA, 20 nt, Human
uguggggagacagguggaga

SEQ ID NO: 264091 - RNA, 30 nt, Human
uguggggagagccacagggccagguggaca

SEQ ID NO: 264092 - RNA, 32 nt, Human
uguggggagagggaaggaggaagucaguuauu

SEQ ID NO: 264093 - RNA, 32 nt, Human
uguggggagaggggaaggaucagggggccagg

SEQ ID NO: 264094 - RNA, 32 nt, Human
uguggggagaggguacuggggaggcagcggcu

SEQ ID NO: 264095 - RNA, 32 nt, Human
uguggggagagugagguugcuggagccacggc

SEQ ID NO: 264096 - RNA, 26 nt, Human
uguggggagaguggaagaggcaggga

SEQ ID NO: 264097 - RNA, 32 nt, Human
uguggggaggagagagaaugggguacuagcac

SEQ ID NO: 264098 - RNA, 23 nt, Human
uguggggaggagagagaugcaga

SEQ ID NO: 264099 - RNA, 32 nt, Human
uguggggaggaguggcuggggcugugcgcucc

SEQ ID NO: 264100 - RNA, 32 nt, Human
uguggggaggauggaggcaggagcuggucugg

SEQ ID NO: 264101 - RNA, 32 nt, Human
uguggggaggccguccucgggguggggugggg

SEQ ID NO: 264102 - RNA, 32 nt, Human
uguggggaggcugagggcgcuggucagagccc

SEQ ID NO: 264103 - RNA, 21 nt, Human
uguggggagggaaaaugagga

SEQ ID NO: 264104 - RNA, 18 nt, Human
uguggggaggggaggaga

SEQ ID NO: 264105 - RNA, 32 nt, Human
uguggggaggggcagaugacuugcagcuccgg

SEQ ID NO: 264106 - RNA, 32 nt, Human
uguggggaggggcaguguuagagcagggcugg

SEQ ID NO: 264107 - RNA, 22 nt, Human
uguggggaggugggacugagga

SEQ ID NO: 264108 - RNA, 20 nt, Human
uguggggagguggguggaga

SEQ ID NO: 264109 - RNA, 22 nt, Human
uguggggaucacugagaugagg

SEQ ID NO: 264110 - RNA, 32 nt, Human
uguggggauccuauaauaaaagugaaugacua

SEQ ID NO: 264111 - RNA, 32 nt, Human
uguggggaugaaauaagccccaguuucucaga

SEQ ID NO: 264112 - RNA, 18 nt, Human
uguggggaugaaaugggg

SEQ ID NO: 264113 - RNA, 32 nt, Human
uguggggaugggaagagagaguuggggaaaga

SEQ ID NO: 264114 - RNA, 20 nt, Human
uguggggauggugauggaga

SEQ ID NO: 264115 - RNA, 32 nt, Human
uguggggcaaggcagugagugaagaguuggga

SEQ ID NO: 264116 - RNA, 32 nt, Human
uguggggcaggcaccugguaccaaggguaacc

SEQ ID NO: 264117 - RNA, 32 nt, Human
uguggggcaggcaggauguggugcaggcaggu

SEQ ID NO: 264118 - RNA, 32 nt, Human
uguggggcagggcagugagugaagaguuggga

SEQ ID NO: 264119 - RNA, 21 nt, Human
uguggggccccagagagggga

SEQ ID NO: 264120 - RNA, 32 nt, Human
uguggggcgacagggucugucuuguucugucu

SEQ ID NO: 264121 - RNA, 31 nt, Human
uguggggcgggggucuauacauuccugagau

SEQ ID NO: 264122 - RNA, 32 nt, Human
uguggggcgggugggaugcacagagcacagcg

SEQ ID NO: 264123 - RNA, 32 nt, Human
uguggggcggugagcgccggcccagccugaug

SEQ ID NO: 264124 - RNA, 32 nt, Human
uguggggcucaagggggccucaccuggaggug

SEQ ID NO: 264125 - RNA, 31 nt, Human
uguggggcucagagcagaaccaaagcaugau

SEQ ID NO: 264126 - RNA, 32 nt, Human
uguggggcucauuuugccagggccaagcuacc

SEQ ID NO: 264127 - RNA, 32 nt, Human
uguggggcucugccaugaggaagucacagcag

SEQ ID NO: 264128 - RNA, 20 nt, Human
uguggggcuggagagauggg

SEQ ID NO: 264129 - RNA, 23 nt, Human
uguggggcuggagcugcucccac

SEQ ID NO: 264130 - RNA, 32 nt, Human
uguggggcuggccccuuuucucccucugagac

SEQ ID NO: 264131 - RNA, 32 nt, Human
ugugggggagagagugagggguugggggaucg

SEQ ID NO: 264132 - RNA, 32 nt, Human
ugugggggagaguucaggaucaggcugcuuga

SEQ ID NO: 264133 - RNA, 32 nt, Human
ugugggggagggagggagacgugaagccuauu

SEQ ID NO: 264134 - RNA, 32 nt, Human
ugugggggcaggggcuccuggcucagagccgu

SEQ ID NO: 264135 - RNA, 32 nt, Human
ugugggggcaguguccauccacaaaggggcag

SEQ ID NO: 264136 - RNA, 32 nt, Human
ugugggggcccgugggagggaggcagaccccu

SEQ ID NO: 264137 - RNA, 32 nt, Human
ugugggggcucacgccuguaaucccagcacuu

SEQ ID NO: 264138 - RNA, 32 nt, Human
ugugggggugacgguggccacugugaggagcu

SEQ ID NO: 264139 - RNA, 32 nt, Human
ugugggggugcaguguggaggaaggcacguga

SEQ ID NO: 264140 - RNA, 20 nt, Human
ugugggggugggaguggaga

SEQ ID NO: 264141 - RNA, 32 nt, Human
ugugggggugugagccgcggugcccaaggcug

SEQ ID NO: 264142 - RNA, 32 nt, Human
uguggggguuuccagcccugagguugaggaca

SEQ ID NO: 264143 - RNA, 32 nt, Human
uguggggucugaggaagccauuugagucuggc

SEQ ID NO: 264144 - RNA, 19 nt, Human
uguggggugggagugggga

SEQ ID NO: 264145 - RNA, 20 nt, Human
uguggggugggcagugggga

SEQ ID NO: 264146 - RNA, 22 nt, Human
ugugggguggggggagcgggga

SEQ ID NO: 264147 - RNA, 32 nt, Human
uguggggugggggugggagcagguguguguaa

SEQ ID NO: 264148 - RNA, 32 nt, Human
uguggggugggguauggggaggagaaccuuca

SEQ ID NO: 264149 - RNA, 32 nt, Human
uguggggugguauuuugcauugcaaggagacg

SEQ ID NO: 264150 - RNA, 32 nt, Human
ugugggguugauaccccaacucccucuacccu

SEQ ID NO: 264151 - RNA, 32 nt, Human
uguggguaaaauuucgcagaaugugauaagag

SEQ ID NO: 264152 - RNA, 32 nt, Human
uguggguaaccagcaggcaggccaaagacugg

SEQ ID NO: 264153 - RNA, 32 nt, Human
uguggguaagguaagguguaugugaaacaaau

SEQ ID NO: 264154 - RNA, 31 nt, Human
uguggguagaggaaagagugaucuggugucg

SEQ ID NO: 264155 - RNA, 32 nt, Human
uguggguauguauguguguauguauguauccg

SEQ ID NO: 264156 - RNA, 32 nt, Human
ugugggucccaggauggaggagccccaggccg

SEQ ID NO: 264157 - RNA, 32 nt, Human
uguggguccccuguaccuuucucccccaacag

SEQ ID NO: 264158 - RNA, 32 nt, Human
ugugggucucuccugcagagggugggggucuc

SEQ ID NO: 264159 - RNA, 19 nt, Human
ugugggugaagagagaggg

SEQ ID NO: 264160 - RNA, 32 nt, Human
ugugggugagagaagggacuagacuccuaagc

SEQ ID NO: 264161 - RNA, 32 nt, Human
ugugggugagcugggccuugucuagccccugc

SEQ ID NO: 264162 - RNA, 32 nt, Human
ugugggugaggguggccaugcuuauggccauc

SEQ ID NO: 264163 - RNA, 32 nt, Human
ugugggugccagaggccagcucucccccucca

SEQ ID NO: 264164 - RNA, 32 nt, Human
ugugggugcccuuuccugauuggcuggcucag

SEQ ID NO: 264165 - RNA, 32 nt, Human
ugugggugccuuaucagggcugggauacuucu

SEQ ID NO: 264166 - RNA, 32 nt, Human
uguggguggaagccucagaggccuugggagcu

SEQ ID NO: 264167 - RNA, 32 nt, Human
uguggguggagagaggagugaguuuguuuagg

SEQ ID NO: 264168 - RNA, 32 nt, Human
uguggguggaguggggacaagcgguggagaag

SEQ ID NO: 264169 - RNA, 32 nt, Human
uguggguggauggguggauugccuggguucca

SEQ ID NO: 264170 - RNA, 22 nt, Human
ugugggugggcaaggccagggc

SEQ ID NO: 264171 - RNA, 32 nt, Human
ugugggugggggagggagagggcaguuuguag

SEQ ID NO: 264172 - RNA, 32 nt, Human
ugugggugggguggagggugaaauucuugguc

SEQ ID NO: 264173 - RNA, 31 nt, Human
ugugggugggugggcugaauggggaggaaau

SEQ ID NO: 264174 - RNA, 32 nt, Human
ugugggugguucugagcuguuuggcuucaguu

SEQ ID NO: 264175 - RNA, 32 nt, Human
ugugggugguuuuaguggcauguaggacguga

SEQ ID NO: 264176 - RNA, 32 nt, Human
ugugggugucugcaggcccgaauggaagcccc

SEQ ID NO: 264177 - RNA, 29 nt, Human
ugugggugucuguuuggucaggauguuag

SEQ ID NO: 264178 - RNA, 32 nt, Human
ugugggugugagccaccgcgcucagucuuguu

SEQ ID NO: 264179 - RNA, 32 nt, Human
ugugggugugagccagccgcguggcccugggc

SEQ ID NO: 264180 - RNA, 32 nt, Human
uguggguguggcaguuacagggcccaggugag

SEQ ID NO: 264181 - RNA, 32 nt, Human
uguggguguguguggcugcacgugucacuggg

SEQ ID NO: 264182 - RNA, 19 nt, Human
uguggguguugccuuccau

SEQ ID NO: 264183 - RNA, 32 nt, Human
uguggguguuguugccuuccucugucugacag

SEQ ID NO: 264184 - RNA, 32 nt, Human
uguggguguuuccuccucugauuugcaucauu

SEQ ID NO: 264185 - RNA, 32 nt, Human
uguggguuaagaauaggcuagagcagacauug

SEQ ID NO: 264186 - RNA, 32 nt, Human
uguggguucgagguggaggcugcagcugaagg

SEQ ID NO: 264187 - RNA, 32 nt, Human
uguggguucugugucugucuguucaucccagg

SEQ ID NO: 264188 - RNA, 32 nt, Human
uguggguugaagcacuggacaaugccacauac

SEQ ID NO: 264189 - RNA, 32 nt, Human
uguggguugacuuucacccaucuggaguugcu

SEQ ID NO: 264190 - RNA, 20 nt, Human
uguggguugcaagaggggga

SEQ ID NO: 264191 - RNA, 23 nt, Human
uguggguuggacuuugaagcugg

SEQ ID NO: 264192 - RNA, 32 nt, Human
uguggguuuauuauaaggcggagcucggcggg

SEQ ID NO: 264193 - RNA, 32 nt, Human
uguggguuuggaaucuuggauuuucccccuuu

SEQ ID NO: 264194 - RNA, 29 nt, Human
uguggguuuguguguguggaugugguuuc

SEQ ID NO: 264195 - RNA, 32 nt, Human
ugugguaacacauaggaacugagggagaggac

SEQ ID NO: 264196 - RNA, 32 nt, Human
ugugguaacccaggaaccacagccaaugggaa

SEQ ID NO: 264197 - RNA, 32 nt, Human
ugugguaagcugggaguaucacucuggaagaa

SEQ ID NO: 264198 - RNA, 32 nt, Human
ugugguaauguucaccugcagucccagcuacu

SEQ ID NO: 264199 - RNA, 32 nt, Human
ugugguaauuuccuugccaguuucugagauau

SEQ ID NO: 264200 - RNA, 21 nt, Human
ugugguaauuuguuggcuuua

SEQ ID NO: 264201 - RNA, 32 nt, Human
ugugguacccuggcugcccaggccagugcugc

SEQ ID NO: 264202 - RNA, 32 nt, Human
ugugguacuaccuucaggcauuugguaacuca

SEQ ID NO: 264203 - RNA, 32 nt, Human
ugugguagagcuugguaaaagacugaauacau

SEQ ID NO: 264204 - RNA, 32 nt, Human
ugugguagcaggcacccguaaucccagcuacu

SEQ ID NO: 264205 - RNA, 32 nt, Human
ugugguagcaggcaccuguagucuuagcuacu

SEQ ID NO: 264206 - RNA, 32 nt, Human
ugugguagcccacgccucuaaucccagcacuu

SEQ ID NO: 264207 - RNA, 32 nt, Human
ugugguagccccagcaguucucagggugcuga

SEQ ID NO: 264208 - RNA, 32 nt, Human
ugugguagccucagaagcagagcuguuuggca

SEQ ID NO: 264209 - RNA, 32 nt, Human
ugugguagcgcacaccuguagucacagcuacu

SEQ ID NO: 264210 - RNA, 32 nt, Human
ugugguagcgcacaccuguggucccaacuacu

SEQ ID NO: 264211 - RNA, 32 nt, Human
ugugguagcucaagccuguaaucccagcacuu

SEQ ID NO: 264212 - RNA, 32 nt, Human
ugugguagcucacaccuauaaucccagcaccu

SEQ ID NO: 264213 - RNA, 32 nt, Human
ugugguagcucacaccuauaaucccagcacuu

SEQ ID NO: 264214 - RNA, 32 nt, Human
ugugguagcucacaccuguaauucccagcgcu

SEQ ID NO: 264215 - RNA, 32 nt, Human
ugugguagcucaugccuauaaucccaggacuu

SEQ ID NO: 264216 - RNA, 32 nt, Human
ugugguagcuuacaccuauaaucccagcacuu

SEQ ID NO: 264217 - RNA, 32 nt, Human
ugugguaggaguaggccaggagagugagcugu

SEQ ID NO: 264218 - RNA, 32 nt, Human
ugugguagggguuuuccagagugugggcauua

SEQ ID NO: 264219 - RNA, 32 nt, Human
ugugguagguggaucacuugaggucaggaguu

SEQ ID NO: 264220 - RNA, 32 nt, Human
ugugguaguuagcgggcaggagagcgacaucu

SEQ ID NO: 264221 - RNA, 32 nt, Human
ugugguaguucacaccuguaaucccagcacuu

SEQ ID NO: 264222 - RNA, 32 nt, Human
ugugguauaguauuaguggaaagugauuugua

SEQ ID NO: 264223 - RNA, 32 nt, Human
ugugguauauacuuucuccuacucuagcaaac

SEQ ID NO: 264224 - RNA, 32 nt, Human
ugugguaugggagggguuggaaaccaaguugu

SEQ ID NO: 264225 - RNA, 32 nt, Human
uguggucaaaaauauaaggauuuugaacuaau

SEQ ID NO: 264226 - RNA, 32 nt, Human
uguggucaaaaauauaaggauuuugaauuaau

SEQ ID NO: 264227 - RNA, 32 nt, Human
uguggucaaaacugagccucacugaaacaauu

SEQ ID NO: 264228 - RNA, 32 nt, Human
uguggucaaaggacaggcgaggagcugugggc

SEQ ID NO: 264229 - RNA, 32 nt, Human
uguggucaacgaauacuacuacaggaagaagu

SEQ ID NO: 264230 - RNA, 32 nt, Human
uguggucaagaguucaagaccagccuggccau

SEQ ID NO: 264231 - RNA, 32 nt, Human
uguggucacaaaccuucuuggucaccaccucu

SEQ ID NO: 264232 - RNA, 32 nt, Human
uguggucacaccacuguauuccagccugggug

SEQ ID NO: 264233 - RNA, 32 nt, Human
uguggucacagcccuuccuggaggcaugagga

SEQ ID NO: 264234 - RNA, 31 nt, Human
uguggucacagcugccagguaccuaagcaag

SEQ ID NO: 264235 - RNA, 32 nt, Human
uguggucacaugcuuuagccauacacauggua

SEQ ID NO: 264236 - RNA, 32 nt, Human
uguggucacuugaggaggcgagucuagcagau

SEQ ID NO: 264237 - RNA, 22 nt, Human
uguggucagacuugcucucuau

SEQ ID NO: 264238 - RNA, 32 nt, Human
uguggucagagccacagucaggggccuucuga

SEQ ID NO: 264239 - RNA, 32 nt, Human
uguggucagcugucugcuuuccuugcucagca

SEQ ID NO: 264240 - RNA, 32 nt, Human
uguggucauggugagaaaacuaaaacuacaug

SEQ ID NO: 264241 - RNA, 32 nt, Human
uguggucaugucccacagcaagcuuuugggau

SEQ ID NO: 264242 - RNA, 32 nt, Human
ugugguccagccagcgcucuuuccagcuguaa

SEQ ID NO: 264243 - RNA, 24 nt, Human
ugugguccaggcaggagugcagug

SEQ ID NO: 264244 - RNA, 32 nt, Human
uguggucccaggagaaggucugggggucacua

SEQ ID NO: 264245 - RNA, 32 nt, Human
ugugguccccucacucagucucucauuuggua

SEQ ID NO: 264246 - RNA, 32 nt, Human
uguggucccgguuacucaggaggcugaggcag

SEQ ID NO: 264247 - RNA, 32 nt, Human
uguggucccucauugaccaaaacaucauuaug

SEQ ID NO: 264248 - RNA, 32 nt, Human
ugugguccggcagugcuaccaugguaauggac

SEQ ID NO: 264249 - RNA, 32 nt, Human
ugugguccuagccacuagaggcugagguggga

SEQ ID NO: 264250 - RNA, 32 nt, Human
ugugguccuagccucuuggagggcugaggugg

SEQ ID NO: 264251 - RNA, 32 nt, Human
uguggucggugcccugcuuccuccuccacucc

SEQ ID NO: 264252 - RNA, 32 nt, Human
uguggucuacuuuccaauugguugucuggcca

SEQ ID NO: 264253 - RNA, 21 nt, Human
uguggucucaagagauggggg

SEQ ID NO: 264254 - RNA, 32 nt, Human
uguggucuccauccugacucuugaacuuaccc

SEQ ID NO: 264255 - RNA, 32 nt, Human
uguggucugcaggcccuggacccgcuggccag

SEQ ID NO: 264256 - RNA, 32 nt, Human
uguggucugucccggcuucacggccugacacg

SEQ ID NO: 264257 - RNA, 32 nt, Human
uguggucuguccucacaugugcacugguaaca

SEQ ID NO: 264258 - RNA, 32 nt, Human
uguggucuuccuugcuugacccucucuacucu

SEQ ID NO: 264259 - RNA, 32 nt, Human
uguggugaauaugcaggaaucauucaugagac

SEQ ID NO: 264260 - RNA, 32 nt, Human
uguggugacguacaccuguaauuccagcuacu

SEQ ID NO: 264261 - RNA, 32 nt, Human
uguggugacucacaccuauaaucccaauacuu

SEQ ID NO: 264262 - RNA, 32 nt, Human
uguggugacucacacuuguaaucccagcaauu

SEQ ID NO: 264263 - RNA, 32 nt, Human
uguggugacucacagccguaaucccagcuacu

SEQ ID NO: 264264 - RNA, 32 nt, Human
uguggugacucaugccuguaauccuaguacuu

SEQ ID NO: 264265 - RNA, 32 nt, Human
uguggugacugagguacaggaaacuacuaauc

SEQ ID NO: 264266 - RNA, 32 nt, Human
uguggugagaaaccucacuguccaugguuaac

SEQ ID NO: 264267 - RNA, 32 nt, Human
uguggugagccccaucauucugcaccucaacu

SEQ ID NO: 264268 - RNA, 32 nt, Human
uguggugaggccaccaggcugaagucagcuca

SEQ ID NO: 264269 - RNA, 32 nt, Human
uguggugagguuggcagagaauauacgauggg

SEQ ID NO: 264270 - RNA, 32 nt, Human
uguggugaugcugucugucugucugagucucg

SEQ ID NO: 264271 - RNA, 32 nt, Human
uguggugauucucaguggcucaucuaauauuu

SEQ ID NO: 264272 - RNA, 32 nt, Human
uguggugcacgugucuccaccuccaaggagag

SEQ ID NO: 264273 - RNA, 32 nt, Human
uguggugcagcccugcuccagccuuggccucu

SEQ ID NO: 264274 - RNA, 32 nt, Human
uguggugcaguaagccaagaucacgccacugc

SEQ ID NO: 264275 - RNA, 32 nt, Human
uguggugcaguuggagaccgaggccccgcgca

SEQ ID NO: 264276 - RNA, 32 nt, Human
uguggugcaugcuguugaguccaacccaaagg

SEQ ID NO: 264277 - RNA, 32 nt, Human
uguggugccacaugccuguaauuccagcuacu

SEQ ID NO: 264278 - RNA, 32 nt, Human
uguggugccagagaaaaguagccagagcggcg

SEQ ID NO: 264279 - RNA, 32 nt, Human
uguggugcccccuccagggcucuggaggaugg

SEQ ID NO: 264280 - RNA, 32 nt, Human
uguggugccgcaugccuguaaucccagcuacu

SEQ ID NO: 264281 - RNA, 32 nt, Human
uguggugccgcgugccuguaaucccagcuacu

SEQ ID NO: 264282 - RNA, 32 nt, Human
uguggugccucacaccuguaaucucagcacuu

SEQ ID NO: 264283 - RNA, 32 nt, Human
uguggugcuaggugaguaugagaagaugucaa

SEQ ID NO: 264284 - RNA, 32 nt, Human
uguggugcuguggaaggagcacuggacuaaag

SEQ ID NO: 264285 - RNA, 32 nt, Human
uguggugcuguggcuggccacgugucaggguu

SEQ ID NO: 264286 - RNA, 32 nt, Human
ugugguggaagcuggaccagaggccgggaggc

SEQ ID NO: 264287 - RNA, 32 nt, Human
ugugguggagccaccaccaaaaugcagauuuu

SEQ ID NO: 264288 - RNA, 32 nt, Human
ugugguggagccagcagaaccacaggagagug

SEQ ID NO: 264289 - RNA, 32 nt, Human
ugugguggagggcgccuguaaucccagcuaau

SEQ ID NO: 264290 - RNA, 32 nt, Human
ugugguggagucuugcugucuccccggcugga

SEQ ID NO: 264291 - RNA, 32 nt, Human
ugugguggaucacaccugcaaucccagcacuu

SEQ ID NO: 264292 - RNA, 31 nt, Human
ugugguggcacaaucucggcucacugcaacc

SEQ ID NO: 264293 - RNA, 32 nt, Human
ugugguggcacacaccaguaaucccagcuacu

SEQ ID NO: 264294 - RNA, 32 nt, Human
ugugguggcacacaccaguaauccuggcuacu

SEQ ID NO: 264295 - RNA, 32 nt, Human
ugugguggcacacaccuguaaucccagcuacu

SEQ ID NO: 264296 - RNA, 32 nt, Human
ugugguggcacacaccuguaaucccaguuacu

SEQ ID NO: 264297 - RNA, 32 nt, Human
ugugguggcacacaccuguagucccagcuacu

SEQ ID NO: 264298 - RNA, 32 nt, Human
ugugguggcacacaccuguagucccagcuagu

SEQ ID NO: 264299 - RNA, 32 nt, Human
ugugguggcacacaccuguagucccagguacu

SEQ ID NO: 264300 - RNA, 32 nt, Human
ugugguggcacacaccuguaguuccagcuacu

SEQ ID NO: 264301 - RNA, 32 nt, Human
ugugguggcacacaccuguguguccagaauug

SEQ ID NO: 264302 - RNA, 32 nt, Human
ugugguggcacacgccuguaaucccagcuacu

SEQ ID NO: 264303 - RNA, 32 nt, Human
ugugguggcacaugccuauaaucccagcuacu

SEQ ID NO: 264304 - RNA, 20 nt, Human
ugugguggcacaugccugua

SEQ ID NO: 264305 - RNA, 32 nt, Human
ugugguggcacaugccuguaauaucagcuacu

SEQ ID NO: 264306 - RNA, 32 nt, Human
ugugguggcacaugccuguaaucccagcuacu

SEQ ID NO: 264307 - RNA, 32 nt, Human
ugugguggcacaugccuguaaucccagcugcu

SEQ ID NO: 264308 - RNA, 32 nt, Human
ugugguggcacaugccuguaaucccaguuagu

SEQ ID NO: 264309 - RNA, 32 nt, Human
ugugguggcacaugccuguaaucgcagcuacu

SEQ ID NO: 264310 - RNA, 32 nt, Human
ugugguggcacgcaccuguaaucccagcugcu

SEQ ID NO: 264311 - RNA, 32 nt, Human
ugugguggcacgcaccuguagucccaacuacu

SEQ ID NO: 264312 - RNA, 32 nt, Human
ugugguggcacgcaccuguagucccagcuacu

SEQ ID NO: 264313 - RNA, 32 nt, Human
ugugguggcacgcgccuguaaucccagcuacu

SEQ ID NO: 264314 - RNA, 32 nt, Human
ugugguggcacgugccuguaaucucagcaacu

SEQ ID NO: 264315 - RNA, 32 nt, Human
ugugguggcacuucucuguaaucucagcuucu

SEQ ID NO: 264316 - RNA, 32 nt, Human
ugugguggcagacaccuguggucccagcuauu

SEQ ID NO: 264317 - RNA, 32 nt, Human
ugugguggcagaggccuguaaucccaguuccu

SEQ ID NO: 264318 - RNA, 32 nt, Human
ugugguggcaggagccuguaaucccagcuaca

SEQ ID NO: 264319 - RNA, 32 nt, Human
ugugguggcaggagccuguaauccuagcuacu

SEQ ID NO: 264320 - RNA, 32 nt, Human
ugugguggcaggcaccugcaaucccagcuaca

SEQ ID NO: 264321 - RNA, 32 nt, Human
ugugguggcaggcaccuguaaucccagcuacu

SEQ ID NO: 264322 - RNA, 32 nt, Human
ugugguggcaggcaccuguagucccagcuacc

SEQ ID NO: 264323 - RNA, 32 nt, Human
ugugguggcaggccccuguaaucccagcuaau

SEQ ID NO: 264324 - RNA, 32 nt, Human
ugugguggcaggcgccugaaaucccagcuacu

SEQ ID NO: 264325 - RNA, 32 nt, Human
ugugguggcaggcuucuguaaucccagcuacu

SEQ ID NO: 264326 - RNA, 32 nt, Human
ugugguggcaggugccuguaaucccagcuacu

SEQ ID NO: 264327 - RNA, 32 nt, Human
ugugguggcagucaccuguagucccagcuacu

SEQ ID NO: 264328 - RNA, 32 nt, Human
ugugguggcauacaccuguagucccagcuacu

SEQ ID NO: 264329 - RNA, 32 nt, Human
ugugguggcauacgccuguaaucccagcuacu

SEQ ID NO: 264330 - RNA, 32 nt, Human
ugugguggcauaggccuguaaucguagcgcuu

SEQ ID NO: 264331 - RNA, 32 nt, Human
ugugguggcaugcaccuguagucccagcuacu

SEQ ID NO: 264332 - RNA, 32 nt, Human
ugugguggcaugcaccuguagucccagcuauu

SEQ ID NO: 264333 - RNA, 32 nt, Human
ugugguggcaugcgccuguaaucccggcuacu

SEQ ID NO: 264334 - RNA, 32 nt, Human
ugugguggcauucaaccacuugugaaccuccu

SEQ ID NO: 264335 - RNA, 32 nt, Human
ugugguggcccacgccuguaaucccagcacuu

SEQ ID NO: 264336 - RNA, 32 nt, Human
ugugguggcccaggaggcggcaggacggccaa

SEQ ID NO: 264337 - RNA, 32 nt, Human
ugugguggccucuccaggcccagaacuuccuc

SEQ ID NO: 264338 - RNA, 32 nt, Human
ugugguggccugggacaagccuggacuucuga

SEQ ID NO: 264339 - RNA, 32 nt, Human
ugugguggcgagcaccuguaaugucagcuacu

SEQ ID NO: 264340 - RNA, 32 nt, Human
ugugguggcgcaagccuguaaucccagcuauu

SEQ ID NO: 264341 - RNA, 20 nt, Human
ugugguggcgcacaccugua

SEQ ID NO: 264342 - RNA, 32 nt, Human
ugugguggcgcacaccuguaaucccagcuacu

SEQ ID NO: 264343 - RNA, 32 nt, Human
ugugguggcgcacaccuguaguagucccagcu

SEQ ID NO: 264344 - RNA, 32 nt, Human
ugugguggcgcacgccuguaaucccagcuacu

SEQ ID NO: 264345 - RNA, 32 nt, Human
ugugguggcgcaugccuguaaucccaacuacu

SEQ ID NO: 264346 - RNA, 32 nt, Human
ugugguggcgcaugccuguaaucccagcuacu

SEQ ID NO: 264347 - RNA, 32 nt, Human
ugugguggcgcaugccuguaaucccagcugcu

SEQ ID NO: 264348 - RNA, 32 nt, Human
ugugguggcgcaugccuguaauccuagcuacu

SEQ ID NO: 264349 - RNA, 32 nt, Human
ugugguggcgcaugucuguaaucccagcuacu

SEQ ID NO: 264350 - RNA, 32 nt, Human
ugugguggcgcgugccuauaaucccagcuacu

SEQ ID NO: 264351 - RNA, 32 nt, Human
ugugguggcgcgugccuguaaucccagcuacu

SEQ ID NO: 264352 - RNA, 32 nt, Human
ugugguggcgcgugccuguaauccuagcuacu

SEQ ID NO: 264353 - RNA, 32 nt, Human
ugugguggcgcgugcuuguaaucccagcuacu

SEQ ID NO: 264354 - RNA, 32 nt, Human
ugugguggcgggcaccuguaaucccagcuacu

SEQ ID NO: 264355 - RNA, 32 nt, Human
ugugguggcgggcaccuguaauccuggcuacu

SEQ ID NO: 264356 - RNA, 32 nt, Human
ugugguggcgggcaccuguagucccagcuacu

SEQ ID NO: 264357 - RNA, 32 nt, Human
ugugguggcgggcaccuguagucccagguacu

SEQ ID NO: 264358 - RNA, 32 nt, Human
ugugguggcgggcaccuguagucgcagccuuu

SEQ ID NO: 264359 - RNA, 32 nt, Human
ugugguggcgggcgcccguaaucccagcuacu

SEQ ID NO: 264360 - RNA, 32 nt, Human
ugugguggcgggcgccuguaaucccagcuacu

SEQ ID NO: 264361 - RNA, 32 nt, Human
ugugguggcgggugccuguaaucccagauagu

SEQ ID NO: 264362 - RNA, 32 nt, Human
ugugguggcgggugccuguaaucccagcuacu

SEQ ID NO: 264363 - RNA, 32 nt, Human
ugugguggcgugcgccuguaaucccagcuacu

SEQ ID NO: 264364 - RNA, 32 nt, Human
ugugguggcgugugccuguaaucccagcuacu

SEQ ID NO: 264365 - RNA, 32 nt, Human
ugugguggcucaagccuguaaucccagcacuu

SEQ ID NO: 264366 - RNA, 32 nt, Human
ugugguggcucacacccagcacuuugggaggc

SEQ ID NO: 264367 - RNA, 32 nt, Human
ugugguggcucacacccauaaucccaacacuu

SEQ ID NO: 264368 - RNA, 32 nt, Human
ugugguggcucacaccugcaaucccagcacuu

SEQ ID NO: 264369 - RNA, 32 nt, Human
ugugguggcucacaccuguaaccccagcacuu

SEQ ID NO: 264370 - RNA, 32 nt, Human
ugugguggcucacaccuguaaucccaaaaccu

SEQ ID NO: 264371 - RNA, 32 nt, Human
ugugguggcucacaccuguaaucccaacacuu

SEQ ID NO: 264372 - RNA, 32 nt, Human
ugugguggcucacaccuguaaucccagcaauu

SEQ ID NO: 264373 - RNA, 32 nt, Human
ugugguggcucacaccuguaaucccagcacuu

SEQ ID NO: 264374 - RNA, 32 nt, Human
ugugguggcucacaccuguaaucccagcuacu

SEQ ID NO: 264375 - RNA, 32 nt, Human
ugugguggcucacaccuguaauccuaacacuu

SEQ ID NO: 264376 - RNA, 32 nt, Human
ugugguggcucacaccuguaaucucggcacuu

SEQ ID NO: 264377 - RNA, 32 nt, Human
ugugguggcucacaccuguaauugcagcacuc

SEQ ID NO: 264378 - RNA, 32 nt, Human
ugugguggcucacaccuguauucccagcacuu

SEQ ID NO: 264379 - RNA, 32 nt, Human
ugugguggcucacaccugugaucccagcacuu

SEQ ID NO: 264380 - RNA, 32 nt, Human
ugugguggcucacacuuguaaucccagcacuu

SEQ ID NO: 264381 - RNA, 32 nt, Human
ugugguggcucacaucuguaaucccagcacuu

SEQ ID NO: 264382 - RNA, 32 nt, Human
ugugguggcucacgcauguaaucccagcacuc

SEQ ID NO: 264383 - RNA, 32 nt, Human
ugugguggcucacgccgguaaucccagcauuu

SEQ ID NO: 264384 - RNA, 32 nt, Human
ugugguggcucacgccuauaaucccagcacuu

SEQ ID NO: 264385 - RNA, 32 nt, Human
ugugguggcucacgccuguaaucccaacacuu

SEQ ID NO: 264386 - RNA, 32 nt, Human
ugugguggcucacgccuguaaucccagcacuu

SEQ ID NO: 264387 - RNA, 32 nt, Human
ugugguggcucacgccuguaaucccagcucuu

SEQ ID NO: 264388 - RNA, 32 nt, Human
ugugguggcucacgccuguaaucccuacacuu

SEQ ID NO: 264389 - RNA, 32 nt, Human
ugugguggcucacgccuguaaucccugcauuu

SEQ ID NO: 264390 - RNA, 32 nt, Human
ugugguggcucacgccuguaauccuagcacuu

SEQ ID NO: 264391 - RNA, 32 nt, Human
ugugguggcucacgccuguaaucgcggcacuu

SEQ ID NO: 264392 - RNA, 32 nt, Human
ugugguggcucacgccuguaauucuagcacuu

SEQ ID NO: 264393 - RNA, 32 nt, Human
ugugguggcucacgucuguaaucccagcaguu

SEQ ID NO: 264394 - RNA, 32 nt, Human
ugugguggcucacuccuguaaucccggcacuu

SEQ ID NO: 264395 - RNA, 32 nt, Human
ugugguggcucaggccuguaaucccaacacuu

SEQ ID NO: 264396 - RNA, 32 nt, Human
ugugguggcucaggccuguaaucccagcacuu

SEQ ID NO: 264397 - RNA, 32 nt, Human
ugugguggcucaggccuguaauccuggcacuu

SEQ ID NO: 264398 - RNA, 32 nt, Human
ugugguggcucauaccuguaaaucccagcacu

SEQ ID NO: 264399 - RNA, 32 nt, Human
ugugguggcucauaccuguaaucccagcacuu

SEQ ID NO: 264400 - RNA, 18 nt, Human
ugugguggcucauaugua

SEQ ID NO: 264401 - RNA, 32 nt, Human
ugugguggcucaugcauguaaucccagcacuu

SEQ ID NO: 264402 - RNA, 32 nt, Human
ugugguggcucaugccuauaaucccagcacuu

SEQ ID NO: 264403 - RNA, 32 nt, Human
ugugguggcucaugccugcaaucccagcacug

SEQ ID NO: 264404 - RNA, 20 nt, Human
ugugguggcucaugccugua

SEQ ID NO: 264405 - RNA, 32 nt, Human
ugugguggcucaugccuguaauagcagcuacu

SEQ ID NO: 264406 - RNA, 32 nt, Human
ugugguggcucaugccuguaaucccaacauuc

SEQ ID NO: 264407 - RNA, 32 nt, Human
ugugguggcucaugccuguaaucccaacucuu

SEQ ID NO: 264408 - RNA, 32 nt, Human
ugugguggcucaugccuguaaucccagcaauu

SEQ ID NO: 264409 - RNA, 32 nt, Human
ugugguggcucaugccuguaaucccagcacuc

SEQ ID NO: 264410 - RNA, 32 nt, Human
ugugguggcucaugccuguaaucccagcacug

SEQ ID NO: 264411 - RNA, 32 nt, Human
ugugguggcucaugccuguaaucccagcacuu

SEQ ID NO: 264412 - RNA, 32 nt, Human
ugugguggcucaugccuguaaucccgacacuu

SEQ ID NO: 264413 - RNA, 32 nt, Human
ugugguggcucaugccuguaauccuagcacuu

SEQ ID NO: 264414 - RNA, 32 nt, Human
ugugguggcucaugccuguaaucucagcuacu

SEQ ID NO: 264415 - RNA, 32 nt, Human
ugugguggcucaugccuguaauuccagcacuu

SEQ ID NO: 264416 - RNA, 32 nt, Human
ugugguggcucccaccuauaaucccagcaguu

SEQ ID NO: 264417 - RNA, 32 nt, Human
ugugguggcuccgaccuguaaucccagcacgu

SEQ ID NO: 264418 - RNA, 32 nt, Human
ugugguggcucguaucuguaaucccagcacuu

SEQ ID NO: 264419 - RNA, 32 nt, Human
ugugguggcugacaccuguaaucccagcacuu

SEQ ID NO: 264420 - RNA, 32 nt, Human
ugugguggcugcuccaugagggugggggugau

SEQ ID NO: 264421 - RNA, 32 nt, Human
ugugguggcuuacaccuguaaucccaacacuu

SEQ ID NO: 264422 - RNA, 32 nt, Human
ugugguggcuuacaccuguaauccuaguacuu

SEQ ID NO: 264423 - RNA, 32 nt, Human
ugugguggcuuaccccuguaaucccagcacuu

SEQ ID NO: 264424 - RNA, 32 nt, Human
ugugguggcuuacgccuguaaucccagcagug

SEQ ID NO: 264425 - RNA, 32 nt, Human
ugugguggcuuaugccuguaaucccacuuugg

SEQ ID NO: 264426 - RNA, 32 nt, Human
ugugguggcuuaugccuguaauccuagaacuu

SEQ ID NO: 264427 - RNA, 32 nt, Human
ugugguggcuuaugccuguaauccuagcgcuu

SEQ ID NO: 264428 - RNA, 32 nt, Human
ugugguggcuuaugcuuguaaucccagaacuu

SEQ ID NO: 264429 - RNA, 32 nt, Human
ugugguggcuucaguccugccccugcaccuga

SEQ ID NO: 264430 - RNA, 32 nt, Human
ugugguggcuuccguuuguugguggaggaggu

SEQ ID NO: 264431 - RNA, 32 nt, Human
ugugguggcuucugccugaaaucccaguacuc

SEQ ID NO: 264432 - RNA, 32 nt, Human
ugugguggcuuguacccguaaucccagcacuu

SEQ ID NO: 264433 - RNA, 32 nt, Human
ugugguggcuuuaaucccagcacuuugggaac

SEQ ID NO: 264434 - RNA, 32 nt, Human
uguggugggacccccuuuagcgggacucagug

SEQ ID NO: 264435 - RNA, 32 nt, Human
uguggugggaggaggagguucgggugcugggu

SEQ ID NO: 264436 - RNA, 32 nt, Human
uguggugggaggauugcuuaagcccaggagcu

SEQ ID NO: 264437 - RNA, 32 nt, Human
uguggugggaggauugcuugaguccaggaggu

SEQ ID NO: 264438 - RNA, 32 nt, Human
uguggugggcgccggcccugcccgaggcccag

SEQ ID NO: 264439 - RNA, 32 nt, Human
uguggugggcggagcucccagucgcauggagc

SEQ ID NO: 264440 - RNA, 32 nt, Human
uguggugggggccuccuguaaucccagcuacu

SEQ ID NO: 264441 - RNA, 32 nt, Human
ugugguggggugcaccuguagucccagcuacu

SEQ ID NO: 264442 - RNA, 32 nt, Human
ugugguggggugcgcuuguaaucccagcuacu

SEQ ID NO: 264443 - RNA, 32 nt, Human
uguggugggucacaucuguaaucucagcucuu

SEQ ID NO: 264444 - RNA, 32 nt, Human
uguggugggugacauauguaaucccagcacuu

SEQ ID NO: 264445 - RNA, 32 nt, Human
ugugguggguuacaccuguaaucccagcacuu

SEQ ID NO: 264446 - RNA, 32 nt, Human
ugugguggguugucugugugcauauguccugc

SEQ ID NO: 264447 - RNA, 32 nt, Human
uguggugguacacgccuauaaucccagcuacu

SEQ ID NO: 264448 - RNA, 32 nt, Human
uguggugguaggcaccuguaauccagguaugu

SEQ ID NO: 264449 - RNA, 32 nt, Human
uguggugguaggcaccuguaaucccagcuacu

SEQ ID NO: 264450 - RNA, 32 nt, Human
uguggugguaugcaccuguagucccggcuacu

SEQ ID NO: 264451 - RNA, 32 nt, Human
ugugguggugagcaccuguaauccuagcuacu

SEQ ID NO: 264452 - RNA, 32 nt, Human
ugugguggugagugccuguaaucccagcuacu

SEQ ID NO: 264453 - RNA, 32 nt, Human
ugugguggugcacaccuguaaucccagcuacu

SEQ ID NO: 264454 - RNA, 32 nt, Human
ugugguggugcacaccuguagucccaacuauu

SEQ ID NO: 264455 - RNA, 32 nt, Human
ugugguggugcacaccuguagucccagcuacu

SEQ ID NO: 264456 - RNA, 32 nt, Human
ugugguggugcacaccuguagucccagguacu

SEQ ID NO: 264457 - RNA, 32 nt, Human
ugugguggugcacaccuguagucucaacuauu

SEQ ID NO: 264458 - RNA, 32 nt, Human
ugugguggugcacaccugugaucccagcuacu

SEQ ID NO: 264459 - RNA, 32 nt, Human
ugugguggugcacaccuguuauccuagcuacu

SEQ ID NO: 264460 - RNA, 32 nt, Human
ugugguggugcacacguauaaucccagcuacu

SEQ ID NO: 264461 - RNA, 32 nt, Human
ugugguggugcacaucuauaaucccaguuacc

SEQ ID NO: 264462 - RNA, 32 nt, Human
ugugguggugcacgccuguaaucccagcuacu

SEQ ID NO: 264463 - RNA, 32 nt, Human
ugugguggugcacgccuguaaucccagcuccu

SEQ ID NO: 264464 - RNA, 32 nt, Human
ugugguggugcacgccuguaauccccagauac

SEQ ID NO: 264465 - RNA, 32 nt, Human
ugugguggugcacuccuguaaucccagcuacu

SEQ ID NO: 264466 - RNA, 32 nt, Human
ugugguggugcaugccuguaaucccagcuacc

SEQ ID NO: 264467 - RNA, 32 nt, Human
ugugguggugcaugccuguaaucccagcuacu

SEQ ID NO: 264468 - RNA, 32 nt, Human
ugugguggugcaugccuguaaucccagcuucu

SEQ ID NO: 264469 - RNA, 32 nt, Human
ugugguggugcaugcuuguaaucccagcuacu

SEQ ID NO: 264470 - RNA, 32 nt, Human
ugugguggugcgcaccuguaaucccagccacu

SEQ ID NO: 264471 - RNA, 32 nt, Human
ugugguggugggcacauguaaucccagcuacu

SEQ ID NO: 264472 - RNA, 32 nt, Human
ugugguggugggcaccuguaaucccaccuacu

SEQ ID NO: 264473 - RNA, 32 nt, Human
ugugguggugggcaccuguaaucccagauacu

SEQ ID NO: 264474 - RNA, 32 nt, Human
ugugguggugggcaccuguaaucccagcuacu

SEQ ID NO: 264475 - RNA, 32 nt, Human
ugugguggugggcaccuguagucccagcuacu

SEQ ID NO: 264476 - RNA, 32 nt, Human
ugugguggugggcaccuguagucucagcuacu

SEQ ID NO: 264477 - RNA, 32 nt, Human
ugugguggugggcgccuguaauuccagcuacu

SEQ ID NO: 264478 - RNA, 32 nt, Human
ugugguggugggcggcuauaaucccagccacu

SEQ ID NO: 264479 - RNA, 32 nt, Human
ugugguggugggugccuguaaucccagcuaca

SEQ ID NO: 264480 - RNA, 32 nt, Human
ugugguggugggugccuguaaucccagcuacu

SEQ ID NO: 264481 - RNA, 32 nt, Human
ugugguggugggugccuguaaucucagcuacu

SEQ ID NO: 264482 - RNA, 32 nt, Human
ugugguggugugcaccuguaaucccagcuacu

SEQ ID NO: 264483 - RNA, 32 nt, Human
ugugguggugugcaccuguagucacagcuacu

SEQ ID NO: 264484 - RNA, 32 nt, Human
ugugguggugugcaccuguagucccagcuacu

SEQ ID NO: 264485 - RNA, 32 nt, Human
ugugguggugugcaccuguagucccagcuauu

SEQ ID NO: 264486 - RNA, 32 nt, Human
ugugguggugugcaccuguaguucuagcuacu

SEQ ID NO: 264487 - RNA, 32 nt, Human
ugugguggugugcgccuauaaucccagcuacu

SEQ ID NO: 264488 - RNA, 32 nt, Human
ugugguggugugugccuauaaucccagcuacu

SEQ ID NO: 264489 - RNA, 32 nt, Human
ugugguggugugugccuguaauuccagcuacu

SEQ ID NO: 264490 - RNA, 32 nt, Human
uguggugguguucaccuuuaaucccagcuacu

SEQ ID NO: 264491 - RNA, 32 nt, Human
uguggugguucacaccuguaauccaagcacuu

SEQ ID NO: 264492 - RNA, 32 nt, Human
uguggugucacgcgccuguaaucccagcuacu

SEQ ID NO: 264493 - RNA, 32 nt, Human
uguggugucaugagccauucuccauguccccu

SEQ ID NO: 264494 - RNA, 32 nt, Human
uguggugucgggcaccuguagucccagcuacu

SEQ ID NO: 264495 - RNA, 32 nt, Human
uguggugugaaaggguaggagagaugcuggag

SEQ ID NO: 264496 - RNA, 32 nt, Human
uguggugugagugacuuccugcaccaucaucu

SEQ ID NO: 264497 - RNA, 32 nt, Human
uguggugugaugcugugucuguauauucuaua

SEQ ID NO: 264498 - RNA, 21 nt, Human
uguggugugcagaggugggga

SEQ ID NO: 264499 - RNA, 32 nt, Human
uguggugugcucuccagcucuucaccuuccuc

SEQ ID NO: 264500 - RNA, 32 nt, Human
uguggugugcugcuguccacagauaaaccagu

SEQ ID NO: 264501 - RNA, 32 nt, Human
ugugguguggagggagugagccagcagcuuaa

SEQ ID NO: 264502 - RNA, 32 nt, Human
ugugguguggccugcugcuuccaggcugcaaa

SEQ ID NO: 264503 - RNA, 32 nt, Human
uguggugugugggcgacuccacaagaccugcc

SEQ ID NO: 264504 - RNA, 32 nt, Human
ugugguguguuucugugccagugcuguaugac

SEQ ID NO: 264505 - RNA, 32 nt, Human
ugugguguucucuucucaaggcuuugaaaucu

SEQ ID NO: 264506 - RNA, 32 nt, Human
ugugguguugcaugccuguaaucccagcuauu

SEQ ID NO: 264507 - RNA, 32 nt, Human
ugugguguugggcaccuguaaucccagcuacu

SEQ ID NO: 264508 - RNA, 32 nt, Human
ugugguguugggguuuggguaggggaggggag

SEQ ID NO: 264509 - RNA, 32 nt, Human
ugugguuaaaguuuuggcaguuuauugauuag

SEQ ID NO: 264510 - RNA, 32 nt, Human
ugugguuaucuugggucauuuggauguuuugu

SEQ ID NO: 264511 - RNA, 28 nt, Human
ugugguucaagugcuuccuuccccauca

SEQ ID NO: 264512 - RNA, 32 nt, Human
ugugguucaucaggugaggaauucuuuaauaa

SEQ ID NO: 264513 - RNA, 32 nt, Human
ugugguucauucuuuucaaaucuauuuuuguu

SEQ ID NO: 264514 - RNA, 24 nt, Human
ugugguuccuggggugcccuccac

SEQ ID NO: 264515 - RNA, 20 nt, Human
ugugguucugcgggugcagg

SEQ ID NO: 264516 - RNA, 32 nt, Human
ugugguugcacacgccuguaaucccagcuacu

SEQ ID NO: 264517 - RNA, 32 nt, Human
ugugguugcccacuuucugcuggucuccgaga

SEQ ID NO: 264518 - RNA, 32 nt, Human
ugugguugcugagggaugagggggaggagaga

SEQ ID NO: 264519 - RNA, 32 nt, Human
ugugguugcuucucuuccuccugcugccgcug

SEQ ID NO: 264520 - RNA, 32 nt, Human
ugugguuggaggaaagaugagugaagggauca

SEQ ID NO: 264521 - RNA, 32 nt, Human
ugugguuggcccaaaaggcaaaaguuugcagc

SEQ ID NO: 264522 - RNA, 32 nt, Human
ugugguuggcucugccuuugcugucuuuaccu

SEQ ID NO: 264523 - RNA, 32 nt, Human
ugugguugucuccguuuauagcacagacuuga

SEQ ID NO: 264524 - RNA, 32 nt, Human
ugugguuuccaaggagcugagaauagaaggaa

SEQ ID NO: 264525 - RNA, 32 nt, Human
ugugguuucuaugcccgcaaguuucaggaagu

SEQ ID NO: 264526 - RNA, 32 nt, Human
ugugguuucugggagcugguucuuaauuuggc

SEQ ID NO: 264527 - RNA, 32 nt, Human
ugugguuugccucauugugcuauuugcccacu

SEQ ID NO: 264528 - RNA, 32 nt, Human
ugugguuuuugucuggagauguuuucauuuuu

SEQ ID NO: 264529 - RNA, 32 nt, Human
uguguaaaacucugcugcuuuccccagcucca

SEQ ID NO: 264530 - RNA, 32 nt, Human
uguguaaaauagauugcuugauccaaaacaga

SEQ ID NO: 264531 - RNA, 32 nt, Human
uguguaaacauuuguuuuaacugugaaaggua

SEQ ID NO: 264532 - RNA, 32 nt, Human
uguguaaagaaagaaaaagggaaguaccaaug

SEQ ID NO: 264533 - RNA, 32 nt, Human
uguguaaagguuucauguucacugugagugaa

SEQ ID NO: 264534 - RNA, 32 nt, Human
uguguaaauacuguauauugcaaaaaucagua

SEQ ID NO: 264535 - RNA, 32 nt, Human
uguguaaaucagaugccagcuguacugccggc

SEQ ID NO: 264536 - RNA, 20 nt, Human
uguguaaaucuaacuacaag

SEQ ID NO: 264537 - RNA, 32 nt, Human
uguguaacaaaccugcacauucagcacaugua

SEQ ID NO: 264538 - RNA, 32 nt, Human
uguguaacaaaccugcauguucugcacaugga

SEQ ID NO: 264539 - RNA, 32 nt, Human
uguguaacacagauucuccucugcgcuaugug

SEQ ID NO: 264540 - RNA, 32 nt, Human
uguguaagacaguaacuuuacacuucagacag

SEQ ID NO: 264541 - RNA, 32 nt, Human
uguguaagagccaacacaugcccagcugcgga

SEQ ID NO: 264542 - RNA, 31 nt, Human
uguguaagcucaagaaccuguugagaggagc

SEQ ID NO: 264543 - RNA, 32 nt, Human
uguguaagcuguguccuaguucuugaacaguu

SEQ ID NO: 264544 - RNA, 32 nt, Human
uguguaaggaaagaaggagggagccggagaag

SEQ ID NO: 264545 - RNA, 32 nt, Human
uguguaaggguaggcuuuguugaaaaagaaag

SEQ ID NO: 264546 - RNA, 32 nt, Human
uguguaagugugauucauuugaaaagaccuug

SEQ ID NO: 264547 - RNA, 32 nt, Human
uguguaauauccacaaucauagacaaccaaag

SEQ ID NO: 264548 - RNA, 32 nt, Human
uguguaaucccagcuacuugggaggcugaggc

SEQ ID NO: 264549 - RNA, 32 nt, Human
uguguaaucucaaauaucugaauauugaaaaa

SEQ ID NO: 264550 - RNA, 19 nt, Human
uguguacacauauguacau

SEQ ID NO: 264551 - RNA, 32 nt, Human
uguguacacaugcuugcacacaugcacacaca

SEQ ID NO: 264552 - RNA, 32 nt, Human
uguguacacucucuaagacauucuccaaauug

SEQ ID NO: 264553 - RNA, 32 nt, Human
uguguacaggaaaauuggaagcacacagugga

SEQ ID NO: 264554 - RNA, 32 nt, Human
uguguacaguuuccuuuugcuucaucuccugc

SEQ ID NO: 264555 - RNA, 24 nt, Human
uguguacauauacuguauauaaua

SEQ ID NO: 264556 - RNA, 23 nt, Human
uguguacauauauauucuacaua

SEQ ID NO: 264557 - RNA, 25 nt, Human
uguguacauaucuauauuguauaua

SEQ ID NO: 264558 - RNA, 32 nt, Human
uguguacauauguauagucauguauuccugca

SEQ ID NO: 264559 - RNA, 32 nt, Human
uguguacauauguauauaauauguauauacaa

SEQ ID NO: 264560 - RNA, 32 nt, Human
uguguacauauguauguuuauguauguguguu

SEQ ID NO: 264561 - RNA, 26 nt, Human
uguguacauauguguauauguauaua

SEQ ID NO: 264562 - RNA, 32 nt, Human
uguguacauguaucuuuuucucgauucaaauc

SEQ ID NO: 264563 - RNA, 32 nt, Human
uguguacaugucugcauguguauauguucgug

SEQ ID NO: 264564 - RNA, 32 nt, Human
uguguacaugugcauguguagauaugugugua

SEQ ID NO: 264565 - RNA, 32 nt, Human
uguguaccaagugcuguccuugacaagaagac

SEQ ID NO: 264566 - RNA, 32 nt, Human
uguguaccacacccugccugcuguggagccca

SEQ ID NO: 264567 - RNA, 20 nt, Human
uguguaccaggaacuauaaa

SEQ ID NO: 264568 - RNA, 32 nt, Human
uguguaccaguuuaaagcuuucacuucauuug

SEQ ID NO: 264569 - RNA, 32 nt, Human
uguguaccauugagaugagaauggguagaugg

SEQ ID NO: 264570 - RNA, 32 nt, Human
uguguacccauacugcagccccaucccauggg

SEQ ID NO: 264571 - RNA, 32 nt, Human
uguguaccccuaaauccucccaccccagcacu

SEQ ID NO: 264572 - RNA, 32 nt, Human
uguguaccccuccacccgcugcgggcugaggg

SEQ ID NO: 264573 - RNA, 32 nt, Human
uguguacccugccucucucugucauagcuaac

SEQ ID NO: 264574 - RNA, 32 nt, Human
uguguaccuauguaacaaaccugcacauucug

SEQ ID NO: 264575 - RNA, 32 nt, Human
uguguaccucauucuucccuuaucacugaagg

SEQ ID NO: 264576 - RNA, 32 nt, Human
uguguaccucauucuuccuggauauggacaag

SEQ ID NO: 264577 - RNA, 32 nt, Human
uguguaccucuugccuuuucugggcuugcguu

SEQ ID NO: 264578 - RNA, 32 nt, Human
uguguaccuggaaugggguggucuuugaccuu

SEQ ID NO: 264579 - RNA, 32 nt, Human
uguguaccuuuucugucauauucagaaaccgu

SEQ ID NO: 264580 - RNA, 32 nt, Human
uguguacgcacauacacacaugcacgcacgca

SEQ ID NO: 264581 - RNA, 32 nt, Human
uguguacgcagggggccggggccccgcgaagc

SEQ ID NO: 264582 - RNA, 32 nt, Human
uguguacggagggucuagccugggugaguacg

SEQ ID NO: 264583 - RNA, 32 nt, Human
uguguacggugcacacacacagugcaucauuu

SEQ ID NO: 264584 - RNA, 32 nt, Human
uguguacucuggagauagauggagaaguguuu

SEQ ID NO: 264585 - RNA, 32 nt, Human
uguguacugaguauugauaaacuuugaauuuu

SEQ ID NO: 264586 - RNA, 32 nt, Human
uguguacuuccaccaugcuccagcucagugau

SEQ ID NO: 264587 - RNA, 32 nt, Human
uguguacuucccuugugucugucuuucuccua

SEQ ID NO: 264588 - RNA, 32 nt, Human
uguguacuugacugcccuagacaguggugacu

SEQ ID NO: 264589 - RNA, 32 nt, Human
uguguacuugauagagcuaaaauaugaucuuu

SEQ ID NO: 264590 - RNA, 32 nt, Human
uguguacuuggcugguacuuaaauucguuuug

SEQ ID NO: 264591 - RNA, 32 nt, Human
uguguacuuguagaacugcuauuagaaggagg

SEQ ID NO: 264592 - RNA, 32 nt, Human
uguguagaaagagguagacgugggagacuuuu

SEQ ID NO: 264593 - RNA, 32 nt, Human
uguguagaauacuuugacuuaauuuucuucca

SEQ ID NO: 264594 - RNA, 32 nt, Human
uguguagacacaaacauauacacagaugugua

SEQ ID NO: 264595 - RNA, 32 nt, Human
uguguagagauggcugagugcaauggcucaca

SEQ ID NO: 264596 - RNA, 32 nt, Human
uguguagagguuguucaacugaaggaauaaau

SEQ ID NO: 264597 - RNA, 32 nt, Human
uguguagauauguguguauauguaucaggaaa

SEQ ID NO: 264598 - RNA, 21 nt, Human
uguguagccaaaaauuacaaa

SEQ ID NO: 264599 - RNA, 32 nt, Human
uguguagcccuggcauagacuugcucgucagg

SEQ ID NO: 264600 - RNA, 32 nt, Human
uguguagcgguuugaauguugguuccaugccu

SEQ ID NO: 264601 - RNA, 32 nt, Human
uguguagcuacacuccaugauuccaagagccc

SEQ ID NO: 264602 - RNA, 32 nt, Human
uguguagcuuauugaugccucuccucuucuug

SEQ ID NO: 264603 - RNA, 32 nt, Human
uguguagcuucucauuuucaucagcacagcau

SEQ ID NO: 264604 - RNA, 32 nt, Human
uguguaggaggaaaugccagacuugcugaguc

SEQ ID NO: 264605 - RNA, 32 nt, Human
uguguaggguuggggagagugcagugauggga

SEQ ID NO: 264606 - RNA, 31 nt, Human
uguguaggugagagaaagagggaggagugag

SEQ ID NO: 264607 - RNA, 32 nt, Human
uguguaguaaagcauuaggagggucauucuug

SEQ ID NO: 264608 - RNA, 32 nt, Human
uguguagugcaaccaucugauaaacuagugug

SEQ ID NO: 264609 - RNA, 32 nt, Human
uguguaguuagacaauguccuguugggugguc

SEQ ID NO: 264610 - RNA, 32 nt, Human
uguguaguuuagauaggucacagaguugcugg

SEQ ID NO: 264611 - RNA, 24 nt, Human
uguguauaaauauauauguauaua

SEQ ID NO: 264612 - RNA, 32 nt, Human
uguguauaaaugcuuaaaguaccaucuuuguu

SEQ ID NO: 264613 - RNA, 32 nt, Human
uguguauaacaauaugguuuacauuuugcuca

SEQ ID NO: 264614 - RNA, 32 nt, Human
uguguauaaguugggggaauuaaguuucaaga

SEQ ID NO: 264615 - RNA, 22 nt, Human
uguguauacauacauccauaua

SEQ ID NO: 264616 - RNA, 32 nt, Human
uguguauagugccaccacaagcuuauggcauc

SEQ ID NO: 264617 - RNA, 32 nt, Human
uguguauagugccaccacagcuuauggcaucu

SEQ ID NO: 264618 - RNA, 32 nt, Human
uguguauaguuauugguuaaaaugacuguuuu

SEQ ID NO: 264619 - RNA, 32 nt, Human
uguguauauaaaugccuuuuccauaucuuaaa

SEQ ID NO: 264620 - RNA, 25 nt, Human
uguguauauacacuauauguauaua

SEQ ID NO: 264621 - RNA, 27 nt, Human
uguguauauacaguauauacauauaua

SEQ ID NO: 264622 - RNA, 23 nt, Human
uguguauauauaaauacauauau

SEQ ID NO: 264623 - RNA, 23 nt, Human
uguguauauauaauauguaugua

SEQ ID NO: 264624 - RNA, 19 nt, Human
uguguauauauaauuugua

SEQ ID NO: 264625 - RNA, 24 nt, Human
uguguauauauacacauaugugug

SEQ ID NO: 264626 - RNA, 26 nt, Human
uguguauauauacagacacauaugua

SEQ ID NO: 264627 - RNA, 21 nt, Human
uguguauauauacauuuuaua

SEQ ID NO: 264628 - RNA, 22 nt, Human
uguguauauauacguguauaua

SEQ ID NO: 264629 - RNA, 22 nt, Human
uguguauauauagauguauaua

SEQ ID NO: 264630 - RNA, 24 nt, Human
uguguauauauauaaauauaugua

SEQ ID NO: 264631 - RNA, 25 nt, Human
uguguauauauauaauauauaugua

SEQ ID NO: 264632 - RNA, 22 nt, Human
uguguauauauauacacacaua

SEQ ID NO: 264633 - RNA, 26 nt, Human
uguguauauauauaccaucccauaua

SEQ ID NO: 264634 - RNA, 24 nt, Human
uguguauauauaugcaaauauaug

SEQ ID NO: 264635 - RNA, 26 nt, Human
uguguauauauauguauguguauaua

SEQ ID NO: 264636 - RNA, 22 nt, Human
uguguauauauauguguauaua

SEQ ID NO: 264637 - RNA, 24 nt, Human
uguguauauauggauaaauauaua

SEQ ID NO: 264638 - RNA, 23 nt, Human
uguguauauauguaauauauaua

SEQ ID NO: 264639 - RNA, 22 nt, Human
uguguauauauguauacauaua

SEQ ID NO: 264640 - RNA, 23 nt, Human
uguguauauauguauauuacaua

SEQ ID NO: 264641 - RNA, 24 nt, Human
uguguauauauguauguguauaua

SEQ ID NO: 264642 - RNA, 22 nt, Human
uguguauauauguguauauaua

SEQ ID NO: 264643 - RNA, 26 nt, Human
uguguauauauguuugcaucuacaua

SEQ ID NO: 264644 - RNA, 26 nt, Human
uguguauauauguuugcauuuacaua

SEQ ID NO: 264645 - RNA, 23 nt, Human
uguguauauauuauacauauaua

SEQ ID NO: 264646 - RNA, 20 nt, Human
uguguauauguauacacaua

SEQ ID NO: 264647 - RNA, 22 nt, Human
uguguauauguauacacauaua

SEQ ID NO: 264648 - RNA, 22 nt, Human
uguguauauguauauguauaua

SEQ ID NO: 264649 - RNA, 32 nt, Human
uguguauauguauguauguguguuucuguaua

SEQ ID NO: 264650 - RNA, 32 nt, Human
uguguauauguguauauaaauauaugugugug

SEQ ID NO: 264651 - RNA, 32 nt, Human
uguguauauuagacauugccacccucaccucu

SEQ ID NO: 264652 - RNA, 32 nt, Human
uguguauauugacaucuuuaucuuccaucagg

SEQ ID NO: 264653 - RNA, 32 nt, Human
uguguaucaacauuauuuaaugucuucuaauu

SEQ ID NO: 264654 - RNA, 32 nt, Human
uguguaucaugcuaagcugcaucucuacucuu

SEQ ID NO: 264655 - RNA, 32 nt, Human
uguguauccacauucuuaccuuugguagucag

SEQ ID NO: 264656 - RNA, 32 nt, Human
uguguauccucagaccaaacugauucauguac

SEQ ID NO: 264657 - RNA, 32 nt, Human
uguguaucugugcacacauacacacgucugug

SEQ ID NO: 264658 - RNA, 32 nt, Human
uguguaugcagauaagcuuucucuucagacuu

SEQ ID NO: 264659 - RNA, 32 nt, Human
uguguaugcauacaucccacuuuuugacccag

SEQ ID NO: 264660 - RNA, 32 nt, Human
uguguaugcccuagagcccuugcucacguuuc

SEQ ID NO: 264661 - RNA, 18 nt, Human
uguguaugcuacuacaaa

SEQ ID NO: 264662 - RNA, 20 nt, Human
uguguaugcugaacuacaga

SEQ ID NO: 264663 - RNA, 32 nt, Human
uguguauggaggaucuagccugggugaguaug

SEQ ID NO: 264664 - RNA, 32 nt, Human
uguguauggagggucuagccugggugaguaug

SEQ ID NO: 264665 - RNA, 32 nt, Human
uguguauguaguguaacuauuuuguacaauag

SEQ ID NO: 264666 - RNA, 32 nt, Human
uguguauguauaugugugugggugcacacauc

SEQ ID NO: 264667 - RNA, 32 nt, Human
uguguauguaugcguauguauguauguaugua

SEQ ID NO: 264668 - RNA, 30 nt, Human
uguguaugucacuuauccuccuuuguccac

SEQ ID NO: 264669 - RNA, 24 nt, Human
uguguauguccauauguacacaua

SEQ ID NO: 264670 - RNA, 32 nt, Human
uguguaugugagugccgaucugugccagaagg

SEQ ID NO: 264671 - RNA, 32 nt, Human
uguguaugugcaaaugucaaauaaucuuuugc

SEQ ID NO: 264672 - RNA, 29 nt, Human
uguguaugugcgugugugcgagugugugc

SEQ ID NO: 264673 - RNA, 32 nt, Human
uguguauguggucugugacaagccuguggcuc

SEQ ID NO: 264674 - RNA, 32 nt, Human
uguguauguguauguguauguguuucauuuac

SEQ ID NO: 264675 - RNA, 32 nt, Human
uguguauguguauuuauauguauguauguaug

SEQ ID NO: 264676 - RNA, 18 nt, Human
uguguauguguguacaca

SEQ ID NO: 264677 - RNA, 24 nt, Human
uguguauguguguacauauauaua

SEQ ID NO: 264678 - RNA, 32 nt, Human
uguguaugugugugugcacgcgcgugcgcgcu

SEQ ID NO: 264679 - RNA, 18 nt, Human
uguguauuaaacuacgaa

SEQ ID NO: 264680 - RNA, 32 nt, Human
uguguauuaguccauuuucacacugcugagaa

SEQ ID NO: 264681 - RNA, 32 nt, Human
uguguauuagugagaggugaagccagcuggac

SEQ ID NO: 264682 - RNA, 32 nt, Human
uguguauuauuugguuucuuuuacuuaccugc

SEQ ID NO: 264683 - RNA, 24 nt, Human
uguguauucacauacauauauaua

SEQ ID NO: 264684 - RNA, 20 nt, Human
uguguauucauuuuauacaa

SEQ ID NO: 264685 - RNA, 20 nt, Human
uguguauuccacggcacaag

SEQ ID NO: 264686 - RNA, 32 nt, Human
uguguauucuacccuguugcaaaggaaauaaa

SEQ ID NO: 264687 - RNA, 32 nt, Human
uguguauucucccaggcacucccuucauaguc

SEQ ID NO: 264688 - RNA, 32 nt, Human
uguguauugagcaucuguaaugugccagcauu

SEQ ID NO: 264689 - RNA, 20 nt, Human
uguguauuggauaauacaaa

SEQ ID NO: 264690 - RNA, 32 nt, Human
uguguauuuaaugcauuauagcaugguggaaa

SEQ ID NO: 264691 - RNA, 32 nt, Human
uguguauuuauauguauguauguaugugugug

SEQ ID NO: 264692 - RNA, 32 nt, Human
uguguauuugcaccacggcaggugccucugug

SEQ ID NO: 264693 - RNA, 32 nt, Human
uguguauuugugaauaacaaacugcacaaccu

SEQ ID NO: 264694 - RNA, 18 nt, Human
uguguauuuugggaccuu

SEQ ID NO: 264695 - RNA, 18 nt, Human
uguguauuuuuacucaaa

SEQ ID NO: 264696 - RNA, 19 nt, Human
uguguauuuuuucuacaga

SEQ ID NO: 264697 - RNA, 19 nt, Human
ugugucaaaaguccccuca

SEQ ID NO: 264698 - RNA, 19 nt, Human
ugugucaaagagaugagga

SEQ ID NO: 264699 - RNA, 32 nt, Human
ugugucaacuucaacauuuacauguauuauuu

SEQ ID NO: 264700 - RNA, 32 nt, Human
ugugucaagaagcaucguccggggaggugaga

SEQ ID NO: 264701 - RNA, 32 nt, Human
ugugucaaucacuccauuuugcucagggaagg

SEQ ID NO: 264702 - RNA, 32 nt, Human
ugugucaaugccacaaaaucguguguccgugg

SEQ ID NO: 264703 - RNA, 32 nt, Human
ugugucacaguagcuuccuuugggaggaugau

SEQ ID NO: 264704 - RNA, 32 nt, Human
ugugucaccacccacaucaauaccuuucaaau

SEQ ID NO: 264705 - RNA, 32 nt, Human
ugugucaccaggauggagugcaguggcaugau

SEQ ID NO: 264706 - RNA, 32 nt, Human
ugugucaccaggcuggagcaguggcacgaucu

SEQ ID NO: 264707 - RNA, 32 nt, Human
ugugucacccacccaccuccuucauuaucagc

SEQ ID NO: 264708 - RNA, 32 nt, Human
ugugucacccaggcuggagugcaguggcacaa

SEQ ID NO: 264709 - RNA, 32 nt, Human
ugugucacccaggcuggagugcaguggcgcaa

SEQ ID NO: 264710 - RNA, 32 nt, Human
ugugucacccaggcuggagugcaguggugcaa

SEQ ID NO: 264711 - RNA, 32 nt, Human
ugugucaccuaggcuggagugcaguggcacaa

SEQ ID NO: 264712 - RNA, 32 nt, Human
ugugucacucacucauacauguccucaggacg

SEQ ID NO: 264713 - RNA, 32 nt, Human
ugugucacugcacuccagccugggcaacaggu

SEQ ID NO: 264714 - RNA, 32 nt, Human
ugugucacugcacuccagcuugggugacagag

SEQ ID NO: 264715 - RNA, 32 nt, Human
ugugucacugcauccauugccaccuccuguuc

SEQ ID NO: 264716 - RNA, 21 nt, Human
ugugucacuggcugccuccac

SEQ ID NO: 264717 - RNA, 32 nt, Human
ugugucagagcccagcccaggaguuugaggcu

SEQ ID NO: 264718 - RNA, 32 nt, Human
ugugucagccucccuccucucccugcagccca

SEQ ID NO: 264719 - RNA, 32 nt, Human
ugugucaggaaagcaugucagagcagagcugc

SEQ ID NO: 264720 - RNA, 32 nt, Human
ugugucaggggugggaccagguggaggacuga

SEQ ID NO: 264721 - RNA, 32 nt, Human
ugugucagucuccugaguagcugggauuacag

SEQ ID NO: 264722 - RNA, 32 nt, Human
ugugucagugccugagauacaccuacaagagc

SEQ ID NO: 264723 - RNA, 32 nt, Human
ugugucauccagagcuggagugcagcggcaca

SEQ ID NO: 264724 - RNA, 32 nt, Human
ugugucaucucugccuugagacugccuugaga

SEQ ID NO: 264725 - RNA, 32 nt, Human
ugugucaucuuccucuuucacacucuugauga

SEQ ID NO: 264726 - RNA, 32 nt, Human
ugugucaucuuugaaucccagauuuuugugag

SEQ ID NO: 264727 - RNA, 31 nt, Human
ugugucaugacuucucaagagaagacagaag

SEQ ID NO: 264728 - RNA, 32 nt, Human
ugugucaugcaggcuggagugcaguggcauga

SEQ ID NO: 264729 - RNA, 32 nt, Human
ugugucaugccugcaaucccagcacuuuggga

SEQ ID NO: 264730 - RNA, 32 nt, Human
ugugucauugcacuccagccugggcaacaaga

SEQ ID NO: 264731 - RNA, 32 nt, Human
ugugucauugcacuccagccugggcgacaaga

SEQ ID NO: 264732 - RNA, 32 nt, Human
ugugucauugcacuccagccuggggaacagag

SEQ ID NO: 264733 - RNA, 32 nt, Human
ugugucauuuugcuucagguauuucuuguccu

SEQ ID NO: 264734 - RNA, 32 nt, Human
uguguccaccuugccuucuuugcagccaagca

SEQ ID NO: 264735 - RNA, 32 nt, Human
uguguccaccuuucucuccucuucccaagccu

SEQ ID NO: 264736 - RNA, 32 nt, Human
uguguccacuaaaaauacaaaauuagccgggu

SEQ ID NO: 264737 - RNA, 32 nt, Human
uguguccagagacauccugaagaggcucgggg

SEQ ID NO: 264738 - RNA, 32 nt, Human
uguguccagaggugugugugaggcugccagaa

SEQ ID NO: 264739 - RNA, 32 nt, Human
uguguccagccgggggaaggaggucaccaagc

SEQ ID NO: 264740 - RNA, 32 nt, Human
uguguccaggcaugcggagcugugagugccug

SEQ ID NO: 264741 - RNA, 32 nt, Human
uguguccagggcagcacaggaggcaggugccc

SEQ ID NO: 264742 - RNA, 32 nt, Human
uguguccagugcuucauggaugggaccauccc

SEQ ID NO: 264743 - RNA, 32 nt, Human
uguguccaucaucaacggcuucacaucggugu

SEQ ID NO: 264744 - RNA, 32 nt, Human
uguguccauggcggcgcuugaccugcgagcgg

SEQ ID NO: 264745 - RNA, 32 nt, Human
uguguccauuaaagugguuuguuguuguuuuu

SEQ ID NO: 264746 - RNA, 32 nt, Human
ugugucccaaggcgcaugcacacacagacgga

SEQ ID NO: 264747 - RNA, 32 nt, Human
ugugucccagcccucugaugguggugagacca

SEQ ID NO: 264748 - RNA, 32 nt, Human
ugugucccaguaggaggucaagaagaucucca

SEQ ID NO: 264749 - RNA, 32 nt, Human
ugugucccaucaugcuuuccacugacccaaaa

SEQ ID NO: 264750 - RNA, 32 nt, Human
uguguccccagaaaaauuugcacacaauguuc

SEQ ID NO: 264751 - RNA, 32 nt, Human
ugugucccccaggcuggagugcaguggcacaa

SEQ ID NO: 264752 - RNA, 32 nt, Human
uguguccccuccgccccugccucccuccugcc

SEQ ID NO: 264753 - RNA, 32 nt, Human
uguguccccuccucccccuccacagccccuga

SEQ ID NO: 264754 - RNA, 32 nt, Human
uguguccccugcagcuccagccccgggcugca

SEQ ID NO: 264755 - RNA, 32 nt, Human
uguguccccugccugcacuggcacuuugucca

SEQ ID NO: 264756 - RNA, 32 nt, Human
ugugucccuuuagucccuuagccauuaucuga

SEQ ID NO: 264757 - RNA, 32 nt, Human
ugugucccuuucucccugucucugccugucuu

SEQ ID NO: 264758 - RNA, 32 nt, Human
ugugucccuuucuccuuccugaccuuccucag

SEQ ID NO: 264759 - RNA, 32 nt, Human
ugugucccuuucucucuccuuagugccuagcu

SEQ ID NO: 264760 - RNA, 32 nt, Human
uguguccgaguggggauggcucugggggccgc

SEQ ID NO: 264761 - RNA, 29 nt, Human
uguguccgucuguguaugugugugucugu

SEQ ID NO: 264762 - RNA, 32 nt, Human
uguguccguggaaggcaccaccagggacugga

SEQ ID NO: 264763 - RNA, 32 nt, Human
uguguccucaaagggccacgaggccugaaagg

SEQ ID NO: 264764 - RNA, 32 nt, Human
uguguccucauagcuuagcucccacuuauaac

SEQ ID NO: 264765 - RNA, 32 nt, Human
uguguccuccacucaggcuggggcucccugag

SEQ ID NO: 264766 - RNA, 32 nt, Human
uguguccuccagggccucugguuuguuguauu

SEQ ID NO: 264767 - RNA, 32 nt, Human
uguguccucccucccucccuuccuugggcaga

SEQ ID NO: 264768 - RNA, 32 nt, Human
uguguccucuacuuccaugaggccuucgagag

SEQ ID NO: 264769 - RNA, 32 nt, Human
uguguccucuacuuuucugaucucccacaagu

SEQ ID NO: 264770 - RNA, 32 nt, Human
uguguccugaguuuccagugcaagucaucugg

SEQ ID NO: 264771 - RNA, 32 nt, Human
uguguccugccucuugccucuuguagaaugca

SEQ ID NO: 264772 - RNA, 32 nt, Human
uguguccugcugugugcagcucgcucuuuccu

SEQ ID NO: 264773 - RNA, 32 nt, Human
uguguccugcuucucacucucuuccauuccca

SEQ ID NO: 264774 - RNA, 32 nt, Human
uguguccuggacagccaggagggaggccccgc

SEQ ID NO: 264775 - RNA, 32 nt, Human
uguguccuggcugaggaaugcacucacagcac

SEQ ID NO: 264776 - RNA, 32 nt, Human
uguguccuggcuggcugggaugcugguggcuc

SEQ ID NO: 264777 - RNA, 32 nt, Human
uguguccugggcuguguguccagcacaugugu

SEQ ID NO: 264778 - RNA, 32 nt, Human
uguguccuucaucacugucacccuccagugac

SEQ ID NO: 264779 - RNA, 32 nt, Human
uguguccuugcacuccuaucuggagauaucac

SEQ ID NO: 264780 - RNA, 32 nt, Human
uguguccuuugagcaagaggaggaacuccugg

SEQ ID NO: 264781 - RNA, 32 nt, Human
ugugucgccaaggcuggagugcaguggugcga

SEQ ID NO: 264782 - RNA, 32 nt, Human
ugugucgcccaggcuggagugcagugagcuga

SEQ ID NO: 264783 - RNA, 32 nt, Human
ugugucgcccaggcuggagugcaguggcguga

SEQ ID NO: 264784 - RNA, 32 nt, Human
ugugucgccuaggcuggagugcaguggcguga

SEQ ID NO: 264785 - RNA, 32 nt, Human
ugugucggcccaacggggucucaggaccuguc

SEQ ID NO: 264786 - RNA, 32 nt, Human
ugugucgggcaucagauggagcacacaggugg

SEQ ID NO: 264787 - RNA, 32 nt, Human
ugugucgguaguggugcccacccuggaugugg

SEQ ID NO: 264788 - RNA, 32 nt, Human
ugugucgucccagcuacuugugaggcugaagc

SEQ ID NO: 264789 - RNA, 32 nt, Human
ugugucguucccuugugucuguugcuuauugg

SEQ ID NO: 264790 - RNA, 32 nt, Human
ugugucuaaaggccugcuccaugacacaggau

SEQ ID NO: 264791 - RNA, 32 nt, Human
ugugucuaauaaaaauacaaaaauuagccggg

SEQ ID NO: 264792 - RNA, 32 nt, Human
ugugucuacaccucucugggccuuggugucgu

SEQ ID NO: 264793 - RNA, 32 nt, Human
ugugucuacuaaaaauacaaaacuagccagga

SEQ ID NO: 264794 - RNA, 32 nt, Human
ugugucuagaggaagccagagacagaaauagg

SEQ ID NO: 264795 - RNA, 32 nt, Human
ugugucuaggugaugucagugggagccaugaa

SEQ ID NO: 264796 - RNA, 32 nt, Human
ugugucuauguguguguuucagcacuuuguaa

SEQ ID NO: 264797 - RNA, 32 nt, Human
ugugucucacccacuacugagauuguucagcc

SEQ ID NO: 264798 - RNA, 32 nt, Human
ugugucucagcucucuggaagguggcccugcc

SEQ ID NO: 264799 - RNA, 18 nt, Human
ugugucucaggcaccuca

SEQ ID NO: 264800 - RNA, 23 nt, Human
ugugucucaggcuggaguacagu

SEQ ID NO: 264801 - RNA, 32 nt, Human
ugugucucagggucuucaguuuuucuauaagu

SEQ ID NO: 264802 - RNA, 32 nt, Human
ugugucucaguuuacagauguuaaggaacuua

SEQ ID NO: 264803 - RNA, 32 nt, Human
ugugucucauuacugcugaaauguccucacau

SEQ ID NO: 264804 - RNA, 32 nt, Human
ugugucucccucuuggacugagcacacaucug

SEQ ID NO: 264805 - RNA, 18 nt, Human
ugugucuccucagaguau

SEQ ID NO: 264806 - RNA, 17 nt, Human
ugugucuccucccagca

SEQ ID NO: 264807 - RNA, 19 nt, Human
ugugucuccugcccgacgc

SEQ ID NO: 264808 - RNA, 32 nt, Human
ugugucuccugccuccacucagcugcuucuca

SEQ ID NO: 264809 - RNA, 18 nt, Human
ugugucuccuggguggca

SEQ ID NO: 264810 - RNA, 18 nt, Human
ugugucuccugucggcag

SEQ ID NO: 264811 - RNA, 31 nt, Human
ugugucucgaguggcuaccuguugggcuugu

SEQ ID NO: 264812 - RNA, 32 nt, Human
ugugucucucacagcuugaaagccugagacag

SEQ ID NO: 264813 - RNA, 32 nt, Human
ugugucucugucaucacuaggaaucacagaua

SEQ ID NO: 264814 - RNA, 32 nt, Human
ugugucucuucucuuuguugcugagaagguag

SEQ ID NO: 264815 - RNA, 32 nt, Human
ugugucucuuucugucagaacugucuucuauu

SEQ ID NO: 264816 - RNA, 32 nt, Human
ugugucucuuugucccugccucccagagcgcc

SEQ ID NO: 264817 - RNA, 32 nt, Human
ugugucucuuuuucuccucucugagccuuugu

SEQ ID NO: 264818 - RNA, 32 nt, Human
ugugucugagaagccgggagccuggacacaaa

SEQ ID NO: 264819 - RNA, 32 nt, Human
ugugucugagcaccuccagcagaugucacucu

SEQ ID NO: 264820 - RNA, 32 nt, Human
ugugucugagcauucugcucccauggacaucc

SEQ ID NO: 264821 - RNA, 32 nt, Human
ugugucugaguacaugugcacacacgugugca

SEQ ID NO: 264822 - RNA, 32 nt, Human
ugugucugcaguuccaaccucuucccugagca

SEQ ID NO: 264823 - RNA, 32 nt, Human
ugugucugcauauugcagaacagcucugagag

SEQ ID NO: 264824 - RNA, 32 nt, Human
ugugucugcccaggcuggcugagcggguggau

SEQ ID NO: 264825 - RNA, 32 nt, Human
ugugucugcccccucuggcauccucugggcgu

SEQ ID NO: 264826 - RNA, 32 nt, Human
ugugucugccuucuuucaugcaucaacguaau

SEQ ID NO: 264827 - RNA, 31 nt, Human
ugugucugcgggagaaggaccaaagcaaucu

SEQ ID NO: 264828 - RNA, 32 nt, Human
ugugucugcuacugcugggacucaggcccucg

SEQ ID NO: 264829 - RNA, 32 nt, Human
ugugucugcuguucuccucuauguguucuugu

SEQ ID NO: 264830 - RNA, 32 nt, Human
ugugucuggaugaagcuggggcugcaagacug

SEQ ID NO: 264831 - RNA, 32 nt, Human
ugugucuggcagcagggagugguguggguacu

SEQ ID NO: 264832 - RNA, 32 nt, Human
ugugucugggauccagggcaaugugaauuuuc

SEQ ID NO: 264833 - RNA, 32 nt, Human
ugugucugggggacugcuggucacuguuucuc

SEQ ID NO: 264834 - RNA, 32 nt, Human
ugugucuguaaucccagcuacucgggaggcug

SEQ ID NO: 264835 - RNA, 32 nt, Human
ugugucuguaguucauuugcaaauaaacauuu

SEQ ID NO: 264836 - RNA, 22 nt, Human
ugugucugucauuucucuuuca

SEQ ID NO: 264837 - RNA, 32 nt, Human
ugugucugucccacccugauccuuuucaauau

SEQ ID NO: 264838 - RNA, 31 nt, Human
ugugucugugagagagccagagagagugaga

SEQ ID NO: 264839 - RNA, 32 nt, Human
ugugucugugaggguguugccaaagaagauua

SEQ ID NO: 264840 - RNA, 32 nt, Human
ugugucugugaucuccucugucuuaauccacg

SEQ ID NO: 264841 - RNA, 32 nt, Human
ugugucugugugaccugagagugauccaucuc

SEQ ID NO: 264842 - RNA, 32 nt, Human
ugugucuguguguguacacacgucccuuugaa

SEQ ID NO: 264843 - RNA, 32 nt, Human
ugugucuguguguguauucauuuuauacaaau

SEQ ID NO: 264844 - RNA, 32 nt, Human
ugugucugugugugugcacgcgcgugcacguc

SEQ ID NO: 264845 - RNA, 32 nt, Human
ugugucugugugugugcaugugcacacaugug

SEQ ID NO: 264846 - RNA, 32 nt, Human
ugugucugugugugugccuggagcugcgcuug

SEQ ID NO: 264847 - RNA, 32 nt, Human
ugugucuguuaccaagcaaagccaguuaaaga

SEQ ID NO: 264848 - RNA, 32 nt, Human
ugugucuguucccaggaguccuucggcggcug

SEQ ID NO: 264849 - RNA, 32 nt, Human
ugugucuuacagagaagagaagagggagucag

SEQ ID NO: 264850 - RNA, 20 nt, Human
ugugucuucacauuuuucua

SEQ ID NO: 264851 - RNA, 32 nt, Human
ugugucuucagauagcccuguccuggugguau

SEQ ID NO: 264852 - RNA, 22 nt, Human
ugugucuucagcuuucuuuugc

SEQ ID NO: 264853 - RNA, 22 nt, Human
ugugucuucaguagacaaguca

SEQ ID NO: 264854 - RNA, 32 nt, Human
ugugucuuccagccccagcugcagccugcucu

SEQ ID NO: 264855 - RNA, 32 nt, Human
ugugucuucuguugcuguagaggacacaaguc

SEQ ID NO: 264856 - RNA, 32 nt, Human
ugugucuugcuucaugauuccucucuccauua

SEQ ID NO: 264857 - RNA, 32 nt, Human
ugugucuuggguucucaccuguugauugggga

SEQ ID NO: 264858 - RNA, 32 nt, Human
ugugucuugguugcugcucuggccagggaggc

SEQ ID NO: 264859 - RNA, 32 nt, Human
ugugucuuuagauagcccuguccuggugguau

SEQ ID NO: 264860 - RNA, 32 nt, Human
ugugucuuuagauggcccuguccuggugguau

SEQ ID NO: 264861 - RNA, 32 nt, Human
ugugucuuuauucgcgggaggccacugucagc

SEQ ID NO: 264862 - RNA, 32 nt, Human
ugugucuuuccaguuacaggcgaugcugccgg

SEQ ID NO: 264863 - RNA, 32 nt, Human
ugugucuuugcaccugggcaucagcugcuugg

SEQ ID NO: 264864 - RNA, 32 nt, Human
ugugugaaaccaaaaugaucacugccuacuug

SEQ ID NO: 264865 - RNA, 32 nt, Human
ugugugaaaccugacaccuagauuuauuugga

SEQ ID NO: 264866 - RNA, 32 nt, Human
ugugugaaaugacuaaccugcagaaagagaug

SEQ ID NO: 264867 - RNA, 32 nt, Human
ugugugaaaugagagaccauggggauucauua

SEQ ID NO: 264868 - RNA, 20 nt, Human
ugugugaacaauacuacaaa

SEQ ID NO: 264869 - RNA, 32 nt, Human
ugugugacagucaugugcacacaugggcgggg

SEQ ID NO: 264870 - RNA, 21 nt, Human
ugugugacccacgcuggccug

SEQ ID NO: 264871 - RNA, 32 nt, Human
ugugugacccagagaaauaaagaugccucagu

SEQ ID NO: 264872 - RNA, 32 nt, Human
ugugugaccuuaggcuggagugcaauggcaug

SEQ ID NO: 264873 - RNA, 32 nt, Human
ugugugaccuugggcaaguuacugaaccucuc

SEQ ID NO: 264874 - RNA, 32 nt, Human
ugugugacugagaagcagccuggguguguaaa

SEQ ID NO: 264875 - RNA, 32 nt, Human
ugugugacugcaaccucauaucaggauuccug

SEQ ID NO: 264876 - RNA, 32 nt, Human
ugugugagaaaaacagacucuguccagguaga

SEQ ID NO: 264877 - RNA, 31 nt, Human
ugugugagacuucucccauuguuaacagauu

SEQ ID NO: 264878 - RNA, 32 nt, Human
ugugugagaggaggaggagagggagaauucug

SEQ ID NO: 264879 - RNA, 32 nt, Human
ugugugagccaccacacccagccugggucucu

SEQ ID NO: 264880 - RNA, 32 nt, Human
ugugugagcuaccacaccagcaaugucuaugc

SEQ ID NO: 264881 - RNA, 32 nt, Human
ugugugagcuccugccgguuucuuggcuguca

SEQ ID NO: 264882 - RNA, 32 nt, Human
ugugugaggaaagagcucaccgcugaagaagg

SEQ ID NO: 264883 - RNA, 32 nt, Human
ugugugaggaagcaggagucagccaccaagug

SEQ ID NO: 264884 - RNA, 32 nt, Human
ugugugaggagcugcuggcuugcagugcgcgu

SEQ ID NO: 264885 - RNA, 32 nt, Human
ugugugagguucgcuuaucaacuaaugauuua

SEQ ID NO: 264886 - RNA, 31 nt, Human
ugugugagugagagagcgagugagugaguga

SEQ ID NO: 264887 - RNA, 32 nt, Human
ugugugagugugacggggguugggguggggcg

SEQ ID NO: 264888 - RNA, 32 nt, Human
ugugugaucccagaggaggggcaguagcuggg

SEQ ID NO: 264889 - RNA, 32 nt, Human
ugugugaucucuucagggugggguggucucug

SEQ ID NO: 264890 - RNA, 32 nt, Human
ugugugaugcuguuagacaagacacugacgcu

SEQ ID NO: 264891 - RNA, 32 nt, Human
ugugugauguagcuuucucucccucagccugc

SEQ ID NO: 264892 - RNA, 32 nt, Human
ugugugaugugcagucccgaagccacacccuc

SEQ ID NO: 264893 - RNA, 32 nt, Human
ugugugauuguaucuuuuccauuaugugacug

SEQ ID NO: 264894 - RNA, 32 nt, Human
ugugugauuuugcuaaaaugcaucaccaacag

SEQ ID NO: 264895 - RNA, 32 nt, Human
ugugugcacaugcuuaaugagcgugcaagugu

SEQ ID NO: 264896 - RNA, 32 nt, Human
ugugugcacgcuuggacacccaccuccaugga

SEQ ID NO: 264897 - RNA, 32 nt, Human
ugugugcagaugcagaaugacaagcugcauuc

SEQ ID NO: 264898 - RNA, 32 nt, Human
ugugugcagcauucaguacacugaaggcauaa

SEQ ID NO: 264899 - RNA, 32 nt, Human
ugugugcagccugagugggguggugcaggccg

SEQ ID NO: 264900 - RNA, 32 nt, Human
ugugugcaggugcaucaccuggaucaugaggu

SEQ ID NO: 264901 - RNA, 32 nt, Human
ugugugcaugaaucugucauauagaggggguc

SEQ ID NO: 264902 - RNA, 21 nt, Human
ugugugcaugcgugugcacac

SEQ ID NO: 264903 - RNA, 32 nt, Human
ugugugcaugugucugucuuuugugaggguua

SEQ ID NO: 264904 - RNA, 32 nt, Human
ugugugcaugugugugcacacgugugcaugug

SEQ ID NO: 264905 - RNA, 32 nt, Human
ugugugcauuagaaaucaguugcuugauagua

SEQ ID NO: 264906 - RNA, 22 nt, Human
ugugugcauugugugugcacac

SEQ ID NO: 264907 - RNA, 26 nt, Human
ugugugcauuugcccauugggguaaa

SEQ ID NO: 264908 - RNA, 32 nt, Human
ugugugccaaugguggaucuuugcuacugaau

SEQ ID NO: 264909 - RNA, 32 nt, Human
ugugugccaccaugcccagacgcccagcuaau

SEQ ID NO: 264910 - RNA, 32 nt, Human
ugugugccaguaugauguuccacccacagaaa

SEQ ID NO: 264911 - RNA, 32 nt, Human
ugugugccaucuccaaugagaaggaauccugc

SEQ ID NO: 264912 - RNA, 32 nt, Human
ugugugccccacuccagccuggggaccccacu

SEQ ID NO: 264913 - RNA, 32 nt, Human
ugugugccccugguggagguggacgacaugau

SEQ ID NO: 264914 - RNA, 32 nt, Human
ugugugcccucagggauacgagauucucuguu

SEQ ID NO: 264915 - RNA, 32 nt, Human
ugugugcccugagccgugaugauccucccauc

SEQ ID NO: 264916 - RNA, 32 nt, Human
ugugugcccugcagggaccugccuuugccucc

SEQ ID NO: 264917 - RNA, 32 nt, Human
ugugugccuaugagauugggugcaguguaucc

SEQ ID NO: 264918 - RNA, 32 nt, Human
ugugugccucagaucuguuccaccccacucac

SEQ ID NO: 264919 - RNA, 32 nt, Human
ugugugccucauuccuuucccaccaagaaucc

SEQ ID NO: 264920 - RNA, 32 nt, Human
ugugugccugggagaggcucugucuccuuccu

SEQ ID NO: 264921 - RNA, 32 nt, Human
ugugugccugggagugaccucacagcugccgg

SEQ ID NO: 264922 - RNA, 32 nt, Human
ugugugccugggaucuccuugccccagccuga

SEQ ID NO: 264923 - RNA, 32 nt, Human
ugugugccuguaaucccggcuacuugggaggc

SEQ ID NO: 264924 - RNA, 32 nt, Human
ugugugccuguaauccuagcuacucgggaggc

SEQ ID NO: 264925 - RNA, 32 nt, Human
ugugugccuguaguucagcuacucagggggcu

SEQ ID NO: 264926 - RNA, 32 nt, Human
ugugugccuuucauucuuacauuucuaaucau

SEQ ID NO: 264927 - RNA, 32 nt, Human
ugugugccuuucuaucuuagguaaagaagaga

SEQ ID NO: 264928 - RNA, 32 nt, Human
ugugugccuuucuuccgccccggugggagccg

SEQ ID NO: 264929 - RNA, 32 nt, Human
ugugugcgcugcagcguugcggggugggagaa

SEQ ID NO: 264930 - RNA, 32 nt, Human
ugugugcgggccuggggguugcaugugucacc

SEQ ID NO: 264931 - RNA, 32 nt, Human
ugugugcgugagcaccaagccagagcccgagg

SEQ ID NO: 264932 - RNA, 32 nt, Human
ugugugcgugagcaccaagccggagcccgagg

SEQ ID NO: 264933 - RNA, 29 nt, Human
ugugugcgugcgugugugcgugucugggc

SEQ ID NO: 264934 - RNA, 32 nt, Human
ugugugcgugugcacacacacuuaaacacgug

SEQ ID NO: 264935 - RNA, 32 nt, Human
ugugugcgugugcacacacgcaaguaugcaca

SEQ ID NO: 264936 - RNA, 32 nt, Human
ugugugcguguguguaaauguguacacacaga

SEQ ID NO: 264937 - RNA, 32 nt, Human
ugugugcguguguguauacauacauccauaua

SEQ ID NO: 264938 - RNA, 32 nt, Human
ugugugcuaagugccauguugggcuccucaca

SEQ ID NO: 264939 - RNA, 32 nt, Human
ugugugcucacucuacacagcauacaagugug

SEQ ID NO: 264940 - RNA, 32 nt, Human
ugugugcucagggcacaugcacacagacauuu

SEQ ID NO: 264941 - RNA, 32 nt, Human
ugugugcucauuuggugcggaccugguaccuc

SEQ ID NO: 264942 - RNA, 32 nt, Human
ugugugcuccucuuuuggauuuacagaaaugu

SEQ ID NO: 264943 - RNA, 32 nt, Human
ugugugcugugaaccccugcacccaaccccac

SEQ ID NO: 264944 - RNA, 32 nt, Human
ugugugcuguggcccaugaugcauggggacag

SEQ ID NO: 264945 - RNA, 32 nt, Human
ugugugcuucccucucuuaugacugugucccu

SEQ ID NO: 264946 - RNA, 32 nt, Human
ugugugcuugccuugucccucgggguagaugc

SEQ ID NO: 264947 - RNA, 29 nt, Human
ugugugcuugcuuccagaaucuucuggau

SEQ ID NO: 264948 - RNA, 32 nt, Human
ugugugcuuguaaucccagcuacuugggaggc

SEQ ID NO: 264949 - RNA, 32 nt, Human
ugugugcuuugcuccugcaucuuguugaggug

SEQ ID NO: 264950 - RNA, 32 nt, Human
uguguggaagagcagccuuccuuugucccugu

SEQ ID NO: 264951 - RNA, 32 nt, Human
uguguggaccugggacacucucuucacuucuc

SEQ ID NO: 264952 - RNA, 32 nt, Human
uguguggagacaggguuuugccauguugccca

SEQ ID NO: 264953 - RNA, 32 nt, Human
uguguggagacuggaagccaggaagcaucugc

SEQ ID NO: 264954 - RNA, 32 nt, Human
uguguggagcacguagugcacagaauacguga

SEQ ID NO: 264955 - RNA, 32 nt, Human
uguguggagcugagacaggcucggcagcggca

SEQ ID NO: 264956 - RNA, 32 nt, Human
uguguggagggagggagggaggggagcauggu

SEQ ID NO: 264957 - RNA, 32 nt, Human
uguguggagugugcugaacacacaccaguuua

SEQ ID NO: 264958 - RNA, 32 nt, Human
uguguggaguuuuccaugaagugcagucccaa

SEQ ID NO: 264959 - RNA, 32 nt, Human
uguguggauacuuguucaauacugcuccaaaa

SEQ ID NO: 264960 - RNA, 32 nt, Human
uguguggaugugugugcaugaaucugucauau

SEQ ID NO: 264961 - RNA, 32 nt, Human
uguguggauuauagcaccuccucuccagccuc

SEQ ID NO: 264962 - RNA, 32 nt, Human
uguguggcacccgcucccucuggcagcgaaug

SEQ ID NO: 264963 - RNA, 32 nt, Human
uguguggcagagccaggacccaggagguguga

SEQ ID NO: 264964 - RNA, 32 nt, Human
uguguggcaggcagggcauggguuuuaguccu

SEQ ID NO: 264965 - RNA, 32 nt, Human
uguguggcauuaucaaaaugaagaggagcaag

SEQ ID NO: 264966 - RNA, 32 nt, Human
uguguggccacucgcaggagaagcacuauccu

SEQ ID NO: 264967 - RNA, 32 nt, Human
uguguggcccaggcuggagugcaguggcgcaa

SEQ ID NO: 264968 - RNA, 32 nt, Human
uguguggccuagguuggagugcaauggcgcaa

SEQ ID NO: 264969 - RNA, 32 nt, Human
uguguggccuucugguugaccucugcccgauc

SEQ ID NO: 264970 - RNA, 32 nt, Human
uguguggcuauuuuuccuuucucuguauucuu

SEQ ID NO: 264971 - RNA, 32 nt, Human
uguguggcuccuggaugggcucguggggcggg

SEQ ID NO: 264972 - RNA, 32 nt, Human
uguguggcuggaccaggugucuccccacgcuu

SEQ ID NO: 264973 - RNA, 32 nt, Human
uguguggcugguggacggugaugaggaaggac

SEQ ID NO: 264974 - RNA, 32 nt, Human
uguguggcuuagaugaaagggagaguaaauuu

SEQ ID NO: 264975 - RNA, 32 nt, Human
uguguggcuuccugccucugcacgccaccccg

SEQ ID NO: 264976 - RNA, 32 nt, Human
uguguggcuuuaaccuccacauccaggucuuu

SEQ ID NO: 264977 - RNA, 32 nt, Human
ugugugggagagaaggaggcccguguugagcu

SEQ ID NO: 264978 - RNA, 32 nt, Human
ugugugggagagagugugugagagggugugcc

SEQ ID NO: 264979 - RNA, 32 nt, Human
ugugugggaggcagagagaggagcaggggcca

SEQ ID NO: 264980 - RNA, 32 nt, Human
ugugugggaggcagguucugcaaagcaagugc

SEQ ID NO: 264981 - RNA, 32 nt, Human
ugugugggauugggggaggaguggggacaaga

SEQ ID NO: 264982 - RNA, 32 nt, Human
ugugugggcccagaugguugagcuugagcagg

SEQ ID NO: 264983 - RNA, 32 nt, Human
ugugugggcucaagaugaagcugaagcaacag

SEQ ID NO: 264984 - RNA, 32 nt, Human
ugugugggcucuggccuggccugguggcuggc

SEQ ID NO: 264985 - RNA, 32 nt, Human
uguguggggaaaggagaugugugagcaauuuc

SEQ ID NO: 264986 - RNA, 32 nt, Human
uguguggggaagcacagacaacaggagacccc

SEQ ID NO: 264987 - RNA, 32 nt, Human
uguguggggaagccggucacauggacacaccu

SEQ ID NO: 264988 - RNA, 32 nt, Human
uguguggggagguggguggagaggugagccca

SEQ ID NO: 264989 - RNA, 32 nt, Human
uguguggggaugugugugugggccuaugcacu

SEQ ID NO: 264990 - RNA, 32 nt, Human
uguguggggcccaguagaaauggucuuguaau

SEQ ID NO: 264991 - RNA, 32 nt, Human
ugugugggggcagagguuaugugggaaaucuc

SEQ ID NO: 264992 - RNA, 31 nt, Human
uguguggggucaaaggauguggccccugcca

SEQ ID NO: 264993 - RNA, 32 nt, Human
uguguggggucaucuaggaauauuucuggcca

SEQ ID NO: 264994 - RNA, 32 nt, Human
uguguggguaaucuggucaguaagauugagac

SEQ ID NO: 264995 - RNA, 32 nt, Human
ugugugggucugcaggugagcagacaggacag

SEQ ID NO: 264996 - RNA, 32 nt, Human
uguguggguggcacagaucugggcaguuagau

SEQ ID NO: 264997 - RNA, 32 nt, Human
uguguggguguguguauaccauguauccacau

SEQ ID NO: 264998 - RNA, 29 nt, Human
uguguggguuuguguguguggaugugguu

SEQ ID NO: 264999 - RNA, 32 nt, Human
uguguggucagggcaccaugaggguguacaga

SEQ ID NO: 265000 - RNA, 32 nt, Human
uguguggugcaggagugccacccccagggccc

SEQ ID NO: 265001 - RNA, 32 nt, Human
uguguggugucguggucacaucucccgcuucc

SEQ ID NO: 265002 - RNA, 32 nt, Human
ugugugguguuuuggauuuggagagaaauauu

SEQ ID NO: 265003 - RNA, 32 nt, Human
uuaaaaucaucaggcuggaagaugaagccaug

SEQ ID NO: 265004 - RNA, 32 nt, Human
uuaaaaucggggcuggaggugcagacgguguc

SEQ ID NO: 265005 - RNA, 32 nt, Human
uuaaaaucguucauagacuucuguaaaaugca

SEQ ID NO: 265006 - RNA, 32 nt, Human
uuaaaaucucaaaugacaugcagugugaguag

SEQ ID NO: 265007 - RNA, 32 nt, Human
uuaaaaucucauaauggauaucucauguuuuc

SEQ ID NO: 265008 - RNA, 32 nt, Human
uuaaaaucuggccccagcuuucuuucuguuag

SEQ ID NO: 265009 - RNA, 32 nt, Human
uuaaaaucuguggcuugccuguucaauucauu

SEQ ID NO: 265010 - RNA, 32 nt, Human
uuaaaaugaagacauuuggguguuucauguca

SEQ ID NO: 265011 - RNA, 32 nt, Human
uuaaaaugacccugaauagaauaggaagaaca

SEQ ID NO: 265012 - RNA, 32 nt, Human
uuaaaaugagccacaaacaguaaagcccuauc

SEQ ID NO: 265013 - RNA, 22 nt, Human
uuaaaaugauaaguaccuuuca

SEQ ID NO: 265014 - RNA, 32 nt, Human
uuaaaaugcacacguagccacgcacagccaga

SEQ ID NO: 265015 - RNA, 32 nt, Human
uuaaaaugcccuuuuaagaccugcagcaguga

SEQ ID NO: 265016 - RNA, 32 nt, Human
uuaaaaugcuuuccucuucuuguccugcuuga

SEQ ID NO: 265017 - RNA, 32 nt, Human
uuaaaauggaaaucauucuccaacgauauaca

SEQ ID NO: 265018 - RNA, 31 nt, Human
uuaaaauggacaacuuuucaccuaaagcugg

SEQ ID NO: 265019 - RNA, 32 nt, Human
uuaaaauggacaccccucagcccgcccucccc

SEQ ID NO: 265020 - RNA, 32 nt, Human
uuaaaauggcauguuuucuuuucaagccguua

SEQ ID NO: 265021 - RNA, 32 nt, Human
uuaaaauguaugaaaagaaaacuuuccccugc

SEQ ID NO: 265022 - RNA, 32 nt, Human
uuaaaaugucuaucucauuugcugccuuuuca

SEQ ID NO: 265023 - RNA, 32 nt, Human
uuaaaaugugagaucagugaacucugguuuua

SEQ ID NO: 265024 - RNA, 32 nt, Human
uuaaaauguggcuaaugccugccuuagggaac

SEQ ID NO: 265025 - RNA, 32 nt, Human
uuaaaauguuucuuauuuucagcacuuacauc

SEQ ID NO: 265026 - RNA, 32 nt, Human
uuaaaauuaaucucuuccgaaaauauccacua

SEQ ID NO: 265027 - RNA, 32 nt, Human
uuaaaauuagucuuuguaguucuaucauuagc

SEQ ID NO: 265028 - RNA, 32 nt, Human
uuaaaauuauauuuaucuuggggccuguggga

SEQ ID NO: 265029 - RNA, 32 nt, Human
uuaaaauucacugagaaaaaugagacuaaauu

SEQ ID NO: 265030 - RNA, 32 nt, Human
uuaaaauuccuuaacuccuuuuugauucaugu

SEQ ID NO: 265031 - RNA, 32 nt, Human
uuaaaauugcaucuugaccaggcacaguggcu

SEQ ID NO: 265032 - RNA, 32 nt, Human
uuaaaauugcccagggaugguggugcacacuu

SEQ ID NO: 265033 - RNA, 32 nt, Human
uuaaaauuggcccagaccagaacccaguuucc

SEQ ID NO: 265034 - RNA, 32 nt, Human
uuaaaauugucaaauauauuuuaugaagaauu

SEQ ID NO: 265035 - RNA, 32 nt, Human
uuaaaauuuaacaucugcaguguucugugaau

SEQ ID NO: 265036 - RNA, 24 nt, Human
uuaaaauuuagcuuggcaaaaugu

SEQ ID NO: 265037 - RNA, 32 nt, Human
uuaaaauuuauuucagggagaagaauugcacc

SEQ ID NO: 265038 - RNA, 32 nt, Human
uuaaaauuucaucuguuaauagaucauuaggu

SEQ ID NO: 265039 - RNA, 32 nt, Human
uuaaaauuuuaacaagacagggcuaagagcca

SEQ ID NO: 265040 - RNA, 32 nt, Human
uuaaaauuuugugacgugucuuuuuccuuuuu

SEQ ID NO: 265041 - RNA, 32 nt, Human
uuaaacaaaacacacaacauguaagcauguaa

SEQ ID NO: 265042 - RNA, 32 nt, Human
uuaaacaaaagcauccagacacacaacaaugu

SEQ ID NO: 265043 - RNA, 32 nt, Human
uuaaacaaacaaaaucaccgaccuugcaaaua

SEQ ID NO: 265044 - RNA, 32 nt, Human
uuaaacaaacuagacauuuucuuacggaaaaa

SEQ ID NO: 265045 - RNA, 32 nt, Human
uuaaacaaagggcccugaaguuugagugcgcc

SEQ ID NO: 265046 - RNA, 32 nt, Human
uuaaacaagucaaauaggccaagugccauggc

SEQ ID NO: 265047 - RNA, 32 nt, Human
uuaaacaauuguucauagcuguguagacauuu

SEQ ID NO: 265048 - RNA, 32 nt, Human
uuaaacacaaaugguaacauauuccaaaacca

SEQ ID NO: 265049 - RNA, 32 nt, Human
uuaaacacaaguguguuguaggagacugcauc

SEQ ID NO: 265050 - RNA, 32 nt, Human
uuaaacacagcagaggauggcgcaggcacccc

SEQ ID NO: 265051 - RNA, 23 nt, Human
uuaaacacaucagaauauuucca

SEQ ID NO: 265052 - RNA, 21 nt, Human
uuaaacacaucagugcuucca

SEQ ID NO: 265053 - RNA, 32 nt, Human
uuaaacacuggcauauauggagagaacaguug

SEQ ID NO: 265054 - RNA, 32 nt, Human
uuaaacacuggugauuucagguguacuugugu

SEQ ID NO: 265055 - RNA, 32 nt, Human
uuaaacacuuugggauacuaaucccuagacau

SEQ ID NO: 265056 - RNA, 32 nt, Human
uuaaacagaacugccuuuuucuacucuuuaug

SEQ ID NO: 265057 - RNA, 32 nt, Human
uuaaacagaaggguaucuccuccaucagaucu

SEQ ID NO: 265058 - RNA, 32 nt, Human
uuaaacagacucuugcucugucauucaggcug

SEQ ID NO: 265059 - RNA, 32 nt, Human
uuaaacagcacuaguacuguacacugguuuuu

SEQ ID NO: 265060 - RNA, 32 nt, Human
uuaaacagcauugacaucaucuguaaaaccau

SEQ ID NO: 265061 - RNA, 32 nt, Human
uuaaacagcucuccaagcuuucacugaagucu

SEQ ID NO: 265062 - RNA, 32 nt, Human
uuaaacaggaucacacuguacccccugccugc

SEQ ID NO: 265063 - RNA, 32 nt, Human
uuaaacaggauuggguugaugguacaacauga

SEQ ID NO: 265064 - RNA, 32 nt, Human
uuaaacaguaaucauuuuugucaaccacucca

SEQ ID NO: 265065 - RNA, 32 nt, Human
uuaaacaguccuuuaaccagcacagccaguua

SEQ ID NO: 265066 - RNA, 32 nt, Human
uuaaacaguuucuaaauaaaauucuguauuuc

SEQ ID NO: 265067 - RNA, 32 nt, Human
uuaaacauagccacgccaccuuggccuucaau

SEQ ID NO: 265068 - RNA, 32 nt, Human
uuaaacaucuuaggucagcuuuaccagugagg

SEQ ID NO: 265069 - RNA, 32 nt, Human
uuaaacaugcugugugccacaggccaguguug

SEQ ID NO: 265070 - RNA, 22 nt, Human
uuaaacauggaaagauacucca

SEQ ID NO: 265071 - RNA, 32 nt, Human
uuaaacauguacaaagggcuacauuuuaauuu

SEQ ID NO: 265072 - RNA, 32 nt, Human
uuaaacauuaacaucacuaucauuuauuuauu

SEQ ID NO: 265073 - RNA, 32 nt, Human
uuaaacauucuuuuaaccuucccccaaagaua

SEQ ID NO: 265074 - RNA, 32 nt, Human
uuaaacauuguuuuaucaagucacuguuaagu

SEQ ID NO: 265075 - RNA, 32 nt, Human
uuaaacauuuccugcgcagcuaaagcaagucu

SEQ ID NO: 265076 - RNA, 32 nt, Human
uuaaaccaaaguuuagaaagagguuuuugaaa

SEQ ID NO: 265077 - RNA, 32 nt, Human
uuaaaccaaggcacuccagccugggugacaga

SEQ ID NO: 265078 - RNA, 32 nt, Human
uuaaaccacaaaacaucaaguauuccaaguuu

SEQ ID NO: 265079 - RNA, 32 nt, Human
uuaaacccaacuccuagcacugaagauguuau

SEQ ID NO: 265080 - RNA, 32 nt, Human
uuaaacccaagugcugcacaaaagcagauacu

SEQ ID NO: 265081 - RNA, 32 nt, Human
uuaaacccacuguauaugauguuuucaaugug

SEQ ID NO: 265082 - RNA, 32 nt, Human
uuaaacccagccgucauucucuccccacucca

SEQ ID NO: 265083 - RNA, 32 nt, Human
uuaaacccagcuguuuacacagcagcuacaaa

SEQ ID NO: 265084 - RNA, 32 nt, Human
uuaaacccaggaggcaaaggcugcagugagcc

SEQ ID NO: 265085 - RNA, 32 nt, Human
uuaaacccaggaggcagagguugcagugagug

SEQ ID NO: 265086 - RNA, 32 nt, Human
uuaaacccaggaggcggagguugcagugagcu

SEQ ID NO: 265087 - RNA, 32 nt, Human
uuaaacccaggaggcggagguugcagugaguu

SEQ ID NO: 265088 - RNA, 32 nt, Human
uuaaacccaggagguggagguugcagugagcc

SEQ ID NO: 265089 - RNA, 32 nt, Human
uuaaacccaggagguggagguugcagugagcu

SEQ ID NO: 265090 - RNA, 32 nt, Human
uuaaacccaggaguucaagaccagccugggua

SEQ ID NO: 265091 - RNA, 32 nt, Human
uuaaacccgggaggcagaggcugcagagagcc

SEQ ID NO: 265092 - RNA, 32 nt, Human
uuaaacccuuuccuccucccauuuggacauuu

SEQ ID NO: 265093 - RNA, 32 nt, Human
uuaaacccuuucuccccacugagucccauuuu

SEQ ID NO: 265094 - RNA, 32 nt, Human
uuaaaccucauuaaaucucuguuuucucaucu

SEQ ID NO: 265095 - RNA, 32 nt, Human
uuaaaccucuuuccuuugcaaauuaccuaguc

SEQ ID NO: 265096 - RNA, 32 nt, Human
uuaaaccugcagcaagcaggcauguugaagag

SEQ ID NO: 265097 - RNA, 32 nt, Human
uuaaaccugcugcaagagccauaacuuugagg

SEQ ID NO: 265098 - RNA, 32 nt, Human
uuaaaccugcuugcuuccuaccacagauucuu

SEQ ID NO: 265099 - RNA, 32 nt, Human
uuaaaccugggagguggagguugcagugaccc

SEQ ID NO: 265100 - RNA, 32 nt, Human
uuaaaccugguaaccagagauuacugguggcu

SEQ ID NO: 265101 - RNA, 32 nt, Human
uuaaaccugugcuuucauguuuaagaaaugag

SEQ ID NO: 265102 - RNA, 32 nt, Human
uuaaacgauucucccaccucagccucucgagu

SEQ ID NO: 265103 - RNA, 32 nt, Human
uuaaacgcaacaaaaggcuacauuuccauggg

SEQ ID NO: 265104 - RNA, 32 nt, Human
uuaaacgcaggagucugcagcugcaaugaacu

SEQ ID NO: 265105 - RNA, 32 nt, Human
uuaaacgcuuaacaucuuccaccgcaacagcu

SEQ ID NO: 265106 - RNA, 32 nt, Human
uuaaacggagucuugcuauaucgcccaggcuc

SEQ ID NO: 265107 - RNA, 32 nt, Human
uuaaacggguggcuccuuuaauauuauuauua

SEQ ID NO: 265108 - RNA, 32 nt, Human
uuaaacgucccagucuagcuuagaggaggacc

SEQ ID NO: 265109 - RNA, 32 nt, Human
uuaaacuaaaaauuuacaagagaagaaaguga

SEQ ID NO: 265110 - RNA, 32 nt, Human
uuaaacuaauucauauuaugacuuuaaagggu

SEQ ID NO: 265111 - RNA, 32 nt, Human
uuaaacuagaauaugagauucaagagauuuaa

SEQ ID NO: 265112 - RNA, 32 nt, Human
uuaaacuauaacuguuucauauuuuucuuuug

SEQ ID NO: 265113 - RNA, 32 nt, Human
uuaaacucaguucugcauccaacuugagaaga

SEQ ID NO: 265114 - RNA, 32 nt, Human
uuaaacucauggggaggggcccuucagagcag

SEQ ID NO: 265115 - RNA, 32 nt, Human
uuaaacucccucucuucuuaaauggaacagcu

SEQ ID NO: 265116 - RNA, 32 nt, Human
uuaaacucuccaggaacuugugcuaugcuggg

SEQ ID NO: 265117 - RNA, 32 nt, Human
uuaaacucucccaccaugauuauguauugcug

SEQ ID NO: 265118 - RNA, 32 nt, Human
uuaaacucuuugucucauugaaaguuugguua

SEQ ID NO: 265119 - RNA, 32 nt, Human
uuaaacugaauuuugcaucuguguacaugaag

SEQ ID NO: 265120 - RNA, 32 nt, Human
uuaaacugacccuucccuuugaguggucuuca

SEQ ID NO: 265121 - RNA, 32 nt, Human
uuaaacugaguguagggaaugggauauugaca

SEQ ID NO: 265122 - RNA, 32 nt, Human
uuaaacuggcggugccaguugcagugaaggug

SEQ ID NO: 265123 - RNA, 32 nt, Human
uuaaacugugcaaauaugaaaauuuuucgagg

SEQ ID NO: 265124 - RNA, 32 nt, Human
uuaaacuguggaagagugacugcuagucccuu

SEQ ID NO: 265125 - RNA, 32 nt, Human
uuaaacuguggaagagugacuguuaagucccu

SEQ ID NO: 265126 - RNA, 32 nt, Human
uuaaacuguuuccccuaagagaaaguucaacg

SEQ ID NO: 265127 - RNA, 32 nt, Human
uuaaacuuaaaacuuuguagaaagcaaacaaa

SEQ ID NO: 265128 - RNA, 20 nt, Human
uuaaacuuacaaguaccgua

SEQ ID NO: 265129 - RNA, 32 nt, Human
uuaaacuuuggaacaagaauguagcuucaacg

SEQ ID NO: 265130 - RNA, 32 nt, Human
uuaaacuuuuguuaugaaauugcugaaauguu

SEQ ID NO: 265131 - RNA, 32 nt, Human
uuaaagaaaaagaaaguaguaccuuaguaugu

SEQ ID NO: 265132 - RNA, 32 nt, Human
uuaaagaaaauggacucaugcacagaacacua

SEQ ID NO: 265133 - RNA, 32 nt, Human
uuaaagaaacacggagcugggccaucgucaga

SEQ ID NO: 265134 - RNA, 32 nt, Human
uuaaagaaagugaaaaauguaaaacacauaca

SEQ ID NO: 265135 - RNA, 32 nt, Human
uuaaagaaccccagaggucaccaacauguuua

SEQ ID NO: 265136 - RNA, 32 nt, Human
uuaaagaacccccuuuccgugccacuggugaa

SEQ ID NO: 265137 - RNA, 32 nt, Human
uuaaagaagaaacaccuuuuacuccaaaugua

SEQ ID NO: 265138 - RNA, 32 nt, Human
uuaaagaagaaagaaaaagaaguuucugaaaa

SEQ ID NO: 265139 - RNA, 32 nt, Human
uuaaagaagaugugcugauugcagccuuacua

SEQ ID NO: 265140 - RNA, 32 nt, Human
uuaaagaaguaguaaggcugggcacuguggcu

SEQ ID NO: 265141 - RNA, 32 nt, Human
uuaaagacagagcaggagcuucuuccaggagu

SEQ ID NO: 265142 - RNA, 32 nt, Human
uuaaagacaugaaugaacucacucuggagaga

SEQ ID NO: 265143 - RNA, 32 nt, Human
uuaaagaccagaaaagacuugcuuuuacccag

SEQ ID NO: 265144 - RNA, 32 nt, Human
uuaaagaccagccugaccgacauggagaaacc

SEQ ID NO: 265145 - RNA, 32 nt, Human
uuaaagaccagccuggccaacaaggugaaacc

SEQ ID NO: 265146 - RNA, 32 nt, Human
uuaaagaccagccuggccaacauggcaaaacc

SEQ ID NO: 265147 - RNA, 32 nt, Human
uuaaagaccagccugggcaacacagcaagacc

SEQ ID NO: 265148 - RNA, 32 nt, Human
uuaaagaccagccuggucaauauagcaagacc

SEQ ID NO: 265149 - RNA, 32 nt, Human
uuaaagaccaggcuguuggcaccagaacuuaa

SEQ ID NO: 265150 - RNA, 32 nt, Human
uuaaagaccauuucuggcugggcagggcacuc

SEQ ID NO: 265151 - RNA, 32 nt, Human
uuaaagaccccagcaccuccagugagacccuu

SEQ ID NO: 265152 - RNA, 32 nt, Human
uuaaagacuaaaacaaaugcacagaucaaggg

SEQ ID NO: 265153 - RNA, 32 nt, Human
uuaaagacugacacagacuuagaaucaaauuu

SEQ ID NO: 265154 - RNA, 32 nt, Human
uuaaagacugauauucaaaugcuguaguguug

SEQ ID NO: 265155 - RNA, 32 nt, Human
uuaaagacugauuuuaaucugacuaugacacu

SEQ ID NO: 265156 - RNA, 32 nt, Human
uuaaagacuguauccaugcugugcucaaggag

SEQ ID NO: 265157 - RNA, 32 nt, Human
uuaaagacuucugcugcugcuaugccucuugg

SEQ ID NO: 265158 - RNA, 32 nt, Human
uuaaagagaaaauaucauaaaugguauacucu

SEQ ID NO: 265159 - RNA, 32 nt, Human
uuaaagagaaacuuucacaaugucuggagccc

SEQ ID NO: 265160 - RNA, 32 nt, Human
uuaaagagaagaggcgagagcaugaagauaaa

SEQ ID NO: 265161 - RNA, 32 nt, Human
uuaaagagagucuggcucugucgcccaggcug

SEQ ID NO: 265162 - RNA, 32 nt, Human
uuaaagagauagcuucucuucuuucugaagau

SEQ ID NO: 265163 - RNA, 32 nt, Human
uuaaagagcagccuggcuaacauggugaaacc

SEQ ID NO: 265164 - RNA, 32 nt, Human
uuaaagaggauucucauaaggaaagcaaugac

SEQ ID NO: 265165 - RNA, 32 nt, Human
uuaaagagggaaagagugagauucagaaaucg

SEQ ID NO: 265166 - RNA, 32 nt, Human
uuaaagagggugaggaagggaaaaggaauauu

SEQ ID NO: 265167 - RNA, 32 nt, Human
uuaaagaguuacuuguagaacacuccauguca

SEQ ID NO: 265168 - RNA, 32 nt, Human
uuaaagauaauuggagguuaagagaauuaguc

SEQ ID NO: 265169 - RNA, 32 nt, Human
uuaaagauagugucccugcuguggaaaaccug

SEQ ID NO: 265170 - RNA, 32 nt, Human
uuaaagaucaaauuauccaugaaauuauagcc

SEQ ID NO: 265171 - RNA, 32 nt, Human
uuaaagaugaaaggguucaguacuggauugag

SEQ ID NO: 265172 - RNA, 32 nt, Human
uuaaagaugaauucccagccugaggugacaca

SEQ ID NO: 265173 - RNA, 32 nt, Human
uuaaagauggcacagacccaaagagugagcaa

SEQ ID NO: 265174 - RNA, 32 nt, Human
uuaaagaugggcaaaagaucugaauagacauu

SEQ ID NO: 265175 - RNA, 32 nt, Human
uuaaagauucacugcgugcuguccucacuugu

SEQ ID NO: 265176 - RNA, 32 nt, Human
uuaaagauuguauuuucacagaguggaaacca

SEQ ID NO: 265177 - RNA, 32 nt, Human
uuaaagcaacagacuucucaauaaaagcaggu

SEQ ID NO: 265178 - RNA, 32 nt, Human
uuaaagcaagaugcgauguccagaguuacaga

SEQ ID NO: 265179 - RNA, 32 nt, Human
uuaaagcaaguuucacacugaacuuaacguuu

SEQ ID NO: 265180 - RNA, 32 nt, Human
uuaaagcacagaucauuaagcaauaaaaacca

SEQ ID NO: 265181 - RNA, 32 nt, Human
uuaaagcacagucugaugacacauuuggcagu

SEQ ID NO: 265182 - RNA, 32 nt, Human
uuaaagcaccuuguggaaucuguuuccuauau

SEQ ID NO: 265183 - RNA, 32 nt, Human
uuaaagccaccaggaaguucacacggggcaga

SEQ ID NO: 265184 - RNA, 32 nt, Human
uuaaagccaccagggcuucuggaacaccuguc

SEQ ID NO: 265185 - RNA, 32 nt, Human
uuaaagccaccugcuuccuccaccccaccuuc

SEQ ID NO: 265186 - RNA, 32 nt, Human
uuaaagccgcuggagcuuggggagagaacauu

SEQ ID NO: 265187 - RNA, 32 nt, Human
uuaaagcucccaccugguggcucauuuuucau

SEQ ID NO: 265188 - RNA, 32 nt, Human
uuaaagcugcaacacagcuggugaugagaggc

SEQ ID NO: 265189 - RNA, 32 nt, Human
uuaaagcugcaagcuuucugucuucaguggau

SEQ ID NO: 265190 - RNA, 32 nt, Human
uuaaagcugcuuccuguuuguugagggucugu

SEQ ID NO: 265191 - RNA, 32 nt, Human
uuaaagcugggaaccuguugggaguucacaag

SEQ ID NO: 265192 - RNA, 32 nt, Human
uuaaagcuuaaauuuaugaaccaccuuugugg

SEQ ID NO: 265193 - RNA, 32 nt, Human
uuaaagcuuuaaaaguuuaacagucuaaaaca

SEQ ID NO: 265194 - RNA, 32 nt, Human
uuaaagcuuucaacauguacaggaaguuggaa

SEQ ID NO: 265195 - RNA, 32 nt, Human
uuaaagcuuuccaugggcucugccccaaggcc

SEQ ID NO: 265196 - RNA, 32 nt, Human
uuaaagcuuuucucccuccuuguucuuguuuu

SEQ ID NO: 265197 - RNA, 32 nt, Human
uuaaaggaaaccacucuuucuacaggaaacaa

SEQ ID NO: 265198 - RNA, 32 nt, Human
uuaaaggaauaagguguugccuggaauuucug

SEQ ID NO: 265199 - RNA, 32 nt, Human
uuaaaggagauucuucucccacccccaacuuu

SEQ ID NO: 265200 - RNA, 32 nt, Human
uuaaaggagccagccagguguaauacagucaa

SEQ ID NO: 265201 - RNA, 32 nt, Human
uuaaaggaggagugcaucuuuggccgacagug

SEQ ID NO: 265202 - RNA, 32 nt, Human
uuaaaggaggggcuaggggagaagcugcagcu

SEQ ID NO: 265203 - RNA, 32 nt, Human
uuaaaggagugagccagucacccaggagaauc

SEQ ID NO: 265204 - RNA, 32 nt, Human
uuaaaggauuucuuccucugggacaccaaagc

SEQ ID NO: 265205 - RNA, 32 nt, Human
uuaaaggcaacuuaugaaggcaaaacaggacu

SEQ ID NO: 265206 - RNA, 32 nt, Human
uuaaaggcaaggaaggauugguauaugauugc

SEQ ID NO: 265207 - RNA, 32 nt, Human
uuaaaggcaaguaugucauauuacugaggcua

SEQ ID NO: 265208 - RNA, 32 nt, Human
uuaaaggccuggaacugggaggaagcuggaga

SEQ ID NO: 265209 - RNA, 32 nt, Human
uuaaaggcuguaauuggagcagcuuuuggcug

SEQ ID NO: 265210 - RNA, 32 nt, Human
uuaaaggcuuugccacauccuuuacauuuggg

SEQ ID NO: 265211 - RNA, 32 nt, Human
uuaaagggaggaaacuccucacagccuuuuua

SEQ ID NO: 265212 - RNA, 32 nt, Human
uuaaagggcacuugggcugaaggaucgcuuug

SEQ ID NO: 265213 - RNA, 31 nt, Human
uuaaaggggcugucucccaaugaaagaggca

SEQ ID NO: 265214 - RNA, 32 nt, Human
uuaaaggguccaguucugauuggagccucuag

SEQ ID NO: 265215 - RNA, 32 nt, Human
uuaaagggucuuuugcagaugguacaaauuag

SEQ ID NO: 265216 - RNA, 32 nt, Human
uuaaagguauuggcauacuccacacaucugua

SEQ ID NO: 265217 - RNA, 32 nt, Human
uuaaaggucaugugaaaacucccacuggaaau

SEQ ID NO: 265218 - RNA, 32 nt, Human
uuaaaggugguuuucgcccuuccucucccaca

SEQ ID NO: 265219 - RNA, 32 nt, Human
uuaaaguaagcauuuuuaaaggauuuauuuua

SEQ ID NO: 265220 - RNA, 32 nt, Human
uuaaagucaaccggagaacccaaaaaucagga

SEQ ID NO: 265221 - RNA, 32 nt, Human
uuaaagucaggaguccaagaccagacucgcca

SEQ ID NO: 265222 - RNA, 32 nt, Human
uuaaagucauucucugccugcauccagccccu

SEQ ID NO: 265223 - RNA, 28 nt, Human
uuaaagugaaaaugcauuuuuaaagggc

SEQ ID NO: 265224 - RNA, 32 nt, Human
uuaaagugaagaaacaauggccagcaaucaca

SEQ ID NO: 265225 - RNA, 32 nt, Human
uuaaagugagagaagagagagaugucccagag

SEQ ID NO: 265226 - RNA, 32 nt, Human
uuaaagugagagcacgccuguacuagagcaag

SEQ ID NO: 265227 - RNA, 32 nt, Human
uuaaagugaggaguucaagaccagccugagca

SEQ ID NO: 265228 - RNA, 32 nt, Human
uuaaagugaggcuguacccacagaucaugcuc

SEQ ID NO: 265229 - RNA, 32 nt, Human
uuaaagugauuugaaaaauacucauucugaac

SEQ ID NO: 265230 - RNA, 32 nt, Human
uuaaagugcugagcuuagugcccagcccaaaa

SEQ ID NO: 265231 - RNA, 32 nt, Human
uuaaaguguagaaaauauugucuugccgaagg

SEQ ID NO: 265232 - RNA, 31 nt, Human
uuaaaguguccaggcaucacagaagcacagg

SEQ ID NO: 265233 - RNA, 32 nt, Human
uuaaagugugguuaugggcaggaagacagacu

SEQ ID NO: 265234 - RNA, 32 nt, Human
uuaaaguuauagcuaauagaugcuguuggggg

SEQ ID NO: 265235 - RNA, 31 nt, Human
uuaaaguucaauaaauacuuuguugaauuua

SEQ ID NO: 265236 - RNA, 32 nt, Human
uuaaaguucaguauuucaugguguuuucaggg

SEQ ID NO: 265237 - RNA, 32 nt, Human
uuaaaguucaguugacuuuccccaccaaaugg

SEQ ID NO: 265238 - RNA, 32 nt, Human
uuaaaguucccuauuugugaauucugggauua

SEQ ID NO: 265239 - RNA, 32 nt, Human
uuaaaguuucauuauuggcaacuagaggguug

SEQ ID NO: 265240 - RNA, 32 nt, Human
uuaaaguuuccucugcucagcaucauuucaug

SEQ ID NO: 265241 - RNA, 32 nt, Human
uuaaaguuugggguaaagauuggcaaacuuuu

SEQ ID NO: 265242 - RNA, 32 nt, Human
uuaaaguuuuugaaauguuuuguuuacuaagu

SEQ ID NO: 265243 - RNA, 32 nt, Human
uuaaauaaaauuaaugggacucuugcaaagua

SEQ ID NO: 265244 - RNA, 32 nt, Human
uuaaauaacacuagucacaaugcaguagcagc

SEQ ID NO: 265245 - RNA, 32 nt, Human
uuaaauaagaugauuauuuggcccaggcugag

SEQ ID NO: 265246 - RNA, 32 nt, Human
uuaaauaaggguacuccaucugccacagaauc

SEQ ID NO: 265247 - RNA, 32 nt, Human
uuaaauaaguuacuugccaguuugugagagca

SEQ ID NO: 265248 - RNA, 32 nt, Human
uuaaauaauagucugauugauacaguuuguac

SEQ ID NO: 265249 - RNA, 32 nt, Human
uuaaauacaaaacuggacaggccaggcauggu

SEQ ID NO: 265250 - RNA, 32 nt, Human
uuaaauacaccaacaugagacaucaguaguca

SEQ ID NO: 265251 - RNA, 32 nt, Human
uuaaauacaggagagacacucaagacagaaau

SEQ ID NO: 265252 - RNA, 32 nt, Human
uuaaauacauauuaguuuuaacuuuuccuacc

SEQ ID NO: 265253 - RNA, 32 nt, Human
uuaaauaccauccuuaauacugggaacagaau

SEQ ID NO: 265254 - RNA, 32 nt, Human
uuaaauacugucugugagaaaccagcugguuu

SEQ ID NO: 265255 - RNA, 32 nt, Human
uuaaauagaguuuccaucuuuugucagcucug

SEQ ID NO: 265256 - RNA, 32 nt, Human
uuaaauagcacagaccuauugugcacaucuuu

SEQ ID NO: 265257 - RNA, 32 nt, Human
uuaaauagccacaguccuuaagccacacacau

SEQ ID NO: 265258 - RNA, 32 nt, Human
uuaaauagguccugagacuguugauagcccca

SEQ ID NO: 265259 - RNA, 32 nt, Human
uuaaauauacaauuaucaagcaaguaugaagu

SEQ ID NO: 265260 - RNA, 32 nt, Human
uuaaauauaucuauauuauuguauuuaaaaug

SEQ ID NO: 265261 - RNA, 32 nt, Human
uuaaauauauuuuaauauuugcccucacaggu

SEQ ID NO: 265262 - RNA, 32 nt, Human
uuaaauaucaaagcaguugucauuuggaaguc

SEQ ID NO: 265263 - RNA, 32 nt, Human
uuaaauaugauccucagacaugcagcugugug

SEQ ID NO: 265264 - RNA, 32 nt, Human
uuaaauauucucuggaaccugauaccugcagu

SEQ ID NO: 265265 - RNA, 32 nt, Human
uuaaauauugaauaaguauucuucaucagcau

SEQ ID NO: 265266 - RNA, 32 nt, Human
uuaaauauuucucuuuuuaaagcuucugccaa

SEQ ID NO: 265267 - RNA, 32 nt, Human
uuaaaucaaaggacaccagaccugaaggacgu

SEQ ID NO: 265268 - RNA, 32 nt, Human
uuaaaucaagagcuuacauaauuuuaaccagu

SEQ ID NO: 265269 - RNA, 32 nt, Human
uuaaaucaaggaggcuguaguagaggcaguuu

SEQ ID NO: 265270 - RNA, 32 nt, Human
uuaaaucaaucaggaaugagucaaucagccuu

SEQ ID NO: 265271 - RNA, 32 nt, Human
uuaaaucaggaaccuuguugcuucugguaucu

SEQ ID NO: 265272 - RNA, 32 nt, Human
uuaaaucagugcaguggccagggagauggaac

SEQ ID NO: 265273 - RNA, 32 nt, Human
uuaaaucaucugcugcugugguuaucuccuau

SEQ ID NO: 265274 - RNA, 32 nt, Human
uuaaaucaugccaggaucaugcacccuuguua

SEQ ID NO: 265275 - RNA, 32 nt, Human
uuaaaucauuaucagguuauuuccuaauguaa

SEQ ID NO: 265276 - RNA, 32 nt, Human
uuaaauccaacucaacuuuauaagcuaaggaa

SEQ ID NO: 265277 - RNA, 32 nt, Human
uuaaauccaacuuuucacagugaagugccuuu

SEQ ID NO: 265278 - RNA, 32 nt, Human
uuaaauccaggauccaaucaagaauuauacgu

SEQ ID NO: 265279 - RNA, 32 nt, Human
uuaaaucuagaacgaacaaaauuucagagcuc

SEQ ID NO: 265280 - RNA, 32 nt, Human
uuaaaucucagcugggauccuggaccugggag

SEQ ID NO: 265281 - RNA, 32 nt, Human
uuaaaucucccagaagaggaaaguggccugcu

SEQ ID NO: 265282 - RNA, 32 nt, Human
uuaaaucucugagcuaacagugaccuuugaua

SEQ ID NO: 265283 - RNA, 32 nt, Human
uuaaaucugccuggcguccccucccucugucu

SEQ ID NO: 265284 - RNA, 32 nt, Human
uuaaaucuuaaauuuaauagagucuagugaaa

SEQ ID NO: 265285 - RNA, 32 nt, Human
uuaaaucuuccuaguaguuuguuuucaccaaa

SEQ ID NO: 265286 - RNA, 32 nt, Human
uuaaaugaacaaguaaccacaucucaggcggc

SEQ ID NO: 265287 - RNA, 32 nt, Human
uuaaaugaacugcuuagcccugcucugaagaa

SEQ ID NO: 265288 - RNA, 32 nt, Human
uuaaaugaagaaaggaguggagggaggggauc

SEQ ID NO: 265289 - RNA, 32 nt, Human
uuaaaugauguaauauuccaggaugcugcugc

SEQ ID NO: 265290 - RNA, 32 nt, Human
uuaaaugauuucauaaggaaaaccacuguuug

SEQ ID NO: 265291 - RNA, 32 nt, Human
uuaaaugcauuuuacuacaaagcacaauucau

SEQ ID NO: 265292 - RNA, 32 nt, Human
uuaaaugccacguuuucauaccaagagucauu

SEQ ID NO: 265293 - RNA, 32 nt, Human
uuaaaugccuccuauagaaauucaaggaaugu

SEQ ID NO: 265294 - RNA, 32 nt, Human
uuaaaugcuaugcagucauuaguagaaaauuu

SEQ ID NO: 265295 - RNA, 32 nt, Human
uuaaauggaaucuguaguuuguuugcaggaga

SEQ ID NO: 265296 - RNA, 32 nt, Human
uuaaauggauuucuaggaaaagcuaccuuaag

SEQ ID NO: 265297 - RNA, 32 nt, Human
uuaaauggcauuuaaaaauuugcugaaugcuu

SEQ ID NO: 265298 - RNA, 32 nt, Human
uuaaauggccccuguuugaacucucaugcuuu

SEQ ID NO: 265299 - RNA, 31 nt, Human
uuaaauggggacuucuuuccccauugcuugu

SEQ ID NO: 265300 - RNA, 32 nt, Human
uuaaauggucaacaguggaaaaguaagggaug

SEQ ID NO: 265301 - RNA, 32 nt, Human
uuaaauggugucggaauuguuguauuuuccuu

SEQ ID NO: 265302 - RNA, 32 nt, Human
uuaaauggugucuuucuauguugcccagggug

SEQ ID NO: 265303 - RNA, 32 nt, Human
uuaaauguaaugcaaccaaguuccucccagau

SEQ ID NO: 265304 - RNA, 32 nt, Human
uuaaauguacuaugccaucauccaccauuuag

SEQ ID NO: 265305 - RNA, 32 nt, Human
uuaaauguauucucucauuugaccuucauacu

SEQ ID NO: 265306 - RNA, 32 nt, Human
uuaaaugucaguugaaaauuauggcuguacua

SEQ ID NO: 265307 - RNA, 32 nt, Human
uuaaauguccauuuuuauucuuuaugcuugaa

SEQ ID NO: 265308 - RNA, 32 nt, Human
uuaaaugucccaggcuggaagguggagcgaga

SEQ ID NO: 265309 - RNA, 32 nt, Human
uuaaaugugaacccaacuuuuccccagggcuu

SEQ ID NO: 265310 - RNA, 24 nt, Human
uuaaaugugaacucaacacuucca

SEQ ID NO: 265311 - RNA, 32 nt, Human
uuaaaugugccagcagguaacauuuacagucu

SEQ ID NO: 265312 - RNA, 32 nt, Human
uuaaaugugcuacccucugccucaaggcuugg

SEQ ID NO: 265313 - RNA, 32 nt, Human
uuaaauguuugcagucagugcaagacaagucu

SEQ ID NO: 265314 - RNA, 32 nt, Human
uuaaauguuuuuccuccuaugcaaucaccauu

SEQ ID NO: 265315 - RNA, 32 nt, Human
uuaaauuaauuauagacagagagaggcauuua

SEQ ID NO: 265316 - RNA, 32 nt, Human
uuaaauuaccccucccugcacacacauacaca

SEQ ID NO: 265317 - RNA, 32 nt, Human
uuaaauuauaaggacugcaugguaauuuauag

SEQ ID NO: 265318 - RNA, 32 nt, Human
uuaaauuauugauuuuuaaauuaugggagcaa

SEQ ID NO: 265319 - RNA, 32 nt, Human
uuaaauuauuuaucaaguguauuugaaaaaua

SEQ ID NO: 265320 - RNA, 32 nt, Human
uuaaauuauuuuuauagagauggggguuuugc

SEQ ID NO: 265321 - RNA, 32 nt, Human
uuaaauucacaucucaaggagggagaacccgg

SEQ ID NO: 265322 - RNA, 32 nt, Human
uuaaauucaguauguuggccugugaguuacgg

SEQ ID NO: 265323 - RNA, 32 nt, Human
uuaaauucaguccuaagaaagaggagugcuug

SEQ ID NO: 265324 - RNA, 32 nt, Human
uuaaauuccaggccuuucaucccccuuccuuc

SEQ ID NO: 265325 - RNA, 32 nt, Human
uuaaauucuccacucuguccaucagauacuau

SEQ ID NO: 265326 - RNA, 32 nt, Human
uuaaauucuguucacucaacaaugccagauga

SEQ ID NO: 265327 - RNA, 32 nt, Human
uuaaauucuuaugugucuuuugugucuuaggc

SEQ ID NO: 265328 - RNA, 32 nt, Human
uuaaauucuuugaaaguggcucccagugcuau

SEQ ID NO: 265329 - RNA, 32 nt, Human
uuaaauugcaauucaccauccccagcccagcc

SEQ ID NO: 265330 - RNA, 32 nt, Human
uuaaauuggcugcuacugucaguuauuuugcu

SEQ ID NO: 265331 - RNA, 32 nt, Human
uuaaauuuagccuugccguauuauuuauaguu

SEQ ID NO: 265332 - RNA, 32 nt, Human
uuaaauuuaguuuuggagaauggaauuuuugc

SEQ ID NO: 265333 - RNA, 23 nt, Human
uuaaauuucagaagauaaauaaa

SEQ ID NO: 265334 - RNA, 32 nt, Human
uuaaauuuccucaccuucacuauugaucugua

SEQ ID NO: 265335 - RNA, 31 nt, Human
uuaaauuugauaaaucuccuguugagugaca

SEQ ID NO: 265336 - RNA, 32 nt, Human
uuaaauuugcccagguuucugacaggugauac

SEQ ID NO: 265337 - RNA, 32 nt, Human
uuaaauuuggguuauuuuugguuagugcaauu

SEQ ID NO: 265338 - RNA, 32 nt, Human
uuaaauuuuaagucuuccagucuuccauguga

SEQ ID NO: 265339 - RNA, 32 nt, Human
uuaaauuuugaaaucuaaacauucuuucccac

SEQ ID NO: 265340 - RNA, 32 nt, Human
uuaaauuuugagacaggcucucacucuguugc

SEQ ID NO: 265341 - RNA, 22 nt, Human
uuaaauuuugugacccaacaaa

SEQ ID NO: 265342 - RNA, 32 nt, Human
uuaaauuuuguuuguauuaagcacuuuuaauu

SEQ ID NO: 265343 - RNA, 32 nt, Human
uuaacaaaacaguccuaaauagcagcccucaa

SEQ ID NO: 265344 - RNA, 32 nt, Human
uuaacaaagauagaguuuacaguuuuugaacu

SEQ ID NO: 265345 - RNA, 32 nt, Human
uuaacaaccacucucgaaauucuaucauuuuu

SEQ ID NO: 265346 - RNA, 21 nt, Human
uuaacaagacccagaggagcu

SEQ ID NO: 265347 - RNA, 32 nt, Human
uuaacaagaggcauuugugcacacacacaggg

SEQ ID NO: 265348 - RNA, 32 nt, Human
uuaacaaggaccuguccaacaugcccugccca

SEQ ID NO: 265349 - RNA, 32 nt, Human
uuaacaagguaggaaguuaggagaucauuuac

SEQ ID NO: 265350 - RNA, 32 nt, Human
uuaacaauaacaaaagccauuuauuuauucca

SEQ ID NO: 265351 - RNA, 32 nt, Human
uuaacaaucuaacaauaauauuucaagugccu

SEQ ID NO: 265352 - RNA, 27 nt, Human
uuaacaaugaacauguaacuucucuca

SEQ ID NO: 265353 - RNA, 19 nt, Human
uuaacaauuggauuucuaa

SEQ ID NO: 265354 - RNA, 32 nt, Human
uuaacaauuugaaaaauuauucuuuaauguau

SEQ ID NO: 265355 - RNA, 32 nt, Human
uuaacaauuuguaagaugacugugcaguaaua

SEQ ID NO: 265356 - RNA, 32 nt, Human
uuaacaauuuucaugucccccaccucauguuu

SEQ ID NO: 265357 - RNA, 32 nt, Human
uuaacacaaucccaccaugagggauggguaaa

SEQ ID NO: 265358 - RNA, 32 nt, Human
uuaacacaauuugcgucuucugaucccauucc

SEQ ID NO: 265359 - RNA, 32 nt, Human
uuaacacagccgggcuugggggcagucaggag

SEQ ID NO: 265360 - RNA, 32 nt, Human
uuaacacagcucagggaugacaaccaggaugg

SEQ ID NO: 265361 - RNA, 32 nt, Human
uuaacacaggcagacgggaccugaaggggccg

SEQ ID NO: 265362 - RNA, 32 nt, Human
uuaacacaucguugguuugaaaacuuccauuu

SEQ ID NO: 265363 - RNA, 32 nt, Human
uuaacacauuuaagaaguagguguguggccuu

SEQ ID NO: 265364 - RNA, 32 nt, Human
uuaacacccugagaccaucuucccacuuccaa

SEQ ID NO: 265365 - RNA, 32 nt, Human
uuaacaccuaaccccaaaggcucuuuuaagag

SEQ ID NO: 265366 - RNA, 32 nt, Human
uuaacaccucaccaaguucuuccagcaaaaug

SEQ ID NO: 265367 - RNA, 32 nt, Human
uuaacaccuggcaacagucuccccucauccug

SEQ ID NO: 265368 - RNA, 32 nt, Human
uuaacacuagaaaacauuccaaaacuuuaagg

SEQ ID NO: 265369 - RNA, 32 nt, Human
uuaacacuagggacugcguccauguacuagua

SEQ ID NO: 265370 - RNA, 32 nt, Human
uuaacacuaguaacagugaaagcacaagauuu

SEQ ID NO: 265371 - RNA, 32 nt, Human
uuaacacucauuuuuacucccauugcucaaca

SEQ ID NO: 265372 - RNA, 32 nt, Human
uuaacacucugugacagagcugcagaccccug

SEQ ID NO: 265373 - RNA, 32 nt, Human
uuaacacugagcugucauguuuuaaagcuugc

SEQ ID NO: 265374 - RNA, 32 nt, Human
uuaacacugaguaggcaguugguuaaagaagc

SEQ ID NO: 265375 - RNA, 32 nt, Human
uuaacacuuggcucaaaccucuaggucauacu

SEQ ID NO: 265376 - RNA, 32 nt, Human
uuaacagaaaguaaauauguauaaaauuugaa

SEQ ID NO: 265377 - RNA, 32 nt, Human
uuaacagaacaacagggugaaaccccaucucu

SEQ ID NO: 265378 - RNA, 32 nt, Human
uuaacagacguguccugguaaauaugauuuuu

SEQ ID NO: 265379 - RNA, 32 nt, Human
uuaacagauagaguguggcuucauuuguccau

SEQ ID NO: 265380 - RNA, 32 nt, Human
uuaacagauuuccucuggaaugucuucccuac

SEQ ID NO: 265381 - RNA, 32 nt, Human
uuaacagcaagcuuuuucuuuuauguaaaaua

SEQ ID NO: 265382 - RNA, 32 nt, Human
uuaacagcccuccacuccagauggauauccag

SEQ ID NO: 265383 - RNA, 32 nt, Human
uuaacagcucauaucaggagcugugauaagua

SEQ ID NO: 265384 - RNA, 32 nt, Human
uuaacagcuuaauuuuucucuuuuacuccaua

SEQ ID NO: 265385 - RNA, 32 nt, Human
uuaacaggagggcagagggcaggggacagacg

SEQ ID NO: 265386 - RNA, 32 nt, Human
uuaacaggcaggcaaggggugcggggaccagg

SEQ ID NO: 265387 - RNA, 32 nt, Human
uuaacaggcuaaaaaugccacuuuuuggcugg

SEQ ID NO: 265388 - RNA, 32 nt, Human
uuaacagggagaaaguaguggcuucccuuuuc

SEQ ID NO: 265389 - RNA, 32 nt, Human
uuaacagggagggccugagaaaagaaugggag

SEQ ID NO: 265390 - RNA, 32 nt, Human
uuaacagucugucaguuacacuguacauuagg

SEQ ID NO: 265391 - RNA, 22 nt, Human
uuaacagugaaaucugaucaua

SEQ ID NO: 265392 - RNA, 32 nt, Human
uuaacagugccuggcuuggugccuggcaccua

SEQ ID NO: 265393 - RNA, 32 nt, Human
uuaacaguuuuuccugaguuuacugaagaaau

SEQ ID NO: 265394 - RNA, 32 nt, Human
uuaacauacacccaagcccacccggcccgucg

SEQ ID NO: 265395 - RNA, 32 nt, Human
uuaacaucacccagauuucuucaguuauaaau

SEQ ID NO: 265396 - RNA, 32 nt, Human
uuaacaucauuuccacagaccccucugcccug

SEQ ID NO: 265397 - RNA, 32 nt, Human
uuaacaucccacaacaaccacccggaagccug

SEQ ID NO: 265398 - RNA, 32 nt, Human
uuaacaucccuguuaugcugguuucucuuaaa

SEQ ID NO: 265399 - RNA, 32 nt, Human
uuaacauccuccugccugaaaacaaauagguc

SEQ ID NO: 265400 - RNA, 32 nt, Human
uuaacaucuacaaucaguugacuuuaagugaa

SEQ ID NO: 265401 - RNA, 32 nt, Human
uuaacaucucagaaaacucugguaaaugauca

SEQ ID NO: 265402 - RNA, 32 nt, Human
uuaacaucuccaacaccaaacaacagucacuu

SEQ ID NO: 265403 - RNA, 32 nt, Human
uuaacaucuggagccuuuguggguggaaauau

SEQ ID NO: 265404 - RNA, 32 nt, Human
uuaacaugauuaacugaccauacuacuaaugu

SEQ ID NO: 265405 - RNA, 32 nt, Human
uuaacaugauuugccuuuuuguguuugcuuuu

SEQ ID NO: 265406 - RNA, 32 nt, Human
uuaacauuacagccacagugaccuuucaaaaa

SEQ ID NO: 265407 - RNA, 32 nt, Human
uuaacauugaaagguaaaaucugauuauuuag

SEQ ID NO: 265408 - RNA, 32 nt, Human
uuaacauuugagucaggcuggggaaggcagac

SEQ ID NO: 265409 - RNA, 32 nt, Human
uuaaccaaccaccaccaccaccaaaaccaguu

SEQ ID NO: 265410 - RNA, 32 nt, Human
uuaaccaagauggggagaggggagggccucag

SEQ ID NO: 265411 - RNA, 32 nt, Human
uuaaccaaggagagaggaagggagcagguuca

SEQ ID NO: 265412 - RNA, 32 nt, Human
uuaaccaaggcagaaagaggugaguaacuugc

SEQ ID NO: 265413 - RNA, 32 nt, Human
uuaaccaaggggaaauacaucagaucugcaac

SEQ ID NO: 265414 - RNA, 32 nt, Human
uuaaccacaagaaaauaaucccacauauacaa

SEQ ID NO: 265415 - RNA, 32 nt, Human
uuaaccacacagucuuucuuagccauuccaaa

SEQ ID NO: 265416 - RNA, 32 nt, Human
uuaaccaccaugggcaaggcagucucucuccc

SEQ ID NO: 265417 - RNA, 32 nt, Human
uuaaccacuguuaagugaucugugaucaaggc

SEQ ID NO: 265418 - RNA, 32 nt, Human
uuaaccagcacauuucuccuguuuacacucgg

SEQ ID NO: 265419 - RNA, 32 nt, Human
uuaaccagcugauuuuucuuagugugaugauu

SEQ ID NO: 265420 - RNA, 32 nt, Human
uuaaccagcuuccugagacaugcacccucaug

SEQ ID NO: 265421 - RNA, 32 nt, Human
uuaaccaggggcaccuguuugagcuggaggug

SEQ ID NO: 265422 - RNA, 32 nt, Human
uuaaccauaguacuccuccccaccucaaguag

SEQ ID NO: 265423 - RNA, 24 nt, Human
uuaaccauaugcaugcaaguguua

SEQ ID NO: 265424 - RNA, 32 nt, Human
uuaaccaucuggcugcuuguccccuggagaaa

SEQ ID NO: 265425 - RNA, 32 nt, Human
uuaaccaucugucaguuacauugcaguauuuu

SEQ ID NO: 265426 - RNA, 32 nt, Human
uuaaccaugcaagcccucccaccucccagggc

SEQ ID NO: 265427 - RNA, 32 nt, Human
uuaaccauuucgacucgagcagugccacuuua

SEQ ID NO: 265428 - RNA, 32 nt, Human
uuaacccaaaaggcggagguugcagugagcca

SEQ ID NO: 265429 - RNA, 32 nt, Human
uuaacccaggaggcagagguugcagugagcug

SEQ ID NO: 265430 - RNA, 32 nt, Human
uuaacccaucccucagcaaacgcagcucuucc

SEQ ID NO: 265431 - RNA, 32 nt, Human
uuaaccccagcaccucagugugggacuggguu

SEQ ID NO: 265432 - RNA, 32 nt, Human
uuaaccccaggagguggggguuguugugagcc

SEQ ID NO: 265433 - RNA, 32 nt, Human
uuaacccccacccuuccagucgggugugaggg

SEQ ID NO: 265434 - RNA, 32 nt, Human
uuaaccccuucuuucacugcauggcccuucaa

SEQ ID NO: 265435 - RNA, 32 nt, Human
uuaaccccuuuucuguguuacagaguaacuuc

SEQ ID NO: 265436 - RNA, 32 nt, Human
uuaacccggaagguggaguuugcagugagccg

SEQ ID NO: 265437 - RNA, 32 nt, Human
uuaacccgggagguggagguugcagugagcug

SEQ ID NO: 265438 - RNA, 32 nt, Human
uuaacccgggcccgggcccaccuuggacuccc

SEQ ID NO: 265439 - RNA, 32 nt, Human
uuaacccggugaauaaauguagauccugccau

SEQ ID NO: 265440 - RNA, 32 nt, Human
uuaacccuaaaauuuuaaggccacggcuugug

SEQ ID NO: 265441 - RNA, 32 nt, Human
uuaacccucgcacuuucuccacuguggagaug

SEQ ID NO: 265442 - RNA, 32 nt, Human
uuaacccugcaagcuguuuccacaucagaacu

SEQ ID NO: 265443 - RNA, 32 nt, Human
uuaacccugcucccaucuccccuucccccacu

SEQ ID NO: 265444 - RNA, 32 nt, Human
uuaacccuuagcaacugaucuuuucacugugu

SEQ ID NO: 265445 - RNA, 32 nt, Human
uuaacccuucuuucuuuucuauuucuccgugu

SEQ ID NO: 265446 - RNA, 32 nt, Human
uuaacccuugcccccaucccucccucuccccu

SEQ ID NO: 265447 - RNA, 32 nt, Human
uuaacccuuguagcccaauccccucucuucgc

SEQ ID NO: 265448 - RNA, 32 nt, Human
uuaacccuuuccucccuucucucccucccucc

SEQ ID NO: 265449 - RNA, 32 nt, Human
uuaaccgaaaccaguuuugcaaucaauuccug

SEQ ID NO: 265450 - RNA, 32 nt, Human
uuaaccgaaacuagcaaucccaggcgguacaa

SEQ ID NO: 265451 - RNA, 32 nt, Human
uuaaccguugcaaagcacacugucuuucucag

SEQ ID NO: 265452 - RNA, 32 nt, Human
uuaaccuaaaagauuguauuuugccaacuuuc

SEQ ID NO: 265453 - RNA, 32 nt, Human
uuaaccuaaaugcuauuuaucucugagccguc

SEQ ID NO: 265454 - RNA, 31 nt, Human
uuaaccuaaguguccaucaauagagaauugg

SEQ ID NO: 265455 - RNA, 31 nt, Human
uuaaccuagguguccaucaauagagaauugg

SEQ ID NO: 265456 - RNA, 32 nt, Human
uuaaccucccaaagugcugggauuacaggugu

SEQ ID NO: 265457 - RNA, 32 nt, Human
uuaaccuccccaagccucaguuucuaccauaa

SEQ ID NO: 265458 - RNA, 32 nt, Human
uuaaccuccccucuccccgggaccgcgcuagg

SEQ ID NO: 265459 - RNA, 32 nt, Human
uuaaccuccuuguugcuuaggaugaggagacu

SEQ ID NO: 265460 - RNA, 32 nt, Human
uuaaccucucccaccaugugaggacaaaguga

SEQ ID NO: 265461 - RNA, 32 nt, Human
uuaaccucugaacucugaccucaggaggcucu

SEQ ID NO: 265462 - RNA, 32 nt, Human
uuaaccugcagacagaacucaguuagucgggg

SEQ ID NO: 265463 - RNA, 32 nt, Human
uuaaccugccuggccgggcgcaauggcucaug

SEQ ID NO: 265464 - RNA, 32 nt, Human
uuaaccugggcaacauaaugauacccugucuc

SEQ ID NO: 265465 - RNA, 22 nt, Human
uuaaccuguaaaggaggcucuu

SEQ ID NO: 265466 - RNA, 32 nt, Human
uuaaccuguauucucuuuccucccagaacuau

SEQ ID NO: 265467 - RNA, 32 nt, Human
uuaaccugugaacuuccuucuccuggcucaga

SEQ ID NO: 265468 - RNA, 23 nt, Human
uuaaccuucucauuugucuccua

SEQ ID NO: 265469 - RNA, 21 nt, Human
uuaaccuucugagugcugcua

SEQ ID NO: 265470 - RNA, 32 nt, Human
uuaaccuuggaggcggagguugcauugagcug

SEQ ID NO: 265471 - RNA, 32 nt, Human
uuaacgagacugauauucaacaggcuucuaag

SEQ ID NO: 265472 - RNA, 32 nt, Human
uuaacgcaacccaggaaugcucucccggagug

SEQ ID NO: 265473 - RNA, 32 nt, Human
uuaacgcaccgacuagacacacaaagcaguug

SEQ ID NO: 265474 - RNA, 32 nt, Human
uuaacgcaggagcuggcagagaaaguggauac

SEQ ID NO: 265475 - RNA, 31 nt, Human
uuaacggagguaaaagaguggcucuguuuga

SEQ ID NO: 265476 - RNA, 32 nt, Human
uuaacgggccuuuuucacuuagaagcugcaca

SEQ ID NO: 265477 - RNA, 32 nt, Human
uuaacgggugugagccacggcgcccagcccag

SEQ ID NO: 265478 - RNA, 32 nt, Human
uuaacgugccuuucugacucaucuccuucucu

SEQ ID NO: 265479 - RNA, 32 nt, Human
uuaacguguagguugagaacaagccuaaagga

SEQ ID NO: 265480 - RNA, 32 nt, Human
uuaacguuuuugaauuacacaugcuuucacua

SEQ ID NO: 265481 - RNA, 32 nt, Human
uuaacuaaaacuugaagaacuaaaacaacaau

SEQ ID NO: 265482 - RNA, 32 nt, Human
uuaacuaauuuaaaccagcagaaaagugcuua

SEQ ID NO: 265483 - RNA, 32 nt, Human
uuaacuacaauucacuguugugagaauauucc

SEQ ID NO: 265484 - RNA, 32 nt, Human
uuaacuacacagaggacccaggggaaacgagc

SEQ ID NO: 265485 - RNA, 32 nt, Human
uuaacuacauaaaaauguuuauaggacaagaa

SEQ ID NO: 265486 - RNA, 32 nt, Human
uuaacuacccccagcccgaggcagggugaggg

SEQ ID NO: 265487 - RNA, 32 nt, Human
uuaacuacucuccugguuauguuggccuuaca

SEQ ID NO: 265488 - RNA, 32 nt, Human
uuaacuacuguauucccacaaggaauccccag

SEQ ID NO: 265489 - RNA, 32 nt, Human
uuaacuagcagcuuuugcuccacccaccagag

SEQ ID NO: 265490 - RNA, 32 nt, Human
uuaacuagcuuaguggacccucugccuuuuug

SEQ ID NO: 265491 - RNA, 32 nt, Human
uuaacuaggcuucaguauaucaguguuuauuu

SEQ ID NO: 265492 - RNA, 32 nt, Human
uuaacuauccuagcccaccaguugucagaaau

SEQ ID NO: 265493 - RNA, 32 nt, Human
uuaacuauccuuccagggcucuuccagaugag

SEQ ID NO: 265494 - RNA, 32 nt, Human
uuaacuauuaguuaaaggugagggaaaaucau

SEQ ID NO: 265495 - RNA, 32 nt, Human
uuaacuauucaucagaggugcuguaauuuuaa

SEQ ID NO: 265496 - RNA, 32 nt, Human
uuaacucaaccagcagcagagccagggcccag

SEQ ID NO: 265497 - RNA, 32 nt, Human
uuaacucaacccagaaccauuggucagaauug

SEQ ID NO: 265498 - RNA, 32 nt, Human
uuaacucacugcaaccuccgcuucccagguaa

SEQ ID NO: 265499 - RNA, 32 nt, Human
uuaacucagcccuucccaucagauaaaaagaa

SEQ ID NO: 265500 - RNA, 32 nt, Human
uuaacucaggccuuuuuaagaggaaucacaau

SEQ ID NO: 265501 - RNA, 32 nt, Human
uuaacucaggcucguucuagggacucauucau

SEQ ID NO: 265502 - RNA, 32 nt, Human
uuaacucauagccucaaacuccuggucucaag

SEQ ID NO: 265503 - RNA, 32 nt, Human
uuaacucaugccaagcaucucagcuugggguc

SEQ ID NO: 265504 - RNA, 32 nt, Human
uuaacuccaagugccuuuuugacagugacaac

SEQ ID NO: 265505 - RNA, 32 nt, Human
uuaacucccgagaagagaguccuugugcacag

SEQ ID NO: 265506 - RNA, 32 nt, Human
uuaacucccuccaccagccugcugacagacac

SEQ ID NO: 265507 - RNA, 32 nt, Human
uuaacucuacuuccucuucagucugugguacu

SEQ ID NO: 265508 - RNA, 32 nt, Human
uuaacucuacuuuuacauccccaaaccaccuu

SEQ ID NO: 265509 - RNA, 32 nt, Human
uuaacucugagugccuugccagcacuaacauu

SEQ ID NO: 265510 - RNA, 32 nt, Human
uuaacucugcuguguguuaggcaauccuguaa

SEQ ID NO: 265511 - RNA, 32 nt, Human
uuaacucugggaguuggggacaguuuguauuc

SEQ ID NO: 265512 - RNA, 32 nt, Human
uuaacucuguaagaugcaaagagguuggauca

SEQ ID NO: 265513 - RNA, 32 nt, Human
uuaacucuucacugcuagacccaguuguguuc

SEQ ID NO: 265514 - RNA, 32 nt, Human
uuaacucuugacugccaagguuuccaagugag

SEQ ID NO: 265515 - RNA, 32 nt, Human
uuaacucuuguccaggcuggaggagugcaguc

SEQ ID NO: 265516 - RNA, 32 nt, Human
uuaacugaaaacuuacuuaauaguuuagaaga

SEQ ID NO: 265517 - RNA, 32 nt, Human
uuaacugaaagcuuccaagaauuuaaaaugag

SEQ ID NO: 265518 - RNA, 32 nt, Human
uuaacugaagugacagauuagaguuagaagug

SEQ ID NO: 265519 - RNA, 32 nt, Human
uuaacugaaguguuuaaaaagcugcauuucug

SEQ ID NO: 265520 - RNA, 32 nt, Human
uuaacugagccuccauuagugcacugagacca

SEQ ID NO: 265521 - RNA, 32 nt, Human
uuaacugaguccauuuaacuugcuuucuuuuu

SEQ ID NO: 265522 - RNA, 32 nt, Human
uuaacugaugacauuccaccacugugacuugu

SEQ ID NO: 265523 - RNA, 31 nt, Human
uuaacugcacuuuucauuacgugaauggaac

SEQ ID NO: 265524 - RNA, 32 nt, Human
uuaacugccaugagcccuaaagaagguuugcu

SEQ ID NO: 265525 - RNA, 32 nt, Human
uuaacugccuguaacaugaaacuucaaacuaa

SEQ ID NO: 265526 - RNA, 32 nt, Human
uuaacugggaggaauauuugacaguacuuauu

SEQ ID NO: 265527 - RNA, 32 nt, Human
uuaacuggugaagagaaaaaggcugaaaagaa

SEQ ID NO: 265528 - RNA, 32 nt, Human
uuaacugguuccugcaacccacuuuuaggucu

SEQ ID NO: 265529 - RNA, 32 nt, Human
uuaacuguacaucucaguggcuggaggccaug

SEQ ID NO: 265530 - RNA, 32 nt, Human
uuaacugucauuguuguugcccagagccaugg

SEQ ID NO: 265531 - RNA, 32 nt, Human
uuaacuguuuucccuugagauuuccuucuccu

SEQ ID NO: 265532 - RNA, 32 nt, Human
uuaacuuaaauagguacagcccacgcuugaug

SEQ ID NO: 265533 - RNA, 32 nt, Human
uuaacuuagcaggggcauggacuuuauagcac

SEQ ID NO: 265534 - RNA, 32 nt, Human
uuaacuuaguaaaauaguuugauuuuuaccug

SEQ ID NO: 265535 - RNA, 32 nt, Human
uuaacuucacagaaaaacacacaaggcaaagu

SEQ ID NO: 265536 - RNA, 32 nt, Human
uuaacuucacugcaauucuguuucccucauuu

SEQ ID NO: 265537 - RNA, 32 nt, Human
uuaacuucagccaggauugauggcagcugagg

SEQ ID NO: 265538 - RNA, 32 nt, Human
uuaacuuccagaaauaaacguuauauaggaac

SEQ ID NO: 265539 - RNA, 32 nt, Human
uuaacuuccucaucagaacucugcccuuccuu

SEQ ID NO: 265540 - RNA, 32 nt, Human
uuaacuuccuuugaggaagcugccuuauaguu

SEQ ID NO: 265541 - RNA, 32 nt, Human
uuaacuucucucuucacugcaucccaauccau

SEQ ID NO: 265542 - RNA, 32 nt, Human
uuaacuugccucuuacucuuugcccuuuagcu

SEQ ID NO: 265543 - RNA, 32 nt, Human
uuaacuugcuugccgccugccugcuugagcag

SEQ ID NO: 265544 - RNA, 32 nt, Human
uuaacuugcuuugcaagccuacucugaaaaua

SEQ ID NO: 265545 - RNA, 32 nt, Human
uuaacuuggaaaacaugggaagaccuugguga

SEQ ID NO: 265546 - RNA, 32 nt, Human
uuaacuugggaagaagucucagaggaaauuuu

SEQ ID NO: 265547 - RNA, 32 nt, Human
uuaacuuguuccccugcauccuggcauguccc

SEQ ID NO: 265548 - RNA, 32 nt, Human
uuaacuuucucagaccagaggcagaggacuua

SEQ ID NO: 265549 - RNA, 32 nt, Human
uuaacuuucugccucggccucuguggaugcag

SEQ ID NO: 265550 - RNA, 32 nt, Human
uuaacuuugguuuugcucuaguucuuucuuuu

SEQ ID NO: 265551 - RNA, 32 nt, Human
uuaacuuuguacuagacuggccugggccugcc

SEQ ID NO: 265552 - RNA, 32 nt, Human
uuaacuuuuaaaaaucaaaaugaugaaauccc

SEQ ID NO: 265553 - RNA, 32 nt, Human
uuaacuuuuccagaucuaacacuagcuuauuc

SEQ ID NO: 265554 - RNA, 32 nt, Human
uuaacuuuuucuucuuaaaauuauucauagau

SEQ ID NO: 265555 - RNA, 21 nt, Human
uuaagaaaaaauuauuuccau

SEQ ID NO: 265556 - RNA, 32 nt, Human
uuaagaaaaaguucaacccaggucuuguaucc

SEQ ID NO: 265557 - RNA, 32 nt, Human
uuaagaaaaauggagcucuugaaaucaaaaga

SEQ ID NO: 265558 - RNA, 32 nt, Human
uuaagaaaacuagcaaauauaugaaaagaccc

SEQ ID NO: 265559 - RNA, 32 nt, Human
uuaagaaaaugaauuuauucuguuauauuuau

SEQ ID NO: 265560 - RNA, 32 nt, Human
uuaagaaaccaauauuuaaaauguuggucuag

SEQ ID NO: 265561 - RNA, 24 nt, Human
uuaagaaacccugagauuaaaaaa

SEQ ID NO: 265562 - RNA, 32 nt, Human
uuaagaaagaauuggacguuagaaguugucau

SEQ ID NO: 265563 - RNA, 32 nt, Human
uuaagaaaggaaucuagccaaugagguccaag

SEQ ID NO: 265564 - RNA, 32 nt, Human
uuaagaaaguuggaaaggucucuccucccaag

SEQ ID NO: 265565 - RNA, 32 nt, Human
uuaagaaauggagagaaaaauaagcagaaucc

SEQ ID NO: 265566 - RNA, 32 nt, Human
uuaagaaccaggcaaccucugccuucuucccu

SEQ ID NO: 265567 - RNA, 32 nt, Human
uuaagaaccuauugaguggacauucuugguga

SEQ ID NO: 265568 - RNA, 24 nt, Human
uuaagaacgaaggagaaaaaggua

SEQ ID NO: 265569 - RNA, 32 nt, Human
uuaagaacuuaguuuuggucucagggagaagg

SEQ ID NO: 265570 - RNA, 32 nt, Human
uuaagaagaauuugaacauucaggccuugcug

SEQ ID NO: 265571 - RNA, 32 nt, Human
uuaagaagacuuaguaauaauaacaacaauag

SEQ ID NO: 265572 - RNA, 32 nt, Human
uuaagaagagucagcucagagaaagcaagcau

SEQ ID NO: 265573 - RNA, 32 nt, Human
uuaagaagcuaaaaggaaagaaaauaaaucua

SEQ ID NO: 265574 - RNA, 32 nt, Human
uuaagaaggagguggacgaugccuuaguggag

SEQ ID NO: 265575 - RNA, 32 nt, Human
uuaagaaggcauuggcaucugcuuuuaaugga

SEQ ID NO: 265576 - RNA, 32 nt, Human
uuaagaauccuggcucacuucuuuggugauac

SEQ ID NO: 265577 - RNA, 32 nt, Human
uuaagaaugagcugugcugugcaugggucccu

SEQ ID NO: 265578 - RNA, 31 nt, Human
uuaagaauggcggaaccaggaggacgaggag

SEQ ID NO: 265579 - RNA, 32 nt, Human
uuaagaaugggacuaaaaaggccaggcguggu

SEQ ID NO: 265580 - RNA, 32 nt, Human
uuaagaauggucccuggcuggucgcgguggcu

SEQ ID NO: 265581 - RNA, 32 nt, Human
uuaagaauuuggaacugaaacaugaagaggaa

SEQ ID NO: 265582 - RNA, 32 nt, Human
uuaagacaauaugcgcaauccucgccuuuccu

SEQ ID NO: 265583 - RNA, 32 nt, Human
uuaagacacuaguagagcaaagacuuaaucau

SEQ ID NO: 265584 - RNA, 32 nt, Human
uuaagacagagaaacagacagaaagagacaca

SEQ ID NO: 265585 - RNA, 32 nt, Human
uuaagacagaugucuauucauguucuuuagcu

SEQ ID NO: 265586 - RNA, 32 nt, Human
uuaagacaugcacucuugaguccuacaguaac

SEQ ID NO: 265587 - RNA, 32 nt, Human
uuaagacauucuaagucacaggaugagacagg

SEQ ID NO: 265588 - RNA, 32 nt, Human
uuaagaccaaucacagcuugugccucagauca

SEQ ID NO: 265589 - RNA, 32 nt, Human
uuaagaccaccaggagcacacuuguaaguaaa

SEQ ID NO: 265590 - RNA, 32 nt, Human
uuaagaccagccugaccaacauggagaaaccu

SEQ ID NO: 265591 - RNA, 32 nt, Human
uuaagaccagccugaccaacauggugaaaccc

SEQ ID NO: 265592 - RNA, 23 nt, Human
uuaagaccagccuggacaacaua

SEQ ID NO: 265593 - RNA, 32 nt, Human
uuaagaccagccuggccaacauggcaaaaccc

SEQ ID NO: 265594 - RNA, 32 nt, Human
uuaagaccagccuggccaacuuggugaaaccu

SEQ ID NO: 265595 - RNA, 32 nt, Human
uuaagaccagccugggcaacaaagugagaccc

SEQ ID NO: 265596 - RNA, 23 nt, Human
uuaagaccagccugggcaacaua

SEQ ID NO: 265597 - RNA, 32 nt, Human
uuaagaccagccugggcaacauggcaagaccc

SEQ ID NO: 265598 - RNA, 32 nt, Human
uuaagaccagccugggcaacauggugaagccc

SEQ ID NO: 265599 - RNA, 32 nt, Human
uuaagaccagccugggcaacauggugaagccu

SEQ ID NO: 265600 - RNA, 32 nt, Human
uuaagaccagcuugaccaacauggugaaaccc

SEQ ID NO: 265601 - RNA, 32 nt, Human
uuaagaccauccuggcuaacacggugaaaccc

SEQ ID NO: 265602 - RNA, 32 nt, Human
uuaagacccacugaguggccaccagugcaagu

SEQ ID NO: 265603 - RNA, 32 nt, Human
uuaagaccucacuuuuaaaacugccuuaagua

SEQ ID NO: 265604 - RNA, 32 nt, Human
uuaagacuagccuggccaacauggugaaaccc

SEQ ID NO: 265605 - RNA, 32 nt, Human
uuaagacucuaaaccugauuuuugccauggau

SEQ ID NO: 265606 - RNA, 32 nt, Human
uuaagacugaguuucacucuuguugcccaggc

SEQ ID NO: 265607 - RNA, 32 nt, Human
uuaagacuguguauucuaguuuugucaaacug

SEQ ID NO: 265608 - RNA, 18 nt, Human
uuaagacuuuuucuucaa

SEQ ID NO: 265609 - RNA, 32 nt, Human
uuaagagaaagccaaggcacguagaguaggga

SEQ ID NO: 265610 - RNA, 19 nt, Human
uuaagagaaauacuuccau

SEQ ID NO: 265611 - RNA, 32 nt, Human
uuaagagaauugggcuuucuucaucccuuccg

SEQ ID NO: 265612 - RNA, 32 nt, Human
uuaagagacagaggagaaaguggagcggggag

SEQ ID NO: 265613 - RNA, 32 nt, Human
uuaagagacagaguuucgcuuguugcccaggc

SEQ ID NO: 265614 - RNA, 32 nt, Human
uuaagagaggcagaaucuugagcuugaggcac

SEQ ID NO: 265615 - RNA, 32 nt, Human
uuaagagaguaccuaaaauggagagaagaaug

SEQ ID NO: 265616 - RNA, 32 nt, Human
uuaagagauagucaauucuugccuuauaccuc

SEQ ID NO: 265617 - RNA, 32 nt, Human
uuaagagauauuagauauuucuuaauguuuuc

SEQ ID NO: 265618 - RNA, 32 nt, Human
uuaagagauggcauuagagggagcccagucug

SEQ ID NO: 265619 - RNA, 32 nt, Human
uuaagagauguucuuacagcuggccugggcau

SEQ ID NO: 265620 - RNA, 32 nt, Human
uuaagagauuauggcaucagaaacccacaaug

SEQ ID NO: 265621 - RNA, 32 nt, Human
uuaagagcaagggagagcuggccagggacagc

SEQ ID NO: 265622 - RNA, 32 nt, Human
uuaagagcccuagggcaggcuggaccugucaa

SEQ ID NO: 265623 - RNA, 32 nt, Human
uuaagagccugaugcuugagcucugaauucca

SEQ ID NO: 265624 - RNA, 32 nt, Human
uuaagagcuugcugacuuguuuucuugugaaa

SEQ ID NO: 265625 - RNA, 32 nt, Human
uuaagaggaauuggaccaguucugcugccuaa

SEQ ID NO: 265626 - RNA, 32 nt, Human
uuaagaggauugaggaaggcugggaaguuugc

SEQ ID NO: 265627 - RNA, 32 nt, Human
uuaagaggccgaggcgggcagaucaccugagg

SEQ ID NO: 265628 - RNA, 32 nt, Human
uuaagagggucugguacccuugcaggaccuuu

SEQ ID NO: 265629 - RNA, 32 nt, Human
uuaagaguagguaaagacccuuuuguucuuuc

SEQ ID NO: 265630 - RNA, 32 nt, Human
uuaagaguaguaaugaaaaacaugcucagugc

SEQ ID NO: 265631 - RNA, 32 nt, Human
uuaagagugauauuucuaauucacaaaaguua

SEQ ID NO: 265632 - RNA, 32 nt, Human
uuaagagugggggagagcaggcuggcagcucu

SEQ ID NO: 265633 - RNA, 32 nt, Human
uuaagaguuucugcuucccuacaaagaucuuu

SEQ ID NO: 265634 - RNA, 32 nt, Human
uuaagauaaacaaauaugauguucuuugacgu

SEQ ID NO: 265635 - RNA, 32 nt, Human
uuaagauacuuggaauagcuguggaggaagaa

SEQ ID NO: 265636 - RNA, 32 nt, Human
uuaagauagaaaaauauacuucauguauagcc

SEQ ID NO: 265637 - RNA, 32 nt, Human
uuaagauagaagcagcagcugcauagugguaa

SEQ ID NO: 265638 - RNA, 32 nt, Human
uuaagauaggaggaaggagagcaauuucuaag

SEQ ID NO: 265639 - RNA, 32 nt, Human
uuaagauauauguauauaaaguguaugcugua

SEQ ID NO: 265640 - RNA, 32 nt, Human
uuaagaucacauuuugagguaguggggguuag

SEQ ID NO: 265641 - RNA, 32 nt, Human
uuaagaucacccuuuauuuuaaugaaauugua

SEQ ID NO: 265642 - RNA, 32 nt, Human
uuaagaucacgccacuggacugucuaugaacu

SEQ ID NO: 265643 - RNA, 32 nt, Human
uuaagaucagccuggccaacauaaggagaccu

SEQ ID NO: 265644 - RNA, 32 nt, Human
uuaagaucaggaguucaagaccagccuggcca

SEQ ID NO: 265645 - RNA, 32 nt, Human
uuaagaucaggaguucgagaccagccuggcca

SEQ ID NO: 265646 - RNA, 32 nt, Human
uuaagaucauccuggccaacauggugacaccc

SEQ ID NO: 265647 - RNA, 32 nt, Human
uuaagauccgcaauguggagcagcagccacug

SEQ ID NO: 265648 - RNA, 32 nt, Human
uuaagaucuguuuuaaauuuaaaacaaugaau

SEQ ID NO: 265649 - RNA, 32 nt, Human
uuaagauggaguuucccucuguugccaggcua

SEQ ID NO: 265650 - RNA, 32 nt, Human
uuaagauggcuggaauagcacagggaguauau

SEQ ID NO: 265651 - RNA, 32 nt, Human
uuaagaugguaaaaugguucucagggauuccu

SEQ ID NO: 265652 - RNA, 32 nt, Human
uuaagaugugcuugcuucuccuuuccugaggc

SEQ ID NO: 265653 - RNA, 32 nt, Human
uuaagauuacuuuuguauuaucacuauuuaaa

SEQ ID NO: 265654 - RNA, 32 nt, Human
uuaagcaaacgguguggcauggguugagugug

SEQ ID NO: 265655 - RNA, 32 nt, Human
uuaagcaaaugauagaaagggaaguaaggcgu

SEQ ID NO: 265656 - RNA, 20 nt, Human
uuaagcaaauuacuuacugu

SEQ ID NO: 265657 - RNA, 32 nt, Human
uuaagcaacaucuagcaaauguuaugcauaaa

SEQ ID NO: 265658 - RNA, 21 nt, Human
uuaagcaacauuuuauuucca

SEQ ID NO: 265659 - RNA, 32 nt, Human
uuaagcaaggaacuugucaagagaucaugguu

SEQ ID NO: 265660 - RNA, 32 nt, Human
uuaagcaaguggcuuggcuguuaaauucuugg

SEQ ID NO: 265661 - RNA, 32 nt, Human
uuaagcaauuuucuuccucuguggauugauau

SEQ ID NO: 265662 - RNA, 32 nt, Human
uuaagcacaaagcaucuuccuuaaagcacaaa

SEQ ID NO: 265663 - RNA, 32 nt, Human
uuaagcacagaagauuuguggggagguacaca

SEQ ID NO: 265664 - RNA, 32 nt, Human
uuaagcacaugauuuacagcugugaugguuua

SEQ ID NO: 265665 - RNA, 32 nt, Human
uuaagcacccacugcaugucauugugucuagg

SEQ ID NO: 265666 - RNA, 32 nt, Human
uuaagcacccgguggcccuccgaggccuggcg

SEQ ID NO: 265667 - RNA, 32 nt, Human
uuaagcacucuaagagccgagauagcuuccug

SEQ ID NO: 265668 - RNA, 32 nt, Human
uuaagcacuugcagccuucggaggcucugcgc

SEQ ID NO: 265669 - RNA, 32 nt, Human
uuaagcacuuuuaauuuuauccuuccuaaaaa

SEQ ID NO: 265670 - RNA, 32 nt, Human
uuaagcagagacauaagugccuugcauuacac

SEQ ID NO: 265671 - RNA, 17 nt, Human
uuaagcagagagcccau

SEQ ID NO: 265672 - RNA, 19 nt, Human
uuaagcagauacucuccau

SEQ ID NO: 265673 - RNA, 19 nt, Human
uuaagcagauuacuuccau

SEQ ID NO: 265674 - RNA, 18 nt, Human
uuaagcagcaacuuacca

SEQ ID NO: 265675 - RNA, 32 nt, Human
uuaagcagcacuagugaagcccaggcaaccca

SEQ ID NO: 265676 - RNA, 32 nt, Human
uuaagcagccuaucagugauugccauuagacu

SEQ ID NO: 265677 - RNA, 32 nt, Human
uuaagcagcucuugcuaaucagugucucacac

SEQ ID NO: 265678 - RNA, 18 nt, Human
uuaagcagcugcucucca

SEQ ID NO: 265679 - RNA, 32 nt, Human
uuaagcaggaauccuagaagcaaauggauggg

SEQ ID NO: 265680 - RNA, 32 nt, Human
uuaagcagguaaagcagucacugugaagaaaa

SEQ ID NO: 265681 - RNA, 20 nt, Human
uuaagcaguagugcuuccau

SEQ ID NO: 265682 - RNA, 32 nt, Human
uuaagcagugccacacuacaggguagauaugg

SEQ ID NO: 265683 - RNA, 21 nt, Human
uuaagcaguguuggcuuccau

SEQ ID NO: 265684 - RNA, 32 nt, Human
uuaagcaucccuugggcuuuggauuuggagau

SEQ ID NO: 265685 - RNA, 32 nt, Human
uuaagcaucuuuaugaaacaggcacaguaccc

SEQ ID NO: 265686 - RNA, 32 nt, Human
uuaagcaucuuucugcucccgacuuucuggug

SEQ ID NO: 265687 - RNA, 32 nt, Human
uuaagcauuauccugaagacucugccaggaga

SEQ ID NO: 265688 - RNA, 32 nt, Human
uuaagcauucucaguucccuccagaaaaccua

SEQ ID NO: 265689 - RNA, 32 nt, Human
uuaagccaaguggaagcugugcucugacagga

SEQ ID NO: 265690 - RNA, 32 nt, Human
uuaagccaccgcacuccagccugggcgacaga

SEQ ID NO: 265691 - RNA, 32 nt, Human
uuaagccacugccucucccucuggucccacaa

SEQ ID NO: 265692 - RNA, 32 nt, Human
uuaagccaggccugggcugggcucauagacgc

SEQ ID NO: 265693 - RNA, 32 nt, Human
uuaagccagggccccagaucaggugugacgug

SEQ ID NO: 265694 - RNA, 31 nt, Human
uuaagccaguuucagauuuacucugaaaugu

SEQ ID NO: 265695 - RNA, 32 nt, Human
uuaagccauugcccuggcugggguugggcugg

SEQ ID NO: 265696 - RNA, 32 nt, Human
uuaagcccagaaggucgaggcugcagugagcu

SEQ ID NO: 265697 - RNA, 32 nt, Human
uuaagcccaggagacagagguugcagugagcc

SEQ ID NO: 265698 - RNA, 32 nt, Human
uuaagcccaggagcuuaagaccagccugggca

SEQ ID NO: 265699 - RNA, 32 nt, Human
uuaagcccaggagguucaggcugcaguaaggu

SEQ ID NO: 265700 - RNA, 32 nt, Human
uuaagcccaggagucugagaccagccugggca

SEQ ID NO: 265701 - RNA, 32 nt, Human
uuaagcccaggaguucaagaccaaccuggaca

SEQ ID NO: 265702 - RNA, 32 nt, Human
uuaagcccaggaguucaagaccagccugggca

SEQ ID NO: 265703 - RNA, 32 nt, Human
uuaagcccaggaguucgggguuacagugagcu

SEQ ID NO: 265704 - RNA, 32 nt, Human
uuaagcccaggaguuugagaccagcuugggca

SEQ ID NO: 265705 - RNA, 32 nt, Human
uuaagcccaggaguuugagucuguaaugcacu

SEQ ID NO: 265706 - RNA, 32 nt, Human
uuaagcccaucccucgcccccagccugaggug

SEQ ID NO: 265707 - RNA, 32 nt, Human
uuaagcccgggaguucaagaccagccuagccc

SEQ ID NO: 265708 - RNA, 32 nt, Human
uuaagcccguuuucacacugcuguuaaagaca

SEQ ID NO: 265709 - RNA, 32 nt, Human
uuaagcccugcacagggacccccgaagggcug

SEQ ID NO: 265710 - RNA, 32 nt, Human
uuaagcccugcauuucuccaacugacaagugg

SEQ ID NO: 265711 - RNA, 32 nt, Human
uuaagcccugcucgaugcucacagggccccca

SEQ ID NO: 265712 - RNA, 32 nt, Human
uuaagccgagcucuccccuccaguggacaucc

SEQ ID NO: 265713 - RNA, 32 nt, Human
uuaagccucaaauuugaacauguggcuugaau

SEQ ID NO: 265714 - RNA, 23 nt, Human
uuaagccucauucuccuuuuguu

SEQ ID NO: 265715 - RNA, 32 nt, Human
uuaagccucuugucuacauauuuggagagaau

SEQ ID NO: 265716 - RNA, 32 nt, Human
uuaagccuguuaacucuuucuccauucucuuu

SEQ ID NO: 265717 - RNA, 32 nt, Human
uuaagccuucucuaguuccaucauccucugag

SEQ ID NO: 265718 - RNA, 20 nt, Human
uuaagccuuuguauuuccau

SEQ ID NO: 265719 - RNA, 32 nt, Human
uuaagccuuuuguuccccgucugcaccugaag

SEQ ID NO: 265720 - RNA, 32 nt, Human
uuaagcgcagaagaucaagaccagccugggaa

SEQ ID NO: 265721 - RNA, 32 nt, Human
uuaagcguugagccaccaagcugguggcucug

SEQ ID NO: 265722 - RNA, 32 nt, Human
uuaagcuaaaugguauuuucauuuuucucaag

SEQ ID NO: 265723 - RNA, 32 nt, Human
uuaagcuaauaaauauaagaauucuuuuggaa

SEQ ID NO: 265724 - RNA, 32 nt, Human
uuaagcucaggaguuugagaccagccugggca

SEQ ID NO: 265725 - RNA, 32 nt, Human
uuaagcucccagguagcugggauuacgggcgc

SEQ ID NO: 265726 - RNA, 32 nt, Human
uuaagcuccuacucugugcaaaucacucuacu

SEQ ID NO: 265727 - RNA, 32 nt, Human
uuaagcuccucccaguagauuccugaacccaa

SEQ ID NO: 265728 - RNA, 32 nt, Human
uuaagcuccucuuaaagagggcaggaauuaag

SEQ ID NO: 265729 - RNA, 32 nt, Human
uuaagcugagccacggauaccgccacggguuu

SEQ ID NO: 265730 - RNA, 32 nt, Human
uuaagcugagggcagagaacuuggaugcgugc

SEQ ID NO: 265731 - RNA, 32 nt, Human
uuaagcugcauauguaugcugggaaacggcuu

SEQ ID NO: 265732 - RNA, 32 nt, Human
uuaagcugccuggcauguggcacuuugucagg

SEQ ID NO: 265733 - RNA, 31 nt, Human
uuaagcugcucgagucuccuguugaagaaug

SEQ ID NO: 265734 - RNA, 32 nt, Human
uuaagcugcugcaggucggggaggaaggaccu

SEQ ID NO: 265735 - RNA, 32 nt, Human
uuaagcugcugcuuccucuguuucauuggauu

SEQ ID NO: 265736 - RNA, 32 nt, Human
uuaagcugcuggcugggcaaguguucauugac

SEQ ID NO: 265737 - RNA, 25 nt, Human
uuaagcuucacucuccaccaccugg

SEQ ID NO: 265738 - RNA, 32 nt, Human
uuaagcuucccucuccagccuaggguggggaa

SEQ ID NO: 265739 - RNA, 32 nt, Human
uuaagcuuccgccgucucaaccccucacagga

SEQ ID NO: 265740 - RNA, 32 nt, Human
uuaagcuucucuagugcccuuaacuuuuguua

SEQ ID NO: 265741 - RNA, 32 nt, Human
uuaagcuuuuaccccuguccucuuuggccugc

SEQ ID NO: 265742 - RNA, 32 nt, Human
uuaagcuuuucauuuguuacuaauauccauga

SEQ ID NO: 265743 - RNA, 32 nt, Human
uuaaggaaaaguaagggaauaaauuuuugucu

SEQ ID NO: 265744 - RNA, 32 nt, Human
uuaaggaaagggcuaucuuuguucuuuguuag

SEQ ID NO: 265745 - RNA, 32 nt, Human
uuaaggacaaagcuccagaccagugaacgagc

SEQ ID NO: 265746 - RNA, 32 nt, Human
uuaaggacaccaacagguaacuucuuauuccc

SEQ ID NO: 265747 - RNA, 22 nt, Human
uuaaggacaucuguucuuccau

SEQ ID NO: 265748 - RNA, 32 nt, Human
uuaaggacccucccuaccccagcaugaccccg

SEQ ID NO: 265749 - RNA, 32 nt, Human
uuaaggacucucugcuccagccucucacucuc

SEQ ID NO: 265750 - RNA, 32 nt, Human
uuaaggagaaggucaaggcugcagugagccau

SEQ ID NO: 265751 - RNA, 32 nt, Human
uuaaggagcugggaucauccuccgucucaggu

SEQ ID NO: 265752 - RNA, 32 nt, Human
uuaaggaggagaaaggggaagcuuugaccagu

SEQ ID NO: 265753 - RNA, 32 nt, Human
uuaaggagggaugggaaggaaagaguuguguu

SEQ ID NO: 265754 - RNA, 32 nt, Human
uuaaggaucccagcuacuuaauugacuuaugc

SEQ ID NO: 265755 - RNA, 32 nt, Human
uuaaggaucggcucccugucgcgcccgaggag

SEQ ID NO: 265756 - RNA, 32 nt, Human
uuaaggaugaucuugucaaaauacaguacccu

SEQ ID NO: 265757 - RNA, 32 nt, Human
uuaaggauguacaaaaguaugucugcaucgau

SEQ ID NO: 265758 - RNA, 32 nt, Human
uuaaggcaaggugaaggcauugccaagugugu

SEQ ID NO: 265759 - RNA, 32 nt, Human
uuaaggcaagugggguugguggaacuaaaugu

SEQ ID NO: 265760 - RNA, 32 nt, Human
uuaaggcacacuuccuacacacagcuaucagg

SEQ ID NO: 265761 - RNA, 32 nt, Human
uuaaggcacaggcuguugaagcauuuucucag

SEQ ID NO: 265762 - RNA, 32 nt, Human
uuaaggcaggcggaucaccugaggucaggagu

SEQ ID NO: 265763 - RNA, 32 nt, Human
uuaaggcaucaauccagucuuuggcagaggau

SEQ ID NO: 265764 - RNA, 32 nt, Human
uuaaggcaucugacaugcaucaucucauuuaa

SEQ ID NO: 265765 - RNA, 24 nt, Human
uuaaggcauugagggcucuaaaca

SEQ ID NO: 265766 - RNA, 32 nt, Human
uuaaggccagaguucaagaccaaacuggccaa

SEQ ID NO: 265767 - RNA, 32 nt, Human
uuaaggccaggaguucaagaccaccuggccaa

SEQ ID NO: 265768 - RNA, 32 nt, Human
uuaaggccaggaguucgagaccagccugggca

SEQ ID NO: 265769 - RNA, 32 nt, Human
uuaaggccaggaguuugagaccagcuugggca

SEQ ID NO: 265770 - RNA, 32 nt, Human
uuaaggccauggucuuucucugcaguccccag

SEQ ID NO: 265771 - RNA, 32 nt, Human
uuaaggcccacuguuuuacuggggcccauugu

SEQ ID NO: 265772 - RNA, 32 nt, Human
uuaaggcccagcugcgccugugccuugggcuc

SEQ ID NO: 265773 - RNA, 32 nt, Human
uuaaggccuaacuuaaagcccagauccuacag

SEQ ID NO: 265774 - RNA, 32 nt, Human
uuaaggccugaacaaagcacaucuuuccacca

SEQ ID NO: 265775 - RNA, 32 nt, Human
uuaaggccuuucuucccaccccaaguccaaga

SEQ ID NO: 265776 - RNA, 32 nt, Human
uuaaggcgccugccaccaugcccggcuaauuu

SEQ ID NO: 265777 - RNA, 32 nt, Human
uuaaggcgugagccacugcgcccggcccaaga

SEQ ID NO: 265778 - RNA, 32 nt, Human
uuaaggcuauggaagaaaaagugaaagcaaug

SEQ ID NO: 265779 - RNA, 32 nt, Human
uuaaggcuauuguccuuuguuccuucauguau

SEQ ID NO: 265780 - RNA, 32 nt, Human
uuaagggaacccagaagugaauucuuuuguaa

SEQ ID NO: 265781 - RNA, 32 nt, Human
uuaagggaaggaacucuggcuuccagguaucu

SEQ ID NO: 265782 - RNA, 32 nt, Human
uuaagggacgggcacauuuuucaacgauuaag

SEQ ID NO: 265783 - RNA, 32 nt, Human
uuaagggacugcaggccuggcagcaggacaug

SEQ ID NO: 265784 - RNA, 32 nt, Human
uuaagggacuggucaguggcagaauuaacaua

SEQ ID NO: 265785 - RNA, 32 nt, Human
uuaagggacuguccuuggggaggcaggcgggg

SEQ ID NO: 265786 - RNA, 32 nt, Human
uuaagggagagguagagaggggcccgugaagu

SEQ ID NO: 265787 - RNA, 32 nt, Human
uuaagggaggucgucacuggggugggagaaga

SEQ ID NO: 265788 - RNA, 32 nt, Human
uuaagggaugggaagagcaggaaaagaagcug

SEQ ID NO: 265789 - RNA, 19 nt, Human
uuaagggauucuccugccu

SEQ ID NO: 265790 - RNA, 32 nt, Human
uuaagggcaaaggaguuggauugcugaauuac

SEQ ID NO: 265791 - RNA, 32 nt, Human
uuaagggcauuuuuauacucagaacuguccca

SEQ ID NO: 265792 - RNA, 32 nt, Human
uuaagggccacuggaaagcuggagagagcuug

SEQ ID NO: 265793 - RNA, 32 nt, Human
uuaagggcuugauuuccaagggccacaucucu

SEQ ID NO: 265794 - RNA, 32 nt, Human
uuaagggggccuuggaaucuauaguauagaau

SEQ ID NO: 265795 - RNA, 32 nt, Human
uuaagggggugaggaucauuaauucagauaau

SEQ ID NO: 265796 - RNA, 32 nt, Human
uuaagggguaggaagaaaaaccugacugcaaa

SEQ ID NO: 265797 - RNA, 32 nt, Human
uuaagggguggguccuucccaucaagcugauu

SEQ ID NO: 265798 - RNA, 32 nt, Human
uuaagggguuuauuuuacaaacugugcgccug

SEQ ID NO: 265799 - RNA, 32 nt, Human
uuaaggguagccaagaccuugcaugguagagu

SEQ ID NO: 265800 - RNA, 32 nt, Human
uuaaggguuaauaauguagagaggagggagga

SEQ ID NO: 265801 - RNA, 32 nt, Human
uuaagguacugagggcaggagaaguuaaugua

SEQ ID NO: 265802 - RNA, 32 nt, Human
uuaaggucaggaauucuagaccagccugggca

SEQ ID NO: 265803 - RNA, 32 nt, Human
uuaaggucaggaguucaagaccaggcugguca

SEQ ID NO: 265804 - RNA, 32 nt, Human
uuaaggucaggaguucaggaccagccuggcca

SEQ ID NO: 265805 - RNA, 32 nt, Human
uuaaggucaggaguucgagaccagccuggcca

SEQ ID NO: 265806 - RNA, 32 nt, Human
uuaaggucaggaguuugagaccagccuggcca

SEQ ID NO: 265807 - RNA, 32 nt, Human
uuaagguccuuucuaaauuccuccauugugag

SEQ ID NO: 265808 - RNA, 32 nt, Human
uuaaggucgagaguccaagaccagccuggcca

SEQ ID NO: 265809 - RNA, 32 nt, Human
uuaaggucugcagccuuaauucuaccugcaaa

SEQ ID NO: 265810 - RNA, 32 nt, Human
uuaaggugauuuuuacagaaaugugauuuugc

SEQ ID NO: 265811 - RNA, 32 nt, Human
uuaaggugugagccacugugcccagccuauua

SEQ ID NO: 265812 - RNA, 32 nt, Human
uuaagguuccccuugagucuccugggcuacaa

SEQ ID NO: 265813 - RNA, 32 nt, Human
uuaagguuguuacugcccagcucagccagaaa

SEQ ID NO: 265814 - RNA, 32 nt, Human
uuaagguuuaacugguuuugcuuuuguuuauc

SEQ ID NO: 265815 - RNA, 32 nt, Human
uuaagguuugugaagaguauuugcauuguguc

SEQ ID NO: 265816 - RNA, 32 nt, Human
uuaaguaaaaucaguaagaccaaaccacugga

SEQ ID NO: 265817 - RNA, 32 nt, Human
uuaaguaaacauccuccuccucucuacacccc

SEQ ID NO: 265818 - RNA, 32 nt, Human
uuaaguaacuauaaugaaaucugcugcaaaau

SEQ ID NO: 265819 - RNA, 32 nt, Human
uuaaguaaguaaaauuaauuuuuccauuuggu

SEQ ID NO: 265820 - RNA, 32 nt, Human
uuaaguacaccaugcagcaauguaauaaaaac

SEQ ID NO: 265821 - RNA, 32 nt, Human
uuaaguacauggucaaguauuaacagcacaag

SEQ ID NO: 265822 - RNA, 32 nt, Human
uuaaguacauggucaaguguuaacagcacaag

SEQ ID NO: 265823 - RNA, 17 nt, Human
uuaaguacugcuuccau

SEQ ID NO: 265824 - RNA, 32 nt, Human
uuaaguacuuugcugaaugucauuuuaaagca

SEQ ID NO: 265825 - RNA, 32 nt, Human
uuaaguagaaguagcuuuuuaugcaaauacau

SEQ ID NO: 265826 - RNA, 19 nt, Human
uuaaguagagcucuggaca

SEQ ID NO: 265827 - RNA, 21 nt, Human
uuaaguagcugagacuacagg

SEQ ID NO: 265828 - RNA, 20 nt, Human
uuaaguagguucauuuccau

SEQ ID NO: 265829 - RNA, 32 nt, Human
uuaaguauacagaacuacaguaaugaaugugu

SEQ ID NO: 265830 - RNA, 19 nt, Human
uuaaguauauaacuuccau

SEQ ID NO: 265831 - RNA, 32 nt, Human
uuaaguauuuuguuugguuugaacucaaucag

SEQ ID NO: 265832 - RNA, 32 nt, Human
uuaagucaacauccuuuaaagcuaagaguaug

SEQ ID NO: 265833 - RNA, 32 nt, Human
uuaagucaagagaucaagaccauccuggccaa

SEQ ID NO: 265834 - RNA, 32 nt, Human
uuaagucaagugagcgggaucgcuugaaagcu

SEQ ID NO: 265835 - RNA, 32 nt, Human
uuaagucaggacugagcacacaggugaacucc

SEQ ID NO: 265836 - RNA, 32 nt, Human
uuaagucaucacauuaaacauuguaauacuag

SEQ ID NO: 265837 - RNA, 32 nt, Human
uuaaguccaggaguucaagaccagccugggua

SEQ ID NO: 265838 - RNA, 32 nt, Human
uuaaguccaguucuuugccucaggggucucgu

SEQ ID NO: 265839 - RNA, 32 nt, Human
uuaagucccaaagaaagaggcagaggagcgac

SEQ ID NO: 265840 - RNA, 32 nt, Human
uuaagucccauguuacugcuguuugcuuuuac

SEQ ID NO: 265841 - RNA, 32 nt, Human
uuaaguccucagguuuggcccagauuccaguu

SEQ ID NO: 265842 - RNA, 32 nt, Human
uuaaguccuggguggacugagagaugguuugc

SEQ ID NO: 265843 - RNA, 32 nt, Human
uuaaguccuuaaugaagagccagcccaaguag

SEQ ID NO: 265844 - RNA, 32 nt, Human
uuaagucuacaggggcugggugaccucuuuuu

SEQ ID NO: 265845 - RNA, 22 nt, Human
uuaagucucagaacuuaacaga

SEQ ID NO: 265846 - RNA, 32 nt, Human
uuaagucugagagguugcuggaaaggacuguu

SEQ ID NO: 265847 - RNA, 32 nt, Human
uuaagucugggagguugaggcugcagugagcu

SEQ ID NO: 265848 - RNA, 32 nt, Human
uuaagugaauaaagcacacagacagugcuacu

SEQ ID NO: 265849 - RNA, 32 nt, Human
uuaagugaucaaaaguaaauguucucuuugcc

SEQ ID NO: 265850 - RNA, 32 nt, Human
uuaagugaucccaugaaauaaaagucgauaau

SEQ ID NO: 265851 - RNA, 32 nt, Human
uuaagugauugcacuuuugcucaaauugaagu

SEQ ID NO: 265852 - RNA, 32 nt, Human
uuaagugcaauuuccccucuguguccucuccc

SEQ ID NO: 265853 - RNA, 32 nt, Human
uuaagugcacacaagcauuucagaacucaggu

SEQ ID NO: 265854 - RNA, 32 nt, Human
uuaagugcagugguaugaucaugagcucacug

SEQ ID NO: 265855 - RNA, 32 nt, Human
uuaagugccaggcugggcacaauggcucgugc

SEQ ID NO: 265856 - RNA, 32 nt, Human
uuaaguggaagcaggaggcuuugaugaccaag

SEQ ID NO: 265857 - RNA, 32 nt, Human
uuaaguggaauauucuaauaagcuaccuuuug

SEQ ID NO: 265858 - RNA, 32 nt, Human
uuaaguggagagugcuuccagcugagaugauu

SEQ ID NO: 265859 - RNA, 32 nt, Human
uuaaguggaggcagagucaguucugaggcguc

SEQ ID NO: 265860 - RNA, 31 nt, Human
uuaaguggcuuucagcaaaccucagucauau

SEQ ID NO: 265861 - RNA, 32 nt, Human
uuaaguggucuuucuuucucuccugucucuug

SEQ ID NO: 265862 - RNA, 17 nt, Human
uuaagugguuaccucca

SEQ ID NO: 265863 - RNA, 28 nt, Human
uuaaguguaacuucugccgccaguguga

SEQ ID NO: 265864 - RNA, 32 nt, Human
uuaagugugcugugugcacauguguacacaca

SEQ ID NO: 265865 - RNA, 32 nt, Human
uuaaguguggcacauaaggaucugcagaauuu

SEQ ID NO: 265866 - RNA, 21 nt, Human
uuaagugugugcuaaacaacu

SEQ ID NO: 265867 - RNA, 24 nt, Human
uuaaguguguguuaaacaacuaca

SEQ ID NO: 265868 - RNA, 32 nt, Human
uuaaguguucagaaagaaaaaggagcuuauuu

SEQ ID NO: 265869 - RNA, 22 nt, Human
uuaaguguuggaaccaacacca

SEQ ID NO: 265870 - RNA, 32 nt, Human
uuaaguuacaguuuaagcacccuucaguauua

SEQ ID NO: 265871 - RNA, 32 nt, Human
uuaaguuacuuuucucagcccaaaggagacug

SEQ ID NO: 265872 - RNA, 32 nt, Human
uuaaguuauuaaggaagggaugauuuggagac

SEQ ID NO: 265873 - RNA, 32 nt, Human
uuaaguuauuauuuguauugugcaaaaauuuu

SEQ ID NO: 265874 - RNA, 32 nt, Human
uuaaguucagggccuaggaaggggagcauuca

SEQ ID NO: 265875 - RNA, 32 nt, Human
uuaaguucaguuauuagucugugaagugcuuu

SEQ ID NO: 265876 - RNA, 32 nt, Human
uuaaguucaucucuacgccugcccugguuaag

SEQ ID NO: 265877 - RNA, 32 nt, Human
uuaaguucauuucucuuuuacacuuuuguacu

SEQ ID NO: 265878 - RNA, 32 nt, Human
uuaaguucuacucagaaucauaacaucuggca

SEQ ID NO: 265879 - RNA, 32 nt, Human
uuaaguucuaggguacacgugcacaacgugca

SEQ ID NO: 265880 - RNA, 32 nt, Human
uuaaguucuaggguacaggugcacaacgugca

SEQ ID NO: 265881 - RNA, 32 nt, Human
uuaaguucuaggguacaugugcacaacgugca

SEQ ID NO: 265882 - RNA, 32 nt, Human
uuaaguucuaggguacaugugcacaaugugca

SEQ ID NO: 265883 - RNA, 32 nt, Human
uuaaguucuggcuuuuaucuuuacuauuuucu

SEQ ID NO: 265884 - RNA, 32 nt, Human
uuaaguuggaacaguauuuucccauugacuac

SEQ ID NO: 265885 - RNA, 32 nt, Human
uuaaguuggacaagacuuagcacaagaaacca

SEQ ID NO: 265886 - RNA, 32 nt, Human
uuaaguugucuggacugaaaagucauuucuuu

SEQ ID NO: 265887 - RNA, 32 nt, Human
uuaaguuguuccucuguuaucaugccugaauu

SEQ ID NO: 265888 - RNA, 23 nt, Human
uuaaguuucagguuaccagcaaa

SEQ ID NO: 265889 - RNA, 32 nt, Human
uuaaguuugcaguuacaggccaguucuccagc

SEQ ID NO: 265890 - RNA, 32 nt, Human
uuaaguuugguagaagaugagaacaaaauaac

SEQ ID NO: 265891 - RNA, 18 nt, Human
uuaaguuuguacuuccau

SEQ ID NO: 265892 - RNA, 32 nt, Human
uuaaguuugugagguguggugggugaaacuaa

SEQ ID NO: 265893 - RNA, 32 nt, Human
uuaaguuuguguuuuuagguuuacuuacauac

SEQ ID NO: 265894 - RNA, 32 nt, Human
uuaaguuuucuuucuguuucuaagacaacagu

SEQ ID NO: 265895 - RNA, 32 nt, Human
uuaauaaaaugaaaacaggcugggacaguggu

SEQ ID NO: 265896 - RNA, 32 nt, Human
uuaauaaacaauuuauacugaagagaaacccu

SEQ ID NO: 265897 - RNA, 32 nt, Human
uuaauaaacuugacugaauucauuuacaaaaa

SEQ ID NO: 265898 - RNA, 32 nt, Human
uuaauaaagacaggguuucaccauguuggcca

SEQ ID NO: 265899 - RNA, 32 nt, Human
uuaauaaagacggguuucaccauguuggccag

SEQ ID NO: 265900 - RNA, 32 nt, Human
uuaauaaagcacaaaacccacacagauugucu

SEQ ID NO: 265901 - RNA, 32 nt, Human
uuaauaaagcugcugggcaguggugcagcauu

SEQ ID NO: 265902 - RNA, 31 nt, Human
uuaauaaauacuucugacacuacauuuaaau

SEQ ID NO: 265903 - RNA, 32 nt, Human
uuaauaaauacuucuggucugauaccuaagga

SEQ ID NO: 265904 - RNA, 32 nt, Human
uuaauaaauaguaauauaucaucuuuuuaggg

SEQ ID NO: 265905 - RNA, 32 nt, Human
uuaauaaaugcuggauggaugcaggaaggaau

SEQ ID NO: 265906 - RNA, 32 nt, Human
uuaauaaaugggccaccucccucuucuucaag

SEQ ID NO: 265907 - RNA, 28 nt, Human
uuaauaaccaguguugccucauucagcu

SEQ ID NO: 265908 - RNA, 32 nt, Human
uuaauaaccuccccuucucucucuacauguuc

SEQ ID NO: 265909 - RNA, 32 nt, Human
uuaauaaccugcauuguugcugucugccaaau

SEQ ID NO: 265910 - RNA, 32 nt, Human
uuaauaacuccuucccagaagcuguaucauga

SEQ ID NO: 265911 - RNA, 32 nt, Human
uuaauaagagguaauacccaucuaggaaagaa

SEQ ID NO: 265912 - RNA, 32 nt, Human
uuaauaagaguauaaaauguuaaucaagaguc

SEQ ID NO: 265913 - RNA, 32 nt, Human
uuaauaagcacaauaaauaucuuuuuggauac

SEQ ID NO: 265914 - RNA, 32 nt, Human
uuaauaagccuccugaagaaguugaagcaauu

SEQ ID NO: 265915 - RNA, 32 nt, Human
uuaauaagcuguuaaugcagccuugcacucag

SEQ ID NO: 265916 - RNA, 32 nt, Human
uuaauaaggaagcagagaguaugggauagaga

SEQ ID NO: 265917 - RNA, 32 nt, Human
uuaauaauugaaucagauuuaagggcucuguc

SEQ ID NO: 265918 - RNA, 32 nt, Human
uuaauacaaucagcucaugaaugcacagcuau

SEQ ID NO: 265919 - RNA, 32 nt, Human
uuaauacagccagcuaucauugcccauuugua

SEQ ID NO: 265920 - RNA, 32 nt, Human
uuaauacaggagacccaacaaugaguggacaa

SEQ ID NO: 265921 - RNA, 32 nt, Human
uuaauacagguuguuucuauuuuacuuuuucu

SEQ ID NO: 265922 - RNA, 32 nt, Human
uuaauacauauaugaguacugaaaaauuaagu

SEQ ID NO: 265923 - RNA, 32 nt, Human
uuaauacccacuggguaacagugguuacccau

SEQ ID NO: 265924 - RNA, 32 nt, Human
uuaauaccugggaggcggagauugcagugagc

SEQ ID NO: 265925 - RNA, 32 nt, Human
uuaauacugcaacugcucccuuuugcccaguc

SEQ ID NO: 265926 - RNA, 32 nt, Human
uuaauacugggagcuucucugccuccugaucc

SEQ ID NO: 265927 - RNA, 32 nt, Human
uuaauacuucauuuggugcuggucuauuuuga

SEQ ID NO: 265928 - RNA, 32 nt, Human
uuaauacuuggaguuuaacugccuucccuuug

SEQ ID NO: 265929 - RNA, 32 nt, Human
uuaauagaaaaaucacuuguaugcuuauauuu

SEQ ID NO: 265930 - RNA, 32 nt, Human
uuaauagaaagccucauugaauggcuuucagc

SEQ ID NO: 265931 - RNA, 32 nt, Human
uuaauagaauuccugcaucuucugccacuccc

SEQ ID NO: 265932 - RNA, 32 nt, Human
uuaauagaauugguuucucccuucucugaugu

SEQ ID NO: 265933 - RNA, 32 nt, Human
uuaauagacggaagucuugcucugucaugcag

SEQ ID NO: 265934 - RNA, 32 nt, Human
uuaauagagacagggucucacuaucuugucca

SEQ ID NO: 265935 - RNA, 32 nt, Human
uuaauagagacagggucucgcaguguugccca

SEQ ID NO: 265936 - RNA, 32 nt, Human
uuaauagagacagggucuugcuucuguggccc

SEQ ID NO: 265937 - RNA, 32 nt, Human
uuaauagagacaggguuucacaauguugacca

SEQ ID NO: 265938 - RNA, 32 nt, Human
uuaauagagacaggguuucaccauguuagcca

SEQ ID NO: 265939 - RNA, 32 nt, Human
uuaauagagaccgguuuugccauguuggccag

SEQ ID NO: 265940 - RNA, 32 nt, Human
uuaauagagacggguuucaccacguuggccag

SEQ ID NO: 265941 - RNA, 32 nt, Human
uuaauagagauggauuucaccauguuggucaa

SEQ ID NO: 265942 - RNA, 32 nt, Human
uuaauagaggcagggucuugcuguauugccca

SEQ ID NO: 265943 - RNA, 32 nt, Human
uuaauagcauugggauauagucacuguaaugg

SEQ ID NO: 265944 - RNA, 32 nt, Human
uuaauagcuauuauagaccuguauuuacugua

SEQ ID NO: 265945 - RNA, 32 nt, Human
uuaauagcucuggugauccuguuggcuuuggg

SEQ ID NO: 265946 - RNA, 32 nt, Human
uuaauagcucuuuaacugcuguccucauuagg

SEQ ID NO: 265947 - RNA, 32 nt, Human
uuaauagcugcuucuguggauauggcugggga

SEQ ID NO: 265948 - RNA, 32 nt, Human
uuaauagcuguggcauaaaguuuccaacuaag

SEQ ID NO: 265949 - RNA, 32 nt, Human
uuaauaggaagcuuccaaaagaagaaaacccc

SEQ ID NO: 265950 - RNA, 32 nt, Human
uuaauaggaggccucuggucucugccugcccu

SEQ ID NO: 265951 - RNA, 32 nt, Human
uuaauagggccgggaguggaggcucaagccug

SEQ ID NO: 265952 - RNA, 32 nt, Human
uuaauagggggagaggagagaagaccccaguu

SEQ ID NO: 265953 - RNA, 32 nt, Human
uuaauaguaaaaacacauuccuagguggagac

SEQ ID NO: 265954 - RNA, 32 nt, Human
uuaauaguggcaaaugaaagcauaagcuuaag

SEQ ID NO: 265955 - RNA, 32 nt, Human
uuaauaguguaauauccacagaugcauaagua

SEQ ID NO: 265956 - RNA, 32 nt, Human
uuaauauaaaugauuuugauuuggaggccuaa

SEQ ID NO: 265957 - RNA, 32 nt, Human
uuaauauaaguaugucccaagucuuaaaagag

SEQ ID NO: 265958 - RNA, 32 nt, Human
uuaauauaucuuugccaaguccaaggguacaa

SEQ ID NO: 265959 - RNA, 32 nt, Human
uuaauauaugugaaaguauggaggagaugugc

SEQ ID NO: 265960 - RNA, 32 nt, Human
uuaauaucaguuguugcccaagacagaucuca

SEQ ID NO: 265961 - RNA, 32 nt, Human
uuaauaucccacuugagaaaaauugugagacu

SEQ ID NO: 265962 - RNA, 32 nt, Human
uuaauauccugccuuuuaccuucaguaaacac

SEQ ID NO: 265963 - RNA, 32 nt, Human
uuaauaucugcucuccucuugggagugaggac

SEQ ID NO: 265964 - RNA, 32 nt, Human
uuaauaugcccuuuugccgaugcauacuauua

SEQ ID NO: 265965 - RNA, 32 nt, Human
uuaauaugcuggcaacagaaucauugaaacag

SEQ ID NO: 265966 - RNA, 32 nt, Human
uuaauaugcuguugaaccuacucuguuccuug

SEQ ID NO: 265967 - RNA, 32 nt, Human
uuaauaugcuuuuguugaaaccacagcuuuug

SEQ ID NO: 265968 - RNA, 32 nt, Human
uuaauauggaaaugcauuuagagaagcccagu

SEQ ID NO: 265969 - RNA, 32 nt, Human
uuaauauggaaaugugauuccuacuaaguugu

SEQ ID NO: 265970 - RNA, 32 nt, Human
uuaauauggagaagaaaacuauauuggcugau

SEQ ID NO: 265971 - RNA, 32 nt, Human
uuaauauggggacaaugaagacaagcacacag

SEQ ID NO: 265972 - RNA, 32 nt, Human
uuaauaugugagagacaacagcuggguuuucc

SEQ ID NO: 265973 - RNA, 32 nt, Human
uuaauauguuacauuuguuuaguuuccacgua

SEQ ID NO: 265974 - RNA, 32 nt, Human
uuaauauuaaauauaugauuagccaggcacgg

SEQ ID NO: 265975 - RNA, 32 nt, Human
uuaauauuauucacauuucaugucacaaauuu

SEQ ID NO: 265976 - RNA, 32 nt, Human
uuaauauucccaaugaaauccuguucuuuaau

SEQ ID NO: 265977 - RNA, 32 nt, Human
uuaauauugauaguuucacauccagguuucua

SEQ ID NO: 265978 - RNA, 32 nt, Human
uuaauauugauuggggguggggagaaagaaaa

SEQ ID NO: 265979 - RNA, 32 nt, Human
uuaauauugcaacuuucaccacagggccucug

SEQ ID NO: 265980 - RNA, 32 nt, Human
uuaauauuuaaugcccuuggauuugggaaauc

SEQ ID NO: 265981 - RNA, 32 nt, Human
uuaauauuuacagguuuaccagaucuggaaca

SEQ ID NO: 265982 - RNA, 32 nt, Human
uuaauauuucccaagugucuguugacucauug

SEQ ID NO: 265983 - RNA, 32 nt, Human
uuaaucaaauuacccacccaaggcuucuagaa

SEQ ID NO: 265984 - RNA, 31 nt, Human
uuaaucaauaaaguaugucuguugaagcaag

SEQ ID NO: 265985 - RNA, 32 nt, Human
uuaaucaccaugggaaacuguugugggcgcug

SEQ ID NO: 265986 - RNA, 32 nt, Human
uuaaucacuauuguuccagcaguuuucaaguc

SEQ ID NO: 265987 - RNA, 32 nt, Human
uuaaucacuucugaccuaagguccucauugag

SEQ ID NO: 265988 - RNA, 32 nt, Human
uuaaucagaccagcccaugaguguauaacaaa

SEQ ID NO: 265989 - RNA, 32 nt, Human
uuaaucagagguggcuuaauuacauugaaauu

SEQ ID NO: 265990 - RNA, 32 nt, Human
uuaaucagccagaaggugcagugugacuauga

SEQ ID NO: 265991 - RNA, 24 nt, Human
uuaaucaguccucacaccuuucua

SEQ ID NO: 265992 - RNA, 21 nt, Human
uuaaucagucugcacauccug

SEQ ID NO: 265993 - RNA, 32 nt, Human
uuaaucauccccaguguccaggcacagaguag

SEQ ID NO: 265994 - RNA, 32 nt, Human
uuaauccacugcauccaucuaggauuuauuuu

SEQ ID NO: 265995 - RNA, 32 nt, Human
uuaauccagugaucuuuuaggccaaggaaaua

SEQ ID NO: 265996 - RNA, 32 nt, Human
uuaauccaguguguuucaaacuuuguuugaau

SEQ ID NO: 265997 - RNA, 32 nt, Human
uuaaucccacuagacuauuuuaagaaguuaag

SEQ ID NO: 265998 - RNA, 32 nt, Human
uuaaucccagcacuuugggagacugagguggg

SEQ ID NO: 265999 - RNA, 32 nt, Human
uuaaucccagcacuuugggaggcugaggaagg

SEQ ID NO: 266000 - RNA, 32 nt, Human
uuaaucccagcacuuugggaggcugaguugcu

SEQ ID NO: 266001 - RNA, 32 nt, Human
uuaaucccagcacuuugggaggucaagauggg

SEQ ID NO: 266002 - RNA, 32 nt, Human
uuaauccccuucagccccuagcucuuuuauuc

SEQ ID NO: 266003 - RNA, 32 nt, Human
uuaaucccucauauucaauuucaucaagccuu

SEQ ID NO: 266004 - RNA, 32 nt, Human
uuaauccucaggcaaaugcuacacccguaccc

SEQ ID NO: 266005 - RNA, 32 nt, Human
uuaauccucccuuccucccuauuaaccuagag

SEQ ID NO: 266006 - RNA, 32 nt, Human
uuaauccucuacuacugccugcucuucauuuu

SEQ ID NO: 266007 - RNA, 23 nt, Human
uuaauccuugauaagaguugcuu

SEQ ID NO: 266008 - RNA, 32 nt, Human
uuaaucgacuccugcaaaucuauaccagugag

SEQ ID NO: 266009 - RNA, 32 nt, Human
uuaaucguccugcugcugcugccguuccggug

SEQ ID NO: 266010 - RNA, 32 nt, Human
uuaaucuaccugcuuugucuaaauccucugaa

SEQ ID NO: 266011 - RNA, 32 nt, Human
uuaaucuacuccugaaugacuuggguaaacaa

SEQ ID NO: 266012 - RNA, 32 nt, Human
uuaaucucauuucuggacucuuuaaguucuac

SEQ ID NO: 266013 - RNA, 32 nt, Human
uuaaucucucagccacaaaccucaguuuccaa

SEQ ID NO: 266014 - RNA, 32 nt, Human
uuaaucucugcaguuuauucucucuuaaggaa

SEQ ID NO: 266015 - RNA, 31 nt, Human
uuaaucugauauuauauuuguugaaauagaa

SEQ ID NO: 266016 - RNA, 32 nt, Human
uuaaucugcacaguuuaucuucugccaaaaua

SEQ ID NO: 266017 - RNA, 32 nt, Human
uuaaucugcauucuguuuccucuucuaguugu

SEQ ID NO: 266018 - RNA, 32 nt, Human
uuaaucugccuggcguccccucccucugucuu

SEQ ID NO: 266019 - RNA, 32 nt, Human
uuaaucuuaaaauugguggucauuucaauggu

SEQ ID NO: 266020 - RNA, 32 nt, Human
uuaaucuuauacagaagaaacuaacuuagaaa

SEQ ID NO: 266021 - RNA, 32 nt, Human
uuaaucuugagucuggcagcaauuuguaaagg

SEQ ID NO: 266022 - RNA, 32 nt, Human
uuaaucuugauacuaaggauuuguuacuuuuu

SEQ ID NO: 266023 - RNA, 32 nt, Human
uuaaucuugcagaagagguucaacauauuaac

SEQ ID NO: 266024 - RNA, 32 nt, Human
uuaaugaaaacuacuuuugucuucaucauaaa

SEQ ID NO: 266025 - RNA, 32 nt, Human
uuaaugaaaaugucagaaaccaguuaugugaa

SEQ ID NO: 266026 - RNA, 32 nt, Human
uuaaugaacacgugucucacacacaaaaagaa

SEQ ID NO: 266027 - RNA, 32 nt, Human
uuaaugaacuauaccuguuaaguuccaaaggu

SEQ ID NO: 266028 - RNA, 32 nt, Human
uuaaugaacuucuuuucaugauguagggaaag

SEQ ID NO: 266029 - RNA, 32 nt, Human
uuaaugaaugaccagcagcagcuuucagcucu

SEQ ID NO: 266030 - RNA, 32 nt, Human
uuaaugacacugguuucauguaguuuucaaga

SEQ ID NO: 266031 - RNA, 32 nt, Human
uuaaugacagaacuuggcuaauggaauucaca

SEQ ID NO: 266032 - RNA, 32 nt, Human
uuaaugaccaggcucuaugugcugcuguagug

SEQ ID NO: 266033 - RNA, 32 nt, Human
uuaaugagacagagucucucucugucaccuag

SEQ ID NO: 266034 - RNA, 32 nt, Human
uuaaugagauacuuugcuuccucauucaacau

SEQ ID NO: 266035 - RNA, 32 nt, Human
uuaaugagcaaggacaaccugccccuccccag

SEQ ID NO: 266036 - RNA, 32 nt, Human
uuaaugaggagggggagaaggagcaggaauau

SEQ ID NO: 266037 - RNA, 32 nt, Human
uuaaugagugaccaguguccauguuuaugcau

SEQ ID NO: 266038 - RNA, 32 nt, Human
uuaaugaucuuucacaagagcuguuuggccuu

SEQ ID NO: 266039 - RNA, 32 nt, Human
uuaaugauucaccaauuucuugcauuaauuug

SEQ ID NO: 266040 - RNA, 32 nt, Human
uuaaugauugagguauuuguuuaaaauucagu

SEQ ID NO: 266041 - RNA, 32 nt, Human
uuaaugcaacccagguaugcuccaugcauauc

SEQ ID NO: 266042 - RNA, 32 nt, Human
uuaaugcacauccuuaucucauugcuggcuuc

SEQ ID NO: 266043 - RNA, 32 nt, Human
uuaaugcagauggcaagugcaccaaggagaag

SEQ ID NO: 266044 - RNA, 31 nt, Human
uuaaugcaguuucacuuauguuaaauguugc

SEQ ID NO: 266045 - RNA, 32 nt, Human
uuaaugcauauggggaaacugaggcccagauu

SEQ ID NO: 266046 - RNA, 32 nt, Human
uuaaugcauuugcccaauauuuuacauuguua

SEQ ID NO: 266047 - RNA, 32 nt, Human
uuaaugccacaacagcuacgucaugggauuga

SEQ ID NO: 266048 - RNA, 32 nt, Human
uuaaugccagaagaaaaguuaccagaauuuau

SEQ ID NO: 266049 - RNA, 32 nt, Human
uuaaugccagccuggggcucucagcaggagga

SEQ ID NO: 266050 - RNA, 32 nt, Human
uuaaugccagcgcauugagggagaugucccca

SEQ ID NO: 266051 - RNA, 32 nt, Human
uuaaugcccagccagccaccccugccacucac

SEQ ID NO: 266052 - RNA, 32 nt, Human
uuaaugccugccuuaaggggugagugagugcu

SEQ ID NO: 266053 - RNA, 32 nt, Human
uuaaugccuuuggccuuccauucugacuucuc

SEQ ID NO: 266054 - RNA, 32 nt, Human
uuaaugcgggcagcaccuacagcaacuuggaa

SEQ ID NO: 266055 - RNA, 32 nt, Human
uuaaugcuaaauaugugcuaaauacuggauua

SEQ ID NO: 266056 - RNA, 32 nt, Human
uuaaugcucucugaagaaaggcaacaucuuuu

SEQ ID NO: 266057 - RNA, 32 nt, Human
uuaaugcucuggacuugccuccagagacugcu

SEQ ID NO: 266058 - RNA, 32 nt, Human
uuaaugcugcucccagucuucuguccauacca

SEQ ID NO: 266059 - RNA, 32 nt, Human
uuaaugcuugaaggaugguuugggaggcaggg

SEQ ID NO: 266060 - RNA, 32 nt, Human
uuaauggaauacagucauguccacucaagacg

SEQ ID NO: 266061 - RNA, 32 nt, Human
uuaauggagagggcggcgaagaggacccgcag

SEQ ID NO: 266062 - RNA, 32 nt, Human
uuaauggaucugauuugucuccacucuuugcc

SEQ ID NO: 266063 - RNA, 32 nt, Human
uuaauggcugccgacaaugaacugucugucug

SEQ ID NO: 266064 - RNA, 32 nt, Human
uuaauggcuuuccucucucuuguuuuaccuua

SEQ ID NO: 266065 - RNA, 32 nt, Human
uuaaugggcucaaggucaccuaccugaccuac

SEQ ID NO: 266066 - RNA, 32 nt, Human
uuaaugguaaaagagaaaaggagagagguuga

SEQ ID NO: 266067 - RNA, 32 nt, Human
uuaaugguacuccuauaauuuuugauugugag

SEQ ID NO: 266068 - RNA, 32 nt, Human
uuaauggugagcuuuuaaaaauguaggauaga

SEQ ID NO: 266069 - RNA, 32 nt, Human
uuaaugguuacaacucccaccccaccaaagug

SEQ ID NO: 266070 - RNA, 32 nt, Human
uuaaugucacaucugccuuuggagauuacaaa

SEQ ID NO: 266071 - RNA, 32 nt, Human
uuaaugucauuucuuccugaggaaggaagauu

SEQ ID NO: 266072 - RNA, 32 nt, Human
uuaaugucucauuccccuugaggccagcugcu

SEQ ID NO: 266073 - RNA, 32 nt, Human
uuaaugucuuaaugauuggugcugcuaacuug

SEQ ID NO: 266074 - RNA, 32 nt, Human
uuaaugugagaaggaagggaggaguaggaauc

SEQ ID NO: 266075 - RNA, 32 nt, Human
uuaaugugauuguguauucuguuuacauuaaa

SEQ ID NO: 266076 - RNA, 32 nt, Human
uuaauguggaaaugauguuucauaagaauucu

SEQ ID NO: 266077 - RNA, 31 nt, Human
uuaauguggacaauuuacacacccaacacau

SEQ ID NO: 266078 - RNA, 32 nt, Human
uuaauguggacaauuuacacacccaacacaua

SEQ ID NO: 266079 - RNA, 32 nt, Human
uuaauguggauuuccuccuuccuuccaaguuc

SEQ ID NO: 266080 - RNA, 32 nt, Human
uuaauguggcucacaaucuuauccaaucuuuc

SEQ ID NO: 266081 - RNA, 31 nt, Human
uuaauguggguggagauggggaugauuguag

SEQ ID NO: 266082 - RNA, 32 nt, Human
uuaauguguccccugaguuggagcucauucug

SEQ ID NO: 266083 - RNA, 32 nt, Human
uuaauguguuucuccccaugguccuauuucuc

SEQ ID NO: 266084 - RNA, 32 nt, Human
uuaauguuaagcaauuccaccacacuucugaa

SEQ ID NO: 266085 - RNA, 32 nt, Human
uuaauguuaccugaacauguggugaggucagc

SEQ ID NO: 266086 - RNA, 32 nt, Human
uuaauguucauuuugauuuauuuuaaaucuuu

SEQ ID NO: 266087 - RNA, 32 nt, Human
uuaauguuccaagucagcugugccucacacaa

SEQ ID NO: 266088 - RNA, 32 nt, Human
uuaauguuccucgucgggcaaaagauaaggau

SEQ ID NO: 266089 - RNA, 32 nt, Human
uuaauguugaugucuucauuggaugggucaua

SEQ ID NO: 266090 - RNA, 32 nt, Human
uuaauguuggguuuugguagaugaggaaagca

SEQ ID NO: 266091 - RNA, 32 nt, Human
uuaauguuucuguccuuucugugaauuauuga

SEQ ID NO: 266092 - RNA, 32 nt, Human
uuaauguuuuuccccaugaaccacaguuuuua

SEQ ID NO: 266093 - RNA, 32 nt, Human
uuaauuaaaauacaagaagcagcugaggaaag

SEQ ID NO: 266094 - RNA, 32 nt, Human
uuaauuaaagcccacaauccuccuggggagag

SEQ ID NO: 266095 - RNA, 32 nt, Human
uuaauuaaauuucacaauauaaaguucuacag

SEQ ID NO: 266096 - RNA, 32 nt, Human
uuaauuaaguaggucuuuggggcaguuaguuc

SEQ ID NO: 266097 - RNA, 32 nt, Human
uuaauuacaauguaauagaagcuuaaaauaaa

SEQ ID NO: 266098 - RNA, 32 nt, Human
uuaauuaccaaaacucuccugcaucagagcau

SEQ ID NO: 266099 - RNA, 32 nt, Human
uuaauuacuggacucucuuagcacaggaaggu

SEQ ID NO: 266100 - RNA, 32 nt, Human
uuaauuacuugggcaucccaggaagcuuucca

SEQ ID NO: 266101 - RNA, 32 nt, Human
uuaauuagaaucgagcuggcuuuguauuauau

SEQ ID NO: 266102 - RNA, 32 nt, Human
uuaauuagacauuguuauuaacaggaacagug

SEQ ID NO: 266103 - RNA, 32 nt, Human
uuaauuaggcagccuggagaaaaccagagauc

SEQ ID NO: 266104 - RNA, 32 nt, Human
uuaauuauacaacuccauuuuuguauuugcau

SEQ ID NO: 266105 - RNA, 32 nt, Human
uuaauuauaggagagaaagagagaaacuucag

SEQ ID NO: 266106 - RNA, 32 nt, Human
uuaauuauauuggcaaugaagcacuuucaaug

SEQ ID NO: 266107 - RNA, 32 nt, Human
uuaauuaucaagucuguuuugggaaacacuuu

SEQ ID NO: 266108 - RNA, 32 nt, Human
uuaauuaugagggagaaaauguuucucugcug

SEQ ID NO: 266109 - RNA, 32 nt, Human
uuaauuaugcacuuuguccucuggaccauuuu

SEQ ID NO: 266110 - RNA, 32 nt, Human
uuaauuauggcacaguaacaggaaaagguugu

SEQ ID NO: 266111 - RNA, 32 nt, Human
uuaauuauuguaaaaaguccaagcagaucaau

SEQ ID NO: 266112 - RNA, 32 nt, Human
uuaauucaacccagccaugcaaugccaaauaa

SEQ ID NO: 266113 - RNA, 32 nt, Human
uuaauucaacuccugagguccugaaggaacuu

SEQ ID NO: 266114 - RNA, 32 nt, Human
uuaauucacauuuccacuagcacuacacgaua

SEQ ID NO: 266115 - RNA, 32 nt, Human
uuaauucagcaacccucaguacauacuaagua

SEQ ID NO: 266116 - RNA, 32 nt, Human
uuaauucagccccucugaaaagcacauacagu

SEQ ID NO: 266117 - RNA, 32 nt, Human
uuaauucaugaggagggugggggagggaggug

SEQ ID NO: 266118 - RNA, 32 nt, Human
uuaauuccacacacaccacagagcugguuuua

SEQ ID NO: 266119 - RNA, 32 nt, Human
uuaauuccaccagcaaagcuggcgaggcaggg

SEQ ID NO: 266120 - RNA, 32 nt, Human
uuaauuccagagaauuuuuaucacccaaauaa

SEQ ID NO: 266121 - RNA, 32 nt, Human
uuaauuccaguaaaauaacagcaaugacaaug

SEQ ID NO: 266122 - RNA, 32 nt, Human
uuaauucccgccuuaugccucagucuauucug

SEQ ID NO: 266123 - RNA, 32 nt, Human
uuaauuccuacguacaugcgcccacaucucgu

SEQ ID NO: 266124 - RNA, 32 nt, Human
uuaauuccucuccaaucucuccuagcagcguc

SEQ ID NO: 266125 - RNA, 32 nt, Human
uuaauuccuggucuaguuuccugggccuugug

SEQ ID NO: 266126 - RNA, 32 nt, Human
uuaauuccuugcauagucucucuugucaaguc

SEQ ID NO: 266127 - RNA, 32 nt, Human
uuaauucucaacuacuguacucauuuaguaga

SEQ ID NO: 266128 - RNA, 32 nt, Human
uuaauucucaguugauacaaaggcuuauaauc

SEQ ID NO: 266129 - RNA, 32 nt, Human
uuaauucuccagccacuuuuggugccaacuua

SEQ ID NO: 266130 - RNA, 32 nt, Human
uuaauucugcugucugcucuucucuaaugcug

SEQ ID NO: 266131 - RNA, 32 nt, Human
uuaauucugggagaaaugagauaaaagaugua

SEQ ID NO: 266132 - RNA, 32 nt, Human
uuaauucugugcuaugucaauggcaguuuuca

SEQ ID NO: 266133 - RNA, 32 nt, Human
uuaauucuguuuagaugaucuguccauuguug

SEQ ID NO: 266134 - RNA, 32 nt, Human
uuaauucuuagcaagcuccuuguucucuacug

SEQ ID NO: 266135 - RNA, 32 nt, Human
uuaauucuucaaggacuuugacauuuguuuau

SEQ ID NO: 266136 - RNA, 32 nt, Human
uuaauucuucaguuauugaaaguagaguccaa

SEQ ID NO: 266137 - RNA, 32 nt, Human
uuaauucuugccuuauaccucagucuauuaug

SEQ ID NO: 266138 - RNA, 32 nt, Human
uuaauucuuguucuuugcaccucucucuccac

SEQ ID NO: 266139 - RNA, 32 nt, Human
uuaauugaaauccugggucucuuggccugucc

SEQ ID NO: 266140 - RNA, 32 nt, Human
uuaauugaagugagauuuuucuggccugagac

SEQ ID NO: 266141 - RNA, 32 nt, Human
uuaauugaauacuguuucuucagucaugguua

SEQ ID NO: 266142 - RNA, 32 nt, Human
uuaauugacucugccuagauaggucucauuaa

SEQ ID NO: 266143 - RNA, 32 nt, Human
uuaauugaugaaacugugcauaaguuuacaug

SEQ ID NO: 266144 - RNA, 32 nt, Human
uuaauugauuuuccuuugggguuccagauaau

SEQ ID NO: 266145 - RNA, 32 nt, Human
uuaauugcacauacagauguuugcuggguaua

SEQ ID NO: 266146 - RNA, 32 nt, Human
uuaauugccaaccaggaggaguugggcuguau

SEQ ID NO: 266147 - RNA, 32 nt, Human
uuaauugcuagcaaggcugagcacuuuuccau

SEQ ID NO: 266148 - RNA, 32 nt, Human
uuaauugcuugcucugcuaauauuucagcuuc

SEQ ID NO: 266149 - RNA, 32 nt, Human
uuaauuggauugauuauaauaccaccuuaagc

SEQ ID NO: 266150 - RNA, 32 nt, Human
uuaauuggcugacaguuuugcaggcuguacaa

SEQ ID NO: 266151 - RNA, 32 nt, Human
uuaauuggcuuggaaaggggucagcaggguga

SEQ ID NO: 266152 - RNA, 32 nt, Human
uuaauugguguuuucuuauugcacugaauuca

SEQ ID NO: 266153 - RNA, 32 nt, Human
uuaauuguaacugucaguuugcacuggucggu

SEQ ID NO: 266154 - RNA, 32 nt, Human
uuaauuguguaacuguucuuugcagugaagau

SEQ ID NO: 266155 - RNA, 32 nt, Human
uuaauuguguuuuagaacauccccggacacuc

SEQ ID NO: 266156 - RNA, 32 nt, Human
uuaauuguucucaaacauugcaagaaauucgu

SEQ ID NO: 266157 - RNA, 32 nt, Human
uuaauuguugaaugauuaagucucuaaguauc

SEQ ID NO: 266158 - RNA, 32 nt, Human
uuaauuguuggauagaaaaaucauuggauaga

SEQ ID NO: 266159 - RNA, 32 nt, Human
uuaauuguuggggagaggaggaugagcagaac

SEQ ID NO: 266160 - RNA, 32 nt, Human
uuaauuguuuucuuggcacucucucccuucuc

SEQ ID NO: 266161 - RNA, 32 nt, Human
uuaauuuaaaaagggaaccuuggagaauucuu

SEQ ID NO: 266162 - RNA, 32 nt, Human
uuaauuuaaagaaaaagaaaauuagcaguauc

SEQ ID NO: 266163 - RNA, 32 nt, Human
uuaauuuaaauacccaaccucuccaucacagc

SEQ ID NO: 266164 - RNA, 32 nt, Human
uuaauuuacauacuuguuuguagauucuguuu

SEQ ID NO: 266165 - RNA, 32 nt, Human
uuaauuuaugcucacaccuuacugcacagaaa

SEQ ID NO: 266166 - RNA, 32 nt, Human
uuaauuuaugugaaagaguucuggauucaaau

SEQ ID NO: 266167 - RNA, 32 nt, Human
uuaauuucaaaauauuugucauucaagucccu

SEQ ID NO: 266168 - RNA, 32 nt, Human
uuaauuucaaagaagacuuacaugggggagaa

SEQ ID NO: 266169 - RNA, 32 nt, Human
uuaauuucaccugaauaucauaaugcuuaaag

SEQ ID NO: 266170 - RNA, 32 nt, Human
uuaauuucagucuuggugguucuaucaggggu

SEQ ID NO: 266171 - RNA, 32 nt, Human
uuaauuucauguucacagcacuguguagagca

SEQ ID NO: 266172 - RNA, 31 nt, Human
uuaauuuccauaacuaaaguguucagacugg

SEQ ID NO: 266173 - RNA, 32 nt, Human
uuaauuuccuucucugcuucugaccaagcuaa

SEQ ID NO: 266174 - RNA, 32 nt, Human
uuaauuuccuuucugcaaauuaaaacuaauga

SEQ ID NO: 266175 - RNA, 32 nt, Human
uuaauuucugggcugcugagguucuagaauag

SEQ ID NO: 266176 - RNA, 32 nt, Human
uuaauuucuucuucuuuuccuuuuggcaaagc

SEQ ID NO: 266177 - RNA, 32 nt, Human
uuaauuucuuuucuauuccaucaucugcccuu

SEQ ID NO: 266178 - RNA, 32 nt, Human
uuaauuugcaccaguaaacuucaagcugcuuu

SEQ ID NO: 266179 - RNA, 32 nt, Human
uuaauuuguacaaaaagaacucuuuauaaggu

SEQ ID NO: 266180 - RNA, 32 nt, Human
uuaauuugucugaguccuggaccucagccuag

SEQ ID NO: 266181 - RNA, 32 nt, Human
uuaauuuuaaaaagucauaaaagcuuucaaac

SEQ ID NO: 266182 - RNA, 32 nt, Human
uuaauuuuagguuugaaauauauuugguaauc

SEQ ID NO: 266183 - RNA, 32 nt, Human
uuaauuuuaguguuguuucucacaucagcuuc

SEQ ID NO: 266184 - RNA, 32 nt, Human
uuaauuuuauauacaguaaaagccuggguugu

SEQ ID NO: 266185 - RNA, 32 nt, Human
uuaauuuuauucauuaucccuagauagcuauu

SEQ ID NO: 266186 - RNA, 32 nt, Human
uuaauuuuccagaaccaggaaugaguaucuaa

SEQ ID NO: 266187 - RNA, 32 nt, Human
uuaauuuuccugaagcuugcaggauagauuga

SEQ ID NO: 266188 - RNA, 32 nt, Human
uuaauuuucuauccucccuuacuauccuccuu

SEQ ID NO: 266189 - RNA, 32 nt, Human
uuaauuuucucauucuguugcuguugaacgua

SEQ ID NO: 266190 - RNA, 21 nt, Human
uuaauuuuguaucuacugaua

SEQ ID NO: 266191 - RNA, 32 nt, Human
uuaauuuugucuuccucacuuuucaccuuagu

SEQ ID NO: 266192 - RNA, 32 nt, Human
uuaauuuuguugaagcauuucaagaugagcua

SEQ ID NO: 266193 - RNA, 32 nt, Human
uuaauuuuuauuacugaaaaacauggaaauca

SEQ ID NO: 266194 - RNA, 32 nt, Human
uuaauuuuugagacagagucucgcucugucgc

SEQ ID NO: 266195 - RNA, 32 nt, Human
uuacaaaaauaacacuaaacucucaacacuuu

SEQ ID NO: 266196 - RNA, 32 nt, Human
uuacaaaaaugcuuacaauccaggcauucuuu

SEQ ID NO: 266197 - RNA, 32 nt, Human
uuacaaaaauuagccgagcaugguggcgcaug

SEQ ID NO: 266198 - RNA, 32 nt, Human
uuacaaaaauuagccggccaugguggcaggug

SEQ ID NO: 266199 - RNA, 32 nt, Human
uuacaaaaauuagccgggcaugguggcacaug

SEQ ID NO: 266200 - RNA, 32 nt, Human
uuacaaaaauuagcugcgugugguggcaggcc

SEQ ID NO: 266201 - RNA, 32 nt, Human
uuacaaaaauuagcuggcaugguggugcaugc

SEQ ID NO: 266202 - RNA, 32 nt, Human
uuacaaaacguuagaaaaauuagccaggugug

SEQ ID NO: 266203 - RNA, 32 nt, Human
uuacaaaagaaaaggaccagauugaggcagcg

SEQ ID NO: 266204 - RNA, 32 nt, Human
uuacaaaagauaaucaaaagcaugaaagcacu

SEQ ID NO: 266205 - RNA, 32 nt, Human
uuacaaaaggaaacccagagcagcuugaugag

SEQ ID NO: 266206 - RNA, 32 nt, Human
uuacaaaauugcuggcugggugcaguggcuua

SEQ ID NO: 266207 - RNA, 32 nt, Human
uuacaaacagaagaguagcaucagagcccuga

SEQ ID NO: 266208 - RNA, 32 nt, Human
uuacaaaccaaaauuauuuuacagcaacgaaa

SEQ ID NO: 266209 - RNA, 32 nt, Human
uuacaaacgggaccauauuuugcuucgaaaug

SEQ ID NO: 266210 - RNA, 32 nt, Human
uuacaaacuauguauaguauguauguuuugug

SEQ ID NO: 266211 - RNA, 32 nt, Human
uuacaaacugguuuuaaauauuggacauacug

SEQ ID NO: 266212 - RNA, 32 nt, Human
uuacaaagagcaauuuugagcugugacuuuuu

SEQ ID NO: 266213 - RNA, 32 nt, Human
uuacaaaggaacaaagaagggaaaagguauuu

SEQ ID NO: 266214 - RNA, 32 nt, Human
uuacaaaggugaaacccaggaggagagugugg

SEQ ID NO: 266215 - RNA, 32 nt, Human
uuacaaauccacugcuaucuucuucuguccug

SEQ ID NO: 266216 - RNA, 32 nt, Human
uuacaaaucuggucaaaacaccuguccauuuc

SEQ ID NO: 266217 - RNA, 32 nt, Human
uuacaaaugaaagaaggccaaaagccacuuua

SEQ ID NO: 266218 - RNA, 32 nt, Human
uuacaaaugcugacugaacacuagcauaccug

SEQ ID NO: 266219 - RNA, 32 nt, Human
uuacaaccaagaaauaauaguaugaagcggau

SEQ ID NO: 266220 - RNA, 32 nt, Human
uuacaaccagcccagccuaggauauggacaga

SEQ ID NO: 266221 - RNA, 32 nt, Human
uuacaacgugacaggaagaggagggagagggu

SEQ ID NO: 266222 - RNA, 32 nt, Human
uuacaacuaaaacugaccagagccccaggaau

SEQ ID NO: 266223 - RNA, 32 nt, Human
uuacaacuauuguucucauauuucucacacua

SEQ ID NO: 266224 - RNA, 32 nt, Human
uuacaacugaccaaaguggcccccucuggggg

SEQ ID NO: 266225 - RNA, 32 nt, Human
uuacaacugaguucugucuggcccagaaccag

SEQ ID NO: 266226 - RNA, 32 nt, Human
uuacaacugccuguucuuucuccaguccuuuu

SEQ ID NO: 266227 - RNA, 32 nt, Human
uuacaacuuacaggaacauuuguacuuuaaga

SEQ ID NO: 266228 - RNA, 32 nt, Human
uuacaacuuauccccacucauuggagugaaca

SEQ ID NO: 266229 - RNA, 32 nt, Human
uuacaacuucagaccggagaaaaggccagagg

SEQ ID NO: 266230 - RNA, 32 nt, Human
uuacaagaagugaaacugcaaguucacuuugc

SEQ ID NO: 266231 - RNA, 32 nt, Human
uuacaagacauagcuaaugagguugcuguaua

SEQ ID NO: 266232 - RNA, 32 nt, Human
uuacaagaggcugaaauugagcaaucagauac

SEQ ID NO: 266233 - RNA, 32 nt, Human
uuacaagagguggagcaugcagaugagcaggu

SEQ ID NO: 266234 - RNA, 32 nt, Human
uuacaagcaaagcaguuccacccaugaccaau

SEQ ID NO: 266235 - RNA, 24 nt, Human
uuacaagcaccagccaccaugccu

SEQ ID NO: 266236 - RNA, 32 nt, Human
uuacaagcaguuuccuuauagcucauguaucu

SEQ ID NO: 266237 - RNA, 24 nt, Human
uuacaagcaugagccaccaugccc

SEQ ID NO: 266238 - RNA, 24 nt, Human
uuacaagcaugcaccaccaugccc

SEQ ID NO: 266239 - RNA, 24 nt, Human
uuacaagcaugcgccaccaugccc

SEQ ID NO: 266240 - RNA, 31 nt, Human
uuacaagcaugcgucaccacagcaggcccaa

SEQ ID NO: 266241 - RNA, 32 nt, Human
uuacaagcgugagccaccacacuaggccuuua

SEQ ID NO: 266242 - RNA, 32 nt, Human
uuacaagcuggacucagggauccuccuggccg

SEQ ID NO: 266243 - RNA, 32 nt, Human
uuacaagcuggacucagggauccuccugggcg

SEQ ID NO: 266244 - RNA, 32 nt, Human
uuacaaggcagcagcaagagaaaaugaggaag

SEQ ID NO: 266245 - RNA, 24 nt, Human
uuacaagggugagccaccaugccc

SEQ ID NO: 266246 - RNA, 32 nt, Human
uuacaaggguguuacugaaaucuggaaggcga

SEQ ID NO: 266247 - RNA, 32 nt, Human
uuacaaguacuguucuaaauguuaacaccugu

SEQ ID NO: 266248 - RNA, 32 nt, Human
uuacaagucagccuaccucucugugaucuggu

SEQ ID NO: 266249 - RNA, 24 nt, Human
uuacaagugcccaccaccaugccc

SEQ ID NO: 266250 - RNA, 32 nt, Human
uuacaaguucccaaaguaaccgucuccaugua

SEQ ID NO: 266251 - RNA, 32 nt, Human
uuacaaguuucagugagaagaauuggaacuuu

SEQ ID NO: 266252 - RNA, 32 nt, Human
uuacaauaagugucugcaggaggaguguccug

SEQ ID NO: 266253 - RNA, 32 nt, Human
uuacaauauuuaaguucucugcuucugcauuu

SEQ ID NO: 266254 - RNA, 32 nt, Human
uuacaaucaaccugcacugagcacuuugugcg

SEQ ID NO: 266255 - RNA, 21 nt, Human
uuacaauccucaaaacuucuu

SEQ ID NO: 266256 - RNA, 32 nt, Human
uuacaaucuccacaaugaaaacaaauagugca

SEQ ID NO: 266257 - RNA, 32 nt, Human
uuacaaucucucucccgucauccacacugaau

SEQ ID NO: 266258 - RNA, 32 nt, Human
uuacaaugacauccuccuccuccaucacucca

SEQ ID NO: 266259 - RNA, 32 nt, Human
uuacaauguuugucccauuucuaagggcuucu

SEQ ID NO: 266260 - RNA, 32 nt, Human
uuacaauucaacuacuuguucuacccagcauu

SEQ ID NO: 266261 - RNA, 32 nt, Human
uuacaauucuaagcugcaucccuguaucaaaa

SEQ ID NO: 266262 - RNA, 32 nt, Human
uuacaauuucucagguaaacaauuguuuucuc

SEQ ID NO: 266263 - RNA, 24 nt, Human
uuacacaaaaauuauuuccagaaa

SEQ ID NO: 266264 - RNA, 32 nt, Human
uuacacaaacaaucucggccuggguaaaugag

SEQ ID NO: 266265 - RNA, 32 nt, Human
uuacacaaauuauaaaaauuagucggguguca

SEQ ID NO: 266266 - RNA, 32 nt, Human
uuacacaacugauccgugugugaggugggagu

SEQ ID NO: 266267 - RNA, 32 nt, Human
uuacacaaggaaauguguggcuuuuguuuugu

SEQ ID NO: 266268 - RNA, 32 nt, Human
uuacacacaucuggacuuucagaucugaaacg

SEQ ID NO: 266269 - RNA, 32 nt, Human
uuacacaccgaaggaauugaaauaaguuacca

SEQ ID NO: 266270 - RNA, 32 nt, Human
uuacacacuuccuauuuagcaaugagcacacc

SEQ ID NO: 266271 - RNA, 32 nt, Human
uuacacacuuuccuguucauagcaauauuaaa

SEQ ID NO: 266272 - RNA, 32 nt, Human
uuacacagacacacaaaugcaccuauuuauac

SEQ ID NO: 266273 - RNA, 32 nt, Human
uuacacagcaaggacugcugugugugggugug

SEQ ID NO: 266274 - RNA, 32 nt, Human
uuacacagcuggucaguagcagacacaagauc

SEQ ID NO: 266275 - RNA, 32 nt, Human
uuacacaguuuccuguaucauaaauccuagug

SEQ ID NO: 266276 - RNA, 32 nt, Human
uuacacaguuuuuaccucccuguauggcaauu

SEQ ID NO: 266277 - RNA, 32 nt, Human
uuacacaucuuacugucaaucuugccuacauu

SEQ ID NO: 266278 - RNA, 32 nt, Human
uuacacaugcuggaaugacuguaauuacucua

SEQ ID NO: 266279 - RNA, 32 nt, Human
uuacacauggacucaaagaagggaacaguaga

SEQ ID NO: 266280 - RNA, 32 nt, Human
uuacacauucgggccugaaaacaaauaugacc

SEQ ID NO: 266281 - RNA, 32 nt, Human
uuacacauucucacaauuguaaaguuuccccu

SEQ ID NO: 266282 - RNA, 32 nt, Human
uuacacauuuucucagaggccuuugugcuccc

SEQ ID NO: 266283 - RNA, 32 nt, Human
uuacaccacugcacuccagucuggaugacaaa

SEQ ID NO: 266284 - RNA, 32 nt, Human
uuacaccacugcacuucagucugugugacuga

SEQ ID NO: 266285 - RNA, 32 nt, Human
uuacaccacugcacuugagccugggcagcaga

SEQ ID NO: 266286 - RNA, 32 nt, Human
uuacaccaguaaucccagcacuuugggaggcu

SEQ ID NO: 266287 - RNA, 32 nt, Human
uuacaccauacagcucaaacuucagaagauuu

SEQ ID NO: 266288 - RNA, 32 nt, Human
uuacaccauugcauuccagccuaggcaacaga

SEQ ID NO: 266289 - RNA, 32 nt, Human
uuacaccauugcauuccagccugggcaacaga

SEQ ID NO: 266290 - RNA, 32 nt, Human
uuacaccauuugcugcucacacuuucugccuu

SEQ ID NO: 266291 - RNA, 32 nt, Human
uuacacccaaguguccugguuaacuugaagca

SEQ ID NO: 266292 - RNA, 32 nt, Human
uuacacccagaacugucucagaggagguucaa

SEQ ID NO: 266293 - RNA, 32 nt, Human
uuacacccagagcguccagaucugccacauag

SEQ ID NO: 266294 - RNA, 32 nt, Human
uuacacccagagguggagcagguggcuuaggg

SEQ ID NO: 266295 - RNA, 32 nt, Human
uuacaccccugcacuccagccugggcggcaga

SEQ ID NO: 266296 - RNA, 32 nt, Human
uuacaccccuggacuccagcuugggugacaca

SEQ ID NO: 266297 - RNA, 32 nt, Human
uuacacccuuguucugucaaagcaauuaaaga

SEQ ID NO: 266298 - RNA, 32 nt, Human
uuacaccuacucagaugaggcagcagcagacc

SEQ ID NO: 266299 - RNA, 32 nt, Human
uuacaccuauaaucccagcaauuugggaggcc

SEQ ID NO: 266300 - RNA, 32 nt, Human
uuacaccuauaaucccagcacuuugggaggcu

SEQ ID NO: 266301 - RNA, 32 nt, Human
uuacaccuccacucagcacucuggacuccacg

SEQ ID NO: 266302 - RNA, 32 nt, Human
uuacaccucuugcugguuugagacgucaauca

SEQ ID NO: 266303 - RNA, 32 nt, Human
uuacaccugagauaaauaauaagcuuagagug

SEQ ID NO: 266304 - RNA, 32 nt, Human
uuacaccugcauguccuuugcauuucagauuc

SEQ ID NO: 266305 - RNA, 32 nt, Human
uuacaccugccuguccuuccugggccccuccu

SEQ ID NO: 266306 - RNA, 32 nt, Human
uuacaccuggacaguagacagggacuucagag

SEQ ID NO: 266307 - RNA, 32 nt, Human
uuacaccuguaaccccagcacuuugggaggcu

SEQ ID NO: 266308 - RNA, 32 nt, Human
uuacaccuguaacccuggcauuuugggaggcc

SEQ ID NO: 266309 - RNA, 32 nt, Human
uuacaccuguaaucccaacacuuugcgaggcc

SEQ ID NO: 266310 - RNA, 32 nt, Human
uuacaccuguaaucccaacacuuugggaagcc

SEQ ID NO: 266311 - RNA, 32 nt, Human
uuacaccuguaaucccagcacuuugggaggcc

SEQ ID NO: 266312 - RNA, 32 nt, Human
uuacaccuguaaucccagcacuuugggaggcu

SEQ ID NO: 266313 - RNA, 32 nt, Human
uuacaccuguaaucccagcuacucaggagggu

SEQ ID NO: 266314 - RNA, 32 nt, Human
uuacaccuguaaucccaguacuuugggaggcc

SEQ ID NO: 266315 - RNA, 32 nt, Human
uuacaccuguaauccuaguacuuugggaggcu

SEQ ID NO: 266316 - RNA, 32 nt, Human
uuacaccuguaaucgcagcauuuugggaggcc

SEQ ID NO: 266317 - RNA, 32 nt, Human
uuacaccuguaaucugagcgcuuugggaggcc

SEQ ID NO: 266318 - RNA, 32 nt, Human
uuacaccuguaauuccagcacuuugggacgcc

SEQ ID NO: 266319 - RNA, 32 nt, Human
uuacaccuguagucccaggcacuuugggaggc

SEQ ID NO: 266320 - RNA, 32 nt, Human
uuacaccugugaucccagcacuuugggaggcc

SEQ ID NO: 266321 - RNA, 32 nt, Human
uuacaccuucauucucuccagcauccucggca

SEQ ID NO: 266322 - RNA, 32 nt, Human
uuacaccuugggcuuggauauugcccagagaa

SEQ ID NO: 266323 - RNA, 32 nt, Human
uuacacgaaagccacagaguugaaagccacag

SEQ ID NO: 266324 - RNA, 32 nt, Human
uuacacgacggcggggacugaggucccucgca

SEQ ID NO: 266325 - RNA, 32 nt, Human
uuacacgauucagccuuagaacugggggcaug

SEQ ID NO: 266326 - RNA, 32 nt, Human
uuacacggcaggcugaggugggaggaucacuu

SEQ ID NO: 266327 - RNA, 32 nt, Human
uuacacgggagaggagaauggauuuauaaaga

SEQ ID NO: 266328 - RNA, 32 nt, Human
uuacacgugaauucuggucuauaguggucaug

SEQ ID NO: 266329 - RNA, 32 nt, Human
uuacacgugccuguagucccagcuacucuaua

SEQ ID NO: 266330 - RNA, 21 nt, Human
uuacacguuuaaaaacuucuu

SEQ ID NO: 266331 - RNA, 26 nt, Human
uuacacuaagccucucucugucuuug

SEQ ID NO: 266332 - RNA, 32 nt, Human
uuacacuauuccucaucacccaacuaaaaaua

SEQ ID NO: 266333 - RNA, 32 nt, Human
uuacacucaggaguucaagaccagucugggca

SEQ ID NO: 266334 - RNA, 32 nt, Human
uuacacucaugaguaaaagcacuccagacauu

SEQ ID NO: 266335 - RNA, 32 nt, Human
uuacacuccagccuggauaacagagcgagacc

SEQ ID NO: 266336 - RNA, 32 nt, Human
uuacacuccagccuggcugacagugcaagacu

SEQ ID NO: 266337 - RNA, 32 nt, Human
uuacacuccagccugggcaacagagcgagacu

SEQ ID NO: 266338 - RNA, 32 nt, Human
uuacacuccagccugggcaacagcguaagacc

SEQ ID NO: 266339 - RNA, 32 nt, Human
uuacacuccagccugggcaacagugacacucu

SEQ ID NO: 266340 - RNA, 32 nt, Human
uuacacuccagccugggugacagagugagacu

SEQ ID NO: 266341 - RNA, 32 nt, Human
uuacacucccaaauugcaggcuuuauuuaaag

SEQ ID NO: 266342 - RNA, 32 nt, Human
uuacacucgggccucagaaguccgugccagug

SEQ ID NO: 266343 - RNA, 32 nt, Human
uuacacucuagaaacccacaggccugggaacu

SEQ ID NO: 266344 - RNA, 32 nt, Human
uuacacugaaacgggaguguucccuggccccu

SEQ ID NO: 266345 - RNA, 32 nt, Human
uuacacugaagcugcaucuauaugucacugac

SEQ ID NO: 266346 - RNA, 32 nt, Human
uuacacugaggugaggcuacaaggggugugua

SEQ ID NO: 266347 - RNA, 32 nt, Human
uuacacuggaggugggggacgggaagggacug

SEQ ID NO: 266348 - RNA, 32 nt, Human
uuacacugggaaaguuuguagaaauuuuaaaa

SEQ ID NO: 266349 - RNA, 32 nt, Human
uuacacugggaaaguuuguggaaauuuuaaaa

SEQ ID NO: 266350 - RNA, 32 nt, Human
uuacacugguaaaauaaacuaguuuuucccau

SEQ ID NO: 266351 - RNA, 32 nt, Human
uuacacuguaccauauagcaaaacuuuuaaac

SEQ ID NO: 266352 - RNA, 32 nt, Human
uuacacugugugaccugcagggcaugagguau

SEQ ID NO: 266353 - RNA, 32 nt, Human
uuacacuuaacuccuucuugcuccacagccua

SEQ ID NO: 266354 - RNA, 32 nt, Human
uuacacuugguugacuacuccggagcagccac

SEQ ID NO: 266355 - RNA, 32 nt, Human
uuacacuuguaacccuagaacuugggaggcug

SEQ ID NO: 266356 - RNA, 32 nt, Human
uuacagaaacuugcccugugccuguguccccc

SEQ ID NO: 266357 - RNA, 32 nt, Human
uuacagaaagaaugggggcuuggggccugagc

SEQ ID NO: 266358 - RNA, 24 nt, Human
uuacagaaagauacccucuccaga

SEQ ID NO: 266359 - RNA, 32 nt, Human
uuacagaacuauucaaagaagcucacagaugg

SEQ ID NO: 266360 - RNA, 32 nt, Human
uuacagaauagcacuucugauaagcuguauua

SEQ ID NO: 266361 - RNA, 32 nt, Human
uuacagacacagaaaaugucagacaacaaaga

SEQ ID NO: 266362 - RNA, 21 nt, Human
uuacagacaugccaccaugcc

SEQ ID NO: 266363 - RNA, 32 nt, Human
uuacagaccagccagccaccauucugcuugcc

SEQ ID NO: 266364 - RNA, 32 nt, Human
uuacagaccuaguuacugggaauucauuacuu

SEQ ID NO: 266365 - RNA, 32 nt, Human
uuacagacugaagggaagcauguccuuacuua

SEQ ID NO: 266366 - RNA, 31 nt, Human
uuacagagaaaccuacaacagaugcuugaug

SEQ ID NO: 266367 - RNA, 32 nt, Human
uuacagagacuggagucaggagagagcaggag

SEQ ID NO: 266368 - RNA, 32 nt, Human
uuacagagccucacaguuacaguuccaagaag

SEQ ID NO: 266369 - RNA, 32 nt, Human
uuacagaggcagaagcaagcucagggagggua

SEQ ID NO: 266370 - RNA, 32 nt, Human
uuacagagucaaaucacuucccaguaaacacc

SEQ ID NO: 266371 - RNA, 32 nt, Human
uuacagagugugagccaccacacccagccagc

SEQ ID NO: 266372 - RNA, 32 nt, Human
uuacagaugagaaaguugaggcuugggaacau

SEQ ID NO: 266373 - RNA, 32 nt, Human
uuacagaugaggaaauggaggugguccagaga

SEQ ID NO: 266374 - RNA, 32 nt, Human
uuacagcaaauugaucuaaaagccacuaauaa

SEQ ID NO: 266375 - RNA, 32 nt, Human
uuacagcaauauugccuucacaguuauaaacu

SEQ ID NO: 266376 - RNA, 32 nt, Human
uuacagcacagaugccauuagaaugugaauug

SEQ ID NO: 266377 - RNA, 32 nt, Human
uuacagcaccagaacccucagcaguugucugc

SEQ ID NO: 266378 - RNA, 32 nt, Human
uuacagcaggaaaauccguggagacagcagau

SEQ ID NO: 266379 - RNA, 32 nt, Human
uuacagcaggugauucagcuacuugaggucgg

SEQ ID NO: 266380 - RNA, 32 nt, Human
uuacagccacacacacagucacacagacgcgu

SEQ ID NO: 266381 - RNA, 32 nt, Human
uuacagccagaccucuggcugcagaggagucu

SEQ ID NO: 266382 - RNA, 32 nt, Human
uuacagccauucuaugaaaaaguguucggaau

SEQ ID NO: 266383 - RNA, 32 nt, Human
uuacagcccauuaggauguguaaagagauggg

SEQ ID NO: 266384 - RNA, 32 nt, Human
uuacagccucugacuuaagcugccucaaggaa

SEQ ID NO: 266385 - RNA, 32 nt, Human
uuacagccugcucuugccuauuaccauaccag

SEQ ID NO: 266386 - RNA, 32 nt, Human
uuacagcgugagccaccgcacccagccgcuug

SEQ ID NO: 266387 - RNA, 32 nt, Human
uuacagcgugagcuaccuggccccuccccaaa

SEQ ID NO: 266388 - RNA, 32 nt, Human
uuacagcuaagcuguaguugcagaguacaugu

SEQ ID NO: 266389 - RNA, 32 nt, Human
uuacagcucugcccugaccccagccccugccc

SEQ ID NO: 266390 - RNA, 32 nt, Human
uuacagcugaaauggaaccaaauguuuguuuu

SEQ ID NO: 266391 - RNA, 32 nt, Human
uuacagcugguucugagccgcuugccuuguga

SEQ ID NO: 266392 - RNA, 32 nt, Human
uuacagcuguugcaacagcagaacuagaauuc

SEQ ID NO: 266393 - RNA, 20 nt, Human
uuacaggaaauggugccuuu

SEQ ID NO: 266394 - RNA, 32 nt, Human
uuacaggaacugagguccagagaggacaugga

SEQ ID NO: 266395 - RNA, 32 nt, Human
uuacaggaagccucucauagaaauugccucca

SEQ ID NO: 266396 - RNA, 32 nt, Human
uuacaggacucugccagcuuuguuaaacuguc

SEQ ID NO: 266397 - RNA, 22 nt, Human
uuacaggagguguccuagccuu

SEQ ID NO: 266398 - RNA, 24 nt, Human
uuacaggagugagccaccaugccc

SEQ ID NO: 266399 - RNA, 32 nt, Human
uuacaggauccccagaaagcuguugaauaagc

SEQ ID NO: 266400 - RNA, 32 nt, Human
uuacaggaugagccacugagcccagcugacuc

SEQ ID NO: 266401 - RNA, 32 nt, Human
uuacaggauugugugaggauugagacugacac

SEQ ID NO: 266402 - RNA, 24 nt, Human
uuacaggcaaacgccaccacaccc

SEQ ID NO: 266403 - RNA, 22 nt, Human
uuacaggcaacugccaccaugc

SEQ ID NO: 266404 - RNA, 24 nt, Human
uuacaggcaacugccaccaugccc

SEQ ID NO: 266405 - RNA, 24 nt, Human
uuacaggcaagagccuccacgccc

SEQ ID NO: 266406 - RNA, 24 nt, Human
uuacaggcaagcaccaccaugccu

SEQ ID NO: 266407 - RNA, 32 nt, Human
uuacaggcaaggacacagcagcugcgagaggu

SEQ ID NO: 266408 - RNA, 32 nt, Human
uuacaggcacaaaaugauggacccaaugcaca

SEQ ID NO: 266409 - RNA, 24 nt, Human
uuacaggcacaaaccaccaugccu

SEQ ID NO: 266410 - RNA, 24 nt, Human
uuacaggcacaagccaccgugccc

SEQ ID NO: 266411 - RNA, 23 nt, Human
uuacaggcacaagcugcugcacc

SEQ ID NO: 266412 - RNA, 24 nt, Human
uuacaggcacacacaaccacgccc

SEQ ID NO: 266413 - RNA, 32 nt, Human
uuacaggcacacacaaccacgcccagcuaauu

SEQ ID NO: 266414 - RNA, 32 nt, Human
uuacaggcacacacagacacagaccagagacu

SEQ ID NO: 266415 - RNA, 32 nt, Human
uuacaggcacacaccaccacaccuggcccagc

SEQ ID NO: 266416 - RNA, 24 nt, Human
uuacaggcacacaccaccacgccc

SEQ ID NO: 266417 - RNA, 32 nt, Human
uuacaggcacacaccaccacgcccagcuaauu

SEQ ID NO: 266418 - RNA, 32 nt, Human
uuacaggcacacaccaccacgcccagcuaguu

SEQ ID NO: 266419 - RNA, 32 nt, Human
uuacaggcacacaccaccacgccuggcuaauu

SEQ ID NO: 266420 - RNA, 24 nt, Human
uuacaggcacacaccaccauaccu

SEQ ID NO: 266421 - RNA, 32 nt, Human
uuacaggcacacaccaccauaccuggcuaauu

SEQ ID NO: 266422 - RNA, 24 nt, Human
uuacaggcacacaccaccaugccc

SEQ ID NO: 266423 - RNA, 24 nt, Human
uuacaggcacacacuaccacgccu

SEQ ID NO: 266424 - RNA, 32 nt, Human
uuacaggcacacacuaccacgccuggcuaauu

SEQ ID NO: 266425 - RNA, 24 nt, Human
uuacaggcacacgacaccaugccu

SEQ ID NO: 266426 - RNA, 24 nt, Human
uuacaggcacacgccaccacaccc

SEQ ID NO: 266427 - RNA, 24 nt, Human
uuacaggcacacgccaccaugccc

SEQ ID NO: 266428 - RNA, 24 nt, Human
uuacaggcacaggccgccacgccc

SEQ ID NO: 266429 - RNA, 24 nt, Human
uuacaggcacaugccaccacaccc

SEQ ID NO: 266430 - RNA, 24 nt, Human
uuacaggcacaugccaccacgccc

SEQ ID NO: 266431 - RNA, 24 nt, Human
uuacaggcacaugccaccaugccc

SEQ ID NO: 266432 - RNA, 24 nt, Human
uuacaggcacaugccaccaugcuc

SEQ ID NO: 266433 - RNA, 24 nt, Human
uuacaggcaccagccaccaugccu

SEQ ID NO: 266434 - RNA, 24 nt, Human
uuacaggcacccaccaccacaccc

SEQ ID NO: 266435 - RNA, 32 nt, Human
uuacaggcacccaccaccacacccagcucauu

SEQ ID NO: 266436 - RNA, 24 nt, Human
uuacaggcacccaccaccacgccu

SEQ ID NO: 266437 - RNA, 24 nt, Human
uuacaggcacccaccaccacgucc

SEQ ID NO: 266438 - RNA, 24 nt, Human
uuacaggcacccaccaccaugccc

SEQ ID NO: 266439 - RNA, 24 nt, Human
uuacaggcacccaccaccaugccu

SEQ ID NO: 266440 - RNA, 24 nt, Human
uuacaggcacccaccacuaugccc

SEQ ID NO: 266441 - RNA, 24 nt, Human
uuacaggcacccacgaccacgcuc

SEQ ID NO: 266442 - RNA, 24 nt, Human
uuacaggcacccacgagcaugccc

SEQ ID NO: 266443 - RNA, 24 nt, Human
uuacaggcacccaucaccacaccc

SEQ ID NO: 266444 - RNA, 32 nt, Human
uuacaggcacccaucaccacacccagcuaauu

SEQ ID NO: 266445 - RNA, 24 nt, Human
uuacaggcaccccccaccaugcuc

SEQ ID NO: 266446 - RNA, 24 nt, Human
uuacaggcacccgccaccacgccc

SEQ ID NO: 266447 - RNA, 24 nt, Human
uuacaggcacccgccaccgugccc

SEQ ID NO: 266448 - RNA, 24 nt, Human
uuacaggcaccuaccaccuugccc

SEQ ID NO: 266449 - RNA, 24 nt, Human
uuacaggcaccugccaccacgccc

SEQ ID NO: 266450 - RNA, 24 nt, Human
uuacaggcaccugccaccacgccu

SEQ ID NO: 266451 - RNA, 24 nt, Human
uuacaggcaccugccaccaugccc

SEQ ID NO: 266452 - RNA, 24 nt, Human
uuacaggcaccugccaccaugccu

SEQ ID NO: 266453 - RNA, 24 nt, Human
uuacaggcaccugccacuaugccc

SEQ ID NO: 266454 - RNA, 24 nt, Human
uuacaggcaccugucaccacaccc

SEQ ID NO: 266455 - RNA, 24 nt, Human
uuacaggcacgcaccaccaugccu

SEQ ID NO: 266456 - RNA, 32 nt, Human
uuacaggcacgcuccaccacacccagcuaauu

SEQ ID NO: 266457 - RNA, 23 nt, Human
uuacaggcacgggccaccagccc

SEQ ID NO: 266458 - RNA, 24 nt, Human
uuacaggcacguaccaccacgccu

SEQ ID NO: 266459 - RNA, 24 nt, Human
uuacaggcacgugccaccacgccc

SEQ ID NO: 266460 - RNA, 24 nt, Human
uuacaggcacuugccaccauuccc

SEQ ID NO: 266461 - RNA, 32 nt, Human
uuacaggcaggcaggggugguuggugucaaca

SEQ ID NO: 266462 - RNA, 24 nt, Human
uuacaggcauaagacaccaugccu

SEQ ID NO: 266463 - RNA, 22 nt, Human
uuacaggcauaagcauugcgcc

SEQ ID NO: 266464 - RNA, 24 nt, Human
uuacaggcauaagccaccgcgccc

SEQ ID NO: 266465 - RNA, 24 nt, Human
uuacaggcauaagccacugagccc

SEQ ID NO: 266466 - RNA, 23 nt, Human
uuacaggcauaagccacugcacc

SEQ ID NO: 266467 - RNA, 24 nt, Human
uuacaggcauacuccaccuugccc

SEQ ID NO: 266468 - RNA, 24 nt, Human
uuacaggcauaugccaccaccccc

SEQ ID NO: 266469 - RNA, 24 nt, Human
uuacaggcaucagccaccacaccc

SEQ ID NO: 266470 - RNA, 24 nt, Human
uuacaggcaucagccaccacaccu

SEQ ID NO: 266471 - RNA, 24 nt, Human
uuacaggcauccgccaccaugccc

SEQ ID NO: 266472 - RNA, 21 nt, Human
uuacaggcaucgcccaugcuc

SEQ ID NO: 266473 - RNA, 25 nt, Human
uuacaggcaucugccaaccaugccu

SEQ ID NO: 266474 - RNA, 24 nt, Human
uuacaggcaucugcuaccacgccu

SEQ ID NO: 266475 - RNA, 24 nt, Human
uuacaggcaugaaccaccgugccc

SEQ ID NO: 266476 - RNA, 24 nt, Human
uuacaggcaugaaucaccaugccu

SEQ ID NO: 266477 - RNA, 24 nt, Human
uuacaggcaugagccaccaaaccc

SEQ ID NO: 266478 - RNA, 24 nt, Human
uuacaggcaugagccaccaagccc

SEQ ID NO: 266479 - RNA, 24 nt, Human
uuacaggcaugagccaccacaccc

SEQ ID NO: 266480 - RNA, 24 nt, Human
uuacaggcaugagccaccacaccu

SEQ ID NO: 266481 - RNA, 24 nt, Human
uuacaggcaugagccaccacaucc

SEQ ID NO: 266482 - RNA, 23 nt, Human
uuacaggcaugagccaccacgcc

SEQ ID NO: 266483 - RNA, 24 nt, Human
uuacaggcaugagccaccacgccc

SEQ ID NO: 266484 - RNA, 24 nt, Human
uuacaggcaugagccaccacgccu

SEQ ID NO: 266485 - RNA, 24 nt, Human
uuacaggcaugagccaccacggcc

SEQ ID NO: 266486 - RNA, 23 nt, Human
uuacaggcaugagccaccaugcc

SEQ ID NO: 266487 - RNA, 24 nt, Human
uuacaggcaugagccaccaugccc

SEQ ID NO: 266488 - RNA, 24 nt, Human
uuacaggcaugagccaccaugccu

SEQ ID NO: 266489 - RNA, 24 nt, Human
uuacaggcaugagccaccgcaccc

SEQ ID NO: 266490 - RNA, 24 nt, Human
uuacaggcaugagccaccgcgccc

SEQ ID NO: 266491 - RNA, 24 nt, Human
uuacaggcaugagccaccgugccc

SEQ ID NO: 266492 - RNA, 24 nt, Human
uuacaggcaugagccaccucaccc

SEQ ID NO: 266493 - RNA, 24 nt, Human
uuacaggcaugagccaccucgccc

SEQ ID NO: 266494 - RNA, 23 nt, Human
uuacaggcaugagccaccugccc

SEQ ID NO: 266495 - RNA, 32 nt, Human
uuacaggcaugagccaccugcccagccauguu

SEQ ID NO: 266496 - RNA, 24 nt, Human
uuacaggcaugagccacuacaccc

SEQ ID NO: 266497 - RNA, 22 nt, Human
uuacaggcaugagccaucgccc

SEQ ID NO: 266498 - RNA, 24 nt, Human
uuacaggcaugagcuaccacgccu

SEQ ID NO: 266499 - RNA, 24 nt, Human
uuacaggcaugagcuacuaugccc

SEQ ID NO: 266500 - RNA, 24 nt, Human
uuacaggcaugagucaccauaucc

SEQ ID NO: 266501 - RNA, 24 nt, Human
uuacaggcaugagucacuacgccc

SEQ ID NO: 266502 - RNA, 24 nt, Human
uuacaggcaugcacaaccacaccc

SEQ ID NO: 266503 - RNA, 32 nt, Human
uuacaggcaugcaccaccacacacagcuaagu

SEQ ID NO: 266504 - RNA, 23 nt, Human
uuacaggcaugcaccaccacacc

SEQ ID NO: 266505 - RNA, 32 nt, Human
uuacaggcaugcaccaccacaccaggcuaauu

SEQ ID NO: 266506 - RNA, 24 nt, Human
uuacaggcaugcaccaccacaccc

SEQ ID NO: 266507 - RNA, 24 nt, Human
uuacaggcaugcaccaccacaccu

SEQ ID NO: 266508 - RNA, 24 nt, Human
uuacaggcaugcaccaccacacuc

SEQ ID NO: 266509 - RNA, 24 nt, Human
uuacaggcaugcaccaccacagcc

SEQ ID NO: 266510 - RNA, 24 nt, Human
uuacaggcaugcaccaccacgccc

SEQ ID NO: 266511 - RNA, 24 nt, Human
uuacaggcaugcaccaccacgccu

SEQ ID NO: 266512 - RNA, 24 nt, Human
uuacaggcaugcaccaccacgcuc

SEQ ID NO: 266513 - RNA, 24 nt, Human
uuacaggcaugcaccaccaugccc

SEQ ID NO: 266514 - RNA, 24 nt, Human
uuacaggcaugcaccaccaugccu

SEQ ID NO: 266515 - RNA, 24 nt, Human
uuacaggcaugcacuaccacaccc

SEQ ID NO: 266516 - RNA, 31 nt, Human
uuacaggcaugcauccccaugcccagcuaau

SEQ ID NO: 266517 - RNA, 24 nt, Human
uuacaggcaugcgccaccacaccc

SEQ ID NO: 266518 - RNA, 24 nt, Human
uuacaggcaugcgccaccacgccu

SEQ ID NO: 266519 - RNA, 24 nt, Human
uuacaggcaugcgccaccacgcuc

SEQ ID NO: 266520 - RNA, 24 nt, Human
uuacaggcaugcgccaccauaccc

SEQ ID NO: 266521 - RNA, 24 nt, Human
uuacaggcaugcgccaccaugacc

SEQ ID NO: 266522 - RNA, 24 nt, Human
uuacaggcaugcgccaccaugccc

SEQ ID NO: 266523 - RNA, 24 nt, Human
uuacaggcaugcgccaccaugccu

SEQ ID NO: 266524 - RNA, 24 nt, Human
uuacaggcaugcgccacuaugccc

SEQ ID NO: 266525 - RNA, 24 nt, Human
uuacaggcaugcgccagcacgccc

SEQ ID NO: 266526 - RNA, 24 nt, Human
uuacaggcaugcgcuaacacaccc

SEQ ID NO: 266527 - RNA, 23 nt, Human
uuacaggcaugcgucaccacgcc

SEQ ID NO: 266528 - RNA, 24 nt, Human
uuacaggcaugcuccaccaugccc

SEQ ID NO: 266529 - RNA, 32 nt, Human
uuacaggcauggccaccacgcccagccaucaa

SEQ ID NO: 266530 - RNA, 24 nt, Human
uuacaggcaugggccaccacgccc

SEQ ID NO: 266531 - RNA, 24 nt, Human
uuacaggcaugggccaccacgccu

SEQ ID NO: 266532 - RNA, 24 nt, Human
uuacaggcauguaccaccacaccc

SEQ ID NO: 266533 - RNA, 24 nt, Human
uuacaggcauguacuaccaugccu

SEQ ID NO: 266534 - RNA, 24 nt, Human
uuacaggcaugugccaccacaccc

SEQ ID NO: 266535 - RNA, 24 nt, Human
uuacaggcaugugccaccacaccu

SEQ ID NO: 266536 - RNA, 24 nt, Human
uuacaggcaugugccaccacacuc

SEQ ID NO: 266537 - RNA, 23 nt, Human
uuacaggcaugugccaccacgcc

SEQ ID NO: 266538 - RNA, 24 nt, Human
uuacaggcaugugccaccacgccc

SEQ ID NO: 266539 - RNA, 24 nt, Human
uuacaggcaugugccaccaugccu

SEQ ID NO: 266540 - RNA, 23 nt, Human
uuacaggcaugugccacccaccc

SEQ ID NO: 266541 - RNA, 24 nt, Human
uuacaggcaugugccaccgcgccc

SEQ ID NO: 266542 - RNA, 22 nt, Human
uuacaggcaugugccacuaccc

SEQ ID NO: 266543 - RNA, 24 nt, Human
uuacaggcaugugccagcaugccc

SEQ ID NO: 266544 - RNA, 24 nt, Human
uuacaggcaugugucaccacaccc

SEQ ID NO: 266545 - RNA, 24 nt, Human
uuacaggcaugugucaccacgccc

SEQ ID NO: 266546 - RNA, 24 nt, Human
uuacaggcaugugucaccaugccc

SEQ ID NO: 266547 - RNA, 32 nt, Human
uuacaggccacagcaaacacaggugugcagga

SEQ ID NO: 266548 - RNA, 22 nt, Human
uuacaggccuauuaacaucaua

SEQ ID NO: 266549 - RNA, 24 nt, Human
uuacaggccucagccaccaugccc

SEQ ID NO: 266550 - RNA, 24 nt, Human
uuacaggccugagccaccaugccc

SEQ ID NO: 266551 - RNA, 32 nt, Human
uuacaggcgcacaccaccacacacagcuaauu

SEQ ID NO: 266552 - RNA, 24 nt, Human
uuacaggcgcacaccaccacgccc

SEQ ID NO: 266553 - RNA, 31 nt, Human
uuacaggcgcaugccaccaugccaggcuaau

SEQ ID NO: 266554 - RNA, 32 nt, Human
uuacaggcgcccaccuccacacccagcuaauu

SEQ ID NO: 266555 - RNA, 24 nt, Human
uuacaggcgcccgccaccacaccc

SEQ ID NO: 266556 - RNA, 24 nt, Human
uuacaggcgcccgccaccacgccc

SEQ ID NO: 266557 - RNA, 24 nt, Human
uuacaggcgcccgccaccaugccc

SEQ ID NO: 266558 - RNA, 32 nt, Human
uuacaggcgcccgccaucacacccggcuaauu

SEQ ID NO: 266559 - RNA, 22 nt, Human
uuacaggcgccucaccaugccu

SEQ ID NO: 266560 - RNA, 24 nt, Human
uuacaggcgccugccaccacaccc

SEQ ID NO: 266561 - RNA, 24 nt, Human
uuacaggcgccugccaccacgccc

SEQ ID NO: 266562 - RNA, 24 nt, Human
uuacaggcgcgagccaccacaccc

SEQ ID NO: 266563 - RNA, 24 nt, Human
uuacaggcgcguaucaccauaccc

SEQ ID NO: 266564 - RNA, 24 nt, Human
uuacaggcgcgugccaccacaccc

SEQ ID NO: 266565 - RNA, 24 nt, Human
uuacaggcgcgugccaccacgccc

SEQ ID NO: 266566 - RNA, 24 nt, Human
uuacaggcguaagccaccacaccc

SEQ ID NO: 266567 - RNA, 24 nt, Human
uuacaggcgucagccaccaugccc

SEQ ID NO: 266568 - RNA, 24 nt, Human
uuacaggcgugaagcaccacgccc

SEQ ID NO: 266569 - RNA, 24 nt, Human
uuacaggcgugagacaccgcgccc

SEQ ID NO: 266570 - RNA, 24 nt, Human
uuacaggcgugagacaccgugccc

SEQ ID NO: 266571 - RNA, 32 nt, Human
uuacaggcgugagacacugcgcccagccucau

SEQ ID NO: 266572 - RNA, 24 nt, Human
uuacaggcgugagccaccacaccc

SEQ ID NO: 266573 - RNA, 24 nt, Human
uuacaggcgugagccaccacgccc

SEQ ID NO: 266574 - RNA, 24 nt, Human
uuacaggcgugagccaccauaccc

SEQ ID NO: 266575 - RNA, 24 nt, Human
uuacaggcgugagccaccaugccc

SEQ ID NO: 266576 - RNA, 32 nt, Human
uuacaggcgugagccacuuacccggccucugc

SEQ ID NO: 266577 - RNA, 32 nt, Human
uuacaggcgugagcuaccaccaugccuggcuu

SEQ ID NO: 266578 - RNA, 31 nt, Human
uuacaggcgugagcugccaugccaggcagau

SEQ ID NO: 266579 - RNA, 24 nt, Human
uuacaggcgugcaccaccacgccc

SEQ ID NO: 266580 - RNA, 24 nt, Human
uuacaggcgugcacuaccacaccc

SEQ ID NO: 266581 - RNA, 24 nt, Human
uuacaggcgugcgccaccacgccc

SEQ ID NO: 266582 - RNA, 32 nt, Human
uuacaggcguggccaccauccccgcccccuca

SEQ ID NO: 266583 - RNA, 24 nt, Human
uuacaggcgugugccaccaugccc

SEQ ID NO: 266584 - RNA, 24 nt, Human
uuacaggcuccugccaccacgccc

SEQ ID NO: 266585 - RNA, 32 nt, Human
uuacaggcugagccaccgcgaccggcccugcu

SEQ ID NO: 266586 - RNA, 32 nt, Human
uuacaggcuggaacagaugagagcccuccugc

SEQ ID NO: 266587 - RNA, 24 nt, Human
uuacaggcuuaagccaccacgccc

SEQ ID NO: 266588 - RNA, 32 nt, Human
uuacagggagcuauugaucuacuagcaucaaa

SEQ ID NO: 266589 - RNA, 32 nt, Human
uuacagggaugguucucccccgugcagggccg

SEQ ID NO: 266590 - RNA, 32 nt, Human
uuacagggcacaggugacagggccggagaaag

SEQ ID NO: 266591 - RNA, 32 nt, Human
uuacagggcuaggauuucaguguugucagagu

SEQ ID NO: 266592 - RNA, 32 nt, Human
uuacagggggaugcauauaacagaucauguau

SEQ ID NO: 266593 - RNA, 32 nt, Human
uuacaggggugagucaccacaccccaccccuu

SEQ ID NO: 266594 - RNA, 32 nt, Human
uuacagggugugagccacugcaccuggccgau

SEQ ID NO: 266595 - RNA, 24 nt, Human
uuacagguacgcaccaccacgccc

SEQ ID NO: 266596 - RNA, 32 nt, Human
uuacagguacgcaccaccaugcccagcuugug

SEQ ID NO: 266597 - RNA, 24 nt, Human
uuacagguaugagccaccacaccc

SEQ ID NO: 266598 - RNA, 24 nt, Human
uuacagguaugagccaccacgccc

SEQ ID NO: 266599 - RNA, 24 nt, Human
uuacagguaugcaccaccacgccc

SEQ ID NO: 266600 - RNA, 32 nt, Human
uuacagguaugcaccaccacgcccagcuaauu

SEQ ID NO: 266601 - RNA, 32 nt, Human
uuacaggucaugcaaauuuaagaaaaggcuaa

SEQ ID NO: 266602 - RNA, 32 nt, Human
uuacagguccugggguccaggagacccagaau

SEQ ID NO: 266603 - RNA, 24 nt, Human
uuacaggugaccgccaccacgccc

SEQ ID NO: 266604 - RNA, 24 nt, Human
uuacaggugagcacuaccacgccc

SEQ ID NO: 266605 - RNA, 24 nt, Human
uuacaggugcaggccaccaugccc

SEQ ID NO: 266606 - RNA, 32 nt, Human
uuacaggugcccaccaccacaccaggcuaauu

SEQ ID NO: 266607 - RNA, 24 nt, Human
uuacaggugcccaccaccacgccc

SEQ ID NO: 266608 - RNA, 24 nt, Human
uuacaggugcccaccaccaugccc

SEQ ID NO: 266609 - RNA, 32 nt, Human
uuacaggugcccgccaccacaccagccuaauu

SEQ ID NO: 266610 - RNA, 24 nt, Human
uuacaggugcccgccaccacgccc

SEQ ID NO: 266611 - RNA, 32 nt, Human
uuacaggugccugccaccacacccagcuaacg

SEQ ID NO: 266612 - RNA, 32 nt, Human
uuacaggugccugccaccacacccagcuaaug

SEQ ID NO: 266613 - RNA, 24 nt, Human
uuacaggugccugccaccacgccc

SEQ ID NO: 266614 - RNA, 24 nt, Human
uuacaggugccugccaccaugccc

SEQ ID NO: 266615 - RNA, 32 nt, Human
uuacaggugcgugccaccacaccaggcugguu

SEQ ID NO: 266616 - RNA, 24 nt, Human
uuacaggugcgugccaccacgccc

SEQ ID NO: 266617 - RNA, 24 nt, Human
uuacagguguaagccaccaugccc

SEQ ID NO: 266618 - RNA, 24 nt, Human
uuacaggugugaaccaccacaccc

SEQ ID NO: 266619 - RNA, 24 nt, Human
uuacaggugugaaccaccaugccc

SEQ ID NO: 266620 - RNA, 32 nt, Human
uuacaggugugaaccaccaugcccagccagag

SEQ ID NO: 266621 - RNA, 24 nt, Human
uuacaggugugagccaccacaccc

SEQ ID NO: 266622 - RNA, 24 nt, Human
uuacaggugugagccaccacgccc

SEQ ID NO: 266623 - RNA, 24 nt, Human
uuacaggugugagccaccaugccc

SEQ ID NO: 266624 - RNA, 24 nt, Human
uuacaggugugcaccaccacaccc

SEQ ID NO: 266625 - RNA, 24 nt, Human
uuacaggugugcaccaccacgccc

SEQ ID NO: 266626 - RNA, 24 nt, Human
uuacaggugugcgccaccacgccc

SEQ ID NO: 266627 - RNA, 24 nt, Human
uuacaggugugcgccaccaugccc

SEQ ID NO: 266628 - RNA, 24 nt, Human
uuacaggugugggccaccaugccc

SEQ ID NO: 266629 - RNA, 24 nt, Human
uuacaggugugugccaccacaccc

SEQ ID NO: 266630 - RNA, 32 nt, Human
uuacaggugugugccaucaugccugacuaauu

SEQ ID NO: 266631 - RNA, 24 nt, Human
uuacagguguguggcaccaugccc

SEQ ID NO: 266632 - RNA, 32 nt, Human
uuacagguucugacaggaacagcauggauucc

SEQ ID NO: 266633 - RNA, 32 nt, Human
uuacagguugguuugcaguguuaacauuuuug

SEQ ID NO: 266634 - RNA, 20 nt, Human
uuacagguuuucuugcagcu

SEQ ID NO: 266635 - RNA, 32 nt, Human
uuacaguaacccucauauuuuaaugguguuac

SEQ ID NO: 266636 - RNA, 32 nt, Human
uuacaguacaguucgagaggaauggaaauugu

SEQ ID NO: 266637 - RNA, 32 nt, Human
uuacaguagagaggaagggaacuccacugugu

SEQ ID NO: 266638 - RNA, 32 nt, Human
uuacaguaugccaguuccacugaagacaugaa

SEQ ID NO: 266639 - RNA, 32 nt, Human
uuacagucaccugaacaaugacccaucaucuc

SEQ ID NO: 266640 - RNA, 24 nt, Human
uuacagucaugagccaccaugccc

SEQ ID NO: 266641 - RNA, 32 nt, Human
uuacagucauuuacacauauuuuugcaugcca

SEQ ID NO: 266642 - RNA, 30 nt, Human
uuacagucugcuccguggcuccuguggccu

SEQ ID NO: 266643 - RNA, 32 nt, Human
uuacagucuguaacuuuccacucuuccuguag

SEQ ID NO: 266644 - RNA, 32 nt, Human
uuacagugaaauggagaauuucaggucuccac

SEQ ID NO: 266645 - RNA, 32 nt, Human
uuacagugaccuggcuggaguuaccuggugca

SEQ ID NO: 266646 - RNA, 32 nt, Human
uuacagugagcuaugauugcaccacugcacuc

SEQ ID NO: 266647 - RNA, 32 nt, Human
uuacagugccacugcaauccagccugggcaac

SEQ ID NO: 266648 - RNA, 32 nt, Human
uuacagugccagugugccuggccaucagcauc

SEQ ID NO: 266649 - RNA, 23 nt, Human
uuacagugccugccaccaugccc

SEQ ID NO: 266650 - RNA, 32 nt, Human
uuacagugccugccaccaugcccagcuaauuu

SEQ ID NO: 266651 - RNA, 32 nt, Human
uuacagugccuguaucuuuuauuuuccugucu

SEQ ID NO: 266652 - RNA, 32 nt, Human
uuacagugcugggagagaggggagaugugggc

SEQ ID NO: 266653 - RNA, 32 nt, Human
uuacaguggauugcucaucucaguccucaaag

SEQ ID NO: 266654 - RNA, 32 nt, Human
uuacagugugccagguccuuuggaggcccuac

SEQ ID NO: 266655 - RNA, 32 nt, Human
uuacaguucacauuuacuaagagcucaaauga

SEQ ID NO: 266656 - RNA, 32 nt, Human
uuacaguucccauagcuguuagagucugguuu

SEQ ID NO: 266657 - RNA, 32 nt, Human
uuacaguuggcccucugugguuaguuccacau

SEQ ID NO: 266658 - RNA, 24 nt, Human
uuacaguugugagccaccaugccc

SEQ ID NO: 266659 - RNA, 32 nt, Human
uuacaguuucaaaucaaaccuugaaauacauc

SEQ ID NO: 266660 - RNA, 32 nt, Human
uuacauaaaaguuggcucaggagucuuagagc

SEQ ID NO: 266661 - RNA, 28 nt, Human
uuacauaaaggaauuuuggugaaacugc

SEQ ID NO: 266662 - RNA, 32 nt, Human
uuacauaaggcaguuacuuaaugugauuuuua

SEQ ID NO: 266663 - RNA, 32 nt, Human
uuacauaaugccguuuauuugagaaacacaua

SEQ ID NO: 266664 - RNA, 32 nt, Human
uuacauaauuugcaauuucaggaauuuaauuu

SEQ ID NO: 266665 - RNA, 23 nt, Human
uuacauacaaacaaauucaugca

SEQ ID NO: 266666 - RNA, 22 nt, Human
uuacauacaggagucccaucca

SEQ ID NO: 266667 - RNA, 32 nt, Human
uuacauacaucuuagugaauucuaucacaugg

SEQ ID NO: 266668 - RNA, 32 nt, Human
uuacauaccaugggauguucccaguguuggug

SEQ ID NO: 266669 - RNA, 32 nt, Human
uuacauacccugggcauguccagaugaacgaa

SEQ ID NO: 266670 - RNA, 32 nt, Human
uuacauaccugcccaauggccaaaggaaccgc

SEQ ID NO: 266671 - RNA, 32 nt, Human
uuacauaccugccuccugcauuggacuaugug

SEQ ID NO: 266672 - RNA, 32 nt, Human
uuacauacuuaagagauaaacauaucaguguu

SEQ ID NO: 266673 - RNA, 32 nt, Human
uuacauagcauuguaaaauacacuucuaggaa

SEQ ID NO: 266674 - RNA, 32 nt, Human
uuacauaggagaugcacuuagccucuaagccu

SEQ ID NO: 266675 - RNA, 32 nt, Human
uuacauagguaaacacaugucaugggguuuug

SEQ ID NO: 266676 - RNA, 32 nt, Human
uuacauagguaaacugcaugucauggggguuu

SEQ ID NO: 266677 - RNA, 32 nt, Human
uuacauauaaucaucuguaucuuaucaugauu

SEQ ID NO: 266678 - RNA, 32 nt, Human
uuacauauacaccauggaauacuacucaguua

SEQ ID NO: 266679 - RNA, 32 nt, Human
uuacauaucuggguuucuauuuuguagauaug

SEQ ID NO: 266680 - RNA, 32 nt, Human
uuacauauguacaaauuguuuuaagcuuuggc

SEQ ID NO: 266681 - RNA, 32 nt, Human
uuacauauucucucugugcauguggggcuguc

SEQ ID NO: 266682 - RNA, 32 nt, Human
uuacaucaaacagugacuuccaguuauucccc

SEQ ID NO: 266683 - RNA, 32 nt, Human
uuacaucacagaaacuguagaaucucuaugcu

SEQ ID NO: 266684 - RNA, 31 nt, Human
uuacaucacagcuuaauguccuggcauuuaa

SEQ ID NO: 266685 - RNA, 32 nt, Human
uuacaucagcaacugucuugagaauucaggga

SEQ ID NO: 266686 - RNA, 32 nt, Human
uuacauccacgucuucugaauguggauuccag

SEQ ID NO: 266687 - RNA, 32 nt, Human
uuacauccagaacgguugggaaaguuagucuu

SEQ ID NO: 266688 - RNA, 32 nt, Human
uuacauccagauauggccaucugugaaacaga

SEQ ID NO: 266689 - RNA, 32 nt, Human
uuacauccugcacuuucucaggaagccguucg

SEQ ID NO: 266690 - RNA, 32 nt, Human
uuacaucugccgcggccacacgcgguggcaug

SEQ ID NO: 266691 - RNA, 32 nt, Human
uuacaucuguaaucccagcacuuugggaggcu

SEQ ID NO: 266692 - RNA, 32 nt, Human
uuacaucugucuggguuuaagugucucaucuu

SEQ ID NO: 266693 - RNA, 32 nt, Human
uuacaucugucuuaacuacuccuucccaggua

SEQ ID NO: 266694 - RNA, 32 nt, Human
uuacaucuuacuccuuaaaaccgccucucgcu

SEQ ID NO: 266695 - RNA, 32 nt, Human
uuacaucuugugaaaauauaugauuuuuaugu

SEQ ID NO: 266696 - RNA, 32 nt, Human
uuacaugaaaguugugcugauaaucucuucuc

SEQ ID NO: 266697 - RNA, 32 nt, Human
uuacaugaacuguaugguauccaucuaucucu

SEQ ID NO: 266698 - RNA, 32 nt, Human
uuacaugaaguacaaaccucucugcuagcucu

SEQ ID NO: 266699 - RNA, 32 nt, Human
uuacaugacuguuucuuuuguaaagagaauca

SEQ ID NO: 266700 - RNA, 31 nt, Human
uuacaugagauucucauuuguaggaggaugu

SEQ ID NO: 266701 - RNA, 32 nt, Human
uuacaugaguuagauguggaggucagagugga

SEQ ID NO: 266702 - RNA, 32 nt, Human
uuacaugcaaaaagauaguagacaauacacag

SEQ ID NO: 266703 - RNA, 32 nt, Human
uuacaugcaugagccacgcgcccagccuagac

SEQ ID NO: 266704 - RNA, 32 nt, Human
uuacaugccaagggcccuaaaaagcaaauuuu

SEQ ID NO: 266705 - RNA, 32 nt, Human
uuacaugccauagguguucuggucuggaugau

SEQ ID NO: 266706 - RNA, 32 nt, Human
uuacaugccucaugucaaaugcagcaucaguc

SEQ ID NO: 266707 - RNA, 32 nt, Human
uuacauggcccaugagagugcuguaaucaagc

SEQ ID NO: 266708 - RNA, 32 nt, Human
uuacauggucuguaaauauuuguauuuaaaaa

SEQ ID NO: 266709 - RNA, 32 nt, Human
uuacaugguuaagguaaaguaagucuccaguu

SEQ ID NO: 266710 - RNA, 32 nt, Human
uuacauguacccuuucuugggaagcuaucgga

SEQ ID NO: 266711 - RNA, 32 nt, Human
uuacauguauauguucaguugugaaggcauga

SEQ ID NO: 266712 - RNA, 32 nt, Human
uuacaugugguguagcaaguguucuugcccaa

SEQ ID NO: 266713 - RNA, 32 nt, Human
uuacauguguaauuacccaucugugaucauuc

SEQ ID NO: 266714 - RNA, 32 nt, Human
uuacauguguuuuugggaacaaggaaaauuuc

SEQ ID NO: 266715 - RNA, 32 nt, Human
uuacauguucuuccaucuccccagccaccuga

SEQ ID NO: 266716 - RNA, 32 nt, Human
uuacauguuugcaugagugucagggcuuuguc

SEQ ID NO: 266717 - RNA, 32 nt, Human
uuacauguuugucuccccuucuagacugugaa

SEQ ID NO: 266718 - RNA, 32 nt, Human
uuacauuagaaguuuucucucuuuucuccacc

SEQ ID NO: 266719 - RNA, 32 nt, Human
uuacauuauagauaaguaguacaugguggaua

SEQ ID NO: 266720 - RNA, 32 nt, Human
uuacauuaugucagaaugcaagcccugccuca

SEQ ID NO: 266721 - RNA, 32 nt, Human
uuacauucucauaacgugauugauaacuuagg

SEQ ID NO: 266722 - RNA, 32 nt, Human
uuacauucucucucaucacuggagcucaguug

SEQ ID NO: 266723 - RNA, 19 nt, Human
uuacauucugcacuucaua

SEQ ID NO: 266724 - RNA, 32 nt, Human
uuacauucuucccugagguuguggcugacaga

SEQ ID NO: 266725 - RNA, 32 nt, Human
uuacauucuucucuuuucuaugaaaggcaggg

SEQ ID NO: 266726 - RNA, 32 nt, Human
uuacauucuuggaaagucuauaugaaaaacaa

SEQ ID NO: 266727 - RNA, 32 nt, Human
uuacauucuuuccaaagaagcuuccuggacac

SEQ ID NO: 266728 - RNA, 32 nt, Human
uuacauuggaaugggugcggggaggccucuuu

SEQ ID NO: 266729 - RNA, 32 nt, Human
uuacauuuaguucccuccuaggacuacuuuaa

SEQ ID NO: 266730 - RNA, 32 nt, Human
uuacauuuauuuuugcacugagaguuuacugu

SEQ ID NO: 266731 - RNA, 32 nt, Human
uuacauuucauucauuuauauuagaguaaaug

SEQ ID NO: 266732 - RNA, 32 nt, Human
uuacauuuggaggacagggacaaggacugagc

SEQ ID NO: 266733 - RNA, 32 nt, Human
uuacauuuuccugcaacucugccuucuugagu

SEQ ID NO: 266734 - RNA, 32 nt, Human
uuacauuuugugguuauacaugauacaucuuu

SEQ ID NO: 266735 - RNA, 32 nt, Human
uuaccaaaaauacaaaaauuagccagguguag

SEQ ID NO: 266736 - RNA, 32 nt, Human
uuaccaaaacucuauuuuuaaaagcuuucaga

SEQ ID NO: 266737 - RNA, 32 nt, Human
uuaccaaacucaugauuuuguagucacaccac

SEQ ID NO: 266738 - RNA, 32 nt, Human
uuaccaaagaaaaauacauacauugcuugguc

SEQ ID NO: 266739 - RNA, 32 nt, Human
uuaccaaagagcucagggaugcagugaaaagc

SEQ ID NO: 266740 - RNA, 26 nt, Human
uuaccaaagaggaaaaaucaaaagag

SEQ ID NO: 266741 - RNA, 32 nt, Human
uuaccaaagcagccgggucagugccuucucac

SEQ ID NO: 266742 - RNA, 32 nt, Human
uuaccaaaguuugcagccuauaccucaauaaa

SEQ ID NO: 266743 - RNA, 32 nt, Human
uuaccaaauagaagacaaugagaagucauacc

SEQ ID NO: 266744 - RNA, 32 nt, Human
uuaccaacauggagaaaccccaucucuacuaa

SEQ ID NO: 266745 - RNA, 32 nt, Human
uuaccaacucgaacacacaucauuucaucuuc

SEQ ID NO: 266746 - RNA, 32 nt, Human
uuaccaaggaaacugccaaggccaggugcagu

SEQ ID NO: 266747 - RNA, 32 nt, Human
uuaccaaggaugaaagaggagccaggccuugg

SEQ ID NO: 266748 - RNA, 32 nt, Human
uuaccaaucagaaaaucgacuccaccuaugag

SEQ ID NO: 266749 - RNA, 32 nt, Human
uuaccaauguauggcuuagaaguuaauaaaaa

SEQ ID NO: 266750 - RNA, 23 nt, Human
uuaccaaugugucaggcaaucug

SEQ ID NO: 266751 - RNA, 32 nt, Human
uuaccaauucugcgucacuaggaagcuauagc

SEQ ID NO: 266752 - RNA, 32 nt, Human
uuaccacacaauauuucaugauucaaauucuu

SEQ ID NO: 266753 - RNA, 32 nt, Human
uuaccacaggaccugggcuucgucuccagggg

SEQ ID NO: 266754 - RNA, 32 nt, Human
uuaccacaucauuguugguaucuuaagaucaa

SEQ ID NO: 266755 - RNA, 17 nt, Human
uuaccacauucuguuca

SEQ ID NO: 266756 - RNA, 32 nt, Human
uuaccaccaagaaguguugaaacaccaaauag

SEQ ID NO: 266757 - RNA, 32 nt, Human
uuaccaccuaguugauaguuaaucucaugcag

SEQ ID NO: 266758 - RNA, 32 nt, Human
uuaccaccucuuccucccccucaaaggaaaaa

SEQ ID NO: 266759 - RNA, 32 nt, Human
uuaccaccugaccucuugcugccagcuaauaa

SEQ ID NO: 266760 - RNA, 32 nt, Human
uuaccacggggccucgcccacccugggcgccc

SEQ ID NO: 266761 - RNA, 32 nt, Human
uuaccacugcacuccagcuugggcgacggagu

SEQ ID NO: 266762 - RNA, 32 nt, Human
uuaccacuguaaauucaagaagcuuuugaaau

SEQ ID NO: 266763 - RNA, 32 nt, Human
uuaccacuguugcucauuuuguaaguauaugu

SEQ ID NO: 266764 - RNA, 32 nt, Human
uuaccacuuuccccaaacaacauaaaagacaa

SEQ ID NO: 266765 - RNA, 32 nt, Human
uuaccagaaagccaaauuuuauaaugcgggug

SEQ ID NO: 266766 - RNA, 32 nt, Human
uuaccagaaguuuaaaucuuuguuaaaauaua

SEQ ID NO: 266767 - RNA, 32 nt, Human
uuaccagaccucacagaguauuggacgucuac

SEQ ID NO: 266768 - RNA, 32 nt, Human
uuaccagacuaaaucaaccacuccagcagagc

SEQ ID NO: 266769 - RNA, 32 nt, Human
uuaccagagccacagcccugcugccucaggac

SEQ ID NO: 266770 - RNA, 32 nt, Human
uuaccagagcccaguaagaacugcugucauga

SEQ ID NO: 266771 - RNA, 32 nt, Human
uuaccagaguauaucucagaacauuuucauga

SEQ ID NO: 266772 - RNA, 32 nt, Human
uuaccagaguguucauacuggagagaaacccu

SEQ ID NO: 266773 - RNA, 32 nt, Human
uuaccagauaaugcuacuuuauuuauacacug

SEQ ID NO: 266774 - RNA, 32 nt, Human
uuaccagaucccucacgacuggucccagcuuc

SEQ ID NO: 266775 - RNA, 32 nt, Human
uuaccagaucuuucuucacgcugugcuacaug

SEQ ID NO: 266776 - RNA, 32 nt, Human
uuaccagaugaaugcugagaaauaaguaauca

SEQ ID NO: 266777 - RNA, 32 nt, Human
uuaccagcacgcugucucagaaaacgaaaacg

SEQ ID NO: 266778 - RNA, 32 nt, Human
uuaccagccgagaaggaauuccuagcuagcuu

SEQ ID NO: 266779 - RNA, 32 nt, Human
uuaccaggaagagacgcuaaguuuuaucagag

SEQ ID NO: 266780 - RNA, 32 nt, Human
uuaccaggaagcagaggagagcuacuuguuua

SEQ ID NO: 266781 - RNA, 32 nt, Human
uuaccaggaggaagagaaagaggacaaaauca

SEQ ID NO: 266782 - RNA, 32 nt, Human
uuaccaggcacuguguguagccccaggguuug

SEQ ID NO: 266783 - RNA, 32 nt, Human
uuaccaggcccagcuguaaaauaaaggcucag

SEQ ID NO: 266784 - RNA, 32 nt, Human
uuaccaggcccaggcugggguggugugaaccc

SEQ ID NO: 266785 - RNA, 32 nt, Human
uuaccagggcccuccgugguccugaauggucu

SEQ ID NO: 266786 - RNA, 31 nt, Human
uuaccaggggagugggaaaaagaguugagca

SEQ ID NO: 266787 - RNA, 32 nt, Human
uuaccaggggagugggaaaaagaguugagcag

SEQ ID NO: 266788 - RNA, 32 nt, Human
uuaccaggugcugaagauaaggaaacccggga

SEQ ID NO: 266789 - RNA, 32 nt, Human
uuaccaguaaacauguaacuagaaagccaggc

SEQ ID NO: 266790 - RNA, 32 nt, Human
uuaccagugaaauagcaaagcuguucuccagg

SEQ ID NO: 266791 - RNA, 32 nt, Human
uuaccagugaccccagagacagagccaggaca

SEQ ID NO: 266792 - RNA, 32 nt, Human
uuaccagugaggaaaccgacacugugagcucu

SEQ ID NO: 266793 - RNA, 32 nt, Human
uuaccagugccacccaugucccuagcucccgg

SEQ ID NO: 266794 - RNA, 32 nt, Human
uuaccaguggacuacaggauuacuugagaguu

SEQ ID NO: 266795 - RNA, 32 nt, Human
uuaccauagcaaccagcaacuccaggguacca

SEQ ID NO: 266796 - RNA, 32 nt, Human
uuaccaucauugaagaugucacucagguggcc

SEQ ID NO: 266797 - RNA, 32 nt, Human
uuaccauccuccuuccuccccuucccauuagc

SEQ ID NO: 266798 - RNA, 32 nt, Human
uuaccaucucagaagucaagcugauggaguau

SEQ ID NO: 266799 - RNA, 32 nt, Human
uuaccaucugaagucccuuccauuguuuucua

SEQ ID NO: 266800 - RNA, 32 nt, Human
uuaccaugaauuuacuuccucccaagaguuug

SEQ ID NO: 266801 - RNA, 32 nt, Human
uuaccaugacaacaugguaauguccauagaca

SEQ ID NO: 266802 - RNA, 17 nt, Human
uuaccaugcauaacaga

SEQ ID NO: 266803 - RNA, 30 nt, Human
uuaccauggaggaucacauguucgguguuc

SEQ ID NO: 266804 - RNA, 32 nt, Human
uuaccauggcaacccuugcauuccacccugag

SEQ ID NO: 266805 - RNA, 32 nt, Human
uuaccauggcuguguguguccaugucugcaag

SEQ ID NO: 266806 - RNA, 32 nt, Human
uuaccauguuggccaggcaggucuccaacucc

SEQ ID NO: 266807 - RNA, 32 nt, Human
uuaccauguuugccaggauggucuugaucucu

SEQ ID NO: 266808 - RNA, 32 nt, Human
uuaccauucauguaacaaaacccagcacauua

SEQ ID NO: 266809 - RNA, 32 nt, Human
uuaccauuuuccuggcaugucagucugaugau

SEQ ID NO: 266810 - RNA, 32 nt, Human
uuaccauuuucuucuuucucaggauuuggugc

SEQ ID NO: 266811 - RNA, 32 nt, Human
uuaccauuuugcuuucccagccuccaaacaua

SEQ ID NO: 266812 - RNA, 32 nt, Human
uuaccauuuugugaaagguuuuugaaaaucga

SEQ ID NO: 266813 - RNA, 32 nt, Human
uuacccaaaggcugcaccugccguguugucug

SEQ ID NO: 266814 - RNA, 32 nt, Human
uuacccaagaguucaaggcugcagugaacuau

SEQ ID NO: 266815 - RNA, 22 nt, Human
uuacccaagcuggagugcagug

SEQ ID NO: 266816 - RNA, 32 nt, Human
uuacccaaggaauucccuaaagaauuagaagu

SEQ ID NO: 266817 - RNA, 32 nt, Human
uuacccaaugugccucugcuucccuggguuug

SEQ ID NO: 266818 - RNA, 32 nt, Human
uuacccacaagaaauacuuauuauccacuugg

SEQ ID NO: 266819 - RNA, 32 nt, Human
uuacccacaagcccaaaccucagggauuucag

SEQ ID NO: 266820 - RNA, 32 nt, Human
uuacccacagaaggaggaaguggaagggacag

SEQ ID NO: 266821 - RNA, 32 nt, Human
uuacccacuccaucuucucuuuccuucuuacu

SEQ ID NO: 266822 - RNA, 32 nt, Human
uuacccacuccccucacaauguuguccacuua

SEQ ID NO: 266823 - RNA, 32 nt, Human
uuacccacucugggaccagcagucuuucugau

SEQ ID NO: 266824 - RNA, 32 nt, Human
uuacccacuguuauuuuaucauucauaauggg

SEQ ID NO: 266825 - RNA, 32 nt, Human
uuacccacuuugugucuccugagagcuccucu

SEQ ID NO: 266826 - RNA, 32 nt, Human
uuacccagaguuuuuauguagcagggaaaaua

SEQ ID NO: 266827 - RNA, 32 nt, Human
uuacccagauggcagaugaucagggcuguauu

SEQ ID NO: 266828 - RNA, 32 nt, Human
uuacccagauuggagugcaguggcgcgaucuc

SEQ ID NO: 266829 - RNA, 32 nt, Human
uuacccagcccggggcaggugcagcccuuccu

SEQ ID NO: 266830 - RNA, 32 nt, Human
uuacccaggacagauaaaaaugauagaauggc

SEQ ID NO: 266831 - RNA, 32 nt, Human
uuacccaggcaggagugcaguggcgugaucuu

SEQ ID NO: 266832 - RNA, 22 nt, Human
uuacccaggccggagugcagug

SEQ ID NO: 266833 - RNA, 32 nt, Human
uuacccaggccggagugcaguggcgcagucuc

SEQ ID NO: 266834 - RNA, 32 nt, Human
uuacccaggcuagagugcaauggcgugauuuu

SEQ ID NO: 266835 - RNA, 32 nt, Human
uuacccaggcuagagugcaguggcgcgaucuc

SEQ ID NO: 266836 - RNA, 32 nt, Human
uuacccaggcuagggugcaguggugugaucau

SEQ ID NO: 266837 - RNA, 22 nt, Human
uuacccaggcuggaauacagug

SEQ ID NO: 266838 - RNA, 22 nt, Human
uuacccaggcuggaaugcagug

SEQ ID NO: 266839 - RNA, 32 nt, Human
uuacccaggcuggaaugcaguggcgcaaucuu

SEQ ID NO: 266840 - RNA, 32 nt, Human
uuacccaggcuggaggacagugaugugaucuc

SEQ ID NO: 266841 - RNA, 22 nt, Human
uuacccaggcuggaguacagug

SEQ ID NO: 266842 - RNA, 32 nt, Human
uuacccaggcuggaguacaguggugucaucaa

SEQ ID NO: 266843 - RNA, 32 nt, Human
uuacccaggcuggagugcaaggcacgaucuug

SEQ ID NO: 266844 - RNA, 22 nt, Human
uuacccaggcuggagugcaaug

SEQ ID NO: 266845 - RNA, 32 nt, Human
uuacccaggcuggagugcaaugaugcgaucuc

SEQ ID NO: 266846 - RNA, 32 nt, Human
uuacccaggcuggagugcaauggagugaucac

SEQ ID NO: 266847 - RNA, 32 nt, Human
uuacccaggcuggagugcaauggcacgcaauc

SEQ ID NO: 266848 - RNA, 32 nt, Human
uuacccaggcuggagugcaauggcgcaaacuu

SEQ ID NO: 266849 - RNA, 22 nt, Human
uuacccaggcuggagugcagug

SEQ ID NO: 266850 - RNA, 32 nt, Human
uuacccaggcuggagugcaguggcacaaucuc

SEQ ID NO: 266851 - RNA, 32 nt, Human
uuacccaggcuggagugcaguggcgcgaucuu

SEQ ID NO: 266852 - RNA, 32 nt, Human
uuacccaggcuggagugcaguggcgugaucuu

SEQ ID NO: 266853 - RNA, 32 nt, Human
uuacccaggcuggagugcagugggugaucuug

SEQ ID NO: 266854 - RNA, 32 nt, Human
uuacccaggcuggagugcaguggugcgaucuc

SEQ ID NO: 266855 - RNA, 32 nt, Human
uuacccaggcuggagugcaguggugcuaucuu

SEQ ID NO: 266856 - RNA, 32 nt, Human
uuacccaggcuggagugcaguggugugaucau

SEQ ID NO: 266857 - RNA, 32 nt, Human
uuacccaggcuggagugcaguggugugaucuc

SEQ ID NO: 266858 - RNA, 32 nt, Human
uuacccaggcuggaguguaguggugccaucuc

SEQ ID NO: 266859 - RNA, 32 nt, Human
uuacccaggcuggucucaacuccugggcucaa

SEQ ID NO: 266860 - RNA, 32 nt, Human
uuacccaggcuggucuugaacucuugggcuca

SEQ ID NO: 266861 - RNA, 32 nt, Human
uuacccaggguggagugcagugguagcgaucu

SEQ ID NO: 266862 - RNA, 31 nt, Human
uuacccaguagcuagaauguuaauggcagaa

SEQ ID NO: 266863 - RNA, 32 nt, Human
uuacccaguugauagaaggacaaggacagaau

SEQ ID NO: 266864 - RNA, 32 nt, Human
uuacccauaccuguucucauccuugaaauaua

SEQ ID NO: 266865 - RNA, 32 nt, Human
uuacccauauugcuuuuagccugcugccagga

SEQ ID NO: 266866 - RNA, 32 nt, Human
uuacccaugcucuguguaccugcagcauaaca

SEQ ID NO: 266867 - RNA, 32 nt, Human
uuacccaugcuggucuugaacuucuggcuuca

SEQ ID NO: 266868 - RNA, 32 nt, Human
uuaccccacugcugcugacugggcagggcccu

SEQ ID NO: 266869 - RNA, 32 nt, Human
uuaccccagaagcagcugguggcgccugaccu

SEQ ID NO: 266870 - RNA, 32 nt, Human
uuaccccagccuacccuuccugcauuucucuu

SEQ ID NO: 266871 - RNA, 32 nt, Human
uuaccccaucccugcaugacugugaagcuggc

SEQ ID NO: 266872 - RNA, 32 nt, Human
uuacccccuccccagaccuguucccuuucuuu

SEQ ID NO: 266873 - RNA, 32 nt, Human
uuacccccuccccuuuuauuuucuuuuugcuu

SEQ ID NO: 266874 - RNA, 32 nt, Human
uuacccccuuacaaaucucuggcaacagagag

SEQ ID NO: 266875 - RNA, 32 nt, Human
uuaccccucacagguuuaagagaccaggucuu

SEQ ID NO: 266876 - RNA, 32 nt, Human
uuaccccugcagcuguggggcuggccagccac

SEQ ID NO: 266877 - RNA, 32 nt, Human
uuaccccuggcagagccaguugcagugcaauu

SEQ ID NO: 266878 - RNA, 32 nt, Human
uuaccccuguaaucccagcacuuugggaggcc

SEQ ID NO: 266879 - RNA, 32 nt, Human
uuaccccuguucugcuuaacagaacugccaag

SEQ ID NO: 266880 - RNA, 32 nt, Human
uuaccccuuccacuccaguaggggacaccuuu

SEQ ID NO: 266881 - RNA, 32 nt, Human
uuaccccuucccacuuugcacuccucaaaugu

SEQ ID NO: 266882 - RNA, 32 nt, Human
uuacccggcagcgagcgcgcaggcccccgcga

SEQ ID NO: 266883 - RNA, 24 nt, Human
uuacccggcaucagaguacucaca

SEQ ID NO: 266884 - RNA, 32 nt, Human
uuacccucaugauuuacuaucuguaagagcau

SEQ ID NO: 266885 - RNA, 32 nt, Human
uuacccuccacuuccuccuccuguuuggcuuc

SEQ ID NO: 266886 - RNA, 32 nt, Human
uuacccuccccaggauggagccccaggaaacc

SEQ ID NO: 266887 - RNA, 32 nt, Human
uuacccuccucucuccccagaugugacuacug

SEQ ID NO: 266888 - RNA, 32 nt, Human
uuacccucugcagcuugucaucccuuccgucu

SEQ ID NO: 266889 - RNA, 32 nt, Human
uuacccucugcagcuuguccucccuuccgucu

SEQ ID NO: 266890 - RNA, 32 nt, Human
uuacccugaccuggacucaggccuguuuagua

SEQ ID NO: 266891 - RNA, 32 nt, Human
uuacccugcaggcagcauuguggugacguaga

SEQ ID NO: 266892 - RNA, 32 nt, Human
uuacccugcccuggcuggcaugugagaagcca

SEQ ID NO: 266893 - RNA, 32 nt, Human
uuacccuggacagcaggaaaccuguauauuca

SEQ ID NO: 266894 - RNA, 32 nt, Human
uuacccuggcaucuuucuuuuaaauuauaucu

SEQ ID NO: 266895 - RNA, 32 nt, Human
uuacccuggggccuggcuuaaaagcaggauug

SEQ ID NO: 266896 - RNA, 32 nt, Human
uuacccuguggaagauuuuauuagaauuaauu

SEQ ID NO: 266897 - RNA, 32 nt, Human
uuacccuguucuguucaucuaaaugcagacau

SEQ ID NO: 266898 - RNA, 32 nt, Human
uuacccuguugaaguucaucucugccugugcc

SEQ ID NO: 266899 - RNA, 32 nt, Human
uuacccuuccaccuuuccauccugccuucuac

SEQ ID NO: 266900 - RNA, 32 nt, Human
uuacccuucccugcgggcucucuccccgacac

SEQ ID NO: 266901 - RNA, 32 nt, Human
uuacccuucucaaaguccuuauuaaguguaaa

SEQ ID NO: 266902 - RNA, 32 nt, Human
uuacccuucuuuccauuucucucuccagucuu

SEQ ID NO: 266903 - RNA, 32 nt, Human
uuaccgagagccaaacagagcccagggagacu

SEQ ID NO: 266904 - RNA, 32 nt, Human
uuaccgaggccuucccuuugauacaguccagg

SEQ ID NO: 266905 - RNA, 32 nt, Human
uuaccgcaagggugggaaggggcugcugcccg

SEQ ID NO: 266906 - RNA, 32 nt, Human
uuaccgcaucuucucagcagcuucugaccacu

SEQ ID NO: 266907 - RNA, 32 nt, Human
uuaccgcccaggcuggagugcagugccaugau

SEQ ID NO: 266908 - RNA, 32 nt, Human
uuaccgcggcaagaacaucccucccagccagc

SEQ ID NO: 266909 - RNA, 32 nt, Human
uuaccggaguuuuagcaaaacagcuagcagau

SEQ ID NO: 266910 - RNA, 32 nt, Human
uuaccggcucaagcaauccucccaucucagcc

SEQ ID NO: 266911 - RNA, 32 nt, Human
uuaccgggaggcaguuccuggcuaacgaagag

SEQ ID NO: 266912 - RNA, 32 nt, Human
uuaccgucaaugcuccuuaccaguuagggaug

SEQ ID NO: 266913 - RNA, 32 nt, Human
uuaccgucaccacucuuacaaaggacaguuua

SEQ ID NO: 266914 - RNA, 32 nt, Human
uuaccgucuccagcuucagccuuuccagaaac

SEQ ID NO: 266915 - RNA, 32 nt, Human
uuaccgucucugcuuauggcuggaccucagcu

SEQ ID NO: 266916 - RNA, 32 nt, Human
uuaccgugggcacugaaggcuuucagggccuc

SEQ ID NO: 266917 - RNA, 32 nt, Human
uuaccguucccuuccuccugccuggaccaugg

SEQ ID NO: 266918 - RNA, 32 nt, Human
uuaccuacaaauucugauguuaaauagaguag

SEQ ID NO: 266919 - RNA, 17 nt, Human
uuaccuacaugauugau

SEQ ID NO: 266920 - RNA, 32 nt, Human
uuaccuaggcugagguuagagagauuggccag

SEQ ID NO: 266921 - RNA, 32 nt, Human
uuaccuagggcuggguggacaacaaggcacag

SEQ ID NO: 266922 - RNA, 32 nt, Human
uuaccuauaguuggacaagcuaaccuaccacc

SEQ ID NO: 266923 - RNA, 28 nt, Human
uuaccuaugugugcugccucauuccugg

SEQ ID NO: 266924 - RNA, 32 nt, Human
uuaccuauugcaacuucuguucagaaauacac

SEQ ID NO: 266925 - RNA, 32 nt, Human
uuaccuauugcugcuacuuguucuguccucug

SEQ ID NO: 266926 - RNA, 32 nt, Human
uuaccuauuugagccccucuagcuacagucug

SEQ ID NO: 266927 - RNA, 32 nt, Human
uuaccucacugcauuccagccugggcaacaga

SEQ ID NO: 266928 - RNA, 32 nt, Human
uuaccucacugcauuccggccugggcaacaga

SEQ ID NO: 266929 - RNA, 32 nt, Human
uuaccucagaugggaaacugaggcccagcaag

SEQ ID NO: 266930 - RNA, 32 nt, Human
uuaccucauucccugccccaggaagggaccca

SEQ ID NO: 266931 - RNA, 32 nt, Human
uuaccuccaaacgaucacuccauuuccucagu

SEQ ID NO: 266932 - RNA, 32 nt, Human
uuaccuccaguaugaagugaauugcaaauccu

SEQ ID NO: 266933 - RNA, 32 nt, Human
uuaccucccaagcuggaguccaguggugagau

SEQ ID NO: 266934 - RNA, 21 nt, Human
uuaccucccacccccucucca

SEQ ID NO: 266935 - RNA, 32 nt, Human
uuaccuccccugccaaguuauggucuugaucu

SEQ ID NO: 266936 - RNA, 32 nt, Human
uuaccuccucaccuaccucuccagucacagcu

SEQ ID NO: 266937 - RNA, 32 nt, Human
uuaccuccuccacucccccugccugcccccag

SEQ ID NO: 266938 - RNA, 32 nt, Human
uuaccuccucgugccuuacagccugggcgccu

SEQ ID NO: 266939 - RNA, 32 nt, Human
uuaccuccuggccucagauauuccagggucau

SEQ ID NO: 266940 - RNA, 32 nt, Human
uuaccucgagcuucucaaccacugcggccuaa

SEQ ID NO: 266941 - RNA, 32 nt, Human
uuaccucucuacuggaacccugaccagaagcc

SEQ ID NO: 266942 - RNA, 32 nt, Human
uuaccucucugagccucgguuacccugucugu

SEQ ID NO: 266943 - RNA, 21 nt, Human
uuaccucuguuuaauuucaaa

SEQ ID NO: 266944 - RNA, 32 nt, Human
uuaccucuuaauucuccuuugccuggaaguga

SEQ ID NO: 266945 - RNA, 32 nt, Human
uuaccucuucugcaggcucugccaugcacgca

SEQ ID NO: 266946 - RNA, 32 nt, Human
uuaccucuuuaaguuucaaucucccaucuccc

SEQ ID NO: 266947 - RNA, 32 nt, Human
uuaccugaagucaggaguuagagaccagccug

SEQ ID NO: 266948 - RNA, 32 nt, Human
uuaccugaaugaggagcucauauuuauuuuca

SEQ ID NO: 266949 - RNA, 32 nt, Human
uuaccugacaacaccacagccucaggccuccu

SEQ ID NO: 266950 - RNA, 32 nt, Human
uuaccugagacccagaggguguaggaauggca

SEQ ID NO: 266951 - RNA, 32 nt, Human
uuaccugauuggcacuucgcagucuaucuccc

SEQ ID NO: 266952 - RNA, 23 nt, Human
uuaccugcagaaauucucucaca

SEQ ID NO: 266953 - RNA, 22 nt, Human
uuaccugcaguggcacccugua

SEQ ID NO: 266954 - RNA, 32 nt, Human
uuaccugcccaaguucuucacugagauugaau

SEQ ID NO: 266955 - RNA, 24 nt, Human
uuaccugcccuaaccccucccuca

SEQ ID NO: 266956 - RNA, 32 nt, Human
uuaccugcguaucuacuaacaaacaugagacc

SEQ ID NO: 266957 - RNA, 32 nt, Human
uuaccugcugggaccugcucccagagaccuuc

SEQ ID NO: 266958 - RNA, 32 nt, Human
uuaccugcugggaccugcucccagagaccuug

SEQ ID NO: 266959 - RNA, 32 nt, Human
uuaccugcuugagugauccugaacuuguugcg

SEQ ID NO: 266960 - RNA, 32 nt, Human
uuaccuggagccuggagccacuuuaaguugua

SEQ ID NO: 266961 - RNA, 32 nt, Human
uuaccuggcaucuucugcccuguucaucuacg

SEQ ID NO: 266962 - RNA, 32 nt, Human
uuaccuggccaagaaggaacacagaggagaac

SEQ ID NO: 266963 - RNA, 32 nt, Human
uuaccuggcccagaaucuggaucucugccccc

SEQ ID NO: 266964 - RNA, 32 nt, Human
uuaccugggacccaccucggcgacggagaccg

SEQ ID NO: 266965 - RNA, 32 nt, Human
uuaccugggaggcagaggguguuaugggagga

SEQ ID NO: 266966 - RNA, 32 nt, Human
uuaccugggaggcugaggcaggagaaucauuu

SEQ ID NO: 266967 - RNA, 32 nt, Human
uuaccugggaguagaaggugggaagaaaugga

SEQ ID NO: 266968 - RNA, 32 nt, Human
uuaccugggauuacaggcaugugccaccacac

SEQ ID NO: 266969 - RNA, 32 nt, Human
uuaccuggggccacucucccacccucucgauc

SEQ ID NO: 266970 - RNA, 32 nt, Human
uuaccugggucccuaagcagucuuaugacccc

SEQ ID NO: 266971 - RNA, 32 nt, Human
uuaccugguacaacacaaugguucuggacugg

SEQ ID NO: 266972 - RNA, 32 nt, Human
uuaccugguccugagagcugagcuguagccuc

SEQ ID NO: 266973 - RNA, 32 nt, Human
uuaccuggugaccaccaucauuguuuucccca

SEQ ID NO: 266974 - RNA, 32 nt, Human
uuaccugguuagcucagacggcuugaggcagu

SEQ ID NO: 266975 - RNA, 32 nt, Human
uuaccugguuggggguuuuggugaggauggca

SEQ ID NO: 266976 - RNA, 32 nt, Human
uuaccuguaacuuccuuuaucucagaagggag

SEQ ID NO: 266977 - RNA, 32 nt, Human
uuaccuguagcuuugggcagauuugcaacagc

SEQ ID NO: 266978 - RNA, 32 nt, Human
uuaccuguauguucaaccuauguuaucaaaca

SEQ ID NO: 266979 - RNA, 18 nt, Human
uuaccugucacacauuga

SEQ ID NO: 266980 - RNA, 19 nt, Human
uuaccugucacaucuuggc

SEQ ID NO: 266981 - RNA, 16 nt, Human
uuaccugucacauuga

SEQ ID NO: 266982 - RNA, 32 nt, Human
uuaccugucagaggaggugacaaggcagucuc

SEQ ID NO: 266983 - RNA, 20 nt, Human
uuaccugucauuguaauuga

SEQ ID NO: 266984 - RNA, 19 nt, Human
uuaccugugagcugacuga

SEQ ID NO: 266985 - RNA, 32 nt, Human
uuaccugugcaggucuccugaugcaggucuca

SEQ ID NO: 266986 - RNA, 32 nt, Human
uuaccuguguccaacauguugagaacucaaaa

SEQ ID NO: 266987 - RNA, 18 nt, Human
uuaccuguguugauugau

SEQ ID NO: 266988 - RNA, 32 nt, Human
uuaccuguucuuuuccagagcugacagcacgg

SEQ ID NO: 266989 - RNA, 32 nt, Human
uuaccuguuucugcugcuagaagauccaggaa

SEQ ID NO: 266990 - RNA, 32 nt, Human
uuaccuguuuugucuggauggcugguuuugag

SEQ ID NO: 266991 - RNA, 32 nt, Human
uuaccuuaagaauugcccaaaaaugaaagaaa

SEQ ID NO: 266992 - RNA, 32 nt, Human
uuaccuuccaguaacauacuucuagucacccc

SEQ ID NO: 266993 - RNA, 32 nt, Human
uuaccuuccucccauggucuccuuccgguucu

SEQ ID NO: 266994 - RNA, 32 nt, Human
uuaccuuccucccauuucucuuccuggguccu

SEQ ID NO: 266995 - RNA, 32 nt, Human
uuaccuucuccaggaacccuccaguggggaag

SEQ ID NO: 266996 - RNA, 32 nt, Human
uuaccuucuccugggagguccugcugcaacuc

SEQ ID NO: 266997 - RNA, 32 nt, Human
uuaccuucuggccccucucuucauucagagau

SEQ ID NO: 266998 - RNA, 32 nt, Human
uuaccuugggcaagccacuuaacagcucgaug

SEQ ID NO: 266999 - RNA, 32 nt, Human
uuaccuuggguaagccauaagcgaaucuuaau

SEQ ID NO: 267000 - RNA, 32 nt, Human
uuaccuugucucaauaaaagguuucuaaugcc

SEQ ID NO: 267001 - RNA, 32 nt, Human
uuaccuuuacauaugaagguuuaaaaauacau

SEQ ID NO: 267002 - RNA, 19 nt, Human
uuaccuuuaguucagccaa

SEQ ID NO: 267003 - RNA, 32 nt, Human
uuaccuuuauaaagaucaggacagguuauguc

SEQ ID NO: 267004 - RNA, 32 nt, Human
uuaccuuuauagccaggugagugcaguuugaa

SEQ ID NO: 267005 - RNA, 32 nt, Human
uuaccuuucacuuucaaaaacaugaccuucca

SEQ ID NO: 267006 - RNA, 32 nt, Human
uuaccuuuccagcccuuugaggagggaccaug

SEQ ID NO: 267007 - RNA, 32 nt, Human
uuaccuuuccccucagcaccugucccacuauc

SEQ ID NO: 267008 - RNA, 32 nt, Human
uuaccuuucuggcuuccaguucccagguguuc

SEQ ID NO: 267009 - RNA, 32 nt, Human
uuaccuuugaacucccugcuucucaucuuuga

SEQ ID NO: 267010 - RNA, 32 nt, Human
uuaccuuugaucccuguaaagcagaaaggacu

SEQ ID NO: 267011 - RNA, 32 nt, Human
uuaccuuugccaagccuuuccuaaugaauucc

SEQ ID NO: 267012 - RNA, 32 nt, Human
uuaccuuugccucugccucucaagcugguacc

SEQ ID NO: 267013 - RNA, 32 nt, Human
uuaccuuuuaguuucagcaguccucaccacca

SEQ ID NO: 267014 - RNA, 32 nt, Human
uuaccuuuuccagugggacaguacagugugag

SEQ ID NO: 267015 - RNA, 32 nt, Human
uuaccuuuucccuuuugugcuuugggggaaac

SEQ ID NO: 267016 - RNA, 32 nt, Human
uuaccuuuugacuggaaccagauggcacugag

SEQ ID NO: 267017 - RNA, 32 nt, Human
uuaccuuuuuggugugcugcuuuuccaggcuc

SEQ ID NO: 267018 - RNA, 32 nt, Human
uuaccuuuuuguauggugaagggaggccuucc

SEQ ID NO: 267019 - RNA, 32 nt, Human
uuacgaaacugcacuccugucuucuggcuuca

SEQ ID NO: 267020 - RNA, 32 nt, Human
uuacgaaaugcuagccagggugcaauggcuca

SEQ ID NO: 267021 - RNA, 32 nt, Human
uuacgaagugccagaagugucuagucauagaa

SEQ ID NO: 267022 - RNA, 32 nt, Human
uuacgacaaacacaaagaaacuauaccauaac

SEQ ID NO: 267023 - RNA, 32 nt, Human
uuacgaccacuggaagccagcacccaaggaag

SEQ ID NO: 267024 - RNA, 32 nt, Human
uuacgacuccuguaaucccagcacuuugggag

SEQ ID NO: 267025 - RNA, 32 nt, Human
uuacgagcagcugugagugaggggacaagggg

SEQ ID NO: 267026 - RNA, 32 nt, Human
uuacgagccggguggaggguuggggaggaaag

SEQ ID NO: 267027 - RNA, 22 nt, Human
uuacgagcuccaucggcagcca

SEQ ID NO: 267028 - RNA, 32 nt, Human
uuacgcacugccucucuaagcuggccucaggu

SEQ ID NO: 267029 - RNA, 32 nt, Human
uuacgcaucagcugccuuagacagcuucuaga

SEQ ID NO: 267030 - RNA, 32 nt, Human
uuacgccacugcaccccaaccugggcgacaga

SEQ ID NO: 267031 - RNA, 32 nt, Human
uuacgccacugcacuaaugucuggugacagag

SEQ ID NO: 267032 - RNA, 32 nt, Human
uuacgccacugcacuccagccugggcaacaca

SEQ ID NO: 267033 - RNA, 32 nt, Human
uuacgccacugcacuccagccugggcaacaga

SEQ ID NO: 267034 - RNA, 32 nt, Human
uuacgccacugcacuccagccugggugacgga

SEQ ID NO: 267035 - RNA, 32 nt, Human
uuacgccacugcauuguagccugggcaacaga

SEQ ID NO: 267036 - RNA, 32 nt, Human
uuacgcccaugacugcagaagacugaacaggu

SEQ ID NO: 267037 - RNA, 32 nt, Human
uuacgccuauaaucccagcacuuugggaggcc

SEQ ID NO: 267038 - RNA, 32 nt, Human
uuacgccuauaaucccagcauuuugggacucc

SEQ ID NO: 267039 - RNA, 32 nt, Human
uuacgccuauaaucccagcuacucaggaggcu

SEQ ID NO: 267040 - RNA, 32 nt, Human
uuacgccuccaccccugcagccuccuggcccg

SEQ ID NO: 267041 - RNA, 32 nt, Human
uuacgccuguaaucccaauacuuugggaggcc

SEQ ID NO: 267042 - RNA, 32 nt, Human
uuacgccuguaaucccagcacugugggaggcc

SEQ ID NO: 267043 - RNA, 32 nt, Human
uuacgccuguaaucccagcacuuugagaggcu

SEQ ID NO: 267044 - RNA, 32 nt, Human
uuacgccuguaaucccagcacuuugggacgcc

SEQ ID NO: 267045 - RNA, 32 nt, Human
uuacgccuguaaucccagcacuuugggaggcc

SEQ ID NO: 267046 - RNA, 32 nt, Human
uuacgccuguaaucccagcacuuugggaggcg

SEQ ID NO: 267047 - RNA, 32 nt, Human
uuacgccuguaaucccagcacuuugggaggcu

SEQ ID NO: 267048 - RNA, 32 nt, Human
uuacgccuguaaucccagcacuuugggaggua

SEQ ID NO: 267049 - RNA, 32 nt, Human
uuacgccuguaaucccagcgcuuugggaggcc

SEQ ID NO: 267050 - RNA, 32 nt, Human
uuacgccuguaaucccaggacuuugggaggcc

SEQ ID NO: 267051 - RNA, 32 nt, Human
uuacgccuguaauccuagcacuuugggaggcc

SEQ ID NO: 267052 - RNA, 32 nt, Human
uuacgccuguaaucucagcacuuugggaggcc

SEQ ID NO: 267053 - RNA, 32 nt, Human
uuacgccuguaauuccagcacuuugggaggcc

SEQ ID NO: 267054 - RNA, 32 nt, Human
uuacgccuguuaucccagcacuuugggagguc

SEQ ID NO: 267055 - RNA, 32 nt, Human
uuacgcuaggucacacagcaguagagcugggc

SEQ ID NO: 267056 - RNA, 32 nt, Human
uuacgcuucccuaguucugccugccugcuugu

SEQ ID NO: 267057 - RNA, 32 nt, Human
uuacgcuucguccuccaccucucccuccaacg

SEQ ID NO: 267058 - RNA, 32 nt, Human
uuacggaaagcacgcuccagacaagcucggca

SEQ ID NO: 267059 - RNA, 32 nt, Human
uuacggacugcaaccuucaaauucagcugugg

SEQ ID NO: 267060 - RNA, 32 nt, Human
uuacggagaguuuccuauguuucacugugcaa

SEQ ID NO: 267061 - RNA, 32 nt, Human
uuacggagcuguguaaaccaguuucucauugc

SEQ ID NO: 267062 - RNA, 32 nt, Human
uuacggaggagaaaggguguggaggaagggag

SEQ ID NO: 267063 - RNA, 32 nt, Human
uuacggcacaguguccagggcagcugggugug

SEQ ID NO: 267064 - RNA, 32 nt, Human
uuacggcacccaugcuuucuuugaggaguuuu

SEQ ID NO: 267065 - RNA, 32 nt, Human
uuacggcauuacauuccauccagccugggcga

SEQ ID NO: 267066 - RNA, 32 nt, Human
uuacggcgaagggagagggaccuuaggggagc

SEQ ID NO: 267067 - RNA, 32 nt, Human
uuacggcucagugcaaccuugaccuccugggc

SEQ ID NO: 267068 - RNA, 32 nt, Human
uuacgggaggcugagagacugagggucuuucu

SEQ ID NO: 267069 - RNA, 32 nt, Human
uuacggucuccucuaugaguuaugucaugcug

SEQ ID NO: 267070 - RNA, 32 nt, Human
uuacguauaauccuuuucuuuucaagaugccu

SEQ ID NO: 267071 - RNA, 32 nt, Human
uuacguaucuuuucuccuccucccuaguguuc

SEQ ID NO: 267072 - RNA, 32 nt, Human
uuacgucacugcauuccagccugggugacaga

SEQ ID NO: 267073 - RNA, 32 nt, Human
uuacgucagaaucucagggaaggaggguccag

SEQ ID NO: 267074 - RNA, 32 nt, Human
uuacgucauuaugggaauaacaucccaucacc

SEQ ID NO: 267075 - RNA, 32 nt, Human
uuacguccuuuggacuggcuucucccaggauu

SEQ ID NO: 267076 - RNA, 32 nt, Human
uuacgugauccucucaccucagccucucaagu

SEQ ID NO: 267077 - RNA, 32 nt, Human
uuacguguaaggagucuaugcauuuuacagua

SEQ ID NO: 267078 - RNA, 32 nt, Human
uuacguguucccuacccugccacccagccacc

SEQ ID NO: 267079 - RNA, 32 nt, Human
uuacguucuuuucucaccuuugauccccucac

SEQ ID NO: 267080 - RNA, 32 nt, Human
uuacguugguggcuuugcagugguugaauaua

SEQ ID NO: 267081 - RNA, 32 nt, Human
uuacuaaaaacacaaaaauuagccaggugugg

SEQ ID NO: 267082 - RNA, 32 nt, Human
uuacuaaaaauacaaaaacaaaaauuagccag

SEQ ID NO: 267083 - RNA, 32 nt, Human
uuacuaaaaauacaaaaacuuagccgggcaug

SEQ ID NO: 267084 - RNA, 32 nt, Human
uuacuaaaaauacaaaaauuagccaggcaugg

SEQ ID NO: 267085 - RNA, 32 nt, Human
uuacuaaaaauacaaaaauuagccaggcgcac

SEQ ID NO: 267086 - RNA, 32 nt, Human
uuacuaaaaauacaaaaauuagccaggcgugg

SEQ ID NO: 267087 - RNA, 32 nt, Human
uuacuaaaaauacaaaaauuagccaggugugg

SEQ ID NO: 267088 - RNA, 32 nt, Human
uuacuaaaaauacaaaaauuagccgggcaugg

SEQ ID NO: 267089 - RNA, 32 nt, Human
uuacuaaaaauacaaaaauuagccgggcgugg

SEQ ID NO: 267090 - RNA, 32 nt, Human
uuacuaaaaauacaaaaauuagcugggcaugg

SEQ ID NO: 267091 - RNA, 32 nt, Human
uuacuaaaaauacaaaaauuagcugggugugg

SEQ ID NO: 267092 - RNA, 32 nt, Human
uuacuaaaaauacaaaaauuagucaggcaugg

SEQ ID NO: 267093 - RNA, 32 nt, Human
uuacuaaaaauacaaaauuagccaggcauggu

SEQ ID NO: 267094 - RNA, 32 nt, Human
uuacuaaaaauacaaaauuagccagguguggu

SEQ ID NO: 267095 - RNA, 32 nt, Human
uuacuaaaaauauaaaaauuagcugggugugg

SEQ ID NO: 267096 - RNA, 32 nt, Human
uuacuaaaagaacauaagucaagggaggauga

SEQ ID NO: 267097 - RNA, 32 nt, Human
uuacuaaaagguagaagacuucauggcuuacu

SEQ ID NO: 267098 - RNA, 32 nt, Human
uuacuaaaauagguaaccaggcgucucacagu

SEQ ID NO: 267099 - RNA, 32 nt, Human
uuacuaaaugaaagaauuaaugaggcagaagg

SEQ ID NO: 267100 - RNA, 32 nt, Human
uuacuaacgcagacuucauuuugguccgguuu

SEQ ID NO: 267101 - RNA, 32 nt, Human
uuacuaaucacaguauugugauuuucagugua

SEQ ID NO: 267102 - RNA, 32 nt, Human
uuacuaauucuuuugagaacuccuaagagacc

SEQ ID NO: 267103 - RNA, 32 nt, Human
uuacuacaaagacaaaugucuguuuuuauuug

SEQ ID NO: 267104 - RNA, 32 nt, Human
uuacuacaagcaguggcagagugaauguccuu

SEQ ID NO: 267105 - RNA, 32 nt, Human
uuacuacacuucaagaaagaucugaagcggaa

SEQ ID NO: 267106 - RNA, 32 nt, Human
uuacuacagccaaauaaucaguguuuuauaug

SEQ ID NO: 267107 - RNA, 32 nt, Human
uuacuaccacugguucuuccucuugggcuuuc

SEQ ID NO: 267108 - RNA, 32 nt, Human
uuacuacccuccugaggaaaucagaaaugauu

SEQ ID NO: 267109 - RNA, 32 nt, Human
uuacuaccuauguaacaaaccugcacauccug

SEQ ID NO: 267110 - RNA, 32 nt, Human
uuacuacgugagcucagaagagcacugggcac

SEQ ID NO: 267111 - RNA, 32 nt, Human
uuacuacugaaucucuaaucaauguucaucau

SEQ ID NO: 267112 - RNA, 32 nt, Human
uuacuacugcugccgucaauggugcuacuaua

SEQ ID NO: 267113 - RNA, 32 nt, Human
uuacuacugcuggggccuuccuucauccucug

SEQ ID NO: 267114 - RNA, 32 nt, Human
uuacuacugcuuuccaauccuuggugauauga

SEQ ID NO: 267115 - RNA, 32 nt, Human
uuacuacuggguuauuaauccugcugacagua

SEQ ID NO: 267116 - RNA, 32 nt, Human
uuacuagaauguacaaaugaacuccagauucu

SEQ ID NO: 267117 - RNA, 32 nt, Human
uuacuagagacaggguuucaccauguuggcca

SEQ ID NO: 267118 - RNA, 32 nt, Human
uuacuagagacaggguuucacuaugugggcug

SEQ ID NO: 267119 - RNA, 32 nt, Human
uuacuagagaucuagcagauaaguggguuaau

SEQ ID NO: 267120 - RNA, 32 nt, Human
uuacuagcuggguaaucauaaauaaauugggc

SEQ ID NO: 267121 - RNA, 32 nt, Human
uuacuaggacaggccuuugugcugaguagcaa

SEQ ID NO: 267122 - RNA, 32 nt, Human
uuacuaggaggcagcuggauggcagauacgag

SEQ ID NO: 267123 - RNA, 32 nt, Human
uuacuagggaggagagaaagggacaaaagcac

SEQ ID NO: 267124 - RNA, 32 nt, Human
uuacuauaaccacaucauaagaauucuggaaa

SEQ ID NO: 267125 - RNA, 32 nt, Human
uuacuauaauaaugauaaggcuguauauaaau

SEQ ID NO: 267126 - RNA, 32 nt, Human
uuacuaucagcuguuugagaccagcugcucgg

SEQ ID NO: 267127 - RNA, 32 nt, Human
uuacuauccccaaaucuguucuguaaauaaua

SEQ ID NO: 267128 - RNA, 32 nt, Human
uuacuaucuuuuccucuccccagaggaacacu

SEQ ID NO: 267129 - RNA, 32 nt, Human
uuacuaugaccuuccaaguuugacuuguauaa

SEQ ID NO: 267130 - RNA, 32 nt, Human
uuacuauguguauguauauagaugugcauaua

SEQ ID NO: 267131 - RNA, 32 nt, Human
uuacuauguugccagagaggaugcugugugcu

SEQ ID NO: 267132 - RNA, 32 nt, Human
uuacuauguuuaccuuuuauaaaacauaaccu

SEQ ID NO: 267133 - RNA, 32 nt, Human
uuacuauuccuucccuuccuaucuccuuucua

SEQ ID NO: 267134 - RNA, 32 nt, Human
uuacuauucugccuagcaaacucaaacuacga

SEQ ID NO: 267135 - RNA, 32 nt, Human
uuacuauugcugauggagccugggggaaccau

SEQ ID NO: 267136 - RNA, 32 nt, Human
uuacuauuguagcugcucacuauacccuccug

SEQ ID NO: 267137 - RNA, 32 nt, Human
uuacuauuuauaaugaauaaacaguuaugaaa

SEQ ID NO: 267138 - RNA, 32 nt, Human
uuacuauuuguacuugaagaaauaaauguuuu

SEQ ID NO: 267139 - RNA, 32 nt, Human
uuacuauuuuauauucuuuccugcuuuuugua

SEQ ID NO: 267140 - RNA, 32 nt, Human
uuacucaagaaugaaguagaacuauuuuuaaa

SEQ ID NO: 267141 - RNA, 32 nt, Human
uuacucaagacucugaggaugacuuggacugg

SEQ ID NO: 267142 - RNA, 32 nt, Human
uuacucacaccuguaaucccagcacuuuggga

SEQ ID NO: 267143 - RNA, 32 nt, Human
uuacucaccaucucacagaggagaaacagaaa

SEQ ID NO: 267144 - RNA, 32 nt, Human
uuacucacugaugguucagccacuuccagaac

SEQ ID NO: 267145 - RNA, 32 nt, Human
uuacucagaccaccuacuucucuagcagcacu

SEQ ID NO: 267146 - RNA, 32 nt, Human
uuacucagcuuuauaacaaauguggcuccaag

SEQ ID NO: 267147 - RNA, 32 nt, Human
uuacucaggaggcugaggcaggagaaucacuu

SEQ ID NO: 267148 - RNA, 32 nt, Human
uuacucaggaggcugaggcaggagaauggcgu

SEQ ID NO: 267149 - RNA, 32 nt, Human
uuacucaggaggcugagucaggagaaucacuu

SEQ ID NO: 267150 - RNA, 32 nt, Human
uuacucaggcuggaguaaaauggugccaugcu

SEQ ID NO: 267151 - RNA, 32 nt, Human
uuacucaggguucaucuguccauggccuuucu

SEQ ID NO: 267152 - RNA, 32 nt, Human
uuacucaguagcugaggcaggagaaucgcuug

SEQ ID NO: 267153 - RNA, 32 nt, Human
uuacucauccaucugcugcccucaguccacuc

SEQ ID NO: 267154 - RNA, 32 nt, Human
uuacucauggcagaaggcaaagcaaaggcagg

SEQ ID NO: 267155 - RNA, 32 nt, Human
uuacucauguacauuggucuuucuacauaguu

SEQ ID NO: 267156 - RNA, 32 nt, Human
uuacucauuucuagggaagaaauucuaaaucc

SEQ ID NO: 267157 - RNA, 22 nt, Human
uuacuccaacaggacugaggga

SEQ ID NO: 267158 - RNA, 32 nt, Human
uuacuccaagcccacaauugccgugaagccca

SEQ ID NO: 267159 - RNA, 32 nt, Human
uuacuccaaucagcuggcaauuuugagcugcc

SEQ ID NO: 267160 - RNA, 32 nt, Human
uuacuccaaugauuagcucuguccucauuguc

SEQ ID NO: 267161 - RNA, 32 nt, Human
uuacuccaccugcucaccccgcaagcugaguc

SEQ ID NO: 267162 - RNA, 32 nt, Human
uuacuccacugcacuccagccugggcaacaga

SEQ ID NO: 267163 - RNA, 32 nt, Human
uuacuccagaggcuaaggcaggagaauugcuu

SEQ ID NO: 267164 - RNA, 32 nt, Human
uuacuccaucggcaggcccgagcccagggacc

SEQ ID NO: 267165 - RNA, 32 nt, Human
uuacuccaugaggacaaauacuggggaggugu

SEQ ID NO: 267166 - RNA, 32 nt, Human
uuacuccaugccaccggagaaacucuggugaa

SEQ ID NO: 267167 - RNA, 32 nt, Human
uuacucccaggauucagcagaagauugcguua

SEQ ID NO: 267168 - RNA, 32 nt, Human
uuacucccaggccuccugucaccagcugugug

SEQ ID NO: 267169 - RNA, 32 nt, Human
uuacucccaguauuauguucauuuaauaaauu

SEQ ID NO: 267170 - RNA, 32 nt, Human
uuacuccccugccucccccuaccccagcccau

SEQ ID NO: 267171 - RNA, 32 nt, Human
uuacuccccuggcugcaaaugcuuuucugaaa

SEQ ID NO: 267172 - RNA, 32 nt, Human
uuacucccuaaacaacacuugacaggcuguug

SEQ ID NO: 267173 - RNA, 32 nt, Human
uuacucccucauaacauaucuacuugcacaau

SEQ ID NO: 267174 - RNA, 32 nt, Human
uuacucccuggcuuccaguccuaggcaaucac

SEQ ID NO: 267175 - RNA, 32 nt, Human
uuacucccuuucucuuacuaccuguggcucau

SEQ ID NO: 267176 - RNA, 32 nt, Human
uuacucccuuucucuuccuaccuguggcucau

SEQ ID NO: 267177 - RNA, 32 nt, Human
uuacuccgucuuugaagccagcauccuagcau

SEQ ID NO: 267178 - RNA, 32 nt, Human
uuacuccucuuuccuuccuuccuccuuuccua

SEQ ID NO: 267179 - RNA, 32 nt, Human
uuacuccugccagcuugggaaaaggccggaga

SEQ ID NO: 267180 - RNA, 32 nt, Human
uuacuccugccuccccauuccuugccugucag

SEQ ID NO: 267181 - RNA, 32 nt, Human
uuacuccuuucccucacuuucuccagugcuca

SEQ ID NO: 267182 - RNA, 32 nt, Human
uuacuccuuugagaauucuuuaacaauauuua

SEQ ID NO: 267183 - RNA, 32 nt, Human
uuacucgcggucaucccggccugggccuuuua

SEQ ID NO: 267184 - RNA, 32 nt, Human
uuacucggaaggcugaggugggcggaugacug

SEQ ID NO: 267185 - RNA, 32 nt, Human
uuacucggccccuacucacauuuccuuggguu

SEQ ID NO: 267186 - RNA, 32 nt, Human
uuacucgggaggaugagucaggagaauugcuu

SEQ ID NO: 267187 - RNA, 32 nt, Human
uuacucgggaggcugagacaggagaaucgcuu

SEQ ID NO: 267188 - RNA, 32 nt, Human
uuacucgggaggcugaggcaggagaaucacuu

SEQ ID NO: 267189 - RNA, 32 nt, Human
uuacucgggaggcugaggcaggagaaucgcuu

SEQ ID NO: 267190 - RNA, 32 nt, Human
uuacucgggaggcugaggcaggaggaucacuu

SEQ ID NO: 267191 - RNA, 32 nt, Human
uuacucggguggcugaggcaggagaaucacuu

SEQ ID NO: 267192 - RNA, 32 nt, Human
uuacucuauuaaaucuagaauuagccgggcau

SEQ ID NO: 267193 - RNA, 32 nt, Human
uuacucucaaauacucaaauauauguuuucau

SEQ ID NO: 267194 - RNA, 32 nt, Human
uuacucucagaggagauucuguugcuuuugaa

SEQ ID NO: 267195 - RNA, 32 nt, Human
uuacucucagcagucagaggcuugcuugcucu

SEQ ID NO: 267196 - RNA, 32 nt, Human
uuacucucaggggcuucucugucaucugacuu

SEQ ID NO: 267197 - RNA, 32 nt, Human
uuacucucauacccuucuccuuaguccuucau

SEQ ID NO: 267198 - RNA, 32 nt, Human
uuacucucgccaggaacaggcuccgacgagau

SEQ ID NO: 267199 - RNA, 32 nt, Human
uuacucucgcccaggcuagagugcaguggcau

SEQ ID NO: 267200 - RNA, 32 nt, Human
uuacucucuccuccuagaaugcugcccuugac

SEQ ID NO: 267201 - RNA, 32 nt, Human
uuacucugaccugccgcagucaccucucacuu

SEQ ID NO: 267202 - RNA, 32 nt, Human
uuacucugagggucaagaauugccgcuuccuu

SEQ ID NO: 267203 - RNA, 32 nt, Human
uuacucugcaaaggaaucuggacuuuauucug

SEQ ID NO: 267204 - RNA, 32 nt, Human
uuacucugcccugggccgccugaggccuggca

SEQ ID NO: 267205 - RNA, 32 nt, Human
uuacucuguugccaggcuggagugcaguggcg

SEQ ID NO: 267206 - RNA, 32 nt, Human
uuacucuguugcuaggcuggagugcaguggug

SEQ ID NO: 267207 - RNA, 32 nt, Human
uuacucuuacugaucaauauaacucugcagac

SEQ ID NO: 267208 - RNA, 32 nt, Human
uuacucuuagagauaagacuucagcaggggcu

SEQ ID NO: 267209 - RNA, 32 nt, Human
uuacucuuagucaaguggaaugugcaugcugg

SEQ ID NO: 267210 - RNA, 32 nt, Human
uuacucuuaucaucuagaaauguaauaugcuu

SEQ ID NO: 267211 - RNA, 32 nt, Human
uuacucuucaucuguagcgugaccucaaggua

SEQ ID NO: 267212 - RNA, 32 nt, Human
uuacucuuccucuaacauuuuugaggaaguuu

SEQ ID NO: 267213 - RNA, 32 nt, Human
uuacucuuccuuuuaaguuuucuaaguacguc

SEQ ID NO: 267214 - RNA, 32 nt, Human
uuacucuugccugugaaccucaugcaugaaag

SEQ ID NO: 267215 - RNA, 32 nt, Human
uuacucuugucacccaggcuggagugcagugg

SEQ ID NO: 267216 - RNA, 32 nt, Human
uuacucuuguugcccaggcuagagugcaaugg

SEQ ID NO: 267217 - RNA, 32 nt, Human
uuacucuuguugcccaggcuggagugcaacgg

SEQ ID NO: 267218 - RNA, 32 nt, Human
uuacucuuuauccugagacuguuuauagcuua

SEQ ID NO: 267219 - RNA, 32 nt, Human
uuacucuuucacuaacuugguguaugaucuug

SEQ ID NO: 267220 - RNA, 32 nt, Human
uuacucuuucugagguccaggguccuuauaug

SEQ ID NO: 267221 - RNA, 32 nt, Human
uuacucuuugugacuucgaaaucuuuucaugu

SEQ ID NO: 267222 - RNA, 32 nt, Human
uuacugaaaacagugccuuucuuuguaagcag

SEQ ID NO: 267223 - RNA, 32 nt, Human
uuacugaaaauacaaaauaauuagccgggugu

SEQ ID NO: 267224 - RNA, 32 nt, Human
uuacugaaaauagaauuggccccauggcuuga

SEQ ID NO: 267225 - RNA, 31 nt, Human
uuacugaaccucucugugccucagucaauag

SEQ ID NO: 267226 - RNA, 32 nt, Human
uuacugaagagggagggagggaggagugcuga

SEQ ID NO: 267227 - RNA, 32 nt, Human
uuacugaaucucucucccuuguuuuuauuacg

SEQ ID NO: 267228 - RNA, 32 nt, Human
uuacugacagaagaguuuggaauaguacaugu

SEQ ID NO: 267229 - RNA, 32 nt, Human
uuacugacccgcuuuccacaucagcccaaggu

SEQ ID NO: 267230 - RNA, 32 nt, Human
uuacugacggaagaaguauugguuccagacuu

SEQ ID NO: 267231 - RNA, 32 nt, Human
uuacugagaaaggugaaaugaaaacaagcuca

SEQ ID NO: 267232 - RNA, 32 nt, Human
uuacugagcuugcacaugauacaugauagcug

SEQ ID NO: 267233 - RNA, 32 nt, Human
uuacugaggaauugaguguaagaguggaauaa

SEQ ID NO: 267234 - RNA, 32 nt, Human
uuacugauacuacaacuuuuguuuucugaugg

SEQ ID NO: 267235 - RNA, 32 nt, Human
uuacugauaguugggaaaagaagauuggguua

SEQ ID NO: 267236 - RNA, 32 nt, Human
uuacugaugcuaaaucacaguacaugcaugau

SEQ ID NO: 267237 - RNA, 32 nt, Human
uuacugcaaaaguucagauggaaaaguaauug

SEQ ID NO: 267238 - RNA, 32 nt, Human
uuacugcagaacaaauuacccccaaauuuagu

SEQ ID NO: 267239 - RNA, 32 nt, Human
uuacugcagcacuguugguguucggagcucuu

SEQ ID NO: 267240 - RNA, 32 nt, Human
uuacugcagccuuugccuccccggcucgagca

SEQ ID NO: 267241 - RNA, 32 nt, Human
uuacugcauaggaaacaaucuaccucaucauu

SEQ ID NO: 267242 - RNA, 32 nt, Human
uuacugcaucacugcaccaucuuuccuauuuc

SEQ ID NO: 267243 - RNA, 32 nt, Human
uuacugcauccagccaggcugcagggagugag

SEQ ID NO: 267244 - RNA, 32 nt, Human
uuacugcauccagcucagcguccaugaucuaa

SEQ ID NO: 267245 - RNA, 32 nt, Human
uuacugcaugccacgcacuguguugggcuuag

SEQ ID NO: 267246 - RNA, 32 nt, Human
uuacugccacaaaucagauuauuugggauuua

SEQ ID NO: 267247 - RNA, 32 nt, Human
uuacugccacagcugcucaccuugucuggcaa

SEQ ID NO: 267248 - RNA, 32 nt, Human
uuacugccaccugaccugaagcagaagaaauc

SEQ ID NO: 267249 - RNA, 32 nt, Human
uuacugccaucaggaaggugcuacuggccucg

SEQ ID NO: 267250 - RNA, 32 nt, Human
uuacugccuccccuucucccugccuccagaau

SEQ ID NO: 267251 - RNA, 32 nt, Human
uuacugcgccaccacaucacaugaccuuaaca

SEQ ID NO: 267252 - RNA, 32 nt, Human
uuacugcuagcccccgggggugccaggggucc

SEQ ID NO: 267253 - RNA, 32 nt, Human
uuacugcuauggaagaaaaauacagagugcuc

SEQ ID NO: 267254 - RNA, 32 nt, Human
uuacugcugcccaccucaccuuuccucugcug

SEQ ID NO: 267255 - RNA, 29 nt, Human
uuacugcugcugcuauugucuuuccuuug

SEQ ID NO: 267256 - RNA, 32 nt, Human
uuacugcuggguuuuggaggcugcgauaaaau

SEQ ID NO: 267257 - RNA, 32 nt, Human
uuacugcuucacagccuccccuggugaagaca

SEQ ID NO: 267258 - RNA, 32 nt, Human
uuacugcuuccuaaggauagauuaucaagaaa

SEQ ID NO: 267259 - RNA, 32 nt, Human
uuacuggaacuccauucacugugaccugaagu

SEQ ID NO: 267260 - RNA, 21 nt, Human
uuacuggaagacuccaugccc

SEQ ID NO: 267261 - RNA, 32 nt, Human
uuacuggagaacugaagagccagcuagccuac

SEQ ID NO: 267262 - RNA, 32 nt, Human
uuacuggagacaggguuucaccauguuggcca

SEQ ID NO: 267263 - RNA, 32 nt, Human
uuacuggagacggguuucaccguguuggccag

SEQ ID NO: 267264 - RNA, 32 nt, Human
uuacuggagagggaacucugugaggagaugcu

SEQ ID NO: 267265 - RNA, 32 nt, Human
uuacuggaguccuccauuguguggccacacag

SEQ ID NO: 267266 - RNA, 32 nt, Human
uuacuggagucuccugaugcugagaugaauag

SEQ ID NO: 267267 - RNA, 32 nt, Human
uuacuggcacacaccaccaugcacaguugcag

SEQ ID NO: 267268 - RNA, 32 nt, Human
uuacuggcacugaguaucacugaauuucuuag

SEQ ID NO: 267269 - RNA, 32 nt, Human
uuacuggcauuaaaaaggugggagaaauggaa

SEQ ID NO: 267270 - RNA, 32 nt, Human
uuacuggcuuugcccugcacaccaauauuccu

SEQ ID NO: 267271 - RNA, 32 nt, Human
uuacuggggagaauagaaagaaaacaauugac

SEQ ID NO: 267272 - RNA, 32 nt, Human
uuacuggggaggaggaagcggacagaggaagc

SEQ ID NO: 267273 - RNA, 32 nt, Human
uuacuggggaggcugaggcaggagaaucacuu

SEQ ID NO: 267274 - RNA, 32 nt, Human
uuacuggggugagggacagcuuacuccauuug

SEQ ID NO: 267275 - RNA, 32 nt, Human
uuacugguggaggguguccagguucuuggcau

SEQ ID NO: 267276 - RNA, 32 nt, Human
uuacuguagucuccauuuagauauuaaaagaa

SEQ ID NO: 267277 - RNA, 32 nt, Human
uuacuguauaaauauaauuuaucauuuguacc

SEQ ID NO: 267278 - RNA, 32 nt, Human
uuacuguauauacuuugccuuuccauaaucac

SEQ ID NO: 267279 - RNA, 32 nt, Human
uuacuguauuuugcuuccuacuuuaugucuaa

SEQ ID NO: 267280 - RNA, 32 nt, Human
uuacugucauugaaggaaaaaugauagccaua

SEQ ID NO: 267281 - RNA, 32 nt, Human
uuacuguccuaaccccagaggcucccugcucu

SEQ ID NO: 267282 - RNA, 32 nt, Human
uuacuguccuagugaauagcuuccaccuccuu

SEQ ID NO: 267283 - RNA, 32 nt, Human
uuacugucugguuuuaacaauuuccuuuauau

SEQ ID NO: 267284 - RNA, 32 nt, Human
uuacugugaaguucuauagaguguuaaauaca

SEQ ID NO: 267285 - RNA, 31 nt, Human
uuacugugcaucucugggcauggccugugug

SEQ ID NO: 267286 - RNA, 32 nt, Human
uuacugugcuguguugcuaaugguuaaagaag

SEQ ID NO: 267287 - RNA, 32 nt, Human
uuacugugcuuuucacaccaucucagagguug

SEQ ID NO: 267288 - RNA, 32 nt, Human
uuacuguggaagguggaagagcugaggagggc

SEQ ID NO: 267289 - RNA, 32 nt, Human
uuacuguuccccaacccacaacuaucuuuuaa

SEQ ID NO: 267290 - RNA, 32 nt, Human
uuacuguugcuuguauuuggacucauuugggg

SEQ ID NO: 267291 - RNA, 32 nt, Human
uuacuguuguugagaagcaacagcccuaucac

SEQ ID NO: 267292 - RNA, 32 nt, Human
uuacuguuucaauaaccucugccucccccacc

SEQ ID NO: 267293 - RNA, 32 nt, Human
uuacuguuuuugcuuuaagcagccugcauaua

SEQ ID NO: 267294 - RNA, 32 nt, Human
uuacuuaaguugaaaaagcuucaacucucaag

SEQ ID NO: 267295 - RNA, 32 nt, Human
uuacuuacagaagaaggacugauacaaagaaa

SEQ ID NO: 267296 - RNA, 32 nt, Human
uuacuuacuacugcacuccugcuuuuguggga

SEQ ID NO: 267297 - RNA, 32 nt, Human
uuacuuagcagaaccacauauuuuagacacuu

SEQ ID NO: 267298 - RNA, 32 nt, Human
uuacuuagccugggugacagagugagacccua

SEQ ID NO: 267299 - RNA, 32 nt, Human
uuacuuagcugcaugagaauaauacuauuaua

SEQ ID NO: 267300 - RNA, 32 nt, Human
uuacuuaggaggcugaggcaggagaaucacau

SEQ ID NO: 267301 - RNA, 32 nt, Human
uuacuuaguggccucuuuaauucuccacggug

SEQ ID NO: 267302 - RNA, 32 nt, Human
uuacuuauaaugaaguauuugggagggugguu

SEQ ID NO: 267303 - RNA, 32 nt, Human
uuacuuaugauacuuuguguaaaaaggaaaaa

SEQ ID NO: 267304 - RNA, 32 nt, Human
uuacuuauggagcaccaaagcauuuggauaaa

SEQ ID NO: 267305 - RNA, 32 nt, Human
uuacuuauucaucccucccucuccuuuaaccc

SEQ ID NO: 267306 - RNA, 32 nt, Human
uuacuucaaauccuuuggucacugugauuuca

SEQ ID NO: 267307 - RNA, 32 nt, Human
uuacuucaaccugggagguugaggcugcagug

SEQ ID NO: 267308 - RNA, 32 nt, Human
uuacuucaagccuccaggauggcaauccaguu

SEQ ID NO: 267309 - RNA, 32 nt, Human
uuacuucaaggcagcaagaauugcuauagaga

SEQ ID NO: 267310 - RNA, 32 nt, Human
uuacuucaagggcagccagcaggccuggaugg

SEQ ID NO: 267311 - RNA, 31 nt, Human
uuacuucaccucucugagccuguuuccucau

SEQ ID NO: 267312 - RNA, 31 nt, Human
uuacuucaccucucugggcuucaguugucuc

SEQ ID NO: 267313 - RNA, 32 nt, Human
uuacuucaccucuuacgccucaguuuucucau

SEQ ID NO: 267314 - RNA, 32 nt, Human
uuacuucacuuccagucuucauucccucaucc

SEQ ID NO: 267315 - RNA, 32 nt, Human
uuacuucaucuuuucuggaguuugagguugug

SEQ ID NO: 267316 - RNA, 32 nt, Human
uuacuucauuaucugcuagugucauccacagc

SEQ ID NO: 267317 - RNA, 25 nt, Human
uuacuuccaagacagacuuuuaaca

SEQ ID NO: 267318 - RNA, 32 nt, Human
uuacuuccgugugcuuucaguuuuuccaucau

SEQ ID NO: 267319 - RNA, 32 nt, Human
uuacuuccuagagugucugcuugaugcaugga

SEQ ID NO: 267320 - RNA, 32 nt, Human
uuacuuccuccaccccucccuaucucaccugc

SEQ ID NO: 267321 - RNA, 32 nt, Human
uuacuuccucuccccucucccauuuugcacug

SEQ ID NO: 267322 - RNA, 32 nt, Human
uuacuuccugcguggcccagcauccaggcugu

SEQ ID NO: 267323 - RNA, 32 nt, Human
uuacuucgugguagcugggcuugcagggaacg

SEQ ID NO: 267324 - RNA, 32 nt, Human
uuacuucuagaggagcuuagaguuuauugcag

SEQ ID NO: 267325 - RNA, 32 nt, Human
uuacuucuauguugaaauaaaauuuaaaauca

SEQ ID NO: 267326 - RNA, 32 nt, Human
uuacuucucaaggauuauuagaaucuuaggua

SEQ ID NO: 267327 - RNA, 32 nt, Human
uuacuucuccaaauaaugaacuaccugauuca

SEQ ID NO: 267328 - RNA, 32 nt, Human
uuacuucuccaucucacuucuggcuuuucuca

SEQ ID NO: 267329 - RNA, 32 nt, Human
uuacuucucccagagaaaggaaaaucuuggaa

SEQ ID NO: 267330 - RNA, 32 nt, Human
uuacuucucgaauugaagcaagugaggccuga

SEQ ID NO: 267331 - RNA, 32 nt, Human
uuacuucucuaacaggaucaccaguuugcucc

SEQ ID NO: 267332 - RNA, 32 nt, Human
uuacuucugggaggucacuggaggccagcuca

SEQ ID NO: 267333 - RNA, 32 nt, Human
uuacuucugucacggauugaagaucggcggau

SEQ ID NO: 267334 - RNA, 32 nt, Human
uuacuucugucugauccugggccuuucuuuca

SEQ ID NO: 267335 - RNA, 32 nt, Human
uuacuugaaaagcuuucagaaagcuuuugaaa

SEQ ID NO: 267336 - RNA, 32 nt, Human
uuacuugagauggaguuugguucuguccccga

SEQ ID NO: 267337 - RNA, 32 nt, Human
uuacuugaggcagcucuugugggugaaaaguu

SEQ ID NO: 267338 - RNA, 32 nt, Human
uuacuugaugaaacaaaacuauaccucugaau

SEQ ID NO: 267339 - RNA, 32 nt, Human
uuacuugaugauuuuuaacuuuuuauuucuaa

SEQ ID NO: 267340 - RNA, 32 nt, Human
uuacuugcaagaugugcaagcacacaagaccu

SEQ ID NO: 267341 - RNA, 32 nt, Human
uuacuugcacacagccacaaagccagccagag

SEQ ID NO: 267342 - RNA, 32 nt, Human
uuacuugcaucccugugucuguauuuacagua

SEQ ID NO: 267343 - RNA, 32 nt, Human
uuacuugccaagcagugcacauuucauaguuu

SEQ ID NO: 267344 - RNA, 32 nt, Human
uuacuugccaaggcaagaucuagagggaaccc

SEQ ID NO: 267345 - RNA, 32 nt, Human
uuacuuggauaccggcauauaaaggagaggac

SEQ ID NO: 267346 - RNA, 32 nt, Human
uuacuugggaggcugaggcaggagaaucgcuu

SEQ ID NO: 267347 - RNA, 32 nt, Human
uuacuugggaggcugaggcaggagaauugcuu

SEQ ID NO: 267348 - RNA, 32 nt, Human
uuacuugggaggcugaggugggaggaucuuuu

SEQ ID NO: 267349 - RNA, 32 nt, Human
uuacuuggguuauuucuugaaugaacauacag

SEQ ID NO: 267350 - RNA, 32 nt, Human
uuacuugguggcuaauaaauguuacauucuuu

SEQ ID NO: 267351 - RNA, 32 nt, Human
uuacuugguuucccuugugcagccuggggcuc

SEQ ID NO: 267352 - RNA, 32 nt, Human
uuacuuguauaugauguagucaccuuaacuau

SEQ ID NO: 267353 - RNA, 32 nt, Human
uuacuugucauagucaauacagcaaguaagua

SEQ ID NO: 267354 - RNA, 32 nt, Human
uuacuugucaucugacaaccacuauuuagcua

SEQ ID NO: 267355 - RNA, 32 nt, Human
uuacuugucugccucuuugaccaccugugaac

SEQ ID NO: 267356 - RNA, 32 nt, Human
uuacuuuaaaaaggcucuggauuuucagaagc

SEQ ID NO: 267357 - RNA, 32 nt, Human
uuacuuuaaaaaguaaccagaauccaagguau

SEQ ID NO: 267358 - RNA, 32 nt, Human
uuacuuuaaagugaauguuuuucucuucagcu

SEQ ID NO: 267359 - RNA, 32 nt, Human
uuacuuuaaugaccauccgcagagccauccug

SEQ ID NO: 267360 - RNA, 32 nt, Human
uuacuuuacugaucaggugacuuugagucaau

SEQ ID NO: 267361 - RNA, 32 nt, Human
uuacuuuacuuugucccagguuggagucccua

SEQ ID NO: 267362 - RNA, 32 nt, Human
uuacuuuagaaaacagacaaaauuuccuuuua

SEQ ID NO: 267363 - RNA, 32 nt, Human
uuacuuuagcauugaagccacuuugaaaccug

SEQ ID NO: 267364 - RNA, 32 nt, Human
uuacuuuaugaauauauucaugacauuuguaa

SEQ ID NO: 267365 - RNA, 32 nt, Human
uuacuuuauuacauaucuuuuauagggaaaca

SEQ ID NO: 267366 - RNA, 32 nt, Human
uuacuuucacaaaagaacacugagaugagaua

SEQ ID NO: 267367 - RNA, 32 nt, Human
uuacuuucaggagccucaacacgagagcucaa

SEQ ID NO: 267368 - RNA, 32 nt, Human
uuacuuuccacuucugggcuguauuuugaugu

SEQ ID NO: 267369 - RNA, 32 nt, Human
uuacuuuccagaaagguuucuaaaguuacaga

SEQ ID NO: 267370 - RNA, 32 nt, Human
uuacuuuccagaugaagagcugagccugauuc

SEQ ID NO: 267371 - RNA, 32 nt, Human
uuacuuuccauccccaagccagccugcccccu

SEQ ID NO: 267372 - RNA, 32 nt, Human
uuacuuucccauucacuagguaaagaaucaug

SEQ ID NO: 267373 - RNA, 32 nt, Human
uuacuuucccuguaauuccuggccugaaagcc

SEQ ID NO: 267374 - RNA, 32 nt, Human
uuacuuuccucugccugccucaguuuaauuau

SEQ ID NO: 267375 - RNA, 32 nt, Human
uuacuuucuaucuguacuccucuccuucucuu

SEQ ID NO: 267376 - RNA, 32 nt, Human
uuacuuucucuuuccuccuuuucaaaucuuuu

SEQ ID NO: 267377 - RNA, 32 nt, Human
uuacuuucugagcaucugcaguacagucuuau

SEQ ID NO: 267378 - RNA, 32 nt, Human
uuacuuucuugaugaugcugccuuuuaaaagc

SEQ ID NO: 267379 - RNA, 32 nt, Human
uuacuuucuuuucuguguuuuuaaguuaauuu

SEQ ID NO: 267380 - RNA, 32 nt, Human
uuacuuucuuuuuccgagauggagucuugcuc

SEQ ID NO: 267381 - RNA, 32 nt, Human
uuacuuugcauaguuucaugagcacuggccag

SEQ ID NO: 267382 - RNA, 32 nt, Human
uuacuuugcuccauguaauuuuaugaauuggc

SEQ ID NO: 267383 - RNA, 32 nt, Human
uuacuuugcucggcgcugcucccaggcaucuc

SEQ ID NO: 267384 - RNA, 32 nt, Human
uuacuuugcugaggccuuacuuccccaguagu

SEQ ID NO: 267385 - RNA, 32 nt, Human
uuacuuugcuugagaauccucuccuuucuuau

SEQ ID NO: 267386 - RNA, 32 nt, Human
uuacuuuggcuaaaaggaggugagcggcacuc

SEQ ID NO: 267387 - RNA, 32 nt, Human
uuacuuugggguccaaggacaggauggucaac

SEQ ID NO: 267388 - RNA, 32 nt, Human
uuacuuuguaauucaaaaggccuguuaaccuu

SEQ ID NO: 267389 - RNA, 32 nt, Human
uuacuuuguucugcuucaaggcuguuuugacu

SEQ ID NO: 267390 - RNA, 32 nt, Human
uuacuuuuaaugcugucuuaaaaugaacauuc

SEQ ID NO: 267391 - RNA, 32 nt, Human
uuacuuuuacuuaaugcuuuuguguuuuguua

SEQ ID NO: 267392 - RNA, 32 nt, Human
uuacuuuucacagaaaagcugcugucuguugg

SEQ ID NO: 267393 - RNA, 24 nt, Human
uuacuuuucuagcagauuuuaaca

SEQ ID NO: 267394 - RNA, 22 nt, Human
uuacuuuucuuguauuuaaaca

SEQ ID NO: 267395 - RNA, 32 nt, Human
uuacuuuugacucacaguguuaggcaagccag

SEQ ID NO: 267396 - RNA, 32 nt, Human
uuacuuuugcaucuuuacuuguggagcugugg

SEQ ID NO: 267397 - RNA, 32 nt, Human
uuacuuuugcugccugugccuuuggugucaua

SEQ ID NO: 267398 - RNA, 32 nt, Human
uuacuuuuuacaaagaaugaaaccaaauggac

SEQ ID NO: 267399 - RNA, 32 nt, Human
uuacuuuuucauuuuggggugaagauucaguu

SEQ ID NO: 267400 - RNA, 23 nt, Human
uuacuuuuugcacaauuuuaaua

SEQ ID NO: 267401 - RNA, 32 nt, Human
uuacuuuuuguauaacgaacaaaugcugucuc

SEQ ID NO: 267402 - RNA, 32 nt, Human
uuagaaaaauggggagaaagcuggaagaacaa

SEQ ID NO: 267403 - RNA, 32 nt, Human
uuagaaaacauguuccccaucuggugcucuua

SEQ ID NO: 267404 - RNA, 32 nt, Human
uuagaaaaggaaaaggauucgaggagaaggga

SEQ ID NO: 267405 - RNA, 32 nt, Human
uuagaaaaucagcagaggcagcaaugauguga

SEQ ID NO: 267406 - RNA, 32 nt, Human
uuagaaaaugucaauauagacauaucacaggg

SEQ ID NO: 267407 - RNA, 32 nt, Human
uuagaaaauguuccuuuuacugagaugcaguu

SEQ ID NO: 267408 - RNA, 32 nt, Human
uuagaaacagaaguggcuggaaacucacaugg

SEQ ID NO: 267409 - RNA, 24 nt, Human
uuagaaacagaguuaaagucucaa

SEQ ID NO: 267410 - RNA, 32 nt, Human
uuagaaacauauaggaauaaugccuaggggaa

SEQ ID NO: 267411 - RNA, 32 nt, Human
uuagaaaccagccuggccaacauggcaaaacc

SEQ ID NO: 267412 - RNA, 32 nt, Human
uuagaaaccagccuggccaacguggugaaacc

SEQ ID NO: 267413 - RNA, 32 nt, Human
uuagaaacccacaaaaucagaaacacaguaca

SEQ ID NO: 267414 - RNA, 32 nt, Human
uuagaaacgaugaaccuguaaucacucuggcc

SEQ ID NO: 267415 - RNA, 32 nt, Human
uuagaaacuaucccuaaauguaaagaucuuuu

SEQ ID NO: 267416 - RNA, 32 nt, Human
uuagaaacucagaaauggaaagggaacaauga

SEQ ID NO: 267417 - RNA, 32 nt, Human
uuagaaacucccacaagcucugccuucccucc

SEQ ID NO: 267418 - RNA, 22 nt, Human
uuagaaacuucaccgucuucaa

SEQ ID NO: 267419 - RNA, 32 nt, Human
uuagaaagaaggaagaagucagcucugagugu

SEQ ID NO: 267420 - RNA, 32 nt, Human
uuagaaagacaaguggguggcuuugauggacg

SEQ ID NO: 267421 - RNA, 32 nt, Human
uuagaaagacaugcauuuauauuuuguuucug

SEQ ID NO: 267422 - RNA, 32 nt, Human
uuagaaagauuuugguaacuaggugucucagg

SEQ ID NO: 267423 - RNA, 32 nt, Human
uuagaaagcgagccucacagggcggcucugga

SEQ ID NO: 267424 - RNA, 32 nt, Human
uuagaaaggaaaaguuuucuucauuuagcugc

SEQ ID NO: 267425 - RNA, 32 nt, Human
uuagaaaggaacacugaacaaaguucaaaagu

SEQ ID NO: 267426 - RNA, 32 nt, Human
uuagaaaggacauuucugccauuguucaggcu

SEQ ID NO: 267427 - RNA, 32 nt, Human
uuagaaagggagguggcggauggagugggaag

SEQ ID NO: 267428 - RNA, 32 nt, Human
uuagaaaguccccagugccgcuguccguauga

SEQ ID NO: 267429 - RNA, 32 nt, Human
uuagaaagucuucugcaaacccauuucugaaa

SEQ ID NO: 267430 - RNA, 32 nt, Human
uuagaaagugauuuuuaugcucgcacuauaaa

SEQ ID NO: 267431 - RNA, 32 nt, Human
uuagaaaguucuuccuuagacaacugaaaccc

SEQ ID NO: 267432 - RNA, 32 nt, Human
uuagaaauaagcaagacagagcaggaaaugga

SEQ ID NO: 267433 - RNA, 32 nt, Human
uuagaaauagccacuugccuauucccuggggc

SEQ ID NO: 267434 - RNA, 32 nt, Human
uuagaaauagcuucaaaagcacuuguguaucu

SEQ ID NO: 267435 - RNA, 32 nt, Human
uuagaaaucccaguuggcacagccugggcaag

SEQ ID NO: 267436 - RNA, 32 nt, Human
uuagaaauccugaagaauucagucuucgucua

SEQ ID NO: 267437 - RNA, 32 nt, Human
uuagaaaucugaagacuuucguuuacagcugu

SEQ ID NO: 267438 - RNA, 32 nt, Human
uuagaaaugcucagacuuccccagaaaugaac

SEQ ID NO: 267439 - RNA, 23 nt, Human
uuagaaauggaugcaaauguuag

SEQ ID NO: 267440 - RNA, 32 nt, Human
uuagaaauugaguugaacaggccaggugcggu

SEQ ID NO: 267441 - RNA, 32 nt, Human
uuagaaauuuccccuuuugcugccucaggauc

SEQ ID NO: 267442 - RNA, 32 nt, Human
uuagaacaaaggacagaguaugaacaccuggg

SEQ ID NO: 267443 - RNA, 32 nt, Human
uuagaacaaugaauuauccagcauucagaucu

SEQ ID NO: 267444 - RNA, 19 nt, Human
uuagaacagaauaccuucc

SEQ ID NO: 267445 - RNA, 32 nt, Human
uuagaacagcugguuacugagcucucaggcca

SEQ ID NO: 267446 - RNA, 32 nt, Human
uuagaacauauauuggagagaagcccuguuau

SEQ ID NO: 267447 - RNA, 32 nt, Human
uuagaacaugaccccacacaaugcugcuugac

SEQ ID NO: 267448 - RNA, 32 nt, Human
uuagaacauucacucuggcugcagagggagaa

SEQ ID NO: 267449 - RNA, 32 nt, Human
uuagaaccucaguucuauuacguuauagucag

SEQ ID NO: 267450 - RNA, 32 nt, Human
uuagaaccugggugggaaguagggaagaagcc

SEQ ID NO: 267451 - RNA, 32 nt, Human
uuagaacggugcuucucagcucugcuuaaaug

SEQ ID NO: 267452 - RNA, 32 nt, Human
uuagaacuacagcugcuaggaacaucccugug

SEQ ID NO: 267453 - RNA, 32 nt, Human
uuagaacucuagcccaggcuuugucaacugua

SEQ ID NO: 267454 - RNA, 32 nt, Human
uuagaacugguuccccucaccacccaaccuac

SEQ ID NO: 267455 - RNA, 32 nt, Human
uuagaacuuugaagggcauuaugauccugacu

SEQ ID NO: 267456 - RNA, 32 nt, Human
uuagaagacagaaaccacacucacaguccaaa

SEQ ID NO: 267457 - RNA, 32 nt, Human
uuagaagaccauagaacaugccagcagguugg

SEQ ID NO: 267458 - RNA, 32 nt, Human
uuagaagagcaacuagcaggugucucagcaga

SEQ ID NO: 267459 - RNA, 32 nt, Human
uuagaagagcccagaggcuggaagcaaacaca

SEQ ID NO: 267460 - RNA, 32 nt, Human
uuagaagagcccagguugaugagcauuuagag

SEQ ID NO: 267461 - RNA, 32 nt, Human
uuagaagagcugcuccccucuguuaggaccag

SEQ ID NO: 267462 - RNA, 32 nt, Human
uuagaagaggaacauggagcugauccaggaca

SEQ ID NO: 267463 - RNA, 32 nt, Human
uuagaagaguaugauacaacauuagagaaaga

SEQ ID NO: 267464 - RNA, 32 nt, Human
uuagaagauauaauuauauuuaaauucaucac

SEQ ID NO: 267465 - RNA, 32 nt, Human
uuagaagaugaggagaggcagcagggauuucc

SEQ ID NO: 267466 - RNA, 32 nt, Human
uuagaagcaaaagacuguaccuaacuggaaug

SEQ ID NO: 267467 - RNA, 32 nt, Human
uuagaagcaaguuagaggaagaaggucuuggg

SEQ ID NO: 267468 - RNA, 32 nt, Human
uuagaagcagagccugaaaacgugacugaauu

SEQ ID NO: 267469 - RNA, 32 nt, Human
uuagaagcaggccacuccccagccugcugcca

SEQ ID NO: 267470 - RNA, 32 nt, Human
uuagaagcagggaaguauuguuagucuagcuu

SEQ ID NO: 267471 - RNA, 32 nt, Human
uuagaagcauuuuuaucuuagcauuucauaag

SEQ ID NO: 267472 - RNA, 32 nt, Human
uuagaagccaccacuggcuuucaggcuugggg

SEQ ID NO: 267473 - RNA, 32 nt, Human
uuagaagccagcccugcuauuuccagccuccu

SEQ ID NO: 267474 - RNA, 32 nt, Human
uuagaagcccuagaaaacaaucuccuggucca

SEQ ID NO: 267475 - RNA, 32 nt, Human
uuagaagcucaugugguuguugcagcauucag

SEQ ID NO: 267476 - RNA, 32 nt, Human
uuagaaggaaggagggggagcccagguaugag

SEQ ID NO: 267477 - RNA, 32 nt, Human
uuagaaggcugcagauaacagaaaggcuuuuu

SEQ ID NO: 267478 - RNA, 32 nt, Human
uuagaagggaaagugguaagggagagugcugg

SEQ ID NO: 267479 - RNA, 32 nt, Human
uuagaagggagcacuugugaucaacgucaguu

SEQ ID NO: 267480 - RNA, 32 nt, Human
uucaacaauguugacagcaucuucaccaggag

SEQ ID NO: 267481 - RNA, 24 nt, Human
uucaacaccagccugagcaacaug

SEQ ID NO: 267482 - RNA, 32 nt, Human
uucaacaccagccugagcaacaugguaaaacc

SEQ ID NO: 267483 - RNA, 32 nt, Human
uucaacaccagccuggccaacauagugaaacc

SEQ ID NO: 267484 - RNA, 24 nt, Human
uucaacaccagccuggccaacaug

SEQ ID NO: 267485 - RNA, 32 nt, Human
uucaacaccagccuggccaacauggaaaaacc

SEQ ID NO: 267486 - RNA, 32 nt, Human
uucaacaccagccuggccaacauggugaaacc

SEQ ID NO: 267487 - RNA, 24 nt, Human
uucaacaccagccugggcaacaug

SEQ ID NO: 267488 - RNA, 32 nt, Human
uucaacaccagccugggccauauugugagaac

SEQ ID NO: 267489 - RNA, 24 nt, Human
uucaacaccagcuugggcaacaua

SEQ ID NO: 267490 - RNA, 20 nt, Human
uucaacacuacaaugcauuu

SEQ ID NO: 267491 - RNA, 32 nt, Human
uucaacacugcagaaugggugaccucaaagau

SEQ ID NO: 267492 - RNA, 32 nt, Human
uucaacagaacaccaggaaggucaagacgcuc

SEQ ID NO: 267493 - RNA, 32 nt, Human
uucaacagacccaggugcaaaaccccacaucc

SEQ ID NO: 267494 - RNA, 32 nt, Human
uucaacagaucugucugucuugagucuaucgu

SEQ ID NO: 267495 - RNA, 32 nt, Human
uucaacagaugaagcugcaaaacaguuuucuu

SEQ ID NO: 267496 - RNA, 32 nt, Human
uucaacaggaggaacagcaugccaccacagua

SEQ ID NO: 267497 - RNA, 32 nt, Human
uucaacaggcugagaggaugccuccaauggac

SEQ ID NO: 267498 - RNA, 32 nt, Human
uucaacagggcaaguguggucucuccaguugg

SEQ ID NO: 267499 - RNA, 32 nt, Human
uucaacaucacugauaguuagagaacugcaaa

SEQ ID NO: 267500 - RNA, 24 nt, Human
uucaacaucagccuggccaacaug

SEQ ID NO: 267501 - RNA, 32 nt, Human
uucaacaucagccuggccaacaugaugaaacc

SEQ ID NO: 267502 - RNA, 23 nt, Human
uucaacaucaugccauuccugcu

SEQ ID NO: 267503 - RNA, 32 nt, Human
uucaacauccuugccaagacuucuccacccuc

SEQ ID NO: 267504 - RNA, 32 nt, Human
uucaacaucuuccuaaucuuucuagugcaguc

SEQ ID NO: 267505 - RNA, 32 nt, Human
uucaacaucuucuggaaucagaggugauuuuu

SEQ ID NO: 267506 - RNA, 32 nt, Human
uucaacaugccugguuuaggcagcagcuuggg

SEQ ID NO: 267507 - RNA, 32 nt, Human
uucaacauggugaggggcuacaagaaaacgcu

SEQ ID NO: 267508 - RNA, 32 nt, Human
uucaacauguuggccaggcuggucaugaacuc

SEQ ID NO: 267509 - RNA, 32 nt, Human
uucaacauuucuuucccucugugaaaugauug

SEQ ID NO: 267510 - RNA, 32 nt, Human
uucaaccaaugccuggaccuguccaccugaga

SEQ ID NO: 267511 - RNA, 32 nt, Human
uucaaccacaguuaaggguaaaagggacugag

SEQ ID NO: 267512 - RNA, 32 nt, Human
uucaaccacguuggccaggcugguuuugaacu

SEQ ID NO: 267513 - RNA, 32 nt, Human
uucaaccacugcacuccacuaagcaacuggca

SEQ ID NO: 267514 - RNA, 32 nt, Human
uucaaccagcuucuuuauaccucuuuucuugc

SEQ ID NO: 267515 - RNA, 22 nt, Human
uucaaccaguggaagagcaagg

SEQ ID NO: 267516 - RNA, 18 nt, Human
uucaaccaguggcuccug

SEQ ID NO: 267517 - RNA, 32 nt, Human
uucaacccagacuuugcugggaucucuuccuu

SEQ ID NO: 267518 - RNA, 32 nt, Human
uucaacccaggaggcagaggcuacagugagcu

SEQ ID NO: 267519 - RNA, 32 nt, Human
uucaacccaggaguucaagaccugccagagca

SEQ ID NO: 267520 - RNA, 32 nt, Human
uucaaccccugcccuuguuuggagcuaaggga

SEQ ID NO: 267521 - RNA, 32 nt, Human
uucaacccuguucccuaauccaacacauuccc

SEQ ID NO: 267522 - RNA, 25 nt, Human
uucaacccuuugaaacagagugaga

SEQ ID NO: 267523 - RNA, 32 nt, Human
uucaaccucagcuguauuccuuguuucuguau

SEQ ID NO: 267524 - RNA, 32 nt, Human
uucaaccucauucaacaccagaaaguucacag

SEQ ID NO: 267525 - RNA, 32 nt, Human
uucaaccuccagccagcuucuugagccuauuu

SEQ ID NO: 267526 - RNA, 32 nt, Human
uucaaccuccuguacagcacccugccaguucu

SEQ ID NO: 267527 - RNA, 32 nt, Human
uucaaccucuuuaucaguucugaggcuggagg

SEQ ID NO: 267528 - RNA, 32 nt, Human
uucaaccugaacaaaucacauucuguccagau

SEQ ID NO: 267529 - RNA, 32 nt, Human
uucaaccugcagcaccuggccacgcuggccac

SEQ ID NO: 267530 - RNA, 32 nt, Human
uucaaccugcauuuaccgaguaccugcugaac

SEQ ID NO: 267531 - RNA, 32 nt, Human
uucaaccugcugcuccuggccugggauaccuu

SEQ ID NO: 267532 - RNA, 32 nt, Human
uucaaccugcuguauccuguggcacugguccc

SEQ ID NO: 267533 - RNA, 32 nt, Human
uucaaccuggcccaguccccugcgucauuccc

SEQ ID NO: 267534 - RNA, 32 nt, Human
uucaaccugggagguugaggcugcagugagcu

SEQ ID NO: 267535 - RNA, 24 nt, Human
uucaaccugggugacagaaccaga

SEQ ID NO: 267536 - RNA, 32 nt, Human
uucaaccuucagcaaccaccauacugaucagu

SEQ ID NO: 267537 - RNA, 32 nt, Human
uucaaccuucaucccuucuguggcaguuagga

SEQ ID NO: 267538 - RNA, 32 nt, Human
uucaaccuuccagggaauacgaccccuucucc

SEQ ID NO: 267539 - RNA, 21 nt, Human
uucaacgagccugggaaugug

SEQ ID NO: 267540 - RNA, 24 nt, Human
uucaacgccagccuggccaacaug

SEQ ID NO: 267541 - RNA, 32 nt, Human
uucaacgccagccuggccaacauggugaaacc

SEQ ID NO: 267542 - RNA, 32 nt, Human
uucaacguggaucccucaacuccggcgacucc

SEQ ID NO: 267543 - RNA, 32 nt, Human
uucaacuagaguugaucaugcaaccaaguucu

SEQ ID NO: 267544 - RNA, 32 nt, Human
uucaacuauuuaacccacuugccuuauuuugu

SEQ ID NO: 267545 - RNA, 32 nt, Human
uucaacucaguuugcaacuauaauagcuacuc

SEQ ID NO: 267546 - RNA, 32 nt, Human
uucaacuccccugguuuuaucaucucuacucu

SEQ ID NO: 267547 - RNA, 32 nt, Human
uucaacuccuuucuuuggacccagaugguuuu

SEQ ID NO: 267548 - RNA, 32 nt, Human
uucaacucucacugcuagaauuccuccaacca

SEQ ID NO: 267549 - RNA, 23 nt, Human
uucaacucugguuuauuaucuua

SEQ ID NO: 267550 - RNA, 32 nt, Human
uucaacugacacagcacuguccccuggcagua

SEQ ID NO: 267551 - RNA, 32 nt, Human
uucaacugaugccugcucgucgugacgggagc

SEQ ID NO: 267552 - RNA, 32 nt, Human
uucaacugccagcuuuaccaaugcagcauuua

SEQ ID NO: 267553 - RNA, 31 nt, Human
uucaacugccucucuuuuugggcuuucauag

SEQ ID NO: 267554 - RNA, 32 nt, Human
uucaacugcuccagacuauugaaguaugcaaa

SEQ ID NO: 267555 - RNA, 32 nt, Human
uucaacugcuugccugaauuuacuccuuucac

SEQ ID NO: 267556 - RNA, 32 nt, Human
uucaacuggaccuucuggaaugugaccuucaa

SEQ ID NO: 267557 - RNA, 32 nt, Human
uucaacuggagacagagaaaccagcuagaggc

SEQ ID NO: 267558 - RNA, 32 nt, Human
uucaacugggcacguguugugauuggucaguc

SEQ ID NO: 267559 - RNA, 32 nt, Human
uucaacugugccagaggaaacagcccuccagu

SEQ ID NO: 267560 - RNA, 32 nt, Human
uucaacuguggacuucugggauuugcagauuu

SEQ ID NO: 267561 - RNA, 32 nt, Human
uucaacuguuuugcacaacagacugcugauuc

SEQ ID NO: 267562 - RNA, 32 nt, Human
uucaacuuaaugucuaauguuuucugacaauu

SEQ ID NO: 267563 - RNA, 32 nt, Human
uucaacuuccucuuccucauuuucuugagaug

SEQ ID NO: 267564 - RNA, 32 nt, Human
uucaacuucgguaaugaggaagaaggagaaag

SEQ ID NO: 267565 - RNA, 32 nt, Human
uucaacuucugaagugaauguggauacagcgc

SEQ ID NO: 267566 - RNA, 32 nt, Human
uucaacuugugucacuuccuccagaaagccua

SEQ ID NO: 267567 - RNA, 32 nt, Human
uucaacuuugacuucuuuugacaaaggacuuu

SEQ ID NO: 267568 - RNA, 32 nt, Human
uucaacuuuggcaucuugccaccagaagaccc

SEQ ID NO: 267569 - RNA, 24 nt, Human
uucaacuuugugucauuuaccuua

SEQ ID NO: 267570 - RNA, 32 nt, Human
uucaagaaagaaaaggagaaggaagaggaaga

SEQ ID NO: 267571 - RNA, 32 nt, Human
uucaagaacagccuagccaacauggugaaacc

SEQ ID NO: 267572 - RNA, 32 nt, Human
uucaagaacagccugaccaacauggugaaacu

SEQ ID NO: 267573 - RNA, 32 nt, Human
uucaagaaccaggcagcccugccaugucacaa

SEQ ID NO: 267574 - RNA, 32 nt, Human
uucaagaacuccagaaaucaggagacggagac

SEQ ID NO: 267575 - RNA, 32 nt, Human
uucaagaaguuaauugcuauguggaaagaagg

SEQ ID NO: 267576 - RNA, 24 nt, Human
uucaagaauagccugggcaacaua

SEQ ID NO: 267577 - RNA, 32 nt, Human
uucaagaauagccugggcaacauagcaagacc

SEQ ID NO: 267578 - RNA, 32 nt, Human
uucaagaauagggagagagaggauggguacca

SEQ ID NO: 267579 - RNA, 32 nt, Human
uucaagaauguggaggccugggccaaggucaa

SEQ ID NO: 267580 - RNA, 32 nt, Human
uucaagacaaaccuggccaacauggugaaacc

SEQ ID NO: 267581 - RNA, 32 nt, Human
uucaagacaagaccagccuggccaacauggug

SEQ ID NO: 267582 - RNA, 32 nt, Human
uucaagacaagccuggccaacauggugaaacc

SEQ ID NO: 267583 - RNA, 32 nt, Human
uucaagacaagccuggccuacaugguugaaac

SEQ ID NO: 267584 - RNA, 32 nt, Human
uucaagacaaggagagccaaagacugauggga

SEQ ID NO: 267585 - RNA, 32 nt, Human
uucaagacaauccuggccaacggcgaaacucu

SEQ ID NO: 267586 - RNA, 32 nt, Human
uucaagacagaagcauuuauuccuucacuucc

SEQ ID NO: 267587 - RNA, 32 nt, Human
uucaagacagagaauuuugauaaauccugaca

SEQ ID NO: 267588 - RNA, 32 nt, Human
uucaagacagccugggcaacauggugaaaccu

SEQ ID NO: 267589 - RNA, 23 nt, Human
uucaagacagccugggcaucaua

SEQ ID NO: 267590 - RNA, 32 nt, Human
uucaagacauuugcuaauuuuguaguuucaug

SEQ ID NO: 267591 - RNA, 32 nt, Human
uucaagaccaaacuggccaauauagugagauc

SEQ ID NO: 267592 - RNA, 32 nt, Human
uucaagaccaaccugacuaacauggugaaacc

SEQ ID NO: 267593 - RNA, 32 nt, Human
uucaagaccaaccuggacaacauagcaagacc

SEQ ID NO: 267594 - RNA, 32 nt, Human
uucaagaccaaccuggccaacauugugaaacc

SEQ ID NO: 267595 - RNA, 32 nt, Human
uucaagaccaaccuggccaauguggcaaaacc

SEQ ID NO: 267596 - RNA, 24 nt, Human
uucaagaccaaccugggcaacaua

SEQ ID NO: 267597 - RNA, 32 nt, Human
uucaagaccaaccugggcaacauagcaacacc

SEQ ID NO: 267598 - RNA, 32 nt, Human
uucaagaccaaccugggcaacauagugagacc

SEQ ID NO: 267599 - RNA, 32 nt, Human
uucaagaccaacuuggacaacauagugagaac

SEQ ID NO: 267600 - RNA, 32 nt, Human
uucaagaccaacuugggcaacauagcaagacc

SEQ ID NO: 267601 - RNA, 32 nt, Human
uucaagaccaaucuggccaacauggugaaacc

SEQ ID NO: 267602 - RNA, 24 nt, Human
uucaagaccaaucugggcaacaua

SEQ ID NO: 267603 - RNA, 32 nt, Human
uucaagaccaaucugggcaacauagcaaaacc

SEQ ID NO: 267604 - RNA, 32 nt, Human
uucaagaccacccuggccaacauggugaaacc

SEQ ID NO: 267605 - RNA, 32 nt, Human
uucaagaccacccuggccaacauggugacacc

SEQ ID NO: 267606 - RNA, 32 nt, Human
uucaagaccacccuggccaacaugguuaaacc

SEQ ID NO: 267607 - RNA, 32 nt, Human
uucaagaccacccuggccaaccuggugaaacc

SEQ ID NO: 267608 - RNA, 32 nt, Human
uucaagaccaccuggccaacauggugaaaccc

SEQ ID NO: 267609 - RNA, 32 nt, Human
uucaagaccagccaaggcaacauagugaggcc

SEQ ID NO: 267610 - RNA, 24 nt, Human
uucaagaccagccagggcaacaug

SEQ ID NO: 267611 - RNA, 32 nt, Human
uucaagaccagccagggcaacauggugagacc

SEQ ID NO: 267612 - RNA, 32 nt, Human
uucaagaccagcccagccaacauggcaaaacc

SEQ ID NO: 267613 - RNA, 32 nt, Human
uucaagaccagcccagccaacauggugaaaac

SEQ ID NO: 267614 - RNA, 32 nt, Human
uucaagaccagcccaggcaacauggugacccc

SEQ ID NO: 267615 - RNA, 32 nt, Human
uucaagaccagcccgggcaauucagugagaug

SEQ ID NO: 267616 - RNA, 32 nt, Human
uucaagaccagccgggccagcauggugaaacc

SEQ ID NO: 267617 - RNA, 32 nt, Human
uucaagaccagccuaaaggucaacauaggcag

SEQ ID NO: 267618 - RNA, 32 nt, Human
uucaagaccagccuagccaacauggugaaacc

SEQ ID NO: 267619 - RNA, 32 nt, Human
uucaagaccagccuagccaagauggugaaacc

SEQ ID NO: 267620 - RNA, 32 nt, Human
uucaagaccagccuagcccacauggccaaacc

SEQ ID NO: 267621 - RNA, 24 nt, Human
uucaagaccagccuaggcaacaua

SEQ ID NO: 267622 - RNA, 32 nt, Human
uucaagaccagccuaggcaacauagugagaug

SEQ ID NO: 267623 - RNA, 24 nt, Human
uucaagaccagccuaggcaacaug

SEQ ID NO: 267624 - RNA, 32 nt, Human
uucaagaccagccuaggcaacauggugaaacc

SEQ ID NO: 267625 - RNA, 32 nt, Human
uucaagaccagccuaggcaacuaagugaaacc

SEQ ID NO: 267626 - RNA, 32 nt, Human
uucaagaccagccuaggcaagauggcaacauc

SEQ ID NO: 267627 - RNA, 24 nt, Human
uucaagaccagccuaggcaaugua

SEQ ID NO: 267628 - RNA, 32 nt, Human
uucaagaccagccuaggcaauguagugacacc

SEQ ID NO: 267629 - RNA, 32 nt, Human
uucaagaccagccuaggccagauggugaaacc

SEQ ID NO: 267630 - RNA, 32 nt, Human
uucaagaccagccuagguaacauagugggacc

SEQ ID NO: 267631 - RNA, 32 nt, Human
uucaagaccagccucaacauggagaaacccca

SEQ ID NO: 267632 - RNA, 32 nt, Human
uucaagaccagccucaucaacauagugagacc

SEQ ID NO: 267633 - RNA, 32 nt, Human
uucaagaccagccugaccaacaucgugaaaug

SEQ ID NO: 267634 - RNA, 32 nt, Human
uucaagaccagccugaccaacaugaagaaacc

SEQ ID NO: 267635 - RNA, 32 nt, Human
uucaagaccagccugaccaacaugacaaaacc

SEQ ID NO: 267636 - RNA, 32 nt, Human
uucaagaccagccugaccaacauggagaaacc

SEQ ID NO: 267637 - RNA, 32 nt, Human
uucaagaccagccugaccaacauggagaaacg

SEQ ID NO: 267638 - RNA, 32 nt, Human
uucaagaccagccugaccaacauggauaaauc

SEQ ID NO: 267639 - RNA, 32 nt, Human
uucaagaccagccugaccaacauggauuaacc

SEQ ID NO: 267640 - RNA, 32 nt, Human
uucaagaccagccugaccaacauggcaaaaca

SEQ ID NO: 267641 - RNA, 32 nt, Human
uucaagaccagccugaccaacauggccaaaaa

SEQ ID NO: 267642 - RNA, 32 nt, Human
uucaagaccagccugaccaacauggcgaaacc

SEQ ID NO: 267643 - RNA, 32 nt, Human
uucaagaccagccugaccaacauggggauacc

SEQ ID NO: 267644 - RNA, 32 nt, Human
uucaagaccagccugaccaacauggugaaacc

SEQ ID NO: 267645 - RNA, 32 nt, Human
uucaagaccagccugaccaacguggagaaacc

SEQ ID NO: 267646 - RNA, 32 nt, Human
uucaagaccagccugaccaacguggagaaacu

SEQ ID NO: 267647 - RNA, 32 nt, Human
uucaagaccagccugacccacauggagaaacg

SEQ ID NO: 267648 - RNA, 32 nt, Human
uucaagaccagccugacgaacauggugaaacc

SEQ ID NO: 267649 - RNA, 32 nt, Human
uucaagaccagccugacuaacauggagaaacc

SEQ ID NO: 267650 - RNA, 32 nt, Human
uucaagaccagccugagaaacauagugagccc

SEQ ID NO: 267651 - RNA, 24 nt, Human
uucaagaccagccugagcaacaua

SEQ ID NO: 267652 - RNA, 32 nt, Human
uucaagaccagccugagcaacauagugagacc

SEQ ID NO: 267653 - RNA, 24 nt, Human
uucaagaccagccugagcaacaug

SEQ ID NO: 267654 - RNA, 32 nt, Human
uucaagaccagccugagcaacaugaugaaacu

SEQ ID NO: 267655 - RNA, 24 nt, Human
uucaagaccagccugagcagcgua

SEQ ID NO: 267656 - RNA, 32 nt, Human
uucaagaccagccugagcagcguagcaagacc

SEQ ID NO: 267657 - RNA, 32 nt, Human
uucaagaccagccugaguaacaugaugagacc

SEQ ID NO: 267658 - RNA, 32 nt, Human
uucaagaccagccugaucaacauggugaaacc

SEQ ID NO: 267659 - RNA, 32 nt, Human
uucaagaccagccugaugaacauggagaaacc

SEQ ID NO: 267660 - RNA, 32 nt, Human
uucaagaccagccugcccaacauagugaaacu

SEQ ID NO: 267661 - RNA, 32 nt, Human
uucaagaccagccugcccaacauggcaaaacc

SEQ ID NO: 267662 - RNA, 32 nt, Human
uucaagaccagccugcccaacauggugaaacc

SEQ ID NO: 267663 - RNA, 32 nt, Human
uucaagaccagccuggacaacacagcagaccc

SEQ ID NO: 267664 - RNA, 32 nt, Human
uucaagaccagccuggacaacauagugagacc

SEQ ID NO: 267665 - RNA, 24 nt, Human
uucaagaccagccuggacaacaug

SEQ ID NO: 267666 - RNA, 32 nt, Human
uucaagaccagccuggacaacauggcaaaacc

SEQ ID NO: 267667 - RNA, 32 nt, Human
uucaagaccagccuggacaacauggugaaacc

SEQ ID NO: 267668 - RNA, 24 nt, Human
uucaagaccagccuggacaauaua

SEQ ID NO: 267669 - RNA, 32 nt, Human
uucaagaccagccuggacaauauagugaaacc

SEQ ID NO: 267670 - RNA, 32 nt, Human
uucaagaccagccuggacagcuuagugagauc

SEQ ID NO: 267671 - RNA, 32 nt, Human
uucaagaccagccuggcaaacauggugaaacg

SEQ ID NO: 267672 - RNA, 32 nt, Human
uucaagaccagccuggccaaacauggugaaac

SEQ ID NO: 267673 - RNA, 32 nt, Human
uucaagaccagccuggccaacaaggcgaaacc

SEQ ID NO: 267674 - RNA, 32 nt, Human
uucaagaccagccuggccaacaaggugaaacc

SEQ ID NO: 267675 - RNA, 32 nt, Human
uucaagaccagccuggccaacacagugaaacc

SEQ ID NO: 267676 - RNA, 32 nt, Human
uucaagaccagccuggccaacacggugaaacc

SEQ ID NO: 267677 - RNA, 32 nt, Human
uucaagaccagccuggccaacagggugaaacc

SEQ ID NO: 267678 - RNA, 24 nt, Human
uucaagaccagccuggccaacaua

SEQ ID NO: 267679 - RNA, 32 nt, Human
uucaagaccagccuggccaacauagugaaaac

SEQ ID NO: 267680 - RNA, 32 nt, Human
uucaagaccagccuggccaacauagugaaacc

SEQ ID NO: 267681 - RNA, 24 nt, Human
uucaagaccagccuggccaacaug

SEQ ID NO: 267682 - RNA, 32 nt, Human
uucaagaccagccuggccaacaugaaaaauac

SEQ ID NO: 267683 - RNA, 32 nt, Human
uucaagaccagccuggccaacaugacaaaacc

SEQ ID NO: 267684 - RNA, 32 nt, Human
uucaagaccagccuggccaacaugacgaaacc

SEQ ID NO: 267685 - RNA, 32 nt, Human
uucaagaccagccuggccaacaugauaaaaca

SEQ ID NO: 267686 - RNA, 32 nt, Human
uucaagaccagccuggccaacaugauaaaauc

SEQ ID NO: 267687 - RNA, 32 nt, Human
uucaagaccagccuggccaacaugaugaaacc

SEQ ID NO: 267688 - RNA, 32 nt, Human
uucaagaccagccuggccaacaugaugagacc

SEQ ID NO: 267689 - RNA, 32 nt, Human
uucaagaccagccuggccaacauggagaaacc

SEQ ID NO: 267690 - RNA, 32 nt, Human
uucaagaccagccuggccaacauggcaaaacc

SEQ ID NO: 267691 - RNA, 32 nt, Human
uucaagaccagccuggccaacauggcaaaauc

SEQ ID NO: 267692 - RNA, 32 nt, Human
uucaagaccagccuggccaacauggcagaaac

SEQ ID NO: 267693 - RNA, 32 nt, Human
uucaagaccagccuggccaacauggcgaaaac

SEQ ID NO: 267694 - RNA, 32 nt, Human
uucaagaccagccuggccaacauggcgaaacc

SEQ ID NO: 267695 - RNA, 32 nt, Human
uucaagaccagccuggccaacauggcgaaauu

SEQ ID NO: 267696 - RNA, 32 nt, Human
uucaagaccagccuggccaacauggcgaauuc

SEQ ID NO: 267697 - RNA, 32 nt, Human
uucaagaccagccuggccaacauggggaaauc

SEQ ID NO: 267698 - RNA, 32 nt, Human
uucaagaccagccuggccaacaugguaaaacc

SEQ ID NO: 267699 - RNA, 32 nt, Human
uucaagaccagccuggccaacauggucccagc

SEQ ID NO: 267700 - RNA, 32 nt, Human
uucaagaccagccuggccaacauggugaaaac

SEQ ID NO: 267701 - RNA, 32 nt, Human
uucaagaccagccuggccaacauggugaaaca

SEQ ID NO: 267702 - RNA, 32 nt, Human
uucaagaccagccuggccaacauggugaaacc

SEQ ID NO: 267703 - RNA, 32 nt, Human
uucaagaccagccuggccaacauggugaaacg

SEQ ID NO: 267704 - RNA, 32 nt, Human
uucaagaccagccuggccaacauggugaaauc

SEQ ID NO: 267705 - RNA, 32 nt, Human
uucaagaccagccuggccaacauggugaaucc

SEQ ID NO: 267706 - RNA, 32 nt, Human
uucaagaccagccuggccaacauggugaauua

SEQ ID NO: 267707 - RNA, 32 nt, Human
uucaagaccagccuggccaacauggugagaca

SEQ ID NO: 267708 - RNA, 32 nt, Human
uucaagaccagccuggccaacaugguggaacc

SEQ ID NO: 267709 - RNA, 32 nt, Human
uucaagaccagccuggccaacaugguguaacc

SEQ ID NO: 267710 - RNA, 32 nt, Human
uucaagaccagccuggccaacaugguguaacg

SEQ ID NO: 267711 - RNA, 32 nt, Human
uucaagaccagccuggccaacaugucagaacu

SEQ ID NO: 267712 - RNA, 32 nt, Human
uucaagaccagccuggccaacaugugaaaccc

SEQ ID NO: 267713 - RNA, 32 nt, Human
uucaagaccagccuggccaaccuggugaaacc

SEQ ID NO: 267714 - RNA, 32 nt, Human
uucaagaccagccuggccaaccuggugaaaug

SEQ ID NO: 267715 - RNA, 24 nt, Human
uucaagaccagccuggccaacgug

SEQ ID NO: 267716 - RNA, 32 nt, Human
uucaagaccagccuggccaacguggcaaauac

SEQ ID NO: 267717 - RNA, 32 nt, Human
uucaagaccagccuggccaacguggugaaacc

SEQ ID NO: 267718 - RNA, 32 nt, Human
uucaagaccagccuggccaacguggugaaagc

SEQ ID NO: 267719 - RNA, 32 nt, Human
uucaagaccagccuggccaacuuggagaaacc

SEQ ID NO: 267720 - RNA, 32 nt, Human
uucaagaccagccuggccaacuuggugaaacc

SEQ ID NO: 267721 - RNA, 32 nt, Human
uucaagaccagccuggccaagauggugaaauc

SEQ ID NO: 267722 - RNA, 32 nt, Human
uucaagaccagccuggccaagaugguggaacc

SEQ ID NO: 267723 - RNA, 32 nt, Human
uucaagaccagccuggccaaggcggcaaaacc

SEQ ID NO: 267724 - RNA, 24 nt, Human
uucaagaccagccuggccaauaug

SEQ ID NO: 267725 - RNA, 32 nt, Human
uucaagaccagccuggccaauauggcaaaacc

SEQ ID NO: 267726 - RNA, 32 nt, Human
uucaagaccagccuggccaauauggugaaaaa

SEQ ID NO: 267727 - RNA, 32 nt, Human
uucaagaccagccuggccaauauggugaaacc

SEQ ID NO: 267728 - RNA, 24 nt, Human
uucaagaccagccuggccaaugua

SEQ ID NO: 267729 - RNA, 32 nt, Human
uucaagaccagccuggccaauguagugaaacc

SEQ ID NO: 267730 - RNA, 24 nt, Human
uucaagaccagccuggccaaugug

SEQ ID NO: 267731 - RNA, 32 nt, Human
uucaagaccagccuggccaaugugaugaaacc

SEQ ID NO: 267732 - RNA, 32 nt, Human
uucaagaccagccuggccaauguggugaaacc

SEQ ID NO: 267733 - RNA, 32 nt, Human
uucaagaccagccuggccacauggugcaaccc

SEQ ID NO: 267734 - RNA, 24 nt, Human
uucaagaccagccuggccagcaua

SEQ ID NO: 267735 - RNA, 32 nt, Human
uucaagaccagccuggccagcauagugaaacc

SEQ ID NO: 267736 - RNA, 24 nt, Human
uucaagaccagccuggccagcaug

SEQ ID NO: 267737 - RNA, 32 nt, Human
uucaagaccagccuggccaucauggugaaacc

SEQ ID NO: 267738 - RNA, 32 nt, Human
uucaagaccagccuggcccaaauggugaaacc

SEQ ID NO: 267739 - RNA, 24 nt, Human
uucaagaccagccuggccgacaug

SEQ ID NO: 267740 - RNA, 32 nt, Human
uucaagaccagccuggccgacauggcgaaacc

SEQ ID NO: 267741 - RNA, 32 nt, Human
uucaagaccagccuggccgggguggugaaacc

SEQ ID NO: 267742 - RNA, 24 nt, Human
uucaagaccagccuggcuaacaug

SEQ ID NO: 267743 - RNA, 32 nt, Human
uucaagaccagccuggcuaacauggcaaaacc

SEQ ID NO: 267744 - RNA, 32 nt, Human
uucaagaccagccuggcuaacauggugaaauc

SEQ ID NO: 267745 - RNA, 32 nt, Human
uucaagaccagccuggcuaacaugugaaacua

SEQ ID NO: 267746 - RNA, 24 nt, Human
uucaagaccagccuggcuaauaug

SEQ ID NO: 267747 - RNA, 32 nt, Human
uucaagaccagccuggcuaauauggugaaacc

SEQ ID NO: 267748 - RNA, 32 nt, Human
uucaagaccagccuggcugacaccgugaaacc

SEQ ID NO: 267749 - RNA, 32 nt, Human
uucaagaccagccugggaaaaauagcaagacc

SEQ ID NO: 267750 - RNA, 24 nt, Human
uucaagaccagccugggaaacaua

SEQ ID NO: 267751 - RNA, 32 nt, Human
uucaagaccagccugggaaacauagcaagauc

SEQ ID NO: 267752 - RNA, 24 nt, Human
uucaagaccagccugggaaacaug

SEQ ID NO: 267753 - RNA, 32 nt, Human
uucaagaccagccugggaaacauggcaaacuc

SEQ ID NO: 267754 - RNA, 24 nt, Human
uucaagaccagccugggaaacgug

SEQ ID NO: 267755 - RNA, 32 nt, Human
uucaagaccagccugggaaacguggggaaauc

SEQ ID NO: 267756 - RNA, 32 nt, Human
uucaagaccagccugggaacacagcgagaccc

SEQ ID NO: 267757 - RNA, 24 nt, Human
uucaagaccagccugggcaaaaua

SEQ ID NO: 267758 - RNA, 32 nt, Human
uucaagaccagccugggcaaaauagcaagacc

SEQ ID NO: 267759 - RNA, 32 nt, Human
uucaagaccagccugggcaaaguagggagacc

SEQ ID NO: 267760 - RNA, 21 nt, Human
uucaagaccagccugggcaac

SEQ ID NO: 267761 - RNA, 22 nt, Human
uucaagaccagccugggcaaca

SEQ ID NO: 267762 - RNA, 32 nt, Human
uucaagaccagccugggcaacacagcaagacc

SEQ ID NO: 267763 - RNA, 32 nt, Human
uucaagaccagccugggcaacacagcaagauc

SEQ ID NO: 267764 - RNA, 32 nt, Human
uucaagaccagccugggcaacacagcgagacc

SEQ ID NO: 267765 - RNA, 32 nt, Human
uucaagaccagccugggcaacacagggaggcu

SEQ ID NO: 267766 - RNA, 32 nt, Human
uucaagaccagccugggcaacacagugacacc

SEQ ID NO: 267767 - RNA, 32 nt, Human
uucaagaccagccugggcaacacagugaggcc

SEQ ID NO: 267768 - RNA, 32 nt, Human
uucaagaccagccugggcaacacagugaguga

SEQ ID NO: 267769 - RNA, 32 nt, Human
uucaagaccagccugggcaacacgaaagcuga

SEQ ID NO: 267770 - RNA, 32 nt, Human
uucaagaccagccugggcaacagaacaagacu

SEQ ID NO: 267771 - RNA, 24 nt, Human
uucaagaccagccugggcaacaua

SEQ ID NO: 267772 - RNA, 32 nt, Human
uucaagaccagccugggcaacauaaugagacc

SEQ ID NO: 267773 - RNA, 32 nt, Human
uucaagaccagccugggcaacauaccaagacc

SEQ ID NO: 267774 - RNA, 32 nt, Human
uucaagaccagccugggcaacauagcaagacc

SEQ ID NO: 267775 - RNA, 32 nt, Human
uucaagaccagccugggcaacauagcaagauc

SEQ ID NO: 267776 - RNA, 32 nt, Human
uucaagaccagccugggcaacauagcgagacc

SEQ ID NO: 267777 - RNA, 32 nt, Human
uucaagaccagccugggcaacauaggaagacu

SEQ ID NO: 267778 - RNA, 32 nt, Human
uucaagaccagccugggcaacauaguaagacc

SEQ ID NO: 267779 - RNA, 32 nt, Human
uucaagaccagccugggcaacauagugaaacc

SEQ ID NO: 267780 - RNA, 32 nt, Human
uucaagaccagccugggcaacauagugagaac

SEQ ID NO: 267781 - RNA, 32 nt, Human
uucaagaccagccugggcaacauagugagaau

SEQ ID NO: 267782 - RNA, 32 nt, Human
uucaagaccagccugggcaacauagugagacc

SEQ ID NO: 267783 - RNA, 32 nt, Human
uucaagaccagccugggcaacauagugagacg

SEQ ID NO: 267784 - RNA, 32 nt, Human
uucaagaccagccugggcaacauagugagacu

SEQ ID NO: 267785 - RNA, 24 nt, Human
uucaagaccagccugggcaacaug

SEQ ID NO: 267786 - RNA, 32 nt, Human
uucaagaccagccugggcaacaugauaccgaa

SEQ ID NO: 267787 - RNA, 32 nt, Human
uucaagaccagccugggcaacauggcaagacc

SEQ ID NO: 267788 - RNA, 32 nt, Human
uucaagaccagccugggcaacauggcgaaaac

SEQ ID NO: 267789 - RNA, 32 nt, Human
uucaagaccagccugggcaacauggcgaaacc

SEQ ID NO: 267790 - RNA, 32 nt, Human
uucaagaccagccugggcaacauggcgagacc

SEQ ID NO: 267791 - RNA, 32 nt, Human
uucaagaccagccugggcaacauggcuauaug

SEQ ID NO: 267792 - RNA, 32 nt, Human
uucaagaccagccugggcaacaugguaaaacu

SEQ ID NO: 267793 - RNA, 32 nt, Human
uucaagaccagccugggcaacauggugaaacc

SEQ ID NO: 267794 - RNA, 32 nt, Human
uucaagaccagccugggcaacauggugaaauc

SEQ ID NO: 267795 - RNA, 32 nt, Human
uucaagaccagccugggcaacauggugagacc

SEQ ID NO: 267796 - RNA, 32 nt, Human
uucaagaccagccugggcaacauggugagauu

SEQ ID NO: 267797 - RNA, 32 nt, Human
uucaagaccagccugggcaacauucccaagcu

SEQ ID NO: 267798 - RNA, 24 nt, Human
uucaagaccagccugggcaacgua

SEQ ID NO: 267799 - RNA, 32 nt, Human
uucaagaccagccugggcaacguagcaagacc

SEQ ID NO: 267800 - RNA, 32 nt, Human
uucaagaccagccugggcaacgugguggugug

SEQ ID NO: 267801 - RNA, 32 nt, Human
uucaagaccagccugggcaacuuagggagaua

SEQ ID NO: 267802 - RNA, 32 nt, Human
uucaagaccagccugggcaacuuagugaggcc

SEQ ID NO: 267803 - RNA, 22 nt, Human
uucaagaccagccugggcaaua

SEQ ID NO: 267804 - RNA, 24 nt, Human
uucaagaccagccugggcaauaua

SEQ ID NO: 267805 - RNA, 32 nt, Human
uucaagaccagccugggcaauauagugagacc

SEQ ID NO: 267806 - RNA, 24 nt, Human
uucaagaccagccugggcaaugua

SEQ ID NO: 267807 - RNA, 32 nt, Human
uucaagaccagccugggcaauguaguaagacc

SEQ ID NO: 267808 - RNA, 32 nt, Human
uucaagaccagccugggcaaugugaugaaacu

SEQ ID NO: 267809 - RNA, 21 nt, Human
uucaagaccagccugggcagc

SEQ ID NO: 267810 - RNA, 24 nt, Human
uucaagaccagccugggcagcaug

SEQ ID NO: 267811 - RNA, 32 nt, Human
uucaagaccagccugggcagcauggugaaacc

SEQ ID NO: 267812 - RNA, 32 nt, Human
uucaagaccagccugggcuacagagcaagacc

SEQ ID NO: 267813 - RNA, 32 nt, Human
uucaagaccagccugggcuacaugacgaaacu

SEQ ID NO: 267814 - RNA, 32 nt, Human
uucaagaccagccuggggaacauagagagacc

SEQ ID NO: 267815 - RNA, 25 nt, Human
uucaagaccagccuggggcaacaua

SEQ ID NO: 267816 - RNA, 24 nt, Human
uucaagaccagccuggguaacaug

SEQ ID NO: 267817 - RNA, 32 nt, Human
uucaagaccagccuggguaacaugggguggaa

SEQ ID NO: 267818 - RNA, 32 nt, Human
uucaagaccagccuggguaacauggugaaauc

SEQ ID NO: 267819 - RNA, 24 nt, Human
uucaagaccagccuggguaucaua

SEQ ID NO: 267820 - RNA, 24 nt, Human
uucaagaccagccuggucaacaua

SEQ ID NO: 267821 - RNA, 32 nt, Human
uucaagaccagccuggucaacauagugagaca

SEQ ID NO: 267822 - RNA, 24 nt, Human
uucaagaccagccuggucaacaug

SEQ ID NO: 267823 - RNA, 32 nt, Human
uucaagaccagccuggucaacauggcaaaagc

SEQ ID NO: 267824 - RNA, 32 nt, Human
uucaagaccagccuggucaacauggugaaacu

SEQ ID NO: 267825 - RNA, 32 nt, Human
uucaagaccagccuggucaacauggugaaauc

SEQ ID NO: 267826 - RNA, 32 nt, Human
uucaagaccagccuggucaacaugucaaaacc

SEQ ID NO: 267827 - RNA, 32 nt, Human
uucaagaccagccuguccaacauggugaaacc

SEQ ID NO: 267828 - RNA, 32 nt, Human
uucaagaccagccuugccaacauggugaaacc

SEQ ID NO: 267829 - RNA, 32 nt, Human
uucaagaccagccuugccaagauggugacacc

SEQ ID NO: 267830 - RNA, 24 nt, Human
uucaagaccagccuuggcaacaug

SEQ ID NO: 267831 - RNA, 32 nt, Human
uucaagaccagccuuggcaacauggugaaacc

SEQ ID NO: 267832 - RNA, 32 nt, Human
uucaagaccagcguggccaacguggcgaaacc

SEQ ID NO: 267833 - RNA, 24 nt, Human
uucaagaccagcgugggcaauaua

SEQ ID NO: 267834 - RNA, 32 nt, Human
uucaagaccagcugaccaacacggugaaaccc

SEQ ID NO: 267835 - RNA, 24 nt, Human
uucaagaccagcuuggccaacaua

SEQ ID NO: 267836 - RNA, 32 nt, Human
uucaagaccagcuuggccaacauagugaaauc

SEQ ID NO: 267837 - RNA, 24 nt, Human
uucaagaccagcuuggccaacaug

SEQ ID NO: 267838 - RNA, 32 nt, Human
uucaagaccagcuuggccaacauggagaaacc

SEQ ID NO: 267839 - RNA, 32 nt, Human
uucaagaccagcuuggccaacauggcgaaacc

SEQ ID NO: 267840 - RNA, 32 nt, Human
uucaagaccagcuuggccaacauggugaaacc

SEQ ID NO: 267841 - RNA, 24 nt, Human
uucaagaccagcuugggcaacaua

SEQ ID NO: 267842 - RNA, 24 nt, Human
uucaagaccagcuugggcaacgua

SEQ ID NO: 267843 - RNA, 24 nt, Human
uucaagaccagcuugggcaagaua

SEQ ID NO: 267844 - RNA, 24 nt, Human
uucaagaccagcuugugcaauaua

SEQ ID NO: 267845 - RNA, 32 nt, Human
uucaagaccaggcuggccaacaugguaaaacc

SEQ ID NO: 267846 - RNA, 32 nt, Human
uucaagaccaggcuggccaacauggugaaacc

SEQ ID NO: 267847 - RNA, 32 nt, Human
uucaagaccaggcuggucaacauggcgaaacc

SEQ ID NO: 267848 - RNA, 32 nt, Human
uucaagaccaguauggccaacaugguaagacc

SEQ ID NO: 267849 - RNA, 32 nt, Human
uucaagaccaguccgagcaacauagcaaaagc

SEQ ID NO: 267850 - RNA, 24 nt, Human
uucaagaccagucugagcaacaug

SEQ ID NO: 267851 - RNA, 32 nt, Human
uucaagaccagucugagcaacauggugagagc

SEQ ID NO: 267852 - RNA, 23 nt, Human
uucaagaccagucuggccaacau

SEQ ID NO: 267853 - RNA, 24 nt, Human
uucaagaccagucuggccaacaua

SEQ ID NO: 267854 - RNA, 32 nt, Human
uucaagaccagucuggccaacauagcaaaacc

SEQ ID NO: 267855 - RNA, 24 nt, Human
uucaagaccagucuggccaacaug

SEQ ID NO: 267856 - RNA, 32 nt, Human
uucaagaccagucuggccaacaugacgaaacc

SEQ ID NO: 267857 - RNA, 32 nt, Human
uucaagaccagucuggccaacauggugaaaug

SEQ ID NO: 267858 - RNA, 24 nt, Human
uucaagaccagucuggccaauaug

SEQ ID NO: 267859 - RNA, 32 nt, Human
uucaagaccagucuggccaauauggagaaacc

SEQ ID NO: 267860 - RNA, 22 nt, Human
uucaagaccagucugggcaaca

SEQ ID NO: 267861 - RNA, 24 nt, Human
uucaagaccagucugggcaacaua

SEQ ID NO: 267862 - RNA, 32 nt, Human
uucaagaccagucugggcaacauagcgagacu

SEQ ID NO: 267863 - RNA, 32 nt, Human
uucaagaccagucugggcaacauagugagacc

SEQ ID NO: 267864 - RNA, 24 nt, Human
uucaagaccagucugggcaacaug

SEQ ID NO: 267865 - RNA, 32 nt, Human
uucaagaccagucugggcaacaugguaaaacc

SEQ ID NO: 267866 - RNA, 32 nt, Human
uucaagaccagucugggcaacauggugagacc

SEQ ID NO: 267867 - RNA, 24 nt, Human
uucaagaccagugugggcaacaug

SEQ ID NO: 267868 - RNA, 32 nt, Human
uucaagaccauccuggccaacacagugaaacc

SEQ ID NO: 267869 - RNA, 32 nt, Human
uucaagaccauccuggccaacauagugaaacc

SEQ ID NO: 267870 - RNA, 32 nt, Human
uucaagaccauguuggccaggcuggucucgaa

SEQ ID NO: 267871 - RNA, 32 nt, Human
uucaagacccuugagguauuguuucaucauuu

SEQ ID NO: 267872 - RNA, 24 nt, Human
uucaagaccggccugagcaacaua

SEQ ID NO: 267873 - RNA, 32 nt, Human
uucaagaccggccugagcaacauagugaggau

SEQ ID NO: 267874 - RNA, 24 nt, Human
uucaagaccggccuggccaacaug

SEQ ID NO: 267875 - RNA, 32 nt, Human
uucaagaccggccuggccaacauggugaaacc

SEQ ID NO: 267876 - RNA, 32 nt, Human
uucaagaccugccuggccaacauggugaaacc

SEQ ID NO: 267877 - RNA, 24 nt, Human
uucaagaccugccuggguaacaua

SEQ ID NO: 267878 - RNA, 32 nt, Human
uucaagaccuucuccccauucugccuccauuc

SEQ ID NO: 267879 - RNA, 32 nt, Human
uucaagacgacagcucuguaucugccauguga

SEQ ID NO: 267880 - RNA, 24 nt, Human
uucaagacgagccugggcaacaug

SEQ ID NO: 267881 - RNA, 24 nt, Human
uucaagacuagccuaggcaacaua

SEQ ID NO: 267882 - RNA, 32 nt, Human
uucaagacuagccuaggcaacauagugagacc

SEQ ID NO: 267883 - RNA, 32 nt, Human
uucaagacuagccugaccaacauggugaaacu

SEQ ID NO: 267884 - RNA, 32 nt, Human
uucaagacuagccuggccaacaaguugaaacc

SEQ ID NO: 267885 - RNA, 32 nt, Human
uucaagacuagccuggccaacaucaugaaacc

SEQ ID NO: 267886 - RNA, 24 nt, Human
uucaagacuagccuggccaacaug

SEQ ID NO: 267887 - RNA, 32 nt, Human
uucaagacuagccuggccaacaugaugaaacc

SEQ ID NO: 267888 - RNA, 32 nt, Human
uucaagacuagccuggccaacauggcaaaacc

SEQ ID NO: 267889 - RNA, 32 nt, Human
uucaagacuagccuggccaacauggugaaacc

SEQ ID NO: 267890 - RNA, 32 nt, Human
uucaagacuagccuggccaacauggugagaca

SEQ ID NO: 267891 - RNA, 32 nt, Human
uucaagacuagccuggccaacauguuguaaac

SEQ ID NO: 267892 - RNA, 24 nt, Human
uucaagacuagccuggcugacaug

SEQ ID NO: 267893 - RNA, 32 nt, Human
uucaagacuagccuggcugacauggugaaacu

SEQ ID NO: 267894 - RNA, 24 nt, Human
uucaagacuagccugggcaacaua

SEQ ID NO: 267895 - RNA, 32 nt, Human
uucaagacuagccugggcaacauagcgagacu

SEQ ID NO: 267896 - RNA, 32 nt, Human
uucaagacuagccugggcaacauagugagacu

SEQ ID NO: 267897 - RNA, 24 nt, Human
uucaagacuagccuggucaacaug

SEQ ID NO: 267898 - RNA, 32 nt, Human
uucaagacuagccuggucaacauggugaaacc

SEQ ID NO: 267899 - RNA, 32 nt, Human
uucaagacuagcguggccaacgugaggaaacc

SEQ ID NO: 267900 - RNA, 32 nt, Human
uucaagagaagcuuccuugaaaagaaacgcuu

SEQ ID NO: 267901 - RNA, 32 nt, Human
uucaagagaagcuuccuuggacaaaaggaccc

SEQ ID NO: 267902 - RNA, 32 nt, Human
uucaagagacuugcagggcuagguagagggcc

SEQ ID NO: 267903 - RNA, 32 nt, Human
uucaagagagcuuucuuccacugacauaaaau

SEQ ID NO: 267904 - RNA, 32 nt, Human
uucaagagauccauccucccaccucagucucc

SEQ ID NO: 267905 - RNA, 22 nt, Human
uucaagagauucucuugccuua

SEQ ID NO: 267906 - RNA, 32 nt, Human
uucaagagcaacuucuccacauguuggguguc

SEQ ID NO: 267907 - RNA, 24 nt, Human
uucaagagcagccuggccaacaug

SEQ ID NO: 267908 - RNA, 32 nt, Human
uucaagagcagccuggccaacauggugaaacc

SEQ ID NO: 267909 - RNA, 32 nt, Human
uucaagagcagccuggccaacauugugaaacc

SEQ ID NO: 267910 - RNA, 32 nt, Human
uucaagagcagccuggccaaccuggugaaacc

SEQ ID NO: 267911 - RNA, 32 nt, Human
uucaagagcagccuggccaagauggugaaacc

SEQ ID NO: 267912 - RNA, 24 nt, Human
uucaagagcagccugggcaacaug

SEQ ID NO: 267913 - RNA, 32 nt, Human
uucaagagcagccugggcaacauggcaaaacc

SEQ ID NO: 267914 - RNA, 24 nt, Human
uucaagagcagccugggcaauaua

SEQ ID NO: 267915 - RNA, 32 nt, Human
uucaagagcagccuggucaacauggugaaacu

SEQ ID NO: 267916 - RNA, 32 nt, Human
uucaagagcagucugggcaacauggugagacc

SEQ ID NO: 267917 - RNA, 32 nt, Human
uucaagagcccaaaaacaguucuccuccaugc

SEQ ID NO: 267918 - RNA, 32 nt, Human
uucaagagcuccaauggggucuccagcugaaa

SEQ ID NO: 267919 - RNA, 32 nt, Human
uucaagaggcagaugaggcucaguuggacucc

SEQ ID NO: 267920 - RNA, 32 nt, Human
uucaagaguaugcccacccagccccaaagcca

SEQ ID NO: 267921 - RNA, 32 nt, Human
uucaagaucaaccuggccaacauacugaaacc

SEQ ID NO: 267922 - RNA, 32 nt, Human
uucaagaucagccugaccaacauggagaaacc

SEQ ID NO: 267923 - RNA, 24 nt, Human
uucaagaucagccugcgcaacaug

SEQ ID NO: 267924 - RNA, 32 nt, Human
uucaagaucagccugcgcaacauggcgaaacc

SEQ ID NO: 267925 - RNA, 32 nt, Human
uucaagaucagccuggccaacauaaggagacc

SEQ ID NO: 267926 - RNA, 24 nt, Human
uucaagaucagccuggccaacaug

SEQ ID NO: 267927 - RNA, 32 nt, Human
uucaagaucagccuggccaacauggcaaaacc

SEQ ID NO: 267928 - RNA, 32 nt, Human
uucaagaucagccuggccaacauggugaaacc

SEQ ID NO: 267929 - RNA, 32 nt, Human
uucaagaucagccuggccuagauggcaaaacc

SEQ ID NO: 267930 - RNA, 24 nt, Human
uucaagaucagccuggcuaacaug

SEQ ID NO: 267931 - RNA, 32 nt, Human
uucaagaucagccuggcuaacauggcgaaacc

SEQ ID NO: 267932 - RNA, 24 nt, Human
uucaagaucagccuggcuaacgug

SEQ ID NO: 267933 - RNA, 32 nt, Human
uucaagaucagccugggaaacauagugagacc

SEQ ID NO: 267934 - RNA, 24 nt, Human
uucaagaucagccugggcaacaua

SEQ ID NO: 267935 - RNA, 32 nt, Human
uucaagaucagccugggcaacauagugaaacc

SEQ ID NO: 267936 - RNA, 32 nt, Human
uucaagaucagccugggcaacauagugagacc

SEQ ID NO: 267937 - RNA, 32 nt, Human
uucaagaucagccugggcaacauggugaaacc

SEQ ID NO: 267938 - RNA, 24 nt, Human
uucaagaucagccugggcaauaua

SEQ ID NO: 267939 - RNA, 32 nt, Human
uucaagaucagccugggcaauauagugaaacc

SEQ ID NO: 267940 - RNA, 24 nt, Human
uucaagaucagccugggcaguaua

SEQ ID NO: 267941 - RNA, 32 nt, Human
uucaagaucagccugggcaguauagcaagacc

SEQ ID NO: 267942 - RNA, 24 nt, Human
uucaagaucagucuggacaacaug

SEQ ID NO: 267943 - RNA, 32 nt, Human
uucaagaucagucuggacaacauggcaaaacc

SEQ ID NO: 267944 - RNA, 22 nt, Human
uucaagaucagucugggcaaca

SEQ ID NO: 267945 - RNA, 32 nt, Human
uucaagaugaaauaaggagaaaccccauaacu

SEQ ID NO: 267946 - RNA, 32 nt, Human
uucaagaugaaucaaaaugauggcugguaaua

SEQ ID NO: 267947 - RNA, 32 nt, Human
uucaagaugacaagaacagagcauuaaaccaa

SEQ ID NO: 267948 - RNA, 31 nt, Human
uucaagaugcugcugguccugcucucagugg

SEQ ID NO: 267949 - RNA, 24 nt, Human
uucaagauuagccuggacaacaug

SEQ ID NO: 267950 - RNA, 32 nt, Human
uucaagauuagccuggacaacauggugaaacc

SEQ ID NO: 267951 - RNA, 32 nt, Human
uucaagauuagccuggccaacuuagugaaacu

SEQ ID NO: 267952 - RNA, 32 nt, Human
uucaagcaaagguccaaaaagacuggagaaau

SEQ ID NO: 267953 - RNA, 32 nt, Human
uucaagcaagaaagccugggcccuuugcaccc

SEQ ID NO: 267954 - RNA, 22 nt, Human
uucaagcaauccucccaucuca

SEQ ID NO: 267955 - RNA, 32 nt, Human
uucaagcaauccucccaucucagccuccugag

SEQ ID NO: 267956 - RNA, 32 nt, Human
uucaagcaauccuucugucucagucuccucag

SEQ ID NO: 267957 - RNA, 32 nt, Human
uucaagcaauucucaugccucagucccccgau

SEQ ID NO: 267958 - RNA, 32 nt, Human
uucaagcaauucuccagccucugccucccgag

SEQ ID NO: 267959 - RNA, 32 nt, Human
uucaagcaauucucccaucucagccuccugag

SEQ ID NO: 267960 - RNA, 22 nt, Human
uucaagcaauucuccugccuca

SEQ ID NO: 267961 - RNA, 32 nt, Human
uucaagcacaauaaucaucacagacuugaguu

SEQ ID NO: 267962 - RNA, 32 nt, Human
uucaagcacugaguuucuauuccaagaucaua

SEQ ID NO: 267963 - RNA, 32 nt, Human
uucaagcacuucagacaaacugugcagaagag

SEQ ID NO: 267964 - RNA, 32 nt, Human
uucaagcacuucuucccuccacccucacucca

SEQ ID NO: 267965 - RNA, 32 nt, Human
uucaagcagcgaguguuggguccucugcuucc

SEQ ID NO: 267966 - RNA, 32 nt, Human
uucaagcaggaaagauuuaacacaacauacua

SEQ ID NO: 267967 - RNA, 22 nt, Human
uucaagcaguucuccugccuca

SEQ ID NO: 267968 - RNA, 31 nt, Human
uucaagcaguuuccugcuucagacuuccaag

SEQ ID NO: 267969 - RNA, 32 nt, Human
uucaagcaucugagagucuuaaaaguggaauu

SEQ ID NO: 267970 - RNA, 32 nt, Human
uucaagccaucuuuaaacagggaucugcacag

SEQ ID NO: 267971 - RNA, 32 nt, Human
uucaagccgggccuggccuacguggggaaggu

SEQ ID NO: 267972 - RNA, 32 nt, Human
uucaagccuagccuggccaacauggugaaacc

SEQ ID NO: 267973 - RNA, 32 nt, Human
uucaagccugccaucaaggacauuucuuaaga

SEQ ID NO: 267974 - RNA, 32 nt, Human
uucaagcgauucucccaucucagccucccgag

SEQ ID NO: 267975 - RNA, 22 nt, Human
uucaagcgauucuccugccuca

SEQ ID NO: 267976 - RNA, 32 nt, Human
uucaagcgauucuccugccucugccucccaag

SEQ ID NO: 267977 - RNA, 20 nt, Human
uucaagcgauucuccugucu

SEQ ID NO: 267978 - RNA, 32 nt, Human
uucaagcgauucucuugccucugccucccgag

SEQ ID NO: 267979 - RNA, 32 nt, Human
uucaagcgauucugccucgaccucucaaguag

SEQ ID NO: 267980 - RNA, 32 nt, Human
uucaagcgauucugcugccucagccucccgag

SEQ ID NO: 267981 - RNA, 32 nt, Human
uucaagcgauucuucugccucagccuucugag

SEQ ID NO: 267982 - RNA, 32 nt, Human
uucaagcgauuuucuugccucugccuccugag

SEQ ID NO: 267983 - RNA, 32 nt, Human
uucaagcucagagaggaugaaggggcaucugg

SEQ ID NO: 267984 - RNA, 32 nt, Human
uucaagcugaacaucugggauguggguggcca

SEQ ID NO: 267985 - RNA, 32 nt, Human
uucaagcugcagauuuguuugucauccuugua

SEQ ID NO: 267986 - RNA, 32 nt, Human
uucaaggaaaaauggcacaauuuuugcucagg

SEQ ID NO: 267987 - RNA, 32 nt, Human
uucaaggaaaagaauucucagcagagcucaag

SEQ ID NO: 267988 - RNA, 32 nt, Human
uucaaggaaagaucugauaucuguaaagcaag

SEQ ID NO: 267989 - RNA, 32 nt, Human
uucaaggacaccugccuucaaagccacugagg

SEQ ID NO: 267990 - RNA, 24 nt, Human
uucaaggacagccuggguaauaua

SEQ ID NO: 267991 - RNA, 32 nt, Human
uucaaggaccaccagccccuuacucuucaagc

SEQ ID NO: 267992 - RNA, 32 nt, Human
uucaaggaccaguuccagagaggaugucacca

SEQ ID NO: 267993 - RNA, 32 nt, Human
uucaaggaccuuucaucuucaggauuuacagu

SEQ ID NO: 267994 - RNA, 32 nt, Human
uucaaggacuccucucuuucuucaccaagaag

SEQ ID NO: 267995 - RNA, 32 nt, Human
uucaaggagaaucaaaaugcaaaacuugggaa

SEQ ID NO: 267996 - RNA, 32 nt, Human
uucaaggagcuugcaguauagugagaaaagcc

SEQ ID NO: 267997 - RNA, 32 nt, Human
uucaaggaggaucgcuugagcaggaguuccag

SEQ ID NO: 267998 - RNA, 32 nt, Human
uucaaggaggcccacugugucuaggcaggcaa

SEQ ID NO: 267999 - RNA, 32 nt, Human
uucaaggaggugaaaaugauggaugacuccuc

SEQ ID NO: 268000 - RNA, 32 nt, Human
uucaaggauaaaaacugccaccccaacacccu

SEQ ID NO: 268001 - RNA, 24 nt, Human
uucaaggauggagaugguuuugcc

SEQ ID NO: 268002 - RNA, 32 nt, Human
uucaaggcaaggggcgggaucuccacuggggg

SEQ ID NO: 268003 - RNA, 32 nt, Human
uucaaggcagcaagaauugcuauagagaucua

SEQ ID NO: 268004 - RNA, 32 nt, Human
uucaaggcagccacggugucucacugcggccc

SEQ ID NO: 268005 - RNA, 32 nt, Human
uucaaggcaggauauaggaggaagggauggug

SEQ ID NO: 268006 - RNA, 32 nt, Human
uucaaggcagugagacaaagaagggagauggg

SEQ ID NO: 268007 - RNA, 32 nt, Human
uucaaggccagcauggacaacauagugaggcc

SEQ ID NO: 268008 - RNA, 24 nt, Human
uucaaggccagccuggacaacaua

SEQ ID NO: 268009 - RNA, 32 nt, Human
uucaaggccagccuggacaacauaguaagacc

SEQ ID NO: 268010 - RNA, 24 nt, Human
uucaaggccagccuggacgacaua

SEQ ID NO: 268011 - RNA, 32 nt, Human
uucaaggccagccuggacgacauagcgagacu

SEQ ID NO: 268012 - RNA, 32 nt, Human
uucaaggccagccuggccaacauggugaaccc

SEQ ID NO: 268013 - RNA, 24 nt, Human
uucaaggccagccuggccaacgug

SEQ ID NO: 268014 - RNA, 32 nt, Human
uucaaggccagccuggccaacgugaugaaacu

SEQ ID NO: 268015 - RNA, 24 nt, Human
uucaaggccagccugggcaacaua

SEQ ID NO: 268016 - RNA, 32 nt, Human
uucaaggccagccugggcaacauagaccucug

SEQ ID NO: 268017 - RNA, 32 nt, Human
uucaaggccagccugggcaacauaguaagacu

SEQ ID NO: 268018 - RNA, 32 nt, Human
uucaaggccagccugggcaacauagugaagcc

SEQ ID NO: 268019 - RNA, 24 nt, Human
uucaaggccagccugggcaacaug

SEQ ID NO: 268020 - RNA, 32 nt, Human
uucaaggccagccugggcaacauggcaaaacc

SEQ ID NO: 268021 - RNA, 32 nt, Human
uucaaggccagccugggcaacauggugaaacc

SEQ ID NO: 268022 - RNA, 32 nt, Human
uucaaggccagccugggcaacauggugucucu

SEQ ID NO: 268023 - RNA, 32 nt, Human
uucaaggccugggaguaaucuucagcucacug

SEQ ID NO: 268024 - RNA, 32 nt, Human
uucaaggcgggcuguaacugguggcauuuguc

SEQ ID NO: 268025 - RNA, 31 nt, Human
uucaaggcuaagagagaaagacugccucuga

SEQ ID NO: 268026 - RNA, 32 nt, Human
uucaaggcuaauaccuacuuguacguacaugu

SEQ ID NO: 268027 - RNA, 22 nt, Human
uucaagggacagcacaaccuca

SEQ ID NO: 268028 - RNA, 32 nt, Human
uucaagggacucucagaucaucaaacccaccc

SEQ ID NO: 268029 - RNA, 22 nt, Human
uucaagggaggacuuccccagc

SEQ ID NO: 268030 - RNA, 32 nt, Human
uucaagggaggcagggccccugugggcacuag

SEQ ID NO: 268031 - RNA, 32 nt, Human
uucaagggaguguugcuucucaacucagccaa

SEQ ID NO: 268032 - RNA, 32 nt, Human
uucaagggaugagcuaugaggcucccugggag

SEQ ID NO: 268033 - RNA, 32 nt, Human
uucaagggauuucccugucucagagcagccuu

SEQ ID NO: 268034 - RNA, 32 nt, Human
uucaagggccuugcccugccccggucuguccg

SEQ ID NO: 268035 - RNA, 32 nt, Human
uucaagggcugcagccagggugaggccucugu

SEQ ID NO: 268036 - RNA, 32 nt, Human
uucaaggggaagaaagagucucggcgggaaaa

SEQ ID NO: 268037 - RNA, 23 nt, Human
uucaaggggccuaccuccugcca

SEQ ID NO: 268038 - RNA, 32 nt, Human
uucaaggucaccagguacaguuguacagguug

SEQ ID NO: 268039 - RNA, 32 nt, Human
uucaaggucaugcagugggucgagcgccugag

SEQ ID NO: 268040 - RNA, 32 nt, Human
uucaagguccgagcucuguccucugucaguca

SEQ ID NO: 268041 - RNA, 32 nt, Human
uucaaggugaagccucaagcgucagccuugga

SEQ ID NO: 268042 - RNA, 32 nt, Human
uucaagguuacaucugcuagcagaguaguguu

SEQ ID NO: 268043 - RNA, 32 nt, Human
uucaaguaaaugacuuuuucuucuauucucua

SEQ ID NO: 268044 - RNA, 32 nt, Human
uucaaguacaagaaggcuuucucuaccauuug

SEQ ID NO: 268045 - RNA, 32 nt, Human
uucaaguaccugcugcucacacaggucugggu

SEQ ID NO: 268046 - RNA, 32 nt, Human
uucaaguagacaguuaaauuaccagaggaucc

SEQ ID NO: 268047 - RNA, 19 nt, Human
uucaagucaaaaauauuua

SEQ ID NO: 268048 - RNA, 32 nt, Human
uucaagucacaugucucucagaccccuggauu

SEQ ID NO: 268049 - RNA, 32 nt, Human
uucaagucagacagaucccugccuuggugggc

SEQ ID NO: 268050 - RNA, 32 nt, Human
uucaagucaguguggccaugaaggggcugccu

SEQ ID NO: 268051 - RNA, 32 nt, Human
uucaagucaugccugagucaagaguugaggag

SEQ ID NO: 268052 - RNA, 24 nt, Human
uucaaguccaaucugggcaacaug

SEQ ID NO: 268053 - RNA, 24 nt, Human
uucaaguccagccugggcuacaua

SEQ ID NO: 268054 - RNA, 32 nt, Human
uucaaguccagccugggcuacauagugagacc

SEQ ID NO: 268055 - RNA, 19 nt, Human
uucaaguccuaaaauauuu

SEQ ID NO: 268056 - RNA, 22 nt, Human
uucaagucuaauaaauucuuaa

SEQ ID NO: 268057 - RNA, 32 nt, Human
uucaagucucugcucaaugucacuucauuaaa

SEQ ID NO: 268058 - RNA, 32 nt, Human
uucaagucugaaagcaggaaaagcacugguac

SEQ ID NO: 268059 - RNA, 32 nt, Human
uucaagucugcagccggcucccagggagaucu

SEQ ID NO: 268060 - RNA, 20 nt, Human
uucaagucuuauguuuuccu

SEQ ID NO: 268061 - RNA, 32 nt, Human
uucaagugacuuuugacuauugccaaaaauca

SEQ ID NO: 268062 - RNA, 22 nt, Human
uucaagugauccucccaccuca

SEQ ID NO: 268063 - RNA, 22 nt, Human
uucaagugauccucccaucuca

SEQ ID NO: 268064 - RNA, 32 nt, Human
uucaagugauccucccaucucagccucccaag

SEQ ID NO: 268065 - RNA, 22 nt, Human
uucaagugauccuccugccuca

SEQ ID NO: 268066 - RNA, 32 nt, Human
uucaagugauccucuugucucaguccccugag

SEQ ID NO: 268067 - RNA, 32 nt, Human
uucaagugaucugcccaccucugccucccaaa

SEQ ID NO: 268068 - RNA, 32 nt, Human
uucaagugauucucaugccucagucccccgag

SEQ ID NO: 268069 - RNA, 32 nt, Human
uucaagugauucuccugccucugccuccugag

SEQ ID NO: 268070 - RNA, 22 nt, Human
uucaagugauucugcugucuca

SEQ ID NO: 268071 - RNA, 32 nt, Human
uucaagugcagccccagguggccaggccucca

SEQ ID NO: 268072 - RNA, 32 nt, Human
uucaagugcugccugcucacugaccaacugcc

SEQ ID NO: 268073 - RNA, 32 nt, Human
uucaaguggcugggaugacuacaggcaugggc

SEQ ID NO: 268074 - RNA, 32 nt, Human
uucaagugggucuggccaaaugugacagaugc

SEQ ID NO: 268075 - RNA, 32 nt, Human
uucaaguuccuagauacaaccuucccaugcug

SEQ ID NO: 268076 - RNA, 20 nt, Human
uucaaguuguacuuguuaua

SEQ ID NO: 268077 - RNA, 32 nt, Human
uucaaguuuacaugauuuuuaaauuugcaaug

SEQ ID NO: 268078 - RNA, 24 nt, Human
uucaaguuuagccugggcaguaua

SEQ ID NO: 268079 - RNA, 32 nt, Human
uucaaguuucauggugauuauagcacagcucc

SEQ ID NO: 268080 - RNA, 23 nt, Human
uucaauaaauacucuuucaugua

SEQ ID NO: 268081 - RNA, 32 nt, Human
uucaauaauguucaacugaucucacagaugag

SEQ ID NO: 268082 - RNA, 32 nt, Human
uucaauacacaguacuuccucccagcauugcu

SEQ ID NO: 268083 - RNA, 32 nt, Human
uucaauacagagguugcuggggucugugacau

SEQ ID NO: 268084 - RNA, 32 nt, Human
uucaauacaucuuucccuuucucuucuucaug

SEQ ID NO: 268085 - RNA, 32 nt, Human
uucaauacauuugccaucaccaucaacguuau

SEQ ID NO: 268086 - RNA, 32 nt, Human
uucaauaccagccugagcaaccuaaugagacc

SEQ ID NO: 268087 - RNA, 32 nt, Human
uucaauaccagccuggccaacauggugaaacc

SEQ ID NO: 268088 - RNA, 32 nt, Human
uucaauaccagccuggccaacguggugaaacc

SEQ ID NO: 268089 - RNA, 24 nt, Human
uucaauaccagccugggcaacaua

SEQ ID NO: 268090 - RNA, 32 nt, Human
uucaauaccagccugggcaacauacggaggcc

SEQ ID NO: 268091 - RNA, 32 nt, Human
uucaauaccauucacagcauucaucaccaacu

SEQ ID NO: 268092 - RNA, 32 nt, Human
uucaauauaggugagaggagaaguuggagggu

SEQ ID NO: 268093 - RNA, 32 nt, Human
uucaauaucaaauuauucauaguggagagaaa

SEQ ID NO: 268094 - RNA, 32 nt, Human
uucaauaucaagacugacuggcaccaacacuu

SEQ ID NO: 268095 - RNA, 32 nt, Human
uucaauauguagaacaggagaaucacuugaug

SEQ ID NO: 268096 - RNA, 32 nt, Human
uucaaucacccucugucucuccugccuucugc

SEQ ID NO: 268097 - RNA, 32 nt, Human
uucaaucacuauucaaucacuacuuuuugccc

SEQ ID NO: 268098 - RNA, 32 nt, Human
uucaaucagaucagauuguuguauuuauucca

SEQ ID NO: 268099 - RNA, 32 nt, Human
uucaaucaguugacacaaggaggcagcuacgg

SEQ ID NO: 268100 - RNA, 32 nt, Human
uucaaucauaauaccugcuguggaugcuucau

SEQ ID NO: 268101 - RNA, 17 nt, Human
uucaauccccuuuccuu

SEQ ID NO: 268102 - RNA, 32 nt, Human
uucaauccccuuuccuuccucuuuuuggguuu

SEQ ID NO: 268103 - RNA, 32 nt, Human
uucaauccuccgggcggcucaggcucaaacau

SEQ ID NO: 268104 - RNA, 32 nt, Human
uucaauccugcaggcagcccgguuuggggaug

SEQ ID NO: 268105 - RNA, 32 nt, Human
uucaaucugggagccuuccuggccagucugag

SEQ ID NO: 268106 - RNA, 32 nt, Human
uucaaucuugacuuccuagucgagugacaagu

SEQ ID NO: 268107 - RNA, 32 nt, Human
uucaaugaagaaaucggagugggaagagacac

SEQ ID NO: 268108 - RNA, 32 nt, Human
uucaaugaauacuggucucuuuccaaagcauu

SEQ ID NO: 268109 - RNA, 32 nt, Human
uucaaugacgcacacuuccuguggcaucccug

SEQ ID NO: 268110 - RNA, 32 nt, Human
uucaaugagauauuccauguaaaagagcuuag

SEQ ID NO: 268111 - RNA, 32 nt, Human
uucaaugagggacuguguugcuaagagcguug

SEQ ID NO: 268112 - RNA, 21 nt, Human
uucaaugauuauuuguauuua

SEQ ID NO: 268113 - RNA, 32 nt, Human
uucaaugcucaagugagucacaucuaccuauu

SEQ ID NO: 268114 - RNA, 32 nt, Human
uucaaugcuggugcuuucuuauugcaacucag

SEQ ID NO: 268115 - RNA, 32 nt, Human
uucaauggaaauucacguugcuuugcauuucu

SEQ ID NO: 268116 - RNA, 21 nt, Human
uucaauggagcuugggcagca

SEQ ID NO: 268117 - RNA, 29 nt, Human
uucaaugggcgaggacacggacacgcgga

SEQ ID NO: 268118 - RNA, 32 nt, Human
uucaaugggcugggggacuuccugcuggucgg

SEQ ID NO: 268119 - RNA, 32 nt, Human
uucaaugucaagacauccagaaagaucugucu

SEQ ID NO: 268120 - RNA, 32 nt, Human
uucaaugucccuggaguugggagggaggaaug

SEQ ID NO: 268121 - RNA, 32 nt, Human
uucaaugugaaaucuuagaaugcaguuuuacc

SEQ ID NO: 268122 - RNA, 32 nt, Human
uucaauguggacaacacaguaagacccugucu

SEQ ID NO: 268123 - RNA, 32 nt, Human
uucaauguugggacucaaaggugaagacacug

SEQ ID NO: 268124 - RNA, 32 nt, Human
uucaauuaaagaaagggaaauacaaggcuaaa

SEQ ID NO: 268125 - RNA, 32 nt, Human
uucaauuagcacucgcugauuggucgcugcuc

SEQ ID NO: 268126 - RNA, 32 nt, Human
uucaauucaaugcacguucacccuagagcuuu

SEQ ID NO: 268127 - RNA, 32 nt, Human
uucaauucaguuauuauauucauuuagcauua

SEQ ID NO: 268128 - RNA, 32 nt, Human
uucaauucauguaacacuguugagugcuuacu

SEQ ID NO: 268129 - RNA, 32 nt, Human
uucaauucucagauuauacauauguuauaaaa

SEQ ID NO: 268130 - RNA, 32 nt, Human
uucaauucuggcuucuugcacuuagcauaaug

SEQ ID NO: 268131 - RNA, 31 nt, Human
uucaauugacuucuguuccuugcuuuuaguu

SEQ ID NO: 268132 - RNA, 32 nt, Human
uucaauuugugaaaucaaagaacugaugcacu

SEQ ID NO: 268133 - RNA, 32 nt, Human
uucaauuuuuaucauuccccuuaucauuagaa

SEQ ID NO: 268134 - RNA, 32 nt, Human
uucacaaaaagcugggccuacugaacaauuca

SEQ ID NO: 268135 - RNA, 18 nt, Human
uucacaaaacuggacuca

SEQ ID NO: 268136 - RNA, 32 nt, Human
uucacaaaaucaguuguacaagagaaggcacc

SEQ ID NO: 268137 - RNA, 32 nt, Human
uucacaaacagagaagcaacauuugaaaguag

SEQ ID NO: 268138 - RNA, 32 nt, Human
uucacaaacaugacaucacccugcagcuugca

SEQ ID NO: 268139 - RNA, 32 nt, Human
uucacaaaggcugaagugggagucagaugaua

SEQ ID NO: 268140 - RNA, 27 nt, Human
uucacaaaguaaauugccacaaccuca

SEQ ID NO: 268141 - RNA, 32 nt, Human
uucacaacaaccuugugaaagacauaggggaa

SEQ ID NO: 268142 - RNA, 32 nt, Human
uucacaacauugaacccaggaggcggagcuug

SEQ ID NO: 268143 - RNA, 32 nt, Human
uucacaaccagaaaccacuaccccucaggggu

SEQ ID NO: 268144 - RNA, 32 nt, Human
uucacaaccagccugaccaacauggagaaacc

SEQ ID NO: 268145 - RNA, 32 nt, Human
uucacaaccagccuggucaacuugguaaaacc

SEQ ID NO: 268146 - RNA, 32 nt, Human
uucacaacccagcagcgcuccaccuccaacuu

SEQ ID NO: 268147 - RNA, 32 nt, Human
uucacaaccgagaugccuuugacauuuugggc

SEQ ID NO: 268148 - RNA, 22 nt, Human
uucacaacuacuuucucucucc

SEQ ID NO: 268149 - RNA, 32 nt, Human
uucacaacuggccuccccuugagguuccucca

SEQ ID NO: 268150 - RNA, 32 nt, Human
uucacaacuuucuucuacucugugccuugagc

SEQ ID NO: 268151 - RNA, 32 nt, Human
uucacaagaagaagaaugaaguccaggaggag

SEQ ID NO: 268152 - RNA, 32 nt, Human
uucacaagagauuacaaaauauacaaaaguuu

SEQ ID NO: 268153 - RNA, 32 nt, Human
uucacaagaggugucagauuaagaugugaaag

SEQ ID NO: 268154 - RNA, 32 nt, Human
uucacaagcuguucuuuguuucauaauuggau

SEQ ID NO: 268155 - RNA, 31 nt, Human
uucacaaggaaacuucugccucaggugggga

SEQ ID NO: 268156 - RNA, 32 nt, Human
uucacaagggauucuacuugacaggcaauugg

SEQ ID NO: 268157 - RNA, 32 nt, Human
uucacaaguagguuuucaccuggucauagcua

SEQ ID NO: 268158 - RNA, 32 nt, Human
uucacaagucuguaaucccagcacuuugggag

SEQ ID NO: 268159 - RNA, 32 nt, Human
uucacaauaaaggagauucacuggguucugca

SEQ ID NO: 268160 - RNA, 32 nt, Human
uucacaaucuguugcauguuguguuucaagua

SEQ ID NO: 268161 - RNA, 32 nt, Human
uucacaaugauuuuguucucugcuccauauuu

SEQ ID NO: 268162 - RNA, 32 nt, Human
uucacaaugguuuuguuucuuuccuucugauc

SEQ ID NO: 268163 - RNA, 32 nt, Human
uucacaaugugaccccgcucccaugggcuccc

SEQ ID NO: 268164 - RNA, 32 nt, Human
uucacaaugugcccaggucagcuguauaaaau

SEQ ID NO: 268165 - RNA, 23 nt, Human
uucacacaacaaccuucugcuca

SEQ ID NO: 268166 - RNA, 21 nt, Human
uucacacaacugauucauuca

SEQ ID NO: 268167 - RNA, 32 nt, Human
uucacacagaacuuuuccauaaacauuguucc

SEQ ID NO: 268168 - RNA, 32 nt, Human
uucacacagcagagucagaaguagaagccaga

SEQ ID NO: 268169 - RNA, 22 nt, Human
uucacacagcuaggucuuuuca

SEQ ID NO: 268170 - RNA, 32 nt, Human
uucacacaguguuauaguuuugccgcuggacu

SEQ ID NO: 268171 - RNA, 32 nt, Human
uucacacauauguacaaauacaugaacacagc

SEQ ID NO: 268172 - RNA, 32 nt, Human
uucacacauuuuaaaaauguuugcuacuuguu

SEQ ID NO: 268173 - RNA, 32 nt, Human
uucacaccacugcacuccagucugggcaacag

SEQ ID NO: 268174 - RNA, 32 nt, Human
uucacaccacugccauuuccuccugggcaaca

SEQ ID NO: 268175 - RNA, 32 nt, Human
uucacaccagcaguguaugaaggauccaguuu

SEQ ID NO: 268176 - RNA, 22 nt, Human
uucacaccauucuccugccuca

SEQ ID NO: 268177 - RNA, 32 nt, Human
uucacacccaccucccacaugaccuuauuuua

SEQ ID NO: 268178 - RNA, 32 nt, Human
uucacacccccauuccuccuggcuccuuaucc

SEQ ID NO: 268179 - RNA, 32 nt, Human
uucacaccgcugcacucaagcuugggugacag

SEQ ID NO: 268180 - RNA, 32 nt, Human
uucacaccuacuuuuuaaaaacaaauauuauu

SEQ ID NO: 268181 - RNA, 32 nt, Human
uucacaccucaucaaacagaacaaauaaguua

SEQ ID NO: 268182 - RNA, 32 nt, Human
uucacaccucuaaucccugcacuuugggaggc

SEQ ID NO: 268183 - RNA, 32 nt, Human
uucacaccuggcccaacaaacuagaagucaca

SEQ ID NO: 268184 - RNA, 32 nt, Human
uucacaccuguaauccaagcacuuugggaggc

SEQ ID NO: 268185 - RNA, 32 nt, Human
uucacaccuguaaucccaacacuuugggaggc

SEQ ID NO: 268186 - RNA, 32 nt, Human
uucacaccuguaaucccagcacuuugggaggc

SEQ ID NO: 268187 - RNA, 32 nt, Human
uucacaccuguaauccccgcacuuuggaaggc

SEQ ID NO: 268188 - RNA, 32 nt, Human
uucacaccuguaaucccggcacuuugggaggc

SEQ ID NO: 268189 - RNA, 32 nt, Human
uucacaccuguaaucccggcauuuugggaggc

SEQ ID NO: 268190 - RNA, 32 nt, Human
uucacaccuguaauccuagaacuuugggaggc

SEQ ID NO: 268191 - RNA, 32 nt, Human
uucacaccuguaauccuagcaguuugggaggc

SEQ ID NO: 268192 - RNA, 32 nt, Human
uucacaccuguaauugcagcacuuugggaggc

SEQ ID NO: 268193 - RNA, 32 nt, Human
uucacaccugucuucuuaaaagccuggcccuu

SEQ ID NO: 268194 - RNA, 32 nt, Human
uucacacggaggcagagguggggaugagguau

SEQ ID NO: 268195 - RNA, 32 nt, Human
uucacacuaagcugagacagcgcagguuagaa

SEQ ID NO: 268196 - RNA, 32 nt, Human
uucacacucacagagguggagcaggggcacgg

SEQ ID NO: 268197 - RNA, 32 nt, Human
uucacacucauuuuuccuuacaacaauucuga

SEQ ID NO: 268198 - RNA, 32 nt, Human
uucacacuccucugcccucgauuugcaugaag

SEQ ID NO: 268199 - RNA, 32 nt, Human
uucacacugccacucuagaaagagcggaaaug

SEQ ID NO: 268200 - RNA, 23 nt, Human
uucacacuggaaucauccaggga

SEQ ID NO: 268201 - RNA, 18 nt, Human
uucacacuggagugaaug

SEQ ID NO: 268202 - RNA, 32 nt, Human
uucacacuggcuuucuuaucugcuccagaucc

SEQ ID NO: 268203 - RNA, 32 nt, Human
uucacagaacggagaacagagcagaaaugacc

SEQ ID NO: 268204 - RNA, 32 nt, Human
uucacagaagacaggucagcugaggggccugc

SEQ ID NO: 268205 - RNA, 24 nt, Human
uucacagaccccgcaacuccugcu

SEQ ID NO: 268206 - RNA, 32 nt, Human
uucacagaccuuaggcaccagacuggaggccc

SEQ ID NO: 268207 - RNA, 32 nt, Human
uucacagacugcucuggugccugguggugcua

SEQ ID NO: 268208 - RNA, 32 nt, Human
uucacagacuuggcacuucuccagaaggagga

SEQ ID NO: 268209 - RNA, 32 nt, Human
uucacagagaucccaagguggggaggaucugc

SEQ ID NO: 268210 - RNA, 32 nt, Human
uucacagagcuccucccaccccuagaccaguu

SEQ ID NO: 268211 - RNA, 32 nt, Human
uucacagaggcagagugggcagggacaaggga

SEQ ID NO: 268212 - RNA, 32 nt, Human
uucacagauacuugaauuaauucauccaaaug

SEQ ID NO: 268213 - RNA, 32 nt, Human
uucacagaucaaggagggucuacuacagagaa

SEQ ID NO: 268214 - RNA, 32 nt, Human
uucacagaugcugcaaguucagggagcguuuu

SEQ ID NO: 268215 - RNA, 32 nt, Human
uucacagauguggaaacugaggcugagaagag

SEQ ID NO: 268216 - RNA, 32 nt, Human
uucacagauucagcucuucucuccuuacauuu

SEQ ID NO: 268217 - RNA, 32 nt, Human
uucacagcacugcacugcagccugggugacaa

SEQ ID NO: 268218 - RNA, 32 nt, Human
uucacagcagcaauaacagccaaaaaguggga

SEQ ID NO: 268219 - RNA, 32 nt, Human
uucacagcaucaucaagucauucuuuggaagu

SEQ ID NO: 268220 - RNA, 32 nt, Human
uucacagccaaggccccuuccacccucuccag

SEQ ID NO: 268221 - RNA, 20 nt, Human
uucacagccagccuaggguc

SEQ ID NO: 268222 - RNA, 32 nt, Human
uucacagccaggagaugcugggccaguuccuc

SEQ ID NO: 268223 - RNA, 32 nt, Human
uucacagccagguaaaauuuaacugguggcuu

SEQ ID NO: 268224 - RNA, 32 nt, Human
uucacagcccaggcaggacagagcagaucaca

SEQ ID NO: 268225 - RNA, 21 nt, Human
uucacagccccagcgcagguc

SEQ ID NO: 268226 - RNA, 22 nt, Human
uucacagccggucucucugcca

SEQ ID NO: 268227 - RNA, 32 nt, Human
uucacagccugccucugguucuauaaacaagu

SEQ ID NO: 268228 - RNA, 31 nt, Human
uucacagcuacucgggagguugaggcaggag

SEQ ID NO: 268229 - RNA, 32 nt, Human
uucacagcuggggaguggagccugggccugag

SEQ ID NO: 268230 - RNA, 32 nt, Human
uucacagcuugaguuaaccuugcuuuuccggg

SEQ ID NO: 268231 - RNA, 32 nt, Human
uucacaggaucuguuugaguccuguccaccgg

SEQ ID NO: 268232 - RNA, 32 nt, Human
uucacaggcagaguaguugaucucacacaacg

SEQ ID NO: 268233 - RNA, 32 nt, Human
uucacaggcagcaaaccuccuggguuugaaaa

SEQ ID NO: 268234 - RNA, 32 nt, Human
uucacaggcuuaaaauguugcuguaauguaga

SEQ ID NO: 268235 - RNA, 32 nt, Human
uucacaggcuucacugaugauaacuccaggua

SEQ ID NO: 268236 - RNA, 32 nt, Human
uucacagggagcaacugauccauuccacaaca

SEQ ID NO: 268237 - RNA, 32 nt, Human
uucacagggagcucuaaucucugugauuacau

SEQ ID NO: 268238 - RNA, 32 nt, Human
uucacagggaggcaaagcugacaugaaccuuu

SEQ ID NO: 268239 - RNA, 32 nt, Human
uucacagggcugugaggauuacagaggauaau

SEQ ID NO: 268240 - RNA, 32 nt, Human
uucacagggugggaaacgaaauucgagggaaa

SEQ ID NO: 268241 - RNA, 23 nt, Human
uucacaggugggccuuuccagcu

SEQ ID NO: 268242 - RNA, 32 nt, Human
uucacagguguauccugaacaccugagacaag

SEQ ID NO: 268243 - RNA, 32 nt, Human
uucacagguucccaaagcuggcccagaugcug

SEQ ID NO: 268244 - RNA, 32 nt, Human
uucacaguaguauaaggguugcagcugaaugg

SEQ ID NO: 268245 - RNA, 32 nt, Human
uucacagugagcugauggucucuacagggagg

SEQ ID NO: 268246 - RNA, 32 nt, Human
uucacagugcccaugguauucaugccaacauu

SEQ ID NO: 268247 - RNA, 32 nt, Human
uucacagugucaggcuggacgccgugauuuca

SEQ ID NO: 268248 - RNA, 32 nt, Human
uucacaguuagaacgcagugcugugcggaggc

SEQ ID NO: 268249 - RNA, 32 nt, Human
uucacaguuagugccauuuaagccuuucuguc

SEQ ID NO: 268250 - RNA, 32 nt, Human
uucacaguuuguuuuucuagaagagaagaaag

SEQ ID NO: 268251 - RNA, 23 nt, Human
uucacauaaggcguugcuccaug

SEQ ID NO: 268252 - RNA, 24 nt, Human
uucacauaaucugaacuuuguuca

SEQ ID NO: 268253 - RNA, 32 nt, Human
uucacauaguuccccaaaggcuuucaacgggg

SEQ ID NO: 268254 - RNA, 22 nt, Human
uucacaucaauaaaauuuacca

SEQ ID NO: 268255 - RNA, 32 nt, Human
uucacaucacuguugcaccaagccacugcaag

SEQ ID NO: 268256 - RNA, 32 nt, Human
uucacaucccagcucugccucugacaaucaga

SEQ ID NO: 268257 - RNA, 32 nt, Human
uucacauccgaaugcauacaggagaaaaaccc

SEQ ID NO: 268258 - RNA, 32 nt, Human
uucacauccucagcaucccugccuccugcauc

SEQ ID NO: 268259 - RNA, 32 nt, Human
uucacauccugggugggacagagcaggacaau

SEQ ID NO: 268260 - RNA, 32 nt, Human
uucacauccuucuccugcucucuuucaauucc

SEQ ID NO: 268261 - RNA, 32 nt, Human
uucacaucucaaggagggagaacccgggcugu

SEQ ID NO: 268262 - RNA, 32 nt, Human
uucacaucucuuuaaaggaaaggaaagaggga

SEQ ID NO: 268263 - RNA, 32 nt, Human
uucacaugaugggcaccugugggaaaccugcc

SEQ ID NO: 268264 - RNA, 32 nt, Human
uucacaugcaggaggccucucucaggugaguc

SEQ ID NO: 268265 - RNA, 32 nt, Human
uucacaugcuccauagcgaccugugggcaacg

SEQ ID NO: 268266 - RNA, 32 nt, Human
uucacaugcuuaucugagaagacuuaaguucu

SEQ ID NO: 268267 - RNA, 32 nt, Human
uucacaugggaaaguauuuuggaaugugucuu

SEQ ID NO: 268268 - RNA, 21 nt, Human
uucacauguaaucuccaguga

SEQ ID NO: 268269 - RNA, 32 nt, Human
uucacauguccucugccuucucccucuucucu

SEQ ID NO: 268270 - RNA, 32 nt, Human
uucacauucccccucggauuagagaugcucaa

SEQ ID NO: 268271 - RNA, 32 nt, Human
uucacauucuuauuguaaccuuccucauuuca

SEQ ID NO: 268272 - RNA, 32 nt, Human
uucacauuggaacaaccuucuuuccagugcua

SEQ ID NO: 268273 - RNA, 32 nt, Human
uucacauuucugcugagagaaggugacuuaac

SEQ ID NO: 268274 - RNA, 32 nt, Human
uucacauuucuuccucuucguggcugcuccuc

SEQ ID NO: 268275 - RNA, 32 nt, Human
uucacauuuguaaucccagcacuuuggaaggc

SEQ ID NO: 268276 - RNA, 32 nt, Human
uucacauuuugcagaaacuuguucacauuucc

SEQ ID NO: 268277 - RNA, 32 nt, Human
uucacauuuuuaaaauguucuagucauuuuga

SEQ ID NO: 268278 - RNA, 32 nt, Human
uucaccaaacagcuagcacucuagcuugcaug

SEQ ID NO: 268279 - RNA, 32 nt, Human
uucaccaaacugucucugccucuuccuggaga

SEQ ID NO: 268280 - RNA, 32 nt, Human
uucaccaaacugucucugccucuucucagaga

SEQ ID NO: 268281 - RNA, 32 nt, Human
uucaccaaagggaccuguuaccuggaccaggu

SEQ ID NO: 268282 - RNA, 32 nt, Human
uucaccaagccgccuccacagugccggugggc

SEQ ID NO: 268283 - RNA, 32 nt, Human
uucaccaaggaaauauugagagagaagucggc

SEQ ID NO: 268284 - RNA, 18 nt, Human
uucaccacacacucacca

SEQ ID NO: 268285 - RNA, 32 nt, Human
uucaccaccacagccaaacgggagaucuugug

SEQ ID NO: 268286 - RNA, 32 nt, Human
uucaccaccacuagugucuguccauggaguua

SEQ ID NO: 268287 - RNA, 32 nt, Human
uucaccaccauccucguucuccagggucaagg

SEQ ID NO: 268288 - RNA, 32 nt, Human
uucaccacccuccaaguccucugaccuaauuu

SEQ ID NO: 268289 - RNA, 32 nt, Human
uucaccaccugucaguaaacgggggagggggc

SEQ ID NO: 268290 - RNA, 32 nt, Human
uucaccacuaagggcaaccuccagguacacuu

SEQ ID NO: 268291 - RNA, 32 nt, Human
uucaccacugcauucuagccugggcaacagag

SEQ ID NO: 268292 - RNA, 32 nt, Human
uucaccacugcucucccagagguccagguccg

SEQ ID NO: 268293 - RNA, 32 nt, Human
uucaccacuguaugccaaggcuuuucaguucu

SEQ ID NO: 268294 - RNA, 32 nt, Human
uucaccagaagauaugcacaagaggcugggca

SEQ ID NO: 268295 - RNA, 32 nt, Human
uucaccagaccagaagccacugguguacagag

SEQ ID NO: 268296 - RNA, 32 nt, Human
uucaccagcaucucucaacagucucagcucgc

SEQ ID NO: 268297 - RNA, 30 nt, Human
uucaccagccucucuugguuccuuccuugg

SEQ ID NO: 268298 - RNA, 20 nt, Human
uucaccagcuccuccuuagc

SEQ ID NO: 268299 - RNA, 21 nt, Human
uucaccagcucuccagcacuu

SEQ ID NO: 268300 - RNA, 32 nt, Human
uucaccagcugaugacacuuccaaagagauua

SEQ ID NO: 268301 - RNA, 32 nt, Human
uucaccagcugcaugaccuugagcagugcacu

SEQ ID NO: 268302 - RNA, 32 nt, Human
uucaccagcugggcugggccagccuggcccug

SEQ ID NO: 268303 - RNA, 20 nt, Human
uucaccagcuuagcuugagc

SEQ ID NO: 268304 - RNA, 32 nt, Human
uucaccaggacccagacccuuggcaagggaua

SEQ ID NO: 268305 - RNA, 21 nt, Human
uucaccagguuuuuggugcca

SEQ ID NO: 268306 - RNA, 32 nt, Human
uucaccaguaggagguuggacuagaugaacuc

SEQ ID NO: 268307 - RNA, 32 nt, Human
uucaccagugcacuccagccugggugacagag

SEQ ID NO: 268308 - RNA, 32 nt, Human
uucaccaguuaagcacaugaguagagaaagag

SEQ ID NO: 268309 - RNA, 32 nt, Human
uucaccauauccaaggaguauaacuagugcug

SEQ ID NO: 268310 - RNA, 32 nt, Human
uucaccaucauuaacagcaaacaaaugggaag

SEQ ID NO: 268311 - RNA, 32 nt, Human
uucaccaucauuaggaaugugaccauuccuau

SEQ ID NO: 268312 - RNA, 32 nt, Human
uucaccauccaucugccccacgcuccaagccu

SEQ ID NO: 268313 - RNA, 32 nt, Human
uucaccaucccuuggccauccuggcccuccca

SEQ ID NO: 268314 - RNA, 32 nt, Human
uucaccaucuuucugauuccgcacccugccua

SEQ ID NO: 268315 - RNA, 31 nt, Human
uucaccauggccuccaaccacccggccuuca

SEQ ID NO: 268316 - RNA, 32 nt, Human
uucaccaugugggccaggcuggucuugaacuc

SEQ ID NO: 268317 - RNA, 32 nt, Human
uucaccauguuaccaggauggucuccaucucc

SEQ ID NO: 268318 - RNA, 32 nt, Human
uucaccauguuaccaggauggucuugaucucc

SEQ ID NO: 268319 - RNA, 32 nt, Human
uucaccauguuagccaggcugaucuugaacuc

SEQ ID NO: 268320 - RNA, 32 nt, Human
uucaccauguucgccaggcuggucuggaacuc

SEQ ID NO: 268321 - RNA, 32 nt, Human
uucaccauguugaccaggcuggucuugaacuc

SEQ ID NO: 268322 - RNA, 32 nt, Human
uucaccauguugaccaggcuggucuugaacug

SEQ ID NO: 268323 - RNA, 32 nt, Human
uucaccauguuggccaggauguucucgaucuc

SEQ ID NO: 268324 - RNA, 32 nt, Human
uucaccauguuggccaggcugaucuggaacuc

SEQ ID NO: 268325 - RNA, 32 nt, Human
uucaccauguuggccaggcuggucaagaacuc

SEQ ID NO: 268326 - RNA, 32 nt, Human
uucaccauguuggccaggcuggucuggaaccc

SEQ ID NO: 268327 - RNA, 32 nt, Human
uucaccauguuggccaggcuggucuggaacuc

SEQ ID NO: 268328 - RNA, 32 nt, Human
uucaccauguuggucaggauggucucaauccu

SEQ ID NO: 268329 - RNA, 32 nt, Human
uucaccauguuguccaggcuggucacgaacuc

SEQ ID NO: 268330 - RNA, 32 nt, Human
uucacccaaugccucacugaucugccccaaug

SEQ ID NO: 268331 - RNA, 32 nt, Human
uucacccacuccacuuuccuccacagaugccu

SEQ ID NO: 268332 - RNA, 32 nt, Human
uucacccacugccucugccucccuggggcaga

SEQ ID NO: 268333 - RNA, 32 nt, Human
uucacccacuggcuucccccuucccacugaag

SEQ ID NO: 268334 - RNA, 18 nt, Human
uucacccagcaccagcgg

SEQ ID NO: 268335 - RNA, 32 nt, Human
uucacccagccacauuuauccaucuuguaaaa

SEQ ID NO: 268336 - RNA, 32 nt, Human
uucacccagcuacucaggaggcugaggcagga

SEQ ID NO: 268337 - RNA, 23 nt, Human
uucacccagguguccaggcaaug

SEQ ID NO: 268338 - RNA, 32 nt, Human
uucacccauacuuccauuucuuuauucaauaa

SEQ ID NO: 268339 - RNA, 32 nt, Human
uucaccccaaagugcugggauuacaggcguga

SEQ ID NO: 268340 - RNA, 32 nt, Human
uucaccccaagcccaccucccuuguccucagc

SEQ ID NO: 268341 - RNA, 32 nt, Human
uucaccccaccaggcuugggaggaagugccug

SEQ ID NO: 268342 - RNA, 32 nt, Human
uucaccccacuuccucugggcccuggcugugg

SEQ ID NO: 268343 - RNA, 32 nt, Human
uucaccccagccuguaguccuccucacuucaa

SEQ ID NO: 268344 - RNA, 24 nt, Human
uucaccccagcuccuucauucaca

SEQ ID NO: 268345 - RNA, 32 nt, Human
uucaccccaguggccugcagaccucagcuucu

SEQ ID NO: 268346 - RNA, 32 nt, Human
uucaccccaugucccagagccucagaacccac

SEQ ID NO: 268347 - RNA, 32 nt, Human
uucaccccauuuucugugguuugggcuccaca

SEQ ID NO: 268348 - RNA, 19 nt, Human
uucacccccaccucagguc

SEQ ID NO: 268349 - RNA, 32 nt, Human
uucacccccucagaaaccacugucauuaguuu

SEQ ID NO: 268350 - RNA, 32 nt, Human
uucaccccggcaggcccugcaguguucgcuug

SEQ ID NO: 268351 - RNA, 32 nt, Human
uucaccccucaccuccagccuggaggagacag

SEQ ID NO: 268352 - RNA, 32 nt, Human
uucaccccuccccuuucaccaccauccucuuu

SEQ ID NO: 268353 - RNA, 32 nt, Human
uucaccccugaacuaagacacagggaguauuu

SEQ ID NO: 268354 - RNA, 32 nt, Human
uucaccccuuccccucucccuugggcucugau

SEQ ID NO: 268355 - RNA, 32 nt, Human
uucaccccuucccucacccucuucuuucguca

SEQ ID NO: 268356 - RNA, 32 nt, Human
uucaccccuuucucucaccccuggagccccgu

SEQ ID NO: 268357 - RNA, 32 nt, Human
uucacccgaaggcagagagacuccagaccccg

SEQ ID NO: 268358 - RNA, 32 nt, Human
uucacccgauccugggcucucccuuccaagcu

SEQ ID NO: 268359 - RNA, 32 nt, Human
uucacccgcacaccguccgcgcacgccugagg

SEQ ID NO: 268360 - RNA, 32 nt, Human
uucacccgggucucccugucucagcaccuccu

SEQ ID NO: 268361 - RNA, 19 nt, Human
uucacccgugugugcaaug

SEQ ID NO: 268362 - RNA, 32 nt, Human
uucacccuacauuccucuccucuucacuagcc

SEQ ID NO: 268363 - RNA, 32 nt, Human
uucacccuccacccccucccccgcucccgccc

SEQ ID NO: 268364 - RNA, 32 nt, Human
uucacccugcccccugggccugaggcccccug

SEQ ID NO: 268365 - RNA, 32 nt, Human
uucacccugggcaacagagugagaccccaucu

SEQ ID NO: 268366 - RNA, 32 nt, Human
uucacccuguucuagaagcacaugguuguccu

SEQ ID NO: 268367 - RNA, 32 nt, Human
uucacccuugcauuccagccugugaaauaaag

SEQ ID NO: 268368 - RNA, 25 nt, Human
uucacccuugugacucucucagagg

SEQ ID NO: 268369 - RNA, 32 nt, Human
uucaccgaggcacugccaccaccagcucuagc

SEQ ID NO: 268370 - RNA, 32 nt, Human
uucaccgaugucagcauuuuacccagagccau

SEQ ID NO: 268371 - RNA, 32 nt, Human
uucaccgcagcuugucugaaacucuuagccug

SEQ ID NO: 268372 - RNA, 32 nt, Human
uucaccgcaggcacuucugaguaccauuccau

SEQ ID NO: 268373 - RNA, 32 nt, Human
uucaccgcaguugaggcuguugcaguggucuc

SEQ ID NO: 268374 - RNA, 32 nt, Human
uucaccgcauuccaggggcugcagcccccugc

SEQ ID NO: 268375 - RNA, 32 nt, Human
uucaccgccauggagaaggcuggggcucauuu

SEQ ID NO: 268376 - RNA, 32 nt, Human
uucaccgcugcucaccaccacacucaaccguc

SEQ ID NO: 268377 - RNA, 32 nt, Human
uucaccggcggcagcaguuucagcgugcaguu

SEQ ID NO: 268378 - RNA, 32 nt, Human
uucaccggcuuccuuauuuuauacguaaaaau

SEQ ID NO: 268379 - RNA, 32 nt, Human
uucaccgucgcgccgacucuccggagggaaac

SEQ ID NO: 268380 - RNA, 30 nt, Human
uucaccgucggcucccugcuccugucagaa

SEQ ID NO: 268381 - RNA, 32 nt, Human
uucaccguguuagccaggauguucucgaucuc

SEQ ID NO: 268382 - RNA, 32 nt, Human
uucaccguguuggccaggcuggucuggaacuc

SEQ ID NO: 268383 - RNA, 32 nt, Human
uucaccuaaguuucugccacagcuccacauga

SEQ ID NO: 268384 - RNA, 32 nt, Human
uucaccuacuggcauccuccagcuucccuggu

SEQ ID NO: 268385 - RNA, 32 nt, Human
uucaccuagagaagacaguauuggcaaucaug

SEQ ID NO: 268386 - RNA, 32 nt, Human
uucaccuagagucuagaacacaauuuaauuua

SEQ ID NO: 268387 - RNA, 32 nt, Human
uucaccuaggugaggugugugcagcaguuggu

SEQ ID NO: 268388 - RNA, 22 nt, Human
uucaccuauuauauuguaccca

SEQ ID NO: 268389 - RNA, 32 nt, Human
uucaccucaccuuucugcaaagcagaaaaagu

SEQ ID NO: 268390 - RNA, 32 nt, Human
uucaccucacuccagccugggugacagcguaa

SEQ ID NO: 268391 - RNA, 32 nt, Human
uucaccuccaaguuuuaccuccugugucuucc

SEQ ID NO: 268392 - RNA, 32 nt, Human
uucaccuccaggaacugucauggauguccaaa

SEQ ID NO: 268393 - RNA, 32 nt, Human
uucaccucccaccaugauucugaggccucccc

SEQ ID NO: 268394 - RNA, 32 nt, Human
uucaccucccgccaugauucugaggccucccc

SEQ ID NO: 268395 - RNA, 32 nt, Human
uucaccucccuccaacccuacauuucuucaga

SEQ ID NO: 268396 - RNA, 32 nt, Human
uucaccuccugccagcaaccccaaacccaagu

SEQ ID NO: 268397 - RNA, 32 nt, Human
uucaccucuaaggggcucugcaacgugauaga

SEQ ID NO: 268398 - RNA, 32 nt, Human
uucaccucugucuguuggaagcaguacuuuuu

SEQ ID NO: 268399 - RNA, 32 nt, Human
uucaccucuuagccuuguucuccucacuagca

SEQ ID NO: 268400 - RNA, 32 nt, Human
uucaccucuuucuccccacugccuacgugccu

SEQ ID NO: 268401 - RNA, 32 nt, Human
uucaccugacuuaaaauauaaaaugcuaaauu

SEQ ID NO: 268402 - RNA, 32 nt, Human
uucaccugaugccucugcagcuacacaauccc

SEQ ID NO: 268403 - RNA, 32 nt, Human
uucaccugcagucccagcuacuugggaggcca

SEQ ID NO: 268404 - RNA, 32 nt, Human
uucaccugcccacuuguccccugcugccugcc

SEQ ID NO: 268405 - RNA, 32 nt, Human
uucaccugcccugugcaugucuggacucacgg

SEQ ID NO: 268406 - RNA, 32 nt, Human
uucaccugcugaugcugcccuggguccagacu

SEQ ID NO: 268407 - RNA, 32 nt, Human
uucaccuggacuaucuaaccaguccuaugaau

SEQ ID NO: 268408 - RNA, 32 nt, Human
uucaccugguauccagcuccagcaacuuagag

SEQ ID NO: 268409 - RNA, 23 nt, Human
uucaccuguaaucccagcacuuu

SEQ ID NO: 268410 - RNA, 32 nt, Human
uucaccuguagucccagcugcucuggaguuug

SEQ ID NO: 268411 - RNA, 32 nt, Human
uucaccuguggacaaccuggcugggggugggg

SEQ ID NO: 268412 - RNA, 32 nt, Human
uucaccuguguuugccaugcaggaacaugagc

SEQ ID NO: 268413 - RNA, 32 nt, Human
uucaccuguuagccaggauggucucaaucucc

SEQ ID NO: 268414 - RNA, 32 nt, Human
uucaccuguucuggaggcaccagaccuugaaa

SEQ ID NO: 268415 - RNA, 32 nt, Human
uucaccuguuuaaaagaaaacauugcaucuca

SEQ ID NO: 268416 - RNA, 32 nt, Human
uucaccuuaccccauagcaucuugcggcccag

SEQ ID NO: 268417 - RNA, 32 nt, Human
uucaccuuauguauuauuuucuauagcucuuc

SEQ ID NO: 268418 - RNA, 32 nt, Human
uucaccuucaccuuacaccgugagugauucca

SEQ ID NO: 268419 - RNA, 32 nt, Human
uucaccuucauaccuuuggugccugcauugua

SEQ ID NO: 268420 - RNA, 21 nt, Human
uucaccuuccagcuuccucag

SEQ ID NO: 268421 - RNA, 23 nt, Human
uucaccuuccccagucccagggg

SEQ ID NO: 268422 - RNA, 32 nt, Human
uucaccuuccucuucguuuacgguuaggacau

SEQ ID NO: 268423 - RNA, 32 nt, Human
uucaccuuccugagagaggaccagcggccaga

SEQ ID NO: 268424 - RNA, 32 nt, Human
uucaccuugccaagacacccacacuacuuugg

SEQ ID NO: 268425 - RNA, 32 nt, Human
uucaccuugccucuggccuuguauuucacacc

SEQ ID NO: 268426 - RNA, 20 nt, Human
uucaccuuggacuuuccagc

SEQ ID NO: 268427 - RNA, 32 nt, Human
uucaccuuuaaucccagcuacuugggaggcug

SEQ ID NO: 268428 - RNA, 23 nt, Human
uucaccuuuccucuccuggcggg

SEQ ID NO: 268429 - RNA, 24 nt, Human
uucaccuuuccucuccuggcgggg

SEQ ID NO: 268430 - RNA, 32 nt, Human
uucacgaagaauucaggggaugugggaagugg

SEQ ID NO: 268431 - RNA, 23 nt, Human
uucacgaaggcuuuguguugcca

SEQ ID NO: 268432 - RNA, 32 nt, Human
uucacgaauguauacucagugcccagcacaua

SEQ ID NO: 268433 - RNA, 32 nt, Human
uucacgaauguuggcccugccuagauguugug

SEQ ID NO: 268434 - RNA, 32 nt, Human
uucacgacaauguugagaaguucccauuauua

SEQ ID NO: 268435 - RNA, 23 nt, Human
uucacgacaguccggguaacaua

SEQ ID NO: 268436 - RNA, 24 nt, Human
uucacgaccagccuggccaacaug

SEQ ID NO: 268437 - RNA, 32 nt, Human
uucacgaccagccuggccaacauggugaaacc

SEQ ID NO: 268438 - RNA, 32 nt, Human
uucacgaccagccuggccaacauugugaaacc

SEQ ID NO: 268439 - RNA, 32 nt, Human
uucacgacuguacauugcuuucagugaccuua

SEQ ID NO: 268440 - RNA, 21 nt, Human
uucacgagcugcuccuugagc

SEQ ID NO: 268441 - RNA, 32 nt, Human
uucacgaggaagcagcacuaaagcacucugaa

SEQ ID NO: 268442 - RNA, 32 nt, Human
uucacgaggguaauccagaugaagguauauca

SEQ ID NO: 268443 - RNA, 32 nt, Human
uucacgaugguuuugugccagcucuuuuuagg

SEQ ID NO: 268444 - RNA, 32 nt, Human
uucacgcacacaggagauggggcaguuaaugc

SEQ ID NO: 268445 - RNA, 32 nt, Human
uucacgccaucccggcgaguccaggggaggag

SEQ ID NO: 268446 - RNA, 22 nt, Human
uucacgccauucuccugccuca

SEQ ID NO: 268447 - RNA, 32 nt, Human
uucacgcccagccucugccucacaguggaccc

SEQ ID NO: 268448 - RNA, 32 nt, Human
uucacgcccucuuguuuccuuuugggcucaaa

SEQ ID NO: 268449 - RNA, 32 nt, Human
uucacgccuguaauccagcacugugggaggcc

SEQ ID NO: 268450 - RNA, 32 nt, Human
uucacgccuguaaucccaauacuuugggaggc

SEQ ID NO: 268451 - RNA, 32 nt, Human
uucacgccuguaaucccagaacucugggaagc

SEQ ID NO: 268452 - RNA, 32 nt, Human
uucacgccuguaaucccagcacuuugagaggc

SEQ ID NO: 268453 - RNA, 32 nt, Human
uucacgccuguaaucccagcacuuugggaggc

SEQ ID NO: 268454 - RNA, 32 nt, Human
uucacgccuguaaucccagcacuuugggaugc

SEQ ID NO: 268455 - RNA, 32 nt, Human
uucacgccuguaaugccagcacuuugggaggc

SEQ ID NO: 268456 - RNA, 32 nt, Human
uucacgccuguaauucuagcacuuugggaggc

SEQ ID NO: 268457 - RNA, 32 nt, Human
uucacgcguucgguccuccuuggcugacucac

SEQ ID NO: 268458 - RNA, 32 nt, Human
uucacgcuuguaaucccaucacuuugggaggc

SEQ ID NO: 268459 - RNA, 32 nt, Human
uucacggaccgggagagagggggcgcggaagg

SEQ ID NO: 268460 - RNA, 32 nt, Human
uucacggagagcaggagcagaggcuuugagaa

SEQ ID NO: 268461 - RNA, 32 nt, Human
uucacggauccaagacuucccaacaagauuca

SEQ ID NO: 268462 - RNA, 32 nt, Human
uucacggcgauucuccccaugggaucuugagg

SEQ ID NO: 268463 - RNA, 32 nt, Human
uucacggcuaaagcaaucguucagagagacag

SEQ ID NO: 268464 - RNA, 32 nt, Human
uucacggcucaagugaagccacguuucacugu

SEQ ID NO: 268465 - RNA, 32 nt, Human
uucacgggacuuccagcuccagcuaccuuugu

SEQ ID NO: 268466 - RNA, 32 nt, Human
uucacggugcgcuggggaagcuucaaaauaua

SEQ ID NO: 268467 - RNA, 32 nt, Human
uucacguagacacaccuggcugccuucuucac

SEQ ID NO: 268468 - RNA, 32 nt, Human
uucacguccaaaaauccacauucuccaucgcu

SEQ ID NO: 268469 - RNA, 32 nt, Human
uucacgugcccaggccuguggguaguggggag

SEQ ID NO: 268470 - RNA, 32 nt, Human
uucacguggagaggaaggauauuuugcgaagc

SEQ ID NO: 268471 - RNA, 32 nt, Human
uucacgugggccggagucggagacugaguuua

SEQ ID NO: 268472 - RNA, 32 nt, Human
uucacguuccaucgugucaucugggucuguua

SEQ ID NO: 268473 - RNA, 32 nt, Human
uucacuacagaugcaaccauuguuaagccuga

SEQ ID NO: 268474 - RNA, 32 nt, Human
uucacuaccucagaucuaaucaauuaguccau

SEQ ID NO: 268475 - RNA, 32 nt, Human
uucacuaggagaggagaaacacaauggccacc

SEQ ID NO: 268476 - RNA, 32 nt, Human
uucacuaggaggucaucaaccgaugguccuca

SEQ ID NO: 268477 - RNA, 32 nt, Human
uucacuauggaaaaacaaauauacaaauauga

SEQ ID NO: 268478 - RNA, 32 nt, Human
uucacuauguuggccaggcuggucuggaacgc

SEQ ID NO: 268479 - RNA, 32 nt, Human
uucacucaaggcccaaggacccuucagucagc

SEQ ID NO: 268480 - RNA, 32 nt, Human
uucacucaauaugcagcuuccuguuucaguag

SEQ ID NO: 268481 - RNA, 32 nt, Human
uucacucaaugccaggcagugcagcauuuagg

SEQ ID NO: 268482 - RNA, 32 nt, Human
uucacucacgucagaagagguuggggcaaaac

SEQ ID NO: 268483 - RNA, 32 nt, Human
uucacucagaccaucugugcucugcccugagu

SEQ ID NO: 268484 - RNA, 32 nt, Human
uucacucagagguuuguccugaggcuuaaaug

SEQ ID NO: 268485 - RNA, 32 nt, Human
uucacucagcaaccaugcccuuagucugaaga

SEQ ID NO: 268486 - RNA, 32 nt, Human
uucacucagucgcccaggcuggagugcagugg

SEQ ID NO: 268487 - RNA, 32 nt, Human
uucacucauagaacauuuguugagcaauuacu

SEQ ID NO: 268488 - RNA, 32 nt, Human
uucacucaugaagaguggggauggcucaguuc

SEQ ID NO: 268489 - RNA, 32 nt, Human
uucacucauggacccuggagccagccacugac

SEQ ID NO: 268490 - RNA, 32 nt, Human
uucacuccaaaauugugugagccaauucccau

SEQ ID NO: 268491 - RNA, 32 nt, Human
uucacuccacacccucuggccuucugccuuga

SEQ ID NO: 268492 - RNA, 21 nt, Human
uucacuccagccugggcaaca

SEQ ID NO: 268493 - RNA, 32 nt, Human
uucacuccagccugggcaacagagugagacuc

SEQ ID NO: 268494 - RNA, 21 nt, Human
uucacuccagccugggcgaca

SEQ ID NO: 268495 - RNA, 32 nt, Human
uucacuccagccugggcgacaagagugaaacu

SEQ ID NO: 268496 - RNA, 32 nt, Human
uucacuccagccugggugacaaagugagacuc

SEQ ID NO: 268497 - RNA, 32 nt, Human
uucacuccagccugggugacggagugagacuc

SEQ ID NO: 268498 - RNA, 32 nt, Human
uucacuccauuccccugucugucugcauuugu

SEQ ID NO: 268499 - RNA, 32 nt, Human
uucacucccaacucugagguugccuaacucuu

SEQ ID NO: 268500 - RNA, 32 nt, Human
uucacucccacugccugggauugcacuggauc

SEQ ID NO: 268501 - RNA, 32 nt, Human
uucacucccaggaccuaccuucugcuaguaaa

SEQ ID NO: 268502 - RNA, 32 nt, Human
uucacuccccuaucccauucucccucucaagg

SEQ ID NO: 268503 - RNA, 32 nt, Human
uucacuccccuccagagagcccugagacccgc

SEQ ID NO: 268504 - RNA, 32 nt, Human
uucacucccgagggugccgcgagcccaggcgg

SEQ ID NO: 268505 - RNA, 32 nt, Human
uucacucccuggaagagagagaggggucuugg

SEQ ID NO: 268506 - RNA, 32 nt, Human
uucacucccuuguuuucccuguugcuaugugu

SEQ ID NO: 268507 - RNA, 32 nt, Human
uucacuccucaggaaguaccauggacagacgc

SEQ ID NO: 268508 - RNA, 32 nt, Human
uucacuccuccccuucuuccaugucuccucag

SEQ ID NO: 268509 - RNA, 32 nt, Human
uucacuccucguucuugugcuugguucuuacu

SEQ ID NO: 268510 - RNA, 32 nt, Human
uucacuccucucccuuucaucucccucugcau

SEQ ID NO: 268511 - RNA, 32 nt, Human
uucacuccuuguuggguaacucagccauggag

SEQ ID NO: 268512 - RNA, 22 nt, Human
uucacuccuuucuccccuucca

SEQ ID NO: 268513 - RNA, 32 nt, Human
uucacucggaucacgcccuccugggcacaggu

SEQ ID NO: 268514 - RNA, 32 nt, Human
uucacucucaggagaacccacagucuaauauu

SEQ ID NO: 268515 - RNA, 32 nt, Human
uucacucucccacuucuguggucaacucccug

SEQ ID NO: 268516 - RNA, 32 nt, Human
uucacucucccuugaucccggccaccugcaga

SEQ ID NO: 268517 - RNA, 32 nt, Human
uucacucuccucccuucuccagccucagggga

SEQ ID NO: 268518 - RNA, 21 nt, Human
uucacucuccucuccccuccc

SEQ ID NO: 268519 - RNA, 32 nt, Human
uucacucugacucugugcaaauuguauuacag

SEQ ID NO: 268520 - RNA, 32 nt, Human
uucacucugccccucacuuccuuuagggcaaa

SEQ ID NO: 268521 - RNA, 32 nt, Human
uucacucugggagagcgaugcuaaguuucucc

SEQ ID NO: 268522 - RNA, 32 nt, Human
uucacucugucacccaggcuggagugcaaugg

SEQ ID NO: 268523 - RNA, 32 nt, Human
uucacucugucacccaggcuggagugcagugg

SEQ ID NO: 268524 - RNA, 32 nt, Human
uucacucugucacccaggcugggaauugcagu

SEQ ID NO: 268525 - RNA, 32 nt, Human
uucacucuguccuuacucugguguuucacugu

SEQ ID NO: 268526 - RNA, 32 nt, Human
uucacucugucgcccaggcuggagugcagugg

SEQ ID NO: 268527 - RNA, 32 nt, Human
uucacucugucucccaggcuggagugcaaugg

SEQ ID NO: 268528 - RNA, 32 nt, Human
uucacucugucucccaggcuggagugcagugg

SEQ ID NO: 268529 - RNA, 32 nt, Human
uucacucuguuccucuucugcagccaccagug

SEQ ID NO: 268530 - RNA, 32 nt, Human
uucacucuguugcccaggcuagagugcacuaa

SEQ ID NO: 268531 - RNA, 32 nt, Human
uucacucuguugcccaggcuggagugcagugg

SEQ ID NO: 268532 - RNA, 32 nt, Human
uucacucuuaccaagaaucuuugaugcagcuu

SEQ ID NO: 268533 - RNA, 32 nt, Human
uucacucuuccuacccucucccuccuaacccu

SEQ ID NO: 268534 - RNA, 32 nt, Human
uucacucuucgaauuugugcuuagcucuuuuc

SEQ ID NO: 268535 - RNA, 32 nt, Human
uucacucuuggagccugcagagcugcgggcug

SEQ ID NO: 268536 - RNA, 32 nt, Human
uucacucuuguccucacagacuuucagccucc

SEQ ID NO: 268537 - RNA, 32 nt, Human
uucacucuugugcccaggcuggagugcaauag

SEQ ID NO: 268538 - RNA, 23 nt, Human
uucacucuuguugcccaagcugg

SEQ ID NO: 268539 - RNA, 23 nt, Human
uucacucuuguugcccacgcugg

SEQ ID NO: 268540 - RNA, 23 nt, Human
uucacucuuguugcccaggcugg

SEQ ID NO: 268541 - RNA, 23 nt, Human
uucacucuuguugccuaggcugg

SEQ ID NO: 268542 - RNA, 23 nt, Human
uucacucuuguugccugggcugg

SEQ ID NO: 268543 - RNA, 32 nt, Human
uucacucuuucauaauauauaggauaaauugu

SEQ ID NO: 268544 - RNA, 32 nt, Human
uucacucuuucgcccaggcuggagugcauugg

SEQ ID NO: 268545 - RNA, 19 nt, Human
uucacugaccccaucucca

SEQ ID NO: 268546 - RNA, 32 nt, Human
uucacugacccuaugauuucacugugaguagg

SEQ ID NO: 268547 - RNA, 32 nt, Human
uucacugcaaccucugccuccugggcucaagc

SEQ ID NO: 268548 - RNA, 32 nt, Human
uucacugcaaccucugccuccuggguucaagc

SEQ ID NO: 268549 - RNA, 32 nt, Human
uucacugcaaccucugccuccuggguucaagu

SEQ ID NO: 268550 - RNA, 32 nt, Human
uucacugcaaucucugccuccuggguuuaagc

SEQ ID NO: 268551 - RNA, 32 nt, Human
uucacugcacuccagucugggugacagagcaa

SEQ ID NO: 268552 - RNA, 32 nt, Human
uucacugcagggacccagacaaguggaucugc

SEQ ID NO: 268553 - RNA, 22 nt, Human
uucacugcauccuggagugcaa

SEQ ID NO: 268554 - RNA, 26 nt, Human
uucacugcaugaaguuguucauuugg

SEQ ID NO: 268555 - RNA, 19 nt, Human
uucacugccucugcuucca

SEQ ID NO: 268556 - RNA, 32 nt, Human
uucacugccugccucuugcggaacuggguuac

SEQ ID NO: 268557 - RNA, 32 nt, Human
uucacuggcucuauaacagucuaccucuacac

SEQ ID NO: 268558 - RNA, 32 nt, Human
uucacuggcugcugccccaggaagacuccucu

SEQ ID NO: 268559 - RNA, 32 nt, Human
uucacugggcucaccugcuucugaaaacggcu

SEQ ID NO: 268560 - RNA, 32 nt, Human
uucacugguggacagugguggggcuugagugc

SEQ ID NO: 268561 - RNA, 32 nt, Human
uucacugguggagcuggaggagccggaggugg

SEQ ID NO: 268562 - RNA, 32 nt, Human
uucacugguggaggcagccguggucugccagg

SEQ ID NO: 268563 - RNA, 32 nt, Human
uucacugguuccagggauuaaggaaugaaccu

SEQ ID NO: 268564 - RNA, 32 nt, Human
uucacuguaguauuuaaauaucuguuacaggu

SEQ ID NO: 268565 - RNA, 32 nt, Human
uucacuguauucucaaccuccuaggcucaaau

SEQ ID NO: 268566 - RNA, 32 nt, Human
uucacugucaccaaggcuuagugcagugacac

SEQ ID NO: 268567 - RNA, 32 nt, Human
uucacuguccccaaaccuauggaaguuguugc

SEQ ID NO: 268568 - RNA, 23 nt, Human
uucacugucuaccuccagaaccu

SEQ ID NO: 268569 - RNA, 32 nt, Human
uucacugucuccauuccauaaaucucuuccug

SEQ ID NO: 268570 - RNA, 32 nt, Human
uucacugugauauuucaggggcagaguguugg

SEQ ID NO: 268571 - RNA, 32 nt, Human
uucacugugucagggaugagccuggcuugggg

SEQ ID NO: 268572 - RNA, 32 nt, Human
uucacuguguccuggcugucucugcugcccau

SEQ ID NO: 268573 - RNA, 32 nt, Human
uucacuguguugcccaggcuagagugcagugg

SEQ ID NO: 268574 - RNA, 24 nt, Human
uucacuguugauguguuuguuugg

SEQ ID NO: 268575 - RNA, 32 nt, Human
uucacuguuuauguucacgugaucucaacagg

SEQ ID NO: 268576 - RNA, 32 nt, Human
uucacuuaccuugccuaguguaucuuaucccu

SEQ ID NO: 268577 - RNA, 23 nt, Human
uucacuuagcaacaaaguaccuu

SEQ ID NO: 268578 - RNA, 32 nt, Human
uucacuuagugguuguguugggaccaaaaccu

SEQ ID NO: 268579 - RNA, 32 nt, Human
uucacuucaaccucaaccucccaggcucaagu

SEQ ID NO: 268580 - RNA, 32 nt, Human
uucacuucaauuuugaccucugucccauagug

SEQ ID NO: 268581 - RNA, 32 nt, Human
uucacuucacuggcucccucaggcugcagccc

SEQ ID NO: 268582 - RNA, 32 nt, Human
uucacuucauuccuugagcugugugaccuugg

SEQ ID NO: 268583 - RNA, 32 nt, Human
uucacuuccccucuaggaggugaugauagggu

SEQ ID NO: 268584 - RNA, 32 nt, Human
uucacuucucacucuuauggucucaaagcuuc

SEQ ID NO: 268585 - RNA, 32 nt, Human
uucacuugaagccaaaugaaagagaugaauaa

SEQ ID NO: 268586 - RNA, 32 nt, Human
uucacuugauacuauaugauaugaaccuuuuu

SEQ ID NO: 268587 - RNA, 21 nt, Human
uucacuugcaugacguuacug

SEQ ID NO: 268588 - RNA, 32 nt, Human
uucacuugcucauccuugcucuaccucaacgu

SEQ ID NO: 268589 - RNA, 21 nt, Human
uucacuuggcacccauuaucu

SEQ ID NO: 268590 - RNA, 32 nt, Human
uucacuuggucugucugucucugucuugguag

SEQ ID NO: 268591 - RNA, 18 nt, Human
uucacuugucuauacuaa

SEQ ID NO: 268592 - RNA, 32 nt, Human
uucacuuguuacuguuacugggagagggagac

SEQ ID NO: 268593 - RNA, 32 nt, Human
uucacuuuacuacauccugccccacauucuga

SEQ ID NO: 268594 - RNA, 32 nt, Human
uucacuuucacucccaugaggaggcuuccagg

SEQ ID NO: 268595 - RNA, 32 nt, Human
uucacuuugcagccuccucuucugucaccaac

SEQ ID NO: 268596 - RNA, 32 nt, Human
uucacuuugcuccucuugcccucugucuucug

SEQ ID NO: 268597 - RNA, 20 nt, Human
uucacuuugguuccagcauc

SEQ ID NO: 268598 - RNA, 32 nt, Human
uucacuuugucaagcaccucaguuacacauuc

SEQ ID NO: 268599 - RNA, 32 nt, Human
uucacuuuguucauuucucuucuguuuucugu

SEQ ID NO: 268600 - RNA, 29 nt, Human
uucacuuuguugcuaucauccuccuuucu

SEQ ID NO: 268601 - RNA, 32 nt, Human
uucacuuuuaaucuuuccuuugaaauuauuaa

SEQ ID NO: 268602 - RNA, 32 nt, Human
uucacuuuuacacuggcauuccugccuacuug

SEQ ID NO: 268603 - RNA, 32 nt, Human
uucacuuuuuauccucccuggagcuacagcug

SEQ ID NO: 268604 - RNA, 32 nt, Human
uucagaaaaagaaucugcauccuggaaaccag

SEQ ID NO: 268605 - RNA, 32 nt, Human
uucagaaaacaguuuccagugccucuggccuu

SEQ ID NO: 268606 - RNA, 32 nt, Human
uucagaaacagcuugagagcuggaauggacag

SEQ ID NO: 268607 - RNA, 32 nt, Human
uucagaaacauguaaaaugaaucaugauuaua

SEQ ID NO: 268608 - RNA, 23 nt, Human
uucagaaacauuguauuguacca

SEQ ID NO: 268609 - RNA, 32 nt, Human
uucagaaacccacuuuguucucagccacgcaa

SEQ ID NO: 268610 - RNA, 32 nt, Human
uucagaaacuggaguaguucuuugccagugca

SEQ ID NO: 268611 - RNA, 32 nt, Human
uucagaaagaaguggggacagagcagaacuuu

SEQ ID NO: 268612 - RNA, 31 nt, Human
uucagaaagagaccuacucugggucauuuaa

SEQ ID NO: 268613 - RNA, 32 nt, Human
uucagaaagggcagaagugggggaagaauaau

SEQ ID NO: 268614 - RNA, 31 nt, Human
uucagaaaggggagagaaagaaguccugugg

SEQ ID NO: 268615 - RNA, 32 nt, Human
uucagaaaucugauuauaacaauagcuccauc

SEQ ID NO: 268616 - RNA, 32 nt, Human
uucagaacacacaaaccaugcucuacuccacc

SEQ ID NO: 268617 - RNA, 32 nt, Human
uucagaacacacaaccuucuaacgugaaccuc

SEQ ID NO: 268618 - RNA, 32 nt, Human
uucagaacauccugggcaccagucaugagucu

SEQ ID NO: 268619 - RNA, 24 nt, Human
uucagaaccacucugggcaacaua

SEQ ID NO: 268620 - RNA, 32 nt, Human
uucagaaccagccuggacaacauagugagacc

SEQ ID NO: 268621 - RNA, 32 nt, Human
uucagaaccaucaaugaauucagauaugggaa

SEQ ID NO: 268622 - RNA, 32 nt, Human
uucagaacccacgcuuucccacccuccuacuu

SEQ ID NO: 268623 - RNA, 23 nt, Human
uucagaacgcaucuguaguguca

SEQ ID NO: 268624 - RNA, 32 nt, Human
uucagaacugaaaacuccaccuuccguugggc

SEQ ID NO: 268625 - RNA, 31 nt, Human
uucagaacugagagagaagaaagaucugugg

SEQ ID NO: 268626 - RNA, 32 nt, Human
uucagaacuugggagcccccagggaggggcua

SEQ ID NO: 268627 - RNA, 32 nt, Human
uucagaacuuguccugauggugucuuauugug

SEQ ID NO: 268628 - RNA, 32 nt, Human
uucagaagagaaggaagaggugcuggaaggau

SEQ ID NO: 268629 - RNA, 32 nt, Human
uucagaagagcagaaagcaucugcugugugag

SEQ ID NO: 268630 - RNA, 32 nt, Human
uucagaagagcagaaaguaucugcugugugag

SEQ ID NO: 268631 - RNA, 32 nt, Human
uucagaagcaucaccaauuauauuucuuucuu

SEQ ID NO: 268632 - RNA, 32 nt, Human
uucagaagcaucccggauaauagauggguaaa

SEQ ID NO: 268633 - RNA, 32 nt, Human
uucagaagcccuaaaacauaccaccuuggcua

SEQ ID NO: 268634 - RNA, 32 nt, Human
uucagaagcugcagcuggucuguuuccagguc

SEQ ID NO: 268635 - RNA, 32 nt, Human
uucagaagcuuggaaaucgacacacaaaacag

SEQ ID NO: 268636 - RNA, 32 nt, Human
uucagaaggccuuuccugugugagacccacau

SEQ ID NO: 268637 - RNA, 31 nt, Human
uucagaaggggaccuguuuucuucaagggaa

SEQ ID NO: 268638 - RNA, 32 nt, Human
uucagaagguguugggauuaucacagguuaag

SEQ ID NO: 268639 - RNA, 32 nt, Human
uucagaaguacaacaucagcucagcaggaacg

SEQ ID NO: 268640 - RNA, 32 nt, Human
uucagaaguaugaaccagcuuucuuuuuauua

SEQ ID NO: 268641 - RNA, 32 nt, Human
uucagaaguccauguuguagcaguuagaauuu

SEQ ID NO: 268642 - RNA, 32 nt, Human
uucagaagucugaccuuagaacaugagagagu

SEQ ID NO: 268643 - RNA, 22 nt, Human
uucagaauaacaaaaauauacc

SEQ ID NO: 268644 - RNA, 32 nt, Human
uucagaauacagguucuuuucuggugucacuu

SEQ ID NO: 268645 - RNA, 32 nt, Human
uucagaauagagugccuuagcuaggccagagg

SEQ ID NO: 268646 - RNA, 32 nt, Human
uucagaauauaacuucaggacaauucaaacua

SEQ ID NO: 268647 - RNA, 24 nt, Human
uucagaaucagccugggcaacaua

SEQ ID NO: 268648 - RNA, 32 nt, Human
uucagaaucagccugggcaacauagcaauacu

SEQ ID NO: 268649 - RNA, 23 nt, Human
uucagaaucaggacacucaagcu

SEQ ID NO: 268650 - RNA, 23 nt, Human
uucagaauccuaguuuaugcaca

SEQ ID NO: 268651 - RNA, 32 nt, Human
uucagaaucugucaaacuuuuguguaucccac

SEQ ID NO: 268652 - RNA, 32 nt, Human
uucagaaugaggaaaagcuguggggaccaaag

SEQ ID NO: 268653 - RNA, 32 nt, Human
uucagaaugauauacacacauauguguauaug

SEQ ID NO: 268654 - RNA, 31 nt, Human
uucagaaugccaccucacguucccccaagaa

SEQ ID NO: 268655 - RNA, 32 nt, Human
uucagaauggagaaacagacagcaaccaagcc

SEQ ID NO: 268656 - RNA, 32 nt, Human
uucagaauggcaggaguugagugugcagggac

SEQ ID NO: 268657 - RNA, 22 nt, Human
uucagaauguaaaaauugggua

SEQ ID NO: 268658 - RNA, 32 nt, Human
uucagaaugucuccuggcauccuaaccaugua

SEQ ID NO: 268659 - RNA, 21 nt, Human
uucagaauuagagaacaugcu

SEQ ID NO: 268660 - RNA, 23 nt, Human
uucagaauuccugguguuucauc

SEQ ID NO: 268661 - RNA, 32 nt, Human
uucagaauuuccaagaguucugucuguucugu

SEQ ID NO: 268662 - RNA, 32 nt, Human
uucagacaacuccaauaccaagaaacugauga

SEQ ID NO: 268663 - RNA, 32 nt, Human
uucagacaacuugcauucuguggaugccagcu

SEQ ID NO: 268664 - RNA, 32 nt, Human
uucagacacauggugagguccauggcucuugu

SEQ ID NO: 268665 - RNA, 32 nt, Human
uucagacacucauccuucauccuuccugcugc

SEQ ID NO: 268666 - RNA, 32 nt, Human
uucagacagagggagguggacggcagggauca

SEQ ID NO: 268667 - RNA, 32 nt, Human
uucagacagauguuuguuucugcucuagucac

SEQ ID NO: 268668 - RNA, 32 nt, Human
uucagacaugauccaguccagccugggcuugg

SEQ ID NO: 268669 - RNA, 21 nt, Human
uucagaccagcagagugaaga

SEQ ID NO: 268670 - RNA, 32 nt, Human
uucagaccaguaaaccagaugcuguagagcag

SEQ ID NO: 268671 - RNA, 21 nt, Human
uucagacccagacgaugccag

SEQ ID NO: 268672 - RNA, 18 nt, Human
uucagaccccaggcugca

SEQ ID NO: 268673 - RNA, 32 nt, Human
uucagaccucgguugcagcccggugccgugag

SEQ ID NO: 268674 - RNA, 32 nt, Human
uucagaccuugggcagaaggaggccuccuugg

SEQ ID NO: 268675 - RNA, 20 nt, Human
uucagacgacacagagcaag

SEQ ID NO: 268676 - RNA, 32 nt, Human
uucagacggaguuucgcucuuguugcccaggc

SEQ ID NO: 268677 - RNA, 32 nt, Human
uucagacuagccuugccaacauggugaaaccc

SEQ ID NO: 268678 - RNA, 32 nt, Human
uucagacuccagcccgcuccagcccggcccga

SEQ ID NO: 268679 - RNA, 32 nt, Human
uucagacugaagauaggccaaggucgucacug

SEQ ID NO: 268680 - RNA, 32 nt, Human
uucagacugauccuuucucugccuguauuucu

SEQ ID NO: 268681 - RNA, 32 nt, Human
uucagacugcaaaggcauccuacugaaggggc

SEQ ID NO: 268682 - RNA, 32 nt, Human
uucagacugcaugggccggccuaggagucuuu

SEQ ID NO: 268683 - RNA, 32 nt, Human
uucagacugcgccauggggcucagcgacgggg

SEQ ID NO: 268684 - RNA, 20 nt, Human
uucagacuggagugcagugg

SEQ ID NO: 268685 - RNA, 32 nt, Human
uucagacuucauccugcaucucccaucaccuc

SEQ ID NO: 268686 - RNA, 32 nt, Human
uucagacuuccuccucagccaccuggccacug

SEQ ID NO: 268687 - RNA, 32 nt, Human
uucagacuugaacaagaaacugggucucacua

SEQ ID NO: 268688 - RNA, 32 nt, Human
uucagacuuggaaaggucacagaaggaaaaua

SEQ ID NO: 268689 - RNA, 32 nt, Human
uucagacuuuggugaugggcaagguuucucga

SEQ ID NO: 268690 - RNA, 32 nt, Human
uucagagaaaccagauauuuuauagaggaaau

SEQ ID NO: 268691 - RNA, 32 nt, Human
uucagagaacuugcuuaaucuuccauauauuc

SEQ ID NO: 268692 - RNA, 32 nt, Human
uucagagaaggcugcagaggccuggguuacac

SEQ ID NO: 268693 - RNA, 16 nt, Human
uucagagacuguucca

SEQ ID NO: 268694 - RNA, 32 nt, Human
uucagagagauagggucucucuauguugcccu

SEQ ID NO: 268695 - RNA, 32 nt, Human
uucagagagaugaugggaggggccagugagga

SEQ ID NO: 268696 - RNA, 32 nt, Human
uucagagagauuuaguuuuacuuuaauggagu

SEQ ID NO: 268697 - RNA, 32 nt, Human
uucagagaggccuuuuggaauguggccccuga

SEQ ID NO: 268698 - RNA, 32 nt, Human
uucagagaucaaggugcucccuauacucccuu

SEQ ID NO: 268699 - RNA, 32 nt, Human
uucagagauccaggccucccaccucagacuca

SEQ ID NO: 268700 - RNA, 32 nt, Human
uucagagaucgcagcugcugugagaauacggu

SEQ ID NO: 268701 - RNA, 32 nt, Human
uucagagcaauauucuucugcauuauaguaag

SEQ ID NO: 268702 - RNA, 32 nt, Human
uucagagcacuuuaaagucugauauuucucga

SEQ ID NO: 268703 - RNA, 32 nt, Human
uucagagcagacagaagcagggugguggcacc

SEQ ID NO: 268704 - RNA, 32 nt, Human
uucagagcagaggcaaacccaccacagggcag

SEQ ID NO: 268705 - RNA, 32 nt, Human
uucagagcagaggcuguuccugcuuugccccu

SEQ ID NO: 268706 - RNA, 32 nt, Human
uucagagcagaggggacugucucagccaugca

SEQ ID NO: 268707 - RNA, 32 nt, Human
uucagagcagccuggccaccauagugagaucc

SEQ ID NO: 268708 - RNA, 32 nt, Human
uucagagcaggcuggagggauuugccacacag

SEQ ID NO: 268709 - RNA, 32 nt, Human
uucagagcaggcuggagggauuugccacagcc

SEQ ID NO: 268710 - RNA, 32 nt, Human
uucagagcaggggagagcuggaaggggcuaga

SEQ ID NO: 268711 - RNA, 32 nt, Human
uucagagcagguaacgccuuuugguuguuuug

SEQ ID NO: 268712 - RNA, 32 nt, Human
uucagagcauuuuuaccucucucuuaaauguu

SEQ ID NO: 268713 - RNA, 32 nt, Human
uucagagcccaggagucagugcuggugguugg

SEQ ID NO: 268714 - RNA, 32 nt, Human
uucagagcccccgccuuugccugcacuccucu

SEQ ID NO: 268715 - RNA, 32 nt, Human
uucagagccuagccaccucccaccccacuuca

SEQ ID NO: 268716 - RNA, 32 nt, Human
uucagagccuccacaccaugaccuccaagaag

SEQ ID NO: 268717 - RNA, 32 nt, Human
uucagagcugcucuccccaguugcacccccug

SEQ ID NO: 268718 - RNA, 32 nt, Human
uucagagcugggucugccccaucaaagagcaa

SEQ ID NO: 268719 - RNA, 32 nt, Human
uucagagcuguguguucaccugggcagauccc

SEQ ID NO: 268720 - RNA, 32 nt, Human
uucagagcuuucccaagagagcugucaguuuu

SEQ ID NO: 268721 - RNA, 20 nt, Human
uucagagcuuucccauuuaa

SEQ ID NO: 268722 - RNA, 32 nt, Human
uucagaggaaguggaguauaguauuuaacauu

SEQ ID NO: 268723 - RNA, 32 nt, Human
uucagaggagaggggcaccagccgggggcccu

SEQ ID NO: 268724 - RNA, 32 nt, Human
uucagaggccauaugucucagcaaguacuggu

SEQ ID NO: 268725 - RNA, 32 nt, Human
uucagaggcugagacaggugggccacaugagc

SEQ ID NO: 268726 - RNA, 32 nt, Human
uucagagggaaaggaggaagcugcguggcauu

SEQ ID NO: 268727 - RNA, 32 nt, Human
uucagagggcagcuccagugagugccaagucc

SEQ ID NO: 268728 - RNA, 32 nt, Human
uucagaggggacccuccagaagcccagccggc

SEQ ID NO: 268729 - RNA, 32 nt, Human
uucagagggggaaacuuucuucuuuuaggagg

SEQ ID NO: 268730 - RNA, 32 nt, Human
uucagagggucuggagugaaccucaggaauuu

SEQ ID NO: 268731 - RNA, 32 nt, Human
uucagaguacugcucaucuuaauuaauuuuug

SEQ ID NO: 268732 - RNA, 26 nt, Human
uucagaguaugggcaaaugcuucugg

SEQ ID NO: 268733 - RNA, 32 nt, Human
uucagagucaaaggccagagagcauggagcug

SEQ ID NO: 268734 - RNA, 32 nt, Human
uucagagucagcuauguguacaggaggcauua

SEQ ID NO: 268735 - RNA, 21 nt, Human
uucagaguccugggcagcgug

SEQ ID NO: 268736 - RNA, 32 nt, Human
uucagagucuauuucucaugugcacugcugaa

SEQ ID NO: 268737 - RNA, 32 nt, Human
uucagagucucacccugucacccaggcuggaa

SEQ ID NO: 268738 - RNA, 32 nt, Human
uucagagucuccgaggaugacgagaacgccgu

SEQ ID NO: 268739 - RNA, 32 nt, Human
uucagagugacggaugaccgggccaagcaauc

SEQ ID NO: 268740 - RNA, 32 nt, Human
uucagaguuagaagcaugaacuuuagaaccag

SEQ ID NO: 268741 - RNA, 32 nt, Human
uucagaguucaaggaagaagcaaaauaucaca

SEQ ID NO: 268742 - RNA, 32 nt, Human
uucagaguuguacacuguguacauuuggcauu

SEQ ID NO: 268743 - RNA, 32 nt, Human
uucagaguuugagauaccuuguuuucauuuuu

SEQ ID NO: 268744 - RNA, 32 nt, Human
uucagauacuuggucauuuacuuaccaaauua

SEQ ID NO: 268745 - RNA, 21 nt, Human
uucagauacuuuauuuucuca

SEQ ID NO: 268746 - RNA, 32 nt, Human
uucagauauaaauacugacaauguauuuugga

SEQ ID NO: 268747 - RNA, 32 nt, Human
uucagauaucuugccagauuguuaacuuccua

SEQ ID NO: 268748 - RNA, 32 nt, Human
uucagaucagggaaaucuccacuucgggaccu

SEQ ID NO: 268749 - RNA, 32 nt, Human
uucagauccaaaagcacaaaauguuguauaua

SEQ ID NO: 268750 - RNA, 32 nt, Human
uucagauccaacaagauauuggauagcaggca

SEQ ID NO: 268751 - RNA, 32 nt, Human
uucagauccaguagcuuuuagggaaggaacua

SEQ ID NO: 268752 - RNA, 32 nt, Human
uucagauccugcaugcugauaaaacuacugac

SEQ ID NO: 268753 - RNA, 32 nt, Human
uucagaucuccaaucccugccaccaccccaac

SEQ ID NO: 268754 - RNA, 22 nt, Human
uucagaucugcagcagagcaag

SEQ ID NO: 268755 - RNA, 32 nt, Human
uucagaugacacugcugcauccuggucacauu

SEQ ID NO: 268756 - RNA, 32 nt, Human
uucagaugaguccuaugggagcuggggaucug

SEQ ID NO: 268757 - RNA, 32 nt, Human
uucagaugcugggauuggcaaugauuuaagca

SEQ ID NO: 268758 - RNA, 32 nt, Human
uucagauggaguuuuguucuuguugcccaggc

SEQ ID NO: 268759 - RNA, 32 nt, Human
uucagauggguuaagauugaaggguggacugg

SEQ ID NO: 268760 - RNA, 32 nt, Human
uucagauggugauucugaagcuuacaucuccc

SEQ ID NO: 268761 - RNA, 32 nt, Human
uucagauggugcgaacagcagagcaggcaagg

SEQ ID NO: 268762 - RNA, 32 nt, Human
uucagauuagacuuuauuuaugugggucuaua

SEQ ID NO: 268763 - RNA, 32 nt, Human
uucagauucccugagguauggcuuggucacuc

SEQ ID NO: 268764 - RNA, 32 nt, Human
uucagauucccuucuguagauuuccuuaaaac

SEQ ID NO: 268765 - RNA, 32 nt, Human
uucagauugaaacaaacaaaaagcuuuugaug

SEQ ID NO: 268766 - RNA, 32 nt, Human
uucagauugguggugucugugccugaaccccc

SEQ ID NO: 268767 - RNA, 32 nt, Human
uucagauuguuuugauuuaggccagguauauu

SEQ ID NO: 268768 - RNA, 32 nt, Human
uucagauuuggagggcauggaucuucugacag

SEQ ID NO: 268769 - RNA, 32 nt, Human
uucagauuuucagcugacauuagcuauaguau

SEQ ID NO: 268770 - RNA, 22 nt, Human
uucagcaaagccugggcaauug

SEQ ID NO: 268771 - RNA, 32 nt, Human
uucagcaagccuuccuucuagagcuccuagaa

SEQ ID NO: 268772 - RNA, 32 nt, Human
uucagcaaucauaagugcugugcauaacuauu

SEQ ID NO: 268773 - RNA, 23 nt, Human
uucagcaauucuaauccacuuug

SEQ ID NO: 268774 - RNA, 32 nt, Human
uucagcaauugcuguucugugugugccugccc

SEQ ID NO: 268775 - RNA, 23 nt, Human
uucagcacaaaaggccucuguaa

SEQ ID NO: 268776 - RNA, 32 nt, Human
uucagcaccauggcugcucauacccugccucg

SEQ ID NO: 268777 - RNA, 20 nt, Human
uucagcaccuuuagcugcau

SEQ ID NO: 268778 - RNA, 32 nt, Human
uucagcacugaucaacaauccugggcaugggc

SEQ ID NO: 268779 - RNA, 32 nt, Human
uucagcacuguguuccuguugucgugguucaa

SEQ ID NO: 268780 - RNA, 32 nt, Human
uucagcacuuaccgauccagagccucccggcc

SEQ ID NO: 268781 - RNA, 32 nt, Human
uucagcacuuccuguuccuauaaacccaaaga

SEQ ID NO: 268782 - RNA, 32 nt, Human
uucagcagaaggcaggguguagggaagcggga

SEQ ID NO: 268783 - RNA, 19 nt, Human
uucagcagaggacuugaua

SEQ ID NO: 268784 - RNA, 32 nt, Human
uucagcagagucaguggccaaagaaaacuuug

SEQ ID NO: 268785 - RNA, 32 nt, Human
uucagcagaucuuucuaccuacuuuggugauc

SEQ ID NO: 268786 - RNA, 22 nt, Human
uucagcagccucccccuugagc

SEQ ID NO: 268787 - RNA, 32 nt, Human
uucagcagccucccccuugagcccccucgcuu

SEQ ID NO: 268788 - RNA, 32 nt, Human
uucagcaggaagcaucucagacaccaaccacu

SEQ ID NO: 268789 - RNA, 32 nt, Human
uucagcaggaucaugccuucugugucuggaag

SEQ ID NO: 268790 - RNA, 32 nt, Human
uucagcagggcuaagucaucagauaugucaga

SEQ ID NO: 268791 - RNA, 20 nt, Human
uucagcagucaggacucuaa

SEQ ID NO: 268792 - RNA, 32 nt, Human
uucagcaguccaggcugaugcaguggcuucaa

SEQ ID NO: 268793 - RNA, 32 nt, Human
uucagcagucuugccagcuuaccaguggacug

SEQ ID NO: 268794 - RNA, 32 nt, Human
uucagcagugaccaccacccacaugacauuuc

SEQ ID NO: 268795 - RNA, 22 nt, Human
uucagcagugccuucuggggug

SEQ ID NO: 268796 - RNA, 31 nt, Human
uucagcauaaagagccuuuguugaaacaucu

SEQ ID NO: 268797 - RNA, 32 nt, Human
uucagcauagcaggacccccaucucuacaaaa

SEQ ID NO: 268798 - RNA, 32 nt, Human
uucagcauauuuauaagacccugcucucuauu

SEQ ID NO: 268799 - RNA, 32 nt, Human
uucagcaucucagucugaagcuucugggacuu

SEQ ID NO: 268800 - RNA, 32 nt, Human
uucagcaucuuaaaaugucucuuuuggcagua

SEQ ID NO: 268801 - RNA, 32 nt, Human
uucagcaugaacaugggcuucuugcugucugu

SEQ ID NO: 268802 - RNA, 31 nt, Human
uucagcaugaguguacugcugaggucagguu

SEQ ID NO: 268803 - RNA, 32 nt, Human
uucagcaugggggugaccaccauguacaucac

SEQ ID NO: 268804 - RNA, 32 nt, Human
uucagcauggugauggagggaggcagaguaac

SEQ ID NO: 268805 - RNA, 32 nt, Human
uucagcauguaauuggggaaacccucgcgucu

SEQ ID NO: 268806 - RNA, 32 nt, Human
uucagcauguuuaaggaaaauagcccacaaug

SEQ ID NO: 268807 - RNA, 22 nt, Human
uucagcauuaacuccugccuca

SEQ ID NO: 268808 - RNA, 32 nt, Human
uucagcauuuccagagaccacaugugagcuuc

SEQ ID NO: 268809 - RNA, 32 nt, Human
uucagcauuucugucauuuacuucugcuauga

SEQ ID NO: 268810 - RNA, 32 nt, Human
uucagcauuugacccuugcugugaauuaagcc

SEQ ID NO: 268811 - RNA, 32 nt, Human
uucagcauuugaguuauugagauccuuauuau

SEQ ID NO: 268812 - RNA, 19 nt, Human
uucagccacagucuuauca

SEQ ID NO: 268813 - RNA, 32 nt, Human
uucagccaccucucuuuuucaguuggcugacu

SEQ ID NO: 268814 - RNA, 32 nt, Human
uucagccacugcaagcccugggccucuggcac

SEQ ID NO: 268815 - RNA, 32 nt, Human
uucagccacuuugccuucucuggacucaguuu

SEQ ID NO: 268816 - RNA, 32 nt, Human
uucagccagaacgauaugucuguccaucuuuc

SEQ ID NO: 268817 - RNA, 31 nt, Human
uucagccagaagcagcaccugcucaagcacc

SEQ ID NO: 268818 - RNA, 32 nt, Human
uucagccagaugcuugccaucucuagggauug

SEQ ID NO: 268819 - RNA, 32 nt, Human
uucagccaggacaacaaauggcuuccaagccu

SEQ ID NO: 268820 - RNA, 32 nt, Human
uucagccauaaagaaagaacaagaucaugccc

SEQ ID NO: 268821 - RNA, 32 nt, Human
uucagccaugcugaugaccacaccccguccag

SEQ ID NO: 268822 - RNA, 24 nt, Human
uucagccauggaugaggaguggga

SEQ ID NO: 268823 - RNA, 32 nt, Human
uucagcccaagcagaaccacagagacaggcca

SEQ ID NO: 268824 - RNA, 32 nt, Human
uucagcccagccugggcacagcacauggaugg

SEQ ID NO: 268825 - RNA, 32 nt, Human
uucagcccaggaauucaagaccagccugggca

SEQ ID NO: 268826 - RNA, 32 nt, Human
uucagcccaggagguggagguugcagugagcg

SEQ ID NO: 268827 - RNA, 32 nt, Human
uucagcccaggaguucgagaccagccugggca

SEQ ID NO: 268828 - RNA, 32 nt, Human
uucagcccaggaguuuaaggcugcagugagcu

SEQ ID NO: 268829 - RNA, 32 nt, Human
uucagcccagugacaccucugauguccccugg

SEQ ID NO: 268830 - RNA, 32 nt, Human
uucagcccauuucucuccauuuccuccucauu

SEQ ID NO: 268831 - RNA, 32 nt, Human
uucagccccaaaacaucucugccugccuuuau

SEQ ID NO: 268832 - RNA, 32 nt, Human
uucagccccaaggacauccuggcugccauacc

SEQ ID NO: 268833 - RNA, 32 nt, Human
uucagcccccgagggcccccaguauuggucgg

SEQ ID NO: 268834 - RNA, 32 nt, Human
uucagccccuaguuaaccucaggacuugguuu

SEQ ID NO: 268835 - RNA, 32 nt, Human
uucagccccuggcagucugcccaccugggugc

SEQ ID NO: 268836 - RNA, 32 nt, Human
uucagccccuucuccccuccccgccuggccag

SEQ ID NO: 268837 - RNA, 32 nt, Human
uucagcccgggagauugaggcugcggugagcu

SEQ ID NO: 268838 - RNA, 32 nt, Human
uucagcccgggagguggagguugcagugagcc

SEQ ID NO: 268839 - RNA, 32 nt, Human
uucagcccuccccuucccagccccaaacugag

SEQ ID NO: 268840 - RNA, 24 nt, Human
uucagcccugccugacagagaagg

SEQ ID NO: 268841 - RNA, 32 nt, Human
uucagcccuguuuugcagcccugggugggggc

SEQ ID NO: 268842 - RNA, 32 nt, Human
uucagccgcugccucuguucucagcgucagug

SEQ ID NO: 268843 - RNA, 32 nt, Human
uucagccgggcaggaaagaugggaugaagccc

SEQ ID NO: 268844 - RNA, 21 nt, Human
uucagccgugggugccccugg

SEQ ID NO: 268845 - RNA, 32 nt, Human
uucagccuacugccucggaucucuccagccga

SEQ ID NO: 268846 - RNA, 32 nt, Human
uucagccuagaagaaaagauaaugaguaaaac

SEQ ID NO: 268847 - RNA, 32 nt, Human
uucagccuaggacguugaggcugcagugagcu

SEQ ID NO: 268848 - RNA, 24 nt, Human
uucagccuaggugacagagugaga

SEQ ID NO: 268849 - RNA, 32 nt, Human
uucagccucagagacaugaagagggcuuuagc

SEQ ID NO: 268850 - RNA, 32 nt, Human
uucagccuccacugugucugucuuuucuuccc

SEQ ID NO: 268851 - RNA, 24 nt, Human
uucagccucccaacagggcagaga

SEQ ID NO: 268852 - RNA, 32 nt, Human
uucagccucgcaguccagcacacacaaacaga

SEQ ID NO: 268853 - RNA, 32 nt, Human
uucagccucuagccuucacuccugggcuccaa

SEQ ID NO: 268854 - RNA, 32 nt, Human
uucagccucucaucugcugcuccgggcugagg

SEQ ID NO: 268855 - RNA, 32 nt, Human
uucagccucugccuuuccacagcuccuccaag

SEQ ID NO: 268856 - RNA, 24 nt, Human
uucagccugagaaccucaagcagg

SEQ ID NO: 268857 - RNA, 32 nt, Human
uucagccugagcaacagagugagacugucuca

SEQ ID NO: 268858 - RNA, 23 nt, Human
uucagccugagcaacagaucaag

SEQ ID NO: 268859 - RNA, 22 nt, Human
uucagccugagcgacagaguga

SEQ ID NO: 268860 - RNA, 32 nt, Human
uucagccugagugcaaccugacucucugcauc

SEQ ID NO: 268861 - RNA, 32 nt, Human
uucagccugauuaugcccuccuggggcuccug

SEQ ID NO: 268862 - RNA, 32 nt, Human
uucagccugcaaaggcuccucuccccacuuga

SEQ ID NO: 268863 - RNA, 21 nt, Human
uucagccugcagcagaggagg

SEQ ID NO: 268864 - RNA, 32 nt, Human
uucagccugccugccuugccuuggggcaggga

SEQ ID NO: 268865 - RNA, 21 nt, Human
uucagccugccuggggugaga

SEQ ID NO: 268866 - RNA, 24 nt, Human
uucagccuggacaacagagugaga

SEQ ID NO: 268867 - RNA, 32 nt, Human
uucagccuggacaacagagugagacccugucu

SEQ ID NO: 268868 - RNA, 32 nt, Human
uucagccuggacaacagagugagacuccaucu

SEQ ID NO: 268869 - RNA, 32 nt, Human
uucagccuggaccccagccucugccaacggcc

SEQ ID NO: 268870 - RNA, 32 nt, Human
uucagccuggagaagggauaugggagcuggag

SEQ ID NO: 268871 - RNA, 32 nt, Human
uucagccuggagaugguggaagagauaaaggc

SEQ ID NO: 268872 - RNA, 24 nt, Human
uucagccuggaugacagagugaga

SEQ ID NO: 268873 - RNA, 32 nt, Human
uucagccuggaugacagagugagacccuguau

SEQ ID NO: 268874 - RNA, 25 nt, Human
uucagccuggaugaugagagugaga

SEQ ID NO: 268875 - RNA, 32 nt, Human
uucagccuggcugacagagcaagacucagucu

SEQ ID NO: 268876 - RNA, 32 nt, Human
uucagccugggaggucaaggcugcagugagcu

SEQ ID NO: 268877 - RNA, 23 nt, Human
uucagccugggcaacaagaguga

SEQ ID NO: 268878 - RNA, 23 nt, Human
uucagccugggcaacagagcaag

SEQ ID NO: 268879 - RNA, 24 nt, Human
uucagccugggcaacagagcaaga

SEQ ID NO: 268880 - RNA, 32 nt, Human
uucagccugggcaacagagcgagacuccaucu

SEQ ID NO: 268881 - RNA, 24 nt, Human
uucagccugggcaacagagugaga

SEQ ID NO: 268882 - RNA, 32 nt, Human
uucagccugggcaacagagugagacuccaucu

SEQ ID NO: 268883 - RNA, 23 nt, Human
uucagccugggcaacauagcaag

SEQ ID NO: 268884 - RNA, 24 nt, Human
uucagccugggcaacauagcaaga

SEQ ID NO: 268885 - RNA, 21 nt, Human
uucagccugggcgaaaguaag

SEQ ID NO: 268886 - RNA, 22 nt, Human
uucagccugggcgaaaguaaga

SEQ ID NO: 268887 - RNA, 31 nt, Human
uucagccugggcgacagagcgagacugcuuc

SEQ ID NO: 268888 - RNA, 24 nt, Human
uucagccugggcgauagagcaaga

SEQ ID NO: 268889 - RNA, 32 nt, Human
uucagccugggcgauagagcaagacucugucu

SEQ ID NO: 268890 - RNA, 24 nt, Human
uucagccugggggauacagugaga

SEQ ID NO: 268891 - RNA, 24 nt, Human
uucagccugggugacagaaagaga

SEQ ID NO: 268892 - RNA, 32 nt, Human
uucagccugggugacagaaagagaccuucucu

SEQ ID NO: 268893 - RNA, 24 nt, Human
uucagccugggugacagaaugaga

SEQ ID NO: 268894 - RNA, 32 nt, Human
uucagccugggugacagaaugagacucugugu

SEQ ID NO: 268895 - RNA, 23 nt, Human
uucagccugggugacagagaagg

SEQ ID NO: 268896 - RNA, 24 nt, Human
uucagccugggugacagagaagga

SEQ ID NO: 268897 - RNA, 32 nt, Human
uucagccugggugacagagaaggacuccgucu

SEQ ID NO: 268898 - RNA, 23 nt, Human
uucagccugggugacagagcaag

SEQ ID NO: 268899 - RNA, 24 nt, Human
uucagccugggugacagagcaaga

SEQ ID NO: 268900 - RNA, 32 nt, Human
uucagccugggugacagagcaagacucuuauc

SEQ ID NO: 268901 - RNA, 32 nt, Human
uucagccugggugacagagcuagacuccaucu

SEQ ID NO: 268902 - RNA, 24 nt, Human
uucagccugggugacagagggaga

SEQ ID NO: 268903 - RNA, 32 nt, Human
uucagccugggugacagagggagacucugucu

SEQ ID NO: 268904 - RNA, 24 nt, Human
uucagccugggugacagagugaga

SEQ ID NO: 268905 - RNA, 32 nt, Human
uucagccugggugacagagugagacagucucc

SEQ ID NO: 268906 - RNA, 32 nt, Human
uucagccugggugacagagugagacccuuucu

SEQ ID NO: 268907 - RNA, 32 nt, Human
uucagccugggugacagagugagacuccaucu

SEQ ID NO: 268908 - RNA, 32 nt, Human
uucagccugggugacagagugagacucugucu

SEQ ID NO: 268909 - RNA, 32 nt, Human
uucagccugggugacauagagagacuccaucu

SEQ ID NO: 268910 - RNA, 24 nt, Human
uucagccugggugccacagcgaga

SEQ ID NO: 268911 - RNA, 32 nt, Human
uucagccuggucaugcuugcucugccacuugc

SEQ ID NO: 268912 - RNA, 22 nt, Human
uucagccuggugacagagcgag

SEQ ID NO: 268913 - RNA, 23 nt, Human
uucagccuggugacagagcgaga

SEQ ID NO: 268914 - RNA, 27 nt, Human
uucagccugugcaaaacaaagcaaugg

SEQ ID NO: 268915 - RNA, 32 nt, Human
uucagccuguucugaauuggugacucugucac

SEQ ID NO: 268916 - RNA, 32 nt, Human
uucagccuuaaggguacuucagucuuaacugu

SEQ ID NO: 268917 - RNA, 32 nt, Human
uucagccuucugagcagcugggauuaugaagg

SEQ ID NO: 268918 - RNA, 32 nt, Human
uucagccuuguggagccugucagucgccauca

SEQ ID NO: 268919 - RNA, 32 nt, Human
uucagccuuucccaagagcagcagaaaaugaa

SEQ ID NO: 268920 - RNA, 32 nt, Human
uucagcgacccauagcucuaagcaggacuauu

SEQ ID NO: 268921 - RNA, 32 nt, Human
uucagcgagaacccuucaaaauucaguguggu

SEQ ID NO: 268922 - RNA, 32 nt, Human
uucagcggauacugccgccaccaagaauccaa

SEQ ID NO: 268923 - RNA, 31 nt, Human
uucagcggcacaaucucagcucacuacaacc

SEQ ID NO: 268924 - RNA, 32 nt, Human
uucagcggcaggcgaagggggcugaggaaagg

SEQ ID NO: 268925 - RNA, 32 nt, Human
uucagcgggaggcagcagaggggaagugguca

SEQ ID NO: 268926 - RNA, 32 nt, Human
uucagcgucauccuugaacgcaggauccggga

SEQ ID NO: 268927 - RNA, 32 nt, Human
uucagcgucuuuuccuagagcuggucaccacu

SEQ ID NO: 268928 - RNA, 23 nt, Human
uucagcuaaagguucuuacacca

SEQ ID NO: 268929 - RNA, 32 nt, Human
uucagcuaacacucagcaccccucccaaagag

SEQ ID NO: 268930 - RNA, 32 nt, Human
uucagcuaacuucuguguaugauaugagguaa

SEQ ID NO: 268931 - RNA, 32 nt, Human
uucagcuacauauaugaacaaauccuuuauua

SEQ ID NO: 268932 - RNA, 32 nt, Human
uucagcuagagucuccuuucugcuccaguucu

SEQ ID NO: 268933 - RNA, 21 nt, Human
uucagcuauguugcuaaagca

SEQ ID NO: 268934 - RNA, 32 nt, Human
uucagcuauuccagauugcugucugugauuuc

SEQ ID NO: 268935 - RNA, 32 nt, Human
uucagcucaauuguaucugacccuucuuuaag

SEQ ID NO: 268936 - RNA, 23 nt, Human
uucagcucaccuggugcaucugg

SEQ ID NO: 268937 - RNA, 32 nt, Human
uucagcucacggcuaccucugccucccggguu

SEQ ID NO: 268938 - RNA, 32 nt, Human
uucagcucacuacaaccucugccuccggguuc

SEQ ID NO: 268939 - RNA, 32 nt, Human
uucagcucacugcaaccuccaccucccaggug

SEQ ID NO: 268940 - RNA, 32 nt, Human
uucagcucacugcaaccuccgccucccagguu

SEQ ID NO: 268941 - RNA, 32 nt, Human
uucagcucacugcaaccucugccucccagguu

SEQ ID NO: 268942 - RNA, 32 nt, Human
uucagcucacugcaaccucugccucccggguu

SEQ ID NO: 268943 - RNA, 32 nt, Human
uucagcucacugcaaccuucgccaccuggguu

SEQ ID NO: 268944 - RNA, 32 nt, Human
uucagcucacugcaaccuucgccucccagcuu

SEQ ID NO: 268945 - RNA, 22 nt, Human
uucagcucacugcaaucuccgc

SEQ ID NO: 268946 - RNA, 32 nt, Human
uucagcucacugcaaucuccgccucccggguu

SEQ ID NO: 268947 - RNA, 32 nt, Human
uucagcucacugcaaucucugccacccagauu

SEQ ID NO: 268948 - RNA, 32 nt, Human
uucagcucagccucacaaguggcaggggaaag

SEQ ID NO: 268949 - RNA, 23 nt, Human
uucagcuccccuccucccagggg

SEQ ID NO: 268950 - RNA, 32 nt, Human
uucagcuccuacuggacccucuugcccagccg

SEQ ID NO: 268951 - RNA, 32 nt, Human
uucagcuccuccuuucuccuacugacacauuu

SEQ ID NO: 268952 - RNA, 32 nt, Human
uucagcuccucguugucuagguggugaaauga

SEQ ID NO: 268953 - RNA, 20 nt, Human
uucagcuccuuugccccugg

SEQ ID NO: 268954 - RNA, 32 nt, Human
uucagcucucacucccuucucaucagcacgug

SEQ ID NO: 268955 - RNA, 24 nt, Human
uucagcucugcaaaggacuucugg

SEQ ID NO: 268956 - RNA, 32 nt, Human
uucagcucugucugcaugaucuaucccagacu

SEQ ID NO: 268957 - RNA, 32 nt, Human
uucagcucuucucucagaaguucagcuguuga

SEQ ID NO: 268958 - RNA, 32 nt, Human
uucagcucuucucuccuuacauuuuacauuca

SEQ ID NO: 268959 - RNA, 32 nt, Human
uucagcucuugcucccuuccucguucaucacc

SEQ ID NO: 268960 - RNA, 22 nt, Human
uucagcucuuucugugcccugg

SEQ ID NO: 268961 - RNA, 20 nt, Human
uucagcugaaagugggggua

SEQ ID NO: 268962 - RNA, 23 nt, Human
uucagcugaggaugugccugaua

SEQ ID NO: 268963 - RNA, 32 nt, Human
uucagcugagucucagaaggggagaaucuccu

SEQ ID NO: 268964 - RNA, 32 nt, Human
uucagcugcauuucacaugccuugcaauggau

SEQ ID NO: 268965 - RNA, 32 nt, Human
uucagcugcccaggcagaggagaauggggucu

SEQ ID NO: 268966 - RNA, 32 nt, Human
uucagcugcccugguggggguugugugagaga

SEQ ID NO: 268967 - RNA, 32 nt, Human
uucagcugccuaagcuguggguucucugaagc

SEQ ID NO: 268968 - RNA, 32 nt, Human
uucagcugcugcaggcucuccugcugcaucuc

SEQ ID NO: 268969 - RNA, 22 nt, Human
uucagcugcuggcagagggagg

SEQ ID NO: 268970 - RNA, 32 nt, Human
uucagcugcuuugacaaaaugacuggcuccug

SEQ ID NO: 268971 - RNA, 32 nt, Human
uucagcugcuuuguuggcagccaggccuggcu

SEQ ID NO: 268972 - RNA, 32 nt, Human
uucagcuggacucugccaucugugggcccagc

SEQ ID NO: 268973 - RNA, 32 nt, Human
uucagcuggagcuuuuugacuucuuagaaaua

SEQ ID NO: 268974 - RNA, 32 nt, Human
uucagcuggggaggggaagagugcuggcuccu

SEQ ID NO: 268975 - RNA, 32 nt, Human
uucagcugugguagaauaccaugcuguguuua

SEQ ID NO: 268976 - RNA, 22 nt, Human
uucagcuguggucggcugaaaa

SEQ ID NO: 268977 - RNA, 21 nt, Human
uucagcuuauaauaaugaaaa

SEQ ID NO: 268978 - RNA, 24 nt, Human
uucagcuuauacccgggcugaaaa

SEQ ID NO: 268979 - RNA, 21 nt, Human
uucagcuucagcaggugaaaa

SEQ ID NO: 268980 - RNA, 32 nt, Human
uucagcuucaugccucuuccacacagcguuuc

SEQ ID NO: 268981 - RNA, 32 nt, Human
uucagcuuccccuguccucuggccacaccgcc

SEQ ID NO: 268982 - RNA, 32 nt, Human
uucagcuuccucagggcagcacgagggucgug

SEQ ID NO: 268983 - RNA, 32 nt, Human
uucagcuuccugcugcuggggccagcgauuuu

SEQ ID NO: 268984 - RNA, 32 nt, Human
uucagcuucugcugggagaaucuugcuaagac

SEQ ID NO: 268985 - RNA, 32 nt, Human
uucagcuucuucucuuauccuuacuuucuuua

SEQ ID NO: 268986 - RNA, 23 nt, Human
uucagcuugggcaacagagcaag

SEQ ID NO: 268987 - RNA, 24 nt, Human
uucagcuugggcaacagagcaaga

SEQ ID NO: 268988 - RNA, 32 nt, Human
uucagcuugggcaagugugugccugugugccg

SEQ ID NO: 268989 - RNA, 21 nt, Human
uucagcuuggggagagagggg

SEQ ID NO: 268990 - RNA, 23 nt, Human
uucagcuuggggugugagugaga

SEQ ID NO: 268991 - RNA, 24 nt, Human
uucagcuugggugacagagccaga

SEQ ID NO: 268992 - RNA, 32 nt, Human
uucagcuugggugacagagccagaccuuauuu

SEQ ID NO: 268993 - RNA, 32 nt, Human
uucagcuugggugaugaagugagaccccuguc

SEQ ID NO: 268994 - RNA, 32 nt, Human
uucagcuuguuggugcgggagcucaggauuuc

SEQ ID NO: 268995 - RNA, 32 nt, Human
uucagcuuucggacucugguucuuggaucgug

SEQ ID NO: 268996 - RNA, 24 nt, Human
uucagcuuugugaguggggcgagg

SEQ ID NO: 268997 - RNA, 32 nt, Human
uucagcuuuuugcuaacuuuuguauuuugaaa

SEQ ID NO: 268998 - RNA, 21 nt, Human
uucaggaaaaggccuggggug

SEQ ID NO: 268999 - RNA, 22 nt, Human
uucaggaaagccugggcaauug

SEQ ID NO: 269000 - RNA, 32 nt, Human
uucaggaaaugccacagauaugaguacuuuuc

SEQ ID NO: 269001 - RNA, 32 nt, Human
uucaggaagauggaggaugaggauucccaggu

SEQ ID NO: 269002 - RNA, 32 nt, Human
uucaggaagggccauauuuucuguugaguaaa

SEQ ID NO: 269003 - RNA, 23 nt, Human
uucaggaagggugucucaggaug

SEQ ID NO: 269004 - RNA, 20 nt, Human
uucaggaauauuuugggaua

SEQ ID NO: 269005 - RNA, 32 nt, Human
uucaggacaucucaagauucagucuugacaau

SEQ ID NO: 269006 - RNA, 32 nt, Human
uucaggaccagccugaccaacauggugaaacc

SEQ ID NO: 269007 - RNA, 32 nt, Human
uucaggaccagccuggccaacaugaugaaacc

SEQ ID NO: 269008 - RNA, 32 nt, Human
uucaggaccagccuggccaauauggugaaacc

SEQ ID NO: 269009 - RNA, 32 nt, Human
uucaggaccagccuggccagcauggugaaacc

SEQ ID NO: 269010 - RNA, 24 nt, Human
uucaggaccagccugggcaacaua

SEQ ID NO: 269011 - RNA, 32 nt, Human
uucaggaccagccugggcaacauagcgagacc

SEQ ID NO: 269012 - RNA, 24 nt, Human
uucaggaccagcuugggcugcgug

SEQ ID NO: 269013 - RNA, 24 nt, Human
uucaggaccaggaaaugguacaug

SEQ ID NO: 269014 - RNA, 32 nt, Human
uucaggaccaggcagagagugaggcugggggu

SEQ ID NO: 269015 - RNA, 32 nt, Human
uucaggacccacccacccuaugccggcuucug

SEQ ID NO: 269016 - RNA, 24 nt, Human
uucaggaccugccugggcaacaug

SEQ ID NO: 269017 - RNA, 24 nt, Human
uucaggacuagccugggcaacaua

SEQ ID NO: 269018 - RNA, 32 nt, Human
uucaggacuagccugggcaacauagcaagauc

SEQ ID NO: 269019 - RNA, 32 nt, Human
uucaggacugcgugaucgugcacuuugugugg

SEQ ID NO: 269020 - RNA, 24 nt, Human
uucaggacuggccuagugaacgua

SEQ ID NO: 269021 - RNA, 32 nt, Human
uucaggagacugagacagagaagacaagugaa

SEQ ID NO: 269022 - RNA, 31 nt, Human
uucaggagacuucucuuucuccaaggacgcc

SEQ ID NO: 269023 - RNA, 32 nt, Human
uucaggagaguuuguugucaggauuuaacacu

SEQ ID NO: 269024 - RNA, 22 nt, Human
uucaggagaugcgcuuggggug

SEQ ID NO: 269025 - RNA, 23 nt, Human
uucaggagauuauauuucacuca

SEQ ID NO: 269026 - RNA, 32 nt, Human
uucaggagcaugacuccagugcugggcucuug

SEQ ID NO: 269027 - RNA, 32 nt, Human
uucaggagccuaagacccucccagagcccagg

SEQ ID NO: 269028 - RNA, 32 nt, Human
uucaggagcucaaggcuggagugucuugacag

SEQ ID NO: 269029 - RNA, 32 nt, Human
uucaggaggaagagaugcccaugaagcagguc

SEQ ID NO: 269030 - RNA, 32 nt, Human
uucaggaggagagaaggaaggagaggugaucu

SEQ ID NO: 269031 - RNA, 32 nt, Human
uucaggaggcggagguugcagugagccaagau

SEQ ID NO: 269032 - RNA, 32 nt, Human
uucaggagguacugugaggaagagcaggcacc

SEQ ID NO: 269033 - RNA, 32 nt, Human
uucaggaggugaggacaagccagagguccuug

SEQ ID NO: 269034 - RNA, 32 nt, Human
uucaggagguggagguugcagugagccgacau

SEQ ID NO: 269035 - RNA, 24 nt, Human
uucaggagguggagguuuuagugg

SEQ ID NO: 269036 - RNA, 32 nt, Human
uucaggaguaauuccccguuuccuucaagagu

SEQ ID NO: 269037 - RNA, 32 nt, Human
uucaggaguuaaaucauucuuccacccagaua

SEQ ID NO: 269038 - RNA, 32 nt, Human
  misc_feature (8)..(8): n is a, c, g or u
uucagganacucuguaccuaucuggaauccaa

SEQ ID NO: 269039 - RNA, 16 nt, Human
uucaggaucaauguga

SEQ ID NO: 269040 - RNA, 32 nt, Human
uucaggaucagcuggggguauggaauuggcug

SEQ ID NO: 269041 - RNA, 23 nt, Human
uucaggaucagucaaaggcagca

SEQ ID NO: 269042 - RNA, 32 nt, Human
uucaggauccuaauacuuggccaucuccacac

SEQ ID NO: 269043 - RNA, 32 nt, Human
uucaggaugagugaaggcuggagccagggagc

SEQ ID NO: 269044 - RNA, 32 nt, Human
uucaggaugccauuaagaaugccaaaucaaau

SEQ ID NO: 269045 - RNA, 31 nt, Human
uucaggaugccuucuuuagcauuuagaaccc

SEQ ID NO: 269046 - RNA, 32 nt, Human
uucaggauggccaggacuguggauucccagca

SEQ ID NO: 269047 - RNA, 30 nt, Human
uucaggaugggccacagggcgucaagcagc

SEQ ID NO: 269048 - RNA, 32 nt, Human
uucaggauuaauccucuugcaccagcucucag

SEQ ID NO: 269049 - RNA, 32 nt, Human
uucaggcaaagaaucaagggugaagguaaaau

SEQ ID NO: 269050 - RNA, 23 nt, Human
uucaggcaagagugcaguagugu

SEQ ID NO: 269051 - RNA, 32 nt, Human
uucaggcacacccucuggaagcggguccaagg

SEQ ID NO: 269052 - RNA, 32 nt, Human
uucaggcaccuugauggggcucaguggggcca

SEQ ID NO: 269053 - RNA, 32 nt, Human
uucaggcagacugguggcaguggaguagggaa

SEQ ID NO: 269054 - RNA, 32 nt, Human
uucaggcagggugagcaggcaggagcagggga

SEQ ID NO: 269055 - RNA, 32 nt, Human
uucaggcauuuauggggagaaaaggcccuccc

SEQ ID NO: 269056 - RNA, 32 nt, Human
uucaggcauuugcuucaaacaaaaagaagcuu

SEQ ID NO: 269057 - RNA, 31 nt, Human
uucaggccaaugucucagcccaggaaccagg

SEQ ID NO: 269058 - RNA, 32 nt, Human
uucaggccaccugaggcacauccucucugaaa

SEQ ID NO: 269059 - RNA, 32 nt, Human
uucaggccacuuggggucuagaccaugguggu

SEQ ID NO: 269060 - RNA, 32 nt, Human
uucaggccagggcaucccagaggucaaugcgu

SEQ ID NO: 269061 - RNA, 32 nt, Human
uucaggcccaaauuauggcagacaucuugaug

SEQ ID NO: 269062 - RNA, 31 nt, Human
uucaggcccccgccuuggccuguguucuucc

SEQ ID NO: 269063 - RNA, 32 nt, Human
uucaggcccugagaggucucagcucuuggagg

SEQ ID NO: 269064 - RNA, 32 nt, Human
uucaggccugggaaggaagacacugggaggag

SEQ ID NO: 269065 - RNA, 32 nt, Human
uucaggccuguaauuccagcacuuugggaggc

SEQ ID NO: 269066 - RNA, 18 nt, Human
uucaggccuguaguccca

SEQ ID NO: 269067 - RNA, 32 nt, Human
uucaggccugugcauguguguacagcaggagg

SEQ ID NO: 269068 - RNA, 32 nt, Human
uucaggccuguucuagcaucuggccggggcgg

SEQ ID NO: 269069 - RNA, 32 nt, Human
uucaggccuucccuucuccauccugccauguc

SEQ ID NO: 269070 - RNA, 32 nt, Human
uucaggcgaccucugcccucccugccucuccu

SEQ ID NO: 269071 - RNA, 32 nt, Human
uucaggcgugagccaccacacccggccaaaac

SEQ ID NO: 269072 - RNA, 28 nt, Human
uucaggcuaagagcugccucgcucuuug

SEQ ID NO: 269073 - RNA, 32 nt, Human
uucaggcucaggcuccagccuuggcagccuuc

SEQ ID NO: 269074 - RNA, 32 nt, Human
uucaggcucaggcugaagaacugacccacuua

SEQ ID NO: 269075 - RNA, 24 nt, Human
uucaggcucugaacauucccagcg

SEQ ID NO: 269076 - RNA, 32 nt, Human
uucaggcucugccucucccacuaggucuggau

SEQ ID NO: 269077 - RNA, 32 nt, Human
uucaggcugcccauccccuccccaccggcguc

SEQ ID NO: 269078 - RNA, 32 nt, Human
uucaggcugccuggaggaaggacggggcugag

SEQ ID NO: 269079 - RNA, 32 nt, Human
uucaggcugcugugguucucagcagcaauuug

SEQ ID NO: 269080 - RNA, 23 nt, Human
uucaggcuggagcugggggccag

SEQ ID NO: 269081 - RNA, 20 nt, Human
uucaggcuggagugcagugg

SEQ ID NO: 269082 - RNA, 22 nt, Human
uucaggcuggagugcaguggug

SEQ ID NO: 269083 - RNA, 24 nt, Human
uucaggcugggcgaaagagugaga

SEQ ID NO: 269084 - RNA, 19 nt, Human
uucaggcugggugcagugg

SEQ ID NO: 269085 - RNA, 32 nt, Human
uucaggcuucauuccuucccaagagugcuuuu

SEQ ID NO: 269086 - RNA, 32 nt, Human
uucagggaaccauccacacaccugccaacccu

SEQ ID NO: 269087 - RNA, 32 nt, Human
uucagggaaggaguuugauauagcagauuaac

SEQ ID NO: 269088 - RNA, 32 nt, Human
uucagggaauaacauucugagcccucgauggc

SEQ ID NO: 269089 - RNA, 22 nt, Human
uucagggacaaucacccaggga

SEQ ID NO: 269090 - RNA, 32 nt, Human
uucagggacacauaccgccuccagcggggagc

SEQ ID NO: 269091 - RNA, 32 nt, Human
uucagggagagcugggcagacaggugggagau

SEQ ID NO: 269092 - RNA, 32 nt, Human
uucagggagaggggagaucuaagcaggacaga

SEQ ID NO: 269093 - RNA, 32 nt, Human
uucagggagcaggaggagagagccccugaagu

SEQ ID NO: 269094 - RNA, 32 nt, Human
uucagggagccccgcccucccaaaaagccgug

SEQ ID NO: 269095 - RNA, 32 nt, Human
uucagggagcugcagaagcagggggcuggugg

SEQ ID NO: 269096 - RNA, 18 nt, Human
uucagggauauggccaug

SEQ ID NO: 269097 - RNA, 32 nt, Human
uucagggauauguauauguauguuugugugug

SEQ ID NO: 269098 - RNA, 32 nt, Human
uucagggaucagaggccauccuuugugggcuu

SEQ ID NO: 269099 - RNA, 32 nt, Human
uucagggauuacaggcaugagccaccaugccc

SEQ ID NO: 269100 - RNA, 32 nt, Human
uucagggauuccauaaacauuuaaacaauguu

SEQ ID NO: 269101 - RNA, 32 nt, Human
uucagggcaaaguggggccuggauugugggcc

SEQ ID NO: 269102 - RNA, 32 nt, Human
uucagggcagaauauguguuugugacccaaaa

SEQ ID NO: 269103 - RNA, 32 nt, Human
uucagggcauuucucccuccagccagggccca

SEQ ID NO: 269104 - RNA, 24 nt, Human
uucagggccagcccuggcuggcau

SEQ ID NO: 269105 - RNA, 32 nt, Human
uucagggccagcccuggcuggcauggagggug

SEQ ID NO: 269106 - RNA, 32 nt, Human
uucagggccaggcagagagugaggcugggggu

SEQ ID NO: 269107 - RNA, 21 nt, Human
uucagggccagggcguagcgu

SEQ ID NO: 269108 - RNA, 21 nt, Human
uucagggccauugcaaacaua

SEQ ID NO: 269109 - RNA, 32 nt, Human
uucagggcccuccacaucugagguggcucauu

SEQ ID NO: 269110 - RNA, 24 nt, Human
uucagggccgauggggcagucgug

SEQ ID NO: 269111 - RNA, 32 nt, Human
uucagggccuaggaaggggagcauucaggaac

SEQ ID NO: 269112 - RNA, 19 nt, Human
uucagggccucccugccug

SEQ ID NO: 269113 - RNA, 32 nt, Human
uucagggccuccucaagcugguugggccacug

SEQ ID NO: 269114 - RNA, 32 nt, Human
uucagggccugcucucugucaugugaugcuau

SEQ ID NO: 269115 - RNA, 32 nt, Human
uucagggcucagagcagcaaaggccugaagag

SEQ ID NO: 269116 - RNA, 32 nt, Human
uucagggcucaggugauccucccaccucagcc

SEQ ID NO: 269117 - RNA, 32 nt, Human
uucagggcuuccuuccugugugcagccuaggg

SEQ ID NO: 269118 - RNA, 22 nt, Human
uucaggggaaaauuuugggaug

SEQ ID NO: 269119 - RNA, 32 nt, Human
uucaggggacacucaggagucacugcacauua

SEQ ID NO: 269120 - RNA, 32 nt, Human
uucaggggacaugacaucaauagguuucugga

SEQ ID NO: 269121 - RNA, 22 nt, Human
uucaggggauggcagagcuggg

SEQ ID NO: 269122 - RNA, 32 nt, Human
uucaggggucccggaagaguuguuugagguuu

SEQ ID NO: 269123 - RNA, 32 nt, Human
uucaggggucccugugcuggccaagccaguga

SEQ ID NO: 269124 - RNA, 32 nt, Human
uucaggggugacucagaagaaaaagaagcuga

SEQ ID NO: 269125 - RNA, 32 nt, Human
uucaggggugagagucagagagcacugcaaua

SEQ ID NO: 269126 - RNA, 32 nt, Human
uucaggguaggugggcacaggcuuggacuaga

SEQ ID NO: 269127 - RNA, 32 nt, Human
uucaggguccccuuggauuguguagaugcagu

SEQ ID NO: 269128 - RNA, 32 nt, Human
uucagggucuagauggaugggaaaguagaaaa

SEQ ID NO: 269129 - RNA, 32 nt, Human
uucagggugaaauccuaugcuuccauguacau

SEQ ID NO: 269130 - RNA, 32 nt, Human
uucagggugaccuaacaccaccucaugcccug

SEQ ID NO: 269131 - RNA, 32 nt, Human
uucagggugcuccaucagagccagcgggaugg

SEQ ID NO: 269132 - RNA, 32 nt, Human
uucagggugggaugacggaccgcuucugggac

SEQ ID NO: 269133 - RNA, 32 nt, Human
uucaggguguugggcuggagggaguggggugg

SEQ ID NO: 269134 - RNA, 22 nt, Human
uucaggguuagucagcaacaua

SEQ ID NO: 269135 - RNA, 32 nt, Human
uucaggguuuuguccucccaaaccagagucau

SEQ ID NO: 269136 - RNA, 32 nt, Human
uucagguaaguuugcauccaagcaaugucguc

SEQ ID NO: 269137 - RNA, 32 nt, Human
uucagguaucuuuucagcagcacuccacuccu

SEQ ID NO: 269138 - RNA, 32 nt, Human
uucaggucaacacugcacuccagccugggcga

SEQ ID NO: 269139 - RNA, 32 nt, Human
uucaggucagccagcgcccacaaccugacggu

SEQ ID NO: 269140 - RNA, 32 nt, Human
uucaggucaggaguucgagaccagccuggcca

SEQ ID NO: 269141 - RNA, 32 nt, Human
uucaggucauuucuccucucucagacucagug

SEQ ID NO: 269142 - RNA, 32 nt, Human
uucagguccuccuccacaagggccacauuuca

SEQ ID NO: 269143 - RNA, 32 nt, Human
uucagguccucggacaaccucucuccagcucu

SEQ ID NO: 269144 - RNA, 32 nt, Human
uucaggucgggaguuccagaccagccuguuca

SEQ ID NO: 269145 - RNA, 32 nt, Human
uucaggucuccagcuucucugcuucucagcug

SEQ ID NO: 269146 - RNA, 23 nt, Human
uucaggugaccacaauagcaaca

SEQ ID NO: 269147 - RNA, 32 nt, Human
uucaggugaggcccaaugaggucagggaccca

SEQ ID NO: 269148 - RNA, 32 nt, Human
uucagguguccguuauucaggugcaaagaaga

SEQ ID NO: 269149 - RNA, 32 nt, Human
uucaggugugagccacugugcccagcagggau

SEQ ID NO: 269150 - RNA, 32 nt, Human
uucaggugugcaaaggaggggaaagugaagcc

SEQ ID NO: 269151 - RNA, 32 nt, Human
uucagguguuaugccugauuccuucaucauaa

SEQ ID NO: 269152 - RNA, 21 nt, Human
uucagguuacuagguguucug

SEQ ID NO: 269153 - RNA, 24 nt, Human
uucagguuaucuugaagaugccaa

SEQ ID NO: 269154 - RNA, 22 nt, Human
uucagguuaucuuggcaacaug

SEQ ID NO: 269155 - RNA, 32 nt, Human
uucagguuucacuccuaguggaggaggcucuu

SEQ ID NO: 269156 - RNA, 32 nt, Human
uucagguuucagcaugaacaugggcuucuugc

SEQ ID NO: 269157 - RNA, 32 nt, Human
uucagguuugcugucacauaugcaucaucuga

SEQ ID NO: 269158 - RNA, 24 nt, Human
uucaguaaaaauaacaaauacaug

SEQ ID NO: 269159 - RNA, 32 nt, Human
uucaguaagcuacagcuaagcccaucggccgg

SEQ ID NO: 269160 - RNA, 22 nt, Human
uucaguaaguuagugcuucugg

SEQ ID NO: 269161 - RNA, 32 nt, Human
uucaguacaaguuuaaguugcuuucuuugagg

SEQ ID NO: 269162 - RNA, 18 nt, Human
uucaguacccuuggccug

SEQ ID NO: 269163 - RNA, 32 nt, Human
uucaguaccugacagagaacaucugggcgucc

SEQ ID NO: 269164 - RNA, 32 nt, Human
uucaguacugggugguucagcagggaagccag

SEQ ID NO: 269165 - RNA, 32 nt, Human
uucaguacuguagugcucacagggcuuccugg

SEQ ID NO: 269166 - RNA, 28 nt, Human
uucaguagagaccagccuggccaacaug

SEQ ID NO: 269167 - RNA, 32 nt, Human
uucaguagagaugcaguuucacuguguuggcc

SEQ ID NO: 269168 - RNA, 24 nt, Human
uucaguagcagccuaggcaacaug

SEQ ID NO: 269169 - RNA, 32 nt, Human
uucaguagcucugaaggcuggaaaagagagca

SEQ ID NO: 269170 - RNA, 32 nt, Human
uucaguagcugagaacuugagcguagauaugu

SEQ ID NO: 269171 - RNA, 32 nt, Human
uucaguaguaaagacccagcuugaauguaaau

SEQ ID NO: 269172 - RNA, 32 nt, Human
uucaguaguacuucaaagaagauagcuguaua

SEQ ID NO: 269173 - RNA, 32 nt, Human
uucaguaguuccaggacucagggacucaggcc

SEQ ID NO: 269174 - RNA, 32 nt, Human
uucaguaguuuauauuggaaagaaaaacaauu

SEQ ID NO: 269175 - RNA, 32 nt, Human
uucaguaucaguuaaucagaacaaaaagauaa

SEQ ID NO: 269176 - RNA, 32 nt, Human
uucaguaucuucucuaucauaggcccuaaguu

SEQ ID NO: 269177 - RNA, 32 nt, Human
uucaguauuagaugcacuuaaguuagccucca

SEQ ID NO: 269178 - RNA, 32 nt, Human
uucaguauuuggaguucaacacugucucucaa

SEQ ID NO: 269179 - RNA, 32 nt, Human
uucagucaaacaguaaagacuuuauuuaugga

SEQ ID NO: 269180 - RNA, 32 nt, Human
uucagucaaagauacacaaucugaaacagcuu

SEQ ID NO: 269181 - RNA, 32 nt, Human
uucagucaacagaaaaugugauuuucacagau

SEQ ID NO: 269182 - RNA, 32 nt, Human
uucagucaacuuaaaucugaacuuuuucuuaa

SEQ ID NO: 269183 - RNA, 32 nt, Human
uucagucaagugaaaaauuaacauguggacug

SEQ ID NO: 269184 - RNA, 32 nt, Human
uucagucacaggcagaaagggaagcacagggu

SEQ ID NO: 269185 - RNA, 32 nt, Human
uucagucaccucccaccucuugccaccugcug

SEQ ID NO: 269186 - RNA, 32 nt, Human
uucagucagccuguggcacuguucaucugcug

SEQ ID NO: 269187 - RNA, 32 nt, Human
uucagucauaauaccaauaguuaucucaugca

SEQ ID NO: 269188 - RNA, 32 nt, Human
uucagucauccaucuucucuggaggcugcaga

SEQ ID NO: 269189 - RNA, 32 nt, Human
uucagucauuuucugcacgcaucccccuuuau

SEQ ID NO: 269190 - RNA, 32 nt, Human
uucaguccagugccaugccuuagauggaauug

SEQ ID NO: 269191 - RNA, 32 nt, Human
uucaguccauggugcuuuguaacuuuuacguu

SEQ ID NO: 269192 - RNA, 32 nt, Human
uucaguccccuccccucugcccuguuuuguau

SEQ ID NO: 269193 - RNA, 32 nt, Human
uucaguccuaguuuuuacuuuuauucuuaaag

SEQ ID NO: 269194 - RNA, 32 nt, Human
uucaguccuauuacugaugaguuuacaucuuc

SEQ ID NO: 269195 - RNA, 32 nt, Human
uucaguccugcacugcucaccuggguuuacug

SEQ ID NO: 269196 - RNA, 32 nt, Human
uucaguccugcaggaacaggaucaucugucuc

SEQ ID NO: 269197 - RNA, 32 nt, Human
uucaguccugccucuacugucucuccauagcc

SEQ ID NO: 269198 - RNA, 32 nt, Human
uucaguccugcugccugaaucaucucacacca

SEQ ID NO: 269199 - RNA, 28 nt, Human
uucagucgagaccggccuggccaacgug

SEQ ID NO: 269200 - RNA, 32 nt, Human
uucagucucacugccaucuacagccacacugc

SEQ ID NO: 269201 - RNA, 32 nt, Human
uucagucuccaucauggcaugccauacucucc

SEQ ID NO: 269202 - RNA, 32 nt, Human
uucagucugcugaagagcuuggaagacuggag

SEQ ID NO: 269203 - RNA, 32 nt, Human
uucagucuguaggugacuacagaaggaggagg

SEQ ID NO: 269204 - RNA, 24 nt, Human
uucagucugugugacugagcaaga

SEQ ID NO: 269205 - RNA, 32 nt, Human
uucagucugugugacugagcaagacucuuuca

SEQ ID NO: 269206 - RNA, 32 nt, Human
uucagucuucaaagagaaagauaagaaauucu

SEQ ID NO: 269207 - RNA, 32 nt, Human
uucagucuugccuuacacaaaggggaucauaa

SEQ ID NO: 269208 - RNA, 32 nt, Human
uucagucuuuaagagucuguugugcagcggag

SEQ ID NO: 269209 - RNA, 32 nt, Human
uucagugaaagaggaaggaaaggaguagggcu

SEQ ID NO: 269210 - RNA, 32 nt, Human
uucagugaaauggcauugcauauuuauauguu

SEQ ID NO: 269211 - RNA, 32 nt, Human
uucagugaacugcuggaacucacacaugcccu

SEQ ID NO: 269212 - RNA, 32 nt, Human
uucagugaagcacuacgaaaauuugaaaccaa

SEQ ID NO: 269213 - RNA, 32 nt, Human
uucagugacgucauucuucuccaggcuggccc

SEQ ID NO: 269214 - RNA, 32 nt, Human
uucagugagaaggugacccgccuucuucccau

SEQ ID NO: 269215 - RNA, 32 nt, Human
uucagugagacgcccugcacacacagaaagcc

SEQ ID NO: 269216 - RNA, 32 nt, Human
uucagugagguaggccagcuuuuaugacgcac

SEQ ID NO: 269217 - RNA, 32 nt, Human
uucagugcaaucuccgccuccuggguucaaau

SEQ ID NO: 269218 - RNA, 32 nt, Human
uucagugcagaaguccucacacacuaacagau

SEQ ID NO: 269219 - RNA, 32 nt, Human
uucagugcaggacucaaguguacuuguacaga

SEQ ID NO: 269220 - RNA, 32 nt, Human
uucagugcaucuccuagaaaagaaguguugga

SEQ ID NO: 269221 - RNA, 32 nt, Human
uucagugccagggcccugaggaagaaaugggg

SEQ ID NO: 269222 - RNA, 32 nt, Human
uucagugccauggacaugauuuaaacugaaac

SEQ ID NO: 269223 - RNA, 32 nt, Human
uucagugcgugguaggaaagaaagucagguca

SEQ ID NO: 269224 - RNA, 32 nt, Human
uucagugcucugcagaagccucucccccucac

SEQ ID NO: 269225 - RNA, 32 nt, Human
uucagugcuggcauauuuuggaauucugcaca

SEQ ID NO: 269226 - RNA, 32 nt, Human
uucagugcuguccuuccacauuuaauugcauu

SEQ ID NO: 269227 - RNA, 26 nt, Human
uucagugcuguggccugggcaagaua

SEQ ID NO: 269228 - RNA, 32 nt, Human
uucagugcuugcugguguccugggcagcacca

SEQ ID NO: 269229 - RNA, 32 nt, Human
uucagugcuuucuaaguagcagccccugccuc

SEQ ID NO: 269230 - RNA, 32 nt, Human
uucaguggagugaaguucaggaggcauggagc

SEQ ID NO: 269231 - RNA, 31 nt, Human
uucaguggcgcgaucucagcucacuacaagc

SEQ ID NO: 269232 - RNA, 32 nt, Human
uucaguggcuuaaauuauaacguuuuggcuua

SEQ ID NO: 269233 - RNA, 32 nt, Human
uucaguggcuugcaguugcagcaaggaccgaa

SEQ ID NO: 269234 - RNA, 31 nt, Human
uucagugggucaaaauggggagauguacugg

SEQ ID NO: 269235 - RNA, 32 nt, Human
uucagugguggagauggccuucugguaacuga

SEQ ID NO: 269236 - RNA, 32 nt, Human
uucagugguggguggggcagggcagaugaaag

SEQ ID NO: 269237 - RNA, 32 nt, Human
uucaguguagauuuugucuuucuugaacuuaa

SEQ ID NO: 269238 - RNA, 32 nt, Human
uucaguguaugguuuucccugccaaacgguuc

SEQ ID NO: 269239 - RNA, 32 nt, Human
uucagugucuguggcuggagagugugucuuuc

SEQ ID NO: 269240 - RNA, 32 nt, Human
uucagugugguguccagcagugucucccacuc

SEQ ID NO: 269241 - RNA, 32 nt, Human
uucaguguuccucccacugccaacacacccac

SEQ ID NO: 269242 - RNA, 32 nt, Human
uucaguguuguggugacucagggccuucacca

SEQ ID NO: 269243 - RNA, 32 nt, Human
uucaguguuuauggggaaaauaccucauuagu

SEQ ID NO: 269244 - RNA, 32 nt, Human
uucaguguuuugucaaccauuucaaagugucu

SEQ ID NO: 269245 - RNA, 32 nt, Human
uucaguuaccauuguaugcaagagccaagcac

SEQ ID NO: 269246 - RNA, 32 nt, Human
uucaguuaggcagaggaagagcgacugcagug

SEQ ID NO: 269247 - RNA, 32 nt, Human
uucaguuaggcgcucaucaguucuccagagug

SEQ ID NO: 269248 - RNA, 32 nt, Human
uucaguuaucucucgaguuuugaagcugaaca

SEQ ID NO: 269249 - RNA, 32 nt, Human
uucaguuaugagacucuuugcauaguauaggg

SEQ ID NO: 269250 - RNA, 32 nt, Human
uucaguucaagaaauuguucugccugggcaag

SEQ ID NO: 269251 - RNA, 32 nt, Human
uucaguucaguguaugaccaaaagcaauaugu

SEQ ID NO: 269252 - RNA, 32 nt, Human
uucaguucccagagagcagagacucuugggaa

SEQ ID NO: 269253 - RNA, 32 nt, Human
uucaguucccagccaaguaggugcuucauguc

SEQ ID NO: 269254 - RNA, 32 nt, Human
uucaguuccuuaagacugucuggucauaucug

SEQ ID NO: 269255 - RNA, 32 nt, Human
uucaguuccuucccccugacccugacuccuug

SEQ ID NO: 269256 - RNA, 32 nt, Human
uucaguucucauccucuccaucccaauccagu

SEQ ID NO: 269257 - RNA, 28 nt, Human
uucaguucucaugcugccucuuccaaaa

SEQ ID NO: 269258 - RNA, 32 nt, Human
uucaguugaauauaaagaaaugggguuguuug

SEQ ID NO: 269259 - RNA, 32 nt, Human
uucaguuguaugacagucaguauugacaauaa

SEQ ID NO: 269260 - RNA, 32 nt, Human
uucaguugugcaaaugaaagccaucugacagu

SEQ ID NO: 269261 - RNA, 32 nt, Human
uucaguugugguagaauaccgugcuguguuua

SEQ ID NO: 269262 - RNA, 32 nt, Human
uucaguuguuuauuuuaaaugauaucgaucuu

SEQ ID NO: 269263 - RNA, 32 nt, Human
uucaguuguuuugcauaacgucugccuucuuu

SEQ ID NO: 269264 - RNA, 32 nt, Human
uucaguuuacuguuuccaugcuaaacaugauu

SEQ ID NO: 269265 - RNA, 32 nt, Human
uucaguuucauuguuaacgggccuuauucuga

SEQ ID NO: 269266 - RNA, 32 nt, Human
uucaguuucauuuuguuuucccuaauucaagu

SEQ ID NO: 269267 - RNA, 32 nt, Human
uucaguuuccccaaguaccuguuuucauuccc

SEQ ID NO: 269268 - RNA, 32 nt, Human
uucaguuucucuucccuaagaggcugccggag

SEQ ID NO: 269269 - RNA, 23 nt, Human
uucaguuuggggcaggagggaga

SEQ ID NO: 269270 - RNA, 32 nt, Human
uucaguuugucacccaggcuggagugcugugg

SEQ ID NO: 269271 - RNA, 32 nt, Human
uucaguuuuaguuucaaaauguuaacaacuug

SEQ ID NO: 269272 - RNA, 32 nt, Human
uucaguuuugagacucggauuggcucuccuug

SEQ ID NO: 269273 - RNA, 32 nt, Human
uucauaaaauacugcaagcacuucucuucaag

SEQ ID NO: 269274 - RNA, 32 nt, Human
uucauaaacugcacuucuuuacucugguaaag

SEQ ID NO: 269275 - RNA, 31 nt, Human
uucauaaaguuuagagaaaaggaauggaaag

SEQ ID NO: 269276 - RNA, 32 nt, Human
uucauaaaucauagauuucauauuacucagug

SEQ ID NO: 269277 - RNA, 32 nt, Human
uucauaacagcgucugcuauuauuacucaaaa

SEQ ID NO: 269278 - RNA, 32 nt, Human
uucauaagauggaaaugcuauaccuuaccuac

SEQ ID NO: 269279 - RNA, 32 nt, Human
uucauaaggcaguucauacugcagagaaaccc

SEQ ID NO: 269280 - RNA, 32 nt, Human
uucauaaggccugcccucccauguugcaugcc

SEQ ID NO: 269281 - RNA, 32 nt, Human
uucauaauccuuccucuauuaaaaugugaauu

SEQ ID NO: 269282 - RNA, 32 nt, Human
uucauaauguacuaggaaaaacauccugcaau

SEQ ID NO: 269283 - RNA, 32 nt, Human
uucauaauucugaaacaacuugccccaagggu

SEQ ID NO: 269284 - RNA, 32 nt, Human
uucauacaacagaaaccagaaaagcaauacug

SEQ ID NO: 269285 - RNA, 32 nt, Human
uucauacaacaucagugguuacagcuauacua

SEQ ID NO: 269286 - RNA, 32 nt, Human
uucauacaacucaagaguaaauugcucggauu

SEQ ID NO: 269287 - RNA, 32 nt, Human
uucauacacacacgcacacacgcacacaaaca

SEQ ID NO: 269288 - RNA, 32 nt, Human
uucauacacagccugggcuggggguggggugg

SEQ ID NO: 269289 - RNA, 32 nt, Human
uucauacacaugcaaucauacaugcacacuga

SEQ ID NO: 269290 - RNA, 32 nt, Human
uucauacacgugcacacacacgcauacacagg

SEQ ID NO: 269291 - RNA, 24 nt, Human
uucauacacuaaccaaaucucuca

SEQ ID NO: 269292 - RNA, 32 nt, Human
uucauacaggaaaucugugugcacgaggcauu

SEQ ID NO: 269293 - RNA, 32 nt, Human
uucauacauacucugugguaauagagacuuga

SEQ ID NO: 269294 - RNA, 32 nt, Human
uucauaccaacacaggcuucagcacuuccuuu

SEQ ID NO: 269295 - RNA, 32 nt, Human
uucauaccaagaaguuugcugagcaugauguu

SEQ ID NO: 269296 - RNA, 32 nt, Human
uucauaccccaaauauuuucagaaggacauag

SEQ ID NO: 269297 - RNA, 32 nt, Human
uucauaccucuaaugcuagcacuuuuggaggc

SEQ ID NO: 269298 - RNA, 32 nt, Human
uucauaccuguagagcacgaauccaaguagau

SEQ ID NO: 269299 - RNA, 23 nt, Human
uucauacuauauuguauuguacu

SEQ ID NO: 269300 - RNA, 32 nt, Human
uucauacucuucuaaguccucuuccagccuca

SEQ ID NO: 269301 - RNA, 32 nt, Human
uucauacugccuccucccuuguuuuucugucu

SEQ ID NO: 269302 - RNA, 32 nt, Human
uucauacuggagagaagcccuaugcauguaag

SEQ ID NO: 269303 - RNA, 32 nt, Human
uucauagaaacauggaauucucugauuuugag

SEQ ID NO: 269304 - RNA, 32 nt, Human
uucauagaaauuaggcuggagaaagaaggaag

SEQ ID NO: 269305 - RNA, 32 nt, Human
uucauagagacagggacucacuauguugucca

SEQ ID NO: 269306 - RNA, 32 nt, Human
uucauagagacaggggaucucauuauguugcc

SEQ ID NO: 269307 - RNA, 32 nt, Human
uucauagagacagggucucacuguguugucca

SEQ ID NO: 269308 - RNA, 32 nt, Human
uucauagagacaggguuucaccauguuggcca

SEQ ID NO: 269309 - RNA, 32 nt, Human
uucauagagcccagaacaaauaguaauauuuc

SEQ ID NO: 269310 - RNA, 32 nt, Human
uucauagaggcagaggguggggaagggcuggg

SEQ ID NO: 269311 - RNA, 32 nt, Human
uucauagauuuauaugaugauaugacaucugg

SEQ ID NO: 269312 - RNA, 32 nt, Human
uucauagcaaagcaguuuagcccagugacuaa

SEQ ID NO: 269313 - RNA, 32 nt, Human
uucauagcaagccucaucaucauaagccccca

SEQ ID NO: 269314 - RNA, 32 nt, Human
uucauagcucuccuuaguuuacucugccugga

SEQ ID NO: 269315 - RNA, 32 nt, Human
uucauagcugcauuaccauagcuaaacuccuc

SEQ ID NO: 269316 - RNA, 32 nt, Human
uucauaggaaauuaauuuuucuucucaaguau

SEQ ID NO: 269317 - RNA, 23 nt, Human
uucauaggcucucccucauuaca

SEQ ID NO: 269318 - RNA, 32 nt, Human
uucauagggaaagacuugcucgggagcaaguc

SEQ ID NO: 269319 - RNA, 32 nt, Human
uucauaguauuuuuaagugauauccuggugcu

SEQ ID NO: 269320 - RNA, 32 nt, Human
uucauaguguuucuuucaucaucuucauugaa

SEQ ID NO: 269321 - RNA, 32 nt, Human
uucauaguuaccacuuacgcgaguagacagaa

SEQ ID NO: 269322 - RNA, 32 nt, Human
uucauaguuucauuuguucuugcccacaagcu

SEQ ID NO: 269323 - RNA, 32 nt, Human
uucauauacucagguuccaaagggccaacugc

SEQ ID NO: 269324 - RNA, 32 nt, Human
uucauauauguaccugcacauguacccaccug

SEQ ID NO: 269325 - RNA, 22 nt, Human
uucauauauuaaauugcacuua

SEQ ID NO: 269326 - RNA, 32 nt, Human
uucauauauuuuuauagcacuuuuggaaccua

SEQ ID NO: 269327 - RNA, 32 nt, Human
uucauaucaaguccucacccuccuuccacaua

SEQ ID NO: 269328 - RNA, 32 nt, Human
uucauaucauacaguuuucuaaaacaacuuca

SEQ ID NO: 269329 - RNA, 32 nt, Human
uucauauccacugauuuccugauguccauguc

SEQ ID NO: 269330 - RNA, 32 nt, Human
uucauaucccuugggcccucgugacuaguacu

SEQ ID NO: 269331 - RNA, 32 nt, Human
uucauauccuuucuucaaaaaucuaaaugaug

SEQ ID NO: 269332 - RNA, 24 nt, Human
uucauaucuagccuggucaacaua

SEQ ID NO: 269333 - RNA, 32 nt, Human
uucauaucuagccuggucaacauagcaagacc

SEQ ID NO: 269334 - RNA, 32 nt, Human
uucauaucuccugcuguuccaucccagcuuga

SEQ ID NO: 269335 - RNA, 32 nt, Human
uucauaucuguaauccuaacacuuugacaggc

SEQ ID NO: 269336 - RNA, 32 nt, Human
uucauaugaaguacugugccccuucccuucuu

SEQ ID NO: 269337 - RNA, 32 nt, Human
uucauaugaagugcuuuacucccaaccauuga

SEQ ID NO: 269338 - RNA, 32 nt, Human
uucauaugagaacuccuuccucccuuugaaga

SEQ ID NO: 269339 - RNA, 32 nt, Human
uucauaugcuguuuguucuggauuucuuuuaa

SEQ ID NO: 269340 - RNA, 32 nt, Human
uucauauggacagagaaaaugaaagaaaggga

SEQ ID NO: 269341 - RNA, 32 nt, Human
uucauauggcugcuccagccccacuucuuagc

SEQ ID NO: 269342 - RNA, 32 nt, Human
uucauauguacaacaaacuacuuucuucuuca

SEQ ID NO: 269343 - RNA, 32 nt, Human
uucauauuacucugcuuugugcacuuuaugga

SEQ ID NO: 269344 - RNA, 32 nt, Human
uucauauucauuggccaugcuauauucauucu

SEQ ID NO: 269345 - RNA, 32 nt, Human
uucauauuccaaugcuucgucugcucaauuau

SEQ ID NO: 269346 - RNA, 32 nt, Human
uucauauucccuuuugauauguuuaccuuguu

SEQ ID NO: 269347 - RNA, 32 nt, Human
uucauauucguuaauaaacuuugcuacuuugc

SEQ ID NO: 269348 - RNA, 32 nt, Human
uucauauucuauuauugaacaguauuaaugcu

SEQ ID NO: 269349 - RNA, 32 nt, Human
uucauauuugcaccuaagauauuuccaggcug

SEQ ID NO: 269350 - RNA, 32 nt, Human
uucauauuugccaagccauccccaccacccag

SEQ ID NO: 269351 - RNA, 32 nt, Human
uucauauuuguaucagcuuuugugcuaaaacu

SEQ ID NO: 269352 - RNA, 32 nt, Human
uucauauuuuaaacuaguuccauuccacaguu

SEQ ID NO: 269353 - RNA, 20 nt, Human
uucauauuuuuagugcuuca

SEQ ID NO: 269354 - RNA, 24 nt, Human
uucauauuuuucaguagagacggg

SEQ ID NO: 269355 - RNA, 20 nt, Human
uucaucaacauaguaaaaua

SEQ ID NO: 269356 - RNA, 32 nt, Human
uucaucaagauaagcauuucuuuccugaguuc

SEQ ID NO: 269357 - RNA, 32 nt, Human
uucaucaaggaaagccuggugaagccuuuacu

SEQ ID NO: 269358 - RNA, 32 nt, Human
uucaucacaagaaaccuacucuucugucaucu

SEQ ID NO: 269359 - RNA, 22 nt, Human
uucaucacaauucauggugcua

SEQ ID NO: 269360 - RNA, 32 nt, Human
uucaucacacacacccccuuccucccccucau

SEQ ID NO: 269361 - RNA, 32 nt, Human
uucaucaccaguacauuauauguuguaauauu

SEQ ID NO: 269362 - RNA, 32 nt, Human
uucaucacccccaguaaaaccccguacccuug

SEQ ID NO: 269363 - RNA, 32 nt, Human
uucaucacccugaugacaccaggauuugaaau

SEQ ID NO: 269364 - RNA, 32 nt, Human
uucaucacugcaacauuucucugacuagcaau

SEQ ID NO: 269365 - RNA, 32 nt, Human
uucaucagaaucauagcuuggaggcuucauag

SEQ ID NO: 269366 - RNA, 32 nt, Human
uucaucagacacauaccgaacacccucuauuu

SEQ ID NO: 269367 - RNA, 32 nt, Human
uucaucagacaccagaggacacacacagugcu

SEQ ID NO: 269368 - RNA, 32 nt, Human
uucaucagcugaucggccacugccucaccugg

SEQ ID NO: 269369 - RNA, 32 nt, Human
uucaucagcuuugcuaauucugcuuugaggca

SEQ ID NO: 269370 - RNA, 32 nt, Human
uucaucaggaagggaaagggcuuuggggucag

SEQ ID NO: 269371 - RNA, 32 nt, Human
uucaucagggugagggguucuccucugaggug

SEQ ID NO: 269372 - RNA, 32 nt, Human
uucaucaguaacucacuugcccauugagaacc

SEQ ID NO: 269373 - RNA, 32 nt, Human
uucaucagugcagaguuaggccagauucauuu

SEQ ID NO: 269374 - RNA, 32 nt, Human
uucaucaucaggcugcaaugacagaauguggu

SEQ ID NO: 269375 - RNA, 32 nt, Human
uucaucaugaacacauaaccuuuuguugugac

SEQ ID NO: 269376 - RNA, 32 nt, Human
uucaucaugucgaccccaccucuugggugggc

SEQ ID NO: 269377 - RNA, 32 nt, Human
uucaucauguucauuugauacacaagugaacu

SEQ ID NO: 269378 - RNA, 32 nt, Human
uucaucauguuggccaggcuggucuggaacuc

SEQ ID NO: 269379 - RNA, 32 nt, Human
uucaucauuaacauccuucuuuucuauugcuu

SEQ ID NO: 269380 - RNA, 32 nt, Human
uucaucauuucuguauugucuuucaauaaaga

SEQ ID NO: 269381 - RNA, 32 nt, Human
uucaucauuuuccacauacuuuacuucauuua

SEQ ID NO: 269382 - RNA, 32 nt, Human
uucauccaaauguuacccuguaauacuggcau

SEQ ID NO: 269383 - RNA, 32 nt, Human
uucauccacugcauugaguagugaccccgacg

SEQ ID NO: 269384 - RNA, 32 nt, Human
uucauccagaugcacagggccuagagccucag

SEQ ID NO: 269385 - RNA, 32 nt, Human
uucauccagcaaacauugaguaccaauuauuu

SEQ ID NO: 269386 - RNA, 32 nt, Human
uucauccaggacaguggcuacacuucagguag

SEQ ID NO: 269387 - RNA, 32 nt, Human
uucauccaucuauccauccaucauccguccau

SEQ ID NO: 269388 - RNA, 32 nt, Human
uucaucccaacagcccagcaagaaggaggaga

SEQ ID NO: 269389 - RNA, 23 nt, Human
uucaucccaaccccucucagagc

SEQ ID NO: 269390 - RNA, 22 nt, Human
uucaucccaaccgggcaucaca

SEQ ID NO: 269391 - RNA, 22 nt, Human
uucaucccaacugguucucaca

SEQ ID NO: 269392 - RNA, 24 nt, Human
uucaucccacucccuuucauccca

SEQ ID NO: 269393 - RNA, 32 nt, Human
uucaucccagccugggagacagagugagaccc

SEQ ID NO: 269394 - RNA, 32 nt, Human
uucauccccaacaugggucuauuuugugcuua

SEQ ID NO: 269395 - RNA, 32 nt, Human
uucauccccaggcuggagucaggcucagcugu

SEQ ID NO: 269396 - RNA, 32 nt, Human
uucaucccccaagaggaugcggugaaguuuaa

SEQ ID NO: 269397 - RNA, 32 nt, Human
uucauccccugccuccuucaccagccuggcuu

SEQ ID NO: 269398 - RNA, 32 nt, Human
uucaucccuaucagagaacuuucuugaggcuu

SEQ ID NO: 269399 - RNA, 19 nt, Human
uucauccuacccauugcca

SEQ ID NO: 269400 - RNA, 32 nt, Human
uucauccucagcagaacuccugccuggccucu

SEQ ID NO: 269401 - RNA, 32 nt, Human
uucauccucaugggauggugaggggcaggaaa

SEQ ID NO: 269402 - RNA, 32 nt, Human
uucauccugcagcccauccacaaccugcucau

SEQ ID NO: 269403 - RNA, 32 nt, Human
uucauccugccuggcucacgggucuccugucc

SEQ ID NO: 269404 - RNA, 32 nt, Human
uucauccugggguuacgugugauggaugucag

SEQ ID NO: 269405 - RNA, 32 nt, Human
uucauccuuccugcuucccaggccaguagauc

SEQ ID NO: 269406 - RNA, 32 nt, Human
uucauccuuuucuauuucccuagaaccuuaau

SEQ ID NO: 269407 - RNA, 32 nt, Human
uucaucgaggagaacuugguagauggggagaa

SEQ ID NO: 269408 - RNA, 32 nt, Human
uucaucgggaaagaaugagggagggagaauaa

SEQ ID NO: 269409 - RNA, 19 nt, Human
uucaucgggcucucagagg

SEQ ID NO: 269410 - RNA, 32 nt, Human
uucaucgugcuggaguccaagcgucuggacag

SEQ ID NO: 269411 - RNA, 32 nt, Human
uucaucguguuaccaggauggucucggucucc

SEQ ID NO: 269412 - RNA, 32 nt, Human
uucaucuacuccaaccuccacauuuuaccuga

SEQ ID NO: 269413 - RNA, 32 nt, Human
uucaucuagccuggccgcggccuuucgcugag

SEQ ID NO: 269414 - RNA, 32 nt, Human
uucaucuauguugguuucugucucguuccaga

SEQ ID NO: 269415 - RNA, 32 nt, Human
uucaucucaaagccaaagagcugccagguaaa

SEQ ID NO: 269416 - RNA, 32 nt, Human
uucaucucaaggggcccagccuccucuggacu

SEQ ID NO: 269417 - RNA, 32 nt, Human
uucaucucagcuuuugaugguacugaugaguc

SEQ ID NO: 269418 - RNA, 32 nt, Human
uucaucucccaaagugcugggauuacaggcgu

SEQ ID NO: 269419 - RNA, 32 nt, Human
uucaucucccagagaaugggauccuuugcauc

SEQ ID NO: 269420 - RNA, 32 nt, Human
uucaucuccugccaugauucugaggccucccc

SEQ ID NO: 269421 - RNA, 32 nt, Human
uucaucucuaaaacaaaacaaaacaaaauuac

SEQ ID NO: 269422 - RNA, 32 nt, Human
uucaucucugccucucuccaccccaccccaau

SEQ ID NO: 269423 - RNA, 32 nt, Human
uucaucucuuugccccaguuuugccaucugaa

SEQ ID NO: 269424 - RNA, 32 nt, Human
uucaucugacucugguuccuccuucuccucag

SEQ ID NO: 269425 - RNA, 31 nt, Human
uucaucugcacaaugaggcuguugaaaggaa

SEQ ID NO: 269426 - RNA, 32 nt, Human
uucaucugcaccugacaucaacucugcauuug

SEQ ID NO: 269427 - RNA, 32 nt, Human
uucaucugcucuuucaaaaugagugacucuuc

SEQ ID NO: 269428 - RNA, 32 nt, Human
uucaucugcugcugaaacuguguacgacaaag

SEQ ID NO: 269429 - RNA, 32 nt, Human
uucaucugcuguauccucucccauggagacaa

SEQ ID NO: 269430 - RNA, 32 nt, Human
uucaucugcugucuuucucuuuggaaagaauc

SEQ ID NO: 269431 - RNA, 32 nt, Human
uucaucugcuuccuccuuagggaaggcuggga

SEQ ID NO: 269432 - RNA, 32 nt, Human
uucaucuggaaccuggaucuaaggagggaaga

SEQ ID NO: 269433 - RNA, 32 nt, Human
uucaucuggcaccugggcccggagaucaccaa

SEQ ID NO: 269434 - RNA, 32 nt, Human
uucaucuggcuucucucucuuaagugagaaag

SEQ ID NO: 269435 - RNA, 32 nt, Human
uucaucuguaccacacccuggugaaaccuuug

SEQ ID NO: 269436 - RNA, 32 nt, Human
uucaucuguagccugagugaccccaaaaagau

SEQ ID NO: 269437 - RNA, 32 nt, Human
uucaucugucagcucacuccagcuucacaaau

SEQ ID NO: 269438 - RNA, 32 nt, Human
uucaucuguccucauucucugcgccuuucgca

SEQ ID NO: 269439 - RNA, 32 nt, Human
uucaucuuauucuucuugacuuuuggauuuuu

SEQ ID NO: 269440 - RNA, 32 nt, Human
uucaucuucaaacucuucagaagcagcaacag

SEQ ID NO: 269441 - RNA, 32 nt, Human
uucaucuucacugcauagccucaggcuaguga

SEQ ID NO: 269442 - RNA, 32 nt, Human
uucaucuuccaagccuguagcucuugguauac

SEQ ID NO: 269443 - RNA, 32 nt, Human
uucaucuucuaauguccucauccugguuucuu

SEQ ID NO: 269444 - RNA, 32 nt, Human
uucaucuucuuccuuucccuucucccaccuuc

SEQ ID NO: 269445 - RNA, 32 nt, Human
uucaucuuuaacugggcaccugagaugggaac

SEQ ID NO: 269446 - RNA, 32 nt, Human
uucaucuuuauucccuccaucaucuagacuug

SEQ ID NO: 269447 - RNA, 23 nt, Human
uucaucuuugaaaaagucugaga

SEQ ID NO: 269448 - RNA, 32 nt, Human
uucaucuuuguaggaaggucuggccugggguc

SEQ ID NO: 269449 - RNA, 32 nt, Human
uucaucuuuguggccccagagcccagaccaca

SEQ ID NO: 269450 - RNA, 32 nt, Human
uucaugaaaugagugcccaaacuggaaaauuu

SEQ ID NO: 269451 - RNA, 32 nt, Human
uucaugaacaagucccugccucauguuaauug

SEQ ID NO: 269452 - RNA, 21 nt, Human
uucaugaacaucccccuccca

SEQ ID NO: 269453 - RNA, 32 nt, Human
uucaugaagaggcccuccucugccuuucaaaa

SEQ ID NO: 269454 - RNA, 31 nt, Human
uucaugaaggacuucuuuuuguuucuaacua

SEQ ID NO: 269455 - RNA, 32 nt, Human
uucaugaaguauuuuggauuacagguauauua

SEQ ID NO: 269456 - RNA, 32 nt, Human
uucaugaaugugccgagugacuucugacucug

SEQ ID NO: 269457 - RNA, 32 nt, Human
uucaugacacugcacuccagccugggugauag

SEQ ID NO: 269458 - RNA, 32 nt, Human
uucaugacacugcacuccagccuuggcaacaa

SEQ ID NO: 269459 - RNA, 32 nt, Human
uucaugacacugcacuccagccuuggcaacag

SEQ ID NO: 269460 - RNA, 32 nt, Human
uucaugacagcaucauauacgacugaaagaag

SEQ ID NO: 269461 - RNA, 32 nt, Human
uucaugacauagugagggaaagaaaaagcuua

SEQ ID NO: 269462 - RNA, 32 nt, Human
uucaugaccacuuucaggagagccuaggacuc

SEQ ID NO: 269463 - RNA, 24 nt, Human
uucaugaccagccugggcaacaua

SEQ ID NO: 269464 - RNA, 32 nt, Human
uucaugaccagccugggcaacauagcgagacu

SEQ ID NO: 269465 - RNA, 24 nt, Human
uucaugaccagcuuaggcaacaug

SEQ ID NO: 269466 - RNA, 32 nt, Human
uucaugacccgccuggccaacauggugaaacc

SEQ ID NO: 269467 - RNA, 32 nt, Human
uucaugacggcagccaugccucccagaggcca

SEQ ID NO: 269468 - RNA, 32 nt, Human
uucaugacuacugcugcuagcucuucaagcca

SEQ ID NO: 269469 - RNA, 24 nt, Human
uucaugacuggcuuauuucauuua

SEQ ID NO: 269470 - RNA, 24 nt, Human
uucaugacuuaaguuguuggcuca

SEQ ID NO: 269471 - RNA, 32 nt, Human
uucaugacuuccucaaggccaaggccacguuc

SEQ ID NO: 269472 - RNA, 32 nt, Human
uucaugacuuuuccauguaucuaccucacuau

SEQ ID NO: 269473 - RNA, 28 nt, Human
uucaugagcuccagaggucacagcacgc

SEQ ID NO: 269474 - RNA, 32 nt, Human
uucaugagcucucaauuucauggcaggccaua

SEQ ID NO: 269475 - RNA, 32 nt, Human
uucaugaggggaaagggagaagggugguaaau

SEQ ID NO: 269476 - RNA, 32 nt, Human
uucaugaggggaggggcgaggggaagcccacc

SEQ ID NO: 269477 - RNA, 32 nt, Human
uucaugaggugacuucuguuuuggaggugaag

SEQ ID NO: 269478 - RNA, 21 nt, Human
uucaugagguguguugcacuu

SEQ ID NO: 269479 - RNA, 23 nt, Human
uucaugaucacuugggcaguaua

SEQ ID NO: 269480 - RNA, 32 nt, Human
uucaugaucauugcauauuucuugucauugaa

SEQ ID NO: 269481 - RNA, 32 nt, Human
uucaugaugugugugcuggagaucuggcacuc

SEQ ID NO: 269482 - RNA, 32 nt, Human
uucaugcaaaacuguuuucuucuuccuucuca

SEQ ID NO: 269483 - RNA, 28 nt, Human
uucaugcagcugguggaacuagaugugu

SEQ ID NO: 269484 - RNA, 32 nt, Human
uucaugcagggacgccuccaccuuucagccug

SEQ ID NO: 269485 - RNA, 32 nt, Human
uucaugcauccuggccuugccaagguucuggc

SEQ ID NO: 269486 - RNA, 32 nt, Human
uucaugcaugcauucauccgugacacaugagu

SEQ ID NO: 269487 - RNA, 32 nt, Human
uucaugcauuuuuaaagacagaaggccuugaa

SEQ ID NO: 269488 - RNA, 32 nt, Human
uucaugccacaccuccagcagagggccuggaa

SEQ ID NO: 269489 - RNA, 32 nt, Human
uucaugccacucggagcaaccagacuuacagc

SEQ ID NO: 269490 - RNA, 32 nt, Human
uucaugccacugcacuuccagccugggugaca

SEQ ID NO: 269491 - RNA, 32 nt, Human
uucaugccaguaaucccagcacuuucggaggc

SEQ ID NO: 269492 - RNA, 32 nt, Human
uucaugcccauuuucuaucacacugggcucca

SEQ ID NO: 269493 - RNA, 32 nt, Human
uucaugcccgcaaugaacgcugugcuggguuc

SEQ ID NO: 269494 - RNA, 32 nt, Human
uucaugcccuguaauccuagaacuuugggagg

SEQ ID NO: 269495 - RNA, 32 nt, Human
uucaugcccuguaauccuagcacuuugggagg

SEQ ID NO: 269496 - RNA, 32 nt, Human
uucaugccuauaaucccagcacuuugggagac

SEQ ID NO: 269497 - RNA, 32 nt, Human
uucaugccucuuccacacagcguuuccaugca

SEQ ID NO: 269498 - RNA, 32 nt, Human
uucaugccuggaaucccagcacuuugggaggc

SEQ ID NO: 269499 - RNA, 32 nt, Human
uucaugccuggaauccuagcacuuugggaggc

SEQ ID NO: 269500 - RNA, 32 nt, Human
uucaugccuggguggccaaacaacagucuuca

SEQ ID NO: 269501 - RNA, 32 nt, Human
uucaugccuguaauccaagcacuuugagaggc

SEQ ID NO: 269502 - RNA, 32 nt, Human
uucaugccuguaauccagcacuuugggaggcu

SEQ ID NO: 269503 - RNA, 18 nt, Human
uucaugccuguaauccca

SEQ ID NO: 269504 - RNA, 32 nt, Human
uucaugccuguaaucccaacauuuugggaggc

SEQ ID NO: 269505 - RNA, 32 nt, Human
uucaugccuguaaucccaaugcuuugggaggc

SEQ ID NO: 269506 - RNA, 32 nt, Human
uucaugccuguaaucccagcacuaugggaggc

SEQ ID NO: 269507 - RNA, 32 nt, Human
uucaugccuguaaucccagcacuucacuuugg

SEQ ID NO: 269508 - RNA, 32 nt, Human
uucaugccuguaaucccagcacuugggaggcc

SEQ ID NO: 269509 - RNA, 32 nt, Human
uucaugccuguaaucccagcacuuuggaaggc

SEQ ID NO: 269510 - RNA, 32 nt, Human
uucaugccuguaaucccagcacuuugggaggc

SEQ ID NO: 269511 - RNA, 32 nt, Human
uucaugccuguaaucccaguacuuuggaaagc

SEQ ID NO: 269512 - RNA, 32 nt, Human
uucaugccuguaaucccaguacuuugggaggc

SEQ ID NO: 269513 - RNA, 32 nt, Human
uucaugccuguaauccgagugcuuuaggaggc

SEQ ID NO: 269514 - RNA, 32 nt, Human
uucaugccuuaaucccagcacuuugggaggcc

SEQ ID NO: 269515 - RNA, 18 nt, Human
uucaugccuuccugccuc

SEQ ID NO: 269516 - RNA, 32 nt, Human
uucaugccuuugacaagcauuuuugugccccc

SEQ ID NO: 269517 - RNA, 32 nt, Human
uucaugcucagcccugacuggugcuauaggcu

SEQ ID NO: 269518 - RNA, 21 nt, Human
uucaugcuccauuuuuaacca

SEQ ID NO: 269519 - RNA, 32 nt, Human
uucaugcucuccccaucccaguuuuuaggaug

SEQ ID NO: 269520 - RNA, 22 nt, Human
uucaugcucugagccucugcca

SEQ ID NO: 269521 - RNA, 24 nt, Human
uucaugcugaauacuuuucagcca

SEQ ID NO: 269522 - RNA, 21 nt, Human
uucaugcugcaguccaagcca

SEQ ID NO: 269523 - RNA, 32 nt, Human
uucaugcugcugcccaggcuggagugcagugg

SEQ ID NO: 269524 - RNA, 32 nt, Human
uucaugcuguaaucccaucacuuugggaggcc

SEQ ID NO: 269525 - RNA, 32 nt, Human
uucaugcuguagucacuccagaccauggagug

SEQ ID NO: 269526 - RNA, 32 nt, Human
uucaugcuguaugugcccgugccuguagcuuc

SEQ ID NO: 269527 - RNA, 23 nt, Human
uucaugcuuguaucuugcauuca

SEQ ID NO: 269528 - RNA, 32 nt, Human
uucauggaaaugguugacauuacacaugguau

SEQ ID NO: 269529 - RNA, 32 nt, Human
uucauggaacuuggacauacaccaccaggucc

SEQ ID NO: 269530 - RNA, 32 nt, Human
uucauggacaagggguuucaauggacagccug

SEQ ID NO: 269531 - RNA, 32 nt, Human
uucauggacacaaguugauuacaugguuuuua

SEQ ID NO: 269532 - RNA, 28 nt, Human
uucauggagaaauggaaucacacuucaa

SEQ ID NO: 269533 - RNA, 32 nt, Human
uucauggagaggggagaaggaagcuuccaagu

SEQ ID NO: 269534 - RNA, 32 nt, Human
uucauggagcacugacagcagugagucuuccc

SEQ ID NO: 269535 - RNA, 32 nt, Human
uucauggaggcagaugcugguggccucagcgg

SEQ ID NO: 269536 - RNA, 32 nt, Human
uucauggaugaaauugacucuuuuggcuccuc

SEQ ID NO: 269537 - RNA, 32 nt, Human
uucauggcaaagugauugagcugagaauugaa

SEQ ID NO: 269538 - RNA, 23 nt, Human
uucauggcaaugauauguauuca

SEQ ID NO: 269539 - RNA, 32 nt, Human
uucauggcagggacauuugcuuccuucacagg

SEQ ID NO: 269540 - RNA, 32 nt, Human
uucauggcauagaugaugauuuacagacaauu

SEQ ID NO: 269541 - RNA, 32 nt, Human
uucauggcauuugggggcucaccccaccucca

SEQ ID NO: 269542 - RNA, 32 nt, Human
uucauggcucacugcaaccuugacgucccagg

SEQ ID NO: 269543 - RNA, 32 nt, Human
uucauggcucagaagaaagaacauguuuagcu

SEQ ID NO: 269544 - RNA, 21 nt, Human
uucauggcugcuauuuauuca

SEQ ID NO: 269545 - RNA, 23 nt, Human
uucauggcuuaauagugcauuua

SEQ ID NO: 269546 - RNA, 32 nt, Human
uucauggcuucugcuuuuuaaucuuaggcuca

SEQ ID NO: 269547 - RNA, 32 nt, Human
uucauggcuuuuccugagguggcuggaaaccu

SEQ ID NO: 269548 - RNA, 32 nt, Human
uucaugggaagagagaaggaaggcccugggua

SEQ ID NO: 269549 - RNA, 32 nt, Human
uucaugggcuacaacuagcacagggaauuuag

SEQ ID NO: 269550 - RNA, 32 nt, Human
uucaugggcuguggccucugcagcgaccugcc

SEQ ID NO: 269551 - RNA, 32 nt, Human
uucaugggggcucuuucgcugcagccuccacc

SEQ ID NO: 269552 - RNA, 32 nt, Human
uucaugggggcugaggcagaacccaggagcuc

SEQ ID NO: 269553 - RNA, 32 nt, Human
uucaugggguuuuugcccuggagccucagcag

SEQ ID NO: 269554 - RNA, 32 nt, Human
uucauggguccccuaguuaggcccagauaaaa

SEQ ID NO: 269555 - RNA, 32 nt, Human
uucaugguacguauucucuagcacagucugag

SEQ ID NO: 269556 - RNA, 28 nt, Human
uucauggucaucugguuccaaagcccau

SEQ ID NO: 269557 - RNA, 32 nt, Human
uucauggugcuacaauaaccucagaaucuacu

SEQ ID NO: 269558 - RNA, 32 nt, Human
uucauggugcugcuccugcuaugguuccacag

SEQ ID NO: 269559 - RNA, 32 nt, Human
uucaugguuagaaacacaagcuggaggccgga

SEQ ID NO: 269560 - RNA, 32 nt, Human
uucaugguucaaguauuaagcaguucauucua

SEQ ID NO: 269561 - RNA, 23 nt, Human
uucaugguuuauauuuucacuua

SEQ ID NO: 269562 - RNA, 32 nt, Human
uucauguaaaacugaugugugaaugacauugc

SEQ ID NO: 269563 - RNA, 32 nt, Human
uucauguaagugagagggagacagaaagaaag

SEQ ID NO: 269564 - RNA, 32 nt, Human
uucauguaaucuucugugauaauuuggcuugg

SEQ ID NO: 269565 - RNA, 32 nt, Human
uucauguaauuguaugucuguguguguuuuau

SEQ ID NO: 269566 - RNA, 20 nt, Human
uucauguacauccauggugu

SEQ ID NO: 269567 - RNA, 21 nt, Human
uucauguacaugugucuauuc

SEQ ID NO: 269568 - RNA, 32 nt, Human
uucauguaccugcacaugugaccuuugugaac

SEQ ID NO: 269569 - RNA, 32 nt, Human
uucauguauaucuccccuagugacuaucacag

SEQ ID NO: 269570 - RNA, 32 nt, Human
uucauguauaucuccccuagugacuaucacgg

SEQ ID NO: 269571 - RNA, 32 nt, Human
uucauguaucuucugaauucuauccgugaauc

SEQ ID NO: 269572 - RNA, 32 nt, Human
uucauguauucugccaaaagcauuguuuucca

SEQ ID NO: 269573 - RNA, 32 nt, Human
uucauguauuucuuuucugucucuccaaugca

SEQ ID NO: 269574 - RNA, 32 nt, Human
uucauguccagaccucggcaguggcgugcacu

SEQ ID NO: 269575 - RNA, 32 nt, Human
uucauguccccaggaauggaaguggacccuag

SEQ ID NO: 269576 - RNA, 32 nt, Human
uucaugucccuccaagauuugagaucaauuua

SEQ ID NO: 269577 - RNA, 32 nt, Human
uucauguccuuuguagaacaugggugaagcug

SEQ ID NO: 269578 - RNA, 32 nt, Human
uucaugucuaggauaacuugcuuucuucuuuc

SEQ ID NO: 269579 - RNA, 32 nt, Human
uucaugucuguaaucccagcacuuugugaggc

SEQ ID NO: 269580 - RNA, 32 nt, Human
uucaugucuuacugaaacauuuugccagacuu

SEQ ID NO: 269581 - RNA, 32 nt, Human
uucaugucuucauuuugggaugcagcuaauau

SEQ ID NO: 269582 - RNA, 32 nt, Human
uucaugugcccccuacccuccaccccacugcc

SEQ ID NO: 269583 - RNA, 32 nt, Human
uucauguggacacacaaaggcaaacagaucug

SEQ ID NO: 269584 - RNA, 32 nt, Human
uucauguggcaccugccugccauguccacaac

SEQ ID NO: 269585 - RNA, 32 nt, Human
uucauguggcucagugccuuccucucucuacc

SEQ ID NO: 269586 - RNA, 32 nt, Human
uucaugugucaccaaguacuuuucucaugaga

SEQ ID NO: 269587 - RNA, 29 nt, Human
uucaugugucugugcauccuaggaaacaa

SEQ ID NO: 269588 - RNA, 29 nt, Human
uucauguguggcuuuuaagagcagguuug

SEQ ID NO: 269589 - RNA, 32 nt, Human
uucaugugugggcaccagggcugcggcuggaa

SEQ ID NO: 269590 - RNA, 32 nt, Human
uucauguuaaauauucaacaccaaugaucuac

SEQ ID NO: 269591 - RNA, 25 nt, Human
uucauguuaauauuauuuguacuua

SEQ ID NO: 269592 - RNA, 31 nt, Human
uucauguucaauaaauauuggguguauugaa

SEQ ID NO: 269593 - RNA, 32 nt, Human
uucauguucagaaaauucuugcucauccaggc

SEQ ID NO: 269594 - RNA, 32 nt, Human
uucauguuccaggggcgcuuggcaucucccau

SEQ ID NO: 269595 - RNA, 32 nt, Human
uucauguuccuaugcggaucuaaugccacugc

SEQ ID NO: 269596 - RNA, 32 nt, Human
uucauguucucuucucccagcaggccucauug

SEQ ID NO: 269597 - RNA, 32 nt, Human
uucauguuguuuucugugaugugcguugucug

SEQ ID NO: 269598 - RNA, 32 nt, Human
uucauguuuugugucagagaaaacauguacaa

SEQ ID NO: 269599 - RNA, 32 nt, Human
uucauguuuuugaaacagaaccauaaagcaua

SEQ ID NO: 269600 - RNA, 32 nt, Human
uucauuaaauuuuaacagcuguauuuaguuau

SEQ ID NO: 269601 - RNA, 32 nt, Human
uucauuaaccaccaaaccucuaccucuucucu

SEQ ID NO: 269602 - RNA, 32 nt, Human
uucauuaagcuucauugccaauuagcuaggaa

SEQ ID NO: 269603 - RNA, 32 nt, Human
uucauuacaaaugucucagcauugguuaacua

SEQ ID NO: 269604 - RNA, 32 nt, Human
uucauuacacuaucuucucugccuuuguacau

SEQ ID NO: 269605 - RNA, 32 nt, Human
uucauuacagaguccagguggccugcaguuga

SEQ ID NO: 269606 - RNA, 32 nt, Human
uucauuaccaacacugcagauucccauugagu

SEQ ID NO: 269607 - RNA, 32 nt, Human
uucauuaccuguagcuuugggcagauuugcaa

SEQ ID NO: 269608 - RNA, 32 nt, Human
uucauuacucagcuaacauuuagucuacucuu

SEQ ID NO: 269609 - RNA, 32 nt, Human
uucauuacuccuccuccagauaccaacugcug

SEQ ID NO: 269610 - RNA, 32 nt, Human
uucauuacuuuucugaaauucaaacaaauucu

SEQ ID NO: 269611 - RNA, 32 nt, Human
uucauuagcagcuuuuccuccucuucccugca

SEQ ID NO: 269612 - RNA, 32 nt, Human
uucauuagcuucaaagagaagcuguauuuaca

SEQ ID NO: 269613 - RNA, 32 nt, Human
uucauuagucuagacugggaauggggagggga

SEQ ID NO: 269614 - RNA, 32 nt, Human
uucauuauacaugaaauucaacuuuccaaaua

SEQ ID NO: 269615 - RNA, 32 nt, Human
uucauuauaucuaauuauuuugcaguugggca

SEQ ID NO: 269616 - RNA, 32 nt, Human
uucauuauggugcugggaagcucugucuuuga

SEQ ID NO: 269617 - RNA, 32 nt, Human
uucauuauuuggaaauuuagggguagaaaaug

SEQ ID NO: 269618 - RNA, 32 nt, Human
uucauuauuuucuuuucuuucuuccaagugca

SEQ ID NO: 269619 - RNA, 32 nt, Human
uucauucaacaaacacauaggugcuggggaug

SEQ ID NO: 269620 - RNA, 32 nt, Human
uucauucacaucuacgcgccugagugguacug

SEQ ID NO: 269621 - RNA, 32 nt, Human
uucauucacaugcucaucugagaagacuuaag

SEQ ID NO: 269622 - RNA, 21 nt, Human
uucauucaccccuccccuccc

SEQ ID NO: 269623 - RNA, 22 nt, Human
uucauucacuggaauuuacuca

SEQ ID NO: 269624 - RNA, 32 nt, Human
uucauucagagaauauuuaugaaaugccuacu

SEQ ID NO: 269625 - RNA, 32 nt, Human
uucauucagcaaccuugucuaagugguuuaug

SEQ ID NO: 269626 - RNA, 32 nt, Human
uucauucagccuguguguccuaaagccucccu

SEQ ID NO: 269627 - RNA, 32 nt, Human
uucauucagcuggcugugcugugcuguggacc

SEQ ID NO: 269628 - RNA, 32 nt, Human
uucauucagggugucugugcucugacugcaau

SEQ ID NO: 269629 - RNA, 32 nt, Human
uucauucagggugucugugcucugacuguaau

SEQ ID NO: 269630 - RNA, 26 nt, Human
uucauucaguguauccauugguguua

SEQ ID NO: 269631 - RNA, 32 nt, Human
uucauucauccagcaaacauugaguaccaauu

SEQ ID NO: 269632 - RNA, 32 nt, Human
uucauucauuauuaccugacaguauuaaacua

SEQ ID NO: 269633 - RNA, 32 nt, Human
uucauucauucauucauucauccaucagacac

SEQ ID NO: 269634 - RNA, 32 nt, Human
uucauucauuuaccuuauuaagcuuuucuuag

SEQ ID NO: 269635 - RNA, 32 nt, Human
uucauuccacgguccauuccacagcuuguucc

SEQ ID NO: 269636 - RNA, 23 nt, Human
uucauuccagccugggcaacaug

SEQ ID NO: 269637 - RNA, 32 nt, Human
uucauuccagccugggcaacaugagugaaagu

SEQ ID NO: 269638 - RNA, 21 nt, Human
uucauuccagccugggcgaca

SEQ ID NO: 269639 - RNA, 32 nt, Human
uucauuccagguggccagagcgaguggggccg

SEQ ID NO: 269640 - RNA, 32 nt, Human
uucauuccaugaugcauauuacuggauuagau

SEQ ID NO: 269641 - RNA, 32 nt, Human
uucauuccauucccuuucaucugugcucauac

SEQ ID NO: 269642 - RNA, 32 nt, Human
uucauuccauuucugcccacucccucuccucu

SEQ ID NO: 269643 - RNA, 32 nt, Human
uucauucccacauguuuaaagacauucguagg

SEQ ID NO: 269644 - RNA, 32 nt, Human
uucauucccccagggaaacagcaccuguagaa

SEQ ID NO: 269645 - RNA, 32 nt, Human
uucauucccucacuccugccuuucucauuugu

SEQ ID NO: 269646 - RNA, 32 nt, Human
uucauuccucaccuuuauccuguuaucucuau

SEQ ID NO: 269647 - RNA, 32 nt, Human
uucauuccucauaucuauccuuuucuccccuu

SEQ ID NO: 269648 - RNA, 32 nt, Human
uucauuccuccccuggcucuucucccucuuca

SEQ ID NO: 269649 - RNA, 32 nt, Human
uucauuccuccugguuauugguuuguuuguca

SEQ ID NO: 269650 - RNA, 32 nt, Human
uucauuccuugggccagcuucucagguggcuu

SEQ ID NO: 269651 - RNA, 32 nt, Human
uucauucuacacuucccugaaauuccauuuuu

SEQ ID NO: 269652 - RNA, 32 nt, Human
uucauucuagggcagugccaggaaguauauug

SEQ ID NO: 269653 - RNA, 32 nt, Human
uucauucuaucgcccaggcuggagugcaaugg

SEQ ID NO: 269654 - RNA, 32 nt, Human
uucauucuccacgcagccuggugauggcaggc

SEQ ID NO: 269655 - RNA, 32 nt, Human
uucauucucuaaugaaaacaaaacauaaaaac

SEQ ID NO: 269656 - RNA, 32 nt, Human
uucauucugaaggagcagaaacauaaucaauc

SEQ ID NO: 269657 - RNA, 32 nt, Human
uucauucugaaggcuccuguguauacacauua

SEQ ID NO: 269658 - RNA, 18 nt, Human
uucauucugaugccuccc

SEQ ID NO: 269659 - RNA, 26 nt, Human
uucauucugcaggguucucccuccca

SEQ ID NO: 269660 - RNA, 32 nt, Human
uucauucugcaguugucuggaagccugggugg

SEQ ID NO: 269661 - RNA, 32 nt, Human
uucauucugucacccaggcuggagugcaaagg

SEQ ID NO: 269662 - RNA, 32 nt, Human
uucauucuguccuucagggaaggcagaagaaa

SEQ ID NO: 269663 - RNA, 32 nt, Human
uucauucuucacuuaggggaagugaaaucgcu

SEQ ID NO: 269664 - RNA, 32 nt, Human
uucauucuugucccagaauucuguugagaaca

SEQ ID NO: 269665 - RNA, 32 nt, Human
uucauucuuugcagcuuugcuaauccaguugc

SEQ ID NO: 269666 - RNA, 32 nt, Human
uucauucuuugucccucuaguuuugccuuuug

SEQ ID NO: 269667 - RNA, 32 nt, Human
uucauucuuuuccccucucuuuucucauuuau

SEQ ID NO: 269668 - RNA, 32 nt, Human
uucauugaacuuaaagagugaaaaccauguaa

SEQ ID NO: 269669 - RNA, 32 nt, Human
uucauugaucuaugcuuugaguuugcuuucuc

SEQ ID NO: 269670 - RNA, 32 nt, Human
uucauugcacacacccacaaaugcaaaucauu

SEQ ID NO: 269671 - RNA, 31 nt, Human
uucauugcacuuugauuagcagcggaacaag

SEQ ID NO: 269672 - RNA, 32 nt, Human
uucauugcagagcgaggugaccaaacugagga

SEQ ID NO: 269673 - RNA, 32 nt, Human
uucauugcagcugcuuucugcucccucuaugg

SEQ ID NO: 269674 - RNA, 32 nt, Human
uucauugccucucuccccuuggcgucugauga

SEQ ID NO: 269675 - RNA, 32 nt, Human
uucauugcggcugcuuucugcucccuccaugg

SEQ ID NO: 269676 - RNA, 32 nt, Human
uucauugcuaugcuaauuuuuguauuuuucau

SEQ ID NO: 269677 - RNA, 32 nt, Human
uucauugcuuggauucaauccuccgggcggcu

SEQ ID NO: 269678 - RNA, 32 nt, Human
uucauuggccugaccucugcuucucaggcuaa

SEQ ID NO: 269679 - RNA, 32 nt, Human
uucauuggcucccaaucucugauaauaucaag

SEQ ID NO: 269680 - RNA, 32 nt, Human
uucauuggcuucaaaauccaaaaguuuauuuu

SEQ ID NO: 269681 - RNA, 32 nt, Human
uucauuggguuuuauacuggcuuucuuuuugg

SEQ ID NO: 269682 - RNA, 24 nt, Human
uucauuggugaggauuuccuuuga

SEQ ID NO: 269683 - RNA, 32 nt, Human
uucauuguagccuccgccucagccucuggagu

SEQ ID NO: 269684 - RNA, 32 nt, Human
uucauuguauauuugucucugaugcaaaaagg

SEQ ID NO: 269685 - RNA, 32 nt, Human
uucauugucacccaggcuggaguacaguggca

SEQ ID NO: 269686 - RNA, 32 nt, Human
uucauugugaccacucugaaguaagagcaaug

SEQ ID NO: 269687 - RNA, 23 nt, Human
uucauugugcaacuuucuagcca

SEQ ID NO: 269688 - RNA, 32 nt, Human
uucauuguggagagaaaaagcaaaugguauac

SEQ ID NO: 269689 - RNA, 32 nt, Human
uucauuguggagagaaaaagcaaaugguaugc

SEQ ID NO: 269690 - RNA, 32 nt, Human
uucauuguguuauugacauccaugucucucgu

SEQ ID NO: 269691 - RNA, 32 nt, Human
uucauuguucaaauauucauugcacaguggau

SEQ ID NO: 269692 - RNA, 32 nt, Human
uucauuguugaaacuugugagcauuuugaucc

SEQ ID NO: 269693 - RNA, 23 nt, Human
uucauuguuuaaaugguuugccu

SEQ ID NO: 269694 - RNA, 32 nt, Human
uucauuguuugcagcggaucacuggacaucaa

SEQ ID NO: 269695 - RNA, 32 nt, Human
uucauuguuuuacuuuugucuuccucacuagu

SEQ ID NO: 269696 - RNA, 32 nt, Human
uucauuguuuuuaaauuuagacuucuuauuuc

SEQ ID NO: 269697 - RNA, 32 nt, Human
uucauuuaagccuucagaaauaugagccaauu

SEQ ID NO: 269698 - RNA, 32 nt, Human
uucauuuaccucugccccaguuguuucuacua

SEQ ID NO: 269699 - RNA, 32 nt, Human
uucauuuauauuuuccuuacuaauaucuaaua

SEQ ID NO: 269700 - RNA, 32 nt, Human
uucauuucaagaaaaugcauauuuuccaauaa

SEQ ID NO: 269701 - RNA, 32 nt, Human
uucauuucacagucuaauucucccagacuagg

SEQ ID NO: 269702 - RNA, 32 nt, Human
uucauuucacagucuucuauuguuggaccacu

SEQ ID NO: 269703 - RNA, 32 nt, Human
uucauuucacugcacaucuagagaaaaacaaa

SEQ ID NO: 269704 - RNA, 32 nt, Human
uucauuucaguccuuucccccaccucagcguc

SEQ ID NO: 269705 - RNA, 32 nt, Human
uucauuuccaaaacauccaucuuucuccacuu

SEQ ID NO: 269706 - RNA, 32 nt, Human
uucauuuccuggaaguacauaggguuugguuu

SEQ ID NO: 269707 - RNA, 32 nt, Human
uucauuuccugggaaugacagcagaaagguga

SEQ ID NO: 269708 - RNA, 32 nt, Human
uucauuuccuuggggcugcaguuuugugguug

SEQ ID NO: 269709 - RNA, 22 nt, Human
uucauuucggugacagaagaga

SEQ ID NO: 269710 - RNA, 32 nt, Human
uucauuucucauuguggguuuaacuucuaaaa

SEQ ID NO: 269711 - RNA, 32 nt, Human
uucauuucucucugccucaauuccucuaguuu

SEQ ID NO: 269712 - RNA, 32 nt, Human
uucauuucucuguuaagaugcagccauccaug

SEQ ID NO: 269713 - RNA, 19 nt, Human
uucauuucuuccacugcca

SEQ ID NO: 269714 - RNA, 32 nt, Human
uucauuugaaguuugcuuuggcuaaauuuuga

SEQ ID NO: 269715 - RNA, 32 nt, Human
uucauuugagccugaacccccagaggcaggga

SEQ ID NO: 269716 - RNA, 32 nt, Human
uucauuugauauuaucuauauguauguaguug

SEQ ID NO: 269717 - RNA, 32 nt, Human
uucauuugaugcagauauuugcacaaugguuu

SEQ ID NO: 269718 - RNA, 32 nt, Human
uucauuugauuuuguuaagagugcaguauugc

SEQ ID NO: 269719 - RNA, 32 nt, Human
uucauuugauuuuguugcucccucucuccugg

SEQ ID NO: 269720 - RNA, 32 nt, Human
uucauuugcaguaucuacaucgaaugucaaaa

SEQ ID NO: 269721 - RNA, 32 nt, Human
uucauuugcuagugggacuacacauggcuuua

SEQ ID NO: 269722 - RNA, 32 nt, Human
uucauuuggaaaggaaaagucaaccaggcaca

SEQ ID NO: 269723 - RNA, 32 nt, Human
uucauuugggaaagcuaccauugauuugggag

SEQ ID NO: 269724 - RNA, 32 nt, Human
uucauuuguaggaaacugggaaauaaaaaccu

SEQ ID NO: 269725 - RNA, 32 nt, Human
uucauuuguccaugguagcccaucucuccuaa

SEQ ID NO: 269726 - RNA, 32 nt, Human
uucauuugugaguguuaaugugcugcuguuuu

SEQ ID NO: 269727 - RNA, 32 nt, Human
uucauuuguuacuuucagcuauuaaaggauac

SEQ ID NO: 269728 - RNA, 32 nt, Human
uucauuuuacuuccuuuucucugagaaaggua

SEQ ID NO: 269729 - RNA, 32 nt, Human
uucauuuuagcuucaaaacaagcugggcacac

SEQ ID NO: 269730 - RNA, 32 nt, Human
uucauuuuauuucucacuguauuuuccucaac

SEQ ID NO: 269731 - RNA, 32 nt, Human
uucauuuuccaaaugcaggagucuuggugcac

SEQ ID NO: 269732 - RNA, 32 nt, Human
uucauuuucuacacauuucaggauuuguuuua

SEQ ID NO: 269733 - RNA, 32 nt, Human
uucauuuucuuuagaaucauuugcuacuguuu

SEQ ID NO: 269734 - RNA, 32 nt, Human
uucauuuuguuuagguugaggacauacauuca

SEQ ID NO: 269735 - RNA, 32 nt, Human
uucauuuuuaucuguaccgauguaugaaagac

SEQ ID NO: 269736 - RNA, 32 nt, Human
uucauuuuucuccagaguccccaaagccacau

SEQ ID NO: 269737 - RNA, 22 nt, Human
uuccaaaaauacaaacacuagu

SEQ ID NO: 269738 - RNA, 32 nt, Human
uuccaaaacagccuguucucuccucucuccuc

SEQ ID NO: 269739 - RNA, 21 nt, Human
uuccaaaacuguguacuuguc

SEQ ID NO: 269740 - RNA, 32 nt, Human
uuccaaaagagagggauggcuuucccagaaga

SEQ ID NO: 269741 - RNA, 32 nt, Human
uuccaaaagauugcuguagcucucacagggaa

SEQ ID NO: 269742 - RNA, 32 nt, Human
uuccaaaagcuucacguuacagcauggaagcu

SEQ ID NO: 269743 - RNA, 32 nt, Human
uuccaaaagugcugggauuacaggcgugagcc

SEQ ID NO: 269744 - RNA, 32 nt, Human
uuccaaaaugucaccauuccuguaccugguuc

SEQ ID NO: 269745 - RNA, 32 nt, Human
uuccaaaauucagauucugccucugcggauaa

SEQ ID NO: 269746 - RNA, 21 nt, Human
uuccaaaauucccucuucugc

SEQ ID NO: 269747 - RNA, 32 nt, Human
uuccaaacaaaacaaaaaugucucuagguuua

SEQ ID NO: 269748 - RNA, 32 nt, Human
uuccaaacauggauuccucaacaaggccaaaa

SEQ ID NO: 269749 - RNA, 32 nt, Human
uuccaaacugaacuguagaagcagagcagcag

SEQ ID NO: 269750 - RNA, 32 nt, Human
uuccaaagaacccaaguaguauagagaccaaa

SEQ ID NO: 269751 - RNA, 32 nt, Human
uuccaaagagcccaccaccauuucacugacuc

SEQ ID NO: 269752 - RNA, 32 nt, Human
uuccaaagagguggaauuucaucagaauggag

SEQ ID NO: 269753 - RNA, 32 nt, Human
uuccaaagagucaucagaagaggaaaaaugaa

SEQ ID NO: 269754 - RNA, 32 nt, Human
uuccaaagccuuccaaacccaaaaagcuggga

SEQ ID NO: 269755 - RNA, 32 nt, Human
uuccaaagcuugcuuccuuccuccuggcugca

SEQ ID NO: 269756 - RNA, 24 nt, Human
uuccaaaggaaauaccagcuuguc

SEQ ID NO: 269757 - RNA, 32 nt, Human
uuccaaagggagcauuggaggagauugagaua

SEQ ID NO: 269758 - RNA, 21 nt, Human
uuccaaagggauaaucuugca

SEQ ID NO: 269759 - RNA, 20 nt, Human
uuccaaagggguugucuuug

SEQ ID NO: 269760 - RNA, 22 nt, Human
uuccaaagguccauacugguua

SEQ ID NO: 269761 - RNA, 19 nt, Human
uuccaaaggugguacuugu

SEQ ID NO: 269762 - RNA, 32 nt, Human
uuccaaagucacuuccacauuuuggguauuuc

SEQ ID NO: 269763 - RNA, 32 nt, Human
uuccaaaguccccagcaguggcagguguacac

SEQ ID NO: 269764 - RNA, 32 nt, Human
uuccaaaguucuuaucucuagcucagacaucu

SEQ ID NO: 269765 - RNA, 18 nt, Human
uuccaaauaaaacuugag

SEQ ID NO: 269766 - RNA, 21 nt, Human
uuccaaauaaggccuuguuca

SEQ ID NO: 269767 - RNA, 32 nt, Human
uuccaaauauccacuugcagacacuacaaaaa

SEQ ID NO: 269768 - RNA, 23 nt, Human
uuccaaaucacugggauuauagg

SEQ ID NO: 269769 - RNA, 32 nt, Human
uuccaaaucaggaaccacaaucugcccucuaa

SEQ ID NO: 269770 - RNA, 32 nt, Human
uuccaaaucaucugggacaugacccacucccc

SEQ ID NO: 269771 - RNA, 26 nt, Human
uuccaaaugaacuugcacuuguuaua

SEQ ID NO: 269772 - RNA, 27 nt, Human
uuccaaaugguaaaugaacacucacua

SEQ ID NO: 269773 - RNA, 32 nt, Human
uuccaaauguccugaauuccuguucauuaaua

SEQ ID NO: 269774 - RNA, 32 nt, Human
uuccaaauuccauuaaggucagcccaccaugu

SEQ ID NO: 269775 - RNA, 32 nt, Human
uuccaacaaucaggaccccauccugucuguuc

SEQ ID NO: 269776 - RNA, 22 nt, Human
uuccaacacacugcaccacagg

SEQ ID NO: 269777 - RNA, 32 nt, Human
uuccaacaccuugccucuuguuucaccaugaa

SEQ ID NO: 269778 - RNA, 32 nt, Human
uuccaacaucuucguucuuucucacugaccga

SEQ ID NO: 269779 - RNA, 32 nt, Human
uuccaaccacaucugcuggcucugggguccca

SEQ ID NO: 269780 - RNA, 32 nt, Human
uuccaaccaccaccaccugacaacccugcaug

SEQ ID NO: 269781 - RNA, 32 nt, Human
uuccaacccacuggcccagggccaccucuugc

SEQ ID NO: 269782 - RNA, 32 nt, Human
uuccaacccagcccuggacugaggauggaugg

SEQ ID NO: 269783 - RNA, 32 nt, Human
uuccaaccuaagauaguuaacuaccugagacc

SEQ ID NO: 269784 - RNA, 23 nt, Human
uuccaaccucccccacugcggag

SEQ ID NO: 269785 - RNA, 32 nt, Human
uuccaaccuuuuuaucuguucucuccaccuuc

SEQ ID NO: 269786 - RNA, 32 nt, Human
uuccaacggccagcaaaaagugaccggagagg

SEQ ID NO: 269787 - RNA, 32 nt, Human
uuccaacuaauguguauuaugugccuaauuuu

SEQ ID NO: 269788 - RNA, 32 nt, Human
uuccaacuacagccgccaccugcuguccuccu

SEQ ID NO: 269789 - RNA, 32 nt, Human
uuccaacuccacccucuccugccaagcaaucc

SEQ ID NO: 269790 - RNA, 32 nt, Human
uuccaacucuccccauuuuccuguucgacugg

SEQ ID NO: 269791 - RNA, 32 nt, Human
uuccaacuuccucagucuuuucugccucaacu

SEQ ID NO: 269792 - RNA, 32 nt, Human
uuccaacuuccucuugcagcaggaaagaaugc

SEQ ID NO: 269793 - RNA, 23 nt, Human
uuccaacuuguccaaaagcuuuc

SEQ ID NO: 269794 - RNA, 32 nt, Human
uuccaacuuuccauuccccaucaugcuggggg

SEQ ID NO: 269795 - RNA, 32 nt, Human
uuccaacuuucccucccuggggguguaaagga

SEQ ID NO: 269796 - RNA, 32 nt, Human
uuccaacuuugucagucuuuucugccucaacu

SEQ ID NO: 269797 - RNA, 32 nt, Human
uuccaagaaagaggaggagaguugaaaagaga

SEQ ID NO: 269798 - RNA, 32 nt, Human
uuccaagaagucagguugccaaaggaagaagc

SEQ ID NO: 269799 - RNA, 32 nt, Human
uuccaagaaugcugagguuacaggcaccauga

SEQ ID NO: 269800 - RNA, 32 nt, Human
uuccaagacuccaggaaaaacagcuuccaugg

SEQ ID NO: 269801 - RNA, 32 nt, Human
uuccaagagaagcagccccugagggagucugc

SEQ ID NO: 269802 - RNA, 32 nt, Human
uuccaagagacacuuuuccuggaaagccccug

SEQ ID NO: 269803 - RNA, 32 nt, Human
uuccaagauuccagaugugucugugagacaac

SEQ ID NO: 269804 - RNA, 32 nt, Human
uuccaagcaugcaguaucauaagaacuggaaa

SEQ ID NO: 269805 - RNA, 19 nt, Human
uuccaagccaagaacuugg

SEQ ID NO: 269806 - RNA, 32 nt, Human
uuccaagccuccagaacugugagaauucuuuu

SEQ ID NO: 269807 - RNA, 32 nt, Human
uuccaagcuagagggcugggcccuaugacugu

SEQ ID NO: 269808 - RNA, 32 nt, Human
uuccaagcuccaaauccaaggaaacaugcagc

SEQ ID NO: 269809 - RNA, 32 nt, Human
uuccaagcuccaccacuuccuaaaucuuaaga

SEQ ID NO: 269810 - RNA, 32 nt, Human
uuccaaggagacaaaucuccccugccaauuuc

SEQ ID NO: 269811 - RNA, 32 nt, Human
uuccaaggccccaccuucuaucuaagacaauc

SEQ ID NO: 269812 - RNA, 32 nt, Human
uuccaaggcccugaguaccucuugccuuguuu

SEQ ID NO: 269813 - RNA, 19 nt, Human
uuccaaggcucugcuucag

SEQ ID NO: 269814 - RNA, 32 nt, Human
uuccaaggcuguaggaguucuggagcugcugg

SEQ ID NO: 269815 - RNA, 21 nt, Human
uuccaagggaaugggcuugca

SEQ ID NO: 269816 - RNA, 32 nt, Human
uuccaaggggcaggaggagcugggcagaggag

SEQ ID NO: 269817 - RNA, 32 nt, Human
uuccaaggggcuuaugugugccaaguugugug

SEQ ID NO: 269818 - RNA, 20 nt, Human
uuccaaggugcucaccuggu

SEQ ID NO: 269819 - RNA, 32 nt, Human
uuccaaguagagucuggcaguauuaguuuccc

SEQ ID NO: 269820 - RNA, 32 nt, Human
uuccaaguagcugagacuacaggccugugcca

SEQ ID NO: 269821 - RNA, 32 nt, Human
uuccaaguccuuuaacucguugcagucuguau

SEQ ID NO: 269822 - RNA, 32 nt, Human
uuccaagugacuuagccacauuuccuucagug

SEQ ID NO: 269823 - RNA, 32 nt, Human
uuccaagugcagcaacccagcccauggagauu

SEQ ID NO: 269824 - RNA, 32 nt, Human
uuccaaguucccaggucugucugccuaagagc

SEQ ID NO: 269825 - RNA, 32 nt, Human
uuccaaguucucgauuucacaugccuucaaga

SEQ ID NO: 269826 - RNA, 19 nt, Human
uuccaaguugccacccacu

SEQ ID NO: 269827 - RNA, 32 nt, Human
uuccaaguugggacccagaaggugggguuggc

SEQ ID NO: 269828 - RNA, 32 nt, Human
uuccaaguuguucaaacauuuaccaaucauau

SEQ ID NO: 269829 - RNA, 32 nt, Human
uuccaaguuuugcauugaugucugacugccac

SEQ ID NO: 269830 - RNA, 32 nt, Human
uuccaauacauuaucaagcaagcacaaguaug

SEQ ID NO: 269831 - RNA, 32 nt, Human
uuccaauaccgauaacucagaaaccucagggu

SEQ ID NO: 269832 - RNA, 32 nt, Human
uuccaauccagaggaacaagcaugucucucug

SEQ ID NO: 269833 - RNA, 32 nt, Human
uuccaauccuacucuagauuuuuacuuucauu

SEQ ID NO: 269834 - RNA, 32 nt, Human
uuccaauccugggaaggagguggacuugagac

SEQ ID NO: 269835 - RNA, 32 nt, Human
uuccaaugaagccauaugaaccagcugucagu

SEQ ID NO: 269836 - RNA, 32 nt, Human
uuccaaugaaggacagggagcaaagggagacu

SEQ ID NO: 269837 - RNA, 32 nt, Human
uuccaaugacaaaggaaguggugaucagucug

SEQ ID NO: 269838 - RNA, 32 nt, Human
uuccaaugcagaggaaggcuguuguuuaacag

SEQ ID NO: 269839 - RNA, 22 nt, Human
uuccaauguaggauucacuuga

SEQ ID NO: 269840 - RNA, 32 nt, Human
uuccaauuccauccuggcgagauccaagugcu

SEQ ID NO: 269841 - RNA, 32 nt, Human
uuccaauucuggguccauuugcacuagcaaau

SEQ ID NO: 269842 - RNA, 24 nt, Human
uuccaauuggaaagaacaagcaaa

SEQ ID NO: 269843 - RNA, 24 nt, Human
uuccaauugguggccaucucccua

SEQ ID NO: 269844 - RNA, 24 nt, Human
uuccaauuuacugaccaauuugaa

SEQ ID NO: 269845 - RNA, 32 nt, Human
uuccaauuuuaccuucuuuaaaauagguuguu

SEQ ID NO: 269846 - RNA, 32 nt, Human
uuccacaaaggagagaaaggguggaggagggc

SEQ ID NO: 269847 - RNA, 32 nt, Human
uuccacaagagggcuuuuccacacucggugug

SEQ ID NO: 269848 - RNA, 32 nt, Human
uuccacacacaugcaguuccugcuugggugcu

SEQ ID NO: 269849 - RNA, 32 nt, Human
uuccacacagccccugcagggaaaggcuaauc

SEQ ID NO: 269850 - RNA, 32 nt, Human
uuccacacaugguuuguucaagcacacuuaau

SEQ ID NO: 269851 - RNA, 32 nt, Human
uuccacacauuuaaaacauuugaaggaccuaa

SEQ ID NO: 269852 - RNA, 32 nt, Human
uuccacacccuggcaauugugaagagcuggcc

SEQ ID NO: 269853 - RNA, 32 nt, Human
uuccacaccucagggaggccucggugauuuug

SEQ ID NO: 269854 - RNA, 22 nt, Human
uuccacaccuccugccuuuagg

SEQ ID NO: 269855 - RNA, 32 nt, Human
uuccacaccuuaaaaccaucugcucaguuuga

SEQ ID NO: 269856 - RNA, 32 nt, Human
uuccacaccuuauuggccccagaggggcccuc

SEQ ID NO: 269857 - RNA, 32 nt, Human
uuccacacgagacggggcuucagccggggaug

SEQ ID NO: 269858 - RNA, 32 nt, Human
uuccacacgaugacacuggaacugaaugccac

SEQ ID NO: 269859 - RNA, 32 nt, Human
uuccacacucgcauucaagguuccugucuucc

SEQ ID NO: 269860 - RNA, 32 nt, Human
uuccacagacaaggccuccagcacagauggca

SEQ ID NO: 269861 - RNA, 32 nt, Human
uuccacagacagggaaacaagcccagagaggg

SEQ ID NO: 269862 - RNA, 32 nt, Human
uuccacagaguugaccucucugauuuucuacu

SEQ ID NO: 269863 - RNA, 24 nt, Human
uuccacagaugagaagcagaguga

SEQ ID NO: 269864 - RNA, 32 nt, Human
uuccacagcaccugaugaacaugucuucacug

SEQ ID NO: 269865 - RNA, 32 nt, Human
uuccacagccuccaccccugacccccauccuc

SEQ ID NO: 269866 - RNA, 32 nt, Human
uuccacagcuccaccugcaucuucucaucaaa

SEQ ID NO: 269867 - RNA, 32 nt, Human
uuccacagcuccugccguucuccuugccagga

SEQ ID NO: 269868 - RNA, 32 nt, Human
uuccacaggaagcacucacaggcaccacacac

SEQ ID NO: 269869 - RNA, 32 nt, Human
uuccacaggcagcgucuccacagggagagggg

SEQ ID NO: 269870 - RNA, 32 nt, Human
uuccacagggaguaucaggggagccagaggga

SEQ ID NO: 269871 - RNA, 32 nt, Human
uuccacagggaucucucauugggucucuuugg

SEQ ID NO: 269872 - RNA, 32 nt, Human
uuccacagguucuggaauaacucuuacagcuu

SEQ ID NO: 269873 - RNA, 31 nt, Human
uuccacagucucucuggggcuguguccuaca

SEQ ID NO: 269874 - RNA, 32 nt, Human
uuccacagugccuugcauauaguaggcgccca

SEQ ID NO: 269875 - RNA, 32 nt, Human
uuccacaguggcugggugaccacagcagcugc

SEQ ID NO: 269876 - RNA, 32 nt, Human
uuccacaguucugcaggcuggaaauccaagau

SEQ ID NO: 269877 - RNA, 32 nt, Human
uuccacaguugccaccaccucuguggcauuga

SEQ ID NO: 269878 - RNA, 32 nt, Human
uuccacauaguguucgauaaagauugauaaac

SEQ ID NO: 269879 - RNA, 32 nt, Human
uuccacauccuguuggacacagagauauuaug

SEQ ID NO: 269880 - RNA, 32 nt, Human
uuccacaucggcaguuccaauggcuugggccg

SEQ ID NO: 269881 - RNA, 32 nt, Human
uuccacaucucaucuucugucacuaaauaccc

SEQ ID NO: 269882 - RNA, 32 nt, Human
uuccacaucugcuucuggagcacauuucccuc

SEQ ID NO: 269883 - RNA, 32 nt, Human
uuccacaucuuuccucuagucauuuugaaaua

SEQ ID NO: 269884 - RNA, 32 nt, Human
uuccacaugcuggauuauggugguuuuauguu

SEQ ID NO: 269885 - RNA, 32 nt, Human
uuccaccaagcgcccacccaggcugaggucuc

SEQ ID NO: 269886 - RNA, 32 nt, Human
uuccaccaaggccagaagggaaaaaggaagaa

SEQ ID NO: 269887 - RNA, 32 nt, Human
uuccaccacagcucuaucaaggcuugucaagc

SEQ ID NO: 269888 - RNA, 32 nt, Human
uuccaccacagcuggauuccaaugauucagaa

SEQ ID NO: 269889 - RNA, 32 nt, Human
uuccaccacuccuuuuccaucucccagaagcc

SEQ ID NO: 269890 - RNA, 32 nt, Human
uuccaccagaagcuguucgugcagcuggggag

SEQ ID NO: 269891 - RNA, 32 nt, Human
uuccaccagcaggauguggagcagggccacgu

SEQ ID NO: 269892 - RNA, 32 nt, Human
uuccaccaggagucuggagugcaauggcacga

SEQ ID NO: 269893 - RNA, 18 nt, Human
uuccaccaggugcagugg

SEQ ID NO: 269894 - RNA, 32 nt, Human
uuccaccaugcucuccccuucaucaagcuaac

SEQ ID NO: 269895 - RNA, 32 nt, Human
uuccaccaugcuugugagaucuucccagccaa

SEQ ID NO: 269896 - RNA, 32 nt, Human
uuccaccauugcacuccagucugggcaacaga

SEQ ID NO: 269897 - RNA, 32 nt, Human
uuccacccaagccaugggcgcugucgggcacu

SEQ ID NO: 269898 - RNA, 32 nt, Human
uuccacccacagaguggugaaucucucagcca

SEQ ID NO: 269899 - RNA, 32 nt, Human
uuccacccagaaauuccugggcuggaacuggu

SEQ ID NO: 269900 - RNA, 32 nt, Human
uuccacccagaagauaagggagggaguaucgc

SEQ ID NO: 269901 - RNA, 32 nt, Human
uuccacccaucuuuacagcagaagaauacauu

SEQ ID NO: 269902 - RNA, 32 nt, Human
uuccacccaucuuucaaggcuggucccagaag

SEQ ID NO: 269903 - RNA, 32 nt, Human
uuccaccccaacauagaguaguauuugcuuuu

SEQ ID NO: 269904 - RNA, 32 nt, Human
uuccaccccagaggagucuucuguccuccucc

SEQ ID NO: 269905 - RNA, 32 nt, Human
uuccaccccagccccucacaccacucgggaga

SEQ ID NO: 269906 - RNA, 32 nt, Human
uuccaccccagccugccuggacaacccuccuu

SEQ ID NO: 269907 - RNA, 32 nt, Human
uuccaccccaggagucagaacccuggcugcac

SEQ ID NO: 269908 - RNA, 24 nt, Human
uuccacccccaacucccuuccagg

SEQ ID NO: 269909 - RNA, 32 nt, Human
uuccaccccuggaagauggaaauaaaccugcg

SEQ ID NO: 269910 - RNA, 32 nt, Human
uuccacccucacccuucauucuucuaaccagc

SEQ ID NO: 269911 - RNA, 17 nt, Human
uuccacccuccaaccuc

SEQ ID NO: 269912 - RNA, 32 nt, Human
uuccacccuccaccaccccaaccucacauaau

SEQ ID NO: 269913 - RNA, 32 nt, Human
uuccacccuccccuucaacugccccucuaaag

SEQ ID NO: 269914 - RNA, 32 nt, Human
uuccacccugcucugccugccuggggcccugg

SEQ ID NO: 269915 - RNA, 32 nt, Human
uuccaccgagggagguggagcuucaggaugcc

SEQ ID NO: 269916 - RNA, 32 nt, Human
uuccaccggugcaaggagaugucugaauacug

SEQ ID NO: 269917 - RNA, 32 nt, Human
uuccaccgugcuccuauguaacagcugggugg

SEQ ID NO: 269918 - RNA, 32 nt, Human
uuccaccuaagccguugguaggggacuguggc

SEQ ID NO: 269919 - RNA, 32 nt, Human
uuccaccuacagcuugccauccugugaguaua

SEQ ID NO: 269920 - RNA, 19 nt, Human
uuccaccucacacccagga

SEQ ID NO: 269921 - RNA, 32 nt, Human
uuccaccucagccucagaguccagcugcccgg

SEQ ID NO: 269922 - RNA, 32 nt, Human
uuccaccucccccagucaaaaugcuuucuaaa

SEQ ID NO: 269923 - RNA, 32 nt, Human
uuccaccuccccucccuccaucaccucacgcc

SEQ ID NO: 269924 - RNA, 32 nt, Human
uuccaccugacccaaagcucucuagccacccc

SEQ ID NO: 269925 - RNA, 32 nt, Human
uuccaccugcccugucagcccaguuccccagg

SEQ ID NO: 269926 - RNA, 32 nt, Human
uuccaccuggcccagacccuguggggcagcgg

SEQ ID NO: 269927 - RNA, 32 nt, Human
uuccaccuucaucuauccuugugggccgcgug

SEQ ID NO: 269928 - RNA, 32 nt, Human
uuccaccuucucagggcucuggagggggaggg

SEQ ID NO: 269929 - RNA, 32 nt, Human
uuccacgaacuccuccuccauuuccuuuuugg

SEQ ID NO: 269930 - RNA, 18 nt, Human
uuccacgaugaaaaacuu

SEQ ID NO: 269931 - RNA, 32 nt, Human
uuccacgcaccccucuuuauucuggagcauau

SEQ ID NO: 269932 - RNA, 32 nt, Human
uuccacgccgggacaccauguucuccaucaag

SEQ ID NO: 269933 - RNA, 32 nt, Human
uuccacggcccgcacaccaccugccugcaugc

SEQ ID NO: 269934 - RNA, 32 nt, Human
uuccacgggagaggagaaacuuaaagagguuu

SEQ ID NO: 269935 - RNA, 32 nt, Human
uuccacggggaucucucauugggucucuuugg

SEQ ID NO: 269936 - RNA, 32 nt, Human
uuccacggggcuugacaccagagcagcccccg

SEQ ID NO: 269937 - RNA, 17 nt, Human
uuccacgucccuggccu

SEQ ID NO: 269938 - RNA, 32 nt, Human
uuccacgucuuuuucuccugcaaugaacugcu

SEQ ID NO: 269939 - RNA, 31 nt, Human
uuccacgugagugaggauaaagacugggcug

SEQ ID NO: 269940 - RNA, 32 nt, Human
uuccacuaaagugccuauugaaacucuuauca

SEQ ID NO: 269941 - RNA, 32 nt, Human
uuccacuaggugccauggcaaagagggauuaa

SEQ ID NO: 269942 - RNA, 32 nt, Human
uuccacucagcuggaggcucaagagggcuuga

SEQ ID NO: 269943 - RNA, 32 nt, Human
uuccacuccaaccagaagugaauauuugagac

SEQ ID NO: 269944 - RNA, 32 nt, Human
uuccacuccagccugagcaacacagugagacc

SEQ ID NO: 269945 - RNA, 32 nt, Human
uuccacuccgccgcgccuuccucccaguuucc

SEQ ID NO: 269946 - RNA, 32 nt, Human
uuccacuccuccccaucuccaggcgcugggag

SEQ ID NO: 269947 - RNA, 32 nt, Human
uuccacucucagaccuugccucccgggcugcc

SEQ ID NO: 269948 - RNA, 32 nt, Human
uuccacucuggccaaacaggcucuacucucuu

SEQ ID NO: 269949 - RNA, 32 nt, Human
uuccacucugggauauugagcagugcuccuag

SEQ ID NO: 269950 - RNA, 21 nt, Human
uuccacucuucugccuuuagg

SEQ ID NO: 269951 - RNA, 32 nt, Human
uuccacugaaaccucuguucucaugaaggaga

SEQ ID NO: 269952 - RNA, 32 nt, Human
uuccacugaccacccuauacccugaggaaagg

SEQ ID NO: 269953 - RNA, 32 nt, Human
uuccacugagaccccaggcuguuagggguuau

SEQ ID NO: 269954 - RNA, 32 nt, Human
uuccacugaggacauucagccugggaaggagg

SEQ ID NO: 269955 - RNA, 32 nt, Human
uuccacugaggggagcacuggagcagcccuuu

SEQ ID NO: 269956 - RNA, 32 nt, Human
uuccacugcauuucagccugggggauacagug

SEQ ID NO: 269957 - RNA, 32 nt, Human
uuccacugcccuuggugaaucuauuccuagug

SEQ ID NO: 269958 - RNA, 32 nt, Human
uuccacugccuuaaggaugacagucguaggga

SEQ ID NO: 269959 - RNA, 32 nt, Human
uuccacugcuauaaccaccaagccaccuucau

SEQ ID NO: 269960 - RNA, 32 nt, Human
uuccacugcucagcugccgccugguggggcca

SEQ ID NO: 269961 - RNA, 32 nt, Human
uuccacugcugccucuugaaugcagggacaaa

SEQ ID NO: 269962 - RNA, 32 nt, Human
uuccacugcuucuaccuccccucccaggaccc

SEQ ID NO: 269963 - RNA, 32 nt, Human
uuccacugucuucccuggcagcugugaugugu

SEQ ID NO: 269964 - RNA, 32 nt, Human
uuccacuuaugccuccuuuucuccuuauuccu

SEQ ID NO: 269965 - RNA, 32 nt, Human
uuccacuucccaacagcccccaucaagggacc

SEQ ID NO: 269966 - RNA, 32 nt, Human
uuccacuucugcacgucuuccuuuccccauga

SEQ ID NO: 269967 - RNA, 32 nt, Human
uuccacuucuucuguuccaugagcugcagggc

SEQ ID NO: 269968 - RNA, 32 nt, Human
uuccacuuguacugccccauccuugaauccuu

SEQ ID NO: 269969 - RNA, 32 nt, Human
uuccacuuucaucaacuuuccaucucaucgcu

SEQ ID NO: 269970 - RNA, 32 nt, Human
uuccacuuugggaggccgaggcgggcagauca

SEQ ID NO: 269971 - RNA, 32 nt, Human
uuccagaaaacaucuccaaagcuauaccaguc

SEQ ID NO: 269972 - RNA, 32 nt, Human
uuccagaaacucaagaaaaagcucaaacagaa

SEQ ID NO: 269973 - RNA, 32 nt, Human
uuccagaaagaagacgccagggaugaggcugg

SEQ ID NO: 269974 - RNA, 32 nt, Human
uuccagaaagcaggagcagcugugcugcaccc

SEQ ID NO: 269975 - RNA, 32 nt, Human
uuccagaaaggccauguacaagaggaaguacu

SEQ ID NO: 269976 - RNA, 24 nt, Human
uucgagaccagccuggucaauaug

SEQ ID NO: 269977 - RNA, 32 nt, Human
uucgagaccagccuggucaauauggugaaacc

SEQ ID NO: 269978 - RNA, 32 nt, Human
uucgagaccagccugguccacauggcaaaacc

SEQ ID NO: 269979 - RNA, 32 nt, Human
uucgagaccagccuguccaacauggcgaaccu

SEQ ID NO: 269980 - RNA, 32 nt, Human
uucgagaccagccuguucagcauagcaggacc

SEQ ID NO: 269981 - RNA, 32 nt, Human
uucgagaccagccuuaccaacauggagaaacc

SEQ ID NO: 269982 - RNA, 32 nt, Human
uucgagaccagccuugccaacauagugaaacc

SEQ ID NO: 269983 - RNA, 32 nt, Human
uucgagaccagccuuggccaacauggcgaaac

SEQ ID NO: 269984 - RNA, 32 nt, Human
uucgagaccagcguggucaacaugguguaacc

SEQ ID NO: 269985 - RNA, 23 nt, Human
uucgagaccagcugggcaacaug

SEQ ID NO: 269986 - RNA, 32 nt, Human
uucgagaccagcugggcaacauggugaaaccc

SEQ ID NO: 269987 - RNA, 24 nt, Human
uucgagaccagcuuggccaacaug

SEQ ID NO: 269988 - RNA, 32 nt, Human
uucgagaccagcuuggccaacauggugaagcu

SEQ ID NO: 269989 - RNA, 32 nt, Human
uucgagaccagcuuggccaacaugucgaaacu

SEQ ID NO: 269990 - RNA, 24 nt, Human
uucgagaccagcuuggccaauaua

SEQ ID NO: 269991 - RNA, 24 nt, Human
uucgagaccagcuugggcaacaug

SEQ ID NO: 269992 - RNA, 32 nt, Human
uucgagaccagcuugggcaacauggagaaacc

SEQ ID NO: 269993 - RNA, 32 nt, Human
uucgagaccagcuugggcaacauggcgaaacc

SEQ ID NO: 269994 - RNA, 32 nt, Human
uucgagaccagcuugggcaacauggugaaacc

SEQ ID NO: 269995 - RNA, 24 nt, Human
uucgagaccagcuugggcaauaua

SEQ ID NO: 269996 - RNA, 32 nt, Human
uucgagaccaggcuggccaacacggugaaacg

SEQ ID NO: 269997 - RNA, 32 nt, Human
uucgagaccagguuggccaacauggugagacc

SEQ ID NO: 269998 - RNA, 32 nt, Human
uucgagaccagucucaccaacauggagaaacc

SEQ ID NO: 269999 - RNA, 24 nt, Human
uucgagaccagucugagcaacaua

SEQ ID NO: 270000 - RNA, 32 nt, Human
uucgagaccagucuggccaacauagugaaagc

SEQ ID NO: 270001 - RNA, 32 nt, Human
uucgagaccagucuggccaacauagugaaauc

SEQ ID NO: 270002 - RNA, 32 nt, Human
uucgagaccagucuggccaacaucgugaaacc

SEQ ID NO: 270003 - RNA, 24 nt, Human
uucgagaccagucuggccaacaug

SEQ ID NO: 270004 - RNA, 32 nt, Human
uucgagaccagucuggccaacauggcgaaacc

SEQ ID NO: 270005 - RNA, 32 nt, Human
uucgagaccagucuggccaaccuggugaaacc

SEQ ID NO: 270006 - RNA, 32 nt, Human
uucgagaccagucuggcccacauggugaaacc

SEQ ID NO: 270007 - RNA, 32 nt, Human
uucgagaccagucugggcaacauagugaaacc

SEQ ID NO: 270008 - RNA, 24 nt, Human
uucgagaccagucuggucaacaug

SEQ ID NO: 270009 - RNA, 32 nt, Human
uucgagaccagucuggucaacauggugaaacc

SEQ ID NO: 270010 - RNA, 32 nt, Human
uucgagaccauccuggccaacauggcgaaacc

SEQ ID NO: 270011 - RNA, 32 nt, Human
uucgagaccauccuggccaacauggugaaacc

SEQ ID NO: 270012 - RNA, 24 nt, Human
uucgagaccauccugggcaauaug

SEQ ID NO: 270013 - RNA, 32 nt, Human
uucgagaccaucuuggcuaacauggugaaacc

SEQ ID NO: 270014 - RNA, 32 nt, Human
uucgagacccaccuggacaacauagugaaacc

SEQ ID NO: 270015 - RNA, 24 nt, Human
uucgagaccggccuggccaacaug

SEQ ID NO: 270016 - RNA, 32 nt, Human
uucgagaccggccuggccaacauggugaaacc

SEQ ID NO: 270017 - RNA, 24 nt, Human
uucgagaccggccuggccaauaug

SEQ ID NO: 270018 - RNA, 32 nt, Human
uucgagaccggccuggccaauauggugaaacc

SEQ ID NO: 270019 - RNA, 24 nt, Human
uucgagaccggccuggucaacaug

SEQ ID NO: 270020 - RNA, 32 nt, Human
uucgagaccggccuggucaacauggugaaacc

SEQ ID NO: 270021 - RNA, 24 nt, Human
uucgagaccggucuggccaacaug

SEQ ID NO: 270022 - RNA, 32 nt, Human
uucgagaccggucuggccaacauggugaaacc

SEQ ID NO: 270023 - RNA, 32 nt, Human
uucgagaccugccugaccaacaugcugaaacc

SEQ ID NO: 270024 - RNA, 32 nt, Human
uucgagaccugccuggccaacauggcaacacc

SEQ ID NO: 270025 - RNA, 32 nt, Human
uucgagacgacccuggccaacauggugaaauc

SEQ ID NO: 270026 - RNA, 32 nt, Human
uucgagacuagccugaccaacauggagaaacc

SEQ ID NO: 270027 - RNA, 32 nt, Human
uucgagacuagccugaccaacauggugaaacu

SEQ ID NO: 270028 - RNA, 24 nt, Human
uucgagacuagccuggacagcaug

SEQ ID NO: 270029 - RNA, 24 nt, Human
uucgagacuagccuggccaacaug

SEQ ID NO: 270030 - RNA, 32 nt, Human
uucgagacuagccuggccaacaugguaaaacc

SEQ ID NO: 270031 - RNA, 32 nt, Human
uucgagacuagccuggccaacauggugauacc

SEQ ID NO: 270032 - RNA, 24 nt, Human
uucgagacuagccuggccaauaug

SEQ ID NO: 270033 - RNA, 32 nt, Human
uucgagacuagccuggccaauaugguaaaacc

SEQ ID NO: 270034 - RNA, 32 nt, Human
uucgagacuagccuggccaccguggcgaaaca

SEQ ID NO: 270035 - RNA, 32 nt, Human
uucgagacuagccuggcuaauacagugaaacc

SEQ ID NO: 270036 - RNA, 32 nt, Human
uucgagacuagccugggcaacauagcgagacc

SEQ ID NO: 270037 - RNA, 24 nt, Human
uucgagacuagccugggcaacgug

SEQ ID NO: 270038 - RNA, 24 nt, Human
uucgagacuagcuuggccaacaug

SEQ ID NO: 270039 - RNA, 32 nt, Human
uucgagacuagcuuggccaacauggugaaacc

SEQ ID NO: 270040 - RNA, 24 nt, Human
uucgagacuugccugggcggcaua

SEQ ID NO: 270041 - RNA, 32 nt, Human
uucgagagcagagcacaccccuaagugcgugg

SEQ ID NO: 270042 - RNA, 32 nt, Human
uucgagagcagccuggccaacaccgugaaccu

SEQ ID NO: 270043 - RNA, 24 nt, Human
uucgagagcagccuggccaacaug

SEQ ID NO: 270044 - RNA, 32 nt, Human
uucgagagcagccuggccaacaugaugaaacc

SEQ ID NO: 270045 - RNA, 32 nt, Human
uucgagagcagccuggccaacauggcaaaacc

SEQ ID NO: 270046 - RNA, 32 nt, Human
uucgagagcagccuggccaauaugaugaaacc

SEQ ID NO: 270047 - RNA, 24 nt, Human
uucgagagcagccugggcaacaug

SEQ ID NO: 270048 - RNA, 32 nt, Human
uucgagagcagccugggcaacauggugaaagc

SEQ ID NO: 270049 - RNA, 24 nt, Human
uucgagagcagccuggucaacaua

SEQ ID NO: 270050 - RNA, 32 nt, Human
uucgagagcagccuggucaacauagugaaacc

SEQ ID NO: 270051 - RNA, 32 nt, Human
uucgagagcauccuggccaacguggugaaacc

SEQ ID NO: 270052 - RNA, 32 nt, Human
uucgagaucagcauggccaacauggugaagcc

SEQ ID NO: 270053 - RNA, 24 nt, Human
uucgagaucagccuaggcaacaug

SEQ ID NO: 270054 - RNA, 32 nt, Human
uucgagaucagccuaggcaacauggugaaauc

SEQ ID NO: 270055 - RNA, 32 nt, Human
uucgagaucagccugaccaacaugaugaaaug

SEQ ID NO: 270056 - RNA, 32 nt, Human
uucgagaucagccugaccaacauggagaaacc

SEQ ID NO: 270057 - RNA, 32 nt, Human
uucgagaucagccugaccaacauggugaaacc

SEQ ID NO: 270058 - RNA, 32 nt, Human
uucgagaucagccuggacaauacggugagacc

SEQ ID NO: 270059 - RNA, 24 nt, Human
uucgagaucagccuggccaacaug

SEQ ID NO: 270060 - RNA, 32 nt, Human
uucgagaucagccuggccaacauggcaaaacc

SEQ ID NO: 270061 - RNA, 32 nt, Human
uucgagaucagccuggccaacauggugaaacc

SEQ ID NO: 270062 - RNA, 32 nt, Human
uucgagaucagccuggccaacauggugaaauc

SEQ ID NO: 270063 - RNA, 32 nt, Human
uucgagaucagccuggccaauagggugaaacu

SEQ ID NO: 270064 - RNA, 24 nt, Human
uucgagaucagccugggcaucaug

SEQ ID NO: 270065 - RNA, 24 nt, Human
uucgagaucagccuggguaacaua

SEQ ID NO: 270066 - RNA, 32 nt, Human
uucgagaucagccuggguaacauagcgagacc

SEQ ID NO: 270067 - RNA, 32 nt, Human
uucgagaucagcgggaccaacauggugaaacc

SEQ ID NO: 270068 - RNA, 32 nt, Human
uucgagauccacccgugugucuggaagggacu

SEQ ID NO: 270069 - RNA, 32 nt, Human
uucgagaugagccuggccaacauggugaaacc

SEQ ID NO: 270070 - RNA, 32 nt, Human
uucgagauuagccuggccgacauggcaaaacc

SEQ ID NO: 270071 - RNA, 32 nt, Human
uucgagauuagucuggccaacauggugaaacc

SEQ ID NO: 270072 - RNA, 21 nt, Human
uucgagcagaacauucccagc

SEQ ID NO: 270073 - RNA, 32 nt, Human
uucgagcauaagaggcauaugaauggugucuu

SEQ ID NO: 270074 - RNA, 32 nt, Human
uucgagcaucccucggauaggccgggugucag

SEQ ID NO: 270075 - RNA, 32 nt, Human
uucgagcauggaggggcacuggggaagguccc

SEQ ID NO: 270076 - RNA, 32 nt, Human
uucgagccagccugaccaacaugaugaaaccc

SEQ ID NO: 270077 - RNA, 32 nt, Human
uucgagccagugggugucucuccuuugggccu

SEQ ID NO: 270078 - RNA, 32 nt, Human
uucgagcccagccugaccaauaugaugaaacc

SEQ ID NO: 270079 - RNA, 32 nt, Human
uucgagcccagccugaccaauauggugaaacc

SEQ ID NO: 270080 - RNA, 24 nt, Human
uucgagcccagccuggccaacaug

SEQ ID NO: 270081 - RNA, 32 nt, Human
uucgagcccagccuggccaacauggcgaaacc

SEQ ID NO: 270082 - RNA, 32 nt, Human
uucgagcccagccuggccaacauggugaaacc

SEQ ID NO: 270083 - RNA, 32 nt, Human
uucgagcccugaguaugugcccugcuguuacu

SEQ ID NO: 270084 - RNA, 32 nt, Human
uucgagcucuugaccaccuccaauguguaggu

SEQ ID NO: 270085 - RNA, 32 nt, Human
uucgagcugcaacuacaugugugggagagugg

SEQ ID NO: 270086 - RNA, 32 nt, Human
uucgagcuuccacgcaccagccacuccgggga

SEQ ID NO: 270087 - RNA, 32 nt, Human
uucgaggagaagggaaggaugcagcuuugccu

SEQ ID NO: 270088 - RNA, 32 nt, Human
uucgaggagauggagaaguaacagcauguguu

SEQ ID NO: 270089 - RNA, 32 nt, Human
uucgaggaggccagagguggcgaggcaggcuu

SEQ ID NO: 270090 - RNA, 32 nt, Human
uucgaggaggguggggcagggaaagggcuggc

SEQ ID NO: 270091 - RNA, 32 nt, Human
uucgaggccagccugaccaacauggagaaacc

SEQ ID NO: 270092 - RNA, 32 nt, Human
uucgaggccagccugaccaacauggugaaaca

SEQ ID NO: 270093 - RNA, 32 nt, Human
uucgaggccagccugaccaacauggugaaacc

SEQ ID NO: 270094 - RNA, 32 nt, Human
uucgaggccagccugaccaacguggagaaaug

SEQ ID NO: 270095 - RNA, 24 nt, Human
uucgaggccagccuggccaacaug

SEQ ID NO: 270096 - RNA, 32 nt, Human
uucgaggccagccuggccaacaugacaaaacc

SEQ ID NO: 270097 - RNA, 32 nt, Human
uucgaggccagccuggccaacaugaugaaacc

SEQ ID NO: 270098 - RNA, 32 nt, Human
uucgaggccagccuggccaacauggugaaacc

SEQ ID NO: 270099 - RNA, 24 nt, Human
uucgaggccagccuggccaauaug

SEQ ID NO: 270100 - RNA, 24 nt, Human
uucgaggccagccugggcaacaug

SEQ ID NO: 270101 - RNA, 32 nt, Human
uucgaggcccuguacagccaggccaggaccaa

SEQ ID NO: 270102 - RNA, 32 nt, Human
uucgaggccuggccggguugggccuacuucuc

SEQ ID NO: 270103 - RNA, 32 nt, Human
uucgaggccuucccacaggagcguacucacuc

SEQ ID NO: 270104 - RNA, 32 nt, Human
uucgaggccuugcuuuucucucuucuucauuc

SEQ ID NO: 270105 - RNA, 32 nt, Human
uucgaggcgagccuggccaacauggugaaacc

SEQ ID NO: 270106 - RNA, 32 nt, Human
uucgaggcuagauucucgaaagacauccugaa

SEQ ID NO: 270107 - RNA, 32 nt, Human
uucgagggaggcagcgccuaggccagcacgga

SEQ ID NO: 270108 - RNA, 32 nt, Human
uucgagggcagccugaccaacauagugaaacc

SEQ ID NO: 270109 - RNA, 32 nt, Human
uucgaggucagcccggccuacauggugaaacc

SEQ ID NO: 270110 - RNA, 32 nt, Human
uucgaggucaugcuuugagcaaaagccauuaa

SEQ ID NO: 270111 - RNA, 32 nt, Human
uucgaggugggccuggccgugguggugcagga

SEQ ID NO: 270112 - RNA, 32 nt, Human
uucgagguugcagugagccaugaucaugccac

SEQ ID NO: 270113 - RNA, 32 nt, Human
uucgaguagcuggaaugacuacaggcaugggc

SEQ ID NO: 270114 - RNA, 32 nt, Human
uucgagucagcagccuuuggagacggcagacu

SEQ ID NO: 270115 - RNA, 32 nt, Human
uucgaguccagccuggccaacauggugaaacc

SEQ ID NO: 270116 - RNA, 24 nt, Human
uucgaguccagccuggccaauaug

SEQ ID NO: 270117 - RNA, 32 nt, Human
uucgaguccagccuggccaauaugcugaaacc

SEQ ID NO: 270118 - RNA, 24 nt, Human
uucgaguccagccugggcagcaua

SEQ ID NO: 270119 - RNA, 32 nt, Human
uucgaguccagccugggcagcauagugugaga

SEQ ID NO: 270120 - RNA, 32 nt, Human
uucgagucucaaaauaaagaguuccugaugga

SEQ ID NO: 270121 - RNA, 32 nt, Human
uucgaguuaccuaggaacuggaaauguuggug

SEQ ID NO: 270122 - RNA, 32 nt, Human
uucgaguuguacaaaguuaagcauuaaucaga

SEQ ID NO: 270123 - RNA, 32 nt, Human
uucgauaccagccugaccaacauggcgaaacc

SEQ ID NO: 270124 - RNA, 24 nt, Human
uucgauaccagccuggccaacaug

SEQ ID NO: 270125 - RNA, 32 nt, Human
uucgauaccagccuggccaacauggugaaacc

SEQ ID NO: 270126 - RNA, 32 nt, Human
uucgauaccagccuggccaauaugcaaaacca

SEQ ID NO: 270127 - RNA, 32 nt, Human
uucgauaccagccuggccaauaugcgaaacca

SEQ ID NO: 270128 - RNA, 32 nt, Human
uucgauaccagccugggcaacauagugggauc

SEQ ID NO: 270129 - RNA, 32 nt, Human
uucgaucuuggaauugaaaguaaagcuggaaa

SEQ ID NO: 270130 - RNA, 32 nt, Human
uucgauggacgcaaucuuaagccacccuggcc

SEQ ID NO: 270131 - RNA, 32 nt, Human
uucgauucaaagcuucggcaagacgaagaaaa

SEQ ID NO: 270132 - RNA, 32 nt, Human
uucgauucagagcuggaguggaagaagcagcc

SEQ ID NO: 270133 - RNA, 32 nt, Human
uucgauucuuccaaaaucagagacagagugcu

SEQ ID NO: 270134 - RNA, 32 nt, Human
uucgauuucagaagcuggggcaguccagucac

SEQ ID NO: 270135 - RNA, 32 nt, Human
uucgauuuucaccugguucugggaaauaucuu

SEQ ID NO: 270136 - RNA, 32 nt, Human
uucgcaaagaagcugacuucagagggggaaac

SEQ ID NO: 270137 - RNA, 24 nt, Human
uucgcaaccagccuggccaauaug

SEQ ID NO: 270138 - RNA, 32 nt, Human
uucgcaaccagccuggccaauauggugagacc

SEQ ID NO: 270139 - RNA, 32 nt, Human
uucgcacacagcuggcuccaggaaaauacacc

SEQ ID NO: 270140 - RNA, 32 nt, Human
uucgcacaggcagcgggaggaggggcggcgcg

SEQ ID NO: 270141 - RNA, 32 nt, Human
uucgcaccacugcacuccagccugggugauag

SEQ ID NO: 270142 - RNA, 32 nt, Human
uucgcaccucaucaaacagaacaaauaaguua

SEQ ID NO: 270143 - RNA, 32 nt, Human
uucgcacuccauggccuccuguccuggacccc

SEQ ID NO: 270144 - RNA, 32 nt, Human
uucgcacugcuuguugggcucaucaugaagcg

SEQ ID NO: 270145 - RNA, 32 nt, Human
uucgcacuggguugcauugauucccccucuga

SEQ ID NO: 270146 - RNA, 32 nt, Human
uucgcacuuugcccucugccugguggggaggg

SEQ ID NO: 270147 - RNA, 32 nt, Human
uucgcagaagugaggaaggcaaauacucaggg

SEQ ID NO: 270148 - RNA, 32 nt, Human
uucgcagauccuggcggggcugugccaacgcu

SEQ ID NO: 270149 - RNA, 23 nt, Human
uucgcagcccgcuuccggccuca

SEQ ID NO: 270150 - RNA, 32 nt, Human
uucgcagcugucuccccuccgcagcagauacc

SEQ ID NO: 270151 - RNA, 32 nt, Human
uucgcagggcaauuuccuccugugacgguugc

SEQ ID NO: 270152 - RNA, 32 nt, Human
uucgcagggggugggaaugggguggggucacu

SEQ ID NO: 270153 - RNA, 32 nt, Human
uucgcagucacucccaauccugccucacccca

SEQ ID NO: 270154 - RNA, 32 nt, Human
uucgcaucuccuccucgcgcgucuuggacaug

SEQ ID NO: 270155 - RNA, 32 nt, Human
uucgcaucucuccuuuuccugguuagacucug

SEQ ID NO: 270156 - RNA, 32 nt, Human
uucgcaugccacugcacuccagccugggcgac

SEQ ID NO: 270157 - RNA, 32 nt, Human
uucgccacccaggaugguggcaucgggcugcu

SEQ ID NO: 270158 - RNA, 32 nt, Human
uucgccacugcacaccagccugggugacagug

SEQ ID NO: 270159 - RNA, 32 nt, Human
uucgccagcuagaagcgggacugaggcugccu

SEQ ID NO: 270160 - RNA, 32 nt, Human
uucgccaggagggcacguucgcgccgcgccgc

SEQ ID NO: 270161 - RNA, 31 nt, Human
uucgccaugaaaacuaaggcugccuuagcua

SEQ ID NO: 270162 - RNA, 32 nt, Human
uucgccaugaaccuugccaugggugaggaaaa

SEQ ID NO: 270163 - RNA, 32 nt, Human
uucgccauguugaccaggcuggucuugaacuc

SEQ ID NO: 270164 - RNA, 32 nt, Human
uucgccauguugcucaggcugaucucaaacuc

SEQ ID NO: 270165 - RNA, 32 nt, Human
uucgccauguuggccaggcugaucuugaacuc

SEQ ID NO: 270166 - RNA, 32 nt, Human
uucgccauguuugccaggcugguccugaaugc

SEQ ID NO: 270167 - RNA, 32 nt, Human
uucgccauguuuuccaggcugaucuugaaccu

SEQ ID NO: 270168 - RNA, 32 nt, Human
uucgccauugcaucuacucuuugcugcacaca

SEQ ID NO: 270169 - RNA, 32 nt, Human
uucgcccaggcugaguacaguggugcaaucuc

SEQ ID NO: 270170 - RNA, 23 nt, Human
uucgcccaggcuggagugcagug

SEQ ID NO: 270171 - RNA, 32 nt, Human
uucgcccaucacugcccucugacuccaggcca

SEQ ID NO: 270172 - RNA, 32 nt, Human
uucgcccccugcccggcuccgcggcgcggagg

SEQ ID NO: 270173 - RNA, 32 nt, Human
uucgccccucgagggaggugacccuuggccac

SEQ ID NO: 270174 - RNA, 32 nt, Human
uucgccccugaggcccggugacccuucgcccg

SEQ ID NO: 270175 - RNA, 31 nt, Human
uucgcccgcgucucugggcuuuugcucuguc

SEQ ID NO: 270176 - RNA, 32 nt, Human
uucgcccuggucguugcacuccagccugucgc

SEQ ID NO: 270177 - RNA, 19 nt, Human
uucgccgccgccgccgccg

SEQ ID NO: 270178 - RNA, 32 nt, Human
uucgccgcugcuguaguuccccggcuggaugc

SEQ ID NO: 270179 - RNA, 32 nt, Human
uucgccggggucuucugcauccuggccauugg

SEQ ID NO: 270180 - RNA, 32 nt, Human
uucgccgucugcgucucccccacgccgccucg

SEQ ID NO: 270181 - RNA, 32 nt, Human
uucgccgugccucagcgagcaggugugugugg

SEQ ID NO: 270182 - RNA, 32 nt, Human
uucgccuaucaucuggccacaugaggcuguca

SEQ ID NO: 270183 - RNA, 32 nt, Human
uucgccuccaaggacugaauuuugccaauuac

SEQ ID NO: 270184 - RNA, 32 nt, Human
uucgccucccaccaugacucugaggccuacac

SEQ ID NO: 270185 - RNA, 32 nt, Human
uucgccucccgaagugcugggauuacagaugu

SEQ ID NO: 270186 - RNA, 32 nt, Human
uucgccucccgccaugauucugaggccucccu

SEQ ID NO: 270187 - RNA, 32 nt, Human
uucgccucgccaccuugccuguccucaggacg

SEQ ID NO: 270188 - RNA, 32 nt, Human
uucgccucuccucccgggagucuucugccuac

SEQ ID NO: 270189 - RNA, 32 nt, Human
uucgccucugcucucagcuuugcaccucguca

SEQ ID NO: 270190 - RNA, 32 nt, Human
uucgccugcugcugggaccaugggggcugggg

SEQ ID NO: 270191 - RNA, 32 nt, Human
uucgccuuauguucuucuugccggacucuuuu

SEQ ID NO: 270192 - RNA, 32 nt, Human
uucgccuucagccaccauggggaaugggauga

SEQ ID NO: 270193 - RNA, 32 nt, Human
uucgcgaaggagcaaggcugaagaaccagacc

SEQ ID NO: 270194 - RNA, 21 nt, Human
uucgcgaaggugucgcugcca

SEQ ID NO: 270195 - RNA, 32 nt, Human
uucgcgaccagccuacccaacauggugaaacc

SEQ ID NO: 270196 - RNA, 32 nt, Human
uucgcgaccagccugaccaacauggaaaaacc

SEQ ID NO: 270197 - RNA, 32 nt, Human
uucgcgagaaagucacauucggacccuuuggc

SEQ ID NO: 270198 - RNA, 32 nt, Human
uucgcgagcgcuggcuauggguccuggggcgc

SEQ ID NO: 270199 - RNA, 32 nt, Human
uucgcgagugugagagggaagcgccgcggccu

SEQ ID NO: 270200 - RNA, 32 nt, Human
uucgcgcagccuguuguuuuccuuagacaggu

SEQ ID NO: 270201 - RNA, 32 nt, Human
uucgcgcgugagcugcgcgggucgggccuggu

SEQ ID NO: 270202 - RNA, 32 nt, Human
uucgcgcugcgcgccccggccuccagggacuc

SEQ ID NO: 270203 - RNA, 32 nt, Human
uucgcggaggagucgagcagaagaauagaagg

SEQ ID NO: 270204 - RNA, 26 nt, Human
uucgcgggaaggcguuuguggugcca

SEQ ID NO: 270205 - RNA, 22 nt, Human
uucgcggugccagccucugcag

SEQ ID NO: 270206 - RNA, 32 nt, Human
uucgcgucgcagcucuggacugcauggaagag

SEQ ID NO: 270207 - RNA, 32 nt, Human
uucgcguuucaggcgcucguguuuuccgggaa

SEQ ID NO: 270208 - RNA, 32 nt, Human
uucgcguuuggucggccagggagcugccuucc

SEQ ID NO: 270209 - RNA, 32 nt, Human
uucgcucacaauaauacacagccccuggaugg

SEQ ID NO: 270210 - RNA, 32 nt, Human
uucgcucagagaucccgugggguggggcaggg

SEQ ID NO: 270211 - RNA, 32 nt, Human
uucgcuccaagaagaggaaggcgggagcuucu

SEQ ID NO: 270212 - RNA, 32 nt, Human
uucgcuccaagccucaggccaccggcuuggau

SEQ ID NO: 270213 - RNA, 32 nt, Human
uucgcucccucgggaugcaaaggccaacuuca

SEQ ID NO: 270214 - RNA, 32 nt, Human
uucgcuccuauucaacccgggauuuccaggac

SEQ ID NO: 270215 - RNA, 32 nt, Human
uucgcuccuccuggucucuguccucuucccua

SEQ ID NO: 270216 - RNA, 32 nt, Human
uucgcucugcugcccaggcuggaguacaguga

SEQ ID NO: 270217 - RNA, 32 nt, Human
uucgcucugucgcccaggcuggagugcagugg

SEQ ID NO: 270218 - RNA, 32 nt, Human
uucgcucuguugcccaggcuggagugcagugg

SEQ ID NO: 270219 - RNA, 32 nt, Human
uucgcucuguugcccaggcuggaguguaaugg

SEQ ID NO: 270220 - RNA, 22 nt, Human
uucgcucuugcugcuccccuga

SEQ ID NO: 270221 - RNA, 23 nt, Human
uucgcucuugucacccaggcugg

SEQ ID NO: 270222 - RNA, 23 nt, Human
uucgcucuugucauccuggcugg

SEQ ID NO: 270223 - RNA, 22 nt, Human
uucgcucuugucgcccaggcug

SEQ ID NO: 270224 - RNA, 23 nt, Human
uucgcucuugucgcccaggcugg

SEQ ID NO: 270225 - RNA, 23 nt, Human
uucgcucuuguugcccaagcugg

SEQ ID NO: 270226 - RNA, 23 nt, Human
uucgcucuuguugcccaggcgga

SEQ ID NO: 270227 - RNA, 21 nt, Human
uucgcucuuguugcccaggcu

SEQ ID NO: 270228 - RNA, 24 nt, Human
uucgcucuuguugcccaggcuaga

SEQ ID NO: 270229 - RNA, 23 nt, Human
uucgcucuuguugcccaggcugg

SEQ ID NO: 270230 - RNA, 24 nt, Human
uucgcucuuguugcccaggcuuga

SEQ ID NO: 270231 - RNA, 23 nt, Human
uucgcucuuguugcccgggcugg

SEQ ID NO: 270232 - RNA, 23 nt, Human
uucgcucuuguugcucagacugg

SEQ ID NO: 270233 - RNA, 23 nt, Human
uucgcucuuguugcugaggcugg

SEQ ID NO: 270234 - RNA, 23 nt, Human
uucgcucuuguuggcuaggcugg

SEQ ID NO: 270235 - RNA, 23 nt, Human
uucgcucuuguuguccaggcugg

SEQ ID NO: 270236 - RNA, 23 nt, Human
uucgcugacgccgggugagcuga

SEQ ID NO: 270237 - RNA, 32 nt, Human
uucgcugagauggagacgugggcccccgugga

SEQ ID NO: 270238 - RNA, 32 nt, Human
uucgcugaggcuucgccugccuccuuccuccg

SEQ ID NO: 270239 - RNA, 32 nt, Human
uucgcuggacgggaagaagggcugggccgucc

SEQ ID NO: 270240 - RNA, 21 nt, Human
uucgcuggaggggcugggcca

SEQ ID NO: 270241 - RNA, 32 nt, Human
uucgcuggcuuuccagcuuagaaugcaucuca

SEQ ID NO: 270242 - RNA, 32 nt, Human
uucgcugggaguggauuuccacacgugccuuu

SEQ ID NO: 270243 - RNA, 32 nt, Human
uucgcuggggagcaggcgucucuccucagucg

SEQ ID NO: 270244 - RNA, 32 nt, Human
uucgcuggguuugcccagauguuuacgaauaa

SEQ ID NO: 270245 - RNA, 32 nt, Human
uucgcugguacccagauuuccacaggaguuaa

SEQ ID NO: 270246 - RNA, 32 nt, Human
uucgcuguccccucagcgggggccuugaagac

SEQ ID NO: 270247 - RNA, 32 nt, Human
uucgcugucccucccgcacuccuuaggcaaga

SEQ ID NO: 270248 - RNA, 32 nt, Human
uucgcuguguuuuugaaauguugggcauggcc

SEQ ID NO: 270249 - RNA, 31 nt, Human
uucgcuucacuuuuccuggcuguagagcgcu

SEQ ID NO: 270250 - RNA, 32 nt, Human
uucgcuucaguugcucgcuucugggugugcuc

SEQ ID NO: 270251 - RNA, 32 nt, Human
uucgcuuccagcucuuaaaauucuuuaucuuu

SEQ ID NO: 270252 - RNA, 21 nt, Human
uucgcuuccugagucuuuuca

SEQ ID NO: 270253 - RNA, 32 nt, Human
uucgcuugaacagcuucuccugaguccuccuu

SEQ ID NO: 270254 - RNA, 32 nt, Human
uucgcuugagcccaggagguggagguugcagu

SEQ ID NO: 270255 - RNA, 32 nt, Human
uucgcuugaguuaggaaugagaaguagccaca

SEQ ID NO: 270256 - RNA, 32 nt, Human
uucgcuugggguggucucucucacucugcccc

SEQ ID NO: 270257 - RNA, 32 nt, Human
uucgcuuuccagcaccagcuccugggggucac

SEQ ID NO: 270258 - RNA, 32 nt, Human
uucgcuuugucgcccaggcuggagugcaaugc

SEQ ID NO: 270259 - RNA, 32 nt, Human
uucgcuuuucccuaggcuguuccgcguggguu

SEQ ID NO: 270260 - RNA, 32 nt, Human
uucgcuuuuuccucccugccccucucucccuc

SEQ ID NO: 270261 - RNA, 32 nt, Human
uucggaaagacaccuggccagcgguccagagc

SEQ ID NO: 270262 - RNA, 32 nt, Human
uucggaacauggcaacccgugugugucucauc

SEQ ID NO: 270263 - RNA, 32 nt, Human
uucggaauuuuuccugaacaaauaacagaaag

SEQ ID NO: 270264 - RNA, 32 nt, Human
uucggaccagccuggccaacguggugaaaccu

SEQ ID NO: 270265 - RNA, 32 nt, Human
uucggacuggccuggccgacgugguaaaaccc

SEQ ID NO: 270266 - RNA, 32 nt, Human
uucggacugggcagagcacuagaaugcugcag

SEQ ID NO: 270267 - RNA, 32 nt, Human
uucggagaaagccuagguucugggcucagguc

SEQ ID NO: 270268 - RNA, 32 nt, Human
uucggagacggcuucuggaggaacggcuuggc

SEQ ID NO: 270269 - RNA, 32 nt, Human
uucggagagggcgagggccaccaccugcagca

SEQ ID NO: 270270 - RNA, 32 nt, Human
uucggagcaggagacaucccugugagcagaaa

SEQ ID NO: 270271 - RNA, 32 nt, Human
uucggagccuccugccugcacccuccaccucu

SEQ ID NO: 270272 - RNA, 32 nt, Human
uucggagcgggaguguucguugugccagcgac

SEQ ID NO: 270273 - RNA, 32 nt, Human
uucggaggaggcacuccauggagaaagggcuc

SEQ ID NO: 270274 - RNA, 32 nt, Human
uucggaggccaaggcggguggaucacgagguc

SEQ ID NO: 270275 - RNA, 32 nt, Human
uucggaggccgaggaagguagaucacuugagg

SEQ ID NO: 270276 - RNA, 32 nt, Human
uucggaggccgagguggucggaucacgagguu

SEQ ID NO: 270277 - RNA, 32 nt, Human
uucggagggaaggccccagggagccaccugag

SEQ ID NO: 270278 - RNA, 32 nt, Human
uucggagugaagacaucaguaagaagaccuga

SEQ ID NO: 270279 - RNA, 32 nt, Human
uucggauaucuucucaccuauguucccuggcu

SEQ ID NO: 270280 - RNA, 32 nt, Human
uucggaucucacuccauuauuugucagcacca

SEQ ID NO: 270281 - RNA, 32 nt, Human
uucggauggagggagacuagggagcgcggugg

SEQ ID NO: 270282 - RNA, 32 nt, Human
uucggauuagcgguuuauuaagcucuucuaua

SEQ ID NO: 270283 - RNA, 32 nt, Human
uucggauucacuucuggggaugcuguguagcg

SEQ ID NO: 270284 - RNA, 32 nt, Human
uucggauugccuucuuucaauuuccuugugaa

SEQ ID NO: 270285 - RNA, 32 nt, Human
uucggcagugcauuccagccugcagaaaaccu

SEQ ID NO: 270286 - RNA, 32 nt, Human
uucggcaucaucucuucccucucccaucguau

SEQ ID NO: 270287 - RNA, 32 nt, Human
uucggcaucgucuggugaugggucuggccucg

SEQ ID NO: 270288 - RNA, 32 nt, Human
uucggcaugguggcaggcgccuguaaucccag

SEQ ID NO: 270289 - RNA, 32 nt, Human
uucggccagcacaaccuuccucccuacucacg

SEQ ID NO: 270290 - RNA, 31 nt, Human
uucggccaucucucuggccugguuucccucg

SEQ ID NO: 270291 - RNA, 32 nt, Human
uucggccguccugcuucucuguuuccacacgu

SEQ ID NO: 270292 - RNA, 32 nt, Human
uucggccugccugccugccugccugagguccc

SEQ ID NO: 270293 - RNA, 32 nt, Human
uucggcgagguggaaguggagcccagugaggu

SEQ ID NO: 270294 - RNA, 32 nt, Human
uucggcgggaggugggggaacaaggggucuuc

SEQ ID NO: 270295 - RNA, 32 nt, Human
uucggcuagggaggaagguagaguaagagguu

SEQ ID NO: 270296 - RNA, 32 nt, Human
uucggcucacugcaaccuccaccuccuggguu

SEQ ID NO: 270297 - RNA, 32 nt, Human
uucggcucacugcaaccuccuccucccagagg

SEQ ID NO: 270298 - RNA, 32 nt, Human
uucggcucacugcaaccucugccucccaaguu

SEQ ID NO: 270299 - RNA, 32 nt, Human
uucggcucacugcaaccucugucuccuggguu

SEQ ID NO: 270300 - RNA, 32 nt, Human
uucggcucacugcaacuucugccucccggguu

SEQ ID NO: 270301 - RNA, 32 nt, Human
uucggcucagcuggaggaggccagcucuacag

SEQ ID NO: 270302 - RNA, 32 nt, Human
uucggcuccgggcaaauggcugagauggaggu

SEQ ID NO: 270303 - RNA, 32 nt, Human
uucggcuccuggaauuuccaauguauuuauuu

SEQ ID NO: 270304 - RNA, 30 nt, Human
uucggcugagcccacagggcacagacuguu

SEQ ID NO: 270305 - RNA, 32 nt, Human
uucggcugcugucuggacgucuggacccugcc

SEQ ID NO: 270306 - RNA, 32 nt, Human
uucggcuggaacaaaguggcccacauugugga

SEQ ID NO: 270307 - RNA, 32 nt, Human
uucggcuggagagggccagcucgcuucaggag

SEQ ID NO: 270308 - RNA, 32 nt, Human
uucggcuuacucuugccaaguuggaguugccu

SEQ ID NO: 270309 - RNA, 32 nt, Human
uucggcuucugagacggcggcagcagcggcau

SEQ ID NO: 270310 - RNA, 32 nt, Human
uucggcuuguuacugccuuuugucaaauaauc

SEQ ID NO: 270311 - RNA, 32 nt, Human
uucgggaacaaauggugucguaccaaauggcu

SEQ ID NO: 270312 - RNA, 32 nt, Human
uucgggaacccccuuccccgcucuugcccugc

SEQ ID NO: 270313 - RNA, 32 nt, Human
uucgggaacugugaguauuucacuuugcguag

SEQ ID NO: 270314 - RNA, 32 nt, Human
uucgggaagcaggccugcaucuuaccuguaca

SEQ ID NO: 270315 - RNA, 24 nt, Human
uucgggaaguggagguugcaguga

SEQ ID NO: 270316 - RNA, 32 nt, Human
uucgggaaugacacgucuucugaucccaugag

SEQ ID NO: 270317 - RNA, 32 nt, Human
uucgggaccaauauauaguggguacaucaagu

SEQ ID NO: 270318 - RNA, 32 nt, Human
uucgggaccaaucuggccaacauggcgaaacc

SEQ ID NO: 270319 - RNA, 24 nt, Human
uucgggaccagccuagccuacaug

SEQ ID NO: 270320 - RNA, 32 nt, Human
uucgggaccagccuagccuacauggugaaacc

SEQ ID NO: 270321 - RNA, 22 nt, Human
uucgggaccagccuggcaaaca

SEQ ID NO: 270322 - RNA, 24 nt, Human
uucgggaccagccuggccaacaug

SEQ ID NO: 270323 - RNA, 32 nt, Human
uucgggaccagccuggccaacaugaugaaacc

SEQ ID NO: 270324 - RNA, 24 nt, Human
uucgggaccagccugggaaauaua

SEQ ID NO: 270325 - RNA, 32 nt, Human
uucgggaccagccugggaaauauagugaaacu

SEQ ID NO: 270326 - RNA, 32 nt, Human
uucgggaccagccugggcaacauggugaaacc

SEQ ID NO: 270327 - RNA, 24 nt, Human
uucgggaccauccuggccaacaug

SEQ ID NO: 270328 - RNA, 32 nt, Human
uucgggaccauccuggccaacauggugaaacc

SEQ ID NO: 270329 - RNA, 32 nt, Human
uucgggacccucccgcgugccgaacugaucuu

SEQ ID NO: 270330 - RNA, 32 nt, Human
uucgggagccgccugcaccaacgcugccgccg

SEQ ID NO: 270331 - RNA, 22 nt, Human
uucgggaggcggaaaaagauga

SEQ ID NO: 270332 - RNA, 32 nt, Human
uucgggaggcugagacaggagaaucgcuugaa

SEQ ID NO: 270333 - RNA, 32 nt, Human
uucgggagguggagguugcagugagccgaaau

SEQ ID NO: 270334 - RNA, 32 nt, Human
uucgggaggugucuugaggcucagggaguuau

SEQ ID NO: 270335 - RNA, 32 nt, Human
uucgggaucggcugggugaggcugggcaggcc

SEQ ID NO: 270336 - RNA, 23 nt, Human
uucgggaugaguugggcagggug

SEQ ID NO: 270337 - RNA, 23 nt, Human
uucgggaugcagggggcacuaua

SEQ ID NO: 270338 - RNA, 32 nt, Human
uucgggcagagugcgggcuccucuccggcgcc

SEQ ID NO: 270339 - RNA, 32 nt, Human
uucgggcaguggacuguguccauagcugaaaa

SEQ ID NO: 270340 - RNA, 32 nt, Human
uucgggcaguguccgaacggcuucggaggggc

SEQ ID NO: 270341 - RNA, 32 nt, Human
uucgggcaugaagaacagggagcaggugcccc

SEQ ID NO: 270342 - RNA, 22 nt, Human
uucgggccccguaugaccuggg

SEQ ID NO: 270343 - RNA, 21 nt, Human
uucgggcccuccuuugguggg

SEQ ID NO: 270344 - RNA, 32 nt, Human
uucgggccgugacggggcggccagcagggacg

SEQ ID NO: 270345 - RNA, 32 nt, Human
uucgggccucacaccuuagucaacaucaaaga

SEQ ID NO: 270346 - RNA, 32 nt, Human
uucgggccuccaggauauguuugcgggggugg

SEQ ID NO: 270347 - RNA, 32 nt, Human
uucgggccugggacugugucugucgcccaugg

SEQ ID NO: 270348 - RNA, 32 nt, Human
uucgggcucaugcccagacacacucacugccc

SEQ ID NO: 270349 - RNA, 32 nt, Human
uucgggcucccaggccagcgaugcgcucgcgg

SEQ ID NO: 270350 - RNA, 32 nt, Human
uucgggcugauacaaccuguucugaccugcaa

SEQ ID NO: 270351 - RNA, 32 nt, Human
uucgggcugccuccuucucuuccuucauugcc

SEQ ID NO: 270352 - RNA, 28 nt, Human
uucggggaaucccggcuuuggcagcgug

SEQ ID NO: 270353 - RNA, 32 nt, Human
uucggggaggaagcaaacuuguuugcacuaug

SEQ ID NO: 270354 - RNA, 24 nt, Human
uucggggaggguuuuggugggaug

SEQ ID NO: 270355 - RNA, 32 nt, Human
uucggggagguaaucucugagguccucacugc

SEQ ID NO: 270356 - RNA, 21 nt, Human
uucggggagguggguggggug

SEQ ID NO: 270357 - RNA, 32 nt, Human
uucggggaguuaaagugcacucucucaccccu

SEQ ID NO: 270358 - RNA, 32 nt, Human
uucggggcagguugugaggccacagcaaugcu

SEQ ID NO: 270359 - RNA, 32 nt, Human
uucggggcuaccagaaaaauguuuccagaugg

SEQ ID NO: 270360 - RNA, 32 nt, Human
uucgggguaacccagaggcugaugaguguguu

SEQ ID NO: 270361 - RNA, 23 nt, Human
uucggggugcgggcuggggccgg

SEQ ID NO: 270362 - RNA, 32 nt, Human
uucggggugguuuugguccauuucuccagcga

SEQ ID NO: 270363 - RNA, 32 nt, Human
uucgggguugucauuaaguaaguugugaaauu

SEQ ID NO: 270364 - RNA, 32 nt, Human
uucggguaggagagagaggccuaagaggcuca

SEQ ID NO: 270365 - RNA, 24 nt, Human
uucggguccggccugggcaacgua

SEQ ID NO: 270366 - RNA, 32 nt, Human
uucgggugcaggagcaggagauggaacuggua

SEQ ID NO: 270367 - RNA, 24 nt, Human
uucgggugcuggguaagugccaug

SEQ ID NO: 270368 - RNA, 32 nt, Human
uucggguggagcugagccggagacaggcaauu

SEQ ID NO: 270369 - RNA, 31 nt, Human
uucgggugguaauccaucacaugcagcacua

SEQ ID NO: 270370 - RNA, 21 nt, Human
uucgggugucggggcagcaug

SEQ ID NO: 270371 - RNA, 32 nt, Human
uucggucauguuuuagagacaguggaguguaa

SEQ ID NO: 270372 - RNA, 32 nt, Human
uucgguccaacaacaggaaaccugacuggggc

SEQ ID NO: 270373 - RNA, 32 nt, Human
uucggucccccaggaccuccaggugcagaagu

SEQ ID NO: 270374 - RNA, 32 nt, Human
uucggucccuuucuuuuaaugcccauccucau

SEQ ID NO: 270375 - RNA, 32 nt, Human
uucggucuaccacggagggcugugcuguuagg

SEQ ID NO: 270376 - RNA, 32 nt, Human
uucggucuaguucugucaguugcugagagagg

SEQ ID NO: 270377 - RNA, 32 nt, Human
uucggucucuccccagccucuuccuucccccu

SEQ ID NO: 270378 - RNA, 32 nt, Human
uucggucugacaguccuugggguuaagucucc

SEQ ID NO: 270379 - RNA, 32 nt, Human
uucggugguaggggugggagggcgagucaccg

SEQ ID NO: 270380 - RNA, 32 nt, Human
uucgguguggagggguggagugcugugaucuc

SEQ ID NO: 270381 - RNA, 32 nt, Human
uucgguuugugagcaggcccggccgggccagg

SEQ ID NO: 270382 - RNA, 32 nt, Human
uucgguuuuuguuauugaacuguuucauguau

SEQ ID NO: 270383 - RNA, 32 nt, Human
uucguaaaccuaggggaaaccaucucucucac

SEQ ID NO: 270384 - RNA, 22 nt, Human
uucguaacaggugugcauuuca

SEQ ID NO: 270385 - RNA, 32 nt, Human
uucguaagaugcguugaacaaauagcuuuuga

SEQ ID NO: 270386 - RNA, 31 nt, Human
uucguaaucaguaaucucaugccaaggauga

SEQ ID NO: 270387 - RNA, 32 nt, Human
uucguagaucaagaucagcuucacucagaaga

SEQ ID NO: 270388 - RNA, 32 nt, Human
uucguauccuucugggcggugaaggggagagg

SEQ ID NO: 270389 - RNA, 32 nt, Human
uucguauuuguugagccagggauggaaaaaua

SEQ ID NO: 270390 - RNA, 32 nt, Human
uucgucacagccgcgcagugcccauggaggcg

SEQ ID NO: 270391 - RNA, 32 nt, Human
uucgucagcuuugacaccucuuuucugauuua

SEQ ID NO: 270392 - RNA, 32 nt, Human
uucgucccacugcaccgccuggcugagggcgu

SEQ ID NO: 270393 - RNA, 32 nt, Human
uucguccccacacuguggaggaagggaccugu

SEQ ID NO: 270394 - RNA, 19 nt, Human
uucguccccaguugccguc

SEQ ID NO: 270395 - RNA, 32 nt, Human
uucgucccccuccaccacacacaacgccaaga

SEQ ID NO: 270396 - RNA, 32 nt, Human
uucgucccucgggacagagcacagcuugugca

SEQ ID NO: 270397 - RNA, 32 nt, Human
uucguccggagcgccucacagcuuagugcgcc

SEQ ID NO: 270398 - RNA, 32 nt, Human
uucguccucccagggcccagaguguuccccau

SEQ ID NO: 270399 - RNA, 18 nt, Human
uucguccuccucgccuuc

SEQ ID NO: 270400 - RNA, 32 nt, Human
uucguccuccucgccuuccuccuccucgucag

SEQ ID NO: 270401 - RNA, 32 nt, Human
uucguccuggccaggacuuuccuugcccugaa

SEQ ID NO: 270402 - RNA, 32 nt, Human
uucgucggcugucggaaaguucugagcagugg

SEQ ID NO: 270403 - RNA, 32 nt, Human
uucgucgguggcagaggugggcgugggugcug

SEQ ID NO: 270404 - RNA, 32 nt, Human
uucgucuccaucuggugguccagcacaagcag

SEQ ID NO: 270405 - RNA, 32 nt, Human
uucgucucccucucuuuuacccagagacagca

SEQ ID NO: 270406 - RNA, 32 nt, Human
uucgucugacacugagaaagguggugguccgc

SEQ ID NO: 270407 - RNA, 32 nt, Human
uucgucugcaucuucuucucagcugccuuucc

SEQ ID NO: 270408 - RNA, 32 nt, Human
uucgucuuaaacuaguuaugcauuuguaaacu

SEQ ID NO: 270409 - RNA, 32 nt, Human
uucgucuucgguuuuucucuuccuucgcuaac

SEQ ID NO: 270410 - RNA, 32 nt, Human
uucgucuuuaagccucccuugccucagcaagg

SEQ ID NO: 270411 - RNA, 24 nt, Human
uucgugaccagccuggccaauaug

SEQ ID NO: 270412 - RNA, 32 nt, Human
uucgugaccagccuggccaauauggugaaacc

SEQ ID NO: 270413 - RNA, 24 nt, Human
uucgugaccagccuggucaacaug

SEQ ID NO: 270414 - RNA, 32 nt, Human
uucgugaccagccuggucaacauggugaaacc

SEQ ID NO: 270415 - RNA, 32 nt, Human
uucgugacgcagcccgggucucagggaacaug

SEQ ID NO: 270416 - RNA, 32 nt, Human
uucgugacggaguuaucagagacauugagagg

SEQ ID NO: 270417 - RNA, 32 nt, Human
uucgugacggccaccaggacagaaccaccuga

SEQ ID NO: 270418 - RNA, 32 nt, Human
uucgugagcgcagggugcgggccccgccggcc

SEQ ID NO: 270419 - RNA, 32 nt, Human
uucgugaguccccaagccauagcagggcgucu

SEQ ID NO: 270420 - RNA, 32 nt, Human
uucgugauaaacugcaugaaacuccugccguc

SEQ ID NO: 270421 - RNA, 32 nt, Human
uucgugauacagauuccuuugcucacauguuu

SEQ ID NO: 270422 - RNA, 32 nt, Human
uucgugaucagccuggccaacguggagaaacc

SEQ ID NO: 270423 - RNA, 32 nt, Human
uucgugcagcagccgcaaaggaaagcugauuu

SEQ ID NO: 270424 - RNA, 32 nt, Human
uucgugcaggagcugggggacacaguggcugu

SEQ ID NO: 270425 - RNA, 32 nt, Human
uucgugccaucggacuccagccugggugaagg

SEQ ID NO: 270426 - RNA, 32 nt, Human
uucgugccauuacacuccagccugggugacag

SEQ ID NO: 270427 - RNA, 32 nt, Human
uucgugcccagccuguacccacaguggcagcc

SEQ ID NO: 270428 - RNA, 32 nt, Human
uucgugccgcaguaacagacacaguauuuaau

SEQ ID NO: 270429 - RNA, 32 nt, Human
uucgugccuguaaucccagcucuuugggaggc

SEQ ID NO: 270430 - RNA, 32 nt, Human
uucgugcuggaaauuucuccuggguuucuugg

SEQ ID NO: 270431 - RNA, 32 nt, Human
uucgugcugugugcucuggggagcugcaaaag

SEQ ID NO: 270432 - RNA, 32 nt, Human
uucgugcuucucucuccggacucucauuaucc

SEQ ID NO: 270433 - RNA, 32 nt, Human
uucguggcagcacggcccggccccucacccuc

SEQ ID NO: 270434 - RNA, 32 nt, Human
uucguggcauuucuguggcucugcaguguucc

SEQ ID NO: 270435 - RNA, 32 nt, Human
uucguggccugcucucaggaagugggucaagc

SEQ ID NO: 270436 - RNA, 32 nt, Human
uucguggcgcugguggcuccagcuguuaguuu

SEQ ID NO: 270437 - RNA, 32 nt, Human
uucgugggccuuugauuuaccaacacuggaaa

SEQ ID NO: 270438 - RNA, 32 nt, Human
uucguggucacugcacuccagccuggcuacag

SEQ ID NO: 270439 - RNA, 32 nt, Human
uucguggucacugcuccagccucagccagggc

SEQ ID NO: 270440 - RNA, 32 nt, Human
uucguguaggaggcggaggggccgcagcuggg

SEQ ID NO: 270441 - RNA, 32 nt, Human
uucguguaugugacucaaagcauguaaccuua

SEQ ID NO: 270442 - RNA, 32 nt, Human
uucgugucugcccaccucuucucccccaccuc

SEQ ID NO: 270443 - RNA, 32 nt, Human
uucgugucugugcuggagcugcagccugcucg

SEQ ID NO: 270444 - RNA, 32 nt, Human
uucgugugccccgggccccauggagcugcggg

SEQ ID NO: 270445 - RNA, 32 nt, Human
uucgugugccuguagugccagcuacucaggag

SEQ ID NO: 270446 - RNA, 32 nt, Human
uucguguuacuuaagcaaaaucaacuauauag

SEQ ID NO: 270447 - RNA, 32 nt, Human
uucguucaagcgauucucccaccucagccucc

SEQ ID NO: 270448 - RNA, 31 nt, Human
uucguucacagcugaguuaugaagcuggaau

SEQ ID NO: 270449 - RNA, 32 nt, Human
uucguuccauucauccacucugugccuuguca

SEQ ID NO: 270450 - RNA, 32 nt, Human
uucguucugguucugguucugguucuaguucu

SEQ ID NO: 270451 - RNA, 32 nt, Human
uucguucuuccagcaaaggcuuccaagguaca

SEQ ID NO: 270452 - RNA, 32 nt, Human
uucguucuuccuccccucaguggcaguuuggu

SEQ ID NO: 270453 - RNA, 31 nt, Human
uucguugcaacuucucccauccgagucaccu

SEQ ID NO: 270454 - RNA, 32 nt, Human
uucguuuacagcuguugcaacagcagaacuag

SEQ ID NO: 270455 - RNA, 32 nt, Human
uucguuuccagccucaggaauuuauggucgcc

SEQ ID NO: 270456 - RNA, 32 nt, Human
uucguuucuaugagagauuuccucugauagcu

SEQ ID NO: 270457 - RNA, 32 nt, Human
uucguuucuauugcauauauaacugaaauauu

SEQ ID NO: 270458 - RNA, 32 nt, Human
uucguuucuggggcaacugagagcugagcgcu

SEQ ID NO: 270459 - RNA, 32 nt, Human
uucguuuucuagcuauaggaacuaucugggga

SEQ ID NO: 270460 - RNA, 32 nt, Human
uucguuuugucgcccaggcuggagugcagugg

SEQ ID NO: 270461 - RNA, 32 nt, Human
uucguuuuugagacggaguuugcucuuguuga

SEQ ID NO: 270462 - RNA, 32 nt, Human
uucguuuuugcaauaaugacaaaugcccugca

SEQ ID NO: 270463 - RNA, 32 nt, Human
uucuaaaaccaaaagaaaaaccauuuugaaua

SEQ ID NO: 270464 - RNA, 32 nt, Human
uucuaaaaccagcacagaaugauaugacucaa

SEQ ID NO: 270465 - RNA, 32 nt, Human
uucuaaaauugcuuucuugaugcagcuacaag

SEQ ID NO: 270466 - RNA, 32 nt, Human
uucuaaacacagaguguugggccugguuuguu

SEQ ID NO: 270467 - RNA, 32 nt, Human
uucuaaacacaugccaauguuugucuuuuccc

SEQ ID NO: 270468 - RNA, 32 nt, Human
uucuaaacacggcgaggucaccucucacucuu

SEQ ID NO: 270469 - RNA, 32 nt, Human
uucuaaacagcauaaggaagacuugcuccccu

SEQ ID NO: 270470 - RNA, 32 nt, Human
uucuaaagagaaguuugauauuuuguaugcuu

SEQ ID NO: 270471 - RNA, 32 nt, Human
uucuaaaggaagguagauccagcucugcccac

SEQ ID NO: 270472 - RNA, 32 nt, Human
uucuaaaggagaaggugcuaacaauggaaaga

SEQ ID NO: 270473 - RNA, 32 nt, Human
uucuaaaggcagaagcagaaguagcugcuuuu

SEQ ID NO: 270474 - RNA, 32 nt, Human
uucuaaagggcaugacagugaccugggaggua

SEQ ID NO: 270475 - RNA, 32 nt, Human
uucuaaaggggacagaucuugagcaaggcaag

SEQ ID NO: 270476 - RNA, 23 nt, Human
uucuaaagguaaauuauuuguua

SEQ ID NO: 270477 - RNA, 31 nt, Human
uucuaaaggucauauuuacauuuaaaaucaa

SEQ ID NO: 270478 - RNA, 32 nt, Human
uucuaaauaaggagauuuuggaacucucagcu

SEQ ID NO: 270479 - RNA, 32 nt, Human
uucuaaaucaggccaggaaggaggggaaaaga

SEQ ID NO: 270480 - RNA, 21 nt, Human
uucuaaaucaucugguugguu

SEQ ID NO: 270481 - RNA, 32 nt, Human
uucuaaaucuccaaaauaaaacuuuuuaaaau

SEQ ID NO: 270482 - RNA, 32 nt, Human
uucuaaaucugagaucucccuccagggaaucc

SEQ ID NO: 270483 - RNA, 32 nt, Human
uucuaaaugaugucuagcugcuuaccaacuuu

SEQ ID NO: 270484 - RNA, 32 nt, Human
uucuaaaugggagacugcugaggcucuuugca

SEQ ID NO: 270485 - RNA, 32 nt, Human
uucuaaauuauuucuaagguugugcuaauucu

SEQ ID NO: 270486 - RNA, 32 nt, Human
uucuaaauuuagugauaugguaaugaaauugg

SEQ ID NO: 270487 - RNA, 32 nt, Human
uucuaacaaagaaaagaauaaaguauuuauua

SEQ ID NO: 270488 - RNA, 21 nt, Human
uucuaacacaacaaaguggga

SEQ ID NO: 270489 - RNA, 32 nt, Human
uucuaacaggagaaaaguccuguaaggaugau

SEQ ID NO: 270490 - RNA, 32 nt, Human
uucuaacaguaguggaacaggagaaucugggc

SEQ ID NO: 270491 - RNA, 32 nt, Human
uucuaacauauguauuaagccaaacaugagug

SEQ ID NO: 270492 - RNA, 32 nt, Human
uucuaacaugccacucaagugccucuucgugu

SEQ ID NO: 270493 - RNA, 32 nt, Human
uucuaaccauaaaagaaauuauacuggugaga

SEQ ID NO: 270494 - RNA, 32 nt, Human
uucuaacccaaaacaguucuacucacuuccuu

SEQ ID NO: 270495 - RNA, 32 nt, Human
uucuaaccccaaaucuuagaucugccagguag

SEQ ID NO: 270496 - RNA, 32 nt, Human
uucuaaccuugccacuuugagggaaggaaggg

SEQ ID NO: 270497 - RNA, 32 nt, Human
uucuaacgcgguggcucccaagccacauucau

SEQ ID NO: 270498 - RNA, 32 nt, Human
uucuaacuacuaaaaaucaaaaauuuaacuuu

SEQ ID NO: 270499 - RNA, 32 nt, Human
uucuaacuccacuggcuccaugauucucugag

SEQ ID NO: 270500 - RNA, 32 nt, Human
uucuaacuccucccgcccucucuucccauuga

SEQ ID NO: 270501 - RNA, 32 nt, Human
uucuaacucgugaauaguuuaaggaccacauc

SEQ ID NO: 270502 - RNA, 32 nt, Human
uucuaacuuucuuuacuccaucauggcugguu

SEQ ID NO: 270503 - RNA, 32 nt, Human
uucuaagaacuuauagauaacuuaaaacuuuu

SEQ ID NO: 270504 - RNA, 32 nt, Human
uucuaagaaggcagaccaggucuugggcacag

SEQ ID NO: 270505 - RNA, 32 nt, Human
uucuaagaagugaaaaucuacacuccagugag

SEQ ID NO: 270506 - RNA, 32 nt, Human
uucuaagacaacaguaugcugcuauagccguc

SEQ ID NO: 270507 - RNA, 32 nt, Human
uucuaagacuagugaagaacuggaggaguccu

SEQ ID NO: 270508 - RNA, 32 nt, Human
uucuaagaggcaccuccaucgagggccggucu

SEQ ID NO: 270509 - RNA, 32 nt, Human
uucuaagaucagugcuugagacauguugcaga

SEQ ID NO: 270510 - RNA, 32 nt, Human
uucuaagauuauucuccucuauccacagcauu

SEQ ID NO: 270511 - RNA, 32 nt, Human
uucuaagcaauauuuuucaagccagaaguccu

SEQ ID NO: 270512 - RNA, 32 nt, Human
uucuaagcacagauucaucagugagccaaaug

SEQ ID NO: 270513 - RNA, 32 nt, Human
uucuaagcaguuucaucagcauuacuugggaa

SEQ ID NO: 270514 - RNA, 32 nt, Human
uucuaagcauuuucacagccguuucuucauau

SEQ ID NO: 270515 - RNA, 32 nt, Human
uucuaagcuggacgcacagaacagucucuccg

SEQ ID NO: 270516 - RNA, 32 nt, Human
uucuaaggaaggaggugcuggagcaguugaug

SEQ ID NO: 270517 - RNA, 32 nt, Human
uucuaaggacgaaggaaagggccaggcaaggc

SEQ ID NO: 270518 - RNA, 32 nt, Human
uucuaaggagguuucuaauuuuguaauuguua

SEQ ID NO: 270519 - RNA, 32 nt, Human
uucuaaggcugugccaucagcuccuuccuccc

SEQ ID NO: 270520 - RNA, 23 nt, Human
uucuaagggaagguuacuucuca

SEQ ID NO: 270521 - RNA, 32 nt, Human
uucuaagggaggaguacugaagagugacggac

SEQ ID NO: 270522 - RNA, 32 nt, Human
uucuaagggcuaugcaauugaaugaagaagca

SEQ ID NO: 270523 - RNA, 32 nt, Human
uucuaagguagaaaguggaugucauuuucagc

SEQ ID NO: 270524 - RNA, 24 nt, Human
uucuaaguacuaucagagugguga

SEQ ID NO: 270525 - RNA, 32 nt, Human
uucuaaguacuggacaccagccagggcggcag

SEQ ID NO: 270526 - RNA, 32 nt, Human
uucuaaguauggugcucucagguccaaguuca

SEQ ID NO: 270527 - RNA, 24 nt, Human
uucuaaguauucaauuaaguggga

SEQ ID NO: 270528 - RNA, 23 nt, Human
uucuaaguauucaggugaaagga

SEQ ID NO: 270529 - RNA, 32 nt, Human
uucuaagugggaagaggaagggagaggcaagc

SEQ ID NO: 270530 - RNA, 32 nt, Human
uucuaaguuguucacagauuuuuaccugcuaa

SEQ ID NO: 270531 - RNA, 32 nt, Human
uucuaauacaaacucaguucaagcuaauuaag

SEQ ID NO: 270532 - RNA, 32 nt, Human
uucuaauaguuuuugcuuucuguuuugcuguu

SEQ ID NO: 270533 - RNA, 32 nt, Human
uucuaaucauaaaagaaaucauauuggugaga

SEQ ID NO: 270534 - RNA, 32 nt, Human
uucuaauccaacaacaaaagaaaugucuggcu

SEQ ID NO: 270535 - RNA, 32 nt, Human
uucuaaucccaaagacuucgaacccaggaucu

SEQ ID NO: 270536 - RNA, 32 nt, Human
uucuaaucccaaauuaaaacucuaauacaaau

SEQ ID NO: 270537 - RNA, 32 nt, Human
uucuaauccugccuugguguuuauggagacca

SEQ ID NO: 270538 - RNA, 32 nt, Human
uucuaaucuccugccucuccccaacugucccc

SEQ ID NO: 270539 - RNA, 32 nt, Human
uucuaaugacaaaggaaguggugaucagucug

SEQ ID NO: 270540 - RNA, 32 nt, Human
uucuaaugaggagagaaaauauauguauuuuu

SEQ ID NO: 270541 - RNA, 32 nt, Human
uucuaauggaagcaaggacuggagaagcaaag

SEQ ID NO: 270542 - RNA, 32 nt, Human
uucuaauguggaccuuagaauacaguuuugag

SEQ ID NO: 270543 - RNA, 32 nt, Human
uucuaauguguacccaucaguggaaccaggau

SEQ ID NO: 270544 - RNA, 32 nt, Human
uucuaauucaaaggaaucacuuuauuguaaac

SEQ ID NO: 270545 - RNA, 32 nt, Human
uucuaauucauauauuuaacaaacaugauggu

SEQ ID NO: 270546 - RNA, 32 nt, Human
uucuaauugucugguugaggggccacaccacc

SEQ ID NO: 270547 - RNA, 29 nt, Human
uucuaauuguuuugugugccaggggcagu

SEQ ID NO: 270548 - RNA, 32 nt, Human
uucuaauuuucggagaaggcaagugcccucau

SEQ ID NO: 270549 - RNA, 32 nt, Human
uucuaauuuugagcauucaccuugcuaccuuu

SEQ ID NO: 270550 - RNA, 32 nt, Human
uucuacaaaacucuaguaugggcuucugacuu

SEQ ID NO: 270551 - RNA, 32 nt, Human
uucuacaaaagcuuucucccagcauuucuauu

SEQ ID NO: 270552 - RNA, 32 nt, Human
uucuacaaaaugcaaaaauuagcugggcaugg

SEQ ID NO: 270553 - RNA, 32 nt, Human
uucuacaacgugcagagaggugucacaccuuc

SEQ ID NO: 270554 - RNA, 32 nt, Human
uucuacaaggaugccagucauauuggauaagg

SEQ ID NO: 270555 - RNA, 32 nt, Human
uucuacaccagaccugcuuggcaccacaggga

SEQ ID NO: 270556 - RNA, 32 nt, Human
uucuacacccuugaucauuugcaaaccuguaa

SEQ ID NO: 270557 - RNA, 32 nt, Human
uucuacaccugcaugagugaaggauuuccacg

SEQ ID NO: 270558 - RNA, 32 nt, Human
uucuacagauuuuccaggguuuaagcauugcu

SEQ ID NO: 270559 - RNA, 32 nt, Human
uucuacagccuagucagcagauuuaucuuuga

SEQ ID NO: 270560 - RNA, 18 nt, Human
uucuacagcucacuucua

SEQ ID NO: 270561 - RNA, 32 nt, Human
uucuacagcugcagaauguauauaacacaaua

SEQ ID NO: 270562 - RNA, 32 nt, Human
uucuacaggagacuggagucuugcuuugugga

SEQ ID NO: 270563 - RNA, 32 nt, Human
uucuacaggaugaccccuugauauuugcacag

SEQ ID NO: 270564 - RNA, 32 nt, Human
uucuacagugauggggugcuuccuuuuggcuu

SEQ ID NO: 270565 - RNA, 32 nt, Human
uucuacagugguuuuauacugaaggaaaaaca

SEQ ID NO: 270566 - RNA, 32 nt, Human
uucuacagugucuccagauccagacccucuua

SEQ ID NO: 270567 - RNA, 32 nt, Human
uucuacaucaauuuggaacgagaggaguggaa

SEQ ID NO: 270568 - RNA, 32 nt, Human
uucuacaucuuuccucuagucauuuugaaaua

SEQ ID NO: 270569 - RNA, 32 nt, Human
uucuacaugggagcaagacagcugcuacguga

SEQ ID NO: 270570 - RNA, 32 nt, Human
uucuacaugggagcaagacagcugcuagguga

SEQ ID NO: 270571 - RNA, 32 nt, Human
uucuacauggguaccacaggaaccugggggcc

SEQ ID NO: 270572 - RNA, 32 nt, Human
uucuacauucugaaagcacaauuuuccauuca

SEQ ID NO: 270573 - RNA, 32 nt, Human
uucuacauuuugcaugaggccugcagguggcc

SEQ ID NO: 270574 - RNA, 32 nt, Human
uucuaccaaaaauacaaaaauuagccgggcgu

SEQ ID NO: 270575 - RNA, 32 nt, Human
uucuaccaaaaccuguguauuucuugaguuuu

SEQ ID NO: 270576 - RNA, 32 nt, Human
uucuaccaaaacuacaaaaauuagccgggcuc

SEQ ID NO: 270577 - RNA, 32 nt, Human
uucuaccagacucacagagaacugcuggguuu

SEQ ID NO: 270578 - RNA, 32 nt, Human
uucuaccagcacucugccacagcaucccugcc

SEQ ID NO: 270579 - RNA, 32 nt, Human
uucuaccaggcccucacuccccuuccccaugu

SEQ ID NO: 270580 - RNA, 32 nt, Human
uucuaccaguuccuuuccuccccacuucacca

SEQ ID NO: 270581 - RNA, 32 nt, Human
uucuaccaugccacgaagguguauggugucuc

SEQ ID NO: 270582 - RNA, 32 nt, Human
uucuacccaagugcuuuugcuuacagcagaua

SEQ ID NO: 270583 - RNA, 32 nt, Human
uucuacccaggugcuaggaacacuccuucaca

SEQ ID NO: 270584 - RNA, 24 nt, Human
uucuaccccagguuccuuuccuua

SEQ ID NO: 270585 - RNA, 32 nt, Human
uucuacccgcugagugccuacaagaggggaua

SEQ ID NO: 270586 - RNA, 32 nt, Human
uucuacccgugcaggccccaggagagccgcag

SEQ ID NO: 270587 - RNA, 32 nt, Human
uucuacccuagaagcucucugccaucgaugua

SEQ ID NO: 270588 - RNA, 32 nt, Human
uucuacccuccccuauuacauacaucuuucaa

SEQ ID NO: 270589 - RNA, 32 nt, Human
uucuacccugcucugcaccugugcucgacugc

SEQ ID NO: 270590 - RNA, 32 nt, Human
uucuacccuggcucaaccgaccccugucugcc

SEQ ID NO: 270591 - RNA, 32 nt, Human
uucuaccuccacuguauccugcaucccagacc

SEQ ID NO: 270592 - RNA, 32 nt, Human
uucuaccucuacccucuccaacuucuccuggu

SEQ ID NO: 270593 - RNA, 32 nt, Human
uucuaccucuugcugucuguguguucuuaagu

SEQ ID NO: 270594 - RNA, 32 nt, Human
uucuaccugcugcaguugcacugaagugauua

SEQ ID NO: 270595 - RNA, 32 nt, Human
uucuaccugggcagagccugccaaguugaguu

SEQ ID NO: 270596 - RNA, 32 nt, Human
uucuaccuggggaaauggaaaacagaggccac

SEQ ID NO: 270597 - RNA, 32 nt, Human
uucuaccuguauuccagggcuggaccacuuga

SEQ ID NO: 270598 - RNA, 32 nt, Human
uucuacuaaaaauacaaaaaguagcuaggugu

SEQ ID NO: 270599 - RNA, 32 nt, Human
uucuacuaaaaauacaaaaaugagcugggcgu

SEQ ID NO: 270600 - RNA, 32 nt, Human
uucuacuaaaaauacaaaaauuagccaggcgu

SEQ ID NO: 270601 - RNA, 32 nt, Human
uucuacuaaaaauacaaaaauuagccgagugc

SEQ ID NO: 270602 - RNA, 32 nt, Human
uucuacuaaaaauacaaaaauuagccgggcgu

SEQ ID NO: 270603 - RNA, 32 nt, Human
uucuacuaaaaauacaaaaauuagcuaggccu

SEQ ID NO: 270604 - RNA, 32 nt, Human
uucuacuaaaaauacaaaaauuagcuaggcgu

SEQ ID NO: 270605 - RNA, 32 nt, Human
uucuacuaaaaauacaaaaauuagcuggaugc

SEQ ID NO: 270606 - RNA, 32 nt, Human
uucuacuaaaaauacaaaaauuagcugggcau

SEQ ID NO: 270607 - RNA, 32 nt, Human
uucuacuaaaaauacaaaaauuagcuggggcg

SEQ ID NO: 270608 - RNA, 32 nt, Human
uucuacuaaaaauacaaaaauuagcugggugu

SEQ ID NO: 270609 - RNA, 32 nt, Human
uucuacuaaaaauacaaaaauuagucaggcau

SEQ ID NO: 270610 - RNA, 32 nt, Human
uucuacuaaaaauacaaaauuagcugggcaug

SEQ ID NO: 270611 - RNA, 32 nt, Human
uucuacuaaaaaugcaaaaauuagcugggugu

SEQ ID NO: 270612 - RNA, 32 nt, Human
uucuacuaaaaguacagaaauuagcugggugu

SEQ ID NO: 270613 - RNA, 32 nt, Human
uucuacuaauggccucggcuucccucuuucca

SEQ ID NO: 270614 - RNA, 32 nt, Human
uucuacuagaaauacaaagaagagcugguacc

SEQ ID NO: 270615 - RNA, 32 nt, Human
uucuacuagugagucuuuuucucugaaacacu

SEQ ID NO: 270616 - RNA, 32 nt, Human
uucuacuauggcaggagauguggugugcuguu

SEQ ID NO: 270617 - RNA, 32 nt, Human
uucuacucauauccuccccuugguuucaacca

SEQ ID NO: 270618 - RNA, 32 nt, Human
uucuacucccacugcuccuaccacuccagcaa

SEQ ID NO: 270619 - RNA, 32 nt, Human
uucuacuccucggaacguugcugguggggucc

SEQ ID NO: 270620 - RNA, 32 nt, Human
uucuacucuagauggcaacauuggacagaaaa

SEQ ID NO: 270621 - RNA, 32 nt, Human
uucuacucuggcaccacucuccaggcugccau

SEQ ID NO: 270622 - RNA, 32 nt, Human
uucuacucuguucuugcugucucccucuuuac

SEQ ID NO: 270623 - RNA, 32 nt, Human
uucuacucuucuggugggcuuugggguauccc

SEQ ID NO: 270624 - RNA, 32 nt, Human
uucuacugaacugucuuuaaguuuuucauucc

SEQ ID NO: 270625 - RNA, 32 nt, Human
uucuacugagccacccuacagccagaagagau

SEQ ID NO: 270626 - RNA, 32 nt, Human
uucuacugcaaaccuccacauccuggaaucaa

SEQ ID NO: 270627 - RNA, 32 nt, Human
uucuacugcaccugccugcucuggguggcaga

SEQ ID NO: 270628 - RNA, 32 nt, Human
uucuacugcucccuccaggucugggggcuuuu

SEQ ID NO: 270629 - RNA, 32 nt, Human
uucuacugcuucuuauucacacuauaauacau

SEQ ID NO: 270630 - RNA, 32 nt, Human
uucuacugcuuuucaguucccuucccugcugu

SEQ ID NO: 270631 - RNA, 32 nt, Human
uucuacuggauccuguaacagaaagaagacau

SEQ ID NO: 270632 - RNA, 32 nt, Human
uucuacugggaugugugcugagcugaaccaag

SEQ ID NO: 270633 - RNA, 32 nt, Human
uucuacugggcugugggcucagaccucauuuc

SEQ ID NO: 270634 - RNA, 32 nt, Human
uucuacuguaccagcugagcugccuucuuuua

SEQ ID NO: 270635 - RNA, 32 nt, Human
uucuacugugcaacauagugaugauucagaaa

SEQ ID NO: 270636 - RNA, 32 nt, Human
uucuacuguguagaauacuuugacuuaauuuu

SEQ ID NO: 270637 - RNA, 32 nt, Human
uucuacuguuuacaaauaaaacucagccaguc

SEQ ID NO: 270638 - RNA, 32 nt, Human
uucuacuucauauuuugagaauggccaugauu

SEQ ID NO: 270639 - RNA, 32 nt, Human
uucuacuuccuugaguuuugcuguugccaacc

SEQ ID NO: 270640 - RNA, 32 nt, Human
uucuacuugaagcaaagaccuuucucuuucac

SEQ ID NO: 270641 - RNA, 32 nt, Human
uucuacuugagcccucucucucugccacccac

SEQ ID NO: 270642 - RNA, 32 nt, Human
uucuacuugagugagaaaacugggugaaggaa

SEQ ID NO: 270643 - RNA, 32 nt, Human
uucuacuugcccacauaccucauucuuccugg

SEQ ID NO: 270644 - RNA, 32 nt, Human
uucuacuuuauucuguuuuacaauaagcaucc

SEQ ID NO: 270645 - RNA, 32 nt, Human
uucuacuuuccagguccacugguguuuggugu

SEQ ID NO: 270646 - RNA, 32 nt, Human
uucuagaagcagaaauagacugggaagaugca

SEQ ID NO: 270647 - RNA, 32 nt, Human
uucuagaagccgcuguuaccucuuguuuacag

SEQ ID NO: 270648 - RNA, 32 nt, Human
uucuagaagcuggaaaaggcaaaggagcacau

SEQ ID NO: 270649 - RNA, 32 nt, Human
uucuagaaggaggaguuggccauguugaaaug

SEQ ID NO: 270650 - RNA, 32 nt, Human
uucuagacaagaagcauccaaaccacuaucaa

SEQ ID NO: 270651 - RNA, 32 nt, Human
uucuagacaagccugggaaacauagcaagauc

SEQ ID NO: 270652 - RNA, 23 nt, Human
uucuagacacaguguacuuguca

SEQ ID NO: 270653 - RNA, 31 nt, Human
uucuagacauauugaacacauuuaagauuug

SEQ ID NO: 270654 - RNA, 32 nt, Human
uucuagaccagccugaccaacauggagaaacc

SEQ ID NO: 270655 - RNA, 32 nt, Human
uucuagaccagccugaccaacauggugaaacc

SEQ ID NO: 270656 - RNA, 32 nt, Human
uucuagaccagccugaccgacauggagaaacc

SEQ ID NO: 270657 - RNA, 24 nt, Human
uucuagaccagccuggccaacaua

SEQ ID NO: 270658 - RNA, 32 nt, Human
uucuagaccagccuggccaacauauagugaaa

SEQ ID NO: 270659 - RNA, 24 nt, Human
uucuagaccagccuggccaacaug

SEQ ID NO: 270660 - RNA, 32 nt, Human
uucuagaccagccuggccaacaugacccaucu

SEQ ID NO: 270661 - RNA, 24 nt, Human
uucuagaccagccuggccagcaug

SEQ ID NO: 270662 - RNA, 32 nt, Human
uucuagaccagccuggccagcauggugaaaac

SEQ ID NO: 270663 - RNA, 32 nt, Human
uucuagaccagccuggccagcauggugaaacc

SEQ ID NO: 270664 - RNA, 24 nt, Human
uucuagaccagccugggcaacaua

SEQ ID NO: 270665 - RNA, 32 nt, Human
uucuagaccagccugggcaacauagugagacc

SEQ ID NO: 270666 - RNA, 24 nt, Human
uucuagaccagccugggcaacgug

SEQ ID NO: 270667 - RNA, 32 nt, Human
uucuagaccagccugggcaacguggugaaacc

SEQ ID NO: 270668 - RNA, 24 nt, Human
uucuagaccagccuggucaacaug

SEQ ID NO: 270669 - RNA, 32 nt, Human
uucuagaccagccuggucaacauggcgaaacc

SEQ ID NO: 270670 - RNA, 24 nt, Human
uucuagaccagcuuaggcaacaua

SEQ ID NO: 270671 - RNA, 32 nt, Human
uucuagaccagcuuaggcaacauagcaagacc

SEQ ID NO: 270672 - RNA, 32 nt, Human
uucuagaccccaacuacagggaacaggcuuug

SEQ ID NO: 270673 - RNA, 32 nt, Human
uucuagacuguaacccugccucccugcuuccu

SEQ ID NO: 270674 - RNA, 32 nt, Human
uucuagacugugcuacagccugggcgacacag

SEQ ID NO: 270675 - RNA, 32 nt, Human
uucuagagaaauaugugcacauggacacaaag

SEQ ID NO: 270676 - RNA, 32 nt, Human
uucuagagacugggguuucuucauagguuuga

SEQ ID NO: 270677 - RNA, 32 nt, Human
uucuagagagaugucagggcagggcugggcgc

SEQ ID NO: 270678 - RNA, 32 nt, Human
uucuagagaucuuuugaaaauuucacacgauu

SEQ ID NO: 270679 - RNA, 32 nt, Human
uucuagagccagucucugccucccagacgcgg

SEQ ID NO: 270680 - RNA, 32 nt, Human
uucuagagcuaccguggagucucuccagugga

SEQ ID NO: 270681 - RNA, 32 nt, Human
uucuagagcuaugcagcuggagcacugccuuu

SEQ ID NO: 270682 - RNA, 32 nt, Human
uucuagagugacaggcaccagaugggaugggc

SEQ ID NO: 270683 - RNA, 32 nt, Human
uucuagaucgcuucaagccuauacugauggcc

SEQ ID NO: 270684 - RNA, 32 nt, Human
uucuagaucgucuagaucuacuagaccauggg

SEQ ID NO: 270685 - RNA, 32 nt, Human
uucuagauuguggggcucauuuugccagggcc

SEQ ID NO: 270686 - RNA, 18 nt, Human
uucuagcaaagcaggcca

SEQ ID NO: 270687 - RNA, 32 nt, Human
uucuagcaaccaggacaccugccgcagugcca

SEQ ID NO: 270688 - RNA, 32 nt, Human
uucuagcaagugagagagaugggagcuccucu

SEQ ID NO: 270689 - RNA, 32 nt, Human
uucuagcacaaacuguaagaaugcuguuguaa

SEQ ID NO: 270690 - RNA, 32 nt, Human
uucuagcacuccaggaaacugugggagagugu

SEQ ID NO: 270691 - RNA, 32 nt, Human
uucuagcacugguggagaauuauagaauaaag

SEQ ID NO: 270692 - RNA, 32 nt, Human
uucuagcagaucaugccauggagcucacgacg

SEQ ID NO: 270693 - RNA, 32 nt, Human
uucuagcagcugcaaaaugguuuaaugccccc

SEQ ID NO: 270694 - RNA, 32 nt, Human
uucuagcaggagagaacagauggcagauaugg

SEQ ID NO: 270695 - RNA, 32 nt, Human
uucuagcaggcaggaaguccugugcgguguca

SEQ ID NO: 270696 - RNA, 32 nt, Human
uucuagccccugguucuaucccuucuuccgcc

SEQ ID NO: 270697 - RNA, 32 nt, Human
uucuagccuaucuccugugccccugacugagc

SEQ ID NO: 270698 - RNA, 31 nt, Human
uucuagccucauggaauacuguugaaccuau

SEQ ID NO: 270699 - RNA, 32 nt, Human
uucuagccuucccccaucuccugucguuuucg

SEQ ID NO: 270700 - RNA, 32 nt, Human
uucuagccuucgugaaguuguucucguggagg

SEQ ID NO: 270701 - RNA, 32 nt, Human
uucuagcuacgcaggaggauugcuugagccca

SEQ ID NO: 270702 - RNA, 32 nt, Human
uucuagcucagguccaacccucggugggugca

SEQ ID NO: 270703 - RNA, 32 nt, Human
uucuagcucaucucacucugguaaugucuuuc

SEQ ID NO: 270704 - RNA, 32 nt, Human
uucuagcucaucucacucugguaaugucuuug

SEQ ID NO: 270705 - RNA, 32 nt, Human
uucuagcugaaaacuuuuccacaguuuuacau

SEQ ID NO: 270706 - RNA, 32 nt, Human
uucuagcugcaagccagcucuggcuucuggag

SEQ ID NO: 270707 - RNA, 32 nt, Human
uucuagcugcagcuuugcuuccaaugugaccu

SEQ ID NO: 270708 - RNA, 32 nt, Human
uucuagcugccuggggcuggcccugcucagac

SEQ ID NO: 270709 - RNA, 32 nt, Human
uucuagcuugauaaguuaugugcugccuuggc

SEQ ID NO: 270710 - RNA, 32 nt, Human
uucuaggaaagguggagucgguagugagaagc

SEQ ID NO: 270711 - RNA, 32 nt, Human
uucuaggaagcccagacacauggagaaguucu

SEQ ID NO: 270712 - RNA, 32 nt, Human
uucuaggaaguagauguuccauaucuucaaaa

SEQ ID NO: 270713 - RNA, 32 nt, Human
uucuaggagaccccacaugcaggcagauggag

SEQ ID NO: 270714 - RNA, 32 nt, Human
uucuaggagaccccacaugcaggcagguggag

SEQ ID NO: 270715 - RNA, 32 nt, Human
uucuaggagagaagcugguccacccacaggcu

SEQ ID NO: 270716 - RNA, 32 nt, Human
uucuaggagagaggugaaagaaaccuggcaaa

SEQ ID NO: 270717 - RNA, 32 nt, Human
uucuaggagcagaaaucuaucuugccauaccc

SEQ ID NO: 270718 - RNA, 32 nt, Human
uucuaggaggcugagaagcaggagauccaagc

SEQ ID NO: 270719 - RNA, 32 nt, Human
uucuaggaguagugguaucggcgucugcugcg

SEQ ID NO: 270720 - RNA, 32 nt, Human
uucuaggauguucacuucuucuccacaaugaa

SEQ ID NO: 270721 - RNA, 32 nt, Human
uucuaggccaugaggcccauccagugccucgu

SEQ ID NO: 270722 - RNA, 32 nt, Human
uucuaggcccgcccaccccaaccuucuggugg

SEQ ID NO: 270723 - RNA, 32 nt, Human
uucuaggccugcuuuccagacuucugagauag

SEQ ID NO: 270724 - RNA, 32 nt, Human
uucuaggcucaagcaguccuucgucuaagccu

SEQ ID NO: 270725 - RNA, 32 nt, Human
uucuaggcucaagcgauucuccugccucaucc

SEQ ID NO: 270726 - RNA, 32 nt, Human
uucuaggcucacugcaacuucugccucccaug

SEQ ID NO: 270727 - RNA, 32 nt, Human
uucuagggagugagacauuuuugggagcagag

SEQ ID NO: 270728 - RNA, 32 nt, Human
uucuagggccuggcuuccucagccucuucucu

SEQ ID NO: 270729 - RNA, 32 nt, Human
uucuagggcugguucccgucaucuucgggagc

SEQ ID NO: 270730 - RNA, 32 nt, Human
uucuaggggaauggcuguguugagucaaggca

SEQ ID NO: 270731 - RNA, 32 nt, Human
uucuaggggaggcgggugggggagggagggau

SEQ ID NO: 270732 - RNA, 32 nt, Human
uucuaggggaggugguaggcugcaugugccac

SEQ ID NO: 270733 - RNA, 32 nt, Human
uucuagguacugucuucuggaccucagagccc

SEQ ID NO: 270734 - RNA, 32 nt, Human
uucuaggucuccaggucuccccagccuuaguu

SEQ ID NO: 270735 - RNA, 32 nt, Human
uucuagguuugcacugaauugucuuuuguaca

SEQ ID NO: 270736 - RNA, 32 nt, Human
uucuaguaaagugaagauucaagucaguuguu

SEQ ID NO: 270737 - RNA, 21 nt, Human
uucuaguacagcagccaugca

SEQ ID NO: 270738 - RNA, 32 nt, Human
uucuaguauucagggagauuucagaggcuggg

SEQ ID NO: 270739 - RNA, 32 nt, Human
uucuagucacuggccucaaaggaccccacagc

SEQ ID NO: 270740 - RNA, 32 nt, Human
uucuagucucacaaaaaggaagaccagggagg

SEQ ID NO: 270741 - RNA, 32 nt, Human
uucuagucuugaacuccugaccucaggugauc

SEQ ID NO: 270742 - RNA, 32 nt, Human
uucuagugcacucugauccacccugcacacca

SEQ ID NO: 270743 - RNA, 32 nt, Human
uucuagugguaucaaugaagauaguuacagua

SEQ ID NO: 270744 - RNA, 32 nt, Human
uucuagugucuauccauuguaccugcucuuga

SEQ ID NO: 270745 - RNA, 32 nt, Human
uucuaguuaaaauuuugcuaucuuucaaauaa

SEQ ID NO: 270746 - RNA, 19 nt, Human
uucuaguuacauggacucu

SEQ ID NO: 270747 - RNA, 32 nt, Human
uucuaguucaacuuuuauccugcagcaaguaa

SEQ ID NO: 270748 - RNA, 32 nt, Human
uucuaguucagucauuuauuccugcauggagg

SEQ ID NO: 270749 - RNA, 32 nt, Human
uucuaguugccgaagugucugcuucauggugc

SEQ ID NO: 270750 - RNA, 32 nt, Human
uucuaguugcuguaaaugauaucuuauguuuu

SEQ ID NO: 270751 - RNA, 32 nt, Human
uucuaguugucaggaaugcugaagaauuaaca

SEQ ID NO: 270752 - RNA, 32 nt, Human
uucuauaacaaaacaaguagcucuaggaaaag

SEQ ID NO: 270753 - RNA, 32 nt, Human
uucuauaaccucaguccccaaccuuuuuggca

SEQ ID NO: 270754 - RNA, 32 nt, Human
uucuauaaguucuaucagucugauucuuaguu

SEQ ID NO: 270755 - RNA, 32 nt, Human
uucuauaaucauaccccuaacauccaggagac

SEQ ID NO: 270756 - RNA, 32 nt, Human
uucuauaaucuuugaacaugcuggcagaugga

SEQ ID NO: 270757 - RNA, 32 nt, Human
uucuauacaacaaauguuucuucuaacauccc

SEQ ID NO: 270758 - RNA, 32 nt, Human
uucuauacaacugugaaauacagauuuuuacc

SEQ ID NO: 270759 - RNA, 32 nt, Human
uucuauacauguuugcaguguuaagauaauug

SEQ ID NO: 270760 - RNA, 32 nt, Human
uucuauacugauguuuucguuuugccaauaua

SEQ ID NO: 270761 - RNA, 32 nt, Human
uucuauacugauuugaaguggagcuguucaga

SEQ ID NO: 270762 - RNA, 32 nt, Human
uucuauagacuaaaguuggcccagcuuuggaa

SEQ ID NO: 270763 - RNA, 32 nt, Human
uucuauaguacacggcuaucugugcuggcccc

SEQ ID NO: 270764 - RNA, 32 nt, Human
uucuauauuuuuaucacuauagaucauaguua

SEQ ID NO: 270765 - RNA, 32 nt, Human
uucuaucaaaacagcacccugcuugcucacca

SEQ ID NO: 270766 - RNA, 32 nt, Human
uucuaucaaacuaccaauggcauuuuucacag

SEQ ID NO: 270767 - RNA, 32 nt, Human
uucuaucaaucagcuguccugucccugccagc

SEQ ID NO: 270768 - RNA, 32 nt, Human
uucuaucacccaggcuggaguggagugguaug

SEQ ID NO: 270769 - RNA, 32 nt, Human
uucuaucaccucucuccaggaucucugcuguc

SEQ ID NO: 270770 - RNA, 32 nt, Human
uucuaucacugggguuucccauguugcagcac

SEQ ID NO: 270771 - RNA, 32 nt, Human
uucuaucagccugcagaaauguuacacuuucc

SEQ ID NO: 270772 - RNA, 32 nt, Human
uucuaucaguguaucucauuauuucauacugu

SEQ ID NO: 270773 - RNA, 32 nt, Human
uucuauccacaucccuaacaucaugcauucac

SEQ ID NO: 270774 - RNA, 32 nt, Human
uucuaucccaccccucugaucucccauaagug

SEQ ID NO: 270775 - RNA, 32 nt, Human
uucuauccccucaauccucccacccaccaggc

SEQ ID NO: 270776 - RNA, 32 nt, Human
uucuaucccuucacuuucagucuacgucuaaa

SEQ ID NO: 270777 - RNA, 32 nt, Human
uucuauccucuccucuuccucucccauuucuu

SEQ ID NO: 270778 - RNA, 32 nt, Human
uucuaucgcccaggcuggagugcaauggcaca

SEQ ID NO: 270779 - RNA, 32 nt, Human
uucuaucggcagcaauuccaucaagccaagcc

SEQ ID NO: 270780 - RNA, 32 nt, Human
uucuaucggccaggcuggagugcaguggugca

SEQ ID NO: 270781 - RNA, 32 nt, Human
uucuaucuuaucagggccuacaguaacaugcc

SEQ ID NO: 270782 - RNA, 32 nt, Human
uucuaucuucuuuucuugccucccugaccagc

SEQ ID NO: 270783 - RNA, 32 nt, Human
uucuaugaaauaaaccuaguuuagaaauaggg

SEQ ID NO: 270784 - RNA, 32 nt, Human
uucuaugaacagcucagaaggaauccaaaaag

SEQ ID NO: 270785 - RNA, 32 nt, Human
uucuaugaaccuuuggaagaccaccuguguug

SEQ ID NO: 270786 - RNA, 32 nt, Human
uucuaugacagauccccucuggcucaccgagc

SEQ ID NO: 270787 - RNA, 32 nt, Human
uucuaugaccaccgcccccaaccagcugcccc

SEQ ID NO: 270788 - RNA, 32 nt, Human
uucuaugagagauuuccucugauagcucugcu

SEQ ID NO: 270789 - RNA, 32 nt, Human
uucuaugagcuuccaagucccuuuccacuuua

SEQ ID NO: 270790 - RNA, 32 nt, Human
uucuaugaggggcagagcuccugguacaucca

SEQ ID NO: 270791 - RNA, 32 nt, Human
uucuaugaucauugcuuuuucucuuuacaggg

SEQ ID NO: 270792 - RNA, 32 nt, Human
uucuaugcaaaaagaagguggggaagaaagug

SEQ ID NO: 270793 - RNA, 32 nt, Human
uucuaugcaaagcaaaaagccagcagcagccc

SEQ ID NO: 270794 - RNA, 32 nt, Human
uucuaugcagcucagggagacccuaaguuaag

SEQ ID NO: 270795 - RNA, 29 nt, Human
uucuaugcaggaccccaaaaugcagguuu

SEQ ID NO: 270796 - RNA, 32 nt, Human
uucuaugccuuauuugaguuaucacuuggagg

SEQ ID NO: 270797 - RNA, 32 nt, Human
uucuaugcuauauuuugcuauucaaaauuuag

SEQ ID NO: 270798 - RNA, 32 nt, Human
uucuaugcugagccuuagccucccagguuaua

SEQ ID NO: 270799 - RNA, 32 nt, Human
uucuaugcugauuuuacaaaagaucauuuuua

SEQ ID NO: 270800 - RNA, 32 nt, Human
uucuauggagcuugucauaauaauagcagaua

SEQ ID NO: 270801 - RNA, 32 nt, Human
uucuauggccauuacuaacacgcauuguacac

SEQ ID NO: 270802 - RNA, 32 nt, Human
uucuaugggucugagcuguggaaaagggagag

SEQ ID NO: 270803 - RNA, 32 nt, Human
uucuauggguuuuccuuucuuuccuuuaugca

SEQ ID NO: 270804 - RNA, 32 nt, Human
uucuauguauuuguuuaucuacaaauuacagg

SEQ ID NO: 270805 - RNA, 29 nt, Human
uucuaugucccuguggcuauguuuccagu

SEQ ID NO: 270806 - RNA, 32 nt, Human
uucuaugucccuguggcuauguuuccaguguc

SEQ ID NO: 270807 - RNA, 24 nt, Human
uucuaugucuccccaaggcugggg

SEQ ID NO: 270808 - RNA, 32 nt, Human
uucuaugugaaauccaaccuugucgugcauca

SEQ ID NO: 270809 - RNA, 24 nt, Human
uucuaugugcagggauccaaggca

SEQ ID NO: 270810 - RNA, 32 nt, Human
uucuaugugcagggauccaaggcaggcccuag

SEQ ID NO: 270811 - RNA, 32 nt, Human
uucuauguggcaacccuagguaggggagcaca

SEQ ID NO: 270812 - RNA, 29 nt, Human
uucuaugugugaacagcuagucuguaucu

SEQ ID NO: 270813 - RNA, 32 nt, Human
uucuauuaaguuuuagugaaaagccuaauuac

SEQ ID NO: 270814 - RNA, 32 nt, Human
uucuauuauggguagccuuuuuaccaauuaua

SEQ ID NO: 270815 - RNA, 32 nt, Human
uucuauucaaggagaaaacaccauucaguaag

SEQ ID NO: 270816 - RNA, 32 nt, Human
uucuauucacagcaccuccugcuucugccugg

SEQ ID NO: 270817 - RNA, 32 nt, Human
uucuauucacaucuucuccacuugagagagac

SEQ ID NO: 270818 - RNA, 32 nt, Human
uucuauuccauggcuaacuggcgaggggguga

SEQ ID NO: 270819 - RNA, 32 nt, Human
uucuauuccuuucugugucuacacauguucua

SEQ ID NO: 270820 - RNA, 32 nt, Human
uucuauucuacuuccuccauuucaccauuuau

SEQ ID NO: 270821 - RNA, 32 nt, Human
uucuauucucauuccuuucucuccaaugaguu

SEQ ID NO: 270822 - RNA, 32 nt, Human
uucuauucucauuccuuuucccacagcagcau

SEQ ID NO: 270823 - RNA, 32 nt, Human
uucuauucucucuuauagugaccaacaucuuu

SEQ ID NO: 270824 - RNA, 32 nt, Human
uucuauugaauugccuugggauuuccuucucc

SEQ ID NO: 270825 - RNA, 32 nt, Human
uucuauugaguauuauaagauagcuuacauuu

SEQ ID NO: 270826 - RNA, 32 nt, Human
uucuauuggucuuguguuuugcuugauugcuu

SEQ ID NO: 270827 - RNA, 32 nt, Human
uucuauuguuaaaaauaacagaaaucaguuca

SEQ ID NO: 270828 - RNA, 32 nt, Human
uucuauuuauucugucuuucuccucccacacu

SEQ ID NO: 270829 - RNA, 32 nt, Human
uucuauuuccagacuugaaaacauggaggauu

SEQ ID NO: 270830 - RNA, 32 nt, Human
uucuauuuccucaucucccuaaccacuaauua

SEQ ID NO: 270831 - RNA, 32 nt, Human
uucuauuucuucuuucucugguucuucuaaca

SEQ ID NO: 270832 - RNA, 32 nt, Human
uucuauuugaagauugccuuugcacucagugu

SEQ ID NO: 270833 - RNA, 32 nt, Human
uucuauuugcacagguucccuggcacugguag

SEQ ID NO: 270834 - RNA, 32 nt, Human
uucuauuugcauucaaaacugaguguucucuu

SEQ ID NO: 270835 - RNA, 32 nt, Human
uucuauuuuaaucuugcuacuaccguuauaca

SEQ ID NO: 270836 - RNA, 32 nt, Human
uucuauuuuacaccugcauguccuuugcauuu

SEQ ID NO: 270837 - RNA, 32 nt, Human
uucuauuuucagaaagugagaggagggaccgu

SEQ ID NO: 270838 - RNA, 32 nt, Human
uucuauuuucauuuucugcaagccugcguucu

SEQ ID NO: 270839 - RNA, 32 nt, Human
uucuauuuucuuauuuuucuuaggcaacacag

SEQ ID NO: 270840 - RNA, 32 nt, Human
uucuauuuugcguuucuuacugccuucuuuau

SEQ ID NO: 270841 - RNA, 32 nt, Human
uucucaaaacaucacaucacauuagcagaacu

SEQ ID NO: 270842 - RNA, 32 nt, Human
uucucaaacaagaugcuuuguucuccaacaag

SEQ ID NO: 270843 - RNA, 32 nt, Human
uucucaaacuaauucaugaaacagcaacuuuu

SEQ ID NO: 270844 - RNA, 32 nt, Human
uucucaaaguacugggauuauauaggcaugag

SEQ ID NO: 270845 - RNA, 32 nt, Human
uucucaaagugcugggauuacaggcgugagcc

SEQ ID NO: 270846 - RNA, 32 nt, Human
uucucaaaguucugggacuacaggcaugaaau

SEQ ID NO: 270847 - RNA, 32 nt, Human
uucucaacacccuuccuuguccuggaguaugg

SEQ ID NO: 270848 - RNA, 32 nt, Human
uucucaacccuccaggggucaggagugguacc

SEQ ID NO: 270849 - RNA, 32 nt, Human
uucucaagaaugcaucagcuguaccuacaaua

SEQ ID NO: 270850 - RNA, 32 nt, Human
uucucaagccuuuggauucagacugaauuaua

SEQ ID NO: 270851 - RNA, 32 nt, Human
uucucaagcguuucucuucacugugaguuguc

SEQ ID NO: 270852 - RNA, 32 nt, Human
uucucaaggggaagauaaaaugacuaagagga

SEQ ID NO: 270853 - RNA, 28 nt, Human
uucucaauaaaaaugucuuuugcuuuuu

SEQ ID NO: 270854 - RNA, 32 nt, Human
uucucaauaaaccugcauuaguuggcauugca

SEQ ID NO: 270855 - RNA, 32 nt, Human
uucucaauaaauauucagauguccuaagaaua

SEQ ID NO: 270856 - RNA, 32 nt, Human
uucucaauaggccacaggaagagggcauugug

SEQ ID NO: 270857 - RNA, 32 nt, Human
uucucaaugaacacagcuguuuugcugcuaga

SEQ ID NO: 270858 - RNA, 32 nt, Human
uucucaaugcucugauuccaucauguuuucuu

SEQ ID NO: 270859 - RNA, 32 nt, Human
uucucaauguuuucuuuugauuuccucugaca

SEQ ID NO: 270860 - RNA, 24 nt, Human
uucucaauucucugagacucagug

SEQ ID NO: 270861 - RNA, 32 nt, Human
uucucaauugacugcaaccucugcuucccagg

SEQ ID NO: 270862 - RNA, 32 nt, Human
uucucaauuggccagucuucugaucuuuagua

SEQ ID NO: 270863 - RNA, 21 nt, Human
uucucaauuuaucaauggaua

SEQ ID NO: 270864 - RNA, 32 nt, Human
uucucacacaugccacauccauugcagagaug

SEQ ID NO: 270865 - RNA, 32 nt, Human
uucucacacccacacaaauaggcucugccgug

SEQ ID NO: 270866 - RNA, 32 nt, Human
uucucacagaacuucuaucauuuuaaacugac

SEQ ID NO: 270867 - RNA, 32 nt, Human
uucucacagguaaaucuuucagccacagaauc

SEQ ID NO: 270868 - RNA, 32 nt, Human
uucucacaguccuggagacugggaaaucugag

SEQ ID NO: 270869 - RNA, 32 nt, Human
uucucacaguuuuuccccaggaagucuggaga

SEQ ID NO: 270870 - RNA, 32 nt, Human
uucucacaucuucuaaacccugguccauucuc

SEQ ID NO: 270871 - RNA, 32 nt, Human
uucucaccacagugcccauuuuucauccaggg

SEQ ID NO: 270872 - RNA, 32 nt, Human
uucucaccacccugaccuaucuccugcaguca

SEQ ID NO: 270873 - RNA, 23 nt, Human
uucucaccacugucccuauguca

SEQ ID NO: 270874 - RNA, 32 nt, Human
uucucaccaggaaggggguccacccagcaaag

SEQ ID NO: 270875 - RNA, 32 nt, Human
uucucacccaggaguggauuugugguuuggcu

SEQ ID NO: 270876 - RNA, 32 nt, Human
uucucacccaggcuggaaugcaguggcacaau

SEQ ID NO: 270877 - RNA, 32 nt, Human
uucucacccaggcuggacugaucacggcucac

SEQ ID NO: 270878 - RNA, 21 nt, Human
uucucaccccauacucuguca

SEQ ID NO: 270879 - RNA, 22 nt, Human
uucucaccccuagcuucccuca

SEQ ID NO: 270880 - RNA, 23 nt, Human
uucucaccccucugcagccccaa

SEQ ID NO: 270881 - RNA, 32 nt, Human
uucucacccuacucuauuauuuaccuucagau

SEQ ID NO: 270882 - RNA, 23 nt, Human
uucucacccuuaaggacucccaa

SEQ ID NO: 270883 - RNA, 32 nt, Human
uucucaccugcgcguucacacuggcgagaagc

SEQ ID NO: 270884 - RNA, 32 nt, Human
uucucaccugcuccucuaccugcuccacccuc

SEQ ID NO: 270885 - RNA, 21 nt, Human
uucucaccuuccugccuguca

SEQ ID NO: 270886 - RNA, 32 nt, Human
uucucaccuuguucucugccuccagaggauca

SEQ ID NO: 270887 - RNA, 32 nt, Human
uucucacgaggacccuuucuugcccacaguuu

SEQ ID NO: 270888 - RNA, 32 nt, Human
uucucacgccuguaaucccagcacuuugggag

SEQ ID NO: 270889 - RNA, 32 nt, Human
uucucacggggucaaucuuuuguguuuagaga

SEQ ID NO: 270890 - RNA, 32 nt, Human
uucucacggggugaaacaugucuuuaguuccu

SEQ ID NO: 270891 - RNA, 23 nt, Human
uucucacucaauucacauagaua

SEQ ID NO: 270892 - RNA, 32 nt, Human
uucucacucaccugcacaucucagucaagcaa

SEQ ID NO: 270893 - RNA, 32 nt, Human
uucucacucacuguagacccuauauuccuucu

SEQ ID NO: 270894 - RNA, 32 nt, Human
uucucacucuucucugcccuccacagaccucc

SEQ ID NO: 270895 - RNA, 32 nt, Human
uucucacugaagagagaaagcagaagguucua

SEQ ID NO: 270896 - RNA, 22 nt, Human
uucucacugcauccucccugca

SEQ ID NO: 270897 - RNA, 32 nt, Human
uucucacugccuggucacauggugccuaggga

SEQ ID NO: 270898 - RNA, 32 nt, Human
uucucacugguuuuuccaccuuccuccuuccc

SEQ ID NO: 270899 - RNA, 32 nt, Human
uucucacuuccgaguccaugugcagugcuuga

SEQ ID NO: 270900 - RNA, 32 nt, Human
uucucacuuugcaauaaauaguccaguguuuc

SEQ ID NO: 270901 - RNA, 32 nt, Human
uucucagaaaauacuugccuaggaggcucuca

SEQ ID NO: 270902 - RNA, 32 nt, Human
uucucagaaacacuccuucaauauuauauugg

SEQ ID NO: 270903 - RNA, 32 nt, Human
uucucagaacugaccguagucacuguauggaa

SEQ ID NO: 270904 - RNA, 32 nt, Human
uucucagaauaaugacaaguuuucguauuugu

SEQ ID NO: 270905 - RNA, 32 nt, Human
uucucagaccucugaccugugacagaagccca

SEQ ID NO: 270906 - RNA, 32 nt, Human
uucucagagaaaaguggaauuucuugaagauu

SEQ ID NO: 270907 - RNA, 22 nt, Human
uucucagagaauccagcugggc

SEQ ID NO: 270908 - RNA, 32 nt, Human
uucucagagacucacccccagcccugacccua

SEQ ID NO: 270909 - RNA, 32 nt, Human
uucucagagacuguucuacggauuguggugcu

SEQ ID NO: 270910 - RNA, 32 nt, Human
uucucagagagcagguuucuuuauaguuugga

SEQ ID NO: 270911 - RNA, 32 nt, Human
uucucagagauuccuaggaaagcugccuuauu

SEQ ID NO: 270912 - RNA, 32 nt, Human
uucucagagcuggagguugcugggcaccuaaa

SEQ ID NO: 270913 - RNA, 32 nt, Human
uucucagaguauuuccgcagcaaccaacuggc

SEQ ID NO: 270914 - RNA, 32 nt, Human
uucucagauguggccaagcaucacucuucacc

SEQ ID NO: 270915 - RNA, 32 nt, Human
uucucagcagcaguugccuccugauauguguc

SEQ ID NO: 270916 - RNA, 32 nt, Human
uucucagcaggaaccucaugcgaccugugacc

SEQ ID NO: 270917 - RNA, 32 nt, Human
uucucagcauuuuccuuucucugugaucauug

SEQ ID NO: 270918 - RNA, 20 nt, Human
uucucagccaggggagcacu

SEQ ID NO: 270919 - RNA, 32 nt, Human
uucucagccagggggaggacccuucaucuucu

SEQ ID NO: 270920 - RNA, 32 nt, Human
uucucagccuccagaacugugagaaauaaaug

SEQ ID NO: 270921 - RNA, 32 nt, Human
uucucagccuccagucuccaguuccaaggaug

SEQ ID NO: 270922 - RNA, 32 nt, Human
uucucagccucccucaccccagccccuucccc

SEQ ID NO: 270923 - RNA, 32 nt, Human
uucucagcucacugcaaccuccgccucuuggg

SEQ ID NO: 270924 - RNA, 32 nt, Human
uucucagcuccuuugacagacauucaagggca

SEQ ID NO: 270925 - RNA, 32 nt, Human
uucucagcugccaucuccagugccccagaaug

SEQ ID NO: 270926 - RNA, 32 nt, Human
uucucagcugcgccgucuccccaguccccaaa

SEQ ID NO: 270927 - RNA, 32 nt, Human
uucucagcuucgagcauggcuuuuggcuguca

SEQ ID NO: 270928 - RNA, 32 nt, Human
uucucaggaaucacagggccuaccuccuagcc

SEQ ID NO: 270929 - RNA, 32 nt, Human
uucucaggaauguagaaaugaggcagagguua

SEQ ID NO: 270930 - RNA, 32 nt, Human
uucucaggcagguugucccacagcagagacaa

SEQ ID NO: 270931 - RNA, 32 nt, Human
uucucaggcauucugcccuccugggccccucu

SEQ ID NO: 270932 - RNA, 32 nt, Human
uucucaggccacugcauuuagccugggcgaca

SEQ ID NO: 270933 - RNA, 32 nt, Human
uucucaggccaggcacauugagcauugguccu

SEQ ID NO: 270934 - RNA, 32 nt, Human
uucucaggcccagccucagagcagaucuuggc

SEQ ID NO: 270935 - RNA, 32 nt, Human
uucucaggccugacucucagcagcuaugguag

SEQ ID NO: 270936 - RNA, 32 nt, Human
uucucaggccuugcucccccaggaugacccac

SEQ ID NO: 270937 - RNA, 32 nt, Human
uucucaggcugcccaaggcucuucuguaacau

SEQ ID NO: 270938 - RNA, 32 nt, Human
uucucaggcuggccagaagagacaucuugggu

SEQ ID NO: 270939 - RNA, 32 nt, Human
uucucaggcuguagaugaagggguucagcaug

SEQ ID NO: 270940 - RNA, 20 nt, Human
uucucagggacaagaguagu

SEQ ID NO: 270941 - RNA, 24 nt, Human
uucucagggacaggcugguccagu

SEQ ID NO: 270942 - RNA, 32 nt, Human
uucucagggcaaaggaaccuggcucauuugaa

SEQ ID NO: 270943 - RNA, 32 nt, Human
uucucagggcacagcaacugccaaucccgcug

SEQ ID NO: 270944 - RNA, 32 nt, Human
uucucagggcuagcugcuccucucacaggcug

SEQ ID NO: 270945 - RNA, 32 nt, Human
uucucaggggcgccccucccaggcccucaggg

SEQ ID NO: 270946 - RNA, 32 nt, Human
uucucaggguuauuauaauguuaaaugagaua

SEQ ID NO: 270947 - RNA, 28 nt, Human
uucucaggucaugcugccucucccuauc

SEQ ID NO: 270948 - RNA, 32 nt, Human
uucucaggugugaccuacugugcuuggccuaa

SEQ ID NO: 270949 - RNA, 32 nt, Human
uucucagucaccaugcagaagaacacccgccc

SEQ ID NO: 270950 - RNA, 32 nt, Human
uucucagucccaaagaucuaagauaaauaaac

SEQ ID NO: 270951 - RNA, 32 nt, Human
uucucagugagggucagaguggggguggggga

SEQ ID NO: 270952 - RNA, 32 nt, Human
uucucagugagguagauauuaucugcaggacc

SEQ ID NO: 270953 - RNA, 32 nt, Human
uucucagugcucuccuaccccaccucaugccu

SEQ ID NO: 270954 - RNA, 32 nt, Human
uucucaguggacugccuugggcaaaccacugc

SEQ ID NO: 270955 - RNA, 32 nt, Human
uucucaguggguggagugccagggaggaggag

SEQ ID NO: 270956 - RNA, 32 nt, Human
uucucaguuucuuccccacaaaauuuggaauc

SEQ ID NO: 270957 - RNA, 32 nt, Human
uucucaguuucuuuucuguugaaaauccuggg

SEQ ID NO: 270958 - RNA, 32 nt, Human
uucucauacaauauauaguuauuuccuuuguu

SEQ ID NO: 270959 - RNA, 32 nt, Human
uucucauagcucugccuuauagaucauguaaa

SEQ ID NO: 270960 - RNA, 32 nt, Human
uucucauaguuacucaaaccuuuguuuagcau

SEQ ID NO: 270961 - RNA, 32 nt, Human
uucucauauucuugguauuccuccuggaugga

SEQ ID NO: 270962 - RNA, 32 nt, Human
uucucaucacacacacauggaaacccauaggu

SEQ ID NO: 270963 - RNA, 32 nt, Human
uucucaucaucaucaucucugcuacagucaug

SEQ ID NO: 270964 - RNA, 32 nt, Human
uucucaucuggauuaccagcucgaucucuaau

SEQ ID NO: 270965 - RNA, 32 nt, Human
uucucaucuguggagaagauggaaucuuaaaa

SEQ ID NO: 270966 - RNA, 32 nt, Human
uucucaugaaccucuguauugcuuuccuuaaa

SEQ ID NO: 270967 - RNA, 32 nt, Human
uucucaugaugcuucucagaccggcaacauca

SEQ ID NO: 270968 - RNA, 32 nt, Human
uucucaugaugucuuuccuuucaccuccugcg

SEQ ID NO: 270969 - RNA, 32 nt, Human
uucucaugcuacagagaaagauaaggaagaug

SEQ ID NO: 270970 - RNA, 32 nt, Human
uucucaugcuauuucuaccucacuuugguuuu

SEQ ID NO: 270971 - RNA, 32 nt, Human
uucucauggcuuuucagaauucagaauaugga

SEQ ID NO: 270972 - RNA, 32 nt, Human
uucucauguaaacuucagccaggcuguaaguc

SEQ ID NO: 270973 - RNA, 32 nt, Human
uucucaugucccccacuggucuguaccccagg

SEQ ID NO: 270974 - RNA, 32 nt, Human
uucucaugugccugaugugguggagggagaca

SEQ ID NO: 270975 - RNA, 32 nt, Human
uucucauguugccagaccugagguuccucacu

SEQ ID NO: 270976 - RNA, 32 nt, Human
uucucauguuuucuucccuccaccuccacccc

SEQ ID NO: 270977 - RNA, 30 nt, Human
uucucauuaccccuacacaucucuccacgg

SEQ ID NO: 270978 - RNA, 32 nt, Human
uucucauuaugggagcacuugguuaaauuaaa

SEQ ID NO: 270979 - RNA, 32 nt, Human
uucucauuccagcaugagcguuucugagucuc

SEQ ID NO: 270980 - RNA, 32 nt, Human
uucucauuggguggauggaugggugaggaggg

SEQ ID NO: 270981 - RNA, 32 nt, Human
uucucauugugccucuagacccucuuuaaagc

SEQ ID NO: 270982 - RNA, 32 nt, Human
uucucauuuauguauauuguauguuuaacccc

SEQ ID NO: 270983 - RNA, 32 nt, Human
uucucauuucuuuccuguucaucuccuugguc

SEQ ID NO: 270984 - RNA, 24 nt, Human
uucuccaaacccucuaggccucug

SEQ ID NO: 270985 - RNA, 32 nt, Human
uucuccaaacuugccgaaggcuucacagcugg

SEQ ID NO: 270986 - RNA, 32 nt, Human
uucuccaaauggcugcugucuuccucuaguac

SEQ ID NO: 270987 - RNA, 32 nt, Human
uucuccaacauacauccugcauuacaugaaug

SEQ ID NO: 270988 - RNA, 21 nt, Human
uucuccaagaaagguugcaag

SEQ ID NO: 270989 - RNA, 32 nt, Human
uucuccaagaggaggagggcgacgccaaggac

SEQ ID NO: 270990 - RNA, 32 nt, Human
uucuccaagcuccccuccugcucucccucccu

SEQ ID NO: 270991 - RNA, 32 nt, Human
uucuccaaguccugagcuucagaacuagggaa

SEQ ID NO: 270992 - RNA, 22 nt, Human
uucuccaagucuauucugcuuu

SEQ ID NO: 270993 - RNA, 32 nt, Human
uucuccaaguucuccuuuucucuccagaguga

SEQ ID NO: 270994 - RNA, 32 nt, Human
uucuccaauagucacauuggcaaagggagaac

SEQ ID NO: 270995 - RNA, 20 nt, Human
uucuccacacagguaauuca

SEQ ID NO: 270996 - RNA, 23 nt, Human
uucuccacacuuguccuaagcca

SEQ ID NO: 270997 - RNA, 32 nt, Human
uucuccacagccuucuccagccugugugauac

SEQ ID NO: 270998 - RNA, 32 nt, Human
uucuccacauccaggucagguggcguuugcug

SEQ ID NO: 270999 - RNA, 32 nt, Human
uucuccaccacucuugcauucugggugccugc

SEQ ID NO: 271000 - RNA, 32 nt, Human
uucuccaccaugagccucagacuugauaccac

SEQ ID NO: 271001 - RNA, 32 nt, Human
uucuccacccaauggggaaggaaggggguuuc

SEQ ID NO: 271002 - RNA, 19 nt, Human
uucuccacccaccagucag

SEQ ID NO: 271003 - RNA, 32 nt, Human
uucuccaccccucccccauacaaaauccacaa

SEQ ID NO: 271004 - RNA, 32 nt, Human
uucuccaccucucucucacagguacacacaca

SEQ ID NO: 271005 - RNA, 32 nt, Human
uucuccacucuccaccaugcaggacaaacauc

SEQ ID NO: 271006 - RNA, 32 nt, Human
uucuccacugcacuggagcuuugaagaccuaa

SEQ ID NO: 271007 - RNA, 32 nt, Human
uucuccacugcacugugcuagcagcucagcag

SEQ ID NO: 271008 - RNA, 32 nt, Human
uucuccacugugguggucuggauucagugauu

SEQ ID NO: 271009 - RNA, 32 nt, Human
uucuccagacccaccugcugacuuuagacucu

SEQ ID NO: 271010 - RNA, 32 nt, Human
uucuccagagauuacaaaaauguagcuucuca

SEQ ID NO: 271011 - RNA, 32 nt, Human
uucuccagagccuccagauaagaggccaggcu

SEQ ID NO: 271012 - RNA, 24 nt, Human
uucuccagaucucccucugucucc

SEQ ID NO: 271013 - RNA, 32 nt, Human
uucuccagcagcgaggagggaacuccaccgca

SEQ ID NO: 271014 - RNA, 21 nt, Human
uucuccagcagggcggcugca

SEQ ID NO: 271015 - RNA, 32 nt, Human
uucuccagcaucuuugcauugugaauaucuuc

SEQ ID NO: 271016 - RNA, 32 nt, Human
uucuccagccaagcucugagggcccaccuccu

SEQ ID NO: 271017 - RNA, 23 nt, Human
uucuccagccacccagccccaag

SEQ ID NO: 271018 - RNA, 21 nt, Human
uucuccagccagcugcugcag

SEQ ID NO: 271019 - RNA, 32 nt, Human
uucuccagcccugguagcauuugcucagagcc

SEQ ID NO: 271020 - RNA, 21 nt, Human
uucuccagcccuguggucuca

SEQ ID NO: 271021 - RNA, 18 nt, Human
uucuccagccucagccuc

SEQ ID NO: 271022 - RNA, 32 nt, Human
uucuccagccuccacccagcagcccuggauug

SEQ ID NO: 271023 - RNA, 32 nt, Human
uucuccagccuccaccugccugucugauccaa

SEQ ID NO: 271024 - RNA, 32 nt, Human
uucuccagccugggcaacagagugagucccug

SEQ ID NO: 271025 - RNA, 32 nt, Human
uucuccagccugggcaacggagugagacucca

SEQ ID NO: 271026 - RNA, 23 nt, Human
uucuccagccugugugauacaag

SEQ ID NO: 271027 - RNA, 32 nt, Human
uucuccagcucacccccagccugccgauguuu

SEQ ID NO: 271028 - RNA, 32 nt, Human
uucuccagcugaggcaggagaaugccuaccug

SEQ ID NO: 271029 - RNA, 32 nt, Human
uucuccagcuuuugcaguguccuggcauccuu

SEQ ID NO: 271030 - RNA, 30 nt, Human
uucuccaggaagcccagggcaccauccagc

SEQ ID NO: 271031 - RNA, 32 nt, Human
uucuccaggacugacucaacagccgauuugga

SEQ ID NO: 271032 - RNA, 32 nt, Human
uucuccaggauggcagaggcggaauugcacaa

SEQ ID NO: 271033 - RNA, 32 nt, Human
uucuccaggcagcacaugcgguggcucuggga

SEQ ID NO: 271034 - RNA, 24 nt, Human
uucuccaggcaggccuggccucug

SEQ ID NO: 271035 - RNA, 32 nt, Human
uucuccaggcccaguucuuccucccagcuggg

SEQ ID NO: 271036 - RNA, 21 nt, Human
uucuccaggcccucugaguuc

SEQ ID NO: 271037 - RNA, 20 nt, Human
uucuccaggcccugauucuc

SEQ ID NO: 271038 - RNA, 22 nt, Human
uucuccaggccugggcuacagg

SEQ ID NO: 271039 - RNA, 32 nt, Human
uucuccagggcauguugguuucccuggccucu

SEQ ID NO: 271040 - RNA, 32 nt, Human
uucuccaggguggcccaguguccccuucugcc

SEQ ID NO: 271041 - RNA, 24 nt, Human
uucuccaggugauucugaucccug

SEQ ID NO: 271042 - RNA, 32 nt, Human
uucuccaguagcugagcaaugcuugugaaucu

SEQ ID NO: 271043 - RNA, 32 nt, Human
uucuccaguauccugacauguaaagagauucu

SEQ ID NO: 271044 - RNA, 32 nt, Human
uucuccagucugaacaguucagcuacagucug

SEQ ID NO: 271045 - RNA, 32 nt, Human
uucuccagucugucacccuccuuuccugcucc

SEQ ID NO: 271046 - RNA, 32 nt, Human
uucuccaguuugaaaauaaaauagccuuuaaa

SEQ ID NO: 271047 - RNA, 32 nt, Human
uucuccaucgcuucucagccuuuuggcuaaga

SEQ ID NO: 271048 - RNA, 32 nt, Human
uucuccaucucacuaaggguuaaaggcgugca

SEQ ID NO: 271049 - RNA, 32 nt, Human
uucuccaucuccauucuuuugaauuuccucau

SEQ ID NO: 271050 - RNA, 32 nt, Human
uucuccaucuccugggacguagcaggaaauca

SEQ ID NO: 271051 - RNA, 32 nt, Human
uucuccaucuuccucgucuggacgguggucua

SEQ ID NO: 271052 - RNA, 32 nt, Human
uucuccaugagggagaaggaagcagcuagcua

SEQ ID NO: 271053 - RNA, 32 nt, Human
uucuccaugcacugucccugcccacacucgcu

SEQ ID NO: 271054 - RNA, 32 nt, Human
uucuccauggccuuugcacucuuuuugcuuuu

SEQ ID NO: 271055 - RNA, 32 nt, Human
uucuccauggugcuucaauagcauguuauuau

SEQ ID NO: 271056 - RNA, 32 nt, Human
uucuccauucaaggagcuuguagcucugagcu

SEQ ID NO: 271057 - RNA, 32 nt, Human
uucuccauucaggccuugagugguguccuauu

SEQ ID NO: 271058 - RNA, 32 nt, Human
uucuccauucucuuucauauuuuaaccaauuu

SEQ ID NO: 271059 - RNA, 32 nt, Human
uucuccauuuaucucuucguccuuccugccug

SEQ ID NO: 271060 - RNA, 32 nt, Human
uucuccauuugccucuuccuuccuauuucccu

SEQ ID NO: 271061 - RNA, 32 nt, Human
uucucccaagcugcaguacuggggaagggcug

SEQ ID NO: 271062 - RNA, 32 nt, Human
uucucccaccauaacaugaaaacaguguaaga

SEQ ID NO: 271063 - RNA, 32 nt, Human
uucucccacgggaagauucuuaaaacgaagaa

SEQ ID NO: 271064 - RNA, 32 nt, Human
uucucccacuccucacacucuucuacagggau

SEQ ID NO: 271065 - RNA, 32 nt, Human
uucucccagagaaaccaccuuccauccagcgg

SEQ ID NO: 271066 - RNA, 32 nt, Human
uucucccagccuuuuacccucuugccuccugc

SEQ ID NO: 271067 - RNA, 32 nt, Human
uucucccagcuucaaaugcacaauucaucauu

SEQ ID NO: 271068 - RNA, 32 nt, Human
uucucccaggaaccccaguuggggaaggccua

SEQ ID NO: 271069 - RNA, 32 nt, Human
uucucccaggagaggcuggaguguccaaaagc

SEQ ID NO: 271070 - RNA, 32 nt, Human
uucucccaggccugugcacacacccccucagc

SEQ ID NO: 271071 - RNA, 32 nt, Human
uucucccaguggcaggccucugucuuuuugcc

SEQ ID NO: 271072 - RNA, 32 nt, Human
uucucccauacauuccaaaaggaaguucaaca

SEQ ID NO: 271073 - RNA, 32 nt, Human
uucucccaugcacuugcacguccaggacuccu

SEQ ID NO: 271074 - RNA, 32 nt, Human
uucucccauggccauggaauaaaugccaugcu

SEQ ID NO: 271075 - RNA, 32 nt, Human
uucucccauucaaaccauucuaggccugcaau

SEQ ID NO: 271076 - RNA, 32 nt, Human
uucucccauucucccucccucucccuuuucuc

SEQ ID NO: 271077 - RNA, 32 nt, Human
uucucccauuucucccucuccuucccugacac

SEQ ID NO: 271078 - RNA, 32 nt, Human
uucuccccaaaagguguucaugccucccugug

SEQ ID NO: 271079 - RNA, 32 nt, Human
uucuccccaaagacgcacuccagaagucucgc

SEQ ID NO: 271080 - RNA, 32 nt, Human
uucuccccaaaucuagaaauuuuaguucauau

SEQ ID NO: 271081 - RNA, 32 nt, Human
uucuccccacaaccccaaccccagaggaaaag

SEQ ID NO: 271082 - RNA, 32 nt, Human
uucuccccacaucuagaaauuguaguucauau

SEQ ID NO: 271083 - RNA, 32 nt, Human
uucuccccaccccagccccacaccugcuccuu

SEQ ID NO: 271084 - RNA, 32 nt, Human
uucuccccaguccuccagcccaggagggagcc

SEQ ID NO: 271085 - RNA, 32 nt, Human
uucuccccaguucugauaccacuaagaagaag

SEQ ID NO: 271086 - RNA, 32 nt, Human
uucuccccaucccaccugugugcagugcccuu

SEQ ID NO: 271087 - RNA, 32 nt, Human
uucuccccaucugagccagccugcugguguga

SEQ ID NO: 271088 - RNA, 32 nt, Human
uucuccccaucuuuucuucuacauuuuguuau

SEQ ID NO: 271089 - RNA, 32 nt, Human
uucucccccaaagccaagccauuuaaugaccu

SEQ ID NO: 271090 - RNA, 32 nt, Human
uucucccccaucucccccucuccaucuccucu

SEQ ID NO: 271091 - RNA, 32 nt, Human
uucucccccuaaaaaugaauacauaguaggac

SEQ ID NO: 271092 - RNA, 31 nt, Human
uucucccccucucucccuccugugucuugcg

SEQ ID NO: 271093 - RNA, 32 nt, Human
uucuccccuacccagggaacuggaccuggcag

SEQ ID NO: 271094 - RNA, 32 nt, Human
uucuccccuacggcugcuucucaggccucccu

SEQ ID NO: 271095 - RNA, 17 nt, Human
uucuccccucaagggug

SEQ ID NO: 271096 - RNA, 32 nt, Human
uucuccccucacugcugagucucccaggaccc

SEQ ID NO: 271097 - RNA, 32 nt, Human
uucuccccucauuuccucuucuccuuacuaag

SEQ ID NO: 271098 - RNA, 32 nt, Human
uucuccccucccccuccucaccgucuucuccc

SEQ ID NO: 271099 - RNA, 32 nt, Human
uucuccccuccccucuuuccucacccuuuucu

SEQ ID NO: 271100 - RNA, 32 nt, Human
uucuccccugcacucugcucccugcgcgguaa

SEQ ID NO: 271101 - RNA, 32 nt, Human
uucuccccugcagcuuccucugcuucuggaau

SEQ ID NO: 271102 - RNA, 32 nt, Human
uucuccccugcccuauucugcuucacuugcau

SEQ ID NO: 271103 - RNA, 32 nt, Human
uucuccccugcccuuccuccugauggagugug

SEQ ID NO: 271104 - RNA, 32 nt, Human
uucuccccuuccccucccccuccccucccccu

SEQ ID NO: 271105 - RNA, 32 nt, Human
uucuccccuuugagaacauucagugaauacaa

SEQ ID NO: 271106 - RNA, 32 nt, Human
uucucccgacugcggcccccagccugguccac

SEQ ID NO: 271107 - RNA, 32 nt, Human
uucucccgccauucuuuuucugaggucuccug

SEQ ID NO: 271108 - RNA, 32 nt, Human
uucucccggaaccucugcucagccuggugaac

SEQ ID NO: 271109 - RNA, 32 nt, Human
uucucccgguggcucuguguacacgcucugcc

SEQ ID NO: 271110 - RNA, 32 nt, Human
uucucccuacaaccccaggcccagggauagga

SEQ ID NO: 271111 - RNA, 32 nt, Human
uucucccuagaugagcuucacaucucagguaa

SEQ ID NO: 271112 - RNA, 32 nt, Human
uucucccuccaaugcaccaucuguggauagau

SEQ ID NO: 271113 - RNA, 32 nt, Human
uucucccuccagaccuuccucugacccuugcu

SEQ ID NO: 271114 - RNA, 32 nt, Human
uucucccuccccacccccuccaggcccggggc

SEQ ID NO: 271115 - RNA, 32 nt, Human
uucucccucccgcuucccccagccgcggccua

SEQ ID NO: 271116 - RNA, 32 nt, Human
uucucccuccggaucgaugugcugcuguuaac

SEQ ID NO: 271117 - RNA, 32 nt, Human
uucucccuccuaccugucuguaguguuguggg

SEQ ID NO: 271118 - RNA, 32 nt, Human
uucucccuccucccaaccuccacccucaagua

SEQ ID NO: 271119 - RNA, 32 nt, Human
uucucccuccuccuuuuccuguguucucuuaa

SEQ ID NO: 271120 - RNA, 32 nt, Human
uucucccuccuuuccaacuuccuuccuuucuu

SEQ ID NO: 271121 - RNA, 32 nt, Human
uucucccucucccugcugcuucauacugaaac

SEQ ID NO: 271122 - RNA, 32 nt, Human
uucucccucugcaggcucugcagcagcuccug

SEQ ID NO: 271123 - RNA, 32 nt, Human
uucucccucuucucccugagacuucaguuuug

SEQ ID NO: 271124 - RNA, 32 nt, Human
uucucccucuuucauaacuggaugcagcugcu

SEQ ID NO: 271125 - RNA, 32 nt, Human
uucucccugagcuccuggaaggagcaguuacc

SEQ ID NO: 271126 - RNA, 32 nt, Human
uucucccugcaaccucaguccaaggaaccugc

SEQ ID NO: 271127 - RNA, 32 nt, Human
uucucccugcagcugccuagaccccguucaca

SEQ ID NO: 271128 - RNA, 32 nt, Human
uucucccugccugauucucugagcucugggcu

SEQ ID NO: 271129 - RNA, 32 nt, Human
uucucccugcuucuccccuuugucaucucuga

SEQ ID NO: 271130 - RNA, 32 nt, Human
uucucccuggccuucugcuccaagcucuccug

SEQ ID NO: 271131 - RNA, 32 nt, Human
uucucccugggaagguggggccagcaggagau

SEQ ID NO: 271132 - RNA, 32 nt, Human
uucucccugggccuggugaccuccacaggaug

SEQ ID NO: 271133 - RNA, 16 nt, Human
uucucccuguacagug

SEQ ID NO: 271134 - RNA, 32 nt, Human
uucucccugucccuuccuuucuccccuauuuu

SEQ ID NO: 271135 - RNA, 32 nt, Human
uucucccugucucugccugucuuccaagcucc

SEQ ID NO: 271136 - RNA, 32 nt, Human
uucucccugugccuuagagcagguguguacau

SEQ ID NO: 271137 - RNA, 32 nt, Human
uucucccuuauuuugugaucuguaacagggua

SEQ ID NO: 271138 - RNA, 32 nt, Human
uucucccuucccauuucuccccacuuucaucu

SEQ ID NO: 271139 - RNA, 32 nt, Human
uucucccuuuccaaccccuuccuuccuuuucc

SEQ ID NO: 271140 - RNA, 32 nt, Human
uucucccuuuggcuccucuccugcugccuuac

SEQ ID NO: 271141 - RNA, 32 nt, Human
uucucccuuuguccucauacagucgucucucu

SEQ ID NO: 271142 - RNA, 32 nt, Human
uucucccuuuuccuagacacaggacucugaca

SEQ ID NO: 271143 - RNA, 32 nt, Human
uucuccgaacccugaggcagugugugaagcug

SEQ ID NO: 271144 - RNA, 32 nt, Human
uucuccgaguuuugcuaccagccgaggcugug

SEQ ID NO: 271145 - RNA, 32 nt, Human
uucuccggaggcaccccuugcccagagugugc

SEQ ID NO: 271146 - RNA, 20 nt, Human
uucuccgggucaaggccagg

SEQ ID NO: 271147 - RNA, 32 nt, Human
uucuccggugagccacagccuggccaccuguc

SEQ ID NO: 271148 - RNA, 32 nt, Human
uucuccgugaccuuucucuagccagggagaag

SEQ ID NO: 271149 - RNA, 32 nt, Human
uucuccguggggacccgugucugugggagcgg

SEQ ID NO: 271150 - RNA, 32 nt, Human
uucuccguggugagcagggccaccccuggggc

SEQ ID NO: 271151 - RNA, 32 nt, Human
uucuccgugugggggcuacaugcgacccucuc

SEQ ID NO: 271152 - RNA, 32 nt, Human
uucuccguucuuuuuacaaucaucuuacacgc

SEQ ID NO: 271153 - RNA, 32 nt, Human
uucuccuaagggugucaggaaccucuaaaaag

SEQ ID NO: 271154 - RNA, 32 nt, Human
uucuccuagggaggaaacugaaaagcagaaag

SEQ ID NO: 271155 - RNA, 32 nt, Human
uucuccuaucuuucuuucucuucuuccuuucu

SEQ ID NO: 271156 - RNA, 32 nt, Human
uucuccucaccugggccuucucagccucugga

SEQ ID NO: 271157 - RNA, 32 nt, Human
uucuccucaguuuucuggagugcuuuggagga

SEQ ID NO: 271158 - RNA, 22 nt, Human
uucuccucaucuccccaucauu

SEQ ID NO: 271159 - RNA, 32 nt, Human
uucuccucaucugccucuuccugggcgccaac

SEQ ID NO: 271160 - RNA, 32 nt, Human
uucuccuccacccucuuaauggaugguauggc

SEQ ID NO: 271161 - RNA, 32 nt, Human
uucuccuccagaacaugcagagacccauggau

SEQ ID NO: 271162 - RNA, 32 nt, Human
uucuccuccagcccuucucuucaauggucccu

SEQ ID NO: 271163 - RNA, 25 nt, Human
uucuccuccauacauccccaucccu

SEQ ID NO: 271164 - RNA, 32 nt, Human
uucuccuccauucauguuuaauuugcaucaca

SEQ ID NO: 271165 - RNA, 32 nt, Human
uucuccucccacagggucccccuugccccagc

SEQ ID NO: 271166 - RNA, 32 nt, Human
uucuccucccaggaacugggccaacucaccug

SEQ ID NO: 271167 - RNA, 32 nt, Human
uucuccucccccaugcccaaccccuguggccg

SEQ ID NO: 271168 - RNA, 32 nt, Human
uucuccuccguuuucuucucuuccugcccuau

SEQ ID NO: 271169 - RNA, 31 nt, Human
uucuccuccuaaucugggccucuugucaugg

SEQ ID NO: 271170 - RNA, 32 nt, Human
uucuccuccuaaucugggccucuugucaugga

SEQ ID NO: 271171 - RNA, 32 nt, Human
uucuccuccuccagaccuaguauucuaaguua

SEQ ID NO: 271172 - RNA, 32 nt, Human
uucuccucgaccagccaucaugacauuuacca

SEQ ID NO: 271173 - RNA, 32 nt, Human
uucuccucguacugcugggugagguucucgau

SEQ ID NO: 271174 - RNA, 32 nt, Human
uucuccucuagggacucuucagucucauuuag

SEQ ID NO: 271175 - RNA, 32 nt, Human
uucuccucuaggguauugggaugcauguucug

SEQ ID NO: 271176 - RNA, 32 nt, Human
uucuccucuccccuccuucccccaccacaggu

SEQ ID NO: 271177 - RNA, 32 nt, Human
uucuccucuccccucuaaggccgaagaagggu

SEQ ID NO: 271178 - RNA, 32 nt, Human
uucuccucuccucaaaucucugaucaucuucu

SEQ ID NO: 271179 - RNA, 32 nt, Human
uucuccucuccucuccugguccuguugucccc

SEQ ID NO: 271180 - RNA, 32 nt, Human
uucuccucuccucugaccccucagcuccuugg

SEQ ID NO: 271181 - RNA, 32 nt, Human
uucuccucuucuuccuccuucguuucuuccuu

SEQ ID NO: 271182 - RNA, 32 nt, Human
uucuccugaaaccuucauccacacaaugccuc

SEQ ID NO: 271183 - RNA, 21 nt, Human
uucuccugaaggggcugcaag

SEQ ID NO: 271184 - RNA, 17 nt, Human
uucuccugaaugcagug

SEQ ID NO: 271185 - RNA, 32 nt, Human
uucuccugaccuccuuucaccugcugcuuuuu

SEQ ID NO: 271186 - RNA, 32 nt, Human
uucuccugauagucaccugcugguuguugcca

SEQ ID NO: 271187 - RNA, 32 nt, Human
uucuccugccaaaugacccuagacccucuguc

SEQ ID NO: 271188 - RNA, 32 nt, Human
uucuccugcccuccugugucucaggcccguuu

SEQ ID NO: 271189 - RNA, 32 nt, Human
uucuccugccuaagccucucgaguagcuggga

SEQ ID NO: 271190 - RNA, 20 nt, Human
uucuccugccucagccucgu

SEQ ID NO: 271191 - RNA, 32 nt, Human
uucuccugccucccugccucagccugggaccu

SEQ ID NO: 271192 - RNA, 32 nt, Human
uucuccugccucuccacacuccagguucccuc

SEQ ID NO: 271193 - RNA, 31 nt, Human
uucuccugccucuuggcccccagucacauuu

SEQ ID NO: 271194 - RNA, 32 nt, Human
uucuccugcuacagaacuggauccucccagcu

SEQ ID NO: 271195 - RNA, 32 nt, Human
uucuccugcuagccuagcuuuguauuuuauca

SEQ ID NO: 271196 - RNA, 32 nt, Human
uucuccugcuucuuccucuuccucucacucug

SEQ ID NO: 271197 - RNA, 32 nt, Human
uucuccugcuuuggccuccugaguagcuggga

SEQ ID NO: 271198 - RNA, 32 nt, Human
uucuccugcuuuggccuccugaguagcugggg

SEQ ID NO: 271199 - RNA, 32 nt, Human
uucuccuggaaccuguccacaguggggauugu

SEQ ID NO: 271200 - RNA, 32 nt, Human
uucuccuggagacagcucucaucaggcuuccc

SEQ ID NO: 271201 - RNA, 32 nt, Human
uucuccuggaucuugcugaauuaguggcuugg

SEQ ID NO: 271202 - RNA, 32 nt, Human
uucuccuggcaaguaaaccccaaggaggacug

SEQ ID NO: 271203 - RNA, 32 nt, Human
uucuccugggcccgcuuugccugcuugaagga

SEQ ID NO: 271204 - RNA, 32 nt, Human
uucuccugggcuccagccuccugcaaggacug

SEQ ID NO: 271205 - RNA, 32 nt, Human
uucuccuggggucacucccacauggcugccuc

SEQ ID NO: 271206 - RNA, 32 nt, Human
uucuccugggugaagauggaccagcccaccuu

SEQ ID NO: 271207 - RNA, 32 nt, Human
uucuccugguguuugcgcaagugccuucuccg

SEQ ID NO: 271208 - RNA, 32 nt, Human
uucuccuguaaucccagcuacucgggaggccg

SEQ ID NO: 271209 - RNA, 18 nt, Human
uucuccugucccagccuc

SEQ ID NO: 271210 - RNA, 32 nt, Human
uucuccugucuuagccuccugaguagcuguga

SEQ ID NO: 271211 - RNA, 32 nt, Human
uucuccugucuucauuuuccuccuuccaggcc

SEQ ID NO: 271212 - RNA, 32 nt, Human
uucuccugugucccaaaccccagggggcccca

SEQ ID NO: 271213 - RNA, 32 nt, Human
uucuccuguguucccuuugaguccaguguggg

SEQ ID NO: 271214 - RNA, 32 nt, Human
uucuccuguucugccaagacuuccuccucuuu

SEQ ID NO: 271215 - RNA, 32 nt, Human
uucuccuguuuagaauggcuguauuuacccaa

SEQ ID NO: 271216 - RNA, 32 nt, Human
uucuccuguuucacacagaggugggugguucu

SEQ ID NO: 271217 - RNA, 32 nt, Human
uucuccuguuucagccuccugaguagcuggga

SEQ ID NO: 271218 - RNA, 32 nt, Human
uucuccuuaagagcaacuuccuuuuuaaaaug

SEQ ID NO: 271219 - RNA, 32 nt, Human
uucuccuucaagguucuuucccccucaguuuu

SEQ ID NO: 271220 - RNA, 32 nt, Human
uucuccuucaguugugggguccugcuuugccc

SEQ ID NO: 271221 - RNA, 20 nt, Human
uucuccuucauccccaccac

SEQ ID NO: 271222 - RNA, 32 nt, Human
uucuccuuccucagcccugcccugcuuggaua

SEQ ID NO: 271223 - RNA, 32 nt, Human
uucuccuuccugaccuuccucagucugcagcu

SEQ ID NO: 271224 - RNA, 32 nt, Human
uucuccuuccuugucugccuuuacagauguuu

SEQ ID NO: 271225 - RNA, 32 nt, Human
uucuccuugaaaagugacauccugucacuucu

SEQ ID NO: 271226 - RNA, 32 nt, Human
uucuccuugacaauggaaaggcagcagucuuc

SEQ ID NO: 271227 - RNA, 32 nt, Human
uucuccuugagcucuuugacucccagaaggua

SEQ ID NO: 271228 - RNA, 21 nt, Human
uucuccuuggcaccugugcgc

SEQ ID NO: 271229 - RNA, 32 nt, Human
uucuccuuggguauuacaaguuuuugucugga

SEQ ID NO: 271230 - RNA, 21 nt, Human
uucuccuugguccuccuguca

SEQ ID NO: 271231 - RNA, 32 nt, Human
uucuccuuuacacauccuuuauuucauuaaau

SEQ ID NO: 271232 - RNA, 18 nt, Human
uucuccuuuauucuucua

SEQ ID NO: 271233 - RNA, 32 nt, Human
uucuccuuucacaaccuucuguggcucacaga

SEQ ID NO: 271234 - RNA, 18 nt, Human
uucuccuuucauuuucca

SEQ ID NO: 271235 - RNA, 32 nt, Human
uucuccuuucuacaugacauugcagugguggu

SEQ ID NO: 271236 - RNA, 32 nt, Human
uucuccuuucuuuccuccuugaagccuggcuc

SEQ ID NO: 271237 - RNA, 32 nt, Human
uucuccuuugaggcagagguuuaaguguaggc

SEQ ID NO: 271238 - RNA, 32 nt, Human
uucuccuuugauuauauaaaagcuauuucauu

SEQ ID NO: 271239 - RNA, 32 nt, Human
uucuccuuuggguuucuugcugcugcaauuuu

SEQ ID NO: 271240 - RNA, 32 nt, Human
uucucgaacuggaugcauuaggaagcugcugu

SEQ ID NO: 271241 - RNA, 22 nt, Human
uucucgaagaggccaguugggc

SEQ ID NO: 271242 - RNA, 32 nt, Human
uucucgacccuggacgucuaccuuccggaggc

SEQ ID NO: 271243 - RNA, 32 nt, Human
uucucgaguuuaaaguucagaggaucaugaag

SEQ ID NO: 271244 - RNA, 32 nt, Human
uucucgaucucauuuccacaaaggauaugaag

SEQ ID NO: 271245 - RNA, 32 nt, Human
uucucgauuuugcucuaaacugcugcaucugu

SEQ ID NO: 271246 - RNA, 32 nt, Human
uucucgcaacaguggccuacacugccuuucag

SEQ ID NO: 271247 - RNA, 32 nt, Human
uucucgcacaggcuuggagugcaguggugcga

SEQ ID NO: 271248 - RNA, 32 nt, Human
uucucgcaccugcucagcccugugucggcuuc

SEQ ID NO: 271249 - RNA, 32 nt, Human
uucucgcagucuuccuggaaaauauuuuccuu

SEQ ID NO: 271250 - RNA, 32 nt, Human
uucucgccaugucuucucacaagacuuucacc

SEQ ID NO: 271251 - RNA, 32 nt, Human
uucucgccgggcugggaacaauaaugcagcca

SEQ ID NO: 271252 - RNA, 32 nt, Human
uucucgccuaacgccgccaacaugguguucag

SEQ ID NO: 271253 - RNA, 32 nt, Human
uucucgccugucguuuagccugugccacacuu

SEQ ID NO: 271254 - RNA, 32 nt, Human
uucucgcucucuguccaccacacacacggccc

SEQ ID NO: 271255 - RNA, 32 nt, Human
uucucggccucucucucugugugaaggggccu

SEQ ID NO: 271256 - RNA, 32 nt, Human
uucucggcugaucucucuggguaggugcccuc

SEQ ID NO: 271257 - RNA, 32 nt, Human
uucucggcugcaguguacucaucuugauccua

SEQ ID NO: 271258 - RNA, 32 nt, Human
uucucgggaacgagggagagguugauccuaug

SEQ ID NO: 271259 - RNA, 32 nt, Human
uucucgggacaggcuaaccaggaggacaggag

SEQ ID NO: 271260 - RNA, 21 nt, Human
uucucgggcagccagcuaggu

SEQ ID NO: 271261 - RNA, 32 nt, Human
uucucgguuuuccuuugagucuucuggagcug

SEQ ID NO: 271262 - RNA, 32 nt, Human
uucucgucagcaagggcggacaaggacucuuc

SEQ ID NO: 271263 - RNA, 32 nt, Human
uucucguccccaugcucccccaccucagugcu

SEQ ID NO: 271264 - RNA, 32 nt, Human
uucucgucggauugcccaugcacuuguugcag

SEQ ID NO: 271265 - RNA, 32 nt, Human
uucucgucuguauaauggaagcaagacuucca

SEQ ID NO: 271266 - RNA, 32 nt, Human
uucucgugacagcaugagcagagaucauuaaa

SEQ ID NO: 271267 - RNA, 32 nt, Human
uucucguggccgcggcagcgcggucucugcgg

SEQ ID NO: 271268 - RNA, 29 nt, Human
uucucgugucuguguguuuggcuucuaaa

SEQ ID NO: 271269 - RNA, 32 nt, Human
uucucguguugcuucuccacuuugagagguug

SEQ ID NO: 271270 - RNA, 32 nt, Human
uucucguucucaucucugccggaauuccacau

SEQ ID NO: 271271 - RNA, 32 nt, Human
uucucguugcucgucaccuccaugccaggcac

SEQ ID NO: 271272 - RNA, 32 nt, Human
uucucguuucaggucaccaucagaaaagcuaa

SEQ ID NO: 271273 - RNA, 21 nt, Human
uucucuaaacccuuucuguca

SEQ ID NO: 271274 - RNA, 32 nt, Human
uucucuaagccuugguuuccugaaccuuaaaa

SEQ ID NO: 271275 - RNA, 32 nt, Human
uucucuaauaauacuuaaaacucuuuacuaaa

SEQ ID NO: 271276 - RNA, 32 nt, Human
uucucuaccaacaauaaaccaaacccagccac

SEQ ID NO: 271277 - RNA, 32 nt, Human
uucucuaccauccuuuuccuucccaugcagau

SEQ ID NO: 271278 - RNA, 32 nt, Human
uucucuacccacccucuucucucuucucuucu

SEQ ID NO: 271279 - RNA, 32 nt, Human
uucucuacuccauuauuucucuacuuuuccuu

SEQ ID NO: 271280 - RNA, 20 nt, Human
uucucuacucuuccccagca

SEQ ID NO: 271281 - RNA, 32 nt, Human
uucucuacugauuuuguggcugugguuaacuu

SEQ ID NO: 271282 - RNA, 32 nt, Human
uucucuagacaggcgcugggagaaagaaccgg

SEQ ID NO: 271283 - RNA, 32 nt, Human
uucucuagagagguacaguuguaagucagagu

SEQ ID NO: 271284 - RNA, 32 nt, Human
uucucuagcccacccucgcacacucauucacu

SEQ ID NO: 271285 - RNA, 32 nt, Human
uucucuaggcuguuauguuaauuccucugaua

SEQ ID NO: 271286 - RNA, 32 nt, Human
uucucuaguguuuuaagugauccuuugaagua

SEQ ID NO: 271287 - RNA, 32 nt, Human
uucucuaguucucauaagacuaucuccccgcc

SEQ ID NO: 271288 - RNA, 32 nt, Human
uucucuaugacacagcuuuaaccuucuucucu

SEQ ID NO: 271289 - RNA, 32 nt, Human
uucucuaugcacucuuauauucugccuuucug

SEQ ID NO: 271290 - RNA, 32 nt, Human
uucucuauggagugaagcgaaugaagugaaua

SEQ ID NO: 271291 - RNA, 32 nt, Human
uucucuauggggcucccagagugcaaaggaca

SEQ ID NO: 271292 - RNA, 32 nt, Human
uucucuauguagucuggcaguauaaauauaaa

SEQ ID NO: 271293 - RNA, 32 nt, Human
uucucuauuaugcuccuuucuucaaggccgcc

SEQ ID NO: 271294 - RNA, 32 nt, Human
uucucucaagcuagggcagaagagggguguca

SEQ ID NO: 271295 - RNA, 32 nt, Human
uucucucaagcuagggcagaagagggugucaa

SEQ ID NO: 271296 - RNA, 31 nt, Human
uucucucaagugucccaaaucaggguagcaa

SEQ ID NO: 271297 - RNA, 32 nt, Human
uucucucacauggagaaaaccaagacagaauu

SEQ ID NO: 271298 - RNA, 32 nt, Human
uucucucaccacaaaaagugguaugugaggua

SEQ ID NO: 271299 - RNA, 32 nt, Human
uucucucacccaggugcaaaugaccaguggug

SEQ ID NO: 271300 - RNA, 32 nt, Human
uucucucacuacuacauuucuguaaguggucc

SEQ ID NO: 271301 - RNA, 32 nt, Human
uucucucacucucgccacugggguuaagggca

SEQ ID NO: 271302 - RNA, 32 nt, Human
uucucucacuuaguacugaggaauuuucaugu

SEQ ID NO: 271303 - RNA, 31 nt, Human
uucucucagaaguucagcuguugaaacgaaa

SEQ ID NO: 271304 - RNA, 32 nt, Human
uucucucagcuauuuugagucuguggaagaaa

SEQ ID NO: 271305 - RNA, 20 nt, Human
uucucucagcuucucagggu

SEQ ID NO: 271306 - RNA, 32 nt, Human
uucucucagguuuguucuuccuaucauguuug

SEQ ID NO: 271307 - RNA, 32 nt, Human
uucucucauagaacauugaucuguuuuacagg

SEQ ID NO: 271308 - RNA, 32 nt, Human
uucucucauccagaagacauaggaacccuacc

SEQ ID NO: 271309 - RNA, 32 nt, Human
uucucucauguggauggauggacucugggguu

SEQ ID NO: 271310 - RNA, 32 nt, Human
uucucucauuccgaguucagggugacacauuu

SEQ ID NO: 271311 - RNA, 32 nt, Human
uucucuccaaccagggcagaaaggagggagga

SEQ ID NO: 271312 - RNA, 32 nt, Human
uucucuccaagcugggagcuccugggccccca

SEQ ID NO: 271313 - RNA, 21 nt, Human
uucucuccacaaaaaagagac

SEQ ID NO: 271314 - RNA, 32 nt, Human
uucucuccaccaccaaaagcaaaagaugauuu

SEQ ID NO: 271315 - RNA, 32 nt, Human
uucucuccacccuucuuagggcuggaggaugg

SEQ ID NO: 271316 - RNA, 32 nt, Human
uucucuccagaacagggaaaugugguguuuac

SEQ ID NO: 271317 - RNA, 32 nt, Human
uucucuccagccucugugccuuuguuccaggu

SEQ ID NO: 271318 - RNA, 32 nt, Human
uucucuccaucaggaugguacuuugggggaac

SEQ ID NO: 271319 - RNA, 32 nt, Human
uucucucccacacgccccucuccucuaccccu

SEQ ID NO: 271320 - RNA, 32 nt, Human
uucucucccacugcaacuccacuuucuuugca

SEQ ID NO: 271321 - RNA, 32 nt, Human
uucucuccccagccauucagagguuuccaaac

SEQ ID NO: 271322 - RNA, 32 nt, Human
uucucuccccuccucugcccugugccacucuc

SEQ ID NO: 271323 - RNA, 32 nt, Human
uucucuccccugccccaaaccucucuccucuc

SEQ ID NO: 271324 - RNA, 28 nt, Human
uucucucccgcagcugccucagucggcu

SEQ ID NO: 271325 - RNA, 32 nt, Human
uucucucccuaaggucugguggagucucccca

SEQ ID NO: 271326 - RNA, 32 nt, Human
uucucucccucuuucccuccauccucgagcgu

SEQ ID NO: 271327 - RNA, 32 nt, Human
uucucucccuuucucauucucauuccaccugu

SEQ ID NO: 271328 - RNA, 32 nt, Human
uucucucccuuucuccuucucguucucucccg

SEQ ID NO: 271329 - RNA, 32 nt, Human
uucucuccuccccuaccuugacucccccaacc

SEQ ID NO: 271330 - RNA, 32 nt, Human
uucucuccuccccuccccucccuucucauucc

SEQ ID NO: 271331 - RNA, 32 nt, Human
uucucuccuccccuucucucuuucugucuuuc

SEQ ID NO: 271332 - RNA, 32 nt, Human
uucucuccuccgcuuaaccaagcuguuguggu

SEQ ID NO: 271333 - RNA, 32 nt, Human
uucucuccuccuccucgcccuucuccucgccc

SEQ ID NO: 271334 - RNA, 32 nt, Human
uucucuccucucggaagcugcagccaugaugg

SEQ ID NO: 271335 - RNA, 32 nt, Human
uucucuccuggccacucuuccugcugccucug

SEQ ID NO: 271336 - RNA, 32 nt, Human
uucucuccuguucaaagaagcuuucaccaugg

SEQ ID NO: 271337 - RNA, 32 nt, Human
uucucuccuucucuccuccucucuccucuccu

SEQ ID NO: 271338 - RNA, 32 nt, Human
uucucuccuuucuccccauccuguguucuggg

SEQ ID NO: 271339 - RNA, 32 nt, Human
uucucuccuuucucccugcagccuuuucuggu

SEQ ID NO: 271340 - RNA, 32 nt, Human
uucucuccuuucucguccccaugcucccccac

SEQ ID NO: 271341 - RNA, 32 nt, Human
uucucucgacuucggccuuucggaaagaagcg

SEQ ID NO: 271342 - RNA, 32 nt, Human
uucucucgccacccucucguccccucgucucc

SEQ ID NO: 271343 - RNA, 21 nt, Human
uucucucgggcucuuugcuca

SEQ ID NO: 271344 - RNA, 32 nt, Human
uucucucucacugccacgccuuccuuucccuc

SEQ ID NO: 271345 - RNA, 32 nt, Human
uucucucucagccucauccuucugggccugga

SEQ ID NO: 271346 - RNA, 32 nt, Human
uucucucuccaauaaaccuuuugcuucagggu

SEQ ID NO: 271347 - RNA, 32 nt, Human
uucucucuccaccccuccuccauccacccuga

SEQ ID NO: 271348 - RNA, 32 nt, Human
uucucucuccaccuauccauuagccuuccuaa

SEQ ID NO: 271349 - RNA, 32 nt, Human
uucucucuccauguuuuacaucauucacaguu

SEQ ID NO: 271350 - RNA, 32 nt, Human
uucucucucccaguucuuccuuccgcuacccu

SEQ ID NO: 271351 - RNA, 32 nt, Human
uucucucucccccuuucucucuucucuuggcu

SEQ ID NO: 271352 - RNA, 32 nt, Human
uucucucuccuccuugcaauuuuccuuucugu

SEQ ID NO: 271353 - RNA, 32 nt, Human
uucucucucuuuuccucucucucccucuuucu

SEQ ID NO: 271354 - RNA, 32 nt, Human
uucucucugcaaucugcaaauaacuccuccau

SEQ ID NO: 271355 - RNA, 32 nt, Human
uucucucugccucgucccaccuugcugucugu

SEQ ID NO: 271356 - RNA, 32 nt, Human
uucucucugccugguugcccucugcguggggu

SEQ ID NO: 271357 - RNA, 32 nt, Human
uucucucuggccuggacauucucuggcagcac

SEQ ID NO: 271358 - RNA, 32 nt, Human
uucucucugggaacaucugguggguacuacag

SEQ ID NO: 271359 - RNA, 32 nt, Human
uucucucugucgcccaggcuggaguacagugg

SEQ ID NO: 271360 - RNA, 32 nt, Human
uucucucuguugcccaggcuggagugcaaugg

SEQ ID NO: 271361 - RNA, 32 nt, Human
uucucucuguugcccaggcuggagugcagugg

SEQ ID NO: 271362 - RNA, 32 nt, Human
uucucucuuaacguuccugggagacuccaaca

SEQ ID NO: 271363 - RNA, 32 nt, Human
uucucucuuauaccaacaauaucagaaauguu

SEQ ID NO: 271364 - RNA, 32 nt, Human
uucucucuuauuuucaguguauuugaaugaag

SEQ ID NO: 271365 - RNA, 32 nt, Human
uucucucuucauuccucuuaggagagugccaa

SEQ ID NO: 271366 - RNA, 32 nt, Human
uucucucuucucuucuucuugccugcaauuug

SEQ ID NO: 271367 - RNA, 32 nt, Human
uucucucuucuuuucuccuuuggggcuggggc

SEQ ID NO: 271368 - RNA, 32 nt, Human
uucucucuuggguggaggagacaaggggaggg

SEQ ID NO: 271369 - RNA, 32 nt, Human
uucucucuuucuuggugucuguccuuugcccc

SEQ ID NO: 271370 - RNA, 32 nt, Human
uucucucuuucuuucucuuccucucucucuuu

SEQ ID NO: 271371 - RNA, 32 nt, Human
uucucugaacuccaguaagagagaaugacacg

SEQ ID NO: 271372 - RNA, 32 nt, Human
uucucugaacucuuccccuuguuccaagggga

SEQ ID NO: 271373 - RNA, 32 nt, Human
uucucugaagagggguuggauaaggcaaaggu

SEQ ID NO: 271374 - RNA, 32 nt, Human
uucucugaagaguauuuucgaagaggagcaac

SEQ ID NO: 271375 - RNA, 32 nt, Human
uucucugaaggaugagaucacaacugacaacu

SEQ ID NO: 271376 - RNA, 32 nt, Human
uucucugacaucucaugacauugucuuuauca

SEQ ID NO: 271377 - RNA, 32 nt, Human
uucucugacccagcguugcuucugccucucau

SEQ ID NO: 271378 - RNA, 23 nt, Human
uucucugaccuguuccccacacu

SEQ ID NO: 271379 - RNA, 32 nt, Human
uucucugagaagaaaaguugaaaaaggguaaa

SEQ ID NO: 271380 - RNA, 32 nt, Human
uucucugagccugucuguacagugcuuugccc

SEQ ID NO: 271381 - RNA, 32 nt, Human
uucucugaguaugcagcagugcaguugaaggg

SEQ ID NO: 271382 - RNA, 32 nt, Human
uucucugaguucaggugggaaaaagagcugug

SEQ ID NO: 271383 - RNA, 32 nt, Human
uucucugauuuaauuccaaauggcaguuuuua

SEQ ID NO: 271384 - RNA, 32 nt, Human
uucucugauuucccaccucccaaccuuguucc

SEQ ID NO: 271385 - RNA, 32 nt, Human
uucucugcaagugucuguuauuagagaaacga

SEQ ID NO: 271386 - RNA, 32 nt, Human
uucucugcacuccuuccaauuuaauucugcuu

SEQ ID NO: 271387 - RNA, 31 nt, Human
uucucugcacuuugaggaugcagacagugaa

SEQ ID NO: 271388 - RNA, 32 nt, Human
uucucugcauggguuggucaggagaaugaaac

SEQ ID NO: 271389 - RNA, 32 nt, Human
uucucugccaauuaacuugucauuucaguaca

SEQ ID NO: 271390 - RNA, 32 nt, Human
uucucugccagccugugucacccacccaccuc

SEQ ID NO: 271391 - RNA, 32 nt, Human
uucucugccaucacccuuuccuugccggccgg

SEQ ID NO: 271392 - RNA, 32 nt, Human
uucucugccccagccaacguuggccuuacuuc

SEQ ID NO: 271393 - RNA, 32 nt, Human
uucucugccccaggcagccaugacauacacau

SEQ ID NO: 271394 - RNA, 32 nt, Human
uucucugccccagggaccuuccaucccugaau

SEQ ID NO: 271395 - RNA, 32 nt, Human
uucucugccccuuaaaucacacaugcuuuucu

SEQ ID NO: 271396 - RNA, 32 nt, Human
uucucugcccugccugauacuuguuuuaaaca

SEQ ID NO: 271397 - RNA, 32 nt, Human
uucucugccuccagucccccagccccuggccg

SEQ ID NO: 271398 - RNA, 32 nt, Human
uucucugccucuggcccuccuggcucuuccuc

SEQ ID NO: 271399 - RNA, 32 nt, Human
uucucugccugaugcucaaaaguguacuugug

SEQ ID NO: 271400 - RNA, 32 nt, Human
uucucugccugggagauggcuuccccgagccc

SEQ ID NO: 271401 - RNA, 32 nt, Human
uucucugccuguauuucuaucucauuugaucu

SEQ ID NO: 271402 - RNA, 32 nt, Human
uucucugcuaggagccagccuggguggcgcug

SEQ ID NO: 271403 - RNA, 32 nt, Human
uucucugcuccaccacauccuccguccagccg

SEQ ID NO: 271404 - RNA, 32 nt, Human
uucucugcucccagccugccucaccagggaag

SEQ ID NO: 271405 - RNA, 32 nt, Human
uucucugcugcagaaagcagacuugcauaucc

SEQ ID NO: 271406 - RNA, 32 nt, Human
uucucugcugugguugcugcagcuccaggaag

SEQ ID NO: 271407 - RNA, 32 nt, Human
uucucugcuuugucuguguuuugagucugcuu

SEQ ID NO: 271408 - RNA, 32 nt, Human
uucucuggaauggggcuucaguuuccacauuu

SEQ ID NO: 271409 - RNA, 32 nt, Human
uucucuggacaggagucuggggcacaacugga

SEQ ID NO: 271410 - RNA, 32 nt, Human
uucucuggagcuuaacaaacuuuuauuuccug

SEQ ID NO: 271411 - RNA, 32 nt, Human
uucucuggauucuagcaucuuuaaaaagagaa

SEQ ID NO: 271412 - RNA, 32 nt, Human
uucucuggcaugcucuuuuccucucucucauu

SEQ ID NO: 271413 - RNA, 30 nt, Human
uucucuggccucuccaguccugcuuacucc

SEQ ID NO: 271414 - RNA, 32 nt, Human
uucucuggccuugccaagagucucaucccuac

SEQ ID NO: 271415 - RNA, 32 nt, Human
uucucuggcgcuuuacuggccugggcacaccu

SEQ ID NO: 271416 - RNA, 32 nt, Human
uucucuggcugagcaggucugaccucagggga

SEQ ID NO: 271417 - RNA, 32 nt, Human
uucucuggcugcagagccgucuucucagguug

SEQ ID NO: 271418 - RNA, 32 nt, Human
uucucugggaggcaaaggcuggcacuggacug

SEQ ID NO: 271419 - RNA, 32 nt, Human
uucucugggauuauacuuaggcauuucuuaau

SEQ ID NO: 271420 - RNA, 32 nt, Human
uucucugggcagguggccauggggaggggcca

SEQ ID NO: 271421 - RNA, 32 nt, Human
uucucugggggccguggggugggagcuggggc

SEQ ID NO: 271422 - RNA, 32 nt, Human
uucucuggguacugcuggccagaggacuuuag

SEQ ID NO: 271423 - RNA, 32 nt, Human
uucucugguauuucaaggcaccgagaacaaga

SEQ ID NO: 271424 - RNA, 21 nt, Human
uucucugguccccugucccua

SEQ ID NO: 271425 - RNA, 32 nt, Human
uucucuggugcuguaauuuggcugcaggagcu

SEQ ID NO: 271426 - RNA, 32 nt, Human
uucucugguguuuguugacuucugccuguggg

SEQ ID NO: 271427 - RNA, 32 nt, Human
uucucugguucauguccaccacugacugggac

SEQ ID NO: 271428 - RNA, 32 nt, Human
uucucugguuuccccaccuuguggcuuagaga

SEQ ID NO: 271429 - RNA, 32 nt, Human
uucucuguaacaguguccuaacagugaaaauc

SEQ ID NO: 271430 - RNA, 32 nt, Human
uucucuguaaucucagcuucucaggaggcuga

SEQ ID NO: 271431 - RNA, 32 nt, Human
uucucuguagcuuggggaacuugcuguuucua

SEQ ID NO: 271432 - RNA, 16 nt, Human
uucucuguaugcagug

SEQ ID NO: 271433 - RNA, 32 nt, Human
uucucugucaacuucaguuucucucucaguuu

SEQ ID NO: 271434 - RNA, 32 nt, Human
uucucugucacccaggauggagugcaguguug

SEQ ID NO: 271435 - RNA, 32 nt, Human
uucucugucacccaggcuggaaugcaguggcg

SEQ ID NO: 271436 - RNA, 32 nt, Human
uucucugucacccaggcuggagugcaguggug

SEQ ID NO: 271437 - RNA, 32 nt, Human
uucucugucaucugacuuuccucacucuugcu

SEQ ID NO: 271438 - RNA, 32 nt, Human
uucucugucccuccucccaaccccuccuuucc

SEQ ID NO: 271439 - RNA, 32 nt, Human
uucucugucucaugugugcucuucuucuuucu

SEQ ID NO: 271440 - RNA, 32 nt, Human
uucucugucuccccauccuacuccaaggaugc

SEQ ID NO: 271441 - RNA, 32 nt, Human
uucucugugaaaagacagacugagggaaaauu

SEQ ID NO: 271442 - RNA, 32 nt, Human
uucucugugagcugaucuggcguccacacccc

SEQ ID NO: 271443 - RNA, 32 nt, Human
uucucugugcaucuguccauccucccuauggc

SEQ ID NO: 271444 - RNA, 32 nt, Human
uucucugugccucacaacagucuugcgcugua

SEQ ID NO: 271445 - RNA, 32 nt, Human
uucucuguggcuucugacagcagaaaucucug

SEQ ID NO: 271446 - RNA, 32 nt, Human
uucucugugugguucagcuacuuuccauuugg

SEQ ID NO: 271447 - RNA, 32 nt, Human
uucucuguguuccguccuggccaugggcuugu

SEQ ID NO: 271448 - RNA, 32 nt, Human
uucucuguguuguccuccuccuucccuuccca

SEQ ID NO: 271449 - RNA, 32 nt, Human
uucucuguucuccugagagcccuucagaugag

SEQ ID NO: 271450 - RNA, 32 nt, Human
uucucuguucuguucuccccauggcccagaca

SEQ ID NO: 271451 - RNA, 32 nt, Human
uucucuguugcccaggcuagagugcacuggug

SEQ ID NO: 271452 - RNA, 32 nt, Human
uucucuguuguuguuguuuuagaugggcucau

SEQ ID NO: 271453 - RNA, 32 nt, Human
uucucuguuugcccgugauuguuuucuuuauu

SEQ ID NO: 271454 - RNA, 32 nt, Human
uucucuuacuuuccucugccugccucaguuua

SEQ ID NO: 271455 - RNA, 21 nt, Human
uucucuuagauucuuaauuca

SEQ ID NO: 271456 - RNA, 32 nt, Human
uucucuuagggcucccggaaagaaggagggcu

SEQ ID NO: 271457 - RNA, 32 nt, Human
uucucuucaaugccuuugacaccaaccaugau

SEQ ID NO: 271458 - RNA, 32 nt, Human
uucucuucacagucacauuccaagccucaugu

SEQ ID NO: 271459 - RNA, 32 nt, Human
uucucuucagccccuucccuguguccaccuuu

SEQ ID NO: 271460 - RNA, 32 nt, Human
uucucuucagggucucuuuccacagcggauaa

SEQ ID NO: 271461 - RNA, 32 nt, Human
uucucuucaguuaguguaaacugcaaauacua

SEQ ID NO: 271462 - RNA, 32 nt, Human
uucucuucauacucucuaccuuccuuaccaug

SEQ ID NO: 271463 - RNA, 32 nt, Human
uucucuucauucuuuuaaggccuugcaagguc

SEQ ID NO: 271464 - RNA, 32 nt, Human
uucucuuccaggcagggcucucaucgguggug

SEQ ID NO: 271465 - RNA, 32 nt, Human
uucucuuccaguuugaaaaccaggcagguuua

SEQ ID NO: 271466 - RNA, 32 nt, Human
uucucuucccagcucugcccucgcuugcuggc

SEQ ID NO: 271467 - RNA, 32 nt, Human
uucucuuccccagaaaggacuggggucaaagg

SEQ ID NO: 271468 - RNA, 32 nt, Human
uucucuucccccaacacucccaaagauaccca

SEQ ID NO: 271469 - RNA, 32 nt, Human
uucucuucccuuuaaugcuugcagaagcuguu

SEQ ID NO: 271470 - RNA, 32 nt, Human
uucucuucccuuugaucucucuuccgcuugcu

SEQ ID NO: 271471 - RNA, 32 nt, Human
uucucuuccguuugcgguuuucugccuaauug

SEQ ID NO: 271472 - RNA, 32 nt, Human
uucucuuccucuucuuucucucucuucuccuc

SEQ ID NO: 271473 - RNA, 32 nt, Human
uucucuuccucuuuuaagcccucucuuccucg

SEQ ID NO: 271474 - RNA, 32 nt, Human
uucucuuccugccuuuccucuaucagagaagu

SEQ ID NO: 271475 - RNA, 32 nt, Human
uucucuuccugcucuccaucauggcgcaggau

SEQ ID NO: 271476 - RNA, 32 nt, Human
uucucuuccugguaauccucuggcccagccuu

SEQ ID NO: 271477 - RNA, 32 nt, Human
uucucuuccuucauugccaccuuuccucugug

SEQ ID NO: 271478 - RNA, 32 nt, Human
uucucuuccuugugccucuccucuuuaucacu

SEQ ID NO: 271479 - RNA, 32 nt, Human
uucucuuccuuuccuuuccuuuccucuccugc

SEQ ID NO: 271480 - RNA, 32 nt, Human
uucucuucuaucuccuuguugaucugaagcuu

SEQ ID NO: 271481 - RNA, 32 nt, Human
uucucuucucagacucuuccucugucacacgu

SEQ ID NO: 271482 - RNA, 32 nt, Human
uucucuucuccucgauccucaugguccuggga

SEQ ID NO: 271483 - RNA, 32 nt, Human
uucucuucuccucuuccuggcuguguuuucuc

SEQ ID NO: 271484 - RNA, 32 nt, Human
uucucuucucucucuuuuccuaggucugcagc

SEQ ID NO: 271485 - RNA, 32 nt, Human
uucucuucugacccagggcugagacagguuaa

SEQ ID NO: 271486 - RNA, 32 nt, Human
uucucuucugaccugcugaaccuuggugucca

SEQ ID NO: 271487 - RNA, 32 nt, Human
uucucuucugagugagucuagggcagauucuu

SEQ ID NO: 271488 - RNA, 32 nt, Human
uucucuucugauucuucucuucucccaagccc

SEQ ID NO: 271489 - RNA, 32 nt, Human
uucucuucuuccucagcuucuccauguuuagg

SEQ ID NO: 271490 - RNA, 32 nt, Human
uucucuucuucuaccucuacccucuccaacuu

SEQ ID NO: 271491 - RNA, 31 nt, Human
uucucuugacuacuggcuugccaaagcagag

SEQ ID NO: 271492 - RNA, 32 nt, Human
uucucuugacugccucucucuuaccuguucag

SEQ ID NO: 271493 - RNA, 32 nt, Human
uucucuugcccaggcuggagugcaguggcacg

SEQ ID NO: 271494 - RNA, 32 nt, Human
uucucuugcccugaccccuuguucccuggacc

SEQ ID NO: 271495 - RNA, 32 nt, Human
uucucuugcucugagccucccuuccccauucc

SEQ ID NO: 271496 - RNA, 32 nt, Human
uucucuuggaccuuaccuuaugugccuuucuu

SEQ ID NO: 271497 - RNA, 32 nt, Human
uucucuugggaaaugacuggggagacaccuga

SEQ ID NO: 271498 - RNA, 20 nt, Human
uucucuugggacggggaagc

SEQ ID NO: 271499 - RNA, 32 nt, Human
uucucuugucugucugucucugucuugaagcu

SEQ ID NO: 271500 - RNA, 32 nt, Human
uucucuugucuuuucuaaauguuaacaaaaua

SEQ ID NO: 271501 - RNA, 32 nt, Human
uucucuugugucuguugagacuuuaagggaga

SEQ ID NO: 271502 - RNA, 32 nt, Human
uucucuuguuucauuuuccugaagauuuaugu

SEQ ID NO: 271503 - RNA, 32 nt, Human
uucucuuuacaugcagccgcucucugcucccu

SEQ ID NO: 271504 - RNA, 32 nt, Human
uucucuuuacauguuaacaccuugcuacuacc

SEQ ID NO: 271505 - RNA, 32 nt, Human
uucucuuuaccagucccaccuaccucacuaug

SEQ ID NO: 271506 - RNA, 32 nt, Human
uucucuuuacuggaguuuccucuuguccauuu

SEQ ID NO: 271507 - RNA, 32 nt, Human
uucucuuuagggacugcuccauaccccaugau

SEQ ID NO: 271508 - RNA, 32 nt, Human
uucucuuucaauguguuuaauuuuggaguaac

SEQ ID NO: 271509 - RNA, 32 nt, Human
uucucuuuccauccuccuccucagaaauauag

SEQ ID NO: 271510 - RNA, 32 nt, Human
uucucuuuccuugagcugccuuuggcaaggga

SEQ ID NO: 271511 - RNA, 32 nt, Human
uucucuuuccuuucuuuccuuccacaaaucuu

SEQ ID NO: 271512 - RNA, 32 nt, Human
uucucuuucucagucccugccugucugccagc

SEQ ID NO: 271513 - RNA, 32 nt, Human
uucucuuucuucucuccacauuuccugucucc

SEQ ID NO: 271514 - RNA, 32 nt, Human
uucucuuugaccccaucucauuucgaagccac

SEQ ID NO: 271515 - RNA, 32 nt, Human
uucucuuugaggcuggaaugcaguagcgugau

SEQ ID NO: 271516 - RNA, 32 nt, Human
uucucuuuguuguuuuccuacuuucucaaggu

SEQ ID NO: 271517 - RNA, 32 nt, Human
uucucuuuuacacuuuuguacuccucagagca

SEQ ID NO: 271518 - RNA, 32 nt, Human
uucucuuuucccuagacugcagccagcggagc

SEQ ID NO: 271519 - RNA, 32 nt, Human
uucucuuuugagacagaguuucacucugucgc

SEQ ID NO: 271520 - RNA, 32 nt, Human
uucucuuuuguaacugcugucuuuacaauaaa

SEQ ID NO: 271521 - RNA, 32 nt, Human
uucucuuuuucuuccuccuuugggaucauugu

SEQ ID NO: 271522 - RNA, 32 nt, Human
uucugaaaaccacuucucuaccuucaccacca

SEQ ID NO: 271523 - RNA, 32 nt, Human
uucugaaaagguuggugaugaagaacuucagu

SEQ ID NO: 271524 - RNA, 32 nt, Human
uucugaaacacaaauuaaauucaaugccuuaa

SEQ ID NO: 271525 - RNA, 32 nt, Human
uucugaaacacacaccagcccugaguucuggg

SEQ ID NO: 271526 - RNA, 32 nt, Human
uucugaaacucacgcugcuccagccugaggcu

SEQ ID NO: 271527 - RNA, 32 nt, Human
uucugaaagaccacagcacucuaugucuacuu

SEQ ID NO: 271528 - RNA, 32 nt, Human
uucugaaagcccagagugcccuuggggacacu

SEQ ID NO: 271529 - RNA, 32 nt, Human
uucugaaaguggagguuucuuaagcagauaca

SEQ ID NO: 271530 - RNA, 32 nt, Human
uucugaaaucauugauuauucuacaaaaacau

SEQ ID NO: 271531 - RNA, 32 nt, Human
uucugaaauuuccauauugagagaagccaaac

SEQ ID NO: 271532 - RNA, 32 nt, Human
uucugaacacaaaucgagggagggagggagaa

SEQ ID NO: 271533 - RNA, 19 nt, Human
uucugaacagauguguucu

SEQ ID NO: 271534 - RNA, 32 nt, Human
uucugaaccaauuuugcacucagcauuaagag

SEQ ID NO: 271535 - RNA, 32 nt, Human
uucugaaccccuggccuguuccuuggaaugag

SEQ ID NO: 271536 - RNA, 32 nt, Human
uucugaacucgauaccuaccaaaaagaaaaag

SEQ ID NO: 271537 - RNA, 32 nt, Human
uucugaacugaugcuuucucacugucaucacu

SEQ ID NO: 271538 - RNA, 22 nt, Human
uucugaagcagaugguucauca

SEQ ID NO: 271539 - RNA, 32 nt, Human
uucugaagcagcauuugaagcugcaguccuga

SEQ ID NO: 271540 - RNA, 32 nt, Human
uucugaagccacuccucaggggcacagacccu

SEQ ID NO: 271541 - RNA, 30 nt, Human
uucugaagcuugcauugggaauggcugcuu

SEQ ID NO: 271542 - RNA, 32 nt, Human
uucugaagcuuggaaugcaaacacaggcuuca

SEQ ID NO: 271543 - RNA, 32 nt, Human
uucugaaggaaauguuaggucuucucaaggua

SEQ ID NO: 271544 - RNA, 29 nt, Human
uucugaaggaugcuaucauuugcccucug

SEQ ID NO: 271545 - RNA, 32 nt, Human
uucugaaggcagggcccggcagaggaaggauc

SEQ ID NO: 271546 - RNA, 32 nt, Human
uucugaaggccaugacaccugccuugccuccc

SEQ ID NO: 271547 - RNA, 32 nt, Human
uucugaagggcacgggccagauucaagaacgg

SEQ ID NO: 271548 - RNA, 32 nt, Human
uucugaaguuuccugacuuaacauaagcauuu

SEQ ID NO: 271549 - RNA, 32 nt, Human
uucugaaguuugucuggacuguuuacagacau

SEQ ID NO: 271550 - RNA, 32 nt, Human
uucugaauauagaauaucagcucucauuccag

SEQ ID NO: 271551 - RNA, 32 nt, Human
uucugaauauuuucccuucaucuaacauugau

SEQ ID NO: 271552 - RNA, 24 nt, Human
uucugaaucauguucuaguugcuu

SEQ ID NO: 271553 - RNA, 32 nt, Human
uucugaaucauuucuucuucucaggccaaagu

SEQ ID NO: 271554 - RNA, 32 nt, Human
uucugaaucuuccugccccuccucacugcuua

SEQ ID NO: 271555 - RNA, 32 nt, Human
uucugaaucuuuuccagggauaggcagguagc

SEQ ID NO: 271556 - RNA, 32 nt, Human
uucugaauguugguggaggguguaguggcuuu

SEQ ID NO: 271557 - RNA, 23 nt, Human
uucugaauuuuauguugcauuca

SEQ ID NO: 271558 - RNA, 32 nt, Human
uucugacaaggguggcuuuucucugccauucg

SEQ ID NO: 271559 - RNA, 32 nt, Human
uucugacaaguucccaggagcugcagcugcug

SEQ ID NO: 271560 - RNA, 32 nt, Human
uucugacaaucagugaauguacaacccagccg

SEQ ID NO: 271561 - RNA, 32 nt, Human
uucugacacagcccaggugggaacaaugcugc

SEQ ID NO: 271562 - RNA, 32 nt, Human
uucugacaccuucuuucucucccguuucacua

SEQ ID NO: 271563 - RNA, 32 nt, Human
uucugacagaagcagaggcaguucugaggcag

SEQ ID NO: 271564 - RNA, 20 nt, Human
uucugacagacagaagccaa

SEQ ID NO: 271565 - RNA, 32 nt, Human
uucugacagccaugugucacuaugcgcucguu

SEQ ID NO: 271566 - RNA, 32 nt, Human
uucugacagccaugugucacuaugcgcuuguu

SEQ ID NO: 271567 - RNA, 23 nt, Human
uucugacagcucccagcugggag

SEQ ID NO: 271568 - RNA, 32 nt, Human
uucugacagcucuaccucaagccccggagaac

SEQ ID NO: 271569 - RNA, 32 nt, Human
uucugacaggcgcaacuccuccauuuuccucc

SEQ ID NO: 271570 - RNA, 32 nt, Human
uucugacccacugaucucuacuaccacaagga

SEQ ID NO: 271571 - RNA, 20 nt, Human
uucugacccacugggauuug

SEQ ID NO: 271572 - RNA, 32 nt, Human
uucugacccaggagcgaaagucugucucuucc

SEQ ID NO: 271573 - RNA, 32 nt, Human
uucugacccauguucacguuguucacauccca

SEQ ID NO: 271574 - RNA, 32 nt, Human
uucugacccucacccacuguccaccaaaagcc

SEQ ID NO: 271575 - RNA, 32 nt, Human
uucugacccugaguccuugaaucacuagguuu

SEQ ID NO: 271576 - RNA, 32 nt, Human
uucugaccucaagugauccgcccgccucagcc

SEQ ID NO: 271577 - RNA, 24 nt, Human
uucugaccucaagugaucugccca

SEQ ID NO: 271578 - RNA, 32 nt, Human
uucugaccucaagugaucugcccaccuuggcc

SEQ ID NO: 271579 - RNA, 24 nt, Human
uucugaccucaagugaucugcccg

SEQ ID NO: 271580 - RNA, 21 nt, Human
uucugaccucaagugguccac

SEQ ID NO: 271581 - RNA, 19 nt, Human
uucugaccucagacggcuc

SEQ ID NO: 271582 - RNA, 24 nt, Human
uucugaccucagaugaucugcccg

SEQ ID NO: 271583 - RNA, 32 nt, Human
uucugaccucagccuuggaacuccucaagaac

SEQ ID NO: 271584 - RNA, 22 nt, Human
uucugaccucaggccuccauuu

SEQ ID NO: 271585 - RNA, 21 nt, Human
uucugaccucaggugauccac

SEQ ID NO: 271586 - RNA, 23 nt, Human
uucugaccucaggugauccacca

SEQ ID NO: 271587 - RNA, 24 nt, Human
uucugaccucaggugauccaccca

SEQ ID NO: 271588 - RNA, 24 nt, Human
uucugaccucaggugaucugccca

SEQ ID NO: 271589 - RNA, 32 nt, Human
uucugaccucagguuaggcaaagcuuucuuag

SEQ ID NO: 271590 - RNA, 32 nt, Human
uucugaccucccagggugucugaggccucuaa

SEQ ID NO: 271591 - RNA, 32 nt, Human
uucugaccuccuccucccaaaaggugcuaaac

SEQ ID NO: 271592 - RNA, 20 nt, Human
uucugaccuccuggcaagag

SEQ ID NO: 271593 - RNA, 22 nt, Human
uucugaccucgugaugcacuca

SEQ ID NO: 271594 - RNA, 32 nt, Human
uucugaccucuuagcuggggauuccauggcca

SEQ ID NO: 271595 - RNA, 32 nt, Human
uucugaccugagccccgggucucggcuguuuc

SEQ ID NO: 271596 - RNA, 32 nt, Human
uucugaccuggaggccagaggcuaggcugagg

SEQ ID NO: 271597 - RNA, 17 nt, Human
uucugaccuggcuccug

SEQ ID NO: 271598 - RNA, 20 nt, Human
uucugaccuucaguucacuu

SEQ ID NO: 271599 - RNA, 32 nt, Human
uucugaccuugaaauaaaucacuucugaccuu

SEQ ID NO: 271600 - RNA, 24 nt, Human
uucugaccuuggacaaagcacuca

SEQ ID NO: 271601 - RNA, 32 nt, Human
uucugaccuuguaccucucuuugaugguaacc

SEQ ID NO: 271602 - RNA, 32 nt, Human
uucugacgcgaugaggaagcaccugagcuggu

SEQ ID NO: 271603 - RNA, 32 nt, Human
uucugacggucugaggucuugcuugggccagu

SEQ ID NO: 271604 - RNA, 24 nt, Human
uucugacgucaagugauccacccg

SEQ ID NO: 271605 - RNA, 32 nt, Human
uucugacucaucuccuucucuccgucuugccu

SEQ ID NO: 271606 - RNA, 32 nt, Human
uucugacugacaugaucuuuugcaauaccuca

SEQ ID NO: 271607 - RNA, 32 nt, Human
uucugacugagucccuggaagaguaguaauuc

SEQ ID NO: 271608 - RNA, 32 nt, Human
uucugacuuguauccagcaugcuggagaccaa

SEQ ID NO: 271609 - RNA, 23 nt, Human
uucugacuuuagaaaguuucuca

SEQ ID NO: 271610 - RNA, 23 nt, Human
uucugacuuugaccagcuguaag

SEQ ID NO: 271611 - RNA, 22 nt, Human
uucugacuuuggaauggacuca

SEQ ID NO: 271612 - RNA, 25 nt, Human
uucugacuuuuuccaucucuugcuu

SEQ ID NO: 271613 - RNA, 32 nt, Human
uucugacuuuuuccaucucuugcuucaaagua

SEQ ID NO: 271614 - RNA, 32 nt, Human
uucugagaaaugcugcagucagaagggugugc

SEQ ID NO: 271615 - RNA, 32 nt, Human
uucugagaagggugucucucugucugugugga

SEQ ID NO: 271616 - RNA, 32 nt, Human
uucugagaaguacgucauaucuucccacagcu

SEQ ID NO: 271617 - RNA, 32 nt, Human
uucugagaaguuagaggguaaagagccccacc

SEQ ID NO: 271618 - RNA, 32 nt, Human
uucugagacagagagguacggacuaggcugca

SEQ ID NO: 271619 - RNA, 32 nt, Human
uucugagaccagccuggcuuacauggugaaac

SEQ ID NO: 271620 - RNA, 32 nt, Human
uucugagaccuuguuucaaucuuugcuguaua

SEQ ID NO: 271621 - RNA, 32 nt, Human
uucugagagcccaaaaaggccagaauagcugg

SEQ ID NO: 271622 - RNA, 32 nt, Human
uucugagaggaaaaggaaaagggaagggagag

SEQ ID NO: 271623 - RNA, 32 nt, Human
uucugagaucaugcaucucccacccaucugcc

SEQ ID NO: 271624 - RNA, 32 nt, Human
uucugagauccagcacaacucagucuguggga

SEQ ID NO: 271625 - RNA, 32 nt, Human
uucugagauggagucucacuccguugccaggc

SEQ ID NO: 271626 - RNA, 32 nt, Human
uucugagaugggagcagagcagcauuuagucu

SEQ ID NO: 271627 - RNA, 32 nt, Human
uucugagauguggugacucaugugaaguggug

SEQ ID NO: 271628 - RNA, 32 nt, Human
uucugagauuucacauccacacacaccacaga

SEQ ID NO: 271629 - RNA, 32 nt, Human
uucugagcaaacaugaucuagcucucaccaaa

SEQ ID NO: 271630 - RNA, 32 nt, Human
uucugagcaccagcugccccaggugaggugug

SEQ ID NO: 271631 - RNA, 31 nt, Human
uucugagcacuuuuauuuaauagcagaaugg

SEQ ID NO: 271632 - RNA, 32 nt, Human
uucugagcauuuuuaucaccuuuccucacaua

SEQ ID NO: 271633 - RNA, 32 nt, Human
uucugagccagccucugcgggucccccaauaa

SEQ ID NO: 271634 - RNA, 32 nt, Human
uucugagcccagggagguagaggcuucaguga

SEQ ID NO: 271635 - RNA, 32 nt, Human
uucugagcccaucuuccauuguccucaacgag

SEQ ID NO: 271636 - RNA, 32 nt, Human
uucugagccuuccucuggacccaggcaggaga

SEQ ID NO: 271637 - RNA, 32 nt, Human
uucugagcgauagggucucaccauguugccca

SEQ ID NO: 271638 - RNA, 32 nt, Human
uucugagcucuccccaaucaccagcugucugc

SEQ ID NO: 271639 - RNA, 32 nt, Human
uucugagcuggacaugguggcucagcuucuaa

SEQ ID NO: 271640 - RNA, 32 nt, Human
uucugagcuggcagaguuuagggacgacgccc

SEQ ID NO: 271641 - RNA, 32 nt, Human
uucugagcuuuaggcaagagaagagaagcauc

SEQ ID NO: 271642 - RNA, 32 nt, Human
uucugagcuuuccuggaguuaggcccuucuag

SEQ ID NO: 271643 - RNA, 32 nt, Human
uucugaggagugugugauguguuuccauauau

SEQ ID NO: 271644 - RNA, 32 nt, Human
uucugaggauucaggggcugggggugcuggau

SEQ ID NO: 271645 - RNA, 32 nt, Human
uucugaggcccagaggagcaggugggauggga

SEQ ID NO: 271646 - RNA, 32 nt, Human
uucugaggcccagggguggagguuaggggugg

SEQ ID NO: 271647 - RNA, 24 nt, Human
uucugaggccuccccagccaugug

SEQ ID NO: 271648 - RNA, 32 nt, Human
uucugaggccuccuccagccucagggaacugu

SEQ ID NO: 271649 - RNA, 32 nt, Human
uucugaggccugguuugcucuuaauuaauaua

SEQ ID NO: 271650 - RNA, 32 nt, Human
uucugaggcuggucccuccucaguuuccgcag

SEQ ID NO: 271651 - RNA, 32 nt, Human
uucugaggcuuuugucuucuagcuacuuacuu

SEQ ID NO: 271652 - RNA, 32 nt, Human
uucugagggagggagaccucggcacuagaaaa

SEQ ID NO: 271653 - RNA, 32 nt, Human
uucugagggccugcuuggccuccugggggcaa

SEQ ID NO: 271654 - RNA, 32 nt, Human
uucugaggggcaacguggaggaagggccaggg

SEQ ID NO: 271655 - RNA, 32 nt, Human
uucugagggugacugaggcuacagcugcuauc

SEQ ID NO: 271656 - RNA, 32 nt, Human
uucugagguacagaggaagugauguccuugac

SEQ ID NO: 271657 - RNA, 32 nt, Human
uucugagguacuuuagaugaacaguaaauauu

SEQ ID NO: 271658 - RNA, 32 nt, Human
uucugagguauugauagcuugcuuuauuucug

SEQ ID NO: 271659 - RNA, 32 nt, Human
uucugaggugggaggaucaugaggucaaggga

SEQ ID NO: 271660 - RNA, 32 nt, Human
uucugagguguuugagccucuuuugccuacac

SEQ ID NO: 271661 - RNA, 32 nt, Human
uucugaguacuggccucauuaaggauuauaaa

SEQ ID NO: 271662 - RNA, 32 nt, Human
uucugagugcauaagaccuccaccucuagacu

SEQ ID NO: 271663 - RNA, 32 nt, Human
uucugagugccuaucugugcucuuuccucccu

SEQ ID NO: 271664 - RNA, 32 nt, Human
uucugagugggauguuuggccacauuuauggu

SEQ ID NO: 271665 - RNA, 32 nt, Human
uucugaguuaggcagaacauagccauggcccu

SEQ ID NO: 271666 - RNA, 23 nt, Human
uucugaguuucauucuccugccu

SEQ ID NO: 271667 - RNA, 32 nt, Human
uucugauaagccguguguuccaaagaaugucu

SEQ ID NO: 271668 - RNA, 32 nt, Human
uucugauaccaaccucuuuccuuuggaaguag

SEQ ID NO: 271669 - RNA, 32 nt, Human
uucugauaccacugcacugucugagaauuucc

SEQ ID NO: 271670 - RNA, 32 nt, Human
uucugauagaaagugcuuaaaccaccacucuu

SEQ ID NO: 271671 - RNA, 32 nt, Human
uucugauagaagauaucauugauaacuggaag

SEQ ID NO: 271672 - RNA, 32 nt, Human
uucugauagccugccucacagaguuuagacau

SEQ ID NO: 271673 - RNA, 32 nt, Human
uucugaucaaggcaucagcuguccugagcaag

SEQ ID NO: 271674 - RNA, 32 nt, Human
uucugauccucucuucuuuucccauuuacaaa

SEQ ID NO: 271675 - RNA, 32 nt, Human
uucugauccugccuuuuucuuuuccccacaac

SEQ ID NO: 271676 - RNA, 22 nt, Human
uucugaucuaagaaucuaccca

SEQ ID NO: 271677 - RNA, 21 nt, Human
uucugaucucaagugauccau

SEQ ID NO: 271678 - RNA, 32 nt, Human
uucugaucucaagugauccaucugccuuggcc

SEQ ID NO: 271679 - RNA, 20 nt, Human
uucugaucucagauaacuca

SEQ ID NO: 271680 - RNA, 23 nt, Human
uucugaucucagcagucuucuca

SEQ ID NO: 271681 - RNA, 30 nt, Human
uucugaugcagcugagaaaaaugcagaccg

SEQ ID NO: 271682 - RNA, 32 nt, Human
uucugaugcagugguagcauugguucaaguuc

SEQ ID NO: 271683 - RNA, 32 nt, Human
uucugaugcccagguugcaccccaugccaaug

SEQ ID NO: 271684 - RNA, 32 nt, Human
uucugaugcccagguuggggugcaguggcaca

SEQ ID NO: 271685 - RNA, 31 nt, Human
uucugauggaaggugggagccaacacccuuc

SEQ ID NO: 271686 - RNA, 32 nt, Human
uucugauggacuucagcuguuggccuugcaug

SEQ ID NO: 271687 - RNA, 32 nt, Human
uucugauguccaguuuccugucuuccaugccu

SEQ ID NO: 271688 - RNA, 32 nt, Human
uucugauguggaauauuuucagcugcucauau

SEQ ID NO: 271689 - RNA, 32 nt, Human
uucugauguguucucugaucugcccccacugu

SEQ ID NO: 271690 - RNA, 32 nt, Human
uucugauuaaaggauuuggauuuguacaugua

SEQ ID NO: 271691 - RNA, 32 nt, Human
uucugauucaguagacuggaggugaagucagg

SEQ ID NO: 271692 - RNA, 32 nt, Human
uucugauuucgucugugaaugagggaaauggu

SEQ ID NO: 271693 - RNA, 32 nt, Human
uucugauuucucucaccaaagacuggaaaaau

SEQ ID NO: 271694 - RNA, 32 nt, Human
uucugauuucugucucccuuccaucuuuucuc

SEQ ID NO: 271695 - RNA, 32 nt, Human
uucugauuucuuuugcaacccucugcauucca

SEQ ID NO: 271696 - RNA, 32 nt, Human
uucugcaaaaauaaucauacucagccuggcaa

SEQ ID NO: 271697 - RNA, 32 nt, Human
uucugcaaaacuuggacaggggcaaaguugcu

SEQ ID NO: 271698 - RNA, 32 nt, Human
uucugcaaacucccccuccccuccucugugcc

SEQ ID NO: 271699 - RNA, 32 nt, Human
uucugcaaauauggcuuaaauauuucauggca

SEQ ID NO: 271700 - RNA, 32 nt, Human
uucugcaacagcuuuccagcuuugaaaaccug

SEQ ID NO: 271701 - RNA, 23 nt, Human
uucugcaaccucugccucccagg

SEQ ID NO: 271702 - RNA, 32 nt, Human
uucugcaacugugcacuccucccuugguggca

SEQ ID NO: 271703 - RNA, 32 nt, Human
uucugcaacuugcuacucucucccucuccauc

SEQ ID NO: 271704 - RNA, 22 nt, Human
uucugcaaguagcuggcuugua

SEQ ID NO: 271705 - RNA, 31 nt, Human
uucugcaaguguccugaaaaagacugaacga

SEQ ID NO: 271706 - RNA, 32 nt, Human
uucugcaaguugccuccacuuccaaguggcca

SEQ ID NO: 271707 - RNA, 32 nt, Human
uucugcaaugcagagugaaguggauacugggc

SEQ ID NO: 271708 - RNA, 32 nt, Human
uucugcaaugcagcccugccaacuggggaccu

SEQ ID NO: 271709 - RNA, 32 nt, Human
uucugcacagccgucuauccccaggaucuaac

SEQ ID NO: 271710 - RNA, 32 nt, Human
uucugcacagcucagggacuuagccagguccu

SEQ ID NO: 271711 - RNA, 32 nt, Human
uucugcaccaauagcugaggcguucaggguug

SEQ ID NO: 271712 - RNA, 19 nt, Human
uucugcacccauugcccag

SEQ ID NO: 271713 - RNA, 32 nt, Human
uucugcaccccucuccccaugggaccuuggag

SEQ ID NO: 271714 - RNA, 32 nt, Human
uucugcaccuggggacccagagcgagaugggu

SEQ ID NO: 271715 - RNA, 31 nt, Human
uucugcacugccccuuggccugugugugagu

SEQ ID NO: 271716 - RNA, 32 nt, Human
uucugcacuggugcuuuggauucccugauaug

SEQ ID NO: 271717 - RNA, 32 nt, Human
uucugcacuguugccaauaaaaagcucuuaaa

SEQ ID NO: 271718 - RNA, 32 nt, Human
uucugcacuucugcugcuuacccagcccccuc

SEQ ID NO: 271719 - RNA, 32 nt, Human
uucugcagacuggcagucgcacacacauuugg

SEQ ID NO: 271720 - RNA, 32 nt, Human
uucugcagaggacgggaggcuggaagcuggga

SEQ ID NO: 271721 - RNA, 32 nt, Human
uucugcagagugaacugggagcagagagccuc

SEQ ID NO: 271722 - RNA, 32 nt, Human
uucugcagaucuuggacccagggagagagcug

SEQ ID NO: 271723 - RNA, 27 nt, Human
uucugcagcaggcgcaaccucuccuag

SEQ ID NO: 271724 - RNA, 32 nt, Human
uucugcagcaguugccccaggcaccuguucga

SEQ ID NO: 271725 - RNA, 32 nt, Human
uucugcagccagaaugaaggugccaucagcag

SEQ ID NO: 271726 - RNA, 32 nt, Human
uucugcagccuacagaugcagaaccagaauga

SEQ ID NO: 271727 - RNA, 32 nt, Human
uucugcagcuggcuggcuaccaguggcagcgg

SEQ ID NO: 271728 - RNA, 32 nt, Human
uucugcagcugggaucagccucagcuuggcag

SEQ ID NO: 271729 - RNA, 32 nt, Human
uucugcagcuguccauccugugucugggucag

SEQ ID NO: 271730 - RNA, 32 nt, Human
uucugcaggacagggccagcugucucccagcc

SEQ ID NO: 271731 - RNA, 32 nt, Human
uucugcaggcagccaugagcuccagccacccc

SEQ ID NO: 271732 - RNA, 32 nt, Human
uucugcaggcaguugaauggcacuccagaugg

SEQ ID NO: 271733 - RNA, 32 nt, Human
uucugcaggggaagcgaccauggccauagauc

SEQ ID NO: 271734 - RNA, 32 nt, Human
uucugcaguccguuguucuacuucucuuuccu

SEQ ID NO: 271735 - RNA, 32 nt, Human
uucugcagugcgacauccagaaauggcugaug

SEQ ID NO: 271736 - RNA, 32 nt, Human
uucugcaguggaacuguccuugcuacccucag

SEQ ID NO: 271737 - RNA, 28 nt, Human
uucugcauagcugcugccuccuaaucuu

SEQ ID NO: 271738 - RNA, 32 nt, Human
uucugcauauccagcaaaaggaaucucauguu

SEQ ID NO: 271739 - RNA, 32 nt, Human
uucugcaucacacauccucugagaccuaccau

SEQ ID NO: 271740 - RNA, 32 nt, Human
uucugcauccaccucugcccucauucugucaa

SEQ ID NO: 271741 - RNA, 32 nt, Human
uucugcaucucuggagcucaucagucuugcuu

SEQ ID NO: 271742 - RNA, 18 nt, Human
uucugcaucuggcuccug

SEQ ID NO: 271743 - RNA, 32 nt, Human
uucugcaugauuucucugggcuugcugucuua

SEQ ID NO: 271744 - RNA, 32 nt, Human
uucugcauuaaugccacaguggggauggaggc

SEQ ID NO: 271745 - RNA, 32 nt, Human
uucugcauucacaauuagugacuuugaggccu

SEQ ID NO: 271746 - RNA, 32 nt, Human
uucugcauuuucaggauucaauagaacugcuc

SEQ ID NO: 271747 - RNA, 32 nt, Human
uucugcauuuuguuaagaagcaccucaugcaa

SEQ ID NO: 271748 - RNA, 32 nt, Human
uucugccaaaaauacaaaaauuagcugggcuu

SEQ ID NO: 271749 - RNA, 32 nt, Human
uucugccaacguagcucugccugccugucaac

SEQ ID NO: 271750 - RNA, 32 nt, Human
uucugccaauuaaagacuagaagggcacaacu

SEQ ID NO: 271751 - RNA, 32 nt, Human
uucugccacaucucgcccuucuggaccugcac

SEQ ID NO: 271752 - RNA, 32 nt, Human
uucugccacccacgcccccaccccuggcaugg

SEQ ID NO: 271753 - RNA, 32 nt, Human
uucugccacccaggcuggaguacaguggcaug

SEQ ID NO: 271754 - RNA, 32 nt, Human
uucugccacuggcggcuucccuucuuggcucu

SEQ ID NO: 271755 - RNA, 32 nt, Human
uucugccagcacuuggcauuccagcugaccuc

SEQ ID NO: 271756 - RNA, 32 nt, Human
uucugccagcaugcaccagugcagccuuacca

SEQ ID NO: 271757 - RNA, 32 nt, Human
uucugccagccugaacuauauuuaagaaacuu

SEQ ID NO: 271758 - RNA, 32 nt, Human
uucugccagcuggccuggggauucugaguggu

SEQ ID NO: 271759 - RNA, 32 nt, Human
uucugccaggaccacaccgagggugcccacug

SEQ ID NO: 271760 - RNA, 32 nt, Human
uucugccaggagagauguggcugugagcuggg

SEQ ID NO: 271761 - RNA, 32 nt, Human
uucugccaucaucucagagcaugaucacauug

SEQ ID NO: 271762 - RNA, 32 nt, Human
uucugccaugccacacagccucagcuugaauc

SEQ ID NO: 271763 - RNA, 28 nt, Human
uucugcccaagugguaauucaucuuggu

SEQ ID NO: 271764 - RNA, 21 nt, Human
uucugcccagcacaccuuucc

SEQ ID NO: 271765 - RNA, 32 nt, Human
uucugcccagcacucgugcuuguucacauaau

SEQ ID NO: 271766 - RNA, 32 nt, Human
uucugcccauggucaucugcagcugcacgagu

SEQ ID NO: 271767 - RNA, 32 nt, Human
uucugcccauuguuucuuacuaguuucuugaa

SEQ ID NO: 271768 - RNA, 25 nt, Human
uucugcccauuuggggacacuuccc

SEQ ID NO: 271769 - RNA, 23 nt, Human
uucugccccaccgacaacuuacc

SEQ ID NO: 271770 - RNA, 22 nt, Human
uucugcccccagugcccuuccc

SEQ ID NO: 271771 - RNA, 32 nt, Human
uucugccccgaguuuugccacacugagacuuu

SEQ ID NO: 271772 - RNA, 20 nt, Human
uucugccccgccgccuuccc

SEQ ID NO: 271773 - RNA, 32 nt, Human
uucugccccuccacccacauccacauucagca

SEQ ID NO: 271774 - RNA, 22 nt, Human
uucugccccucccaccuguccc

SEQ ID NO: 271775 - RNA, 32 nt, Human
uucugccccugcccuuccucacacugacacuu

SEQ ID NO: 271776 - RNA, 32 nt, Human
uucugccccugggcccagucucuccucggagg

SEQ ID NO: 271777 - RNA, 32 nt, Human
uucugcccgggcccuggccacaaugaccucuu

SEQ ID NO: 271778 - RNA, 32 nt, Human
uucugcccuaaccugacagaggugucauccac

SEQ ID NO: 271779 - RNA, 22 nt, Human
uucugcccuacccggacuuccu

SEQ ID NO: 271780 - RNA, 32 nt, Human
uucugcccuccagauccacggugcuaauuccc

SEQ ID NO: 271781 - RNA, 32 nt, Human
uucugcccucccccuucacucuccccacaagu

SEQ ID NO: 271782 - RNA, 32 nt, Human
uucugcccucccugagcccacagggucaguca

SEQ ID NO: 271783 - RNA, 32 nt, Human
uucugcccucuagcagggagguuuuccaacug

SEQ ID NO: 271784 - RNA, 19 nt, Human
uucugcccucugaccuggg

SEQ ID NO: 271785 - RNA, 17 nt, Human
uucugcccucugcccag

SEQ ID NO: 271786 - RNA, 23 nt, Human
uucugcccugcccuaaaucuccc

SEQ ID NO: 271787 - RNA, 24 nt, Human
uucugcccugccgaacacuuuccc

SEQ ID NO: 271788 - RNA, 21 nt, Human
uucugcccugggcacccuccu

SEQ ID NO: 271789 - RNA, 19 nt, Human
uucugcccuuccacuuucc

SEQ ID NO: 271790 - RNA, 32 nt, Human
uucugcccuugccuucgcccugggugggacag

SEQ ID NO: 271791 - RNA, 32 nt, Human
uucugcccuuugcccucuacuuuucucccuuu

SEQ ID NO: 271792 - RNA, 32 nt, Human
uucugccgagccucuugucccuucccugcucu

SEQ ID NO: 271793 - RNA, 32 nt, Human
uucugccgaguccacauggccaugaagcagag

SEQ ID NO: 271794 - RNA, 32 nt, Human
uucugccgcagcccugcagagggcacagaaaa

SEQ ID NO: 271795 - RNA, 32 nt, Human
uucugccgcuucuccccugauggccaccucuu

SEQ ID NO: 271796 - RNA, 32 nt, Human
uucugccggccccagccggaagcuuacuccgc

SEQ ID NO: 271797 - RNA, 32 nt, Human
uucugccgugagccacugcgcccggccuccuu

SEQ ID NO: 271798 - RNA, 32 nt, Human
uucugccguuuugucucccagcuggcauucuc

SEQ ID NO: 271799 - RNA, 32 nt, Human
uucugccuagucucugugcccugucuuugugu

SEQ ID NO: 271800 - RNA, 32 nt, Human
uucugccuaugauguugaggaaguuguaucag

SEQ ID NO: 271801 - RNA, 32 nt, Human
uucugccucacucaucccuccuguacccuggc

SEQ ID NO: 271802 - RNA, 32 nt, Human
uucugccucauuccucuccaugaugcccccug

SEQ ID NO: 271803 - RNA, 20 nt, Human
uucugccucccccucccccc

SEQ ID NO: 271804 - RNA, 21 nt, Human
uucugccuccccucuggucuc

SEQ ID NO: 271805 - RNA, 22 nt, Human
uucugccucccucuuucuuccu

SEQ ID NO: 271806 - RNA, 32 nt, Human
uucugccucccugcccuccagaccauggacgg

SEQ ID NO: 271807 - RNA, 20 nt, Human
uucugccuccuccccacucc

SEQ ID NO: 271808 - RNA, 32 nt, Human
uucugccucuacuagaacucagcuagagagga

SEQ ID NO: 271809 - RNA, 32 nt, Human
uucugccucuacuugucccuuuggccccuugc

SEQ ID NO: 271810 - RNA, 32 nt, Human
uucugccucucaaacuccugaccucaaguaau

SEQ ID NO: 271811 - RNA, 32 nt, Human
uucugccucugagggaaagcccagaaaaggac

SEQ ID NO: 271812 - RNA, 22 nt, Human
uucugccucuguccacauuucc

SEQ ID NO: 271813 - RNA, 32 nt, Human
uucugccucuuacuauacgacuguagugcaac

SEQ ID NO: 271814 - RNA, 32 nt, Human
uucugccugaaaucccaguacucuggaaggcc

SEQ ID NO: 271815 - RNA, 32 nt, Human
uucugccugccccucagaaccucucuguacuc

SEQ ID NO: 271816 - RNA, 32 nt, Human
uucugccugccggaccuccaccuggagcuguc

SEQ ID NO: 271817 - RNA, 32 nt, Human
uucugccugccuccgucucuuucucccucaga

SEQ ID NO: 271818 - RNA, 32 nt, Human
uucugccugccuguccucaugccucuccuccu

SEQ ID NO: 271819 - RNA, 32 nt, Human
uucugccugcugaccauaacagugccagcuuc

SEQ ID NO: 271820 - RNA, 32 nt, Human
uucugccugcugcccacuucccuagacuggag

SEQ ID NO: 271821 - RNA, 32 nt, Human
uucugccuggacaucauaaauggggacuugga

SEQ ID NO: 271822 - RNA, 32 nt, Human
uucugccugggcacacaccacaugcagauuuc

SEQ ID NO: 271823 - RNA, 32 nt, Human
uucugccugguggucuuucuucugccugcuau

SEQ ID NO: 271824 - RNA, 32 nt, Human
uucugccuguaaucccagaauuuugggaggcc

SEQ ID NO: 271825 - RNA, 32 nt, Human
uucugccuguacugcugcugcugcugcucagg

SEQ ID NO: 271826 - RNA, 32 nt, Human
uucugccugucaggcaggcggcaaagcucucc

SEQ ID NO: 271827 - RNA, 32 nt, Human
uucugccugucucagccucccaaaaagcuggg

SEQ ID NO: 271828 - RNA, 23 nt, Human
uucugccugugaucauuucuuua

SEQ ID NO: 271829 - RNA, 32 nt, Human
uucugccuuauacugggaaugccucaggcuug

SEQ ID NO: 271830 - RNA, 18 nt, Human
uucugccuucaaagguug

SEQ ID NO: 271831 - RNA, 32 nt, Human
uucugccuuccagaggugggaaugacuuggcu

SEQ ID NO: 271832 - RNA, 32 nt, Human
uucugccuuccaggagaggucuugcuuuugaa

SEQ ID NO: 271833 - RNA, 32 nt, Human
uucugccuucccuaguaguagggacugacaga

SEQ ID NO: 271834 - RNA, 32 nt, Human
uucugccuuuugucucuggguuuuguucucag

SEQ ID NO: 271835 - RNA, 32 nt, Human
uucugcgaggaauggcagcggcagcagcaucc

SEQ ID NO: 271836 - RNA, 32 nt, Human
uucugcgauauuuuuccacauuuucuugucgc

SEQ ID NO: 271837 - RNA, 32 nt, Human
uucugcgcucccggcccugcugcaggcugucu

SEQ ID NO: 271838 - RNA, 32 nt, Human
uucugcgcuuccuucucccucucuccagacgu

SEQ ID NO: 271839 - RNA, 32 nt, Human
uucugcggaggaggucaccugagcucacagga

SEQ ID NO: 271840 - RNA, 32 nt, Human
uucugcggagggugagacugagguggcugcag

SEQ ID NO: 271841 - RNA, 18 nt, Human
uucugcggcgcaaggcua

SEQ ID NO: 271842 - RNA, 32 nt, Human
uucugcggcuccaagccagcggguccugugaa

SEQ ID NO: 271843 - RNA, 32 nt, Human
uucugcguuggguuuucccuugccuuaugggc

SEQ ID NO: 271844 - RNA, 32 nt, Human
uucugcuaccccgugaccucccucucuccuuc

SEQ ID NO: 271845 - RNA, 32 nt, Human
uucugcuagagauucucagacugugggcauca

SEQ ID NO: 271846 - RNA, 32 nt, Human
uucugcuaguaaaggacuggcuucauucuaau

SEQ ID NO: 271847 - RNA, 32 nt, Human
uucugcucacaauaacaucugcccaaagaggg

SEQ ID NO: 271848 - RNA, 32 nt, Human
uucugcucacaucccauugcccggcuacaagg

SEQ ID NO: 271849 - RNA, 32 nt, Human
uucugcucagccacugggcucuuucacuuuuu

SEQ ID NO: 271850 - RNA, 32 nt, Human
uucugcucagccugugaccagcucuuucucuc

SEQ ID NO: 271851 - RNA, 32 nt, Human
uucugcucagcugguggguauggguccccuau

SEQ ID NO: 271852 - RNA, 32 nt, Human
uucugcucaguucaacaaugaaaugaagagga

SEQ ID NO: 271853 - RNA, 32 nt, Human
uucugcucaucucuccccauuucuuucuuccc

SEQ ID NO: 271854 - RNA, 32 nt, Human
uucugcuccauuuguagcaggugacagggguc

SEQ ID NO: 271855 - RNA, 32 nt, Human
uucugcuccccgccucaccccgccuccuccug

SEQ ID NO: 271856 - RNA, 32 nt, Human
uucugcucccgacuuucuggugucucuggcac

SEQ ID NO: 271857 - RNA, 32 nt, Human
uucugcucccucauucucuccccaccacucuc

SEQ ID NO: 271858 - RNA, 32 nt, Human
uucugcucccuuccaucucucucccauacuug

SEQ ID NO: 271859 - RNA, 32 nt, Human
uucugcuccgcuuccuccugcccagccaggca

SEQ ID NO: 271860 - RNA, 32 nt, Human
uucugcuccugcuuuucuguccugggcauggg

SEQ ID NO: 271861 - RNA, 32 nt, Human
uucugcucuaucucaaagacugaaugauacua

SEQ ID NO: 271862 - RNA, 32 nt, Human
uucugcucuccugcccacggugaucuggugcc

SEQ ID NO: 271863 - RNA, 32 nt, Human
uucugcucuguggaggggcgggcaccagcgcc

SEQ ID NO: 271864 - RNA, 32 nt, Human
uucugcucuguugcaugccugcucuaauuucu

SEQ ID NO: 271865 - RNA, 32 nt, Human
uucugcucuuagaccaggaagcugcauccaca

SEQ ID NO: 271866 - RNA, 32 nt, Human
uucugcugaaccugacagccagugggacucca

SEQ ID NO: 271867 - RNA, 32 nt, Human
uucugcugaccacagcacuccaaccaaaagcc

SEQ ID NO: 271868 - RNA, 32 nt, Human
uucugcugcacucugcuugggccuugaggucu

SEQ ID NO: 271869 - RNA, 32 nt, Human
uucugcugcccaagcuggaguggcaguggcau

SEQ ID NO: 271870 - RNA, 32 nt, Human
uucugcugcccagguuggagugcaguggcacg

SEQ ID NO: 271871 - RNA, 32 nt, Human
uucugcugccccuucaggguuuggaggagccg

SEQ ID NO: 271872 - RNA, 32 nt, Human
uucugcugcccucugcugucugcugagaugcc

SEQ ID NO: 271873 - RNA, 32 nt, Human
uucugcugccgcucugcagccuggaccugugg

SEQ ID NO: 271874 - RNA, 32 nt, Human
uucugcugcuaaaaauacaaaaguuuggaaac

SEQ ID NO: 271875 - RNA, 32 nt, Human
uucugcugcuacugcugcugcugcaagguugg

SEQ ID NO: 271876 - RNA, 32 nt, Human
uucugcugcuccacacacccagagaaggagug

SEQ ID NO: 271877 - RNA, 32 nt, Human
uucugcugcucccagcccccuccuccuggggc

SEQ ID NO: 271878 - RNA, 32 nt, Human
uucugcugcuggcuugcagaaaaagaaaaaug

SEQ ID NO: 271879 - RNA, 32 nt, Human
uucugcuggcggguguucugugccugggauua

SEQ ID NO: 271880 - RNA, 32 nt, Human
uucugcuguccccacugcccccggcuaggauc

SEQ ID NO: 271881 - RNA, 32 nt, Human
uucugcugugagaauguaagauggauccagaa

SEQ ID NO: 271882 - RNA, 32 nt, Human
uucugcuguggcuauauuggccuagaggggcu

SEQ ID NO: 271883 - RNA, 32 nt, Human
uucugcugugugacucugggcaagucacucuc

SEQ ID NO: 271884 - RNA, 32 nt, Human
uucugcugugugucuguguagacugggcacag

SEQ ID NO: 271885 - RNA, 32 nt, Human
uucugcuguuacggguacuuugcucauacgag

SEQ ID NO: 271886 - RNA, 32 nt, Human
uucugcuuacucacuccuucucccucuuucug

SEQ ID NO: 271887 - RNA, 32 nt, Human
uucugcuuagcugggccagcucccugcaacuc

SEQ ID NO: 271888 - RNA, 32 nt, Human
uucugcuucacacuaagugugucaucuuggcu

SEQ ID NO: 271889 - RNA, 32 nt, Human
uucugcuucacucuauuuaucucuugauguaa

SEQ ID NO: 271890 - RNA, 32 nt, Human
uucugcuuccacuguguuggggagagguguuc

SEQ ID NO: 271891 - RNA, 32 nt, Human
uucugcuuccccagcggauucccacucugucc

SEQ ID NO: 271892 - RNA, 32 nt, Human
uucugcuucccccauucccuuccacagcucau

SEQ ID NO: 271893 - RNA, 32 nt, Human
uucugcuuccccucacuuuuagaaguuaauug

SEQ ID NO: 271894 - RNA, 32 nt, Human
uucugcuucccuggaaaggaugaauuuacauc

SEQ ID NO: 271895 - RNA, 32 nt, Human
uucugcuucuucuguuuugccccauggucaag

SEQ ID NO: 271896 - RNA, 32 nt, Human
uucugcuugagguuuggggaggagggcaggcg

SEQ ID NO: 271897 - RNA, 32 nt, Human
uucugcuugcagccuucugucuuaaagguuuu

SEQ ID NO: 271898 - RNA, 32 nt, Human
uucugcuugcagcugcccaagucugccugggc

SEQ ID NO: 271899 - RNA, 32 nt, Human
uucugcuugcugcuaagaguuugcuaaagugu

SEQ ID NO: 271900 - RNA, 32 nt, Human
uucugcuuucaucuuggucacauacaauuauu

SEQ ID NO: 271901 - RNA, 32 nt, Human
uucugcuuucuugccacacagugggccggccc

SEQ ID NO: 271902 - RNA, 32 nt, Human
uucugcuuuguucgcucuuacuucugaggaag

SEQ ID NO: 271903 - RNA, 32 nt, Human
uucugcuuuuucuauucugaaaaaggacuuac

SEQ ID NO: 271904 - RNA, 32 nt, Human
uucuggaaaaggcaagaauagagaggcaguaa

SEQ ID NO: 271905 - RNA, 32 nt, Human
uucuggaaaauauccaugugguaaugguagac

SEQ ID NO: 271906 - RNA, 32 nt, Human
uucuggaaacccuuagcaaaccugccaugcuu

SEQ ID NO: 271907 - RNA, 32 nt, Human
uucuggaaacuaguuuuaauacauuuguuuuu

SEQ ID NO: 271908 - RNA, 32 nt, Human
uucuggaaagguuuuguuucugccucaaagca

SEQ ID NO: 271909 - RNA, 32 nt, Human
uucuggaaauggugcagccacuggggacaguu

SEQ ID NO: 271910 - RNA, 32 nt, Human
uucuggaacucuccaccuccgucucccuuggg

SEQ ID NO: 271911 - RNA, 32 nt, Human
uucuggaacuuaugauaggaagaaaagauguu

SEQ ID NO: 271912 - RNA, 32 nt, Human
uucuggaacuucugggcucaagcaauuuuccu

SEQ ID NO: 271913 - RNA, 32 nt, Human
uucuggaagagcucauauguguuuagcagguc

SEQ ID NO: 271914 - RNA, 32 nt, Human
uucuggaaggacaguaaccacugucaauugug

SEQ ID NO: 271915 - RNA, 32 nt, Human
uucuggaagugaugcuuccaggauuuguuuuc

SEQ ID NO: 271916 - RNA, 32 nt, Human
uucuggaaucaguguuuuccagucccauccca

SEQ ID NO: 271917 - RNA, 26 nt, Human
uucuggacaacuuuccccuucugcuu

SEQ ID NO: 271918 - RNA, 32 nt, Human
uucuggacacaaaaccaccccaaaaagugagu

SEQ ID NO: 271919 - RNA, 32 nt, Human
uucuggacaccaugcccugugccuugucacuc

SEQ ID NO: 271920 - RNA, 32 nt, Human
uucuggacagacacuuguacauggacagacau

SEQ ID NO: 271921 - RNA, 32 nt, Human
uucuggacauaaaacacagaugaggaaagggc

SEQ ID NO: 271922 - RNA, 32 nt, Human
uucuggacauaguaaaauuuuucuccauaaau

SEQ ID NO: 271923 - RNA, 32 nt, Human
uucuggaccagaacagcuccagcucccaggua

SEQ ID NO: 271924 - RNA, 32 nt, Human
uucuggaccagagacuuggugcgggguuaaca

SEQ ID NO: 271925 - RNA, 32 nt, Human
uucuggacucaaacgauccucucaccucggcc

SEQ ID NO: 271926 - RNA, 32 nt, Human
uucuggacucaagugauccucccgccucggcc

SEQ ID NO: 271927 - RNA, 32 nt, Human
uucuggacucaagugauccuccugccucagcu

SEQ ID NO: 271928 - RNA, 32 nt, Human
uucuggacucaagugauccucuggccucagcc

SEQ ID NO: 271929 - RNA, 21 nt, Human
uucuggacuccugaaggucgu

SEQ ID NO: 271930 - RNA, 32 nt, Human
uucuggacugcaaaggggacccccagguggga

SEQ ID NO: 271931 - RNA, 32 nt, Human
uucuggagaauaggaguggagcugcaggcccu

SEQ ID NO: 271932 - RNA, 32 nt, Human
uucuggagacugcgccguccucccgggagagc

SEQ ID NO: 271933 - RNA, 32 nt, Human
uucuggagagccucugcaggggguuugccauc

SEQ ID NO: 271934 - RNA, 32 nt, Human
uucuggagaggaacuuggaauuugagggagau

SEQ ID NO: 271935 - RNA, 32 nt, Human
uucuggagagggccucugagaaggcacugaau

SEQ ID NO: 271936 - RNA, 32 nt, Human
uucuggagcaccaguucacuccagguuuuuau

SEQ ID NO: 271937 - RNA, 32 nt, Human
uucuggagcagccuggugaacccugccacagg

SEQ ID NO: 271938 - RNA, 32 nt, Human
uucuggagccugacgaugaggggagugaugcu

SEQ ID NO: 271939 - RNA, 32 nt, Human
uucuggagcucuugugucauuguuagaaaucc

SEQ ID NO: 271940 - RNA, 32 nt, Human
uucuggagcugcuguuccaacagacagggccu

SEQ ID NO: 271941 - RNA, 32 nt, Human
uucuggaggaagagcaaucaaguuuguggcca

SEQ ID NO: 271942 - RNA, 32 nt, Human
uucuggaggaugucacagagaauuccauccug

SEQ ID NO: 271943 - RNA, 32 nt, Human
uucuggaggcuccagggcaggaaggggaggau

SEQ ID NO: 271944 - RNA, 24 nt, Human
uucuggaggcugcaaaguccaaua

SEQ ID NO: 271945 - RNA, 32 nt, Human
uucuggagguggguggcaacuccacgcgggag

SEQ ID NO: 271946 - RNA, 32 nt, Human
uucuggagguuggagguuccgcucagugacag

SEQ ID NO: 271947 - RNA, 32 nt, Human
uucuggaguccagagccacugccuuugcucca

SEQ ID NO: 271948 - RNA, 32 nt, Human
uucuggaguccuuuggaaacaugugucccaga

SEQ ID NO: 271949 - RNA, 32 nt, Human
uucuggagugccugaacggcccccugagcccu

SEQ ID NO: 271950 - RNA, 32 nt, Human
uucuggauagaggaagugauuggaaguauucc

SEQ ID NO: 271951 - RNA, 32 nt, Human
uucuggauaggggaugagguugcugugaaagc

SEQ ID NO: 271952 - RNA, 32 nt, Human
uucuggauauuuuugccacauuucuuugcaaa

SEQ ID NO: 271953 - RNA, 32 nt, Human
uucuggaucacgugggcccagugcaguucaaa

SEQ ID NO: 271954 - RNA, 32 nt, Human
uucuggauccuugagcaaaugauuauagucuc

SEQ ID NO: 271955 - RNA, 32 nt, Human
uucuggauccuuggagcuuagcucggagcuug

SEQ ID NO: 271956 - RNA, 32 nt, Human
uucuggaugaauauaaaaugugcugcccuuca

SEQ ID NO: 271957 - RNA, 32 nt, Human
uucuggaugcagagguggagguugaggccgug

SEQ ID NO: 271958 - RNA, 32 nt, Human
uucuggauggguuaguuguaggucccuagauu

SEQ ID NO: 271959 - RNA, 32 nt, Human
uucuggauucaagugauucuccugccucagcc

SEQ ID NO: 271960 - RNA, 32 nt, Human
uucuggauucaagugauucuugugccuuagcc

SEQ ID NO: 271961 - RNA, 32 nt, Human
uucuggauuuuguagugcacacaaagacaaga

SEQ ID NO: 271962 - RNA, 32 nt, Human
uucuggcaacuccuuguaauuccaauguauuu

SEQ ID NO: 271963 - RNA, 26 nt, Human
uucuggcaagguuuccaccucuuccu

SEQ ID NO: 271964 - RNA, 32 nt, Human
uucuggcacauacuugaguuugagaauaacug

SEQ ID NO: 271965 - RNA, 32 nt, Human
uucuggcacaucugaauaaacauguucuuauu

SEQ ID NO: 271966 - RNA, 32 nt, Human
uucuggcaccacuuccuucccuggccccuuaa

SEQ ID NO: 271967 - RNA, 23 nt, Human
uucuggcaccuaccuaccugcuu

SEQ ID NO: 271968 - RNA, 32 nt, Human
uucuggcagggaccuggcuggggaacguucug

SEQ ID NO: 271969 - RNA, 32 nt, Human
uucuggcauguagaucaguggucuccaagcuu

SEQ ID NO: 271970 - RNA, 32 nt, Human
uucuggcauucucugccucugccucauauucu

SEQ ID NO: 271971 - RNA, 32 nt, Human
uucuggccacaucagaaucgucugagggacuu

SEQ ID NO: 271972 - RNA, 32 nt, Human
uucuggccacugccacugaugcccagggauuc

SEQ ID NO: 271973 - RNA, 32 nt, Human
uucuggccaggaauaaauacuuccugaacauc

SEQ ID NO: 271974 - RNA, 32 nt, Human
uucuggccaggaggaagggcagaugcucccuc

SEQ ID NO: 271975 - RNA, 32 nt, Human
uucuggccagggaggcauugcugcaggugagc

SEQ ID NO: 271976 - RNA, 32 nt, Human
uucuggcccacaccuauggcucaggccgaggc

SEQ ID NO: 271977 - RNA, 32 nt, Human
uucuggcccagggacaggaggaagagaugcca

SEQ ID NO: 271978 - RNA, 32 nt, Human
uucuggcccucucgacccuccugggccuuguu

SEQ ID NO: 271979 - RNA, 21 nt, Human
uucuggccucaagugauccac

SEQ ID NO: 271980 - RNA, 32 nt, Human
uucuggccucaagugauccaccuaccuaguuu

SEQ ID NO: 271981 - RNA, 32 nt, Human
uucuggccucaagugauccuccugccucggcc

SEQ ID NO: 271982 - RNA, 20 nt, Human
uucuggccucagaccaacuc

SEQ ID NO: 271983 - RNA, 24 nt, Human
uucuggccucuuuccauccaauca

SEQ ID NO: 271984 - RNA, 32 nt, Human
uucuggccuucagggucacaggcaguaggggg

SEQ ID NO: 271985 - RNA, 21 nt, Human
uucuggccuuggugaucacuu

SEQ ID NO: 271986 - RNA, 32 nt, Human
uucuggcggaagagacaagcaagcaaugaaca

SEQ ID NO: 271987 - RNA, 32 nt, Human
uucuggcgucucucaccuccuucauccccuac

SEQ ID NO: 271988 - RNA, 32 nt, Human
uucuggcuaacacugaaaccccgucucuacua

SEQ ID NO: 271989 - RNA, 32 nt, Human
uucuggcucacugcagccucaaacuccugagu

SEQ ID NO: 271990 - RNA, 32 nt, Human
uucuggcuccagccagaccuucagugguccug

SEQ ID NO: 271991 - RNA, 18 nt, Human
uucuggcuccguccccag

SEQ ID NO: 271992 - RNA, 32 nt, Human
uucuggcuccuguggccucaccaggaagcguc

SEQ ID NO: 271993 - RNA, 32 nt, Human
uucuggcucugaagacacagacagagguuucc

SEQ ID NO: 271994 - RNA, 32 nt, Human
uucuggcucugaguguuccucucagcaccucu

SEQ ID NO: 271995 - RNA, 32 nt, Human
uucuggcucuggggcuccaaggacucacaaag

SEQ ID NO: 271996 - RNA, 32 nt, Human
uucuggcugcagaucuggagguggaggcagua

SEQ ID NO: 271997 - RNA, 23 nt, Human
uucuggcugccagccugggcagc

SEQ ID NO: 271998 - RNA, 32 nt, Human
uucuggcugccugguggccacugcuacagcug

SEQ ID NO: 271999 - RNA, 32 nt, Human
uucuggcugcucuucauugaccuguguguucc

SEQ ID NO: 272000 - RNA, 32 nt, Human
uucuggcugggaacguagacagugggguugug

SEQ ID NO: 272001 - RNA, 32 nt, Human
uucuggcugggcugccgugugcacagcaaguu

SEQ ID NO: 272002 - RNA, 32 nt, Human
uucuggcugguuuggaacaggcugccaugcuu

SEQ ID NO: 272003 - RNA, 32 nt, Human
uucuggcugugggagcaccaccugguggcuga

SEQ ID NO: 272004 - RNA, 21 nt, Human
uucuggcuucagcccccacca

SEQ ID NO: 272005 - RNA, 32 nt, Human
uucuggcuucaggcugggaggcacaguucagg

SEQ ID NO: 272006 - RNA, 32 nt, Human
uucuggcuucugcuucauccugcuccaucggg

SEQ ID NO: 272007 - RNA, 20 nt, Human
uucuggcuucuguuccacuu

SEQ ID NO: 272008 - RNA, 32 nt, Human
uucuggcuuggcuaauggaaaucgacacuagc

SEQ ID NO: 272009 - RNA, 32 nt, Human
uucuggcuuuggucuguucuccuuccuuacag

SEQ ID NO: 272010 - RNA, 32 nt, Human
uucuggcuuuucaaccaaacauuguugcuaau

SEQ ID NO: 272011 - RNA, 32 nt, Human
uucugggaaagcaguuuugcuaaaagcuguac

SEQ ID NO: 272012 - RNA, 32 nt, Human
uucugggaacugcuuugcauuucuccuauaga

SEQ ID NO: 272013 - RNA, 32 nt, Human
uucugggaagcccguggcagggcacaggguug

SEQ ID NO: 272014 - RNA, 32 nt, Human
uucugggaaggccugggugugugcacaaggag

SEQ ID NO: 272015 - RNA, 32 nt, Human
uucugggaagggcagaggauaaauguggcccu

SEQ ID NO: 272016 - RNA, 32 nt, Human
uucugggaauacagacuugaaccagacaugcu

SEQ ID NO: 272017 - RNA, 32 nt, Human
uucugggaaugcuaauaugcaagugaaccagu

SEQ ID NO: 272018 - RNA, 32 nt, Human
uucugggacccaggcuucagugucacacgguc

SEQ ID NO: 272019 - RNA, 18 nt, Human
uucugggaccugccagca

SEQ ID NO: 272020 - RNA, 32 nt, Human
uucugggacugcugugaggcagaggaaugaug

SEQ ID NO: 272021 - RNA, 32 nt, Human
uucugggagcagaguugagggagccgagcuga

SEQ ID NO: 272022 - RNA, 19 nt, Human
uucugggagccacugggca

SEQ ID NO: 272023 - RNA, 24 nt, Human
uucugggagccauucuucuugccu

SEQ ID NO: 272024 - RNA, 32 nt, Human
uucugggagccuuuugacagcuggucccugcc

SEQ ID NO: 272025 - RNA, 32 nt, Human
uucugggagcugugaccucccuuccuccucca

SEQ ID NO: 272026 - RNA, 32 nt, Human
uucugggaggccgaggcgggcagaucacuuga

SEQ ID NO: 272027 - RNA, 32 nt, Human
uucugggaggucacuggaggccagcucagccc

SEQ ID NO: 272028 - RNA, 26 nt, Human
uucugggagguucccgcuugcugccu

SEQ ID NO: 272029 - RNA, 32 nt, Human
uucugggaguugcauaccggccagucuuauuc

SEQ ID NO: 272030 - RNA, 32 nt, Human
uucugggaguuuagacaauguugcccuuggau

SEQ ID NO: 272031 - RNA, 32 nt, Human
uucugggauacauaugcaaaacaugcauguuu

SEQ ID NO: 272032 - RNA, 32 nt, Human
uucugggauaguagucuucauccacuaaacug

SEQ ID NO: 272033 - RNA, 32 nt, Human
uucugggauuacaggcaugagccaccaugccc

SEQ ID NO: 272034 - RNA, 32 nt, Human
uucugggauuacaggcaugagccaccgugccc

SEQ ID NO: 272035 - RNA, 32 nt, Human
uucugggauuacaggcaugagccacugugccc

SEQ ID NO: 272036 - RNA, 32 nt, Human
uucugggauuacaggguguugagccacucuga

SEQ ID NO: 272037 - RNA, 32 nt, Human
uucugggauucaggcuggccggugcugugucc

SEQ ID NO: 272038 - RNA, 32 nt, Human
uucugggauuucucccucucaguggagccuua

SEQ ID NO: 272039 - RNA, 32 nt, Human
uucugggcaccacugcauucccugauacccac

SEQ ID NO: 272040 - RNA, 21 nt, Human
uucugggcaccgccuucugcu

SEQ ID NO: 272041 - RNA, 31 nt, Human
uucugggcacuuuuuaacauugcugauguag

SEQ ID NO: 272042 - RNA, 32 nt, Human
uucugggcaggcaggccauggggcauggagga

SEQ ID NO: 272043 - RNA, 32 nt, Human
uucugggcaguuucaccuuugugccuuaaaug

SEQ ID NO: 272044 - RNA, 32 nt, Human
uucugggcauucuauggagaccccaggagagc

SEQ ID NO: 272045 - RNA, 31 nt, Human
uucugggccaagagacacucacuggacaaua

SEQ ID NO: 272046 - RNA, 32 nt, Human
uucugggccaucccccuccacccccacccuga

SEQ ID NO: 272047 - RNA, 24 nt, Human
uucugggccauucuuuuccugucu

SEQ ID NO: 272048 - RNA, 32 nt, Human
uucugggccuguaaucccaguuuggauggcac

SEQ ID NO: 272049 - RNA, 32 nt, Human
uucugggcgccacugcauucccugauacacac

SEQ ID NO: 272050 - RNA, 32 nt, Human
uucugggcucaagcaaucuucccaccucagcc

SEQ ID NO: 272051 - RNA, 32 nt, Human
uucugggcucaagcaauucaucugccucaacc

SEQ ID NO: 272052 - RNA, 32 nt, Human
uucugggcucaagcaauugucccuccucagcc

SEQ ID NO: 272053 - RNA, 32 nt, Human
uucugggcucaagcaauuuuccugccuugggc

SEQ ID NO: 272054 - RNA, 32 nt, Human
uucugggcucaagugauccucccuccuuggcc

SEQ ID NO: 272055 - RNA, 32 nt, Human
uucugggcucaagugauccucucaccucagcu

SEQ ID NO: 272056 - RNA, 32 nt, Human
uucugggcucaagugcuucucccaccucagcc

SEQ ID NO: 272057 - RNA, 32 nt, Human
uucugggcucaggugauccucccgccuuggcc

SEQ ID NO: 272058 - RNA, 32 nt, Human
uucugggcucaggugauccuuccgccucaccc

SEQ ID NO: 272059 - RNA, 32 nt, Human
uucugggcucuugccugugaaaucuuucuuug

SEQ ID NO: 272060 - RNA, 32 nt, Human
uucugggcuggccaaggccagagcaggcuccc

SEQ ID NO: 272061 - RNA, 32 nt, Human
uucugggcugggauccuggcuccagggccaug

SEQ ID NO: 272062 - RNA, 32 nt, Human
uucuggggaaagcauccaucacagaaccuccc

SEQ ID NO: 272063 - RNA, 32 nt, Human
uucuggggaagagaccuagaaacaagcuuuca

SEQ ID NO: 272064 - RNA, 32 nt, Human
uucuggggaccaugcauuugccuggauuuucc

SEQ ID NO: 272065 - RNA, 32 nt, Human
uucuggggagcaccgcaggcuccucaccccca

SEQ ID NO: 272066 - RNA, 32 nt, Human
uucuggggaggcagagaggcagggacuuuggg

SEQ ID NO: 272067 - RNA, 32 nt, Human
uucuggggagguaggaaggaccaggggcauuc

SEQ ID NO: 272068 - RNA, 32 nt, Human
uucuggggaugguuugggggcgggccgggucc

SEQ ID NO: 272069 - RNA, 32 nt, Human
uucuggggcaggcaccgagguccgaguggcaa

SEQ ID NO: 272070 - RNA, 21 nt, Human
uucuggggcaggucuccgccu

SEQ ID NO: 272071 - RNA, 22 nt, Human
uucuggggccacccuccagccu

SEQ ID NO: 272072 - RNA, 32 nt, Human
uucuggggcccagguugaagccgaccaacccu

SEQ ID NO: 272073 - RNA, 32 nt, Human
uucuggggccccugcccucaggaggcugucag

SEQ ID NO: 272074 - RNA, 23 nt, Human
uucuggggcuaacuucucugccu

SEQ ID NO: 272075 - RNA, 22 nt, Human
uucuggggcuaagccuccuucu

SEQ ID NO: 272076 - RNA, 32 nt, Human
uucugggggaggguuucacuguuacaucacca

SEQ ID NO: 272077 - RNA, 32 nt, Human
uucugggggaggucacugcagaaggauggaac

SEQ ID NO: 272078 - RNA, 32 nt, Human
uucugggggcuggagggagccggggcagccac

SEQ ID NO: 272079 - RNA, 32 nt, Human
uucugggggugagguugacggcuggucgugau

SEQ ID NO: 272080 - RNA, 26 nt, Human
uucugggguaaguuccaccucuucuu

SEQ ID NO: 272081 - RNA, 32 nt, Human
uucuggggucaagugauccucucaccucagcc

SEQ ID NO: 272082 - RNA, 32 nt, Human
uucugggguggaggguggggguggagguccug

SEQ ID NO: 272083 - RNA, 24 nt, Human
uucugggguuucuugaaucuuguc

SEQ ID NO: 272084 - RNA, 24 nt, Human
uucugggguuuugauuuuccuucu

SEQ ID NO: 272085 - RNA, 32 nt, Human
uucuggguagaguuuguccucucacuucugga

SEQ ID NO: 272086 - RNA, 24 nt, Human
uucugggucagaaugaucuacuca

SEQ ID NO: 272087 - RNA, 32 nt, Human
uucugggucccugguugaagcagcagcuuacc

SEQ ID NO: 272088 - RNA, 32 nt, Human
uucuggguccucuucagguuugagugcuugaa

SEQ ID NO: 272089 - RNA, 23 nt, Human
uucugggucgguuccagcggcuu

SEQ ID NO: 272090 - RNA, 32 nt, Human
uucugggugagguuauuugcagguggagacgg

SEQ ID NO: 272091 - RNA, 32 nt, Human
uucugggugaugaaaauguucuauuucuugau

SEQ ID NO: 272092 - RNA, 32 nt, Human
uucugggugcagacugcaccuccggaugcagu

SEQ ID NO: 272093 - RNA, 32 nt, Human
uucugggugggaccuaagauggcuugggaguu

SEQ ID NO: 272094 - RNA, 32 nt, Human
uucugggugggaguggggagggcgaggggccu

SEQ ID NO: 272095 - RNA, 32 nt, Human
uucugggugggcugguucuggguggggagcug

SEQ ID NO: 272096 - RNA, 32 nt, Human
uucugggugugacugauucccagccuguggca

SEQ ID NO: 272097 - RNA, 32 nt, Human
uucuggguuagaagcuauucgaaaaguccagu

SEQ ID NO: 272098 - RNA, 32 nt, Human
uucuggguuaucuucugaucauggccuuucaa

SEQ ID NO: 272099 - RNA, 32 nt, Human
uucuggguucaagugauucuccugccucagcc

SEQ ID NO: 272100 - RNA, 32 nt, Human
uucuggguucaagugauucuucugccucagcc

SEQ ID NO: 272101 - RNA, 32 nt, Human
uucuggguucacgugauucucuugccuuagcc

SEQ ID NO: 272102 - RNA, 32 nt, Human
uucuggguuuucucaugccuggucuuacugcu

SEQ ID NO: 272103 - RNA, 32 nt, Human
uucugguaauuuccucuucuugaucugggugu

SEQ ID NO: 272104 - RNA, 32 nt, Human
uucugguaccaccuccaugggccccagauugg

SEQ ID NO: 272105 - RNA, 32 nt, Human
uucugguagugacagaucugcaggacagauuu

SEQ ID NO: 272106 - RNA, 32 nt, Human
uucugguaucuuugaaaaauguaaauaguuua

SEQ ID NO: 272107 - RNA, 32 nt, Human
uucuggucaccaggcuguucaguggacucagu

SEQ ID NO: 272108 - RNA, 32 nt, Human
uucuggucauuucauauaaauggaauucuaca

SEQ ID NO: 272109 - RNA, 24 nt, Human
uucuggucccacccaccucugccu

SEQ ID NO: 272110 - RNA, 32 nt, Human
uucuggucguccucacugcucacuauaugcua

SEQ ID NO: 272111 - RNA, 32 nt, Human
uucuggucugcuguugagauguuugguaaaug

SEQ ID NO: 272112 - RNA, 32 nt, Human
uucuggucuguggagaaacugugaauuggaga

SEQ ID NO: 272113 - RNA, 23 nt, Human
uucuggucuuuccucuucuguuu

SEQ ID NO: 272114 - RNA, 32 nt, Human
uucuggugaccuuccaagagccugagagugag

SEQ ID NO: 272115 - RNA, 32 nt, Human
uucuggugagauugcaccuggauaccaggcuu

SEQ ID NO: 272116 - RNA, 32 nt, Human
uucuggugagccagcgggacccaccagcucua

SEQ ID NO: 272117 - RNA, 32 nt, Human
uucuggugaggaaugaaagggccaaguguucc

SEQ ID NO: 272118 - RNA, 32 nt, Human
uucuggugccagccccaugcagggggacucuc

SEQ ID NO: 272119 - RNA, 32 nt, Human
uucugguggccccuucuaugcccagcugugcu

SEQ ID NO: 272120 - RNA, 32 nt, Human
uucugguggggguagugauggacgcugaccca

SEQ ID NO: 272121 - RNA, 32 nt, Human
uucugguguccaggcugaaguccucgugugac

SEQ ID NO: 272122 - RNA, 32 nt, Human
uucuggugugugcucccgccuccuggguauac

SEQ ID NO: 272123 - RNA, 22 nt, Human
uucugguuccugcacaaccuca

SEQ ID NO: 272124 - RNA, 19 nt, Human
uucugguuccuggcugccu

SEQ ID NO: 272125 - RNA, 32 nt, Human
uucugguugcccuggaaagccugcugcucagc

SEQ ID NO: 272126 - RNA, 32 nt, Human
uucugguuucaagcaacucuucugccucagca

SEQ ID NO: 272127 - RNA, 32 nt, Human
uucugguuucugacuuuuccuucuugaugacc

SEQ ID NO: 272128 - RNA, 32 nt, Human
uucugguuugguguugagucucucuccugcug

SEQ ID NO: 272129 - RNA, 32 nt, Human
uucugguuuuuaaccauugucuuguucuguga

SEQ ID NO: 272130 - RNA, 32 nt, Human
uucuguaaagcagagugauggcugagaagucc

SEQ ID NO: 272131 - RNA, 32 nt, Human
uucuguaaauaacaucuaguaucuucacuaaa

SEQ ID NO: 272132 - RNA, 32 nt, Human
uucuguaaccaggaaaaguuacaagaagaggg

SEQ ID NO: 272133 - RNA, 32 nt, Human
uucuguaacccaggcuggagugcaguggccug

SEQ ID NO: 272134 - RNA, 32 nt, Human
uucuguaacccuugguugccagagauaaagug

SEQ ID NO: 272135 - RNA, 32 nt, Human
uucuguaacugcauuuuucaccuuaaaaguua

SEQ ID NO: 272136 - RNA, 32 nt, Human
uucuguaauuauacacauuuccaguuccaugc

SEQ ID NO: 272137 - RNA, 32 nt, Human
uucuguacacccuuucuaucgugucaaauguu

SEQ ID NO: 272138 - RNA, 32 nt, Human
uucuguacauuucucagggaaaggggacuuug

SEQ ID NO: 272139 - RNA, 32 nt, Human
uucuguaccagcccccucagauacucaugccc

SEQ ID NO: 272140 - RNA, 32 nt, Human
uucuguaccccuuccccagccugggccuugac

SEQ ID NO: 272141 - RNA, 32 nt, Human
uucuguaccuucaaccugguguuaggugugca

SEQ ID NO: 272142 - RNA, 32 nt, Human
uucuguaccuuggaacagucuucccugacaag

SEQ ID NO: 272143 - RNA, 32 nt, Human
uucuguacucaccuacucccaccccaagggaa

SEQ ID NO: 272144 - RNA, 32 nt, Human
uucuguacucucacaaacuuuguuacucaaaa

SEQ ID NO: 272145 - RNA, 32 nt, Human
uucuguacugcacuguggcuugcccuggcggg

SEQ ID NO: 272146 - RNA, 32 nt, Human
uucuguagaccagcuccaacaggauuccaugg

SEQ ID NO: 272147 - RNA, 32 nt, Human
uucuguagauccugagucgguguuacaauagu

SEQ ID NO: 272148 - RNA, 32 nt, Human
uucuguagaugaugcaguguucuaucauaagu

SEQ ID NO: 272149 - RNA, 32 nt, Human
uucuguagauggggucucacuauguugcccag

SEQ ID NO: 272150 - RNA, 32 nt, Human
uucuguagcuaagagggaauccuggcccccuc

SEQ ID NO: 272151 - RNA, 32 nt, Human
uucuguagcuuuuugaccuaagaucucagcaa

SEQ ID NO: 272152 - RNA, 32 nt, Human
uucuguagggcagagggcacuauuccagaguc

SEQ ID NO: 272153 - RNA, 32 nt, Human
uucuguagggcuggggcuggaaaugggucgug

SEQ ID NO: 272154 - RNA, 32 nt, Human
uucuguaggucggaggaauggaggcuuacuaa

SEQ ID NO: 272155 - RNA, 32 nt, Human
uucuguaguaacuguuuaaccuuucuaaaucu

SEQ ID NO: 272156 - RNA, 32 nt, Human
uucuguaguacugacugguucaucacaaggca

SEQ ID NO: 272157 - RNA, 32 nt, Human
uucuguaguauucacuacuccagaccuuuuuc

SEQ ID NO: 272158 - RNA, 32 nt, Human
uucuguagucccugagcuuggaaauuacugug

SEQ ID NO: 272159 - RNA, 32 nt, Human
uucuguaguguagcugcacguccugguacugu

SEQ ID NO: 272160 - RNA, 31 nt, Human
uucuguaguuacuucuuuuauucuuucaggu

SEQ ID NO: 272161 - RNA, 32 nt, Human
uucuguauaaaguuaccugacacacauauaaa

SEQ ID NO: 272162 - RNA, 32 nt, Human
uucuguaucaauucaauaaauggaauugacug

SEQ ID NO: 272163 - RNA, 32 nt, Human
uucuguaucuuuuccuguuaaacacacagacc

SEQ ID NO: 272164 - RNA, 19 nt, Human
uucuguauucucauuucca

SEQ ID NO: 272165 - RNA, 32 nt, Human
uucuguauugcaacuuuucucagagauugcaa

SEQ ID NO: 272166 - RNA, 32 nt, Human
uucugucaaagacaauauuuuguguuuuucag

SEQ ID NO: 272167 - RNA, 32 nt, Human
uucugucaacuagucguggagggaaggagacu

SEQ ID NO: 272168 - RNA, 32 nt, Human
uucugucaauauguccuugcccacugccucuc

SEQ ID NO: 272169 - RNA, 32 nt, Human
uucugucacacagucuggagugcuguggugca

SEQ ID NO: 272170 - RNA, 32 nt, Human
uucugucacccagacuggagugcagugccaca

SEQ ID NO: 272171 - RNA, 32 nt, Human
uucugucacccaggccggagugcaguggugua

SEQ ID NO: 272172 - RNA, 32 nt, Human
uucugucacccaggcuagagcgcaguggcaag

SEQ ID NO: 272173 - RNA, 32 nt, Human
uucugucacccaggcuagaguacagugggaac

SEQ ID NO: 272174 - RNA, 32 nt, Human
uucugucacccaggcuggaguccaauggggcg

SEQ ID NO: 272175 - RNA, 32 nt, Human
uucugucacccaggcuggagugcaaaggugca

SEQ ID NO: 272176 - RNA, 32 nt, Human
uucugucacccaggcuggagugcagugacuca

SEQ ID NO: 272177 - RNA, 32 nt, Human
uucugucacccaggcuggagugcaguggcacc

SEQ ID NO: 272178 - RNA, 32 nt, Human
uucugucacccaggcuggagugcaguggcgca

SEQ ID NO: 272179 - RNA, 32 nt, Human
uucugucacccaggcuggagugcaguggcgug

SEQ ID NO: 272180 - RNA, 32 nt, Human
uucugucacccaggcuggagugcaguggugca

SEQ ID NO: 272181 - RNA, 32 nt, Human
uucugucacccaggcuggagugcaguggugug

SEQ ID NO: 272182 - RNA, 32 nt, Human
uucugucacccaggcuggcgugcaauaguuca

SEQ ID NO: 272183 - RNA, 32 nt, Human
uucugucacccaggcuggggugcaguggcgug

SEQ ID NO: 272184 - RNA, 32 nt, Human
uucugucacccagguuagaguagauuucagug

SEQ ID NO: 272185 - RNA, 32 nt, Human
uucugucacccgggcuggagugcaguggcgug

SEQ ID NO: 272186 - RNA, 32 nt, Human
uucugucaccuaggcuggaaugcaguggugca

SEQ ID NO: 272187 - RNA, 32 nt, Human
uucugucaccuaggcuggaguguagugacaug

SEQ ID NO: 272188 - RNA, 32 nt, Human
uucugucaccuaggguggagugcaguggcaca

SEQ ID NO: 272189 - RNA, 32 nt, Human
uucugucacucaagcuguagugcaguggugcc

SEQ ID NO: 272190 - RNA, 32 nt, Human
uucugucacucaggcuagagugcaguggcaug

SEQ ID NO: 272191 - RNA, 32 nt, Human
uucugucacucaggcuggaguacaguggugcc

SEQ ID NO: 272192 - RNA, 32 nt, Human
uucugucacucaggcuggagugcaguggcgug

SEQ ID NO: 272193 - RNA, 32 nt, Human
uucugucaggaaaauuuaguuuacagaauacu

SEQ ID NO: 272194 - RNA, 32 nt, Human
uucugucauuccuaaaacacccuucagcaaug

SEQ ID NO: 272195 - RNA, 32 nt, Human
uucugucauuuuccuuucacuuccugaaagcc

SEQ ID NO: 272196 - RNA, 32 nt, Human
uucuguccagccagcaggaugcagccuuugcc

SEQ ID NO: 272197 - RNA, 32 nt, Human
uucuguccccgaggccggagugcaauggcgug

SEQ ID NO: 272198 - RNA, 32 nt, Human
uucuguccccuccccaagaccccaccucauau

SEQ ID NO: 272199 - RNA, 32 nt, Human
uucuguccccuucacuucacuccuggaaaaga

SEQ ID NO: 272200 - RNA, 32 nt, Human
uucugucccuuucuucuaccacucuuccuuuc

SEQ ID NO: 272201 - RNA, 28 nt, Human
uucuguccuaaagucgccucaucuucac

SEQ ID NO: 272202 - RNA, 32 nt, Human
uucuguccuagaguucuuuccugaccucuagc

SEQ ID NO: 272203 - RNA, 32 nt, Human
uucuguccucacccuacccugcucuccacccc

SEQ ID NO: 272204 - RNA, 32 nt, Human
uucuguccuccaggcuggagugcaaugacaug

SEQ ID NO: 272205 - RNA, 32 nt, Human
uucuguccucugaggucuuccuugucccuuua

SEQ ID NO: 272206 - RNA, 32 nt, Human
uucuguccugggaacagccugacccaccuccc

SEQ ID NO: 272207 - RNA, 32 nt, Human
uucuguccuuagauccucacauguuaucccug

SEQ ID NO: 272208 - RNA, 32 nt, Human
uucuguccuuccaucccucuuuugggcucuuc

SEQ ID NO: 272209 - RNA, 32 nt, Human
uucuguccuuguccuggaccucagguucccag

SEQ ID NO: 272210 - RNA, 32 nt, Human
uucugucgaggagcuucggggcucagagaggu

SEQ ID NO: 272211 - RNA, 32 nt, Human
uucugucgcccaggcuggagugcaggggcauu

SEQ ID NO: 272212 - RNA, 32 nt, Human
uucugucgcccaggcuggagugcaguggcgcg

SEQ ID NO: 272213 - RNA, 32 nt, Human
uucugucgcccaggcuggaguguagugacgcg

SEQ ID NO: 272214 - RNA, 32 nt, Human
uucugucgcccaggcuggcgugcaguggcgcg

SEQ ID NO: 272215 - RNA, 32 nt, Human
uucugucgcccuggcuggagugcaauggugug

SEQ ID NO: 272216 - RNA, 32 nt, Human
uucugucgcccuggcuggaguggaaugccgug

SEQ ID NO: 272217 - RNA, 32 nt, Human
uucugucggccucgcuuuuccugggccagugu

SEQ ID NO: 272218 - RNA, 32 nt, Human
uucugucguccaggcuggagugcaguagcgca

SEQ ID NO: 272219 - RNA, 32 nt, Human
uucugucguccaggcuggagugcaguggugug

SEQ ID NO: 272220 - RNA, 32 nt, Human
uucugucguccaggcuggagugcgguggcgug

SEQ ID NO: 272221 - RNA, 32 nt, Human
uucugucgucugcaguucagucagggacaaau

SEQ ID NO: 272222 - RNA, 32 nt, Human
uucugucuacagcuagaagcugugccccaguu

SEQ ID NO: 272223 - RNA, 32 nt, Human
uucugucuaguuacaguuauggaaguaugaga

SEQ ID NO: 272224 - RNA, 32 nt, Human
uucugucucccaggcugaagugcagugaguca

SEQ ID NO: 272225 - RNA, 32 nt, Human
uucugucuccuccccucccuccuucuuuaguu

SEQ ID NO: 272226 - RNA, 32 nt, Human
uucugucuccuccucccgcugaacacguccuc

SEQ ID NO: 272227 - RNA, 32 nt, Human
uucugucucgcaggccagagugcaguggugug

SEQ ID NO: 272228 - RNA, 32 nt, Human
uucugucucucaggugaugucaccagcaauaa

SEQ ID NO: 272229 - RNA, 32 nt, Human
uucugucucugccucccucacccugagccccu

SEQ ID NO: 272230 - RNA, 32 nt, Human
uucugucucugucuuuggcuucuguccaggca

SEQ ID NO: 272231 - RNA, 32 nt, Human
uucugucucuucuguuccaaagccaggagagc

SEQ ID NO: 272232 - RNA, 32 nt, Human
uucugucucuugaguugaaaucagaggcugcu

SEQ ID NO: 272233 - RNA, 32 nt, Human
uucugucugaucaaggcaccacacaacccaga

SEQ ID NO: 272234 - RNA, 32 nt, Human
uucugucugccucgccuguucucuccagguag

SEQ ID NO: 272235 - RNA, 32 nt, Human
uucugucugggcagagacuguggacccuggua

SEQ ID NO: 272236 - RNA, 32 nt, Human
uucugucuggggacgaaggguuggacgggaug

SEQ ID NO: 272237 - RNA, 32 nt, Human
uucugucugucaccaaguaucuugaagugaua

SEQ ID NO: 272238 - RNA, 32 nt, Human
uucugucuguucucuuuucucucccucccuca

SEQ ID NO: 272239 - RNA, 32 nt, Human
uucugucuucuccagaaggcaauaccaaccug

SEQ ID NO: 272240 - RNA, 32 nt, Human
uucugucuucucuugaacugcauaacugagaa

SEQ ID NO: 272241 - RNA, 32 nt, Human
uucugucuugcucuccccuccccuggcuuucc

SEQ ID NO: 272242 - RNA, 32 nt, Human
uucugugaagaauguuguugguaguuugauag

SEQ ID NO: 272243 - RNA, 32 nt, Human
uucugugaagacagaagaguaucaagauuaau

SEQ ID NO: 272244 - RNA, 32 nt, Human
uucugugacuccugucuccucuacaauguaca

SEQ ID NO: 272245 - RNA, 20 nt, Human
uucugugagacuggggccag

SEQ ID NO: 272246 - RNA, 31 nt, Human
uucugugagguggaaacagugguccugaauc

SEQ ID NO: 272247 - RNA, 32 nt, Human
uucugugagugggagagcaggaccgcggugcu

SEQ ID NO: 272248 - RNA, 32 nt, Human
uucugugauaaaauguaauuucaacuauuuug

SEQ ID NO: 272249 - RNA, 32 nt, Human
uucugugauccuggacaaguaacugaaucucu

SEQ ID NO: 272250 - RNA, 32 nt, Human
uucugugaucuaaaacaacucuuauugaauug

SEQ ID NO: 272251 - RNA, 32 nt, Human
uucugugauuggguaugucaaugauucucuuc

SEQ ID NO: 272252 - RNA, 32 nt, Human
uucugugcaacaguuuuucacugagcauguca

SEQ ID NO: 272253 - RNA, 32 nt, Human
uucugugcacacagccuucuccucgacucucu

SEQ ID NO: 272254 - RNA, 32 nt, Human
uucugugcacccaccaguacccugccauggga

SEQ ID NO: 272255 - RNA, 32 nt, Human
uucugugcacccuggucgcugggaaacguauu

SEQ ID NO: 272256 - RNA, 32 nt, Human
uucugugcauugcuguauacacacagacacac

SEQ ID NO: 272257 - RNA, 32 nt, Human
uucugugccaaugaacaagaacaaaagucauu

SEQ ID NO: 272258 - RNA, 32 nt, Human
uucugugccagccuggcucugccccuccccca

SEQ ID NO: 272259 - RNA, 32 nt, Human
uucugugcccugcugacgugacugacccgaga

SEQ ID NO: 272260 - RNA, 32 nt, Human
uucugugccugggguacucucgcucuguagac

SEQ ID NO: 272261 - RNA, 32 nt, Human
uucugugccuuuccagcuucuagaggcugccu

SEQ ID NO: 272262 - RNA, 32 nt, Human
uucugugcuggcugugccucuagucgcagcuc

SEQ ID NO: 272263 - RNA, 18 nt, Human
uucugugcugggcuccug

SEQ ID NO: 272264 - RNA, 32 nt, Human
uucugugcuuaaacuuucagaaacccaagggu

SEQ ID NO: 272265 - RNA, 32 nt, Human
uucugugcuuccugguuuugcaauuggauuga

SEQ ID NO: 272266 - RNA, 32 nt, Human
uucugugcuugcuguccuaccucucuccacag

SEQ ID NO: 272267 - RNA, 32 nt, Human
uucuguggaacaagccuaucagcuucagaaug

SEQ ID NO: 272268 - RNA, 32 nt, Human
uucuguggaagagagaaaaugagugaauauuc

SEQ ID NO: 272269 - RNA, 32 nt, Human
uucuguggaagaggcgcccacucccacuuuaa

SEQ ID NO: 272270 - RNA, 31 nt, Human
uucuguggacaaugccugcaucauuuuucag

SEQ ID NO: 272271 - RNA, 31 nt, Human
uucuguggagccuguuccucacuggaaauug

SEQ ID NO: 272272 - RNA, 32 nt, Human
uucuguggccacuguuaggucugccauuuuac

SEQ ID NO: 272273 - RNA, 32 nt, Human
uucuguggcccaggcuggagugcaguggcugu

SEQ ID NO: 272274 - RNA, 32 nt, Human
uucuguggccccggaggaaggagagacugagg

SEQ ID NO: 272275 - RNA, 32 nt, Human
uucuguggcccuggcuggaguucaguggugug

SEQ ID NO: 272276 - RNA, 32 nt, Human
uucuguggccugagaaggaagggaccuccacg

SEQ ID NO: 272277 - RNA, 32 nt, Human
uucuguggccuggacacaaccagcacagagcu

SEQ ID NO: 272278 - RNA, 32 nt, Human
uucuguggcggcuggaaguggacggagaucac

SEQ ID NO: 272279 - RNA, 32 nt, Human
uucuguggcugggaacaccuuccaccaugacc

SEQ ID NO: 272280 - RNA, 32 nt, Human
uucuguggcuucguggucacugcuccagccuc

SEQ ID NO: 272281 - RNA, 32 nt, Human
uucugugggaaucacaagaguuuauccacuaa

SEQ ID NO: 272282 - RNA, 32 nt, Human
uucugugggaggggcagagagguagguggcac

SEQ ID NO: 272283 - RNA, 32 nt, Human
uucugugggccuggcugggggcaguuaaaaag

SEQ ID NO: 272284 - RNA, 32 nt, Human
uucugugggcucuggaaggccaccaggguagg

SEQ ID NO: 272285 - RNA, 32 nt, Human
uucuguggggagagaaguugaaggaucccgaa

SEQ ID NO: 272286 - RNA, 32 nt, Human
uucuguggggucuuacuauauugcccaagccg

SEQ ID NO: 272287 - RNA, 32 nt, Human
uucugugggucgcucccagagccauggcccau

SEQ ID NO: 272288 - RNA, 32 nt, Human
uucugugggucugugguaucugacacugugga

SEQ ID NO: 272289 - RNA, 32 nt, Human
uucugugguccaggcuagagggcaguggcaug

SEQ ID NO: 272290 - RNA, 32 nt, Human
uucuguggucccagaccagcccucuucucccu

SEQ ID NO: 272291 - RNA, 32 nt, Human
uucugugguguuucauacucuacucagaguuc

SEQ ID NO: 272292 - RNA, 32 nt, Human
uucuguguccaguuuuggaggcugaguucugg

SEQ ID NO: 272293 - RNA, 32 nt, Human
uucugugucuacaccuagagagagggccagua

SEQ ID NO: 272294 - RNA, 32 nt, Human
uucugugucucccagcccauuuccacuccuag

SEQ ID NO: 272295 - RNA, 32 nt, Human
uucugugucuugguuucugccugcugcccacu

SEQ ID NO: 272296 - RNA, 32 nt, Human
uucuguguggauuugucugauugcuucagaca

SEQ ID NO: 272297 - RNA, 32 nt, Human
uucuguguguccgcccucccagcuccagcccu

SEQ ID NO: 272298 - RNA, 32 nt, Human
uucuguguucacagagcgugcugcagaucauc

SEQ ID NO: 272299 - RNA, 32 nt, Human
uucuguguucacugagaacagaaaggaagggg

SEQ ID NO: 272300 - RNA, 32 nt, Human
uucuguguucucuccauuugaguauuuuguaa

SEQ ID NO: 272301 - RNA, 32 nt, Human
uucuguguuuauaaaugcauuaucucugagaa

SEQ ID NO: 272302 - RNA, 32 nt, Human
uucuguuaaggccuagcccaggaaaagauguc

SEQ ID NO: 272303 - RNA, 31 nt, Human
uucuguuacacuacagauaccaaaacacuga

SEQ ID NO: 272304 - RNA, 32 nt, Human
uucuguuaucgggggcagaaagacugaagcac

SEQ ID NO: 272305 - RNA, 32 nt, Human
uucuguucaaugcaaauaaacauucacuuuuu

SEQ ID NO: 272306 - RNA, 32 nt, Human
uucuguucaguugcuaaugaggcuccuccgcu

SEQ ID NO: 272307 - RNA, 32 nt, Human
uucuguucauucuuuaaguaucuauauuucau

SEQ ID NO: 272308 - RNA, 32 nt, Human
uucuguuccaaagcagucuuauccugacagga

SEQ ID NO: 272309 - RNA, 32 nt, Human
uucuguuccucuuuugaacuuuuccuuuuguc

SEQ ID NO: 272310 - RNA, 32 nt, Human
uucuguuccuguguuaguuugcugagaaugau

SEQ ID NO: 272311 - RNA, 32 nt, Human
uucuguucucucuugcccaaauaauauuaaag

SEQ ID NO: 272312 - RNA, 32 nt, Human
uucuguucucuuccuccuccaucuuuauucau

SEQ ID NO: 272313 - RNA, 32 nt, Human
uucuguucucuuccugcccauuuccuugaacc

SEQ ID NO: 272314 - RNA, 32 nt, Human
uucuguucugcccaggccuucccaccaggaau

SEQ ID NO: 272315 - RNA, 32 nt, Human
uucuguucugggucugaauucccuuuugugcc

SEQ ID NO: 272316 - RNA, 32 nt, Human
uucuguucuguucauguagcacagauaagcau

SEQ ID NO: 272317 - RNA, 32 nt, Human
uucuguucuucccucacuccauccccgcuacc

SEQ ID NO: 272318 - RNA, 32 nt, Human
uucuguucuugcacguucuucucccaucuugg

SEQ ID NO: 272319 - RNA, 32 nt, Human
uucuguugaaggagagggugaggaagaaagag

SEQ ID NO: 272320 - RNA, 32 nt, Human
uucuguugaagggcuuaaccuggguccccuaa

SEQ ID NO: 272321 - RNA, 32 nt, Human
uucuguugacccuucaucugaaagauucucuu

SEQ ID NO: 272322 - RNA, 32 nt, Human
uucuguugauacacauucaggacucugguuuc

SEQ ID NO: 272323 - RNA, 32 nt, Human
uucuguugccacugcaaccuauuacuugguag

SEQ ID NO: 272324 - RNA, 32 nt, Human
uucuguugcccaaguuggagugcaguggcaug

SEQ ID NO: 272325 - RNA, 32 nt, Human
uucuguugcccagacuagaguacaauauugca

SEQ ID NO: 272326 - RNA, 32 nt, Human
uucuguugcccaggagggagugcaguggugca

SEQ ID NO: 272327 - RNA, 32 nt, Human
uucuguugcccaggcaagagugcagugguaug

SEQ ID NO: 272328 - RNA, 32 nt, Human
uucuguugcccaggcuggagugcaauggcaug

SEQ ID NO: 272329 - RNA, 32 nt, Human
uucuguugcccaggcuggagugcaguggcgug

SEQ ID NO: 272330 - RNA, 32 nt, Human
uucuguugcccaggcuggagugcaguggugcg

SEQ ID NO: 272331 - RNA, 32 nt, Human
uucuguugcccaggcuggccugaucuuggcuc

SEQ ID NO: 272332 - RNA, 32 nt, Human
uucuguugcccaugcuggagugcaguggcgug

SEQ ID NO: 272333 - RNA, 32 nt, Human
uucuguugccuaggccagagugcaguggcaug

SEQ ID NO: 272334 - RNA, 32 nt, Human
uucuguugccuaggcuggagugcaguggcgca

SEQ ID NO: 272335 - RNA, 32 nt, Human
uucuguugccugggcuggagugcaguggcaug

SEQ ID NO: 272336 - RNA, 32 nt, Human
uucuguugccugggcuggagugcaguggcgug

SEQ ID NO: 272337 - RNA, 32 nt, Human
uucuguugcuagaccgagccugugggauauac

SEQ ID NO: 272338 - RNA, 24 nt, Human
uucuguugcuccgcauaacugugg

SEQ ID NO: 272339 - RNA, 32 nt, Human
uucuguugcuccugccuuauuucucuuucaac

SEQ ID NO: 272340 - RNA, 24 nt, Human
uucuguuggcuccaccuccagccu

SEQ ID NO: 272341 - RNA, 32 nt, Human
uucuguugggguucagaacacaauaccccaaa

SEQ ID NO: 272342 - RNA, 32 nt, Human
uucuguuguccaggauggagugcagugguuga

SEQ ID NO: 272343 - RNA, 32 nt, Human
uucuguuguuucugcugacuguguggguggaa

SEQ ID NO: 272344 - RNA, 32 nt, Human
uucuguuguuuuuauagcaggguugggguggu

SEQ ID NO: 272345 - RNA, 32 nt, Human
uucuguuuagagauucuagcccauggguuauc

SEQ ID NO: 272346 - RNA, 32 nt, Human
uucuguuuauucacacuaaugagccagagcug

SEQ ID NO: 272347 - RNA, 32 nt, Human
uucuguuuauugaaccucuuuauuaaaccucu

SEQ ID NO: 272348 - RNA, 32 nt, Human
uucuguuuauuuucucuuuuccucccccaucc

SEQ ID NO: 272349 - RNA, 32 nt, Human
uucuguuuccaaagggagaucucuguggcccu

SEQ ID NO: 272350 - RNA, 32 nt, Human
uucuguuucccaaagcgcuggugugacugugg

SEQ ID NO: 272351 - RNA, 32 nt, Human
uucuguuucccaggcuggagugcagugguggg

SEQ ID NO: 272352 - RNA, 32 nt, Human
uucuguuucccauuacuuuaauacucaccccc

SEQ ID NO: 272353 - RNA, 32 nt, Human
uucuguuuccuuccuuucuauuaauuuggaaa

SEQ ID NO: 272354 - RNA, 32 nt, Human
uucuguuucuaaauaaaagcugugccuucuga

SEQ ID NO: 272355 - RNA, 32 nt, Human
uucuguuucuaaucccagccugggcaggaaug

SEQ ID NO: 272356 - RNA, 32 nt, Human
uucuguuucuccccuuggcugccuguaagccc

SEQ ID NO: 272357 - RNA, 32 nt, Human
uucuguuucuccccuuggcugccuguacgccc

SEQ ID NO: 272358 - RNA, 32 nt, Human
uucuguuucugagugagaagauaaaaacugcc

SEQ ID NO: 272359 - RNA, 22 nt, Human
uucuguuugcuccagacugggg

SEQ ID NO: 272360 - RNA, 20 nt, Human
uucuguuugcugccugaaag

SEQ ID NO: 272361 - RNA, 32 nt, Human
uucuguuuuaaaggagguauuuuggaaauuga

SEQ ID NO: 272362 - RNA, 32 nt, Human
uucuguuuuagaguguuucugggccaggaucc

SEQ ID NO: 272363 - RNA, 32 nt, Human
uucuguuuuaugggagaggucuguuggcaaag

SEQ ID NO: 272364 - RNA, 32 nt, Human
uucuguuuucuaaaggacaaaauacagagugu

SEQ ID NO: 272365 - RNA, 32 nt, Human
uucuguuuucuaccucuccaggccugcccacu

SEQ ID NO: 272366 - RNA, 32 nt, Human
uucuguuuucuggaaguugcuggagaagggcu

SEQ ID NO: 272367 - RNA, 32 nt, Human
uucuguuuugagauggagucucucucugucac

SEQ ID NO: 272368 - RNA, 32 nt, Human
uucuguuuugcaccugcagaucaccgaguugg

SEQ ID NO: 272369 - RNA, 32 nt, Human
uucuguuuuguugacucuugaaugcuccccca

SEQ ID NO: 272370 - RNA, 32 nt, Human
uucuguuuuuccuaccucuuaggcugguccuu

SEQ ID NO: 272371 - RNA, 32 nt, Human
uucuguuuuugagacacuuuucugccuucuau

SEQ ID NO: 272372 - RNA, 32 nt, Human
uucuuaaaaaggacaaugcugauggaagacca

SEQ ID NO: 272373 - RNA, 32 nt, Human
uucuuaaaaauguauuuuauuuuagccagugg

SEQ ID NO: 272374 - RNA, 32 nt, Human
uucuuaaaaauuguacuuacugccuuuccaug

SEQ ID NO: 272375 - RNA, 32 nt, Human
uucuuaaaacaacagcaacgugaucuuggcug

SEQ ID NO: 272376 - RNA, 32 nt, Human
uucuuaaaacauuuuaacauuagaauggauug

SEQ ID NO: 272377 - RNA, 32 nt, Human
uucuuaaaccacaaaacaucaaguauuccaag

SEQ ID NO: 272378 - RNA, 23 nt, Human
uucuuaaaccaggcuguggcagg

SEQ ID NO: 272379 - RNA, 32 nt, Human
uucuuaaacugauuaacuagcuguaauauagu

SEQ ID NO: 272380 - RNA, 27 nt, Human
uucuuaaacuuuuuagaggguggcagg

SEQ ID NO: 272381 - RNA, 32 nt, Human
uucuuaaagauaauuaaaaaugaaacaaagug

SEQ ID NO: 272382 - RNA, 32 nt, Human
uucuuaaauguggcuaauucuguaacauaguc

SEQ ID NO: 272383 - RNA, 32 nt, Human
uucuuaacaagugucuaaagacaguaggcugu

SEQ ID NO: 272384 - RNA, 22 nt, Human
uucuuaacaauuugacccucca

SEQ ID NO: 272385 - RNA, 32 nt, Human
uucuuaacauugcagcuuucucuccaucugca

SEQ ID NO: 272386 - RNA, 28 nt, Human
uucuuaaccaaggcugccucuuccaaca

SEQ ID NO: 272387 - RNA, 32 nt, Human
uucuuaaccaucagccaugugcugcuauuucu

SEQ ID NO: 272388 - RNA, 32 nt, Human
uucuuaaccugcuuuuucagcaacuaaaacca

SEQ ID NO: 272389 - RNA, 32 nt, Human
uucuuaacuccucuguccucuauauucagcau

SEQ ID NO: 272390 - RNA, 32 nt, Human
uucuuaacuggguggagaaagaauggaaaacc

SEQ ID NO: 272391 - RNA, 32 nt, Human
uucuuaagaaaugcgccaguguuuaugagguu

SEQ ID NO: 272392 - RNA, 32 nt, Human
uucuuaagaauguacacuuggccaggugcagu

SEQ ID NO: 272393 - RNA, 24 nt, Human
uucuuaagcagaggaguggcaagg

SEQ ID NO: 272394 - RNA, 21 nt, Human
uucuuaagcucacagagucag

SEQ ID NO: 272395 - RNA, 32 nt, Human
uucuuaaggacuuugugugaaguaauucuuua

SEQ ID NO: 272396 - RNA, 32 nt, Human
uucuuaaguguggaaucaaaugagcacauaag

SEQ ID NO: 272397 - RNA, 32 nt, Human
uucuuaauacgugcaacaucuuaauuuuuguu

SEQ ID NO: 272398 - RNA, 32 nt, Human
uucuuaauaguuacaguugggcaugauuugua

SEQ ID NO: 272399 - RNA, 32 nt, Human
uucuuaaucuuuauccaauaaaaugaaacaaa

SEQ ID NO: 272400 - RNA, 32 nt, Human
uucuuaaugcuguauuuguucaucucaaaccu

SEQ ID NO: 272401 - RNA, 32 nt, Human
uucuuaauguuuguggcuuucucuccagccuc

SEQ ID NO: 272402 - RNA, 22 nt, Human
uucuuaauucauuucaccuucc

SEQ ID NO: 272403 - RNA, 32 nt, Human
uucuuaauugaaagacuucccccaaaaggaag

SEQ ID NO: 272404 - RNA, 23 nt, Human
uucuuacacacgcugaguacaga

SEQ ID NO: 272405 - RNA, 32 nt, Human
uucuuacacagaaacauacacauaccgagaaa

SEQ ID NO: 272406 - RNA, 32 nt, Human
uucuuacacagaaacaugcacauacccagaaa

SEQ ID NO: 272407 - RNA, 32 nt, Human
uucuuacacagcagccuuacuucaucggccca

SEQ ID NO: 272408 - RNA, 32 nt, Human
uucuuacacaggcuucaucaagguucagcuga

SEQ ID NO: 272409 - RNA, 32 nt, Human
uucuuacaccgucuccacuuguggagagccac

SEQ ID NO: 272410 - RNA, 32 nt, Human
uucuuacagaggagauggagugcuaugagcau

SEQ ID NO: 272411 - RNA, 32 nt, Human
uucuuacagcuauucugggccuggauggucua

SEQ ID NO: 272412 - RNA, 32 nt, Human
uucuuacaggaaccaccuacucuuucaguuuu

SEQ ID NO: 272413 - RNA, 32 nt, Human
uucuuacagucccugucauauuaccaacagag

SEQ ID NO: 272414 - RNA, 31 nt, Human
uucuuacauacuucuguguuuaaauuuucau

SEQ ID NO: 272415 - RNA, 32 nt, Human
uucuuacauggcagcaagagaaaaugaggaag

SEQ ID NO: 272416 - RNA, 32 nt, Human
uucuuaccaaagaaaaugaaaagaucuuaucc

SEQ ID NO: 272417 - RNA, 32 nt, Human
uucuuaccaugcuaauauguaaaguucaugcc

SEQ ID NO: 272418 - RNA, 32 nt, Human
uucuuacccagcccuggucaagaaucugugag

SEQ ID NO: 272419 - RNA, 32 nt, Human
uucuuaccucaaggcucugucuagccauguua

SEQ ID NO: 272420 - RNA, 32 nt, Human
uucuuaccuccccuaacuugcuuucccuguuu

SEQ ID NO: 272421 - RNA, 32 nt, Human
uucuuaccugggaaccuaauuccccagaagcu

SEQ ID NO: 272422 - RNA, 32 nt, Human
uucuuacgaucaaauuugucucuugcaaugau

SEQ ID NO: 272423 - RNA, 32 nt, Human
uucuuacgcagcuggggccaggagggucagag

SEQ ID NO: 272424 - RNA, 32 nt, Human
uucuuacgugaacuguauacauucauauagaa

SEQ ID NO: 272425 - RNA, 32 nt, Human
uucuuacuaagcuaaguuguauacaaccccac

SEQ ID NO: 272426 - RNA, 32 nt, Human
uucuuacuccagcucaacccauuggguguugg

SEQ ID NO: 272427 - RNA, 32 nt, Human
uucuuacugagcaccugcugggcaugcugugu

SEQ ID NO: 272428 - RNA, 32 nt, Human
uucuuacugcaaccuucgccucccgaguucaa

SEQ ID NO: 272429 - RNA, 32 nt, Human
uucuuacuuaaacuuggucuucuuucaaguug

SEQ ID NO: 272430 - RNA, 32 nt, Human
uucuuacuucugucacucuuccuucuccagcc

SEQ ID NO: 272431 - RNA, 32 nt, Human
uucuuacuucuuuucucucuuauuuauuaacc

SEQ ID NO: 272432 - RNA, 32 nt, Human
uucuuagaaaugcagaccugugggcucuacca

SEQ ID NO: 272433 - RNA, 32 nt, Human
uucuuagaauacagugcucacugcauuuaaua

SEQ ID NO: 272434 - RNA, 32 nt, Human
uucuuagacauuuugucauaccauucuagaag

SEQ ID NO: 272435 - RNA, 32 nt, Human
uucuuagagaucuggccacuggucaaacagua

SEQ ID NO: 272436 - RNA, 32 nt, Human
uucuuagagcuuucuaaagaacaggaaguagg

SEQ ID NO: 272437 - RNA, 32 nt, Human
uucuuagaggguucagucuaggacccggcucu

SEQ ID NO: 272438 - RNA, 32 nt, Human
uucuuagauaucuuauucuuaguaauacuacu

SEQ ID NO: 272439 - RNA, 32 nt, Human
uucuuagauuuggcaucugaggguauaaaggc

SEQ ID NO: 272440 - RNA, 32 nt, Human
uucuuagcaacagaaaaaucaaacuucuguua

SEQ ID NO: 272441 - RNA, 32 nt, Human
uucuuagcacucuucccuccccuaaaccaucc

SEQ ID NO: 272442 - RNA, 32 nt, Human
uucuuagcagccgccgcagcagccgcggcgac

SEQ ID NO: 272443 - RNA, 32 nt, Human
uucuuagcagugaguuucuguucuguuggaug

SEQ ID NO: 272444 - RNA, 32 nt, Human
uucuuagcaguuuuauaacccuuuuuccucaa

SEQ ID NO: 272445 - RNA, 32 nt, Human
uucuuagcaugagcuaccucaucucuagaagc

SEQ ID NO: 272446 - RNA, 32 nt, Human
uucuuagccuuacuugaaucuugccuauaaua

SEQ ID NO: 272447 - RNA, 32 nt, Human
uucuuagcuaucauugcuuccuccuccccaac

SEQ ID NO: 272448 - RNA, 32 nt, Human
uucuuaggcuuccucagcuauguggaggugua

SEQ ID NO: 272449 - RNA, 32 nt, Human
uucuuaggucccuguccucugucuuugaggcu

SEQ ID NO: 272450 - RNA, 32 nt, Human
uugagccugggaggucaaggcugcagugagcc

SEQ ID NO: 272451 - RNA, 32 nt, Human
uugagccugggaggucaaggcugcagugagcu

SEQ ID NO: 272452 - RNA, 32 nt, Human
uugagccugggaggucgaggcugcagugagcu

SEQ ID NO: 272453 - RNA, 32 nt, Human
uugagccugggaggucgaggcuguagugagcc

SEQ ID NO: 272454 - RNA, 32 nt, Human
uugagccugggaggucgaggcuguagugagcu

SEQ ID NO: 272455 - RNA, 32 nt, Human
uugagccugggagguggagguugcagugagcu

SEQ ID NO: 272456 - RNA, 32 nt, Human
uugagccugggagguggagguugcagugagug

SEQ ID NO: 272457 - RNA, 32 nt, Human
uugagccugggagguugaggcugcagugagcc

SEQ ID NO: 272458 - RNA, 32 nt, Human
uugagccugggagguugugguugcagugagcu

SEQ ID NO: 272459 - RNA, 32 nt, Human
uugagccugggaguucaagaccagccugggca

SEQ ID NO: 272460 - RNA, 32 nt, Human
uugagccugggaguuggagaccagccugggca

SEQ ID NO: 272461 - RNA, 32 nt, Human
uugagccugggaguuugagaccagccugggca

SEQ ID NO: 272462 - RNA, 32 nt, Human
uugagccugggaguuugaggcugcagugagcu

SEQ ID NO: 272463 - RNA, 32 nt, Human
uugagccugggaugucaaggcugcagugagcu

SEQ ID NO: 272464 - RNA, 24 nt, Human
uugagccugggcaacagagugaga

SEQ ID NO: 272465 - RNA, 32 nt, Human
uugagccugggcaggcucuguggagcucacca

SEQ ID NO: 272466 - RNA, 24 nt, Human
uugagccugggcgacagagcgaga

SEQ ID NO: 272467 - RNA, 32 nt, Human
uugagccugggcgacagagcgagacuccaucu

SEQ ID NO: 272468 - RNA, 24 nt, Human
uugagccugggcgacagagugaga

SEQ ID NO: 272469 - RNA, 32 nt, Human
uugagccugggggacugaggcugcagugagcc

SEQ ID NO: 272470 - RNA, 32 nt, Human
uugagccugugaggucgaggcuacagugagca

SEQ ID NO: 272471 - RNA, 32 nt, Human
uugagccugugaggucgaggcugcagugagcc

SEQ ID NO: 272472 - RNA, 32 nt, Human
uugagccuuuagggagcuucucuguuuuggga

SEQ ID NO: 272473 - RNA, 32 nt, Human
uugagcgaauguauggaagaaaauauuauucu

SEQ ID NO: 272474 - RNA, 32 nt, Human
uugagcgagagggaggaagggcgcgcgggccg

SEQ ID NO: 272475 - RNA, 32 nt, Human
uugagcgagggaaguugaggcugcagugaacu

SEQ ID NO: 272476 - RNA, 32 nt, Human
uugagcggcugaggcaggagaauugcuugaac

SEQ ID NO: 272477 - RNA, 32 nt, Human
uugagcgggaggaggaggaggagcggcggcgc

SEQ ID NO: 272478 - RNA, 32 nt, Human
uugagcgguugaauugggagaaugaagauaag

SEQ ID NO: 272479 - RNA, 32 nt, Human
uugagcuacuaaaaagcagaauuccggagcuu

SEQ ID NO: 272480 - RNA, 32 nt, Human
uugagcuagggagguggugcagucagccucgc

SEQ ID NO: 272481 - RNA, 32 nt, Human
uugagcuaucuacaaccucccacggcagcccg

SEQ ID NO: 272482 - RNA, 32 nt, Human
uugagcuaucuguggccagggugcuggcaugg

SEQ ID NO: 272483 - RNA, 32 nt, Human
uugagcucaaagcuuagcagcuucaauguugu

SEQ ID NO: 272484 - RNA, 32 nt, Human
uugagcucaacaguuccagaccagccugggca

SEQ ID NO: 272485 - RNA, 32 nt, Human
uugagcucaagaguucaagaccagccugggaa

SEQ ID NO: 272486 - RNA, 32 nt, Human
uugagcucaagcaauccaccugccucaaccuc

SEQ ID NO: 272487 - RNA, 32 nt, Human
uugagcucagccuguucucagcaguagagaaa

SEQ ID NO: 272488 - RNA, 32 nt, Human
uugagcucaggagcuugagaccagccugggca

SEQ ID NO: 272489 - RNA, 32 nt, Human
uugagcucaggagguugaggcugcagagagug

SEQ ID NO: 272490 - RNA, 32 nt, Human
uugagcucaggaguccuaaaccagccugggca

SEQ ID NO: 272491 - RNA, 32 nt, Human
uugagcucaggaguuagagaccagccugggca

SEQ ID NO: 272492 - RNA, 32 nt, Human
uugagcucaggaguucaagaccagccuaggca

SEQ ID NO: 272493 - RNA, 32 nt, Human
uugagcucaggaguucaagaccagccuaggcc

SEQ ID NO: 272494 - RNA, 32 nt, Human
uugagcucaggaguucaagaccagccuggaca

SEQ ID NO: 272495 - RNA, 32 nt, Human
uugagcucaggaguucaagaccagccugggca

SEQ ID NO: 272496 - RNA, 32 nt, Human
uugagcucaggaguucaagaccagcuugggaa

SEQ ID NO: 272497 - RNA, 32 nt, Human
uugagcucaggaguucaaggcugcagagagcu

SEQ ID NO: 272498 - RNA, 32 nt, Human
uugagcucaggaguuccagaccagcccgggcc

SEQ ID NO: 272499 - RNA, 32 nt, Human
uugagcucaggaguuccagaccagccugggca

SEQ ID NO: 272500 - RNA, 32 nt, Human
uugagcucaggaguuccauaccagccugggca

SEQ ID NO: 272501 - RNA, 32 nt, Human
uugagcucaggaguucgagaccaccuugggcc

SEQ ID NO: 272502 - RNA, 32 nt, Human
uugagcucaggaguucgagaccagccugggca

SEQ ID NO: 272503 - RNA, 32 nt, Human
uugagcucaggaguucgugaccagccugggca

SEQ ID NO: 272504 - RNA, 32 nt, Human
uugagcucaggaguuucagaccagccugggca

SEQ ID NO: 272505 - RNA, 32 nt, Human
uugagcucaggaguuugagaccagccugagca

SEQ ID NO: 272506 - RNA, 32 nt, Human
uugagcucaggaguuugagaccagccugggca

SEQ ID NO: 272507 - RNA, 32 nt, Human
uugagcucaggaguuugagaccagcugggcaa

SEQ ID NO: 272508 - RNA, 32 nt, Human
uugagcucaggaguuugagaccagcuugggua

SEQ ID NO: 272509 - RNA, 32 nt, Human
uugagcucaggaguuugaggccaggcugggca

SEQ ID NO: 272510 - RNA, 32 nt, Human
uugagcucaggcguucgggaccagccuggcca

SEQ ID NO: 272511 - RNA, 32 nt, Human
uugagcucagggggccaaggcugcagugaguc

SEQ ID NO: 272512 - RNA, 32 nt, Human
uugagcucaguaguucaagaccagccuaggca

SEQ ID NO: 272513 - RNA, 32 nt, Human
uugagcucaugaguucaagaccagucugggca

SEQ ID NO: 272514 - RNA, 32 nt, Human
uugagcucauucucacaccucauuagacauaa

SEQ ID NO: 272515 - RNA, 32 nt, Human
uugagcuccaagcacagcaaagccugacagaa

SEQ ID NO: 272516 - RNA, 32 nt, Human
uugagcuccggagcuugagaccagccugagca

SEQ ID NO: 272517 - RNA, 32 nt, Human
uugagcuccuguagccucugcagcugcccauu

SEQ ID NO: 272518 - RNA, 32 nt, Human
uugagcucggaagauggaggcugcagugagcc

SEQ ID NO: 272519 - RNA, 32 nt, Human
uugagcucgggaguuugagaccagccucauca

SEQ ID NO: 272520 - RNA, 32 nt, Human
uugagcucugaaugucaagaccaguccuggac

SEQ ID NO: 272521 - RNA, 32 nt, Human
uugagcucuggaguuugagaccagccugggca

SEQ ID NO: 272522 - RNA, 32 nt, Human
uugagcucugguuugaaaguagccaaggggac

SEQ ID NO: 272523 - RNA, 32 nt, Human
uugagcugaaacauugcuuccacccaccauca

SEQ ID NO: 272524 - RNA, 32 nt, Human
uugagcugacuuuagagaucacugugggguca

SEQ ID NO: 272525 - RNA, 32 nt, Human
uugagcugaggaguucaagaccagccugggca

SEQ ID NO: 272526 - RNA, 32 nt, Human
uugagcugaggaguuugagaccagccugggca

SEQ ID NO: 272527 - RNA, 32 nt, Human
uugagcugaugguucccagccugcugugaaga

SEQ ID NO: 272528 - RNA, 32 nt, Human
uugagcugcacuggccccggugcuggcaucug

SEQ ID NO: 272529 - RNA, 32 nt, Human
uugagcugccagguugucuucaucucagaacu

SEQ ID NO: 272530 - RNA, 22 nt, Human
uugagcuggaagcguagggcug

SEQ ID NO: 272531 - RNA, 32 nt, Human
uugagcugggaguucaagaccagucugagcaa

SEQ ID NO: 272532 - RNA, 32 nt, Human
uugagcuggggagauggaggcugcagugagcu

SEQ ID NO: 272533 - RNA, 32 nt, Human
uugagcugucucagugggauaaguuugaaauu

SEQ ID NO: 272534 - RNA, 32 nt, Human
uugagcugugugaccuuggguaaguaacuuaa

SEQ ID NO: 272535 - RNA, 32 nt, Human
uugagcuguguggggucagcugugcugccagg

SEQ ID NO: 272536 - RNA, 32 nt, Human
uugagcuuaaguguuccuccuaccucggccuc

SEQ ID NO: 272537 - RNA, 32 nt, Human
uugagcuuaggagguugaggcugcagugagcu

SEQ ID NO: 272538 - RNA, 32 nt, Human
uugagcuuaggaguuugagaccagccugggca

SEQ ID NO: 272539 - RNA, 23 nt, Human
uugagcuucacagugucaggcug

SEQ ID NO: 272540 - RNA, 32 nt, Human
uugagcuucugguuuggaaacagcaagaccca

SEQ ID NO: 272541 - RNA, 32 nt, Human
uugagcuucuguuuccugauuuggaguauaca

SEQ ID NO: 272542 - RNA, 32 nt, Human
uugagcuugagagguugaagcugcagugagcu

SEQ ID NO: 272543 - RNA, 32 nt, Human
uugagcuuggccgcccuccacgccccaugcug

SEQ ID NO: 272544 - RNA, 32 nt, Human
uugagcuugggaagucgaggcugcagucagcc

SEQ ID NO: 272545 - RNA, 32 nt, Human
uugagcuugggagaucgaggcuacagugagcu

SEQ ID NO: 272546 - RNA, 32 nt, Human
uugagcuugggaguucaagaccagccugagag

SEQ ID NO: 272547 - RNA, 24 nt, Human
uugagcuugggugacagaguaaga

SEQ ID NO: 272548 - RNA, 32 nt, Human
uugagcuuugggccucaguugcccuggcagaa

SEQ ID NO: 272549 - RNA, 32 nt, Human
uugaggaagaagcacuaugucuggggccaagu

SEQ ID NO: 272550 - RNA, 32 nt, Human
uugaggaagagucuugguuucucucuacagug

SEQ ID NO: 272551 - RNA, 32 nt, Human
uugaggaauuccaccagcuugaagauggcuga

SEQ ID NO: 272552 - RNA, 32 nt, Human
uugaggaauuucuguucuggggcuuguccuuc

SEQ ID NO: 272553 - RNA, 32 nt, Human
uugaggacagcccaucucccuucaagaacccu

SEQ ID NO: 272554 - RNA, 32 nt, Human
uugaggacccccacccuccugcauccucucuc

SEQ ID NO: 272555 - RNA, 32 nt, Human
uugaggacgcccagaggugauacugacgaugc

SEQ ID NO: 272556 - RNA, 32 nt, Human
uugaggacucagaggaacuggcagcucagcug

SEQ ID NO: 272557 - RNA, 32 nt, Human
uugaggacugaagcuggggcuuggggauugcc

SEQ ID NO: 272558 - RNA, 22 nt, Human
uugaggacuguuucaaaaccac

SEQ ID NO: 272559 - RNA, 31 nt, Human
uugaggagaaagggccuacucauuugcaaug

SEQ ID NO: 272560 - RNA, 31 nt, Human
uugaggagaagugaaguuucacugugguaug

SEQ ID NO: 272561 - RNA, 32 nt, Human
uugaggagccgcugcccccgcucccugaagau

SEQ ID NO: 272562 - RNA, 32 nt, Human
uugaggagccuccuggggaauuggaggauuaa

SEQ ID NO: 272563 - RNA, 32 nt, Human
uugaggaggaaaucaguaacaaaaagacaauu

SEQ ID NO: 272564 - RNA, 32 nt, Human
uugaggaggagaagggaggaggugggggagga

SEQ ID NO: 272565 - RNA, 32 nt, Human
uugaggaggccgccacggcagcgcgggagcgg

SEQ ID NO: 272566 - RNA, 32 nt, Human
uugaggagggcagcucaagccacagaguccag

SEQ ID NO: 272567 - RNA, 32 nt, Human
uugaggaggucugauuuucaggcuuuggauuu

SEQ ID NO: 272568 - RNA, 32 nt, Human
uugaggagugaggaaggcaggaagagagcaug

SEQ ID NO: 272569 - RNA, 32 nt, Human
uugaggagugauuuucuuuccuuucccuugaa

SEQ ID NO: 272570 - RNA, 32 nt, Human
uugaggaguuucauucuacaguuuacaaggug

SEQ ID NO: 272571 - RNA, 32 nt, Human
uugaggauaauaaaggugugugaucugguuug

SEQ ID NO: 272572 - RNA, 32 nt, Human
uugaggauggggccguguuagcagguuacucu

SEQ ID NO: 272573 - RNA, 22 nt, Human
uugaggauguccagagcagaau

SEQ ID NO: 272574 - RNA, 17 nt, Human
uugaggauguccaguca

SEQ ID NO: 272575 - RNA, 32 nt, Human
uugaggauguuaccuacuaaacugaaaacauu

SEQ ID NO: 272576 - RNA, 32 nt, Human
uugaggauugcaaccgcugccuccagggucca

SEQ ID NO: 272577 - RNA, 32 nt, Human
uugaggcaaagcauucauccuacaucauaaaa

SEQ ID NO: 272578 - RNA, 32 nt, Human
uugaggcaaauuaaguguauguguguagguua

SEQ ID NO: 272579 - RNA, 32 nt, Human
uugaggcacaccucagacugaaugagucagaa

SEQ ID NO: 272580 - RNA, 32 nt, Human
uugaggcaccuugagugcaucucaguucagcu

SEQ ID NO: 272581 - RNA, 32 nt, Human
uugaggcagaacuaaguuuacagggaaaggua

SEQ ID NO: 272582 - RNA, 32 nt, Human
uugaggcagaguuuugcucuuguugcccaggc

SEQ ID NO: 272583 - RNA, 31 nt, Human
uugaggcagauccuggcacuaccucacagcu

SEQ ID NO: 272584 - RNA, 21 nt, Human
uugaggcagggucucacucug

SEQ ID NO: 272585 - RNA, 32 nt, Human
uugaggcauaccacccucaaaaaccuauuugu

SEQ ID NO: 272586 - RNA, 32 nt, Human
uugaggcaugcugggccuggugcagugauggc

SEQ ID NO: 272587 - RNA, 32 nt, Human
uugaggccaagagaucaagaccagucugggca

SEQ ID NO: 272588 - RNA, 32 nt, Human
uugaggccaagaguuaaagaccagccugguca

SEQ ID NO: 272589 - RNA, 32 nt, Human
uugaggccaagaguucaagaccagccugggca

SEQ ID NO: 272590 - RNA, 32 nt, Human
uugaggccaagaguuucagaccagccugggca

SEQ ID NO: 272591 - RNA, 32 nt, Human
uugaggccacagaacucccuggggcuggggcc

SEQ ID NO: 272592 - RNA, 32 nt, Human
uugaggccacuugcacugaguccucuacaggg

SEQ ID NO: 272593 - RNA, 32 nt, Human
uugaggccagaagugcaagaccagccugcgca

SEQ ID NO: 272594 - RNA, 32 nt, Human
uugaggccagaaguucaagaccauccucagca

SEQ ID NO: 272595 - RNA, 23 nt, Human
uugaggccagacugggcaauaua

SEQ ID NO: 272596 - RNA, 32 nt, Human
uugaggccagagguucaagaccagccugggca

SEQ ID NO: 272597 - RNA, 32 nt, Human
uugaggccagcaguucaagaccaaccuaggca

SEQ ID NO: 272598 - RNA, 32 nt, Human
uugaggccagcaguuugagaccagccuggcca

SEQ ID NO: 272599 - RNA, 32 nt, Human
uugaggccagcccuagccaacaugguguaaac

SEQ ID NO: 272600 - RNA, 32 nt, Human
uugaggccagccuggccaacauggcaaaaccc

SEQ ID NO: 272601 - RNA, 32 nt, Human
uugaggccagccuggccaacauggcgaaaccc

SEQ ID NO: 272602 - RNA, 32 nt, Human
uugaggccagccugggaaauauagugagaccc

SEQ ID NO: 272603 - RNA, 23 nt, Human
uugaggccagccugggcaacaua

SEQ ID NO: 272604 - RNA, 32 nt, Human
uugaggccagccugggcaacauagugagaccc

SEQ ID NO: 272605 - RNA, 32 nt, Human
uugaggccaggaauucaagaccagccuggcca

SEQ ID NO: 272606 - RNA, 32 nt, Human
uugaggccaggaauucgagaccagccuggcaa

SEQ ID NO: 272607 - RNA, 32 nt, Human
uugaggccaggaauucgagaccagccuggcca

SEQ ID NO: 272608 - RNA, 32 nt, Human
uugaggccaggaauucgagaccagccugggca

SEQ ID NO: 272609 - RNA, 32 nt, Human
uugaggccaggaggucaauaccagccugggca

SEQ ID NO: 272610 - RNA, 32 nt, Human
uugaggccaggagguugaggcugcagugagcu

SEQ ID NO: 272611 - RNA, 32 nt, Human
uugaggccaggaguuagagaccagccuggcca

SEQ ID NO: 272612 - RNA, 32 nt, Human
uugaggccaggaguuagagacugcagugagcu

SEQ ID NO: 272613 - RNA, 32 nt, Human
uugaggccaggaguucaagaccagccagggca

SEQ ID NO: 272614 - RNA, 32 nt, Human
uugaggccaggaguucaagaccagcccaggca

SEQ ID NO: 272615 - RNA, 32 nt, Human
uugaggccaggaguucaagaccagccuggcca

SEQ ID NO: 272616 - RNA, 32 nt, Human
uugaggccaggaguucaagaccagccugggca

SEQ ID NO: 272617 - RNA, 32 nt, Human
uugaggccaggaguucaagaccagcuuggcca

SEQ ID NO: 272618 - RNA, 32 nt, Human
uugaggccaggaguucaagaccagucuggcca

SEQ ID NO: 272619 - RNA, 32 nt, Human
uugaggccaggaguucaagaccagucugggca

SEQ ID NO: 272620 - RNA, 32 nt, Human
uugaggccaggaguucaagaccggccuggcca

SEQ ID NO: 272621 - RNA, 32 nt, Human
uugaggccaggaguucaaggcuauagugugcu

SEQ ID NO: 272622 - RNA, 32 nt, Human
uugaggccaggaguucaggaccagccugggca

SEQ ID NO: 272623 - RNA, 32 nt, Human
uugaggccaggaguuccagaccagccuggcca

SEQ ID NO: 272624 - RNA, 32 nt, Human
uugaggccaggaguuccagaccagccugggca

SEQ ID NO: 272625 - RNA, 32 nt, Human
uugaggccaggaguuccagaccagccugggua

SEQ ID NO: 272626 - RNA, 32 nt, Human
uugaggccaggaguucgagaccagccuaguuc

SEQ ID NO: 272627 - RNA, 32 nt, Human
uugaggccaggaguucgagaccagccucagca

SEQ ID NO: 272628 - RNA, 32 nt, Human
uugaggccaggaguucgagaccagccugaaca

SEQ ID NO: 272629 - RNA, 32 nt, Human
uugaggccaggaguucgagaccagccugagca

SEQ ID NO: 272630 - RNA, 32 nt, Human
uugaggccaggaguucgagaccagccuggaca

SEQ ID NO: 272631 - RNA, 32 nt, Human
uugaggccaggaguucgagaccagccuggcca

SEQ ID NO: 272632 - RNA, 32 nt, Human
uugaggccaggaguucgagaccagccugggca

SEQ ID NO: 272633 - RNA, 32 nt, Human
uugaggccaggaguucgagaccagccugguca

SEQ ID NO: 272634 - RNA, 32 nt, Human
uugaggccaggaguucgagaccagccuggucc

SEQ ID NO: 272635 - RNA, 32 nt, Human
uugaggccaggaguucgagaccagccuguuca

SEQ ID NO: 272636 - RNA, 32 nt, Human
uugaggccaggaguucgauaccagccuggcca

SEQ ID NO: 272637 - RNA, 32 nt, Human
uugaggccaggaguucuagaccagccuggcca

SEQ ID NO: 272638 - RNA, 32 nt, Human
uugaggccaggaguugcagaccagccugggua

SEQ ID NO: 272639 - RNA, 32 nt, Human
uugaggccaggaguuggagaccagccuggcca

SEQ ID NO: 272640 - RNA, 32 nt, Human
uugaggccaggaguuggagaccagccugggca

SEQ ID NO: 272641 - RNA, 32 nt, Human
uugaggccaggaguuuaagaccagccugggca

SEQ ID NO: 272642 - RNA, 32 nt, Human
uugaggccaggaguuugaaaccagccuggcca

SEQ ID NO: 272643 - RNA, 32 nt, Human
uugaggccaggaguuugagaccagccugagug

SEQ ID NO: 272644 - RNA, 32 nt, Human
uugaggccaggaguuugagaccagccuggcaa

SEQ ID NO: 272645 - RNA, 32 nt, Human
uugaggccaggaguuugagaccagccuggcca

SEQ ID NO: 272646 - RNA, 32 nt, Human
uugaggccaggaguuugagaccagccugggca

SEQ ID NO: 272647 - RNA, 32 nt, Human
uugaggccaggaguuugagaccagcuugggca

SEQ ID NO: 272648 - RNA, 32 nt, Human
uugaggccaggaguuugaggccagcuagagug

SEQ ID NO: 272649 - RNA, 32 nt, Human
uugaggccaggaguuugaggcugcagugagcu

SEQ ID NO: 272650 - RNA, 32 nt, Human
uugaggccaggaguuugaggcugcagugaguu

SEQ ID NO: 272651 - RNA, 32 nt, Human
uugaggccaggaguuuguuaccagccugggca

SEQ ID NO: 272652 - RNA, 32 nt, Human
uugaggccagggguuugagaccagccuggcca

SEQ ID NO: 272653 - RNA, 32 nt, Human
uugaggccaggguucgagaccaaccuugggca

SEQ ID NO: 272654 - RNA, 32 nt, Human
uugaggccaguaguuggagaccagccuggcca

SEQ ID NO: 272655 - RNA, 32 nt, Human
uugaggccagucuggccaaugugaugaaaccc

SEQ ID NO: 272656 - RNA, 32 nt, Human
uugaggccagugagcugugaucacuccagugc

SEQ ID NO: 272657 - RNA, 32 nt, Human
uugaggccaugccaccucccuuccaguccaca

SEQ ID NO: 272658 - RNA, 32 nt, Human
uugaggcccaacaacaguguauuuguuuuucc

SEQ ID NO: 272659 - RNA, 32 nt, Human
uugaggcccagagucugaggcugcgguaagcu

SEQ ID NO: 272660 - RNA, 32 nt, Human
uugaggcccaggaagagccaguguugcaguuc

SEQ ID NO: 272661 - RNA, 32 nt, Human
uugaggcccgggcacuucccgucuccucccuu

SEQ ID NO: 272662 - RNA, 32 nt, Human
uugaggcccggggagagccggggagccgggcc

SEQ ID NO: 272663 - RNA, 32 nt, Human
uugaggccgggaguucgggaccagccuagccu

SEQ ID NO: 272664 - RNA, 32 nt, Human
uugaggccgggaguuggagaccagccugagca

SEQ ID NO: 272665 - RNA, 32 nt, Human
uugaggccgggaguuugagaccagccugggca

SEQ ID NO: 272666 - RNA, 32 nt, Human
uugaggccuagccuuggaggcugcagugcacu

SEQ ID NO: 272667 - RNA, 32 nt, Human
uugaggccuccccucuccugccucccuccacc

SEQ ID NO: 272668 - RNA, 32 nt, Human
uugaggccuggaguucaagaccagccugugca

SEQ ID NO: 272669 - RNA, 32 nt, Human
uugaggcgaggaguucaagaccagccuaggca

SEQ ID NO: 272670 - RNA, 32 nt, Human
uugaggcgcccaggccccagaagucaccugcc

SEQ ID NO: 272671 - RNA, 32 nt, Human
uugaggcgcgucucacccuguugcccaggcug

SEQ ID NO: 272672 - RNA, 32 nt, Human
uugaggcgggcagauuaccugaggucaggagu

SEQ ID NO: 272673 - RNA, 32 nt, Human
uugaggcguggguagagcaggaauugguuuuc

SEQ ID NO: 272674 - RNA, 32 nt, Human
uugaggcuagauggccuaggagauuuuauugu

SEQ ID NO: 272675 - RNA, 32 nt, Human
uugaggcuaggaguucaagaccagccuggcca

SEQ ID NO: 272676 - RNA, 32 nt, Human
uugaggcuaggaguuccagaccagccugggca

SEQ ID NO: 272677 - RNA, 32 nt, Human
uugaggcuaggauuuugagaccagccugggga

SEQ ID NO: 272678 - RNA, 32 nt, Human
uugaggcuaggcauucaagaccagccuaggca

SEQ ID NO: 272679 - RNA, 22 nt, Human
uugaggcuagucuggaaccuuu

SEQ ID NO: 272680 - RNA, 32 nt, Human
uugaggcuagugagcugugacucccacugcac

SEQ ID NO: 272681 - RNA, 32 nt, Human
uugaggcuagugagcugugauuguaccacugc

SEQ ID NO: 272682 - RNA, 32 nt, Human
uugaggcucagccauaagagcuucacuuugac

SEQ ID NO: 272683 - RNA, 24 nt, Human
uugaggcucagcugccccaccccc

SEQ ID NO: 272684 - RNA, 32 nt, Human
uugaggcugaggccauggcaggacagcugcug

SEQ ID NO: 272685 - RNA, 21 nt, Human
uugaggcugcaaucacacuga

SEQ ID NO: 272686 - RNA, 32 nt, Human
uugaggcugcugaccuuuggaugggguuuuug

SEQ ID NO: 272687 - RNA, 32 nt, Human
uugaggcuggcggggucugcuccugggaaugg

SEQ ID NO: 272688 - RNA, 32 nt, Human
uugaggcugggaguucaaaaccagccugggca

SEQ ID NO: 272689 - RNA, 32 nt, Human
uugaggcuugaaguucgagaccagccuggcca

SEQ ID NO: 272690 - RNA, 32 nt, Human
uugaggcuuguccuaaaguggagaguuucagu

SEQ ID NO: 272691 - RNA, 32 nt, Human
uugaggcuuucauaguucaguguuauaauauu

SEQ ID NO: 272692 - RNA, 32 nt, Human
uugagggagcugauaaagacuuuagcugacuc

SEQ ID NO: 272693 - RNA, 32 nt, Human
uugagggaggacaccuuccuaggccuggagag

SEQ ID NO: 272694 - RNA, 32 nt, Human
uugagggaggcagaagucugcaguugaagaaa

SEQ ID NO: 272695 - RNA, 32 nt, Human
uugagggagggaggggcaagcccaguguuagu

SEQ ID NO: 272696 - RNA, 32 nt, Human
uugagggaggguaggguggugggagcccaguu

SEQ ID NO: 272697 - RNA, 32 nt, Human
uugagggauccucucuccuuguucaucucugc

SEQ ID NO: 272698 - RNA, 32 nt, Human
uugagggcaagcacugugucuccuuucaacca

SEQ ID NO: 272699 - RNA, 32 nt, Human
uugagggcagaauuuccaucucugauucccaa

SEQ ID NO: 272700 - RNA, 32 nt, Human
uugagggcagccugggaaacauggcuaaaucc

SEQ ID NO: 272701 - RNA, 32 nt, Human
uugagggcaggaguucgugaccagccugguca

SEQ ID NO: 272702 - RNA, 32 nt, Human
uugagggcaggcagagguagcugaggguagca

SEQ ID NO: 272703 - RNA, 32 nt, Human
uugagggcaggcaggagguggaguugcagcug

SEQ ID NO: 272704 - RNA, 32 nt, Human
uugagggcagguggcacguggggaagagggcg

SEQ ID NO: 272705 - RNA, 32 nt, Human
uugagggcaugaguucgagaccagccuggcca

SEQ ID NO: 272706 - RNA, 32 nt, Human
uugagggccagaguccccagccccagaucaca

SEQ ID NO: 272707 - RNA, 32 nt, Human
uugagggcccagaggacagagagauggacaug

SEQ ID NO: 272708 - RNA, 32 nt, Human
uugagggcccuggagaaacuucagcagaacag

SEQ ID NO: 272709 - RNA, 32 nt, Human
uugagggcccugggacaugugcuaucugauaa

SEQ ID NO: 272710 - RNA, 32 nt, Human
uugagggccuucucaggaacacuggcauugcc

SEQ ID NO: 272711 - RNA, 32 nt, Human
uugagggcgccugagggccaggagcagcaggc

SEQ ID NO: 272712 - RNA, 32 nt, Human
uugagggcucaaaggcucuucccacugcuugu

SEQ ID NO: 272713 - RNA, 32 nt, Human
uugagggcugaguccuugcugugggaugugcc

SEQ ID NO: 272714 - RNA, 32 nt, Human
uugagggcuggaaaugcaaagacacauuuuuc

SEQ ID NO: 272715 - RNA, 22 nt, Human
uugagggcuuuugguuggccag

SEQ ID NO: 272716 - RNA, 32 nt, Human
uugaggggaaauggugugagacgaaugggcuc

SEQ ID NO: 272717 - RNA, 32 nt, Human
uugaggggagugagaaaaggagaaguagagau

SEQ ID NO: 272718 - RNA, 32 nt, Human
uugaggggcaccacuacuccagcccagaagga

SEQ ID NO: 272719 - RNA, 32 nt, Human
uugaggggcagccugcagcuacuuggcacagg

SEQ ID NO: 272720 - RNA, 32 nt, Human
uugaggggcugaagcuggccaggaguugcugc

SEQ ID NO: 272721 - RNA, 32 nt, Human
uugaggggcugcaggugaugcauugcacggga

SEQ ID NO: 272722 - RNA, 32 nt, Human
uugagggggaaugaccucuaacaucuguaaaa

SEQ ID NO: 272723 - RNA, 32 nt, Human
uugaggggugggagcagguguguacugacaau

SEQ ID NO: 272724 - RNA, 32 nt, Human
uugagggucuccacugcugccuugggggccug

SEQ ID NO: 272725 - RNA, 32 nt, Human
uugagggucucugguggggaaggacagggacc

SEQ ID NO: 272726 - RNA, 21 nt, Human
uugagggucuuaagaaccaca

SEQ ID NO: 272727 - RNA, 32 nt, Human
uugagggugcuguccccaccucugguggaaag

SEQ ID NO: 272728 - RNA, 32 nt, Human
uugagggugggagagaagaaaagggaaagaag

SEQ ID NO: 272729 - RNA, 32 nt, Human
uugagggugggucugccucucccagcccacug

SEQ ID NO: 272730 - RNA, 32 nt, Human
uugagggugggugggaagagugagaagauaua

SEQ ID NO: 272731 - RNA, 32 nt, Human
uugaggguuaagaagaaagaggaaugaggaaa

SEQ ID NO: 272732 - RNA, 32 nt, Human
uugaggguugugaauaguggagauguguaggg

SEQ ID NO: 272733 - RNA, 32 nt, Human
uugaggguuuucuaaauaaucugcuguugauu

SEQ ID NO: 272734 - RNA, 32 nt, Human
uugagguaccagccagaugucuucccacaaag

SEQ ID NO: 272735 - RNA, 32 nt, Human
uugagguagagaguuugagaccagccuggcca

SEQ ID NO: 272736 - RNA, 32 nt, Human
uugaggucaagaguucgagaccagccugacca

SEQ ID NO: 272737 - RNA, 32 nt, Human
uugaggucaagaguuugagaccagccugacca

SEQ ID NO: 272738 - RNA, 32 nt, Human
uugaggucaagaguuugagaccagccuggcca

SEQ ID NO: 272739 - RNA, 32 nt, Human
uugaggucaagcaacccucccaccucggccug

SEQ ID NO: 272740 - RNA, 32 nt, Human
uugaggucaaggggcagcaggagaagaugcaa

SEQ ID NO: 272741 - RNA, 32 nt, Human
uugaggucagaaguucaagaccagccugacca

SEQ ID NO: 272742 - RNA, 32 nt, Human
uugaggucagaaguucgagaccagccugccca

SEQ ID NO: 272743 - RNA, 32 nt, Human
uugaggucagaaguucgagaccagccuggcca

SEQ ID NO: 272744 - RNA, 32 nt, Human
uugaggucagcaguuugagaccagccuggcca

SEQ ID NO: 272745 - RNA, 32 nt, Human
uugaggucaggaauuagagaccagccugggaa

SEQ ID NO: 272746 - RNA, 32 nt, Human
uugaggucaggaauucaaaaccagccuggcca

SEQ ID NO: 272747 - RNA, 32 nt, Human
uugaggucaggaauucaagaccagccuggcca

SEQ ID NO: 272748 - RNA, 32 nt, Human
uugaggucaggaauucgagaccagcuugggca

SEQ ID NO: 272749 - RNA, 32 nt, Human
uugaggucaggacuagguggucucagccaaug

SEQ ID NO: 272750 - RNA, 32 nt, Human
uugaggucaggacuuugagaccagccuggcca

SEQ ID NO: 272751 - RNA, 32 nt, Human
uugaggucaggagauugagaccagccuggcca

SEQ ID NO: 272752 - RNA, 32 nt, Human
uugaggucaggagcucaagaccagccugacca

SEQ ID NO: 272753 - RNA, 32 nt, Human
uugaggucaggagcucaagaccagccugggua

SEQ ID NO: 272754 - RNA, 32 nt, Human
uugaggucaggagcucaagaccagccugguca

SEQ ID NO: 272755 - RNA, 32 nt, Human
uugaggucaggagcucgagaccagccuggcca

SEQ ID NO: 272756 - RNA, 32 nt, Human
uugaggucaggagcucgagaccagcuuggcca

SEQ ID NO: 272757 - RNA, 32 nt, Human
uugaggucaggagcuugaaaccagccuggcca

SEQ ID NO: 272758 - RNA, 32 nt, Human
uugaggucaggagcuugagaccagccuggcca

SEQ ID NO: 272759 - RNA, 32 nt, Human
uugaggucaggaguccaagaccagccuggcca

SEQ ID NO: 272760 - RNA, 32 nt, Human
uugaggucaggaguuagaaaccagccuggcca

SEQ ID NO: 272761 - RNA, 32 nt, Human
uugaggucaggaguucaaaaccagccuggcca

SEQ ID NO: 272762 - RNA, 32 nt, Human
uugaggucaggaguucaacaccagccuggcca

SEQ ID NO: 272763 - RNA, 32 nt, Human
uugaggucaggaguucaagaccacccugacca

SEQ ID NO: 272764 - RNA, 32 nt, Human
uugaggucaggaguucaagaccagccugacca

SEQ ID NO: 272765 - RNA, 32 nt, Human
uugaggucaggaguucaagaccagccuggcca

SEQ ID NO: 272766 - RNA, 32 nt, Human
uugaggucaggaguucaagaccagccuggccg

SEQ ID NO: 272767 - RNA, 32 nt, Human
uugaggucaggaguucaagaccagccuggcua

SEQ ID NO: 272768 - RNA, 32 nt, Human
uugaggucaggaguucaagaccagccuggcug

SEQ ID NO: 272769 - RNA, 32 nt, Human
uugaggucaggaguucaagaccagccugggca

SEQ ID NO: 272770 - RNA, 32 nt, Human
uugaggucaggaguucaagaccagccuuggca

SEQ ID NO: 272771 - RNA, 32 nt, Human
uugaggucaggaguucaagaccagcuuggcca

SEQ ID NO: 272772 - RNA, 32 nt, Human
uugaggucaggaguucaagaccaggcuggcca

SEQ ID NO: 272773 - RNA, 32 nt, Human
uugaggucaggaguucaagaccagucuggcca

SEQ ID NO: 272774 - RNA, 32 nt, Human
uugaggucaggaguucaagaccugccuggcca

SEQ ID NO: 272775 - RNA, 32 nt, Human
uugaggucaggaguucacgaccagccuggcca

SEQ ID NO: 272776 - RNA, 32 nt, Human
uugaggucaggaguucagcuuggaauuaccag

SEQ ID NO: 272777 - RNA, 32 nt, Human
uugaggucaggaguucaggaccagccuggcca

SEQ ID NO: 272778 - RNA, 32 nt, Human
uugaggucaggaguuccagaccagccuggcca

SEQ ID NO: 272779 - RNA, 32 nt, Human
uugaggucaggaguuccuaaccagccugguca

SEQ ID NO: 272780 - RNA, 32 nt, Human
uugaggucaggaguucgaaaccagccuggcca

SEQ ID NO: 272781 - RNA, 32 nt, Human
uugaggucaggaguucgagaccagcccagcca

SEQ ID NO: 272782 - RNA, 32 nt, Human
uugaggucaggaguucgagaccagccuagcua

SEQ ID NO: 272783 - RNA, 32 nt, Human
uugaggucaggaguucgagaccagccugacca

SEQ ID NO: 272784 - RNA, 32 nt, Human
uugaggucaggaguucgagaccagccuggcaa

SEQ ID NO: 272785 - RNA, 32 nt, Human
uugaggucaggaguucgagaccagccuggcca

SEQ ID NO: 272786 - RNA, 32 nt, Human
uugaggucaggaguucgagaccagcuugugca

SEQ ID NO: 272787 - RNA, 32 nt, Human
uugaggucaggaguucgaguccagccuggcca

SEQ ID NO: 272788 - RNA, 32 nt, Human
uugaggucaggaguucgauaccagccugacca

SEQ ID NO: 272789 - RNA, 32 nt, Human
uugaggucaggaguucgcgaccagccuaccca

SEQ ID NO: 272790 - RNA, 32 nt, Human
uugaggucaggaguucuagaccagccuggcca

SEQ ID NO: 272791 - RNA, 32 nt, Human
uugaggucaggaguucuagaccagccugguca

SEQ ID NO: 272792 - RNA, 32 nt, Human
uugaggucaggaguuggagaccagccuggcca

SEQ ID NO: 272793 - RNA, 32 nt, Human
uugaggucaggaguuggagaccagucuggcca

SEQ ID NO: 272794 - RNA, 32 nt, Human
uugaggucaggaguuucggaccagccuggcca

SEQ ID NO: 272795 - RNA, 32 nt, Human
uugaggucaggaguuugaaaccagccugagca

SEQ ID NO: 272796 - RNA, 32 nt, Human
uugaggucaggaguuugaaaccagccuggcca

SEQ ID NO: 272797 - RNA, 32 nt, Human
uugaggucaggaguuugagaccagcccggcca

SEQ ID NO: 272798 - RNA, 32 nt, Human
uugaggucaggaguuugagaccagccuagcca

SEQ ID NO: 272799 - RNA, 32 nt, Human
uugaggucaggaguuugagaccagccucgcca

SEQ ID NO: 272800 - RNA, 32 nt, Human
uugaggucaggaguuugagaccagccucggca

SEQ ID NO: 272801 - RNA, 32 nt, Human
uugaggucaggaguuugagaccagccugacca

SEQ ID NO: 272802 - RNA, 32 nt, Human
uugaggucaggaguuugagaccagccugauca

SEQ ID NO: 272803 - RNA, 32 nt, Human
uugaggucaggaguuugagaccagccuggaca

SEQ ID NO: 272804 - RNA, 32 nt, Human
uugaggucaggaguuugagaccagccuggcca

SEQ ID NO: 272805 - RNA, 32 nt, Human
uugaggucaggaguuugagaccagccuggccg

SEQ ID NO: 272806 - RNA, 32 nt, Human
uugaggucaggaguuugagaccagccugggua

SEQ ID NO: 272807 - RNA, 32 nt, Human
uugaggucaggaguuugagaccagccugguca

SEQ ID NO: 272808 - RNA, 32 nt, Human
uugaggucaggaguuugagaccagugugcaaa

SEQ ID NO: 272809 - RNA, 32 nt, Human
uugaggucaggaguuugaggccagccuggcca

SEQ ID NO: 272810 - RNA, 32 nt, Human
uugaggucaggaguuuuagaccagccuggaca

SEQ ID NO: 272811 - RNA, 32 nt, Human
uugaggucagggguuugagaccagccugacca

SEQ ID NO: 272812 - RNA, 32 nt, Human
uugaggucagggguuugagaccagccuggcuu

SEQ ID NO: 272813 - RNA, 32 nt, Human
uugaggucaugaccacagcacaaccuagccua

SEQ ID NO: 272814 - RNA, 32 nt, Human
uugaggucaugaguucaagaccagccugacca

SEQ ID NO: 272815 - RNA, 32 nt, Human
uugagguccccaaagguguauuuuugggcaaa

SEQ ID NO: 272816 - RNA, 32 nt, Human
uugaggucgggaguucaagaccagccuggcca

SEQ ID NO: 272817 - RNA, 32 nt, Human
uugaggucgggaguucgagaccagccugacca

SEQ ID NO: 272818 - RNA, 32 nt, Human
uugaggucgggaguucgagaccagccugagca

SEQ ID NO: 272819 - RNA, 32 nt, Human
uugaggucgggaguucgagaccagccuggcca

SEQ ID NO: 272820 - RNA, 32 nt, Human
uugaggucgggaguuggaggccagccuggcca

SEQ ID NO: 272821 - RNA, 32 nt, Human
uugaggucggggguuugcgaccagccugguca

SEQ ID NO: 272822 - RNA, 32 nt, Human
uugaggucuagggauugagaccagccuggcca

SEQ ID NO: 272823 - RNA, 32 nt, Human
uugaggucuggggaaaagggaggacuuugcau

SEQ ID NO: 272824 - RNA, 32 nt, Human
uugaggugaggaauucgagaccagccuggcca

SEQ ID NO: 272825 - RNA, 32 nt, Human
uugaggugaggaguucaagaccagccuggcca

SEQ ID NO: 272826 - RNA, 32 nt, Human
uugagguggaguuucacucuuguugcccaagc

SEQ ID NO: 272827 - RNA, 32 nt, Human
uugagguggaguuucgcucuuguugcccgggc

SEQ ID NO: 272828 - RNA, 32 nt, Human
uugagguggccugucugugccucuccuuuguu

SEQ ID NO: 272829 - RNA, 32 nt, Human
uugaggugggagagagaagcagagcgagagag

SEQ ID NO: 272830 - RNA, 32 nt, Human
uugaggugggcaauggcuugagcccaggaguu

SEQ ID NO: 272831 - RNA, 32 nt, Human
uugaggugggcagaucgccugaggucgggagu

SEQ ID NO: 272832 - RNA, 32 nt, Human
uugaggugggcggaucaccugaggucaggagu

SEQ ID NO: 272833 - RNA, 32 nt, Human
uugaggugguguagauggugaccuggguaucc

SEQ ID NO: 272834 - RNA, 32 nt, Human
uugagguuaauggcacuucgguguuuaggcuc

SEQ ID NO: 272835 - RNA, 32 nt, Human
uugagguuaggaguucaagaccagcccagcca

SEQ ID NO: 272836 - RNA, 32 nt, Human
uugagguuaggaguucaagaccagccuggcca

SEQ ID NO: 272837 - RNA, 32 nt, Human
uugagguuaggaguucgauaccagccuggcca

SEQ ID NO: 272838 - RNA, 32 nt, Human
uugagguuaggaguuugagaccagccuggcca

SEQ ID NO: 272839 - RNA, 32 nt, Human
uugagguugcuggugggccugcucuggugguc

SEQ ID NO: 272840 - RNA, 31 nt, Human
uugagguuguuauuuaaaguuggagaugagu

SEQ ID NO: 272841 - RNA, 32 nt, Human
uugagguuuauauuacacauucuaaguguaug

SEQ ID NO: 272842 - RNA, 32 nt, Human
uugaguaaugaccauaugccaggugcuuucac

SEQ ID NO: 272843 - RNA, 32 nt, Human
uugaguacugaugacccaguacucagucuagg

SEQ ID NO: 272844 - RNA, 32 nt, Human
uugaguacuguacugacuuuuugcuaguuucu

SEQ ID NO: 272845 - RNA, 32 nt, Human
uugaguagccaaggaaggucagugugaaaagc

SEQ ID NO: 272846 - RNA, 32 nt, Human
uugaguagcucagacuugguuuugccaaaacu

SEQ ID NO: 272847 - RNA, 21 nt, Human
uugaguagcugggacuacagg

SEQ ID NO: 272848 - RNA, 21 nt, Human
uugaguagcugggacuucagg

SEQ ID NO: 272849 - RNA, 21 nt, Human
uugaguagcugggauuacagg

SEQ ID NO: 272850 - RNA, 32 nt, Human
uugaguagcugugugcuuuguuuaugauaaca

SEQ ID NO: 272851 - RNA, 30 nt, Human
uugaguagcuucuccaugcuauguauuuuu

SEQ ID NO: 272852 - RNA, 32 nt, Human
uugaguagugaaaggaaggaggaggaaaggaa

SEQ ID NO: 272853 - RNA, 32 nt, Human
uugaguauguucucccuuuuccauuuuggauu

SEQ ID NO: 272854 - RNA, 32 nt, Human
uugaguauuucugucuuuucacagaaaaacau

SEQ ID NO: 272855 - RNA, 32 nt, Human
uugagucacuauauguggaugugcuagucuua

SEQ ID NO: 272856 - RNA, 32 nt, Human
uugagucagcaacuaagucuuccuucaaaguu

SEQ ID NO: 272857 - RNA, 32 nt, Human
uugagucagcagacaauggauauuuuuauauc

SEQ ID NO: 272858 - RNA, 32 nt, Human
uugagucagcugacucaauuacccagggguau

SEQ ID NO: 272859 - RNA, 32 nt, Human
uugagucaggcagcuggaggguuguggcccga

SEQ ID NO: 272860 - RNA, 32 nt, Human
uugagucaguuauggacugcugccuuuaaacc

SEQ ID NO: 272861 - RNA, 32 nt, Human
uugaguccaagaguuugagaccagccugagca

SEQ ID NO: 272862 - RNA, 32 nt, Human
uugaguccaaguguuugagaccagccugagca

SEQ ID NO: 272863 - RNA, 32 nt, Human
uugaguccacgaguuuaagaccagccugggca

SEQ ID NO: 272864 - RNA, 23 nt, Human
uugaguccagccugggcaguaua

SEQ ID NO: 272865 - RNA, 32 nt, Human
uugaguccagccugggcaguauagcaagaccc

SEQ ID NO: 272866 - RNA, 32 nt, Human
uugaguccaggaauuugagaccagccuggaca

SEQ ID NO: 272867 - RNA, 32 nt, Human
uugaguccaggaauuugagaccagccuggcca

SEQ ID NO: 272868 - RNA, 32 nt, Human
uugaguccaggaggcggaggcugcagugagcu

SEQ ID NO: 272869 - RNA, 32 nt, Human
uugaguccaggagguugaggcugcagucagcu

SEQ ID NO: 272870 - RNA, 32 nt, Human
uugaguccaggagguugaggcugcagugagcu

SEQ ID NO: 272871 - RNA, 32 nt, Human
uugaguccaggaguccgagaccagccugggca

SEQ ID NO: 272872 - RNA, 32 nt, Human
uugaguccaggaguucaaggcugcagugaguu

SEQ ID NO: 272873 - RNA, 32 nt, Human
uugaguccaggaguuggaggcuacagugagcc

SEQ ID NO: 272874 - RNA, 32 nt, Human
uugaguccaggaguuuaagaccagccuggaca

SEQ ID NO: 272875 - RNA, 32 nt, Human
uugaguccaggaguuugagaccagccuggaca

SEQ ID NO: 272876 - RNA, 32 nt, Human
uugaguccaggaguuugagaccagccugggca

SEQ ID NO: 272877 - RNA, 32 nt, Human
uugaguccaggaguuugagguuacagugaucc

SEQ ID NO: 272878 - RNA, 32 nt, Human
uugagucccacagcaagggagagcaagaacgc

SEQ ID NO: 272879 - RNA, 32 nt, Human
uugaguccgggaguucagaaccagccuggaca

SEQ ID NO: 272880 - RNA, 32 nt, Human
uugaguccucauccauggagugcuguguuugg

SEQ ID NO: 272881 - RNA, 32 nt, Human
uugagucggugggcugggagaggcagacccac

SEQ ID NO: 272882 - RNA, 32 nt, Human
uugagucuaggaguucaagaccagccuggcca

SEQ ID NO: 272883 - RNA, 32 nt, Human
uugagucuaugaguucaagaccagccugggca

SEQ ID NO: 272884 - RNA, 32 nt, Human
uugagucucaaccugcuguucuuuggacuaga

SEQ ID NO: 272885 - RNA, 32 nt, Human
uugagucuccccuagugucagagaucaggaga

SEQ ID NO: 272886 - RNA, 32 nt, Human
uugagucucuuucuuguccucccagcugagcu

SEQ ID NO: 272887 - RNA, 22 nt, Human
uugagucugacccaggaccucu

SEQ ID NO: 272888 - RNA, 32 nt, Human
uugagucugcaagacugggaggaacuggggug

SEQ ID NO: 272889 - RNA, 32 nt, Human
uugagucuggacaccaguagguggucaugguc

SEQ ID NO: 272890 - RNA, 32 nt, Human
uugagucugggagguggaggcugcagugagcc

SEQ ID NO: 272891 - RNA, 32 nt, Human
uugagucugggcuuguuuguguuacugcauac

SEQ ID NO: 272892 - RNA, 32 nt, Human
uugagucuguuuucccaaccuccugugggccu

SEQ ID NO: 272893 - RNA, 32 nt, Human
uugagucuuacucugugccugaccuugugcuu

SEQ ID NO: 272894 - RNA, 32 nt, Human
uugagugaaaugccucucagucuuaggggaca

SEQ ID NO: 272895 - RNA, 32 nt, Human
uugagugaacauuuuuagaggaaagguuaugc

SEQ ID NO: 272896 - RNA, 32 nt, Human
uugagugacaguucuauuugauugccuccggu

SEQ ID NO: 272897 - RNA, 31 nt, Human
uugagugagagaauagaaaaagcgcuuuagu

SEQ ID NO: 272898 - RNA, 32 nt, Human
uugagugagcucugcugccucuucugcugccc

SEQ ID NO: 272899 - RNA, 32 nt, Human
uugagugaugaccacaccaaucacuguauuuu

SEQ ID NO: 272900 - RNA, 32 nt, Human
uugagugaugcaugagguagguguuuggagua

SEQ ID NO: 272901 - RNA, 32 nt, Human
uugagugcaagaagaaagaggcgcugcucacu

SEQ ID NO: 272902 - RNA, 32 nt, Human
uugagugcaaugaccuguucucagcuuacuca

SEQ ID NO: 272903 - RNA, 32 nt, Human
uugagugcagaacuagcuaguagaagccagau

SEQ ID NO: 272904 - RNA, 32 nt, Human
uugagugcaggaguuugagaccagccugggca

SEQ ID NO: 272905 - RNA, 32 nt, Human
uugagugcaguggcgcaaucguggcucacugc

SEQ ID NO: 272906 - RNA, 32 nt, Human
uugagugcaguggcgugaucuggacucacugu

SEQ ID NO: 272907 - RNA, 32 nt, Human
uugagugcaguggugugaucuuggcucacugc

SEQ ID NO: 272908 - RNA, 32 nt, Human
uugagugcuaucagcccucuagacccagaccc

SEQ ID NO: 272909 - RNA, 32 nt, Human
uugagugcuccaguuaagacaguaauuuauuu

SEQ ID NO: 272910 - RNA, 32 nt, Human
uugagugcuccuguggggagcggggaugagcu

SEQ ID NO: 272911 - RNA, 32 nt, Human
uugaguggcgauuaccuccagcacagagacgu

SEQ ID NO: 272912 - RNA, 32 nt, Human
uugaguggggcagagggacagggcagccagac

SEQ ID NO: 272913 - RNA, 32 nt, Human
uugagugggggaggcagggacgagggaaggaa

SEQ ID NO: 272914 - RNA, 32 nt, Human
uugaguggucucaagcccuuaaccucuguaag

SEQ ID NO: 272915 - RNA, 32 nt, Human
uugagugguggagguggaacucagcaggauag

SEQ ID NO: 272916 - RNA, 31 nt, Human
uugaguguacuuuucuauggacaacagguca

SEQ ID NO: 272917 - RNA, 32 nt, Human
uugagugucugugucuuagaccugcaaacagc

SEQ ID NO: 272918 - RNA, 32 nt, Human
uugagugugggaugugcuuccagcagugccuu

SEQ ID NO: 272919 - RNA, 32 nt, Human
uugaguguuaucucucaguggcuagaggugcu

SEQ ID NO: 272920 - RNA, 32 nt, Human
uugaguuaaaccuaccuaaguagauuuuaggu

SEQ ID NO: 272921 - RNA, 32 nt, Human
uugaguuaagauugcuuggaaaaagaacuguu

SEQ ID NO: 272922 - RNA, 32 nt, Human
uugaguuacuccuguaucauugcucauaauau

SEQ ID NO: 272923 - RNA, 32 nt, Human
uugaguuaucuaggugcagcuguguucugcag

SEQ ID NO: 272924 - RNA, 32 nt, Human
uugaguucaagaccagccuggccaacauggug

SEQ ID NO: 272925 - RNA, 32 nt, Human
uugaguucaauaccagccugagcaaccuaaug

SEQ ID NO: 272926 - RNA, 32 nt, Human
uugaguucaggaguucaaaaccagccuggaca

SEQ ID NO: 272927 - RNA, 32 nt, Human
uugaguucaggaguucaagaccggccugggca

SEQ ID NO: 272928 - RNA, 32 nt, Human
uugaguucaggaguuuaagaccagccuggaca

SEQ ID NO: 272929 - RNA, 32 nt, Human
uugaguucagguagcugccccuggcucugacc

SEQ ID NO: 272930 - RNA, 32 nt, Human
uugaguucauacccuguuaccauuuuggggua

SEQ ID NO: 272931 - RNA, 32 nt, Human
uugaguuccuucucucccaucuggaucuccca

SEQ ID NO: 272932 - RNA, 32 nt, Human
uugaguucgagaccagccuggccacaugguga

SEQ ID NO: 272933 - RNA, 32 nt, Human
uugaguucucaguuucucugcagcuacuauag

SEQ ID NO: 272934 - RNA, 32 nt, Human
uugaguucugcuggacaggagcacuuuaucug

SEQ ID NO: 272935 - RNA, 32 nt, Human
uugaguucuucaccaucuuuugcaacugaaau

SEQ ID NO: 272936 - RNA, 32 nt, Human
uugaguugagcuuuagcaaaaguuuccccuca

SEQ ID NO: 272937 - RNA, 32 nt, Human
uugaguugcugcugaaacucauugcaaaccuc

SEQ ID NO: 272938 - RNA, 32 nt, Human
uugaguugugcugaaugccccaccccagcucu

SEQ ID NO: 272939 - RNA, 32 nt, Human
uugaguugugugcggguggcugugcauugggg

SEQ ID NO: 272940 - RNA, 32 nt, Human
uugaguuguguguuacuggggguggggugggg

SEQ ID NO: 272941 - RNA, 32 nt, Human
uugaguuguucgcaccacugcaccacaacuca

SEQ ID NO: 272942 - RNA, 32 nt, Human
uugaguuucauucacacaaaacauggacauca

SEQ ID NO: 272943 - RNA, 32 nt, Human
uugaguuuggaauccagaacagauuccaggcu

SEQ ID NO: 272944 - RNA, 32 nt, Human
uugaguuuguguccuggaagucccagacucgg

SEQ ID NO: 272945 - RNA, 32 nt, Human
uugauaaagauuaaggacauguucuuugguca

SEQ ID NO: 272946 - RNA, 32 nt, Human
uugauaaauuaguggagaaauggcauuuuaag

SEQ ID NO: 272947 - RNA, 32 nt, Human
uugauaacaaucuaaauaagcugcaguugaag

SEQ ID NO: 272948 - RNA, 32 nt, Human
uugauaacaucuuaucaggagacgguuuugag

SEQ ID NO: 272949 - RNA, 32 nt, Human
uugauaaccauguaauuucuuagaaccauggc

SEQ ID NO: 272950 - RNA, 32 nt, Human
uugauaaguuuacauaaacagaaauaaaagau

SEQ ID NO: 272951 - RNA, 32 nt, Human
uugauaaucuugacccguacacugccuuuggu

SEQ ID NO: 272952 - RNA, 32 nt, Human
uugauaauugaauauuucaaagagaucagcau

SEQ ID NO: 272953 - RNA, 32 nt, Human
uugauaauuuguuguugagagcuguucauucu

SEQ ID NO: 272954 - RNA, 32 nt, Human
uugauacaaaugucaacuccagccccugucau

SEQ ID NO: 272955 - RNA, 32 nt, Human
uugauacacagcaaagcauuccuaugguaaaa

SEQ ID NO: 272956 - RNA, 32 nt, Human
uugauacauacagguuagcuguuacaaaagau

SEQ ID NO: 272957 - RNA, 32 nt, Human
uugauacauagagagccacacugaggagaagc

SEQ ID NO: 272958 - RNA, 32 nt, Human
uugauacauguugccaaccacccuccagaaag

SEQ ID NO: 272959 - RNA, 32 nt, Human
uugauaccagccugaccaacauggagaaaccc

SEQ ID NO: 272960 - RNA, 32 nt, Human
uugauaccagccuggccaacauggugaaaccc

SEQ ID NO: 272961 - RNA, 32 nt, Human
uugauaccuugcaaaaguauugcuucugaaag

SEQ ID NO: 272962 - RNA, 32 nt, Human
uugauaccuugcaauaguauugcuucugaaag

SEQ ID NO: 272963 - RNA, 32 nt, Human
uugauacuuggaccccaggucuggagauuggg

SEQ ID NO: 272964 - RNA, 32 nt, Human
uugauacuuuucucaaauuaaguuuaaauaua

SEQ ID NO: 272965 - RNA, 31 nt, Human
uugauagaacaauacuuucaguuauguugca

SEQ ID NO: 272966 - RNA, 32 nt, Human
uugauagaauauucauuuuauggcaaggaaau

SEQ ID NO: 272967 - RNA, 32 nt, Human
uugauagagaagggacagggaacagaaccuuc

SEQ ID NO: 272968 - RNA, 32 nt, Human
uugauagcaaacacugggggcaccuuaagauu

SEQ ID NO: 272969 - RNA, 32 nt, Human
uugauagcacgcuauucuuuccuucauggcac

SEQ ID NO: 272970 - RNA, 32 nt, Human
uugauagcugggacugaauagaagaaaacggg

SEQ ID NO: 272971 - RNA, 32 nt, Human
uugauaggagcugguugaccuuguacagaacc

SEQ ID NO: 272972 - RNA, 32 nt, Human
uugauaggccaugccuugccacuuuacaaguu

SEQ ID NO: 272973 - RNA, 32 nt, Human
uugauaggcugaggcagguggauugcuugagc

SEQ ID NO: 272974 - RNA, 32 nt, Human
uugauaggcuguguguuucuaagaauuugucc

SEQ ID NO: 272975 - RNA, 32 nt, Human
uugauagguuuugcaaagacuugguccugcca

SEQ ID NO: 272976 - RNA, 32 nt, Human
uugauaguaaaaaggcaggugauggaaaucag

SEQ ID NO: 272977 - RNA, 32 nt, Human
uugauagucugaggcugggccucugccuuugu

SEQ ID NO: 272978 - RNA, 32 nt, Human
uugauauaaucagcucaugaaugcacagcuau

SEQ ID NO: 272979 - RNA, 32 nt, Human
uugauauauagcauuguacauaugacaagucu

SEQ ID NO: 272980 - RNA, 32 nt, Human
uugauaucauuuccuagacucuacuccaugau

SEQ ID NO: 272981 - RNA, 32 nt, Human
uugauauccagaaauuagaaagaacguccaau

SEQ ID NO: 272982 - RNA, 32 nt, Human
uugauauccugcaaaugaaggaggaggauguc

SEQ ID NO: 272983 - RNA, 32 nt, Human
uugauaucucccagagguacagaaacaggauu

SEQ ID NO: 272984 - RNA, 32 nt, Human
uugauauggaaagcugaugagagagcaucucu

SEQ ID NO: 272985 - RNA, 32 nt, Human
uugauauggaguuuugcucuuguugcccaggc

SEQ ID NO: 272986 - RNA, 32 nt, Human
uugauaugggaacugaaggccagccaggggag

SEQ ID NO: 272987 - RNA, 32 nt, Human
uugauaugucugcaugcagcacagaacuuuga

SEQ ID NO: 272988 - RNA, 32 nt, Human
uugauauuagauacauuaaagcacugaauuuu

SEQ ID NO: 272989 - RNA, 32 nt, Human
uugauauucauuccccaauucacugcaaggag

SEQ ID NO: 272990 - RNA, 32 nt, Human
uugauauucucccauuuucacugcccaacuaa

SEQ ID NO: 272991 - RNA, 32 nt, Human
uugauauucuguucagaacuuucuuuagacua

SEQ ID NO: 272992 - RNA, 32 nt, Human
uugauauucuuuaaguuaguugcucacacacu

SEQ ID NO: 272993 - RNA, 32 nt, Human
uugauauuugaaauguuauguacuggaaaggc

SEQ ID NO: 272994 - RNA, 22 nt, Human
uugauauuuuuagcaguuccaa

SEQ ID NO: 272995 - RNA, 21 nt, Human
uugaucaacaucucccugaca

SEQ ID NO: 272996 - RNA, 32 nt, Human
uugaucaaggagaaggagagaaaacaccugaa

SEQ ID NO: 272997 - RNA, 32 nt, Human
uugaucacaccacugcacuccagccugggcaa

SEQ ID NO: 272998 - RNA, 32 nt, Human
uugaucacccuggcugacauguuucuggaagu

SEQ ID NO: 272999 - RNA, 32 nt, Human
uugaucacgccacugcacuccagccuggguga

SEQ ID NO: 273000 - RNA, 32 nt, Human
uugaucacugcucuccaucccauguaccacaa

SEQ ID NO: 273001 - RNA, 32 nt, Human
uugaucacuugcaggcccggguucugugugcc

SEQ ID NO: 273002 - RNA, 32 nt, Human
uugaucagacagcuugaaucagcaucucuucu

SEQ ID NO: 273003 - RNA, 32 nt, Human
uugaucagacccuucucuuaacagagagauac

SEQ ID NO: 273004 - RNA, 32 nt, Human
uugaucagacccuucucuuaauagagagauac

SEQ ID NO: 273005 - RNA, 25 nt, Human
uugaucagcccuuuuucccauccug

SEQ ID NO: 273006 - RNA, 32 nt, Human
uugaucagggccugagaugcugaccugccagu

SEQ ID NO: 273007 - RNA, 32 nt, Human
uugaucauauucaacagaaauccaccauauaa

SEQ ID NO: 273008 - RNA, 32 nt, Human
uugaucaucacuucuucagccaucucacugaa

SEQ ID NO: 273009 - RNA, 32 nt, Human
uugaucauuuugaggcugggugcaguggcuca

SEQ ID NO: 273010 - RNA, 32 nt, Human
uugauccacuggcauuugcugcccucuugucc

SEQ ID NO: 273011 - RNA, 32 nt, Human
uugauccagaagccagaggauggacuaagugg

SEQ ID NO: 273012 - RNA, 32 nt, Human
uugauccagcaauaccccacuucaccuacaau

SEQ ID NO: 273013 - RNA, 32 nt, Human
uugauccaggaauauuucaaccagagacacaa

SEQ ID NO: 273014 - RNA, 32 nt, Human
uugauccaggaggucccacuguggcguuucau

SEQ ID NO: 273015 - RNA, 32 nt, Human
uugauccaugaguuguuucuccaacucuucga

SEQ ID NO: 273016 - RNA, 32 nt, Human
uugaucccaggaggcggagguugcagugaguu

SEQ ID NO: 273017 - RNA, 32 nt, Human
uugaucccaggaggucgagaccagccugggga

SEQ ID NO: 273018 - RNA, 32 nt, Human
uugaucccaggaguuugagaccagccugggca

SEQ ID NO: 273019 - RNA, 32 nt, Human
uugaucccucuacaagagggucuggggccagc

SEQ ID NO: 273020 - RNA, 32 nt, Human
uugaucccugugccaucuccagacccucaaac

SEQ ID NO: 273021 - RNA, 32 nt, Human
uugauccggggagguggaaguugcagugggcc

SEQ ID NO: 273022 - RNA, 32 nt, Human
uugauccuacagccaagcuccaagucaguaua

SEQ ID NO: 273023 - RNA, 32 nt, Human
uugauccucaaaggacuguggccaaggccucu

SEQ ID NO: 273024 - RNA, 32 nt, Human
uugauccuccaaauaacucucuucuaauuccu

SEQ ID NO: 273025 - RNA, 32 nt, Human
uugauccuccaaugucuaauuuucuuuccgac

SEQ ID NO: 273026 - RNA, 32 nt, Human
uugauccucugccuccccuuccucuucuuguu

SEQ ID NO: 273027 - RNA, 32 nt, Human
uugauccucuucuuccucugcugggccucgca

SEQ ID NO: 273028 - RNA, 32 nt, Human
uugauccugggaguucgagaccagccugggca

SEQ ID NO: 273029 - RNA, 32 nt, Human
uugauccugucaccaaccauaugaaguaggca

SEQ ID NO: 273030 - RNA, 32 nt, Human
uugauccuugauaaugccuccgacaaauauuu

SEQ ID NO: 273031 - RNA, 32 nt, Human
uugauccuugcuaccccucuaccugcugcugu

SEQ ID NO: 273032 - RNA, 32 nt, Human
uugaucgccacagccccagacagggagugagu

SEQ ID NO: 273033 - RNA, 16 nt, Human
uugaucgcuggcccug

SEQ ID NO: 273034 - RNA, 32 nt, Human
uugaucgguaaaauccaagcucucucagcuga

SEQ ID NO: 273035 - RNA, 32 nt, Human
uugaucgugcagcugcugggcacgcccaguga

SEQ ID NO: 273036 - RNA, 32 nt, Human
uugaucgugccacugcacuccagccuggggga

SEQ ID NO: 273037 - RNA, 32 nt, Human
uugaucuagaacgcucuugauuuuggaauuau

SEQ ID NO: 273038 - RNA, 32 nt, Human
uugaucuagaagcagaggaaucccagcgccuu

SEQ ID NO: 273039 - RNA, 32 nt, Human
uugaucucaaaacagcuugacagagcaacugu

SEQ ID NO: 273040 - RNA, 32 nt, Human
uugaucucaagcgauccucccugccucggccu

SEQ ID NO: 273041 - RNA, 32 nt, Human
uugaucucaagggcaucuuggaaguauuugac

SEQ ID NO: 273042 - RNA, 32 nt, Human
uugaucucaggagguugaggcugcagugaauu

SEQ ID NO: 273043 - RNA, 32 nt, Human
uugaucucauuugccagcaaaauaauauuaua

SEQ ID NO: 273044 - RNA, 32 nt, Human
uugaucuccacauuuucucaggaguaguucgg

SEQ ID NO: 273045 - RNA, 32 nt, Human
uugaucucccagaagugcuggcccucccccag

SEQ ID NO: 273046 - RNA, 32 nt, Human
uugaucucccuucaguuaauuaggcaaggcua

SEQ ID NO: 273047 - RNA, 32 nt, Human
uugaucuccucuccuuccucuggccaguccug

SEQ ID NO: 273048 - RNA, 32 nt, Human
uugaucucucuacaacauuuauccuggucguu

SEQ ID NO: 273049 - RNA, 32 nt, Human
uugaucucucuggccucccaccaggaaugccg

SEQ ID NO: 273050 - RNA, 32 nt, Human
uugaucucugccucccugucacaacgcugccc

SEQ ID NO: 273051 - RNA, 32 nt, Human
uugaucugaauuaagcugucugccauuuggag

SEQ ID NO: 273052 - RNA, 32 nt, Human
uugaucugcaugucuguuuacacuucucugua

SEQ ID NO: 273053 - RNA, 32 nt, Human
uugaucugcccaggaaagggaugcauugacac

SEQ ID NO: 273054 - RNA, 32 nt, Human
uugaucugggagaugagacgggauccuucaug

SEQ ID NO: 273055 - RNA, 32 nt, Human
uugaucuggugggucuuugggguggggcccaa

SEQ ID NO: 273056 - RNA, 32 nt, Human
uugaucuuauuugccucaucuuccucaugguu

SEQ ID NO: 273057 - RNA, 32 nt, Human
uugaucuucucagccaggagaagaggguggug

SEQ ID NO: 273058 - RNA, 32 nt, Human
uugaucuucucuuccaccucucuggcucucau

SEQ ID NO: 273059 - RNA, 32 nt, Human
uugaucuuguauugaucagugccaauguacug

SEQ ID NO: 273060 - RNA, 32 nt, Human
uugaucuugucucucaggcuggguugcaaugg

SEQ ID NO: 273061 - RNA, 32 nt, Human
uugaucuuugccuguuacugcugucuagacgc

SEQ ID NO: 273062 - RNA, 32 nt, Human
uugaugaaaauguugcacauucuauaguugca

SEQ ID NO: 273063 - RNA, 32 nt, Human
uugaugaaagcacuagguaggggccagcaaau

SEQ ID NO: 273064 - RNA, 31 nt, Human
uugaugaacaauaaauauuuguugaacaaau

SEQ ID NO: 273065 - RNA, 32 nt, Human
uugaugaacagccucauuuccccagcuucccu

SEQ ID NO: 273066 - RNA, 32 nt, Human
uugaugaaccaauucacaagaggcuaggcccu

SEQ ID NO: 273067 - RNA, 32 nt, Human
uugaugaaccaauuuucugcagccucuuuuug

SEQ ID NO: 273068 - RNA, 32 nt, Human
uugaugaagagaaugaauggaagguauuggaa

SEQ ID NO: 273069 - RNA, 32 nt, Human
uugaugaaguagauugguuggaguagaaaaau

SEQ ID NO: 273070 - RNA, 32 nt, Human
uugaugacaagaaagauccccuccucuaccag

SEQ ID NO: 273071 - RNA, 32 nt, Human
uugaugacagaagugugagaccagcccagcca

SEQ ID NO: 273072 - RNA, 32 nt, Human
uugaugacaugggauugaguugguuaccuauu

SEQ ID NO: 273073 - RNA, 32 nt, Human
uugaugaccuaaaaagggauuauuucugagga

SEQ ID NO: 273074 - RNA, 32 nt, Human
uugaugacuuccucaaggccaaggccacauuc

SEQ ID NO: 273075 - RNA, 32 nt, Human
uugaugacuuccucaaggcuaaggccacauuc

SEQ ID NO: 273076 - RNA, 32 nt, Human
uugaugacuuccucaaugccaaggccacguuc

SEQ ID NO: 273077 - RNA, 32 nt, Human
uugaugacuucuagcaagccucgcuaaccucg

SEQ ID NO: 273078 - RNA, 32 nt, Human
uugaugagcaagacauacugaaugcauauuuc

SEQ ID NO: 273079 - RNA, 32 nt, Human
uugaugagcggcagcagcaggagccuggagcg

SEQ ID NO: 273080 - RNA, 32 nt, Human
uugaugaggaggugguggccugugauggcaag

SEQ ID NO: 273081 - RNA, 32 nt, Human
uugaugaggcuggagugcaguggcgcgaucuu

SEQ ID NO: 273082 - RNA, 32 nt, Human
uugaugaggggguaggaggggaagaagacagc

SEQ ID NO: 273083 - RNA, 32 nt, Human
uugaugauggcgguggagguggugguuguagu

SEQ ID NO: 273084 - RNA, 32 nt, Human
uugaugauguccuuauucauugccagguuaua

SEQ ID NO: 273085 - RNA, 32 nt, Human
uugaugcacaguuugaaaaugaugaaugaauu

SEQ ID NO: 273086 - RNA, 32 nt, Human
uugaugcacaucuggagccacuggagcuccuu

SEQ ID NO: 273087 - RNA, 32 nt, Human
uugaugcaccauugccacuguaauauugcugu

SEQ ID NO: 273088 - RNA, 32 nt, Human
uugaugcagagcuuuuuagccaugaagaaucu

SEQ ID NO: 273089 - RNA, 32 nt, Human
uugaugcagaugcuaugcuuucacuucucaug

SEQ ID NO: 273090 - RNA, 32 nt, Human
uugaugcagcuuuaagaugguggggaggaugg

SEQ ID NO: 273091 - RNA, 32 nt, Human
uugaugcaguuuguuggaaugacauugggcug

SEQ ID NO: 273092 - RNA, 32 nt, Human
uugaugcauaugcaccacauuauuauauuucc

SEQ ID NO: 273093 - RNA, 32 nt, Human
uugaugccagacaucaccagguuguagaaguu

SEQ ID NO: 273094 - RNA, 32 nt, Human
uugaugccaggaguucaagaccagccugggca

SEQ ID NO: 273095 - RNA, 32 nt, Human
uugaugccaggaguucgagaccagccuggcca

SEQ ID NO: 273096 - RNA, 32 nt, Human
uugaugccauuuuaccaguagaaggaugaaaa

SEQ ID NO: 273097 - RNA, 32 nt, Human
uugaugcccuugaauagccugaagaugaaggg

SEQ ID NO: 273098 - RNA, 32 nt, Human
uugaugccguucccugaacauaggaaaauaga

SEQ ID NO: 273099 - RNA, 32 nt, Human
uugaugcugcuugggccuggcccaguggcggg

SEQ ID NO: 273100 - RNA, 32 nt, Human
uugaugcuguggcucaguuugccuuccugaau

SEQ ID NO: 273101 - RNA, 21 nt, Human
uugaugcuuauguagugccuu

SEQ ID NO: 273102 - RNA, 32 nt, Human
uugaugcuucaguuuugaaguggauucugcac

SEQ ID NO: 273103 - RNA, 32 nt, Human
uugauggacccugagagagguggucccuccag

SEQ ID NO: 273104 - RNA, 32 nt, Human
uugauggagacuccauggaggcucccuccaca

SEQ ID NO: 273105 - RNA, 32 nt, Human
uugauggagauacaacaggaacuccaguggac

SEQ ID NO: 273106 - RNA, 32 nt, Human
uugauggaggcuggagcuuguguuuuaggauc

SEQ ID NO: 273107 - RNA, 32 nt, Human
uugauggaguuucgcuguuguugcccaggcug

SEQ ID NO: 273108 - RNA, 32 nt, Human
uugauggaugagggagaaagacacagucaguu

SEQ ID NO: 273109 - RNA, 28 nt, Human
uugauggcacauacuuuuagaggaugcu

SEQ ID NO: 273110 - RNA, 32 nt, Human
uugauggcaucugcagacucuguuuccaaaua

SEQ ID NO: 273111 - RNA, 32 nt, Human
uugauggcuggggccagucucuugucacuuug

SEQ ID NO: 273112 - RNA, 32 nt, Human
uugauggcuguucauuucacccaguauaagca

SEQ ID NO: 273113 - RNA, 32 nt, Human
uugaugggagcagaacuuuucuaagauacugu

SEQ ID NO: 273114 - RNA, 21 nt, Human
uugaugggauuguuuggaugu

SEQ ID NO: 273115 - RNA, 32 nt, Human
uugaugggcauuucuuuuaagacagagcagaa

SEQ ID NO: 273116 - RNA, 32 nt, Human
uugaugggccaucuugauuuucuucuggaugu

SEQ ID NO: 273117 - RNA, 32 nt, Human
uugaugggccuccccaaaucuaauuuaaagca

SEQ ID NO: 273118 - RNA, 28 nt, Human
uugaugggggaagagggugguucagccu

SEQ ID NO: 273119 - RNA, 32 nt, Human
uugaugggggcugugaguggggcagugugaua

SEQ ID NO: 273120 - RNA, 32 nt, Human
uugauggggguuuaaugauuugcucaaaguca

SEQ ID NO: 273121 - RNA, 32 nt, Human
uugauggugcuagaagaauuugagaagaaaua

SEQ ID NO: 273122 - RNA, 24 nt, Human
uugauggugcuccccuuccugcca

SEQ ID NO: 273123 - RNA, 32 nt, Human
uugauggugcuccccuuccugccagcgucaga

SEQ ID NO: 273124 - RNA, 32 nt, Human
uugaugguuuuguguuagucuuccugcagcug

SEQ ID NO: 273125 - RNA, 22 nt, Human
uugauguaaaaggaacagaaag

SEQ ID NO: 273126 - RNA, 32 nt, Human
uugauguacagaacacaaaugucuaguuucua

SEQ ID NO: 273127 - RNA, 32 nt, Human
uugauguacauacucauguuuuacaucuuuuc

SEQ ID NO: 273128 - RNA, 32 nt, Human
uugauguagaugaaccuguucacuggaaaauu

SEQ ID NO: 273129 - RNA, 32 nt, Human
uugauguaguuuugcuucuugcuuuauccauu

SEQ ID NO: 273130 - RNA, 32 nt, Human
uugauguauguuaauaaaagcauuucaggcug

SEQ ID NO: 273131 - RNA, 32 nt, Human
uugaugucauagggagcggggagcugcauucc

SEQ ID NO: 273132 - RNA, 32 nt, Human
uugauguccaguucuugucagaggaggcuugu

SEQ ID NO: 273133 - RNA, 32 nt, Human
uugauguccugcaaaugaaggaggaggauguc

SEQ ID NO: 273134 - RNA, 32 nt, Human
uugaugucuccccuggaaaccccaggaccaca

SEQ ID NO: 273135 - RNA, 32 nt, Human
uugaugucugagcuuuccagugcaaugugaau

SEQ ID NO: 273136 - RNA, 32 nt, Human
uugaugucuuguuuccugagccugugucaaau

SEQ ID NO: 273137 - RNA, 32 nt, Human
uugaugugaacccagugaucaguggaauuguc

SEQ ID NO: 273138 - RNA, 32 nt, Human
uugaugugcuuguuugacauuugucucauuaa

SEQ ID NO: 273139 - RNA, 32 nt, Human
uugauguggaaagaaguugacagaggguugca

SEQ ID NO: 273140 - RNA, 32 nt, Human
uugauguggccaagccuuucccucccuaccug

SEQ ID NO: 273141 - RNA, 32 nt, Human
uugaugugggagaaaaagcgacuggggcuugc

SEQ ID NO: 273142 - RNA, 32 nt, Human
uugauguggucuggccccuugucuaugaucuu

SEQ ID NO: 273143 - RNA, 32 nt, Human
uugauguguugagcuggaggugaguggaccgg

SEQ ID NO: 273144 - RNA, 32 nt, Human
uugauguuaucagacagagcacugacuaugua

SEQ ID NO: 273145 - RNA, 32 nt, Human
uugauguuccagcucaccagaagauucuuaca

SEQ ID NO: 273146 - RNA, 32 nt, Human
uugauguucuuccuuuucacauuucagaaucg

SEQ ID NO: 273147 - RNA, 32 nt, Human
uugauuaacauggaaggggaaauaugauagau

SEQ ID NO: 273148 - RNA, 24 nt, Human
uugauuaagugggaaguguuuuga

SEQ ID NO: 273149 - RNA, 32 nt, Human
uugauuacaccccugcacuccagccugggcgg

SEQ ID NO: 273150 - RNA, 32 nt, Human
uugauuacaggcaaugagagcugugagugggg

SEQ ID NO: 273151 - RNA, 32 nt, Human
uugauuacccaagaguucaaggcugcagugaa

SEQ ID NO: 273152 - RNA, 32 nt, Human
uugauuagcuguucuucuacaucacauuguua

SEQ ID NO: 273153 - RNA, 32 nt, Human
uugauuauaccacugcacuccagccuggguga

SEQ ID NO: 273154 - RNA, 32 nt, Human
uugauuaugaauagaagguagugaagaaaagc

SEQ ID NO: 273155 - RNA, 32 nt, Human
uugauuauuccauuuaugcuggagauuacaaa

SEQ ID NO: 273156 - RNA, 32 nt, Human
uugauuauuuccaguguuauguuuucauguaa

SEQ ID NO: 273157 - RNA, 32 nt, Human
uugauuauuugaaucuuacagcaacaaauagg

SEQ ID NO: 273158 - RNA, 32 nt, Human
uugauucaacaaugcuauaaucuguuacucuc

SEQ ID NO: 273159 - RNA, 32 nt, Human
uugauucagccuggagaugguggaagagauaa

SEQ ID NO: 273160 - RNA, 32 nt, Human
uugauucagcuggucugaaucucugaauuuau

SEQ ID NO: 273161 - RNA, 32 nt, Human
uugauucauugcaggucucaggcacagguuga

SEQ ID NO: 273162 - RNA, 31 nt, Human
uugauuccacuuuucugcauagccgguagaa

SEQ ID NO: 273163 - RNA, 32 nt, Human
uugauuccagugagggagaaagugaucugcag

SEQ ID NO: 273164 - RNA, 32 nt, Human
uugauuccaucucaagacaauuugucaaauac

SEQ ID NO: 273165 - RNA, 32 nt, Human
uugauuccaugucuuugcuauugugaauagug

SEQ ID NO: 273166 - RNA, 32 nt, Human
uugauuccaugucuuugcuauugugaauauug

SEQ ID NO: 273167 - RNA, 32 nt, Human
uugauuccauguuuuugcuauuguaaauagug

SEQ ID NO: 273168 - RNA, 32 nt, Human
uugauuccauguuuuugcuauugugaauagug

SEQ ID NO: 273169 - RNA, 32 nt, Human
uugauucccagaggaguuggugcuucacauca

SEQ ID NO: 273170 - RNA, 32 nt, Human
uugauuccugcccaacagucccugccagauac

SEQ ID NO: 273171 - RNA, 32 nt, Human
uugauuccugugaguagggcucagggauuuau

SEQ ID NO: 273172 - RNA, 32 nt, Human
uugauuccuuaucuuugcuauugugaacagug

SEQ ID NO: 273173 - RNA, 32 nt, Human
uugauucucagcacuuacuaauuguguggaca

SEQ ID NO: 273174 - RNA, 32 nt, Human
uugauucucagccugguagaugcugguguaua

SEQ ID NO: 273175 - RNA, 32 nt, Human
uugauucucagccugguagauguugguguaua

SEQ ID NO: 273176 - RNA, 32 nt, Human
uugauucucauuuuaccauagcuuauauucuc

SEQ ID NO: 273177 - RNA, 32 nt, Human
uugauucuccagccugggcaacggagugagac

SEQ ID NO: 273178 - RNA, 31 nt, Human
uugauucugcccacagggccugugccaaggc

SEQ ID NO: 273179 - RNA, 32 nt, Human
uugauucugccuuaaucaaccccagcccaugu

SEQ ID NO: 273180 - RNA, 32 nt, Human
uugauucuguaucuacagaagucauguaacug

SEQ ID NO: 273181 - RNA, 32 nt, Human
uugauucugugucuuugcuauuguaaauagug

SEQ ID NO: 273182 - RNA, 24 nt, Human
uugauucuguucgcaaagcacaga

SEQ ID NO: 273183 - RNA, 32 nt, Human
uugauugaaagaguuaugaucuaaagaccugg

SEQ ID NO: 273184 - RNA, 32 nt, Human
uugauugaauccuaauuuagacaagccauaac

SEQ ID NO: 273185 - RNA, 32 nt, Human
uugauugacagagagguugaccuuaugaugag

SEQ ID NO: 273186 - RNA, 32 nt, Human
uugauugacuaaaucaggauggaaaugauggc

SEQ ID NO: 273187 - RNA, 32 nt, Human
uugauugagcaucuacaaugugccaguuguag

SEQ ID NO: 273188 - RNA, 32 nt, Human
uugauugagccuccaccucugggauuuuucuu

SEQ ID NO: 273189 - RNA, 32 nt, Human
uugauugaucucucaugucucccuaaaaugua

SEQ ID NO: 273190 - RNA, 32 nt, Human
uugauugcaccacugcacucuagccugcguga

SEQ ID NO: 273191 - RNA, 32 nt, Human
uugauugcaccacugcacucuagccuggggaa

SEQ ID NO: 273192 - RNA, 32 nt, Human
uugauugcauagcuccucauguuucuacacuc

SEQ ID NO: 273193 - RNA, 32 nt, Human
uugauugccgcuccggucccaggagggaugga

SEQ ID NO: 273194 - RNA, 32 nt, Human
uugauugcuaugcagguuugggagaggaggcc

SEQ ID NO: 273195 - RNA, 32 nt, Human
uugauugcugaagaaguauguuuaagagggag

SEQ ID NO: 273196 - RNA, 32 nt, Human
uugauugcugcagaaauguccuaugcacucuu

SEQ ID NO: 273197 - RNA, 32 nt, Human
uugauugcugugccucauuacaaaugcauaug

SEQ ID NO: 273198 - RNA, 32 nt, Human
uugauugcuuuuguauuuaauucugcaggugu

SEQ ID NO: 273199 - RNA, 32 nt, Human
uugauuggaagaaaggaagucgcagccccugc

SEQ ID NO: 273200 - RNA, 32 nt, Human
uugauugggaaugggguagggggaggaguugu

SEQ ID NO: 273201 - RNA, 32 nt, Human
uugauuggguagaucuggguuaggagcuggga

SEQ ID NO: 273202 - RNA, 32 nt, Human
uugauugguucagaaucuggggcaggauggaa

SEQ ID NO: 273203 - RNA, 32 nt, Human
uugauugguuuuccuguaggcuggaaguaaaa

SEQ ID NO: 273204 - RNA, 25 nt, Human
uugauuguauggauguaaguguucu

SEQ ID NO: 273205 - RNA, 32 nt, Human
uugauugucccuggauggagugcagucaccuu

SEQ ID NO: 273206 - RNA, 32 nt, Human
uugauugugucaccccaucacagcucaguguu

SEQ ID NO: 273207 - RNA, 32 nt, Human
uugauugugucacugcacuccagccugggcaa

SEQ ID NO: 273208 - RNA, 32 nt, Human
uugauugugucacugcacuccagcuuggguga

SEQ ID NO: 273209 - RNA, 32 nt, Human
uugauugugugguucauuuuuguauuuauuuc

SEQ ID NO: 273210 - RNA, 32 nt, Human
uugauuguugaaugauagaugaaguauugcug

SEQ ID NO: 273211 - RNA, 32 nt, Human
uugauuguuugaagucuauggaagaaauaguu

SEQ ID NO: 273212 - RNA, 32 nt, Human
uugauuuaaucagcaacauagaccuugcagcg

SEQ ID NO: 273213 - RNA, 32 nt, Human
uugauuuacaauuguccccacccuuuuauaua

SEQ ID NO: 273214 - RNA, 32 nt, Human
uugauuuaccugccaagaccugaguucaggcc

SEQ ID NO: 273215 - RNA, 32 nt, Human
uugauuuacuauaagagcugggauuugauuca

SEQ ID NO: 273216 - RNA, 20 nt, Human
uugauuuaguaaguguucug

SEQ ID NO: 273217 - RNA, 32 nt, Human
uugauuuauaaauacaaaaauacauucuccaa

SEQ ID NO: 273218 - RNA, 32 nt, Human
uugauuucaacauuuucucccacccucucggc

SEQ ID NO: 273219 - RNA, 32 nt, Human
uugauuucacuuaucauagaacaaauauguau

SEQ ID NO: 273220 - RNA, 32 nt, Human
uugauuucagccacaccccugcagcccugcau

SEQ ID NO: 273221 - RNA, 32 nt, Human
uugauuucagugccuguuggggacuugauuuc

SEQ ID NO: 273222 - RNA, 32 nt, Human
uugauuuccaagaaucggcauguauacuuaau

SEQ ID NO: 273223 - RNA, 32 nt, Human
uugauuucccacuccuagaugcuaaagagacu

SEQ ID NO: 273224 - RNA, 32 nt, Human
uugauuuccuaccucaguguacacucaacuau

SEQ ID NO: 273225 - RNA, 32 nt, Human
uugauuuccucuucucucccuucaagccccac

SEQ ID NO: 273226 - RNA, 32 nt, Human
uugauuucggcaagcuggaauggcccaccagc

SEQ ID NO: 273227 - RNA, 32 nt, Human
uugauuucuaacuccuugucugaauccugcuu

SEQ ID NO: 273228 - RNA, 32 nt, Human
uugauuucucauugaccaggguuuguucuugg

SEQ ID NO: 273229 - RNA, 20 nt, Human
uugauuucugaggaucucag

SEQ ID NO: 273230 - RNA, 32 nt, Human
uugauuucugcccagggauuugcucaccccaa

SEQ ID NO: 273231 - RNA, 32 nt, Human
uugauuucuggaccacugaugcuguugcugag

SEQ ID NO: 273232 - RNA, 32 nt, Human
uugauuugaaagacacuggcucugccacuuaa

SEQ ID NO: 273233 - RNA, 32 nt, Human
uugauuugaacaaauuuucuggugcuaagucu

SEQ ID NO: 273234 - RNA, 32 nt, Human
uugauuugaagaaaaagauauuuuggugcuca

SEQ ID NO: 273235 - RNA, 32 nt, Human
uugauuugcauauccuggguguacugagccac

SEQ ID NO: 273236 - RNA, 32 nt, Human
uugauuugcaucuugggaguugcuuggaauuu

SEQ ID NO: 273237 - RNA, 32 nt, Human
uugauuuggagaaauauaaauuucugccagaa

SEQ ID NO: 273238 - RNA, 32 nt, Human
uugauuuuaaagccucuucauccaggucaguu

SEQ ID NO: 273239 - RNA, 32 nt, Human
uugauuuuaacucauugucacucugauguuca

SEQ ID NO: 273240 - RNA, 32 nt, Human
uugauuuuagccuggugagaccccgagcauau

SEQ ID NO: 273241 - RNA, 32 nt, Human
uugauuuucacugcaacucugccuuugugugu

SEQ ID NO: 273242 - RNA, 32 nt, Human
uugauuuuccaagugguucagaauguaaauau

SEQ ID NO: 273243 - RNA, 32 nt, Human
uugauuuuccacaguucugcaggcuggaaauc

SEQ ID NO: 273244 - RNA, 32 nt, Human
uugauuuuccccucuucuccccaccuccacuc

SEQ ID NO: 273245 - RNA, 32 nt, Human
uugauuuugcauuuugcacuuccucccaggau

SEQ ID NO: 273246 - RNA, 32 nt, Human
uugauuuugccucccaacaccauuucuuuuua

SEQ ID NO: 273247 - RNA, 32 nt, Human
uugauuuuggcccucugauguauugcuagagc

SEQ ID NO: 273248 - RNA, 32 nt, Human
uugauuuuguauccugagacucugcugaaguu

SEQ ID NO: 273249 - RNA, 32 nt, Human
uugauuuuguauccugagacuuugcugaaguu

SEQ ID NO: 273250 - RNA, 32 nt, Human
uugauuuuguuuguuuucucgugagcuuaggc

SEQ ID NO: 273251 - RNA, 32 nt, Human
uugauuuuucuuguuaaucagaauuccuauuc

SEQ ID NO: 273252 - RNA, 32 nt, Human
uugcaaaaagggcacggggcagagggacuaug

SEQ ID NO: 273253 - RNA, 32 nt, Human
uugcaaaacagcuuuaauccuugaguauauuu

SEQ ID NO: 273254 - RNA, 32 nt, Human
uugcaaaacccgccuccagccuccagcagcaa

SEQ ID NO: 273255 - RNA, 23 nt, Human
uugcaaaagaaaguaacaugauc

SEQ ID NO: 273256 - RNA, 32 nt, Human
uugcaaaauagaagaagaggaaguuagagaua

SEQ ID NO: 273257 - RNA, 32 nt, Human
uugcaaaauguucuuucaguuuuuagaaccuc

SEQ ID NO: 273258 - RNA, 32 nt, Human
uugcaaacagcaauggauuaggauauggaaau

SEQ ID NO: 273259 - RNA, 32 nt, Human
uugcaaaccgaguacugcuguaaauacuaugu

SEQ ID NO: 273260 - RNA, 32 nt, Human
uugcaaacuacaccuccacccacugggcugaa

SEQ ID NO: 273261 - RNA, 32 nt, Human
uugcaaacuccuuguuuuauuugcaagugcuu

SEQ ID NO: 273262 - RNA, 32 nt, Human
uugcaaacugaugcuuucuuuaauuguccugg

SEQ ID NO: 273263 - RNA, 32 nt, Human
uugcaaacuggcauuucaucaguggcuaaauu

SEQ ID NO: 273264 - RNA, 32 nt, Human
uugcaaagacacaggcguauacccacaaaaac

SEQ ID NO: 273265 - RNA, 32 nt, Human
uugcaaagaccucaaucaugucagcuuaucuu

SEQ ID NO: 273266 - RNA, 32 nt, Human
uugcaaagacgagguuucaccauguugaccag

SEQ ID NO: 273267 - RNA, 32 nt, Human
uugcaaagagguuucuagacagcagaagaaaa

SEQ ID NO: 273268 - RNA, 32 nt, Human
uugcaaagcagauuuaaugucauguucagcca

SEQ ID NO: 273269 - RNA, 32 nt, Human
uugcaaagccgaggaaucaagccagaugcgag

SEQ ID NO: 273270 - RNA, 32 nt, Human
uugcaaaggaagagcuaagauuaacauaauuu

SEQ ID NO: 273271 - RNA, 32 nt, Human
uugcaaaggaggaggaaaagggaggacuuggu

SEQ ID NO: 273272 - RNA, 32 nt, Human
uugcaaagggccuggggcagagccuggcacau

SEQ ID NO: 273273 - RNA, 32 nt, Human
uugcaaagggcugaggcccagcucugucuggu

SEQ ID NO: 273274 - RNA, 32 nt, Human
uugcaaagucuacauuuuaugcugaaucugca

SEQ ID NO: 273275 - RNA, 32 nt, Human
uugcaaaguucacugucucagcaaaguugaac

SEQ ID NO: 273276 - RNA, 32 nt, Human
uugcaaauacaaaauaaaaauuaguuguuacc

SEQ ID NO: 273277 - RNA, 32 nt, Human
uugcaaauuccaccccuccuucccugguccag

SEQ ID NO: 273278 - RNA, 32 nt, Human
uugcaacaaaaacaaaaauugacaggugggau

SEQ ID NO: 273279 - RNA, 32 nt, Human
uugcaacaaucaauggaaucuucauguauucu

SEQ ID NO: 273280 - RNA, 32 nt, Human
uugcaacacugcaguccagucuggaccacaga

SEQ ID NO: 273281 - RNA, 32 nt, Human
uugcaacacugccacuccagccugggugacag

SEQ ID NO: 273282 - RNA, 32 nt, Human
uugcaacacuggcuggccaucuggccugccug

SEQ ID NO: 273283 - RNA, 32 nt, Human
uugcaacacuguacuccagccugggcaacaga

SEQ ID NO: 273284 - RNA, 32 nt, Human
uugcaaccaccaggcuggugcccugcagcugu

SEQ ID NO: 273285 - RNA, 32 nt, Human
uugcaaccuauccugggagacccuaaaacaua

SEQ ID NO: 273286 - RNA, 32 nt, Human
uugcaaccuccgcuuccuggguucaaacaauu

SEQ ID NO: 273287 - RNA, 31 nt, Human
uugcaaccucugucucccagguucaagcgau

SEQ ID NO: 273288 - RNA, 32 nt, Human
uugcaacggccucagaaguuuggccggagagg

SEQ ID NO: 273289 - RNA, 32 nt, Human
uugcaacucugccucuguucucuugcauucug

SEQ ID NO: 273290 - RNA, 32 nt, Human
uugcaacugcacuccagccugggcuacagagc

SEQ ID NO: 273291 - RNA, 23 nt, Human
uugcaacuggccugagcaacaca

SEQ ID NO: 273292 - RNA, 32 nt, Human
uugcaacugugcccuccacacuauccuuacuu

SEQ ID NO: 273293 - RNA, 32 nt, Human
uugcaacugugccucccucugucuguuuucac

SEQ ID NO: 273294 - RNA, 32 nt, Human
uugcaacuuggacuuguccucagcagcuggua

SEQ ID NO: 273295 - RNA, 32 nt, Human
uugcaacuuuccagaaucuggcccagaaauua

SEQ ID NO: 273296 - RNA, 32 nt, Human
uugcaagaaagaauuugggcgaauccauagag

SEQ ID NO: 273297 - RNA, 32 nt, Human
uugcaagaaagaggcugccaggccuacaucag

SEQ ID NO: 273298 - RNA, 32 nt, Human
uugcaagaaccuggcucugccugcaugucagc

SEQ ID NO: 273299 - RNA, 32 nt, Human
uugcaagaaguuaggguuaaggagaggugaug

SEQ ID NO: 273300 - RNA, 32 nt, Human
uugcaagaccaccagcuccuggaagcugaguu

SEQ ID NO: 273301 - RNA, 32 nt, Human
uugcaagauggauacuaauuccagcauucucu

SEQ ID NO: 273302 - RNA, 32 nt, Human
uugcaagcagacccaaaagcauuaaggagaaa

SEQ ID NO: 273303 - RNA, 32 nt, Human
uugcaagcucaagugauccuccugacucagcc

SEQ ID NO: 273304 - RNA, 32 nt, Human
uugcaagcucaggccuuuaaggacugcugaug

SEQ ID NO: 273305 - RNA, 32 nt, Human
uugcaagcuccgccucccagguucaagugauu

SEQ ID NO: 273306 - RNA, 32 nt, Human
uugcaaggacaguguauguuguccuuuuggaa

SEQ ID NO: 273307 - RNA, 32 nt, Human
uugcaaggaugggagacugggauagcuuccca

SEQ ID NO: 273308 - RNA, 32 nt, Human
uugcaaguaccacuccauccagccuugggcaa

SEQ ID NO: 273309 - RNA, 32 nt, Human
uugcaagucucccagcccaucucuccgagcag

SEQ ID NO: 273310 - RNA, 32 nt, Human
uugcaaguuauccuguggccagguguggucuc

SEQ ID NO: 273311 - RNA, 22 nt, Human
uugcaaguugcccucccuggca

SEQ ID NO: 273312 - RNA, 32 nt, Human
uugcaauaaaguacauuuugacuuuguuggca

SEQ ID NO: 273313 - RNA, 32 nt, Human
uugcaauaacaucccucuguaccuuuucuggc

SEQ ID NO: 273314 - RNA, 32 nt, Human
uugcaauacauuaacagacccuuuaucaacau

SEQ ID NO: 273315 - RNA, 32 nt, Human
uugcaauauuucagaagcuuuaacugaagugu

SEQ ID NO: 273316 - RNA, 32 nt, Human
uugcaaucaaggccauggcaaaauacuggcuc

SEQ ID NO: 273317 - RNA, 32 nt, Human
uugcaaucccuuaaugucagacucuuaggaaa

SEQ ID NO: 273318 - RNA, 32 nt, Human
uugcaaugaacuauuuucucucaguccggggu

SEQ ID NO: 273319 - RNA, 32 nt, Human
uugcaaugaagcggagguugcagugagccgag

SEQ ID NO: 273320 - RNA, 21 nt, Human
uugcaaugagcuaugauuuca

SEQ ID NO: 273321 - RNA, 30 nt, Human
uugcaauggaaaggacacuugagagaagac

SEQ ID NO: 273322 - RNA, 32 nt, Human
uugcaauggaaauggauuauugaagacacaaa

SEQ ID NO: 273323 - RNA, 31 nt, Human
uugcaauggaucauguccaugccagguguua

SEQ ID NO: 273324 - RNA, 32 nt, Human
uugcaaugggcugccaagaaaacggcugugcu

SEQ ID NO: 273325 - RNA, 32 nt, Human
uugcaauggucugaauguauucucccaaaauu

SEQ ID NO: 273326 - RNA, 32 nt, Human
uugcaauguauuucgcucaucuggacccugca

SEQ ID NO: 273327 - RNA, 32 nt, Human
uugcaauguuaauuauuuagauauuuaauuuc

SEQ ID NO: 273328 - RNA, 32 nt, Human
uugcaauuccagaaugcugggaguuuuacagu

SEQ ID NO: 273329 - RNA, 32 nt, Human
uugcaauuccugcaggccaggggagagaccag

SEQ ID NO: 273330 - RNA, 32 nt, Human
uugcaauucuguaggcuggaagucugacuaug

SEQ ID NO: 273331 - RNA, 32 nt, Human
uugcaauugcagucuucauucauuaucaucaa

SEQ ID NO: 273332 - RNA, 32 nt, Human
uugcacaaagccugguccugaguaggugcccu

SEQ ID NO: 273333 - RNA, 32 nt, Human
uugcacaacaacaacaacaacaaauucacgga

SEQ ID NO: 273334 - RNA, 32 nt, Human
uugcacaacuucaagaaaagcagcucagcuca

SEQ ID NO: 273335 - RNA, 32 nt, Human
uugcacaaguacuggcuggauaccucugaggc

SEQ ID NO: 273336 - RNA, 32 nt, Human
uugcacaauugcacuccagccuggcgacagag

SEQ ID NO: 273337 - RNA, 32 nt, Human
uugcacaauugcuuuaggguaagugaauuaua

SEQ ID NO: 273338 - RNA, 32 nt, Human
uugcacacccaccucucccugcaccugguucu

SEQ ID NO: 273339 - RNA, 32 nt, Human
uugcacaccccagcucugagguggcuucagcg

SEQ ID NO: 273340 - RNA, 32 nt, Human
uugcacaccccagcugugagguggcuucagcg

SEQ ID NO: 273341 - RNA, 32 nt, Human
uugcacaccccucccuguaaccaaggaacacu

SEQ ID NO: 273342 - RNA, 32 nt, Human
uugcacacgccuguaaucccagcugcuuggga

SEQ ID NO: 273343 - RNA, 32 nt, Human
uugcacacucacaauauucucucucagaaauc

SEQ ID NO: 273344 - RNA, 32 nt, Human
uugcacacucacuggcaucuuugcuaugggga

SEQ ID NO: 273345 - RNA, 32 nt, Human
uugcacacucaggcuaucugagauacugguaa

SEQ ID NO: 273346 - RNA, 32 nt, Human
uugcacacugcacuccagccugggugacuagc

SEQ ID NO: 273347 - RNA, 32 nt, Human
uugcacacugccuguucacaugucgcccaggc

SEQ ID NO: 273348 - RNA, 32 nt, Human
uugcacagaacaguuacuuacuguagcaggga

SEQ ID NO: 273349 - RNA, 18 nt, Human
uugcacagaaguaauuca

SEQ ID NO: 273350 - RNA, 32 nt, Human
uugcacagacacacacauauaucaauucucau

SEQ ID NO: 273351 - RNA, 32 nt, Human
uugcacagagcuggagggaggggugagauagg

SEQ ID NO: 273352 - RNA, 32 nt, Human
uugcacagauccccaccugccauccuauagug

SEQ ID NO: 273353 - RNA, 32 nt, Human
uugcacagcaaaaacugcgaggccagaacuag

SEQ ID NO: 273354 - RNA, 19 nt, Human
uugcacagcgguauucuca

SEQ ID NO: 273355 - RNA, 32 nt, Human
uugcacagcucauguacuggcucucacggcca

SEQ ID NO: 273356 - RNA, 32 nt, Human
uugcacagcugauguagacagucaggcaaaac

SEQ ID NO: 273357 - RNA, 32 nt, Human
uugcacagcugcacuccagccugugcugagac

SEQ ID NO: 273358 - RNA, 32 nt, Human
uugcacagcugcugcugacaggucuaccugaa

SEQ ID NO: 273359 - RNA, 32 nt, Human
uugcacaggaaagccuuuauacuugaugagaa

SEQ ID NO: 273360 - RNA, 20 nt, Human
uugcacaggaguucauuuca

SEQ ID NO: 273361 - RNA, 32 nt, Human
uugcacaggcuggucuugaacucuugagcuca

SEQ ID NO: 273362 - RNA, 32 nt, Human
uugcacagggaaaugcagggggcaggacuugg

SEQ ID NO: 273363 - RNA, 18 nt, Human
uugcacaguaugcuuuca

SEQ ID NO: 273364 - RNA, 32 nt, Human
uugcacagucggcugggcggugcaauggcgga

SEQ ID NO: 273365 - RNA, 32 nt, Human
uugcacagugccucaagccccagaguggcuca

SEQ ID NO: 273366 - RNA, 32 nt, Human
uugcacagugccuggcagacauuugacauuca

SEQ ID NO: 273367 - RNA, 18 nt, Human
uugcacaguuaauuuuca

SEQ ID NO: 273368 - RNA, 32 nt, Human
uugcacauacauacaaacacaugcaaacauac

SEQ ID NO: 273369 - RNA, 31 nt, Human
uugcacauagaauauagacucacuuguacau

SEQ ID NO: 273370 - RNA, 20 nt, Human
uugcacaucagaaaguucau

SEQ ID NO: 273371 - RNA, 32 nt, Human
uugcacauccuucaaggggaucuuuaaccucu

SEQ ID NO: 273372 - RNA, 32 nt, Human
uugcacaucuagcauccagaacagugagaaug

SEQ ID NO: 273373 - RNA, 32 nt, Human
uugcacauguuggcaacacacgcauccgcauc

SEQ ID NO: 273374 - RNA, 32 nt, Human
uugcacauucuaggcagccauuuggaagauuc

SEQ ID NO: 273375 - RNA, 32 nt, Human
uugcaccaaauccugucuucagucuuuuguuu

SEQ ID NO: 273376 - RNA, 32 nt, Human
uugcaccaacccugcguggcucuugucugugu

SEQ ID NO: 273377 - RNA, 32 nt, Human
uugcaccaacuuugaagucugauuuuccugga

SEQ ID NO: 273378 - RNA, 32 nt, Human
uugcaccaaggaagcuuuuggggaggaaggaa

SEQ ID NO: 273379 - RNA, 32 nt, Human
uugcaccacagcacucaagccugggugacaga

SEQ ID NO: 273380 - RNA, 32 nt, Human
uugcaccacagcacuccaaccugggugacaga

SEQ ID NO: 273381 - RNA, 32 nt, Human
uugcaccacagcacugcagccuagacaacaga

SEQ ID NO: 273382 - RNA, 32 nt, Human
uugcaccaccacacuccagccugcgcgacaga

SEQ ID NO: 273383 - RNA, 32 nt, Human
uugcaccaccacacuccagccugggugacaag

SEQ ID NO: 273384 - RNA, 32 nt, Human
uugcaccaccacacuccagccugggugacaga

SEQ ID NO: 273385 - RNA, 32 nt, Human
uugcaccaccgcacuccagccugggugacaga

SEQ ID NO: 273386 - RNA, 32 nt, Human
uugcaccacggcacgcuagccugggugacaca

SEQ ID NO: 273387 - RNA, 32 nt, Human
uugcaccacggcacuccagccugggugacaga

SEQ ID NO: 273388 - RNA, 32 nt, Human
uugcaccacuacacuccagccuggaugacaga

SEQ ID NO: 273389 - RNA, 32 nt, Human
uugcaccacuacacuccagccugggcaacaga

SEQ ID NO: 273390 - RNA, 32 nt, Human
uugcaccacuacacuccagccugggugacaaa

SEQ ID NO: 273391 - RNA, 32 nt, Human
uugcaccacuacacuguagccugggugacaaa

SEQ ID NO: 273392 - RNA, 32 nt, Human
uugcaccacugaacuccagccugggccacaua

SEQ ID NO: 273393 - RNA, 32 nt, Human
uugcaccacugcacgccagccugggugaaaga

SEQ ID NO: 273394 - RNA, 32 nt, Human
uugcaccacugcacuacagcuugggugacagc

SEQ ID NO: 273395 - RNA, 32 nt, Human
uugcaccacugcacucaagccugggcaacaga

SEQ ID NO: 273396 - RNA, 32 nt, Human
uugcaccacugcacuccaaccugggcaacaga

SEQ ID NO: 273397 - RNA, 32 nt, Human
uugcaccacugcacuccaaccugggugacaag

SEQ ID NO: 273398 - RNA, 32 nt, Human
uugcaccacugcacuccaaccugggugacaga

SEQ ID NO: 273399 - RNA, 32 nt, Human
uugcaccacugcacuccacagagugagacucc

SEQ ID NO: 273400 - RNA, 32 nt, Human
uugcaccacugcacuccagcccaggcaacaga

SEQ ID NO: 273401 - RNA, 32 nt, Human
uugcaccacugcacuccagccggggugacaga

SEQ ID NO: 273402 - RNA, 32 nt, Human
uugcaccacugcacuccagccuaggcgacaga

SEQ ID NO: 273403 - RNA, 32 nt, Human
uugcaccacugcacuccagccugagugacaga

SEQ ID NO: 273404 - RNA, 32 nt, Human
uugcaccacugcacuccagccugagugaggaa

SEQ ID NO: 273405 - RNA, 32 nt, Human
uugcaccacugcacuccagccuggaaaacgga

SEQ ID NO: 273406 - RNA, 32 nt, Human
uugcaccacugcacuccagccuggcgacaaag

SEQ ID NO: 273407 - RNA, 32 nt, Human
uugcaccacugcacuccagccugggaaacaga

SEQ ID NO: 273408 - RNA, 32 nt, Human
uugcaccacugcacuccagccugggagacaga

SEQ ID NO: 273409 - RNA, 32 nt, Human
uugcaccacugcacuccagccugggcaacaaa

SEQ ID NO: 273410 - RNA, 32 nt, Human
uugcaccacugcacuccagccugggcaacaga

SEQ ID NO: 273411 - RNA, 32 nt, Human
uugcaccacugcacuccagccugggcaauaga

SEQ ID NO: 273412 - RNA, 32 nt, Human
uugcaccacugcacuccagccugggcgacaga

SEQ ID NO: 273413 - RNA, 32 nt, Human
uugcaccacugcacuccagccugggcgacugu

SEQ ID NO: 273414 - RNA, 32 nt, Human
uugcaccacugcacuccagccugggcggcaga

SEQ ID NO: 273415 - RNA, 32 nt, Human
uugcaccacugcacuccagccugggcuacaga

SEQ ID NO: 273416 - RNA, 32 nt, Human
uugcaccacugcacuccagccuggggacagag

SEQ ID NO: 273417 - RNA, 32 nt, Human
uugcaccacugcacuccagccuggguaacaag

SEQ ID NO: 273418 - RNA, 32 nt, Human
uugcaccacugcacuccagccugggugacaga

SEQ ID NO: 273419 - RNA, 32 nt, Human
uugcaccacugcacuccagccugggugauaga

SEQ ID NO: 273420 - RNA, 32 nt, Human
uugcaccacugcacuccagccuggguggcaga

SEQ ID NO: 273421 - RNA, 32 nt, Human
uugcaccacugcacuccagccugggugucaga

SEQ ID NO: 273422 - RNA, 32 nt, Human
uugcaccacugcacuccagccuggugacagag

SEQ ID NO: 273423 - RNA, 32 nt, Human
uugcaccacugcacuccagccuggugacaggg

SEQ ID NO: 273424 - RNA, 32 nt, Human
uugcaccacugcacuccagcgagacucugucu

SEQ ID NO: 273425 - RNA, 32 nt, Human
uugcaccacugcacuccaggcuggguaacaga

SEQ ID NO: 273426 - RNA, 32 nt, Human
uugcaccacugcacuccagucugggcaacaga

SEQ ID NO: 273427 - RNA, 32 nt, Human
uugcaccacugcacuccagucugggugagagu

SEQ ID NO: 273428 - RNA, 32 nt, Human
uugcaccacugcacuccagucugguugagaga

SEQ ID NO: 273429 - RNA, 32 nt, Human
uugcaccacugcacuccauccugggcaacaga

SEQ ID NO: 273430 - RNA, 32 nt, Human
uugcaccacugcacucccuuccaggugaaaga

SEQ ID NO: 273431 - RNA, 32 nt, Human
uugcaccacugcacucuaacuugggcaacaaa

SEQ ID NO: 273432 - RNA, 32 nt, Human
uugcaccacugcacucuacucugggugacaga

SEQ ID NO: 273433 - RNA, 32 nt, Human
uugcaccacugcacucuagccugcgugacaca

SEQ ID NO: 273434 - RNA, 32 nt, Human
uugcaccacugcacucuagccuggggaacaga

SEQ ID NO: 273435 - RNA, 32 nt, Human
uugcaccacugcacucuagccuggguaacaag

SEQ ID NO: 273436 - RNA, 32 nt, Human
uugcaccacugcacugcagccugggaaacaga

SEQ ID NO: 273437 - RNA, 32 nt, Human
uugcaccacugcacuucagccuggugacagag

SEQ ID NO: 273438 - RNA, 32 nt, Human
uugcaccacugcacuucagcuugggcaacaga

SEQ ID NO: 273439 - RNA, 32 nt, Human
uugcaccacugcacuuuagucugggugacaga

SEQ ID NO: 273440 - RNA, 32 nt, Human
uugcaccacugcaguucagccuggaugaugag

SEQ ID NO: 273441 - RNA, 32 nt, Human
uugcaccacugcauuccaaccugggcggcaga

SEQ ID NO: 273442 - RNA, 32 nt, Human
uugcaccacugcauuccagcauggccacaaag

SEQ ID NO: 273443 - RNA, 32 nt, Human
uugcaccacugcauuccagccuggaugacaga

SEQ ID NO: 273444 - RNA, 32 nt, Human
uugcaccacugcauuccagccuggcgacagag

SEQ ID NO: 273445 - RNA, 32 nt, Human
uugcaccacugcucuccagccuggggaacaga

SEQ ID NO: 273446 - RNA, 32 nt, Human
uugcaccacuggacgccagccuaggcaacacu

SEQ ID NO: 273447 - RNA, 32 nt, Human
uugcaccacuguacuccaaccugggcgacaga

SEQ ID NO: 273448 - RNA, 32 nt, Human
uugcaccacuguacuccagacuggauaacagc

SEQ ID NO: 273449 - RNA, 32 nt, Human
uugcaccacuguacuccagcacucuagccugg

SEQ ID NO: 273450 - RNA, 32 nt, Human
uugcaccacuguacuccagccugggcaacaga

SEQ ID NO: 273451 - RNA, 32 nt, Human
uugcaccacuguacuccagccugggcgauaca

SEQ ID NO: 273452 - RNA, 32 nt, Human
uugcaccacuguacuccagccugggugacaaa

SEQ ID NO: 273453 - RNA, 32 nt, Human
uugcaccacuguacuccagccugggugacagg

SEQ ID NO: 273454 - RNA, 32 nt, Human
uugcaccacuuacuccagccugggcaacagag

SEQ ID NO: 273455 - RNA, 32 nt, Human
uugcaccacuucacuccagccugggugacgga

SEQ ID NO: 273456 - RNA, 32 nt, Human
uugcaccacuucaucccagccugggagacaga

SEQ ID NO: 273457 - RNA, 32 nt, Human
uugcaccacuuguaacuccagccugggcaaca

SEQ ID NO: 273458 - RNA, 32 nt, Human
uugcaccacuuuacuuagccugggugacagag

SEQ ID NO: 273459 - RNA, 32 nt, Human
uugcaccagccguaacuacagcuuugauugga

SEQ ID NO: 273460 - RNA, 29 nt, Human
uugcaccaggagacagaggcagcugggau

SEQ ID NO: 273461 - RNA, 32 nt, Human
uugcaccaggaucagauucaucaaaugguaca

SEQ ID NO: 273462 - RNA, 32 nt, Human
uugcaccagugacuugaaaaugauucugcucc

SEQ ID NO: 273463 - RNA, 32 nt, Human
uugcaccagugcacuccagcugggcgacagag

SEQ ID NO: 273464 - RNA, 25 nt, Human
uugcaccaguucccaauuuuuccca

SEQ ID NO: 273465 - RNA, 32 nt, Human
uugcaccaucuucugcaggacuguauuuugag

SEQ ID NO: 273466 - RNA, 32 nt, Human
uugcaccauguuggccaggcuggucuugaauu

SEQ ID NO: 273467 - RNA, 32 nt, Human
uugcaccauugaacuccagccugggcaacaag

SEQ ID NO: 273468 - RNA, 32 nt, Human
uugcaccauugcaccuccagccugggcaacag

SEQ ID NO: 273469 - RNA, 32 nt, Human
uugcaccauugcacuccacccugggcgacaga

SEQ ID NO: 273470 - RNA, 32 nt, Human
uugcaccauugcacuccagccugcgcaacaag

SEQ ID NO: 273471 - RNA, 32 nt, Human
uugcaccauugcacuccagccuggcgacagag

SEQ ID NO: 273472 - RNA, 32 nt, Human
uugcaccauugcacuccagccugggcaacaag

SEQ ID NO: 273473 - RNA, 32 nt, Human
uugcaccauugcacuccagccugggcaacaga

SEQ ID NO: 273474 - RNA, 32 nt, Human
uugcaccauugcacuccagccugggcaauaag

SEQ ID NO: 273475 - RNA, 32 nt, Human
uugcaccauugcacuccagccugggcgacaag

SEQ ID NO: 273476 - RNA, 32 nt, Human
uugcaccauugcacuccagccugggcgacaga

SEQ ID NO: 273477 - RNA, 32 nt, Human
uugcaccauugcacuccagccugggugacaga

SEQ ID NO: 273478 - RNA, 32 nt, Human
uugcaccauugcacuccagccugugcaacaag

SEQ ID NO: 273479 - RNA, 32 nt, Human
uugcaccauugcacuccagcuugggugacaga

SEQ ID NO: 273480 - RNA, 32 nt, Human
uugcaccauugcacuccugccugggcaacaag

SEQ ID NO: 273481 - RNA, 32 nt, Human
uugcaccauugcauuccagccugggcaacaag

SEQ ID NO: 273482 - RNA, 32 nt, Human
uugcaccauugcauuccagccugggugacaga

SEQ ID NO: 273483 - RNA, 32 nt, Human
uugcaccauugcccuccagccugagcaacaga

SEQ ID NO: 273484 - RNA, 32 nt, Human
uugcaccauugcgcucuagccugggcaacaac

SEQ ID NO: 273485 - RNA, 32 nt, Human
uugcaccauuguacuccagccugggcaacaag

SEQ ID NO: 273486 - RNA, 32 nt, Human
uugcaccauuguacuccagccugggcaauaag

SEQ ID NO: 273487 - RNA, 32 nt, Human
uugcaccauuucauuccagccugggcaacaug

SEQ ID NO: 273488 - RNA, 32 nt, Human
uugcacccacugcauuugcagccuugagguca

SEQ ID NO: 273489 - RNA, 32 nt, Human
uugcacccaggagguggagguugcagugagcc

SEQ ID NO: 273490 - RNA, 32 nt, Human
uugcacccagggagcuggaguugagcuguucc

SEQ ID NO: 273491 - RNA, 32 nt, Human
uugcaccccagccugagcaacaagagcgaaac

SEQ ID NO: 273492 - RNA, 32 nt, Human
uugcacccccagccuccaccccggcuccccug

SEQ ID NO: 273493 - RNA, 32 nt, Human
uugcacccccaggccuuggggcucagaccagu

SEQ ID NO: 273494 - RNA, 32 nt, Human
uugcaccccugcacuccagccugggugacaga

SEQ ID NO: 273495 - RNA, 32 nt, Human
uugcaccccugcacuccaggcugggcaacagu

SEQ ID NO: 273496 - RNA, 32 nt, Human
uugcacccgugggagucgggacauauaaugga

SEQ ID NO: 273497 - RNA, 32 nt, Human
uugcacccucauucccucgggacccucccagu

SEQ ID NO: 273498 - RNA, 32 nt, Human
uugcacccuccagacacucagguugaaaauag

SEQ ID NO: 273499 - RNA, 32 nt, Human
uugcacccugcacucuagccugggcaacaaga

SEQ ID NO: 273500 - RNA, 32 nt, Human
uugcacccuguauuucuuuuugcagccagcac

SEQ ID NO: 273501 - RNA, 32 nt, Human
uugcaccgcugcacuccagccuggcgacagag

SEQ ID NO: 273502 - RNA, 32 nt, Human
uugcaccgcuguacuccagccugggcaacaga

SEQ ID NO: 273503 - RNA, 32 nt, Human
uugcaccgugacacuccagccugggcaacaga

SEQ ID NO: 273504 - RNA, 32 nt, Human
uugcaccuacauagugugucuccucauuggag

SEQ ID NO: 273505 - RNA, 32 nt, Human
uugcaccuauaaucccagcacuuugggaggca

SEQ ID NO: 273506 - RNA, 20 nt, Human
uugcaccucaacaaaaggcu

SEQ ID NO: 273507 - RNA, 32 nt, Human
uugcaccucauaggugaugaucaugaggggga

SEQ ID NO: 273508 - RNA, 32 nt, Human
uugcaccuccagccugggcaacagagugagac

SEQ ID NO: 273509 - RNA, 32 nt, Human
uugcaccucgcugcuccagccucuggggcgca

SEQ ID NO: 273510 - RNA, 32 nt, Human
uugcaccucucagagaagauaacugccucuug

SEQ ID NO: 273511 - RNA, 32 nt, Human
uugcaccugcagccaagcaaaugccugccaaa

SEQ ID NO: 273512 - RNA, 32 nt, Human
uugcaccugcagccccgcgcucuacccgguuc

SEQ ID NO: 273513 - RNA, 32 nt, Human
uugcaccuguaaucccagcacuuugggaggcc

SEQ ID NO: 273514 - RNA, 32 nt, Human
uugcaccuucuggaacuaugggcuugagaaaa

SEQ ID NO: 273515 - RNA, 32 nt, Human
uugcaccuugucuaaggacccuaaaugaacga

SEQ ID NO: 273516 - RNA, 32 nt, Human
uugcaccuuuggucccaugggugggggacagg

SEQ ID NO: 273517 - RNA, 32 nt, Human
uugcaccuuuguacuccagccugggcaacgag

SEQ ID NO: 273518 - RNA, 32 nt, Human
uugcacgacauuacucgcaggugguggggagc

SEQ ID NO: 273519 - RNA, 32 nt, Human
uugcacgacugcacuccagccugggcaaugga

SEQ ID NO: 273520 - RNA, 32 nt, Human
uugcacgauuccugccucgacguuacaccagg

SEQ ID NO: 273521 - RNA, 32 nt, Human
uugcacgccccuaggcccucugugcuggggca

SEQ ID NO: 273522 - RNA, 32 nt, Human
uugcacggaacagauucagaugagcauuuucc

SEQ ID NO: 273523 - RNA, 32 nt, Human
uugcacggcggagggggugaggugggaggcgu

SEQ ID NO: 273524 - RNA, 32 nt, Human
uugcacgggacacguuacccagcucgggugag

SEQ ID NO: 273525 - RNA, 19 nt, Human
uugcacgguaugagcuuca

SEQ ID NO: 273526 - RNA, 32 nt, Human
uugcacggucucccccuccccaucugaugugu

SEQ ID NO: 273527 - RNA, 32 nt, Human
uugcacgugaguaugauccaggauuggccugu

SEQ ID NO: 273528 - RNA, 32 nt, Human
uugcacguucuucucccaucuuggaauaucca

SEQ ID NO: 273529 - RNA, 32 nt, Human
uugcacuaaaauuauaucaaggucucagauga

SEQ ID NO: 273530 - RNA, 32 nt, Human
uugcacuaaccacauuugucaucucuagggca

SEQ ID NO: 273531 - RNA, 32 nt, Human
uugcacuacagccugggcaacaagagcgaaac

SEQ ID NO: 273532 - RNA, 32 nt, Human
uugcacuacuacacuccagccuggugacagag

SEQ ID NO: 273533 - RNA, 32 nt, Human
uugcacuacugcacuccagacuggugacggag

SEQ ID NO: 273534 - RNA, 32 nt, Human
uugcacuacugcacuccagccugggugacaga

SEQ ID NO: 273535 - RNA, 32 nt, Human
uugcacuacugcauuccagccugggugacaua

SEQ ID NO: 273536 - RNA, 32 nt, Human
uugcacuacugcgcuucacccugggcaacaga

SEQ ID NO: 273537 - RNA, 32 nt, Human
uugcacuagagcuguuuguggacuuggcuuca

SEQ ID NO: 273538 - RNA, 32 nt, Human
uugcacuagaggcuucugacuccugggacuuu

SEQ ID NO: 273539 - RNA, 32 nt, Human
uugcacuagcuguuuccucugccuaaacaucc

SEQ ID NO: 273540 - RNA, 32 nt, Human
uugcacuagugucucugcagguugcugguugu

SEQ ID NO: 273541 - RNA, 32 nt, Human
uugcacuaucuggagcuaacaccugugaccca

SEQ ID NO: 273542 - RNA, 32 nt, Human
uugcacuauugcacuccagccugggcaacagg

SEQ ID NO: 273543 - RNA, 32 nt, Human
uugcacucaaguuguuuaacugugcaugugcg

SEQ ID NO: 273544 - RNA, 32 nt, Human
uugcacucagcccuguacucacuucuucacuc

SEQ ID NO: 273545 - RNA, 32 nt, Human
uugcacuccaaccugggugacaagagcaaaac

SEQ ID NO: 273546 - RNA, 32 nt, Human
uugcacuccacacuccagccugagcaacaaga

SEQ ID NO: 273547 - RNA, 32 nt, Human
uugcacuccagaaaacaacauacauguuuaaa

SEQ ID NO: 273548 - RNA, 32 nt, Human
uugcacuccagcccaggcgacagaacaaaacu

SEQ ID NO: 273549 - RNA, 32 nt, Human
uugcacuccagcccgggcaacaacagcgaaac

SEQ ID NO: 273550 - RNA, 32 nt, Human
uugcacuccagccugagcaacagagugagugu

SEQ ID NO: 273551 - RNA, 32 nt, Human
uugcacuccagccugagcaacaggagcgaaac

SEQ ID NO: 273552 - RNA, 32 nt, Human
uugcacuccagccugagcgacagagcgagacu

SEQ ID NO: 273553 - RNA, 32 nt, Human
uugcacuccagccugagugacaagagacucug

SEQ ID NO: 273554 - RNA, 32 nt, Human
uugcacuccagccugcgcaacaagagcgaaac

SEQ ID NO: 273555 - RNA, 32 nt, Human
uugcacuccagccuggacaacaagagcgaaac

SEQ ID NO: 273556 - RNA, 32 nt, Human
uugcacuccagccuggacaacaagagugaaac

SEQ ID NO: 273557 - RNA, 32 nt, Human
uugcacuccagccuggacagcaggagcgaaac

SEQ ID NO: 273558 - RNA, 32 nt, Human
uugcacuccagccuggaugacagagugagacu

SEQ ID NO: 273559 - RNA, 32 nt, Human
uugcacuccagccuggccacagagcgagacuc

SEQ ID NO: 273560 - RNA, 32 nt, Human
uugcacuccagccuggcgacaagagcgagacu

SEQ ID NO: 273561 - RNA, 32 nt, Human
uugcacuccagccuggcgacagagcgagacuc

SEQ ID NO: 273562 - RNA, 32 nt, Human
uugcacuccagccuggcgacagagugagacuc

SEQ ID NO: 273563 - RNA, 32 nt, Human
uugcacuccagccuggcgaccgagcgggacuc

SEQ ID NO: 273564 - RNA, 32 nt, Human
uugcacuccagccuggcugacagagcgagacu

SEQ ID NO: 273565 - RNA, 32 nt, Human
uugcacuccagccugggcaacaacagugaaac

SEQ ID NO: 273566 - RNA, 32 nt, Human
uugcacuccagccugggcaacaagagcgaaac

SEQ ID NO: 273567 - RNA, 32 nt, Human
uugcacuccagccugggcaacaagagcgaggc

SEQ ID NO: 273568 - RNA, 32 nt, Human
uugcacuccagccugggcaacaagaggaaaac

SEQ ID NO: 273569 - RNA, 32 nt, Human
uugcacuccagccugggcaacaagagggaaac

SEQ ID NO: 273570 - RNA, 32 nt, Human
uugcacuccagccugggcaacaagagugaaac

SEQ ID NO: 273571 - RNA, 32 nt, Human
uugcacuccagccugggcaacaagagugaacc

SEQ ID NO: 273572 - RNA, 32 nt, Human
uugcacuccagccugggcaacaagagugagac

SEQ ID NO: 273573 - RNA, 32 nt, Human
uugcacuccagccugggcaacaagaguggcac

SEQ ID NO: 273574 - RNA, 32 nt, Human
uugcacuccagccugggcaacaagcgaaacuc

SEQ ID NO: 273575 - RNA, 32 nt, Human
uugcacuccagccugggcaacaagugcaaaac

SEQ ID NO: 273576 - RNA, 32 nt, Human
uugcacuccagccugggcaacacagcgagacu

SEQ ID NO: 273577 - RNA, 32 nt, Human
uugcacuccagccugggcaacagagcgagacu

SEQ ID NO: 273578 - RNA, 32 nt, Human
uugcacuccagccugggcaacagagcgagagu

SEQ ID NO: 273579 - RNA, 32 nt, Human
uugcacuccagccugggcaacagagcgcgacu

SEQ ID NO: 273580 - RNA, 32 nt, Human
uugcacuccagccugggcaacagagugaaaaa

SEQ ID NO: 273581 - RNA, 32 nt, Human
uugcacuccagccugggcaacagagugagacc

SEQ ID NO: 273582 - RNA, 32 nt, Human
uugcacuccagccugggcaacagagugagacu

SEQ ID NO: 273583 - RNA, 32 nt, Human
uugcacuccagccugggcaacagcagcgaaac

SEQ ID NO: 273584 - RNA, 32 nt, Human
uugcacuccagccugggcaacagggcaagauu

SEQ ID NO: 273585 - RNA, 32 nt, Human
uugcacuccagccugggcaacaguguuaagac

SEQ ID NO: 273586 - RNA, 32 nt, Human
uugcacuccagccugggcaacgaaaagugaaa

SEQ ID NO: 273587 - RNA, 32 nt, Human
uugcacuccagccugggcaacgagagugaaac

SEQ ID NO: 273588 - RNA, 32 nt, Human
uugcacuccagccugggcaacgagcgaaacua

SEQ ID NO: 273589 - RNA, 32 nt, Human
uugcacuccagccugggcaacgagcgaaacuc

SEQ ID NO: 273590 - RNA, 32 nt, Human
uugcacuccagccugggcaacgagugaaacuc

SEQ ID NO: 273591 - RNA, 32 nt, Human
uugcacuccagccugggcaacgagugcaaaac

SEQ ID NO: 273592 - RNA, 32 nt, Human
uugcacuccagccugggcaauaagagcgaaac

SEQ ID NO: 273593 - RNA, 32 nt, Human
uugcacuccagccugggcaauaagagugaaac

SEQ ID NO: 273594 - RNA, 32 nt, Human
uugcacuccagccugggcaauagagugagacu

SEQ ID NO: 273595 - RNA, 32 nt, Human
uugcacuccagccugggcaauagggcaagagu

SEQ ID NO: 273596 - RNA, 32 nt, Human
uugcacuccagccugggcgacaagagcgaaac

SEQ ID NO: 273597 - RNA, 32 nt, Human
uugcacuccagccugggcgacaagagugaaac

SEQ ID NO: 273598 - RNA, 32 nt, Human
uugcacuccagccugggcgacaagagugaaau

SEQ ID NO: 273599 - RNA, 32 nt, Human
uugcacuccagccugggcgacaagcgaaacuu

SEQ ID NO: 273600 - RNA, 32 nt, Human
uugcacuccagccugggcgacagagcgagacu

SEQ ID NO: 273601 - RNA, 32 nt, Human
uugcacuccagccugggcgacagagugacacu

SEQ ID NO: 273602 - RNA, 32 nt, Human
uugcacuccagccugggcgacagagugagacu

SEQ ID NO: 273603 - RNA, 32 nt, Human
uugcacuccagccugggcgacagggcaagacu

SEQ ID NO: 273604 - RNA, 32 nt, Human
uugcacuccagccugggcgacagggugagacu

SEQ ID NO: 273605 - RNA, 32 nt, Human
uugcacuccagccugggcgacagugcaagacu

SEQ ID NO: 273606 - RNA, 32 nt, Human
uugcacuccagccugggcgacugagcgagacu

SEQ ID NO: 273607 - RNA, 32 nt, Human
uugcacuccagccugggcgauagagugagacu

SEQ ID NO: 273608 - RNA, 32 nt, Human
uugcacuccagccuggggaacagagcgagacu

SEQ ID NO: 273609 - RNA, 32 nt, Human
uugcacuccagccugggugacaagagcgaaac

SEQ ID NO: 273610 - RNA, 32 nt, Human
uugcacuccagccugggugacaagagugaaac

SEQ ID NO: 273611 - RNA, 32 nt, Human
uugcacuccagccugggugacaagagugagac

SEQ ID NO: 273612 - RNA, 32 nt, Human
uugcacuccagccugggugacacagugagacu

SEQ ID NO: 273613 - RNA, 32 nt, Human
uugcacuccagccugggugacagagcgagacc

SEQ ID NO: 273614 - RNA, 32 nt, Human
uugcacuccagccugggugacagagcgagacu

SEQ ID NO: 273615 - RNA, 32 nt, Human
uugcacuccagccugggugacagagugaaacc

SEQ ID NO: 273616 - RNA, 32 nt, Human
uugcacuccagccugggugacagagugagacc

SEQ ID NO: 273617 - RNA, 32 nt, Human
uugcacuccagccugggugacagagugagacu

SEQ ID NO: 273618 - RNA, 32 nt, Human
uugcacuccagccugggugacagugaaacucc

SEQ ID NO: 273619 - RNA, 32 nt, Human
uugcacuccagccugggugacagugagacuuu

SEQ ID NO: 273620 - RNA, 32 nt, Human
uugcacuccagccugggugacgagugaaacuc

SEQ ID NO: 273621 - RNA, 32 nt, Human
uugcacuccagccugggugauaagagcgaaau

SEQ ID NO: 273622 - RNA, 32 nt, Human
uugcacuccagccugugcaacaagcgaaacuc

SEQ ID NO: 273623 - RNA, 32 nt, Human
uugcacuccaggcaccuggccaagagaauaca

SEQ ID NO: 273624 - RNA, 32 nt, Human
uugcacuccaggcugggcagcaagagcaagac

SEQ ID NO: 273625 - RNA, 32 nt, Human
uugcacuccauccuggacaacagagugagacu

SEQ ID NO: 273626 - RNA, 32 nt, Human
uugcacuccauccuggacaacaggagugaaac

SEQ ID NO: 273627 - RNA, 32 nt, Human
uugcacuccucugcuuucucccugccuugauu

SEQ ID NO: 273628 - RNA, 32 nt, Human
uugcacucuagccuggcaacagagcgagauuc

SEQ ID NO: 273629 - RNA, 32 nt, Human
uugcacucuugcucucccccucccucccuuac

SEQ ID NO: 273630 - RNA, 32 nt, Human
uugcacugaggcacccgccgggcagggacccg

SEQ ID NO: 273631 - RNA, 32 nt, Human
uugcacugagguccuggaggccuugugaggcc

SEQ ID NO: 273632 - RNA, 32 nt, Human
uugcacugagugaccugcuuccugauugcgca

SEQ ID NO: 273633 - RNA, 32 nt, Human
uugcacugcccuggcacaugggcacaacgucu

SEQ ID NO: 273634 - RNA, 32 nt, Human
uugcacugccuuuggggcuggagggagacgug

SEQ ID NO: 273635 - RNA, 32 nt, Human
uugcacugcugagagcaagaugggucaccagc

SEQ ID NO: 273636 - RNA, 32 nt, Human
uugcacugcuguuccugcuccaugacuggcug

SEQ ID NO: 273637 - RNA, 32 nt, Human
uugcacuggaaccauugcuuuacucugguugg

SEQ ID NO: 273638 - RNA, 32 nt, Human
uugcacuguaggacagcggcccgaaguggaag

SEQ ID NO: 273639 - RNA, 32 nt, Human
uugcacugucgcacuccagccuggaugauaga

SEQ ID NO: 273640 - RNA, 32 nt, Human
uugcacugugccuuucaacuccagaaacauuc

SEQ ID NO: 273641 - RNA, 32 nt, Human
uugcacuguggaaauugguaaaugcuucaaau

SEQ ID NO: 273642 - RNA, 32 nt, Human
uugcacuuaauaccugcaauguuugcuacugu

SEQ ID NO: 273643 - RNA, 32 nt, Human
uugcacuuacguccucccugggacuuauauca

SEQ ID NO: 273644 - RNA, 32 nt, Human
uugcacuuagcucucccuggggacuuaaauuu

SEQ ID NO: 273645 - RNA, 32 nt, Human
uugcacuucacuuaauguguguccucaucuuu

SEQ ID NO: 273646 - RNA, 32 nt, Human
uugcacuucagccugggcgacacagcgagacc

SEQ ID NO: 273647 - RNA, 25 nt, Human
uugcacuuccagcuuuauuauucaa

SEQ ID NO: 273648 - RNA, 32 nt, Human
uugcacuucuugcauaauauaaaacuuauugc

SEQ ID NO: 273649 - RNA, 32 nt, Human
uugcacuuuaccuguucuuuuccagagcugac

SEQ ID NO: 273650 - RNA, 24 nt, Human
uugcacuuuccccacaucagccaa

SEQ ID NO: 273651 - RNA, 32 nt, Human
uugcacuuuugagacugguagcuaaccaucuu

SEQ ID NO: 273652 - RNA, 32 nt, Human
uugcagaaaacugccuuccuuucuucuuaaug

SEQ ID NO: 273653 - RNA, 24 nt, Human
uugcagaaaagagagccuucaaaa

SEQ ID NO: 273654 - RNA, 26 nt, Human
uugcagaaacagcgagaacuucaaaa

SEQ ID NO: 273655 - RNA, 32 nt, Human
uugcagaaacccagcccugccccugccuccug

SEQ ID NO: 273656 - RNA, 32 nt, Human
uugcagaaaggagcuacccacuucagaucucc

SEQ ID NO: 273657 - RNA, 21 nt, Human
uugcagaacgucaacacgccc

SEQ ID NO: 273658 - RNA, 32 nt, Human
uugcagaacugucagccuguggaguuguuucc

SEQ ID NO: 273659 - RNA, 32 nt, Human
uugcagaagaaguaagugaggaagaaaugagu

SEQ ID NO: 273660 - RNA, 32 nt, Human
uugcagaagaaugccuuucccucauuuuauaa

SEQ ID NO: 273661 - RNA, 32 nt, Human
uugcagaagagguaagggagugaggcacuccu

SEQ ID NO: 273662 - RNA, 21 nt, Human
uugcagaagugcagcucgccc

SEQ ID NO: 273663 - RNA, 24 nt, Human
uugcagaaugaagucaccucgccc

SEQ ID NO: 273664 - RNA, 32 nt, Human
uugcagacaaaugauggaaaugggaaaagacu

SEQ ID NO: 273665 - RNA, 32 nt, Human
uugcagacaaauugaagaacuggugggauuuu

SEQ ID NO: 273666 - RNA, 32 nt, Human
uugcagacacagggucucaccauguugcccag

SEQ ID NO: 273667 - RNA, 18 nt, Human
uugcagacaccaccauau

SEQ ID NO: 273668 - RNA, 32 nt, Human
uugcagacacccaaguuuugugccucaccagg

SEQ ID NO: 273669 - RNA, 32 nt, Human
uugcagacauguucauuccaagcacaauauuc

SEQ ID NO: 273670 - RNA, 32 nt, Human
uugcagaccagccuggccaacauggcaaaacc

SEQ ID NO: 273671 - RNA, 32 nt, Human
uugcagaccagccuggguaacauagugagacc

SEQ ID NO: 273672 - RNA, 32 nt, Human
uugcagaccuuuccuguucccacucuuguugg

SEQ ID NO: 273673 - RNA, 32 nt, Human
uugcagacuacaggcagagaacuccaucuuag

SEQ ID NO: 273674 - RNA, 22 nt, Human
uugcagacuacgucuccugcca

SEQ ID NO: 273675 - RNA, 32 nt, Human
uugcagacucacucggccucacuucauccuug

SEQ ID NO: 273676 - RNA, 32 nt, Human
uugcagagaccacugcacuccagccugggcaa

SEQ ID NO: 273677 - RNA, 32 nt, Human
uugcagagagaaggagcaaaccuuuucauugg

SEQ ID NO: 273678 - RNA, 32 nt, Human
uugcagagaggaggacguguacuccaggcgag

SEQ ID NO: 273679 - RNA, 32 nt, Human
uugcagagagucagggaggcggaaaagacacg

SEQ ID NO: 273680 - RNA, 32 nt, Human
uugcagagaugcuggggucgagaccccaggga

SEQ ID NO: 273681 - RNA, 32 nt, Human
uugcagagauggaguuucaccauauugcccag

SEQ ID NO: 273682 - RNA, 32 nt, Human
uugcagagaugggguucccacuauguugauca

SEQ ID NO: 273683 - RNA, 32 nt, Human
uugcagagcaaagaagaugggggagaacuaau

SEQ ID NO: 273684 - RNA, 26 nt, Human
uugcagagcacuucccaccucucuga

SEQ ID NO: 273685 - RNA, 32 nt, Human
uugcagagcagcaagaggcucucuccagaaaa

SEQ ID NO: 273686 - RNA, 32 nt, Human
uugcagagcagccugggcaacauggugaaacc

SEQ ID NO: 273687 - RNA, 32 nt, Human
uugcagagccugggacaaccuccuuauugaag

SEQ ID NO: 273688 - RNA, 32 nt, Human
uugcagagcgggaggccaggaggacucgucgu

SEQ ID NO: 273689 - RNA, 32 nt, Human
uugcagagcuagggugugugacugccucccuu

SEQ ID NO: 273690 - RNA, 32 nt, Human
uugcagagcugggcacaugugcccagggggca

SEQ ID NO: 273691 - RNA, 32 nt, Human
uugcagaggaagaugagcuggcacucugcaaa

SEQ ID NO: 273692 - RNA, 32 nt, Human
uugcagaggcgguggagggaaggagacaggau

SEQ ID NO: 273693 - RNA, 32 nt, Human
uugcagagucaacagcccaucagcccauguuu

SEQ ID NO: 273694 - RNA, 32 nt, Human
uugcagaguguugggacugucauuugugauuu

SEQ ID NO: 273695 - RNA, 32 nt, Human
uugcagauaagaggaagugggaagagaggugg

SEQ ID NO: 273696 - RNA, 32 nt, Human
uugcagauaccacauucauuaugcugcaguac

SEQ ID NO: 273697 - RNA, 32 nt, Human
uugcagaugcaagcuccucuccuaggucuucu

SEQ ID NO: 273698 - RNA, 32 nt, Human
uugcagauguccugggugcagggccuucccgg

SEQ ID NO: 273699 - RNA, 32 nt, Human
uugcagauguuuaagaaaauaauagccagauu

SEQ ID NO: 273700 - RNA, 32 nt, Human
uugcagauguuuaagaaaauaauggccagauu

SEQ ID NO: 273701 - RNA, 32 nt, Human
uugcagauguuuucagaaaaucaagucacagu

SEQ ID NO: 273702 - RNA, 32 nt, Human
uugcagauugcuuuacuugcucugcuucccag

SEQ ID NO: 273703 - RNA, 32 nt, Human
uugcagcaacagcagcaggauccccagggcag

SEQ ID NO: 273704 - RNA, 32 nt, Human
uugcagcaacagcuccaagaagugcucggcag

SEQ ID NO: 273705 - RNA, 32 nt, Human
uugcagcaagcauuucuccaguuacaggcaaa

SEQ ID NO: 273706 - RNA, 32 nt, Human
uugcagcacaauauaacuuuacauucuuugcc

SEQ ID NO: 273707 - RNA, 32 nt, Human
uugcagcacaaugccuucuccaccugcccucc

SEQ ID NO: 273708 - RNA, 32 nt, Human
uugcagcacagccaggacuccagccugaacca

SEQ ID NO: 273709 - RNA, 32 nt, Human
uugcagcacagccugguuacagagugagauuc

SEQ ID NO: 273710 - RNA, 32 nt, Human
uugcagcacucacgaaauaugcucucuccuuu

SEQ ID NO: 273711 - RNA, 32 nt, Human
uugcagcacugacagaguguuuugaaauuuua

SEQ ID NO: 273712 - RNA, 32 nt, Human
uugcagcacugaguggucaaaauacauuucug

SEQ ID NO: 273713 - RNA, 32 nt, Human
uugcagcagagccacguaguuuggcauuuuga

SEQ ID NO: 273714 - RNA, 32 nt, Human
uugcagcaggguggcagggucaggagagucug

SEQ ID NO: 273715 - RNA, 32 nt, Human
uugcagcaucaugaugggccucuccuuggccu

SEQ ID NO: 273716 - RNA, 32 nt, Human
uugcagcauugcacuccagccugggugacaga

SEQ ID NO: 273717 - RNA, 32 nt, Human
uugcagccaaaccagcugaugaagaacugcug

SEQ ID NO: 273718 - RNA, 32 nt, Human
uugcagccagaggcugcaggaaaaaggcuucc

SEQ ID NO: 273719 - RNA, 32 nt, Human
uugcagccagccggcgguccagccuggugccu

SEQ ID NO: 273720 - RNA, 19 nt, Human
uugcagccaggugcagugg

SEQ ID NO: 273721 - RNA, 32 nt, Human
uugcagccauauccacuuauccaucuuaagau

SEQ ID NO: 273722 - RNA, 32 nt, Human
uugcagcccaggcuggagugcaguggcaccau

SEQ ID NO: 273723 - RNA, 32 nt, Human
uugcagcccgggcaccuucccacuuucuagcu

SEQ ID NO: 273724 - RNA, 32 nt, Human
uugcagcccuccuuuaacccaaaggaggaaag

SEQ ID NO: 273725 - RNA, 32 nt, Human
uugcagccucaaacaccugugcucaagcaauu

SEQ ID NO: 273726 - RNA, 32 nt, Human
uugcagccucaaacuccugggcucaagcaauc

SEQ ID NO: 273727 - RNA, 32 nt, Human
uugcagccucagacuccuggguucaagcaauc

SEQ ID NO: 273728 - RNA, 32 nt, Human
uugcagccucgaacuccugggcucauauuuuc

SEQ ID NO: 273729 - RNA, 32 nt, Human
uugcagccucgaacuccugggcuuaagggauc

SEQ ID NO: 273730 - RNA, 32 nt, Human
uugcagccucgaccugcugggcucgggcuauc

SEQ ID NO: 273731 - RNA, 32 nt, Human
uugcagccucgacuucucggggccaagcgauc

SEQ ID NO: 273732 - RNA, 32 nt, Human
uugcagccucuccaggcccagcuccugcaucu

SEQ ID NO: 273733 - RNA, 32 nt, Human
uugcagccuggugacagagugagacuccaucu

SEQ ID NO: 273734 - RNA, 32 nt, Human
uugcagccuucaauuccugggcucaggcaauc

SEQ ID NO: 273735 - RNA, 32 nt, Human
uugcagccuugacuucucaacgccaagucauc

SEQ ID NO: 273736 - RNA, 32 nt, Human
uugcagcgcugccuuucgaucucuccacaucu

SEQ ID NO: 273737 - RNA, 32 nt, Human
uugcagcgucuccggaaguggaggcgggagcg

SEQ ID NO: 273738 - RNA, 32 nt, Human
uugcagcgucuucuauuuuccaggucaaguac

SEQ ID NO: 273739 - RNA, 32 nt, Human
uugcagcuagagauguaugcagacaguaauaa

SEQ ID NO: 273740 - RNA, 30 nt, Human
uugcagcucaauaaauuuugaaugaacucc

SEQ ID NO: 273741 - RNA, 18 nt, Human
uugcagcuccugagccuu

SEQ ID NO: 273742 - RNA, 32 nt, Human
uugcagcuccuugccagagcccagauucccga

SEQ ID NO: 273743 - RNA, 28 nt, Human
uugcagcucggcugugccucaucuuccc

SEQ ID NO: 273744 - RNA, 32 nt, Human
uugcagcucugacuucugcucccaguaaccca

SEQ ID NO: 273745 - RNA, 32 nt, Human
uugcagcugcccaccucacccucagcucuggc

SEQ ID NO: 273746 - RNA, 32 nt, Human
uugcagcuggaagcauuuguuuuugaaguugu

SEQ ID NO: 273747 - RNA, 32 nt, Human
uugcagcuggcugcagccuccaccucccuggc

SEQ ID NO: 273748 - RNA, 32 nt, Human
uugcagcuucaacuuuucucuuuaguguucug

SEQ ID NO: 273749 - RNA, 20 nt, Human
uugcagcuugcccagagcca

SEQ ID NO: 273750 - RNA, 32 nt, Human
uugcagcuuugaccuccugggcuuaggugauc

SEQ ID NO: 273751 - RNA, 32 nt, Human
uugcagcuuugucuccucagcacucugcuguc

SEQ ID NO: 273752 - RNA, 32 nt, Human
uugcaggaacuuugagaaaggcaggagaagca

SEQ ID NO: 273753 - RNA, 32 nt, Human
uugcaggaagccagaggaggcaauacaguggg

SEQ ID NO: 273754 - RNA, 32 nt, Human
uugcaggaaggugagggugagcagagaugugu

SEQ ID NO: 273755 - RNA, 32 nt, Human
uugcaggacgcugugguguggaggcagcagcc

SEQ ID NO: 273756 - RNA, 32 nt, Human
uugcaggacugccuugguggcuuuguuugcug

SEQ ID NO: 273757 - RNA, 32 nt, Human
uugcaggaggacgguaaacagcaaaggcuuua

SEQ ID NO: 273758 - RNA, 32 nt, Human
uugcaggagguggagguuguugguggaggagg

SEQ ID NO: 273759 - RNA, 32 nt, Human
uugcaggaguugccgauggaggccugcaguac

SEQ ID NO: 273760 - RNA, 32 nt, Human
uugcaggaguugcugcuggaccacaugacacc

SEQ ID NO: 273761 - RNA, 32 nt, Human
uugcaggaugaaucacuugucacuuuucuucu

SEQ ID NO: 273762 - RNA, 32 nt, Human
uugcaggauggacaggaugacagacagggacg

SEQ ID NO: 273763 - RNA, 32 nt, Human
uugcaggaugucgaugacagacuugcugaacg

SEQ ID NO: 273764 - RNA, 32 nt, Human
uugcaggaugugccauaucauugaacggaacu

SEQ ID NO: 273765 - RNA, 21 nt, Human
uugcaggcagacuucccacca

SEQ ID NO: 273766 - RNA, 32 nt, Human
uugcaggcagaggagauugggucuugacuggu

SEQ ID NO: 273767 - RNA, 32 nt, Human
uugcaggcauugugggaaggugaagaguuucc

SEQ ID NO: 273768 - RNA, 32 nt, Human
uugcaggccauggaggagggaccuccacucca

SEQ ID NO: 273769 - RNA, 23 nt, Human
uugcaggcccccaucuucugacu

SEQ ID NO: 273770 - RNA, 21 nt, Human
uugcaggcccggccuccugcc

SEQ ID NO: 273771 - RNA, 32 nt, Human
uugcaggccucugcucugccuccugaggcagg

SEQ ID NO: 273772 - RNA, 32 nt, Human
uugcaggcgggaaccaugucucaggcugcaaa

SEQ ID NO: 273773 - RNA, 30 nt, Human
uugcaggcguggcgcagggcacggugguca

SEQ ID NO: 273774 - RNA, 32 nt, Human
uugcaggcucucuguccagggcugcuuccugu

SEQ ID NO: 273775 - RNA, 24 nt, Human
uugcaggcugcccccuuccugcca

SEQ ID NO: 273776 - RNA, 32 nt, Human
uugcagggaaauacagcuacagaggaaggaga

SEQ ID NO: 273777 - RNA, 32 nt, Human
uugcagggaacuaggaacauggaggggaacca

SEQ ID NO: 273778 - RNA, 32 nt, Human
uugcagggagagugaugcuccaggcaacacgg

SEQ ID NO: 273779 - RNA, 32 nt, Human
uugcagggagcuaagaucgcgccauugcacuc

SEQ ID NO: 273780 - RNA, 32 nt, Human
uugcagggaggcggagguugcagugagccgag

SEQ ID NO: 273781 - RNA, 24 nt, Human
uugcagggauaagcccaggaccgg

SEQ ID NO: 273782 - RNA, 32 nt, Human
uugcagggaugcuuaaggaaggccccgcccag

SEQ ID NO: 273783 - RNA, 32 nt, Human
uugcagggcagccugguuacagagugagacuc

SEQ ID NO: 273784 - RNA, 19 nt, Human
uugcaggggcaucacguua

SEQ ID NO: 273785 - RNA, 32 nt, Human
uugcaggggucaguguagcuucugagcuaccu

SEQ ID NO: 273786 - RNA, 32 nt, Human
uugcaggggucuucaggcuuuuccacuggcuc

SEQ ID NO: 273787 - RNA, 32 nt, Human
uugcaggucgugagauagagccugagaugggg

SEQ ID NO: 273788 - RNA, 32 nt, Human
uugcaggugccuggcuugcuguggcuauggga

SEQ ID NO: 273789 - RNA, 32 nt, Human
uugcagguggagagcauaguugccaaaaucaa

SEQ ID NO: 273790 - RNA, 32 nt, Human
uugcaggugggagauuuggauuugaaugugga

SEQ ID NO: 273791 - RNA, 32 nt, Human
uugcagguucugagagaggcaagcagguaguc

SEQ ID NO: 273792 - RNA, 32 nt, Human
uugcagguugacacucucaccugacagaugau

SEQ ID NO: 273793 - RNA, 32 nt, Human
uugcagguuggaaguuacucugggugagucag

SEQ ID NO: 273794 - RNA, 21 nt, Human
uugcagguuggacucuucaca

SEQ ID NO: 273795 - RNA, 22 nt, Human
uugcagguuuagcuuuuuccca

SEQ ID NO: 273796 - RNA, 32 nt, Human
uugcagguuucuguagccggaagaucuccguu

SEQ ID NO: 273797 - RNA, 32 nt, Human
uugcaguaaaacacaggggcaaaggaagacag

SEQ ID NO: 273798 - RNA, 32 nt, Human
uugcaguaacaccugcucuuucugaagagcua

SEQ ID NO: 273799 - RNA, 32 nt, Human
uugcaguaaccagcagcauucucagcuggaug

SEQ ID NO: 273800 - RNA, 32 nt, Human
uugcaguaccaugcaggacuagcaucuggccu

SEQ ID NO: 273801 - RNA, 32 nt, Human
uugcaguagcuguaggaaggggaggccauuuu

SEQ ID NO: 273802 - RNA, 32 nt, Human
uugcaguagggagguaucaaggagcauaauua

SEQ ID NO: 273803 - RNA, 32 nt, Human
uugcagucagugagcugcugccaaaacggcgu

SEQ ID NO: 273804 - RNA, 32 nt, Human
uugcaguccagccugggcagcaagagugaaac

SEQ ID NO: 273805 - RNA, 32 nt, Human
uugcagucuucaauuugagaaaggugagaaau

SEQ ID NO: 273806 - RNA, 32 nt, Human
uugcagugaccaccccugcaggcauccaaagg

SEQ ID NO: 273807 - RNA, 32 nt, Human
uugcagugagccaaaauuacgccacugcacuc

SEQ ID NO: 273808 - RNA, 32 nt, Human
uugcagugagccaaagguacaccacuacacuc

SEQ ID NO: 273809 - RNA, 32 nt, Human
uugcagugagccaagacuacgccacugcacuc

SEQ ID NO: 273810 - RNA, 32 nt, Human
uugcagugagccaagacugcgccacugcacuc

SEQ ID NO: 273811 - RNA, 32 nt, Human
uugcagugagccaagaucaagccauugcacuc

SEQ ID NO: 273812 - RNA, 32 nt, Human
uugcagugagccaagaucaagccauuguacuc

SEQ ID NO: 273813 - RNA, 32 nt, Human
uugcagugagccaagauccugccacugcacuc

SEQ ID NO: 273814 - RNA, 32 nt, Human
uugcagugagccaagaucgagccauugcacuc

SEQ ID NO: 273815 - RNA, 32 nt, Human
uugcagugagccaagaucucgccacugcacuc

SEQ ID NO: 273816 - RNA, 32 nt, Human
uugcagugagccaagauuacgccacugcacua

SEQ ID NO: 273817 - RNA, 32 nt, Human
uugcagugagccaagauuacgccacugcacuc

SEQ ID NO: 273818 - RNA, 32 nt, Human
uugcagugagccaagauugagccauugcucuc

SEQ ID NO: 273819 - RNA, 32 nt, Human
uugcagugagccaagauugcagugagccaaga

SEQ ID NO: 273820 - RNA, 32 nt, Human
uugcagugagccacugcacuccagccugauga

SEQ ID NO: 273821 - RNA, 32 nt, Human
uugcagugagccaggaucgcgccauugcacuc

SEQ ID NO: 273822 - RNA, 32 nt, Human
uugcagugagccaugaucgagccacugcacuc

SEQ ID NO: 273823 - RNA, 32 nt, Human
uugcagugagcugagguugcggugagcugaga

SEQ ID NO: 273824 - RNA, 32 nt, Human
uugcagugggaggcgacgguggaggagggugg

SEQ ID NO: 273825 - RNA, 31 nt, Human
uugcaguggguggaguuguggauagggguga

SEQ ID NO: 273826 - RNA, 16 nt, Human
uugcaguguccacuca

SEQ ID NO: 273827 - RNA, 32 nt, Human
uugcagugugccaggcacugugccaaguauuu

SEQ ID NO: 273828 - RNA, 32 nt, Human
uugcaguguggacacguguuugaagcaguuac

SEQ ID NO: 273829 - RNA, 32 nt, Human
uugcaguguggggcugccagcauuucauggcc

SEQ ID NO: 273830 - RNA, 32 nt, Human
uugcaguuaagccuguugucuguuguagucug

SEQ ID NO: 273831 - RNA, 32 nt, Human
uugcaguuacugauacaaaugguguuaacugg

SEQ ID NO: 273832 - RNA, 32 nt, Human
uugcaguuacuuuugcaccaaccuaauaacaa

SEQ ID NO: 273833 - RNA, 32 nt, Human
uugcaguuucacaaucaguucuucauuucaug

SEQ ID NO: 273834 - RNA, 32 nt, Human
uugcaguuuuggucuugaauucugugccaucu

SEQ ID NO: 273835 - RNA, 32 nt, Human
uugcaguuuuucucccccgccccaaagauacg

SEQ ID NO: 273836 - RNA, 32 nt, Human
uugcauaaaaggcuucaucuuauaaagugaaa

SEQ ID NO: 273837 - RNA, 22 nt, Human
uugcauaaagugcccucacacu

SEQ ID NO: 273838 - RNA, 32 nt, Human
uugcauaaauguagaagggaacucagcaaugc

SEQ ID NO: 273839 - RNA, 23 nt, Human
uugcauaauuaaacucuucagcu

SEQ ID NO: 273840 - RNA, 32 nt, Human
uugcauacagaaggugcugacugaccccugcc

SEQ ID NO: 273841 - RNA, 32 nt, Human
uugcauacauucuucaagaucccauuugaauu

SEQ ID NO: 273842 - RNA, 32 nt, Human
uugcauacugccucagagccauguguccaguu

SEQ ID NO: 273843 - RNA, 32 nt, Human
uugcauacuuagaaccuugucucacuuugagg

SEQ ID NO: 273844 - RNA, 32 nt, Human
uugcauaggcucuugcuuaucuuuguuuugca

SEQ ID NO: 273845 - RNA, 32 nt, Human
uugcauaguuaauuugggauggggaagcaaau

SEQ ID NO: 273846 - RNA, 32 nt, Human
uugcauauaaccuaugcacauucucccauaua

SEQ ID NO: 273847 - RNA, 32 nt, Human
uugcauaucagauacuucaaaauaugaaaagg

SEQ ID NO: 273848 - RNA, 32 nt, Human
uugcauaucuagagacagagacugagucacug

SEQ ID NO: 273849 - RNA, 32 nt, Human
uugcauaugcaagcccuggccacagcugcacu

SEQ ID NO: 273850 - RNA, 32 nt, Human
uugcauaugguaauuauaauuuccagauaaaa

SEQ ID NO: 273851 - RNA, 32 nt, Human
uugcaucaaccucuugggccucagccaagaug

SEQ ID NO: 273852 - RNA, 32 nt, Human
uugcaucaaucuuaaugucucuucauaauacu

SEQ ID NO: 273853 - RNA, 32 nt, Human
uugcaucaauugagacugucauuuuuccguca

SEQ ID NO: 273854 - RNA, 32 nt, Human
uugcaucacuccacugcacaguguuaguggga

SEQ ID NO: 273855 - RNA, 32 nt, Human
uugcaucacugcacuccaaccugggcaacaga

SEQ ID NO: 273856 - RNA, 32 nt, Human
uugcaucacugcacuccagccugggcaacaga

SEQ ID NO: 273857 - RNA, 32 nt, Human
uugcaucacugcacuccagccugggcagcaga

SEQ ID NO: 273858 - RNA, 32 nt, Human
uugcaucacugcacuccagccugggcgaugga

SEQ ID NO: 273859 - RNA, 32 nt, Human
uugcaucacugcacuccagccugggugacaga

SEQ ID NO: 273860 - RNA, 32 nt, Human
uugcaucacugcacuccagcuugggugacaga

SEQ ID NO: 273861 - RNA, 32 nt, Human
uugcaucacugcacugcagccugggcaacaua

SEQ ID NO: 273862 - RNA, 32 nt, Human
uugcaucagccuguggauguaugccuaccacc

SEQ ID NO: 273863 - RNA, 32 nt, Human
uugcaucagcgugacccagauaugagacaugg

SEQ ID NO: 273864 - RNA, 32 nt, Human
uugcaucauugcacuccagccugggcaacaag

SEQ ID NO: 273865 - RNA, 32 nt, Human
uugcaucauugcacuccagccugggcaacaga

SEQ ID NO: 273866 - RNA, 32 nt, Human
uugcaucauuuccccucucuggcuccaauuug

SEQ ID NO: 273867 - RNA, 32 nt, Human
uugcaucccaaaccacgccucuugaccaggcu

SEQ ID NO: 273868 - RNA, 32 nt, Human
uugcaucccaguugguacagaccuucauccac

SEQ ID NO: 273869 - RNA, 32 nt, Human
uugcaucccuccagccaaggauuugaacccag

SEQ ID NO: 273870 - RNA, 32 nt, Human
uugcaucccugacccagcaucagaaaacacau

SEQ ID NO: 273871 - RNA, 32 nt, Human
uugcauccuugaaauccugggcucaggugauc

SEQ ID NO: 273872 - RNA, 28 nt, Human
uugcaucucagugcugcuuuggggucuc

SEQ ID NO: 273873 - RNA, 32 nt, Human
uugcaucugcccauacaucuucugagagaacc

SEQ ID NO: 273874 - RNA, 32 nt, Human
uugcaucugucugaccucaaagcccugcuucu

SEQ ID NO: 273875 - RNA, 32 nt, Human
uugcaugaaaaagauggagaaacaugccauuu

SEQ ID NO: 273876 - RNA, 32 nt, Human
uugcaugaagagaagcaauuuuggggaagggu

SEQ ID NO: 273877 - RNA, 32 nt, Human
uugcaugaauccauggcaaaguuauguugguu

SEQ ID NO: 273878 - RNA, 22 nt, Human
uugcaugaauugcuuuuacaag

SEQ ID NO: 273879 - RNA, 32 nt, Human
uugcaugacuauucagaaacaauaauccaaac

SEQ ID NO: 273880 - RNA, 32 nt, Human
uugcaugacuguggccuguugcucaugacuuu

SEQ ID NO: 273881 - RNA, 32 nt, Human
uugcaugagaugaaagaugacauuuuaauucu

SEQ ID NO: 273882 - RNA, 32 nt, Human
uugcaugaggccugcagguggccuauuuugac

SEQ ID NO: 273883 - RNA, 32 nt, Human
uugcaugaugcugaagccagaagccuucaagg

SEQ ID NO: 273884 - RNA, 32 nt, Human
uugcaugcacaccuuccuccacccuccacccu

SEQ ID NO: 273885 - RNA, 32 nt, Human
uugcaugcacuuuucaaaaugauugacuuaag

SEQ ID NO: 273886 - RNA, 32 nt, Human
uugcaugcaggauaguugcaucaugucaguug

SEQ ID NO: 273887 - RNA, 32 nt, Human
uugcaugccaugguuuauaaucuaagauaggc

SEQ ID NO: 273888 - RNA, 28 nt, Human
uugcaugcccucaucccacccauucuca

SEQ ID NO: 273889 - RNA, 32 nt, Human
uugcaugcccuccuaugagaaucuaaugccgc

SEQ ID NO: 273890 - RNA, 32 nt, Human
uugcaugccucuuccuccuucccgucuuccug

SEQ ID NO: 273891 - RNA, 32 nt, Human
uugcaugccuguaaucccagcauuuugggagg

SEQ ID NO: 273892 - RNA, 31 nt, Human
uugcauggaagggggagaugggugggaggag

SEQ ID NO: 273893 - RNA, 32 nt, Human
uugcauggcugcacucuagccugggugacagu

SEQ ID NO: 273894 - RNA, 32 nt, Human
uugcaugggagacagaucaaccgcacaagagu

SEQ ID NO: 273895 - RNA, 32 nt, Human
uugcaugggagccacagaggagcgucccuggg

SEQ ID NO: 273896 - RNA, 32 nt, Human
uugcaugggaggcagguggggcuuggaucagu

SEQ ID NO: 273897 - RNA, 20 nt, Human
uugcaugggagggaccccuu

SEQ ID NO: 273898 - RNA, 29 nt, Human
uugcaugggcuacgccaggaaaguaggcu

SEQ ID NO: 273899 - RNA, 32 nt, Human
uugcaugggcugcauuaucuacagcauuguac

SEQ ID NO: 273900 - RNA, 32 nt, Human
uugcauggggauaagagaggcaagcggccagu

SEQ ID NO: 273901 - RNA, 32 nt, Human
uugcauggguuucucacaagcguccuuccuca

SEQ ID NO: 273902 - RNA, 32 nt, Human
uugcauguaaaucacaaaaacugugugacuua

SEQ ID NO: 273903 - RNA, 32 nt, Human
uugcauguauauguguuauggguuaguuuuca

SEQ ID NO: 273904 - RNA, 32 nt, Human
uugcaugucuaaccccuucacugauucccaac

SEQ ID NO: 273905 - RNA, 32 nt, Human
uugcaugugccuggcaggaggcccuccugcuu

SEQ ID NO: 273906 - RNA, 23 nt, Human
uugcaugugugugguggccccag

SEQ ID NO: 273907 - RNA, 19 nt, Human
uugcauguuaagacuaugu

SEQ ID NO: 273908 - RNA, 32 nt, Human
uugcauuauggggcagaagugggagcuucucc

SEQ ID NO: 273909 - RNA, 32 nt, Human
uugcauuauguguuaauuuucuugcaucuaaa

SEQ ID NO: 273910 - RNA, 32 nt, Human
uugcauucaaucccacugcuuugcucggcaau

SEQ ID NO: 273911 - RNA, 32 nt, Human
uugcauucaccuaggccaagaaacaguguugu

SEQ ID NO: 273912 - RNA, 32 nt, Human
uugcauucagggauugcaaggaccauauagac

SEQ ID NO: 273913 - RNA, 32 nt, Human
uugcauucaucuucccagcaucuugcaguuuc

SEQ ID NO: 273914 - RNA, 32 nt, Human
uugcauuccagccugggcaacaagagcgaaac

SEQ ID NO: 273915 - RNA, 32 nt, Human
uugcauuccagccugggcaacaagagggaaac

SEQ ID NO: 273916 - RNA, 32 nt, Human
uugcauuccagccugggcaacaagagugaaac

SEQ ID NO: 273917 - RNA, 32 nt, Human
uugcauuccagccugggugacagagcgagacu

SEQ ID NO: 273918 - RNA, 32 nt, Human
uugcauuccagcugucacucugugccuuucua

SEQ ID NO: 273919 - RNA, 32 nt, Human
uugcauucuagacugcauuuuacagugccucu

SEQ ID NO: 273920 - RNA, 32 nt, Human
uugcauucuuuuccuuuuucuuccuguucauu

SEQ ID NO: 273921 - RNA, 32 nt, Human
uugcauugaagccccacaaagccagauugcag

SEQ ID NO: 273922 - RNA, 32 nt, Human
uugcauugcauucagaguaaccugugugcaua

SEQ ID NO: 273923 - RNA, 32 nt, Human
uugcauuucaccccugcaucccagucgcccug

SEQ ID NO: 273924 - RNA, 32 nt, Human
uugcauuucugacuuuauccuguuguuaggaa

SEQ ID NO: 273925 - RNA, 32 nt, Human
uugcauuucuggacccuccacuucaaucugag

SEQ ID NO: 273926 - RNA, 32 nt, Human
uugcauuugcugucuccucugcucaccaggau

SEQ ID NO: 273927 - RNA, 32 nt, Human
uugcauuuggagccaugacagcugauagcucc

SEQ ID NO: 273928 - RNA, 32 nt, Human
uugcauuugggcagcuucugugguguaaauuc

SEQ ID NO: 273929 - RNA, 21 nt, Human
uugcauuuggggagggacuga

SEQ ID NO: 273930 - RNA, 32 nt, Human
uugcauuugucagccugaguuuccuugucucu

SEQ ID NO: 273931 - RNA, 32 nt, Human
uugcauuuuuccuguuuuaacaacggcugugc

SEQ ID NO: 273932 - RNA, 32 nt, Human
uugccaaaaacaacaaauagccacagaacgua

SEQ ID NO: 273933 - RNA, 32 nt, Human
uugccaaaaaggaacuuuucaugucaugcagu

SEQ ID NO: 273934 - RNA, 32 nt, Human
uugccaaaaugaagaggaaggaaggcgacucc

SEQ ID NO: 273935 - RNA, 32 nt, Human
uugccaaacuuugccauugugcuccugcauuu

SEQ ID NO: 273936 - RNA, 32 nt, Human
uugccaaagcaagggacuccagccucuuagga

SEQ ID NO: 273937 - RNA, 32 nt, Human
uugccaaagccagcaacaagagacuccaacaa

SEQ ID NO: 273938 - RNA, 22 nt, Human
uugccaaagcuuuuugccuugc

SEQ ID NO: 273939 - RNA, 32 nt, Human
uugccaaaguagaagaaauaguaguaccauau

SEQ ID NO: 273940 - RNA, 32 nt, Human
uugccaaaguaggaagaaaaagaacagcaaga

SEQ ID NO: 273941 - RNA, 25 nt, Human
uugccaaaugaugugauacuuucca

SEQ ID NO: 273942 - RNA, 32 nt, Human
uugccaacaauuuuaccagcaguuauaccuaa

SEQ ID NO: 273943 - RNA, 32 nt, Human
uugccaacagaaacauggcagauagguaucaa

SEQ ID NO: 273944 - RNA, 32 nt, Human
uugccaacauggugaaaccccaucucuacuaa

SEQ ID NO: 273945 - RNA, 32 nt, Human
uugccaacauggugaaacuccaucucuacuga

SEQ ID NO: 273946 - RNA, 32 nt, Human
uugccaaccuguccuccacugcagccucaccc

SEQ ID NO: 273947 - RNA, 32 nt, Human
uugccaacuauacgaauggcuucgaggagaua

SEQ ID NO: 273948 - RNA, 32 nt, Human
uugccaacugugugugcagguacuguguguac

SEQ ID NO: 273949 - RNA, 24 nt, Human
uugccaacuucaaugguccuaguc

SEQ ID NO: 273950 - RNA, 32 nt, Human
uugccaagaaggcaggggaagccccagugguc

SEQ ID NO: 273951 - RNA, 32 nt, Human
uugccaagaugggauggggaggggguaugaga

SEQ ID NO: 273952 - RNA, 32 nt, Human
uugccaagcagcugggacuacaggugcgcacc

SEQ ID NO: 273953 - RNA, 32 nt, Human
uugccaaggagggcuucaagaagauuagcaaa

SEQ ID NO: 273954 - RNA, 32 nt, Human
uugccaaggcuggagugcaggccgcgaucucg

SEQ ID NO: 273955 - RNA, 21 nt, Human
uugccaaggcuggagugcagu

SEQ ID NO: 273956 - RNA, 22 nt, Human
uugccaaggcuggagugcagug

SEQ ID NO: 273957 - RNA, 32 nt, Human
uugccaaguaaagucagcaaacaacaaacaaa

SEQ ID NO: 273958 - RNA, 32 nt, Human
uugccaaguccuucccuuugguuuuaguuuau

SEQ ID NO: 273959 - RNA, 32 nt, Human
uugccaaguguuuuuacaucaucucauuugau

SEQ ID NO: 273960 - RNA, 32 nt, Human
uugccaauaaaugaucucucauuuuuccaccu

SEQ ID NO: 273961 - RNA, 32 nt, Human
uugccaauccaguggacaagacaggagacugg

SEQ ID NO: 273962 - RNA, 32 nt, Human
uugccaauugucccccagaggggcucuccacc

SEQ ID NO: 273963 - RNA, 32 nt, Human
uugccacaacccagugaguuuccccagaucuc

SEQ ID NO: 273964 - RNA, 32 nt, Human
uugccacagcagcggauagagcaggagagcac

SEQ ID NO: 273965 - RNA, 32 nt, Human
uugccacaggcaggugagaaaggcagggccac

SEQ ID NO: 273966 - RNA, 32 nt, Human
uugccacaguccagagaaggccaccucuaaug

SEQ ID NO: 273967 - RNA, 32 nt, Human
uugccacauccacagcccaugccaaccccucc

SEQ ID NO: 273968 - RNA, 32 nt, Human
uugccacauuuuccucagguuacucaggaaaa

SEQ ID NO: 273969 - RNA, 32 nt, Human
uugccaccaaauaccacacacacuucaguuac

SEQ ID NO: 273970 - RNA, 32 nt, Human
uugccaccaaauauaaugcagacaaauuaugc

SEQ ID NO: 273971 - RNA, 19 nt, Human
uugccaccaccacuaguuc

SEQ ID NO: 273972 - RNA, 32 nt, Human
uugccaccacugcaagcaaaagucuggagaag

SEQ ID NO: 273973 - RNA, 32 nt, Human
uugccaccagugcugugucuuaagagcugcca

SEQ ID NO: 273974 - RNA, 32 nt, Human
uugccaccccuucacgugcacccucaauuucc

SEQ ID NO: 273975 - RNA, 24 nt, Human
uugccacccugugcugaggccuga

SEQ ID NO: 273976 - RNA, 32 nt, Human
uugccaccucgagggucgucucugcugggcgc

SEQ ID NO: 273977 - RNA, 32 nt, Human
uugccaccucuaacagcaccaaaucaaaaucu

SEQ ID NO: 273978 - RNA, 32 nt, Human
uugccacgaucucacuaaaggauuucuauuug

SEQ ID NO: 273979 - RNA, 32 nt, Human
uugccacuaacugaauucuucaaauacucaca

SEQ ID NO: 273980 - RNA, 32 nt, Human
uugccacuccccuaaacuccaggauuuauaaa

SEQ ID NO: 273981 - RNA, 32 nt, Human
uugccacugaggcuucacuggugagauccguu

SEQ ID NO: 273982 - RNA, 32 nt, Human
uugccacugcaaacaauaaacauccuuguaca

SEQ ID NO: 273983 - RNA, 32 nt, Human
uugccacugcacuccagccuaagcaaauagca

SEQ ID NO: 273984 - RNA, 32 nt, Human
uugccacugcacuccagccugggcaacaagag

SEQ ID NO: 273985 - RNA, 32 nt, Human
uugccacugcacuccagccugggcaacagagu

SEQ ID NO: 273986 - RNA, 32 nt, Human
uugccacugcacuccugccugggugacagaag

SEQ ID NO: 273987 - RNA, 32 nt, Human
uugccacugcacucuggccugggcaacagagc

SEQ ID NO: 273988 - RNA, 32 nt, Human
uugccacugcagaaugaagccagugcacaugg

SEQ ID NO: 273989 - RNA, 32 nt, Human
uugccacugcucuccagccugagcgacagagc

SEQ ID NO: 273990 - RNA, 32 nt, Human
uugccacuggggcagugagccuuugguccauu

SEQ ID NO: 273991 - RNA, 32 nt, Human
uugccacugguauuccuuccucuuuugacuuu

SEQ ID NO: 273992 - RNA, 32 nt, Human
uugccacuguacuccagccugaagagcgagac

SEQ ID NO: 273993 - RNA, 32 nt, Human
uugccacugugcuugagugccuggugaagaau

SEQ ID NO: 273994 - RNA, 32 nt, Human
uugccacuuagauuuucuagcagcaaaguccg

SEQ ID NO: 273995 - RNA, 32 nt, Human
uugccacuucucuccucuuccuccugccccug

SEQ ID NO: 273996 - RNA, 32 nt, Human
uugccacuuuagcugcugccucccucugauuc

SEQ ID NO: 273997 - RNA, 32 nt, Human
uugccagaaaggauucuaauaacucgguguca

SEQ ID NO: 273998 - RNA, 32 nt, Human
uugccagaaaugcuguucucaccagaaugccc

SEQ ID NO: 273999 - RNA, 32 nt, Human
uugccagaagcacauaauaaugacuuuguaag

SEQ ID NO: 274000 - RNA, 32 nt, Human
uugccagacagagaucagaauugaaccgucaa

SEQ ID NO: 274001 - RNA, 32 nt, Human
uugccagacugaagcaggaggauugcuugggc

SEQ ID NO: 274002 - RNA, 20 nt, Human
uugccagacuggagugcagu

SEQ ID NO: 274003 - RNA, 32 nt, Human
uugccagagacaccuugguagugcccaucggc

SEQ ID NO: 274004 - RNA, 32 nt, Human
uugccagagagggagaagagaguauguauaag

SEQ ID NO: 274005 - RNA, 32 nt, Human
uugccagagcccagauucccgagagcacucag

SEQ ID NO: 274006 - RNA, 32 nt, Human
uugccagcaaaccaccagaagcuaggagagaa

SEQ ID NO: 274007 - RNA, 32 nt, Human
uugccagcaaagugacucgcaccgugaaguuc

SEQ ID NO: 274008 - RNA, 32 nt, Human
uugccagcagaggcuguuccuuccugcuguuu

SEQ ID NO: 274009 - RNA, 32 nt, Human
uugccagcaggcucugugcuccuugaagcaag

SEQ ID NO: 274010 - RNA, 32 nt, Human
uugccagcagggugcugccaauaaaagguagu

SEQ ID NO: 274011 - RNA, 32 nt, Human
uugccagcauagugcuccuggaccagcgauau

SEQ ID NO: 274012 - RNA, 32 nt, Human
uugccagcauuuuaaugaaaaucuaaugaugu

SEQ ID NO: 274013 - RNA, 32 nt, Human
uugccagcauuuucacauuuugccuuucucgu

SEQ ID NO: 274014 - RNA, 32 nt, Human
uugccagccauguugcccaggcuggucgugaa

SEQ ID NO: 274015 - RNA, 32 nt, Human
uugccagcccagccccuccaugcacauuugga

SEQ ID NO: 274016 - RNA, 17 nt, Human
uugccagcugcugagcc

SEQ ID NO: 274017 - RNA, 21 nt, Human
uugccagcugcugcugaguca

SEQ ID NO: 274018 - RNA, 32 nt, Human
uugccagcugggugcugagcauugagucacug

SEQ ID NO: 274019 - RNA, 32 nt, Human
uugccagcuguuacagauggaggugaugcacc

SEQ ID NO: 274020 - RNA, 32 nt, Human
uugccagcuuuuccucccuuggguucugauau

SEQ ID NO: 274021 - RNA, 32 nt, Human
uugccaggaaaccagauguggcccagaugucc

SEQ ID NO: 274022 - RNA, 32 nt, Human
uugccaggaagguggcuucagcaccuccaggu

SEQ ID NO: 274023 - RNA, 32 nt, Human
uugccaggaggggucgaagggaaaguacaagg

SEQ ID NO: 274024 - RNA, 32 nt, Human
uugccaggcagcugcaggagagugcugccaag

SEQ ID NO: 274025 - RNA, 32 nt, Human
uugccaggcccaggcugggugcccuguggccu

SEQ ID NO: 274026 - RNA, 32 nt, Human
uugccaggcuagagacagggagagcagaguaa

SEQ ID NO: 274027 - RNA, 20 nt, Human
uugccaggcuagagugcagu

SEQ ID NO: 274028 - RNA, 23 nt, Human
uugccaggcuagagugcaguggc

SEQ ID NO: 274029 - RNA, 32 nt, Human
uugccaggcuagagugguguugcagugucagc

SEQ ID NO: 274030 - RNA, 20 nt, Human
uugccaggcuggaaugcagu

SEQ ID NO: 274031 - RNA, 20 nt, Human
uugccaggcuggagugcagu

SEQ ID NO: 274032 - RNA, 32 nt, Human
uugccaggcuuacagaacacccacugccuaga

SEQ ID NO: 274033 - RNA, 32 nt, Human
uugccagggaccaggagcucucacuuugccua

SEQ ID NO: 274034 - RNA, 32 nt, Human
uugccaggggagagacagccacgguccucuuu

SEQ ID NO: 274035 - RNA, 28 nt, Human
uugccaggugaugcugccucucugugga

SEQ ID NO: 274036 - RNA, 32 nt, Human
uugccaggugaugcugccucucuguggauccc

SEQ ID NO: 274037 - RNA, 32 nt, Human
uugccaggugggcccaaauggaaauguauuca

SEQ ID NO: 274038 - RNA, 32 nt, Human
uugccagguuuccugacuccacauguuaugcu

SEQ ID NO: 274039 - RNA, 32 nt, Human
uugccagucgcuaggucagcccauggggccac

SEQ ID NO: 274040 - RNA, 32 nt, Human
uugccagucuugccagggcaaaaaggcaagcg

SEQ ID NO: 274041 - RNA, 32 nt, Human
uugccagugaagccuccaacccuaagccacug

SEQ ID NO: 274042 - RNA, 32 nt, Human
uugccaguggggugggcagugcaguggggugg

SEQ ID NO: 274043 - RNA, 32 nt, Human
uugccagugggguggucacauauaguguucuc

SEQ ID NO: 274044 - RNA, 32 nt, Human
uugccaguuauguucaggaaacccaauaaccu

SEQ ID NO: 274045 - RNA, 32 nt, Human
uugccaguucccaaaucuuuaucuaucucaga

SEQ ID NO: 274046 - RNA, 32 nt, Human
uugccaguuggcuuuucuuaaaugaaaacacu

SEQ ID NO: 274047 - RNA, 31 nt, Human
uugccaguuuauucuggcccugugucuacug

SEQ ID NO: 274048 - RNA, 32 nt, Human
uugccaguuugaagacuguucuccuaaagugu

SEQ ID NO: 274049 - RNA, 32 nt, Human
uugccauaaaacugccaucacacagaagagag

SEQ ID NO: 274050 - RNA, 32 nt, Human
uugccauaacauccugcuccauucccucuaag

SEQ ID NO: 274051 - RNA, 32 nt, Human
uugccauauggguagagguuacagagggaggu

SEQ ID NO: 274052 - RNA, 32 nt, Human
uugccaucaagcaacccucauucucaugccug

SEQ ID NO: 274053 - RNA, 32 nt, Human
uugccaucacagaggccacacugagcgcuugg

SEQ ID NO: 274054 - RNA, 32 nt, Human
uugccaucagccauggcucccaaaaagagugu

SEQ ID NO: 274055 - RNA, 32 nt, Human
uugccaucccugucuccuccauccuggcugug

SEQ ID NO: 274056 - RNA, 32 nt, Human
uugccaucucaguugcugcagugcagugaauu

SEQ ID NO: 274057 - RNA, 32 nt, Human
uugccaucuccaggaagacuugacggcuuugg

SEQ ID NO: 274058 - RNA, 32 nt, Human
uugccaucuccucaucccugagccaucucccu

SEQ ID NO: 274059 - RNA, 32 nt, Human
uugccaucuccugcacagccugggggagcuaa

SEQ ID NO: 274060 - RNA, 32 nt, Human
uugccaugaaggaacuugggauuuucaaugga

SEQ ID NO: 274061 - RNA, 32 nt, Human
uugccaugcguccuggucaagcuccccucacu

SEQ ID NO: 274062 - RNA, 22 nt, Human
uugccaugcuuaggugacagaa

SEQ ID NO: 274063 - RNA, 32 nt, Human
uugccauggccauagggccacagugccguauc

SEQ ID NO: 274064 - RNA, 19 nt, Human
uugccauggcccugagcca

SEQ ID NO: 274065 - RNA, 32 nt, Human
uugccauggccgcuguaacacuacauguugcu

SEQ ID NO: 274066 - RNA, 32 nt, Human
uugccauggccuggccaucuuguugcugcuug

SEQ ID NO: 274067 - RNA, 32 nt, Human
uugccauggucaccaaacaggaaguggacauu

SEQ ID NO: 274068 - RNA, 32 nt, Human
uugccauggugaugguguagcccucccacuuu

SEQ ID NO: 274069 - RNA, 32 nt, Human
uugccaugugccaggcacugugcugagugcca

SEQ ID NO: 274070 - RNA, 32 nt, Human
uugccauguugcccaagcaggucuccaacucc

SEQ ID NO: 274071 - RNA, 32 nt, Human
uugccauguuuuugccaaaaccaagauuuuga

SEQ ID NO: 274072 - RNA, 23 nt, Human
uugccauuaaacuuaccugggca

SEQ ID NO: 274073 - RNA, 24 nt, Human
uugccauuaacuuucuucugggca

SEQ ID NO: 274074 - RNA, 32 nt, Human
uugccauuacuuuuccuucccacucucuccaa

SEQ ID NO: 274075 - RNA, 32 nt, Human
uugccauucaggaacguggcaaggagcaugca

SEQ ID NO: 274076 - RNA, 22 nt, Human
uugccauucuucauuccuacaa

SEQ ID NO: 274077 - RNA, 32 nt, Human
uugccauugcacuccagcugagagugugaccc

SEQ ID NO: 274078 - RNA, 32 nt, Human
uugccauugcccaggaggggcccagucaccau

SEQ ID NO: 274079 - RNA, 32 nt, Human
uugccauugggcagaggaguauaggacugggg

SEQ ID NO: 274080 - RNA, 32 nt, Human
uugccauugguuucugaaaaguauucacauca

SEQ ID NO: 274081 - RNA, 23 nt, Human
uugccauuuuaaauauguucuga

SEQ ID NO: 274082 - RNA, 32 nt, Human
uugccauuuuucaaagauuaaguaggaggaga

SEQ ID NO: 274083 - RNA, 32 nt, Human
uugccauuuuuggaggcauggaagagagacac

SEQ ID NO: 274084 - RNA, 21 nt, Human
uugcccaaccuggagugcaau

SEQ ID NO: 274085 - RNA, 24 nt, Human
uugcccaaccuggagugcaauggc

SEQ ID NO: 274086 - RNA, 21 nt, Human
uugcccaaccuggagugcagu

SEQ ID NO: 274087 - RNA, 32 nt, Human
uugcccaaccuggagugcaguggugcggucuc

SEQ ID NO: 274088 - RNA, 32 nt, Human
uugcccaagacagaucucaccccacaucuuca

SEQ ID NO: 274089 - RNA, 32 nt, Human
uugcccaagaguuugagaccagccuggacaac

SEQ ID NO: 274090 - RNA, 24 nt, Human
uugcccaagcugaucuugaacucc

SEQ ID NO: 274091 - RNA, 23 nt, Human
uugcccaagcuggaaugcagugg

SEQ ID NO: 274092 - RNA, 24 nt, Human
uugcccaagcuggaaugcaguggc

SEQ ID NO: 274093 - RNA, 32 nt, Human
uugcccaagcuggaaugcaguggcacagucac

SEQ ID NO: 274094 - RNA, 21 nt, Human
uugcccaagcuggaguacagu

SEQ ID NO: 274095 - RNA, 24 nt, Human
uugcccaagcuggaguacaguagu

SEQ ID NO: 274096 - RNA, 32 nt, Human
uugcccaagcuggaguacaguagugcaaucuc

SEQ ID NO: 274097 - RNA, 23 nt, Human
uugcccaagcuggagugaagugg

SEQ ID NO: 274098 - RNA, 32 nt, Human
uugcccaagcuggagugaagugguacaaucug

SEQ ID NO: 274099 - RNA, 19 nt, Human
uugcccaagcuggagugca

SEQ ID NO: 274100 - RNA, 23 nt, Human
uugcccaagcuggagugcaaugg

SEQ ID NO: 274101 - RNA, 24 nt, Human
uugcccaagcuggagugcaauggc

SEQ ID NO: 274102 - RNA, 32 nt, Human
uugcccaagcuggagugcaauggcgcgaucuc

SEQ ID NO: 274103 - RNA, 23 nt, Human
uugcccaagcuggagugcagugg

SEQ ID NO: 274104 - RNA, 24 nt, Human
uugcccaagcuggagugcaguggc

SEQ ID NO: 274105 - RNA, 32 nt, Human
uugcccaagcuggagugcaguggcgcgaucuc

SEQ ID NO: 274106 - RNA, 32 nt, Human
uugcccaagcuggagugcaguggugcaaugug

SEQ ID NO: 274107 - RNA, 32 nt, Human
uugcccaagcuggucuggaacuccugggcuca

SEQ ID NO: 274108 - RNA, 32 nt, Human
uugcccaagcuggucuugaacuacugagcuca

SEQ ID NO: 274109 - RNA, 24 nt, Human
uugcccaagcuggugucaaacucc

SEQ ID NO: 274110 - RNA, 32 nt, Human
uugcccaagcuugagggcaguggugcaaucau

SEQ ID NO: 274111 - RNA, 24 nt, Human
uugcccaagcuugucuugaacucc

SEQ ID NO: 274112 - RNA, 32 nt, Human
uugcccaaggggacacagcagugacggcucug

SEQ ID NO: 274113 - RNA, 23 nt, Human
uugcccaagguagagugcagugg

SEQ ID NO: 274114 - RNA, 24 nt, Human
uugcccaagguagagugcaguggc

SEQ ID NO: 274115 - RNA, 19 nt, Human
uugcccaaggugugcaggg

SEQ ID NO: 274116 - RNA, 32 nt, Human
uugcccaagguugcacagcaagaaaagggaga

SEQ ID NO: 274117 - RNA, 23 nt, Human
uugcccaaguuggagugcagugg

SEQ ID NO: 274118 - RNA, 24 nt, Human
uugcccaaguuggagugcaguggc

SEQ ID NO: 274119 - RNA, 32 nt, Human
uugcccaaugcuucacaggccaugcuggggcc

SEQ ID NO: 274120 - RNA, 32 nt, Human
uugcccaauuaauacuagggugcaguguaucc

SEQ ID NO: 274121 - RNA, 24 nt, Human
uugcccacacuagagugcaauggc

SEQ ID NO: 274122 - RNA, 32 nt, Human
uugcccacagucauggucucuguagaaucuga

SEQ ID NO: 274123 - RNA, 24 nt, Human
uugcccacauuggagugcaguggc

SEQ ID NO: 274124 - RNA, 32 nt, Human
uugcccacccacccaucucacuaugcaauucg

SEQ ID NO: 274125 - RNA, 32 nt, Human
uugcccaccuccacucuaauucccauccauua

SEQ ID NO: 274126 - RNA, 32 nt, Human
uugcccacgaucccagacacugaagaugaaau

SEQ ID NO: 274127 - RNA, 24 nt, Human
uugcccacgcaggagugcaguggc

SEQ ID NO: 274128 - RNA, 32 nt, Human
uugcccacgcaggagugcaguggcaugcucuc

SEQ ID NO: 274129 - RNA, 21 nt, Human
uugcccacgcuggagugcaau

SEQ ID NO: 274130 - RNA, 32 nt, Human
uugcccacgcuggagugcaauggugcaaucuc

SEQ ID NO: 274131 - RNA, 32 nt, Human
uugcccacgcuggucucgaauuccuggccuca

SEQ ID NO: 274132 - RNA, 32 nt, Human
uugcccacggcaacugccuuccugccucuccc

SEQ ID NO: 274133 - RNA, 32 nt, Human
uugcccacggguuuguuuccaaguccucuucu

SEQ ID NO: 274134 - RNA, 24 nt, Human
uugcccacggugaucucgaacucc

SEQ ID NO: 274135 - RNA, 32 nt, Human
uugcccacugcaaguucucuccaggugcaauu

SEQ ID NO: 274136 - RNA, 32 nt, Human
uugcccacugcacacuugcuguguacaaugac

SEQ ID NO: 274137 - RNA, 32 nt, Human
uugcccacugcacuccagccugggcaacagag

SEQ ID NO: 274138 - RNA, 32 nt, Human
uugcccacuuuccucuuuuugggguuggugag

SEQ ID NO: 274139 - RNA, 32 nt, Human
uugcccacuuucugcuggucuccgagagacug

SEQ ID NO: 274140 - RNA, 32 nt, Human
uugcccagaacccacgccucaggaugaucgug

SEQ ID NO: 274141 - RNA, 19 nt, Human
uugcccagacuagaguaca

SEQ ID NO: 274142 - RNA, 23 nt, Human
uugcccagacuagagugcagugg

SEQ ID NO: 274143 - RNA, 24 nt, Human
uugcccagacuagagugcaguggu

SEQ ID NO: 274144 - RNA, 22 nt, Human
uugcccagacuggaauacagug

SEQ ID NO: 274145 - RNA, 23 nt, Human
uugcccagacuggaauacagugg

SEQ ID NO: 274146 - RNA, 24 nt, Human
uugcccagacuggaauacaguggu

SEQ ID NO: 274147 - RNA, 22 nt, Human
uugcccagacuggagagcagug

SEQ ID NO: 274148 - RNA, 23 nt, Human
uugcccagacuggagagcagugg

SEQ ID NO: 274149 - RNA, 24 nt, Human
uugcccagacuggagagcaguggc

SEQ ID NO: 274150 - RNA, 23 nt, Human
uugcccagacuggagggcagugg

SEQ ID NO: 274151 - RNA, 32 nt, Human
uugcccagacuggagugaaguagcaugaucuu

SEQ ID NO: 274152 - RNA, 19 nt, Human
uugcccagacuggagugca

SEQ ID NO: 274153 - RNA, 23 nt, Human
uugcccagacuggagugcaaugg

SEQ ID NO: 274154 - RNA, 24 nt, Human
uugcccagacuggagugcaauggc

SEQ ID NO: 274155 - RNA, 32 nt, Human
uugcccagacuggagugcaauggcacacgauc

SEQ ID NO: 274156 - RNA, 23 nt, Human
uugcccagacuggagugcagugg

SEQ ID NO: 274157 - RNA, 24 nt, Human
uugcccagacuggagugcaguggc

SEQ ID NO: 274158 - RNA, 32 nt, Human
uugcccagacuggagugcaguggcgugaucuc

SEQ ID NO: 274159 - RNA, 32 nt, Human
uugcccagacuggagugcagugguguaaucuu

SEQ ID NO: 274160 - RNA, 32 nt, Human
uugcccagacuggagugcaguggugugaucau

SEQ ID NO: 274161 - RNA, 24 nt, Human
uugcccagacuggucucaaacucc

SEQ ID NO: 274162 - RNA, 24 nt, Human
uugcccagacuggucucgaacucc

SEQ ID NO: 274163 - RNA, 24 nt, Human
uugcccagacuggucucgaacucu

SEQ ID NO: 274164 - RNA, 24 nt, Human
uugcccagacuggucuugaacucc

SEQ ID NO: 274165 - RNA, 24 nt, Human
uugcccagacugguuuugaacucc

SEQ ID NO: 274166 - RNA, 32 nt, Human
uugcccagagaggccucacacaggccucagaa

SEQ ID NO: 274167 - RNA, 32 nt, Human
uugcccagagcacgaggagcugcuggcggggg

SEQ ID NO: 274168 - RNA, 19 nt, Human
uugcccagauuggagucag

SEQ ID NO: 274169 - RNA, 24 nt, Human
uugcccagauuggucucaaacucc

SEQ ID NO: 274170 - RNA, 28 nt, Human
uugcccagcagugcugccuucagcggcc

SEQ ID NO: 274171 - RNA, 17 nt, Human
uugcccagccggcugca

SEQ ID NO: 274172 - RNA, 20 nt, Human
uugcccagccgugguggccc

SEQ ID NO: 274173 - RNA, 21 nt, Human
uugcccagccuggagugcaau

SEQ ID NO: 274174 - RNA, 24 nt, Human
uugcccagccuggagugcaauagc

SEQ ID NO: 274175 - RNA, 32 nt, Human
uugcccagccuggagugcaauagcgugaucuc

SEQ ID NO: 274176 - RNA, 32 nt, Human
uugcccagccuggagugcaauggcacaaucuc

SEQ ID NO: 274177 - RNA, 32 nt, Human
uugcccagccuggagugcagugugucaucuug

SEQ ID NO: 274178 - RNA, 32 nt, Human
uugcccagccugggggaguggggaaggcuugg

SEQ ID NO: 274179 - RNA, 32 nt, Human
uugcccagcugagugcuggcucugaggaagcc

SEQ ID NO: 274180 - RNA, 20 nt, Human
uugcccagcuggagugcagu

SEQ ID NO: 274181 - RNA, 23 nt, Human
uugcccagcuggagugcaguggc

SEQ ID NO: 274182 - RNA, 32 nt, Human
uugcccagcuuggaguugucugucacgcacau

SEQ ID NO: 274183 - RNA, 32 nt, Human
uugcccaggagaaugaggagccucccugcagu

SEQ ID NO: 274184 - RNA, 32 nt, Human
uugcccaggagggagugcaguggugcaaccuc

SEQ ID NO: 274185 - RNA, 24 nt, Human
uugcccaggagggucucgaacucc

SEQ ID NO: 274186 - RNA, 32 nt, Human
uugcccaggauccauugcugcagcuuccugaa

SEQ ID NO: 274187 - RNA, 32 nt, Human
uugcccaggauggaaugcaguggcacaaucuu

SEQ ID NO: 274188 - RNA, 23 nt, Human
uugcccaggauggagugcagugg

SEQ ID NO: 274189 - RNA, 32 nt, Human
uugcccaggauggagugcaguggugagaucac

SEQ ID NO: 274190 - RNA, 24 nt, Human
uugcccaggcagaucucagacucc

SEQ ID NO: 274191 - RNA, 21 nt, Human
uugcccaggcaggaguacagu

SEQ ID NO: 274192 - RNA, 24 nt, Human
uugcccaggcaggaguacaguagu

SEQ ID NO: 274193 - RNA, 24 nt, Human
uugcccaggcaggaguacaguggc

SEQ ID NO: 274194 - RNA, 24 nt, Human
uugcccaggcaggucuugaacucc

SEQ ID NO: 274195 - RNA, 24 nt, Human
uugcccaggcaguagugcaguggc

SEQ ID NO: 274196 - RNA, 32 nt, Human
uugcccaggcaguagugcaguggcgcgauaua

SEQ ID NO: 274197 - RNA, 24 nt, Human
uugcccaggccagucucaaacucc

SEQ ID NO: 274198 - RNA, 24 nt, Human
uugcccaggccagucuugaacucc

SEQ ID NO: 274199 - RNA, 24 nt, Human
uugcccaggccaguuagaaaaucc

SEQ ID NO: 274200 - RNA, 32 nt, Human
uugcccaggcccgagugcaguggugcgaucuu

SEQ ID NO: 274201 - RNA, 19 nt, Human
uugcccaggccggagugca

SEQ ID NO: 274202 - RNA, 21 nt, Human
uugcccaggccggagugcaau

SEQ ID NO: 274203 - RNA, 22 nt, Human
uugcccaggccggagugcaaug

SEQ ID NO: 274204 - RNA, 23 nt, Human
uugcccaggccggagugcaaugg

SEQ ID NO: 274205 - RNA, 24 nt, Human
uugcccaggccggagugcaauggc

SEQ ID NO: 274206 - RNA, 24 nt, Human
uugcccaggccggucuugaacucc

SEQ ID NO: 274207 - RNA, 24 nt, Human
uugcccaggccuaguuucaguggc

SEQ ID NO: 274208 - RNA, 20 nt, Human
uugcccaggcggaguacaau

SEQ ID NO: 274209 - RNA, 23 nt, Human
uugcccaggcggaguacaauggu

SEQ ID NO: 274210 - RNA, 24 nt, Human
uugcccaggcuaauaucgaaugcu

SEQ ID NO: 274211 - RNA, 24 nt, Human
uugcccaggcuaaucucaaauucc

SEQ ID NO: 274212 - RNA, 24 nt, Human
uugcccaggcuagagcgcaggggc

SEQ ID NO: 274213 - RNA, 32 nt, Human
uugcccaggcuagagggcaauggugcaaucuc

SEQ ID NO: 274214 - RNA, 19 nt, Human
uugcccaggcuagagugca

SEQ ID NO: 274215 - RNA, 23 nt, Human
uugcccaggcuagagugcaaugg

SEQ ID NO: 274216 - RNA, 24 nt, Human
uugcccaggcuagagugcaauggc

SEQ ID NO: 274217 - RNA, 32 nt, Human
uugcccaggcuagagugcaauggcacaaucuc

SEQ ID NO: 274218 - RNA, 32 nt, Human
uugcccaggcuagagugcaauggcacaaucug

SEQ ID NO: 274219 - RNA, 32 nt, Human
uugcccaggcuagagugcaauggcgccaucuc

SEQ ID NO: 274220 - RNA, 32 nt, Human
uugcccaggcuagagugcaauggugcgaucua

SEQ ID NO: 274221 - RNA, 23 nt, Human
uugcccaggcuagagugcacugg

SEQ ID NO: 274222 - RNA, 24 nt, Human
uugcccaggcuagagugcacuggu

SEQ ID NO: 274223 - RNA, 20 nt, Human
uugcccaggcuagagugcag

SEQ ID NO: 274224 - RNA, 24 nt, Human
uugcccaggcuagagugcagcagu

SEQ ID NO: 274225 - RNA, 32 nt, Human
uugcccaggcuagagugcagcagugacaugau

SEQ ID NO: 274226 - RNA, 21 nt, Human
uugcccaggcuagagugcagu

SEQ ID NO: 274227 - RNA, 23 nt, Human
uugcccaggcuagagugcagugg

SEQ ID NO: 274228 - RNA, 24 nt, Human
uugcccaggcuagagugcaguggc

SEQ ID NO: 274229 - RNA, 32 nt, Human
uugcccaggcuagagugcaguggcacaaucau

SEQ ID NO: 274230 - RNA, 24 nt, Human
uugcccaggcuagagugcaguggu

SEQ ID NO: 274231 - RNA, 32 nt, Human
uugcccaggcuagagugcaguggugcaaucuc

SEQ ID NO: 274232 - RNA, 32 nt, Human
uugcccaggcuagagugcaguggugccacagc

SEQ ID NO: 274233 - RNA, 23 nt, Human
uugcccaggcuagcaugcaaugg

SEQ ID NO: 274234 - RNA, 24 nt, Human
uugcccaggcuagcaugcaauggu

SEQ ID NO: 274235 - RNA, 24 nt, Human
uugcccaggcuagccucaaacucc

SEQ ID NO: 274236 - RNA, 18 nt, Human
uugcccaggcuagucugg

SEQ ID NO: 274237 - RNA, 24 nt, Human
uugcccaggcuagucuggaacucc

SEQ ID NO: 274238 - RNA, 24 nt, Human
uugcccaggcuagucuugaacucc

SEQ ID NO: 274239 - RNA, 23 nt, Human
uugcccaggcucaucucgaacuc

SEQ ID NO: 274240 - RNA, 32 nt, Human
uugcccaggcuccagugcaguggugugaucau

SEQ ID NO: 274241 - RNA, 32 nt, Human
uugcccaggcucuagugcaauggcacgaucuc

SEQ ID NO: 274242 - RNA, 19 nt, Human
uugcccaggcugaagugca

SEQ ID NO: 274243 - RNA, 32 nt, Human
uugcccaggcugaagugcaauguugugaucuc

SEQ ID NO: 274244 - RNA, 21 nt, Human
uugcccaggcugaagugcagu

SEQ ID NO: 274245 - RNA, 23 nt, Human
uugcccaggcugaagugcagugg

SEQ ID NO: 274246 - RNA, 32 nt, Human
uugcccaggcugaagugcaguggggcgcucuc

SEQ ID NO: 274247 - RNA, 32 nt, Human
uugcccaggcugaagugcaguggugcgaucuc

SEQ ID NO: 274248 - RNA, 32 nt, Human
uugcccaggcugaagugcaguggugugaucuu

SEQ ID NO: 274249 - RNA, 32 nt, Human
uugcccaggcugaagugcaguguugugaucuc

SEQ ID NO: 274250 - RNA, 23 nt, Human
uugcccaggcugaaguguagugg

SEQ ID NO: 274251 - RNA, 24 nt, Human
uugcccaggcugaauucagacucc

SEQ ID NO: 274252 - RNA, 24 nt, Human
uugcccaggcugaccuccaacucc

SEQ ID NO: 274253 - RNA, 24 nt, Human
uugcccaggcugaucucaaauucc

SEQ ID NO: 274254 - RNA, 24 nt, Human
uugcccaggcugaucucgaaccuc

SEQ ID NO: 274255 - RNA, 24 nt, Human
uugcccaggcugaucuugaacucc

SEQ ID NO: 274256 - RNA, 32 nt, Human
uugcccaggcugcagugcaauggcacaaucuu

SEQ ID NO: 274257 - RNA, 24 nt, Human
uugcccaggcugcagugcaguggc

SEQ ID NO: 274258 - RNA, 32 nt, Human
uugcccaggcugcagugcaguggugccaucuc

SEQ ID NO: 274259 - RNA, 32 nt, Human
uugcccaggcugcagugcaguggugugaucuu

SEQ ID NO: 274260 - RNA, 24 nt, Human
uugcccaggcugcucucaaacucc

SEQ ID NO: 274261 - RNA, 32 nt, Human
uugcccaggcuggaaauggcgcgaucucggcu

SEQ ID NO: 274262 - RNA, 23 nt, Human
uugcccaggcuggaauacagugg

SEQ ID NO: 274263 - RNA, 24 nt, Human
uugcccaggcuggaauacaguggc

SEQ ID NO: 274264 - RNA, 23 nt, Human
uugcccaggcuggaaugcaaugg

SEQ ID NO: 274265 - RNA, 24 nt, Human
uugcccaggcuggaaugcaauggc

SEQ ID NO: 274266 - RNA, 32 nt, Human
uugcccaggcuggaaugcaauggcgcgaucuc

SEQ ID NO: 274267 - RNA, 32 nt, Human
uugcccaggcuggaaugcaauggcgugaucuu

SEQ ID NO: 274268 - RNA, 21 nt, Human
uugcccaggcuggaaugcagu

SEQ ID NO: 274269 - RNA, 23 nt, Human
uugcccaggcuggaaugcagugg

SEQ ID NO: 274270 - RNA, 24 nt, Human
uugcccaggcuggaaugcaguggc

SEQ ID NO: 274271 - RNA, 32 nt, Human
uugcccaggcuggaaugcaguggcacaaucuu

SEQ ID NO: 274272 - RNA, 32 nt, Human
uugcccaggcuggaaugcaguggcgugaucuc

SEQ ID NO: 274273 - RNA, 32 nt, Human
uugcccaggcuggaaugcaguggcgugaucuu

SEQ ID NO: 274274 - RNA, 32 nt, Human
uugcccaggcuggaaugcagugguacgcucuc

SEQ ID NO: 274275 - RNA, 32 nt, Human
uugcccaggcuggaaugcaguggugugcucug

SEQ ID NO: 274276 - RNA, 24 nt, Human
uugcccaggcuggaccugaacucc

SEQ ID NO: 274277 - RNA, 32 nt, Human
uugcccaggcuggacuacaguggcacaaucuc

SEQ ID NO: 274278 - RNA, 20 nt, Human
uugcccaggcuggacugcag

SEQ ID NO: 274279 - RNA, 23 nt, Human
uugcccaggcuggacugcagcag

SEQ ID NO: 274280 - RNA, 24 nt, Human
uugcccaggcuggacugcagcagc

SEQ ID NO: 274281 - RNA, 24 nt, Human
uugcccaggcuggacugcaguggc

SEQ ID NO: 274282 - RNA, 32 nt, Human
uugcccaggcuggacugcaguggcgugaucuc

SEQ ID NO: 274283 - RNA, 23 nt, Human
uugcccaggcuggagagcagugg

SEQ ID NO: 274284 - RNA, 24 nt, Human
uugcccaggcuggagagcaguggc

SEQ ID NO: 274285 - RNA, 32 nt, Human
uugcccaggcuggagagcaguggcgcgaucuu

SEQ ID NO: 274286 - RNA, 32 nt, Human
uugcccaggcuggagagcaguggugcaaucuu

SEQ ID NO: 274287 - RNA, 22 nt, Human
uugcccaggcuggagcgaagug

SEQ ID NO: 274288 - RNA, 32 nt, Human
uugcccaggcuggagcgcaaguggcgcgaucu

SEQ ID NO: 274289 - RNA, 23 nt, Human
uugcccaggcuggagcgcagugg

SEQ ID NO: 274290 - RNA, 32 nt, Human
uugcccaggcuggagcgcaguggggugaucuc

SEQ ID NO: 274291 - RNA, 23 nt, Human
uugcccaggcuggagggcaaugg

SEQ ID NO: 274292 - RNA, 32 nt, Human
uugcccaggcuggagggcaauggugcaaucuc

SEQ ID NO: 274293 - RNA, 22 nt, Human
uugcccaggcuggagggcagug

SEQ ID NO: 274294 - RNA, 32 nt, Human
uugcccaggcuggagggcagugacgugaucag

SEQ ID NO: 274295 - RNA, 23 nt, Human
uugcccaggcuggagggcagugg

SEQ ID NO: 274296 - RNA, 21 nt, Human
uugcccaggcuggaguacaau

SEQ ID NO: 274297 - RNA, 22 nt, Human
uugcccaggcuggaguacaaug

SEQ ID NO: 274298 - RNA, 23 nt, Human
uugcccaggcuggaguacaaugg

SEQ ID NO: 274299 - RNA, 24 nt, Human
uugcccaggcuggaguacaauggc

SEQ ID NO: 274300 - RNA, 32 nt, Human
uugcccaggcuggaguacaauggcgcgaucuc

SEQ ID NO: 274301 - RNA, 32 nt, Human
uugcccaggcuggaguacaauggcgugaucuc

SEQ ID NO: 274302 - RNA, 24 nt, Human
uugcccaggcuggaguacaauggu

SEQ ID NO: 274303 - RNA, 32 nt, Human
uugcccaggcuggaguacaauggugcgaucuc

SEQ ID NO: 274304 - RNA, 32 nt, Human
uugcccaggcuggaguacaauggugcgaucuu

SEQ ID NO: 274305 - RNA, 21 nt, Human
uugcccaggcuggaguacagu

SEQ ID NO: 274306 - RNA, 23 nt, Human
uugcccaggcuggaguacagugg

SEQ ID NO: 274307 - RNA, 24 nt, Human
uugcccaggcuggaguacaguggc

SEQ ID NO: 274308 - RNA, 32 nt, Human
uugcccaggcuggaguacaguggcacaaucuc

SEQ ID NO: 274309 - RNA, 32 nt, Human
uugcccaggcuggaguacaguggcacaaucuu

SEQ ID NO: 274310 - RNA, 32 nt, Human
uugcccaggcuggaguacaguggcgugaucuc

SEQ ID NO: 274311 - RNA, 24 nt, Human
uugcccaggcuggaguacaguggu

SEQ ID NO: 274312 - RNA, 32 nt, Human
uugcccaggcuggaguacagugguaugaucuu

SEQ ID NO: 274313 - RNA, 32 nt, Human
uugcccaggcuggaguacaguggucacugcaa

SEQ ID NO: 274314 - RNA, 23 nt, Human
uugcccaggcuggaguacauugg

SEQ ID NO: 274315 - RNA, 32 nt, Human
uugcccaggcuggaguacauuggugugaugau

SEQ ID NO: 274316 - RNA, 21 nt, Human
uugcccaggcuggaguauagu

SEQ ID NO: 274317 - RNA, 32 nt, Human
uugcccaggcuggaguauaguagugcaguggu

SEQ ID NO: 274318 - RNA, 32 nt, Human
uugcccaggcuggagugaaauggugcgaucuc

SEQ ID NO: 274319 - RNA, 21 nt, Human
uugcccaggcuggagugaagu

SEQ ID NO: 274320 - RNA, 23 nt, Human
uugcccaggcuggagugaagugg

SEQ ID NO: 274321 - RNA, 32 nt, Human
uugcccaggcuggagugaaguggcgugaccuu

SEQ ID NO: 274322 - RNA, 32 nt, Human
uugcccaggcuggagugaguggcacagucucg

SEQ ID NO: 274323 - RNA, 19 nt, Human
uugcccaggcuggagugca

SEQ ID NO: 274324 - RNA, 23 nt, Human
uugcccaggcuggagugcaacgg

SEQ ID NO: 274325 - RNA, 24 nt, Human
uugcccaggcuggagugcaacggc

SEQ ID NO: 274326 - RNA, 32 nt, Human
uugcccaggcuggagugcaacggcacgaucuc

SEQ ID NO: 274327 - RNA, 32 nt, Human
uugcccaggcuggagugcaacggcaugauuuu

SEQ ID NO: 274328 - RNA, 32 nt, Human
uugcccaggcuggagugcaacggcgcgcucuu

SEQ ID NO: 274329 - RNA, 32 nt, Human
uugcccaggcuggagugcaacggugcagucuc

SEQ ID NO: 274330 - RNA, 32 nt, Human
uugcccaggcuggagugcaagggcgcaaucuc

SEQ ID NO: 274331 - RNA, 21 nt, Human
uugcccaggcuggagugcaau

SEQ ID NO: 274332 - RNA, 24 nt, Human
uugcccaggcuggagugcaauagc

SEQ ID NO: 274333 - RNA, 32 nt, Human
uugcccaggcuggagugcaauagcacgaucuu

SEQ ID NO: 274334 - RNA, 32 nt, Human
uugcccaggcuggagugcaauagcaugaucuc

SEQ ID NO: 274335 - RNA, 32 nt, Human
uugcccaggcuggagugcaauagcgcaaucuc

SEQ ID NO: 274336 - RNA, 32 nt, Human
uugcccaggcuggagugcaauagcgcgaucuu

SEQ ID NO: 274337 - RNA, 22 nt, Human
uugcccaggcuggagugcaaug

SEQ ID NO: 274338 - RNA, 32 nt, Human
uugcccaggcuggagugcaaugaugcaaucuc

SEQ ID NO: 274339 - RNA, 32 nt, Human
uugcccaggcuggagugcaaugcgcgaucuca

SEQ ID NO: 274340 - RNA, 23 nt, Human
uugcccaggcuggagugcaaugg

SEQ ID NO: 274341 - RNA, 32 nt, Human
uugcccaggcuggagugcaauggagcgaucuu

SEQ ID NO: 274342 - RNA, 24 nt, Human
uugcccaggcuggagugcaauggc

SEQ ID NO: 274343 - RNA, 32 nt, Human
uugcccaggcuggagugcaauggcacaaccuc

SEQ ID NO: 274344 - RNA, 32 nt, Human
uugcccaggcuggagugcaauggcacaaucuc

SEQ ID NO: 274345 - RNA, 32 nt, Human
uugcccaggcuggagugcaauggcacaauuuc

SEQ ID NO: 274346 - RNA, 32 nt, Human
uugcccaggcuggagugcaauggcacaucuug

SEQ ID NO: 274347 - RNA, 32 nt, Human
uugcccaggcuggagugcaauggcacgacguc

SEQ ID NO: 274348 - RNA, 32 nt, Human
uugcccaggcuggagugcaauggcacgaucuc

SEQ ID NO: 274349 - RNA, 32 nt, Human
uugcccaggcuggagugcaauggcacgaucuu

SEQ ID NO: 274350 - RNA, 32 nt, Human
uugcccaggcuggagugcaauggcacguucuc

SEQ ID NO: 274351 - RNA, 32 nt, Human
uugcccaggcuggagugcaauggcgcaaucuc

SEQ ID NO: 274352 - RNA, 32 nt, Human
uugcccaggcuggagugcaauggcgcaaucuu

SEQ ID NO: 274353 - RNA, 32 nt, Human
uugcccaggcuggagugcaauggcgcgaaccu

SEQ ID NO: 274354 - RNA, 32 nt, Human
uugcccaggcuggagugcaauggcgcgauccu

SEQ ID NO: 274355 - RNA, 32 nt, Human
uugcccaggcuggagugcaauggcgcgaucuc

SEQ ID NO: 274356 - RNA, 32 nt, Human
uugcccaggcuggagugcaauggcgcgaucuu

SEQ ID NO: 274357 - RNA, 32 nt, Human
uugcccaggcuggagugcaauggcgcguucuc

SEQ ID NO: 274358 - RNA, 32 nt, Human
uugcccaggcuggagugcaauggcguaaucuc

SEQ ID NO: 274359 - RNA, 32 nt, Human
uugcccaggcuggagugcaauggcguaucucc

SEQ ID NO: 274360 - RNA, 32 nt, Human
uugcccaggcuggagugcaauggcgugaucgc

SEQ ID NO: 274361 - RNA, 32 nt, Human
uugcccaggcuggagugcaauggcgugaucuc

SEQ ID NO: 274362 - RNA, 32 nt, Human
uugcccaggcuggagugcaauggcgugaucuu

SEQ ID NO: 274363 - RNA, 32 nt, Human
uugcccaggcuggagugcaaugguacaaucuc

SEQ ID NO: 274364 - RNA, 32 nt, Human
uugcccaggcuggagugcaaugguaugaucuu

SEQ ID NO: 274365 - RNA, 32 nt, Human
uugcccaggcuggagugcaauggugcaaucuc

SEQ ID NO: 274366 - RNA, 32 nt, Human
uugcccaggcuggagugcaauggugcaaucuu

SEQ ID NO: 274367 - RNA, 32 nt, Human
uugcccaggcuggagugcaauggugcaauuuc

SEQ ID NO: 274368 - RNA, 32 nt, Human
uugcccaggcuggagugcaauggugcaguuuu

SEQ ID NO: 274369 - RNA, 32 nt, Human
uugcccaggcuggagugcaauggugcgaucuc

SEQ ID NO: 274370 - RNA, 32 nt, Human
uugcccaggcuggagugcaauggugcgaucuu

SEQ ID NO: 274371 - RNA, 22 nt, Human
uugcccaggcuggagugcacug

SEQ ID NO: 274372 - RNA, 23 nt, Human
uugcccaggcuggagugcacugg

SEQ ID NO: 274373 - RNA, 32 nt, Human
uugcccaggcuggagugcacuggcgugaucuc

SEQ ID NO: 274374 - RNA, 20 nt, Human
uugcccaggcuggagugcag

SEQ ID NO: 274375 - RNA, 32 nt, Human
uugcccaggcuggagugcagaggugcgaucuc

SEQ ID NO: 274376 - RNA, 24 nt, Human
uugcccaggcuggagugcagcagc

SEQ ID NO: 274377 - RNA, 32 nt, Human
uugcccaggcuggagugcagcgcauggucuca

SEQ ID NO: 274378 - RNA, 32 nt, Human
uugcccaggcuggagugcaggggcacgaucuc

SEQ ID NO: 274379 - RNA, 32 nt, Human
uugcccaggcuggagugcaggggcguaaucuc

SEQ ID NO: 274380 - RNA, 21 nt, Human
uugcccaggcuggagugcagu

SEQ ID NO: 274381 - RNA, 24 nt, Human
uugcccaggcuggagugcaguagc

SEQ ID NO: 274382 - RNA, 32 nt, Human
uugcccaggcuggagugcaguagcacgaucuc

SEQ ID NO: 274383 - RNA, 32 nt, Human
uugcccaggcuggagugcaguagcacuaucac

SEQ ID NO: 274384 - RNA, 32 nt, Human
uugcccaggcuggagugcaguagcuauucaca

SEQ ID NO: 274385 - RNA, 32 nt, Human
uugcccaggcuggagugcaguagugcagucgu

SEQ ID NO: 274386 - RNA, 32 nt, Human
uugcccaggcuggagugcagucgcacaaucuc

SEQ ID NO: 274387 - RNA, 22 nt, Human
uugcccaggcuggagugcagug

SEQ ID NO: 274388 - RNA, 32 nt, Human
uugcccaggcuggagugcagugacgcgauccu

SEQ ID NO: 274389 - RNA, 32 nt, Human
uugcccaggcuggagugcagugacgugaucuc

SEQ ID NO: 274390 - RNA, 32 nt, Human
uugcccaggcuggagugcagugagcuauuaca

SEQ ID NO: 274391 - RNA, 32 nt, Human
uugcccaggcuggagugcagugaugugaucuc

SEQ ID NO: 274392 - RNA, 23 nt, Human
uugcccaggcuggagugcagugg

SEQ ID NO: 274393 - RNA, 32 nt, Human
uugcccaggcuggagugcaguggagcaaucuu

SEQ ID NO: 274394 - RNA, 24 nt, Human
uugcccaggcuggagugcaguggc

SEQ ID NO: 274395 - RNA, 32 nt, Human
uugcccaggcuggagugcaguggcacaaucuc

SEQ ID NO: 274396 - RNA, 32 nt, Human
uugcccaggcuggagugcaguggcgcaauccc

SEQ ID NO: 274397 - RNA, 32 nt, Human
uugcccaggcuggagugcaguggcgcaaucuc

SEQ ID NO: 274398 - RNA, 32 nt, Human
uugcccaggcuggagugcaguggcgcaauuuc

SEQ ID NO: 274399 - RNA, 32 nt, Human
uugcccaggcuggagugcaguggcgccaucuu

SEQ ID NO: 274400 - RNA, 32 nt, Human
uugcccaggcuggagugcaguggcgcgaucuc

SEQ ID NO: 274401 - RNA, 32 nt, Human
uugcccaggcuggagugcaguggcgcgaucuu

SEQ ID NO: 274402 - RNA, 32 nt, Human
uugcccaggcuggagugcaguggcgcggucuc

SEQ ID NO: 274403 - RNA, 32 nt, Human
uugcccaggcuggagugcaguggcgcuaucuc

SEQ ID NO: 274404 - RNA, 32 nt, Human
uugcccaggcuggagugcaguggcgugaucuc

SEQ ID NO: 274405 - RNA, 32 nt, Human
uugcccaggcuggagugcaguggcgugaucuu

SEQ ID NO: 274406 - RNA, 32 nt, Human
uugcccaggcuggagugcaguggcgugauuuc

SEQ ID NO: 274407 - RNA, 32 nt, Human
uugcccaggcuggagugcaguggcucagucuc

SEQ ID NO: 274408 - RNA, 32 nt, Human
uugcccaggcuggagugcagugguacagucuu

SEQ ID NO: 274409 - RNA, 32 nt, Human
uugcccaggcuggagugcagugguaugaucau

SEQ ID NO: 274410 - RNA, 32 nt, Human
uugcccaggcuggagugcagugguaugaucuc

SEQ ID NO: 274411 - RNA, 32 nt, Human
uugcccaggcuggagugcaguggucugaucuc

SEQ ID NO: 274412 - RNA, 32 nt, Human
uugcccaggcuggagugcaguggugagaucug

SEQ ID NO: 274413 - RNA, 32 nt, Human
uugcccaggcuggagugcaguggugcaaucau

SEQ ID NO: 274414 - RNA, 32 nt, Human
uugcccaggcuggagugcaguggugcaaucuc

SEQ ID NO: 274415 - RNA, 32 nt, Human
uugcccaggcuggagugcaguggugcaaucuu

SEQ ID NO: 274416 - RNA, 32 nt, Human
uugcccaggcuggagugcaguggugccaucau

SEQ ID NO: 274417 - RNA, 32 nt, Human
uugcccaggcuggagugcaguggugccaucuu

SEQ ID NO: 274418 - RNA, 32 nt, Human
uugcccaggcuggagugcaguggugcgaccuu

SEQ ID NO: 274419 - RNA, 32 nt, Human
uugcccaggcuggagugcaguggugcgaucau

SEQ ID NO: 274420 - RNA, 32 nt, Human
uugcccaggcuggagugcaguggugcgaucgc

SEQ ID NO: 274421 - RNA, 32 nt, Human
uugcccaggcuggagugcaguggugcgaucuc

SEQ ID NO: 274422 - RNA, 32 nt, Human
uugcccaggcuggagugcaguggugcgaucuu

SEQ ID NO: 274423 - RNA, 32 nt, Human
uugcccaggcuggagugcaguggugggaacuc

SEQ ID NO: 274424 - RNA, 32 nt, Human
uugcccaggcuggagugcagugguguaaacau

SEQ ID NO: 274425 - RNA, 32 nt, Human
uugcccaggcuggagugcagugguguaaucuu

SEQ ID NO: 274426 - RNA, 32 nt, Human
uugcccaggcuggagugcaguggugugaucuc

SEQ ID NO: 274427 - RNA, 32 nt, Human
uugcccaggcuggagugcaguggugugaucuu

SEQ ID NO: 274428 - RNA, 22 nt, Human
uugcccaggcuggagugcauug

SEQ ID NO: 274429 - RNA, 32 nt, Human
uugcccaggcuggagugcauugaugugaucuu

SEQ ID NO: 274430 - RNA, 23 nt, Human
uugcccaggcuggagugcauugg

SEQ ID NO: 274431 - RNA, 32 nt, Human
uugcccaggcuggagugcauuggcgcgaucuc

SEQ ID NO: 274432 - RNA, 32 nt, Human
uugcccaggcuggagugccuuggcgcgaucuc

SEQ ID NO: 274433 - RNA, 21 nt, Human
uugcccaggcuggagugcgau

SEQ ID NO: 274434 - RNA, 32 nt, Human
uugcccaggcuggagugcgauggugcgaucuu

SEQ ID NO: 274435 - RNA, 21 nt, Human
uugcccaggcuggagugcggu

SEQ ID NO: 274436 - RNA, 32 nt, Human
uugcccaggcuggagugcgguggcgugaucau

SEQ ID NO: 274437 - RNA, 32 nt, Human
uugcccaggcuggagugcggugguacaaucuc

SEQ ID NO: 274438 - RNA, 32 nt, Human
uugcccaggcuggagugcgguggugcaaucuc

SEQ ID NO: 274439 - RNA, 32 nt, Human
uugcccaggcuggagugcgguggugcgaucac

SEQ ID NO: 274440 - RNA, 32 nt, Human
uugcccaggcuggagugcguuggcguggucuu

SEQ ID NO: 274441 - RNA, 23 nt, Human
uugcccaggcuggaguggagugg

SEQ ID NO: 274442 - RNA, 32 nt, Human
uugcccaggcuggaguggaguggcgugaucuu

SEQ ID NO: 274443 - RNA, 32 nt, Human
uugcccaggcuggaguguaauggcgccaucuc

SEQ ID NO: 274444 - RNA, 32 nt, Human
uugcccaggcuggaguguaauggugcaaucuc

SEQ ID NO: 274445 - RNA, 23 nt, Human
uugcccaggcuggaguguagugg

SEQ ID NO: 274446 - RNA, 32 nt, Human
uugcccaggcuggaguguaguggcgcaaucuu

SEQ ID NO: 274447 - RNA, 32 nt, Human
uugcccaggcuggaguguaguggcgcgaucuc

SEQ ID NO: 274448 - RNA, 32 nt, Human
uugcccaggcuggaguguagugguaugaucau

SEQ ID NO: 274449 - RNA, 32 nt, Human
uugcccaggcuggaguguaguggugcgaucuc

SEQ ID NO: 274450 - RNA, 32 nt, Human
uugcccaggcuggaguguaguggugugaucac

SEQ ID NO: 274451 - RNA, 32 nt, Human
uugcccaggcuggaguguaguggugugaucuc

SEQ ID NO: 274452 - RNA, 32 nt, Human
uugcccaggcuggaguguagugguguguucuu

SEQ ID NO: 274453 - RNA, 32 nt, Human
uugcccaggcuggagugugaugggcucgaucu

SEQ ID NO: 274454 - RNA, 22 nt, Human
uugcccaggcuggaguguggug

SEQ ID NO: 274455 - RNA, 23 nt, Human
uugcccaggcuggaguguggugg

SEQ ID NO: 274456 - RNA, 32 nt, Human
uugcccaggcuggagugugguggcacaaucac

SEQ ID NO: 274457 - RNA, 32 nt, Human
uugcccaggcuggagugugguggggcaaucuc

SEQ ID NO: 274458 - RNA, 32 nt, Human
uugcccaggcuggaguucagcggugcaauccc

SEQ ID NO: 274459 - RNA, 32 nt, Human
uugcccaggcuggaguucaggggcuauuccca

SEQ ID NO: 274460 - RNA, 32 nt, Human
uugcccaggcuggaguucaguggcgugaucuu

SEQ ID NO: 274461 - RNA, 32 nt, Human
uugcccaggcuggauggagugcaguggcguga

SEQ ID NO: 274462 - RNA, 21 nt, Human
uugcccaggcuggauuacagu

SEQ ID NO: 274463 - RNA, 22 nt, Human
uugcccaggcuggauuacagug

SEQ ID NO: 274464 - RNA, 23 nt, Human
uugcccaggcuggauuacagugg

SEQ ID NO: 274465 - RNA, 24 nt, Human
uugcccaggcuggauuacaguggc

SEQ ID NO: 274466 - RNA, 32 nt, Human
uugcccaggcuggauuacaguggcgcaaucuc

SEQ ID NO: 274467 - RNA, 32 nt, Human
uugcccaggcuggauugcgguggcgcugucuc

SEQ ID NO: 274468 - RNA, 24 nt, Human
uugcccaggcuggcccugaacucc

SEQ ID NO: 274469 - RNA, 24 nt, Human
uugcccaggcuggccucaaacucc

SEQ ID NO: 274470 - RNA, 24 nt, Human
uugcccaggcuggccucaaauucc

SEQ ID NO: 274471 - RNA, 24 nt, Human
uugcccaggcuggccucgaacucu

SEQ ID NO: 274472 - RNA, 23 nt, Human
uugcccaggcuggcgugcagugg

SEQ ID NO: 274473 - RNA, 32 nt, Human
uugcccaggcuggcgugcaguggugcgaucug

SEQ ID NO: 274474 - RNA, 32 nt, Human
uugcccaggcugggguacagugguggaaucuc

SEQ ID NO: 274475 - RNA, 23 nt, Human
uugcccaggcuggggugcagugg

SEQ ID NO: 274476 - RNA, 24 nt, Human
uugcccaggcuggggugcaguggc

SEQ ID NO: 274477 - RNA, 32 nt, Human
uugcccaggcugggugcagcggugcgaucuug

SEQ ID NO: 274478 - RNA, 23 nt, Human
uugcccaggcuggucccgaacuc

SEQ ID NO: 274479 - RNA, 24 nt, Human
uugcccaggcuggucgcgaacucc

SEQ ID NO: 274480 - RNA, 24 nt, Human
uugcccaggcuggucgugaacucc

SEQ ID NO: 274481 - RNA, 32 nt, Human
uugcccaggcuggucuagaacuucuggucuca

SEQ ID NO: 274482 - RNA, 18 nt, Human
uugcccaggcuggucuca

SEQ ID NO: 274483 - RNA, 23 nt, Human
uugcccaggcuggucucaaaccc

SEQ ID NO: 274484 - RNA, 23 nt, Human
uugcccaggcuggucucaaacuc

SEQ ID NO: 274485 - RNA, 24 nt, Human
uugcccaggcuggucucaaacucc

SEQ ID NO: 274486 - RNA, 32 nt, Human
uugcccaggcuggucucaaacuccugagcaca

SEQ ID NO: 274487 - RNA, 32 nt, Human
uugcccaggcuggucucaaacuccugagcuca

SEQ ID NO: 274488 - RNA, 24 nt, Human
uugcccaggcuggucucaaacucu

SEQ ID NO: 274489 - RNA, 24 nt, Human
uugcccaggcuggucucaaacuuc

SEQ ID NO: 274490 - RNA, 32 nt, Human
uugcccaggcuggucucaaacuucuggcuuca

SEQ ID NO: 274491 - RNA, 32 nt, Human
uugcccaggcuggucucaaacuugugagcuca

SEQ ID NO: 274492 - RNA, 32 nt, Human
uugcccaggcuggucucaaauuucugggcuca

SEQ ID NO: 274493 - RNA, 24 nt, Human
uugcccaggcuggucucaaccucc

SEQ ID NO: 274494 - RNA, 32 nt, Human
uugcccaggcuggucucaacuccugagcucag

SEQ ID NO: 274495 - RNA, 24 nt, Human
uugcccaggcuggucucaaucucc

SEQ ID NO: 274496 - RNA, 24 nt, Human
uugcccaggcuggucuccaacucc

SEQ ID NO: 274497 - RNA, 24 nt, Human
uugcccaggcuggucucgaacucc

SEQ ID NO: 274498 - RNA, 32 nt, Human
uugcccaggcuggucucgaacuccugagcuca

SEQ ID NO: 274499 - RNA, 24 nt, Human
uugcccaggcuggucucgaacucu

SEQ ID NO: 274500 - RNA, 32 nt, Human
uugcccaggcuggucucgaacucuggccucaa

SEQ ID NO: 274501 - RNA, 24 nt, Human
uugcccaggcuggucucgaacuuc

SEQ ID NO: 274502 - RNA, 32 nt, Human
uugcccaggcuggucucgaacuucgggcccca

SEQ ID NO: 274503 - RNA, 32 nt, Human
uugcccaggcuggucucgaacuucugagcuca

SEQ ID NO: 274504 - RNA, 32 nt, Human
uugcccaggcuggucucgaacuucugagcucg

SEQ ID NO: 274505 - RNA, 32 nt, Human
uugcccaggcuggucucgaacuucugggcuca

SEQ ID NO: 274506 - RNA, 24 nt, Human
uugcccaggcuggucucgaauucc

SEQ ID NO: 274507 - RNA, 32 nt, Human
uugcccaggcuggucucgaauuccuggauuca

SEQ ID NO: 274508 - RNA, 24 nt, Human
uugcccaggcuggucucggacucc

SEQ ID NO: 274509 - RNA, 32 nt, Human
uugcccaggcuggucugaaacuuuugggcuca

SEQ ID NO: 274510 - RNA, 32 nt, Human
uugcccaggcuggucugaagcugcugggcuca

SEQ ID NO: 274511 - RNA, 24 nt, Human
uugcccaggcuggucuuaaacucc

SEQ ID NO: 274512 - RNA, 32 nt, Human
uugcccaggcuggucuuaagcuucugagcuca

SEQ ID NO: 274513 - RNA, 23 nt, Human
uugcccaggcuggucuugaaccc

SEQ ID NO: 274514 - RNA, 24 nt, Human
uugcccaggcuggucuugaacucc

SEQ ID NO: 274515 - RNA, 32 nt, Human
uugcccaggcuggucuugaacuccggggcuca

SEQ ID NO: 274516 - RNA, 32 nt, Human
uugcccaggcuggucuugaacuccugagcuca

SEQ ID NO: 274517 - RNA, 32 nt, Human
uugcccaggcuggucuugaacucuuggcacuc

SEQ ID NO: 274518 - RNA, 32 nt, Human
uugcccaggcuggucuugaacucuuggccuca

SEQ ID NO: 274519 - RNA, 32 nt, Human
uugcccaggcuggucuugaacucuuggcucca

SEQ ID NO: 274520 - RNA, 32 nt, Human
uugcccaggcuggucuugaacucuugggcuca

SEQ ID NO: 274521 - RNA, 32 nt, Human
uugcccaggcuggucuugaacugggcuuaggc

SEQ ID NO: 274522 - RNA, 32 nt, Human
uugcccaggcuggucuugaacuucugaccuca

SEQ ID NO: 274523 - RNA, 32 nt, Human
uugcccaggcuggucuugaacuucugagcuca

SEQ ID NO: 274524 - RNA, 32 nt, Human
uugcccaggcuggucuugaacuucugggcuca

SEQ ID NO: 274525 - RNA, 32 nt, Human
uugcccaggcuggucuugaauuccugggcuca

SEQ ID NO: 274526 - RNA, 32 nt, Human
uugcccaggcuggucuugacuccugggcucaa

SEQ ID NO: 274527 - RNA, 32 nt, Human
uugcccaggcuggucuugauuccuggacucaa

SEQ ID NO: 274528 - RNA, 24 nt, Human
uugcccaggcuggugucaaacucc

SEQ ID NO: 274529 - RNA, 24 nt, Human
uugcccaggcuggugucgaacucc

SEQ ID NO: 274530 - RNA, 24 nt, Human
uugcccaggcuggugucgaauucc

SEQ ID NO: 274531 - RNA, 23 nt, Human
uugcccaggcuggugugcaaugg

SEQ ID NO: 274532 - RNA, 32 nt, Human
uugcccaggcuggugugcaauggcgugaucuc

SEQ ID NO: 274533 - RNA, 22 nt, Human
uugcccaggcugguugaacucc

SEQ ID NO: 274534 - RNA, 24 nt, Human
uugcccaggcugguuuaaaacucc

SEQ ID NO: 274535 - RNA, 24 nt, Human
uugcccaggcugguuucaaacucc

SEQ ID NO: 274536 - RNA, 24 nt, Human
uugcccaggcugguuucaaccucc

SEQ ID NO: 274537 - RNA, 21 nt, Human
uugcccaggcuguaguacaau

SEQ ID NO: 274538 - RNA, 24 nt, Human
uugcccaggcuguaguacaauggc

SEQ ID NO: 274539 - RNA, 32 nt, Human
uugcccaggcuguagugcaguggugcgaucuc

SEQ ID NO: 274540 - RNA, 23 nt, Human
uugcccaggcugucucaaacucc

SEQ ID NO: 274541 - RNA, 32 nt, Human
uugcccaggcugucucaaacuccuggccucaa

SEQ ID NO: 274542 - RNA, 24 nt, Human
uugcccaggcugucuuugaacucc

SEQ ID NO: 274543 - RNA, 32 nt, Human
uugcccaggcugucuuugaacuccugggauca

SEQ ID NO: 274544 - RNA, 24 nt, Human
uugcccaggcuguuauggaacucc

SEQ ID NO: 274545 - RNA, 24 nt, Human
uugcccaggcuguucucaaacucc

SEQ ID NO: 274546 - RNA, 24 nt, Human
uugcccaggcuguucuucaacucc

SEQ ID NO: 274547 - RNA, 24 nt, Human
uugcccaggcuguucuugaacucc

SEQ ID NO: 274548 - RNA, 21 nt, Human
uugcccaggcuugagugcaau

SEQ ID NO: 274549 - RNA, 22 nt, Human
uugcccaggcuugagugcaaug

SEQ ID NO: 274550 - RNA, 21 nt, Human
uugcccaggcuugagugcagu

SEQ ID NO: 274551 - RNA, 22 nt, Human
uugcccaggcuugagugcagug

SEQ ID NO: 274552 - RNA, 32 nt, Human
uugcccaggcuugagugcagugaugcaaucuu

SEQ ID NO: 274553 - RNA, 24 nt, Human
uugcccaggcuugccuggaacucc

SEQ ID NO: 274554 - RNA, 23 nt, Human
uugcccaggcuuggaguacagug

SEQ ID NO: 274555 - RNA, 24 nt, Human
uugcccaggcuugucucaaacucc

SEQ ID NO: 274556 - RNA, 32 nt, Human
uugcccagggcagagguuuuugaagugagcuu

SEQ ID NO: 274557 - RNA, 32 nt, Human
uugcccagggccuggcaucagaggggccugug

SEQ ID NO: 274558 - RNA, 22 nt, Human
uugcccagggcuggagugcagu

SEQ ID NO: 274559 - RNA, 25 nt, Human
uugcccagggcuggagugcaguggc

SEQ ID NO: 274560 - RNA, 32 nt, Human
uugcccaggguggagugcagcggugcgaucuc

SEQ ID NO: 274561 - RNA, 23 nt, Human
uugcccaggguggagugcagugg

SEQ ID NO: 274562 - RNA, 24 nt, Human
uugcccaggguggagugcaguggc

SEQ ID NO: 274563 - RNA, 24 nt, Human
uugcccaggguggucucaaacucc

SEQ ID NO: 274564 - RNA, 24 nt, Human
uugcccaggguggucucgaacucc

SEQ ID NO: 274565 - RNA, 21 nt, Human
uugcccagguuagagugcagu

SEQ ID NO: 274566 - RNA, 23 nt, Human
uugcccagguuagagugcagugg

SEQ ID NO: 274567 - RNA, 24 nt, Human
uugcccagguuagagugcaguggc

SEQ ID NO: 274568 - RNA, 32 nt, Human
uugcccagguuagagugcaguggcuugaucau

SEQ ID NO: 274569 - RNA, 24 nt, Human
uugcccagguugauauugaacucc

SEQ ID NO: 274570 - RNA, 23 nt, Human
uugcccagguuggagugcagugg

SEQ ID NO: 274571 - RNA, 24 nt, Human
uugcccagguuggagugcaguggc

SEQ ID NO: 274572 - RNA, 24 nt, Human
uugcccagguuggucucaaacucc

SEQ ID NO: 274573 - RNA, 24 nt, Human
uugcccagguuggucucgaacucc

SEQ ID NO: 274574 - RNA, 24 nt, Human
uugcccagguugguuucaaacucc

SEQ ID NO: 274575 - RNA, 32 nt, Human
uugcccaguauuggaccagcaguccucaugaa

SEQ ID NO: 274576 - RNA, 32 nt, Human
uugcccagucuggagugcaguggcgcagucuc

SEQ ID NO: 274577 - RNA, 24 nt, Human
uugcccagucuggaguucaguggc

SEQ ID NO: 274578 - RNA, 32 nt, Human
uugcccagucuggaguucaguggcgcgaucuc

SEQ ID NO: 274579 - RNA, 32 nt, Human
uugcccagugccuucuguuucccaggcagcuc

SEQ ID NO: 274580 - RNA, 32 nt, Human
uugcccagugugugcuuaucauccccugcaag

SEQ ID NO: 274581 - RNA, 32 nt, Human
uugcccauccagccaaggaugccagucuugcu

SEQ ID NO: 274582 - RNA, 32 nt, Human
uugcccaucuguagguagacacacagaucgcu

SEQ ID NO: 274583 - RNA, 21 nt, Human
uugcccaugcuggagugcaau

SEQ ID NO: 274584 - RNA, 24 nt, Human
uugcccaugcuggagugcaauggc

SEQ ID NO: 274585 - RNA, 32 nt, Human
uugcccaugcuggagugcaauggcacgaucuc

SEQ ID NO: 274586 - RNA, 32 nt, Human
uugcccaugcuggagugcaguggcgugaucau

SEQ ID NO: 274587 - RNA, 32 nt, Human
uugcccaugcuggagugcauuggcacaaucuc

SEQ ID NO: 274588 - RNA, 24 nt, Human
uugcccaugcuggucucgaacucc

SEQ ID NO: 274589 - RNA, 32 nt, Human
uugcccauuaacaaauggcuuuuaucuuuagc

SEQ ID NO: 274590 - RNA, 32 nt, Human
uugcccauucuggagugcaguggugugaucuc

SEQ ID NO: 274591 - RNA, 32 nt, Human
uugcccauucuuucuuacuucugacaacuggc

SEQ ID NO: 274592 - RNA, 22 nt, Human
uugcccauuuuaaauccuuuca

SEQ ID NO: 274593 - RNA, 32 nt, Human
uugcccauuuuucuucauuuauuugaauguau

SEQ ID NO: 274594 - RNA, 19 nt, Human
uugccccaccccugccuug

SEQ ID NO: 274595 - RNA, 32 nt, Human
uugccccacccuaccugccuuuuauaguaugc

SEQ ID NO: 274596 - RNA, 32 nt, Human
uugccccacggccauauccacccauugacucu

SEQ ID NO: 274597 - RNA, 32 nt, Human
uugccccacugcacuccacccugggcaaugga

SEQ ID NO: 274598 - RNA, 32 nt, Human
uugccccacugcacuccagccuaggcaacaga

SEQ ID NO: 274599 - RNA, 32 nt, Human
uugccccacugcaggcugccugggacgccuuc

SEQ ID NO: 274600 - RNA, 32 nt, Human
uugccccacuggcugcuccagggccuccaccc

SEQ ID NO: 274601 - RNA, 32 nt, Human
uugccccagcagagcagggguuuuggaaggag

SEQ ID NO: 274602 - RNA, 32 nt, Human
uugccccagccaacaggacguucuugcacaac

SEQ ID NO: 274603 - RNA, 32 nt, Human
uugccccagccacuuugccccaaccacuuuga

SEQ ID NO: 274604 - RNA, 23 nt, Human
uugccccagccauccaguauugu

SEQ ID NO: 274605 - RNA, 21 nt, Human
uugccccagccugcuucuugc

SEQ ID NO: 274606 - RNA, 32 nt, Human
uugccccagcuggucucaaaccccugggcuca

SEQ ID NO: 274607 - RNA, 32 nt, Human
uugccccagcuucacucucucccucagcaccu

SEQ ID NO: 274608 - RNA, 24 nt, Human
uugccccaggacagaugucuugca

SEQ ID NO: 274609 - RNA, 22 nt, Human
uugccccaggcuggagugcagu

SEQ ID NO: 274610 - RNA, 20 nt, Human
uugccccagggcugcuuugc

SEQ ID NO: 274611 - RNA, 25 nt, Human
uugccccaguucuuaucuguuuugc

SEQ ID NO: 274612 - RNA, 32 nt, Human
uugccccaucccucccacacacaggaccagac

SEQ ID NO: 274613 - RNA, 32 nt, Human
uugccccaugggaaacguaugugugcaggagc

SEQ ID NO: 274614 - RNA, 32 nt, Human
uugccccauucagguuggggagugaagugugg

SEQ ID NO: 274615 - RNA, 24 nt, Human
uugcccccacucuuuuugucuugc

SEQ ID NO: 274616 - RNA, 32 nt, Human
uugcccccaucaccugccgcccccaucaaaca

SEQ ID NO: 274617 - RNA, 32 nt, Human
uugcccccauguagcccauuucccagguuaug

SEQ ID NO: 274618 - RNA, 32 nt, Human
uugcccccauguucugcuuuccuccacugugc

SEQ ID NO: 274619 - RNA, 24 nt, Human
uugccccccagagcccugggcugg

SEQ ID NO: 274620 - RNA, 32 nt, Human
uugcccccgcuacacuccagccuggucgacag

SEQ ID NO: 274621 - RNA, 32 nt, Human
uugcccccuccacccacccccacgaccccacu

SEQ ID NO: 274622 - RNA, 32 nt, Human
uugcccccucccccuccuucuguccccucccu

SEQ ID NO: 274623 - RNA, 32 nt, Human
uugcccccucuucuuauacccuaaaaccuucu

SEQ ID NO: 274624 - RNA, 32 nt, Human
uugcccccugcucucuccugucgugccccacc

SEQ ID NO: 274625 - RNA, 32 nt, Human
uugcccccugggccaggcagagcaggcgcugc

SEQ ID NO: 274626 - RNA, 32 nt, Human
uugcccccuuguucuguaucccccuuugcccu

SEQ ID NO: 274627 - RNA, 32 nt, Human
uugcccccuuugaccuuccccaaaggaugguc

SEQ ID NO: 274628 - RNA, 22 nt, Human
uugccccggccaggccugcgag

SEQ ID NO: 274629 - RNA, 23 nt, Human
uugccccggccccuuuucuuccu

SEQ ID NO: 274630 - RNA, 32 nt, Human
uugccccggcuggagugcaguggcgcuaucuu

SEQ ID NO: 274631 - RNA, 32 nt, Human
uugccccguaggaagcuggagugcgggccucg

SEQ ID NO: 274632 - RNA, 32 nt, Human
uugccccguccacccugugcugcuucccuuca

SEQ ID NO: 274633 - RNA, 32 nt, Human
uugccccgucucaaccccaucugacuacccca

SEQ ID NO: 274634 - RNA, 21 nt, Human
uugccccuaccucuucugggc

SEQ ID NO: 274635 - RNA, 32 nt, Human
uugccccuaucuugugcucuucugucugcagu

SEQ ID NO: 274636 - RNA, 32 nt, Human
uugccccucacugggcaggccauggccuacag

SEQ ID NO: 274637 - RNA, 21 nt, Human
uugccccucccccauuucccu

SEQ ID NO: 274638 - RNA, 32 nt, Human
uugccccucccuucuggaccccagagugcccu

SEQ ID NO: 274639 - RNA, 32 nt, Human
uugccccucugccuugcccuccugggcccugg

SEQ ID NO: 274640 - RNA, 18 nt, Human
uugccccugcccugggcu

SEQ ID NO: 274641 - RNA, 32 nt, Human
uugccccugcuuguccuggaccacuuuuaaag

SEQ ID NO: 274642 - RNA, 32 nt, Human
uugccccuggaggugggggcugcuggcugagg

SEQ ID NO: 274643 - RNA, 32 nt, Human
uugcccgaagcggaacugcugaaggagcggca

SEQ ID NO: 274644 - RNA, 32 nt, Human
uugcccgagagggacgaggaggccgugcgggu

SEQ ID NO: 274645 - RNA, 32 nt, Human
uugcccgaguagcugggacuacaggcaugugc

SEQ ID NO: 274646 - RNA, 32 nt, Human
uugcccgcccagcugcuccaugccaggaggag

SEQ ID NO: 274647 - RNA, 32 nt, Human
uugcccgcccuccacccacuaggugaacagca

SEQ ID NO: 274648 - RNA, 32 nt, Human
uugcccgcgggugugugaagggagacagucag

SEQ ID NO: 274649 - RNA, 32 nt, Human
uugcccgcuagacucacuggcccugagcacuu

SEQ ID NO: 274650 - RNA, 32 nt, Human
uugcccggcgaggucgccgcugccucagcugc

SEQ ID NO: 274651 - RNA, 24 nt, Human
uugcccgggcuagucucgaacucc

SEQ ID NO: 274652 - RNA, 21 nt, Human
uugcccgggcuggaaugcaau

SEQ ID NO: 274653 - RNA, 32 nt, Human
uugcccgggcuggaaugcaauggcgcgauuca

SEQ ID NO: 274654 - RNA, 21 nt, Human
uugcccgggcuggagugcaau

SEQ ID NO: 274655 - RNA, 32 nt, Human
uugcccgggcuggagugcaauggcgcgaaguc

SEQ ID NO: 274656 - RNA, 32 nt, Human
uugcccgggcuggagugcaauggugagaucuc

SEQ ID NO: 274657 - RNA, 32 nt, Human
uugcccgggcuggagugcaguggugugaucuc

SEQ ID NO: 274658 - RNA, 22 nt, Human
uugcccuacucaucccuuugca

SEQ ID NO: 274659 - RNA, 32 nt, Human
uugcccuagagccauggcugggaaaaggugga

SEQ ID NO: 274660 - RNA, 32 nt, Human
uugcccucaaguuugcuaagcugcugguuuau

SEQ ID NO: 274661 - RNA, 20 nt, Human
uugcccucaccccaaugcuc

SEQ ID NO: 274662 - RNA, 32 nt, Human
uugcccucacugcccacucugcccacacuucc

SEQ ID NO: 274663 - RNA, 32 nt, Human
uugcccucagcccuuucuccugggaucuccau

SEQ ID NO: 274664 - RNA, 32 nt, Human
uugcccucagcuuugcagaaugaagccuugag

SEQ ID NO: 274665 - RNA, 18 nt, Human
uugcccucaggcagccaa

SEQ ID NO: 274666 - RNA, 32 nt, Human
uugcccuccagccugggugacagagugagacc

SEQ ID NO: 274667 - RNA, 19 nt, Human
uugcccuccagggugccaa

SEQ ID NO: 274668 - RNA, 32 nt, Human
uugcccucccaaagugcugggauuacaggcgu

SEQ ID NO: 274669 - RNA, 32 nt, Human
uugcccucccaaaguguugggauuauaggcau

SEQ ID NO: 274670 - RNA, 32 nt, Human
uugcccucccccagugggagaggggguugggu

SEQ ID NO: 274671 - RNA, 32 nt, Human
uugcccuccccuucuccuccauggcuucccag

SEQ ID NO: 274672 - RNA, 32 nt, Human
uugcccucccucuccuggccuuacaagcacuu

SEQ ID NO: 274673 - RNA, 32 nt, Human
uugcccuccuggcugccaacucuggcugcuaa

SEQ ID NO: 274674 - RNA, 32 nt, Human
uugcccucucuccagcucugcucccacauuuu

SEQ ID NO: 274675 - RNA, 32 nt, Human
uugcccucuucugcucuuuuccuggugcucuu

SEQ ID NO: 274676 - RNA, 32 nt, Human
uugcccugaauguacccugccucugcuuucuc

SEQ ID NO: 274677 - RNA, 32 nt, Human
uugcccugacuggaguucaguggugcaaacac

SEQ ID NO: 274678 - RNA, 32 nt, Human
uugcccugagccacauaugucugugccauggg

SEQ ID NO: 274679 - RNA, 32 nt, Human
uugcccugauccaaauguuagcacuugcuagu

SEQ ID NO: 274680 - RNA, 32 nt, Human
uugcccugcaggcuggagugcagcggcaugau

SEQ ID NO: 274681 - RNA, 32 nt, Human
uugcccugcagggaccaagaccacacucgggc

SEQ ID NO: 274682 - RNA, 32 nt, Human
uugcccugccaucgccuccaucagccagacga

SEQ ID NO: 274683 - RNA, 32 nt, Human
uugcccugccucccaaaccccauuagucuagc

SEQ ID NO: 274684 - RNA, 19 nt, Human
uugcccugcgucgccuugc

SEQ ID NO: 274685 - RNA, 32 nt, Human
uugcccugcucucuccuguugcucugggauug

SEQ ID NO: 274686 - RNA, 32 nt, Human
uugcccuggagacgcuuucccugcugccggcc

SEQ ID NO: 274687 - RNA, 31 nt, Human
uugcccuggcucucugguccuuguugcucua

SEQ ID NO: 274688 - RNA, 32 nt, Human
uugcccuguacaaaacuaagaaaccucuuugg

SEQ ID NO: 274689 - RNA, 32 nt, Human
uugcccugucccaaucccagaaacccaggacc

SEQ ID NO: 274690 - RNA, 32 nt, Human
uugcccugucgccuggcuggaguggaguggca

SEQ ID NO: 274691 - RNA, 32 nt, Human
uugcccuguggcugggcuggagugcaauggcg

SEQ ID NO: 274692 - RNA, 32 nt, Human
uugcccuguugccaggcuggaaugcaguggcg

SEQ ID NO: 274693 - RNA, 32 nt, Human
uugcccuuaaaccauuucuagcuguuaacccu

SEQ ID NO: 274694 - RNA, 32 nt, Human
uugcccuucagcucauaaaagcagaaggugug

SEQ ID NO: 274695 - RNA, 32 nt, Human
uugcccuuccauggaaacucaggcugaucucg

SEQ ID NO: 274696 - RNA, 32 nt, Human
uugcccuucccaaaucccuccaggccagaacu

SEQ ID NO: 274697 - RNA, 32 nt, Human
  misc_feature (28)..(28): n is a, c, g or u
uugcccuucccaaggguauuugcauuunuauu

SEQ ID NO: 274698 - RNA, 32 nt, Human
uugcccuucccaggaaccacggcugccuuuuu

SEQ ID NO: 274699 - RNA, 32 nt, Human
uugcccuuccuaccccuuccucccuucaguca

SEQ ID NO: 274700 - RNA, 32 nt, Human
uugcccuuccucacagcccuuuggccauuggg

SEQ ID NO: 274701 - RNA, 32 nt, Human
uugcccuucucccucccgcuccugggcggagg

SEQ ID NO: 274702 - RNA, 32 nt, Human
uugcccuugguggaaucuuuaggguuuucuau

SEQ ID NO: 274703 - RNA, 32 nt, Human
uugcccuuguugcccaggcuggagugcaaugg

SEQ ID NO: 274704 - RNA, 32 nt, Human
uugcccuuuagucccaggacuaaccggaagcu

SEQ ID NO: 274705 - RNA, 22 nt, Human
uugcccuuucuucugcuuugua

SEQ ID NO: 274706 - RNA, 32 nt, Human
uugcccuuucuuugggggaaacagcuguuuaa

SEQ ID NO: 274707 - RNA, 32 nt, Human
uugcccuuuucuuauuuucugccuguaacuuc

SEQ ID NO: 274708 - RNA, 20 nt, Human
uugccgagagcccugagcca

SEQ ID NO: 274709 - RNA, 32 nt, Human
uugccgaggcaaccuccaagucccagaucaug

SEQ ID NO: 274710 - RNA, 19 nt, Human
uugccgaggcuggagugca

SEQ ID NO: 274711 - RNA, 21 nt, Human
uugccgaggcuggagugcaau

SEQ ID NO: 274712 - RNA, 22 nt, Human
uugccgaggcuggagugcaaug

SEQ ID NO: 274713 - RNA, 32 nt, Human
uugccgaggcuggagugcaauggcgcaaccuu

SEQ ID NO: 274714 - RNA, 32 nt, Human
uugccgaggcuggaguguaguagugugauccu

SEQ ID NO: 274715 - RNA, 18 nt, Human
uugccgagggugcagugg

SEQ ID NO: 274716 - RNA, 32 nt, Human
uugccgaucugccauguauuccagaaaggcca

SEQ ID NO: 274717 - RNA, 20 nt, Human
uugccgcagccgcccgggcc

SEQ ID NO: 274718 - RNA, 21 nt, Human
uugccgcagccuguccgaguc

SEQ ID NO: 274719 - RNA, 18 nt, Human
uugccgcccgccccggcc

SEQ ID NO: 274720 - RNA, 19 nt, Human
uugccgcccgccccgggcu

SEQ ID NO: 274721 - RNA, 18 nt, Human
uugccgcccuccgagcca

SEQ ID NO: 274722 - RNA, 32 nt, Human
uugccgccgucccggcucaccuggcggugccc

SEQ ID NO: 274723 - RNA, 21 nt, Human
uugccgcgcgagucccgggcc

SEQ ID NO: 274724 - RNA, 19 nt, Human
uugccgcucaccugagcua

SEQ ID NO: 274725 - RNA, 19 nt, Human
uugccgcuccccucgcguc

SEQ ID NO: 274726 - RNA, 19 nt, Human
uugccgcucguuuuuguca

SEQ ID NO: 274727 - RNA, 20 nt, Human
uugccgcucugugagggcca

SEQ ID NO: 274728 - RNA, 17 nt, Human
uugccgcugccacgggc

SEQ ID NO: 274729 - RNA, 21 nt, Human
uugccgcugcccagcagagcu

SEQ ID NO: 274730 - RNA, 32 nt, Human
uugccgcugggagcccaggcuccgucugccgc

SEQ ID NO: 274731 - RNA, 31 nt, Human
uugccggacgcucuguggccuguguggacag

SEQ ID NO: 274732 - RNA, 21 nt, Human
uugccggccuuccucgggcca

SEQ ID NO: 274733 - RNA, 20 nt, Human
uugccggcgcggcccgagcc

SEQ ID NO: 274734 - RNA, 16 nt, Human
uugccggcggcuccug

SEQ ID NO: 274735 - RNA, 17 nt, Human
uugccggcucccgggcc

SEQ ID NO: 274736 - RNA, 32 nt, Human
uugccggcucuggccuuccugugacugacugu

SEQ ID NO: 274737 - RNA, 32 nt, Human
uugccggcugcugggagccaggagagcccuga

SEQ ID NO: 274738 - RNA, 32 nt, Human
uugccggugccuaggauugugccuguaugcaa

SEQ ID NO: 274739 - RNA, 20 nt, Human
uugccguccaccccgggcca

SEQ ID NO: 274740 - RNA, 32 nt, Human
uugccguccaggcuggagugcaauggcgugau

SEQ ID NO: 274741 - RNA, 32 nt, Human
uugccguccaguggggaguggagggcagaggc

SEQ ID NO: 274742 - RNA, 32 nt, Human
uugccgucguaucagaaccacccggcccuucu

SEQ ID NO: 274743 - RNA, 32 nt, Human
uugccgucugcgcuccagccuucgccuggcag

SEQ ID NO: 274744 - RNA, 32 nt, Human
uugccgugaagcccaccaugaugagcuccgag

SEQ ID NO: 274745 - RNA, 32 nt, Human
uugccgugacucacacaccucuacuucuguuc

SEQ ID NO: 274746 - RNA, 18 nt, Human
uugccgugccccggacua

SEQ ID NO: 274747 - RNA, 32 nt, Human
uugccguggacuucagcacccagacaagccaa

SEQ ID NO: 274748 - RNA, 20 nt, Human
uugccguggggccucgagcc

SEQ ID NO: 274749 - RNA, 32 nt, Human
uugccguuacacuucccagccugguggucagu

SEQ ID NO: 274750 - RNA, 32 nt, Human
uugccuaagaauuaugacccaaaacuuacccc

SEQ ID NO: 274751 - RNA, 32 nt, Human
uugccuaaucaaacagaggcuuuuggccuuug

SEQ ID NO: 274752 - RNA, 32 nt, Human
uugccuaauuuguuuucccuucuuacaaugca

SEQ ID NO: 274753 - RNA, 32 nt, Human
uugccuacaggagcccccaccuucccugccca

SEQ ID NO: 274754 - RNA, 32 nt, Human
uugccuacaggugagggaagacccccuucacc

SEQ ID NO: 274755 - RNA, 18 nt, Human
uugccuacccucucccca

SEQ ID NO: 274756 - RNA, 32 nt, Human
uugccuacuauccugaauuugccuacuaucua

SEQ ID NO: 274757 - RNA, 32 nt, Human
uugccuacucuuugccccagcaauuccucgua

SEQ ID NO: 274758 - RNA, 32 nt, Human
uugccuagacaacaugagaaaucguggccagg

SEQ ID NO: 274759 - RNA, 32 nt, Human
uugccuagaccauucuccccuccagggagccc

SEQ ID NO: 274760 - RNA, 32 nt, Human
uugccuaggacuucucagcuucucccauaggu

SEQ ID NO: 274761 - RNA, 21 nt, Human
uugccuaggccagagugcagu

SEQ ID NO: 274762 - RNA, 23 nt, Human
uugccuaggcggaguacaguggc

SEQ ID NO: 274763 - RNA, 32 nt, Human
uugccuaggcuagggugcaguggcacaaucuc

SEQ ID NO: 274764 - RNA, 21 nt, Human
uugccuaggcuggaaugcagu

SEQ ID NO: 274765 - RNA, 22 nt, Human
uugccuaggcuggaaugcagug

SEQ ID NO: 274766 - RNA, 23 nt, Human
uugccuaggcuggaaugcagugg

SEQ ID NO: 274767 - RNA, 32 nt, Human
uugccuaggcuggaggacaguggcacaaucau

SEQ ID NO: 274768 - RNA, 21 nt, Human
uugccuaggcuggaguacagu

SEQ ID NO: 274769 - RNA, 24 nt, Human
uugccuaggcuggaguacaguggc

SEQ ID NO: 274770 - RNA, 32 nt, Human
uugccuaggcuggaguacaguggugcagucuc

SEQ ID NO: 274771 - RNA, 32 nt, Human
uugccuaggcuggagugaaaguggcgcaaccu

SEQ ID NO: 274772 - RNA, 19 nt, Human
uugccuaggcuggagugca

SEQ ID NO: 274773 - RNA, 21 nt, Human
uugccuaggcuggagugcaau

SEQ ID NO: 274774 - RNA, 32 nt, Human
uugccuaggcuggagugcaauggugcgaucuu

SEQ ID NO: 274775 - RNA, 21 nt, Human
uugccuaggcuggagugcagu

SEQ ID NO: 274776 - RNA, 22 nt, Human
uugccuaggcuggagugcagug

SEQ ID NO: 274777 - RNA, 32 nt, Human
uugccuaggcuggagugcagugaggcaaucug

SEQ ID NO: 274778 - RNA, 32 nt, Human
uugccuaggcuggagugcaguggcgcaaucuc

SEQ ID NO: 274779 - RNA, 32 nt, Human
uugccuaggcuggagugcaguggcgcagucuu

SEQ ID NO: 274780 - RNA, 32 nt, Human
uugccuaggcuggagugcaguggcgcgaucuu

SEQ ID NO: 274781 - RNA, 32 nt, Human
uugccuaggcuggagugcagugguacaaucuc

SEQ ID NO: 274782 - RNA, 32 nt, Human
uugccuaggcuggucucgaacuccugagcuca

SEQ ID NO: 274783 - RNA, 32 nt, Human
uugccuaggcuggucuugaaauucugggcuaa

SEQ ID NO: 274784 - RNA, 32 nt, Human
uugccuagggcugcuuuauugcucaccuacuu

SEQ ID NO: 274785 - RNA, 32 nt, Human
uugccuagggggcagagggugcaguggcagug

SEQ ID NO: 274786 - RNA, 20 nt, Human
uugccuagguuggaguacag

SEQ ID NO: 274787 - RNA, 32 nt, Human
uugccuaguacuuuaccagcagaccacaguuu

SEQ ID NO: 274788 - RNA, 32 nt, Human
uugccuagucuggucugaaacuucugggcgca

SEQ ID NO: 274789 - RNA, 32 nt, Human
uugccuauccccuccccucugcuugagccuug

SEQ ID NO: 274790 - RNA, 32 nt, Human
uugccuaucgccaagcaaaucgaggccaucaa

SEQ ID NO: 274791 - RNA, 32 nt, Human
uugccuaugaaauguaaaaugugaacucccug

SEQ ID NO: 274792 - RNA, 32 nt, Human
uugccuauuaaaccucugcuccuggccaggca

SEQ ID NO: 274793 - RNA, 32 nt, Human
uugccucacaugguucaacaccaccuuauacu

SEQ ID NO: 274794 - RNA, 32 nt, Human
uugccucacugcaacgccugccucucaggcuc

SEQ ID NO: 274795 - RNA, 32 nt, Human
uugccucaggagaauuguugggugcauggaug

SEQ ID NO: 274796 - RNA, 32 nt, Human
uugccucaugccagcaccuuugaaccggucuc

SEQ ID NO: 274797 - RNA, 32 nt, Human
uugccucauguuuguuagccagcacuucugcu

SEQ ID NO: 274798 - RNA, 23 nt, Human
uugccucauucacuuguacugua

SEQ ID NO: 274799 - RNA, 32 nt, Human
uugccucauuucccuaucuucucccccacggu

SEQ ID NO: 274800 - RNA, 32 nt, Human
uugccuccagaacuuggagagcagggaagugg

SEQ ID NO: 274801 - RNA, 32 nt, Human
uugccucccacacccagccacuaccucccagc

SEQ ID NO: 274802 - RNA, 32 nt, Human
uugccucccucagauagaaaacagcccccacu

SEQ ID NO: 274803 - RNA, 32 nt, Human
uugccucccuccagcucugcuuaggcauuuug

SEQ ID NO: 274804 - RNA, 32 nt, Human
uugccucccuggcugugucuuucuugagggag

SEQ ID NO: 274805 - RNA, 32 nt, Human
uugccuccucaaguagcuucaucacagagugu

SEQ ID NO: 274806 - RNA, 21 nt, Human
uugccuccucacccaccucuu

SEQ ID NO: 274807 - RNA, 32 nt, Human
uugccuccuccacgcucccuacacaccugaga

SEQ ID NO: 274808 - RNA, 32 nt, Human
uugccuccucuccuguccuggcaguagcuucu

SEQ ID NO: 274809 - RNA, 32 nt, Human
uugccuccugguguguuuuaaaggauccucca

SEQ ID NO: 274810 - RNA, 32 nt, Human
uugccuccuugaggaggguggcauucuguguc

SEQ ID NO: 274811 - RNA, 32 nt, Human
uugccucgagccgagcccugcccccgcgagcc

SEQ ID NO: 274812 - RNA, 32 nt, Human
uugccucgaucuguagcaagcaaucuguuguu

SEQ ID NO: 274813 - RNA, 32 nt, Human
uugccucgccaccgcgugcuccugggcgcgcc

SEQ ID NO: 274814 - RNA, 26 nt, Human
uugccucggccuucuuugcuuuuugu

SEQ ID NO: 274815 - RNA, 15 nt, Human
uugccucggcuccug

SEQ ID NO: 274816 - RNA, 32 nt, Human
uugccucuaucagggcuggaguggugcagccc

SEQ ID NO: 274817 - RNA, 32 nt, Human
uugccucucaacugcauuaaccagucacaggc

SEQ ID NO: 274818 - RNA, 23 nt, Human
uugccucucaauucauuccuccu

SEQ ID NO: 274819 - RNA, 32 nt, Human
uugccucucaggaugacaaacaacagcggcuc

SEQ ID NO: 274820 - RNA, 32 nt, Human
uugccucuccaaccucuucauccugcccccgc

SEQ ID NO: 274821 - RNA, 32 nt, Human
uugccucuccaccucccaaucauguaauuugc

SEQ ID NO: 274822 - RNA, 32 nt, Human
uugccucuccccugcucacuccagucacauag

SEQ ID NO: 274823 - RNA, 32 nt, Human
uugccucucucucugaauuaucuugcuuauuu

SEQ ID NO: 274824 - RNA, 32 nt, Human
uugccucucuggacgcucugcaccaaccccag

SEQ ID NO: 274825 - RNA, 32 nt, Human
uugccucucugggucucuaucuccuccucuua

SEQ ID NO: 274826 - RNA, 32 nt, Human
uugccucucuguguuuaaagagcaccaggacc

SEQ ID NO: 274827 - RNA, 32 nt, Human
uugccucugagcgggagagucuguguguaugu

SEQ ID NO: 274828 - RNA, 32 nt, Human
uugccucugcaacuugacucuccucuaggaag

SEQ ID NO: 274829 - RNA, 32 nt, Human
uugccucugcccaaccagguugcaguagcagu

SEQ ID NO: 274830 - RNA, 32 nt, Human
uugccucugggauaaagucuuaucucaguuua

SEQ ID NO: 274831 - RNA, 32 nt, Human
uugccucuggguguguguaggggugagagugg

SEQ ID NO: 274832 - RNA, 32 nt, Human
uugccucugugagcuuucuaggccuggguagg

SEQ ID NO: 274833 - RNA, 32 nt, Human
uugccucuucugcuuuaaucucauccugacag

SEQ ID NO: 274834 - RNA, 32 nt, Human
uugccucuucuuuuccacugcuuggcucuuaa

SEQ ID NO: 274835 - RNA, 32 nt, Human
uugccucuuggcagcccuugaacuugaguaaa

SEQ ID NO: 274836 - RNA, 32 nt, Human
uugccucuuuguccuggccucuaguuuucuuu

SEQ ID NO: 274837 - RNA, 32 nt, Human
uugccugaacauccuuccuucccacccaucgc

SEQ ID NO: 274838 - RNA, 32 nt, Human
uugccugaacccaggaagaggagguugcagug

SEQ ID NO: 274839 - RNA, 32 nt, Human
uugccugaacccaggaggcagagguugcagua

SEQ ID NO: 274840 - RNA, 32 nt, Human
uugccugaacccaggaggcggagguugcagug

SEQ ID NO: 274841 - RNA, 32 nt, Human
uugccugaacccaggagguggagguugcagug

SEQ ID NO: 274842 - RNA, 32 nt, Human
uugccugaaccccagagguggagguugcagug

SEQ ID NO: 274843 - RNA, 32 nt, Human
uugccugaaccuaggagguggaggcugcagcg

SEQ ID NO: 274844 - RNA, 32 nt, Human
uugccugaacuccagaggugucgggacauggu

SEQ ID NO: 274845 - RNA, 32 nt, Human
uugccugaaucuuuuccuuuaacuggugguac

SEQ ID NO: 274846 - RNA, 32 nt, Human
uugccugacagaauugcuuagaaaggagcaga

SEQ ID NO: 274847 - RNA, 32 nt, Human
uugccugagaccaggagguugaggcugcagug

SEQ ID NO: 274848 - RNA, 32 nt, Human
uugccugagagagaauuggcccuacucgaggc

SEQ ID NO: 274849 - RNA, 32 nt, Human
uugccugagcccagaaguuugagacugcagug

SEQ ID NO: 274850 - RNA, 32 nt, Human
uugccugagcccaggagguggaaacugcagag

SEQ ID NO: 274851 - RNA, 32 nt, Human
uugccugagcccaggaguucaagaccagcuug

SEQ ID NO: 274852 - RNA, 32 nt, Human
uugccugagcucaagagguugaggcugcagug

SEQ ID NO: 274853 - RNA, 32 nt, Human
uugccugagggcacacaguggggaagacacag

SEQ ID NO: 274854 - RNA, 32 nt, Human
uugccugaggggaaagagagaugggccaggca

SEQ ID NO: 274855 - RNA, 32 nt, Human
uugccugcaugucuaaaagaaaauaugggccu

SEQ ID NO: 274856 - RNA, 32 nt, Human
uugccugccagagcuuggaagggaggacucuu

SEQ ID NO: 274857 - RNA, 32 nt, Human
uugccugccagcugcucccgagguggccuuga

SEQ ID NO: 274858 - RNA, 32 nt, Human
uugccugcccacugcccaggccugcaccaugu

SEQ ID NO: 274859 - RNA, 32 nt, Human
uugccugccccgaggggcgucugguaggcacc

SEQ ID NO: 274860 - RNA, 32 nt, Human
uugccugcccgcugcccccgccuccuccgccu

SEQ ID NO: 274861 - RNA, 32 nt, Human
uugccugcccugucuccugggaucagagggua

SEQ ID NO: 274862 - RNA, 32 nt, Human
uugccugccuacugcccaggccugcaccaugu

SEQ ID NO: 274863 - RNA, 32 nt, Human
uugccugccuguauuaauuuuaguuuugaguc

SEQ ID NO: 274864 - RNA, 32 nt, Human
uugccugccuucaucccucauuuccucccucu

SEQ ID NO: 274865 - RNA, 20 nt, Human
uugccugcgcgcucugagcc

SEQ ID NO: 274866 - RNA, 32 nt, Human
uugccugcguagugaggaaacagcugauccug

SEQ ID NO: 274867 - RNA, 32 nt, Human
uugccugcucucucugugccuagccucaaagc

SEQ ID NO: 274868 - RNA, 18 nt, Human
uugccugcugcccugagc

SEQ ID NO: 274869 - RNA, 32 nt, Human
uugccugcugucagaggagcagcuaucugauu

SEQ ID NO: 274870 - RNA, 32 nt, Human
uugccugcuguugcuggaagagcuggcucaua

SEQ ID NO: 274871 - RNA, 32 nt, Human
uugccuggauauccccagcagaggcuacagaa

SEQ ID NO: 274872 - RNA, 32 nt, Human
uugccuggauuuggaggcagaguugucaggcu

SEQ ID NO: 274873 - RNA, 32 nt, Human
uugccuggcagaggaggagcaaacagccaugu

SEQ ID NO: 274874 - RNA, 32 nt, Human
uugccuggcccuguccuggacccagcuuugcu

SEQ ID NO: 274875 - RNA, 32 nt, Human
uugccuggccucccccugcauuccugucuggg

SEQ ID NO: 274876 - RNA, 32 nt, Human
uugccuggcuaaaagagucucucucuaaguau

SEQ ID NO: 274877 - RNA, 32 nt, Human
uugccugggaccuggaaaguguuuagauucuu

SEQ ID NO: 274878 - RNA, 32 nt, Human
uugccugggcuggaaugcaguggugcgaucuc

SEQ ID NO: 274879 - RNA, 21 nt, Human
uugccugggcuggagugcagu

SEQ ID NO: 274880 - RNA, 32 nt, Human
uugccugggcuggagugcaguggcccaagcua

SEQ ID NO: 274881 - RNA, 32 nt, Human
uugccugguccacccuugcccucccugggucg

SEQ ID NO: 274882 - RNA, 32 nt, Human
uugccuggugaggcuggagggagcaccaggac

SEQ ID NO: 274883 - RNA, 32 nt, Human
uugccugguucaucuuguagucuuccaaaaca

SEQ ID NO: 274884 - RNA, 32 nt, Human
uugccuguauagucaaacacauaggcaaauag

SEQ ID NO: 274885 - RNA, 32 nt, Human
uugccugucaucuggauagugucuaaaaauuu

SEQ ID NO: 274886 - RNA, 32 nt, Human
uugccuguccccaggagcugggaugccagguc

SEQ ID NO: 274887 - RNA, 32 nt, Human
uugccugugauugcccagcccagauucaucug

SEQ ID NO: 274888 - RNA, 32 nt, Human
uugccugugcucuccucucaggggcagcaugc

SEQ ID NO: 274889 - RNA, 32 nt, Human
uugccuguuccaccccuuuguucacuucgcgu

SEQ ID NO: 274890 - RNA, 32 nt, Human
uugccuguugccagacuggagugcaguggcac

SEQ ID NO: 274891 - RNA, 32 nt, Human
uugccuguuugcaccuuagacuuuuggguaua

SEQ ID NO: 274892 - RNA, 32 nt, Human
uugccuuagugaucaugauuacacaaaagagg

SEQ ID NO: 274893 - RNA, 32 nt, Human
uugccuuauccaaagauggggaaaguaagucc

SEQ ID NO: 274894 - RNA, 32 nt, Human
uugccuuauucacuaucugggucuuacaauac

SEQ ID NO: 274895 - RNA, 32 nt, Human
uugccuucacuaccuuccuggucagcugcgug

SEQ ID NO: 274896 - RNA, 32 nt, Human
uugccuucagcccuggagugggcagagaguau

SEQ ID NO: 274897 - RNA, 32 nt, Human
uugccuucaugcugguuuaccccaaagaguuc

SEQ ID NO: 274898 - RNA, 32 nt, Human
uugccuucauucuuaccaccuggccugcaaag

SEQ ID NO: 274899 - RNA, 32 nt, Human
uugccuucauuucaccuuccucuucguuuacg

SEQ ID NO: 274900 - RNA, 32 nt, Human
uugccuucauuucucuuuuuaucucccccuug

SEQ ID NO: 274901 - RNA, 32 nt, Human
uugccuucccaccugccucugccacaccuggu

SEQ ID NO: 274902 - RNA, 21 nt, Human
uugccuuccucccuucuuccu

SEQ ID NO: 274903 - RNA, 32 nt, Human
uugccuuccuugaccaucuaccuugacuaacc

SEQ ID NO: 274904 - RNA, 32 nt, Human
uugccuucugcgcaaaggguuucaccaaggau

SEQ ID NO: 274905 - RNA, 32 nt, Human
uugccuucuuacuguguuguguguuuuuccug

SEQ ID NO: 274906 - RNA, 32 nt, Human
uugccuucuugaucuuccguccuucuuggaga

SEQ ID NO: 274907 - RNA, 32 nt, Human
uugccuugcaaacuuccaucccugucaugucu

SEQ ID NO: 274908 - RNA, 32 nt, Human
uugccuugccuggugcuuccucccucauugug

SEQ ID NO: 274909 - RNA, 32 nt, Human
uugccuugcucacccuccacuuguccgucuac

SEQ ID NO: 274910 - RNA, 32 nt, Human
uugccuuggaggcagaagcugugaguuucaga

SEQ ID NO: 274911 - RNA, 32 nt, Human
uugccuugggcccagccccuggugaucacagg

SEQ ID NO: 274912 - RNA, 32 nt, Human
uugccuuguguuacagauucagccugcugaag

SEQ ID NO: 274913 - RNA, 32 nt, Human
uugccuuguuuaaaugaaaugcauguuuagug

SEQ ID NO: 274914 - RNA, 32 nt, Human
uugccuuguuuacucauccugcccuguaaugu

SEQ ID NO: 274915 - RNA, 32 nt, Human
uugccuuuagcguguaaauggaagcacugcca

SEQ ID NO: 274916 - RNA, 32 nt, Human
uugccuuuauuuuucugucccagaaggauucu

SEQ ID NO: 274917 - RNA, 32 nt, Human
uugccuuuccaccugcuuucuccugggcccgc

SEQ ID NO: 274918 - RNA, 32 nt, Human
uugccuuugaacacaucuucuugcugaacauu

SEQ ID NO: 274919 - RNA, 32 nt, Human
uugccuuugucgcccaggcuggagugcaaugg

SEQ ID NO: 274920 - RNA, 32 nt, Human
uugccuuugucgcccccgccccucucuucccu

SEQ ID NO: 274921 - RNA, 32 nt, Human
uugccuuuguucagaauacaugacauugguaa

SEQ ID NO: 274922 - RNA, 32 nt, Human
uugccuuuguuuugaacuuccuuucccacuug

SEQ ID NO: 274923 - RNA, 32 nt, Human
uugccuuuuacauuuuguuuaauuccugauuu

SEQ ID NO: 274924 - RNA, 23 nt, Human
uugccuuuuuaugccgauuaaca

SEQ ID NO: 274925 - RNA, 32 nt, Human
uugcgaaggagagaggcggcugagggacugca

SEQ ID NO: 274926 - RNA, 32 nt, Human
uugcgaccagccuggucaacauaguggacccc

SEQ ID NO: 274927 - RNA, 32 nt, Human
uugcgaccaugagagaaaaaccuggagaacgg

SEQ ID NO: 274928 - RNA, 32 nt, Human
uugcgaccuucucuuaacagugugaagugagg

SEQ ID NO: 274929 - RNA, 32 nt, Human
uugcgagagcauuuccuucuaagaauuauugu

SEQ ID NO: 274930 - RNA, 32 nt, Human
uugcgagcacauuacuugcugcaugggaggag

SEQ ID NO: 274931 - RNA, 32 nt, Human
uugcgaggccgaggcagguggaucacuugagc

SEQ ID NO: 274932 - RNA, 32 nt, Human
uugcgaggcuagggcaggagaaucacuugaac

SEQ ID NO: 274933 - RNA, 32 nt, Human
uugcgagggcuucacucuucuuucacuggaua

SEQ ID NO: 274934 - RNA, 32 nt, Human
uugcgaguggaggaugcagucucuuugugguu

SEQ ID NO: 274935 - RNA, 32 nt, Human
uugcgagugugagguuagguccagcaucugca

SEQ ID NO: 274936 - RNA, 32 nt, Human
uugcgaugggcugugaggaugggggugguggg

SEQ ID NO: 274937 - RNA, 32 nt, Human
uugcgaugugucaugugccuguguauggcuuu

SEQ ID NO: 274938 - RNA, 32 nt, Human
uugcgauucuucugugaagguacaguguguau

SEQ ID NO: 274939 - RNA, 32 nt, Human
uugcgcacagucauaagcaguguagacuugag

SEQ ID NO: 274940 - RNA, 32 nt, Human
uugcgcaccggauagaccccuuguauauaaag

SEQ ID NO: 274941 - RNA, 19 nt, Human
uugcgcagcgcgggggcug

SEQ ID NO: 274942 - RNA, 32 nt, Human
uugcgcaggcuggagugcaauggugcaaucuc

SEQ ID NO: 274943 - RNA, 21 nt, Human
uugcgcagggccccugggcca

SEQ ID NO: 274944 - RNA, 32 nt, Human
uugcgccaagaaagcauuuguucuccaaaugu

SEQ ID NO: 274945 - RNA, 32 nt, Human
uugcgccacagcauuccagccugggcgaugga

SEQ ID NO: 274946 - RNA, 32 nt, Human
uugcgccaccacacuccagccugggcaacaga

SEQ ID NO: 274947 - RNA, 32 nt, Human
uugcgccaccacugcacuccagccugggcaac

SEQ ID NO: 274948 - RNA, 32 nt, Human
uugcgccaccgcacuccagccugggcaacaga

SEQ ID NO: 274949 - RNA, 32 nt, Human
uugcgccaccgcacuccagccugggcgacaga

SEQ ID NO: 274950 - RNA, 32 nt, Human
uugggaggccgaggcaggugguucaucuaagg

SEQ ID NO: 274951 - RNA, 32 nt, Human
uugggaggccgaggcagguugaucaccugagg

SEQ ID NO: 274952 - RNA, 32 nt, Human
uugggaggccgaggcaguuggaucaccugagg

SEQ ID NO: 274953 - RNA, 32 nt, Human
uugggaggccgaggcaguuggauuacuugagg

SEQ ID NO: 274954 - RNA, 32 nt, Human
uugggaggccgaggcaugagaaucacuugaac

SEQ ID NO: 274955 - RNA, 32 nt, Human
uugggaggccgaggcauguggaucaccugagg

SEQ ID NO: 274956 - RNA, 32 nt, Human
uugggaggccgaggccaguggaucaccugagg

SEQ ID NO: 274957 - RNA, 32 nt, Human
uugggaggccgaggccggcggaucacaaggaa

SEQ ID NO: 274958 - RNA, 32 nt, Human
uugggaggccgaggccgguggaucacuugagg

SEQ ID NO: 274959 - RNA, 32 nt, Human
uugggaggccgaggcgaguggaucacgagguc

SEQ ID NO: 274960 - RNA, 32 nt, Human
uugggaggccgaggcgccuggaucaccugagg

SEQ ID NO: 274961 - RNA, 32 nt, Human
uugggaggccgaggcggacggaucacgagguc

SEQ ID NO: 274962 - RNA, 32 nt, Human
uugggaggccgaggcggaucauaaggucagga

SEQ ID NO: 274963 - RNA, 32 nt, Human
uugggaggccgaggcggcugaaucacuugagg

SEQ ID NO: 274964 - RNA, 32 nt, Human
uugggaggccgaggcgggaggaucacaaaguc

SEQ ID NO: 274965 - RNA, 32 nt, Human
uugggaggccgaggcgggaggaucaccugagg

SEQ ID NO: 274966 - RNA, 32 nt, Human
uugggaggccgaggcgggaggaucacuugagc

SEQ ID NO: 274967 - RNA, 32 nt, Human
uugggaggccgaggcgggcagaucacaagguc

SEQ ID NO: 274968 - RNA, 32 nt, Human
uugggaggccgaggcgggcagaucaccugaag

SEQ ID NO: 274969 - RNA, 32 nt, Human
uugggaggccgaggcgggcagaucaccugagg

SEQ ID NO: 274970 - RNA, 32 nt, Human
uugggaggccgaggcgggcagaucacgagguc

SEQ ID NO: 274971 - RNA, 32 nt, Human
uugggaggccgaggcgggcagaucacgagguu

SEQ ID NO: 274972 - RNA, 32 nt, Human
uugggaggccgaggcgggcagaucacgaguuc

SEQ ID NO: 274973 - RNA, 32 nt, Human
uugggaggccgaggcgggcagaucacuugagg

SEQ ID NO: 274974 - RNA, 32 nt, Human
uugggaggccgaggcgggcagaucaugagguc

SEQ ID NO: 274975 - RNA, 32 nt, Human
uugggaggccgaggcgggccgaucacgagguc

SEQ ID NO: 274976 - RNA, 32 nt, Human
uugggaggccgaggcgggcggaucaacugagg

SEQ ID NO: 274977 - RNA, 32 nt, Human
uugggaggccgaggcgggcggaucaauagguc

SEQ ID NO: 274978 - RNA, 32 nt, Human
uugggaggccgaggcgggcggaucacaaaguc

SEQ ID NO: 274979 - RNA, 32 nt, Human
uugggaggccgaggcgggcggaucacaagggc

SEQ ID NO: 274980 - RNA, 32 nt, Human
uugggaggccgaggcgggcggaucacaagguc

SEQ ID NO: 274981 - RNA, 32 nt, Human
uugggaggccgaggcgggcggaucacacgguc

SEQ ID NO: 274982 - RNA, 32 nt, Human
uugggaggccgaggcgggcggaucaccggagg

SEQ ID NO: 274983 - RNA, 32 nt, Human
uugggaggccgaggcgggcggaucaccugagg

SEQ ID NO: 274984 - RNA, 32 nt, Human
uugggaggccgaggcgggcggaucaccugagu

SEQ ID NO: 274985 - RNA, 32 nt, Human
uugggaggccgaggcgggcggaucacgagguc

SEQ ID NO: 274986 - RNA, 32 nt, Human
uugggaggccgaggcgggcggaucacuagguc

SEQ ID NO: 274987 - RNA, 32 nt, Human
uugggaggccgaggcgggcggaucacuugaga

SEQ ID NO: 274988 - RNA, 32 nt, Human
uugggaggccgaggcgggcggaucacuugagg

SEQ ID NO: 274989 - RNA, 32 nt, Human
uugggaggccgaggcgggcggaucagaccauc

SEQ ID NO: 274990 - RNA, 32 nt, Human
uugggaggccgaggcgggcggaucaugagguc

SEQ ID NO: 274991 - RNA, 32 nt, Human
uugggaggccgaggcgggcggaucaugagguu

SEQ ID NO: 274992 - RNA, 32 nt, Human
uugggaggccgaggcgggcggaucgcaggguc

SEQ ID NO: 274993 - RNA, 32 nt, Human
uugggaggccgaggcgggcggaucgccugagg

SEQ ID NO: 274994 - RNA, 32 nt, Human
uugggaggccgaggcgggcggaucgcuugagg

SEQ ID NO: 274995 - RNA, 32 nt, Human
uugggaggccgaggcgggcgggucacgagguc

SEQ ID NO: 274996 - RNA, 32 nt, Human
uugggaggccgaggcggggagaucaccugagg

SEQ ID NO: 274997 - RNA, 32 nt, Human
uugggaggccgaggcgggugaaucaugagguc

SEQ ID NO: 274998 - RNA, 32 nt, Human
uugggaggccgaggcgggugaucacuugaggu

SEQ ID NO: 274999 - RNA, 32 nt, Human
uugggaggccgaggcggguggaccaccugagg

SEQ ID NO: 275000 - RNA, 32 nt, Human
uugggaggccgaggcggguggaucacaagguc

SEQ ID NO: 275001 - RNA, 32 nt, Human
uugggaggccgaggcggguggaucaccaagac

SEQ ID NO: 275002 - RNA, 32 nt, Human
uugggaggccgaggcggguggaucaccuaaag

SEQ ID NO: 275003 - RNA, 32 nt, Human
uugggaggccgaggcggguggaucaccuaagg

SEQ ID NO: 275004 - RNA, 32 nt, Human
uugggaggccgaggcggguggaucaccugagg

SEQ ID NO: 275005 - RNA, 32 nt, Human
uugggaggccgaggcggguggaucacgagauc

SEQ ID NO: 275006 - RNA, 32 nt, Human
uugggaggccgaggcggguggaucacgagguc

SEQ ID NO: 275007 - RNA, 32 nt, Human
uugggaggccgaggcggguggaucacucaagg

SEQ ID NO: 275008 - RNA, 32 nt, Human
uugggaggccgaggcggguggaucacuugaga

SEQ ID NO: 275009 - RNA, 32 nt, Human
uugggaggccgaggcggguggaucacuugagg

SEQ ID NO: 275010 - RNA, 32 nt, Human
uugggaggccgaggcggguggaucagaagguc

SEQ ID NO: 275011 - RNA, 32 nt, Human
uugggaggccgaggcggguggaucaugagauc

SEQ ID NO: 275012 - RNA, 32 nt, Human
uugggaggccgaggcggguggaucaugagguc

SEQ ID NO: 275013 - RNA, 32 nt, Human
uugggaggccgaggcggguggaucaugugagg

SEQ ID NO: 275014 - RNA, 32 nt, Human
uugggaggccgaggcggguggaucauuugagg

SEQ ID NO: 275015 - RNA, 32 nt, Human
uugggaggccgaggcggguggguuacuugagg

SEQ ID NO: 275016 - RNA, 32 nt, Human
uugggaggccgaggcggguguaucaccugagg

SEQ ID NO: 275017 - RNA, 32 nt, Human
uugggaggccgaggcggucggaucacgagguc

SEQ ID NO: 275018 - RNA, 32 nt, Human
uugggaggccgaggcguguggaucaccugaga

SEQ ID NO: 275019 - RNA, 32 nt, Human
uugggaggccgaggcuggcggaucacgagguc

SEQ ID NO: 275020 - RNA, 32 nt, Human
uugggaggccgaggcugguggaucacaagguc

SEQ ID NO: 275021 - RNA, 32 nt, Human
uugggaggccgaggcugguggaucacgagguc

SEQ ID NO: 275022 - RNA, 32 nt, Human
uugggaggccgaggggaguggaucaccugagu

SEQ ID NO: 275023 - RNA, 32 nt, Human
uugggaggccgaggggaguggaucacuugagg

SEQ ID NO: 275024 - RNA, 32 nt, Human
uugggaggccgagguaggcagaucacgagguc

SEQ ID NO: 275025 - RNA, 32 nt, Human
uugggaggccgagguaggcggaucaccugagg

SEQ ID NO: 275026 - RNA, 32 nt, Human
uugggaggccgagguagguggaucgccugagg

SEQ ID NO: 275027 - RNA, 32 nt, Human
uugggaggccgaggugaguagaucaucugggg

SEQ ID NO: 275028 - RNA, 32 nt, Human
uugggaggccgaggugaguggaucaccugagg

SEQ ID NO: 275029 - RNA, 32 nt, Human
uugggaggccgaggugggaagaucauuucaac

SEQ ID NO: 275030 - RNA, 32 nt, Human
uugggaggccgaggugggaagauuguucaaga

SEQ ID NO: 275031 - RNA, 32 nt, Human
uugggaggccgaggugggagaaucacaagguc

SEQ ID NO: 275032 - RNA, 32 nt, Human
uugggaggccgaggugggagaaucacuugacg

SEQ ID NO: 275033 - RNA, 32 nt, Human
uugggaggccgaggugggcagaucaugagguc

SEQ ID NO: 275034 - RNA, 32 nt, Human
uugggaggccgaggugggcagaucauggguca

SEQ ID NO: 275035 - RNA, 32 nt, Human
uugggaggccgagguggguggaucacaagguc

SEQ ID NO: 275036 - RNA, 32 nt, Human
uugggaggccgagguggguggaucacaagguu

SEQ ID NO: 275037 - RNA, 32 nt, Human
uugggaggccgagguggguggaucaccagagg

SEQ ID NO: 275038 - RNA, 32 nt, Human
uugggaggccgagguggguggaucaccucagg

SEQ ID NO: 275039 - RNA, 32 nt, Human
uugggaggccgagguggguggaucaccugaag

SEQ ID NO: 275040 - RNA, 32 nt, Human
uugggaggccgagguggguggaucaccugaga

SEQ ID NO: 275041 - RNA, 32 nt, Human
uugggaggccgagguggguggaucaccugagg

SEQ ID NO: 275042 - RNA, 32 nt, Human
uugggaggccgagguggguggaucacgaaguc

SEQ ID NO: 275043 - RNA, 32 nt, Human
uugggaggccgagguggguggaucacgagguc

SEQ ID NO: 275044 - RNA, 32 nt, Human
uugggaggccgagguggguggaucacuugagg

SEQ ID NO: 275045 - RNA, 32 nt, Human
uugggaggccgagguggguggaucaguugagg

SEQ ID NO: 275046 - RNA, 32 nt, Human
uugggaggccgagguggguggaucaucugagg

SEQ ID NO: 275047 - RNA, 32 nt, Human
uugggaggccgagguggguggaucaugaaguc

SEQ ID NO: 275048 - RNA, 32 nt, Human
uugggaggccgagucagguggaucaccugagg

SEQ ID NO: 275049 - RNA, 32 nt, Human
uugggaggccgggacagguggaucaccugagg

SEQ ID NO: 275050 - RNA, 32 nt, Human
uugggaggccgggguuggaggaucauuugagc

SEQ ID NO: 275051 - RNA, 32 nt, Human
uugggaggccuaggcagguggaucaccugacg

SEQ ID NO: 275052 - RNA, 32 nt, Human
uugggaggccuaggcggguggaucaccugagg

SEQ ID NO: 275053 - RNA, 32 nt, Human
uugggaggccuaggcggguggaucacgacguc

SEQ ID NO: 275054 - RNA, 32 nt, Human
uugggaggccuagggugggcaugaaagcuugg

SEQ ID NO: 275055 - RNA, 32 nt, Human
uugggaggccuuggcagguggaucaccugaga

SEQ ID NO: 275056 - RNA, 19 nt, Human
uugggaggcggaagcagga

SEQ ID NO: 275057 - RNA, 32 nt, Human
uugggaggcggaagcaggaguaucccuugagu

SEQ ID NO: 275058 - RNA, 32 nt, Human
uugggaggcggguggaggagcagcagaggaag

SEQ ID NO: 275059 - RNA, 32 nt, Human
uugggaggcuaaagugggagaaucacuuaaac

SEQ ID NO: 275060 - RNA, 32 nt, Human
uugggaggcuaagacaggagaaucacuugagc

SEQ ID NO: 275061 - RNA, 32 nt, Human
uugggaggcuaaggcaggagaaucacuugaac

SEQ ID NO: 275062 - RNA, 32 nt, Human
uugggaggcuaaggcaggagaaucacuugaau

SEQ ID NO: 275063 - RNA, 32 nt, Human
uugggaggcuaaggcaggagaaucgcuugaac

SEQ ID NO: 275064 - RNA, 32 nt, Human
uugggaggcuaaggcaggagaauugcuugaac

SEQ ID NO: 275065 - RNA, 32 nt, Human
uugggaggcuaaggcagggagauggcuugaga

SEQ ID NO: 275066 - RNA, 32 nt, Human
uugggaggcugaaacaggagaauugcuugaac

SEQ ID NO: 275067 - RNA, 32 nt, Human
uugggaggcugaagcagaagaauugcuugaac

SEQ ID NO: 275068 - RNA, 32 nt, Human
uugggaggcugaagcaggagaacugccugaac

SEQ ID NO: 275069 - RNA, 32 nt, Human
uugggaggcugaagcaggagaaucacuuuaac

SEQ ID NO: 275070 - RNA, 32 nt, Human
uugggaggcugaagcaggagaaucccuugaac

SEQ ID NO: 275071 - RNA, 32 nt, Human
uugggaggcugaagcaggagaaucgcuugaac

SEQ ID NO: 275072 - RNA, 32 nt, Human
uugggaggcugaagcaggagaaucguuugaau

SEQ ID NO: 275073 - RNA, 32 nt, Human
uugggaggcugaagcaggagaauugccugaac

SEQ ID NO: 275074 - RNA, 32 nt, Human
uugggaggcugaagcaggagaauugcucaaac

SEQ ID NO: 275075 - RNA, 32 nt, Human
uugggaggcugaagcaggagaauugcucgaac

SEQ ID NO: 275076 - RNA, 32 nt, Human
uugggaggcugaagcaggagagucacuugaac

SEQ ID NO: 275077 - RNA, 32 nt, Human
uugggaggcugaagcaggagcauggcgugaac

SEQ ID NO: 275078 - RNA, 32 nt, Human
uugggaggcugaagcaggaggacugcuugagg

SEQ ID NO: 275079 - RNA, 32 nt, Human
uugggaggcugaagcaggaggauagcuagagc

SEQ ID NO: 275080 - RNA, 32 nt, Human
uugggaggcugaagcaggaggaucacuugagc

SEQ ID NO: 275081 - RNA, 32 nt, Human
uugggaggcugaagcaggaggauugaggaaga

SEQ ID NO: 275082 - RNA, 32 nt, Human
uugggaggcugaagcaggaggauugcuugagc

SEQ ID NO: 275083 - RNA, 32 nt, Human
uugggaggcugaagcaggcagaucaccugagg

SEQ ID NO: 275084 - RNA, 32 nt, Human
uugggaggcugaagcaggcagauugcuugagg

SEQ ID NO: 275085 - RNA, 32 nt, Human
uugggaggcugaagcaggcgggucaccugagg

SEQ ID NO: 275086 - RNA, 32 nt, Human
uugggaggcugaagcaugagaaucacuugaau

SEQ ID NO: 275087 - RNA, 32 nt, Human
uugggaggcugaagcgggaggaucgcuugaga

SEQ ID NO: 275088 - RNA, 32 nt, Human
uugggaggcugaagcggguggaucaccugagg

SEQ ID NO: 275089 - RNA, 32 nt, Human
uugggaggcugaagcggguggaucaugagguc

SEQ ID NO: 275090 - RNA, 32 nt, Human
uugggaggcugaagcugaaggaucacuugagc

SEQ ID NO: 275091 - RNA, 32 nt, Human
uugggaggcugaagggggcagauuagcugagg

SEQ ID NO: 275092 - RNA, 32 nt, Human
uugggaggcugaaguaggaggaucgucuugag

SEQ ID NO: 275093 - RNA, 32 nt, Human
uugggaggcugaagugggaagaucacuugagc

SEQ ID NO: 275094 - RNA, 32 nt, Human
uugggaggcugaagugggaggacugcuugggc

SEQ ID NO: 275095 - RNA, 32 nt, Human
uugggaggcugaagugggaggaucauuugugc

SEQ ID NO: 275096 - RNA, 32 nt, Human
uugggaggcugaagugggaggaucccuugagc

SEQ ID NO: 275097 - RNA, 32 nt, Human
uugggaggcugaagugggaggaucgcuugagc

SEQ ID NO: 275098 - RNA, 32 nt, Human
uugggaggcugaagugggaggauuacuugagc

SEQ ID NO: 275099 - RNA, 32 nt, Human
uugggaggcugaagugggaggguggcuugagu

SEQ ID NO: 275100 - RNA, 32 nt, Human
uugggaggcugaagugggcagauuacuugagg

SEQ ID NO: 275101 - RNA, 32 nt, Human
uugggaggcugaagugggugaaucacuugagg

SEQ ID NO: 275102 - RNA, 32 nt, Human
uugggaggcugaaguggguggaucacaaguca

SEQ ID NO: 275103 - RNA, 32 nt, Human
uugggaggcugaaguggguggaucaccagagg

SEQ ID NO: 275104 - RNA, 32 nt, Human
uugggaggcugacgcaggagaaucgcuugaac

SEQ ID NO: 275105 - RNA, 32 nt, Human
uugggaggcugagacaggagaaucacuugaac

SEQ ID NO: 275106 - RNA, 32 nt, Human
uugggaggcugagacaggagaaucccuugaac

SEQ ID NO: 275107 - RNA, 32 nt, Human
uugggaggcugagacaggagaaucgcuugaac

SEQ ID NO: 275108 - RNA, 32 nt, Human
uugggaggcugagacaggagaauugcuugaac

SEQ ID NO: 275109 - RNA, 32 nt, Human
uugggaggcugagacagguggaucaccugagg

SEQ ID NO: 275110 - RNA, 32 nt, Human
uugggaggcugagacagguggaucacuugagg

SEQ ID NO: 275111 - RNA, 32 nt, Human
uugggaggcugagagaggagaauagcuugaac

SEQ ID NO: 275112 - RNA, 32 nt, Human
uugggaggcugagauaggagaaucgcuugaac

SEQ ID NO: 275113 - RNA, 32 nt, Human
uugggaggcugagaugggagaaucacuugaac

SEQ ID NO: 275114 - RNA, 32 nt, Human
uugggaggcugagaugugagaaucacuugaac

SEQ ID NO: 275115 - RNA, 32 nt, Human
uugggaggcugagccaggagaaucacuugaac

SEQ ID NO: 275116 - RNA, 32 nt, Human
uugggaggcugagccaggagaaucgcuugaac

SEQ ID NO: 275117 - RNA, 32 nt, Human
uugggaggcugagccaggagaauugcuugaac

SEQ ID NO: 275118 - RNA, 32 nt, Human
uugggaggcugaggaaggagaauugcuugaac

SEQ ID NO: 275119 - RNA, 32 nt, Human
uugggaggcugaggaggguggaucacuugagg

SEQ ID NO: 275120 - RNA, 32 nt, Human
uugggaggcugaggcaagagaaucauuugaac

SEQ ID NO: 275121 - RNA, 32 nt, Human
uugggaggcugaggcaagcggaucauuugagg

SEQ ID NO: 275122 - RNA, 32 nt, Human
uugggaggcugaggcaagugaaucacuugaac

SEQ ID NO: 275123 - RNA, 32 nt, Human
uugggaggcugaggcaaguggaucacuugagg

SEQ ID NO: 275124 - RNA, 32 nt, Human
uugggaggcugaggcacaagaaucacuugaac

SEQ ID NO: 275125 - RNA, 32 nt, Human
uugggaggcugaggcacaagaaucacuugaau

SEQ ID NO: 275126 - RNA, 32 nt, Human
uugggaggcugaggcacgagaaucacuugagc

SEQ ID NO: 275127 - RNA, 32 nt, Human
uugggaggcugaggcagaagaaucacuugaac

SEQ ID NO: 275128 - RNA, 32 nt, Human
uugggaggcugaggcagaauugcuugaaccca

SEQ ID NO: 275129 - RNA, 32 nt, Human
uugggaggcugaggcagcauugcuugaacccg

SEQ ID NO: 275130 - RNA, 32 nt, Human
uugggaggcugaggcaggaaaauggcgugaac

SEQ ID NO: 275131 - RNA, 32 nt, Human
uugggaggcugaggcaggagaaccgcuuaaac

SEQ ID NO: 275132 - RNA, 32 nt, Human
uugggaggcugaggcaggagaacugcuugauc

SEQ ID NO: 275133 - RNA, 32 nt, Human
uugggaggcugaggcaggagaauagcuugaac

SEQ ID NO: 275134 - RNA, 32 nt, Human
uugggaggcugaggcaggagaaucaccugaac

SEQ ID NO: 275135 - RNA, 32 nt, Human
uugggaggcugaggcaggagaaucacucgaac

SEQ ID NO: 275136 - RNA, 32 nt, Human
uugggaggcugaggcaggagaaucacuugaac

SEQ ID NO: 275137 - RNA, 32 nt, Human
uugggaggcugaggcaggagaaucacuugaau

SEQ ID NO: 275138 - RNA, 32 nt, Human
uugggaggcugaggcaggagaaucacuugacc

SEQ ID NO: 275139 - RNA, 32 nt, Human
uugggaggcugaggcaggagaaucacuugagc

SEQ ID NO: 275140 - RNA, 32 nt, Human
uugggaggcugaggcaggagaaucacuugagg

SEQ ID NO: 275141 - RNA, 32 nt, Human
uugggaggcugaggcaggagaaucauuuaaac

SEQ ID NO: 275142 - RNA, 32 nt, Human
uugggaggcugaggcaggagaaucauuugaac

SEQ ID NO: 275143 - RNA, 32 nt, Human
uugggaggcugaggcaggagaaucauuugagc

SEQ ID NO: 275144 - RNA, 32 nt, Human
uugggaggcugaggcaggagaaucccuugaac

SEQ ID NO: 275145 - RNA, 32 nt, Human
uugggaggcugaggcaggagaaucgccugaac

SEQ ID NO: 275146 - RNA, 32 nt, Human
uugggaggcugaggcaggagaaucgcuggagc

SEQ ID NO: 275147 - RNA, 32 nt, Human
uugggaggcugaggcaggagaaucgcuuaaac

SEQ ID NO: 275148 - RNA, 32 nt, Human
uugggaggcugaggcaggagaaucgcuugaac

SEQ ID NO: 275149 - RNA, 32 nt, Human
uugggaggcugaggcaggagaaucgcuugaau

SEQ ID NO: 275150 - RNA, 32 nt, Human
uugggaggcugaggcaggagaaucgcuugacu

SEQ ID NO: 275151 - RNA, 32 nt, Human
uugggaggcugaggcaggagaaucgcuugagc

SEQ ID NO: 275152 - RNA, 32 nt, Human
uugggaggcugaggcaggagaaucgguugaac

SEQ ID NO: 275153 - RNA, 32 nt, Human
uugggaggcugaggcaggagaaucucuugaac

SEQ ID NO: 275154 - RNA, 32 nt, Human
uugggaggcugaggcaggagaauggcaagaac

SEQ ID NO: 275155 - RNA, 32 nt, Human
uugggaggcugaggcaggagaauggcauaaac

SEQ ID NO: 275156 - RNA, 32 nt, Human
uugggaggcugaggcaggagaauggcaugaac

SEQ ID NO: 275157 - RNA, 32 nt, Human
uugggaggcugaggcaggagaauggccugaac

SEQ ID NO: 275158 - RNA, 32 nt, Human
uugggaggcugaggcaggagaauggcgggaac

SEQ ID NO: 275159 - RNA, 32 nt, Human
uugggaggcugaggcaggagaauggcgugaac

SEQ ID NO: 275160 - RNA, 32 nt, Human
uugggaggcugaggcaggagaauggcuugaac

SEQ ID NO: 275161 - RNA, 32 nt, Human
uugggaggcugaggcaggagaauuacuugaac

SEQ ID NO: 275162 - RNA, 32 nt, Human
uugggaggcugaggcaggagaauucguugggc

SEQ ID NO: 275163 - RNA, 32 nt, Human
uugggaggcugaggcaggagaauucuuugaac

SEQ ID NO: 275164 - RNA, 32 nt, Human
uugggaggcugaggcaggagaauugauugaac

SEQ ID NO: 275165 - RNA, 32 nt, Human
uugggaggcugaggcaggagaauugcuuaaau

SEQ ID NO: 275166 - RNA, 32 nt, Human
uugggaggcugaggcaggagaauugcuugaac

SEQ ID NO: 275167 - RNA, 32 nt, Human
uugggaggcugaggcaggagaauugcuugaag

SEQ ID NO: 275168 - RNA, 32 nt, Human
uugggaggcugaggcaggagaauugcuugaau

SEQ ID NO: 275169 - RNA, 32 nt, Human
uugggaggcugaggcaggagaauugcuugagc

SEQ ID NO: 275170 - RNA, 32 nt, Human
uugggaggcugaggcaggagaauugcuugagu

SEQ ID NO: 275171 - RNA, 32 nt, Human
uugggaggcugaggcaggagaauuguuugacc

SEQ ID NO: 275172 - RNA, 32 nt, Human
uugggaggcugaggcaggagacuagcuggaac

SEQ ID NO: 275173 - RNA, 32 nt, Human
uugggaggcugaggcaggagacucgcuugaac

SEQ ID NO: 275174 - RNA, 32 nt, Human
uugggaggcugaggcaggagacuggcaugaac

SEQ ID NO: 275175 - RNA, 25 nt, Human
uugggaggcugaggcaggagagucg

SEQ ID NO: 275176 - RNA, 32 nt, Human
uugggaggcugaggcaggagagugcuugaacc

SEQ ID NO: 275177 - RNA, 32 nt, Human
uugggaggcugaggcaggaggacuguuugagu

SEQ ID NO: 275178 - RNA, 32 nt, Human
uugggaggcugaggcaggaggaucacucgagc

SEQ ID NO: 275179 - RNA, 32 nt, Human
uugggaggcugaggcaggaggaucacuuaagc

SEQ ID NO: 275180 - RNA, 32 nt, Human
uugggaggcugaggcaggaggaucacuucagc

SEQ ID NO: 275181 - RNA, 32 nt, Human
uugggaggcugaggcaggaggaucacuugagc

SEQ ID NO: 275182 - RNA, 32 nt, Human
uugggaggcugaggcaggaggaucacuugagg

SEQ ID NO: 275183 - RNA, 32 nt, Human
uugggaggcugaggcaggaggaucgccugagc

SEQ ID NO: 275184 - RNA, 32 nt, Human
uugggaggcugaggcaggaggaucgcuugaac

SEQ ID NO: 275185 - RNA, 32 nt, Human
uugggaggcugaggcaggaggaucgcuugagg

SEQ ID NO: 275186 - RNA, 32 nt, Human
uugggaggcugaggcaggaggaucgcuugagu

SEQ ID NO: 275187 - RNA, 32 nt, Human
uugggaggcugaggcaggaggauuguuugagg

SEQ ID NO: 275188 - RNA, 32 nt, Human
uugggaggcugaggcaggauugcuugagccca

SEQ ID NO: 275189 - RNA, 32 nt, Human
uugggaggcugaggcaggcagaucacaugagg

SEQ ID NO: 275190 - RNA, 32 nt, Human
uugggaggcugaggcaggcagaucaccugagg

SEQ ID NO: 275191 - RNA, 32 nt, Human
uugggaggcugaggcaggcagaucaccugaua

SEQ ID NO: 275192 - RNA, 32 nt, Human
uugggaggcugaggcaggcagaucacgagguc

SEQ ID NO: 275193 - RNA, 32 nt, Human
uugggaggcugaggcaggcagaucacgugagg

SEQ ID NO: 275194 - RNA, 32 nt, Human
uugggaggcugaggcaggcagaucagcugagg

SEQ ID NO: 275195 - RNA, 32 nt, Human
uugggaggcugaggcaggcagaucaucugagg

SEQ ID NO: 275196 - RNA, 32 nt, Human
uugggaggcugaggcaggcagaucaugagguc

SEQ ID NO: 275197 - RNA, 32 nt, Human
uugggaggcugaggcaggcggaucacaagguc

SEQ ID NO: 275198 - RNA, 32 nt, Human
uugggaggcugaggcaggcggaucacaggguc

SEQ ID NO: 275199 - RNA, 32 nt, Human
uugggaggcugaggcaggcggaucaccugaag

SEQ ID NO: 275200 - RNA, 32 nt, Human
uugggaggcugaggcaggcggaucaccugagg

SEQ ID NO: 275201 - RNA, 32 nt, Human
uugggaggcugaggcaggcggaucacgagguc

SEQ ID NO: 275202 - RNA, 32 nt, Human
uugggaggcugaggcaggcggaucacuugagg

SEQ ID NO: 275203 - RNA, 32 nt, Human
uugggaggcugaggcaggcggaucacuugaug

SEQ ID NO: 275204 - RNA, 32 nt, Human
uugggaggcugaggcaggcggaucaugagguc

SEQ ID NO: 275205 - RNA, 32 nt, Human
uugggaggcugaggcaggcgggucaccugagg

SEQ ID NO: 275206 - RNA, 32 nt, Human
uugggaggcugaggcaggcgggucaucugaca

SEQ ID NO: 275207 - RNA, 32 nt, Human
uugggaggcugaggcaggcugaucacuugagg

SEQ ID NO: 275208 - RNA, 32 nt, Human
uugggaggcugaggcaggggaaucacuugaac

SEQ ID NO: 275209 - RNA, 32 nt, Human
uugggaggcugaggcaggucgaucacgagguc

SEQ ID NO: 275210 - RNA, 32 nt, Human
uugggaggcugaggcaggugaaucacuugguc

SEQ ID NO: 275211 - RNA, 32 nt, Human
uugggaggcugaggcagguggaucacaagguc

SEQ ID NO: 275212 - RNA, 32 nt, Human
uugggaggcugaggcagguggaucacaauguc

SEQ ID NO: 275213 - RNA, 32 nt, Human
uugggaggcugaggcagguggaucaccuaagg

SEQ ID NO: 275214 - RNA, 32 nt, Human
uugggaggcugaggcagguggaucaccucaag

SEQ ID NO: 275215 - RNA, 32 nt, Human
uugggaggcugaggcagguggaucaccugagg

SEQ ID NO: 275216 - RNA, 32 nt, Human
uugggaggcugaggcagguggaucacgagguc

SEQ ID NO: 275217 - RNA, 32 nt, Human
uugggaggcugaggcagguggaucacuggagg

SEQ ID NO: 275218 - RNA, 32 nt, Human
uugggaggcugaggcagguggaucacuggagu

SEQ ID NO: 275219 - RNA, 32 nt, Human
uugggaggcugaggcagguggaucacuugaag

SEQ ID NO: 275220 - RNA, 32 nt, Human
uugggaggcugaggcagguggaucacuugaga

SEQ ID NO: 275221 - RNA, 32 nt, Human
uugggaggcugaggcagguggaucacuugagc

SEQ ID NO: 275222 - RNA, 32 nt, Human
uugggaggcugaggcagguggaucacuugagg

SEQ ID NO: 275223 - RNA, 32 nt, Human
uugggaggcugaggcagguggaucgccugagg

SEQ ID NO: 275224 - RNA, 32 nt, Human
uugggaggcugaggcagguggauugccugagg

SEQ ID NO: 275225 - RNA, 32 nt, Human
uugggaggcugaggcagguggauugcuugaac

SEQ ID NO: 275226 - RNA, 32 nt, Human
uugggaggcugaggcagguggauugcuuugag

SEQ ID NO: 275227 - RNA, 32 nt, Human
uugggaggcugaggcaggugguucacuggagg

SEQ ID NO: 275228 - RNA, 32 nt, Human
uugggaggcugaggcaguagaaucacuugaac

SEQ ID NO: 275229 - RNA, 32 nt, Human
uugggaggcugaggcaugagaaucaauugaac

SEQ ID NO: 275230 - RNA, 32 nt, Human
uugggaggcugaggcaugagaaucacuuaaac

SEQ ID NO: 275231 - RNA, 32 nt, Human
uugggaggcugaggccgguggaucaccuggga

SEQ ID NO: 275232 - RNA, 32 nt, Human
uugggaggcugaggcgagagaaucacuugaac

SEQ ID NO: 275233 - RNA, 32 nt, Human
uugggaggcugaggcgaguggaucacaagguc

SEQ ID NO: 275234 - RNA, 32 nt, Human
uugggaggcugaggcgcguggaucaccugagg

SEQ ID NO: 275235 - RNA, 32 nt, Human
uugggaggcugaggcggguggaucaagagguc

SEQ ID NO: 275236 - RNA, 32 nt, Human
uugggaggcugaggcggguggaucacaagcuc

SEQ ID NO: 275237 - RNA, 32 nt, Human
uugggaggcugaggcggguggaucacaagguc

SEQ ID NO: 275238 - RNA, 32 nt, Human
uugggaggcugaggcggguggaucaccuaagg

SEQ ID NO: 275239 - RNA, 32 nt, Human
uugggaggcugaggcggguggaucaccugagg

SEQ ID NO: 275240 - RNA, 32 nt, Human
uugggaggcugaggcggguggaucacgagguc

SEQ ID NO: 275241 - RNA, 32 nt, Human
uugggaggcugaggcggguggaucacuagguc

SEQ ID NO: 275242 - RNA, 32 nt, Human
uugggaggcugaggcggguggaucacuugagg

SEQ ID NO: 275243 - RNA, 32 nt, Human
uugggaggcugaggcggguggaucaucugggu

SEQ ID NO: 275244 - RNA, 32 nt, Human
uugggaggcugaggcggguggaucaugagguc

SEQ ID NO: 275245 - RNA, 32 nt, Human
uugggaggcugaggcggguggaucugcugaag

SEQ ID NO: 275246 - RNA, 32 nt, Human
uugggaggcugaggcgguagaaucacgugagu

SEQ ID NO: 275247 - RNA, 32 nt, Human
uugggaggcugaggcuaguggaucauguggcc

SEQ ID NO: 275248 - RNA, 32 nt, Human
uugggaggcugaggcuggagaaucgcuugaac

SEQ ID NO: 275249 - RNA, 32 nt, Human
uugggaggcugaggcuggagaaucgcuugagg

SEQ ID NO: 275250 - RNA, 32 nt, Human
uugggaggcugaggcuggagaaucguuugagg

SEQ ID NO: 275251 - RNA, 32 nt, Human
uugggaggcugaggguggagaaucgcuugaac

SEQ ID NO: 275252 - RNA, 32 nt, Human
uugggaggcugagguaggagaauggcguaaac

SEQ ID NO: 275253 - RNA, 32 nt, Human
uugggaggcugagguaggagaauggcgugaac

SEQ ID NO: 275254 - RNA, 32 nt, Human
uugggaggcugagguaggagaauuacuugaau

SEQ ID NO: 275255 - RNA, 32 nt, Human
uugggaggcugagguaggagaauugcuuaagc

SEQ ID NO: 275256 - RNA, 32 nt, Human
uugggaggcugagguaggagaauugcuugagc

SEQ ID NO: 275257 - RNA, 32 nt, Human
uugggaggcugagguagguggaucacccaagg

SEQ ID NO: 275258 - RNA, 32 nt, Human
uugggaggcugagguagguggaucaugagguc

SEQ ID NO: 275259 - RNA, 32 nt, Human
uugggaggcugagguggaaggaucauuugagc

SEQ ID NO: 275260 - RNA, 32 nt, Human
uugggaggcugaggugggagaaucaccugagc

SEQ ID NO: 275261 - RNA, 32 nt, Human
uugggaggcugaggugggagaaucacuugaac

SEQ ID NO: 275262 - RNA, 32 nt, Human
uugggaggcugaggugggaggaucauuugagg

SEQ ID NO: 275263 - RNA, 32 nt, Human
uugggaggcugaggugggggaaucacuugagc

SEQ ID NO: 275264 - RNA, 32 nt, Human
uugggaggcugagguggguggaucacaaggcc

SEQ ID NO: 275265 - RNA, 32 nt, Human
uugggaggcugagguggguggaucacaagguc

SEQ ID NO: 275266 - RNA, 32 nt, Human
uugggaggcugagguggguggaucacagguca

SEQ ID NO: 275267 - RNA, 32 nt, Human
uugggaggcugagguggguggaucaccuaagg

SEQ ID NO: 275268 - RNA, 32 nt, Human
uugggaggcugagguggguggaucaccugaga

SEQ ID NO: 275269 - RNA, 32 nt, Human
uugggaggcugagguggguggaucaccugagg

SEQ ID NO: 275270 - RNA, 32 nt, Human
uugggaggcugagguggguggaucacgagguc

SEQ ID NO: 275271 - RNA, 32 nt, Human
uugggaggcugagguggguggaucacuggagu

SEQ ID NO: 275272 - RNA, 32 nt, Human
uugggaggcugagguggguggaucacuggguc

SEQ ID NO: 275273 - RNA, 32 nt, Human
uugggaggcugagguggguggaucacuugaca

SEQ ID NO: 275274 - RNA, 32 nt, Human
uugggaggcugagguggguggaucacuugagg

SEQ ID NO: 275275 - RNA, 32 nt, Human
uugggaggcugagguggguggaucaucugagg

SEQ ID NO: 275276 - RNA, 32 nt, Human
uugggaggcugagguggguggaucaugagguc

SEQ ID NO: 275277 - RNA, 32 nt, Human
uugggaggcugagguggguggaucaugcgguc

SEQ ID NO: 275278 - RNA, 32 nt, Human
uugggaggcugagguggguggaucauuugagg

SEQ ID NO: 275279 - RNA, 32 nt, Human
uugggaggcugaggugugaggaucauuuaggc

SEQ ID NO: 275280 - RNA, 32 nt, Human
uugggaggcugaugcaggagaauagcuuaagc

SEQ ID NO: 275281 - RNA, 32 nt, Human
uugggaggcugaugcgggcggaucacaagguc

SEQ ID NO: 275282 - RNA, 32 nt, Human
uugggaggcuggcacaggagaaucgcuugaau

SEQ ID NO: 275283 - RNA, 32 nt, Human
uugggaggcuggggaaggagaaucacuugagc

SEQ ID NO: 275284 - RNA, 32 nt, Human
uugggaggcuggggcaggagaauugccugagc

SEQ ID NO: 275285 - RNA, 32 nt, Human
uugggaggcuguggcaggagaaucgcuagaac

SEQ ID NO: 275286 - RNA, 32 nt, Human
uugggaggcuguggcagguggaucaccugagg

SEQ ID NO: 275287 - RNA, 32 nt, Human
uugggaggcuuagucaggaggaucucuugagc

SEQ ID NO: 275288 - RNA, 32 nt, Human
uugggagggaaggucugaguucccugggaacu

SEQ ID NO: 275289 - RNA, 32 nt, Human
uugggagggagaaagagggaccuagcgcgggc

SEQ ID NO: 275290 - RNA, 32 nt, Human
uugggagggaggccaaggcgggcagaucaccu

SEQ ID NO: 275291 - RNA, 32 nt, Human
uugggagggcugguaagcuccauccuuucuca

SEQ ID NO: 275292 - RNA, 32 nt, Human
uugggaggggaacagggaaggaagggauggau

SEQ ID NO: 275293 - RNA, 32 nt, Human
uugggaggggauguuaagucaaaucacuaaaa

SEQ ID NO: 275294 - RNA, 32 nt, Human
uugggagggggaggcaggcggaucaugauguc

SEQ ID NO: 275295 - RNA, 21 nt, Human
uugggagggggucccagggaa

SEQ ID NO: 275296 - RNA, 32 nt, Human
uugggagggugaggcaggaggauggcucaagc

SEQ ID NO: 275297 - RNA, 32 nt, Human
uugggagggugaggcagguggaucaccugagg

SEQ ID NO: 275298 - RNA, 32 nt, Human
uugggagguacccuagaaucacuuagcuucag

SEQ ID NO: 275299 - RNA, 32 nt, Human
uugggaggucgaggcaggcagaucaccugagg

SEQ ID NO: 275300 - RNA, 32 nt, Human
uugggaggucgaggcaggcggaucaccugagg

SEQ ID NO: 275301 - RNA, 32 nt, Human
uugggaggucgaggcagguagaucacgagguc

SEQ ID NO: 275302 - RNA, 32 nt, Human
uugggaggucgaggcagguggaucacgaggcc

SEQ ID NO: 275303 - RNA, 32 nt, Human
uugggaggucgagguagguggaucaccugagg

SEQ ID NO: 275304 - RNA, 32 nt, Human
uugggaggucgagguggguggaucaccugagg

SEQ ID NO: 275305 - RNA, 32 nt, Human
uugggaggucgagguggguggaucacuugggg

SEQ ID NO: 275306 - RNA, 32 nt, Human
uugggagguggaggcagguggaucacgauguc

SEQ ID NO: 275307 - RNA, 32 nt, Human
uugggagguggaggccaagauuguaccacugu

SEQ ID NO: 275308 - RNA, 32 nt, Human
uugggagguggggaggaaugagaggguccagg

SEQ ID NO: 275309 - RNA, 32 nt, Human
uugggagguugaggcaagagaaucacuugaac

SEQ ID NO: 275310 - RNA, 32 nt, Human
uugggagguugaggcaggagaaucauuugaac

SEQ ID NO: 275311 - RNA, 32 nt, Human
uugggagguugaggcaggagaaucccuugaac

SEQ ID NO: 275312 - RNA, 32 nt, Human
uugggagguugaggcaggagaaucgcuugaac

SEQ ID NO: 275313 - RNA, 32 nt, Human
uugggagguugagggaggagaauccuuugaac

SEQ ID NO: 275314 - RNA, 32 nt, Human
uugggagguugagguggguggaucaugagguc

SEQ ID NO: 275315 - RNA, 32 nt, Human
uugggaguaggggguagguggggaagauguac

SEQ ID NO: 275316 - RNA, 32 nt, Human
uugggaguagugaccaacuucugcuuuuggaa

SEQ ID NO: 275317 - RNA, 32 nt, Human
uugggaguccauagcuaagcaccaggagcuga

SEQ ID NO: 275318 - RNA, 32 nt, Human
uugggaguccgaggcagguggaucaccugagg

SEQ ID NO: 275319 - RNA, 32 nt, Human
uugggagucugaagcaguagaaucgcuuaaac

SEQ ID NO: 275320 - RNA, 32 nt, Human
uugggagucugaggcaggagaauugcuugagc

SEQ ID NO: 275321 - RNA, 32 nt, Human
uugggagugaagagaauccaggcuggcagagc

SEQ ID NO: 275322 - RNA, 32 nt, Human
uugggaguggccugugcaccccagggccagcu

SEQ ID NO: 275323 - RNA, 32 nt, Human
uugggauaaagugaaaguuccauuuccuaaau

SEQ ID NO: 275324 - RNA, 32 nt, Human
uugggauaaagugaaguuccauuuccuaaaua

SEQ ID NO: 275325 - RNA, 32 nt, Human
uugggauaagagugugagagagacugaugggg

SEQ ID NO: 275326 - RNA, 32 nt, Human
uugggauaauucacacacuaaagccugaguuc

SEQ ID NO: 275327 - RNA, 32 nt, Human
uugggauacuguaauacuucuuuguuauuaua

SEQ ID NO: 275328 - RNA, 32 nt, Human
uugggauagaggccacauugacugaggguagu

SEQ ID NO: 275329 - RNA, 32 nt, Human
uugggaucagccuggccaaugugguaaaaccu

SEQ ID NO: 275330 - RNA, 32 nt, Human
uugggaucuaacuguuguuacuggaagacgaa

SEQ ID NO: 275331 - RNA, 32 nt, Human
uugggaucuaccuugggucuuacuugaguucc

SEQ ID NO: 275332 - RNA, 32 nt, Human
uugggaucugagggguccucucugugcccauc

SEQ ID NO: 275333 - RNA, 32 nt, Human
uugggaucugccaggcugggguguuuucggua

SEQ ID NO: 275334 - RNA, 32 nt, Human
uugggaucuguucaccuucaggcugagucgag

SEQ ID NO: 275335 - RNA, 32 nt, Human
uugggaucuuguguuugggagccaugggggag

SEQ ID NO: 275336 - RNA, 32 nt, Human
uugggaugaucugcuucaccuccagucacaca

SEQ ID NO: 275337 - RNA, 32 nt, Human
uugggaugcaguuaaagcaguguugagggaaa

SEQ ID NO: 275338 - RNA, 32 nt, Human
uugggaugccaauauuucuguuguauuucuau

SEQ ID NO: 275339 - RNA, 32 nt, Human
uugggaugcccaggccgcagaggaagcugggc

SEQ ID NO: 275340 - RNA, 32 nt, Human
uugggaugcugaggcaggagaaucgcuugaau

SEQ ID NO: 275341 - RNA, 32 nt, Human
uugggauggcuacaggacagugcaguggagag

SEQ ID NO: 275342 - RNA, 31 nt, Human
uugggaugguccucugggcccugguccacac

SEQ ID NO: 275343 - RNA, 32 nt, Human
uugggaugguuucagaugcucagcuuuuccau

SEQ ID NO: 275344 - RNA, 32 nt, Human
uugggaugucaccaaaggcagagcagauggga

SEQ ID NO: 275345 - RNA, 32 nt, Human
uugggaugucaucuuccuggaagcagagcugg

SEQ ID NO: 275346 - RNA, 32 nt, Human
uugggauguggacagaggggcagggggcuggg

SEQ ID NO: 275347 - RNA, 32 nt, Human
uugggauguucagagcuugaaauaugacacaa

SEQ ID NO: 275348 - RNA, 22 nt, Human
uugggauguuucagcagccccu

SEQ ID NO: 275349 - RNA, 22 nt, Human
uugggauuacagacaugagcca

SEQ ID NO: 275350 - RNA, 22 nt, Human
uugggauuacagacauuagcca

SEQ ID NO: 275351 - RNA, 32 nt, Human
uugggauuacagccaugagccaccaugcccgg

SEQ ID NO: 275352 - RNA, 22 nt, Human
uugggauuacaggcacgagcca

SEQ ID NO: 275353 - RNA, 20 nt, Human
uugggauuacaggcauaagc

SEQ ID NO: 275354 - RNA, 22 nt, Human
uugggauuacaggcauaagcca

SEQ ID NO: 275355 - RNA, 22 nt, Human
uugggauuacaggcaucagcca

SEQ ID NO: 275356 - RNA, 22 nt, Human
uugggauuacaggcaugagcca

SEQ ID NO: 275357 - RNA, 22 nt, Human
uugggauuacaggcaugagcua

SEQ ID NO: 275358 - RNA, 19 nt, Human
uugggauuacaggcgugag

SEQ ID NO: 275359 - RNA, 22 nt, Human
uugggauuacaggcgugagcca

SEQ ID NO: 275360 - RNA, 22 nt, Human
uugggauuacaggcuugagcca

SEQ ID NO: 275361 - RNA, 22 nt, Human
uugggauuaccggcaugagcca

SEQ ID NO: 275362 - RNA, 32 nt, Human
uugggauuacggaauagagggagaagaggaaa

SEQ ID NO: 275363 - RNA, 32 nt, Human
uugggauuccgaggcggguggaucacaugagg

SEQ ID NO: 275364 - RNA, 22 nt, Human
uugggauugcaggcaugagcca

SEQ ID NO: 275365 - RNA, 32 nt, Human
uugggauugugugucuggggcaagugaccuua

SEQ ID NO: 275366 - RNA, 32 nt, Human
uugggauuucauuucaggugcauuggagauuc

SEQ ID NO: 275367 - RNA, 32 nt, Human
uugggauuucuggcagcacagaacugcuuuuu

SEQ ID NO: 275368 - RNA, 32 nt, Human
uugggauuugaacccagguaguugggcugcag

SEQ ID NO: 275369 - RNA, 32 nt, Human
uugggauuuucaucacagaggagugggagagg

SEQ ID NO: 275370 - RNA, 32 nt, Human
uugggcaaacccuggcucggagcccagggcag

SEQ ID NO: 275371 - RNA, 23 nt, Human
uugggcaacaaagcaagacccca

SEQ ID NO: 275372 - RNA, 23 nt, Human
uugggcaacauagcaagacccca

SEQ ID NO: 275373 - RNA, 32 nt, Human
uugggcaacauggagaaaccccaucuuuacca

SEQ ID NO: 275374 - RNA, 32 nt, Human
uugggcaacauggcaaaacccugucucuacua

SEQ ID NO: 275375 - RNA, 32 nt, Human
uugggcaacauggcaaaacccugucucuauua

SEQ ID NO: 275376 - RNA, 32 nt, Human
uugggcaacauggcaaagccccaucucuacaa

SEQ ID NO: 275377 - RNA, 32 nt, Human
uugggcaacauggcgaaaccccgucucuacua

SEQ ID NO: 275378 - RNA, 32 nt, Human
uugggcaacauggcgaaacccugccucuacaa

SEQ ID NO: 275379 - RNA, 32 nt, Human
uugggcaacauggugaaacacugucucuacau

SEQ ID NO: 275380 - RNA, 32 nt, Human
uugggcaacauggugaaacccugucuacuaaa

SEQ ID NO: 275381 - RNA, 32 nt, Human
uugggcaacauggugaaaccugucucuacuaa

SEQ ID NO: 275382 - RNA, 29 nt, Human
uugggcaacauggugaaacuucucuacaa

SEQ ID NO: 275383 - RNA, 32 nt, Human
uugggcaacaugguggagcccugucucuacag

SEQ ID NO: 275384 - RNA, 32 nt, Human
uugggcacaguccagacccaagucaaagaugc

SEQ ID NO: 275385 - RNA, 32 nt, Human
uugggcacccaggacuuugcucugccuggugg

SEQ ID NO: 275386 - RNA, 22 nt, Human
uugggcaccgcacggugcgcac

SEQ ID NO: 275387 - RNA, 32 nt, Human
uugggcaccuggcacucaagcacuuugcacga

SEQ ID NO: 275388 - RNA, 32 nt, Human
uugggcaccuguaaucccagcuacucuggagg

SEQ ID NO: 275389 - RNA, 32 nt, Human
uugggcacgagcugggcagacagcaggaucug

SEQ ID NO: 275390 - RNA, 32 nt, Human
uugggcacugcuguuuacagccuguguacucc

SEQ ID NO: 275391 - RNA, 32 nt, Human
uugggcacugucugcuaugaugaugccagcug

SEQ ID NO: 275392 - RNA, 32 nt, Human
uugggcacuucacagccagccuagggucuucg

SEQ ID NO: 275393 - RNA, 32 nt, Human
uugggcagagagaggcagggaggccagugagg

SEQ ID NO: 275394 - RNA, 32 nt, Human
uugggcagagcugagugugagaagauggaaaa

SEQ ID NO: 275395 - RNA, 32 nt, Human
uugggcagcagugcccucaccuacaaggugag

SEQ ID NO: 275396 - RNA, 32 nt, Human
uugggcagccccagagaugaggggucagcaga

SEQ ID NO: 275397 - RNA, 32 nt, Human
uugggcagccuggggucccaggaacaagccag

SEQ ID NO: 275398 - RNA, 32 nt, Human
uugggcagcgcuagauggcaggaagcagccuu

SEQ ID NO: 275399 - RNA, 32 nt, Human
uugggcaggaaccuguuguuucaggagccagu

SEQ ID NO: 275400 - RNA, 32 nt, Human
uugggcaggaggcgaagccaaugacgucaguc

SEQ ID NO: 275401 - RNA, 32 nt, Human
uugggcaggagucaccaugcaagggugacauc

SEQ ID NO: 275402 - RNA, 32 nt, Human
uugggcagggcuagcaacaucguagguguuua

SEQ ID NO: 275403 - RNA, 32 nt, Human
uugggcaggggcugcuggugcugcuuggguuu

SEQ ID NO: 275404 - RNA, 32 nt, Human
uugggcagguggugggagagcgucaggcuuga

SEQ ID NO: 275405 - RNA, 32 nt, Human
uugggcaguagauuuacuuucucagguauguu

SEQ ID NO: 275406 - RNA, 32 nt, Human
uugggcagugcucccacccacccuccagaucc

SEQ ID NO: 275407 - RNA, 32 nt, Human
uugggcaguggcagcagcaggaggaaguagca

SEQ ID NO: 275408 - RNA, 32 nt, Human
uugggcaguucugcagagaggauccuggcaac

SEQ ID NO: 275409 - RNA, 32 nt, Human
uugggcaucuccuuaauuucugcuacuaaaga

SEQ ID NO: 275410 - RNA, 31 nt, Human
uugggcaugaagccucaaggcuuaaggauca

SEQ ID NO: 275411 - RNA, 32 nt, Human
uugggcaugguggcacacaccuguaaucccag

SEQ ID NO: 275412 - RNA, 32 nt, Human
uugggcaugguggcucacgccuguaaucccag

SEQ ID NO: 275413 - RNA, 32 nt, Human
uugggcaugguggugagcaccuguaaucccag

SEQ ID NO: 275414 - RNA, 32 nt, Human
uugggcauggugguggacaccuguaaucccag

SEQ ID NO: 275415 - RNA, 32 nt, Human
uugggcauuaaauauaaaaauaacaguucuuc

SEQ ID NO: 275416 - RNA, 32 nt, Human
uugggccaaaccaugaggccaccagaaccgcg

SEQ ID NO: 275417 - RNA, 32 nt, Human
uugggccaagggcagagggggcugcaccugcg

SEQ ID NO: 275418 - RNA, 32 nt, Human
uugggccacaguagcuggagauauaaugccgg

SEQ ID NO: 275419 - RNA, 32 nt, Human
uugggccacugcaaagauuccagccugggucc

SEQ ID NO: 275420 - RNA, 18 nt, Human
uugggccacugcacucca

SEQ ID NO: 275421 - RNA, 32 nt, Human
uugggccacugcacuccacccugggcgacaga

SEQ ID NO: 275422 - RNA, 32 nt, Human
uugggccacugcacucuagccuggcaacagag

SEQ ID NO: 275423 - RNA, 32 nt, Human
uugggccacugcagucgagccugggcgacaca

SEQ ID NO: 275424 - RNA, 32 nt, Human
uugggccaggcagaagguccacauggcagggc

SEQ ID NO: 275425 - RNA, 32 nt, Human
uugggccagggugggagcagggaaagaaaagg

SEQ ID NO: 275426 - RNA, 32 nt, Human
uugggccagggugggaggauggguggucaggu

SEQ ID NO: 275427 - RNA, 32 nt, Human
uugggccaguacgacuucuaaggaaucauagu

SEQ ID NO: 275428 - RNA, 32 nt, Human
uugggccaugaccagauauaauuggugauuac

SEQ ID NO: 275429 - RNA, 32 nt, Human
uugggccauuggugcaugcacauauauuaacu

SEQ ID NO: 275430 - RNA, 32 nt, Human
uugggcccaagaguucgagaccagccugggca

SEQ ID NO: 275431 - RNA, 32 nt, Human
uugggcccagcuuuucccuugugguggccucu

SEQ ID NO: 275432 - RNA, 32 nt, Human
uugggcccaggagauggagguugcggugagug

SEQ ID NO: 275433 - RNA, 32 nt, Human
uugggcccaggagauugagaccagccugggca

SEQ ID NO: 275434 - RNA, 32 nt, Human
uugggcccaggaggucgaggcugcggugagcc

SEQ ID NO: 275435 - RNA, 32 nt, Human
uugggcccaggagguggagguugcagugagcc

SEQ ID NO: 275436 - RNA, 32 nt, Human
uugggcccaggaguucaacgcugcagugagcu

SEQ ID NO: 275437 - RNA, 32 nt, Human
uugggcccaggaguucaaggcugcagugagcu

SEQ ID NO: 275438 - RNA, 32 nt, Human
uugggcccaggaguuugaggcugcagugagcc

SEQ ID NO: 275439 - RNA, 32 nt, Human
uugggcccaggucuugagcucuuuuggcucca

SEQ ID NO: 275440 - RNA, 32 nt, Human
uugggcccagugccuuggugaagguugauuac

SEQ ID NO: 275441 - RNA, 32 nt, Human
uugggccccagcccaaggguggagagggggcc

SEQ ID NO: 275442 - RNA, 32 nt, Human
uugggccccagcuggccagccuggcgaugggg

SEQ ID NO: 275443 - RNA, 32 nt, Human
uugggccccauccugagucuccaggacccaag

SEQ ID NO: 275444 - RNA, 20 nt, Human
uugggcccgggaggucaagg

SEQ ID NO: 275445 - RNA, 32 nt, Human
uugggcccgggaggucaagguugcagugagcu

SEQ ID NO: 275446 - RNA, 32 nt, Human
uugggcccgggagguggagguugcagugagcu

SEQ ID NO: 275447 - RNA, 32 nt, Human
uugggcccgggagguggagguugcagugaguc

SEQ ID NO: 275448 - RNA, 32 nt, Human
uugggcccgggaguuugaaguugcagugagcu

SEQ ID NO: 275449 - RNA, 32 nt, Human
uugggcccuggaggucaaggcugcagugaguc

SEQ ID NO: 275450 - RNA, 20 nt, Human
uugggcccugggaagcgugg

SEQ ID NO: 275451 - RNA, 19 nt, Human
uugggcccugggaagcugg

SEQ ID NO: 275452 - RNA, 32 nt, Human
uugggcccuucccugcuauccuuuuucuccuu

SEQ ID NO: 275453 - RNA, 32 nt, Human
uugggccggcgggcgggggcugaggggcugcc

SEQ ID NO: 275454 - RNA, 32 nt, Human
uugggccucgugagggaucugccuccugagca

SEQ ID NO: 275455 - RNA, 32 nt, Human
uugggccucucaaaaggaaaugcuuuuguuua

SEQ ID NO: 275456 - RNA, 32 nt, Human
uugggccucugccucugugccuauggguugca

SEQ ID NO: 275457 - RNA, 32 nt, Human
uugggccugcaccuccaagauaacaaagaaga

SEQ ID NO: 275458 - RNA, 32 nt, Human
uugggccugccuggcaugacuguuuccagcag

SEQ ID NO: 275459 - RNA, 19 nt, Human
uugggccuggccacucuga

SEQ ID NO: 275460 - RNA, 32 nt, Human
uugggccugggaggucgaggcugcagugagcu

SEQ ID NO: 275461 - RNA, 32 nt, Human
uugggccugggauaaguccacucuccacacau

SEQ ID NO: 275462 - RNA, 21 nt, Human
uugggccuggucucugcugcu

SEQ ID NO: 275463 - RNA, 32 nt, Human
uugggccuggugccaccaucgcucagcccagg

SEQ ID NO: 275464 - RNA, 32 nt, Human
uugggccuggugcugggaaccugcuagcugag

SEQ ID NO: 275465 - RNA, 32 nt, Human
uugggccuuagcaccugcagugccucaaagcc

SEQ ID NO: 275466 - RNA, 32 nt, Human
uugggccuuagguugagcugaugggggaagga

SEQ ID NO: 275467 - RNA, 32 nt, Human
uugggccuuaucagcccaucugauccagauca

SEQ ID NO: 275468 - RNA, 19 nt, Human
uugggccuucgaccugggg

SEQ ID NO: 275469 - RNA, 32 nt, Human
uugggccuugagagacagagaaaacagguauc

SEQ ID NO: 275470 - RNA, 32 nt, Human
uugggcgaacuguacuccaugugaauuaccuc

SEQ ID NO: 275471 - RNA, 32 nt, Human
uugggcgaggggcagaggccaucagaacugcc

SEQ ID NO: 275472 - RNA, 32 nt, Human
uugggcgccguggcucacaccuguaauccuag

SEQ ID NO: 275473 - RNA, 32 nt, Human
uugggcgccuggucagggagguuuguacaagc

SEQ ID NO: 275474 - RNA, 32 nt, Human
uugggcgccuguaaucccagcuacuggggagg

SEQ ID NO: 275475 - RNA, 32 nt, Human
uugggcgcgguggcucgcaccuguaaucccag

SEQ ID NO: 275476 - RNA, 32 nt, Human
uugggcggcggcgagcgcgcgggccgccaugu

SEQ ID NO: 275477 - RNA, 32 nt, Human
uugggcgugauucacaccuggcccaacaaacu

SEQ ID NO: 275478 - RNA, 32 nt, Human
uugggcgugguggcgugcgccuguaaucucag

SEQ ID NO: 275479 - RNA, 32 nt, Human
uugggcgugguggcucaugccuguaaucccac

SEQ ID NO: 275480 - RNA, 32 nt, Human
uugggcguuguggcucaugccuguaaucccag

SEQ ID NO: 275481 - RNA, 32 nt, Human
uugggcuagaggcaggaaggaagugggaugac

SEQ ID NO: 275482 - RNA, 32 nt, Human
uugggcuaggguagugguaugagguuuaaaac

SEQ ID NO: 275483 - RNA, 32 nt, Human
uugggcucaagaguucaagaccagucugggca

SEQ ID NO: 275484 - RNA, 32 nt, Human
uugggcucaagcaauccuccugccucagccuc

SEQ ID NO: 275485 - RNA, 32 nt, Human
uugggcucaagcgauccucccaccugggacuc

SEQ ID NO: 275486 - RNA, 32 nt, Human
uugggcucaagcuauccucccaccucagccuc

SEQ ID NO: 275487 - RNA, 32 nt, Human
uugggcucaagugauccucccaccucagccuc

SEQ ID NO: 275488 - RNA, 32 nt, Human
uugggcucaagugauccucccgccucagccuc

SEQ ID NO: 275489 - RNA, 32 nt, Human
uugggcucaagugauccuccuaccugagccuu

SEQ ID NO: 275490 - RNA, 32 nt, Human
uugggcucaaugauucuccugucucagccucc

SEQ ID NO: 275491 - RNA, 32 nt, Human
uugggcucaggagcuugagaccagccugagca

SEQ ID NO: 275492 - RNA, 32 nt, Human
uugggcucaggagucggagaccagccugggca

SEQ ID NO: 275493 - RNA, 32 nt, Human
uugggcucaggccacaacggccugagauugcc

SEQ ID NO: 275494 - RNA, 32 nt, Human
uugggcucccaaagugcugggauuacagaugu

SEQ ID NO: 275495 - RNA, 32 nt, Human
uugggcucccaaagugcugggauuauaggugu

SEQ ID NO: 275496 - RNA, 32 nt, Human
uugggcucccaaaguguugggauuacaggcgu

SEQ ID NO: 275497 - RNA, 32 nt, Human
uugggcucccaaaguguugggauuacaggugu

SEQ ID NO: 275498 - RNA, 32 nt, Human
uugggcucccccaaggguucugcgaagaggca

SEQ ID NO: 275499 - RNA, 32 nt, Human
uugggcuccuaagcuccugcucugcugggugc

SEQ ID NO: 275500 - RNA, 32 nt, Human
uugggcuccuaccugcugaagccaguccagcg

SEQ ID NO: 275501 - RNA, 32 nt, Human
uugggcuccuccugcccuccaucucagccauu

SEQ ID NO: 275502 - RNA, 32 nt, Human
uugggcuccugcagugauggugggaaagaaaa

SEQ ID NO: 275503 - RNA, 18 nt, Human
uugggcucgggaagccgg

SEQ ID NO: 275504 - RNA, 23 nt, Human
uugggcucuagcuccuggugcug

SEQ ID NO: 275505 - RNA, 32 nt, Human
uugggcucucaccacuucaguuuauaccuugc

SEQ ID NO: 275506 - RNA, 32 nt, Human
uugggcucucagaugaaggcaaagcuuugauc

SEQ ID NO: 275507 - RNA, 32 nt, Human
uugggcucucagcagccucuucugccagcacc

SEQ ID NO: 275508 - RNA, 32 nt, Human
uugggcucuccccagggucuaacgguuaaggg

SEQ ID NO: 275509 - RNA, 32 nt, Human
uugggcucucuucugucccagggcuuucugga

SEQ ID NO: 275510 - RNA, 32 nt, Human
uugggcucugaggaaauguccauagcuuuggu

SEQ ID NO: 275511 - RNA, 32 nt, Human
uugggcugaagcacccagccuggucaaggaca

SEQ ID NO: 275512 - RNA, 32 nt, Human
uugggcugaaggagauaacuuauuaucugucg

SEQ ID NO: 275513 - RNA, 32 nt, Human
uugggcugaaucuccuuccucccacuggcucc

SEQ ID NO: 275514 - RNA, 32 nt, Human
uugggcugagaacugaagggugagugaaugag

SEQ ID NO: 275515 - RNA, 32 nt, Human
uugggcugcacugagcuugucuucaggaaacc

SEQ ID NO: 275516 - RNA, 32 nt, Human
uugggcugcccaggcuggucagagcucagcac

SEQ ID NO: 275517 - RNA, 32 nt, Human
uugggcugcugaggggcuagugcagugguccu

SEQ ID NO: 275518 - RNA, 32 nt, Human
uugggcuggggaggggauuucaagauaguuca

SEQ ID NO: 275519 - RNA, 32 nt, Human
uugggcuggggccaugggaagaaaccauugug

SEQ ID NO: 275520 - RNA, 32 nt, Human
uugggcuggguauggagguucacugguaaucc

SEQ ID NO: 275521 - RNA, 32 nt, Human
uugggcuggugaguuuucgaggugacugugcu

SEQ ID NO: 275522 - RNA, 32 nt, Human
uugggcuguggggcuguaccuggugcccugug

SEQ ID NO: 275523 - RNA, 32 nt, Human
uugggcugugguggaaaaaugagggcuggagc

SEQ ID NO: 275524 - RNA, 32 nt, Human
uugggcuuaaugauggagaaaaaguguacccu

SEQ ID NO: 275525 - RNA, 32 nt, Human
uugggcuuacagagcaagaccccacaacugua

SEQ ID NO: 275526 - RNA, 32 nt, Human
uugggcuucccugagagcagaucuucagagaa

SEQ ID NO: 275527 - RNA, 24 nt, Human
uugggcuuccucauaaguauggug

SEQ ID NO: 275528 - RNA, 32 nt, Human
uugggcuucuuccuccuccaucaccugaaaca

SEQ ID NO: 275529 - RNA, 32 nt, Human
uugggcuugcccacccuaguuugcuuuuguag

SEQ ID NO: 275530 - RNA, 32 nt, Human
uugggcuugggccugggucuuugcugccaggu

SEQ ID NO: 275531 - RNA, 32 nt, Human
uugggcuuggggcagugagggcuuaggacacc

SEQ ID NO: 275532 - RNA, 32 nt, Human
uugggcuuucugcuuuacuucccuccuaacau

SEQ ID NO: 275533 - RNA, 32 nt, Human
uugggcuuugcugugggcaccugcacuggcau

SEQ ID NO: 275534 - RNA, 32 nt, Human
uugggcuuugguacaagaacugugacccccaa

SEQ ID NO: 275535 - RNA, 22 nt, Human
uuggggaaaaaagccuucaaag

SEQ ID NO: 275536 - RNA, 32 nt, Human
uuggggaaaacugcagcccggccaggcagcug

SEQ ID NO: 275537 - RNA, 22 nt, Human
uuggggaaaaugggaaaagcaa

SEQ ID NO: 275538 - RNA, 32 nt, Human
uuggggaaaauguuaugcauggaagccugacc

SEQ ID NO: 275539 - RNA, 32 nt, Human
uuggggaaacucaaccuggugcuggugcucuu

SEQ ID NO: 275540 - RNA, 32 nt, Human
uuggggaaagagaagagaauuuccuguggauu

SEQ ID NO: 275541 - RNA, 32 nt, Human
uuggggaaagagaccuuuaaaaucuuguggug

SEQ ID NO: 275542 - RNA, 22 nt, Human
uuggggaaagugaaaaauguaa

SEQ ID NO: 275543 - RNA, 32 nt, Human
uuggggaagagggagugaggccuaggcagcuu

SEQ ID NO: 275544 - RNA, 32 nt, Human
uuggggaagcccagggugaagacagucacuca

SEQ ID NO: 275545 - RNA, 32 nt, Human
uuggggaagcccaucuaacaggaggacauugg

SEQ ID NO: 275546 - RNA, 23 nt, Human
uuggggaaggacggaggacacag

SEQ ID NO: 275547 - RNA, 19 nt, Human
uuggggaaggcgacugagc

SEQ ID NO: 275548 - RNA, 32 nt, Human
uuggggaagggaaggagccaggaagccgcgcg

SEQ ID NO: 275549 - RNA, 32 nt, Human
uuggggaagggagggcaggguggggcugagga

SEQ ID NO: 275550 - RNA, 32 nt, Human
uuggggaagggccaugaccacccucguagacu

SEQ ID NO: 275551 - RNA, 24 nt, Human
uuggggaagguguuuuuaguacaa

SEQ ID NO: 275552 - RNA, 32 nt, Human
uuggggaagugucugcugagaauaucaagggg

SEQ ID NO: 275553 - RNA, 32 nt, Human
uuggggacaaugcucaggcaggaccaauccaa

SEQ ID NO: 275554 - RNA, 32 nt, Human
uuggggacacauaccccucaguacuguagcau

SEQ ID NO: 275555 - RNA, 32 nt, Human
uuggggacacuggcagcaguugccagguuuua

SEQ ID NO: 275556 - RNA, 32 nt, Human
uuggggacagggacuguguccaugaaacauuc

SEQ ID NO: 275557 - RNA, 32 nt, Human
uuggggaccacaggccugaccagggccugcac

SEQ ID NO: 275558 - RNA, 32 nt, Human
uuggggaccauggucugggagcuguucugggg

SEQ ID NO: 275559 - RNA, 32 nt, Human
uuggggacccuucucugaucaucaggauucuc

SEQ ID NO: 275560 - RNA, 32 nt, Human
uuggggaccuuugccuacauacugguauuguc

SEQ ID NO: 275561 - RNA, 32 nt, Human
uuggggacgcacauacuccuucacaagugcaa

SEQ ID NO: 275562 - RNA, 32 nt, Human
uuggggacuuaaucauguacauggacaagugu

SEQ ID NO: 275563 - RNA, 32 nt, Human
uuggggacuugagucccugaaaggcugauuga

SEQ ID NO: 275564 - RNA, 32 nt, Human
uuggggagagauagggugggaggcagggcaau

SEQ ID NO: 275565 - RNA, 32 nt, Human
uuggggagaugggguggccugcagugacacag

SEQ ID NO: 275566 - RNA, 32 nt, Human
uuggggagccucucagccucuggcaggggagg

SEQ ID NO: 275567 - RNA, 32 nt, Human
uuggggagcggucuaugugaccaaauauugug

SEQ ID NO: 275568 - RNA, 32 nt, Human
uuggggagcuugcccuuuaccuccagggcugc

SEQ ID NO: 275569 - RNA, 32 nt, Human
uuggggaggaagacgaagaggcacugcauuau

SEQ ID NO: 275570 - RNA, 32 nt, Human
uuggggaggcaagagacugggagccacuucuc

SEQ ID NO: 275571 - RNA, 32 nt, Human
uuggggaggcggagguugcagugagcugagau

SEQ ID NO: 275572 - RNA, 32 nt, Human
uuggggagggcuggaagaggaggacggucauc

SEQ ID NO: 275573 - RNA, 32 nt, Human
uuggggaggggagggggcgccuuguucucccu

SEQ ID NO: 275574 - RNA, 32 nt, Human
uuggggagguuuccagcucagaaugaugcaga

SEQ ID NO: 275575 - RNA, 32 nt, Human
uuggggagucccagagguauccagcagagggg

SEQ ID NO: 275576 - RNA, 32 nt, Human
uuggggagugugaauaggaguuugcagaugga

SEQ ID NO: 275577 - RNA, 32 nt, Human
uuggggauaaacacuucaacuuuuggcagaaa

SEQ ID NO: 275578 - RNA, 32 nt, Human
uuggggauggagucucacuuuguugcccaggc

SEQ ID NO: 275579 - RNA, 32 nt, Human
uuggggaugggcugggagugacaguagccuag

SEQ ID NO: 275580 - RNA, 32 nt, Human
uuggggauggggugggcugggguggauggaug

SEQ ID NO: 275581 - RNA, 22 nt, Human
uuggggauugcagcguucucga

SEQ ID NO: 275582 - RNA, 32 nt, Human
uuggggauuuacguuccuaacugcuaagcaac

SEQ ID NO: 275583 - RNA, 20 nt, Human
uuggggcaauuuccagugga

SEQ ID NO: 275584 - RNA, 32 nt, Human
uuggggcacagccugucacugcucugccuaag

SEQ ID NO: 275585 - RNA, 32 nt, Human
uuggggcacccuccucucagcaccaaaauggc

SEQ ID NO: 275586 - RNA, 32 nt, Human
uuggggcaccucagcucuggaugcuaccccug

SEQ ID NO: 275587 - RNA, 32 nt, Human
uuggggcagacagcacuggcccagggaugcua

SEQ ID NO: 275588 - RNA, 19 nt, Human
uuggggcagagccagugga

SEQ ID NO: 275589 - RNA, 32 nt, Human
uuggggcagccucuuguuccagccucuuggaa

SEQ ID NO: 275590 - RNA, 32 nt, Human
uuggggcagcuuuccgguuauauaacacauug

SEQ ID NO: 275591 - RNA, 32 nt, Human
uuggggcaggcaggagcagugugguaguacug

SEQ ID NO: 275592 - RNA, 32 nt, Human
uuggggcaggguggugggguaggugcauggga

SEQ ID NO: 275593 - RNA, 32 nt, Human
uuggggcagugggcucucugcccacacuugga

SEQ ID NO: 275594 - RNA, 32 nt, Human
uuggggcaguggugacgagcugugggaagagc

SEQ ID NO: 275595 - RNA, 18 nt, Human
uuggggcauaccaaccuu

SEQ ID NO: 275596 - RNA, 22 nt, Human
uuggggcauccccuuucugcug

SEQ ID NO: 275597 - RNA, 21 nt, Human
uuggggcaugcccugggcacc

SEQ ID NO: 275598 - RNA, 32 nt, Human
uuggggcauuugaaggauggcuucccuguuuc

SEQ ID NO: 275599 - RNA, 32 nt, Human
uuggggccacauuuaccagggauccccacuau

SEQ ID NO: 275600 - RNA, 32 nt, Human
uuggggccagaacuccagcccuggggaguggg

SEQ ID NO: 275601 - RNA, 32 nt, Human
uuggggccaggccauguuacaaaggauauuga

SEQ ID NO: 275602 - RNA, 32 nt, Human
uuggggcccagaggaagcugaugucauggcug

SEQ ID NO: 275603 - RNA, 32 nt, Human
uuggggcccagcugcagccugcugccugcccu

SEQ ID NO: 275604 - RNA, 32 nt, Human
uuggggcccagcugcccacugucuggguucag

SEQ ID NO: 275605 - RNA, 32 nt, Human
uuggggcccaugggaucauucugggaugcagc

SEQ ID NO: 275606 - RNA, 32 nt, Human
uuggggcccccagacaagagacagggagacug

SEQ ID NO: 275607 - RNA, 32 nt, Human
uuggggccccgggagagcaggagaaccggggu

SEQ ID NO: 275608 - RNA, 32 nt, Human
uuggggccccucuccuccccagcccuucuccu

SEQ ID NO: 275609 - RNA, 22 nt, Human
uuggggccccugucugcugcug

SEQ ID NO: 275610 - RNA, 24 nt, Human
uuggggcccucuugccagccuccu

SEQ ID NO: 275611 - RNA, 32 nt, Human
uuggggccuaucugccauugcaggaccugauu

SEQ ID NO: 275612 - RNA, 32 nt, Human
uuggggccuccccuuuccccagcgucuggcaa

SEQ ID NO: 275613 - RNA, 32 nt, Human
uuggggccugggaacgcucggcccccggcagc

SEQ ID NO: 275614 - RNA, 32 nt, Human
uuggggccugggacucagcucucucugcggua

SEQ ID NO: 275615 - RNA, 32 nt, Human
uuggggcgcugaggguggggccugugucagaa

SEQ ID NO: 275616 - RNA, 32 nt, Human
uuggggcggaguuucacucuuguugcccaggc

SEQ ID NO: 275617 - RNA, 32 nt, Human
uuggggcuacuuccugugcugaaggaaguccu

SEQ ID NO: 275618 - RNA, 32 nt, Human
uuggggcuagggguucgagaccagccugguca

SEQ ID NO: 275619 - RNA, 24 nt, Human
uuggggcucagcuccuaccccucu

SEQ ID NO: 275620 - RNA, 32 nt, Human
uuggggcucauuuugauucucugaauuaucgg

SEQ ID NO: 275621 - RNA, 32 nt, Human
uuggggcuccagggacguaccccaaauguugc

SEQ ID NO: 275622 - RNA, 32 nt, Human
uuggggcucccaccuuccccagacuacuguuc

SEQ ID NO: 275623 - RNA, 22 nt, Human
uuggggcuccgcgauacaguua

SEQ ID NO: 275624 - RNA, 24 nt, Human
uuggggcucuugaucagugugcua

SEQ ID NO: 275625 - RNA, 32 nt, Human
uuggggcugagcugcaaccacccaacuuucuu

SEQ ID NO: 275626 - RNA, 32 nt, Human
uuggggcugagggagcaccaugcagcuucacc

SEQ ID NO: 275627 - RNA, 32 nt, Human
uuggggcugaggggaaggaggagaagcuccug

SEQ ID NO: 275628 - RNA, 32 nt, Human
uuggggcugcagcugcacacuguccuugucca

SEQ ID NO: 275629 - RNA, 32 nt, Human
uuggggcugcgaccuccagacucuccauuaag

SEQ ID NO: 275630 - RNA, 32 nt, Human
uuggggcugcgggggaguggagcccccgugcc

SEQ ID NO: 275631 - RNA, 32 nt, Human
uuggggcugcucauguuggggcucuuccucua

SEQ ID NO: 275632 - RNA, 32 nt, Human
uuggggcugggggccagcuccaggagggcuug

SEQ ID NO: 275633 - RNA, 32 nt, Human
uuggggcuguggauuuagcuacucucaccuga

SEQ ID NO: 275634 - RNA, 20 nt, Human
uuggggcuuagcccagagga

SEQ ID NO: 275635 - RNA, 32 nt, Human
uuggggcuuagggagaggagggaggcaugccu

SEQ ID NO: 275636 - RNA, 20 nt, Human
uuggggcuucaggggaggug

SEQ ID NO: 275637 - RNA, 32 nt, Human
uuggggcuucccugccccuccuggucuguguc

SEQ ID NO: 275638 - RNA, 26 nt, Human
uuggggcuuucagucagcagccuccu

SEQ ID NO: 275639 - RNA, 21 nt, Human
uuggggcuuuuuggcaguggg

SEQ ID NO: 275640 - RNA, 32 nt, Human
uugggggaaaacagucaaccucccaguguaaa

SEQ ID NO: 275641 - RNA, 32 nt, Human
uugggggaaaagccaccccuggagucaccugu

SEQ ID NO: 275642 - RNA, 32 nt, Human
uugggggaaacugaggcaguggggaagacaga

SEQ ID NO: 275643 - RNA, 32 nt, Human
uugggggaagagcuccagccugucugcucccc

SEQ ID NO: 275644 - RNA, 32 nt, Human
uugggggacgcuggcagcuggguucucccggu

SEQ ID NO: 275645 - RNA, 32 nt, Human
uugggggagaaaggaaugggagcccagacagc

SEQ ID NO: 275646 - RNA, 32 nt, Human
uugggggagaagcagcauugaagugggaagau

SEQ ID NO: 275647 - RNA, 32 nt, Human
uugggggagacagggucuugcucugucaccca

SEQ ID NO: 275648 - RNA, 32 nt, Human
uugggggagagggggaccugggaccugcggcu

SEQ ID NO: 275649 - RNA, 32 nt, Human
uugggggagcccagagacaggggaaggcagcc

SEQ ID NO: 275650 - RNA, 32 nt, Human
uugggggaggagggaaagauuagcuuugaaca

SEQ ID NO: 275651 - RNA, 32 nt, Human
uugggggaggcagagccagcagguggacaggu

SEQ ID NO: 275652 - RNA, 32 nt, Human
uugggggaggcagagguggcacuggaggccuc

SEQ ID NO: 275653 - RNA, 19 nt, Human
uugggggaggcgggugcag

SEQ ID NO: 275654 - RNA, 32 nt, Human
uugggggaggucuugcuauguugcccaggcug

SEQ ID NO: 275655 - RNA, 32 nt, Human
uugggggagugaaggcagagccuggugcagau

SEQ ID NO: 275656 - RNA, 32 nt, Human
uugggggauagaggaacggucacagcuaggga

SEQ ID NO: 275657 - RNA, 21 nt, Human
uugggggaugccugggacuuu

SEQ ID NO: 275658 - RNA, 32 nt, Human
uugggggauucgacagcagugacagaucagug

SEQ ID NO: 275659 - RNA, 32 nt, Human
uugggggauugaagcaggcggaucacuugagc

SEQ ID NO: 275660 - RNA, 18 nt, Human
uugggggauugagcagca

SEQ ID NO: 275661 - RNA, 32 nt, Human
uugggggcaaaaacaacugcucaccaaucuua

SEQ ID NO: 275662 - RNA, 32 nt, Human
uugggggcagagcggggcaggaaagguagggc

SEQ ID NO: 275663 - RNA, 32 nt, Human
uugggggcaggagagagacacucuccaugaac

SEQ ID NO: 275664 - RNA, 32 nt, Human
uugggggcagggacucugucuugcuuaccauu

SEQ ID NO: 275665 - RNA, 32 nt, Human
uugggggcauggagggagacugaggcagggug

SEQ ID NO: 275666 - RNA, 32 nt, Human
uugggggccagccugagccagcagugggaggu

SEQ ID NO: 275667 - RNA, 32 nt, Human
uugggggccuuucuuuaacugccuuccuggcu

SEQ ID NO: 275668 - RNA, 32 nt, Human
uugggggcgaagcuguguugacugggagagcg

SEQ ID NO: 275669 - RNA, 32 nt, Human
uugggggcgcuaucuggggcugugcugcuugu

SEQ ID NO: 275670 - RNA, 32 nt, Human
uugggggcgcucaggguuacacugccugcagc

SEQ ID NO: 275671 - RNA, 32 nt, Human
uugggggcggggagcaggcggugcaggagagc

SEQ ID NO: 275672 - RNA, 32 nt, Human
uugggggcucagaugggacaagaagccgccuc

SEQ ID NO: 275673 - RNA, 32 nt, Human
uugggggcucccagggucuccgguggugcacc

SEQ ID NO: 275674 - RNA, 32 nt, Human
uuggggguccccgagcccauggaccaggaaga

SEQ ID NO: 275675 - RNA, 29 nt, Human
uugggggucugcucugugccugggaucag

SEQ ID NO: 275676 - RNA, 32 nt, Human
uugggggugaaacuuuccaguuuacugaacuc

SEQ ID NO: 275677 - RNA, 32 nt, Human
uugggggugaugaccccuucccugagguggcu

SEQ ID NO: 275678 - RNA, 32 nt, Human
uugggggugcuaauccaggacagcauuacacg

SEQ ID NO: 275679 - RNA, 32 nt, Human
uuggggguggaguaagggggagacugaugcua

SEQ ID NO: 275680 - RNA, 32 nt, Human
uugggggugggaacuccccuugcccugugcgg

SEQ ID NO: 275681 - RNA, 32 nt, Human
uuggggguggguggggagcuuuuggggaggac

SEQ ID NO: 275682 - RNA, 32 nt, Human
uuggggguggguggguggauaucuuaauuuuu

SEQ ID NO: 275683 - RNA, 32 nt, Human
uuggggguggucagacaccacaggagcuguca

SEQ ID NO: 275684 - RNA, 32 nt, Human
uuggggguguacuguccugccugugcaucuuc

SEQ ID NO: 275685 - RNA, 32 nt, Human
uuggggguuguuuucuacauaauugugaaaac

SEQ ID NO: 275686 - RNA, 32 nt, Human
uugggguacugcuggccagggguaggauagua

SEQ ID NO: 275687 - RNA, 32 nt, Human
uugggguagggaagggaggggaagcacuuuaa

SEQ ID NO: 275688 - RNA, 32 nt, Human
uugggguaucacacaaaacaccagagcugagg

SEQ ID NO: 275689 - RNA, 32 nt, Human
uuggggucaagccauccucccaccucagcuuu

SEQ ID NO: 275690 - RNA, 32 nt, Human
uuggggucagcccuucuguacgugcauggcag

SEQ ID NO: 275691 - RNA, 32 nt, Human
uuggggucauggggaggguagcaccaggcaua

SEQ ID NO: 275692 - RNA, 32 nt, Human
uuggggucauuuuucuuaaagacgagcuguaa

SEQ ID NO: 275693 - RNA, 22 nt, Human
uuggggucugucuguacaguua

SEQ ID NO: 275694 - RNA, 32 nt, Human
uuggggugaaaccaugagacugacagaucugc

SEQ ID NO: 275695 - RNA, 32 nt, Human
uuggggugacuggccauggugacauuguggac

SEQ ID NO: 275696 - RNA, 32 nt, Human
uuggggugaggaagagggagggauggacaagu

SEQ ID NO: 275697 - RNA, 32 nt, Human
uuggggugaggggagcaagggaagcacuggau

SEQ ID NO: 275698 - RNA, 32 nt, Human
uuggggugaguauaaagaggaauuagaaccug

SEQ ID NO: 275699 - RNA, 29 nt, Human
uuggggugcaggugugugccaggggucuu

SEQ ID NO: 275700 - RNA, 32 nt, Human
uuggggugcggggacuguagggggaggauuug

SEQ ID NO: 275701 - RNA, 32 nt, Human
uuggggugcucaggcugggaggguagaaugcc

SEQ ID NO: 275702 - RNA, 32 nt, Human
uuggggugcugaggcaggagaaucaacugaac

SEQ ID NO: 275703 - RNA, 32 nt, Human
uugggguggaguuuccucugugaggggcuugc

SEQ ID NO: 275704 - RNA, 31 nt, Human
uugggguggcacuucucaauuccucuuuaua

SEQ ID NO: 275705 - RNA, 32 nt, Human
uugggguggcuucucuccuuccuccucccaua

SEQ ID NO: 275706 - RNA, 32 nt, Human
uuggggugggagauggggaacaggcagugagg

SEQ ID NO: 275707 - RNA, 32 nt, Human
uuggggugggaggauggaugcaacugaagcag

SEQ ID NO: 275708 - RNA, 32 nt, Human
uuggggugggcaaggcagucagcaucaccagc

SEQ ID NO: 275709 - RNA, 32 nt, Human
uugggguggggaaaggggcaaaaagaaugauc

SEQ ID NO: 275710 - RNA, 31 nt, Human
uuggggugggugggaggauucgugagcugca

SEQ ID NO: 275711 - RNA, 32 nt, Human
uugggguggucagugcccucugugcuuuaugg

SEQ ID NO: 275712 - RNA, 32 nt, Human
uugggguguacaccuacaccauuaucuuggaa

SEQ ID NO: 275713 - RNA, 32 nt, Human
uuggggugugagagguuuucucgcucuaggga

SEQ ID NO: 275714 - RNA, 32 nt, Human
uuggggugugcacauccaggaggaggaggaga

SEQ ID NO: 275715 - RNA, 32 nt, Human
uugggguguuguacccagcccuaggaguaggg

SEQ ID NO: 275716 - RNA, 32 nt, Human
uugggguuagcauugcacaaagcccaguuucu

SEQ ID NO: 275717 - RNA, 32 nt, Human
uugggguuauuggagccugagcuugaccucaa

SEQ ID NO: 275718 - RNA, 22 nt, Human
uugggguucacaccccaaaaug

SEQ ID NO: 275719 - RNA, 32 nt, Human
uugggguucagggagaggcaggugcaugcugg

SEQ ID NO: 275720 - RNA, 19 nt, Human
uugggguucucgcagugga

SEQ ID NO: 275721 - RNA, 32 nt, Human
uugggguugcaacaucuuuuaacuucucaguu

SEQ ID NO: 275722 - RNA, 31 nt, Human
uugggguugcaugagagaugggugagucaug

SEQ ID NO: 275723 - RNA, 32 nt, Human
uugggguugcccagccuggagcggagcuugcc

SEQ ID NO: 275724 - RNA, 32 nt, Human
uugggguuggggaagcuagaaaaagaaauggg

SEQ ID NO: 275725 - RNA, 32 nt, Human
uugggguugugguugaugcagugugggauguc

SEQ ID NO: 275726 - RNA, 17 nt, Human
uugggguuucccaagug

SEQ ID NO: 275727 - RNA, 20 nt, Human
uugggguuuccugaaguggg

SEQ ID NO: 275728 - RNA, 21 nt, Human
uugggguuucgggagcaggga

SEQ ID NO: 275729 - RNA, 21 nt, Human
uugggguuucuuccuccagug

SEQ ID NO: 275730 - RNA, 19 nt, Human
uugggguuuggacagagga

SEQ ID NO: 275731 - RNA, 21 nt, Human
uugggguuuucuucccagcgg

SEQ ID NO: 275732 - RNA, 18 nt, Human
uugggguuuugccaggga

SEQ ID NO: 275733 - RNA, 25 nt, Human
uugggguuuuuggugcaugcaguug

SEQ ID NO: 275734 - RNA, 32 nt, Human
uuggguaaaccagcucugaacuuccaagcucc

SEQ ID NO: 275735 - RNA, 18 nt, Human
uuggguacauggcccgca

SEQ ID NO: 275736 - RNA, 32 nt, Human
uuggguacuguguuacugccugggugguagga

SEQ ID NO: 275737 - RNA, 23 nt, Human
uuggguagaugcguagcucuuca

SEQ ID NO: 275738 - RNA, 32 nt, Human
uuggguagccauuuauugacuucaccuuuuug

SEQ ID NO: 275739 - RNA, 32 nt, Human
uuggguagggaguggagcuggggaggggccca

SEQ ID NO: 275740 - RNA, 32 nt, Human
uuggguagucuuucaugugaaaaggcucacaa

SEQ ID NO: 275741 - RNA, 32 nt, Human
uuggguauaugcaguaugcuacccacagcguc

SEQ ID NO: 275742 - RNA, 32 nt, Human
uuggguaucugaggugucacacauccuugcca

SEQ ID NO: 275743 - RNA, 28 nt, Human
uugggucaaagugcugccuuuaaucgac

SEQ ID NO: 275744 - RNA, 32 nt, Human
uugggucacugcaaacuccgccucccagguuc

SEQ ID NO: 275745 - RNA, 32 nt, Human
uugggucaggaguucaagacuagccuggccaa

SEQ ID NO: 275746 - RNA, 32 nt, Human
uugggucagguuagcaugggguugugguugaa

SEQ ID NO: 275747 - RNA, 31 nt, Human
uugggucaguuucaguugauaccuccucacu

SEQ ID NO: 275748 - RNA, 32 nt, Human
uugggucauagaaauucuuuauacauucuaga

SEQ ID NO: 275749 - RNA, 32 nt, Human
uugggucaugccacuguuugagucucauaggg

SEQ ID NO: 275750 - RNA, 32 nt, Human
uugggucauggucaucuuccagcaccugcugu

SEQ ID NO: 275751 - RNA, 32 nt, Human
uuggguccaagcugccccugugcuguuucugu

SEQ ID NO: 275752 - RNA, 32 nt, Human
uuggguccacacugcuuuuaugagcuauaaca

SEQ ID NO: 275753 - RNA, 32 nt, Human
uuggguccaggagguggaggcugcagugagcu

SEQ ID NO: 275754 - RNA, 32 nt, Human
uuggguccauuuucuuuucauugccuccuuuu

SEQ ID NO: 275755 - RNA, 32 nt, Human
uugggucccaaaguggguuauuucaaggcauu

SEQ ID NO: 275756 - RNA, 32 nt, Human
uugggucccugaggccuuccucggagcauugg

SEQ ID NO: 275757 - RNA, 32 nt, Human
uugggucccuuccuugggcuguguucuugcug

SEQ ID NO: 275758 - RNA, 32 nt, Human
uuggguccuccacuguccucugucaaucuagu

SEQ ID NO: 275759 - RNA, 32 nt, Human
uuggguccugcaguggcaucuccugagggcag

SEQ ID NO: 275760 - RNA, 32 nt, Human
uuggguccugcugaagccaggagggucuuccc

SEQ ID NO: 275761 - RNA, 32 nt, Human
uuggguccuggguugacugagaagcggcgggg

SEQ ID NO: 275762 - RNA, 32 nt, Human
uuggguccuguucucuacuuuuuaauuggccg

SEQ ID NO: 275763 - RNA, 32 nt, Human
uugggucuacagcuacgucuuacccgccuccu

SEQ ID NO: 275764 - RNA, 32 nt, Human
uugggucucagcugcugacacgcagccugcuc

SEQ ID NO: 275765 - RNA, 32 nt, Human
uugggucuccagagcgcuugcaucaaacaccc

SEQ ID NO: 275766 - RNA, 32 nt, Human
uugggucuccuaggcccacccuuucuaggaca

SEQ ID NO: 275767 - RNA, 32 nt, Human
uugggucucuccacauugccccggcugcucuc

SEQ ID NO: 275768 - RNA, 32 nt, Human
uugggucucugacuuuggcuucugcucccggc

SEQ ID NO: 275769 - RNA, 32 nt, Human
uugggugaaaguaacggacaaugggcuccaga

SEQ ID NO: 275770 - RNA, 18 nt, Human
uugggugacagagcaaga

SEQ ID NO: 275771 - RNA, 32 nt, Human
uugggugacaggcuuuuaagguauauuuugua

SEQ ID NO: 275772 - RNA, 32 nt, Human
uugggugagacacuuuuccuugcugacucauu

SEQ ID NO: 275773 - RNA, 32 nt, Human
uugggugagccuuggagacaugugggaaacac

SEQ ID NO: 275774 - RNA, 32 nt, Human
uugggugagcugcuuucugccuucuugguaca

SEQ ID NO: 275775 - RNA, 32 nt, Human
uugggugaggcgggcaaaucaccugaggucag

SEQ ID NO: 275776 - RNA, 32 nt, Human
uugggugaucaaaggcacaggacagggguugg

SEQ ID NO: 275777 - RNA, 32 nt, Human
uugggugcaauggcucacgccuguaauccugg

SEQ ID NO: 275778 - RNA, 32 nt, Human
uugggugcaccuggccugcucuucccauguug

SEQ ID NO: 275779 - RNA, 32 nt, Human
uugggugcagagccaggagggcguuuggcugu

SEQ ID NO: 275780 - RNA, 32 nt, Human
uugggugcaguggcucacaccuguaauaccag

SEQ ID NO: 275781 - RNA, 32 nt, Human
uugggugccauggcucacaccuguaaucuuaa

SEQ ID NO: 275782 - RNA, 32 nt, Human
uugggugccugaggcaggagaaucucuuaaac

SEQ ID NO: 275783 - RNA, 32 nt, Human
uugggugcggugacaugcaccuguaaucccac

SEQ ID NO: 275784 - RNA, 31 nt, Human
uugggugcugcugcuacucagacuagcucua

SEQ ID NO: 275785 - RNA, 32 nt, Human
uugggugcugcugcuacucagacuagcucuaa

SEQ ID NO: 275786 - RNA, 32 nt, Human
uugggugcugggaaccaggaagagugggggaa

SEQ ID NO: 275787 - RNA, 32 nt, Human
uuggguggaaccuggggcccuggcaucacaca

SEQ ID NO: 275788 - RNA, 32 nt, Human
uuggguggaggcacacauuuggggcaaaggcc

SEQ ID NO: 275789 - RNA, 32 nt, Human
uuggguggcaagggacacagacgaaaagggca

SEQ ID NO: 275790 - RNA, 32 nt, Human
uuggguggcagugucagcacagggagggcuua

SEQ ID NO: 275791 - RNA, 32 nt, Human
uuggguggccaagguaggagaaucgcuugagc

SEQ ID NO: 275792 - RNA, 32 nt, Human
uuggguggccaucaauugcugcagaauagaag

SEQ ID NO: 275793 - RNA, 32 nt, Human
uuggguggccaucaauugcugcagaauagaau

SEQ ID NO: 275794 - RNA, 32 nt, Human
uuggguggccgagacggguggaucaccugagg

SEQ ID NO: 275795 - RNA, 32 nt, Human
uuggguggccgaggcaggagaaucacuugaac

SEQ ID NO: 275796 - RNA, 32 nt, Human
uuggguggcugaggcaggagaauuguuugaac

SEQ ID NO: 275797 - RNA, 32 nt, Human
uuggguggcugaggcaggcagagcauuugagg

SEQ ID NO: 275798 - RNA, 32 nt, Human
uuggguggcuguagcugcgccuaggagagggg

SEQ ID NO: 275799 - RNA, 32 nt, Human
uugggugggaaaggagagaggagccagccagg

SEQ ID NO: 275800 - RNA, 32 nt, Human
uugggugggaccaaggagaugccaccauagac

SEQ ID NO: 275801 - RNA, 32 nt, Human
uugggugggaggauugccugagaccaggaggu

SEQ ID NO: 275802 - RNA, 32 nt, Human
uugggugggcacccccugauugcuugucuguu

SEQ ID NO: 275803 - RNA, 31 nt, Human
uuggguggguuaaguacaugggugaauuuua

SEQ ID NO: 275804 - RNA, 32 nt, Human
uugggugguccuccaaccuccaauacccaggc

SEQ ID NO: 275805 - RNA, 32 nt, Human
uugggugguuccaauugguggagagaagcucu

SEQ ID NO: 275806 - RNA, 32 nt, Human
uugggugguugaggcaggaggauuguuugagc

SEQ ID NO: 275807 - RNA, 30 nt, Human
uugggugguuugcaaucugagacuucucca

SEQ ID NO: 275808 - RNA, 20 nt, Human
uugggugucaguucaggaua

SEQ ID NO: 275809 - RNA, 32 nt, Human
uugggugucccucuccugccucagcuuaauuu

SEQ ID NO: 275810 - RNA, 32 nt, Human
uugggugugaaauguugccagcuuccuauaau

SEQ ID NO: 275811 - RNA, 32 nt, Human
uuggguguggaagggggaaaaggggauggaga

SEQ ID NO: 275812 - RNA, 32 nt, Human
uuggguguggcuucaaccacuacaaacugaug

SEQ ID NO: 275813 - RNA, 32 nt, Human
uugggugugguggcuuacaccuguaaucccaa

SEQ ID NO: 275814 - RNA, 32 nt, Human
uugggugugugugcaugcacauguguguguuu

SEQ ID NO: 275815 - RNA, 32 nt, Human
uugggugugugugcguggucugagcuuccccc

SEQ ID NO: 275816 - RNA, 32 nt, Human
uuggguguuacggugcaugccuguaaucccag

SEQ ID NO: 275817 - RNA, 32 nt, Human
uuggguguuccuucuggccagucccauacuuu

SEQ ID NO: 275818 - RNA, 32 nt, Human
uuggguuaaagcuucugugaggaccuuuuggc

SEQ ID NO: 275819 - RNA, 32 nt, Human
uuggguuacugcaaccucugccccucgggauu

SEQ ID NO: 275820 - RNA, 32 nt, Human
uuggguuauuuggggguucuguuggcuuuuua

SEQ ID NO: 275821 - RNA, 32 nt, Human
uuggguucaaccgauucuccugccucaaccuc

SEQ ID NO: 275822 - RNA, 32 nt, Human
uuggguucaagcaacccugccucagcuaacca

SEQ ID NO: 275823 - RNA, 32 nt, Human
uuggguucaagcaauucucaugccucggccuc

SEQ ID NO: 275824 - RNA, 32 nt, Human
uuggguucaagcaauucugcugcaucagccuc

SEQ ID NO: 275825 - RNA, 32 nt, Human
uuggguucaagcaauucuucugccucagccuc

SEQ ID NO: 275826 - RNA, 32 nt, Human
uuggguucaagcgacucucgugccucagccuc

SEQ ID NO: 275827 - RNA, 32 nt, Human
uuggguucaagugauucuuccaccucagccuc

SEQ ID NO: 275828 - RNA, 32 nt, Human
uuggguucaggaguuuaagaccagccuggaca

SEQ ID NO: 275829 - RNA, 32 nt, Human
uuggguucaugccauucuccugccucagccuc

SEQ ID NO: 275830 - RNA, 32 nt, Human
uuggguucauuaaucugcucacuugaggacuu

SEQ ID NO: 275831 - RNA, 32 nt, Human
uuggguuccaggcuggaggaaugcaggcagaa

SEQ ID NO: 275832 - RNA, 32 nt, Human
uuggguuccauucucaccuauccacacaacau

SEQ ID NO: 275833 - RNA, 32 nt, Human
uuggguuccucucuccucucccccucucuccu

SEQ ID NO: 275834 - RNA, 18 nt, Human
uuggguuccuggggguuu

SEQ ID NO: 275835 - RNA, 31 nt, Human
uuggguugcagcuuaugacaugcaugauagg

SEQ ID NO: 275836 - RNA, 32 nt, Human
uuggguugcauucuucccucuggacuagagua

SEQ ID NO: 275837 - RNA, 32 nt, Human
uuggguuggagugcaguugcaggaucauaguu

SEQ ID NO: 275838 - RNA, 32 nt, Human
uuggguugggcgccguggcucacaccuguaau

SEQ ID NO: 275839 - RNA, 32 nt, Human
uuggguugggggcccuuccaggaggaaacccc

SEQ ID NO: 275840 - RNA, 32 nt, Human
uuggguugguagaaacggaaguagaaguaggc

SEQ ID NO: 275841 - RNA, 32 nt, Human
uuggguuggugugcuggauggaaguagggcug

SEQ ID NO: 275842 - RNA, 32 nt, Human
uuggguuguagucaauggcaggacagacagug

SEQ ID NO: 275843 - RNA, 32 nt, Human
uuggguugucacuguccugcagggggcagcag

SEQ ID NO: 275844 - RNA, 31 nt, Human
uuggguuuacaguucuuuacgcuuucugauu

SEQ ID NO: 275845 - RNA, 32 nt, Human
uuggguuuagacagcaggugcuguuccgagac

SEQ ID NO: 275846 - RNA, 32 nt, Human
uuggguuucacuucugcuucacuauguaguau

SEQ ID NO: 275847 - RNA, 32 nt, Human
uuggguuucagaaugaauuagaaacaaauaac

SEQ ID NO: 275848 - RNA, 32 nt, Human
uuggguuucuaguccuccuuaaccacuuaucu

SEQ ID NO: 275849 - RNA, 32 nt, Human
uuggguuugaccugcacaucugcagugagggc

SEQ ID NO: 275850 - RNA, 32 nt, Human
uuggguuugccauucauccccuaggcauggua

SEQ ID NO: 275851 - RNA, 32 nt, Human
uuggguuugcuuucacagucucucuuccuucu

SEQ ID NO: 275852 - RNA, 32 nt, Human
uuggguuugcuuuggaaaaugccugucucucu

SEQ ID NO: 275853 - RNA, 32 nt, Human
uuggguuuggucuccagcuccaauacuuauua

SEQ ID NO: 275854 - RNA, 32 nt, Human
uuggguuuuaaaggaaugguuuuacugcauua

SEQ ID NO: 275855 - RNA, 32 nt, Human
uugguaaaacuguuucaugaccagcuugauua

SEQ ID NO: 275856 - RNA, 32 nt, Human
uugguaaauacaacacaucuaauuaaauguag

SEQ ID NO: 275857 - RNA, 32 nt, Human
uugguaaauggaggcaggaguggggcagggau

SEQ ID NO: 275858 - RNA, 32 nt, Human
uugguaaauuucugagauauagcaggagacca

SEQ ID NO: 275859 - RNA, 32 nt, Human
uugguaaccagcuucccuuaacuagcuuuuuc

SEQ ID NO: 275860 - RNA, 32 nt, Human
uugguaaccuccauucuaguucugucucugug

SEQ ID NO: 275861 - RNA, 32 nt, Human
uugguaagagaaggaauuuaaaagagguauaa

SEQ ID NO: 275862 - RNA, 32 nt, Human
uugguaagccccgcaaggccaaggauccugaa

SEQ ID NO: 275863 - RNA, 30 nt, Human
uugguaagccucucuuacuccuguuaugca

SEQ ID NO: 275864 - RNA, 31 nt, Human
uugguaaggugugggugauggguggguugug

SEQ ID NO: 275865 - RNA, 32 nt, Human
uugguaagucuaagcauugagaacaaacauua

SEQ ID NO: 275866 - RNA, 32 nt, Human
uugguaaugcucacuccagguucugcaaaagu

SEQ ID NO: 275867 - RNA, 32 nt, Human
uugguaauuaccuggagaagaauggcuuucaa

SEQ ID NO: 275868 - RNA, 32 nt, Human
uugguaauuuguccuucuauagaagcuucaaa

SEQ ID NO: 275869 - RNA, 32 nt, Human
uugguaccaaaccugaggucuuuuggaagaua

SEQ ID NO: 275870 - RNA, 32 nt, Human
uugguaccacugccccuggccugagagccagg

SEQ ID NO: 275871 - RNA, 31 nt, Human
uugguaccaggagagcugcucacuuagggcc

SEQ ID NO: 275872 - RNA, 32 nt, Human
uugguaccucuacuuguucccuucuggaaucu

SEQ ID NO: 275873 - RNA, 32 nt, Human
uugguaccugcucuccccuggacuucuuuuuc

SEQ ID NO: 275874 - RNA, 32 nt, Human
uugguacguaguggaauaacaucucuacuugu

SEQ ID NO: 275875 - RNA, 32 nt, Human
uugguacuaccuaaugaaaggauuugguaaua

SEQ ID NO: 275876 - RNA, 32 nt, Human
uugguacugguugaauccuucaguuaacugcu

SEQ ID NO: 275877 - RNA, 32 nt, Human
uugguacuuauuuguucucuuuucccuuacau

SEQ ID NO: 275878 - RNA, 32 nt, Human
uugguagaaaugcgaagcgucaggguucccgc

SEQ ID NO: 275879 - RNA, 32 nt, Human
uugguagaacuguuaaccuagaaauguagcuu

SEQ ID NO: 275880 - RNA, 22 nt, Human
uugguagaagucuugggaucuu

SEQ ID NO: 275881 - RNA, 32 nt, Human
uugguagagacagaguuucaccagguugguca

SEQ ID NO: 275882 - RNA, 32 nt, Human
uugguagagacaggguaucuccauguugguca

SEQ ID NO: 275883 - RNA, 32 nt, Human
uugguagagacagggucucacuauguugccca

SEQ ID NO: 275884 - RNA, 32 nt, Human
uugguagagacaggguucaaccguguugguca

SEQ ID NO: 275885 - RNA, 32 nt, Human
uugguagagacaggguuucaccauguuagcca

SEQ ID NO: 275886 - RNA, 32 nt, Human
uugguagagacaggguuucaccauguuggcca

SEQ ID NO: 275887 - RNA, 32 nt, Human
uugguagagacaggguuucaccauguugguca

SEQ ID NO: 275888 - RNA, 32 nt, Human
uugguagagacaggguuucgccauguugccca

SEQ ID NO: 275889 - RNA, 32 nt, Human
uugguagagacaggguuucgcuauguuggcca

SEQ ID NO: 275890 - RNA, 32 nt, Human
uugguagagacaggguuuugccauguuucccu

SEQ ID NO: 275891 - RNA, 32 nt, Human
uugguagagacaggguuuugccguguuggccg

SEQ ID NO: 275892 - RNA, 32 nt, Human
uugguagagacaggguuuugcuguguugcuca

SEQ ID NO: 275893 - RNA, 32 nt, Human
uugguagagacggguuucaccauguuggucag

SEQ ID NO: 275894 - RNA, 32 nt, Human
uugguagcccccaaguggcgugcagugacacc

SEQ ID NO: 275895 - RNA, 32 nt, Human
uugguagccguagcacaagugauuggaguaga

SEQ ID NO: 275896 - RNA, 32 nt, Human
uugguagcggagcaaaagugaggggcaccaca

SEQ ID NO: 275897 - RNA, 22 nt, Human
uugguagcuaagacucccgaau

SEQ ID NO: 275898 - RNA, 32 nt, Human
uugguagcuguuucuccguccucucuccaccu

SEQ ID NO: 275899 - RNA, 32 nt, Human
uugguagcuuuuugauuuccccaaacuauuua

SEQ ID NO: 275900 - RNA, 32 nt, Human
uugguaggaggaaacauaagcacuaaacacua

SEQ ID NO: 275901 - RNA, 32 nt, Human
uugguaggcaaaggugggaggaucauuugagc

SEQ ID NO: 275902 - RNA, 32 nt, Human
uugguaggcugaggcaggagaaucgcuugaac

SEQ ID NO: 275903 - RNA, 32 nt, Human
uugguaggcugaggcaggagaauggcgggaac

SEQ ID NO: 275904 - RNA, 32 nt, Human
uugguaggcugagguagguggaucaccugagg

SEQ ID NO: 275905 - RNA, 32 nt, Human
uugguagggcgggguuucaccaugauggccag

SEQ ID NO: 275906 - RNA, 32 nt, Human
uugguaguauuucugcaagcuucuuuaguuuc

SEQ ID NO: 275907 - RNA, 32 nt, Human
uugguagugagugccuugcccucuuugagcua

SEQ ID NO: 275908 - RNA, 32 nt, Human
uugguagugucugaggugaacuguggggguug

SEQ ID NO: 275909 - RNA, 32 nt, Human
uugguaguuaacacaucaaauauuucuugcug

SEQ ID NO: 275910 - RNA, 32 nt, Human
uugguaguuuguuccuuuuauugcugaguaga

SEQ ID NO: 275911 - RNA, 32 nt, Human
uugguauaugauggagaaugaaaaacuagagu

SEQ ID NO: 275912 - RNA, 31 nt, Human
uugguauccaauaaauauuuguuggaugaaa

SEQ ID NO: 275913 - RNA, 31 nt, Human
uugguauccaauaaauauuuguuggaugaau

SEQ ID NO: 275914 - RNA, 32 nt, Human
uugguaugaaggccagaaggagugaaacaugu

SEQ ID NO: 275915 - RNA, 32 nt, Human
uugguauggccaaagucacuuccucgucuccu

SEQ ID NO: 275916 - RNA, 32 nt, Human
uugguaugugccaggcuugccugggcugggca

SEQ ID NO: 275917 - RNA, 32 nt, Human
uugguauuaaggaaaucucauuuuggaugccu

SEQ ID NO: 275918 - RNA, 32 nt, Human
uugguauucucuccaguauauagaugaggaaa

SEQ ID NO: 275919 - RNA, 32 nt, Human
uugguauuggccuggggcagagcagcuccucc

SEQ ID NO: 275920 - RNA, 32 nt, Human
uugguauugugccucugcucccaucucucucu

SEQ ID NO: 275921 - RNA, 32 nt, Human
uugguauuuauuuaugaaauauuugaacauuu

SEQ ID NO: 275922 - RNA, 32 nt, Human
uuggucaccagcaaucugccuuugaccauccu

SEQ ID NO: 275923 - RNA, 32 nt, Human
uuggucaccaggcaaugggagcuguagaccag

SEQ ID NO: 275924 - RNA, 32 nt, Human
uuggucacggccgcaggugaccccuuagccca

SEQ ID NO: 275925 - RNA, 32 nt, Human
uuggucacugcacuucauagcccggcauauca

SEQ ID NO: 275926 - RNA, 32 nt, Human
uuggucagagcaaaucacaaggcuuuacccag

SEQ ID NO: 275927 - RNA, 32 nt, Human
uuggucaggcuggucuugaucucuggccaccu

SEQ ID NO: 275928 - RNA, 32 nt, Human
uuggucaggcuggucuuggauucccgaccuca

SEQ ID NO: 275929 - RNA, 32 nt, Human
uuggucagugccugucaaggcuccaguccugc

SEQ ID NO: 275930 - RNA, 32 nt, Human
uuggucaguuaccugggaauucugggcugcca

SEQ ID NO: 275931 - RNA, 32 nt, Human
uuggucaguuucuagaagacauggaagcauau

SEQ ID NO: 275932 - RNA, 32 nt, Human
uuggucauaaguuggcauucucucacauucca

SEQ ID NO: 275933 - RNA, 32 nt, Human
uuggucauacccaaggggaagguggagcaaga

SEQ ID NO: 275934 - RNA, 32 nt, Human
uuggucauagagucuucauauuucaguauuug

SEQ ID NO: 275935 - RNA, 32 nt, Human
uuggucauagaguuggggaaugacagaauuuu

SEQ ID NO: 275936 - RNA, 32 nt, Human
uuggucaucugacuaaguucuagccaaaguaa

SEQ ID NO: 275937 - RNA, 32 nt, Human
uuggucaugagcugcugggaaguugugacuuu

SEQ ID NO: 275938 - RNA, 32 nt, Human
uuggucauuaacaggaagcaucuuuucuacau

SEQ ID NO: 275939 - RNA, 32 nt, Human
uuggucauuaaguauugugcagugcauuauuu

SEQ ID NO: 275940 - RNA, 32 nt, Human
uuggucauucugcagugcacugcaaccauugu

SEQ ID NO: 275941 - RNA, 32 nt, Human
uuggucauucuuccagccuccaugucaccacg

SEQ ID NO: 275942 - RNA, 32 nt, Human
uuggucauugcaggccagaagauagugucuga

SEQ ID NO: 275943 - RNA, 32 nt, Human
uuggucauuggguuugggugaggccuggaggc

SEQ ID NO: 275944 - RNA, 32 nt, Human
uugguccacaccucaccugcccucucugcccu

SEQ ID NO: 275945 - RNA, 32 nt, Human
uugguccacagcacuccauucuggguggcaga

SEQ ID NO: 275946 - RNA, 20 nt, Human
uugguccaccuuccagcaca

SEQ ID NO: 275947 - RNA, 32 nt, Human
uugguccagaggagggaggaggaagggaagac

SEQ ID NO: 275948 - RNA, 32 nt, Human
uugguccagauucgcuccucuggggcuacguc

SEQ ID NO: 275949 - RNA, 32 nt, Human
uugguccaggcaggcggggaugugcggugacc

SEQ ID NO: 275950 - RNA, 32 nt, Human
uugguccagguacugagggacaaguagaaaga

SEQ ID NO: 275951 - RNA, 32 nt, Human
uugguccagguagcaaugaugagacccuuuua

SEQ ID NO: 275952 - RNA, 32 nt, Human
uugguccaggucaucccuccccgggccugggg

SEQ ID NO: 275953 - RNA, 32 nt, Human
uugguccaguucugcaccgggguggggcuggg

SEQ ID NO: 275954 - RNA, 32 nt, Human
uugguccaugaaggagcagccagggguggugg

SEQ ID NO: 275955 - RNA, 32 nt, Human
uuggucccaacaaggcccaggaaacagacccu

SEQ ID NO: 275956 - RNA, 32 nt, Human
uuggucccaccgcacuccagccugggcaacag

SEQ ID NO: 275957 - RNA, 32 nt, Human
uuggucccagagaggcagccugggcagucugu

SEQ ID NO: 275958 - RNA, 32 nt, Human
uuggucccagagggagaggaggugggcugugc

SEQ ID NO: 275959 - RNA, 32 nt, Human
uuggucccaggaguucaagaccagccugugga

SEQ ID NO: 275960 - RNA, 32 nt, Human
uugguccccaaagccuuauacuuuuugcauug

SEQ ID NO: 275961 - RNA, 32 nt, Human
uugguccccagcgcagugagguggugagccuc

SEQ ID NO: 275962 - RNA, 32 nt, Human
uuggucccgagaugggaggggagcagcugggc

SEQ ID NO: 275963 - RNA, 32 nt, Human
uuggucccuccuucuauuuugugaaaggguag

SEQ ID NO: 275964 - RNA, 21 nt, Human
uugguccgaauuucucccgaa

SEQ ID NO: 275965 - RNA, 32 nt, Human
uugguccgaucuuugacucuuuugccauuaaa

SEQ ID NO: 275966 - RNA, 32 nt, Human
uugguccucacccuccuguuccugggcucccc

SEQ ID NO: 275967 - RNA, 32 nt, Human
uugguccucucuaaggagggcucucuucugag

SEQ ID NO: 275968 - RNA, 32 nt, Human
uugguccugaguguuccaggagcucuuugguu

SEQ ID NO: 275969 - RNA, 32 nt, Human
uugguccugcauccucucucucccagagccuc

SEQ ID NO: 275970 - RNA, 32 nt, Human
uugguccugcuguuuuugaugagccuuuuguc

SEQ ID NO: 275971 - RNA, 32 nt, Human
uugguccuuccaccagccucuuuugggaacag

SEQ ID NO: 275972 - RNA, 32 nt, Human
uuggucgagagggaaagcagaagaagucugcu

SEQ ID NO: 275973 - RNA, 32 nt, Human
uuggucgagauggggugucccuguguugccca

SEQ ID NO: 275974 - RNA, 32 nt, Human
uuggucgaugaggcaagagaucaaggaaagug

SEQ ID NO: 275975 - RNA, 32 nt, Human
uuggucggaagugagugaaggagccaggucgc

SEQ ID NO: 275976 - RNA, 32 nt, Human
uuggucggagucggccaguugccugaaguagg

SEQ ID NO: 275977 - RNA, 32 nt, Human
uuggucgggaacagccagcccagaugagcaac

SEQ ID NO: 275978 - RNA, 32 nt, Human
uuggucgggucagccugggggcugagggccug

SEQ ID NO: 275979 - RNA, 32 nt, Human
uuggucguaaagccccuccaguccagcuuuga

SEQ ID NO: 275980 - RNA, 32 nt, Human
uuggucuagagguggagcacagugaaagaauu

SEQ ID NO: 275981 - RNA, 32 nt, Human
uuggucuagccacagugaaaucuugauggagu

SEQ ID NO: 275982 - RNA, 32 nt, Human
uuggucucagcaggaccccauugcagcaaaga

SEQ ID NO: 275983 - RNA, 32 nt, Human
uuggucucagccacagcaccccuuauuccagc

SEQ ID NO: 275984 - RNA, 32 nt, Human
uuggucucagggggaccccagggaugccccag

SEQ ID NO: 275985 - RNA, 32 nt, Human
uuggucuccaaaagugcugggauuacaggcau

SEQ ID NO: 275986 - RNA, 32 nt, Human
uuggucucccaaagugaugggauuacaggcgu

SEQ ID NO: 275987 - RNA, 32 nt, Human
uuggucucccaaagugcugggaauacaggcau

SEQ ID NO: 275988 - RNA, 32 nt, Human
uuggucucccaaagugcugggauuacagacau

SEQ ID NO: 275989 - RNA, 32 nt, Human
uuggucucccaaagugcugggauuacaggcgu

SEQ ID NO: 275990 - RNA, 32 nt, Human
uuggucucccaaagugcugggauuacccacau

SEQ ID NO: 275991 - RNA, 32 nt, Human
uuggucucccaaagugcugggauuacgguguu

SEQ ID NO: 275992 - RNA, 32 nt, Human
uuggucucccaaagugcugggauuauaggcau

SEQ ID NO: 275993 - RNA, 32 nt, Human
uuggucucccaacgugcugggauuacaggcau

SEQ ID NO: 275994 - RNA, 18 nt, Human
uuggucuccugugaacuu

SEQ ID NO: 275995 - RNA, 20 nt, Human
uuggucuccugugguuucuu

SEQ ID NO: 275996 - RNA, 32 nt, Human
uuggucucgaacuccugaccucaugaucugcc

SEQ ID NO: 275997 - RNA, 32 nt, Human
uuggucucuacccucacuaccucaguucucaa

SEQ ID NO: 275998 - RNA, 32 nt, Human
uuggucucucaaagugcugggauuacaggcau

SEQ ID NO: 275999 - RNA, 18 nt, Human
uuggucucucuagguuuu

SEQ ID NO: 276000 - RNA, 32 nt, Human
uuggucucugccccaucucauuguuugauccu

SEQ ID NO: 276001 - RNA, 18 nt, Human
uuggucucuggagguuuu

SEQ ID NO: 276002 - RNA, 32 nt, Human
uuggucucuguggguaggucucgcagccucug

SEQ ID NO: 276003 - RNA, 18 nt, Human
uuggucucuguuggccuu

SEQ ID NO: 276004 - RNA, 32 nt, Human
uuggucugaacaaaccuuguaaaguuccauug

SEQ ID NO: 276005 - RNA, 32 nt, Human
uuggucugagggugagacauucccugguuucu

SEQ ID NO: 276006 - RNA, 32 nt, Human
uuggucugcuuuguguaugguacuugaaacca

SEQ ID NO: 276007 - RNA, 32 nt, Human
uuggucuggagccugaugauuugcauuuccaa

SEQ ID NO: 276008 - RNA, 32 nt, Human
uuggucugucgccaggcuggagugcaguggcg

SEQ ID NO: 276009 - RNA, 32 nt, Human
uuggucugucugucuguccuuguccuuguggu

SEQ ID NO: 276010 - RNA, 32 nt, Human
uuggucuguggagguaguugcugguggcacug

SEQ ID NO: 276011 - RNA, 32 nt, Human
uuggucuuccaaagugcugggauuacaggugu

SEQ ID NO: 276012 - RNA, 32 nt, Human
uuggucuugagcuggucaggugacaucagcag

SEQ ID NO: 276013 - RNA, 32 nt, Human
uuggucuugccagacagcagauucagggaaag

SEQ ID NO: 276014 - RNA, 32 nt, Human
uuggucuugcugcugauaucugccagaaaagg

SEQ ID NO: 276015 - RNA, 20 nt, Human
uuggucuugcuuggggcguu

SEQ ID NO: 276016 - RNA, 32 nt, Human
uuggucuuggacaacuguaaggaacaacacaa

SEQ ID NO: 276017 - RNA, 20 nt, Human
uuggucuuguucuuggucuu

SEQ ID NO: 276018 - RNA, 32 nt, Human
uuggucuuguuucauuggcuguggcagaaacu

SEQ ID NO: 276019 - RNA, 32 nt, Human
uuggucuuuguuuuuguuauucauccuguguc

SEQ ID NO: 276020 - RNA, 32 nt, Human
uuggucuuuucccuguucaucucccaacaugc

SEQ ID NO: 276021 - RNA, 18 nt, Human
uuggucuuuuggccucuu

SEQ ID NO: 276022 - RNA, 32 nt, Human
uuggugaaacacaucauaaugauuucuauagg

SEQ ID NO: 276023 - RNA, 32 nt, Human
uuggugaaagaccauuccagccauucaguuga

SEQ ID NO: 276024 - RNA, 32 nt, Human
uuggugaacaugccaucaguaaaagcccugga

SEQ ID NO: 276025 - RNA, 32 nt, Human
uuggugaagaccgcacuucaauggagcuuggg

SEQ ID NO: 276026 - RNA, 32 nt, Human
uuggugacauuuuucuagccuggcagaacaga

SEQ ID NO: 276027 - RNA, 32 nt, Human
uuggugagagacaggcuuuguucucuuguuca

SEQ ID NO: 276028 - RNA, 32 nt, Human
uuggugagauuccugacuugauaccuugcuaa

SEQ ID NO: 276029 - RNA, 32 nt, Human
uuggugaggaaagaguaugaauuugccaugug

SEQ ID NO: 276030 - RNA, 32 nt, Human
uuggugaggaagggaaagguuuuucuuguagg

SEQ ID NO: 276031 - RNA, 32 nt, Human
uuggugaggagcuguugggucaugugguugau

SEQ ID NO: 276032 - RNA, 32 nt, Human
uuggugagugugaaccagagucugagaucccc

SEQ ID NO: 276033 - RNA, 32 nt, Human
uuggugauagcgccugggggagggggacugga

SEQ ID NO: 276034 - RNA, 21 nt, Human
uuggugaucaugucuuuucca

SEQ ID NO: 276035 - RNA, 32 nt, Human
uuggugaugagacuuauggagugugccucucu

SEQ ID NO: 276036 - RNA, 32 nt, Human
uuggugauucaaaguguuguguuccuggcuga

SEQ ID NO: 276037 - RNA, 22 nt, Human
uuggugauugccaugggacuuu

SEQ ID NO: 276038 - RNA, 32 nt, Human
uuggugcaagggagauggucucaagucagagg

SEQ ID NO: 276039 - RNA, 31 nt, Human
uuggugcaauuagaagcaaaagacuguaccu

SEQ ID NO: 276040 - RNA, 32 nt, Human
uuggugcagaagcaugcaguggaauuuaacca

SEQ ID NO: 276041 - RNA, 32 nt, Human
uuggugcaggaaaacuaccuggaguaccggca

SEQ ID NO: 276042 - RNA, 31 nt, Human
uuggugcaguuucagcucacugcaaccuccg

SEQ ID NO: 276043 - RNA, 31 nt, Human
uuggugcauaauaaauauuguggaaauaaaa

SEQ ID NO: 276044 - RNA, 32 nt, Human
uuggugcauaauaaauauuguggaaauaaaaa

SEQ ID NO: 276045 - RNA, 32 nt, Human
uuggugccaaugcauuccagccuggaugaugg

SEQ ID NO: 276046 - RNA, 32 nt, Human
uuggugccaggaguucuagaccagccuggcca

SEQ ID NO: 276047 - RNA, 24 nt, Human
uuggugcccaggcuagagugcaau

SEQ ID NO: 276048 - RNA, 32 nt, Human
uuggugcccaggcuagagugcaauggcgcgau

SEQ ID NO: 276049 - RNA, 32 nt, Human
uuggugcccccaggaaccuggccaggggugcu

SEQ ID NO: 276050 - RNA, 21 nt, Human
uuggugccucacugggggcuu

SEQ ID NO: 276051 - RNA, 32 nt, Human
uuggugccugugagcucaucucccaggauggu

SEQ ID NO: 276052 - RNA, 32 nt, Human
uuggugccuuaaagacacgcauuccaaagugg

SEQ ID NO: 276053 - RNA, 32 nt, Human
uuggugcgggcagacaccaauuuaggcaacau

SEQ ID NO: 276054 - RNA, 32 nt, Human
uuggugcuaaggaaguggggagagcaggcucu

SEQ ID NO: 276055 - RNA, 32 nt, Human
uuggugcuaaugaggccagggugcaggguucg

SEQ ID NO: 276056 - RNA, 32 nt, Human
uuggugcuacagcccucuccccaccccuaaag

SEQ ID NO: 276057 - RNA, 32 nt, Human
uuggugcucaacuacagccugccuggauaugg

SEQ ID NO: 276058 - RNA, 32 nt, Human
uuggugcucaagucacucagaaugagaguccu

SEQ ID NO: 276059 - RNA, 32 nt, Human
uuggugcucagccucuggagccucaccugcag

SEQ ID NO: 276060 - RNA, 32 nt, Human
uuggugcuccagucccggguuggggcuggccu

SEQ ID NO: 276061 - RNA, 32 nt, Human
uuggugcucuauggagaaauggagucugugug

SEQ ID NO: 276062 - RNA, 32 nt, Human
uuggugcugaagacgcagggacaggaauggga

SEQ ID NO: 276063 - RNA, 32 nt, Human
uuggugcugggggcugugauucccucugccuc

SEQ ID NO: 276064 - RNA, 32 nt, Human
uuggugcuguuggcauggccugugccaucaau

SEQ ID NO: 276065 - RNA, 29 nt, Human
uuggugcuuaugugugugggcuugggacg

SEQ ID NO: 276066 - RNA, 32 nt, Human
uuggugcuugaggucucccugcucuugguggc

SEQ ID NO: 276067 - RNA, 24 nt, Human
uuggugcuuuguaugcaaguuuaa

SEQ ID NO: 276068 - RNA, 32 nt, Human
uugguggaaaguaggguggaccaaaggaggcc

SEQ ID NO: 276069 - RNA, 32 nt, Human
uugguggagacagggucucaccauguuggcua

SEQ ID NO: 276070 - RNA, 32 nt, Human
uugguggaggggccaggcuggacgcuuccugu

SEQ ID NO: 276071 - RNA, 32 nt, Human
uugguggaugucagugcuuacuccccaugaaa

SEQ ID NO: 276072 - RNA, 32 nt, Human
uugguggcaaggacagagggccuggaccagca

SEQ ID NO: 276073 - RNA, 17 nt, Human
uugguggcaaugugagg

SEQ ID NO: 276074 - RNA, 32 nt, Human
uugguggcaccacugcccuccagccuggauga

SEQ ID NO: 276075 - RNA, 32 nt, Human
uugguggcaccaggggacagcaguaggcugac

SEQ ID NO: 276076 - RNA, 32 nt, Human
uugguggcagcugccaucauggucauugccuu

SEQ ID NO: 276077 - RNA, 32 nt, Human
uugguggcaggauucucagcaggcauggccgu

SEQ ID NO: 276078 - RNA, 32 nt, Human
uugguggcaggcaccuguagucccagcuacac

SEQ ID NO: 276079 - RNA, 32 nt, Human
uugguggccacuuugagaugccagguuucuuu

SEQ ID NO: 276080 - RNA, 32 nt, Human
uugguggccccuccaggcccagccucugccuc

SEQ ID NO: 276081 - RNA, 32 nt, Human
uugguggccugggaucuggcacacucccucuc

SEQ ID NO: 276082 - RNA, 32 nt, Human
uugguggcgggcgccuguagucucagcuacuc

SEQ ID NO: 276083 - RNA, 32 nt, Human
uugguggcucacaccuguaauuccagcacuuu

SEQ ID NO: 276084 - RNA, 32 nt, Human
uugguggcuggcuagcuaguuucuacagaaca

SEQ ID NO: 276085 - RNA, 32 nt, Human
uugguggcuucauguaauguucucauuaauga

SEQ ID NO: 276086 - RNA, 32 nt, Human
uuggugggaaguaagcuggagauccaggcugc

SEQ ID NO: 276087 - RNA, 32 nt, Human
uuggugggaccccuguccacacccacccuauu

SEQ ID NO: 276088 - RNA, 32 nt, Human
uuggugggagccaaggcugagucggauguauc

SEQ ID NO: 276089 - RNA, 32 nt, Human
uuggugggaggaggagaaaacaauuguuuuua

SEQ ID NO: 276090 - RNA, 32 nt, Human
uuggugggcaucaucagcuggggccugggcug

SEQ ID NO: 276091 - RNA, 32 nt, Human
uuggugggcugcacucucaccuggaggcuccg

SEQ ID NO: 276092 - RNA, 32 nt, Human
uugguggggauggugauuaaacaccucuuuug

SEQ ID NO: 276093 - RNA, 32 nt, Human
uugguggggguaaggggcaguggugugaaggg

SEQ ID NO: 276094 - RNA, 32 nt, Human
uuggugggguacaguggaugugaauacuguaa

SEQ ID NO: 276095 - RNA, 32 nt, Human
uugguggguagggggucucucugguuuccccu

SEQ ID NO: 276096 - RNA, 32 nt, Human
uugguggguugguggcugggaauaucuguucc

SEQ ID NO: 276097 - RNA, 32 nt, Human
uuggugguaccaggaaagagagacugauuauc

SEQ ID NO: 276098 - RNA, 32 nt, Human
uuggugguacccucgagcacaccagacuugca

SEQ ID NO: 276099 - RNA, 32 nt, Human
uugguggucugggucacaggaggcagguuucg

SEQ ID NO: 276100 - RNA, 32 nt, Human
uugguggucuuugcuuauucugagguucuugu

SEQ ID NO: 276101 - RNA, 32 nt, Human
uugguggugcuaaaugccaggaagaaaaguaa

SEQ ID NO: 276102 - RNA, 32 nt, Human
uugguggugcuacccuuggccucccagagucc

SEQ ID NO: 276103 - RNA, 32 nt, Human
uugguggugggaggccagcgggcagaaauuua

SEQ ID NO: 276104 - RNA, 32 nt, Human
uuggugguuugagucccuucuacuuggcauuc

SEQ ID NO: 276105 - RNA, 32 nt, Human
uuggugguuuucuuuccuaacuucugauuuag

SEQ ID NO: 276106 - RNA, 32 nt, Human
uugguguacugaggugucugaugaggauguac

SEQ ID NO: 276107 - RNA, 32 nt, Human
uuggugucaggagaggacauggagggggcuga

SEQ ID NO: 276108 - RNA, 32 nt, Human
uuggugucaguccugugucuugucgguccuuc

SEQ ID NO: 276109 - RNA, 32 nt, Human
uuggugucauauccaagaaaucauuacagaau

SEQ ID NO: 276110 - RNA, 32 nt, Human
uugguguccagaaggaaugaaaaccagugaca

SEQ ID NO: 276111 - RNA, 32 nt, Human
uugguguccuggacuucauccugggugcugca

SEQ ID NO: 276112 - RNA, 32 nt, Human
uuggugucucagggauggcagaggcagaaaaa

SEQ ID NO: 276113 - RNA, 32 nt, Human
uuggugucugaggugccacuucugcugugaau

SEQ ID NO: 276114 - RNA, 32 nt, Human
uuggugugaacucgcuuaaaagcaauggugaa

SEQ ID NO: 276115 - RNA, 32 nt, Human
uuggugugcaguucacaguaggauuugggcuc

SEQ ID NO: 276116 - RNA, 32 nt, Human
uuggugugccaagaggagguggguagauggga

SEQ ID NO: 276117 - RNA, 20 nt, Human
uugguguggacggggcgcag

SEQ ID NO: 276118 - RNA, 32 nt, Human
uugguguguauaacuacauuuuuagugaugca

SEQ ID NO: 276119 - RNA, 32 nt, Human
uuggugugucauggugccucaucauucugggg

SEQ ID NO: 276120 - RNA, 32 nt, Human
uugguguguggugggaagcuaucagaacaaga

SEQ ID NO: 276121 - RNA, 32 nt, Human
uugguguucacuuugcuccucuugcccucugu

SEQ ID NO: 276122 - RNA, 32 nt, Human
uugguguucauccuauuuuucugacaagucca

SEQ ID NO: 276123 - RNA, 32 nt, Human
uugguguucuguagucugugaggggagagcag

SEQ ID NO: 276124 - RNA, 32 nt, Human
uugguguugcccaggcagagagggcagugugg

SEQ ID NO: 276125 - RNA, 32 nt, Human
uugguguuucaucagcucuuguuagcaaccag

SEQ ID NO: 276126 - RNA, 32 nt, Human
uugguguuugcucucccuugacccaccccagu

SEQ ID NO: 276127 - RNA, 32 nt, Human
uugguguuuguuucugacauuuuaacuugaaa

SEQ ID NO: 276128 - RNA, 32 nt, Human
uugguuaaaaggaaguuuguucacuucgauga

SEQ ID NO: 276129 - RNA, 22 nt, Human
uugguuaaagugaagaaacagu

SEQ ID NO: 276130 - RNA, 32 nt, Human
uugguuaaugccagucuuccuccccuggacac

SEQ ID NO: 276131 - RNA, 32 nt, Human
uugguuagcacacucagcgcugugagucguga

SEQ ID NO: 276132 - RNA, 32 nt, Human
uugguuauauggucagaccaagaucacacaca

SEQ ID NO: 276133 - RNA, 32 nt, Human
uugguuauucuacugccucuaggccaggguag

SEQ ID NO: 276134 - RNA, 32 nt, Human
uugguuauuuacucauuugucauuucauggau

SEQ ID NO: 276135 - RNA, 32 nt, Human
uugguucaacaacaagaacuuacuuaaaacaa

SEQ ID NO: 276136 - RNA, 32 nt, Human
uugguucacugcaaccuccaccuccaggguuc

SEQ ID NO: 276137 - RNA, 32 nt, Human
uugguucacugcaaccuccaccucccagguuc

SEQ ID NO: 276138 - RNA, 32 nt, Human
uugguucacugcaaccuccaccucuuggguuc

SEQ ID NO: 276139 - RNA, 32 nt, Human
uugguucacugcaaccuccgcauccgggguuc

SEQ ID NO: 276140 - RNA, 32 nt, Human
uugguucacugcaaccuccgccuccuggauuc

SEQ ID NO: 276141 - RNA, 32 nt, Human
uugguucacugcaaccucugccucccagguuc

SEQ ID NO: 276142 - RNA, 32 nt, Human
uugguucacugcaaccucugccucccggguuc

SEQ ID NO: 276143 - RNA, 32 nt, Human
uugguucacugcaagcuccaccucccggguuc

SEQ ID NO: 276144 - RNA, 32 nt, Human
uugguucacuuuuaaagugcagguguauauuu

SEQ ID NO: 276145 - RNA, 32 nt, Human
uugguucagaauauuguuugugccaguacaug

SEQ ID NO: 276146 - RNA, 32 nt, Human
uugguucagcagagcaugggggcgggggcucu

SEQ ID NO: 276147 - RNA, 32 nt, Human
uugguucagcuuuuagcaaaaagggcuacagu

SEQ ID NO: 276148 - RNA, 32 nt, Human
uugguucaugcucugagccucugccaagcuga

SEQ ID NO: 276149 - RNA, 32 nt, Human
uugguuccaaguauuugcuauugugaacagug

SEQ ID NO: 276150 - RNA, 32 nt, Human
uugguuccaagucuuugcuauuguaaauagca

SEQ ID NO: 276151 - RNA, 32 nt, Human
uugguuccaagucuuugcuauuguaaauagug

SEQ ID NO: 276152 - RNA, 32 nt, Human
uugguuccaagucuuugcuauugugaauaaug

SEQ ID NO: 276153 - RNA, 32 nt, Human
uugguuccaagucuuugcuauugugaauagug

SEQ ID NO: 276154 - RNA, 31 nt, Human
uugguuccagaaggaacugucagucaucagc

SEQ ID NO: 276155 - RNA, 32 nt, Human
uugguuccagugcuuuauguuguuguuguuuu

SEQ ID NO: 276156 - RNA, 32 nt, Human
uugguuccaugaauuugcuauuguaaauauug

SEQ ID NO: 276157 - RNA, 32 nt, Human
uugguucccaccacacugaggaaauggggguu

SEQ ID NO: 276158 - RNA, 32 nt, Human
uugguucccuuucaagaugauuuuggcugugu

SEQ ID NO: 276159 - RNA, 22 nt, Human
uugguuccggucuuuacuguug

SEQ ID NO: 276160 - RNA, 32 nt, Human
uugguuccucaugacugugcugugaggaaggc

SEQ ID NO: 276161 - RNA, 32 nt, Human
uugguuccuuagugaaggcucucuuccuggcu

SEQ ID NO: 276162 - RNA, 32 nt, Human
uugguuccuugucugugaugauuugcaaaugu

SEQ ID NO: 276163 - RNA, 32 nt, Human
uugguuccuuucaaaugcacuugagcagcggu

SEQ ID NO: 276164 - RNA, 32 nt, Human
uugguucgugugagcagcugcccagccccagg

SEQ ID NO: 276165 - RNA, 32 nt, Human
uugguucuaguauuaauaaagaaaaauguuau

SEQ ID NO: 276166 - RNA, 32 nt, Human
uugguucuccagcguagacuccugggagcagc

SEQ ID NO: 276167 - RNA, 32 nt, Human
uugguucucccaggagcucagggccugucaga

SEQ ID NO: 276168 - RNA, 32 nt, Human
uugguucuccccucccuucccuggccggcugc

SEQ ID NO: 276169 - RNA, 32 nt, Human
uugguucuccuggauguuuugcucuguuuuga

SEQ ID NO: 276170 - RNA, 32 nt, Human
uugguucugaggccugguuugcucuuaauuaa

SEQ ID NO: 276171 - RNA, 32 nt, Human
uugguucugccucuggcaugcugguagacuag

SEQ ID NO: 276172 - RNA, 28 nt, Human
uugguucugggaggggugagggaugggg

SEQ ID NO: 276173 - RNA, 32 nt, Human
uugguucuuacuuugcugcucguuuagucccu

SEQ ID NO: 276174 - RNA, 32 nt, Human
uugguucuuaguucuuaaagaaucaagaaguu

SEQ ID NO: 276175 - RNA, 32 nt, Human
uugguucuuuugacuuugcucuucugguagag

SEQ ID NO: 276176 - RNA, 32 nt, Human
uugguugaaagaagcgcagggaagagacuggg

SEQ ID NO: 276177 - RNA, 32 nt, Human
uugguugaaaucugaaauguacugucccaaua

SEQ ID NO: 276178 - RNA, 32 nt, Human
uugguugaacccaggaggcggagguugcagug

SEQ ID NO: 276179 - RNA, 32 nt, Human
uugguugaaugucuccagcacuaugcaucccu

SEQ ID NO: 276180 - RNA, 32 nt, Human
uugguugagcuuaggagguugaggcugcagug

SEQ ID NO: 276181 - RNA, 21 nt, Human
uugguugaggaaacaaacaug

SEQ ID NO: 276182 - RNA, 32 nt, Human
uugguugaggggauggaggaauguuuucgggg

SEQ ID NO: 276183 - RNA, 32 nt, Human
uugguugauauaacacaaagagauauuuagga

SEQ ID NO: 276184 - RNA, 32 nt, Human
uugguuggcacuuucaccucagcacuuaccua

SEQ ID NO: 276185 - RNA, 32 nt, Human
uugguugggcagaguggcaggagcaugggcac

SEQ ID NO: 276186 - RNA, 32 nt, Human
uugguugggccugugucacauccaggcagcca

SEQ ID NO: 276187 - RNA, 32 nt, Human
uugguuggugauuuugaugauagccacaaagc

SEQ ID NO: 276188 - RNA, 32 nt, Human
uugguuggugggcgccuguaaucccagcuagg

SEQ ID NO: 276189 - RNA, 32 nt, Human
uugguugucacaccuagggagaugcuauuggg

SEQ ID NO: 276190 - RNA, 31 nt, Human
uugguugugcuuuauauuugccaaaguccua

SEQ ID NO: 276191 - RNA, 32 nt, Human
uugguuguuuguuguuguugcauugcaguucu

SEQ ID NO: 276192 - RNA, 32 nt, Human
uugguuuaagaaagauuuucauacuuaaaaga

SEQ ID NO: 276193 - RNA, 32 nt, Human
uugguuuaaguucaaaugaaugaaacaacuau

SEQ ID NO: 276194 - RNA, 32 nt, Human
uugguuuaauaaucagaaaauauucaauacag

SEQ ID NO: 276195 - RNA, 32 nt, Human
uugguuuacacaauauuuuuaaugucuuaaaa

SEQ ID NO: 276196 - RNA, 32 nt, Human
uugguuuacagaaccggcguuucagauguuua

SEQ ID NO: 276197 - RNA, 32 nt, Human
uugguuuacuccugcacuugucuuacucauuc

SEQ ID NO: 276198 - RNA, 32 nt, Human
uugguuuacugcaaccuccaccuccuaggcuc

SEQ ID NO: 276199 - RNA, 32 nt, Human
uugguuuaucuucuguucuuccuaccuugugc

SEQ ID NO: 276200 - RNA, 32 nt, Human
uugguuuauuuuucaaugcaucuuuaauuugu

SEQ ID NO: 276201 - RNA, 32 nt, Human
uugguuuauuuuugagagugggguaagcaccc

SEQ ID NO: 276202 - RNA, 18 nt, Human
uugguuucacuggauuuu

SEQ ID NO: 276203 - RNA, 32 nt, Human
uugguuucagaaugagaggucacgccagcuga

SEQ ID NO: 276204 - RNA, 32 nt, Human
uugguuucauauugaauaaaucauugccaaau

SEQ ID NO: 276205 - RNA, 32 nt, Human
uugguuucauucuugcaguugccauacagugc

SEQ ID NO: 276206 - RNA, 32 nt, Human
uugguuucccaaaguguugggauuacaggcau

SEQ ID NO: 276207 - RNA, 32 nt, Human
uugguuuccuggaugcugacugugaagauucu

SEQ ID NO: 276208 - RNA, 18 nt, Human
uugguuucugagggcuuu

SEQ ID NO: 276209 - RNA, 32 nt, Human
uugguuucuggugaggccucucuccuuggcuu

SEQ ID NO: 276210 - RNA, 18 nt, Human
uugguuucuugcccccuu

SEQ ID NO: 276211 - RNA, 32 nt, Human
uugguuucuuuugagcccucucuccuuaacuu

SEQ ID NO: 276212 - RNA, 18 nt, Human
uugguuucuuuuggcuuu

SEQ ID NO: 276213 - RNA, 20 nt, Human
uugguuugccauggguacuu

SEQ ID NO: 276214 - RNA, 32 nt, Human
uugguuugcuaccacauaaagccaugcuguuu

SEQ ID NO: 276215 - RNA, 32 nt, Human
uugguuugcuuuguggcaugugcacuguuuuu

SEQ ID NO: 276216 - RNA, 32 nt, Human
uugguuugggucugcauugccauagugcccga

SEQ ID NO: 276217 - RNA, 21 nt, Human
uugguuuguaauuugggaccu

SEQ ID NO: 276218 - RNA, 32 nt, Human
uugguuugucaagccacaucuguaggaauguu

SEQ ID NO: 276219 - RNA, 32 nt, Human
uugguuuuauuugucaucuagucucaaguaua

SEQ ID NO: 276220 - RNA, 32 nt, Human
uugguuuucacugucucugucucaucuaguac

SEQ ID NO: 276221 - RNA, 20 nt, Human
uugguuuucagcuggggcuu

SEQ ID NO: 276222 - RNA, 32 nt, Human
uugguuuucauuucucuucuucacugccuuuu

SEQ ID NO: 276223 - RNA, 19 nt, Human
uugguuuuccaugggaucu

SEQ ID NO: 276224 - RNA, 32 nt, Human
uugguuuuccucuguuuuuaaacaucuuaggu

SEQ ID NO: 276225 - RNA, 18 nt, Human
uugguuuuccuguaccuu

SEQ ID NO: 276226 - RNA, 32 nt, Human
uugguuuuccuguaggcuggaaguaaaaaugu

SEQ ID NO: 276227 - RNA, 32 nt, Human
uugguuuuccuugcagucgccugcugcugucg

SEQ ID NO: 276228 - RNA, 20 nt, Human
uugguuuucuaaggggcuuu

SEQ ID NO: 276229 - RNA, 23 nt, Human
uugguuuucuccaggaaugaagu

SEQ ID NO: 276230 - RNA, 22 nt, Human
uugguuuucugggcuggggccu

SEQ ID NO: 276231 - RNA, 16 nt, Human
uugguuuucuguccuu

SEQ ID NO: 276232 - RNA, 32 nt, Human
uugguuuucuucuucucguccucguuuguguu

SEQ ID NO: 276233 - RNA, 18 nt, Human
uugguuuugggaagccug

SEQ ID NO: 276234 - RNA, 20 nt, Human
uugguuuuggugguggcuuu

SEQ ID NO: 276235 - RNA, 32 nt, Human
uugguuuuguguccuuuuuauuugcaguuuuu

SEQ ID NO: 276236 - RNA, 32 nt, Human
uugguuuuguuuucccagaggcugccauaugg

SEQ ID NO: 276237 - RNA, 32 nt, Human
uugguuuuuaugcaaccuauggucaugcaggg

SEQ ID NO: 276238 - RNA, 32 nt, Human
uugguuuuugagaaggaaugaagugggaacca

SEQ ID NO: 276239 - RNA, 18 nt, Human
uugguuuuuuggagucuu

SEQ ID NO: 276240 - RNA, 32 nt, Human
uuguaaaaacaaacauacuuguggggucugau

SEQ ID NO: 276241 - RNA, 32 nt, Human
uuguaaaaacuuggccccagaugcuugucccu

SEQ ID NO: 276242 - RNA, 32 nt, Human
uuguaaaaagagacuguuuugggggaaugggg

SEQ ID NO: 276243 - RNA, 32 nt, Human
uuguaaaaaguggacucagcuaggauguuaca

SEQ ID NO: 276244 - RNA, 32 nt, Human
uuguaaaacauauggggcaacaggaggcauug

SEQ ID NO: 276245 - RNA, 31 nt, Human
uuguaaaagagaccucuggggccgagugugg

SEQ ID NO: 276246 - RNA, 32 nt, Human
uuguaaaaguggauuccucaggauaugugaaa

SEQ ID NO: 276247 - RNA, 32 nt, Human
uuguaaaauacugugaacuaaccgcagagcug

SEQ ID NO: 276248 - RNA, 32 nt, Human
uuguaaaauagaaaaaguggaguuggugaauc

SEQ ID NO: 276249 - RNA, 32 nt, Human
uuguaaaauuuugccucucagaagaauggaau

SEQ ID NO: 276250 - RNA, 32 nt, Human
uuguaaacaaauucuaaugggcaaaauaucuu

SEQ ID NO: 276251 - RNA, 32 nt, Human
uuguaaacagaggagaaagggaaagaguacaa

SEQ ID NO: 276252 - RNA, 32 nt, Human
uuguaaaccugacaugguacugugcaucuauu

SEQ ID NO: 276253 - RNA, 32 nt, Human
uuguaaaccuucauucuuacuaguuucauucu

SEQ ID NO: 276254 - RNA, 32 nt, Human
uuguaaacucugcugcuucccaacacaacuag

SEQ ID NO: 276255 - RNA, 32 nt, Human
uuguaaacuugucgcuuuuugauaugauuuuc

SEQ ID NO: 276256 - RNA, 32 nt, Human
uuguaaagaaaauaccaguguuucucauccca

SEQ ID NO: 276257 - RNA, 32 nt, Human
uuguaaagcacaaauuaucugccuuaaagggg

SEQ ID NO: 276258 - RNA, 32 nt, Human
uuguaaagcugcauauucacugaauggauccu

SEQ ID NO: 276259 - RNA, 32 nt, Human
uuguaaagcuggaaccaaguuugcauuuuuga

SEQ ID NO: 276260 - RNA, 32 nt, Human
uuguaaaggacacucauuguugccaagaguuu

SEQ ID NO: 276261 - RNA, 32 nt, Human
uuguaaagggaagaucaaagagccagaagucg

SEQ ID NO: 276262 - RNA, 21 nt, Human
uuguaaauagcacuaguuaga

SEQ ID NO: 276263 - RNA, 32 nt, Human
uuguaaauagcaucuauguuacacucuccuag

SEQ ID NO: 276264 - RNA, 32 nt, Human
uuguaaaugaacauaaugaacagaauuuauga

SEQ ID NO: 276265 - RNA, 32 nt, Human
uuguaaauggcaaaguuuguuuugagguuuuu

SEQ ID NO: 276266 - RNA, 32 nt, Human
uuguaaaugucaguaaucacuucaugaaugcu

SEQ ID NO: 276267 - RNA, 32 nt, Human
uuguaaauguggcagugaugacugaagacuuu

SEQ ID NO: 276268 - RNA, 32 nt, Human
uuguaacaaugauaguugucuccuucaguauu

SEQ ID NO: 276269 - RNA, 32 nt, Human
uuguaacaauugcuucagccuacguuauaaau

SEQ ID NO: 276270 - RNA, 32 nt, Human
uuguaacaggaaauauucuauugaugcuacaa

SEQ ID NO: 276271 - RNA, 24 nt, Human
uuguaacccaggcuggaaugcaau

SEQ ID NO: 276272 - RNA, 32 nt, Human
uuguaacccaggcuggaaugcaauggcaugau

SEQ ID NO: 276273 - RNA, 32 nt, Human
uuguaacccuuguggguugcuaauaaccaagc

SEQ ID NO: 276274 - RNA, 32 nt, Human
uuguaaccuauguaugagaaagggauuuucug

SEQ ID NO: 276275 - RNA, 32 nt, Human
uuguaaccucaagugaugcucccaccucagcc

SEQ ID NO: 276276 - RNA, 32 nt, Human
uuguaacgugacugaaguugaguuuaaguagg

SEQ ID NO: 276277 - RNA, 32 nt, Human
uuguaacucacugcagccugaaacuccuuggc

SEQ ID NO: 276278 - RNA, 32 nt, Human
uuguaacucaugggcuauuccuaagugcccau

SEQ ID NO: 276279 - RNA, 32 nt, Human
uuguaacuccagccugggcaacagagugagac

SEQ ID NO: 276280 - RNA, 32 nt, Human
uuguaacucuuugcuauggcuuuuguuaucac

SEQ ID NO: 276281 - RNA, 32 nt, Human
uuguaacugcaaccugcagaaucaaauuuagg

SEQ ID NO: 276282 - RNA, 32 nt, Human
uuguaacuguaaucccaguuauaggggaggcu

SEQ ID NO: 276283 - RNA, 32 nt, Human
uuguaacuuguucugguaauguccuucccgga

SEQ ID NO: 276284 - RNA, 32 nt, Human
uuguaacuuuuuaaaugucuauagcacugaag

SEQ ID NO: 276285 - RNA, 32 nt, Human
uuguaagaaauccugugccuuccccuuugagc

SEQ ID NO: 276286 - RNA, 32 nt, Human
uuguaagacaacacucauucuaggugauucug

SEQ ID NO: 276287 - RNA, 32 nt, Human
uuguaagacaccagucuauggaauucuguuac

SEQ ID NO: 276288 - RNA, 32 nt, Human
uuguaagagagugaggaauacagugauaguaa

SEQ ID NO: 276289 - RNA, 32 nt, Human
uuguaagagauccugcaaauaucuucuuucca

SEQ ID NO: 276290 - RNA, 32 nt, Human
uuguaagaucuggugacuggcuuuucguucug

SEQ ID NO: 276291 - RNA, 32 nt, Human
uuguaagauggauuucacccccaggccaaugc

SEQ ID NO: 276292 - RNA, 32 nt, Human
uuguaagauuauguuuuacuuaucucaaagga

SEQ ID NO: 276293 - RNA, 32 nt, Human
uuguaagcaaaaaguuauuuuuauauuauaua

SEQ ID NO: 276294 - RNA, 32 nt, Human
uuguaagcagaacucuagcuauaugggguaga

SEQ ID NO: 276295 - RNA, 32 nt, Human
uuguaagccccuuccuuccucccuugcccaaa

SEQ ID NO: 276296 - RNA, 32 nt, Human
uuguaagcccuuaaaagggcuaggaauuucuu

SEQ ID NO: 276297 - RNA, 32 nt, Human
uuguaagccuaaaagugauucuuugaaaguuu

SEQ ID NO: 276298 - RNA, 32 nt, Human
uuguaagccugagaucaauaagaaauguucag

SEQ ID NO: 276299 - RNA, 32 nt, Human
uuguaagccuuucaacagcagcaucaaccuac

SEQ ID NO: 276300 - RNA, 19 nt, Human
uuguaagcucccugggcca

SEQ ID NO: 276301 - RNA, 32 nt, Human
uuguaaggacagugccugggaacugguguagc

SEQ ID NO: 276302 - RNA, 32 nt, Human
uuguaaggcugaggcgaguggaucacuugagg

SEQ ID NO: 276303 - RNA, 32 nt, Human
uuguaagggagacacugacuccagccaagaaa

SEQ ID NO: 276304 - RNA, 32 nt, Human
uuguaagguucuggggcagggagggagcauga

SEQ ID NO: 276305 - RNA, 32 nt, Human
uuguaaguaauuuggaaaguggugugaaauag

SEQ ID NO: 276306 - RNA, 32 nt, Human
uuguaaguaauuuuauaaaauccaccuccucc

SEQ ID NO: 276307 - RNA, 32 nt, Human
uuguaaguaggcuggauaaauggugcuuaaau

SEQ ID NO: 276308 - RNA, 32 nt, Human
uuguaagucugcauuuuuguauaucggguuua

SEQ ID NO: 276309 - RNA, 32 nt, Human
uuguaaguuauucugccaccaccuaacaggac

SEQ ID NO: 276310 - RNA, 32 nt, Human
uuguaauaaagugugauggaaaauccagguaa

SEQ ID NO: 276311 - RNA, 32 nt, Human
uuguaauacugauacaguuuggcugugucccc

SEQ ID NO: 276312 - RNA, 32 nt, Human
uuguaauaguacauugucucuacaaagcaccc

SEQ ID NO: 276313 - RNA, 31 nt, Human
uuguaauauuguccugggccuguguuggggu

SEQ ID NO: 276314 - RNA, 32 nt, Human
uuguaaucacaggggcuaccucccaggaaacc

SEQ ID NO: 276315 - RNA, 32 nt, Human
uuguaauccagugcccuacaaaggcuagaaca

SEQ ID NO: 276316 - RNA, 32 nt, Human
uuguaaucccagcuacucccaaggcugaggca

SEQ ID NO: 276317 - RNA, 32 nt, Human
uuguaaucucugaggagaagcagcagcaaaca

SEQ ID NO: 276318 - RNA, 31 nt, Human
uuguaaucugauuuucagccugugucgauac

SEQ ID NO: 276319 - RNA, 32 nt, Human
uuguaaugugguugcugcugaaggaggaggca

SEQ ID NO: 276320 - RNA, 32 nt, Human
uuguaauguguaugucugguaaauagguauua

SEQ ID NO: 276321 - RNA, 32 nt, Human
uuguaauuaacucuuuguuucccuucauaaaa

SEQ ID NO: 276322 - RNA, 32 nt, Human
uuguaauuaagauuauucuggccaggugcggu

SEQ ID NO: 276323 - RNA, 32 nt, Human
uuguaauuuauaguaaucggaggggaaaacac

SEQ ID NO: 276324 - RNA, 32 nt, Human
uuguaauuuuaguauuuguauuaauaucaggg

SEQ ID NO: 276325 - RNA, 32 nt, Human
uuguacaaaagcuucaaucagaaucacugugc

SEQ ID NO: 276326 - RNA, 32 nt, Human
uuguacaaacgaugugcuuugaagauguuagu

SEQ ID NO: 276327 - RNA, 31 nt, Human
uuguacaaguuccuucuuacauucuuucccu

SEQ ID NO: 276328 - RNA, 32 nt, Human
uuguacaauauguuguaaaauguagaucauag

SEQ ID NO: 276329 - RNA, 32 nt, Human
uuguacaauauugcaaaaauucaugcuugaga

SEQ ID NO: 276330 - RNA, 32 nt, Human
uuguacacaaauuuucuuuucucaguuuuaua

SEQ ID NO: 276331 - RNA, 20 nt, Human
uuguacacacugcccccuca

SEQ ID NO: 276332 - RNA, 32 nt, Human
uuguacaccauggaaaccccaucccugcuccu

SEQ ID NO: 276333 - RNA, 32 nt, Human
uuguacacugaacugcgcugcguguaugugaa

SEQ ID NO: 276334 - RNA, 32 nt, Human
uuguacagauaaucagaagaugauacugaaua

SEQ ID NO: 276335 - RNA, 32 nt, Human
uuguacagauacaagcaaagguuuaauaaaua

SEQ ID NO: 276336 - RNA, 32 nt, Human
uuguacagauggggucuugcuauguugcccaa

SEQ ID NO: 276337 - RNA, 32 nt, Human
uuguacagggaaauggugguuuacuuacaaau

SEQ ID NO: 276338 - RNA, 32 nt, Human
uuguacagggucgucacucagcagaucgagga

SEQ ID NO: 276339 - RNA, 32 nt, Human
uuguacaguauguaggagcaggagaacuuugu

SEQ ID NO: 276340 - RNA, 32 nt, Human
uuguacagugccuggcacucugggugcucaau

SEQ ID NO: 276341 - RNA, 32 nt, Human
uuguacagugccuggcacucugugggugcuca

SEQ ID NO: 276342 - RNA, 32 nt, Human
uuguacauacaaaaucaugucugcaaauagga

SEQ ID NO: 276343 - RNA, 19 nt, Human
uuguacauacuugcacaca

SEQ ID NO: 276344 - RNA, 32 nt, Human
uuguacauaugggaggagggggcagauuccug

SEQ ID NO: 276345 - RNA, 32 nt, Human
uuguacaucucuauuguaauguuuccaguugg

SEQ ID NO: 276346 - RNA, 32 nt, Human
uuguacauguaccaccucccuuuccucuuacu

SEQ ID NO: 276347 - RNA, 32 nt, Human
uuguacauguaccugacuggggucauugugua

SEQ ID NO: 276348 - RNA, 32 nt, Human
uuguacaugugcagaagaauaaggcagcugag

SEQ ID NO: 276349 - RNA, 32 nt, Human
uuguacaugugcuuuaacucugggugaaaaac

SEQ ID NO: 276350 - RNA, 27 nt, Human
uuguacauuauuuguuguccuuuacua

SEQ ID NO: 276351 - RNA, 23 nt, Human
uuguacauuuuuaaauucuuacu

SEQ ID NO: 276352 - RNA, 26 nt, Human
uuguacauuuuuuaugaaaguuacua

SEQ ID NO: 276353 - RNA, 32 nt, Human
uuguaccaaaaaccuugugaggagguggggga

SEQ ID NO: 276354 - RNA, 32 nt, Human
uuguaccaaauuuaaugaacgcguguucugua

SEQ ID NO: 276355 - RNA, 32 nt, Human
uuguaccaaggcaucuccuacucuccauuuau

SEQ ID NO: 276356 - RNA, 32 nt, Human
uuguaccaaguggagcaggugguugcgggcaa

SEQ ID NO: 276357 - RNA, 32 nt, Human
uuguaccaauucagguagaaguagaggccuac

SEQ ID NO: 276358 - RNA, 32 nt, Human
uuguaccaccagcugcugucacugucagagug

SEQ ID NO: 276359 - RNA, 32 nt, Human
uuguaccacugcacuccaaccuggguuacagc

SEQ ID NO: 276360 - RNA, 32 nt, Human
uuguaccacugcacuccagccuggcugacagu

SEQ ID NO: 276361 - RNA, 32 nt, Human
uuguaccacugcacuccagccugggcaacaga

SEQ ID NO: 276362 - RNA, 32 nt, Human
uuguaccacugcacuccagccugggcgacaga

SEQ ID NO: 276363 - RNA, 32 nt, Human
uuguaccacugcacuccagccugggugacaga

SEQ ID NO: 276364 - RNA, 32 nt, Human
uuguaccacugcacuccagccuggucaaugga

SEQ ID NO: 276365 - RNA, 32 nt, Human
uuguaccacugcacuccagcucggggaacaga

SEQ ID NO: 276366 - RNA, 32 nt, Human
uuguaccacugcacuccagucugggcaacaga

SEQ ID NO: 276367 - RNA, 32 nt, Human
uuguaccacugcacuccaguuuggcaacagag

SEQ ID NO: 276368 - RNA, 32 nt, Human
uuguaccacuguacuccagccugggcuggaca

SEQ ID NO: 276369 - RNA, 32 nt, Human
uuguaccacuguauuccagccuggacgacuga

SEQ ID NO: 276370 - RNA, 18 nt, Human
uuguaccaggcugcgugu

SEQ ID NO: 276371 - RNA, 32 nt, Human
uuguaccagguaauuuuugccggggaugggua

SEQ ID NO: 276372 - RNA, 21 nt, Human
uuguaccaugaaauauccaga

SEQ ID NO: 276373 - RNA, 32 nt, Human
uuguaccaugcacuccagccuggguaacagag

SEQ ID NO: 276374 - RNA, 32 nt, Human
uuguaccauggcacuccagccuggacaacaag

SEQ ID NO: 276375 - RNA, 32 nt, Human
uuguaccauugcacuccagccugggcaacaag

SEQ ID NO: 276376 - RNA, 32 nt, Human
uuguaccauugcacuccagccugggcaacaga

SEQ ID NO: 276377 - RNA, 32 nt, Human
uuguacccagauagcugggauuggaagugagg

SEQ ID NO: 276378 - RNA, 32 nt, Human
uuguacccaggaggcagagauugcagugagcu

SEQ ID NO: 276379 - RNA, 32 nt, Human
uuguacccaggaggcggagguuguagugagcu

SEQ ID NO: 276380 - RNA, 32 nt, Human
uuguacccaggagguggagguugcagugagcc

SEQ ID NO: 276381 - RNA, 32 nt, Human
uuguacccaggagguggagguugcggugaacu

SEQ ID NO: 276382 - RNA, 32 nt, Human
uuguaccccagaaaaacuuuuccucccucuuc

SEQ ID NO: 276383 - RNA, 24 nt, Human
uuguaccccaggcuggagugcaau

SEQ ID NO: 276384 - RNA, 32 nt, Human
uuguaccccaggcuggagugcaauggcgugau

SEQ ID NO: 276385 - RNA, 32 nt, Human
uuguaccccaugaccugagguaaagaaaauaa

SEQ ID NO: 276386 - RNA, 32 nt, Human
uuguacccccuuccacuucgucuccccuagcu

SEQ ID NO: 276387 - RNA, 32 nt, Human
uuguacccguaaucccagcacuuugggaggcc

SEQ ID NO: 276388 - RNA, 23 nt, Human
uuguacccuggccagcgcaugua

SEQ ID NO: 276389 - RNA, 32 nt, Human
uuguaccucuagucccagcuacuugggaggcu

SEQ ID NO: 276390 - RNA, 21 nt, Human
uuguaccugcagcuccugcca

SEQ ID NO: 276391 - RNA, 32 nt, Human
uuguaccugcagcuccugccauuucucauugg

SEQ ID NO: 276392 - RNA, 32 nt, Human
uuguaccugcugguauuagcucugccuccuuu

SEQ ID NO: 276393 - RNA, 32 nt, Human
uuguaccuguccagcccugcccuguguugggc

SEQ ID NO: 276394 - RNA, 32 nt, Human
uuguacgcuuuucaccccacccccaaguccug

SEQ ID NO: 276395 - RNA, 32 nt, Human
uuguacuaaaucagauuugccauguccaguac

SEQ ID NO: 276396 - RNA, 32 nt, Human
uuguacuaugacuaaaugaaauuauuucuuac

SEQ ID NO: 276397 - RNA, 32 nt, Human
uuguacucaccaggcuggagugugguagcacg

SEQ ID NO: 276398 - RNA, 32 nt, Human
uuguacucacucacccuaccuccagggcauag

SEQ ID NO: 276399 - RNA, 32 nt, Human
uuguacucaggagucugacuccuggguucuag

SEQ ID NO: 276400 - RNA, 32 nt, Human
uuguacuccagccuggacaacaagagcgaaac

SEQ ID NO: 276401 - RNA, 32 nt, Human
uuguacuccagccuggcaacagagcgagacuc

SEQ ID NO: 276402 - RNA, 32 nt, Human
uuguacuccagccugggcaacaagagugaaac

SEQ ID NO: 276403 - RNA, 32 nt, Human
uuguacuccagccugggcaacaagagugaaau

SEQ ID NO: 276404 - RNA, 32 nt, Human
uuguacuccagccugggcgacaaaagugaaac

SEQ ID NO: 276405 - RNA, 32 nt, Human
uuguacuccgcaccccagaugaucuccaggca

SEQ ID NO: 276406 - RNA, 22 nt, Human
uuguacuccuacacaccuugcu

SEQ ID NO: 276407 - RNA, 32 nt, Human
uuguacugagacaaauuuucauuguuauuuuu

SEQ ID NO: 276408 - RNA, 32 nt, Human
uuguacugcuucuguggcucuucacagaccuc

SEQ ID NO: 276409 - RNA, 32 nt, Human
uuguacuggccccauccucuccucacuguaau

SEQ ID NO: 276410 - RNA, 32 nt, Human
uuguacugugggcucagaaaccgugagagagc

SEQ ID NO: 276411 - RNA, 32 nt, Human
uuguacugugggggccauacugucuguugaca

SEQ ID NO: 276412 - RNA, 32 nt, Human
uuguacuucaaaauauauuuaguaugauuguu

SEQ ID NO: 276413 - RNA, 32 nt, Human
uuguacuucagaaugacugaaacccauauacc

SEQ ID NO: 276414 - RNA, 22 nt, Human
uuguacuuuaaauguaaauuca

SEQ ID NO: 276415 - RNA, 32 nt, Human
uuguacuuucuaugccucccagggagccacgu

SEQ ID NO: 276416 - RNA, 32 nt, Human
uuguacuuucucuuuauuucucagccagcuga

SEQ ID NO: 276417 - RNA, 32 nt, Human
uuguacuuucuggauuccaucuggaccugguu

SEQ ID NO: 276418 - RNA, 32 nt, Human
uuguacuuuucacucacuauuucacuuuauua

SEQ ID NO: 276419 - RNA, 32 nt, Human
uuguacuuuuuguuccagagcugcuucugucu

SEQ ID NO: 276420 - RNA, 32 nt, Human
uuguagaaaagcuuccuaaccaucgagauuac

SEQ ID NO: 276421 - RNA, 32 nt, Human
uuguagaaacaggauuucgccauguuggccag

SEQ ID NO: 276422 - RNA, 32 nt, Human
uuguagaaacagggucucaccauguuguccag

SEQ ID NO: 276423 - RNA, 32 nt, Human
uuguagaaaugggguuucaccauguuguccag

SEQ ID NO: 276424 - RNA, 32 nt, Human
uuguagaaaugggguuucgccauguugcucag

SEQ ID NO: 276425 - RNA, 32 nt, Human
uuguagaaugucgugcugucaccagaaagcug

SEQ ID NO: 276426 - RNA, 32 nt, Human
uuguagacacgggguuucaccauguuggccag

SEQ ID NO: 276427 - RNA, 32 nt, Human
uuguagacagcaguuucccuauauuauuugga

SEQ ID NO: 276428 - RNA, 32 nt, Human
uuguagacaucuauaaauauaaaagggccugu

SEQ ID NO: 276429 - RNA, 32 nt, Human
uuguagaccuguaaaccuuccuucccuucuuc

SEQ ID NO: 276430 - RNA, 32 nt, Human
uuguagacugcuuuuggcaguauggucauuuu

SEQ ID NO: 276431 - RNA, 32 nt, Human
uuguagacuuucaccuggauuauugauauucu

SEQ ID NO: 276432 - RNA, 32 nt, Human
uuguagagacaagguuucacuauguugcccag

SEQ ID NO: 276433 - RNA, 32 nt, Human
uuguagagacaagguuuugccauguugcccag

SEQ ID NO: 276434 - RNA, 32 nt, Human
uuguagagacaggauuucaccauauuggccag

SEQ ID NO: 276435 - RNA, 32 nt, Human
uuguagagacagggcuucaccauguugccaag

SEQ ID NO: 276436 - RNA, 32 nt, Human
uuguagagacagggucucaccaugucacccag

SEQ ID NO: 276437 - RNA, 32 nt, Human
uuguagagacagggucucgccauguugcccag

SEQ ID NO: 276438 - RNA, 32 nt, Human
uuguagagacagggucuucccauguugcccag

SEQ ID NO: 276439 - RNA, 32 nt, Human
uuguagagacagggucuugccauguugcccug

SEQ ID NO: 276440 - RNA, 32 nt, Human
uuguagagacaggguuucaccauauuggccag

SEQ ID NO: 276441 - RNA, 32 nt, Human
uuguagagacaggguuucaccauguugcccag

SEQ ID NO: 276442 - RNA, 32 nt, Human
uuguagagacaggguuucaccauguuggccag

SEQ ID NO: 276443 - RNA, 32 nt, Human
uuguagagacaggguuucaccauguugguuag

SEQ ID NO: 276444 - RNA, 32 nt, Human
uuguagagacaggguuucgccauguugacgag

SEQ ID NO: 276445 - RNA, 32 nt, Human
uuguagagacaggguuucuccauguugcccaa

SEQ ID NO: 276446 - RNA, 32 nt, Human
uuguagagacaggguuuugccauguugcucag

SEQ ID NO: 276447 - RNA, 32 nt, Human
uuguagagacaggguuuugccauguuguccag

SEQ ID NO: 276448 - RNA, 32 nt, Human
uuguagagacgaaguuucaccauguuggccag

SEQ ID NO: 276449 - RNA, 32 nt, Human
uuguagagacgaggucccaccauguugcccag

SEQ ID NO: 276450 - RNA, 32 nt, Human
uuguagagacgagguuucaccauguugcccag

SEQ ID NO: 276451 - RNA, 32 nt, Human
uuguagagacgagguuucgccauguugcccag

SEQ ID NO: 276452 - RNA, 32 nt, Human
uuguagagacggagucucccuauguugccuag

SEQ ID NO: 276453 - RNA, 32 nt, Human
uuguagagacgggguuucaccauguuagccaa

SEQ ID NO: 276454 - RNA, 32 nt, Human
uuguagagacgggguuucaccauguugaccag

SEQ ID NO: 276455 - RNA, 32 nt, Human
uuguagagacgggguuucaccauguuguccag

SEQ ID NO: 276456 - RNA, 32 nt, Human
uuguagagacgggguuucacuguguugcccag

SEQ ID NO: 276457 - RNA, 32 nt, Human
uuguagagacgggguuucgccaaguugaccag

SEQ ID NO: 276458 - RNA, 32 nt, Human
uuguagagacgggguuucgccauguuacccag

SEQ ID NO: 276459 - RNA, 32 nt, Human
uuguagagacgggguuuugccauguugcccag

SEQ ID NO: 276460 - RNA, 32 nt, Human
uuguagagacggguuuucgccauguugccuca

SEQ ID NO: 276461 - RNA, 32 nt, Human
uuguagagacgguguuuugccauguuggccag

SEQ ID NO: 276462 - RNA, 32 nt, Human
uuguagagacuagguuucaccauguuguccag

SEQ ID NO: 276463 - RNA, 32 nt, Human
uuguagagacuggguuuugccauguugaccaa

SEQ ID NO: 276464 - RNA, 32 nt, Human
uuguagagaggggguuucacuauguugcucaa

SEQ ID NO: 276465 - RNA, 32 nt, Human
uuguagagaggguauuuugccauguugcccag

SEQ ID NO: 276466 - RNA, 32 nt, Human
uuguagagauaggguuucauuacauugcucag

SEQ ID NO: 276467 - RNA, 32 nt, Human
uuguagagaugaggagugccacuguguugccc

SEQ ID NO: 276468 - RNA, 32 nt, Human
uuguagagaugaggucucaccauguugcccag

SEQ ID NO: 276469 - RNA, 32 nt, Human
uuguagagaugaggucucccuauguugcccag

SEQ ID NO: 276470 - RNA, 32 nt, Human
uuguagagaugagguuucaccauauuggccag

SEQ ID NO: 276471 - RNA, 32 nt, Human
uuguagagaugagguuucaccuuguuggccag

SEQ ID NO: 276472 - RNA, 32 nt, Human
uuguagagauggagucucccuauguugcucag

SEQ ID NO: 276473 - RNA, 32 nt, Human
uuguagagauggaguuucaccacguuggucag

SEQ ID NO: 276474 - RNA, 32 nt, Human
uuguagagauggaguuucaccauguuggccag

SEQ ID NO: 276475 - RNA, 32 nt, Human
uuguagagaugggaucucacuauguugcucag

SEQ ID NO: 276476 - RNA, 32 nt, Human
uuguagagaugggaucucacucuguuguccag

SEQ ID NO: 276477 - RNA, 32 nt, Human
uuguagagaugggauuucaccauguuacucag

SEQ ID NO: 276478 - RNA, 32 nt, Human
uuguagagaugggauuuugccauguugcccag

SEQ ID NO: 276479 - RNA, 32 nt, Human
uuguagagauggggacuugcuauguugcccag

SEQ ID NO: 276480 - RNA, 32 nt, Human
uuguagagauggggaucuccuuauguugucca

SEQ ID NO: 276481 - RNA, 32 nt, Human
uuguagagaugggggucucacuauguugccca

SEQ ID NO: 276482 - RNA, 32 nt, Human
uuguagagauggggucucacaguguugcccag

SEQ ID NO: 276483 - RNA, 32 nt, Human
uuguagagauggggucucacuauguugcccag

SEQ ID NO: 276484 - RNA, 32 nt, Human
uuguagagauggggucucccuauguugcccag

SEQ ID NO: 276485 - RNA, 32 nt, Human
uuguagagauggggucucgccauguugcccgg

SEQ ID NO: 276486 - RNA, 32 nt, Human
uuguagagauggggucuugcuguguugcccag

SEQ ID NO: 276487 - RNA, 32 nt, Human
uuguagagauggggucuugcuuuguugcccag

SEQ ID NO: 276488 - RNA, 32 nt, Human
uuguagagaugggguuucacaauuuuggccag

SEQ ID NO: 276489 - RNA, 32 nt, Human
uuguagagaugggguuucaucacguugcccag

SEQ ID NO: 276490 - RNA, 32 nt, Human
uuguagagaugggguuucgccauguugaccag

SEQ ID NO: 276491 - RNA, 32 nt, Human
uuguagagaugggguuucgccauguugcccag

SEQ ID NO: 276492 - RNA, 32 nt, Human
uuguagagaugggguuucgcguguuggucagg

SEQ ID NO: 276493 - RNA, 32 nt, Human
uuguagagaugggguuucgucauguugcccag

SEQ ID NO: 276494 - RNA, 32 nt, Human
uuguagagaugggguuucuccauguauugccc

SEQ ID NO: 276495 - RNA, 32 nt, Human
uuguagagaugggguuucuccauguuggucag

SEQ ID NO: 276496 - RNA, 32 nt, Human
uuguagagaugggguuucuccuuauugcccag

SEQ ID NO: 276497 - RNA, 32 nt, Human
uuguagagaugggguuucucgauguuggccag

SEQ ID NO: 276498 - RNA, 32 nt, Human
uuguagagaugggguuucucuguguugcccag

SEQ ID NO: 276499 - RNA, 32 nt, Human
uuguagagaugggguuuugccauguugcccag

SEQ ID NO: 276500 - RNA, 32 nt, Human
uuguagagaugggguuuugccauguugcucag

SEQ ID NO: 276501 - RNA, 32 nt, Human
uuguagagaugggguuuugccguguugcccag

SEQ ID NO: 276502 - RNA, 32 nt, Human
uuguagagccaccauucaaagccaggcagucu

SEQ ID NO: 276503 - RNA, 32 nt, Human
uuguagagcuucuggcacuuggagacuuguau

SEQ ID NO: 276504 - RNA, 32 nt, Human
uuguagaggcgggguuucaccauguugcccag

SEQ ID NO: 276505 - RNA, 32 nt, Human
uuguagaggcgggguuucgccauguugcccag

SEQ ID NO: 276506 - RNA, 32 nt, Human
uuguagagggggauaaaaagaaaagaaauugg

SEQ ID NO: 276507 - RNA, 32 nt, Human
uuguagaggugggguuucaccauauugcccag

SEQ ID NO: 276508 - RNA, 32 nt, Human
uuguagagucaggguuucacccuguugcccac

SEQ ID NO: 276509 - RNA, 32 nt, Human
uuguagagucggagcuuuaccauguuggucag

SEQ ID NO: 276510 - RNA, 32 nt, Human
uuguagauugagcugaauaaccaugggaagug

SEQ ID NO: 276511 - RNA, 32 nt, Human
uuguagauuuucauaagccacaauuuuaaaag

SEQ ID NO: 276512 - RNA, 22 nt, Human
uuguagcaaaaguucugagagg

SEQ ID NO: 276513 - RNA, 32 nt, Human
uuguagcagagggaaaugagacaggaagaugc

SEQ ID NO: 276514 - RNA, 32 nt, Human
uuguagcagcuggucuugaagguggggcauau

SEQ ID NO: 276515 - RNA, 32 nt, Human
uuguagcaggucccgcacuccagccucucgcu

SEQ ID NO: 276516 - RNA, 32 nt, Human
uuguagcagucaggaacuaggcauaucaugcc

SEQ ID NO: 276517 - RNA, 32 nt, Human
uuguagcaugcugucugaauucugggguaagu

SEQ ID NO: 276518 - RNA, 32 nt, Human
uuguagcauuugacaaauuuuaugcuuagcag

SEQ ID NO: 276519 - RNA, 32 nt, Human
uuguagccaccugugcaccaugaccaugcugg

SEQ ID NO: 276520 - RNA, 32 nt, Human
uuguagccauuaaauuuugagacauuuuuguu

SEQ ID NO: 276521 - RNA, 32 nt, Human
uuguagcccaggaguuugagaacagccugggc

SEQ ID NO: 276522 - RNA, 24 nt, Human
uuguagcccaggcuggagugcaau

SEQ ID NO: 276523 - RNA, 32 nt, Human
uuguagcccaggcuggagugcaauggcaggau

SEQ ID NO: 276524 - RNA, 32 nt, Human
uuguagcccaggcugggaugcaauggcauggu

SEQ ID NO: 276525 - RNA, 32 nt, Human
uuguagccucaaacucccaggcucaagcaauc

SEQ ID NO: 276526 - RNA, 32 nt, Human
uuguagccucaaccucccaggcuccaagcagu

SEQ ID NO: 276527 - RNA, 32 nt, Human
uuguagcucacugcagccuccaacuccauggc

SEQ ID NO: 276528 - RNA, 32 nt, Human
uuguagcucacugcagucuucagccuccccag

SEQ ID NO: 276529 - RNA, 32 nt, Human
uuguagcucagagagcaccugauguaucaucu

SEQ ID NO: 276530 - RNA, 21 nt, Human
uuguagcuccugcuggcccca

SEQ ID NO: 276531 - RNA, 32 nt, Human
uuguagcucuggguaagaugaccugagucccu

SEQ ID NO: 276532 - RNA, 32 nt, Human
uuguagcuggggcucaguagucugggcuguga

SEQ ID NO: 276533 - RNA, 20 nt, Human
uuguagcuuugccccagcca

SEQ ID NO: 276534 - RNA, 32 nt, Human
uuguaggaaucccuuugagaaugugauuccuu

SEQ ID NO: 276535 - RNA, 32 nt, Human
uuguaggauacuugcuccauucauacacaacg

SEQ ID NO: 276536 - RNA, 32 nt, Human
uuguaggcagccacacuguguccucacauggc

SEQ ID NO: 276537 - RNA, 32 nt, Human
uuguaggcucuuccagccugaacccauggagu

SEQ ID NO: 276538 - RNA, 32 nt, Human
uuguagggaaagggagagcuuuugauuuuugu

SEQ ID NO: 276539 - RNA, 32 nt, Human
uuguagggagaagggcaggauguuuuuaacug

SEQ ID NO: 276540 - RNA, 32 nt, Human
uuguagggagcuaugaucuugccauugcacuc

SEQ ID NO: 276541 - RNA, 32 nt, Human
uuguagggaggcauccaguguggcaagaaacu

SEQ ID NO: 276542 - RNA, 32 nt, Human
uuguagggggauguuacuccuaaugucacagu

SEQ ID NO: 276543 - RNA, 32 nt, Human
uuguagggguagcauuuaagauucaggaguca

SEQ ID NO: 276544 - RNA, 32 nt, Human
uuguagggucgaggcccaggaggaaggggagg

SEQ ID NO: 276545 - RNA, 32 nt, Human
uuguaggugauauuuauuuucuucugaaacuu

SEQ ID NO: 276546 - RNA, 24 nt, Human
uuguaggugcccugccuggcccca

SEQ ID NO: 276547 - RNA, 32 nt, Human
uuguagguugcuuuuucuuccuccugggcaac

SEQ ID NO: 276548 - RNA, 32 nt, Human
uuguaguagccuuaaaauaaacuguuaaacac

SEQ ID NO: 276549 - RNA, 32 nt, Human
uuguaguaggcuucacuagcuuccugcuucuc

SEQ ID NO: 276550 - RNA, 32 nt, Human
uuguaguauucuauaaaagaaaacauggcuua

SEQ ID NO: 276551 - RNA, 32 nt, Human
uuguagucacaccacuucaguucugggcccua

SEQ ID NO: 276552 - RNA, 32 nt, Human
uuguaguccaagcacacacaaauagugccagg

SEQ ID NO: 276553 - RNA, 32 nt, Human
uuguagucccagcuacucaugaggcuuaaaug

SEQ ID NO: 276554 - RNA, 32 nt, Human
uuguagucguuuccucagccucaucucacugu

SEQ ID NO: 276555 - RNA, 32 nt, Human
uuguagucucugcuucugugaguucaucuuuc

SEQ ID NO: 276556 - RNA, 32 nt, Human
uuguagucuuccuuccuuccucucaggguaag

SEQ ID NO: 276557 - RNA, 32 nt, Human
uuguagugagugcuguuuuccaggagauggag

SEQ ID NO: 276558 - RNA, 32 nt, Human
uuguagugcugagagcaagagcugaucuagcu

SEQ ID NO: 276559 - RNA, 17 nt, Human
uuguagugcuucugcaa

SEQ ID NO: 276560 - RNA, 32 nt, Human
uuguaguggguaaagacaguucagagagaccu

SEQ ID NO: 276561 - RNA, 32 nt, Human
uuguagugucugccauggaacacagacagacc

SEQ ID NO: 276562 - RNA, 32 nt, Human
uuguaguguucuguauuuaucugcacuuugug

SEQ ID NO: 276563 - RNA, 32 nt, Human
uuguaguuaaugaugguugauggguucuaauu

SEQ ID NO: 276564 - RNA, 32 nt, Human
uuguaguuacaguaaauacacugugaagagac

SEQ ID NO: 276565 - RNA, 31 nt, Human
uuguaguucaauaaauuguggguugaacuac

SEQ ID NO: 276566 - RNA, 32 nt, Human
uuguaguugauugugucucaaaccaugaauua

SEQ ID NO: 276567 - RNA, 32 nt, Human
uuguaguuuagauuguaucucuugccuuguuc

SEQ ID NO: 276568 - RNA, 32 nt, Human
uuguauaaaaugcuauguguagagguuuuauu

SEQ ID NO: 276569 - RNA, 24 nt, Human
uuguauaacuuuuauucuuuauua

SEQ ID NO: 276570 - RNA, 32 nt, Human
uuguauacaggaaucuacaucccucugugacu

SEQ ID NO: 276571 - RNA, 32 nt, Human
uuguauacagggggcaccuguggccaggccuc

SEQ ID NO: 276572 - RNA, 32 nt, Human
uuguauacaguggccaaagacaugcuucugcu

SEQ ID NO: 276573 - RNA, 32 nt, Human
uuguauacaguuucaucacugcugucagcuau

SEQ ID NO: 276574 - RNA, 32 nt, Human
uuguauaccuuuccaccaauauagacauucua

SEQ ID NO: 276575 - RNA, 32 nt, Human
uuguauacuauuaaaaccagcacauaaguauu

SEQ ID NO: 276576 - RNA, 32 nt, Human
uuguauagaaauagauauuucuuucgagguuu

SEQ ID NO: 276577 - RNA, 32 nt, Human
uuguauagccccacagauuaaauuuaauuaau

SEQ ID NO: 276578 - RNA, 32 nt, Human
uuguauagggcuggggucaggagaggagaaua

SEQ ID NO: 276579 - RNA, 32 nt, Human
uuguauagugagagaggaggccuggaccgaga

SEQ ID NO: 276580 - RNA, 32 nt, Human
uuguauauaaagcaaauaagccagcagauggg

SEQ ID NO: 276581 - RNA, 32 nt, Human
uuguauauacaacuuuguauccugccuuuucc

SEQ ID NO: 276582 - RNA, 32 nt, Human
uuguauauacuaguuucuuucaugcuauuuuu

SEQ ID NO: 276583 - RNA, 32 nt, Human
uuguauauagggacugaccaugauucuccauu

SEQ ID NO: 276584 - RNA, 32 nt, Human
uuguauaugcuccucaugagaaaagcugaaga

SEQ ID NO: 276585 - RNA, 32 nt, Human
uuguauauguuccucaugagaaaagcugaaga

SEQ ID NO: 276586 - RNA, 32 nt, Human
uuguauauguuuugucccaguuguauaguaau

SEQ ID NO: 276587 - RNA, 32 nt, Human
uuguauauugcauauucacaugaucauugcuc

SEQ ID NO: 276588 - RNA, 32 nt, Human
uuguauauuuuugcagagauggaguuucacca

SEQ ID NO: 276589 - RNA, 32 nt, Human
uuguaucaauccauuuucacacugcuauaagg

SEQ ID NO: 276590 - RNA, 32 nt, Human
uuguaucaauuuaacauauaguaaggauaguu

SEQ ID NO: 276591 - RNA, 32 nt, Human
uuguaucagauacaaaauuuuagugagguauc

SEQ ID NO: 276592 - RNA, 32 nt, Human
uuguauccaacccuccaaaaggcagggacaag

SEQ ID NO: 276593 - RNA, 32 nt, Human
uuguauccacaguagacaaaauagcacuaauc

SEQ ID NO: 276594 - RNA, 32 nt, Human
uuguauccaguucaucaucaagaguggagagu

SEQ ID NO: 276595 - RNA, 24 nt, Human
uuguauccauguguaugcuuguua

SEQ ID NO: 276596 - RNA, 32 nt, Human
uuguauccucuccuuuuagaggcuuugcauuc

SEQ ID NO: 276597 - RNA, 32 nt, Human
uuguauccucugguucuucauuuauugagcac

SEQ ID NO: 276598 - RNA, 32 nt, Human
uuguauccuuaugcccacacugggagaggucu

SEQ ID NO: 276599 - RNA, 32 nt, Human
uuguaucgaccaauggcuuaucagccccagga

SEQ ID NO: 276600 - RNA, 32 nt, Human
uuguaucuauuauuacaugugcugcugaaggg

SEQ ID NO: 276601 - RNA, 32 nt, Human
uuguaucucaaaagcaaaaauguaauaaagga

SEQ ID NO: 276602 - RNA, 32 nt, Human
uuguaucucagucuaaggucucaugcuguugc

SEQ ID NO: 276603 - RNA, 32 nt, Human
uuguaucugaacacaugaaucuuuuugaucag

SEQ ID NO: 276604 - RNA, 32 nt, Human
uuguaucugcacuugcagccucagcuuucaua

SEQ ID NO: 276605 - RNA, 21 nt, Human
uuguaucugucuguucuggga

SEQ ID NO: 276606 - RNA, 32 nt, Human
uuguaucuuggcugucugguuuuauugcauuu

SEQ ID NO: 276607 - RNA, 32 nt, Human
uuguaucuuuaaguacugcuacuugaauaacu

SEQ ID NO: 276608 - RNA, 32 nt, Human
uuguaugaagcugaaaccuaucaacacucuuc

SEQ ID NO: 276609 - RNA, 32 nt, Human
uuguaugaauauccaccuccuuuaaauacucu

SEQ ID NO: 276610 - RNA, 32 nt, Human
uuguaugacugcacuccagccugggugacaga

SEQ ID NO: 276611 - RNA, 32 nt, Human
uuguaugagguccucaggucagcugggagcca

SEQ ID NO: 276612 - RNA, 32 nt, Human
uuguaugaguuguaaguaaucuugccaaaggu

SEQ ID NO: 276613 - RNA, 32 nt, Human
uuguaugauaaauagcuuucauuaauaaacau

SEQ ID NO: 276614 - RNA, 32 nt, Human
uuguaugcucuuaaucucaauuuugaagccag

SEQ ID NO: 276615 - RNA, 32 nt, Human
uuguaugcuggucuuuacuuuuugccaaaauc

SEQ ID NO: 276616 - RNA, 32 nt, Human
uuguauggcaugagcugccacuguucaaggca

SEQ ID NO: 276617 - RNA, 32 nt, Human
uuguauggcuuugguaggcauacuuggagaac

SEQ ID NO: 276618 - RNA, 32 nt, Human
uuguaugggagaaauuuuugaccuuagaaagu

SEQ ID NO: 276619 - RNA, 32 nt, Human
uuguauggucucaaaguuggaugaccucauua

SEQ ID NO: 276620 - RNA, 32 nt, Human
uuguaugguguuuccuuagccuaaagaaugau

SEQ ID NO: 276621 - RNA, 32 nt, Human
uuguauguaaagaauuugggaaagcauuugcu

SEQ ID NO: 276622 - RNA, 32 nt, Human
uuguauguaucuaagauaagacauauagaugc

SEQ ID NO: 276623 - RNA, 32 nt, Human
uuguauguauuuccuccuucuccuccucuuuc

SEQ ID NO: 276624 - RNA, 29 nt, Human
uuguaugucuucccaccucauggauguua

SEQ ID NO: 276625 - RNA, 32 nt, Human
uuguaugucuuggaugcaaguauugcuaaaua

SEQ ID NO: 276626 - RNA, 32 nt, Human
uuguaugugugugaugcuucucccaaagguau

SEQ ID NO: 276627 - RNA, 32 nt, Human
uuguaugugugugcauauaugugaacuguaac

SEQ ID NO: 276628 - RNA, 32 nt, Human
uuguauguuacuggcuaagucuuuggaaaaua

SEQ ID NO: 276629 - RNA, 32 nt, Human
uuguauguucucucugucacugacuuauuugu

SEQ ID NO: 276630 - RNA, 32 nt, Human
uuguauguucuguuguugcaggccaaguggca

SEQ ID NO: 276631 - RNA, 32 nt, Human
uuguauguuuucacugucacugagucaaaccu

SEQ ID NO: 276632 - RNA, 32 nt, Human
uuguauguuuugaaacucuuguauuuaugaua

SEQ ID NO: 276633 - RNA, 32 nt, Human
uuguauguuuuuauguggaugaagagcauuuu

SEQ ID NO: 276634 - RNA, 32 nt, Human
uuguauuaauugccuuugagguuauuuuccgc

SEQ ID NO: 276635 - RNA, 32 nt, Human
uuguauuacaucuguuuucuaguguuauucag

SEQ ID NO: 276636 - RNA, 32 nt, Human
uuguauuauucccccagcucucagggacaaga

SEQ ID NO: 276637 - RNA, 32 nt, Human
uuguauuauugaaagccuuggagaucucacag

SEQ ID NO: 276638 - RNA, 32 nt, Human
uuguauuauuuuuguagagacgguguuuugcc

SEQ ID NO: 276639 - RNA, 32 nt, Human
uuguauucaaaugacgauuauuuuucuacuca

SEQ ID NO: 276640 - RNA, 32 nt, Human
uuguauucccagccugugucccaugggcacaa

SEQ ID NO: 276641 - RNA, 32 nt, Human
uuguauucucuccuguaccucuugagccuuga

SEQ ID NO: 276642 - RNA, 32 nt, Human
uuguauucucucuuacacuguagccucaacua

SEQ ID NO: 276643 - RNA, 32 nt, Human
uuguauucugaaguccuucagcacuugauucc

SEQ ID NO: 276644 - RNA, 32 nt, Human
uuguauucugguccaugguggggaagacccug

SEQ ID NO: 276645 - RNA, 32 nt, Human
uuguauugaagguggugcuucuggccuuggcc

SEQ ID NO: 276646 - RNA, 32 nt, Human
uuguauugcuuauuuuauuaugagcuacaaca

SEQ ID NO: 276647 - RNA, 32 nt, Human
uuguauugcuucuguuucagugcaaaaaugua

SEQ ID NO: 276648 - RNA, 32 nt, Human
uuguauugcuuugcacaaaauuaggaacaggu

SEQ ID NO: 276649 - RNA, 32 nt, Human
uuguauuggcuuuugaggauugcacaugagca

SEQ ID NO: 276650 - RNA, 32 nt, Human
uuguauuguuaaugcaucaucauagaaaaacu

SEQ ID NO: 276651 - RNA, 32 nt, Human
uuguauuucaaagaaggugcugagggaucugu

SEQ ID NO: 276652 - RNA, 32 nt, Human
uuguauuugcaguggcugaggaauucuuguac

SEQ ID NO: 276653 - RNA, 32 nt, Human
uuguauuugcugcaucguaaugacaugaguac

SEQ ID NO: 276654 - RNA, 20 nt, Human
uuguauuuguaaggcuggug

SEQ ID NO: 276655 - RNA, 32 nt, Human
uuguauuuuauuuugcauaaucaugcccuuca

SEQ ID NO: 276656 - RNA, 32 nt, Human
uuguauuuucagucuucgccaggucauugaga

SEQ ID NO: 276657 - RNA, 19 nt, Human
uuguauuuugaugauuuca

SEQ ID NO: 276658 - RNA, 32 nt, Human
uuguauuuugcacaucagauguuuacuagugg

SEQ ID NO: 276659 - RNA, 32 nt, Human
uuguauuuuucauagagacuggguuucaccau

SEQ ID NO: 276660 - RNA, 27 nt, Human
uugucaaaaaucaggcuggagugcagu

SEQ ID NO: 276661 - RNA, 32 nt, Human
uugucaaaaaucaggcuggagugcaguggcau

SEQ ID NO: 276662 - RNA, 32 nt, Human
uugucaaaaggagacaaccacagauccuacag

SEQ ID NO: 276663 - RNA, 32 nt, Human
uugucaaaaggaugagaacaucaugaggucca

SEQ ID NO: 276664 - RNA, 32 nt, Human
uugucaaagauuguuguuggauuuuacacaca

SEQ ID NO: 276665 - RNA, 32 nt, Human
uugucaaauagcaaggccagggcacagcugga

SEQ ID NO: 276666 - RNA, 20 nt, Human
uugucaaaugaauucuucac

SEQ ID NO: 276667 - RNA, 32 nt, Human
uugucaacacagauucugcucucaccaauuua

SEQ ID NO: 276668 - RNA, 32 nt, Human
uugucaacacccuggcagcggggucuucaccu

SEQ ID NO: 276669 - RNA, 32 nt, Human
uugucaacacugcuguaugaagcacaaaagca

SEQ ID NO: 276670 - RNA, 32 nt, Human
uugucaacagcccagaaagagaaagacggaga

SEQ ID NO: 276671 - RNA, 32 nt, Human
uugucaaccacaggugaggacaaggacaggaa

SEQ ID NO: 276672 - RNA, 32 nt, Human
uugucaaccagauuggagugcaguggugcaau

SEQ ID NO: 276673 - RNA, 24 nt, Human
uugucaaccgggcuggagugcagu

SEQ ID NO: 276674 - RNA, 25 nt, Human
uugucaaccgggcuggagugcagug

SEQ ID NO: 276675 - RNA, 32 nt, Human
uugucaaccgggcuggagugcaguggugcaau

SEQ ID NO: 276676 - RNA, 32 nt, Human
uugucaacucugguuagaaacagguccucagg

SEQ ID NO: 276677 - RNA, 32 nt, Human
uugucaagaaugucccaguaaccaggggacac

SEQ ID NO: 276678 - RNA, 32 nt, Human
uugucaagaaugucucaguaaccaggggacac

SEQ ID NO: 276679 - RNA, 32 nt, Human
uugucaagacacacccuugggcuuaucuacag

SEQ ID NO: 276680 - RNA, 32 nt, Human
uugucaagagccaagacacagguaaugcacga

SEQ ID NO: 276681 - RNA, 32 nt, Human
uugucaagagccaguaagcagacagaugcuga

SEQ ID NO: 276682 - RNA, 32 nt, Human
uugucaagauggcugcgcugucccuuugaguu

SEQ ID NO: 276683 - RNA, 32 nt, Human
uugucaagcaauuuguccauguggaaagaauu

SEQ ID NO: 276684 - RNA, 32 nt, Human
uugucaauaacagguuuguuugugcuuugucc

SEQ ID NO: 276685 - RNA, 32 nt, Human
uugucaaugugcacuccuagcuuggugucuca

SEQ ID NO: 276686 - RNA, 24 nt, Human
uugucacaaaaggcugcuaaggaa

SEQ ID NO: 276687 - RNA, 32 nt, Human
uugucacaccuggaagcuuggugaauaauugg

SEQ ID NO: 276688 - RNA, 21 nt, Human
uugucacacugaggggacugg

SEQ ID NO: 276689 - RNA, 32 nt, Human
uugucacacuguacuguaauucccucugugcc

SEQ ID NO: 276690 - RNA, 32 nt, Human
uugucacacuugaguauaagcuaauuuauccu

SEQ ID NO: 276691 - RNA, 32 nt, Human
uugucacaucuucccaagccaggccagccagg

SEQ ID NO: 276692 - RNA, 32 nt, Human
uugucacauguucuccugguucuugaauuugc

SEQ ID NO: 276693 - RNA, 23 nt, Human
uugucaccaggcuggagugcagu

SEQ ID NO: 276694 - RNA, 24 nt, Human
uugucacccacgcuggagugcaau

SEQ ID NO: 276695 - RNA, 25 nt, Human
uugucacccacgcuggagugcaaug

SEQ ID NO: 276696 - RNA, 32 nt, Human
uugucacccacgcuggagugcaaugguguggu

SEQ ID NO: 276697 - RNA, 22 nt, Human
uugucacccagacuggagugcg

SEQ ID NO: 276698 - RNA, 24 nt, Human
uugucacccagacuggagugcgau

SEQ ID NO: 276699 - RNA, 25 nt, Human
uugucacccagacuggagugcgaug

SEQ ID NO: 276700 - RNA, 32 nt, Human
uugucacccagacuggagugcgauggcacgau

SEQ ID NO: 276701 - RNA, 24 nt, Human
uugucacccaggauggagugcagu

SEQ ID NO: 276702 - RNA, 32 nt, Human
uugucacccaggcaggagugcaguggcguuau

SEQ ID NO: 276703 - RNA, 32 nt, Human
uugucacccaggccggagugcaguggcaugau

SEQ ID NO: 276704 - RNA, 23 nt, Human
uugucacccaggcuagagugcag

SEQ ID NO: 276705 - RNA, 24 nt, Human
uugucacccaggcuagagugcagu

SEQ ID NO: 276706 - RNA, 25 nt, Human
uugucacccaggcuagagugcagug

SEQ ID NO: 276707 - RNA, 32 nt, Human
uugucacccaggcuagagugcaguggcacgau

SEQ ID NO: 276708 - RNA, 32 nt, Human
uugucacccaggcuagagugcaguggcaugau

SEQ ID NO: 276709 - RNA, 32 nt, Human
uugucacccaggcuagagugcaguggugcaau

SEQ ID NO: 276710 - RNA, 32 nt, Human
uugucacccaggcuggaaugcaguggcacaau

SEQ ID NO: 276711 - RNA, 24 nt, Human
uugucacccaggcuggacugcagu

SEQ ID NO: 276712 - RNA, 22 nt, Human
uugucacccaggcuggaguaca

SEQ ID NO: 276713 - RNA, 24 nt, Human
uugucacccaggcuggaguacaau

SEQ ID NO: 276714 - RNA, 25 nt, Human
uugucacccaggcuggaguacaaug

SEQ ID NO: 276715 - RNA, 32 nt, Human
uugucacccaggcuggaguacaaugaugcgau

SEQ ID NO: 276716 - RNA, 24 nt, Human
uugucacccaggcuggaguacagu

SEQ ID NO: 276717 - RNA, 25 nt, Human
uugucacccaggcuggaguacagug

SEQ ID NO: 276718 - RNA, 32 nt, Human
uugucacccaggcuggaguacaguggcacgau

SEQ ID NO: 276719 - RNA, 32 nt, Human
uugucacccaggcuggaguacaguggcaugau

SEQ ID NO: 276720 - RNA, 32 nt, Human
uugucacccaggcuggaguacaguggcgugau

SEQ ID NO: 276721 - RNA, 32 nt, Human
uugucacccaggcuggaguauaguggcacaaa

SEQ ID NO: 276722 - RNA, 24 nt, Human
uugucacccaggcuggaguccagu

SEQ ID NO: 276723 - RNA, 32 nt, Human
uugucacccaggcuggaguccaguggcacaau

SEQ ID NO: 276724 - RNA, 21 nt, Human
uugucacccaggcuggagugc

SEQ ID NO: 276725 - RNA, 22 nt, Human
uugucacccaggcuggagugca

SEQ ID NO: 276726 - RNA, 24 nt, Human
uugucacccaggcuggagugcaau

SEQ ID NO: 276727 - RNA, 25 nt, Human
uugucacccaggcuggagugcaaug

SEQ ID NO: 276728 - RNA, 32 nt, Human
uugucacccaggcuggagugcaauggcacaau

SEQ ID NO: 276729 - RNA, 32 nt, Human
uugucacccaggcuggagugcaauggcacgau

SEQ ID NO: 276730 - RNA, 32 nt, Human
uugucacccaggcuggagugcaauggcaugau

SEQ ID NO: 276731 - RNA, 32 nt, Human
uugucacccaggcuggagugcaauggcgcgau

SEQ ID NO: 276732 - RNA, 32 nt, Human
uugucacccaggcuggagugcaauggcgugau

SEQ ID NO: 276733 - RNA, 32 nt, Human
uugucacccaggcuggagugcaaugguguguu

SEQ ID NO: 276734 - RNA, 24 nt, Human
uugucacccaggcuggagugcagu

SEQ ID NO: 276735 - RNA, 32 nt, Human
uugucacccaggcuggagugcaguagugcgau

SEQ ID NO: 276736 - RNA, 25 nt, Human
uugucacccaggcuggagugcagug

SEQ ID NO: 276737 - RNA, 32 nt, Human
uugucacccaggcuggagugcaguggcacaau

SEQ ID NO: 276738 - RNA, 32 nt, Human
uugucacccaggcuggagugcaguggcacgau

SEQ ID NO: 276739 - RNA, 32 nt, Human
uugucacccaggcuggagugcaguggcaugau

SEQ ID NO: 276740 - RNA, 32 nt, Human
uugucacccaggcuggagugcaguggcgcaau

SEQ ID NO: 276741 - RNA, 32 nt, Human
uugucacccaggcuggagugcaguggcgccau

SEQ ID NO: 276742 - RNA, 32 nt, Human
uugucacccaggcuggagugcaguggcgcgau

SEQ ID NO: 276743 - RNA, 32 nt, Human
uugucacccaggcuggagugcaguggcucaau

SEQ ID NO: 276744 - RNA, 32 nt, Human
uugucacccaggcuggagugcaguggggcaau

SEQ ID NO: 276745 - RNA, 32 nt, Human
uugucacccaggcuggagugcaguggugcaau

SEQ ID NO: 276746 - RNA, 32 nt, Human
uugucacccaggcuggagugcaguggugugau

SEQ ID NO: 276747 - RNA, 32 nt, Human
uugucacccaggcuggagugcagugucgugau

SEQ ID NO: 276748 - RNA, 32 nt, Human
uugucacccaggcuggagugccauggcacgau

SEQ ID NO: 276749 - RNA, 32 nt, Human
uugucacccaggcuggagugcuguggugugau

SEQ ID NO: 276750 - RNA, 32 nt, Human
uugucacccaggcuggagugcugugguguuac

SEQ ID NO: 276751 - RNA, 24 nt, Human
uugucacccaggcuggaguguagu

SEQ ID NO: 276752 - RNA, 32 nt, Human
uugucacccaggcuggaguguaguggugugau

SEQ ID NO: 276753 - RNA, 32 nt, Human
uugucacccaggcuguagugcgguggcgcgau

SEQ ID NO: 276754 - RNA, 32 nt, Human
uugucacccaugcuggaguacaauggcacaaa

SEQ ID NO: 276755 - RNA, 32 nt, Human
uugucaccccagcuggagugcaguagcacgau

SEQ ID NO: 276756 - RNA, 27 nt, Human
uugucaccccugcugcuggagugcaau

SEQ ID NO: 276757 - RNA, 32 nt, Human
uugucaccccugcugcuggagugcaauugcac

SEQ ID NO: 276758 - RNA, 32 nt, Human
uugucaccccugggaagauucucccaccuccu

SEQ ID NO: 276759 - RNA, 32 nt, Human
uugucacccgggacagaaaacucagucuuuuc

SEQ ID NO: 276760 - RNA, 32 nt, Human
uugucacccuuuuaccaucuuugcuauacuau

SEQ ID NO: 276761 - RNA, 24 nt, Human
uugucaccgaggcuggagugcaau

SEQ ID NO: 276762 - RNA, 25 nt, Human
uugucaccgaggcuggagugcaaug

SEQ ID NO: 276763 - RNA, 32 nt, Human
uugucaccgaggcuggagugcaaugacaugau

SEQ ID NO: 276764 - RNA, 32 nt, Human
uugucaccgaggcuggagugcaauggcccgau

SEQ ID NO: 276765 - RNA, 24 nt, Human
uugucaccuaagcuggaguacagu

SEQ ID NO: 276766 - RNA, 25 nt, Human
uugucaccuaagcuggaguacagug

SEQ ID NO: 276767 - RNA, 32 nt, Human
uugucaccuaagcuggagugcagugcgcgauc

SEQ ID NO: 276768 - RNA, 22 nt, Human
uugucaccuagacuggagugca

SEQ ID NO: 276769 - RNA, 24 nt, Human
uugucaccuagacuggagugcaau

SEQ ID NO: 276770 - RNA, 25 nt, Human
uugucaccuagacuggagugcaaug

SEQ ID NO: 276771 - RNA, 32 nt, Human
uugucaccuagacuggagugcaauggcgugau

SEQ ID NO: 276772 - RNA, 24 nt, Human
uugucaccuaggcaagagugcaau

SEQ ID NO: 276773 - RNA, 25 nt, Human
uugucaccuaggcaagagugcaaug

SEQ ID NO: 276774 - RNA, 32 nt, Human
uugucaccuaggcaagagugcaauggcacaau

SEQ ID NO: 276775 - RNA, 24 nt, Human
uugucaccuaggcuggagugcagu

SEQ ID NO: 276776 - RNA, 25 nt, Human
uugucaccuaggcuggagugcagug

SEQ ID NO: 276777 - RNA, 32 nt, Human
uugucaccugggcugcucucuccugggacauc

SEQ ID NO: 276778 - RNA, 32 nt, Human
uugucaccuguaccugucacacaucuugaaaa

SEQ ID NO: 276779 - RNA, 32 nt, Human
uugucacgaaggaaguguugaccuuggagggu

SEQ ID NO: 276780 - RNA, 24 nt, Human
uugucacgcaggcuagagugcagu

SEQ ID NO: 276781 - RNA, 25 nt, Human
uugucacgcaggcuagagugcagug

SEQ ID NO: 276782 - RNA, 21 nt, Human
uugucacuacugaggagcuga

SEQ ID NO: 276783 - RNA, 20 nt, Human
uugucacuaguaggagacug

SEQ ID NO: 276784 - RNA, 32 nt, Human
uugucacucaggcuggagugcaguggugugau

SEQ ID NO: 276785 - RNA, 21 nt, Human
uugucacucuauccaggcugg

SEQ ID NO: 276786 - RNA, 32 nt, Human
uugucacugaagcuacaggaauccaagaacca

SEQ ID NO: 276787 - RNA, 32 nt, Human
uugucacugaucugaagccacucccccuggag

SEQ ID NO: 276788 - RNA, 20 nt, Human
uugucacugcccucucccca

SEQ ID NO: 276789 - RNA, 32 nt, Human
uugucacugccgucugugcacugauucacacu

SEQ ID NO: 276790 - RNA, 17 nt, Human
uugucacuggagugcuu

SEQ ID NO: 276791 - RNA, 32 nt, Human
uugucacuggaugcuacuugaagagggaguac

SEQ ID NO: 276792 - RNA, 32 nt, Human
uugucacuggcguccuggaauccgaccguguu

SEQ ID NO: 276793 - RNA, 32 nt, Human
uugucacugugacaacacaggaaaaguugguu

SEQ ID NO: 276794 - RNA, 32 nt, Human
uugucacuuaaguuuggagugcaguggcauga

SEQ ID NO: 276795 - RNA, 32 nt, Human
uugucacuuagggcagcuucuccaacuuuaac

SEQ ID NO: 276796 - RNA, 32 nt, Human
uugucacuugaacccuguaauugucacacauc

SEQ ID NO: 276797 - RNA, 32 nt, Human
uugucacuugcaucuucacaaaggauaaacca

SEQ ID NO: 276798 - RNA, 32 nt, Human
uugucacuugcccucuggcuugggcuccuuuu

SEQ ID NO: 276799 - RNA, 32 nt, Human
uugucacuuguucacuguccccaaaccuaugg

SEQ ID NO: 276800 - RNA, 32 nt, Human
uugucacuuuauuacucccagaacaacaacua

SEQ ID NO: 276801 - RNA, 32 nt, Human
uugucacuuuauuuuucugucuguaaauaugc

SEQ ID NO: 276802 - RNA, 32 nt, Human
uugucacuuucuuaaucucugaucucuugagg

SEQ ID NO: 276803 - RNA, 23 nt, Human
uugucacuuuuuguucuuaacca

SEQ ID NO: 276804 - RNA, 32 nt, Human
uugucagaaaaacagcugcaggcuccaaagac

SEQ ID NO: 276805 - RNA, 32 nt, Human
uugucagagacacuaaccagcuauccaaaugc

SEQ ID NO: 276806 - RNA, 32 nt, Human
uugucagagccacugagugcugugcugcucga

SEQ ID NO: 276807 - RNA, 32 nt, Human
uugucagaggcgggggacagcagaggcugcag

SEQ ID NO: 276808 - RNA, 32 nt, Human
uugucagauauaaucaaaguucuguucaguga

SEQ ID NO: 276809 - RNA, 32 nt, Human
uugucagcacuuccaguuuagaacgcaauguu

SEQ ID NO: 276810 - RNA, 32 nt, Human
uugucagcagcccagaggcccuggaauugugg

SEQ ID NO: 276811 - RNA, 32 nt, Human
uugucagcaggucucugugcacugguauuggg

SEQ ID NO: 276812 - RNA, 32 nt, Human
uugucagcaucaggaaggccuuugcuucuugc

SEQ ID NO: 276813 - RNA, 24 nt, Human
uugucagccaggcuggagugcaau

SEQ ID NO: 276814 - RNA, 25 nt, Human
uugucagccaggcuggagugcaaug

SEQ ID NO: 276815 - RNA, 32 nt, Human
uugucagccaggcuggagugcaaugugcaaug

SEQ ID NO: 276816 - RNA, 24 nt, Human
uugucagccaggcuggagugcagu

SEQ ID NO: 276817 - RNA, 25 nt, Human
uugucagccaggcuggagugcagug

SEQ ID NO: 276818 - RNA, 32 nt, Human
uugucagcccucucauacuaugaacauauggg

SEQ ID NO: 276819 - RNA, 32 nt, Human
uugucagcccuuaaaagagcuaggaauuucuu

SEQ ID NO: 276820 - RNA, 32 nt, Human
uugucagcccuuaaaagggcuaggaauuucuu

SEQ ID NO: 276821 - RNA, 32 nt, Human
uugucagcgaagggaaugagacucugggaagu

SEQ ID NO: 276822 - RNA, 32 nt, Human
uugucagcucaaccugguggguucaguucugu

SEQ ID NO: 276823 - RNA, 32 nt, Human
uugucagcucccuguccugugugugggcagaa

SEQ ID NO: 276824 - RNA, 32 nt, Human
uugucagcucccuguccugugugugggcggaa

SEQ ID NO: 276825 - RNA, 32 nt, Human
uugucagcugcuugugaaacucagccagguug

SEQ ID NO: 276826 - RNA, 32 nt, Human
uugucagcugucuucauuuccugggcuaagca

SEQ ID NO: 276827 - RNA, 32 nt, Human
uugucagcugugguguaaaacauaucaaguuc

SEQ ID NO: 276828 - RNA, 30 nt, Human
uugucagcuuaucaaucagacugaucuaau

SEQ ID NO: 276829 - RNA, 32 nt, Human
uugucaggaacccccagugugaccucacacau

SEQ ID NO: 276830 - RNA, 32 nt, Human
uugucaggacaguaugugagugucuggagaca

SEQ ID NO: 276831 - RNA, 32 nt, Human
uugucaggcccagccacaucuuuacgccaugg

SEQ ID NO: 276832 - RNA, 32 nt, Human
uugucaggcccuucaucuucauggcccaccug

SEQ ID NO: 276833 - RNA, 32 nt, Human
uugucagggaggugccaguuacagcaggugau

SEQ ID NO: 276834 - RNA, 32 nt, Human
uugucagggcuggaacuauuguauagaagaua

SEQ ID NO: 276835 - RNA, 32 nt, Human
uugucaggggcagccugguucagagcucagag

SEQ ID NO: 276836 - RNA, 32 nt, Human
uugucaggucaccagauaaaggcaagucuugu

SEQ ID NO: 276837 - RNA, 32 nt, Human
uugucagucaugccagaagguucuagaacugc

SEQ ID NO: 276838 - RNA, 32 nt, Human
uugucaguccuccugaacauucaggaaaucaa

SEQ ID NO: 276839 - RNA, 32 nt, Human
uugucagucgucucucaguucuugagguauau

SEQ ID NO: 276840 - RNA, 32 nt, Human
uugucagugauuagaacaacacuguuuacaua

SEQ ID NO: 276841 - RNA, 32 nt, Human
uugucaguuauucaaaaauaagaaguuauagg

SEQ ID NO: 276842 - RNA, 32 nt, Human
uugucauagccuugggagccaggcugguauga

SEQ ID NO: 276843 - RNA, 32 nt, Human
uugucauaucaucuguaaugauuauucacuag

SEQ ID NO: 276844 - RNA, 32 nt, Human
uugucauauccagcagggagcagcuugguuca

SEQ ID NO: 276845 - RNA, 32 nt, Human
uugucauaugcugcuggugagguaaagguggg

SEQ ID NO: 276846 - RNA, 32 nt, Human
uugucauauugugcucugagcaauuucaauua

SEQ ID NO: 276847 - RNA, 32 nt, Human
uugucaucaccuuccaagaaaguuuccuucug

SEQ ID NO: 276848 - RNA, 32 nt, Human
uugucauccaagcuggaguacagugccaugau

SEQ ID NO: 276849 - RNA, 32 nt, Human
uugucauccccguguuacuguguagaauuucu

SEQ ID NO: 276850 - RNA, 32 nt, Human
uugucauccucccauggcuuccccugcccuca

SEQ ID NO: 276851 - RNA, 32 nt, Human
uugucauccuggcuggagugugauggugcgau

SEQ ID NO: 276852 - RNA, 32 nt, Human
uugucauccugguuguccaacucugaauguac

SEQ ID NO: 276853 - RNA, 32 nt, Human
uugucaucuccgcaaggccagaaagugaucac

SEQ ID NO: 276854 - RNA, 32 nt, Human
uugucaucuguugccacauccauggaacucag

SEQ ID NO: 276855 - RNA, 32 nt, Human
uugucaugaccagacaagauaggaaaggggaa

SEQ ID NO: 276856 - RNA, 32 nt, Human
uugucauggaaaugcaccuguuccaagucauu

SEQ ID NO: 276857 - RNA, 22 nt, Human
uugucauucaugagaagaaugg

SEQ ID NO: 276858 - RNA, 24 nt, Human
uugucauuccauugagaaagcuga

SEQ ID NO: 276859 - RNA, 32 nt, Human
uugucauucuuaucuccagccugggaaaaguu

SEQ ID NO: 276860 - RNA, 23 nt, Human
uugucauucuuggagagagguga

SEQ ID NO: 276861 - RNA, 24 nt, Human
uugucauucuuugcacgaaacugg

SEQ ID NO: 276862 - RNA, 32 nt, Human
uugucauugcauuuccacauucccaggaaagc

SEQ ID NO: 276863 - RNA, 32 nt, Human
uugucauuuaacauaguuugugauauuucagu

SEQ ID NO: 276864 - RNA, 32 nt, Human
uugucauuuaacauaguuugugguauuucagu

SEQ ID NO: 276865 - RNA, 32 nt, Human
uugucauuugccagacaaguggagauuuuugc

SEQ ID NO: 276866 - RNA, 31 nt, Human
uugucauuugugaaggaaguuggagagucac

SEQ ID NO: 276867 - RNA, 32 nt, Human
uugucauuuguggcuuucuuucuuaucaucau

SEQ ID NO: 276868 - RNA, 32 nt, Human
uugucauuuuuauccagagucaagauucucaa

SEQ ID NO: 276869 - RNA, 32 nt, Human
uuguccaaacuguuggggaagcucccagaacu

SEQ ID NO: 276870 - RNA, 32 nt, Human
uuguccaacauuuucuguagaagaacuucauc

SEQ ID NO: 276871 - RNA, 32 nt, Human
uuguccaacccaaaggcucuuuucagagccac

SEQ ID NO: 276872 - RNA, 32 nt, Human
uuguccaacucauugauuucagagauagggaa

SEQ ID NO: 276873 - RNA, 32 nt, Human
uuguccaagcuggucucaaacuccuggguuca

SEQ ID NO: 276874 - RNA, 32 nt, Human
uuguccaauacaguaacuuuuagccaccagug

SEQ ID NO: 276875 - RNA, 32 nt, Human
uuguccaauucuguaacauucaucuccauuuu

SEQ ID NO: 276876 - RNA, 32 nt, Human
uuguccacaggcacuuucaagaacuuugggau

SEQ ID NO: 276877 - RNA, 32 nt, Human
uuguccaccauuccuuuaaauucuccaaccca

SEQ ID NO: 276878 - RNA, 32 nt, Human
uuguccacccacuuaguccacucugagucgau

SEQ ID NO: 276879 - RNA, 32 nt, Human
uuguccacuguggccuugcaaugcuuuguggc

SEQ ID NO: 276880 - RNA, 32 nt, Human
uuguccacuuguuuacaauguccuccuuuuaa

SEQ ID NO: 276881 - RNA, 32 nt, Human
uuguccagaaaaccccagugcuacaagauguc

SEQ ID NO: 276882 - RNA, 32 nt, Human
uuguccagaaagauucaucuguggucugucug

SEQ ID NO: 276883 - RNA, 32 nt, Human
uuguccagacaacuuacauacacuccauggca

SEQ ID NO: 276884 - RNA, 32 nt, Human
uuguccagacucccccgcccccucucugaugc

SEQ ID NO: 276885 - RNA, 32 nt, Human
uuguccagcaguguuucugcaguggcugcagg

SEQ ID NO: 276886 - RNA, 32 nt, Human
uuguccagcugcacucuccucuccugggaccc

SEQ ID NO: 276887 - RNA, 32 nt, Human
uuguccagcugccuggcucuuuugcaauaaca

SEQ ID NO: 276888 - RNA, 21 nt, Human
uuguccaggcuagagugcagu

SEQ ID NO: 276889 - RNA, 22 nt, Human
uuguccaggcuagagugcagug

SEQ ID NO: 276890 - RNA, 23 nt, Human
uuguccaggcuagagugcagugg

SEQ ID NO: 276891 - RNA, 32 nt, Human
uuguccaggcuagagugcaguggugugaucac

SEQ ID NO: 276892 - RNA, 32 nt, Human
uuguccaggcuggagcgcaguugauuguagcu

SEQ ID NO: 276893 - RNA, 32 nt, Human
uuguccaggcuggaggagugcagucguacagu

SEQ ID NO: 276894 - RNA, 21 nt, Human
uuguccaggcuggaguauaau

SEQ ID NO: 276895 - RNA, 32 nt, Human
uuguccaggcuggaguauaauggugcgaucuc

SEQ ID NO: 276896 - RNA, 19 nt, Human
uuguccaggcuggagugca

SEQ ID NO: 276897 - RNA, 21 nt, Human
uuguccaggcuggagugcaau

SEQ ID NO: 276898 - RNA, 32 nt, Human
uuguccaggcuggagugcaauagcgcgaucug

SEQ ID NO: 276899 - RNA, 22 nt, Human
uuguccaggcuggagugcaaug

SEQ ID NO: 276900 - RNA, 32 nt, Human
uuguccaggcuggagugcaauggcacgaucuc

SEQ ID NO: 276901 - RNA, 32 nt, Human
uuguccaggcuggagugcaauggcgcaaucuu

SEQ ID NO: 276902 - RNA, 32 nt, Human
uuguccaggcuggagugcaauggugugaucuc

SEQ ID NO: 276903 - RNA, 32 nt, Human
uuguccaggcuggagugcagcgauauggucau

SEQ ID NO: 276904 - RNA, 21 nt, Human
uuguccaggcuggagugcagu

SEQ ID NO: 276905 - RNA, 32 nt, Human
uuguccaggcuggagugcaguggcaccaugcc

SEQ ID NO: 276906 - RNA, 32 nt, Human
uuguccaggcuggagugcaguggcgcgaucua

SEQ ID NO: 276907 - RNA, 32 nt, Human
uuguccaggcuggagugcaguggugugaucuc

SEQ ID NO: 276908 - RNA, 32 nt, Human
uuguccaggcuggucucagaauucuggugagu

SEQ ID NO: 276909 - RNA, 32 nt, Human
uuguccaggcuggucuugaacuccugagcuca

SEQ ID NO: 276910 - RNA, 32 nt, Human
uuguccaggcuggucuugaauuccugggcuca

SEQ ID NO: 276911 - RNA, 32 nt, Human
uuguccagggccugaggaaauggcuccccagg

SEQ ID NO: 276912 - RNA, 32 nt, Human
uuguccaggggagggcccugccacccacaauu

SEQ ID NO: 276913 - RNA, 32 nt, Human
uuguccaguauuuuucccuuuuuaaccauucc

SEQ ID NO: 276914 - RNA, 21 nt, Human
uuguccagucuggagugcaau

SEQ ID NO: 276915 - RNA, 22 nt, Human
uuguccagucuggagugcaaug

SEQ ID NO: 276916 - RNA, 32 nt, Human
uuguccagucuggagugcaauggcacaaucuc

SEQ ID NO: 276917 - RNA, 32 nt, Human
uuguccagugcucuccccaggcuggccccgcc

SEQ ID NO: 276918 - RNA, 32 nt, Human
uuguccaguuaauuugaaaaggccccagauga

SEQ ID NO: 276919 - RNA, 32 nt, Human
uuguccauaccagacagggagcaggggguagc

SEQ ID NO: 276920 - RNA, 32 nt, Human
uuguccaucagcaagagagagcagcuggaaca

SEQ ID NO: 276921 - RNA, 32 nt, Human
uuguccaugccaacagccugggagaugagaca

SEQ ID NO: 276922 - RNA, 32 nt, Human
uuguccaugccaccaauuccacugcuacuugc

SEQ ID NO: 276923 - RNA, 32 nt, Human
uuguccaugccauuuagcaaucucaucuccua

SEQ ID NO: 276924 - RNA, 32 nt, Human
uuguccauucaucugcccacccaucugucccu

SEQ ID NO: 276925 - RNA, 32 nt, Human
uuguccauuucucuucccuccucuugcauuuu

SEQ ID NO: 276926 - RNA, 32 nt, Human
uugucccaaguugaccuagggugacuuuuaua

SEQ ID NO: 276927 - RNA, 32 nt, Human
uugucccaaugaaauacugagaugcugggcug

SEQ ID NO: 276928 - RNA, 32 nt, Human
uugucccacaguaggucuucuguccgcacccg

SEQ ID NO: 276929 - RNA, 32 nt, Human
uugucccacaucaggauuuucuagagggcccu

SEQ ID NO: 276930 - RNA, 32 nt, Human
uugucccacccacucuucagaggcuaggcccc

SEQ ID NO: 276931 - RNA, 32 nt, Human
uugucccacuuuuacuaaacaguggcagcaga

SEQ ID NO: 276932 - RNA, 32 nt, Human
uugucccagacuaugaacggcauggaaaccaa

SEQ ID NO: 276933 - RNA, 32 nt, Human
uugucccagcuacucaggaggcugaggcagga

SEQ ID NO: 276934 - RNA, 32 nt, Human
uugucccagcuacucgggaggcugaggcagga

SEQ ID NO: 276935 - RNA, 32 nt, Human
uugucccagcuauucaggaggcugacguggga

SEQ ID NO: 276936 - RNA, 32 nt, Human
uugucccagcugcucuggaggcugaggcagga

SEQ ID NO: 276937 - RNA, 32 nt, Human
uugucccagcugcuugggaggcugaggcagga

SEQ ID NO: 276938 - RNA, 32 nt, Human
uugucccagcuguuccguaggcugaggcacga

SEQ ID NO: 276939 - RNA, 32 nt, Human
uugucccagcuucuccccugggggccugagag

SEQ ID NO: 276940 - RNA, 21 nt, Human
uugucccagguaccccugcug

SEQ ID NO: 276941 - RNA, 32 nt, Human
uugucccauucaagccaccgagcucaccacag

SEQ ID NO: 276942 - RNA, 32 nt, Human
uuguccccaagcaacagagugagggucugucu

SEQ ID NO: 276943 - RNA, 32 nt, Human
uuguccccaagccaugguggcagaggagcugg

SEQ ID NO: 276944 - RNA, 32 nt, Human
uuguccccacuaccaucucccucucucaguau

SEQ ID NO: 276945 - RNA, 32 nt, Human
uuguccccagagaggaggauguggugagcccc

SEQ ID NO: 276946 - RNA, 32 nt, Human
uuguccccaggaagcucgccagugcaugggac

SEQ ID NO: 276947 - RNA, 32 nt, Human
uuguccccaugcaacaaccaccaccuuauaca

SEQ ID NO: 276948 - RNA, 32 nt, Human
uugucccccaaacccagcauuuaugucgugag

SEQ ID NO: 276949 - RNA, 32 nt, Human
uugucccccaacacagcuucuguggcugacug

SEQ ID NO: 276950 - RNA, 24 nt, Human
uugucccccaagcuggaguacaau

SEQ ID NO: 276951 - RNA, 25 nt, Human
uugucccccaagcuggaguacaaug

SEQ ID NO: 276952 - RNA, 32 nt, Human
uugucccccagaacaugaccuagagguaccug

SEQ ID NO: 276953 - RNA, 32 nt, Human
uugucccccagacuggagugcaauggcacgau

SEQ ID NO: 276954 - RNA, 32 nt, Human
uugucccccagccucugccacccuccaccucc

SEQ ID NO: 276955 - RNA, 24 nt, Human
uugucccccaggcuggagugcagu

SEQ ID NO: 276956 - RNA, 25 nt, Human
uugucccccaggcuggagugcagug

SEQ ID NO: 276957 - RNA, 32 nt, Human
uugucccccaggcuggagugcagugguacaag

SEQ ID NO: 276958 - RNA, 24 nt, Human
uugucccccaggcuggagugcgau

SEQ ID NO: 276959 - RNA, 32 nt, Human
uugucccccaggcuggagugcgauggcaggau

SEQ ID NO: 276960 - RNA, 32 nt, Human
uugucccccaggcuggaguggugcaguggcac

SEQ ID NO: 276961 - RNA, 24 nt, Human
uugucccccaggcuugagugcaau

SEQ ID NO: 276962 - RNA, 25 nt, Human
uugucccccaggcuugagugcaaug

SEQ ID NO: 276963 - RNA, 32 nt, Human
uugucccccaggcuugagugcaaugacucaau

SEQ ID NO: 276964 - RNA, 21 nt, Human
uugucccccauggaugagccc

SEQ ID NO: 276965 - RNA, 32 nt, Human
uuguccccgggagggggcggggcagccucggg

SEQ ID NO: 276966 - RNA, 32 nt, Human
uuguccccgugucucauccuguccucacccuc

SEQ ID NO: 276967 - RNA, 32 nt, Human
uuguccccuggcuugggccuggaccacaaugc

SEQ ID NO: 276968 - RNA, 32 nt, Human
uugucccggcuacuugggaggcugaaguggga

SEQ ID NO: 276969 - RNA, 32 nt, Human
uugucccggugacuugcacccuggcugcuuug

SEQ ID NO: 276970 - RNA, 32 nt, Human
uugucccucguauuauuucuccacgucuguuu

SEQ ID NO: 276971 - RNA, 32 nt, Human
uugucccucguucuccccugaagugagucaua

SEQ ID NO: 276972 - RNA, 32 nt, Human
uugucccucucccuccccaggacuucugugac

SEQ ID NO: 276973 - RNA, 32 nt, Human
uugucccucugccccauccuccagcagggaaa

SEQ ID NO: 276974 - RNA, 32 nt, Human
uugucccucugucugucugucuaucuacuugu

SEQ ID NO: 276975 - RNA, 32 nt, Human
uugucccugaacuuagcuaaauggugcaacuu

SEQ ID NO: 276976 - RNA, 32 nt, Human
uugucccugcagcucaccggguuagccguggc

SEQ ID NO: 276977 - RNA, 32 nt, Human
uugucccugccuuggcuuuucuccccuucuca

SEQ ID NO: 276978 - RNA, 32 nt, Human
uugucccugcugccucccucuggaguggccac

SEQ ID NO: 276979 - RNA, 22 nt, Human
uugucccuggcaaaauuuucca

SEQ ID NO: 276980 - RNA, 32 nt, Human
uugucccuguucucuguccucuacuccacuca

SEQ ID NO: 276981 - RNA, 32 nt, Human
uugucccuguucugggggaagguguccacccc

SEQ ID NO: 276982 - RNA, 32 nt, Human
uugucccuuacaugauggugcugcaagaaaau

SEQ ID NO: 276983 - RNA, 32 nt, Human
uugucccuuccaggaggacauagccugcaaag

SEQ ID NO: 276984 - RNA, 32 nt, Human
uugucccuuccuccucccagcaacagucccaa

SEQ ID NO: 276985 - RNA, 32 nt, Human
uugucccuuggcacacuuguacccacagguga

SEQ ID NO: 276986 - RNA, 32 nt, Human
uuguccgucuucugcauucugggaacaugcgg

SEQ ID NO: 276987 - RNA, 32 nt, Human
uuguccuaaaaauacaaaaauuaguugggugc

SEQ ID NO: 276988 - RNA, 32 nt, Human
uuguccuagugugcucccugccccagacuuuu

SEQ ID NO: 276989 - RNA, 20 nt, Human
uuguccuaugcuucgagcca

SEQ ID NO: 276990 - RNA, 32 nt, Human
uuguccuauugucacugcccuguuuuucauug

SEQ ID NO: 276991 - RNA, 32 nt, Human
uuguccucaacaacagcaaagcuucuugggag

SEQ ID NO: 276992 - RNA, 32 nt, Human
uuguccucaagugauccucccaccuuagccuc

SEQ ID NO: 276993 - RNA, 28 nt, Human
uuguccucacuggcagcaugcuguaugu

SEQ ID NO: 276994 - RNA, 32 nt, Human
uuguccucacuuuuguucuugucccucuccaa

SEQ ID NO: 276995 - RNA, 32 nt, Human
uuguccuccacuacccucaggaaaccaagaaa

SEQ ID NO: 276996 - RNA, 32 nt, Human
uuguccuccagcugcuccugauuccugcguua

SEQ ID NO: 276997 - RNA, 32 nt, Human
uuguccuccaggaggugggggaaugugguaac

SEQ ID NO: 276998 - RNA, 32 nt, Human
uuguccuccaguuuuauaggaacaagagacua

SEQ ID NO: 276999 - RNA, 32 nt, Human
uuguccuccaucuuccccuccuuuacccuugg

SEQ ID NO: 277000 - RNA, 32 nt, Human
uuguccucccaccuucugguucuugaagacau

SEQ ID NO: 277001 - RNA, 32 nt, Human
uuguccuccucucuccuccaccgggacugcug

SEQ ID NO: 277002 - RNA, 21 nt, Human
uuguccuccucucuggcccca

SEQ ID NO: 277003 - RNA, 32 nt, Human
uuguccuccugccuccucuucuccuuggcugg

SEQ ID NO: 277004 - RNA, 32 nt, Human
uuguccucuucugcucuuuuccuggugcucuu

SEQ ID NO: 277005 - RNA, 32 nt, Human
uuguccucuugcuccuuccugcuaggacagca

SEQ ID NO: 277006 - RNA, 32 nt, Human
uuguccugcacugucuuuagguaucauaggua

SEQ ID NO: 277007 - RNA, 32 nt, Human
uuguccuggcaccuccauuuccuuaguuucug

SEQ ID NO: 277008 - RNA, 32 nt, Human
uuguccuggcacugcuggcccuccucacccua

SEQ ID NO: 277009 - RNA, 32 nt, Human
uuguccuggcuuacugggacagucuguaugag

SEQ ID NO: 277010 - RNA, 32 nt, Human
uuguccugggaagaaggagcaagagguaaaca

SEQ ID NO: 277011 - RNA, 32 nt, Human
uuguccugggauaguugagggagcagggagag

SEQ ID NO: 277012 - RNA, 32 nt, Human
uuguccugggucuugcacuuguuguccauggu

SEQ ID NO: 277013 - RNA, 32 nt, Human
uuguccuguauuuaucacaguuucuguugaac

SEQ ID NO: 277014 - RNA, 32 nt, Human
uuguccuguccccacagccauucugggagcug

SEQ ID NO: 277015 - RNA, 32 nt, Human
uuguccugugaggaaacgaugaggagacuucu

SEQ ID NO: 277016 - RNA, 32 nt, Human
uuguccuguggccucugcuccaggggcagugu

SEQ ID NO: 277017 - RNA, 32 nt, Human
uuguccuguguguguuuacaguauucaauuua

SEQ ID NO: 277018 - RNA, 32 nt, Human
uuguccuuaagguuuuugcaggccagugccaa

SEQ ID NO: 277019 - RNA, 32 nt, Human
uuguccuuagaaggagaaagacagagacacau

SEQ ID NO: 277020 - RNA, 32 nt, Human
uuguccuucauucaaguauacauuucugaugu

SEQ ID NO: 277021 - RNA, 32 nt, Human
uuguccuucccaguuucuccccaaccuccccu

SEQ ID NO: 277022 - RNA, 32 nt, Human
uuguccuuccucccauuuccucccuuuggccc

SEQ ID NO: 277023 - RNA, 32 nt, Human
uuguccuuccugaucaccuucacuuucucgua

SEQ ID NO: 277024 - RNA, 32 nt, Human
uuguccuucucaguuucuccccaaccuccccu

SEQ ID NO: 277025 - RNA, 32 nt, Human
uuguccuucucccacccccuuacuacacccua

SEQ ID NO: 277026 - RNA, 32 nt, Human
uuguccuugcccagcccugccagccgacugca

SEQ ID NO: 277027 - RNA, 32 nt, Human
uuguccuugucuuuucuucacacugaguucuc

SEQ ID NO: 277028 - RNA, 32 nt, Human
uuguccuuuaggcaggacaggagagucauuaa

SEQ ID NO: 277029 - RNA, 32 nt, Human
uuguccuuuagucccagcucucagaauccucg

SEQ ID NO: 277030 - RNA, 32 nt, Human
uuguccuuuccccucagcugucuuugcuucac

SEQ ID NO: 277031 - RNA, 32 nt, Human
uuguccuuugaaaugauugaccaggaaaaaga

SEQ ID NO: 277032 - RNA, 32 nt, Human
uuguccuuuggccuuucacuucugccuucugu

SEQ ID NO: 277033 - RNA, 32 nt, Human
uuguccuuuguggagccucagcaguucccucu

SEQ ID NO: 277034 - RNA, 32 nt, Human
uuguccuuuuccacccuuuuaagaguuacgcu

SEQ ID NO: 277035 - RNA, 32 nt, Human
uuguccuuuuggagcagggcaggcuggcugcu

SEQ ID NO: 277036 - RNA, 32 nt, Human
uugucgacauuuuagaaguucccuaaggcccu

SEQ ID NO: 277037 - RNA, 32 nt, Human
uugucgaccugcggaucagggcugcaaggggc

SEQ ID NO: 277038 - RNA, 32 nt, Human
uugucgagaagcuuccgugaaagggugggcca

SEQ ID NO: 277039 - RNA, 32 nt, Human
uugucgagagugaaacaguuugaagcagagcc

SEQ ID NO: 277040 - RNA, 32 nt, Human
uugucgagggagagaauaaccugguguguuca

SEQ ID NO: 277041 - RNA, 23 nt, Human
uugucgccaggcuggagugcagu

SEQ ID NO: 277042 - RNA, 24 nt, Human
uugucgccaggcuggagugcagug

SEQ ID NO: 277043 - RNA, 32 nt, Human
uugucgcccaggccggagugcaguggugcgau

SEQ ID NO: 277044 - RNA, 24 nt, Human
uugucgcccaggcuggagcgcagu

SEQ ID NO: 277045 - RNA, 32 nt, Human
uugucgcccaggcuggagcgcagucccgcaau

SEQ ID NO: 277046 - RNA, 24 nt, Human
uugucgcccaggcuggagguuaau

SEQ ID NO: 277047 - RNA, 32 nt, Human
uugucgcccaggcuggagguuaauggcaugau

SEQ ID NO: 277048 - RNA, 32 nt, Human
uugucgcccaggcuggaguacaguggugcgau

SEQ ID NO: 277049 - RNA, 22 nt, Human
uugucgcccaggcuggagugca

SEQ ID NO: 277050 - RNA, 32 nt, Human
uugucgcccaggcuggagugcaacgguaugau

SEQ ID NO: 277051 - RNA, 24 nt, Human
uugucgcccaggcuggagugcaau

SEQ ID NO: 277052 - RNA, 32 nt, Human
uugucgcccaggcuggagugcaaugcacgauc

SEQ ID NO: 277053 - RNA, 32 nt, Human
uugucgcccaggcuggagugcaauggcgcaau

SEQ ID NO: 277054 - RNA, 32 nt, Human
uugucgcccaggcuggagugcaauggcgugau

SEQ ID NO: 277055 - RNA, 24 nt, Human
uugucgcccaggcuggagugcagu

SEQ ID NO: 277056 - RNA, 32 nt, Human
uugucgcccaggcuggagugcaguggcacaau

SEQ ID NO: 277057 - RNA, 32 nt, Human
uugucgcccaggcuggagugcaguggcacgau

SEQ ID NO: 277058 - RNA, 32 nt, Human
uugucgcccaggcuggagugcaguggcagugu

SEQ ID NO: 277059 - RNA, 32 nt, Human
uugucgcccaggcuggagugcaguggcaugau

SEQ ID NO: 277060 - RNA, 32 nt, Human
uugucgcccaggcuggagugcaguggcgcaau

SEQ ID NO: 277061 - RNA, 32 nt, Human
uugucgcccaggcuggagugcaguggcgugau

SEQ ID NO: 277062 - RNA, 32 nt, Human
uugucgcccaggcuggagugcaguggugugau

SEQ ID NO: 277063 - RNA, 24 nt, Human
uugucgcccaggcuguagugcagu

SEQ ID NO: 277064 - RNA, 32 nt, Human
uugucgcccaggcuguagugcagugguacagu

SEQ ID NO: 277065 - RNA, 32 nt, Human
uugucgcccgggcaggagugcaguggcucaau

SEQ ID NO: 277066 - RNA, 32 nt, Human
uugucgcccuggcuggagugcaguugcgcagu

SEQ ID NO: 277067 - RNA, 24 nt, Human
uugucgccuacgcuggagugcagu

SEQ ID NO: 277068 - RNA, 32 nt, Human
uugucgccuaggcuggagugcaaugaugcgau

SEQ ID NO: 277069 - RNA, 24 nt, Human
uugucgcucagccuggagugcagu

SEQ ID NO: 277070 - RNA, 32 nt, Human
uugucgcucagccuggagugcagugagcugag

SEQ ID NO: 277071 - RNA, 18 nt, Human
uugucgcucagcuaguca

SEQ ID NO: 277072 - RNA, 32 nt, Human
uugucgcucaggcuggagugccauggcgcgau

SEQ ID NO: 277073 - RNA, 20 nt, Human
uugucgcuccccauggacca

SEQ ID NO: 277074 - RNA, 19 nt, Human
uugucgcuccugcgugcca

SEQ ID NO: 277075 - RNA, 32 nt, Human
uugucgcugaaccugucuccucccagguuucu

SEQ ID NO: 277076 - RNA, 32 nt, Human
uugucgcuuauccagaaugaugcuauguguag

SEQ ID NO: 277077 - RNA, 20 nt, Human
uugucgcuuccgccucgagc

SEQ ID NO: 277078 - RNA, 32 nt, Human
uugucggcaucgcuccccacaggccgacgucg

SEQ ID NO: 277079 - RNA, 24 nt, Human
uugucggccaggcuagagugcagu

SEQ ID NO: 277080 - RNA, 25 nt, Human
uugucggccaggcuagagugcagug

SEQ ID NO: 277081 - RNA, 32 nt, Human
uugucggcucacugcaaccugucucucagguu

SEQ ID NO: 277082 - RNA, 32 nt, Human
uugucguagagcccuccacauuuucuuuuucu

SEQ ID NO: 277083 - RNA, 20 nt, Human
uugucgugccguccugggcc

SEQ ID NO: 277084 - RNA, 31 nt, Human
uugucgugccguccugggccucaggcugucu

SEQ ID NO: 277085 - RNA, 32 nt, Human
uugucguggaagaaggaagugaacccucagaa

SEQ ID NO: 277086 - RNA, 32 nt, Human
uugucguuguuguuguuugccaugacugcucu

SEQ ID NO: 277087 - RNA, 32 nt, Human
uugucguuucuuggaagucacagggaagauug

SEQ ID NO: 277088 - RNA, 32 nt, Human
uugucguuugggguauguaucuccucucugag

SEQ ID NO: 277089 - RNA, 32 nt, Human
uugucuaaaaauaacauacgcacucaacuucc

SEQ ID NO: 277090 - RNA, 32 nt, Human
uugucuaaccccagguuuucugcucuguccaa

SEQ ID NO: 277091 - RNA, 32 nt, Human
uugucuaauguuccugagacuauuucacacuc

SEQ ID NO: 277092 - RNA, 32 nt, Human
uugucuaccacugcgaacuuuccaucuaggca

SEQ ID NO: 277093 - RNA, 32 nt, Human
uugucuaccuuaaaacuagcuuuauucacaga

SEQ ID NO: 277094 - RNA, 32 nt, Human
uugucuagacuugcaucuagagcuacguugua

SEQ ID NO: 277095 - RNA, 32 nt, Human
uugucuagccuccagccucaacuuacuugaug

SEQ ID NO: 277096 - RNA, 32 nt, Human
uugucuaggauuccauggauggauggaauaua

SEQ ID NO: 277097 - RNA, 32 nt, Human
uugucuaggcuggagugccguggugcgaucuu

SEQ ID NO: 277098 - RNA, 32 nt, Human
uugucuaggcuggucuugaacugggcucaagc

SEQ ID NO: 277099 - RNA, 32 nt, Human
uugucuagggcuugcugaccucacagucugug

SEQ ID NO: 277100 - RNA, 32 nt, Human
uugucuaggguucucagaugcuaucugccgcu

SEQ ID NO: 277101 - RNA, 32 nt, Human
uugucuaguucucauucuuucaauuguuaugc

SEQ ID NO: 277102 - RNA, 32 nt, Human
uugucuauccuggccccagcaggaugacccuc

SEQ ID NO: 277103 - RNA, 32 nt, Human
uugucuauggaguuauacuuccauccaauuac

SEQ ID NO: 277104 - RNA, 32 nt, Human
uugucuauucaucugauaaucuuuuggcuaaa

SEQ ID NO: 277105 - RNA, 32 nt, Human
uugucucaccucugaguuuuugcccaugaugu

SEQ ID NO: 277106 - RNA, 32 nt, Human
uugucucacugcaaccucugccucccggguuc

SEQ ID NO: 277107 - RNA, 32 nt, Human
uugucucacuguuuggugcuucuccuaacuca

SEQ ID NO: 277108 - RNA, 32 nt, Human
uugucucagccucugccacuucccagaccgaa

SEQ ID NO: 277109 - RNA, 32 nt, Human
uugucucagcuacacaggaggcugaaguggga

SEQ ID NO: 277110 - RNA, 32 nt, Human
uugucucaggcaggaagucagucuauaucucu

SEQ ID NO: 277111 - RNA, 32 nt, Human
uugucucagggugggaagugggagggcagggc

SEQ ID NO: 277112 - RNA, 32 nt, Human
uugucucagggugggaagugggaggguggggc

SEQ ID NO: 277113 - RNA, 23 nt, Human
uugucucagucauugcuguugua

SEQ ID NO: 277114 - RNA, 32 nt, Human
uugucucaguuacuugggaggcugaggcagga

SEQ ID NO: 277115 - RNA, 32 nt, Human
uugucucauccccagucuaccuccuuccuucu

SEQ ID NO: 277116 - RNA, 32 nt, Human
uugucuccaaaguccuuguuguaggaguugcu

SEQ ID NO: 277117 - RNA, 32 nt, Human
uugucuccaaauucuuaaaauuagucaucugu

SEQ ID NO: 277118 - RNA, 32 nt, Human
uugucuccaacuccaggcgcucagggaaucgc

SEQ ID NO: 277119 - RNA, 32 nt, Human
uugucuccacacacagcugggcugugguaggg

SEQ ID NO: 277120 - RNA, 32 nt, Human
uugucuccacagccccagccacagcuggaagc

SEQ ID NO: 277121 - RNA, 32 nt, Human
uugucuccacaugaagauguacugaugacgcc

SEQ ID NO: 277122 - RNA, 32 nt, Human
uugucuccacuccucccccaucauguccuucc

SEQ ID NO: 277123 - RNA, 32 nt, Human
uugucuccagcccaguucgaggaagaguaagc

SEQ ID NO: 277124 - RNA, 28 nt, Human
uugucuccaguacuugccucauucucau

SEQ ID NO: 277125 - RNA, 32 nt, Human
uugucucccagacuggagugcaauggcaugau

SEQ ID NO: 277126 - RNA, 24 nt, Human
uugucucccaggcuggagugcaau

SEQ ID NO: 277127 - RNA, 32 nt, Human
uugucucccaggcuggagugcaaucgcgcaau

SEQ ID NO: 277128 - RNA, 24 nt, Human
uugucucccaggcuggagugcagu

SEQ ID NO: 277129 - RNA, 25 nt, Human
uugucucccaggcuggagugcagug

SEQ ID NO: 277130 - RNA, 32 nt, Human
uugucucccaggcuggagugcagugacacaau

SEQ ID NO: 277131 - RNA, 32 nt, Human
uugucucccaggcuggagugcaguggcgugau

SEQ ID NO: 277132 - RNA, 32 nt, Human
uugucuccccggcuggagugcaguggcaugau

SEQ ID NO: 277133 - RNA, 32 nt, Human
uugucucccucgggcucuagagcuaggcccga

SEQ ID NO: 277134 - RNA, 32 nt, Human
uugucucccucucccuccacagucuccuuggc

SEQ ID NO: 277135 - RNA, 32 nt, Human
uugucuccgagggggagucauguuccccacuc

SEQ ID NO: 277136 - RNA, 32 nt, Human
uugucuccuagagaaagggacagggaaucgaa

SEQ ID NO: 277137 - RNA, 32 nt, Human
uugucuccuccuccuccugcuuccccugcuca

SEQ ID NO: 277138 - RNA, 32 nt, Human
uugucuccucuauccugggcuuuuguuuugcu

SEQ ID NO: 277139 - RNA, 32 nt, Human
uugucuccugagguggagagggggccucugaa

SEQ ID NO: 277140 - RNA, 32 nt, Human
uugucuccugcucuucuggagccuggaaggaa

SEQ ID NO: 277141 - RNA, 32 nt, Human
uugucuccuucccaccuggcccagagaugcuu

SEQ ID NO: 277142 - RNA, 32 nt, Human
uugucuccuucccccacucauccuggccuucc

SEQ ID NO: 277143 - RNA, 32 nt, Human
uugucucggggucccccgaugaggcgacccgg

SEQ ID NO: 277144 - RNA, 32 nt, Human
uugucucuacaaagcacccugaccccagaugc

SEQ ID NO: 277145 - RNA, 32 nt, Human
uugucucuacauuucuuuaucauuccaguggg

SEQ ID NO: 277146 - RNA, 32 nt, Human
uugucucuagcauaauaaacccagggaacacu

SEQ ID NO: 277147 - RNA, 32 nt, Human
uugucucuaguaguguggccugugccagcacc

SEQ ID NO: 277148 - RNA, 31 nt, Human
uugucucuauggauuuaccuguucuggauau

SEQ ID NO: 277149 - RNA, 32 nt, Human
uugucucuauugucacacaugguuauauuuaa

SEQ ID NO: 277150 - RNA, 32 nt, Human
uugucucucaacucugcuuuucuccaguucca

SEQ ID NO: 277151 - RNA, 32 nt, Human
uugucucucaggcuggguugcaauggcacaau

SEQ ID NO: 277152 - RNA, 32 nt, Human
uugucucucgcugcagucgcagcuccaggucu

SEQ ID NO: 277153 - RNA, 32 nt, Human
uugucucucugacuagcuaaacugccaacuag

SEQ ID NO: 277154 - RNA, 19 nt, Human
uugucucugcucuggguca

SEQ ID NO: 277155 - RNA, 32 nt, Human
uugucucuggccagaggugugguauagaacca

SEQ ID NO: 277156 - RNA, 32 nt, Human
uugucucugggcaguugcagagcagguuuguu

SEQ ID NO: 277157 - RNA, 32 nt, Human
uugucucuggggaaacuuuugcccuaugaacc

SEQ ID NO: 277158 - RNA, 32 nt, Human
uugucucugucucuuaauaauaguuuuuaacg

SEQ ID NO: 277159 - RNA, 32 nt, Human
uugucucuguucugugcuauuugacuugugaa

SEQ ID NO: 277160 - RNA, 32 nt, Human
uugucucuucacgcccaucuucugccucauag

SEQ ID NO: 277161 - RNA, 32 nt, Human
uugucucuuccuuuuugacauuuucugauuuu

SEQ ID NO: 277162 - RNA, 32 nt, Human
uugucucuugguccacaguauuuggaaagguc

SEQ ID NO: 277163 - RNA, 32 nt, Human
uugucugaaacaaacacagagcacuccaucaa

SEQ ID NO: 277164 - RNA, 32 nt, Human
uugucugagcccagcagaagcagcacaagacc

SEQ ID NO: 277165 - RNA, 32 nt, Human
uugucugagcuuccaucuuucucauauuuccu

SEQ ID NO: 277166 - RNA, 32 nt, Human
uugucugagguggcugccagcccagggggugg

SEQ ID NO: 277167 - RNA, 32 nt, Human
uugucugauuuucuccaucauccugauuagca

SEQ ID NO: 277168 - RNA, 32 nt, Human
uugucugcaaaguguuuggugcgaggaagauu

SEQ ID NO: 277169 - RNA, 32 nt, Human
uugucugcaaaugcauuuuucaucuauaaaau

SEQ ID NO: 277170 - RNA, 32 nt, Human
uugucugcacacagagcaguggucuagggagc

SEQ ID NO: 277171 - RNA, 32 nt, Human
uugucugcagaaccaccaccuugaaagaucca

SEQ ID NO: 277172 - RNA, 32 nt, Human
uugucugccaauaccaaggauauucuuguaua

SEQ ID NO: 277173 - RNA, 32 nt, Human
uugucugccauucaauguuuacauuuauguuc

SEQ ID NO: 277174 - RNA, 32 nt, Human
uugucugcccagcugcuccaagccaggcugau

SEQ ID NO: 277175 - RNA, 32 nt, Human
uugucugcucugagggagagugcguggggagc

SEQ ID NO: 277176 - RNA, 32 nt, Human
uugucugcuugaacucugggcuuggugcagag

SEQ ID NO: 277177 - RNA, 32 nt, Human
uugucuggagcagagggagaccauacuagggc

SEQ ID NO: 277178 - RNA, 32 nt, Human
uugucuggaucugagaaccugcauuugguauu

SEQ ID NO: 277179 - RNA, 32 nt, Human
uugucuggccaagacauuugcuucacuuuuaa

SEQ ID NO: 277180 - RNA, 32 nt, Human
uugucuggccacaggccaggcugcugggcauc

SEQ ID NO: 277181 - RNA, 32 nt, Human
uugucuggcuaauaaaucaucaccaacugccu

SEQ ID NO: 277182 - RNA, 32 nt, Human
uugucuggggacccuguagagucacugacccu

SEQ ID NO: 277183 - RNA, 32 nt, Human
uugucuggguuauuggacaauuuauaagaacu

SEQ ID NO: 277184 - RNA, 32 nt, Human
uugucuggguugcuggguuugaaggaaguuug

SEQ ID NO: 277185 - RNA, 32 nt, Human
uugucugguagccuugcuccagaagccuguuc

SEQ ID NO: 277186 - RNA, 32 nt, Human
uugucugguaggggagauguuucguuuucaug

SEQ ID NO: 277187 - RNA, 32 nt, Human
uugucuguacauacuggccucugugauuacau

SEQ ID NO: 277188 - RNA, 32 nt, Human
uugucuguccccacaucuggggauaguaaugc

SEQ ID NO: 277189 - RNA, 32 nt, Human
uugucuguccccaccacauggaggugggggug

SEQ ID NO: 277190 - RNA, 32 nt, Human
uugucuguccuggcugucugugugugugccau

SEQ ID NO: 277191 - RNA, 32 nt, Human
uugucugugcauucaugcaucuaccucauucc

SEQ ID NO: 277192 - RNA, 32 nt, Human
uugucuguggagcugcucucucucccucaucc

SEQ ID NO: 277193 - RNA, 21 nt, Human
uugucugugggcccugggcca

SEQ ID NO: 277194 - RNA, 32 nt, Human
uugucuguggugagcagaugacacccuucuua

SEQ ID NO: 277195 - RNA, 32 nt, Human
uugucugugugugaaccuuuguuuuaggccau

SEQ ID NO: 277196 - RNA, 32 nt, Human
uugucuguuguguucucugugugcccccagug

SEQ ID NO: 277197 - RNA, 32 nt, Human
uugucuuaaaacugaacaugaggauauuaaaa

SEQ ID NO: 277198 - RNA, 24 nt, Human
uugucuuaaaagucucuccuuccc

SEQ ID NO: 277199 - RNA, 32 nt, Human
uugucuuaaugucggggagcagccuggugucc

SEQ ID NO: 277200 - RNA, 32 nt, Human
uugucuuagcuacucaggaggcugaggcagga

SEQ ID NO: 277201 - RNA, 31 nt, Human
uugucuucacucaacgucagggugggggagu

SEQ ID NO: 277202 - RNA, 32 nt, Human
uugucuucagguguuuucucucuuaagucacu

SEQ ID NO: 277203 - RNA, 32 nt, Human
uugucuucccguuccuccccgcagugguuuug

SEQ ID NO: 277204 - RNA, 32 nt, Human
uugucuuccuaaugcuaccuuuguugguccuu

SEQ ID NO: 277205 - RNA, 32 nt, Human
uugucuuccuggauauuugggggugacucgcc

SEQ ID NO: 277206 - RNA, 32 nt, Human
uugucuucuaauuuugcaucccuggacugcgu

SEQ ID NO: 277207 - RNA, 32 nt, Human
uugucuucuacccugcccucuuuucuguucac

SEQ ID NO: 277208 - RNA, 32 nt, Human
uugucuucugcagcuuccuuucccuagagcuu

SEQ ID NO: 277209 - RNA, 32 nt, Human
uugucuucugguuucacaggcuucagcucaug

SEQ ID NO: 277210 - RNA, 32 nt, Human
uugucuucuguccucagacugggcuuuacccc

SEQ ID NO: 277211 - RNA, 32 nt, Human
uugucuucuuacuuccucuccccucucccauu

SEQ ID NO: 277212 - RNA, 32 nt, Human
uugucuucuucugugcuggagauguuuuagag

SEQ ID NO: 277213 - RNA, 32 nt, Human
uugucuucuuucucccuuucccuccuucccuc

SEQ ID NO: 277214 - RNA, 32 nt, Human
uugucuucuuucuccuuacuuuugugaugguu

SEQ ID NO: 277215 - RNA, 32 nt, Human
uugucuugauccaugaaccagaaccacagggc

SEQ ID NO: 277216 - RNA, 32 nt, Human
uugucuugccucugguuccugggauccaguga

SEQ ID NO: 277217 - RNA, 32 nt, Human
uugucuugcucugaaagcuuggagagcuacau

SEQ ID NO: 277218 - RNA, 32 nt, Human
uugucuuggccuuccuggugugcaguacugcu

SEQ ID NO: 277219 - RNA, 32 nt, Human
uugucuuguacccaguuggauuggcagcagcu

SEQ ID NO: 277220 - RNA, 32 nt, Human
uugucuuguauuuuccaaauguuaauacauuu

SEQ ID NO: 277221 - RNA, 32 nt, Human
uugucuugugcaaacauguagaauaugcucuu

SEQ ID NO: 277222 - RNA, 32 nt, Human
uugucuuguucucaacuacuacgcagguagac

SEQ ID NO: 277223 - RNA, 32 nt, Human
uugucuuguugaguuucuccaaaggagcauuu

SEQ ID NO: 277224 - RNA, 32 nt, Human
uugucuuucgugcuccauguuugaagaaauua

SEQ ID NO: 277225 - RNA, 32 nt, Human
uugucuuucugagugguccaagccacuaucac

SEQ ID NO: 277226 - RNA, 32 nt, Human
uugucuuucuuuccucuuccucuuccggcgcg

SEQ ID NO: 277227 - RNA, 32 nt, Human
uugucuuugcugggacugggccugugugccac

SEQ ID NO: 277228 - RNA, 29 nt, Human
uugucuuugucugaaugagaagugagaag

SEQ ID NO: 277229 - RNA, 32 nt, Human
uugucuuuguucugcugauguggagucauguu

SEQ ID NO: 277230 - RNA, 32 nt, Human
uugucuuuuccucugccccuugagccagccua

SEQ ID NO: 277231 - RNA, 32 nt, Human
uugucuuuuuaugacaggauguuugcucagcu

SEQ ID NO: 277232 - RNA, 32 nt, Human
uugucuuuuucccagccgcauccugccuguag

SEQ ID NO: 277233 - RNA, 25 nt, Human
uugucuuuuucucaguggagggagu

SEQ ID NO: 277234 - RNA, 32 nt, Human
uugugaaaaaggcauucagagacgggguuuca

SEQ ID NO: 277235 - RNA, 32 nt, Human
uugugaaaaucucagaaaccugaacauggaaa

SEQ ID NO: 277236 - RNA, 32 nt, Human
uugugaaaccaaaaacaaacgccuuuugugag

SEQ ID NO: 277237 - RNA, 32 nt, Human
uugugaaaucaauguguacaaguggacuuguu

SEQ ID NO: 277238 - RNA, 32 nt, Human
uugugaaaugugcaaaugauaucaccuaugca

SEQ ID NO: 277239 - RNA, 32 nt, Human
uugugaaauguucuuucacuuguaaguuucag

SEQ ID NO: 277240 - RNA, 32 nt, Human
uugugaacaaaugagacaaggcugcaaauuca

SEQ ID NO: 277241 - RNA, 32 nt, Human
uugugaacaagucccuguaauuguuguuugua

SEQ ID NO: 277242 - RNA, 32 nt, Human
uugugaacacauauuuguaaauagugccuuua

SEQ ID NO: 277243 - RNA, 32 nt, Human
uugugaacauuugugauauauguauuaauaaa

SEQ ID NO: 277244 - RNA, 32 nt, Human
uugugaaccaggcuccagucuuccuguggccu

SEQ ID NO: 277245 - RNA, 32 nt, Human
uugugaaccccaaauaucugagaccagucuca

SEQ ID NO: 277246 - RNA, 32 nt, Human
uugugaacggacugcacguuuguuacaaggga

SEQ ID NO: 277247 - RNA, 32 nt, Human
uugugaacugacaggcagccuggacauagaga

SEQ ID NO: 277248 - RNA, 32 nt, Human
uugugaacuuacugccuccccugcugcuccuc

SEQ ID NO: 277249 - RNA, 32 nt, Human
uugugaagaaggcuccugcuuccccuucaccu

SEQ ID NO: 277250 - RNA, 32 nt, Human
uugugaagaguauuugcauugugucuucauuu

SEQ ID NO: 277251 - RNA, 32 nt, Human
uugugaagcacaucauguccagcuaaccucgu

SEQ ID NO: 277252 - RNA, 32 nt, Human
uugugaagcuugagguuggaugugggaauugg

SEQ ID NO: 277253 - RNA, 32 nt, Human
uugugaagcuuugugugacuugcucaggauca

SEQ ID NO: 277254 - RNA, 32 nt, Human
uugugaagucugagguugcaaaaggacuguga

SEQ ID NO: 277255 - RNA, 32 nt, Human
uugugaagugagucugaguuguuuacacugau

SEQ ID NO: 277256 - RNA, 32 nt, Human
uugugaaguggcuguguucacccuggguggac

SEQ ID NO: 277257 - RNA, 32 nt, Human
uugugaaguuuggaagcucuauucgcuguauu

SEQ ID NO: 277258 - RNA, 32 nt, Human
uugugaauagccacugcacuucagccugggca

SEQ ID NO: 277259 - RNA, 32 nt, Human
uugugaaugaucaguggaggacuugcccacgu

SEQ ID NO: 277260 - RNA, 32 nt, Human
uugugaaugaucugcugauuugugcuauuuua

SEQ ID NO: 277261 - RNA, 31 nt, Human
uugugaaugaugggcucuuggaagcacuguc

SEQ ID NO: 277262 - RNA, 32 nt, Human
uugugaaugugacacacgaucucuccaguuuc

SEQ ID NO: 277263 - RNA, 32 nt, Human
uugugaauuuggcuccccaacuccucgcuuca

SEQ ID NO: 277264 - RNA, 32 nt, Human
uugugacaaauugaucacuuguguacgaaaaa

SEQ ID NO: 277265 - RNA, 32 nt, Human
uugugacacugcacuccagccugggcaacaga

SEQ ID NO: 277266 - RNA, 32 nt, Human
uugugacacugcauugcugggcuguguuccuc

SEQ ID NO: 277267 - RNA, 32 nt, Human
uugugacacugcccuccagccugggugacaga

SEQ ID NO: 277268 - RNA, 32 nt, Human
uugugacagagccaugguguguuuguaauaau

SEQ ID NO: 277269 - RNA, 32 nt, Human
uugugacagcacagccauccagcauuaucuua

SEQ ID NO: 277270 - RNA, 32 nt, Human
uugugacaggcagaggguguuccugacagagg

SEQ ID NO: 277271 - RNA, 32 nt, Human
uugugacaggcccugccugccacccuaggcag

SEQ ID NO: 277272 - RNA, 32 nt, Human
uugugacagugaggguugagggcugguccaga

SEQ ID NO: 277273 - RNA, 23 nt, Human
uugugacaucugcauugauuuca

SEQ ID NO: 277274 - RNA, 32 nt, Human
uugugaccagagaauuggcauuuucuacaaau

SEQ ID NO: 277275 - RNA, 32 nt, Human
uugugaccagccugaccaacauagugaaaccc

SEQ ID NO: 277276 - RNA, 32 nt, Human
uugugaccagccuggccaacauagugaaaucc

SEQ ID NO: 277277 - RNA, 32 nt, Human
uugugaccagggucuggaugagcuugaauuug

SEQ ID NO: 277278 - RNA, 32 nt, Human
uugugaccauuguaacaauagcacaauaaagc

SEQ ID NO: 277279 - RNA, 32 nt, Human
uugugaccccauucuguaaucaacugagcuag

SEQ ID NO: 277280 - RNA, 32 nt, Human
uugugaccugggaggcaggaggcgggucuguc

SEQ ID NO: 277281 - RNA, 32 nt, Human
uugugaccuucucugagguugcagcggcucuu

SEQ ID NO: 277282 - RNA, 32 nt, Human
uugugaccuuguacauaacccugggugacgug

SEQ ID NO: 277283 - RNA, 32 nt, Human
uugugacgccugccagccgcaggcuggguccc

SEQ ID NO: 277284 - RNA, 32 nt, Human
uugugacggaguuucccucuuguugcccaggc

SEQ ID NO: 277285 - RNA, 32 nt, Human
uugugacggaguuuugcucuugucucccaggc

SEQ ID NO: 277286 - RNA, 32 nt, Human
uugugacggugugaccagggaggggaagugua

SEQ ID NO: 277287 - RNA, 32 nt, Human
uugugacuagcuacugcacuccaaccugggca

SEQ ID NO: 277288 - RNA, 32 nt, Human
uugugacucuccagagagcaacagugauggcu

SEQ ID NO: 277289 - RNA, 32 nt, Human
uugugacucuuagcagcauggaagagaagugu

SEQ ID NO: 277290 - RNA, 32 nt, Human
uugugacucuucccucucccugccucacagga

SEQ ID NO: 277291 - RNA, 32 nt, Human
uugugacuggacuccagccugggcaacagagc

SEQ ID NO: 277292 - RNA, 32 nt, Human
uugugacugggacaaucagggaccuggauugg

SEQ ID NO: 277293 - RNA, 32 nt, Human
uugugacugggcugugugagggugggguggga

SEQ ID NO: 277294 - RNA, 32 nt, Human
uugugacuguguuugcauugucuaaugacaga

SEQ ID NO: 277295 - RNA, 32 nt, Human
uugugacuuaaagguugacuggucaaaauugu

SEQ ID NO: 277296 - RNA, 32 nt, Human
uugugacuugcagaaacauaggcaguaguccu

SEQ ID NO: 277297 - RNA, 32 nt, Human
uugugagaaagcugccucggggugggguccgg

SEQ ID NO: 277298 - RNA, 32 nt, Human
uugugagaaauccagcaucucaggcuccacug

SEQ ID NO: 277299 - RNA, 32 nt, Human
uugugagaacucccguuccugucccacauugu

SEQ ID NO: 277300 - RNA, 32 nt, Human
uugugagaaugugaugaacgcucugaaccccc

SEQ ID NO: 277301 - RNA, 32 nt, Human
uugugagauccagcccaaucucagccuugaga

SEQ ID NO: 277302 - RNA, 32 nt, Human
uugugagaugaauacuuccugagaaacuugac

SEQ ID NO: 277303 - RNA, 32 nt, Human
uugugagauuuaguuuuugucugccaugggca

SEQ ID NO: 277304 - RNA, 32 nt, Human
uugugagcaauaugcuuucccuuuacacccug

SEQ ID NO: 277305 - RNA, 32 nt, Human
uugugagcauauugagggcagaggaggacuua

SEQ ID NO: 277306 - RNA, 32 nt, Human
uugugagcggccgccucucccggggacaaugu

SEQ ID NO: 277307 - RNA, 32 nt, Human
uugugagcuaucugccccaggcaggccucgcc

SEQ ID NO: 277308 - RNA, 32 nt, Human
uugugagcucagaauuacuuuaaaaggaggua

SEQ ID NO: 277309 - RNA, 32 nt, Human
uugugagcuguggugugagagggugaagccag

SEQ ID NO: 277310 - RNA, 32 nt, Human
uugugaggaaaaagauggcacaaugcuaauaa

SEQ ID NO: 277311 - RNA, 30 nt, Human
uugugaggaagccgcuggggccaguugguc

SEQ ID NO: 277312 - RNA, 32 nt, Human
uugugaggaaggaaaaucagaggacuuggcac

SEQ ID NO: 277313 - RNA, 32 nt, Human
uugugaggagaaauacuaacuggacugacccu

SEQ ID NO: 277314 - RNA, 32 nt, Human
uugugaggccaggccuucugacugucagcacc

SEQ ID NO: 277315 - RNA, 31 nt, Human
uugugaggccuguuuuagccugugucuuuug

SEQ ID NO: 277316 - RNA, 32 nt, Human
uugugaggcugaagcaggaaaauggcaugaac

SEQ ID NO: 277317 - RNA, 32 nt, Human
uugugaggcugaagugggaggacugcuugagc

SEQ ID NO: 277318 - RNA, 32 nt, Human
uugugaggcugaggcgaguggaucacuugagg

SEQ ID NO: 277319 - RNA, 32 nt, Human
uugugaggcugagggaggagaaucgcuugaac

SEQ ID NO: 277320 - RNA, 32 nt, Human
uugugagggagaucugggggaggcaggaagcu

SEQ ID NO: 277321 - RNA, 32 nt, Human
uugugagggcaaggcuugggaggcggggcccu

SEQ ID NO: 277322 - RNA, 32 nt, Human
uugugagggccaaguuugcuaguagaaaucga

SEQ ID NO: 277323 - RNA, 32 nt, Human
uugugagggccagcagugccacccugguaaau

SEQ ID NO: 277324 - RNA, 32 nt, Human
uugugaggguuagacagccucagggcaccauu

SEQ ID NO: 277325 - RNA, 32 nt, Human
uugugagguacugaugagguguaaguggagcu

SEQ ID NO: 277326 - RNA, 32 nt, Human
uugugaguacugucucccucacggugaaugag

SEQ ID NO: 277327 - RNA, 32 nt, Human
uugugagucauugucucucaaaggcugggcca

SEQ ID NO: 277328 - RNA, 32 nt, Human
uugugagugaagaaugcugagaagauuguaau

SEQ ID NO: 277329 - RNA, 32 nt, Human
uugugagugaaugugaaggggagccagcgggc

SEQ ID NO: 277330 - RNA, 32 nt, Human
uugugagugagcugauuuauucugauucauua

SEQ ID NO: 277331 - RNA, 32 nt, Human
uugugaguggccugcugccucaccucccgcag

SEQ ID NO: 277332 - RNA, 32 nt, Human
uugugauauaauaaacuuuucuuauugugguu

SEQ ID NO: 277333 - RNA, 32 nt, Human
uugugauauuuucaccuguagucccagcugcu

SEQ ID NO: 277334 - RNA, 32 nt, Human
uugugaucacacuacgggaaucucugugguau

SEQ ID NO: 277335 - RNA, 32 nt, Human
uugugaucaggagagucaggggugcucagagg

SEQ ID NO: 277336 - RNA, 32 nt, Human
uugugaucaguuauuugcacaguggcucugac

SEQ ID NO: 277337 - RNA, 32 nt, Human
uugugauccaacauguacaguauguauauagu

SEQ ID NO: 277338 - RNA, 32 nt, Human
uugugaucucucucaccuacaucaauuaugua

SEQ ID NO: 277339 - RNA, 32 nt, Human
uugugaugcagaauuaugcacugacaugaccc

SEQ ID NO: 277340 - RNA, 32 nt, Human
uugugaugcccacaggccuggagccagcuagc

SEQ ID NO: 277341 - RNA, 32 nt, Human
uugugauggaugggaacgcaagagauacuuac

SEQ ID NO: 277342 - RNA, 32 nt, Human
uugugaugggcuuucucccacccuggagucuu

SEQ ID NO: 277343 - RNA, 32 nt, Human
uugugauuacaauaugcaaagagucauaaaua

SEQ ID NO: 277344 - RNA, 32 nt, Human
uugugauuggacaagacacaguguggagaaag

SEQ ID NO: 277345 - RNA, 32 nt, Human
uugugauuggucagucacugagccagggauac

SEQ ID NO: 277346 - RNA, 32 nt, Human
uugugauuuccucugaugcaggagaggaaaaa

SEQ ID NO: 277347 - RNA, 32 nt, Human
uugugauuucuuucuguuucuucccacaaaga

SEQ ID NO: 277348 - RNA, 32 nt, Human
uugugcaaccauugcuucauuucuuugcaaaa

SEQ ID NO: 277349 - RNA, 32 nt, Human
uugugcaaggaaaauguccaaaugaugcucuc

SEQ ID NO: 277350 - RNA, 32 nt, Human
uugugcaauucauauauuaaauugcacuuacu

SEQ ID NO: 277351 - RNA, 32 nt, Human
uugugcacacacacagggcucuuggguguguu

SEQ ID NO: 277352 - RNA, 32 nt, Human
uugugcacacagcuuucccagcuuuggugaga

SEQ ID NO: 277353 - RNA, 32 nt, Human
uugugcacacgaugggcaucuaacaucaucau

SEQ ID NO: 277354 - RNA, 32 nt, Human
uugugcacugcacucuagccugggggaagagu

SEQ ID NO: 277355 - RNA, 32 nt, Human
uugugcagaacaaacaaggcauucaugggaau

SEQ ID NO: 277356 - RNA, 32 nt, Human
uugugcagagagaaguagaagcuagaaagcac

SEQ ID NO: 277357 - RNA, 32 nt, Human
uugugcagaguguauaucucugccugggcaag

SEQ ID NO: 277358 - RNA, 32 nt, Human
uugugcagaguuguuugagucauuuccugccu

SEQ ID NO: 277359 - RNA, 21 nt, Human
uugugcagccagaugccugga

SEQ ID NO: 277360 - RNA, 20 nt, Human
uugugcagccaguuccugug

SEQ ID NO: 277361 - RNA, 32 nt, Human
uugugcagcccaccacucccacugaccccacc

SEQ ID NO: 277362 - RNA, 32 nt, Human
uugugcagccgauuucaaggcuaagagagaaa

SEQ ID NO: 277363 - RNA, 24 nt, Human
uugugcagccgggccugccucuga

SEQ ID NO: 277364 - RNA, 32 nt, Human
uugugcaggagaaagggggcgguuggcuuucu

SEQ ID NO: 277365 - RNA, 32 nt, Human
uugugcaggccuccccuccauccuggaccagc

SEQ ID NO: 277366 - RNA, 32 nt, Human
uugugcaggccugcccaguggcuggggcaugg

SEQ ID NO: 277367 - RNA, 21 nt, Human
uugugcaggcuggagugcagu

SEQ ID NO: 277368 - RNA, 22 nt, Human
uugugcaggcuggagugcagug

SEQ ID NO: 277369 - RNA, 32 nt, Human
uugugcaggcuggagugcaguggcacagucuu

SEQ ID NO: 277370 - RNA, 32 nt, Human
uugugcagguggauucuugcucugucacccag

SEQ ID NO: 277371 - RNA, 32 nt, Human
uugugcaguauuagcuugcuuuugcugcugug

SEQ ID NO: 277372 - RNA, 32 nt, Human
uugugcagucauguguuaaauauuucacauuu

SEQ ID NO: 277373 - RNA, 32 nt, Human
uugugcagugaagggaaaaguuggcauuuuga

SEQ ID NO: 277374 - RNA, 32 nt, Human
uugugcagugugacauggacuugcuguccuaa

SEQ ID NO: 277375 - RNA, 32 nt, Human
uugugcaucaccaaugaaugaaucagguugag

SEQ ID NO: 277376 - RNA, 32 nt, Human
uugugcaugcaccauuucucucuuacuaacag

SEQ ID NO: 277377 - RNA, 32 nt, Human
uugugcauugcacuccagccugagcaacagga

SEQ ID NO: 277378 - RNA, 32 nt, Human
uugugccaaaaaugcugaccuucaggccccgc

SEQ ID NO: 277379 - RNA, 32 nt, Human
uugugccaacagcccagaauugucacuuauau

SEQ ID NO: 277380 - RNA, 32 nt, Human
uugugccaauguacuccagccuaggugacaga

SEQ ID NO: 277381 - RNA, 32 nt, Human
uugugccacacacuccagccuggguggcaaag

SEQ ID NO: 277382 - RNA, 32 nt, Human
uugugccacagcacuguuuucuuucugcccuc

SEQ ID NO: 277383 - RNA, 32 nt, Human
uugugccaccacacuccagccugggcgacaga

SEQ ID NO: 277384 - RNA, 32 nt, Human
uugugccaccgcacuccagcaugggugacaga

SEQ ID NO: 277385 - RNA, 32 nt, Human
uugugccacggcacuccagccugggcagcaga

SEQ ID NO: 277386 - RNA, 32 nt, Human
uugugccacuacacuccagccuggccacagag

SEQ ID NO: 277387 - RNA, 32 nt, Human
uugugccacuacacuccagccuggccgacaga

SEQ ID NO: 277388 - RNA, 32 nt, Human
uugugccacuacacuccagccugggagacaga

SEQ ID NO: 277389 - RNA, 32 nt, Human
uugugccacuacacuccagccugggcaacaca

SEQ ID NO: 277390 - RNA, 32 nt, Human
uugugccacuacacuccagccugggcaacaga

SEQ ID NO: 277391 - RNA, 32 nt, Human
uugugccacuacacuccagccugggugacaaa

SEQ ID NO: 277392 - RNA, 32 nt, Human
uugugccacuaguacuccagccugggugacag

SEQ ID NO: 277393 - RNA, 32 nt, Human
uugugccacuccccuccagccugggcgacaga

SEQ ID NO: 277394 - RNA, 32 nt, Human
uugugccacugaacucuagccuggguaacaga

SEQ ID NO: 277395 - RNA, 32 nt, Human
uugugccacugcacaccagccuggacaacaga

SEQ ID NO: 277396 - RNA, 32 nt, Human
uugugccacugcacaccggccugggugacagc

SEQ ID NO: 277397 - RNA, 32 nt, Human
uugugccacugcacacuccaaucugggugaaa

SEQ ID NO: 277398 - RNA, 32 nt, Human
uugugccacugcaccccagccuuggcaacaga

SEQ ID NO: 277399 - RNA, 32 nt, Human
uugugccacugcacgcacuccagccugggcga

SEQ ID NO: 277400 - RNA, 32 nt, Human
uugugccacugcacucaagccugggugacgag

SEQ ID NO: 277401 - RNA, 32 nt, Human
uugugccacugcacucauccuggaagacagag

SEQ ID NO: 277402 - RNA, 32 nt, Human
uugugccacugcacuccaacaaccgagcgaga

SEQ ID NO: 277403 - RNA, 32 nt, Human
uugugccacugcacuccaaccugggugacaga

SEQ ID NO: 277404 - RNA, 32 nt, Human
uugugccacugcacuccacccugggcaacaga

SEQ ID NO: 277405 - RNA, 32 nt, Human
uugugccacugcacuccagacugggugacaca

SEQ ID NO: 277406 - RNA, 32 nt, Human
uugugccacugcacuccagccagagugacaga

SEQ ID NO: 277407 - RNA, 32 nt, Human
uugugccacugcacuccagccggggugacaga

SEQ ID NO: 277408 - RNA, 32 nt, Human
uugugccacugcacuccagccuaggcaacaga

SEQ ID NO: 277409 - RNA, 32 nt, Human
uugugccacugcacuccagccuaggcgacaga

SEQ ID NO: 277410 - RNA, 32 nt, Human
uugugccacugcacuccagccugagcaacaaa

SEQ ID NO: 277411 - RNA, 32 nt, Human
uugugccacugcacuccagccuggacgacaga

SEQ ID NO: 277412 - RNA, 32 nt, Human
uugugccacugcacuccagccuggcaacagag

SEQ ID NO: 277413 - RNA, 32 nt, Human
uugugccacugcacuccagccugggagacaga

SEQ ID NO: 277414 - RNA, 32 nt, Human
uugugccacugcacuccagccugggcaacaag

SEQ ID NO: 277415 - RNA, 32 nt, Human
uugugccacugcacuccagccugggcaacaca

SEQ ID NO: 277416 - RNA, 32 nt, Human
uugugccacugcacuccagccugggcaacaga

SEQ ID NO: 277417 - RNA, 32 nt, Human
uugugccacugcacuccagccugggcaacuga

SEQ ID NO: 277418 - RNA, 32 nt, Human
uugugccacugcacuccagccugggcaauaga

SEQ ID NO: 277419 - RNA, 32 nt, Human
uugugccacugcacuccagccugggcaccaau

SEQ ID NO: 277420 - RNA, 32 nt, Human
uugugccacugcacuccagccugggccacaga

SEQ ID NO: 277421 - RNA, 32 nt, Human
uuuaucuugaaggaaccauuagauauggaaaa

SEQ ID NO: 277422 - RNA, 20 nt, Human
uuuaucuugacccgcaagca

SEQ ID NO: 277423 - RNA, 32 nt, Human
uuuaucuugcccaaagagcucccucucaaggc

SEQ ID NO: 277424 - RNA, 32 nt, Human
uuuaucuugcuuuggaggaccuuaaaugcuac

SEQ ID NO: 277425 - RNA, 26 nt, Human
uuuaucuuuaccuaggguucagucag

SEQ ID NO: 277426 - RNA, 32 nt, Human
uuuaucuuuauuguugaaucuaaugccuaaug

SEQ ID NO: 277427 - RNA, 21 nt, Human
uuuaucuuucaugugggcuaa

SEQ ID NO: 277428 - RNA, 32 nt, Human
uuuaucuuugaaauuuuguacauugcuuuucc

SEQ ID NO: 277429 - RNA, 32 nt, Human
uuuaucuuugucaucucucaaauuagaauaua

SEQ ID NO: 277430 - RNA, 21 nt, Human
uuuaucuuuguucccaaggca

SEQ ID NO: 277431 - RNA, 32 nt, Human
uuuaucuuuuaagcuaucuauaccuuacugca

SEQ ID NO: 277432 - RNA, 32 nt, Human
uuuaucuuuucucugcugauacgguugcuuga

SEQ ID NO: 277433 - RNA, 32 nt, Human
uuuaucuuuugaaaucgaguuucuuuuguauu

SEQ ID NO: 277434 - RNA, 32 nt, Human
uuuaugaaaacugugcaauugugugcauguuu

SEQ ID NO: 277435 - RNA, 32 nt, Human
uuuaugaaaugagaaaauuauuggacaauuca

SEQ ID NO: 277436 - RNA, 21 nt, Human
uuuaugaaauuauauugcauu

SEQ ID NO: 277437 - RNA, 32 nt, Human
uuuaugaaccaccaggcugaacccuucucugg

SEQ ID NO: 277438 - RNA, 32 nt, Human
uuuaugaagagaguugaguuuaacaauccuag

SEQ ID NO: 277439 - RNA, 20 nt, Human
uuuaugaaggcaucauguca

SEQ ID NO: 277440 - RNA, 32 nt, Human
uuuaugacaagcuguaucacugccuucguuua

SEQ ID NO: 277441 - RNA, 32 nt, Human
uuuaugacagaauuauuauagcugagcugacu

SEQ ID NO: 277442 - RNA, 32 nt, Human
uuuaugacugcaacuugccuuuuccauuacag

SEQ ID NO: 277443 - RNA, 21 nt, Human
uuuaugacugugagcaucuca

SEQ ID NO: 277444 - RNA, 21 nt, Human
uuuaugacugugaugcauuca

SEQ ID NO: 277445 - RNA, 20 nt, Human
uuuaugacuguuagugacuc

SEQ ID NO: 277446 - RNA, 32 nt, Human
uuuaugacuucugcuuuuuaugucuuuuuaaa

SEQ ID NO: 277447 - RNA, 32 nt, Human
uuuaugacuuuuugaaaaagcuucugggaguu

SEQ ID NO: 277448 - RNA, 32 nt, Human
uuuaugagaacaaacucaaguccauagaaacc

SEQ ID NO: 277449 - RNA, 23 nt, Human
uuuaugagcauauauugcauuua

SEQ ID NO: 277450 - RNA, 32 nt, Human
uuuaugaguauuagccuuuuaaguuaugggag

SEQ ID NO: 277451 - RNA, 32 nt, Human
uuuaugagugauacccauuugagggccucuaa

SEQ ID NO: 277452 - RNA, 32 nt, Human
uuuaugaucuggguuacgguauguucugggga

SEQ ID NO: 277453 - RNA, 22 nt, Human
uuuaugauuauuauauuuuuca

SEQ ID NO: 277454 - RNA, 32 nt, Human
uuuaugauuguuuuguaaauaucuuuguauau

SEQ ID NO: 277455 - RNA, 32 nt, Human
uuuaugcaaccauaagacaaacuccugaaaug

SEQ ID NO: 277456 - RNA, 32 nt, Human
uuuaugcacacagagacccagggugagggagu

SEQ ID NO: 277457 - RNA, 32 nt, Human
uuuaugcagaauguugauuacagugcagugcg

SEQ ID NO: 277458 - RNA, 32 nt, Human
uuuaugcauagagagugcaguuaugaaaauga

SEQ ID NO: 277459 - RNA, 32 nt, Human
uuuaugcauauguagauacaaggaugcacaua

SEQ ID NO: 277460 - RNA, 32 nt, Human
uuuaugccccacugcuguccuaagucccuggc

SEQ ID NO: 277461 - RNA, 32 nt, Human
uuuaugcccccucuauucuccucucuccccca

SEQ ID NO: 277462 - RNA, 32 nt, Human
uuuaugcccuaucaccauggugaugggauuag

SEQ ID NO: 277463 - RNA, 32 nt, Human
uuuaugcccuggagaagaccuacuugaacagg

SEQ ID NO: 277464 - RNA, 32 nt, Human
uuuaugccucugcuuggcuaucacccucuuag

SEQ ID NO: 277465 - RNA, 28 nt, Human
uuuaugccugaacauagacucucucauc

SEQ ID NO: 277466 - RNA, 32 nt, Human
uuuaugccugcugcuucucugccucuuugagg

SEQ ID NO: 277467 - RNA, 32 nt, Human
uuuaugccuguaaucccagcacugugggaggc

SEQ ID NO: 277468 - RNA, 32 nt, Human
uuuaugccuuuggccuuccauucugauuucuc

SEQ ID NO: 277469 - RNA, 32 nt, Human
uuuaugcuauggaggaaaaagaaaaagaaaua

SEQ ID NO: 277470 - RNA, 32 nt, Human
uuuaugcucuuccuccacaucuucauuuggcu

SEQ ID NO: 277471 - RNA, 32 nt, Human
uuuaugcugaagaccuggcaggaggcaacucc

SEQ ID NO: 277472 - RNA, 32 nt, Human
uuuaugcugaggcuuuaauucaggugacuugc

SEQ ID NO: 277473 - RNA, 32 nt, Human
uuuaugcugcuggcuuuugugcccuggaagau

SEQ ID NO: 277474 - RNA, 32 nt, Human
uuuaugcuggacccaguaagaugaggaagucg

SEQ ID NO: 277475 - RNA, 32 nt, Human
uuuaugcugggugauauagucaaaauuugcuu

SEQ ID NO: 277476 - RNA, 32 nt, Human
uuuaugcuucuuugaaaaccagugugugacuc

SEQ ID NO: 277477 - RNA, 32 nt, Human
uuuaugcuugggaggucgaggcugcagugagu

SEQ ID NO: 277478 - RNA, 32 nt, Human
uuuauggaaucagcucucgcacugcccaucuu

SEQ ID NO: 277479 - RNA, 32 nt, Human
uuuauggaguucccuggaguggcagagcuaua

SEQ ID NO: 277480 - RNA, 32 nt, Human
uuuauggaguuuuugggcaggagcucauugca

SEQ ID NO: 277481 - RNA, 32 nt, Human
uuuauggauguggcugagaccuuaaacuugag

SEQ ID NO: 277482 - RNA, 32 nt, Human
uuuauggcacacugggauaaacaagcaagauu

SEQ ID NO: 277483 - RNA, 32 nt, Human
uuuauggcaggagggagaaaaaguguuacaac

SEQ ID NO: 277484 - RNA, 32 nt, Human
uuuauggcaucacucccuucuaaucagcaagu

SEQ ID NO: 277485 - RNA, 32 nt, Human
uuuauggcauuugagauugaaacuaagaaaug

SEQ ID NO: 277486 - RNA, 32 nt, Human
uuuauggcccaggagaaaauguagacccugag

SEQ ID NO: 277487 - RNA, 32 nt, Human
uuuauggcucagggggcaucacagaaccugcc

SEQ ID NO: 277488 - RNA, 32 nt, Human
uuuauggcugcugggcugagugacacaagcac

SEQ ID NO: 277489 - RNA, 32 nt, Human
uuuauggcuguaaucugcaaacucugggaggc

SEQ ID NO: 277490 - RNA, 32 nt, Human
uuuauggcuuugccaagcuacaucaagaacuc

SEQ ID NO: 277491 - RNA, 32 nt, Human
uuuaugggagaagggcaaagacuucaugggaa

SEQ ID NO: 277492 - RNA, 32 nt, Human
uuuaugggccucccccaauugucuuuuuauuu

SEQ ID NO: 277493 - RNA, 32 nt, Human
uuuaugggcucaagaaugccaugcgcuggcag

SEQ ID NO: 277494 - RNA, 32 nt, Human
uuuauggggaaagggagggacugagggcagag

SEQ ID NO: 277495 - RNA, 32 nt, Human
uuuaugggguggaaacagcauuaagaauacug

SEQ ID NO: 277496 - RNA, 32 nt, Human
uuuauggguauuucccuaauugugagagauua

SEQ ID NO: 277497 - RNA, 32 nt, Human
uuuaugggugagguacuuugggccaguagagu

SEQ ID NO: 277498 - RNA, 32 nt, Human
uuuauggguggcccagcuucuucaagaccuuc

SEQ ID NO: 277499 - RNA, 32 nt, Human
uuuauggucaguugauuuuaaaccagagugcc

SEQ ID NO: 277500 - RNA, 32 nt, Human
uuuauggugggguacuuuauuggugauuaaua

SEQ ID NO: 277501 - RNA, 32 nt, Human
uuuaugguugauauuagguuuaauaccuagaa

SEQ ID NO: 277502 - RNA, 32 nt, Human
uuuaugguuucaaagcaguuuaugggaacuuc

SEQ ID NO: 277503 - RNA, 32 nt, Human
uuuaugguuuuuccugcuucugagcgucguuc

SEQ ID NO: 277504 - RNA, 32 nt, Human
uuuauguaaagagcaacucagcaggacacaga

SEQ ID NO: 277505 - RNA, 25 nt, Human
uuuauguaaagguauuuaugggcca

SEQ ID NO: 277506 - RNA, 32 nt, Human
uuuauguaaauacuuuugugacuucauuguaa

SEQ ID NO: 277507 - RNA, 21 nt, Human
uuuauguaaauauucugcagu

SEQ ID NO: 277508 - RNA, 32 nt, Human
uuuauguagagcuggaagaaggccguccaucc

SEQ ID NO: 277509 - RNA, 32 nt, Human
uuuauguauaugcacauacacacaaaauuagg

SEQ ID NO: 277510 - RNA, 32 nt, Human
uuuauguauuuuuaguagagaugggguuucac

SEQ ID NO: 277511 - RNA, 32 nt, Human
uuuaugucacuccccaccuccucauauuuaau

SEQ ID NO: 277512 - RNA, 32 nt, Human
uuuaugucagccgcgaucccacccccacaagc

SEQ ID NO: 277513 - RNA, 32 nt, Human
uuuauguccauuggauacuuuccuuuuuauca

SEQ ID NO: 277514 - RNA, 32 nt, Human
uuuauguccuccaagagcugcuggagggcaug

SEQ ID NO: 277515 - RNA, 32 nt, Human
uuuauguccucuucucccuuuccauccuucag

SEQ ID NO: 277516 - RNA, 32 nt, Human
uuuauguccucuucucccuuuccaucuuucag

SEQ ID NO: 277517 - RNA, 32 nt, Human
uuuauguccucuucucuguuucuaccuuucag

SEQ ID NO: 277518 - RNA, 32 nt, Human
uuuauguccugagagccaugugcagaugagga

SEQ ID NO: 277519 - RNA, 32 nt, Human
uuuaugucuagacuguugcuuaugacaccucc

SEQ ID NO: 277520 - RNA, 32 nt, Human
uuuaugucuccaugcaaacauucaaagugcuu

SEQ ID NO: 277521 - RNA, 32 nt, Human
uuuaugucuggcuucucucacuuaacauauug

SEQ ID NO: 277522 - RNA, 32 nt, Human
uuuaugucugguguuaagauuaauauuucaga

SEQ ID NO: 277523 - RNA, 32 nt, Human
uuuaugucuuucuccucuuccuauucugucau

SEQ ID NO: 277524 - RNA, 32 nt, Human
uuuaugugagugugucuuuuacagaaaccauu

SEQ ID NO: 277525 - RNA, 32 nt, Human
uuuauguggaucccuguguaugcugaacuaca

SEQ ID NO: 277526 - RNA, 32 nt, Human
uuuauguggucacauuacaucucuccaccucu

SEQ ID NO: 277527 - RNA, 32 nt, Human
uuuaugugguccagagaggcugcaucagucuc

SEQ ID NO: 277528 - RNA, 32 nt, Human
uuuaugugugugccucauuccuuucccaccaa

SEQ ID NO: 277529 - RNA, 32 nt, Human
uuuauguuauuuggcuaaauguuaugaugcag

SEQ ID NO: 277530 - RNA, 32 nt, Human
uuuauguucauguccuguaaauuuuuaaguac

SEQ ID NO: 277531 - RNA, 32 nt, Human
uuuauguugauuuugacccucuuauuuaaucu

SEQ ID NO: 277532 - RNA, 32 nt, Human
uuuauguugcagcaucuuuucuuuguggcuca

SEQ ID NO: 277533 - RNA, 32 nt, Human
uuuauguugcauucaaagacuguugucuuguu

SEQ ID NO: 277534 - RNA, 32 nt, Human
uuuauguuucaucaaacuuguuccagcuaauc

SEQ ID NO: 277535 - RNA, 32 nt, Human
uuuauguuuuaaaaaugaucaauguuuugauu

SEQ ID NO: 277536 - RNA, 32 nt, Human
uuuauuaaaaccagucucagauaucauacuga

SEQ ID NO: 277537 - RNA, 32 nt, Human
uuuauuaaaacuuuacauggaggggaagaaua

SEQ ID NO: 277538 - RNA, 32 nt, Human
uuuauuaaaggcuaaaaacaauaccaccaaua

SEQ ID NO: 277539 - RNA, 32 nt, Human
uuuauuaaaugauggauguucucacugucagu

SEQ ID NO: 277540 - RNA, 32 nt, Human
uuuauuaacuuagggcagauauaaaauaaagg

SEQ ID NO: 277541 - RNA, 32 nt, Human
uuuauuaauaaauugguaauauacaaaacaau

SEQ ID NO: 277542 - RNA, 32 nt, Human
uuuauuaauguucaaaacacuggaauuacaaa

SEQ ID NO: 277543 - RNA, 32 nt, Human
uuuauuaauuuuccuucuguguguucaauuug

SEQ ID NO: 277544 - RNA, 32 nt, Human
uuuauuacaaugauuuucucccuucuuuuaca

SEQ ID NO: 277545 - RNA, 32 nt, Human
uuuauuacauuuucacgugucuucacgcaucu

SEQ ID NO: 277546 - RNA, 32 nt, Human
uuuauuacccuuuugcauguauuugugugaca

SEQ ID NO: 277547 - RNA, 32 nt, Human
uuuauuaccuaggaugggguuucucuaauugc

SEQ ID NO: 277548 - RNA, 32 nt, Human
uuuauuacuacugcuuuacugccuguagcagg

SEQ ID NO: 277549 - RNA, 32 nt, Human
uuuauuacucacaagaccuuuuuccuccguuu

SEQ ID NO: 277550 - RNA, 32 nt, Human
uuuauuacuuaucuugcguauauuuuagaggu

SEQ ID NO: 277551 - RNA, 32 nt, Human
uuuauuacuuuuguuuuuaauuuuaaccauag

SEQ ID NO: 277552 - RNA, 32 nt, Human
uuuauuagaaggagaggguaggugcagagcug

SEQ ID NO: 277553 - RNA, 32 nt, Human
uuuauuagacuuuucucauaaguuuugacugg

SEQ ID NO: 277554 - RNA, 32 nt, Human
uuuauuagagacauaguguggcagucucuaga

SEQ ID NO: 277555 - RNA, 32 nt, Human
uuuauuagauaacauuugaaguaaugacuuag

SEQ ID NO: 277556 - RNA, 32 nt, Human
uuuauuagggcucucauuucaugaccuaauua

SEQ ID NO: 277557 - RNA, 22 nt, Human
uuuauuaugaaucauuuucccc

SEQ ID NO: 277558 - RNA, 32 nt, Human
uuuauuauguguugugguguacuccucuuugg

SEQ ID NO: 277559 - RNA, 32 nt, Human
uuuauuauuagaaaagauugcugagaguauuu

SEQ ID NO: 277560 - RNA, 32 nt, Human
uuuauuauuauuuaguacaaaaauagauuccc

SEQ ID NO: 277561 - RNA, 32 nt, Human
uuuauuauuuacacugaauuccaauuucauuu

SEQ ID NO: 277562 - RNA, 32 nt, Human
uuuauuauuucauaagaaaacuacguuaauuu

SEQ ID NO: 277563 - RNA, 32 nt, Human
uuuauucaagcuucagcuuucagcuggguugu

SEQ ID NO: 277564 - RNA, 32 nt, Human
uuuauucacuuucaacagcaguggcccugggc

SEQ ID NO: 277565 - RNA, 32 nt, Human
uuuauucacuuuccucauuucugccuuucuac

SEQ ID NO: 277566 - RNA, 32 nt, Human
uuuauucagaggagaugcucaauagauguuug

SEQ ID NO: 277567 - RNA, 32 nt, Human
uuuauucagcaacuauuuauuaagcaucaacu

SEQ ID NO: 277568 - RNA, 32 nt, Human
uuuauucauauaaaugugcagaaagauuccaa

SEQ ID NO: 277569 - RNA, 32 nt, Human
uuuauucaucaccccuguccucucauccauaa

SEQ ID NO: 277570 - RNA, 32 nt, Human
uuuauucaugccagucuguugcaugcaggcuu

SEQ ID NO: 277571 - RNA, 32 nt, Human
uuuauucauuagauacagaaggugcaguauua

SEQ ID NO: 277572 - RNA, 32 nt, Human
uuuauucauucaacaaacaguggccgaaggcu

SEQ ID NO: 277573 - RNA, 32 nt, Human
uuuauuccaagacucaguuuugcauuucugac

SEQ ID NO: 277574 - RNA, 32 nt, Human
uuuauuccagcacuucucuguguuuuacagac

SEQ ID NO: 277575 - RNA, 32 nt, Human
uuuauuccauaggguuucucuccugugcagcu

SEQ ID NO: 277576 - RNA, 32 nt, Human
uuuauucccuccaucaucuagacuugauuuua

SEQ ID NO: 277577 - RNA, 32 nt, Human
uuuauuccuccaccucuugcuccaaucagugg

SEQ ID NO: 277578 - RNA, 32 nt, Human
uuuauuccuccaccucuugcugcaaucagugg

SEQ ID NO: 277579 - RNA, 32 nt, Human
uuuauuccugcuguuuuguuuuggggaccagg

SEQ ID NO: 277580 - RNA, 32 nt, Human
uuuauuccuggcauccagagugacagugaacu

SEQ ID NO: 277581 - RNA, 32 nt, Human
uuuauuccuuucccccaggcccucucuauuug

SEQ ID NO: 277582 - RNA, 32 nt, Human
uuuauucgcugggcuccagcccauuugcauaa

SEQ ID NO: 277583 - RNA, 32 nt, Human
uuuauucggaccaagcagagcucacagcugga

SEQ ID NO: 277584 - RNA, 32 nt, Human
uuuauucgugagccucucggcuccuggggucc

SEQ ID NO: 277585 - RNA, 32 nt, Human
uuuauucuacagcgcagcuaccaagccuuuua

SEQ ID NO: 277586 - RNA, 32 nt, Human
uuuauucucucccgcccuccuacaagcgcucu

SEQ ID NO: 277587 - RNA, 32 nt, Human
uuuauucugagaaguugaggcaaaucaguauu

SEQ ID NO: 277588 - RNA, 32 nt, Human
uuuauucugcugucuggcuucaugccauugca

SEQ ID NO: 277589 - RNA, 32 nt, Human
uuuauucuuagacucaugugauccaagcugua

SEQ ID NO: 277590 - RNA, 32 nt, Human
uuuauucuuauucaaagaaauaucugagcucu

SEQ ID NO: 277591 - RNA, 32 nt, Human
uuuauucuuauuuuuggagacagggucucgcu

SEQ ID NO: 277592 - RNA, 32 nt, Human
uuuauucuucacugaggauuucugaucugauu

SEQ ID NO: 277593 - RNA, 32 nt, Human
uuuauucuucauucugacuuuuuaacuguuug

SEQ ID NO: 277594 - RNA, 31 nt, Human
uuuauugaacaauguagucacuugaagguuu

SEQ ID NO: 277595 - RNA, 32 nt, Human
uuuauugacaagugauuuucaagucuguguuc

SEQ ID NO: 277596 - RNA, 32 nt, Human
uuuauugagcacugcugguggccaggagugcg

SEQ ID NO: 277597 - RNA, 32 nt, Human
uuuauugaugauuuuuauuuucuuuauuuuuc

SEQ ID NO: 277598 - RNA, 32 nt, Human
uuuauugcaaaugcacaaucuuuuucccauug

SEQ ID NO: 277599 - RNA, 32 nt, Human
uuuauugcagagacccagcagauguaacucuc

SEQ ID NO: 277600 - RNA, 32 nt, Human
uuuauugcaugguuccugggaacauguggcac

SEQ ID NO: 277601 - RNA, 32 nt, Human
uuuauugccaacacccuuggaagaacaucucc

SEQ ID NO: 277602 - RNA, 32 nt, Human
uuuauugcccaggcuggaguguaguggcgcaa

SEQ ID NO: 277603 - RNA, 32 nt, Human
uuuauugccucgucuuauucacugaccuuugu

SEQ ID NO: 277604 - RNA, 32 nt, Human
uuuauugcuauuugaagcagauguucaccaau

SEQ ID NO: 277605 - RNA, 32 nt, Human
uuuauugcugaaggacuuuuucaggcuuuagc

SEQ ID NO: 277606 - RNA, 32 nt, Human
uuuauugcugaguugcauuccaugguacggau

SEQ ID NO: 277607 - RNA, 32 nt, Human
uuuauugcuucuucucccaucugcccguugac

SEQ ID NO: 277608 - RNA, 32 nt, Human
uuuauugcuuguuuuucucccaauuguaaauu

SEQ ID NO: 277609 - RNA, 32 nt, Human
uuuauuggacuaaaaacuaacagaacuucauu

SEQ ID NO: 277610 - RNA, 32 nt, Human
uuuauuggccuggaguguggccuaggcauuag

SEQ ID NO: 277611 - RNA, 32 nt, Human
uuuauuggcuuugcucccaacccccugcccua

SEQ ID NO: 277612 - RNA, 32 nt, Human
uuuauugggcagggggagggggagggcacagg

SEQ ID NO: 277613 - RNA, 32 nt, Human
uuuauugguccucugguguuugguggcaugaa

SEQ ID NO: 277614 - RNA, 32 nt, Human
uuuauuggucucagcaaauugaacucaagcau

SEQ ID NO: 277615 - RNA, 21 nt, Human
uuuauuggucuguuccuuugg

SEQ ID NO: 277616 - RNA, 28 nt, Human
uuuauugguugaauguguaucuauuuga

SEQ ID NO: 277617 - RNA, 32 nt, Human
uuuauuguaauaccucacagacguuguaccau

SEQ ID NO: 277618 - RNA, 32 nt, Human
uuuauugugauuuauauuuccacagcguuuag

SEQ ID NO: 277619 - RNA, 32 nt, Human
uuuauuguggaccccauggaaugugauuaaau

SEQ ID NO: 277620 - RNA, 32 nt, Human
uuuauugugugguuagcacaaggaaucuaauu

SEQ ID NO: 277621 - RNA, 32 nt, Human
uuuauuguguuuuggaacauuaauugugagau

SEQ ID NO: 277622 - RNA, 23 nt, Human
uuuauuguuauuaauugcacuua

SEQ ID NO: 277623 - RNA, 32 nt, Human
uuuauuguuccaagggagccucaucaaaacca

SEQ ID NO: 277624 - RNA, 32 nt, Human
uuuauuguucugcucauuguguuugugacaaa

SEQ ID NO: 277625 - RNA, 18 nt, Human
uuuauuguugcuggcaca

SEQ ID NO: 277626 - RNA, 32 nt, Human
uuuauuguuguauuaaaguaccuguguuacac

SEQ ID NO: 277627 - RNA, 32 nt, Human
uuuauuguuuuuauuccacacuuccuacuugg

SEQ ID NO: 277628 - RNA, 32 nt, Human
uuuauuuaauuucuuuucuuccugucuguucc

SEQ ID NO: 277629 - RNA, 32 nt, Human
uuuauuuacagucuuauuuauguucuguuuaa

SEQ ID NO: 277630 - RNA, 32 nt, Human
uuuauuuacauacaaguucucucucccucacu

SEQ ID NO: 277631 - RNA, 32 nt, Human
uuuauuuagaaccugguucuguguuuaauaua

SEQ ID NO: 277632 - RNA, 32 nt, Human
uuuauuuagaucuuuccuuguggaaaaauaag

SEQ ID NO: 277633 - RNA, 32 nt, Human
uuuauuuagcacaaaccaagcacaaaaguccu

SEQ ID NO: 277634 - RNA, 32 nt, Human
uuuauuuaggucuggccccacccuggagucuu

SEQ ID NO: 277635 - RNA, 21 nt, Human
uuuauuuaguucacacauuau

SEQ ID NO: 277636 - RNA, 24 nt, Human
uuuauuuauaacacuuuuuuggca

SEQ ID NO: 277637 - RNA, 32 nt, Human
uuuauuuauuacagggcugcuauuuucauaau

SEQ ID NO: 277638 - RNA, 32 nt, Human
uuuauuuauuguauuuaaaccuggugagagga

SEQ ID NO: 277639 - RNA, 32 nt, Human
uuuauuuauuucaaaugcaguuguauuaguuc

SEQ ID NO: 277640 - RNA, 32 nt, Human
uuuauuucaaacucucuaaugcaccugccuca

SEQ ID NO: 277641 - RNA, 32 nt, Human
uuuauuucaaugagaaagcacugugaaauugu

SEQ ID NO: 277642 - RNA, 32 nt, Human
uuuauuucacacauuuucuuuacauaugcaca

SEQ ID NO: 277643 - RNA, 32 nt, Human
uuuauuucaccuugccaagacacccacacuac

SEQ ID NO: 277644 - RNA, 32 nt, Human
uuuauuucacucaggggcacugugguugcugu

SEQ ID NO: 277645 - RNA, 32 nt, Human
uuuauuucauguuugcauacuauaaaaucuga

SEQ ID NO: 277646 - RNA, 31 nt, Human
uuuauuucauuaaauaccuugaagaaucuua

SEQ ID NO: 277647 - RNA, 32 nt, Human
uuuauuucauugacuaacccaggacaguuuca

SEQ ID NO: 277648 - RNA, 32 nt, Human
uuuauuuccacugcacgcuggugcugggagcg

SEQ ID NO: 277649 - RNA, 32 nt, Human
uuuauuucccuaauaucaggaaaucccaguug

SEQ ID NO: 277650 - RNA, 32 nt, Human
uuuauuucccuccugaggggucucugggaaga

SEQ ID NO: 277651 - RNA, 32 nt, Human
uuuauuuccuggauaguaacuggucaggauau

SEQ ID NO: 277652 - RNA, 32 nt, Human
uuuauuucuauuaaacguuucugcacuggcaa

SEQ ID NO: 277653 - RNA, 32 nt, Human
uuuauuucucaaauggaaacaccugaaaaagc

SEQ ID NO: 277654 - RNA, 32 nt, Human
uuuauuucucacuguauuuuccucaacgucug

SEQ ID NO: 277655 - RNA, 32 nt, Human
uuuauuucucagaacaagguaaaaaggugagu

SEQ ID NO: 277656 - RNA, 32 nt, Human
uuuauuucuccccuggcaacagauuucaaauc

SEQ ID NO: 277657 - RNA, 32 nt, Human
uuuauuucucguucucucuuccuuguccuccc

SEQ ID NO: 277658 - RNA, 32 nt, Human
uuuauuucucucucagugcaucuugcuaugag

SEQ ID NO: 277659 - RNA, 32 nt, Human
uuuauuucucucucccauaacagugcagugau

SEQ ID NO: 277660 - RNA, 32 nt, Human
uuuauuucucuugacaaccaagggccuccguc

SEQ ID NO: 277661 - RNA, 32 nt, Human
uuuauuucugagauguugaugugaacuguaca

SEQ ID NO: 277662 - RNA, 32 nt, Human
uuuauuucugcuauuugcuguuguguaauauc

SEQ ID NO: 277663 - RNA, 32 nt, Human
uuuauuucuggugugauuucucugucuuaccu

SEQ ID NO: 277664 - RNA, 32 nt, Human
uuuauuucuguauugaaaauguuacacaaagc

SEQ ID NO: 277665 - RNA, 32 nt, Human
uuuauuucuguggaguauugccuacaaaucuu

SEQ ID NO: 277666 - RNA, 32 nt, Human
uuuauuucugugucuacagucuugcccugcca

SEQ ID NO: 277667 - RNA, 24 nt, Human
uuuauuucuuacgcauucuuggca

SEQ ID NO: 277668 - RNA, 32 nt, Human
uuuauuugaacaaagaccagucuccaccacca

SEQ ID NO: 277669 - RNA, 32 nt, Human
uuuauuugaacuuggaauguucccagugauuu

SEQ ID NO: 277670 - RNA, 32 nt, Human
uuuauuugaauuacccgaauagcaauauguaa

SEQ ID NO: 277671 - RNA, 32 nt, Human
uuuauuugagaaguagagcucuugccauuuuu

SEQ ID NO: 277672 - RNA, 32 nt, Human
uuuauuugauuuuuauccucaucccagcaggc

SEQ ID NO: 277673 - RNA, 32 nt, Human
uuuauuugcaguaucaaacauuccauuucaug

SEQ ID NO: 277674 - RNA, 32 nt, Human
uuuauuugcgggaucaaucagggacucccaga

SEQ ID NO: 277675 - RNA, 32 nt, Human
uuuauuuggaaacugccucucucccuaguucu

SEQ ID NO: 277676 - RNA, 32 nt, Human
uuuauuuggaaaugggaccuuuaaggagguaa

SEQ ID NO: 277677 - RNA, 32 nt, Human
uuuauuuggaggauaaaaugaaguucugaaaa

SEQ ID NO: 277678 - RNA, 32 nt, Human
uuuauuugggaaaggaaagcccagauuugaau

SEQ ID NO: 277679 - RNA, 32 nt, Human
uuuauuugggcuguggcgugaggagcgggcgg

SEQ ID NO: 277680 - RNA, 32 nt, Human
uuuauuuguguauuugcuuucauuucaaaguc

SEQ ID NO: 277681 - RNA, 32 nt, Human
uuuauuuguuauacaauggaagcacaauguua

SEQ ID NO: 277682 - RNA, 32 nt, Human
uuuauuuuaaaaaguaaacaugcggcugggcg

SEQ ID NO: 277683 - RNA, 32 nt, Human
uuuauuuuaaugcucaaauugucccaaauuau

SEQ ID NO: 277684 - RNA, 32 nt, Human
uuuauuuuacuuuugagccagggccucacucu

SEQ ID NO: 277685 - RNA, 26 nt, Human
uuuauuuucauuuuauaucuuuugua

SEQ ID NO: 277686 - RNA, 22 nt, Human
uuuauuuuccacggaugaguca

SEQ ID NO: 277687 - RNA, 32 nt, Human
uuuauuuucccuccucccucuuguuuuagcug

SEQ ID NO: 277688 - RNA, 32 nt, Human
uuuauuuucccugagccuauaucuucaucugu

SEQ ID NO: 277689 - RNA, 26 nt, Human
uuuauuuuccgcagcaugucagcuaa

SEQ ID NO: 277690 - RNA, 32 nt, Human
uuuauuuuccuccuccuccuucuucuucuccu

SEQ ID NO: 277691 - RNA, 26 nt, Human
uuuauuuuccuggagguauuagccaa

SEQ ID NO: 277692 - RNA, 32 nt, Human
uuuauuuucuauuuucuucuguuuccuuugga

SEQ ID NO: 277693 - RNA, 32 nt, Human
uuuauuuucucuucccuguaucugccucuccc

SEQ ID NO: 277694 - RNA, 32 nt, Human
uuuauuuucugugagccacguccuccucgagc

SEQ ID NO: 277695 - RNA, 32 nt, Human
uuuauuuugaagcucuauuuuaauaguauuua

SEQ ID NO: 277696 - RNA, 32 nt, Human
uuuauuuugagcaauucuccugccucagccuc

SEQ ID NO: 277697 - RNA, 32 nt, Human
uuuauuuugccaagguuggggaugcauaugca

SEQ ID NO: 277698 - RNA, 32 nt, Human
uuuauuuugcuuguugaacucuuagagcuauu

SEQ ID NO: 277699 - RNA, 32 nt, Human
uuuauuuuggauacuaaggaugugccaaauga

SEQ ID NO: 277700 - RNA, 32 nt, Human
uuuauuuugguauuaaagaaggacuaagggcu

SEQ ID NO: 277701 - RNA, 32 nt, Human
uuuauuuuggugcaagaaaauuuauguucuca

SEQ ID NO: 277702 - RNA, 32 nt, Human
uuuauuuuguaggcacuaaggguuucuaaaac

SEQ ID NO: 277703 - RNA, 32 nt, Human
uuuauuuuguauuugcagugcaguuuggcacc

SEQ ID NO: 277704 - RNA, 32 nt, Human
uuuauuuugugaaaugaaaauuguucacccaa

SEQ ID NO: 277705 - RNA, 32 nt, Human
uuuauuuuuaaaacacaaguagaaugauuuaa

SEQ ID NO: 277706 - RNA, 32 nt, Human
uuuauuuuuaaugcaguaauauauggagaaau

SEQ ID NO: 277707 - RNA, 32 nt, Human
uuuauuuuuaauucucucuucuccuccagaca

SEQ ID NO: 277708 - RNA, 21 nt, Human
uuuauuuuuagggagugggua

SEQ ID NO: 277709 - RNA, 32 nt, Human
uuuauuuuuagguauuuuaggggaaaugauuu

SEQ ID NO: 277710 - RNA, 32 nt, Human
uuuauuuuuauuuuugagugggaaggaauuuu

SEQ ID NO: 277711 - RNA, 32 nt, Human
uuuauuuuuccccucaaauucaugauuuuuac

SEQ ID NO: 277712 - RNA, 32 nt, Human
uuuauuuuucuugucuuuauuuuaaccuuuga

SEQ ID NO: 277713 - RNA, 32 nt, Human
uuuauuuuugagacagagacuugcuuugucgc

SEQ ID NO: 277714 - RNA, 32 nt, Human
uuuauuuuugagacagagccucgcucguuacc

SEQ ID NO: 277715 - RNA, 32 nt, Human
uuuauuuuugagacagagucucacucugucac

SEQ ID NO: 277716 - RNA, 32 nt, Human
uuuauuuuugagacagaguuuugcucuuguca

SEQ ID NO: 277717 - RNA, 32 nt, Human
uuuauuuuugagacagggucuugcucugucac

SEQ ID NO: 277718 - RNA, 32 nt, Human
uuuauuuuugagacagucucgcccugucaccc

SEQ ID NO: 277719 - RNA, 32 nt, Human
uuuauuuuugagacggagucucgcucugucgc

SEQ ID NO: 277720 - RNA, 32 nt, Human
uuuauuuuugagacggagucuugcugugucac

SEQ ID NO: 277721 - RNA, 32 nt, Human
uuuauuuuugagacggaguuucgcucuugucg

SEQ ID NO: 277722 - RNA, 32 nt, Human
uuuauuuuugagacugagucuugcucugucau

SEQ ID NO: 277723 - RNA, 32 nt, Human
uuuauuuuugagagguagucuugcucugucac

SEQ ID NO: 277724 - RNA, 32 nt, Human
uuuauuuuugagauagagucuugcucugucgc

SEQ ID NO: 277725 - RNA, 32 nt, Human
uuuauuuuugagauggagucucacucugucac

SEQ ID NO: 277726 - RNA, 32 nt, Human
uuuauuuuugagauggagucucuguugcccag

SEQ ID NO: 277727 - RNA, 32 nt, Human
uuuauuuuugagauggagucuugcucugucac

SEQ ID NO: 277728 - RNA, 32 nt, Human
uuuauuuuugagauggaguuucacucuuuuua

SEQ ID NO: 277729 - RNA, 32 nt, Human
uuuauuuuugagauggaguuucgcucuguugc

SEQ ID NO: 277730 - RNA, 32 nt, Human
uuuauuuuugagauggaguuucgcuguuguca

SEQ ID NO: 277731 - RNA, 32 nt, Human
uuuauuuuugagauggaguuuuacucucgccc

SEQ ID NO: 277732 - RNA, 32 nt, Human
uuucaaaacaucaccuugccacccugacacuc

SEQ ID NO: 277733 - RNA, 32 nt, Human
uuucaaaacauccuggagauuuguacuaaggc

SEQ ID NO: 277734 - RNA, 32 nt, Human
uuucaaaaccaggcagggccaagccuuggccc

SEQ ID NO: 277735 - RNA, 32 nt, Human
uuucaaaacccgccccaagcccauuaucacca

SEQ ID NO: 277736 - RNA, 32 nt, Human
uuucaaaaccuacaaucccccauuugcacuac

SEQ ID NO: 277737 - RNA, 32 nt, Human
uuucaaaauauaauuccaucgccuuaauaaua

SEQ ID NO: 277738 - RNA, 32 nt, Human
uuucaaaauuuuguuaacuauuacaaauguaa

SEQ ID NO: 277739 - RNA, 23 nt, Human
uuucaaacagauuucaggcugca

SEQ ID NO: 277740 - RNA, 32 nt, Human
uuucaaaccaaaacucuccaaccaaaaaucaa

SEQ ID NO: 277741 - RNA, 32 nt, Human
uuucaaaccagacgggccaacauggugaaacc

SEQ ID NO: 277742 - RNA, 32 nt, Human
uuucaaaccaguuucacaucuuaaugaaauaa

SEQ ID NO: 277743 - RNA, 32 nt, Human
uuucaaaccccugaaucauauuucuugaugcu

SEQ ID NO: 277744 - RNA, 32 nt, Human
uuucaaacuagagaauaaagauuuggguuuua

SEQ ID NO: 277745 - RNA, 32 nt, Human
uuucaaagaaaauuauucucaucucaaugcca

SEQ ID NO: 277746 - RNA, 32 nt, Human
uuucaaagaauugccucauucagucccuaaaa

SEQ ID NO: 277747 - RNA, 32 nt, Human
uuucaaagacaggacucgugcugcagugaaau

SEQ ID NO: 277748 - RNA, 32 nt, Human
uuucaaagaugacauacuggguuguuuguuug

SEQ ID NO: 277749 - RNA, 32 nt, Human
uuucaaagcauacaauuugauucaugcagaag

SEQ ID NO: 277750 - RNA, 32 nt, Human
uuucaaagcuuccucuggccagguagacuuuu

SEQ ID NO: 277751 - RNA, 32 nt, Human
uuucaaaggaaaacauuaaaaucccuuaggaa

SEQ ID NO: 277752 - RNA, 32 nt, Human
uuucaaaggagccacaguuuaaugggguuagu

SEQ ID NO: 277753 - RNA, 32 nt, Human
uuucaaagguauguaguuacagaauuccuacc

SEQ ID NO: 277754 - RNA, 32 nt, Human
uuucaaaggugagaaaacagaggcucagagag

SEQ ID NO: 277755 - RNA, 32 nt, Human
uuucaaaguccccugacagcucagcauguugu

SEQ ID NO: 277756 - RNA, 32 nt, Human
uuucaaagugauuuuucgucuauucuuaauau

SEQ ID NO: 277757 - RNA, 32 nt, Human
uuucaaauaaugaugugaaguuugagguaggu

SEQ ID NO: 277758 - RNA, 32 nt, Human
uuucaaauauguaaacuuuaacuuccacuuug

SEQ ID NO: 277759 - RNA, 32 nt, Human
uuucaaaucaaauuaucuaagaaaacaagaaa

SEQ ID NO: 277760 - RNA, 32 nt, Human
uuucaaaucaaauuuggaugccaacuaugugg

SEQ ID NO: 277761 - RNA, 32 nt, Human
uuucaaaugaaggugauauauacuuuuucacu

SEQ ID NO: 277762 - RNA, 32 nt, Human
uuucaaaugaugguuccuaauacuucacauua

SEQ ID NO: 277763 - RNA, 32 nt, Human
uuucaaauguuagauauugcuacuauaaucaa

SEQ ID NO: 277764 - RNA, 32 nt, Human
uuucaaauuaaccuuccgcuuuguugcugugu

SEQ ID NO: 277765 - RNA, 32 nt, Human
uuucaaauucauuuuguuuuugcuguuucauu

SEQ ID NO: 277766 - RNA, 32 nt, Human
uuucaaauucugggaaaccaguuccaaacauu

SEQ ID NO: 277767 - RNA, 32 nt, Human
uuucaaauucuuuuuauuaugacuaugcccuu

SEQ ID NO: 277768 - RNA, 32 nt, Human
uuucaaauuuaagagugagucuuugcggcaac

SEQ ID NO: 277769 - RNA, 32 nt, Human
uuucaacaaacauguauuagcacucccuccau

SEQ ID NO: 277770 - RNA, 32 nt, Human
uuucaacaaaggagcuccgaugugaggggcaa

SEQ ID NO: 277771 - RNA, 32 nt, Human
uuucaacaaaggaggaaguauaaggagaucua

SEQ ID NO: 277772 - RNA, 32 nt, Human
uuucaacaagcagguacagaauaucuuauuuc

SEQ ID NO: 277773 - RNA, 32 nt, Human
uuucaacacugagggccuggagaccucggcuc

SEQ ID NO: 277774 - RNA, 32 nt, Human
uuucaacagaacuucacagacuguuagagcug

SEQ ID NO: 277775 - RNA, 32 nt, Human
uuucaacagccaagccaaguuucaugaaugug

SEQ ID NO: 277776 - RNA, 32 nt, Human
uuucaacagcccugccccuccucggagccugc

SEQ ID NO: 277777 - RNA, 32 nt, Human
uuucaacaucuucuccagccaguuuacuggaa

SEQ ID NO: 277778 - RNA, 32 nt, Human
uuucaacaucuuuucauuuucucccauaucua

SEQ ID NO: 277779 - RNA, 32 nt, Human
uuucaacauguuggccaggauggucucaaucu

SEQ ID NO: 277780 - RNA, 32 nt, Human
uuucaacauguuggccaggcuggucaugaacu

SEQ ID NO: 277781 - RNA, 24 nt, Human
uuucaaccaccuuuuaggcugcau

SEQ ID NO: 277782 - RNA, 23 nt, Human
uuucaaccacuaaaaggcuggau

SEQ ID NO: 277783 - RNA, 32 nt, Human
uuucaaccagcacauucguuuuguucauauuc

SEQ ID NO: 277784 - RNA, 32 nt, Human
uuucaaccauguucugaacugcagcuuuacag

SEQ ID NO: 277785 - RNA, 32 nt, Human
uuucaacccaggaggcagacguugcagcgagc

SEQ ID NO: 277786 - RNA, 32 nt, Human
uuucaacccaggaguucaagaccugccagagc

SEQ ID NO: 277787 - RNA, 32 nt, Human
uuucaacccgggaggcugagguugcagugagu

SEQ ID NO: 277788 - RNA, 32 nt, Human
uuucaacgaguuugucagcuuuauuaauguug

SEQ ID NO: 277789 - RNA, 32 nt, Human
uuucaacuauuuaacccacuugccuuauuuug

SEQ ID NO: 277790 - RNA, 32 nt, Human
uuucaacuccucucuucuuaacacuaugaagu

SEQ ID NO: 277791 - RNA, 32 nt, Human
uuucaacuuccucuuccucauuuucuugagau

SEQ ID NO: 277792 - RNA, 32 nt, Human
uuucaacuuuaaaauggaaaacagucauauaa

SEQ ID NO: 277793 - RNA, 32 nt, Human
uuucaagaaagagacaaagaaggaaaauuuua

SEQ ID NO: 277794 - RNA, 32 nt, Human
uuucaagaagaaccuguuauuuguugauuuug

SEQ ID NO: 277795 - RNA, 32 nt, Human
uuucaagaagccacuucugaucuaagaaucua

SEQ ID NO: 277796 - RNA, 32 nt, Human
uuucaagaccccaaaagaggccaaaggucuga

SEQ ID NO: 277797 - RNA, 32 nt, Human
uuucaagagacaccucuggaccugcagcaccg

SEQ ID NO: 277798 - RNA, 32 nt, Human
uuucaagaggacagaauggaguugggggaacu

SEQ ID NO: 277799 - RNA, 32 nt, Human
uuucaagaggcugcuccugccugcuucgauca

SEQ ID NO: 277800 - RNA, 32 nt, Human
uuucaagauacaagaucaauauacaaaaauga

SEQ ID NO: 277801 - RNA, 32 nt, Human
uuucaagauaccuuaagagaucaaaggggagg

SEQ ID NO: 277802 - RNA, 32 nt, Human
uuucaagaucuuauuuaauuuaauaaacuuac

SEQ ID NO: 277803 - RNA, 32 nt, Human
uuucaagauuacucuaaacagaaacaagagug

SEQ ID NO: 277804 - RNA, 32 nt, Human
uuucaagauuauucuaaaucaccagaaaauua

SEQ ID NO: 277805 - RNA, 32 nt, Human
uuucaagcauggccaaccuccaccuuccccuc

SEQ ID NO: 277806 - RNA, 32 nt, Human
uuucaagccagccccaggaccaggcuagcucc

SEQ ID NO: 277807 - RNA, 23 nt, Human
uuucaagcgauucuccugccuca

SEQ ID NO: 277808 - RNA, 32 nt, Human
uuucaagcggacugucacucagaucugcagag

SEQ ID NO: 277809 - RNA, 32 nt, Human
uuucaagcuauacaaauuacuuccaaguuuuc

SEQ ID NO: 277810 - RNA, 32 nt, Human
uuucaagcugcagaggaacguguucacaggcu

SEQ ID NO: 277811 - RNA, 32 nt, Human
uuucaaggaaacacaaucgcugaaccaaaacg

SEQ ID NO: 277812 - RNA, 32 nt, Human
uuucaaggccucuguggcuuucuucugaacuu

SEQ ID NO: 277813 - RNA, 32 nt, Human
uuucaaggcuuccuggagaaauggggguaggg

SEQ ID NO: 277814 - RNA, 32 nt, Human
uuucaagggagcuccuggaguugacaguagca

SEQ ID NO: 277815 - RNA, 32 nt, Human
uuucaagggcugcagccagggugaggccucug

SEQ ID NO: 277816 - RNA, 32 nt, Human
uuucaaggggauguuuaauacugaaucaagcu

SEQ ID NO: 277817 - RNA, 32 nt, Human
uuucaaggucucuaaaccuugaaaauccaaag

SEQ ID NO: 277818 - RNA, 32 nt, Human
uuucaaggucuucuaucuguuuucuuuuggau

SEQ ID NO: 277819 - RNA, 32 nt, Human
uuucaaguaagcaaucagucuacuaccaucag

SEQ ID NO: 277820 - RNA, 32 nt, Human
uuucaaguauuuuucuauaaucacuuuccccu

SEQ ID NO: 277821 - RNA, 32 nt, Human
uuucaagucuggaaguagugagagaagcuggu

SEQ ID NO: 277822 - RNA, 23 nt, Human
uuucaagugauccuccugccuca

SEQ ID NO: 277823 - RNA, 32 nt, Human
uuucaagugauccuccugccucagcuuccuga

SEQ ID NO: 277824 - RNA, 32 nt, Human
uuucaaguuguuguuuuucuggaccuuaguuu

SEQ ID NO: 277825 - RNA, 24 nt, Human
uuucaauaaaccuuccaggcugca

SEQ ID NO: 277826 - RNA, 32 nt, Human
uuucaauaaaccuuuugauauuucucaaggcc

SEQ ID NO: 277827 - RNA, 32 nt, Human
uuucaauacauccuccugaaucauaccucguu

SEQ ID NO: 277828 - RNA, 32 nt, Human
uuucaauaucuuuucauuuucucccauaucua

SEQ ID NO: 277829 - RNA, 32 nt, Human
uuucaauaugauugaaccuggacucuugcccu

SEQ ID NO: 277830 - RNA, 32 nt, Human
uuucaaucuuauuagggugcagaaggaaaacu

SEQ ID NO: 277831 - RNA, 30 nt, Human
uuucaaugggacaccuguggcuccugggua

SEQ ID NO: 277832 - RNA, 31 nt, Human
uuucaauguuuauuauacuguugaaagcaua

SEQ ID NO: 277833 - RNA, 32 nt, Human
uuucaauguuugaacauuaaauagcaaaugac

SEQ ID NO: 277834 - RNA, 32 nt, Human
uuucaauuacuaacacaaagaaacccauuguc

SEQ ID NO: 277835 - RNA, 32 nt, Human
uuucaauucaguuaagacuucugugauagaug

SEQ ID NO: 277836 - RNA, 32 nt, Human
uuucacaaaacauguggcugggcgcagcggcu

SEQ ID NO: 277837 - RNA, 32 nt, Human
uuucacaaaaccuugucaaagaccucaugcaa

SEQ ID NO: 277838 - RNA, 32 nt, Human
uuucacaaaaggcaucugaacuuuuaaugaac

SEQ ID NO: 277839 - RNA, 32 nt, Human
uuucacaaaauaauacugaaggguaaacccuu

SEQ ID NO: 277840 - RNA, 32 nt, Human
uuucacaaacuccuccaaaccccaaaccccaa

SEQ ID NO: 277841 - RNA, 32 nt, Human
uuucacaacaccucaaacuuuucuaaacauaa

SEQ ID NO: 277842 - RNA, 32 nt, Human
uuucacaacuuuggacuguccaacuugcuucc

SEQ ID NO: 277843 - RNA, 32 nt, Human
uuucacaagaucugccccaugauugguuccuu

SEQ ID NO: 277844 - RNA, 32 nt, Human
uuucacacagaagaaaacugagguuggcacuc

SEQ ID NO: 277845 - RNA, 32 nt, Human
uuucacacagaauuguacaagcaaaguuugag

SEQ ID NO: 277846 - RNA, 21 nt, Human
uuucacacagggcuggucuug

SEQ ID NO: 277847 - RNA, 32 nt, Human
uuucacacccacuacagaccucagccccaguu

SEQ ID NO: 277848 - RNA, 32 nt, Human
uuucacacggaguccaaggcccugccaccccu

SEQ ID NO: 277849 - RNA, 32 nt, Human
uuucacacuccacuuuggaacuacccaggagc

SEQ ID NO: 277850 - RNA, 32 nt, Human
uuucacagacagacaauaagccagacaacaca

SEQ ID NO: 277851 - RNA, 32 nt, Human
uuucacagacuggggaaauggacgccuggaga

SEQ ID NO: 277852 - RNA, 32 nt, Human
uuucacagagggcucaaccaccuuuggaguga

SEQ ID NO: 277853 - RNA, 32 nt, Human
uuucacagauugggguaguggcuuccaaguug

SEQ ID NO: 277854 - RNA, 32 nt, Human
uuucacagccaugauucuuuugcccacacuug

SEQ ID NO: 277855 - RNA, 32 nt, Human
uuucacagccucccccucuuucuucagaccua

SEQ ID NO: 277856 - RNA, 32 nt, Human
uuucacagccuucaugcaggccccugugcaac

SEQ ID NO: 277857 - RNA, 32 nt, Human
uuucacagcucugauucuacagaaggaggccg

SEQ ID NO: 277858 - RNA, 32 nt, Human
uuucacaggccugggccuggaaaaagaaaucu

SEQ ID NO: 277859 - RNA, 32 nt, Human
uuucacaggggacaggaugguucccuugauga

SEQ ID NO: 277860 - RNA, 32 nt, Human
uuucacaguaugggcuacacagcagcuguuca

SEQ ID NO: 277861 - RNA, 32 nt, Human
uuucacagugaaccuguauucagcuauucuca

SEQ ID NO: 277862 - RNA, 31 nt, Human
uuucacagugagaguagaagguagauuugga

SEQ ID NO: 277863 - RNA, 32 nt, Human
uuucacagugcccaugguauucaugccaacau

SEQ ID NO: 277864 - RNA, 32 nt, Human
uuucacaguggggaaguggguuacaauauugg

SEQ ID NO: 277865 - RNA, 32 nt, Human
uuucacaguucugcaggcuggaaauccaagau

SEQ ID NO: 277866 - RNA, 32 nt, Human
uuucacauagcccagucuuccuccuugugcug

SEQ ID NO: 277867 - RNA, 32 nt, Human
uuucacauauagccaguguccacagcaccuuc

SEQ ID NO: 277868 - RNA, 32 nt, Human
uuucacaucuauacucccugcacccuucugac

SEQ ID NO: 277869 - RNA, 32 nt, Human
uuucacaucugggucacucuuguugagaaaug

SEQ ID NO: 277870 - RNA, 32 nt, Human
uuucacaucuuccacaaacuccauuuagggag

SEQ ID NO: 277871 - RNA, 32 nt, Human
uuucacauuguugacagugaaaugcuauguug

SEQ ID NO: 277872 - RNA, 32 nt, Human
uuucacauuuuuaaaauguucuagucauuuug

SEQ ID NO: 277873 - RNA, 32 nt, Human
uuucacauuuuucugccugcuuuauauucuac

SEQ ID NO: 277874 - RNA, 32 nt, Human
uuucaccaacccagaaccuccuugaucaucac

SEQ ID NO: 277875 - RNA, 32 nt, Human
uuucaccaaguuggcuagacuagucuugaacu

SEQ ID NO: 277876 - RNA, 32 nt, Human
uuucaccaauucucaaaagccccacaccaccc

SEQ ID NO: 277877 - RNA, 32 nt, Human
uuucaccacaucugaauccagagaaaccggcu

SEQ ID NO: 277878 - RNA, 32 nt, Human
uuucaccacauggccuugccucgguggcccug

SEQ ID NO: 277879 - RNA, 32 nt, Human
uuucaccacauuggccaggauggucucgaucu

SEQ ID NO: 277880 - RNA, 32 nt, Human
uuucaccacguuggccaagcugguuuugaacu

SEQ ID NO: 277881 - RNA, 32 nt, Human
uuucaccacguuggccaggauggucucgaacu

SEQ ID NO: 277882 - RNA, 32 nt, Human
uuucaccacguuggccaggauggucucgauau

SEQ ID NO: 277883 - RNA, 32 nt, Human
uuucaccacguuggccaggauggucucgaucu

SEQ ID NO: 277884 - RNA, 32 nt, Human
uuucaccacguuggccaggaugguuucgaucu

SEQ ID NO: 277885 - RNA, 32 nt, Human
uuucaccacguuggccaggguggucuugagcu

SEQ ID NO: 277886 - RNA, 32 nt, Human
uuucaccacugcauucuagccugggcaacaga

SEQ ID NO: 277887 - RNA, 32 nt, Human
uuucaccacuguguccuuuuacacacuuugua

SEQ ID NO: 277888 - RNA, 32 nt, Human
uuucaccagacaugcagauuugaguucauuaa

SEQ ID NO: 277889 - RNA, 32 nt, Human
uuucaccagccaaguguuuugcuauuuccaau

SEQ ID NO: 277890 - RNA, 32 nt, Human
uuucaccagcccugccccuccucggagccugc

SEQ ID NO: 277891 - RNA, 32 nt, Human
uuucaccagugcacuccagccugggugacaga

SEQ ID NO: 277892 - RNA, 32 nt, Human
uuucaccaguuuacccucccaaccuuagcccu

SEQ ID NO: 277893 - RNA, 32 nt, Human
uuucaccaucuuggccagguuggucuugaacu

SEQ ID NO: 277894 - RNA, 32 nt, Human
uuucaccaugaaggagacagaccgggaggccg

SEQ ID NO: 277895 - RNA, 32 nt, Human
uuucaccaugucagccaggauggucuugaucu

SEQ ID NO: 277896 - RNA, 32 nt, Human
uuucaccauguuagccaggauggucuugauuu

SEQ ID NO: 277897 - RNA, 32 nt, Human
uuucaccauguuagccaggauggucuuuaucu

SEQ ID NO: 277898 - RNA, 32 nt, Human
uuucaccauguuagccgggauggucuugaucu

SEQ ID NO: 277899 - RNA, 32 nt, Human
uuucaccauguuagcuaggauggucuugaucu

SEQ ID NO: 277900 - RNA, 32 nt, Human
uuucaccauguuggccaagauggucucaaucu

SEQ ID NO: 277901 - RNA, 32 nt, Human
uuucaccauguuggccacgcuggucuugaagc

SEQ ID NO: 277902 - RNA, 32 nt, Human
uuucaccauguuggccagacugaucuugaacu

SEQ ID NO: 277903 - RNA, 32 nt, Human
uuucaccauguuggccagacuggucuugaacu

SEQ ID NO: 277904 - RNA, 32 nt, Human
uuucaccauguuggccagccuggucuugaacu

SEQ ID NO: 277905 - RNA, 32 nt, Human
uuucaccauguuggccagcguggucuugaacg

SEQ ID NO: 277906 - RNA, 32 nt, Human
uuucaccauguuggccaggaugauccucaauc

SEQ ID NO: 277907 - RNA, 32 nt, Human
uuucaccauguuggccaggauggccuccaccu

SEQ ID NO: 277908 - RNA, 32 nt, Human
uuucaccauguuggccaggauggccucgaucu

SEQ ID NO: 277909 - RNA, 32 nt, Human
uuucaccauguuggccaggauggucucaaacu

SEQ ID NO: 277910 - RNA, 32 nt, Human
uuucaccauguuggccaggauggucucaaucu

SEQ ID NO: 277911 - RNA, 32 nt, Human
uuucaccauguuggccaggauggucucgaacu

SEQ ID NO: 277912 - RNA, 32 nt, Human
uuucaccauguuggccaggauggucucgaguc

SEQ ID NO: 277913 - RNA, 32 nt, Human
uuucaccauguuggccaggauggucucgaucu

SEQ ID NO: 277914 - RNA, 32 nt, Human
uuucaccauguuggccaggauggucucgcccu

SEQ ID NO: 277915 - RNA, 32 nt, Human
uuucaccauguuggccaggauggucucggucu

SEQ ID NO: 277916 - RNA, 32 nt, Human
uuucaccauguuggccaggauggucuggaucu

SEQ ID NO: 277917 - RNA, 32 nt, Human
uuucaccauguuggccaggauggucuugaacc

SEQ ID NO: 277918 - RNA, 32 nt, Human
uuucaccauguuggccaggauggucuugaucu

SEQ ID NO: 277919 - RNA, 32 nt, Human
uuucaccauguuggccaggcuagucuugaacu

SEQ ID NO: 277920 - RNA, 32 nt, Human
uuucaccauguuggccaggcuagucuugaauu

SEQ ID NO: 277921 - RNA, 32 nt, Human
uuucaccauguuggccaggcugauuuugaacu

SEQ ID NO: 277922 - RNA, 32 nt, Human
uuucaccauguuggccaggcuggucuugaaca

SEQ ID NO: 277923 - RNA, 32 nt, Human
uuucaccauguuggccaggcuggucuugaacc

SEQ ID NO: 277924 - RNA, 32 nt, Human
uuucaccauguuggccaggcuggucuugaacu

SEQ ID NO: 277925 - RNA, 32 nt, Human
uuucaccauguuggccaggcuggucuugaauu

SEQ ID NO: 277926 - RNA, 32 nt, Human
uuucaccauguuggccaggcuguguugaacuc

SEQ ID NO: 277927 - RNA, 32 nt, Human
uuucaccauguuggccagguuggucuugaacu

SEQ ID NO: 277928 - RNA, 32 nt, Human
uuucaccauguuggccaugcuggucuugaacc

SEQ ID NO: 277929 - RNA, 32 nt, Human
uuucaccauuuucuccccacuuccagugacug

SEQ ID NO: 277930 - RNA, 19 nt, Human
uuucaccauuuuggccagg

SEQ ID NO: 277931 - RNA, 32 nt, Human
uuucaccauuuuggccaggauggucucaaucc

SEQ ID NO: 277932 - RNA, 32 nt, Human
uuucaccauuuuggccaggauggucucgaucu

SEQ ID NO: 277933 - RNA, 24 nt, Human
uuucacccaagccugacugcagug

SEQ ID NO: 277934 - RNA, 32 nt, Human
uuucacccaagugccagucaacagaguacaug

SEQ ID NO: 277935 - RNA, 32 nt, Human
uuucacccacacugccagccuggguuggggcc

SEQ ID NO: 277936 - RNA, 32 nt, Human
uuucacccacccuuucuguucuaugguggacu

SEQ ID NO: 277937 - RNA, 32 nt, Human
uuucacccacgugaacaccaccaccagcgcca

SEQ ID NO: 277938 - RNA, 32 nt, Human
uuucacccagcacugugggggccuucagacuc

SEQ ID NO: 277939 - RNA, 22 nt, Human
uuucacccaggccggacugcag

SEQ ID NO: 277940 - RNA, 24 nt, Human
uuucacccaggcuggaguauagug

SEQ ID NO: 277941 - RNA, 24 nt, Human
uuucacccaggcuggagugcagug

SEQ ID NO: 277942 - RNA, 24 nt, Human
uuucacccaggcuggagugcugug

SEQ ID NO: 277943 - RNA, 32 nt, Human
uuucacccauugucuguguuuaguccuuguuc

SEQ ID NO: 277944 - RNA, 32 nt, Human
uuucaccccagccuguaguccuccucacuuca

SEQ ID NO: 277945 - RNA, 32 nt, Human
uuucaccccugccccuguggcuccacauccuc

SEQ ID NO: 277946 - RNA, 23 nt, Human
uuucacccuccuaucuccuccca

SEQ ID NO: 277947 - RNA, 32 nt, Human
uuucacccuugcauuccagccugugaaauaaa

SEQ ID NO: 277948 - RNA, 21 nt, Human
uuucacccuuggaagacaaug

SEQ ID NO: 277949 - RNA, 32 nt, Human
uuucacccuuucuacuuugucagaaacacuga

SEQ ID NO: 277950 - RNA, 22 nt, Human
uuucacccuuugagcacauccu

SEQ ID NO: 277951 - RNA, 32 nt, Human
uuucaccgaggacaugaaacuccaccuugcgg

SEQ ID NO: 277952 - RNA, 32 nt, Human
uuucaccggcaggcccgccugcaggaguggcu

SEQ ID NO: 277953 - RNA, 32 nt, Human
uuucaccggguuggccaggcuggucuugaacu

SEQ ID NO: 277954 - RNA, 32 nt, Human
uuucaccguauuagccaggauggucuugaucu

SEQ ID NO: 277955 - RNA, 32 nt, Human
uuucaccgucaagccuuucaccuuccucaaaa

SEQ ID NO: 277956 - RNA, 32 nt, Human
uuucaccguguuagccaggauggucuugaucu

SEQ ID NO: 277957 - RNA, 32 nt, Human
uuucaccguguuggccaggauggucucaaucu

SEQ ID NO: 277958 - RNA, 32 nt, Human
uuucaccguguuggccaggauggucucgaucu

SEQ ID NO: 277959 - RNA, 32 nt, Human
uuucaccguguuggccaggauggucuugaucu

SEQ ID NO: 277960 - RNA, 32 nt, Human
uuucaccuacaacccagagauggaggaugaau

SEQ ID NO: 277961 - RNA, 32 nt, Human
uuucaccucacuccagccugggugacagcgua

SEQ ID NO: 277962 - RNA, 32 nt, Human
uuucaccucagcaaggccaggggaucugcacg

SEQ ID NO: 277963 - RNA, 32 nt, Human
uuucaccucccguugaggccgggugugaggaa

SEQ ID NO: 277964 - RNA, 31 nt, Human
uuucaccuccucucugaagcugucucugacu

SEQ ID NO: 277965 - RNA, 32 nt, Human
uuucaccuccugccauguucugaggccucccc

SEQ ID NO: 277966 - RNA, 32 nt, Human
uuucaccucuccagacuuccauuucuucacaa

SEQ ID NO: 277967 - RNA, 32 nt, Human
uuucaccucuucacuuauccuuagucccagua

SEQ ID NO: 277968 - RNA, 32 nt, Human
uuucaccugaauccuucucuugcucauuuaag

SEQ ID NO: 277969 - RNA, 32 nt, Human
uuucaccugcagcuuucagucugcuuugucug

SEQ ID NO: 277970 - RNA, 32 nt, Human
uuucaccuggaaugggcuaaguacagugaaua

SEQ ID NO: 277971 - RNA, 32 nt, Human
uuucaccuguaaucccagcacuuugggaggcu

SEQ ID NO: 277972 - RNA, 32 nt, Human
uuucaccuguagucccagcugcucuggaguuu

SEQ ID NO: 277973 - RNA, 32 nt, Human
uuucaccuuauucccaggcuggagugcaaugu

SEQ ID NO: 277974 - RNA, 32 nt, Human
uuucaccuucaguugucucugauguagcuuau

SEQ ID NO: 277975 - RNA, 32 nt, Human
uuucaccuucuuuggggcucucggcugggcgc

SEQ ID NO: 277976 - RNA, 32 nt, Human
uuucaccuuguugcccaggcuggucucaaacu

SEQ ID NO: 277977 - RNA, 32 nt, Human
uuucaccuuguuggccaggaugaucucgaucu

SEQ ID NO: 277978 - RNA, 32 nt, Human
uuucaccuuguuggccaggauggucucgaucu

SEQ ID NO: 277979 - RNA, 32 nt, Human
uuucacgacucagagauagaaaucucuugcua

SEQ ID NO: 277980 - RNA, 23 nt, Human
uuucacgagaucugaugguuuua

SEQ ID NO: 277981 - RNA, 32 nt, Human
uuucacggacacugacaagauccagagcuauc

SEQ ID NO: 277982 - RNA, 32 nt, Human
uuucacgggugaggagacuuagagagacgaag

SEQ ID NO: 277983 - RNA, 32 nt, Human
uuucacguagagucucggccugggcagucacg

SEQ ID NO: 277984 - RNA, 32 nt, Human
uuucacguauguggaugccaguuaauuaaaug

SEQ ID NO: 277985 - RNA, 32 nt, Human
uuucacguauuccgucugcacaggcaaccaag

SEQ ID NO: 277986 - RNA, 32 nt, Human
uuucacuacaccucaaacuuuucuaaacauaa

SEQ ID NO: 277987 - RNA, 32 nt, Human
uuucacuacauucuuccucccacugccaggua

SEQ ID NO: 277988 - RNA, 32 nt, Human
uuucacuacuuacaucuucucacauuucccgg

SEQ ID NO: 277989 - RNA, 32 nt, Human
uuucacuagagcauccugccugccuucuccac

SEQ ID NO: 277990 - RNA, 32 nt, Human
uuucacuagaggaguugugcugguuuuuaaau

SEQ ID NO: 277991 - RNA, 32 nt, Human
uuucacuaguacaccaggaaacuacagauuga

SEQ ID NO: 277992 - RNA, 32 nt, Human
uuucacuaguggcaugaguuaauaggaguguu

SEQ ID NO: 277993 - RNA, 32 nt, Human
uuucacuauagacauuacuugcauuaucuccu

SEQ ID NO: 277994 - RNA, 32 nt, Human
uuucacuauguuggccaggauagucuugaucu

SEQ ID NO: 277995 - RNA, 32 nt, Human
uuucacuauguuggccaggcuagucuugaacu

SEQ ID NO: 277996 - RNA, 32 nt, Human
uuucacucagaagcucaggucgccuccagccc

SEQ ID NO: 277997 - RNA, 32 nt, Human
uuucacucagcaguguuaugaaaggcacguag

SEQ ID NO: 277998 - RNA, 32 nt, Human
uuucacuccagccugggcgacaagagugaaac

SEQ ID NO: 277999 - RNA, 32 nt, Human
uuucacuccucccagacuuuuugacuauccuc

SEQ ID NO: 278000 - RNA, 32 nt, Human
uuucacucguugcccaggcuggagugcagugg

SEQ ID NO: 278001 - RNA, 32 nt, Human
uuucacucuaagacuggcaaaaggacagcagu

SEQ ID NO: 278002 - RNA, 32 nt, Human
uuucacucuccuccgccaugcccgacccggcu

SEQ ID NO: 278003 - RNA, 32 nt, Human
uuucacucugggaggagaggguggagaaagca

SEQ ID NO: 278004 - RNA, 32 nt, Human
uuucacucuuguuguccagucuggagugcaau

SEQ ID NO: 278005 - RNA, 32 nt, Human
uuucacugacaggagagcagagacaggacgug

SEQ ID NO: 278006 - RNA, 32 nt, Human
uuucacugaccagccacagaaagaaacagaag

SEQ ID NO: 278007 - RNA, 32 nt, Human
uuucacugacuaaaccugcugcagcucucuuu

SEQ ID NO: 278008 - RNA, 32 nt, Human
uuucacugcaacucugccuuuguguguauugg

SEQ ID NO: 278009 - RNA, 32 nt, Human
uuucacugcagccucaaacuccuggaguccag

SEQ ID NO: 278010 - RNA, 32 nt, Human
uuucacugcagguauucuggccccagagucuu

SEQ ID NO: 278011 - RNA, 32 nt, Human
uuucacugccuccugcccacagacccaggccu

SEQ ID NO: 278012 - RNA, 32 nt, Human
uuucacugugaagagucagcugccugggccgu

SEQ ID NO: 278013 - RNA, 32 nt, Human
uuucacugugaggaaguguggaaaaauagcuc

SEQ ID NO: 278014 - RNA, 32 nt, Human
uuucacuguguuagccaggauggucuugaucu

SEQ ID NO: 278015 - RNA, 32 nt, Human
uuucacuguguuagccaggauggucuugauuu

SEQ ID NO: 278016 - RNA, 32 nt, Human
uuucacuguguuagccaggauggucuuggucu

SEQ ID NO: 278017 - RNA, 32 nt, Human
uuucacuuaaaaggaaggucauuuggagaugu

SEQ ID NO: 278018 - RNA, 32 nt, Human
uuucacuuacagcacccccaacccuggcaccc

SEQ ID NO: 278019 - RNA, 32 nt, Human
uuucacuucaaacauguaugaguagucagcug

SEQ ID NO: 278020 - RNA, 32 nt, Human
uuucacuuccucacugacauuuugugaaaaau

SEQ ID NO: 278021 - RNA, 32 nt, Human
uuucacuucuccccacaucucccuuuccacuu

SEQ ID NO: 278022 - RNA, 32 nt, Human
uuucacuuggagaaggcggagggcucuuccug

SEQ ID NO: 278023 - RNA, 32 nt, Human
uuucacuugguauccuggaguuggguugcuaa

SEQ ID NO: 278024 - RNA, 32 nt, Human
uuucacuugucacccaggcuggagugcagugg

SEQ ID NO: 278025 - RNA, 32 nt, Human
uuucacuuuuuacauauaguuuuugcaggguu

SEQ ID NO: 278026 - RNA, 23 nt, Human
uuucagaaaauaaaacacaaccu

SEQ ID NO: 278027 - RNA, 22 nt, Human
uuucagaaaauagugcuuauca

SEQ ID NO: 278028 - RNA, 32 nt, Human
uuucagaaaaugucuuucauuucaaucaauaa

SEQ ID NO: 278029 - RNA, 32 nt, Human
uuucagaaacaacauggugucagggcuccaug

SEQ ID NO: 278030 - RNA, 32 nt, Human
uuucagaaaccagcagagcugucaacucuucu

SEQ ID NO: 278031 - RNA, 32 nt, Human
uuucagaaagagaccuacucugggucauuuaa

SEQ ID NO: 278032 - RNA, 32 nt, Human
uuucagaaaugaguaacauuguaggauaguac

SEQ ID NO: 278033 - RNA, 32 nt, Human
uuucagaacucagguuaaucucugugcagcag

SEQ ID NO: 278034 - RNA, 32 nt, Human
uuucagaagagcaagcacaaaguaauuuagcu

SEQ ID NO: 278035 - RNA, 32 nt, Human
uuucagaagauaagaguucacugaaugcaccu

SEQ ID NO: 278036 - RNA, 32 nt, Human
uuucagaagaucuccacuaguuuuuguuccaa

SEQ ID NO: 278037 - RNA, 32 nt, Human
uuucagaaucuuaucaagcaacaggaaaggau

SEQ ID NO: 278038 - RNA, 32 nt, Human
uuucagaaugaggaaaagcuguggggaccaaa

SEQ ID NO: 278039 - RNA, 25 nt, Human
uuucagaauucccagaguuuacuca

SEQ ID NO: 278040 - RNA, 23 nt, Human
uuucagaauuuuacucugcauca

SEQ ID NO: 278041 - RNA, 32 nt, Human
uuucagacaacagcagagaagcccaguuggcu

SEQ ID NO: 278042 - RNA, 32 nt, Human
uuucagacaagcaauuacccaguuuccuuauc

SEQ ID NO: 278043 - RNA, 32 nt, Human
uuucagacauagaauuucacuuuuggagggga

SEQ ID NO: 278044 - RNA, 32 nt, Human
uuucagacaugacgcccccgugccccaaguuc

SEQ ID NO: 278045 - RNA, 32 nt, Human
uuucagaccagccugggcaacauagccagacc

SEQ ID NO: 278046 - RNA, 32 nt, Human
uuucagaccagccugggcaacaugacaaaacu

SEQ ID NO: 278047 - RNA, 32 nt, Human
uuucagaccauacucuuuacgguacuaggcac

SEQ ID NO: 278048 - RNA, 32 nt, Human
uuucagaccauguccaacccagcugugcugcu

SEQ ID NO: 278049 - RNA, 32 nt, Human
uuucagacccuauccugagaaugggguuugaa

SEQ ID NO: 278050 - RNA, 32 nt, Human
uuucagacuagccuugccaacauggugaaacc

SEQ ID NO: 278051 - RNA, 32 nt, Human
uuucagacuggcuucuuucacuuaauaauaug

SEQ ID NO: 278052 - RNA, 31 nt, Human
uuucagagaaacacaacggagggaaggagcc

SEQ ID NO: 278053 - RNA, 32 nt, Human
uuucagagaaccaggagguuugggguuaagag

SEQ ID NO: 278054 - RNA, 32 nt, Human
uuucagagacaagguuucgccauguugccuag

SEQ ID NO: 278055 - RNA, 32 nt, Human
uuucagagagcuggaagagaggcuuuggaaug

SEQ ID NO: 278056 - RNA, 32 nt, Human
uuucagagauagagucucaugcuguugcccag

SEQ ID NO: 278057 - RNA, 32 nt, Human
uuucagagauggugccuucuggcauaguagug

SEQ ID NO: 278058 - RNA, 32 nt, Human
uuucagagcacccauaucccacccuggugaga

SEQ ID NO: 278059 - RNA, 32 nt, Human
uuucagagcaguagugugaggaagcuuggagu

SEQ ID NO: 278060 - RNA, 32 nt, Human
uuucagagccacccacaucagcacuuggaaga

SEQ ID NO: 278061 - RNA, 32 nt, Human
uuucagagccagaaucauacucuccaggaaau

SEQ ID NO: 278062 - RNA, 32 nt, Human
uuucagagcccccagcccugggaaccacuccc

SEQ ID NO: 278063 - RNA, 32 nt, Human
uuucagagccuccuaugguuugggaaggaaua

SEQ ID NO: 278064 - RNA, 18 nt, Human
uuucagagccucuuccca

SEQ ID NO: 278065 - RNA, 32 nt, Human
uuucagagccugcuccccgcccucucugcucg

SEQ ID NO: 278066 - RNA, 32 nt, Human
uuucagagcguggagguguggaaggaguggcu

SEQ ID NO: 278067 - RNA, 32 nt, Human
uuucagagcugcagggacagggugagcagcug

SEQ ID NO: 278068 - RNA, 32 nt, Human
uuucagaggaaggccuguccugcuggaacugg

SEQ ID NO: 278069 - RNA, 32 nt, Human
uuucagaggcuucuuuugaagauuccccaagu

SEQ ID NO: 278070 - RNA, 24 nt, Human
uuucagagggagaucccccuccca

SEQ ID NO: 278071 - RNA, 32 nt, Human
uuucagagggccaggcaagagcacuucagaug

SEQ ID NO: 278072 - RNA, 32 nt, Human
uuucagagggcugccuaaaauauuuuauuucu

SEQ ID NO: 278073 - RNA, 32 nt, Human
uuucagaggggaggcagaaaggagaggucuau

SEQ ID NO: 278074 - RNA, 32 nt, Human
uuucagagucuucuccucucucugaucucugu

SEQ ID NO: 278075 - RNA, 32 nt, Human
uuucagagugacucagaagaaaaagaagcuga

SEQ ID NO: 278076 - RNA, 31 nt, Human
uuucagagugagagugcucaaggcugcaggu

SEQ ID NO: 278077 - RNA, 32 nt, Human
uuucagagugaguuuucuauggagccuguggc

SEQ ID NO: 278078 - RNA, 32 nt, Human
uuucagaguggggcuccccaucugcagggucc

SEQ ID NO: 278079 - RNA, 32 nt, Human
uuucagagugugaggaagggagggaccauuug

SEQ ID NO: 278080 - RNA, 32 nt, Human
uuucagaguucuuaguguggcuuuuuccauuu

SEQ ID NO: 278081 - RNA, 32 nt, Human
uuucagauaagaauguccagcaaggaagugaa

SEQ ID NO: 278082 - RNA, 32 nt, Human
uuucagauaauucccugugauaggacaacuag

SEQ ID NO: 278083 - RNA, 32 nt, Human
uuucagauaucuuggacaaaucacauauuuua

SEQ ID NO: 278084 - RNA, 32 nt, Human
uuucagaucagucuggccaacaaacaugagcc

SEQ ID NO: 278085 - RNA, 32 nt, Human
uuucagauccucugcuauuuuauugaguggaa

SEQ ID NO: 278086 - RNA, 32 nt, Human
uuucagaucuguuuucugaaaucuuuuaagcu

SEQ ID NO: 278087 - RNA, 32 nt, Human
uuucagaugaaggcuuuuccagaagcuucccc

SEQ ID NO: 278088 - RNA, 32 nt, Human
uuucagaugaaugcuuacugugguauuuggaa

SEQ ID NO: 278089 - RNA, 32 nt, Human
uuucagaugaggccacaauccuagccaacauu

SEQ ID NO: 278090 - RNA, 32 nt, Human
uuucagaugccuuugcucaaagcuugggguuu

SEQ ID NO: 278091 - RNA, 32 nt, Human
uuucagcaacagugaaaaacugagaugaaaga

SEQ ID NO: 278092 - RNA, 32 nt, Human
uuucagcaccuacaguguacagucuuguauua

SEQ ID NO: 278093 - RNA, 31 nt, Human
uuucagcacucuggggagguugaggcaggag

SEQ ID NO: 278094 - RNA, 32 nt, Human
uuucagcacuggagaccuucuuugcuauuacu

SEQ ID NO: 278095 - RNA, 32 nt, Human
uuucagcagggacuuuuauugggggcugguac

SEQ ID NO: 278096 - RNA, 32 nt, Human
uuucagcaguuaaugugcuuucuuggauccaa

SEQ ID NO: 278097 - RNA, 32 nt, Human
uuucagcauugacuuuuuaauucccauccuaa

SEQ ID NO: 278098 - RNA, 22 nt, Human
uuucagcauuuuacucacuuua

SEQ ID NO: 278099 - RNA, 32 nt, Human
uuucagccaacacucuucauggcagugucgac

SEQ ID NO: 278100 - RNA, 32 nt, Human
uuucagccaagugccugcccagagcucugcag

SEQ ID NO: 278101 - RNA, 32 nt, Human
uuucagccauggccacaagugaacagaguauc

SEQ ID NO: 278102 - RNA, 31 nt, Human
uuucagccauugcuagauaccaaaguggaga

SEQ ID NO: 278103 - RNA, 32 nt, Human
uuucagcccacuguuuaccuugucucaauaaa

SEQ ID NO: 278104 - RNA, 32 nt, Human
uuucagcccaggaauucaagaccagccugggc

SEQ ID NO: 278105 - RNA, 32 nt, Human
uuucagcccaugcccccucccaaaaagaaauu

SEQ ID NO: 278106 - RNA, 32 nt, Human
uuucagccccucucuacugucagcgagcugug

SEQ ID NO: 278107 - RNA, 32 nt, Human
uuucagcccuaaccccagugugaggggacgug

SEQ ID NO: 278108 - RNA, 32 nt, Human
uuucagccucaagcuuuacacagcuguccuua

SEQ ID NO: 278109 - RNA, 32 nt, Human
uuucagccucuagccuucacuccugggcucca

SEQ ID NO: 278110 - RNA, 32 nt, Human
uuucagccugggaggucaaggcugcagugagc

SEQ ID NO: 278111 - RNA, 32 nt, Human
uuucagccugucugucucagggugcagccuua

SEQ ID NO: 278112 - RNA, 18 nt, Human
uuucagccuucugcugcc

SEQ ID NO: 278113 - RNA, 32 nt, Human
uuucagcgcugagguccaggagcgccuggccc

SEQ ID NO: 278114 - RNA, 32 nt, Human
uuucagcgguuauguaauugugccucauuuua

SEQ ID NO: 278115 - RNA, 32 nt, Human
uuucagcuaagaaaggagaggccaggcaagca

SEQ ID NO: 278116 - RNA, 22 nt, Human
uuucagcuacucaggaagcuga

SEQ ID NO: 278117 - RNA, 32 nt, Human
uuucagcuagaauauguuggauucaggagcuu

SEQ ID NO: 278118 - RNA, 32 nt, Human
uuucagcuagauucagccaccagaucccagaa

SEQ ID NO: 278119 - RNA, 32 nt, Human
uuucagcucacuacaaccuccugcuccugggu

SEQ ID NO: 278120 - RNA, 32 nt, Human
uuucagcucacugaaccucugccucccagguc

SEQ ID NO: 278121 - RNA, 32 nt, Human
uuucagcucacugcaaccuccaccucccaggu

SEQ ID NO: 278122 - RNA, 32 nt, Human
uuucagcucacugcaaccuccgccucccaggu

SEQ ID NO: 278123 - RNA, 32 nt, Human
uuucagcucacugcaaccucugccucccaggu

SEQ ID NO: 278124 - RNA, 32 nt, Human
uuucagcucacugcaaccucugccucccgggu

SEQ ID NO: 278125 - RNA, 32 nt, Human
uuucagcucacugcaaccuucgccaccugggu

SEQ ID NO: 278126 - RNA, 32 nt, Human
uuucagcucacugcaaccuucgccucccagcu

SEQ ID NO: 278127 - RNA, 32 nt, Human
uuucagcucacugcaaucucugccacccagau

SEQ ID NO: 278128 - RNA, 32 nt, Human
uuucagcucacugugaagccagacuccccaac

SEQ ID NO: 278129 - RNA, 32 nt, Human
uuucagcucauuguaaccuccaucuccugugc

SEQ ID NO: 278130 - RNA, 32 nt, Human
uuucagcuccucuguuggacauguaagugugu

SEQ ID NO: 278131 - RNA, 32 nt, Human
uuucagcugagguuugcacuuccucucgcggc

SEQ ID NO: 278132 - RNA, 32 nt, Human
uuucagcugcaacucccuacuggguggggcac

SEQ ID NO: 278133 - RNA, 32 nt, Human
uuucagcuggagugcagacaucacuggaacuu

SEQ ID NO: 278134 - RNA, 32 nt, Human
uuucagcuguucuguaggcugcauaaccacuc

SEQ ID NO: 278135 - RNA, 32 nt, Human
uuucagcuuaauuauaaacaaaggaacaaaua

SEQ ID NO: 278136 - RNA, 32 nt, Human
uuucagcuuauuugaaguccugccucauucuc

SEQ ID NO: 278137 - RNA, 32 nt, Human
uuucagcuuccagauagccggaguuauuucuc

SEQ ID NO: 278138 - RNA, 32 nt, Human
uuucagcuucucagucucugguguuuuguuau

SEQ ID NO: 278139 - RNA, 32 nt, Human
uuucaggaaacagagggcuggagccagguucu

SEQ ID NO: 278140 - RNA, 32 nt, Human
uuucaggaaagggaggagcacaaggacucugu

SEQ ID NO: 278141 - RNA, 32 nt, Human
uuucaggaaauguaagaaaccauuauuucagg

SEQ ID NO: 278142 - RNA, 32 nt, Human
uuucaggaaguuucugcagcagaugcuuuugg

SEQ ID NO: 278143 - RNA, 32 nt, Human
uuucaggaccccugcauuuaccaaaauuugug

SEQ ID NO: 278144 - RNA, 32 nt, Human
uuucaggagcaggggugggaggcagguggacu

SEQ ID NO: 278145 - RNA, 32 nt, Human
uuucaggagcuacucuccuccuggugaggugg

SEQ ID NO: 278146 - RNA, 32 nt, Human
uuucaggaucagcugccgguucgaacacacgc

SEQ ID NO: 278147 - RNA, 32 nt, Human
uuucaggcaaagcuuuaauuuauacuaagcuu

SEQ ID NO: 278148 - RNA, 32 nt, Human
uuucaggcagggcugaagucuuccuuuucaca

SEQ ID NO: 278149 - RNA, 32 nt, Human
uuucaggcauccugccucacugcccccaggcc

SEQ ID NO: 278150 - RNA, 32 nt, Human
uuucaggccaacauggccgugcugcugcugcu

SEQ ID NO: 278151 - RNA, 32 nt, Human
uuucaggccagaaaaucucuuaacacuauuuu

SEQ ID NO: 278152 - RNA, 32 nt, Human
uuucaggcucaggcuccagccuuggcagccuu

SEQ ID NO: 278153 - RNA, 21 nt, Human
uuucaggcuuggggcuggggc

SEQ ID NO: 278154 - RNA, 32 nt, Human
uuucaggcuuugcauuuuguauaugggaagaa

SEQ ID NO: 278155 - RNA, 32 nt, Human
uuucagggaagaggcucuuacagucuauggug

SEQ ID NO: 278156 - RNA, 22 nt, Human
uuucagggauucuuuugcuuca

SEQ ID NO: 278157 - RNA, 32 nt, Human
uuucagggcaaauggggccaggagcugccugu

SEQ ID NO: 278158 - RNA, 32 nt, Human
uuucagggggagagguggagggcagauguccu

SEQ ID NO: 278159 - RNA, 32 nt, Human
uuucaggggugggaguuauggggaaggggugg

SEQ ID NO: 278160 - RNA, 32 nt, Human
uuucagggucccagcuuaguuaagucacccau

SEQ ID NO: 278161 - RNA, 32 nt, Human
uuucagggucuaccuaacugagccuagauaug

SEQ ID NO: 278162 - RNA, 23 nt, Human
uuucaggguugggcugggcccag

SEQ ID NO: 278163 - RNA, 21 nt, Human
uuucagguacucaaucaggaa

SEQ ID NO: 278164 - RNA, 32 nt, Human
uuucagguagagagagaaagugcaugcgguau

SEQ ID NO: 278165 - RNA, 32 nt, Human
uuucaggucaccaucagaaaagcuaaguuugc

SEQ ID NO: 278166 - RNA, 32 nt, Human
uuucagguccagaguaguuucuuucugucugc

SEQ ID NO: 278167 - RNA, 32 nt, Human
uuucaggucccuguaguucacacugugucccc

SEQ ID NO: 278168 - RNA, 23 nt, Human
uuucaggugauccuccugccuca

SEQ ID NO: 278169 - RNA, 32 nt, Human
uuucagguuuacagccacugggccugggcaca

SEQ ID NO: 278170 - RNA, 32 nt, Human
uuucaguaaguccaugccucuggcaggggaug

SEQ ID NO: 278171 - RNA, 32 nt, Human
uuucaguacugaggcgaauacagggaauuuca

SEQ ID NO: 278172 - RNA, 32 nt, Human
uuucaguagaugagcacacaaauguggcagag

SEQ ID NO: 278173 - RNA, 32 nt, Human
uuucaguaguacaggcuucuugccgauaugaa

SEQ ID NO: 278174 - RNA, 32 nt, Human
uuucaguagugagcacaguugacagggucccu

SEQ ID NO: 278175 - RNA, 32 nt, Human
uuucaguauaaauauaaugaacaugucagaac

SEQ ID NO: 278176 - RNA, 32 nt, Human
uuucaguaucaucuggcacacaacuguccaag

SEQ ID NO: 278177 - RNA, 32 nt, Human
uuucagucacuugcugaugacuucugaugucc

SEQ ID NO: 278178 - RNA, 23 nt, Human
uuucagucaggugugccauccca

SEQ ID NO: 278179 - RNA, 21 nt, Human
uuucagucauauaauggugug

SEQ ID NO: 278180 - RNA, 32 nt, Human
uuucagucaugcccccugcucuuuuguauuug

SEQ ID NO: 278181 - RNA, 32 nt, Human
uuucagucauggugucaagcacauuaauacuu

SEQ ID NO: 278182 - RNA, 32 nt, Human
uuucagucauuuucuuuuaccucguugucagu

SEQ ID NO: 278183 - RNA, 32 nt, Human
uuucagucccagaucuugcucugccuuggggu

SEQ ID NO: 278184 - RNA, 32 nt, Human
uuucagucccagcuguaggcuuguaaauaccc

SEQ ID NO: 278185 - RNA, 32 nt, Human
uuucaguccuuaucucaaccacauaagacaga

SEQ ID NO: 278186 - RNA, 32 nt, Human
uuucagucgcaaaucacaucuugaaagacaaa

SEQ ID NO: 278187 - RNA, 32 nt, Human
uuucagucgcaaaucacaucuugaaagacaua

SEQ ID NO: 278188 - RNA, 32 nt, Human
uuucagucuaacugggguuccuuagcuggaag

SEQ ID NO: 278189 - RNA, 32 nt, Human
uuucagucucaaagcaaacaaaagaguauuga

SEQ ID NO: 278190 - RNA, 32 nt, Human
uuucagucuccgcuggcaacagaaaucaagau

SEQ ID NO: 278191 - RNA, 32 nt, Human
uuucagugaacugcuggaacucacacaugccc

SEQ ID NO: 278192 - RNA, 32 nt, Human
uuucagugaagucacaggaugugccuuauuua

SEQ ID NO: 278193 - RNA, 32 nt, Human
uuucagugcccaggaagaaggcagcugggaca

SEQ ID NO: 278194 - RNA, 32 nt, Human
uuucagugcccuggcccuggggugggggacaa

SEQ ID NO: 278195 - RNA, 32 nt, Human
uuucaguguaguucucuccucuucaaauaaac

SEQ ID NO: 278196 - RNA, 29 nt, Human
uuucagugucugucuucccuggguugaca

SEQ ID NO: 278197 - RNA, 32 nt, Human
uuucaguguguauguguguguauauguaaggg

SEQ ID NO: 278198 - RNA, 32 nt, Human
uuucaguguguauguguuaguguguuacggga

SEQ ID NO: 278199 - RNA, 32 nt, Human
uuucaguguguggggaagcuguccugggggcu

SEQ ID NO: 278200 - RNA, 32 nt, Human
uuucaguguuccacauuucucccuuuagaaaa

SEQ ID NO: 278201 - RNA, 32 nt, Human
uuucaguguuuuaaaaucagagcucugaauac

SEQ ID NO: 278202 - RNA, 32 nt, Human
uuucaguuaauuuugcuucauguaucuugaag

SEQ ID NO: 278203 - RNA, 32 nt, Human
uuucaguuaccugagccacagcuuaaggucag

SEQ ID NO: 278204 - RNA, 32 nt, Human
uuucaguucaaagucaugauguuuuuaaaauc
